United States Patent 12,281,301 (SEQUENCING-BASED PROTEOMICS) - sequence listing, part 2

SEQ ID NO: 22208 - DNA, 23 bp, Homo sapiens
cggatgaaaggctgctcatttgg

SEQ ID NO: 22209 - DNA, 23 bp, Homo sapiens
ctgggccttgatagcactactgg

SEQ ID NO: 22210 - DNA, 23 bp, Homo sapiens
cagggatgcatcacaccagaagg

SEQ ID NO: 22211 - DNA, 23 bp, Homo sapiens
ggctgagcagaatacaactgagg

SEQ ID NO: 22212 - DNA, 23 bp, Homo sapiens
aggaaatcacttcatgctttagg

SEQ ID NO: 22213 - DNA, 23 bp, Homo sapiens
caatcatggttccttgcctttgg

SEQ ID NO: 22214 - DNA, 23 bp, Homo sapiens
gtggatgaaatgaccaggaacgg

SEQ ID NO: 22215 - DNA, 23 bp, Homo sapiens
cggcgcaccctgcgccctgatgg

SEQ ID NO: 22216 - DNA, 23 bp, Homo sapiens
ggacttcgcctggctctcctagg

SEQ ID NO: 22217 - DNA, 23 bp, Homo sapiens
gcagctcggcagctagttgttgg

SEQ ID NO: 22218 - DNA, 23 bp, Homo sapiens
gggctatgtgtcacagtcctcgg

SEQ ID NO: 22219 - DNA, 23 bp, Homo sapiens
ggagaagcgcggtacatcactgg

SEQ ID NO: 22220 - DNA, 23 bp, Homo sapiens
aaacagctagagcaaagtgctgg

SEQ ID NO: 22221 - DNA, 23 bp, Homo sapiens
tatctaggcctgatctcaaaagg

SEQ ID NO: 22222 - DNA, 23 bp, Homo sapiens
ttttggtttttaggcgagtccgg

SEQ ID NO: 22223 - DNA, 23 bp, Homo sapiens
gccatggagtcctcttaaagagg

SEQ ID NO: 22224 - DNA, 23 bp, Homo sapiens
tccgaagccaacaactaggctgg

SEQ ID NO: 22225 - DNA, 23 bp, Homo sapiens
acattacagctacctaatgttgg

SEQ ID NO: 22226 - DNA, 23 bp, Homo sapiens
atcttcactcaagtgccatctgg

SEQ ID NO: 22227 - DNA, 23 bp, Homo sapiens
attgctacgtaagtgtctctcgg

SEQ ID NO: 22228 - DNA, 23 bp, Homo sapiens
ggtctataatgaagagaacccgg

SEQ ID NO: 22229 - DNA, 23 bp, Homo sapiens
ttcattgtccaagcaccctcagg

SEQ ID NO: 22230 - DNA, 23 bp, Homo sapiens
gcagtcacttgtaagtccagtgg

SEQ ID NO: 22231 - DNA, 23 bp, Homo sapiens
gccaaattttgctgtgaatgtgg

SEQ ID NO: 22232 - DNA, 23 bp, Homo sapiens
tctggagcaaaactcagacaagg

SEQ ID NO: 22233 - DNA, 23 bp, Homo sapiens
aacctcctcagaagagcaactgg

SEQ ID NO: 22234 - DNA, 23 bp, Homo sapiens
ctccccaggagcagagttaaagg

SEQ ID NO: 22235 - DNA, 23 bp, Homo sapiens
tccattgaagagccacagctggg

SEQ ID NO: 22236 - DNA, 23 bp, Homo sapiens
acggccatgccacactgatgggg

SEQ ID NO: 22237 - DNA, 23 bp, Homo sapiens
tttctgatagctcaagcagaagg

SEQ ID NO: 22238 - DNA, 23 bp, Homo sapiens
gccacaggcagcttactcactgg

SEQ ID NO: 22239 - DNA, 23 bp, Homo sapiens
ccttgattgttgctaagcttagg

SEQ ID NO: 22240 - DNA, 23 bp, Homo sapiens
tcatctttcaataacccagctgg

SEQ ID NO: 22241 - DNA, 23 bp, Homo sapiens
cgcccctgggcaagccctaaggg

SEQ ID NO: 22242 - DNA, 23 bp, Homo sapiens
aagacacacacagttcctgttgg

SEQ ID NO: 22243 - DNA, 23 bp, Homo sapiens
gggatttctaaaaagttggcagg

SEQ ID NO: 22244 - DNA, 23 bp, Homo sapiens
ttgaggtcgaatccatttcaagg

SEQ ID NO: 22245 - DNA, 23 bp, Homo sapiens
tcttttcactggagaggatttgg

SEQ ID NO: 22246 - DNA, 23 bp, Homo sapiens
caagatccccgggaaagcatagg

SEQ ID NO: 22247 - DNA, 23 bp, Homo sapiens
cacatcaaaccacgtctgtgagg

SEQ ID NO: 22248 - DNA, 23 bp, Homo sapiens
cagctctggctggacactactgg

SEQ ID NO: 22249 - DNA, 23 bp, Homo sapiens
taacaaaatggtgaagcagttgg

SEQ ID NO: 22250 - DNA, 23 bp, Homo sapiens
ggcccaaatgataatgactttgg

SEQ ID NO: 22251 - DNA, 23 bp, Homo sapiens
accgccaccactggggagtaggg

SEQ ID NO: 22252 - DNA, 23 bp, Homo sapiens
tcctgaaacacaagaattgttgg

SEQ ID NO: 22253 - DNA, 23 bp, Homo sapiens
ctgcttcagaacacttactctgg

SEQ ID NO: 22254 - DNA, 23 bp, Homo sapiens
tcggttctaactaatcacgcagg

SEQ ID NO: 22255 - DNA, 23 bp, Homo sapiens
ggcttctgtccctgctcagtcgg

SEQ ID NO: 22256 - DNA, 23 bp, Homo sapiens
attccgaatatttcggcagtggg

SEQ ID NO: 22257 - DNA, 23 bp, Homo sapiens
caaaaagccgaaacggaagcagg

SEQ ID NO: 22258 - DNA, 23 bp, Homo sapiens
cttggcctttctttctacattgg

SEQ ID NO: 22259 - DNA, 23 bp, Homo sapiens
gtcagagctgctatctgtgctgg

SEQ ID NO: 22260 - DNA, 23 bp, Homo sapiens
cccaccaagaggaaacgtgtcgg

SEQ ID NO: 22261 - DNA, 23 bp, Homo sapiens
acttctctgagccactgtaaggg

SEQ ID NO: 22262 - DNA, 23 bp, Homo sapiens
gatttaagtggtaacctcactgg

SEQ ID NO: 22263 - DNA, 23 bp, Homo sapiens
cgcccctccagcagaaagtctgg

SEQ ID NO: 22264 - DNA, 23 bp, Homo sapiens
gaagcacaagaagaagcacaagg

SEQ ID NO: 22265 - DNA, 23 bp, Homo sapiens
agtataaagagtgtagggggtgg

SEQ ID NO: 22266 - DNA, 23 bp, Homo sapiens
tgcaagaagtgtggctgtaaagg

SEQ ID NO: 22267 - DNA, 23 bp, Homo sapiens
gctggactagatccttactgtgg

SEQ ID NO: 22268 - DNA, 23 bp, Homo sapiens
ccccccttctaatgatacgttgg

SEQ ID NO: 22269 - DNA, 23 bp, Homo sapiens
cagtctgagctgtcagagccagg

SEQ ID NO: 22270 - DNA, 23 bp, Homo sapiens
ctgccgtcgcgtgcagtgacggg

SEQ ID NO: 22271 - DNA, 23 bp, Homo sapiens
gcaggcgggtgtttagtgcccgg

SEQ ID NO: 22272 - DNA, 23 bp, Homo sapiens
cttccagatgctggattaccagg

SEQ ID NO: 22273 - DNA, 23 bp, Homo sapiens
gaaagagcccatcaatatcttgg

SEQ ID NO: 22274 - DNA, 23 bp, Homo sapiens
ggacccagcaggaatcatgaggg

SEQ ID NO: 22275 - DNA, 23 bp, Homo sapiens
gaagaaaaaggagaggtgctggg

SEQ ID NO: 22276 - DNA, 23 bp, Homo sapiens
acaaaaaggcctctgaataatgg

SEQ ID NO: 22277 - DNA, 23 bp, Homo sapiens
gttttgggtttttgcggtttagg

SEQ ID NO: 22278 - DNA, 23 bp, Homo sapiens
aagcacatatttcagtgatgagg

SEQ ID NO: 22279 - DNA, 23 bp, Homo sapiens
cttccagcctcctgggtcagggg

SEQ ID NO: 22280 - DNA, 23 bp, Homo sapiens
ggcgctgtttgggaagtagctgg

SEQ ID NO: 22281 - DNA, 23 bp, Homo sapiens
aaaagctggagaatgtattgagg

SEQ ID NO: 22282 - DNA, 23 bp, Homo sapiens
aaacaaactgagaggtaatgagg

SEQ ID NO: 22283 - DNA, 23 bp, Homo sapiens
gaggctggtctggcttagctggg

SEQ ID NO: 22284 - DNA, 23 bp, Homo sapiens
gctgctcgggctcacgaaaacgg

SEQ ID NO: 22285 - DNA, 23 bp, Homo sapiens
ttcagcactgtcagttttcatgg

SEQ ID NO: 22286 - DNA, 23 bp, Homo sapiens
ggagaccctctgggctgaggagg

SEQ ID NO: 22287 - DNA, 23 bp, Homo sapiens
ccaggttgcgggtcaggcctcgg

SEQ ID NO: 22288 - DNA, 23 bp, Homo sapiens
ggcagcagcccagctgtttaggg

SEQ ID NO: 22289 - DNA, 23 bp, Homo sapiens
ctttcacccagccagggagaagg

SEQ ID NO: 22290 - DNA, 23 bp, Homo sapiens
ctggggccatgtgggtcacacgg

SEQ ID NO: 22291 - DNA, 23 bp, Homo sapiens
atcatctcttgctgtggaaacgg

SEQ ID NO: 22292 - DNA, 23 bp, Homo sapiens
gctcagcaagtatctcagaaagg

SEQ ID NO: 22293 - DNA, 23 bp, Homo sapiens
tctgtgatggcagtgtgagctgg

SEQ ID NO: 22294 - DNA, 23 bp, Homo sapiens
taagatgtcgctacaccagctgg

SEQ ID NO: 22295 - DNA, 23 bp, Homo sapiens
aagtactgagccgtggtcagggg

SEQ ID NO: 22296 - DNA, 23 bp, Homo sapiens
gggacccccggggcgtggtgagg

SEQ ID NO: 22297 - DNA, 23 bp, Homo sapiens
gagcaatcctgcattaaccatgg

SEQ ID NO: 22298 - DNA, 23 bp, Homo sapiens
gaagaaggcatcgtcaaatcagg

SEQ ID NO: 22299 - DNA, 23 bp, Homo sapiens
tttctattgccactgttacatgg

SEQ ID NO: 22300 - DNA, 23 bp, Homo sapiens
tccatctgtttagacatgattgg

SEQ ID NO: 22301 - DNA, 23 bp, Homo sapiens
aagtgagagctccaagcagcagg

SEQ ID NO: 22302 - DNA, 23 bp, Homo sapiens
ggcacttcagacaatgtcctcgg

SEQ ID NO: 22303 - DNA, 23 bp, Homo sapiens
tgcgggctcatcgtggacacagg

SEQ ID NO: 22304 - DNA, 23 bp, Homo sapiens
aaatccagggacagcctaggagg

SEQ ID NO: 22305 - DNA, 23 bp, Homo sapiens
tggctcttcctggagtcaggagg

SEQ ID NO: 22306 - DNA, 23 bp, Homo sapiens
aaaggacgaggactctgtggagg

SEQ ID NO: 22307 - DNA, 23 bp, Homo sapiens
cgtaccagtatgtggtctgaagg

SEQ ID NO: 22308 - DNA, 23 bp, Homo sapiens
ctgcctttccatgtcatgagagg

SEQ ID NO: 22309 - DNA, 23 bp, Homo sapiens
tggtaccacctatgagatttcgg

SEQ ID NO: 22310 - DNA, 23 bp, Homo sapiens
ctatttttcttctccccctctgg

SEQ ID NO: 22311 - DNA, 23 bp, Homo sapiens
ggcccggagttctcagtgtgagg

SEQ ID NO: 22312 - DNA, 23 bp, Homo sapiens
acctacgagatctcggtgtgagg

SEQ ID NO: 22313 - DNA, 23 bp, Homo sapiens
cagcctctcggggccctagcagg

SEQ ID NO: 22314 - DNA, 23 bp, Homo sapiens
tcagcttcagctgcctcctgtgg

SEQ ID NO: 22315 - DNA, 23 bp, Homo sapiens
agcagcttaggacaaaaagtagg

SEQ ID NO: 22316 - DNA, 23 bp, Homo sapiens
gaggaagacaatatggaagatgg

SEQ ID NO: 22317 - DNA, 23 bp, Homo sapiens
acatggacacgtctagatagagg

SEQ ID NO: 22318 - DNA, 23 bp, Homo sapiens
actttgccgcttctctagccagg

SEQ ID NO: 22319 - DNA, 23 bp, Homo sapiens
ggaaacctggattgctaaggagg

SEQ ID NO: 22320 - DNA, 23 bp, Homo sapiens
gtcgccccaccatcaaagctggg

SEQ ID NO: 22321 - DNA, 23 bp, Homo sapiens
tccaactgcagcctgtgctaggg

SEQ ID NO: 22322 - DNA, 23 bp, Homo sapiens
tcggggaggggtgctcctgaagg

SEQ ID NO: 22323 - DNA, 23 bp, Homo sapiens
agctttggtgcattaaccacagg

SEQ ID NO: 22324 - DNA, 23 bp, Homo sapiens
aaaagagaatccagttgttgtgg

SEQ ID NO: 22325 - DNA, 23 bp, Homo sapiens
cagcaggagttcaaatcttttgg

SEQ ID NO: 22326 - DNA, 23 bp, Homo sapiens
agccggcccaggaactctagagg

SEQ ID NO: 22327 - DNA, 23 bp, Homo sapiens
gtttccaagtgccaagagattgg

SEQ ID NO: 22328 - DNA, 23 bp, Homo sapiens
gtagaggtagtcgtagtttttgg

SEQ ID NO: 22329 - DNA, 23 bp, Homo sapiens
tggtctgaccagtgtaggaacgg

SEQ ID NO: 22330 - DNA, 23 bp, Homo sapiens
aatggatatgttcagtgtgtagg

SEQ ID NO: 22331 - DNA, 23 bp, Homo sapiens
ccatcagagagttcacatcgggg

SEQ ID NO: 22332 - DNA, 23 bp, Homo sapiens
gaatcttctgatgctgagtaagg

SEQ ID NO: 22333 - DNA, 23 bp, Homo sapiens
catcaaagaactcatacgtgagg

SEQ ID NO: 22334 - DNA, 23 bp, Homo sapiens
acgtctcgaggctatggtgatgg

SEQ ID NO: 22335 - DNA, 23 bp, Homo sapiens
aggaggaggaaagaattatttgg

SEQ ID NO: 22336 - DNA, 23 bp, Homo sapiens
acatcaaagtgttcactgtatgg

SEQ ID NO: 22337 - DNA, 23 bp, Homo sapiens
tgactgtaaggaatgtggaaagg

SEQ ID NO: 22338 - DNA, 23 bp, Homo sapiens
aacagagatgcgattgaagatgg

SEQ ID NO: 22339 - DNA, 23 bp, Homo sapiens
cctggcttagtcatctgagatgg

SEQ ID NO: 22340 - DNA, 23 bp, Homo sapiens
ctctccatctccgacgactgagg

SEQ ID NO: 22341 - DNA, 23 bp, Homo sapiens
catagggtttttctccagtgtgg

SEQ ID NO: 22342 - DNA, 23 bp, Homo sapiens
cctcggaagaagccctgagccgg

SEQ ID NO: 22343 - DNA, 23 bp, Homo sapiens
acgaacaagaatgaacaagaggg

SEQ ID NO: 22344 - DNA, 23 bp, Homo sapiens
caaaggagacaaaacaaaggagg

SEQ ID NO: 22345 - DNA, 23 bp, Homo sapiens
gatgaggatgcctctgtagcagg

SEQ ID NO: 22346 - DNA, 23 bp, Homo sapiens
gcactaatctggaatggagtcgg

SEQ ID NO: 22347 - DNA, 23 bp, Homo sapiens
accctcttcggctgagctagagg

SEQ ID NO: 22348 - DNA, 23 bp, Homo sapiens
gaggaacgccttccgaaataagg

SEQ ID NO: 22349 - DNA, 23 bp, Homo sapiens
atttcacacaacattgctgaagg

SEQ ID NO: 22350 - DNA, 23 bp, Homo sapiens
aaggtgtgaatgttgcctaaagg

SEQ ID NO: 22351 - DNA, 23 bp, Homo sapiens
cagctggttacaaagcatgatgg

SEQ ID NO: 22352 - DNA, 23 bp, Homo sapiens
ccttggaaagttgtgaggaaagg

SEQ ID NO: 22353 - DNA, 23 bp, Homo sapiens
cattcttgctgacatcactcagg

SEQ ID NO: 22354 - DNA, 23 bp, Homo sapiens
ccctattcttgtaaggaatgtgg

SEQ ID NO: 22355 - DNA, 23 bp, Homo sapiens
cagactctgccggaccttagtgg

SEQ ID NO: 22356 - DNA, 23 bp, Homo sapiens
cagcggcggctgggcctggaagg

SEQ ID NO: 22357 - DNA, 23 bp, Homo sapiens
cacaagcaagggggctcaggagg

SEQ ID NO: 22358 - DNA, 23 bp, Homo sapiens
gggcgctcacttcacgtgctcgg

SEQ ID NO: 22359 - DNA, 23 bp, Homo sapiens
agtttgaaaggttgttgaactgg

SEQ ID NO: 22360 - DNA, 23 bp, Homo sapiens
ttgatggatttgaagctgagggg

SEQ ID NO: 22361 - DNA, 23 bp, Homo sapiens
ccagccttgggtccttcaccagg

SEQ ID NO: 22362 - DNA, 23 bp, Homo sapiens
ggggccggcggggcggagagggg

SEQ ID NO: 22363 - DNA, 23 bp, Homo sapiens
cgtgctctgcgagctctcagagg

SEQ ID NO: 22364 - DNA, 23 bp, Homo sapiens
tgtagaagtattgttagggcagg

SEQ ID NO: 22365 - DNA, 23 bp, Homo sapiens
atgagacaccataaagaagttgg

SEQ ID NO: 22366 - DNA, 23 bp, Homo sapiens
ggagagggggctggggttaaagg

SEQ ID NO: 22367 - DNA, 23 bp, Homo sapiens
taatggtaaactagagttggagg

SEQ ID NO: 22368 - DNA, 23 bp, Homo sapiens
tttgtggtgtctgttgtaatagg

SEQ ID NO: 22369 - DNA, 23 bp, Homo sapiens
cagggtgtcttcagtgctcttgg

SEQ ID NO: 22370 - DNA, 23 bp, Homo sapiens
tcagccccacgtagagttactgg

SEQ ID NO: 22371 - DNA, 23 bp, Homo sapiens
cactgcccaaggtcacttcctgg

SEQ ID NO: 22372 - DNA, 23 bp, Homo sapiens
cctctcttctcacttgctcaagg

SEQ ID NO: 22373 - DNA, 23 bp, Homo sapiens
acggtgcaggcagatcacggtgg

SEQ ID NO: 22374 - DNA, 23 bp, Homo sapiens
aattcatgtggaactgcaatggg

SEQ ID NO: 22375 - DNA, 23 bp, Homo sapiens
catgttcagcatccccaggctgg

SEQ ID NO: 22376 - DNA, 23 bp, Homo sapiens
gacaaggccggcctgtgacgtgg

SEQ ID NO: 22377 - DNA, 23 bp, Homo sapiens
tagtgagggccccgttgtcatgg

SEQ ID NO: 22378 - DNA, 23 bp, Homo sapiens
tggggtaaacatcccagtgcagg

SEQ ID NO: 22379 - DNA, 23 bp, Homo sapiens
tcacccgtgggtcgctagggtgg

SEQ ID NO: 22380 - DNA, 23 bp, Homo sapiens
tccctggaccccattcaggaagg

SEQ ID NO: 22381 - DNA, 23 bp, Homo sapiens
agaactcagtcatcttcttgtgg

SEQ ID NO: 22382 - DNA, 23 bp, Homo sapiens
ttaaggagatggttcagctgtgg

SEQ ID NO: 22383 - DNA, 23 bp, Homo sapiens
aacctccacgacatgtgaaacgg

SEQ ID NO: 22384 - DNA, 23 bp, Homo sapiens
cttcgtttcacataaacccgagg

SEQ ID NO: 22385 - DNA, 23 bp, Homo sapiens
gaggctggccaggcctagacagg

SEQ ID NO: 22386 - DNA, 23 bp, Homo sapiens
gacacatcgagtccccaggctgg

SEQ ID NO: 22387 - DNA, 23 bp, Homo sapiens
aattggaagagagcgcactgtgg

SEQ ID NO: 22388 - DNA, 23 bp, Homo sapiens
caatgaatggtacgtgtgacggg

SEQ ID NO: 22389 - DNA, 23 bp, Homo sapiens
catttcttgcacagtaggttcgg

SEQ ID NO: 22390 - DNA, 23 bp, Homo sapiens
tttaacgaatggtacgtctgagg

SEQ ID NO: 22391 - DNA, 23 bp, Homo sapiens
ggcctcctcggcggcggtggcgg

SEQ ID NO: 22392 - DNA, 23 bp, Homo sapiens
acgggaaccctgaagttgtgcgg

SEQ ID NO: 22393 - DNA, 23 bp, Homo sapiens
tttttggtgatgtatgaggctgg

SEQ ID NO: 22394 - DNA, 23 bp, Homo sapiens
ggagttgataatgttgagtgagg

SEQ ID NO: 22395 - DNA, 23 bp, Homo sapiens
aagtgcatggggctcctatctgg

SEQ ID NO: 22396 - DNA, 23 bp, Homo sapiens
cagctgatggcagcaaaaatagg

SEQ ID NO: 22397 - DNA, 23 bp, Homo sapiens
tcctgaaaagttgtgtgtaaagg

SEQ ID NO: 22398 - DNA, 23 bp, Homo sapiens
agggaaagactgatgaatttagg

SEQ ID NO: 22399 - DNA, 23 bp, Homo sapiens
atggcatgggtcactgtgatagg

SEQ ID NO: 22400 - DNA, 23 bp, Homo sapiens
aacatcagagaagccatgtaggg

SEQ ID NO: 22401 - DNA, 23 bp, Homo sapiens
cagagacccctctacacttaagg

SEQ ID NO: 22402 - DNA, 23 bp, Homo sapiens
caccatagcatggcctccttggg

SEQ ID NO: 22403 - DNA, 23 bp, Homo sapiens
cgacatcaggtcctgcacactgg

SEQ ID NO: 22404 - DNA, 23 bp, Homo sapiens
ctggcttggtcagtttcttaagg

SEQ ID NO: 22405 - DNA, 23 bp, Homo sapiens
atctgaatccataagcgtttagg

SEQ ID NO: 22406 - DNA, 23 bp, Homo sapiens
ctttgggatgagtctattcttgg

SEQ ID NO: 22407 - DNA, 23 bp, Homo sapiens
tccaccaagaagagttactgagg

SEQ ID NO: 22408 - DNA, 23 bp, Homo sapiens
aggaatgagatggagaatctggg

SEQ ID NO: 22409 - DNA, 23 bp, Homo sapiens
cagtatcatgcccatctgaaagg

SEQ ID NO: 22410 - DNA, 23 bp, Homo sapiens
ggcaaggggctcagccccactgg

SEQ ID NO: 22411 - DNA, 23 bp, Homo sapiens
tctctatttgagaacaactgagg

SEQ ID NO: 22412 - DNA, 23 bp, Homo sapiens
tgttctcaaacagagaaagcagg

SEQ ID NO: 22413 - DNA, 23 bp, Homo sapiens
gcttgaagtctctctagcagtgg

SEQ ID NO: 22414 - DNA, 23 bp, Homo sapiens
aatggctgttgagcaggagttgg

SEQ ID NO: 22415 - DNA, 23 bp, Homo sapiens
ccgtacaagcatattttccaagg

SEQ ID NO: 22416 - DNA, 23 bp, Homo sapiens
cctttgccttggaatacaggagg

SEQ ID NO: 22417 - DNA, 23 bp, Homo sapiens
atggcacacgagctcagtccagg

SEQ ID NO: 22418 - DNA, 23 bp, Homo sapiens
cctctaatgcactactccctcgg

SEQ ID NO: 22419 - DNA, 23 bp, Homo sapiens
aacatcagagtcttcagatttgg

SEQ ID NO: 22420 - DNA, 23 bp, Homo sapiens
aaggatttgcttgattctactgg

SEQ ID NO: 22421 - DNA, 23 bp, Homo sapiens
atgaaaatgggtgcaaagattgg

SEQ ID NO: 22422 - DNA, 23 bp, Homo sapiens
tctacataatgcacgtgttctgg

SEQ ID NO: 22423 - DNA, 23 bp, Homo sapiens
aagatgtgactgcaagtcttagg

SEQ ID NO: 22424 - DNA, 23 bp, Homo sapiens
cagcaactgcagccctcatttgg

SEQ ID NO: 22425 - DNA, 23 bp, Homo sapiens
agggccagcttcatcttttccgg

SEQ ID NO: 22426 - DNA, 23 bp, Homo sapiens
tcagaccaagaagaagcagtggg

SEQ ID NO: 22427 - DNA, 23 bp, Homo sapiens
gctcatgggtcactaagtaatgg

SEQ ID NO: 22428 - DNA, 23 bp, Homo sapiens
gtatcagcattcatttccgccgg

SEQ ID NO: 22429 - DNA, 23 bp, Homo sapiens
gcttgagccagagcgatgacggg

SEQ ID NO: 22430 - DNA, 23 bp, Homo sapiens
ctggttttgtcctgaatgtgagg

SEQ ID NO: 22431 - DNA, 23 bp, Homo sapiens
gattcactgctagtcccagaagg

SEQ ID NO: 22432 - DNA, 23 bp, Homo sapiens
ctggtatccaataaggttagagg

SEQ ID NO: 22433 - DNA, 23 bp, Homo sapiens
gtttaataaggcttagggactgg

SEQ ID NO: 22434 - DNA, 23 bp, Homo sapiens
gtgctttggcaggaggcaggggg

SEQ ID NO: 22435 - DNA, 23 bp, Homo sapiens
tgctaggaaaggatccaaacagg

SEQ ID NO: 22436 - DNA, 23 bp, Homo sapiens
aaaccctacaaatgtgagtatgg

SEQ ID NO: 22437 - DNA, 23 bp, Homo sapiens
ctgtgtagattctctgatgaagg

SEQ ID NO: 22438 - DNA, 23 bp, Homo sapiens
tgagaagccctgtgaatgaaagg

SEQ ID NO: 22439 - DNA, 23 bp, Homo sapiens
aaccgatcttcaacccttattgg

SEQ ID NO: 22440 - DNA, 23 bp, Homo sapiens
tgaatgtaatagatgtgggaagg

SEQ ID NO: 22441 - DNA, 23 bp, Homo sapiens
tctgtagatgtgaagaagcacgg

SEQ ID NO: 22442 - DNA, 23 bp, Homo sapiens
ttagtcgtgctagtaccctttgg

SEQ ID NO: 22443 - DNA, 23 bp, Homo sapiens
cagagagatgtttctgctgatgg

SEQ ID NO: 22444 - DNA, 23 bp, Homo sapiens
tgtactgatcttcaatgctctgg

SEQ ID NO: 22445 - DNA, 23 bp, Homo sapiens
agcagaaaaggcagagaatgagg

SEQ ID NO: 22446 - DNA, 23 bp, Homo sapiens
gctgtgcaaggttacaaagatgg

SEQ ID NO: 22447 - DNA, 23 bp, Homo sapiens
attccttatactctctctgaagg

SEQ ID NO: 22448 - DNA, 23 bp, Homo sapiens
tcacactgcaggcaggctttagg

SEQ ID NO: 22449 - DNA, 23 bp, Homo sapiens
aagcaccagagaactcacactgg

SEQ ID NO: 22450 - DNA, 23 bp, Homo sapiens
gaattagagagcagatgcagagg

SEQ ID NO: 22451 - DNA, 23 bp, Homo sapiens
acatgaacccagagcattaaagg

SEQ ID NO: 22452 - DNA, 23 bp, Homo sapiens
ccatacaaatgtgaggaatgtgg

SEQ ID NO: 22453 - DNA, 23 bp, Homo sapiens
ctgcatgaaaggactcatatggg

SEQ ID NO: 22454 - DNA, 23 bp, Homo sapiens
tctttgcagtgtaaattcactgg

SEQ ID NO: 22455 - DNA, 23 bp, Homo sapiens
ggcgggcgaatcacgaagtcagg

SEQ ID NO: 22456 - DNA, 23 bp, Homo sapiens
caggtgtgagaaccgtttaaagg

SEQ ID NO: 22457 - DNA, 23 bp, Homo sapiens
taaaaattagccaggtgtggtgg

SEQ ID NO: 22458 - DNA, 23 bp, Homo sapiens
tgggcttgttgtcatagagatgg

SEQ ID NO: 22459 - DNA, 23 bp, Homo sapiens
ggggcaggctttcagccctcagg

SEQ ID NO: 22460 - DNA, 23 bp, Homo sapiens
gaggattaatcatccaaccctgg

SEQ ID NO: 22461 - DNA, 23 bp, Homo sapiens
gtctaatgtggtgtgacttctgg

SEQ ID NO: 22462 - DNA, 23 bp, Homo sapiens
agacatgagaagattcatactgg

SEQ ID NO: 22463 - DNA, 23 bp, Homo sapiens
gccacaactggccagacttttgg

SEQ ID NO: 22464 - DNA, 23 bp, Homo sapiens
tctctgatgtttaataaggctgg

SEQ ID NO: 22465 - DNA, 23 bp, Homo sapiens
ctacaagaggcgcttgaatctgg

SEQ ID NO: 22466 - DNA, 23 bp, Homo sapiens
tgagggaagtcttcagtgagagg

SEQ ID NO: 22467 - DNA, 23 bp, Homo sapiens
gttgattcacaccagggaatagg

SEQ ID NO: 22468 - DNA, 23 bp, Homo sapiens
cctcaccacactcatttgtaagg

SEQ ID NO: 22469 - DNA, 23 bp, Homo sapiens
ggggtgtgtgataagcgagtggg

SEQ ID NO: 22470 - DNA, 23 bp, Homo sapiens
acaccagagaattcacatgaggg

SEQ ID NO: 22471 - DNA, 23 bp, Homo sapiens
ggaaaggtcagaagacctcttgg

SEQ ID NO: 22472 - DNA, 23 bp, Homo sapiens
tttatctggtgtgaactttctgg

SEQ ID NO: 22473 - DNA, 23 bp, Homo sapiens
acttcaccatggggactaaaagg

SEQ ID NO: 22474 - DNA, 23 bp, Homo sapiens
atgaacttccatgcaagctatgg

SEQ ID NO: 22475 - DNA, 23 bp, Homo sapiens
tgtatctcatggttctgcaaagg

SEQ ID NO: 22476 - DNA, 23 bp, Homo sapiens
tgcactaggaattcattgcttgg

SEQ ID NO: 22477 - DNA, 23 bp, Homo sapiens
tttggttactggctattgaaagg

SEQ ID NO: 22478 - DNA, 23 bp, Homo sapiens
ccctttacatgtattcagtgtgg

SEQ ID NO: 22479 - DNA, 23 bp, Homo sapiens
acccaatagtgtggtaagtgtgg

SEQ ID NO: 22480 - DNA, 23 bp, Homo sapiens
cactcggaagtcaaagttcatgg

SEQ ID NO: 22481 - DNA, 23 bp, Homo sapiens
tcctagaattgtcatatgccagg

SEQ ID NO: 22482 - DNA, 23 bp, Homo sapiens
accgtgacaccattcactgtggg

SEQ ID NO: 22483 - DNA, 23 bp, Homo sapiens
atcagaaattgcacacagcatgg

SEQ ID NO: 22484 - DNA, 23 bp, Homo sapiens
agggggtaaaaaattctgggagg

SEQ ID NO: 22485 - DNA, 23 bp, Homo sapiens
gaatgctttcatgtacagtcagg

SEQ ID NO: 22486 - DNA, 23 bp, Homo sapiens
aaacagggaatagactgagttgg

SEQ ID NO: 22487 - DNA, 23 bp, Homo sapiens
ttcatgttctcgacatgaactgg

SEQ ID NO: 22488 - DNA, 23 bp, Homo sapiens
cccagtattacttctgctttcgg

SEQ ID NO: 22489 - DNA, 23 bp, Homo sapiens
tcagaaaagacctcctagctagg

SEQ ID NO: 22490 - DNA, 23 bp, Homo sapiens
cccacccgctcccacctaggagg

SEQ ID NO: 22491 - DNA, 23 bp, Homo sapiens
cctcctgtaatgtcgcaaggtgg

SEQ ID NO: 22492 - DNA, 23 bp, Homo sapiens
gaagactgataaccagctgaagg

SEQ ID NO: 22493 - DNA, 23 bp, Homo sapiens
tagaaagagttgatgagtctcgg

SEQ ID NO: 22494 - DNA, 23 bp, Homo sapiens
tatactgactggtctcattcagg

SEQ ID NO: 22495 - DNA, 23 bp, Homo sapiens
tgtgtcttagcaagccttgcagg

SEQ ID NO: 22496 - DNA, 23 bp, Homo sapiens
caacaccagagagttcacattgg

SEQ ID NO: 22497 - DNA, 23 bp, Homo sapiens
ggcccaatggcctgctttaaggg

SEQ ID NO: 22498 - DNA, 23 bp, Homo sapiens
caagccagctgctcaccccacgg

SEQ ID NO: 22499 - DNA, 23 bp, Homo sapiens
tgtaaggtttctctcctgcatgg

SEQ ID NO: 22500 - DNA, 23 bp, Homo sapiens
aaggtttgaactcctgttgaagg

SEQ ID NO: 22501 - DNA, 23 bp, Homo sapiens
tcaacacttatctaacagcatgg

SEQ ID NO: 22502 - DNA, 23 bp, Homo sapiens
gggggggcaagaacggtagtggg

SEQ ID NO: 22503 - DNA, 23 bp, Homo sapiens
acaggaaggaagtctgtggctgg

SEQ ID NO: 22504 - DNA, 23 bp, Homo sapiens
gccattgaaatctggagtgtggg

SEQ ID NO: 22505 - DNA, 23 bp, Homo sapiens
gaacattctgatgaagtcgaagg

SEQ ID NO: 22506 - DNA, 23 bp, Homo sapiens
actgtgggaagcgctacaagagg

SEQ ID NO: 22507 - DNA, 23 bp, Homo sapiens
gaacatcagagaatccacacagg

SEQ ID NO: 22508 - DNA, 23 bp, Homo sapiens
tccaagtttaagtttgagccagg

SEQ ID NO: 22509 - DNA, 23 bp, Homo sapiens
tatcatcagaaagtccatactgg

SEQ ID NO: 22510 - DNA, 23 bp, Homo sapiens
aaccaccaaagagtgcatttagg

SEQ ID NO: 22511 - DNA, 23 bp, Homo sapiens
catcagagtgtccatagtgaagg

SEQ ID NO: 22512 - DNA, 23 bp, Homo sapiens
cgttctccccttcaattcaatgg

SEQ ID NO: 22513 - DNA, 23 bp, Homo sapiens
attcatcagagagtccatgatgg

SEQ ID NO: 22514 - DNA, 23 bp, Homo sapiens
cagagggaggaagttctacaagg

SEQ ID NO: 22515 - DNA, 23 bp, Homo sapiens
atcagagagtccacactggaggg

SEQ ID NO: 22516 - DNA, 23 bp, Homo sapiens
ccaactcgcatcagaagacgtgg

SEQ ID NO: 22517 - DNA, 23 bp, Homo sapiens
tgggctaatgtcagttagcgagg

SEQ ID NO: 22518 - DNA, 23 bp, Homo sapiens
cctgggagctccattccctaagg

SEQ ID NO: 22519 - DNA, 23 bp, Homo sapiens
cttatgaatgcgttcagtgtggg

SEQ ID NO: 22520 - DNA, 23 bp, Homo sapiens
acaagaactgctttcttccgagg

SEQ ID NO: 22521 - DNA, 23 bp, Homo sapiens
acatcagagaattcacacaaggg

SEQ ID NO: 22522 - DNA, 23 bp, Homo sapiens
ggaatagaagctcccaaaaatgg

SEQ ID NO: 22523 - DNA, 23 bp, Homo sapiens
agaagacacacacaaagaagagg

SEQ ID NO: 22524 - DNA, 23 bp, Homo sapiens
acaactttctgtgcactttctgg

SEQ ID NO: 22525 - DNA, 23 bp, Homo sapiens
ttagagccatcatttaaagcagg

SEQ ID NO: 22526 - DNA, 23 bp, Homo sapiens
tgtcacattcttcactatgtagg

SEQ ID NO: 22527 - DNA, 23 bp, Homo sapiens
gagatggtggatgaacccccagg

SEQ ID NO: 22528 - DNA, 23 bp, Homo sapiens
gagttatcttatctgtggtgagg

SEQ ID NO: 22529 - DNA, 23 bp, Homo sapiens
agaacgttcacaagggataaagg

SEQ ID NO: 22530 - DNA, 23 bp, Homo sapiens
gttgagaaaggtgtgaagaccgg

SEQ ID NO: 22531 - DNA, 23 bp, Homo sapiens
attcagggcttcgtatacatcgg

SEQ ID NO: 22532 - DNA, 23 bp, Homo sapiens
ccttatcagtgtagtgaatgtgg

SEQ ID NO: 22533 - DNA, 23 bp, Homo sapiens
agtcatcagagaactcacacagg

SEQ ID NO: 22534 - DNA, 23 bp, Homo sapiens
tctcacagtgaagacacttgtgg

SEQ ID NO: 22535 - DNA, 23 bp, Homo sapiens
gatgagagactgtcagcataagg

SEQ ID NO: 22536 - DNA, 23 bp, Homo sapiens
gacttctctgatgtgcaatgagg

SEQ ID NO: 22537 - DNA, 23 bp, Homo sapiens
gagctgtgacttccaacaaaagg

SEQ ID NO: 22538 - DNA, 23 bp, Homo sapiens
aaagcactgtcacatcttttagg

SEQ ID NO: 22539 - DNA, 23 bp, Homo sapiens
caactggcttgagagctatgagg

SEQ ID NO: 22540 - DNA, 23 bp, Homo sapiens
ccggtgcttgatgaggtcagagg

SEQ ID NO: 22541 - DNA, 23 bp, Homo sapiens
tcctcactgccgtcctcaggtgg

SEQ ID NO: 22542 - DNA, 23 bp, Homo sapiens
agtactcttatagtagcaactgg

SEQ ID NO: 22543 - DNA, 23 bp, Homo sapiens
taccatcatagacttcatagtgg

SEQ ID NO: 22544 - DNA, 23 bp, Homo sapiens
ttccagactcccttgcagcaagg

SEQ ID NO: 22545 - DNA, 23 bp, Homo sapiens
actctgaaccatcactccccagg

SEQ ID NO: 22546 - DNA, 23 bp, Homo sapiens
tcaacttctgaacccactactgg

SEQ ID NO: 22547 - DNA, 23 bp, Homo sapiens
aaataacttgctggcttgtctgg

SEQ ID NO: 22548 - DNA, 23 bp, Homo sapiens
agtcatctctgcagcttgatggg

SEQ ID NO: 22549 - DNA, 23 bp, Homo sapiens
ttctttctttttcgtcttccagg

SEQ ID NO: 22550 - DNA, 23 bp, Homo sapiens
accagccagagttacaggtaagg

SEQ ID NO: 22551 - DNA, 23 bp, Homo sapiens
ccgcctcctgagcgagactaggg

SEQ ID NO: 22552 - DNA, 23 bp, Homo sapiens
ctcgcactcagcgcactcgtagg

SEQ ID NO: 22553 - DNA, 23 bp, Homo sapiens
tgagtaagttgtccacagaaagg

SEQ ID NO: 22554 - DNA, 23 bp, Homo sapiens
actgtgggaagcgctacgagagg

SEQ ID NO: 22555 - DNA, 23 bp, Homo sapiens
gtagtctttgatgagtcagaagg

SEQ ID NO: 22556 - DNA, 23 bp, Homo sapiens
ccctttagatgtaatgagtgtgg

SEQ ID NO: 22557 - DNA, 23 bp, Homo sapiens
cagcatcaacgtgttcatacagg

SEQ ID NO: 22558 - DNA, 23 bp, Homo sapiens
ataggtaaagccacaggcagagg

SEQ ID NO: 22559 - DNA, 23 bp, Homo sapiens
ttcctgggctcaggcctcgccgg

SEQ ID NO: 22560 - DNA, 23 bp, Homo sapiens
tcagagaatgcacacagaagagg

SEQ ID NO: 22561 - DNA, 23 bp, Homo sapiens
gcaggcaggaggtcctcagaagg

SEQ ID NO: 22562 - DNA, 23 bp, Homo sapiens
gggtgtgtggctctttcacgtgg

SEQ ID NO: 22563 - DNA, 23 bp, Homo sapiens
aagggctgaactgtatctaaagg

SEQ ID NO: 22564 - DNA, 23 bp, Homo sapiens
acaccagagaattcacacagtgg

SEQ ID NO: 22565 - DNA, 23 bp, Homo sapiens
tgaatgcaacaaatgtctcaagg

SEQ ID NO: 22566 - DNA, 23 bp, Homo sapiens
agtttaagagatgcagctaaagg

SEQ ID NO: 22567 - DNA, 23 bp, Homo sapiens
gaatcgttatactcaggcactgg

SEQ ID NO: 22568 - DNA, 23 bp, Homo sapiens
gtcggccccgggcccctcacagg

SEQ ID NO: 22569 - DNA, 23 bp, Homo sapiens
tctaaagcaggcgcgctcactgg

SEQ ID NO: 22570 - DNA, 23 bp, Homo sapiens
tgtgaacactggattctgtgtgg

SEQ ID NO: 22571 - DNA, 23 bp, Homo sapiens
cacagccgcagagtcagggcagg

SEQ ID NO: 22572 - DNA, 23 bp, Homo sapiens
ctcttcaggaaagtggtcaaagg

SEQ ID NO: 22573 - DNA, 23 bp, Homo sapiens
gaacctggagtctgtgggtgagg

SEQ ID NO: 22574 - DNA, 23 bp, Homo sapiens
gtggcaaggtctttagtctgagg

SEQ ID NO: 22575 - DNA, 23 bp, Homo sapiens
gcctcacagatgtcttgaccagg

SEQ ID NO: 22576 - DNA, 23 bp, Homo sapiens
tcgcagccagcggaggtctgagg

SEQ ID NO: 22577 - DNA, 23 bp, Homo sapiens
ctgaagccagcgaaggtctgagg

SEQ ID NO: 22578 - DNA, 23 bp, Homo sapiens
gtggtggtggtgggggtagcagg

SEQ ID NO: 22579 - DNA, 23 bp, Homo sapiens
ttttcttcaggttgctcaacagg

SEQ ID NO: 22580 - DNA, 23 bp, Homo sapiens
agcaacccatggaaacataatgg

SEQ ID NO: 22581 - DNA, 23 bp, Homo sapiens
atgaggaacaagagaactagggg

SEQ ID NO: 22582 - DNA, 23 bp, Homo sapiens
aaaaggctcttcaactgttgtgg

SEQ ID NO: 22583 - DNA, 23 bp, Homo sapiens
attcttccaaattagttgggtgg

SEQ ID NO: 22584 - DNA, 23 bp, Homo sapiens
ccatgtctcatccatactgtggg

SEQ ID NO: 22585 - DNA, 23 bp, Homo sapiens
ttttctcgggcacaattaggtgg

SEQ ID NO: 22586 - DNA, 23 bp, Homo sapiens
ttgttggaacttattccttgtgg

SEQ ID NO: 22587 - DNA, 23 bp, Homo sapiens
ggccctcggggctcagtcatcgg

SEQ ID NO: 22588 - DNA, 23 bp, Homo sapiens
ttgtacagggagtgtgggtgagg

SEQ ID NO: 22589 - DNA, 23 bp, Homo sapiens
tggatagttactgaacattcagg

SEQ ID NO: 22590 - DNA, 23 bp, Homo sapiens
gtacatcagagaacacacatagg

SEQ ID NO: 22591 - DNA, 23 bp, Homo sapiens
gacaccgcgccactgttacatgg

SEQ ID NO: 22592 - DNA, 23 bp, Homo sapiens
gacacctcaggtccgtcactcgg

SEQ ID NO: 22593 - DNA, 23 bp, Homo sapiens
tttcactatgttggccaggatgg

SEQ ID NO: 22594 - DNA, 23 bp, Homo sapiens
acaccagaggacacactgacggg

SEQ ID NO: 22595 - DNA, 23 bp, Homo sapiens
tggtaagaaactctgcgaattgg

SEQ ID NO: 22596 - DNA, 23 bp, Homo sapiens
caaccaccttggaagactagagg

SEQ ID NO: 22597 - DNA, 23 bp, Homo sapiens
ctgcctctgcacaaatgtgacgg

SEQ ID NO: 22598 - DNA, 23 bp, Homo sapiens
gcagcaggagtgaattagcccgg

SEQ ID NO: 22599 - DNA, 23 bp, Homo sapiens
tcagaaagactcaaccaccttgg

SEQ ID NO: 22600 - DNA, 23 bp, Homo sapiens
agccatcacagaattcatagtgg

SEQ ID NO: 22601 - DNA, 23 bp, Homo sapiens
attcaacaagatgggttctatgg

SEQ ID NO: 22602 - DNA, 23 bp, Homo sapiens
aagacataattgatcacggaagg

SEQ ID NO: 22603 - DNA, 23 bp, Homo sapiens
gattagtaagggatgacctatgg

SEQ ID NO: 22604 - DNA, 23 bp, Homo sapiens
aggctttcacacatgcaaatcgg

SEQ ID NO: 22605 - DNA, 23 bp, Homo sapiens
agagatgaactaaacctcatagg

SEQ ID NO: 22606 - DNA, 23 bp, Homo sapiens
tgctggggcctgatggctgaagg

SEQ ID NO: 22607 - DNA, 23 bp, Homo sapiens
cagatgagagagattcgcaccgg

SEQ ID NO: 22608 - DNA, 23 bp, Homo sapiens
atgatgttcacaatggctgttgg

SEQ ID NO: 22609 - DNA, 23 bp, Homo sapiens
ccaaaatgacctggaattggagg

SEQ ID NO: 22610 - DNA, 23 bp, Homo sapiens
tatttctgttagctgcttgaagg

SEQ ID NO: 22611 - DNA, 23 bp, Homo sapiens
agtgcttttaggtatctaagtgg

SEQ ID NO: 22612 - DNA, 23 bp, Homo sapiens
gcgccactccgacagtagcttgg

SEQ ID NO: 22613 - DNA, 23 bp, Homo sapiens
cgtcaacatgttacttccaaagg

SEQ ID NO: 22614 - DNA, 23 bp, Homo sapiens
gaagcaaatatggcttggtgtgg

SEQ ID NO: 22615 - DNA, 23 bp, Homo sapiens
taaacgagggaaattactctggg

SEQ ID NO: 22616 - DNA, 23 bp, Homo sapiens
tttccaagccagagtcatctggg

SEQ ID NO: 22617 - DNA, 23 bp, Homo sapiens
cattacttactgaattcccgtgg

SEQ ID NO: 22618 - DNA, 23 bp, Homo sapiens
tcggatctcattcgtcatcaggg

SEQ ID NO: 22619 - DNA, 23 bp, Homo sapiens
cagcacggatctctaagagctgg

SEQ ID NO: 22620 - DNA, 23 bp, Homo sapiens
gttcagggttgaggtcagtacgg

SEQ ID NO: 22621 - DNA, 23 bp, Homo sapiens
ggggtttgcagacgttagtacgg

SEQ ID NO: 22622 - DNA, 23 bp, Homo sapiens
cctccccatgagggctaataagg

SEQ ID NO: 22623 - DNA, 23 bp, Homo sapiens
tagtaaggagcaaacagcacagg

SEQ ID NO: 22624 - DNA, 23 bp, Homo sapiens
cagagttgaactctgacagaagg

SEQ ID NO: 22625 - DNA, 23 bp, Homo sapiens
actcggcggaactgtgctcccgg

SEQ ID NO: 22626 - DNA, 23 bp, Homo sapiens
gtgctgtcggctgggcgtggtgg

SEQ ID NO: 22627 - DNA, 23 bp, Homo sapiens
gaaggcctgccagcgctttctgg

SEQ ID NO: 22628 - DNA, 23 bp, Homo sapiens
aagatttgagctctgactaaagg

SEQ ID NO: 22629 - DNA, 23 bp, Homo sapiens
taaatcagctgagatgtgtgtgg

SEQ ID NO: 22630 - DNA, 23 bp, Homo sapiens
tgccccaggtcactttcaggagg

SEQ ID NO: 22631 - DNA, 23 bp, Homo sapiens
cacatttttagatggcaggatgg

SEQ ID NO: 22632 - DNA, 23 bp, Homo sapiens
ttatagtgtggactctttgatgg

SEQ ID NO: 22633 - DNA, 23 bp, Homo sapiens
tatggggaagggagtggaggggg

SEQ ID NO: 22634 - DNA, 23 bp, Homo sapiens
acattaagagtctctcaccatgg

SEQ ID NO: 22635 - DNA, 23 bp, Homo sapiens
aaaagtgctcacaaagactttgg

SEQ ID NO: 22636 - DNA, 23 bp, Homo sapiens
gccgcgcgtctcatgcttcctgg

SEQ ID NO: 22637 - DNA, 23 bp, Homo sapiens
gcttacctgcatgctggtaaggg

SEQ ID NO: 22638 - DNA, 23 bp, Homo sapiens
gaggtggtggaggtggagatggg

SEQ ID NO: 22639 - DNA, 23 bp, Homo sapiens
gtgaagactttctcagtcactgg

SEQ ID NO: 22640 - DNA, 23 bp, Homo sapiens
ctctacctcccgaattcaagcgg

SEQ ID NO: 22641 - DNA, 23 bp, Homo sapiens
tggtgaccatgcagtcagggagg

SEQ ID NO: 22642 - DNA, 23 bp, Homo sapiens
tgtagtagcagctactcaggagg

SEQ ID NO: 22643 - DNA, 23 bp, Homo sapiens
acgcgccctcaggtgcgtgcagg

SEQ ID NO: 22644 - DNA, 23 bp, Homo sapiens
attcagagctgcgagaacactgg

SEQ ID NO: 22645 - DNA, 23 bp, Homo sapiens
atttgatgtctgaagaggtttgg

SEQ ID NO: 22646 - DNA, 23 bp, Homo sapiens
aatgttagatcttgggctgtagg

SEQ ID NO: 22647 - DNA, 23 bp, Homo sapiens
ccatattcactgcactcataagg

SEQ ID NO: 22648 - DNA, 23 bp, Homo sapiens
tgtgaactctctgatgtcgaagg

SEQ ID NO: 22649 - DNA, 23 bp, Homo sapiens
catctaaatatgcacactggagg

SEQ ID NO: 22650 - DNA, 23 bp, Homo sapiens
ggagctccgttactctcatgggg

SEQ ID NO: 22651 - DNA, 23 bp, Homo sapiens
tcatggagcagaaatacagaagg

SEQ ID NO: 22652 - DNA, 23 bp, Homo sapiens
tgtgggattgactttagtcatgg

SEQ ID NO: 22653 - DNA, 23 bp, Homo sapiens
tgagccagcacgcacagtgaggg

SEQ ID NO: 22654 - DNA, 23 bp, Homo sapiens
tgctgcatggcctgacctagagg

SEQ ID NO: 22655 - DNA, 23 bp, Homo sapiens
gttcatgtcttcgaagtgaacgg

SEQ ID NO: 22656 - DNA, 23 bp, Homo sapiens
gcatgcccggggtgaggtgtagg

SEQ ID NO: 22657 - DNA, 23 bp, Homo sapiens
acctctgcctcccaaagtgctgg

SEQ ID NO: 22658 - DNA, 23 bp, Homo sapiens
aaaatcactgtcacatcttcagg

SEQ ID NO: 22659 - DNA, 23 bp, Homo sapiens
gccacaatcttcacatttgtagg

SEQ ID NO: 22660 - DNA, 23 bp, Homo sapiens
aagagttgaggactgcttaaagg

SEQ ID NO: 22661 - DNA, 23 bp, Homo sapiens
gtacatcagcgaactcataatgg

SEQ ID NO: 22662 - DNA, 23 bp, Homo sapiens
ctcctaaagcctggggttatggg

SEQ ID NO: 22663 - DNA, 23 bp, Homo sapiens
aatgtgagaagagtttcagcagg

SEQ ID NO: 22664 - DNA, 23 bp, Homo sapiens
gtctcatttctcagcttcactgg

SEQ ID NO: 22665 - DNA, 23 bp, Homo sapiens
aaacacataagaatgcactctgg

SEQ ID NO: 22666 - DNA, 23 bp, Homo sapiens
acataaaaggacacactggaagg

SEQ ID NO: 22667 - DNA, 23 bp, Homo sapiens
agaaccttcgaattcatgaaagg

SEQ ID NO: 22668 - DNA, 23 bp, Homo sapiens
tatagggtttctccatactgtgg

SEQ ID NO: 22669 - DNA, 23 bp, Homo sapiens
agagaacccatatgaatgtaagg

SEQ ID NO: 22670 - DNA, 23 bp, Homo sapiens
gccgggaggcggctaacccaagg

SEQ ID NO: 22671 - DNA, 23 bp, Homo sapiens
aaccatattagagattagcctgg

SEQ ID NO: 22672 - DNA, 23 bp, Homo sapiens
gtcgaagctgtcgtcttgcgcgg

SEQ ID NO: 22673 - DNA, 23 bp, Homo sapiens
ctggctgctcatggaacctccgg

SEQ ID NO: 22674 - DNA, 23 bp, Homo sapiens
caccaggtcactcactttagagg

SEQ ID NO: 22675 - DNA, 23 bp, Homo sapiens
cttcatcagaggattcacacagg

SEQ ID NO: 22676 - DNA, 23 bp, Homo sapiens
gagactctccagaacgccatggg

SEQ ID NO: 22677 - DNA, 23 bp, Homo sapiens
agctattagaagaagtcttgagg

SEQ ID NO: 22678 - DNA, 23 bp, Homo sapiens
gccgaggtgggcggatcacgagg

SEQ ID NO: 22679 - DNA, 23 bp, Homo sapiens
cagcatcagagacatcatattgg

SEQ ID NO: 22680 - DNA, 23 bp, Homo sapiens
tctttccacatctgttacaatgg

SEQ ID NO: 22681 - DNA, 23 bp, Homo sapiens
ttcatgatgctagactaggatgg

SEQ ID NO: 22682 - DNA, 23 bp, Homo sapiens
accaaacgctcattcttttttgg

SEQ ID NO: 22683 - DNA, 23 bp, Homo sapiens
aactaggctcagaagaagagcgg

SEQ ID NO: 22684 - DNA, 23 bp, Homo sapiens
tctggggctgctaaatgaattgg

SEQ ID NO: 22685 - DNA, 23 bp, Homo sapiens
taccatcataggcttcatagtgg

SEQ ID NO: 22686 - DNA, 23 bp, Homo sapiens
tcttgctcctagaaattactcgg

SEQ ID NO: 22687 - DNA, 23 bp, Homo sapiens
attgaatctataggacttggtgg

SEQ ID NO: 22688 - DNA, 23 bp, Homo sapiens
tgtcatcaaagaagtcatactgg

SEQ ID NO: 22689 - DNA, 23 bp, Homo sapiens
tgctgccacccaatggctacagg

SEQ ID NO: 22690 - DNA, 23 bp, Homo sapiens
gttttctcttgttcccctacagg

SEQ ID NO: 22691 - DNA, 23 bp, Homo sapiens
aatgtgagcaagcttttaagtgg

SEQ ID NO: 22692 - DNA, 23 bp, Homo sapiens
gcaacaggactggaatgacgcgg

SEQ ID NO: 22693 - DNA, 23 bp, Homo sapiens
tttcatacctagcacaacattgg

SEQ ID NO: 22694 - DNA, 23 bp, Homo sapiens
aaagatgcagatgttctctgagg

SEQ ID NO: 22695 - DNA, 23 bp, Homo sapiens
tcaggcctcattagacatcgggg

SEQ ID NO: 22696 - DNA, 23 bp, Homo sapiens
agatagaagaaagttggccttgg

SEQ ID NO: 22697 - DNA, 23 bp, Homo sapiens
gccatgaaatgtagttagtgtgg

SEQ ID NO: 22698 - DNA, 23 bp, Homo sapiens
ataatcctttgtcacgttcttgg

SEQ ID NO: 22699 - DNA, 23 bp, Homo sapiens
catgacttctcacagctagcagg

SEQ ID NO: 22700 - DNA, 23 bp, Homo sapiens
agtctttgcacgtgcacgaaagg

SEQ ID NO: 22701 - DNA, 23 bp, Homo sapiens
ttcatgttttcgacagtaactgg

SEQ ID NO: 22702 - DNA, 23 bp, Homo sapiens
gtttagaaagagttgaggactgg

SEQ ID NO: 22703 - DNA, 23 bp, Homo sapiens
agagaccatcctggctaaaacgg

SEQ ID NO: 22704 - DNA, 23 bp, Homo sapiens
catgtggcaaagcttttaggcgg

SEQ ID NO: 22705 - DNA, 23 bp, Homo sapiens
cccaggcggagaggctcagtagg

SEQ ID NO: 22706 - DNA, 23 bp, Homo sapiens
gtgtagactctgagtcgtcttgg

SEQ ID NO: 22707 - DNA, 23 bp, Homo sapiens
cctcgggtcagggcgcagcgcgg

SEQ ID NO: 22708 - DNA, 23 bp, Homo sapiens
caggcctggtgatcaggctttgg

SEQ ID NO: 22709 - DNA, 23 bp, Homo sapiens
gcccaccgccggacgcacacagg

SEQ ID NO: 22710 - DNA, 23 bp, Homo sapiens
cgacatcagaggcttcatgctgg

SEQ ID NO: 22711 - DNA, 23 bp, Homo sapiens
agacatcagaaacttcacagtgg

SEQ ID NO: 22712 - DNA, 23 bp, Homo sapiens
cggcgctggggtatcagtgaggg

SEQ ID NO: 22713 - DNA, 23 bp, Homo sapiens
accctgcatagtgaagaatgtgg

SEQ ID NO: 22714 - DNA, 23 bp, Homo sapiens
agctctaaacacaaattaggtgg

SEQ ID NO: 22715 - DNA, 23 bp, Homo sapiens
accagaaaattcagggagagggg

SEQ ID NO: 22716 - DNA, 23 bp, Homo sapiens
ctgagtctatcagcattgtttgg

SEQ ID NO: 22717 - DNA, 23 bp, Homo sapiens
tcataaacgaggaaggaaatagg

SEQ ID NO: 22718 - DNA, 23 bp, Homo sapiens
acgcaccatgctcacttttcagg

SEQ ID NO: 22719 - DNA, 23 bp, Homo sapiens
tagttcaggatgagtctgtgtgg

SEQ ID NO: 22720 - DNA, 23 bp, Homo sapiens
aaacatcagagaagtcatgctgg

SEQ ID NO: 22721 - DNA, 23 bp, Homo sapiens
ctctgagaaagggaacctaaagg

SEQ ID NO: 22722 - DNA, 23 bp, Homo sapiens
ccgtcatcaggaagcccaacagg

SEQ ID NO: 22723 - DNA, 23 bp, Homo sapiens
taatggaagctactcgggattgg

SEQ ID NO: 22724 - DNA, 23 bp, Homo sapiens
actgtttacttatttgcccttgg

SEQ ID NO: 22725 - DNA, 23 bp, Homo sapiens
acacttgcagggtttctacctgg

SEQ ID NO: 22726 - DNA, 23 bp, Homo sapiens
acttgcactaactgctgtgttgg

SEQ ID NO: 22727 - DNA, 23 bp, Homo sapiens
gccgggggtgtgggtcaggccgg

SEQ ID NO: 22728 - DNA, 23 bp, Homo sapiens
caagtgtggagaatgtgacaagg

SEQ ID NO: 22729 - DNA, 23 bp, Homo sapiens
ttttcagctgcgtcacacgaagg

SEQ ID NO: 22730 - DNA, 23 bp, Homo sapiens
gaattctctgatgtcgtctaagg

SEQ ID NO: 22731 - DNA, 23 bp, Homo sapiens
gaactctctgatgctgtgcaagg

SEQ ID NO: 22732 - DNA, 23 bp, Homo sapiens
tgccaaccgaaaatttacactgg

SEQ ID NO: 22733 - DNA, 23 bp, Homo sapiens
gaactcttctgtgtcttaagagg

SEQ ID NO: 22734 - DNA, 23 bp, Homo sapiens
gagcatctgtggctatttctcgg

SEQ ID NO: 22735 - DNA, 23 bp, Homo sapiens
actgcaatgttgtactaggatgg

SEQ ID NO: 22736 - DNA, 23 bp, Homo sapiens
cggcgggtgtcttagctccgcgg

SEQ ID NO: 22737 - DNA, 23 bp, Homo sapiens
atcaagaggccagacttgtgtgg

SEQ ID NO: 22738 - DNA, 23 bp, Homo sapiens
gcaagtagcacagcaaattctgg

SEQ ID NO: 22739 - DNA, 23 bp, Homo sapiens
tgagtgtaaggtatgtagaaagg

SEQ ID NO: 22740 - DNA, 23 bp, Homo sapiens
gccacgggagtcaccactgcagg

SEQ ID NO: 22741 - DNA, 23 bp, Homo sapiens
tgaagaaaatctgtggtgaaagg

SEQ ID NO: 22742 - DNA, 23 bp, Homo sapiens
acaggcatgtccaccatgcccgg

SEQ ID NO: 22743 - DNA, 23 bp, Homo sapiens
acatactggagagaaaccttagg

SEQ ID NO: 22744 - DNA, 23 bp, Homo sapiens
agagcgaaactccgtctcggggg

SEQ ID NO: 22745 - DNA, 23 bp, Homo sapiens
cacactctctcagatccttctgg

SEQ ID NO: 22746 - DNA, 23 bp, Homo sapiens
gctgaggggggcgcatcatgagg

SEQ ID NO: 22747 - DNA, 23 bp, Homo sapiens
cgacatcacagaattcatactgg

SEQ ID NO: 22748 - DNA, 23 bp, Homo sapiens
cagaaagtccacactggataagg

SEQ ID NO: 22749 - DNA, 23 bp, Homo sapiens
tctctgatgtttaatgaggttgg

SEQ ID NO: 22750 - DNA, 23 bp, Homo sapiens
ttcccttgtcaggcaccagaagg

SEQ ID NO: 22751 - DNA, 23 bp, Homo sapiens
caatagggttctctcatgtatgg

SEQ ID NO: 22752 - DNA, 23 bp, Homo sapiens
tagggatgaggaagggcttttgg

SEQ ID NO: 22753 - DNA, 23 bp, Homo sapiens
ggagagttcacactgaagaaagg

SEQ ID NO: 22754 - DNA, 23 bp, Homo sapiens
tcagagagttcacaaaagaaagg

SEQ ID NO: 22755 - DNA, 23 bp, Homo sapiens
taccagaacagacatcttattgg

SEQ ID NO: 22756 - DNA, 23 bp, Homo sapiens
tcaggataaggaactcataaagg

SEQ ID NO: 22757 - DNA, 23 bp, Homo sapiens
tcctgtacatctaagtaatgggg

SEQ ID NO: 22758 - DNA, 23 bp, Homo sapiens
tgcatacgagaatgcataatagg

SEQ ID NO: 22759 - DNA, 23 bp, Homo sapiens
tctcttgtgcacagaaagatagg

SEQ ID NO: 22760 - DNA, 23 bp, Homo sapiens
cacacattcagtaaggcatgagg

SEQ ID NO: 22761 - DNA, 23 bp, Homo sapiens
tccctgagtcatttcattcatgg

SEQ ID NO: 22762 - DNA, 23 bp, Homo sapiens
acgagctgagaaagaagcaaagg

SEQ ID NO: 22763 - DNA, 23 bp, Homo sapiens
atggcaaccgatgggctaaatgg

SEQ ID NO: 22764 - DNA, 23 bp, Homo sapiens
tgaaaactcacagtggagaaagg

SEQ ID NO: 22765 - DNA, 23 bp, Homo sapiens
aaagacatgaaaagactcactgg

SEQ ID NO: 22766 - DNA, 23 bp, Homo sapiens
cctccactattcattttcacagg

SEQ ID NO: 22767 - DNA, 23 bp, Homo sapiens
tgtgggcaggcatttattcttgg

SEQ ID NO: 22768 - DNA, 23 bp, Homo sapiens
ccctatgaatatagggaatgtgg

SEQ ID NO: 22769 - DNA, 23 bp, Homo sapiens
gtccatcaaagaactcacaaggg

SEQ ID NO: 22770 - DNA, 23 bp, Homo sapiens
atacataagagaggtcatacagg

SEQ ID NO: 22771 - DNA, 23 bp, Homo sapiens
tgtgggaagccctttggtggtgg

SEQ ID NO: 22772 - DNA, 23 bp, Homo sapiens
gaattctctggtgtctaacaagg

SEQ ID NO: 22773 - DNA, 23 bp, Homo sapiens
tctttagtgtgtgctctcactgg

SEQ ID NO: 22774 - DNA, 23 bp, Homo sapiens
atttaggactcaggatctatagg

SEQ ID NO: 22775 - DNA, 23 bp, Homo sapiens
atctaaagtctttaccacactgg

SEQ ID NO: 22776 - DNA, 23 bp, Homo sapiens
tcaggaagatgaatttgagacgg

SEQ ID NO: 22777 - DNA, 23 bp, Homo sapiens
aagcccatcagagaattcatagg

SEQ ID NO: 22778 - DNA, 23 bp, Homo sapiens
gctgagggggtccagatcagtgg

SEQ ID NO: 22779 - DNA, 23 bp, Homo sapiens
ccaccaggtggagcacaaggggg

SEQ ID NO: 22780 - DNA, 23 bp, Homo sapiens
gctgcactcagagctccccccgg

SEQ ID NO: 22781 - DNA, 23 bp, Homo sapiens
cctcacaaatgaagtgaatgtgg

SEQ ID NO: 22782 - DNA, 23 bp, Homo sapiens
gaagtctatgatgacatgcaagg

SEQ ID NO: 22783 - DNA, 23 bp, Homo sapiens
gcagggcggcgaaggtcaggagg

SEQ ID NO: 22784 - DNA, 23 bp, Homo sapiens
aggccgggtctcgagcttagtgg

SEQ ID NO: 22785 - DNA, 23 bp, Homo sapiens
cggtggaagcatccatgagccgg

SEQ ID NO: 22786 - DNA, 23 bp, Homo sapiens
tggggaaagcccattagcctagg

SEQ ID NO: 22787 - DNA, 23 bp, Homo sapiens
attcaggagatgaaacctacagg

SEQ ID NO: 22788 - DNA, 23 bp, Homo sapiens
ctgtagctctttagatgctcagg

SEQ ID NO: 22789 - DNA, 23 bp, Homo sapiens
ggaggacagggcacatgggaagg

SEQ ID NO: 22790 - DNA, 23 bp, Homo sapiens
cacactgtttctctcaagcgtgg

SEQ ID NO: 22791 - DNA, 23 bp, Homo sapiens
aagactggagttttcagcaaagg

SEQ ID NO: 22792 - DNA, 23 bp, Homo sapiens
agagagttcatactggaatgagg

SEQ ID NO: 22793 - DNA, 23 bp, Homo sapiens
aggatttcactatattgcccagg

SEQ ID NO: 22794 - DNA, 23 bp, Homo sapiens
ccttatgtgtgcagagattgagg

SEQ ID NO: 22795 - DNA, 23 bp, Homo sapiens
actgtcccctcaggtgtgaccgg

SEQ ID NO: 22796 - DNA, 23 bp, Homo sapiens
atggatacctctacctgacatgg

SEQ ID NO: 22797 - DNA, 23 bp, Homo sapiens
ctcagatctcatcagacatcagg

SEQ ID NO: 22798 - DNA, 23 bp, Homo sapiens
caagcgaattcatactggcaagg

SEQ ID NO: 22799 - DNA, 23 bp, Homo sapiens
gagttctctcatgttgtctaagg

SEQ ID NO: 22800 - DNA, 23 bp, Homo sapiens
cttgaaagttttcccacacacgg

SEQ ID NO: 22801 - DNA, 23 bp, Homo sapiens
cgggagctacgtgatgatcctgg

SEQ ID NO: 22802 - DNA, 23 bp, Homo sapiens
ctctggtatgaatctttcgatgg

SEQ ID NO: 22803 - DNA, 23 bp, Homo sapiens
atcaggcagttcatggtgtaggg

SEQ ID NO: 22804 - DNA, 23 bp, Homo sapiens
aagctgcgacttcctgttgaagg

SEQ ID NO: 22805 - DNA, 23 bp, Homo sapiens
tctcttcactgtgatttctctgg

SEQ ID NO: 22806 - DNA, 23 bp, Homo sapiens
tctctgatgtacttcaaggatgg

SEQ ID NO: 22807 - DNA, 23 bp, Homo sapiens
tctgcatctggaatgtttcctgg

SEQ ID NO: 22808 - DNA, 23 bp, Homo sapiens
cactctacccaccccccaggagg

SEQ ID NO: 22809 - DNA, 23 bp, Homo sapiens
ttcactgcgtaccttacagatgg

SEQ ID NO: 22810 - DNA, 23 bp, Homo sapiens
caagtgtaatgaatgtgggaagg

SEQ ID NO: 22811 - DNA, 23 bp, Homo sapiens
atctgctgagactgaacttctgg

SEQ ID NO: 22812 - DNA, 23 bp, Homo sapiens
tctgcatgagttcacttataagg

SEQ ID NO: 22813 - DNA, 23 bp, Homo sapiens
ttaaacacaggagaattcacagg

SEQ ID NO: 22814 - DNA, 23 bp, Homo sapiens
gaattctttggtgtttgctgagg

SEQ ID NO: 22815 - DNA, 23 bp, Homo sapiens
agtcaagtcttaaagcatgttgg

SEQ ID NO: 22816 - DNA, 23 bp, Homo sapiens
gagaacgtgacggggcttacagg

SEQ ID NO: 22817 - DNA, 23 bp, Homo sapiens
aagacacctgtccaagcataggg

SEQ ID NO: 22818 - DNA, 23 bp, Homo sapiens
ctgccaagataaagctcatgagg

SEQ ID NO: 22819 - DNA, 23 bp, Homo sapiens
gaggtggatcagttgaggtcagg

SEQ ID NO: 22820 - DNA, 23 bp, Homo sapiens
cagactctcagaatctcacttgg

SEQ ID NO: 22821 - DNA, 23 bp, Homo sapiens
gtagataagggggaacacacagg

SEQ ID NO: 22822 - DNA, 23 bp, Homo sapiens
aaggctcgaactactcctgaagg

SEQ ID NO: 22823 - DNA, 23 bp, Homo sapiens
attaagcaatcttctcgccttgg

SEQ ID NO: 22824 - DNA, 23 bp, Homo sapiens
aaggtgtgaggaccgcttgaagg

SEQ ID NO: 22825 - DNA, 23 bp, Homo sapiens
atatgtcatgaagaggactttgg

SEQ ID NO: 22826 - DNA, 23 bp, Homo sapiens
tttcatgctcatgaaagaactgg

SEQ ID NO: 22827 - DNA, 23 bp, Homo sapiens
cagctggtgcacacgttttgagg

SEQ ID NO: 22828 - DNA, 23 bp, Homo sapiens
ccaggtgtctccctgtgaaatgg

SEQ ID NO: 22829 - DNA, 23 bp, Homo sapiens
tacaaggtgtctttcctatatgg

SEQ ID NO: 22830 - DNA, 23 bp, Homo sapiens
gaaagaagctctaggtgattggg

SEQ ID NO: 22831 - DNA, 23 bp, Homo sapiens
aatcaagttgtctcatggactgg

SEQ ID NO: 22832 - DNA, 23 bp, Homo sapiens
ccccggaacagctgggacagagg

SEQ ID NO: 22833 - DNA, 23 bp, Homo sapiens
ctggttctatgaagctgcttcgg

SEQ ID NO: 22834 - DNA, 23 bp, Homo sapiens
agaagacatagacggtattaagg

SEQ ID NO: 22835 - DNA, 23 bp, Homo sapiens
tttggagacttgaagttcagagg

SEQ ID NO: 22836 - DNA, 23 bp, Homo sapiens
atgctatcttcactcgtcagagg

SEQ ID NO: 22837 - DNA, 23 bp, Homo sapiens
taactgtggcaatggtggcaggg

SEQ ID NO: 22838 - DNA, 23 bp, Homo sapiens
ctgaactgttcttctctgccagg

SEQ ID NO: 22839 - DNA, 23 bp, Homo sapiens
cagtggtcaggtgggtcaggtgg

SEQ ID NO: 22840 - DNA, 23 bp, Homo sapiens
aagaaatgtcagacactctttgg

SEQ ID NO: 22841 - DNA, 23 bp, Homo sapiens
aactagatgtgctctctgactgg

SEQ ID NO: 22842 - DNA, 23 bp, Homo sapiens
atatctcacaatcgtggaaaagg

SEQ ID NO: 22843 - DNA, 23 bp, Homo sapiens
atggatttgggaagtcctgaggg

SEQ ID NO: 22844 - DNA, 23 bp, Homo sapiens
acaccagaggaaacataatgagg

SEQ ID NO: 22845 - DNA, 23 bp, Homo sapiens
aatctcaatcttggactcattgg

SEQ ID NO: 22846 - DNA, 23 bp, Homo sapiens
tatggaaatgtgacctccctagg

SEQ ID NO: 22847 - DNA, 23 bp, Homo sapiens
gcactctctaatgttcaagaagg

SEQ ID NO: 22848 - DNA, 23 bp, Homo sapiens
gatggtttctctcctttgtgtgg

SEQ ID NO: 22849 - DNA, 23 bp, Homo sapiens
ggccctgccacgctctgacgggg

SEQ ID NO: 22850 - DNA, 23 bp, Homo sapiens
caaatgtaaccaatgtggcaagg

SEQ ID NO: 22851 - DNA, 23 bp, Homo sapiens
gtgtattctgatgtcgaatcagg

SEQ ID NO: 22852 - DNA, 23 bp, Homo sapiens
gggggtcatgggcttcaggccgg

SEQ ID NO: 22853 - DNA, 23 bp, Homo sapiens
ctcaagcaatccacacgccttgg

SEQ ID NO: 22854 - DNA, 23 bp, Homo sapiens
agcatgaaagagcttatatgtgg

SEQ ID NO: 22855 - DNA, 23 bp, Homo sapiens
ctgcaccagagggttcatgctgg

SEQ ID NO: 22856 - DNA, 23 bp, Homo sapiens
aactaggacacagagaaccctgg

SEQ ID NO: 22857 - DNA, 23 bp, Homo sapiens
aaacatcagagaagtcacacagg

SEQ ID NO: 22858 - DNA, 23 bp, Homo sapiens
ctggagagaaactacagaactgg

SEQ ID NO: 22859 - DNA, 23 bp, Homo sapiens
agacacaagagaattcatactgg

SEQ ID NO: 22860 - DNA, 23 bp, Homo sapiens
gatctccaaggtttgaactttgg

SEQ ID NO: 22861 - DNA, 23 bp, Homo sapiens
acttactatggattgaggattgg

SEQ ID NO: 22862 - DNA, 23 bp, Homo sapiens
taagaggattcatactggagagg

SEQ ID NO: 22863 - DNA, 23 bp, Homo sapiens
cttatgtctagtaaggtgtgagg

SEQ ID NO: 22864 - DNA, 23 bp, Homo sapiens
tgaagggctacatagtagcctgg

SEQ ID NO: 22865 - DNA, 23 bp, Homo sapiens
aaccagtcctcaaaccttactgg

SEQ ID NO: 22866 - DNA, 23 bp, Homo sapiens
aaggtgtgagcaccgattaaagg

SEQ ID NO: 22867 - DNA, 23 bp, Homo sapiens
gactcccctggtgatggggcagg

SEQ ID NO: 22868 - DNA, 23 bp, Homo sapiens
ccctatgaatgtaacagatgtgg

SEQ ID NO: 22869 - DNA, 23 bp, Homo sapiens
ggctcggcagggggctgttgggg

SEQ ID NO: 22870 - DNA, 23 bp, Homo sapiens
cttcgaggagtgcggctgagcgg

SEQ ID NO: 22871 - DNA, 23 bp, Homo sapiens
aggggcaacgcccattagaaggg

SEQ ID NO: 22872 - DNA, 23 bp, Homo sapiens
gcctatgagtatcaggaatatgg

SEQ ID NO: 22873 - DNA, 23 bp, Homo sapiens
aaatggggctctccttcagctgg

SEQ ID NO: 22874 - DNA, 23 bp, Homo sapiens
tggaggagagctcattgctgagg

SEQ ID NO: 22875 - DNA, 23 bp, Homo sapiens
gggtcttcaaagcagctcgatgg

SEQ ID NO: 22876 - DNA, 23 bp, Homo sapiens
gtacagcaagttgtgcagagtgg

SEQ ID NO: 22877 - DNA, 23 bp, Homo sapiens
gtgcatggcgccgagtgagccgg

SEQ ID NO: 22878 - DNA, 23 bp, Homo sapiens
agaagctgcacctgtgttagggg

SEQ ID NO: 22879 - DNA, 23 bp, Homo sapiens
tttgtcctgcctactttcgaagg

SEQ ID NO: 22880 - DNA, 23 bp, Homo sapiens
gggaacgtcagccatatggatgg

SEQ ID NO: 22881 - DNA, 23 bp, Homo sapiens
aagcttttaatcgtagctcaagg

SEQ ID NO: 22882 - DNA, 23 bp, Homo sapiens
ccatcagaagattcattctgggg

SEQ ID NO: 22883 - DNA, 23 bp, Homo sapiens
gggaaagcattcagctagcctgg

SEQ ID NO: 22884 - DNA, 23 bp, Homo sapiens
cgtcatcatagacttcatactgg

SEQ ID NO: 22885 - DNA, 23 bp, Homo sapiens
ggaggaagagctgtagttactgg

SEQ ID NO: 22886 - DNA, 23 bp, Homo sapiens
gcctgggggtctctcagtcgagg

SEQ ID NO: 22887 - DNA, 23 bp, Homo sapiens
atgttctctcatgtcatctaagg

SEQ ID NO: 22888 - DNA, 23 bp, Homo sapiens
gtgttctctcatgtcatctaagg

SEQ ID NO: 22889 - DNA, 23 bp, Homo sapiens
aaggttggaagacagactgaagg

SEQ ID NO: 22890 - DNA, 23 bp, Homo sapiens
ttagctgatgttcaggcataagg

SEQ ID NO: 22891 - DNA, 23 bp, Homo sapiens
acaggcacggggaggtgtagggg

SEQ ID NO: 22892 - DNA, 23 bp, Homo sapiens
acatttgtagggtttctctttgg

SEQ ID NO: 22893 - DNA, 23 bp, Homo sapiens
ttcatgtattcgaaaggaacggg

SEQ ID NO: 22894 - DNA, 23 bp, Homo sapiens
gcgctcaggtgtgaatccgcagg

SEQ ID NO: 22895 - DNA, 23 bp, Homo sapiens
gcgctatagcacattgtagtagg

SEQ ID NO: 22896 - DNA, 23 bp, Homo sapiens
attacataagagcctctttgtgg

SEQ ID NO: 22897 - DNA, 23 bp, Homo sapiens
agttatgtgctgctaaatgaagg

SEQ ID NO: 22898 - DNA, 23 bp, Homo sapiens
ggtgagcagatcgcgaggtcagg

SEQ ID NO: 22899 - DNA, 23 bp, Homo sapiens
actcataagaggattcatactgg

SEQ ID NO: 22900 - DNA, 23 bp, Homo sapiens
gatcacagctagtttgttactgg

SEQ ID NO: 22901 - DNA, 23 bp, Homo sapiens
aaatctgacgtagctgaggcagg

SEQ ID NO: 22902 - DNA, 23 bp, Homo sapiens
gagcctggtggagctccaggagg

SEQ ID NO: 22903 - DNA, 23 bp, Homo sapiens
cataagagaactcatactggagg

SEQ ID NO: 22904 - DNA, 23 bp, Homo sapiens
aggaaagagtgggaaagtgaggg

SEQ ID NO: 22905 - DNA, 23 bp, Homo sapiens
aagatttgcagactgtctaaagg

SEQ ID NO: 22906 - DNA, 23 bp, Homo sapiens
gtttagtaagggttgaggattgg

SEQ ID NO: 22907 - DNA, 23 bp, Homo sapiens
aggcaggcattttaaattactgg

SEQ ID NO: 22908 - DNA, 23 bp, Homo sapiens
cagtagtcaaatactcaggtagg

SEQ ID NO: 22909 - DNA, 23 bp, Homo sapiens
ccttacaagtgtgacgaatgtgg

SEQ ID NO: 22910 - DNA, 23 bp, Homo sapiens
tgtattcactctcacctacctgg

SEQ ID NO: 22911 - DNA, 23 bp, Homo sapiens
aaggtctgagaaccacctaaagg

SEQ ID NO: 22912 - DNA, 23 bp, Homo sapiens
cttatgagtagtaaggtgtgagg

SEQ ID NO: 22913 - DNA, 23 bp, Homo sapiens
ggcacattcttcacatttgtagg

SEQ ID NO: 22914 - DNA, 23 bp, Homo sapiens
ggcggttctcacaccttactagg

SEQ ID NO: 22915 - DNA, 23 bp, Homo sapiens
aaggtatgaggaccacttaaagg

SEQ ID NO: 22916 - DNA, 23 bp, Homo sapiens
taactgctcctcaactgtaaagg

SEQ ID NO: 22917 - DNA, 23 bp, Homo sapiens
aatgtggcaaagcatcgagctgg

SEQ ID NO: 22918 - DNA, 23 bp, Homo sapiens
agccaaacacccaggtaggtggg

SEQ ID NO: 22919 - DNA, 23 bp, Homo sapiens
ctctacccttactacacataagg

SEQ ID NO: 22920 - DNA, 23 bp, Homo sapiens
agcacatcatgttagtttcgagg

SEQ ID NO: 22921 - DNA, 23 bp, Homo sapiens
cgacgggcagttttctctatagg

SEQ ID NO: 22922 - DNA, 23 bp, Homo sapiens
cctgggacccaccgatggcgggg

SEQ ID NO: 22923 - DNA, 23 bp, Homo sapiens
cgccgggtctcctgggctgaagg

SEQ ID NO: 22924 - DNA, 23 bp, Homo sapiens
tattccaggaatgtgggtgacgg

SEQ ID NO: 22925 - DNA, 23 bp, Homo sapiens
atactggaaaaaggccttagtgg

SEQ ID NO: 22926 - DNA, 23 bp, Homo sapiens
gaacccggcgttaggacacccgg

SEQ ID NO: 22927 - DNA, 23 bp, Homo sapiens
ctggacaagcttctcttcacagg

SEQ ID NO: 22928 - DNA, 23 bp, Homo sapiens
gcacgtcttgcctgagtcccagg

SEQ ID NO: 22929 - DNA, 23 bp, Homo sapiens
tctagacaggagatcactttagg

SEQ ID NO: 22930 - DNA, 23 bp, Homo sapiens
catggtaactttcctcagtttgg

SEQ ID NO: 22931 - DNA, 23 bp, Homo sapiens
gagacaacagtgtcggagagtgg

SEQ ID NO: 22932 - DNA, 23 bp, Homo sapiens
gaagtctacgatggcatgtaagg

SEQ ID NO: 22933 - DNA, 23 bp, Homo sapiens
gaggaggatctcttgagctcagg

SEQ ID NO: 22934 - DNA, 23 bp, Homo sapiens
acacacctaagaatgcgctctgg

SEQ ID NO: 22935 - DNA, 23 bp, Homo sapiens
tattccaggagtgtgggtgacgg

SEQ ID NO: 22936 - DNA, 23 bp, Homo sapiens
taccatcatagacttcatactgg

SEQ ID NO: 22937 - DNA, 23 bp, Homo sapiens
tttgccaaactcagtttgtaagg

SEQ ID NO: 22938 - DNA, 23 bp, Homo sapiens
gcggcgggccggcgctgacctgg

SEQ ID NO: 22939 - DNA, 23 bp, Homo sapiens
gcacatgtgagaacacatgctgg

SEQ ID NO: 22940 - DNA, 23 bp, Homo sapiens
gaaagtggttgccttagattcgg

SEQ ID NO: 22941 - DNA, 23 bp, Homo sapiens
gagcgttgcccggagtgtgaggg

SEQ ID NO: 22942 - DNA, 23 bp, Homo sapiens
actggagaaaggccttaggatgg

SEQ ID NO: 22943 - DNA, 23 bp, Homo sapiens
aaacatcgaaggattcacactgg

SEQ ID NO: 22944 - DNA, 23 bp, Homo sapiens
tcttcactcacgtccctgttcgg

SEQ ID NO: 22945 - DNA, 23 bp, Homo sapiens
ataaaagatgcgctttctgacgg

SEQ ID NO: 22946 - DNA, 23 bp, Homo sapiens
ccaaggaggaggcgcgctagtgg

SEQ ID NO: 22947 - DNA, 23 bp, Homo sapiens
aaacatcaacgagttcacacggg

SEQ ID NO: 22948 - DNA, 23 bp, Homo sapiens
ccaggagttgaacatcagtcagg

SEQ ID NO: 22949 - DNA, 23 bp, Homo sapiens
cgcgcgctcactcgcccgtgtgg

SEQ ID NO: 22950 - DNA, 23 bp, Homo sapiens
cagtgtgaatttgagtgtgatgg

SEQ ID NO: 22951 - DNA, 23 bp, Homo sapiens
atttgagcgcctacattcatagg

SEQ ID NO: 22952 - DNA, 23 bp, Homo sapiens
gaacattcacacaggtgagaagg

SEQ ID NO: 22953 - DNA, 23 bp, Homo sapiens
aagttgctactgatgtctgaagg

SEQ ID NO: 22954 - DNA, 23 bp, Homo sapiens
tagatgtgcattatgcttgaagg

SEQ ID NO: 22955 - DNA, 23 bp, Homo sapiens
tatgcatacatttaatcccctgg

SEQ ID NO: 22956 - DNA, 23 bp, Homo sapiens
cggaaggaggagggctgacctgg

SEQ ID NO: 22957 - DNA, 23 bp, Homo sapiens
gtccctggtctgcagcctactgg

SEQ ID NO: 22958 - DNA, 23 bp, Homo sapiens
tatttcaagagtgtgggtgatgg

SEQ ID NO: 22959 - DNA, 23 bp, Homo sapiens
atagaggccgattggagttgagg

SEQ ID NO: 22960 - DNA, 23 bp, Homo sapiens
gcagcacccccgtctgttgaggg

SEQ ID NO: 22961 - DNA, 23 bp, Homo sapiens
cccccgggcccctcccctaccgg

SEQ ID NO: 22962 - DNA, 23 bp, Homo sapiens
ttcccacattgtttattcacagg

SEQ ID NO: 22963 - DNA, 23 bp, Homo sapiens
aagcaccagggcactcacaaagg

SEQ ID NO: 22964 - DNA, 23 bp, Homo sapiens
gccagagacgttcagcacagtgg

SEQ ID NO: 22965 - DNA, 23 bp, Homo sapiens
tcctggaggtcttacagatgagg

SEQ ID NO: 22966 - DNA, 23 bp, Homo sapiens
ctccacgccggagagtaactagg

SEQ ID NO: 22967 - DNA, 23 bp, Homo sapiens
tctgtgaatggacagactatggg

SEQ ID NO: 22968 - DNA, 23 bp, Homo sapiens
taaggatgtggacacactgaagg

SEQ ID NO: 22969 - DNA, 23 bp, Homo sapiens
ccaccctggggaggttccctagg

SEQ ID NO: 22970 - DNA, 23 bp, Homo sapiens
atgctcggaagaatgcctacagg

SEQ ID NO: 22971 - DNA, 23 bp, Homo sapiens
cgtatggatgtaaggaatgtggg

SEQ ID NO: 22972 - DNA, 23 bp, Homo sapiens
agcaaagtttctctcctatgtgg

SEQ ID NO: 22973 - DNA, 23 bp, Homo sapiens
cccacatcatttgcactcaaagg

SEQ ID NO: 22974 - DNA, 23 bp, Homo sapiens
aggccgaagtacaagatctaagg

SEQ ID NO: 22975 - DNA, 23 bp, Homo sapiens
tatggtgatgactagaagagagg

SEQ ID NO: 22976 - DNA, 23 bp, Homo sapiens
caagtgtgtggacacatttaagg

SEQ ID NO: 22977 - DNA, 23 bp, Homo sapiens
atcaggcaattcatggtataggg

SEQ ID NO: 22978 - DNA, 23 bp, Homo sapiens
gcatactgagaactgatttctgg

SEQ ID NO: 22979 - DNA, 23 bp, Homo sapiens
tgacaatcctcacactcatatgg

SEQ ID NO: 22980 - DNA, 23 bp, Homo sapiens
tcaagcaatccatgggtgtaggg

SEQ ID NO: 22981 - DNA, 23 bp, Homo sapiens
atttgccactctcattacattgg

SEQ ID NO: 22982 - DNA, 23 bp, Homo sapiens
gctgctgttctgctcttcaaagg

SEQ ID NO: 22983 - DNA, 23 bp, Homo sapiens
atagacataaaaggactcactgg

SEQ ID NO: 22984 - DNA, 23 bp, Homo sapiens
gccacactgtccccaccggtggg

SEQ ID NO: 22985 - DNA, 23 bp, Homo sapiens
cccaccggtgggctcaagtaagg

SEQ ID NO: 22986 - DNA, 23 bp, Homo sapiens
cgccatgagggaattcatactgg

SEQ ID NO: 22987 - DNA, 23 bp, Homo sapiens
cgtcatcagagatttcatgccgg

SEQ ID NO: 22988 - DNA, 23 bp, Homo sapiens
gtgaaaggggcattgttataggg

SEQ ID NO: 22989 - DNA, 23 bp, Homo sapiens
tcggtcttcatcgtcgctgctgg

SEQ ID NO: 22990 - DNA, 23 bp, Homo sapiens
ctcagctcttaatcttctgctgg

SEQ ID NO: 22991 - DNA, 23 bp, Homo sapiens
tagatgttctcctaacttctggg

SEQ ID NO: 22992 - DNA, 23 bp, Homo sapiens
ggctccctgcagtcaaggcgcgg

SEQ ID NO: 22993 - DNA, 23 bp, Homo sapiens
tctagaggaactccttctagcgg

SEQ ID NO: 22994 - DNA, 23 bp, Homo sapiens
ccttatcgatgcattgaatgtgg

SEQ ID NO: 22995 - DNA, 23 bp, Homo sapiens
aaattatttggggatcccagagg

SEQ ID NO: 22996 - DNA, 23 bp, Homo sapiens
tgcaggctttataggaaacatgg

SEQ ID NO: 22997 - DNA, 23 bp, Homo sapiens
gcacgctggttcttcagtgtcgg

SEQ ID NO: 22998 - DNA, 23 bp, Homo sapiens
agacataaaagggctcacactgg

SEQ ID NO: 22999 - DNA, 23 bp, Homo sapiens
ttacaaggactgaattgtgacgg

SEQ ID NO: 23000 - DNA, 23 bp, Homo sapiens
gttcacacacgaactcacactgg

SEQ ID NO: 23001 - DNA, 23 bp, Homo sapiens
ttacacatgcgaattcacactgg

SEQ ID NO: 23002 - DNA, 23 bp, Homo sapiens
catagaggaatacctgagagtgg

SEQ ID NO: 23003 - DNA, 23 bp, Homo sapiens
gtttagtaaggtttgaggactgg

SEQ ID NO: 23004 - DNA, 23 bp, Homo sapiens
aagctgtgtaagctgtttaaagg

SEQ ID NO: 23005 - DNA, 23 bp, Homo sapiens
ctggctcggtcatcttcttaagg

SEQ ID NO: 23006 - DNA, 23 bp, Homo sapiens
ccgcagacaaggcgctgtgaggg

SEQ ID NO: 23007 - DNA, 23 bp, Homo sapiens
gtggcaaggtcttcagttagagg

SEQ ID NO: 23008 - DNA, 23 bp, Homo sapiens
aggcccccgggatgtcctgaggg

SEQ ID NO: 23009 - DNA, 23 bp, Homo sapiens
cctcggtcaggcatccttcccgg

SEQ ID NO: 23010 - DNA, 23 bp, Homo sapiens
aagcatgtaaggactcacgctgg

SEQ ID NO: 23011 - DNA, 23 bp, Homo sapiens
acacatgagaattcatacagggg

SEQ ID NO: 23012 - DNA, 23 bp, Homo sapiens
ccacacacatttcatctgtacgg

SEQ ID NO: 23013 - DNA, 23 bp, Homo sapiens
ccctatcaatgtactaagtgtgg

SEQ ID NO: 23014 - DNA, 23 bp, Homo sapiens
atcaggcaatccatggtgtaggg

SEQ ID NO: 23015 - DNA, 23 bp, Homo sapiens
tccacattcataacacttacagg

SEQ ID NO: 23016 - DNA, 23 bp, Homo sapiens
agcctacatagtgaagaacatgg

SEQ ID NO: 23017 - DNA, 23 bp, Homo sapiens
ctactttgggaggccgaggcggg

SEQ ID NO: 23018 - DNA, 23 bp, Homo sapiens
aaaccctgcaaacatgaatgtgg

SEQ ID NO: 23019 - DNA, 23 bp, Homo sapiens
ctcatgtctactaaggcttgagg

SEQ ID NO: 23020 - DNA, 23 bp, Homo sapiens
gccgcattcttcacacttgtagg

SEQ ID NO: 23021 - DNA, 23 bp, Homo sapiens
aatgtggtaaagcttttcagtgg

SEQ ID NO: 23022 - DNA, 23 bp, Homo sapiens
ggagatccaggggatgatgtagg

SEQ ID NO: 23023 - DNA, 23 bp, Homo sapiens
tggggacccaccaggagaccagg

SEQ ID NO: 23024 - DNA, 23 bp, Homo sapiens
gaggagctccctagctgaacggg

SEQ ID NO: 23025 - DNA, 23 bp, Homo sapiens
cagaatgaggagtcttaagatgg

SEQ ID NO: 23026 - DNA, 23 bp, Homo sapiens
caaaaattggttgggcgtagtgg

SEQ ID NO: 23027 - DNA, 23 bp, Homo sapiens
taccaaaaccgtaaagcctgtgg

SEQ ID NO: 23028 - DNA, 23 bp, Homo sapiens
agtgaatctaccaagaacgttgg

SEQ ID NO: 23029 - DNA, 23 bp, Homo sapiens
gtcaagagtcttccttctcctgg

SEQ ID NO: 23030 - DNA, 23 bp, Homo sapiens
aagcccgcaggtcagtccgcagg

SEQ ID NO: 23031 - DNA, 23 bp, Homo sapiens
gaagctgacgcttaatctgaagg

SEQ ID NO: 23032 - DNA, 23 bp, Homo sapiens
tcctcctgagctcaggctcccgg

SEQ ID NO: 23033 - DNA, 23 bp, Homo sapiens
gccctagatctttactgaccagg

SEQ ID NO: 23034 - DNA, 23 bp, Homo sapiens
gaaagcaacagacagtgaatggg

SEQ ID NO: 23035 - DNA, 23 bp, Homo sapiens
tctactacctgtacgagaaaagg

SEQ ID NO: 23036 - DNA, 23 bp, Homo sapiens
ttttattcggaagcagacacagg

SEQ ID NO: 23037 - DNA, 23 bp, Homo sapiens
ctgtttcttgacagccaagtagg

SEQ ID NO: 23038 - DNA, 23 bp, Homo sapiens
tgcaatagcagcctggtgtatgg

SEQ ID NO: 23039 - DNA, 23 bp, Homo sapiens
tgggcaagatttagctccatagg

SEQ ID NO: 23040 - DNA, 23 bp, Homo sapiens
tgttatagtcagtcaaagactgg

SEQ ID NO: 23041 - DNA, 23 bp, Homo sapiens
gccacccactgctaccgttgcgg

SEQ ID NO: 23042 - DNA, 23 bp, Homo sapiens
gtctgatggagaggaagatgagg

SEQ ID NO: 23043 - DNA, 23 bp, Homo sapiens
aacttgaacgggaaccagaatgg

SEQ ID NO: 23044 - DNA, 23 bp, Homo sapiens
tagtgttttcaccaatcacctgg

SEQ ID NO: 23045 - DNA, 23 bp, Homo sapiens
atcagacatcacacgatttttgg

SEQ ID NO: 23046 - DNA, 23 bp, Homo sapiens
agtcgtggcaggaggaggtcggg

SEQ ID NO: 23047 - DNA, 23 bp, Homo sapiens
ggcccacggccacatgtgaatgg

SEQ ID NO: 23048 - DNA, 23 bp, Homo sapiens
cgcgagacgctgtactagcttgg

SEQ ID NO: 23049 - DNA, 23 bp, Homo sapiens
caacatcagactatccacaaagg

SEQ ID NO: 23050 - DNA, 23 bp, Homo sapiens
gctgggaaaccacaaaggaatgg

SEQ ID NO: 23051 - DNA, 23 bp, Homo sapiens
accacaaaggaatggtaagcagg

SEQ ID NO: 23052 - DNA, 23 bp, Homo sapiens
agagctgaacttactcggaaagg

SEQ ID NO: 23053 - DNA, 23 bp, Homo sapiens
ccgcacccccagaggcgcagagg

SEQ ID NO: 23054 - DNA, 23 bp, Homo sapiens
aaatgccccgagtgtggcaaagg

SEQ ID NO: 23055 - DNA, 23 bp, Homo sapiens
ggctgcaactggaatcacacagg

SEQ ID NO: 23056 - DNA, 23 bp, Homo sapiens
tccagaagttcattacaaactgg

SEQ ID NO: 23057 - DNA, 23 bp, Homo sapiens
caggagggaaggcgtcgtagggg

SEQ ID NO: 23058 - DNA, 23 bp, Homo sapiens
cagcgagtccacactggagaggg

SEQ ID NO: 23059 - DNA, 23 bp, Homo sapiens
catcacggtgctgcaatgaccgg

SEQ ID NO: 23060 - DNA, 23 bp, Homo sapiens
tcctttggtgctgagtcaggtgg

SEQ ID NO: 23061 - DNA, 23 bp, Homo sapiens
agctagcttgattcagccactgg

SEQ ID NO: 23062 - DNA, 23 bp, Homo sapiens
ccccacaggaagacctgaaaggg

SEQ ID NO: 23063 - DNA, 23 bp, Homo sapiens
agacattgtggaagccattctgg

SEQ ID NO: 23064 - DNA, 23 bp, Homo sapiens
tgctatgctcactgcaccagcgg

SEQ ID NO: 23065 - DNA, 23 bp, Homo sapiens
aaagacaaactggcttgatgagg

SEQ ID NO: 23066 - DNA, 23 bp, Homo sapiens
tatatcctcaggggcttacttgg

SEQ ID NO: 23067 - DNA, 23 bp, Homo sapiens
ttacccacagagttaaactctgg

SEQ ID NO: 23068 - DNA, 23 bp, Homo sapiens
acactggagagagaccataaggg

SEQ ID NO: 23069 - DNA, 23 bp, Homo sapiens
gcagtactctcatcacaggaagg

SEQ ID NO: 23070 - DNA, 23 bp, Homo sapiens
ccagcagcttaggaagcttctgg

SEQ ID NO: 23071 - DNA, 23 bp, Homo sapiens
aatcactgagaagtagcttctgg

SEQ ID NO: 23072 - DNA, 23 bp, Homo sapiens
ggacctgactctggaatcactgg

SEQ ID NO: 23073 - DNA, 23 bp, Homo sapiens
acagtggctgagctggtctaggg

SEQ ID NO: 23074 - DNA, 23 bp, Homo sapiens
gcatcgagaataatcagagttgg

SEQ ID NO: 23075 - DNA, 23 bp, Homo sapiens
gtatttacagagtgagacacagg

SEQ ID NO: 23076 - DNA, 23 bp, Homo sapiens
taatgcatcacagctgtagcagg

SEQ ID NO: 23077 - DNA, 23 bp, Homo sapiens
tgcgggagcgttttggttgaggg

SEQ ID NO: 23078 - DNA, 23 bp, Homo sapiens
ctgctggtgcgagagcgctttgg

SEQ ID NO: 23079 - DNA, 23 bp, Homo sapiens
atgttggttcgggagaggtttgg

SEQ ID NO: 23080 - DNA, 23 bp, Homo sapiens
agagacacttagctgctgacagg

SEQ ID NO: 23081 - DNA, 23 bp, Homo sapiens
cctaagggtgaaagactcagggg

SEQ ID NO: 23082 - DNA, 23 bp, Homo sapiens
ggtggcctctggtatttatttgg

SEQ ID NO: 23083 - DNA, 23 bp, Homo sapiens
ggcatgaagggtcagggctctgg

SEQ ID NO: 23084 - DNA, 23 bp, Homo sapiens
gacttgagaagcttgtctcctgg

SEQ ID NO: 23085 - DNA, 23 bp, Homo sapiens
tctttctgtgttctgaaacaagg

SEQ ID NO: 23086 - DNA, 23 bp, Homo sapiens
cacttcacttgaaatgcacctgg

SEQ ID NO: 23087 - DNA, 23 bp, Homo sapiens
ggcaaatttacatctccagcagg

SEQ ID NO: 23088 - DNA, 23 bp, Homo sapiens
tgtgactggcagctcatttttgg

SEQ ID NO: 23089 - DNA, 23 bp, Homo sapiens
acctgcaggatctgcagtgacgg

SEQ ID NO: 23090 - DNA, 23 bp, Homo sapiens
aggcactggcaacttctatttgg

SEQ ID NO: 23091 - DNA, 23 bp, Homo sapiens
tgaaattccttaggttcagaagg

SEQ ID NO: 23092 - DNA, 23 bp, Homo sapiens
gctatcaatttagtctggcttgg

SEQ ID NO: 23093 - DNA, 23 bp, Homo sapiens
ggcctgtcctcactcaggtctgg

SEQ ID NO: 23094 - DNA, 23 bp, Homo sapiens
ggccacccgcctctggaatgtgg

SEQ ID NO: 23095 - DNA, 23 bp, Homo sapiens
tttccagcaaacagatgacatgg

SEQ ID NO: 23096 - DNA, 30 bp, Homo sapiens
ccctgggcactgtcactgcttgcagcctga

SEQ ID NO: 23097 - DNA, 30 bp, Homo sapiens; identical to SEQ ID NO: 23096

SEQ ID NO: 23098 - DNA, 30 bp, Homo sapiens
ggagctccacagggtcgctgagctccgatt

SEQ ID NO: 23099 - DNA, 30 bp, Homo sapiens
ccatcccctcgggcagtcactgcaaaagtt

SEQ ID NO: 23100 - DNA, 30 bp, Homo sapiens
cgtagtaatcatagactttcactatggctg

SEQ ID NO: 23101 - DNA, 30 bp, Homo sapiens
tcacagggatcagaatactgaattgttgcc

SEQ ID NO: 23102 - DNA, 30 bp, Homo sapiens
cagccggtaccccttgggcgcccacagcag

SEQ ID NO: 23103 - DNA, 30 bp, Homo sapiens
aagtacattttcatggcctcgtgcgtcgtg

SEQ ID NO: 23104 - DNA, 30 bp, Homo sapiens
cccagctccccagtcactgacccctctggg

SEQ ID NO: 23105 - DNA, 30 bp, Homo sapiens
atgtggggagtggggcagaacaggtggtgg

SEQ ID NO: 23106 - DNA, 30 bp, Homo sapiens
agctcagggatgtcccggtacagatccagg

SEQ ID NO: 23107 - DNA, 30 bp, Homo sapiens
tcccggtacagatccagggtctcggggttc

SEQ ID NO: 23108 - DNA, 30 bp, Homo sapiens
gccactcaatatactgatttataagtctgt

SEQ ID NO: 23109 - DNA, 30 bp, Homo sapiens
aacttacatacatatctcttatcctaagac

SEQ ID NO: 23110 - DNA, 30 bp, Homo sapiens
tcatggagcagggaaagtgcaagaagctca

SEQ ID NO: 23111 - DNA, 30 bp, Homo sapiens
ttcagggaacatgggaaagagagagccttc

SEQ ID NO: 23112 - DNA, 30 bp, Homo sapiens
ggaaggccacatccatctgttctggagaag

SEQ ID NO: 23113 - DNA, 30 bp, Homo sapiens
acatggataactgaaggtctgtttgtaaag

SEQ ID NO: 23114 - DNA, 30 bp, Homo sapiens
gaaaggccttcaatttcatctctgtctccc

SEQ ID NO: 23115 - DNA, 30 bp, Homo sapiens
tacaggtctatgagctgatccaccagcagt

SEQ ID NO: 23116 - DNA, 30 bp, Homo sapiens
tgatggcatcatagatttgatacaaaaaag

SEQ ID NO: 23117 - DNA, 30 bp, Homo sapiens
cacagacatgtttgatgctcagtccagctc

SEQ ID NO: 23118 - DNA, 30 bp, Homo sapiens
agcaggtggaatggaagacacctcccaccc

SEQ ID NO: 23119 - DNA, 30 bp, Homo sapiens
taacggtcaggcctttggacacaaaatact

SEQ ID NO: 23120 - DNA, 30 bp, Homo sapiens
cagcagccgctgttcctgcgcaggaagggg

SEQ ID NO: 23121 - DNA, 30 bp, Homo sapiens
tagcccatctcgatgccctcagggagctcc

SEQ ID NO: 23122 - DNA, 30 bp, Homo sapiens
ttccggattcgcagcatcatcttttgggct

SEQ ID NO: 23123 - DNA, 30 bp, Homo sapiens
cagttctttacatccccgaggcgcagctgg

SEQ ID NO: 23124 - DNA, 30 bp, Homo sapiens
agctggctgagggcataggtttgggctata

SEQ ID NO: 23125 - DNA, 30 bp, Homo sapiens
ctccttagcactctgcgtgctgatgtagtc

SEQ ID NO: 23126 - DNA, 30 bp, Homo sapiens
aataaatccagacaataaacataattatct

SEQ ID NO: 23127 - DNA, 30 bp, Homo sapiens
gtgaggtacacggggatgaaaagattggtc

SEQ ID NO: 23128 - DNA, 30 bp, Homo sapiens
acaataaagtttccacacttagatacacat

SEQ ID NO: 23129 - DNA, 30 bp, Homo sapiens
atgaaggatcttcaggtgtcatgggaacgg

SEQ ID NO: 23130 - DNA, 30 bp, Homo sapiens
gctttaattcgctccaatattggtccatag

SEQ ID NO: 23131 - DNA, 30 bp, Homo sapiens
ccgtggccttcgtcgggagggtggagctgg

SEQ ID NO: 23132 - DNA, 30 bp, Homo sapiens
tactctcacccccggcaccagcttcaggtc

SEQ ID NO: 23133 - DNA, 30 bp, Homo sapiens
gcgtggtgatccctgaagaccagcgtggga

SEQ ID NO: 23134 - DNA, 30 bp, Homo sapiens
gaaaagatgtgagaactgcaacgtccacta

SEQ ID NO: 23135 - DNA, 30 bp, Homo sapiens
ctgtgggagaagtttccattcaactgttgt

SEQ ID NO: 23136 - DNA, 30 bp, Homo sapiens
atctggtcatcttgtgagtcaacacttata

SEQ ID NO: 23137 - DNA, 30 bp, Homo sapiens
agatgggcaagtgatgtgtgtggtgactgt

SEQ ID NO: 23138 - DNA, 30 bp, Homo sapiens
tgaaggacagctgggcccgctcctcctcga

SEQ ID NO: 23139 - DNA, 30 bp, Homo sapiens
atcgcccctcctctgcggtgggcggctgca

SEQ ID NO: 23140 - DNA, 30 bp, Homo sapiens
cttgtcgactggctccagcagctcgagggt

SEQ ID NO: 23141 - DNA, 30 bp, Homo sapiens
aaagtgtgctgtttaaagttccacaactat

SEQ ID NO: 23142 - DNA, 30 bp, Homo sapiens
gggaggagtttccatctcattgttgtatca

SEQ ID NO: 23143 - DNA, 30 bp, Homo sapiens
tctcggcagtgctagggtcatcgaggaact

SEQ ID NO: 23144 - DNA, 30 bp, Homo sapiens
tcctgggggaggagcttccacttcactgag

SEQ ID NO: 23145 - DNA, 30 bp, Homo sapiens
tgcaggaggagtttccacttcaccgaggga

SEQ ID NO: 23146 - DNA, 30 bp, Homo sapiens
cactggcgctttgttccagcctggacactg

SEQ ID NO: 23147 - DNA, 30 bp, Homo sapiens
tggttttgaaagcagctcttcatgttttcc

SEQ ID NO: 23148 - DNA, 30 bp, Homo sapiens
tgatgggggatccagtggtgactagtttgt

SEQ ID NO: 23149 - DNA, 30 bp, Homo sapiens
gcctggacactgaccattgaaaaatagatg

SEQ ID NO: 23150 - DNA, 30 bp, Homo sapiens
cagcttgaacagctgacttgctttctgaat

SEQ ID NO: 23151 - DNA, 30 bp, Homo sapiens
ctgggggtatccttctccagtgcagcttga

SEQ ID NO: 23152 - DNA, 30 bp, Homo sapiens
tctttccattgtgcagaaccactatcaaat

SEQ ID NO: 23153 - DNA, 30 bp, Homo sapiens
ccatggtctgaggcttagtgtcttcagagg

SEQ ID NO: 23154 - DNA, 30 bp, Homo sapiens
cctttcacactattgacaatttcttcttgt

SEQ ID NO: 23155 - DNA, 30 bp, Homo sapiens
caggacttgtgctggtggctcctggggcct

SEQ ID NO: 23156 - DNA, 30 bp, Homo sapiens
cgctggtggcttcatccaggatgaggactg

SEQ ID NO: 23157 - DNA, 30 bp, Homo sapiens
caggccttgtgactgccgttggctacaggc

SEQ ID NO: 23158 - DNA, 30 bp, Homo sapiens
agccggcgtctttggccatgctgtagaaaa

SEQ ID NO: 23159 - DNA, 30 bp, Homo sapiens
agtgaggcagggactccctgctggctgctc

SEQ ID NO: 23160 - DNA, 30 bp, Homo sapiens
ctcagtgaagaagtggctgtggccatgagg

SEQ ID NO: 23161 - DNA, 30 bp, Homo sapiens
caatctgacttctgctgctagtaacatcgc

SEQ ID NO: 23162 - DNA, 30 bp, Homo sapiens
tccttagccataaagtaaaagggtccaggg

SEQ ID NO: 23163 - DNA, 30 bp, Homo sapiens
agccctggccatgcctgggcacccagagcc

SEQ ID NO: 23164 - DNA, 30 bp, Homo sapiens
tctctggccatcccgtagaagatgcctcta

SEQ ID NO: 23165 - DNA, 30 bp, Homo sapiens
aggacaacacagcgagatcccatctctgga

SEQ ID NO: 23166 - DNA, 30 bp, Homo sapiens
ttaaggtcgagggctgtccattggaagtgt

SEQ ID NO: 23167 - DNA, 30 bp, Homo sapiens
acagcgaccttgttctctgcagcagcaaac

SEQ ID NO: 23168 - DNA, 30 bp, Homo sapiens
aatacagccatcctgaaaatttggtccact

SEQ ID NO: 23169 - DNA, 30 bp, Homo sapiens
accaggttccagcctgtcccctgcctcccc

SEQ ID NO: 23170 - DNA, 30 bp, Homo sapiens
accaggcctgactcctgggccagtctgtaa

SEQ ID NO: 23171 - DNA, 30 bp, Homo sapiens
gcacggacgaaggaggcgaagacgctgtcc

SEQ ID NO: 23172 - DNA, 30 bp, Homo sapiens
aagtggaaaagaggccattcttgtgggcga

SEQ ID NO: 23173 - DNA, 30 bp, Homo sapiens
catgtctgcgcgaacaaaagaagcaaatac

SEQ ID NO: 23174 - DNA, 30 bp, Homo sapiens
aggtggaggcaccctggaggccaccagggc

SEQ ID NO: 23175 - DNA, 30 bp, Homo sapiens
ttttgggaattccagctagctgagattcta

SEQ ID NO: 23176 - DNA, 30 bp, Homo sapiens
ctccaattgcactcgttaacttaaagatat

SEQ ID NO: 23177 - DNA, 30 bp, Homo sapiens
tcaactgtatcttctgttatctgtttgaat

SEQ ID NO: 23178 - DNA, 30 bp, Homo sapiens
cactggtggcttcatcaagcactgcgtact

SEQ ID NO: 23179 - DNA, 30 bp, Homo sapiens
caggccatccttgtgagcacgggtaccttc

SEQ ID NO: 23180 - DNA, 30 bp, Homo sapiens
tgattctcatcagctcccatcttcctcctc

SEQ ID NO: 23181 - DNA, 30 bp, Homo sapiens
gtttggatctcttctgaatgtaatttcaag

SEQ ID NO: 23182 - DNA, 30 bp, Homo sapiens
tctcggggccggctgaccatgacttcaccc

SEQ ID NO: 23183 - DNA, 30 bp, Homo sapiens
ttgtgggtcctcttggtgagctggggctcc

SEQ ID NO: 23184 - DNA, 30 bp, Homo sapiens
ccttggcagagatgccaatgtcagggtgca

SEQ ID NO: 23185 - DNA, 30 bp, Homo sapiens
tagaggaagccttcgcggcggaactgttcc

SEQ ID NO: 23186 - DNA, 30 bp, Homo sapiens
tgcccggattttgtacctgaggacaaaata

SEQ ID NO: 23187 - DNA, 30 bp, Homo sapiens
attcttcgccagtacatgttgcatagttac

SEQ ID NO: 23188 - DNA, 30 bp, Homo sapiens
gtgaggaaaataacaatcatacaagccaag

SEQ ID NO: 23189 - DNA, 30 bp, Homo sapiens
tctctctgacttgacccggtaacgcagcac

SEQ ID NO: 23190 - DNA, 30 bp, Homo sapiens
aatgagatgatcccttattttgaaaacaac

SEQ ID NO: 23191 - DNA, 30 bp, Homo sapiens
ttgacttggtttctgtttgatgaaccttaa

SEQ ID NO: 23192 - DNA, 30 bp, Homo sapiens
agaaggtaagagagccctgaggtcaggcag

SEQ ID NO: 23193 - DNA, 30 bp, Homo sapiens
caggaagctgattaaactttgtcactaagg

SEQ ID NO: 23194 - DNA, 30 bp, Homo sapiens
attcggtgatcactgtgttttcggaggatg

SEQ ID NO: 23195 - DNA, 30 bp, Homo sapiens
gggtggtggctgggacctctgtagtgccag

SEQ ID NO: 23196 - DNA, 30 bp, Homo sapiens
gggtatatactgaatgggaggaggccccag

SEQ ID NO: 23197 - DNA, 30 bp, Homo sapiens
accaggaagcctcggatggcagctatgaag

SEQ ID NO: 23198 - DNA, 30 bp, Homo sapiens
tgctggtgctcaggctccgacttccccagg

SEQ ID NO: 23199 - DNA, 30 bp, Homo sapiens
ctgaccacatgctgggatctgggctggaac

SEQ ID NO: 23200 - DNA, 30 bp, Homo sapiens
cttgctcaggaaatctctcacggttattaa

SEQ ID NO: 23201 - DNA, 30 bp, Homo sapiens
cttcaggagaatggctctttacgacttctt

SEQ ID NO: 23202 - DNA, 30 bp, Homo sapiens
agatggtcaaggaaggcaagcaggacaagg

SEQ ID NO: 23203 - DNA, 30 bp, Homo sapiens
cactggagcccctgcaggaagtccagcagc

SEQ ID NO: 23204 - DNA, 30 bp, Homo sapiens
gtatgatcgcttccagttaaagatctcctc

SEQ ID NO: 23205 - DNA, 30 bp, Homo sapiens
tagaggtgccagggcatctggaagttctgg

SEQ ID NO: 23206 - DNA, 30 bp, Homo sapiens
gccagggcaactgaaactcctcaggctcca

SEQ ID NO: 23207 - DNA, 30 bp, Homo sapiens
ggcgcgctggctgggcagctcctgggagat

SEQ ID NO: 23208 - DNA, 30 bp, Homo sapiens
cctgtgacacaaactgtttcaacctttcaa

SEQ ID NO: 23209 - DNA, 30 bp, Homo sapiens
attaggaagttcgtgagatatgaactgttt

SEQ ID NO: 23210 - DNA, 30 bp, Homo sapiens
tggaggaagcggtcaaatgcatcatagatg

SEQ ID NO: 23211 - DNA, 30 bp, Homo sapiens
tccaggtcggcctccacctgctccgtgtca

SEQ ID NO: 23212 - DNA, 30 bp, Homo sapiens
tcaaccatggcttgcacaaattgcttgaag

SEQ ID NO: 23213 - DNA, 30 bp, Homo sapiens
ccacagcattgaagatgtgtggctggtcag

SEQ ID NO: 23214 - DNA, 30 bp, Homo sapiens
tgtcgcagatctcctttactttctggttga

SEQ ID NO: 23215 - DNA, 30 bp, Homo sapiens
tccagcttcttgttgttgtctgtgttgtgc

SEQ ID NO: 23216 - DNA, 30 bp, Homo sapiens
ttctggaggcgccggcagtggctccggtag

SEQ ID NO: 23217 - DNA, 30 bp, Homo sapiens
cccagggaacagaccagtcactcgattgca

SEQ ID NO: 23218 - DNA, 30 bp, Homo sapiens
cccaggaaaaagcccagtcactccattcat

SEQ ID NO: 23219 - DNA, 30 bp, Homo sapiens
agctgggctccacatagttcccagggaaga

SEQ ID NO: 23220 - DNA, 30 bp, Homo sapiens
tccaggaattgtagtcccacattcatacca

SEQ ID NO: 23221 - DNA, 30 bp, Homo sapiens
cactatgtcactgatttccttcaccgaact

SEQ ID NO: 23222 - DNA, 30 bp, Homo sapiens
caccacatcactgatttcctgtacacatga

SEQ ID NO: 23223 - DNA, 30 bp, Homo sapiens
gattggcacaatgtaggagaacttcagaaa

SEQ ID NO: 23224 - DNA, 30 bp, Homo sapiens
aagaggtaacctgtcaaactcctgtatgga

SEQ ID NO: 23225 - DNA, 30 bp, Homo sapiens
acgtgagtgaaagctgtcccctgccatcct

SEQ ID NO: 23226 - DNA, 30 bp, Homo sapiens
gaacaaaagggctttcttcttaaggtcatt

SEQ ID NO: 23227 - DNA, 30 bp, Homo sapiens
acagccgggcttgcttcttcagttcattcc

SEQ ID NO: 23228 - DNA, 30 bp, Homo sapiens
aacgggtcctgtctacatccttgggcagtc

SEQ ID NO: 23229 - DNA, 30 bp, Homo sapiens
cacgggttccggaccgcctggtggttcttg

SEQ ID NO: 23230 - DNA, 30 bp, Homo sapiens
cgtcggtggagaagtacagtgtgttccgct

SEQ ID NO: 23231 - DNA, 30 bp, Homo sapiens
cctccccttgccctcttgctcccagactcc

SEQ ID NO: 23232 - DNA, 30 bp, Homo sapiens
acatggtcatctcggccttgccatagcatc

SEQ ID NO: 23233 - DNA, 30 bp, Homo sapiens
agaagcagctctcctggatatgttacaatc

SEQ ID NO: 23234 - DNA, 30 bp, Homo sapiens
atattcaccaaaacccttcatcttttcaat

SEQ ID NO: 23235 - DNA, 30 bp, Homo sapiens
tcctggggtcctcgtcgggatgtgccatgg

SEQ ID NO: 23236 - DNA, 30 bp, Homo sapiens
ggagtccctgacaagggaaggtccctccat

SEQ ID NO: 23237 - DNA, 30 bp, Homo sapiens
cgatggacacgagcaggtcctcgagtgccc

SEQ ID NO: 23238 - DNA, 30 bp, Homo sapiens
acccgggaggtgatgtagacagagtgcacg

SEQ ID NO: 23239 - DNA, 30 bp, Homo sapiens
cccagggtattcaaagacggcagcggctcc

SEQ ID NO: 23240 - DNA, 30 bp, Homo sapiens
ccttggccacctccaatgcaagctgatcca

SEQ ID NO: 23241 - DNA, 30 bp, Homo sapiens
acgtggaaggggaatccattgtggagagga

SEQ ID NO: 23242 - DNA, 30 bp, Homo sapiens
aggtggaggccgggctgtccatggtagaca

SEQ ID NO: 23243 - DNA, 30 bp, Homo sapiens
atgcggtgcttcagctctagcttggccacc

SEQ ID NO: 23244 - DNA, 30 bp, Homo sapiens
tatatcttggctgtcagtcttttggcttgg

SEQ ID NO: 23245 - DNA, 30 bp, Homo sapiens
agcaggcttctagagatcagtatcctcatc

SEQ ID NO: 23246 - DNA, 30 bp, Homo sapiens
catgtcctgtccagagggtgggcacagata

SEQ ID NO: 23247 - DNA, 30 bp, Homo sapiens
tagattggctgaactctggcatccacataa

SEQ ID NO: 23248 - DNA, 30 bp, Homo sapiens
tcacgggctacaataagtctttgaatttgt

SEQ ID NO: 23249 - DNA, 30 bp, Homo sapiens
ctccggtagctcctgagcagatgcccggcg

SEQ ID NO: 23250 - DNA, 30 bp, Homo sapiens
caatggtgttcaactggatgttggaagctc

SEQ ID NO: 23251 - DNA, 30 bp, Homo sapiens
aagtgggttgctggtgaccacaccaccccg

SEQ ID NO: 23252 - DNA, 30 bp, Homo sapiens
cagtgggctgtgctggggcggctcctccga

SEQ ID NO: 23253 - DNA, 30 bp, Homo sapiens
gtgtggaggtcatgactgcgacggctcagc

SEQ ID NO: 23254 - DNA, 30 bp, Homo sapiens
tgctggaaacgatttagtttctctggatta

SEQ ID NO: 23255 - DNA, 30 bp, Homo sapiens
ctctcttccaggtggaggctgatgaactcc

SEQ ID NO: 23256 - DNA, 30 bp, Homo sapiens
gcatggcagaagcacctcctcctccattgc

SEQ ID NO: 23257 - DNA, 30 bp, Homo sapiens
ccacccccaatgcacagggctgcaacacca

SEQ ID NO: 23258 - DNA, 30 bp, Homo sapiens
caaagagtaggagttgtcaaacttgaggag

SEQ ID NO: 23259 - DNA, 30 bp, Homo sapiens
ttttgggtccgaaacattcggaagagccac

SEQ ID NO: 23260 - DNA, 30 bp, Homo sapiens
cctaggaaggctcagggcacagcaagatag

SEQ ID NO: 23261 - DNA, 30 bp, Homo sapiens
cactccagtctgaccgacagagtgagactg

SEQ ID NO: 23262 - DNA, 30 bp, Homo sapiens
actgtgcaataaaaggccatatgatggcaa

SEQ ID NO: 23263 - DNA, 30 bp, Homo sapiens
aggaggacctctgtgaagaggggcatttga

SEQ ID NO: 23264 - DNA, 30 bp, Homo sapiens
cagttgtgtgccgctgcagcaccaaagaaa

SEQ ID NO: 23265 - DNA, 30 bp, Homo sapiens
atcaggagttccagaccagcctgggcaaca

SEQ ID NO: 23266 - DNA, 30 bp, Homo sapiens
cacctgcgttggtcacttggctcctggctc

SEQ ID NO: 23267 - DNA, 30 bp, Homo sapiens
ccctcattgcatcctccaactgcttcacta

SEQ ID NO: 23268 - DNA, 30 bp, Homo sapiens
catcggagttggctcagaccctggctgtgc

SEQ ID NO: 23269 - DNA, 30 bp, Homo sapiens
gagtgtctcagctccacctcggagccgaac

SEQ ID NO: 23270 - DNA, 30 bp, Homo sapiens
ttttggaatcctggattattttctcctttg

SEQ ID NO: 23271 - DNA, 30 bp, Homo sapiens
catcaccccggatttccacgtagggcagcc

SEQ ID NO: 23272 - DNA, 30 bp, Homo sapiens
cgtgatcttgactgatgatttcttgttggc

SEQ ID NO: 23273 - DNA, 30 bp, Homo sapiens
cgcccggcccattatttttaaatagttaga

SEQ ID NO: 23274 - DNA, 30 bp, Homo sapiens
gagaggctcaaacaggatcactggccagat

SEQ ID NO: 23275 - DNA, 30 bp, Homo sapiens
cgccggaggtgggagaggaagaggaggaga

SEQ ID NO: 23276 - DNA, 30 bp, Homo sapiens
cacaggtctgagcagcgatcctgcttgctg

SEQ ID NO: 23277 - DNA, 30 bp, Homo sapiens
tagcggcgcccaccccggtcccgcacaggt

SEQ ID NO: 23278 - DNA, 30 bp, Homo sapiens
ccaagggtgtccagatgagaagaccatcct

SEQ ID NO: 23279 - DNA, 30 bp, Homo sapiens
atcctccttgttagggtagttctcagactg

SEQ ID NO: 23280 - DNA, 30 bp, Homo sapiens
atttggtgctctgctccaaggcagagtact

SEQ ID NO: 23281 - DNA, 30 bp, Homo sapiens
tgtaggaccctcagaatcaaaaggaaactc

SEQ ID NO: 23282 - DNA, 30 bp, Homo sapiens
ttccggaagaacatatgaaatatcatccca

SEQ ID NO: 23283 - DNA, 30 bp, Homo sapiens
aatgccagggcattgccggctttgagttta

SEQ ID NO: 23284 - DNA, 30 bp, Homo sapiens
acttggccatcttgcggatcatgtagttga

SEQ ID NO: 23285 - DNA, 30 bp, Homo sapiens
ctgttgcagttccttcattctgttgagggc

SEQ ID NO: 23286 - DNA, 30 bp, Homo sapiens
gagagatttgtgatagaattattacatgct

SEQ ID NO: 23287 - DNA, 30 bp, Homo sapiens
tagagggtctggaggctgggggccagatca

SEQ ID NO: 23288 - DNA, 30 bp, Homo sapiens
aatcggctgttgattttggccacggggatt

SEQ ID NO: 23289 - DNA, 30 bp, Homo sapiens
atcaggaggattctctaagaactgtataca

SEQ ID NO: 23290 - DNA, 30 bp, Homo sapiens
cccaggtgttttgtgtgtcttccttgtgct

SEQ ID NO: 23291 - DNA, 30 bp, Homo sapiens
tcgtggccacccaagtgtttgtggaagaaa

SEQ ID NO: 23292 - DNA, 30 bp, Homo sapiens
ttctgggtacctcccaggtgtttgcagaag

SEQ ID NO: 23293 - DNA, 30 bp, Homo sapiens
gccaggcatctacctgtgcctttgagtgag

SEQ ID NO: 23294 - DNA, 30 bp, Homo sapiens
ctgaggctccgcgtggccctgtcgcttcgc

SEQ ID NO: 23295 - DNA, 30 bp, Homo sapiens
acctggggcttcactcggatcacgccctcc

SEQ ID NO: 23296 - DNA, 30 bp, Homo sapiens
acaaggtagtcctttctcaaggtcgctggg

SEQ ID NO: 23297 - DNA, 30 bp, Homo sapiens
gcttggactgcagtgacttcaggtgcttgt

SEQ ID NO: 23298 - DNA, 30 bp, Homo sapiens
tattggttggtgacttctgagcccactgga

SEQ ID NO: 23299 - DNA, 30 bp, Homo sapiens
aggaggagcgatcacgtctaccagggcaac

SEQ ID NO: 23300 - DNA, 30 bp, Homo sapiens
agagcttcgatttcagacttcctatgacag

SEQ ID NO: 23301 - DNA, 30 bp, Homo sapiens
agagcttggctcccagcttgggccgccggg

SEQ ID NO: 23302 - DNA, 30 bp, Homo sapiens
cagtgggccttctccaagaacgctctgcag

SEQ ID NO: 23303 - DNA, 30 bp, Homo sapiens
tcttgggtctggggaccggcccacgttcca

SEQ ID NO: 23304 - DNA, 30 bp, Homo sapiens
gcgtggtcctccccatctgcgacgtggcgg

SEQ ID NO: 23305 - DNA, 30 bp, Homo sapiens
acacggggccccccaaggcccgcaggcacc

SEQ ID NO: 23306 - DNA, 30 bp, Homo sapiens
gcctggctcgcctcggcagcctggtcttaa

SEQ ID NO: 23307 - DNA, 30 bp, Homo sapiens
tccatcacctgagtttgagagcagagtgcg

SEQ ID NO: 23308 - DNA, 30 bp, Homo sapiens
ctcaggtaggtgggttttgcaggagggtgc

SEQ ID NO: 23309 - DNA, 30 bp, Homo sapiens
tagaggtacatcctccggccaaacaggggt

SEQ ID NO: 23310 - DNA, 30 bp, Homo sapiens
cataggattctctctgccagcagagtccac

SEQ ID NO: 23311 - DNA, 30 bp, Homo sapiens
tgatggctgtttgtggtcatacactccgtg

SEQ ID NO: 23312 - DNA, 30 bp, Homo sapiens
aggaggtcgaggtcagttctgggagctctg

SEQ ID NO: 23313 - DNA, 30 bp, Homo sapiens
catccgaactggcctagagtcaaggtgctg

SEQ ID NO: 23314 - DNA, 30 bp, Homo sapiens
tccatgggagaagaggttcatagatgggca

SEQ ID NO: 23315 - DNA, 30 bp, Homo sapiens
tacttctccaaaactgtgagccgtttcagt

SEQ ID NO: 23316 - DNA, 30 bp, Homo sapiens
cagtggtacatgtgatcaatttgttttttg

SEQ ID NO: 23317 - DNA, 30 bp, Homo sapiens
gctctcgaagtttgaatttctggatctttc

SEQ ID NO: 23318 - DNA, 30 bp, Homo sapiens
catgaggggtggaagtgcctgatgagcgcc

SEQ ID NO: 23319 - DNA, 30 bp, Homo sapiens
tagtggaatagaggtcatctatctgcgacc

SEQ ID NO: 23320 - DNA, 30 bp, Homo sapiens
attcgctcaatgtccgcctggtaatgtgtt

SEQ ID NO: 23321 - DNA, 30 bp, Homo sapiens
tacattcgttcaatgtctttgaggtaatgg

SEQ ID NO: 23322 - DNA, 30 bp, Homo sapiens
tcctggatgtgctcatacaggctgtcaatt

SEQ ID NO: 23323 - DNA, 30 bp, Homo sapiens
acatggagattgagtaaagctcttctattt

SEQ ID NO: 23324 - DNA, 30 bp, Homo sapiens
acatctgaccagtctcctttttccgaagtt

SEQ ID NO: 23325 - DNA, 30 bp, Homo sapiens
gcacgggcttttccggacatcttccactcc

SEQ ID NO: 23326 - DNA, 30 bp, Homo sapiens
tgcgcacgggcttttccggacatcttccac

SEQ ID NO: 23327 - DNA, 30 bp, Homo sapiens
aagcggtaggtaggtagtgtacagattggg

SEQ ID NO: 23328 - DNA, 30 bp, Homo sapiens
tttcttcctcagttcatttctttttgtctt

SEQ ID NO: 23329 - DNA, 30 bp, Homo sapiens
cattcttggtctcttaaaacgttgcgtttg

SEQ ID NO: 23330 - DNA, 30 bp, Homo sapiens
caccggaggagttccctgaagttcaaccag

SEQ ID NO: 23331 - DNA, 30 bp, Homo sapiens
ttcccccactcctgacttcgcaatttactc

SEQ ID NO: 23332 - DNA, 30 bp, Homo sapiens
tacggggccttcctggggtgcacctcattt

SEQ ID NO: 23333 - DNA, 30 bp, Homo sapiens
gcattggcaacatcatcaactctaccagac

SEQ ID NO: 23334 - DNA, 30 bp, Homo sapiens
cacttagcagcagcctgcttgtccttgcac

SEQ ID NO: 23335 - DNA, 30 bp, Homo sapiens
tagtgctctaacaagtcacctgagtttcta

SEQ ID NO: 23336 - DNA, 30 bp, Homo sapiens
cactggatggtcaggcagcggtggctgaag

SEQ ID NO: 23337 - DNA, 30 bp, Homo sapiens
acgtggccaaaaatgctggggtcttcaatt

SEQ ID NO: 23338 - DNA, 30 bp, Homo sapiens
ttgcggtggacgatggaagggccggcctcg

SEQ ID NO: 23339 - DNA, 30 bp, Homo sapiens
cggtggacaatggaaggcccggcttcatcg

SEQ ID NO: 23340 - DNA, 30 bp, Homo sapiens
agaagcatttgcggtggacgatggaggggc

SEQ ID NO: 23341 - DNA, 30 bp, Homo sapiens
aggaggaccagcctcatcatattcctgctt

SEQ ID NO: 23342 - DNA, 30 bp, Homo sapiens
ttgcggtggacaatggatgggcctgcctca

SEQ ID NO: 23343 - DNA, 30 bp, Homo sapiens; identical to SEQ ID NO: 23340

SEQ ID NO: 23344 - DNA, 30 bp, Homo sapiens
ctgtggacaatggagggccctgcctcatca

SEQ ID NO: 23345 - DNA, 30 bp, Homo sapiens
gcctggagccacactcctggtacatggccc

SEQ ID NO: 23346 - DNA, 30 bp, Homo sapiens
caagggcattttctttctacacactgcttc

SEQ ID NO: 23347 - DNA, 30 bp, Homo sapiens
caggggcactttcgctccacgcactgcttc

SEQ ID NO: 23348 - DNA, 30 bp, Homo sapiens
gtagaggaagaaaggcccgtgttcctcgta

SEQ ID NO: 23349 - DNA, 30 bp, Homo sapiens
agatggccacgctgccccgctcctcaaact

SEQ ID NO: 23350 - DNA, 30 bp, Homo sapiens
atgctcaccatactcctctcgggacatcca

SEQ ID NO: 23351 - DNA, 30 bp, Homo sapiens
cagtagcatttgcggtacacgatataggga

SEQ ID NO: 23352 - DNA, 30 bp, Homo sapiens
tagaggtcactctcgccgtacagcgccgtg

SEQ ID NO: 23353 - DNA, 30 bp, Homo sapiens
agagtgcggaagagaacgcagcgtaatcca

SEQ ID NO: 23354 - DNA, 30 bp, Homo sapiens
caaaggtcgctctccccatagagggcactg

SEQ ID NO: 23355 - DNA, 30 bp, Homo sapiens
cacaggtcgctctcgccatacaaggccgtg

SEQ ID NO: 23356 - DNA, 30 bp, Homo sapiens
cagaggtggttgagttttcccgacatcaaa

SEQ ID NO: 23357 - DNA, 30 bp, Homo sapiens
agaaggtttttctgtggatggatcgggcac

SEQ ID NO: 23358 - DNA, 30 bp, Homo sapiens
gcacgggagccatcctcttcatactccttt

SEQ ID NO: 23359 - DNA, 30 bp, Homo sapiens
ttctctagcacacggacacccttttcttgg

SEQ ID NO: 23360 - DNA, 30 bp, Homo sapiens
cactggattgtgacgacaaatgctaggtcc

SEQ ID NO: 23361 - DNA, 30 bp, Homo sapiens
agacggggttgtggcggcagatgctgggcc

SEQ ID NO: 23362 - DNA, 30 bp, Homo sapiens
ttctggcctgggcgacagagcgagactgac

SEQ ID NO: 23363 - DNA, 30 bp, Homo sapiens
cagaggatggaatccgtgaccttgaggata

SEQ ID NO: 23364 - DNA, 30 bp, Homo sapiens
tagccaagcttggtataccttatacagcgg

SEQ ID NO: 23365 - DNA, 30 bp, Homo sapiens
caccagcaccacctccaccagcagcggagc

SEQ ID NO: 23366 - DNA, 30 bp, Homo sapiens
tcccaggcataagtaatagggttttcaggc

SEQ ID NO: 23367 - DNA, 30 bp, Homo sapiens
caccacacaaacgcagcccgctctcgtaac

SEQ ID NO: 23368 - DNA, 30 bp, Homo sapiens
ttgaaccacagatgtcccatactccttgaa

SEQ ID NO: 23369 - DNA, 30 bp, Homo sapiens
gaagcatcttctctgcaccacggaggtccc

SEQ ID NO: 23370 - DNA, 30 bp, Homo sapiens
tgttgggtccaacttctttaaattctgcag

SEQ ID NO: 23371 - DNA, 30 bp, Homo sapiens
tcgagggaattatcaattttggtcaaagtc

SEQ ID NO: 23372 - DNA, 30 bp, Homo sapiens
cgctgagctgggagagggtcttcttgatgc

SEQ ID NO: 23373 - DNA, 30 bp, Homo sapiens
gttaggcgggccgctccgttggcataccaa

SEQ ID NO: 23374 - DNA, 30 bp, Homo sapiens
gggaggaaagtcaacatttgtcaccattgt

SEQ ID NO: 23375 - DNA, 30 bp, Homo sapiens
tttagggggcaggtccacattggtgacaga

SEQ ID NO: 23376 - DNA, 30 bp, Homo sapiens
tttaggcttctctggactgttgctaatttt

SEQ ID NO: 23377 - DNA, 30 bp, Homo sapiens
cactgggcagggcaggcacactggcaaggg

SEQ ID NO: 23378 - DNA, 30 bp, Homo sapiens
agctgggctcggggcaggggtcagcgcggg

SEQ ID NO: 23379 - DNA, 30 bp, Homo sapiens
tttaggacttcctcttgtttcaagccattc

SEQ ID NO: 23380 - DNA, 30 bp, Homo sapiens
agatggttttttcattagaaaagtttgtgc

SEQ ID NO: 23381 - DNA, 30 bp, Homo sapiens
ttccggagctgatgaattcatggaattgac

SEQ ID NO: 23382 - DNA, 30 bp, Homo sapiens
gcatggaattgactttgtcttctggcccct

SEQ ID NO: 23383 - DNA, 30 bp, Homo sapiens
cagaggttctgccctgcagaggctgaaggt

SEQ ID NO: 23384 - DNA, 30 bp, Homo sapiens
tttgtagccacatctgctatgaacttatcc

SEQ ID NO: 23385 - DNA, 30 bp, Homo sapiens
tccaggatccatagccatgttgttgtaagt

SEQ ID NO: 23386 - DNA, 30 bp, Homo sapiens
cagtggcttcgagggccaagcccccaggcc

SEQ ID NO: 23387 - DNA, 30 bp, Homo sapiens
atctggaagacctgaaactccaagccttac

SEQ ID NO: 23388 - DNA, 30 bp, Homo sapiens
ttcaggtgattccatttcttcctcagttca

SEQ ID NO: 23389 - DNA, 30 bp, Homo sapiens
tgataactctctcggggccgctgacgctgg

SEQ ID NO: 23390 - DNA, 30 bp, Homo sapiens
ctccggaccttcctcggcgaatgtttttaa

SEQ ID NO: 23391 - DNA, 30 bp, Homo sapiens
gtgaggcagtagacgcatgctcctgcgatc

SEQ ID NO: 23392 - DNA, 30 bp, Homo sapiens
tataggcggtgtgggtggatctgggcactt

SEQ ID NO: 23393 - DNA, 30 bp, Homo sapiens
cagaggtagagcgaggacactgtcggaggc

SEQ ID NO: 23394 - DNA, 30 bp, Homo sapiens
ggggcgggattccagcccctgggccgggca

SEQ ID NO: 23395 - DNA, 30 bp, Homo sapiens
cacacctggtcttgcccacccaggctgctc

SEQ ID NO: 23396 - DNA, 30 bp, Homo sapiens
taaaggaggcagccttttcacttctggtga

SEQ ID NO: 23397 - DNA, 30 bp, Homo sapiens
taaaggaactttgtagggctggtctttctg

SEQ ID NO: 23398 - DNA, 30 bp, Homo sapiens
tcatcgctttctgatacaacggatgaatta

SEQ ID NO: 23399 - DNA, 30 bp, Homo sapiens
agccctctgtgatctgtattctggaaactt

SEQ ID NO: 23400 - DNA, 30 bp, Homo sapiens
taccctttaggttcactctcactttcaggt

SEQ ID NO: 23401 - DNA, 30 bp, Homo sapiens
gaagaaggcacaatagtgacaggtaacgca

SEQ ID NO: 23402 - DNA, 30 bp, Homo sapiens
gaatgagccttagtttctttgggaccagaa

SEQ ID NO: 23403 - DNA, 30 bp, Homo sapiens
actttgtcggttcactttcttgtcctcatc

SEQ ID NO: 23404 - DNA, 30 bp, Homo sapiens
gtgaaactccgcttcctctcctctgtagca

SEQ ID NO: 23405 - DNA, 30 bp, Homo sapiens
ccgaggtctaaatcttttgcctctgatttt

SEQ ID NO: 23406 - DNA, 30 bp, Homo sapiens
agatggggccttgctgagtaggatcgaacc

SEQ ID NO: 23407 - DNA, 30 bp, Homo sapiens
ttttggatttgagtcaaaagaggctggggg

SEQ ID NO: 23408 - DNA, 30 bp, Homo sapiens
cacatgcacaggggaaaggatttgtcctcc

SEQ ID NO: 23409 - DNA, 30 bp, Homo sapiens
aggagggcgtcacaggaggttgactctggg

SEQ ID NO: 23410 - DNA, 30 bp, Homo sapiens
ctttgggtcgtttactttcaatgtttgctt

SEQ ID NO: 23411 - DNA, 30 bp, Homo sapiens
atttggatctgctagtatatgcttcagcac

SEQ ID NO: 23412 - DNA, 30 bp, Homo sapiens
accagaggcaggatcttggcatctggactt

SEQ ID NO: 23413 - DNA, 30 bp, Homo sapiens
gaatctttacttgcaggtttatttaggaaa

SEQ ID NO: 23414 - DNA, 30 bp, Homo sapiens
ctggaccagggttggccgcaccagccccgg

SEQ ID NO: 23415 - DNA, 30 bp, Homo sapiens
tagggtgctgtgggagctccggctccttgc

SEQ ID NO: 23416 - DNA, 30 bp, Homo sapiens
aggaggtgcaggagcaggacgggcaggaat

SEQ ID NO: 23417 - DNA, 30 bp, Homo sapiens
caatcagttccaggcttcagtttacacgtt

SEQ ID NO: 23418 - DNA, 30 bp, Homo sapiens
aactgcattctgccattgtgcaaaagtcta

SEQ ID NO: 23419 - DNA, 30 bp, Homo sapiens
tagtggccatggcaggttttgcagcacatc

SEQ ID NO: 23420 - DNA, 30 bp, Homo sapiens
cccaggaggacatgtgagtcacaataccct

SEQ ID NO: 23421 - DNA, 30 bp, Homo sapiens
ccttctttgcctttgggtgtgtgtgatgtg

SEQ ID NO: 23422 - DNA, 30 bp, Homo sapiens
ggttccttcctttcccttccaggactgagg

SEQ ID NO: 23423 - DNA, 30 bp, Homo sapiens
caccggggaggcagcagggaggctggtgcc

SEQ ID NO: 23424 - DNA, 30 bp, Homo sapiens
cagcacggcctcaggacgcagaagtccagc

SEQ ID NO: 23425 - DNA, 30 bp, Homo sapiens
cacaagttggacttagagcaagtcttgcag

SEQ ID NO: 23426 - DNA, 30 bp, Homo sapiens
gttcggcggtggctggcgcatcttgtttgc

SEQ ID NO: 23427 - DNA, 30 bp, Homo sapiens
gcatgacttgcagcattgttttccgtaaaa

SEQ ID NO: 23428 - DNA, 30 bp, Homo sapiens
ttttgggcatagaagtccctgcatgtttca

SEQ ID NO: 23429 - DNA, 30 bp, Homo sapiens
gcgatccacctaccttggcctcccaaagtg

SEQ ID NO: 23430 - DNA, 30 bp, Homo sapiens
atctctttcttccgcatctcatcaatgagc

SEQ ID NO: 23431 - DNA, 30 bp, Homo sapiens
gtcatgtgaggaagacactttccacagtac

SEQ ID NO: 23432 - DNA, 30 bp, Homo sapiens
aggtggatgatcttgtcggacgtctgttgt

SEQ ID NO: 23433 - DNA, 30 bp, Homo sapiens
actgcctcccagggcaggaaaccagggcag

SEQ ID NO: 23434 - DNA, 30 bp, Homo sapiens
cgcccaggggcgccgccgaaggatctccag

SEQ ID NO: 23435 - DNA, 30 bp, Homo sapiens
agaaggcctttgggagagaggacatccttt

SEQ ID NO: 23436 - DNA, 30 bp, Homo sapiens
ccttggcaggtcttacaacacatctgtctg

SEQ ID NO: 23437 - DNA, 30 bp, Homo sapiens
cagcggcgggcaacccgctgatggcctcgg

SEQ ID NO: 23438 - DNA, 30 bp, Homo sapiens
cacagggggcacagctggctttcgcagggc

SEQ ID NO: 23439 - DNA, 30 bp, Homo sapiens
tccaggccagtaccagaggatggagtgcat

SEQ ID NO: 23440 - DNA, 30 bp, Homo sapiens
acgagggctcctctgacacagcagctcctt

SEQ ID NO: 23441 - DNA, 30 bp, Homo sapiens
gttccacagcagcgagatttaaactggctg

SEQ ID NO: 23442 - DNA, 30 bp, Homo sapiens
gagtgggggggcctgcaggagcggcagcac

SEQ ID NO: 23443 - DNA, 30 bp, Homo sapiens
caaaggtttatccctcttgacatgactggc

SEQ ID NO: 23444 - DNA, 30 bp, Homo sapiens
tgacatgactggcagcacctttgtttgtag

SEQ ID NO: 23445 - DNA, 30 bp, Homo sapiens
caggagggatcctggggagaccgctccagg

SEQ ID NO: 23446 - DNA, 30 bp, Homo sapiens
tgctggaaaggctgaggtgtcctgggcgtg

SEQ ID NO: 23447 - DNA, 30 bp, Homo sapiens
gccaggacagcgccgggcagtcaggcgtat

SEQ ID NO: 23448 - DNA, 30 bp, Homo sapiens
gcagcatgggcctgtccaccgccttctgga

SEQ ID NO: 23449 - DNA, 30 bp, Homo sapiens
gctgcggccactctctgttgatgcagtggg

SEQ ID NO: 23450 - DNA, 30 bp, Homo sapiens
tactgggcagagataaaagttcttttcctc

SEQ ID NO: 23451 - DNA, 30 bp, Homo sapiens
cggcctggtactcctttgccgccagcttgg

SEQ ID NO: 23452 - DNA, 30 bp, Homo sapiens
cgttgggcttggtaatcttggagcgtagta

SEQ ID NO: 23453 - DNA, 30 bp, Homo sapiens
cagggcgtgagtgagaactggtcctgctcg

SEQ ID NO: 23454 - DNA, 30 bp, Homo sapiens
gagtcagtagaaactgctgctgctccggtg

SEQ ID NO: 23455 - DNA, 30 bp, Homo sapiens
cacttgaactggtgataatccggtgggttt

SEQ ID NO: 23456 - DNA, 30 bp, Homo sapiens
cttcctcagcccgatatccagggatacact

SEQ ID NO: 23457 - DNA, 30 bp, Homo sapiens
tgtcggggtccagccagcggcactgctcct

SEQ ID NO: 23458 - DNA, 30 bp, Homo sapiens
agagtggagcagggaacagccagcatatta

SEQ ID NO: 23459 - DNA, 30 bp, Homo sapiens
cacggggggcacactgggcccgtgaggagg

SEQ ID NO: 23460 - DNA, 30 bp, Homo sapiens
gtctccaggtactggtagagctcctccgct

SEQ ID NO: 23461 - DNA, 30 bp, Homo sapiens
agcctccttcccagctgctgcagagggcag

SEQ ID NO: 23462 - DNA, 30 bp, Homo sapiens
tgcagggtgggagaccaaaaccccaggagg

SEQ ID NO: 23463 - DNA, 30 bp, Homo sapiens
tattagctctcatcaggaatttgttttttt

SEQ ID NO: 23464 - DNA, 30 bp, Homo sapiens
tgctctgggaaagggaccttgacatttctg

SEQ ID NO: 23465 - DNA, 30 bp, Homo sapiens
aggagttgtccaccacctggtggggcagtg

SEQ ID NO: 23466 - DNA, 30 bp, Homo sapiens
cctagggtagctgaaggaggtccagttcgt

SEQ ID NO: 23467 - DNA, 30 bp, Homo sapiens
gagcgggggccctccattgaggaagtaggt

SEQ ID NO: 23468 - DNA, 30 bp, Homo sapiens
taactgctggggcccccattgaggaagtag

SEQ ID NO: 23469 - DNA, 30 bp, Homo sapiens
gttcagccccagcccctgaaacttggcagt

SEQ ID NO: 23470 - DNA, 30 bp, Homo sapiens
aacgggaaaaaacagtatgcaggtgcggga

SEQ ID NO: 23471 - DNA, 30 bp, Homo sapiens
gcctgggctccaggctctgtgccgctgggt

SEQ ID NO: 23472 - DNA, 30 bp, Homo sapiens
cacacactctttgaaacgttgagcttggtg

SEQ ID NO: 23473 - DNA, 30 bp, Homo sapiens
gtttatacctcttccctaggacggccgcca

SEQ ID NO: 23474 - DNA, 30 bp, Homo sapiens
aggtggccagattgtcagcagggaggccag

SEQ ID NO: 23475 - DNA, 30 bp, Homo sapiens
tccagcttgatgggagtgctgggaggcggg

SEQ ID NO: 23476 - DNA, 30 bp, Homo sapiens
gaaaggacggggtacggaacttcttcttct

SEQ ID NO: 23477 - DNA, 30 bp, Homo sapiens
caggggtcctgcaacccagccccaggcaca

SEQ ID NO: 23478 - DNA, 30 bp, Homo sapiens
taaagggctctttgtctctgcctccttcgc

SEQ ID NO: 23479 - DNA, 30 bp, Homo sapiens
tctccttctttttgctctttttcaggaagg

SEQ ID NO: 23480 - DNA, 30 bp, Homo sapiens
gtgcggaatttcttctttttcttggatggc

SEQ ID NO: 23481 - DNA, 30 bp, Homo sapiens
agctggggtcatcttttctgtctccagctt

SEQ ID NO: 23482 - DNA, 30 bp, Homo sapiens
tacacagtagtttcgtttttccagggtccc

SEQ ID NO: 23483 - DNA, 30 bp, Homo sapiens
tagacggtagtttcgctcttccagagtccg

SEQ ID NO: 23484 - DNA, 30 bp, Homo sapiens
tccagtcctaacattgccagtgctatcggt

SEQ ID NO: 23485 - DNA, 30 bp, Homo sapiens
cagacctcggtctggaggtcgatgatgtcc

SEQ ID NO: 23486 - DNA, 30 bp, Homo sapiens
gtctggaagtcaccatccggtggttctgtg

SEQ ID NO: 23487 - DNA, 30 bp, Homo sapiens
tgcacatccagaggcaaattcagacacttc

SEQ ID NO: 23488 - DNA, 30 bp, Homo sapiens
cacacggctgacaggtcgacgcggtgggca

SEQ ID NO: 23489 - DNA, 30 bp, Homo sapiens
tggaagcggatggcatggaggacagcaaga

SEQ ID NO: 23490 - DNA, 30 bp, Homo sapiens
tgggtttggaggtgtcagccttagcactgc

SEQ ID NO: 23491 - DNA, 30 bp, Homo sapiens
tcctggaaaaacatccccctcactgggttt

SEQ ID NO: 23492 - DNA, 30 bp, Homo sapiens
tatgccggactctgatgccctgagggcccg

SEQ ID NO: 23493 - DNA, 30 bp, Homo sapiens
tgtcggaggaatctccagtatgagaaaatg

SEQ ID NO: 23494 - DNA, 30 bp, Homo sapiens
acttgggcgacaagagtgacattcgaaatt

SEQ ID NO: 23495 - DNA, 30 bp, Homo sapiens
ttaaggcttctcttatctttggatccagga

SEQ ID NO: 23496 - DNA, 30 bp, Homo sapiens
acctggcagtgtcgcttcctcctttgctgt

SEQ ID NO: 23497 - DNA, 30 bp, Homo sapiens
tcctctgaggagggccatggaatgccttct

SEQ ID NO: 23498 - DNA, 30 bp, Homo sapiens
agtgtcgcttcctcctttgctgtgttccaa

SEQ ID NO: 23499 - DNA, 30 bp, Homo sapiens
gttgggcctagtgatgcattctcagctgcc

SEQ ID NO: 23500 - DNA, 30 bp, Homo sapiens
cactggatgagttttccagggatgagctgg

SEQ ID NO: 23501 - DNA, 30 bp, Homo sapiens
atgcggctggacgaggtgctgcccgagctg

SEQ ID NO: 23502 - DNA, 30 bp, Homo sapiens
tttgaagtccttctgagagccatacggcct

SEQ ID NO: 23503 - DNA, 30 bp, Homo sapiens
tattcttgagatgcggagtgggcctggtcc

SEQ ID NO: 23504 - DNA, 30 bp, Homo sapiens
gagaggaacagtaaggatctttgtcaaagt

SEQ ID NO: 23505 - DNA, 30 bp, Homo sapiens
agatggtgaagaggaacagctggggcagca

SEQ ID NO: 23506 - DNA, 30 bp, Homo sapiens
tactgtgttgtttgggaggagctgaaggcc

SEQ ID NO: 23507 - DNA, 30 bp, Homo sapiens
tgaaggtgtctgacatgataatatttttat

SEQ ID NO: 23508 - DNA, 30 bp, Homo sapiens
gcatgggccagttttgacaaggacttgtcc

SEQ ID NO: 23509 - DNA, 30 bp, Homo sapiens
cattgtcactttcagagagtgtgatttcct

SEQ ID NO: 23510 - DNA, 30 bp, Homo sapiens
gagactggtgaccagctgcatctgcccgtc

SEQ ID NO: 23511 - DNA, 30 bp, Homo sapiens
ttaagtgttgaagtgctattgatgtcacct

SEQ ID NO: 23512 - DNA, 30 bp, Homo sapiens
atctggcctaagagtagctctaaatgatat

SEQ ID NO: 23513 - DNA, 30 bp, Homo sapiens
gcatttgtccttctctaacatctccttctg

SEQ ID NO: 23514 - DNA, 30 bp, Homo sapiens
tgccagaggaatagcgagcactggttctgg

SEQ ID NO: 23515 - DNA, 30 bp, Homo sapiens
gagccggtccttttgaacttccctcgggag

SEQ ID NO: 23516 - DNA, 30 bp, Homo sapiens
cagtggtagagtatccatgacacttgtatc

SEQ ID NO: 23517 - DNA, 30 bp, Homo sapiens
caacaggggacatttttgaacaatctgtaa

SEQ ID NO: 23518 - DNA, 30 bp, Homo sapiens
tacaggtgagtgtcggcgatgggtatcctc

SEQ ID NO: 23519 - DNA, 30 bp, Homo sapiens
gtgaagcaggtcaaatccttcatttatttt

SEQ ID NO: 23520 - DNA, 30 bp, Homo sapiens
aacgtcaggacggtacggatacttttccca

SEQ ID NO: 23521 - DNA, 30 bp, Homo sapiens
ggacggtacggatactctttccagagcgaa

SEQ ID NO: 23522 - DNA, 30 bp, Homo sapiens
atgaggattgttcggacgctttttccttgg

SEQ ID NO: 23523 - DNA, 30 bp, Homo sapiens
tgcatcagttcaaaggctttgttgatttca

SEQ ID NO: 23524 - DNA, 30 bp, Homo sapiens
tagggatgtgctgtctgctcttccagcctc

SEQ ID NO: 23525 - DNA, 30 bp, Homo sapiens
gtcaggaccgttcgaatgctttgtcctgaa

SEQ ID NO: 23526 - DNA, 30 bp, Homo sapiens
cctcttctgactggggacagggtgcaagct

SEQ ID NO: 23527 - DNA, 30 bp, Homo sapiens
aggcggtctgtgccagaaatttcacgtact

SEQ ID NO: 23528 - DNA, 30 bp, Homo sapiens
tgtcggtctgaagaggagatgagttggggg

SEQ ID NO: 23529 - DNA, 30 bp, Homo sapiens
agttggtgtcatggtagagaagaaagcctg

SEQ ID NO: 23530 - DNA, 30 bp, Homo sapiens
agaagggtgtcatcagtacagccgccttct

SEQ ID NO: 23531 - DNA, 30 bp, Homo sapiens
cactgcagcccccgccgatcatgaaacgaa

SEQ ID NO: 23532 - DNA, 30 bp, Homo sapiens
ttcaggaggccgaattttttcccaatccca

SEQ ID NO: 23533 - DNA, 30 bp, Homo sapiens
cagtggaagtctggcttctcaggaaaggtg

SEQ ID NO: 23534 - DNA, 30 bp, Homo sapiens
gaaagtggggagcacttccactcggggggg

SEQ ID NO: 23535 - DNA, 30 bp, Homo sapiens
ctccccctcctgtcccacaggcaggcacgt

SEQ ID NO: 23536 - DNA, 30 bp, Homo sapiens
tagtcgcagcccggggagggactggggaag

SEQ ID NO: 23537 - DNA, 30 bp, Homo sapiens
tgttggctgctcagtttaactccggctaag

SEQ ID NO: 23538 - DNA, 30 bp, Homo sapiens
agtacagaaggcttgtgattttttattgct

SEQ ID NO: 23539 - DNA, 30 bp, Homo sapiens
caagggaagaccttgggacctggatagggt

SEQ ID NO: 23540 - DNA, 30 bp, Homo sapiens
atcaggcctctcttctgggagatcctcgtc

SEQ ID NO: 23541 - DNA, 30 bp, Homo sapiens
ccatcctgggccagggggtcatctaggcca

SEQ ID NO: 23542 - DNA, 30 bp, Homo sapiens
cataggcccacaccgagagcaggctgtacc

SEQ ID NO: 23543 - DNA, 30 bp, Homo sapiens
aatcagagggatggcagaccacacaagctt

SEQ ID NO: 23544 - DNA, 30 bp, Homo sapiens
agtgagggtgtacttccgaatagaagagtc

SEQ ID NO: 23545 - DNA, 30 bp, Homo sapiens
taaagggaaattacagtgtcttcttttgac

SEQ ID NO: 23546 - DNA, 30 bp, Homo sapiens
ctgtggacaggcggtagagagccgcgccca

SEQ ID NO: 23547 - DNA, 30 bp, Homo sapiens
caactcttctggaagacacggtgcaggctt

SEQ ID NO: 23548 - DNA, 30 bp, Homo sapiens
cctttcaacatcattttgtcaggatagaca

SEQ ID NO: 23549 - DNA, 30 bp, Homo sapiens
tcagatggatgcttgataaagaagtaaatc

SEQ ID NO: 23550 - DNA, 30 bp, Homo sapiens
ctccacggtggcatcataaaattcacatgc

SEQ ID NO: 23551 - DNA, 30 bp, Homo sapiens
ggcgtcggcctggtggcacatccctgtagt

SEQ ID NO: 23552 - DNA, 30 bp, Homo sapiens
cccacaggtgtctttccttgaaacaccttc

SEQ ID NO: 23553 - DNA, 30 bp, Homo sapiens
tcatgggtgtgtgtccccgggctgtggtac

SEQ ID NO: 23554 - DNA, 30 bp, Homo sapiens
cttcctccccgttctcactgagggagatgg

SEQ ID NO: 23555 - DNA, 30 bp, Homo sapiens
aactgcccgggcgccaggggcatgttgctt

SEQ ID NO: 23556 - DNA, 30 bp, Homo sapiens
atatcggtctcccgtaggttgctgtagtcg

SEQ ID NO: 23557 - DNA, 30 bp, Homo sapiens
acgatccgcttcctgtccccccgacagagg

SEQ ID NO: 23558 - DNA, 30 bp, Homo sapiens
accaggccgtctgggtccacgggcggcaca

SEQ ID NO: 23559 - DNA, 30 bp, Homo sapiens
gccccttctcctccgtcggaagaggatgtg

SEQ ID NO: 23560 - DNA, 30 bp, Homo sapiens
accttggattccgaggcgaagccggggcgg

SEQ ID NO: 23561 - DNA, 30 bp, Homo sapiens
ttgtgaatcaatgttatcgctaggcacagt

SEQ ID NO: 23562 - DNA, 30 bp, Homo sapiens
aaactccccaagaagccccgtcgagccgtt

SEQ ID NO: 23563 - DNA, 30 bp, Homo sapiens
tccaggctcatgtcctcctcttcgtccttc

SEQ ID NO: 23564 - DNA, 30 bp, Homo sapiens
tcacgctttcatatggttttaacaggggat

SEQ ID NO: 23565 - DNA, 30 bp, Homo sapiens
atttgatatgtctgtgttccatcctgggag

SEQ ID NO: 23566 - DNA, 30 bp, Homo sapiens
agctggatcatcgactctcttgacttgcca

SEQ ID NO: 23567 - DNA, 30 bp, Homo sapiens
cttccgtggctgcctcatgtcaccccattt

SEQ ID NO: 23568 - DNA, 30 bp, Homo sapiens
agttcactgtgtaggtctctactgttgtga

SEQ ID NO: 23569 - DNA, 30 bp, Homo sapiens
gcaaggcagtatctttgggtagctttgata

SEQ ID NO: 23570 - DNA, 30 bp, Homo sapiens
caacctcttctgcggcattgttctgtatat

SEQ ID NO: 23571 - DNA, 30 bp, Homo sapiens
caattccttctgtcctgtgcctccctggct

SEQ ID NO: 23572 - DNA, 30 bp, Homo sapiens
taatccgacttctcgccatcatcctcctgg

SEQ ID NO: 23573 - DNA, 30 bp, Homo sapiens
ggtcccgttcttcaattcccattccttggc

SEQ ID NO: 23574 - DNA, 30 bp, Homo sapiens
tcttcttcatttcccattccccactcttgg

SEQ ID NO: 23575 - DNA, 30 bp, Homo sapiens
gtttggcagttgcctgactttccccccagc

SEQ ID NO: 23576 - DNA, 30 bp, Homo sapiens
ccttggctttctggagtacagtgcctttgc

SEQ ID NO: 23577 - DNA, 30 bp, Homo sapiens
taaaggaccataaccttttcttcagcgtct

SEQ ID NO: 23578 - DNA, 30 bp, Homo sapiens
tattggatacatcttgaccttgtgaaaaaa

SEQ ID NO: 23579 - DNA, 30 bp, Homo sapiens
ttttggttaattcttgtagctgctgaaaac

SEQ ID NO: 23580 - DNA, 30 bp, Homo sapiens
acaacaagtgggcatcgatgcgcagccaac

SEQ ID NO: 23581 - DNA, 30 bp, Homo sapiens
gacaggtgggcgctgttccgcagccagtgc

SEQ ID NO: 23582 - DNA, 30 bp, Homo sapiens
tcctggcgaagccagtgcagtccctgccgg

SEQ ID NO: 23583 - DNA, 30 bp, Homo sapiens
tcttggttctgtctccttcattccagtact

SEQ ID NO: 23584 - DNA, 30 bp, Homo sapiens
agttggcaactttctcacccgggggctcct

SEQ ID NO: 23585 - DNA, 30 bp, Homo sapiens
ttttggactctcttcattaaagcagacttc

SEQ ID NO: 23586 - DNA, 30 bp, Homo sapiens
tactggaagattgttttcaagataatctgg

SEQ ID NO: 23587 - DNA, 30 bp, Homo sapiens
gcagcacgagtttttgaaatcagtttttgt

SEQ ID NO: 23588 - DNA, 30 bp, Homo sapiens
gctttttcttgagagcttgtggaaggtgtt

SEQ ID NO: 23589 - DNA, 30 bp, Homo sapiens
tttcctcagttggctgatttttttcggaat

SEQ ID NO: 23590 - DNA, 30 bp, Homo sapiens
attcatcatggccccggacagctgggctga

SEQ ID NO: 23591 - DNA, 30 bp, Homo sapiens
atgatggtgggcaccctcccactgctgttg

SEQ ID NO: 23592 - DNA, 30 bp, Homo sapiens
cgtcggggcagccgtactgcagaagcacgt

SEQ ID NO: 23593 - DNA, 30 bp, Homo sapiens
caaccggggcgtcggcgcggcccacgctag

SEQ ID NO: 23594 - DNA, 30 bp, Homo sapiens
atttggaaggagttggaaaggcctttttgt

SEQ ID NO: 23595 - DNA, 30 bp, Homo sapiens
tataggaggctaggactacggtgcagctca

SEQ ID NO: 23596 - DNA, 30 bp, Homo sapiens
tgtcggggcagccgtactgcagaagcacgt

SEQ ID NO: 23597 - DNA, 30 bp, Homo sapiens; identical to SEQ ID NO: 23592

SEQ ID NO: 23598 - DNA, 30 bp, Homo sapiens
cgtccaccccgtcaggagctgctccaggac

SEQ ID NO: 23599 - DNA, 30 bp, Homo sapiens
atgctttggcaggaaattggatgattttaa

SEQ ID NO: 23600 - DNA, 30 bp, Homo sapiens
tacgggtatgtgtatatgtgcaaggatggg

SEQ ID NO: 23601 - DNA, 30 bp, Homo sapiens
ctttggaacttcagatataaggtgggttgt

SEQ ID NO: 23602 - DNA, 30 bp, Homo sapiens
gtcctctggcattttggtggcttgctatgg

SEQ ID NO: 23603 - DNA, 30 bp, Homo sapiens
aaaaggggttgaagggtctttgtggttcac

SEQ ID NO: 23604 - DNA, 30 bp, Homo sapiens
acccggggagaaacagtcagtgggggagat

SEQ ID NO: 23605 - DNA, 30 bp, Homo sapiens
gcaatgccccagacaaccgaacacatgttg

SEQ ID NO: 23606 - DNA, 30 bp, Homo sapiens
cttcctcctggttttctggggccttccatt

SEQ ID NO: 23607 - DNA, 30 bp, Homo sapiens
cacatgtgttgggggctatcttctgcttcc

SEQ ID NO: 23608 - DNA, 30 bp, Homo sapiens
gttcctccgactgattcagttctgcacgct

SEQ ID NO: 23609 - DNA, 30 bp, Homo sapiens
aaggccctccagtactactctcgcctgcct

SEQ ID NO: 23610 - DNA, 30 bp, Homo sapiens
tgttggaaattgtcctgttggtgcaccagt

SEQ ID NO: 23611 - DNA, 30 bp, Homo sapiens
agaaggggttggtggttggaggtttggagg

SEQ ID NO: 23612 - DNA, 30 bp, Homo sapiens
ctctaaagtcccttttacccaaggcatggt

SEQ ID NO: 23613 - DNA, 30 bp, Homo sapiens
cactgggtggggcttgtgagcatctgttct

SEQ ID NO: 23614 - DNA, 30 bp, Homo sapiens
accaggcttgtgtttcacagctgaaaggac

SEQ ID NO: 23615 - DNA, 30 bp, Homo sapiens
agacggttgtcactttggggagagcacata

SEQ ID NO: 23616 - DNA, 30 bp, Homo sapiens
gtgagaggtgagttgtttcatgcttctaac

SEQ ID NO: 23617 - DNA, 30 bp, Homo sapiens
agcgaagtacatggtgcgcagagtatcctg

SEQ ID NO: 23618 - DNA, 30 bp, Homo sapiens
acatggtgcgcagagtgtcttggtgaacct

SEQ ID NO: 23619 - DNA, 30 bp, Homo sapiens
gtaaggtatcttggtgaatctgtacagcct

SEQ ID NO: 23620 - DNA, 30 bp, Homo sapiens
tgctgggtatcatggtggatttgcacagcc

SEQ ID NO: 23621 - DNA, 30 bp, Homo sapiens
gcccccaggcttcttcagatagtcaccacc

SEQ ID NO: 23622 - DNA, 30 bp, Homo sapiens
tactgggccggctgcacgccagaccccgca

SEQ ID NO: 23623 - DNA, 30 bp, Homo sapiens
agctggagcctttttctatctcagttactc

SEQ ID NO: 23624 - DNA, 30 bp, Homo sapiens
cgtaggcagagcccttgtcaatttccgtca

SEQ ID NO: 23625 - DNA, 30 bp, Homo sapiens
cacaggcagccaagtagggttccatatatc

SEQ ID NO: 23626 - DNA, 30 bp, Homo sapiens
atgttattggggtccacatattccttgaca

SEQ ID NO: 23627 - DNA, 30 bp, Homo sapiens
atatcggctctaactgtcagagatgggtca

SEQ ID NO: 23628 - DNA, 30 bp, Homo sapiens
gctcatatgtgtacaatctgttagagtatc

SEQ ID NO: 23629 - DNA, 30 bp, Homo sapiens
catggggtggggcagggccgcagctctggc

SEQ ID NO: 23630 - DNA, 30 bp, Homo sapiens
aggtgcggctgcagggattcatggcagtac

SEQ ID NO: 23631 - DNA, 30 bp, Homo sapiens
gctgtgctcagcgggttggccacgcggccc

SEQ ID NO: 23632 - DNA, 30 bp, Homo sapiens
ggtaggtatgttcttgataattcagagtca

SEQ ID NO: 23633 - DNA, 30 bp, Homo sapiens
aacatggtgcaggcttcttggtggatgagc

SEQ ID NO: 23634 - DNA, 30 bp, Homo sapiens
caaaggtctccatttctctaagagaactgc

SEQ ID NO: 23635 - DNA, 30 bp, Homo sapiens
cgctcccggtacatgtggtagacgaagcag

SEQ ID NO: 23636 - DNA, 30 bp, Homo sapiens
cctcgggcatcttgactcctgccctctggg

SEQ ID NO: 23637 - DNA, 30 bp, Homo sapiens
ccaaggaaacccccgcgctcccggtacatg

SEQ ID NO: 23638 - DNA, 30 bp, Homo sapiens
tcttggggcagtgctgcagggccgccctca

SEQ ID NO: 23639 - DNA, 30 bp, Homo sapiens
tgttgggttaaggcagaacgaaatacttct

SEQ ID NO: 23640 - DNA, 30 bp, Homo sapiens
gggaggaggtgaccaagcactttctttttc

SEQ ID NO: 23641 - DNA, 30 bp, Homo sapiens
aagacctgttcctgtcacttctgtagtttt

SEQ ID NO: 23642 - DNA, 30 bp, Homo sapiens
tagcggtagtgatccggcttgaaggggcca

SEQ ID NO: 23643 - DNA, 30 bp, Homo sapiens
tttgttgagtcccagatattttgcttggtc

SEQ ID NO: 23644 - DNA, 30 bp, Homo sapiens
gtaattaggcttgaagggcccattcttgtt

SEQ ID NO: 23645 - DNA, 30 bp, Homo sapiens
tacagggatgtgacggtgaatgtgtcctcg

SEQ ID NO: 23646 - DNA, 30 bp, Homo sapiens
tgcttgttcttcctcatccgtgtatccatt

SEQ ID NO: 23647 - DNA, 30 bp, Homo sapiens
ctgaagtcctgggacttgttcttattgatt

SEQ ID NO: 23648 - DNA, 30 bp, Homo sapiens
gagcggtcagcatgtttgactgctttaact

SEQ ID NO: 23649 - DNA, 30 bp, Homo sapiens
tttggggtggagactgaaactgccccggct

SEQ ID NO: 23650 - DNA, 30 bp, Homo sapiens
actctttctttgtggaaactgacagctcca

SEQ ID NO: 23651 - DNA, 30 bp, Homo sapiens
agccttcatttggtcccaggcctgaccctt

SEQ ID NO: 23652 - DNA, 30 bp, Homo sapiens
tacaggaatccactggatgtcaaatcagga

SEQ ID NO: 23653 - DNA, 30 bp, Homo sapiens
ggcaggaatgtgcaccccgaagcttggggc

SEQ ID NO: 23654 - DNA, 30 bp, Homo sapiens
aataagcgtgcgccatagccaaaggtctgt

SEQ ID NO: 23655 - DNA, 30 bp, Homo sapiens
tccccccctaacgtgatcttaatgactttc

SEQ ID NO: 23656 - DNA, 30 bp, Homo sapiens
aggggggtcagctgcagtgaaccttttatt

SEQ ID NO: 23657 - DNA, 30 bp, Homo sapiens
ccttgaagtgtctgatcctccccggacatg

SEQ ID NO: 23658 - DNA, 30 bp, Homo sapiens
aggaggagggcggtgggtgactcgggagct

SEQ ID NO: 23659 - DNA, 30 bp, Homo sapiens
gtacgaaatgcgtctcgtaagtcatcaacc

SEQ ID NO: 23660 - DNA, 30 bp, Homo sapiens
gcaaagtttgatgtagatgaagataaagtg

SEQ ID NO: 23661 - DNA, 30 bp, Homo sapiens
tcttggctggggggcctgttggcttttcct

SEQ ID NO: 23662 - DNA, 30 bp, Homo sapiens
ggcaggctagcaatgtctctctctggaggg

SEQ ID NO: 23663 - DNA, 30 bp, Homo sapiens
tgtcacctctgagatcatcttcttcatctc

SEQ ID NO: 23664 - DNA, 30 bp, Homo sapiens
tgccaagagcacaggccagttcgctaccaa

SEQ ID NO: 23665 - DNA, 30 bp, Homo sapiens
tattggcattcggttaaagatgttccatag

SEQ ID NO: 23666 - DNA, 30 bp, Homo sapiens
aggtggagactgcctcatggttttccagct

SEQ ID NO: 23667 - DNA, 30 bp, Homo sapiens
cccgtaagccaggacatgtcgccagtcttg

SEQ ID NO: 23668 - DNA, 30 bp, Homo sapiens
ttcagccaccctgggataaaattatccagc

SEQ ID NO: 23669 - DNA, 30 bp, Homo sapiens
agcaggtacaggaagttcattaagatggtt

SEQ ID NO: 23670 - DNA, 30 bp, Homo sapiens
tggtgctatgaactccagatgtcagctgta

SEQ ID NO: 23671 - DNA, 30 bp, Homo sapiens
ttgctcatggtttgagccctacatactccc

SEQ ID NO: 23672 - DNA, 30 bp, Homo sapiens
ttaaggagcttgagggccgtgttaaaagga

SEQ ID NO: 23673 - DNA, 30 bp, Homo sapiens
gcctgggcctcctgggcattccacacggcc

SEQ ID NO: 23674 - DNA, 30 bp, Homo sapiens
caatgggagaagatcccccggaaccgggct

SEQ ID NO: 23675 - DNA, 30 bp, Homo sapiens
ccctggggacgggggtggctctgtggctgg

SEQ ID NO: 23676 - DNA, 30 bp, Homo sapiens
cactgtccgcccctgcagccccgcgcacct

SEQ ID NO: 23677 - DNA, 30 bp, Homo sapiens
aggaggggaagggggccgccggacgggcca

SEQ ID NO: 23678 - DNA, 30 bp, Homo sapiens
agcaggagatttcaaaccatttctcagaca

SEQ ID NO: 23679 - DNA, 30 bp, Homo sapiens
cagacttccaaggatggagaaaaggatctg

SEQ ID NO: 23680 - DNA, 30 bp, Homo sapiens
agttggcagggggttgtcgggcattgagcc

SEQ ID NO: 23681 - DNA, 30 bp, Homo sapiens
tcttggatgaatagatataaatccttgaaa

SEQ ID NO: 23682 - DNA, 30 bp, Homo sapiens
tttagggcgtccaggtgggtgcagacctgg

SEQ ID NO: 23683 - DNA, 30 bp, Homo sapiens
ctttacatgtggctttggagaaggctgcta

SEQ ID NO: 23684 - DNA, 30 bp, Homo sapiens
tcatgggctcttttggagggttgaactcct

SEQ ID NO: 23685 - DNA, 30 bp, Homo sapiens
atgtggctttggagaaggctgctaggatgc

SEQ ID NO: 23686 - DNA, 30 bp, Homo sapiens
gctaggatgcttgcgaacacgacatcgggg

SEQ ID NO: 23687 - DNA, 30 bp, Homo sapiens
ggagtaactgaagctttctggcttctttgt

SEQ ID NO: 23688 - DNA, 30 bp, Homo sapiens
ctttggactgaataggtgtgatcttgtttg

SEQ ID NO: 23689 - DNA, 30 bp, Homo sapiens
ctctggtgttccctctgcatttatcttgtg

SEQ ID NO: 23690 - DNA, 30 bp, Homo sapiens
ctcaatccatttcaagatctgatctacatt

SEQ ID NO: 23691 - DNA, 30 bp, Homo sapiens
aatcaacagggtcttcgggtcggacgttgc

SEQ ID NO: 23692 - DNA, 30 bp, Homo sapiens
ttcaggattgttcttgaagagatattctgc

SEQ ID NO: 23693 - DNA, 30 bp, Homo sapiens
caggggattttcttgggcaggggattaatg

SEQ ID NO: 23694 - DNA, 30 bp, Homo sapiens
ctgaggttccttgtattttctggtcatctt

SEQ ID NO: 23695 - DNA, 30 bp, Homo sapiens
atattgaggtccaagtatgaatactttaca

SEQ ID NO: 23696 - DNA, 30 bp, Homo sapiens
tacttcttttcgtgcttcttggttaactcc

SEQ ID NO: 23697 - DNA, 30 bp, Homo sapiens
gcaaatgcatagcctagtggcaaaacagca

SEQ ID NO: 23698 - DNA, 30 bp, Homo sapiens
caaaggcttgtgtagtagctgtctacccac

SEQ ID NO: 23699 - DNA, 30 bp, Homo sapiens
gcataatgtcactgactatcattttagcaa

SEQ ID NO: 23700 - DNA, 30 bp, Homo sapiens
gccaatcaaacagcgacttgcatctctcct

SEQ ID NO: 23701 - DNA, 30 bp, Homo sapiens
gtgcttggggtgtgatcgctttatctgatt

SEQ ID NO: 23702 - DNA, 30 bp, Homo sapiens
gctgatacttctgacgcgggaccatcaccg

SEQ ID NO: 23703 - DNA, 30 bp, Homo sapiens
tccacagtgaattcaccgtgagtcatccac

SEQ ID NO: 23704 - DNA, 30 bp, Homo sapiens
agaaggggaatgactccatgaaactatatt

SEQ ID NO: 23705 - DNA, 30 bp, Homo sapiens
tccaggtactgcggtgcctgctcggggacc

SEQ ID NO: 23706 - DNA, 30 bp, Homo sapiens
tacaggttcaccatcagccagtccagcagc

SEQ ID NO: 23707 - DNA, 30 bp, Homo sapiens
cacaggttagcgagcagccagtccagcaac

SEQ ID NO: 23708 - DNA, 30 bp, Homo sapiens
cattaaccagctgttctattgacaactgaa

SEQ ID NO: 23709 - DNA, 30 bp, Homo sapiens
ggctgggatgcaatgcggccttgtctgttg

SEQ ID NO: 23710 - DNA, 30 bp, Homo sapiens
gttctcattgtcattgccattctgatcagc

SEQ ID NO: 23711 - DNA, 30 bp, Homo sapiens
ctgtgggaacagcgtctttagactctgcat

SEQ ID NO: 23712 - DNA, 30 bp, Homo sapiens
cacggggcgcccccgccgccctcctcgtcg

SEQ ID NO: 23713 - DNA, 30 bp, Homo sapiens
tgaaattgagtagttgaacctgactgtata

SEQ ID NO: 23714 - DNA, 30 bp, Homo sapiens
cacagggaagaccaggtccacgctttgtcc

SEQ ID NO: 23715 - DNA, 30 bp, Homo sapiens
cccataccgtcgcataatctgatcatgtgt

SEQ ID NO: 23716 - DNA, 30 bp, Homo sapiens
ctgccgtagagtaaataagggctgttcttt

SEQ ID NO: 23717 - DNA, 30 bp, Homo sapiens
aagaggcaggagccccgcaggctgtgagcc

SEQ ID NO: 23718 - DNA, 30 bp, Homo sapiens
cctctgtgctttagcaaggtcttctgcaat

SEQ ID NO: 23719 - DNA, 30 bp, Homo sapiens
gtacgggtcattaaaggggtacagaggatg

SEQ ID NO: 23720 - DNA, 30 bp, Homo sapiens
tcatggaaggggtaatccttgtgggaggta

SEQ ID NO: 23721 - DNA, 30 bp, Homo sapiens
tattctgcattgaagggatagtcttccaaa

SEQ ID NO: 23722 - DNA, 30 bp, Homo sapiens
tattctgcatcgaagggaaagtcctccaaa

SEQ ID NO: 23723 - DNA, 30 bp, Homo sapiens
taaaatccctatgtcctcctttacagacac

SEQ ID NO: 23724 - DNA, 30 bp, Homo sapiens
ctatggctttcatctcctctgaagtcaact

SEQ ID NO: 23725 - DNA, 30 bp, Homo sapiens
tctaggccatctatggctttcatgtcctct

SEQ ID NO: 23726 - DNA, 30 bp, Homo sapiens
gagacattggagaatgaataagatagaggt

SEQ ID NO: 23727 - DNA, 30 bp, Homo sapiens
atgtcaactggaattcaaaaacctggatgt

SEQ ID NO: 23728 - DNA, 30 bp, Homo sapiens
ttcaggatgatcgcgccacatgagcaattc

SEQ ID NO: 23729 - DNA, 30 bp, Homo sapiens
ctcgctggatgttgaaacgcaaaacaattt

SEQ ID NO: 23730 - DNA, 30 bp, Homo sapiens
tattctatgtggaaaggatagtctttgtga

SEQ ID NO: 23731 - DNA, 30 bp, Homo sapiens
tagcggaagtagttgggacattcgtgagca

SEQ ID NO: 23732 - DNA, 30 bp, Homo sapiens
tagcggaagtagttgggacattcgtgagta

SEQ ID NO: 23733 - DNA, 30 bp, Homo sapiens
agttgggacattcgtgggcaaacaaatgcc

SEQ ID NO: 23734 - DNA, 30 bp, Homo sapiens
caggccgtgccgctggccgagtaggagaac

SEQ ID NO: 23735 - DNA, 30 bp, Homo sapiens
cagcttctggaagtcgctggtgttaagccg

SEQ ID NO: 23736 - DNA, 30 bp, Homo sapiens
tcgcggatgctggccgagtaggagaactgg

SEQ ID NO: 23737 - DNA, 30 bp, Homo sapiens
acccagcatgccacaatctgattgctgaca

SEQ ID NO: 23738 - DNA, 30 bp, Homo sapiens
gcagagtaggaaaattgagggaaatgcggc

SEQ ID NO: 23739 - DNA, 30 bp, Homo sapiens
gccaggctttacccatgacaggccagcaac

SEQ ID NO: 23740 - DNA, 30 bp, Homo sapiens
ttcctccttcagccactgcagcagctgcgg

SEQ ID NO: 23741 - DNA, 30 bp, Homo sapiens
cagataccaacttgctcaagcctgagaaat

SEQ ID NO: 23742 - DNA, 30 bp, Homo sapiens
cataggtggtgacatactggggccccatgt

SEQ ID NO: 23743 - DNA, 30 bp, Homo sapiens
gcagcttgacttgcagcaacaagtttttta

SEQ ID NO: 23744 - DNA, 30 bp, Homo sapiens
taccgaggtccttgtttacatgttttgatg

SEQ ID NO: 23745 - DNA, 30 bp, Homo sapiens
ctattgtaggtgcctcaaacacgttgtcct

SEQ ID NO: 23746 - DNA, 30 bp, Homo sapiens
gacgacaccagcaacaagggcagcaaggag

SEQ ID NO: 23747 - DNA, 30 bp, Homo sapiens
cataggcagccacagggccttggtccgcgc

SEQ ID NO: 23748 - DNA, 30 bp, Homo sapiens
agttggtgtttctctgaggaatagggaggt

SEQ ID NO: 23749 - DNA, 30 bp, Homo sapiens
tatattcatggaaaccgtactctcccagtt

SEQ ID NO: 23750 - DNA, 30 bp, Homo sapiens
taggagttcttctgggggatctttactgtc

SEQ ID NO: 23751 - DNA, 30 bp, Homo sapiens
caggggttcttgtcgccaagtttgatggtg

SEQ ID NO: 23752 - DNA, 30 bp, Homo sapiens
ctgaggaaccttgatggtgaccgtctttac

SEQ ID NO: 23753 - DNA, 30 bp, Homo sapiens
cgaaggtcactgtcttgacccgcaggtact

SEQ ID NO: 23754 - DNA, 30 bp, Homo sapiens
tcaccgtcttggttttgagatattcattta

SEQ ID NO: 23755 - DNA, 30 bp, Homo sapiens
gcccgtactcgcccaactcccggccactcc

SEQ ID NO: 23756 - DNA, 30 bp, Homo sapiens
tgctgggtcatcttggccgggctcgggggg

SEQ ID NO: 23757 - DNA, 30 bp, Homo sapiens
tactggaccaacgcagtctgtgaactacca

SEQ ID NO: 23758 - DNA, 30 bp, Homo sapiens
caagcacagcggctacaatacccaggaaag

SEQ ID NO: 23759 - DNA, 30 bp, Homo sapiens
ccttgggcctccatggccaccagcagcatc

SEQ ID NO: 23760 - DNA, 30 bp, Homo sapiens
cacaggagggtgcagctctgggagcccatg

SEQ ID NO: 23761 - DNA, 30 bp, Homo sapiens
ccccaggggcttatgtgtctccttgatgac

SEQ ID NO: 23762 - DNA, 30 bp, Homo sapiens
agcccccgtaacacacatacttgagttcca

SEQ ID NO: 23763 - DNA, 30 bp, Homo sapiens
ccatggtaggcatgacaacagcaggtgagg

SEQ ID NO: 23764 - DNA, 30 bp, Homo sapiens
gccagaggaaggtctttactgtagttgata

SEQ ID NO: 23765 - DNA, 30 bp, Homo sapiens
tgatggttttgatctcagtgaagaagtcgt

SEQ ID NO: 23766 - DNA, 30 bp, Homo sapiens
cacccatctccacacacacagtcttcagct

SEQ ID NO: 23767 - DNA, 30 bp, Homo sapiens
aataggcgtggttagagacgaagagggact

SEQ ID NO: 23768 - DNA, 30 bp, Homo sapiens
agtaggtatagcaggctgtgaagagcgact

SEQ ID NO: 23769 - DNA, 30 bp, Homo sapiens
agtaggcatggttggcaatgtagagtgact

SEQ ID NO: 23770 - DNA, 30 bp, Homo sapiens
tctcatcccatcggagctgctgcgactccc

SEQ ID NO: 23771 - DNA, 30 bp, Homo sapiens
aaacctttgaatgtcctgactatttggcca

SEQ ID NO: 23772 - DNA, 30 bp, Homo sapiens
ttctgggttgtaccttgtggaaaagcaaat

SEQ ID NO: 23773 - DNA, 30 bp, Homo sapiens
atgataggaatgtcacttcaaattcctgat

SEQ ID NO: 23774 - DNA, 30 bp, Homo sapiens
caggacggccgggggagcctctccagaagc

SEQ ID NO: 23775 - DNA, 30 bp, Homo sapiens
ctgaggtacataatgagaagctgggggaga

SEQ ID NO: 23776 - DNA, 30 bp, Homo sapiens
ggctggccaggaggataacatttcagtgtt

SEQ ID NO: 23777 - DNA, 30 bp, Homo sapiens
tcaaggaagaactgcaggtacaatagaaga

SEQ ID NO: 23778 - DNA, 30 bp, Homo sapiens
ctggcttcaccctgtgaattaggggaaagg

SEQ ID NO: 23779 - DNA, 30 bp, Homo sapiens
ccaaggtacaccgatttgggatacttttct

SEQ ID NO: 23780 - DNA, 30 bp, Homo sapiens
aaaagggtttgccctgagactccgagaaga

SEQ ID NO: 23781 - DNA, 30 bp, Homo sapiens
agaccaggcggttttcttcatgtttcacca

SEQ ID NO: 23782 - DNA, 30 bp, Homo sapiens
gtttggtaacatatcggtagagctgttctg

SEQ ID NO: 23783 - DNA, 30 bp, Homo sapiens
cagtgggctttcttgctgtgttgggtgctc

SEQ ID NO: 23784 - DNA, 30 bp, Homo sapiens
ttgctcaagcctccaggcaccagtcaaata

SEQ ID NO: 23785 - DNA, 30 bp, Homo sapiens
ttggaatcccacataataataatgttaaag

SEQ ID NO: 23786 - DNA, 30 bp, Homo sapiens
atatgtgatgcctactgcacaatacactga

SEQ ID NO: 23787 - DNA, 30 bp, Homo sapiens
aagagggaataatgtcctgttgtggtcaga

SEQ ID NO: 23788 - DNA, 30 bp, Homo sapiens
cttttcttcctgatttgctttgctttccgg

SEQ ID NO: 23789 - DNA, 30 bp, Homo sapiens
caaggagaagttaatggccaggcacggtgg

SEQ ID NO: 23790 - DNA, 30 bp, Homo sapiens
agttggttctgctcttctccggtctccact

SEQ ID NO: 23791 - DNA, 30 bp, Homo sapiens
tctcagtattcttggcatcgctgaggaagc

SEQ ID NO: 23792 - DNA, 30 bp, Homo sapiens
cccaggctggttcatgctattcttgctttt

SEQ ID NO: 23793 - DNA, 30 bp, Homo sapiens
tctgggagcacagtggactcactgctaatc

SEQ ID NO: 23794 - DNA, 30 bp, Homo sapiens
tgcacactggactgacagccagccgggtaa

SEQ ID NO: 23795 - DNA, 30 bp, Homo sapiens
gtcagggtttatcctggcccgttttacttc

SEQ ID NO: 23796 - DNA, 30 bp, Homo sapiens
ccgtggagccagaaccttctttctcacggg

SEQ ID NO: 23797 - DNA, 30 bp, Homo sapiens
ccgtgggccagcggcagcctgaccaccgcc

SEQ ID NO: 23798 - DNA, 30 bp, Homo sapiens
accagggtgcccctcgagggtctggataga

SEQ ID NO: 23799 - DNA, 30 bp, Homo sapiens
acacgggtcttccctggaaggagagggcga

SEQ ID NO: 23800 - DNA, 30 bp, Homo sapiens
catcttcacctttcgggcagggctgcctgc

SEQ ID NO: 23801 - DNA, 30 bp, Homo sapiens
agcaggaggccggcgcgcagcacgcggggc

SEQ ID NO: 23802 - DNA, 30 bp, Homo sapiens
ctctggccgccgcggctcgtagaagtccag

SEQ ID NO: 23803 - DNA, 30 bp, Homo sapiens
agcaggctgggggcggctgtccagactccc

SEQ ID NO: 23804 - DNA, 30 bp, Homo sapiens
gaagaatcacacaccagtttccttgatcgt

SEQ ID NO: 23805 - DNA, 30 bp, Homo sapiens
taagggtttgctttgaagctcaccgagaac

SEQ ID NO: 23806 - DNA, 30 bp, Homo sapiens
cccagggaacttttctccccagaagttgat

SEQ ID NO: 23807 - DNA, 30 bp, Homo sapiens
agatggtgacactgttctctatgcagctgg

SEQ ID NO: 23808 - DNA, 30 bp, Homo sapiens
caccgggtccaggtagtagtaggggatggg

SEQ ID NO: 23809 - DNA, 30 bp, Homo sapiens
agatggccacactgttttccaccacgctgg

SEQ ID NO: 23810 - DNA, 30 bp, Homo sapiens
agatggagacgctgttctcgatgaggggag

SEQ ID NO: 23811 - DNA, 30 bp, Homo sapiens
agatggccacactgttcggaatccggtctg

SEQ ID NO: 23812 - DNA, 30 bp, Homo sapiens
tagaggggagatggtggtggagatcgtctt

SEQ ID NO: 23813 - DNA, 30 bp, Homo sapiens
agatggagacgctgttctcaatgaggggag

SEQ ID NO: 23814 - DNA, 30 bp, Homo sapiens
cagcggacgcccccagcagcagcagggtcc

SEQ ID NO: 23815 - DNA, 30 bp, Homo sapiens
aaggtctagtcaaagaaagacgatggcaga

SEQ ID NO: 23816 - DNA, 30 bp, Homo sapiens
gcctggggtctcaggccctgccttctttat

SEQ ID NO: 23817 - DNA, 30 bp, Homo sapiens
gccctgggccttggagccctcctcttgggt

SEQ ID NO: 23818 - DNA, 30 bp, Homo sapiens
gaacaggacgctcagggggtagagggccag

SEQ ID NO: 23819 - DNA, 30 bp, Homo sapiens
cagtggccgtctccagcagcagcagggtcc

SEQ ID NO: 23820 - DNA, 30 bp, Homo sapiens
taagcttctcacgctgaatctggtagtaac

SEQ ID NO: 23821 - DNA, 30 bp, Homo sapiens
cagttcaactctagacacacttttatttta

SEQ ID NO: 23822 - DNA, 30 bp, Homo sapiens
taccagagctccctggagtgccagtggcca

SEQ ID NO: 23823 - DNA, 30 bp, Homo sapiens
ttgctaccatcttgcacagtgtcagaatca

SEQ ID NO: 23824 - DNA, 30 bp, Homo sapiens
catgggcaggagacaactttggatctgggc

SEQ ID NO: 23825 - DNA, 30 bp, Homo sapiens
aaatattggcggtgtgctccttggctttca

SEQ ID NO: 23826 - DNA, 30 bp, Homo sapiens
acgtggtccagttcagaaggccgggtggct

SEQ ID NO: 23827 - DNA, 30 bp, Homo sapiens
catgtggcccaggaaatggccgcactgtgc

SEQ ID NO: 23828 - DNA, 30 bp, Homo sapiens
aactggtgtccattctcgcattataggcgt

SEQ ID NO: 23829 - DNA, 30 bp, Homo sapiens
ttctggatgttgctgtgtgttgggtataag

SEQ ID NO: 23830 - DNA, 30 bp, Homo sapiens
tcgcggctgaatccaaattcttcaagtatc

SEQ ID NO: 23831 - DNA, 30 bp, Homo sapiens
atcagcagctcgtagaactggggttctatt

SEQ ID NO: 23832 - DNA, 30 bp, Homo sapiens
tcttggaaatgccatgcgtcatgcatcatc

SEQ ID NO: 23833 - DNA, 30 bp, Homo sapiens
agttggagaagcgcagcagctcctcatcac

SEQ ID NO: 23834 - DNA, 30 bp, Homo sapiens
ccgtggttctcccctagggcctgcagcgtc

SEQ ID NO: 23835 - DNA, 30 bp, Homo sapiens
aactggtaaaaacaaaattgtaatcattga

SEQ ID NO: 23836 - DNA, 30 bp, Homo sapiens
aactggtaaatcaaatgctcccatcgggat

SEQ ID NO: 23837 - DNA, 30 bp, Homo sapiens
ggcgaggccctgcccaggcaggtggttctt

SEQ ID NO: 23838 - DNA, 30 bp, Homo sapiens
cactgcctagctgcgtccgcctgccacacc

SEQ ID NO: 23839 - DNA, 30 bp, Homo sapiens
cctcccgcttggtcttgtctgttgatggcc

SEQ ID NO: 23840 - DNA, 30 bp, Homo sapiens
cctcctgcttggtcttgtctgttgctggcc

SEQ ID NO: 23841 - DNA, 30 bp, Homo sapiens
tcatggcagtggaggagtagctggtggcaa

SEQ ID NO: 23842 - DNA, 30 bp, Homo sapiens
aactttttggcactgtcgtggcaggccgtt

SEQ ID NO: 23843 - DNA, 30 bp, Homo sapiens
agatggggctcagccatggctggcccagag

SEQ ID NO: 23844 - DNA, 30 bp, Homo sapiens
aggaggtctgctgcttctgaagcctccgtt

SEQ ID NO: 23845 - DNA, 30 bp, Homo sapiens
caccggcagccacactcggtggccaccatg

SEQ ID NO: 23846 - DNA, 30 bp, Homo sapiens
atcagggtctgtggcaaagcagcgccaggt

SEQ ID NO: 23847 - DNA, 30 bp, Homo sapiens
gaaagggtacaggcaggctgaggattcctg

SEQ ID NO: 23848 - DNA, 30 bp, Homo sapiens
cacaccacaatgggcgtatcagagaagacc

SEQ ID NO: 23849 - DNA, 30 bp, Homo sapiens
aaaaggtgtgtcagaaaacactgaattgac

SEQ ID NO: 23850 - DNA, 30 bp, Homo sapiens
tcatgggaccctcggagcctatggagctgg

SEQ ID NO: 23851 - DNA, 30 bp, Homo sapiens
taatggttgtatggcggaaggggatgccca

SEQ ID NO: 23852 - DNA, 30 bp, Homo sapiens
tagaggggcggggcatgaagagtgccgttc

SEQ ID NO: 23853 - DNA, 30 bp, Homo sapiens
aggcctcggcctcggccccggcgaacagag

SEQ ID NO: 23854 - DNA, 30 bp, Homo sapiens
cacttgctttagtttgtttgggcctactaa

SEQ ID NO: 23855 - DNA, 30 bp, Homo sapiens
tctctgcatcaggctcttgtcccaggatct

SEQ ID NO: 23856 - DNA, 30 bp, Homo sapiens
atgaggacttccatcatctctccatcaggg

SEQ ID NO: 23857 - DNA, 30 bp, Homo sapiens
gatcagtatctccaccatgtctgacaagtc

SEQ ID NO: 23858 - DNA, 30 bp, Homo sapiens
ttcatagcgataggccatgcggatttgggc

SEQ ID NO: 23859 - DNA, 30 bp, Homo sapiens
ttgaggccctgggctcatggtgatacccgc

SEQ ID NO: 23860 - DNA, 30 bp, Homo sapiens
agttggtcaaggcggtgatctcttctgatt

SEQ ID NO: 23861 - DNA, 30 bp, Homo sapiens
tctaagcgtcgggtgaagttctctggaaag

SEQ ID NO: 23862 - DNA, 30 bp, Homo sapiens
agcagggtcctgaaggaagctctaccagca

SEQ ID NO: 23863 - DNA, 30 bp, Homo sapiens
ttgagggtatagtagtttgtgggcacaaag

SEQ ID NO: 23864 - DNA, 30 bp, Homo sapiens
gctgattctgtggtggcttcctcgatggca

SEQ ID NO: 23865 - DNA, 30 bp, Homo sapiens
cagttgccattaattttatctccagaaatg

SEQ ID NO: 23866 - DNA, 30 bp, Homo sapiens
atgacatcacagtatgtgccagcaggaaga

SEQ ID NO: 23867 - DNA, 30 bp, Homo sapiens
cagagttactaatagaaaaatgagctttgc

SEQ ID NO: 23868 - DNA, 30 bp, Homo sapiens
cccagggacggggggccgactctgctctgg

SEQ ID NO: 23869 - DNA, 30 bp, Homo sapiens
agtcggcgctggcaggcggggtgtcctccc

SEQ ID NO: 23870 - DNA, 30 bp, Homo sapiens
ctgtggctgaagctactgggttcacccagc

SEQ ID NO: 23871 - DNA, 30 bp, Homo sapiens
ttttggagaacagccaggcattttattatc

SEQ ID NO: 23872 - DNA, 30 bp, Homo sapiens
cattggctgtggatttccaagaagcaaagg

SEQ ID NO: 23873 - DNA, 30 bp, Homo sapiens
acttggttccaccaactcaagttgctgaat

SEQ ID NO: 23874 - DNA, 30 bp, Homo sapiens
gagctctcttctactggtgtgtatatttta

SEQ ID NO: 23875 - DNA, 30 bp, Homo sapiens
tttcttgaaggttgtgaaaattatttccta

SEQ ID NO: 23876 - DNA, 30 bp, Homo sapiens
cagcgagagccaggtcgggcctcactcctt

SEQ ID NO: 23877 - DNA, 30 bp, Homo sapiens
caggggcgctgtccccagcagccatcggcg

SEQ ID NO: 23878 - DNA, 30 bp, Homo sapiens
gctgcggcttcctgcctcaggcaggatgta

SEQ ID NO: 23879 - DNA, 30 bp, Homo sapiens
caatggggggaacattctcatggaggtact

SEQ ID NO: 23880 - DNA, 30 bp, Homo sapiens
tccttccatctctctgaacctcactgtcca

SEQ ID NO: 23881 - DNA, 30 bp, Homo sapiens
gcctgggacttcatggagaaagagcaacat

SEQ ID NO: 23882 - DNA, 30 bp, Homo sapiens
tcatccactggtcctgatcctgttcgttgc

SEQ ID NO: 23883 - DNA, 30 bp, Homo sapiens
aagagggggtgaatcccagcagctgctcga

SEQ ID NO: 23884 - DNA, 30 bp, Homo sapiens
tcttgggcaggcggtagacgccggccgagt

SEQ ID NO: 23885 - DNA, 30 bp, Homo sapiens
ctcagggtcaagtttttccactttaatgac

SEQ ID NO: 23886 - DNA, 30 bp, Homo sapiens
tagagatggtttatcaagggtaccccatga

SEQ ID NO: 23887 - DNA, 30 bp, Homo sapiens
tgctatactatactggtccattgcctcctg

SEQ ID NO: 23888 - DNA, 30 bp, Homo sapiens
cactgcatgccgaaccactgctcctggtca

SEQ ID NO: 23889 - DNA, 30 bp, Homo sapiens
cgacggaaaattgactgatccaagtggaca

SEQ ID NO: 23890 - DNA, 30 bp, Homo sapiens
accatctcttccaacacaggctcctcggcc

SEQ ID NO: 23891 - DNA, 30 bp, Homo sapiens
catggggcggtgacttccatcccgaagctg

SEQ ID NO: 23892 - DNA, 30 bp, Homo sapiens
taaaggcagatgatctgaagagttattttc

SEQ ID NO: 23893 - DNA, 30 bp, Homo sapiens
ttgtggaacgtaaggagtaactgggccctt

SEQ ID NO: 23894 - DNA, 30 bp, Homo sapiens
tgctggtcggatcatcatggttgtggcctt

SEQ ID NO: 23895 - DNA, 30 bp, Homo sapiens
tagctggttctcactgcccaggtggaaatg

SEQ ID NO: 23896 - DNA, 30 bp, Homo sapiens
caaaggccgtatcatcatgcgagaggcacg

SEQ ID NO: 23897 - DNA, 30 bp, Homo sapiens
aataggcttgatcatcatctgaactgctct

SEQ ID NO: 23898 - DNA, 30 bp, Homo sapiens
tagtggaaggtgttggggttcggtcggatc

SEQ ID NO: 23899 - DNA, 30 bp, Homo sapiens
tgttggatggatcaacattttggttgattt

SEQ ID NO: 23900 - DNA, 30 bp, Homo sapiens
aggaggctgcctctgctgccatgggctgga

SEQ ID NO: 23901 - DNA, 30 bp, Homo sapiens
ttttggtccacgtgccccattgaattccag

SEQ ID NO: 23902 - DNA, 30 bp, Homo sapiens
ttcaggggccgaatgagcatggcggccttc

SEQ ID NO: 23903 - DNA, 30 bp, Homo sapiens
aaggcttgaagtcttctgggcggattttca

SEQ ID NO: 23904 - DNA, 30 bp, Homo sapiens
ggctgggagcgccgctgtgtggagtctctc

SEQ ID NO: 23905 - DNA, 30 bp, Homo sapiens
cccaggctgctccctgaaaactcaaggagc

SEQ ID NO: 23906 - DNA, 30 bp, Homo sapiens
caggggttgggtgtcgaggtgtgatcctcc

SEQ ID NO: 23907 - DNA, 30 bp, Homo sapiens
tttcaggctggcccgcttcactatctgcgc

SEQ ID NO: 23908 - DNA, 30 bp, Homo sapiens
caaagtcatctttggctgaaggaagatcag

SEQ ID NO: 23909 - DNA, 30 bp, Homo sapiens
actgctcggtgtcactcttcaatacaacac

SEQ ID NO: 23910 - DNA, 30 bp, Homo sapiens
ttaccacggtgtgtccatgctcatcaatgt

SEQ ID NO: 23911 - DNA, 30 bp, Homo sapiens
gagtggctcttcttttccacatgccggatt

SEQ ID NO: 23912 - DNA, 30 bp, Homo sapiens
tgcaggctctgggttggctttctggacatg

SEQ ID NO: 23913 - DNA, 30 bp, Homo sapiens
gccaggtccctcctgccaatggccacgagg

SEQ ID NO: 23914 - DNA, 30 bp, Homo sapiens
tgtaccagctcttcatacagttgcttggcc

SEQ ID NO: 23915 - DNA, 30 bp, Homo sapiens
tcaaggcagcttccagtgctcgagctttct

SEQ ID NO: 23916 - DNA, 30 bp, Homo sapiens
tcaaacatctgaagagggaggttaagaaac

SEQ ID NO: 23917 - DNA, 30 bp, Homo sapiens
ccagagtcagtacatcaaaacaaatgttgc

SEQ ID NO: 23918 - DNA, 30 bp, Homo sapiens
tcattctcctctctcatttccacgatgtct

SEQ ID NO: 23919 - DNA, 30 bp, Homo sapiens
atgaggtgcccacgtgccaggccaaatctg

SEQ ID NO: 23920 - DNA, 30 bp, Homo sapiens
caaaggccaccctcacctgatgcttggccg

SEQ ID NO: 23921 - DNA, 30 bp, Homo sapiens
atcgggtatctcttcctctgtctcctgctc

SEQ ID NO: 23922 - DNA, 30 bp, Homo sapiens
acttgaggtttgaggtgtttgacttgaaac

SEQ ID NO: 23923 - DNA, 30 bp, Homo sapiens
cggctcctggcttagaaccacccagagtgg

SEQ ID NO: 23924 - DNA, 30 bp, Homo sapiens
ccccgggcctggatgtcctggggatgaagc

SEQ ID NO: 23925 - DNA, 30 bp, Homo sapiens
ctgaaaccagagatgggggctgctgtcagc

SEQ ID NO: 23926 - DNA, 30 bp, Homo sapiens
tacagggcggcaagctcagccaggcgcgcc

SEQ ID NO: 23927 - DNA, 30 bp, Homo sapiens
cactggaattcttctctcctcctggaaact

SEQ ID NO: 23928 - DNA, 30 bp, Homo sapiens
acacctgtggccctgcaggagcatcctgta

SEQ ID NO: 23929 - DNA, 30 bp, Homo sapiens
gctacagctagatccatagaattatatcca

SEQ ID NO: 23930 - DNA, 30 bp, Homo sapiens
aatgtagctatgcgagaggtcttgtaggag

SEQ ID NO: 23931 - DNA, 30 bp, Homo sapiens
ttctggaggttcaagagaaactgggcacac

SEQ ID NO: 23932 - DNA, 30 bp, Homo sapiens
ccgtggtgcaggtgcatggtgcccagcacg

SEQ ID NO: 23933 - DNA, 30 bp, Homo sapiens
tgccggcaacaatacaaagtcgtcgttgac

SEQ ID NO: 23934 - DNA, 30 bp, Homo sapiens
tataggagtcaattcaaagtcgtcgttaac

SEQ ID NO: 23935 - DNA, 30 bp, Homo sapiens
tgctggagctcagcctcttcctcctggagc

SEQ ID NO: 23936 - DNA, 30 bp, Homo sapiens
gctcggtcagtgagagcctcaggatgcgct

SEQ ID NO: 23937 - DNA, 30 bp, Homo sapiens
atcaggaaaacggcttgggtcttccttgta

SEQ ID NO: 23938 - DNA, 30 bp, Homo sapiens
tgcaggatccgctgtaagtcctcctcctcc

SEQ ID NO: 23939 - DNA, 30 bp, Homo sapiens
gtcattgcgctatggccagagccctgaagg

SEQ ID NO: 23940 - DNA, 30 bp, Homo sapiens
gtcccgactgcaggagaaacttggcacagg

SEQ ID NO: 23941 - DNA, 30 bp, Homo sapiens
cagccaagctggttcatatgcacactgttc

SEQ ID NO: 23942 - DNA, 30 bp, Homo sapiens
tcaagaagttcttgcagttatttgaagtct

SEQ ID NO: 23943 - DNA, 30 bp, Homo sapiens
tcccctttgagaatgacttcccaaggccca

SEQ ID NO: 23944 - DNA, 30 bp, Homo sapiens
cactgggctggcacaggctgaggggtctct

SEQ ID NO: 23945 - DNA, 30 bp, Homo sapiens
tacttactactccttctgttttctctctct

SEQ ID NO: 23946 - DNA, 30 bp, Homo sapiens
tcaataaagcctctttggatattagttact

SEQ ID NO: 23947 - DNA, 30 bp, Homo sapiens
aatatccagtgagctctcaccatgcttatt

SEQ ID NO: 23948 - DNA, 30 bp, Homo sapiens
caccgggtgcggggatgcgccacgtgggcc

SEQ ID NO: 23949 - DNA, 30 bp, Homo sapiens
cagcggccctgagcctggagtctctgcatc

SEQ ID NO: 23950 - DNA, 30 bp, Homo sapiens
catattctcttgatgctttccaaactagat

SEQ ID NO: 23951 - DNA, 30 bp, Homo sapiens
aggaccgggaagcactaacctcttggggag

SEQ ID NO: 23952 - DNA, 30 bp, Homo sapiens
agtaggtctcagaatcggagtcgttgagct

SEQ ID NO: 23953 - DNA, 30 bp, Homo sapiens
atcaggatctccgttaaatatagcttgcac

SEQ ID NO: 23954 - DNA, 30 bp, Homo sapiens
ttctgggaccttctttacttctcaggagac

SEQ ID NO: 23955 - DNA, 30 bp, Homo sapiens
gttcagtgtgtttgttcacattatcttgtt

SEQ ID NO: 23956 - DNA, 30 bp, Homo sapiens
ccaaggccactttctttcaggaagtttgaa

SEQ ID NO: 23957 - DNA, 30 bp, Homo sapiens
attccacacaaaacttccaatgctgatcca

SEQ ID NO: 23958 - DNA, 30 bp, Homo sapiens
tacctgttcccagcctgtcctatcccatct

SEQ ID NO: 23959 - DNA, 30 bp, Homo sapiens
cttctgtgccattctggcctcctcctcctg

SEQ ID NO: 23960 - DNA, 30 bp, Homo sapiens
cgtcctcttcttccagggcgcagtgcgcct

SEQ ID NO: 23961 - DNA, 30 bp, Homo sapiens
agcgccctggctccccaggcccacctagac

SEQ ID NO: 23962 - DNA, 30 bp, Homo sapiens
tgttggcataagcactttttgaccacaaga

SEQ ID NO: 23963 - DNA, 30 bp, Homo sapiens
ctgaggagcttctttttacttcttaagtca

SEQ ID NO: 23964 - DNA, 30 bp, Homo sapiens
tcctcttccatgctaaggatttgcagcagg

SEQ ID NO: 23965 - DNA, 30 bp, Homo sapiens
ccttgctgcattcttcaatatttgtaccat

SEQ ID NO: 23966 - DNA, 30 bp, Homo sapiens
aatttggtcatcctgttttttaataatttt

SEQ ID NO: 23967 - DNA, 30 bp, Homo sapiens
aatttgttcatcctgttttttaataatttt

SEQ ID NO: 23968 - DNA, 30 bp, Homo sapiens
cccactggtattttctacacttccgagact

SEQ ID NO: 23969 - DNA, 30 bp, Homo sapiens
agctggatagcaggtcccgcaggtcactgt

SEQ ID NO: 23970 - DNA, 30 bp, Homo sapiens
atagcaaggcctttcagtcagtgtggatgc

SEQ ID NO: 23971 - DNA, 30 bp, Homo sapiens
ttcaagtccaaagagccccagcccaaagct

SEQ ID NO: 23972 - DNA, 30 bp, Homo sapiens
cacaaacacccctccagaagaaaccttttt

SEQ ID NO: 23973 - DNA, 30 bp, Homo sapiens
aggaggttctggaaggtttccattgtagtc

SEQ ID NO: 23974 - DNA, 30 bp, Homo sapiens
agctggccctgcagttctttgatggtcttc

SEQ ID NO: 23975 - DNA, 30 bp, Homo sapiens
ctctttgtttgactcacaagaagcgctgtc

SEQ ID NO: 23976 - DNA, 30 bp, Homo sapiens
gtctggtgccggaagaacttcttagttctc

SEQ ID NO: 23977 - DNA, 30 bp, Homo sapiens
acttggctgtgtcagctccgctggttatta

SEQ ID NO: 23978 - DNA, 30 bp, Homo sapiens
tccaggtgtggaacggggtccatttgacct

SEQ ID NO: 23979 - DNA, 30 bp, Homo sapiens
agttggaggtatcatcttgacttctcttct

SEQ ID NO: 23980 - DNA, 30 bp, Homo sapiens
agatggcctggattcggcttctgtcttgcc

SEQ ID NO: 23981 - DNA, 30 bp, Homo sapiens
atgcaccagttcaggctggttttccacgaa

SEQ ID NO: 23982 - DNA, 30 bp, Homo sapiens
acaatttcaaagaggtagtgatagatactt

SEQ ID NO: 23983 - DNA, 30 bp, Homo sapiens
atctgaagcttcagagcttgtttaaggctt

SEQ ID NO: 23984 - DNA, 30 bp, Homo sapiens
aacccaatggcgccgggccgctcctggctg

SEQ ID NO: 23985 - DNA, 30 bp, Homo sapiens
ttgtggggagggcagggtggggagtccttg

SEQ ID NO: 23986 - DNA, 30 bp, Homo sapiens
ttctccaaaggaatccacagtctgatagta

SEQ ID NO: 23987 - DNA, 30 bp, Homo sapiens
ctccatgctctgcatctgcagactgaggga

SEQ ID NO: 23988 - DNA, 30 bp, Homo sapiens
ggttggcagaatgttcactctcttctgctg

SEQ ID NO: 23989 - DNA, 30 bp, Homo sapiens
gcaccctagtccttagtttggcaagttcct

SEQ ID NO: 23990 - DNA, 30 bp, Homo sapiens
atgaggggtcatcgtcatcttctcagacct

SEQ ID NO: 23991 - DNA, 30 bp, Homo sapiens
aagaggtatatgccaagtcataacagcagt

SEQ ID NO: 23992 - DNA, 30 bp, Homo sapiens
acagagtaactgttgacatgctaagtttca

SEQ ID NO: 23993 - DNA, 30 bp, Homo sapiens
accgctgagcacgcagcaccacagcctcgg

SEQ ID NO: 23994 - DNA, 30 bp, Homo sapiens
ccgtggactctatgccctcacactccttct

SEQ ID NO: 23995 - DNA, 30 bp, Homo sapiens
ccacggtaggcccatgccctcgctctgcag

SEQ ID NO: 23996 - DNA, 30 bp, Homo sapiens
ccttggtattgctgggcctggtggggcctc

SEQ ID NO: 23997 - DNA, 30 bp, Homo sapiens
ccatggctcgcagtgaattgtgggtatcta

SEQ ID NO: 23998 - DNA, 30 bp, Homo sapiens
ctttgccagtgaggtccaacggctgcagga

SEQ ID NO: 23999 - DNA, 30 bp, Homo sapiens
agagtctggtttggggtccacaacccagga

SEQ ID NO: 24000 - DNA, 30 bp, Homo sapiens
cagtgtgtctctctgatggttcctgcccgg

SEQ ID NO: 24001 - DNA, 30 bp, Homo sapiens
tcgtggtttcatacttggtattaatgcccc

SEQ ID NO: 24002 - DNA, 30 bp, Homo sapiens
agatgggtcgatctgctttaaaacagaaag

SEQ ID NO: 24003 - DNA, 30 bp, Homo sapiens
acttcttcccgttcagcacctgcagcttct

SEQ ID NO: 24004 - DNA, 30 bp, Homo sapiens
cacaggctggtgtcgaccagctgcccaggc

SEQ ID NO: 24005 - DNA, 30 bp, Homo sapiens
cacaggggctgttgccaggggccctggtgt

SEQ ID NO: 24006 - DNA, 30 bp, Homo sapiens
cctcgggtagtcaagttagaaatgctcttt

SEQ ID NO: 24007 - DNA, 30 bp, Homo sapiens
cacagctaagcagtagattgcgttctccca

SEQ ID NO: 24008 - DNA, 30 bp, Homo sapiens
aagagggcctccctgcctgacggcgatgat

SEQ ID NO: 24009 - DNA, 30 bp, Homo sapiens
taaggctttccaataggtttgtagcaagca

SEQ ID NO: 24010 - DNA, 30 bp, Homo sapiens
tacaggacgcccccgtggtaggcatggctg

SEQ ID NO: 24011 - DNA, 30 bp, Homo sapiens
ccttcccgctttccattggttcctccttca

SEQ ID NO: 24012 - DNA, 30 bp, Homo sapiens
cccaggacctatgacagtgcctggcactga

SEQ ID NO: 24013 - DNA, 30 bp, Homo sapiens
cattggtgtgctgagagcctgacgacatca

SEQ ID NO: 24014 - DNA, 30 bp, Homo sapiens
tcatggtgaacaggctgaccactttttctc

SEQ ID NO: 24015 - DNA, 30 bp, Homo sapiens
gttgtggtgtgcttttccattcttcttcct

SEQ ID NO: 24016 - DNA, 30 bp, Homo sapiens
gtgctttgttttcctcaatcatgacatgct

SEQ ID NO: 24017 - DNA, 30 bp, Homo sapiens
agctatcacccccatatttttcgtcatatc

SEQ ID NO: 24018 - DNA, 30 bp, Homo sapiens
agttggccccaaagaaagtagaaggaaaaa

SEQ ID NO: 24019 - DNA, 30 bp, Homo sapiens
agctggctggccttgggaaccgtgaagggt

SEQ ID NO: 24020 - DNA, 30 bp, Homo sapiens
atgcggcaaggtcatgggtcactgagtgga

SEQ ID NO: 24021 - DNA, 30 bp, Homo sapiens
cgctgggccagcacacggcctgggggctgg

SEQ ID NO: 24022 - DNA, 30 bp, Homo sapiens
acgtctgtgctcctggcactgaagatggat

SEQ ID NO: 24023 - DNA, 30 bp, Homo sapiens
atgtggatgacgatgcttaagatgagatct

SEQ ID NO: 24024 - DNA, 30 bp, Homo sapiens
agtcatcatcttctccctcatcttcaggtt

SEQ ID NO: 24025 - DNA, 30 bp, Homo sapiens
tcatctgtttctctcttcctcttttcacct

SEQ ID NO: 24026 - DNA, 30 bp, Homo sapiens
tcttcttcaccaagctcttcttcatcttcc

SEQ ID NO: 24027 - DNA, 30 bp, Homo sapiens
aagtgaaaaggtctaagctctcgaggtttt

SEQ ID NO: 24028 - DNA, 30 bp, Homo sapiens
catcgtcttcagcatctcgtttcctcttct

SEQ ID NO: 24029 - DNA, 30 bp, Homo sapiens
tcctcttctccctctcccaactctgaacct

SEQ ID NO: 24030 - DNA, 30 bp, Homo sapiens
cactggagcaccacctccttgttctccttc

SEQ ID NO: 24031 - DNA, 30 bp, Homo sapiens
agaaggccttggaggagggcgggagggagg

SEQ ID NO: 24032 - DNA, 30 bp, Homo sapiens
tctcctcggcagggggtggagggacctcct

SEQ ID NO: 24033 - DNA, 30 bp, Homo sapiens
aagcagctgttgtggggcctgatgcaattt

SEQ ID NO: 24034 - DNA, 30 bp, Homo sapiens
tacaaacctcatctccttcctgaggtcgca

SEQ ID NO: 24035 - DNA, 30 bp, Homo sapiens
tactgagatggaactcgggagaagtttatg

SEQ ID NO: 24036 - DNA, 30 bp, Homo sapiens
aagttgggctctgagggggggagtgacaaa

SEQ ID NO: 24037 - DNA, 30 bp, Homo sapiens
caaagagccaccaggattttctcataatct

SEQ ID NO: 24038 - DNA, 30 bp, Homo sapiens
catcaccagcacagatggcaagcagtgctt

SEQ ID NO: 24039 - DNA, 30 bp, Homo sapiens
cagatcttcagcagaatcttccggtaatcc

SEQ ID NO: 24040 - DNA, 30 bp, Homo sapiens
aagagggctactagcagtttccggaagtcc

SEQ ID NO: 24041 - DNA, 30 bp, Homo sapiens
cacaggtacagcagcgctttctggtagtcg

SEQ ID NO: 24042 - DNA, 30 bp, Homo sapiens
atccgtgaacagcacgcccagagtacagag

SEQ ID NO: 24043 - DNA, 30 bp, Homo sapiens
cagatttttaagagtgtgatttcatagtct

SEQ ID NO: 24044 - DNA, 30 bp, Homo sapiens
cagagaacaagcagtactttcctgtagtct

SEQ ID NO: 24045 - DNA, 30 bp, Homo sapiens
agcagcagaagagctttcttatagtcccca

SEQ ID NO: 24046 - DNA, 30 bp, Homo sapiens
tcctcaccaccacagagagccagcaaggcc

SEQ ID NO: 24047 - DNA, 30 bp, Homo sapiens
tactggcccacaatagccagaagaagtctt

SEQ ID NO: 24048 - DNA, 30 bp, Homo sapiens
caggggtcgctgcccaccaggctcagcagg

SEQ ID NO: 24049 - DNA, 30 bp, Homo sapiens
acaaggccaggagggctgactggcaatccc

SEQ ID NO: 24050 - DNA, 30 bp, Homo sapiens
cagcggaagggttactgatcccgggagcac

SEQ ID NO: 24051 - DNA, 30 bp, Homo sapiens
ccttggtctccaaacacctgtttaatctgg

SEQ ID NO: 24052 - DNA, 30 bp, Homo sapiens
cacaggtctataggtcccattgtagctaaa

SEQ ID NO: 24053 - DNA, 30 bp, Homo sapiens
ccgtggtaagagaaagggggtaagtccggg

SEQ ID NO: 24054 - DNA, 30 bp, Homo sapiens
agttgtgagagaagcccccgtgggagaagg

SEQ ID NO: 24055 - DNA, 30 bp, Homo sapiens
cccaggccaccaaatcctctcccagctgaa

SEQ ID NO: 24056 - DNA, 30 bp, Homo sapiens
ccaaggaacgtaggatccaggttcatctct

SEQ ID NO: 24057 - DNA, 30 bp, Homo sapiens
cgagtctgttgatctgtgtcagaatgcctt

SEQ ID NO: 24058 - DNA, 30 bp, Homo sapiens
ttgaggatggtctcgtaggcctggtacacg

SEQ ID NO: 24059 - DNA, 30 bp, Homo sapiens
ttgccaggactgagggggaaagttgttcac

SEQ ID NO: 24060 - DNA, 30 bp, Homo sapiens
ttccacaggcaagttgttcacctcaaagat

SEQ ID NO: 24061 - DNA, 30 bp, Homo sapiens
cactgggtccggagctggtaatctccattc

SEQ ID NO: 24062 - DNA, 30 bp, Homo sapiens
tagctggtacgaagttggtaatcgccactc

SEQ ID NO: 24063 - DNA, 30 bp, Homo sapiens
ccatctcctccagcacactccgtggcgact

SEQ ID NO: 24064 - DNA, 30 bp, Homo sapiens
acgtggggtttcagcttcctcctgcagtag

SEQ ID NO: 24065 - DNA, 30 bp, Homo sapiens
acatatcagagtcttcaatggctttgacag

SEQ ID NO: 24066 - DNA, 30 bp, Homo sapiens
gctcacacaggtgacgggagacgggctcct

SEQ ID NO: 24067 - DNA, 30 bp, Homo sapiens
ttgtgcgcagcgtgagccggtacatctggg

SEQ ID NO: 24068 - DNA, 30 bp, Homo sapiens
agatgtattgagagacttcaggagctctac

SEQ ID NO: 24069 - DNA, 30 bp, Homo sapiens
ctgcggccaatgtagcgcacccatttgatg

SEQ ID NO: 24070 - DNA, 30 bp, Homo sapiens
ctccagggactgtagcatcagcagctgttt

SEQ ID NO: 24071 - DNA, 30 bp, Homo sapiens
agacaggacaggcttcagttcccgcagcag

SEQ ID NO: 24072 - DNA, 30 bp, Homo sapiens
ctccgggggctcaagtggttcatactagaa

SEQ ID NO: 24073 - DNA, 30 bp, Homo sapiens
cactgggtcagagcctgtatcacatccttt

SEQ ID NO: 24074 - DNA, 30 bp, Homo sapiens
acttggccagcgtcgccttcatctcttcta

SEQ ID NO: 24075 - DNA, 30 bp, Homo sapiens
acttggaactttccagctttcgtgacgtat

SEQ ID NO: 24076 - DNA, 30 bp, Homo sapiens
aggttcgaacttggaacttcccagctttgg

SEQ ID NO: 24077 - DNA, 30 bp, Homo sapiens
gtttggcacttttatactgatgtcaccaat

SEQ ID NO: 24078 - DNA, 30 bp, Homo sapiens
ctgtctgggagactgaaagataaaggtctc

SEQ ID NO: 24079 - DNA, 30 bp, Homo sapiens
acaaactgggacaggttgggaactttgatg

SEQ ID NO: 24080 - DNA, 30 bp, Homo sapiens
tccaggctccaatagcagttctgttaagaa

SEQ ID NO: 24081 - DNA, 30 bp, Homo sapiens
atcaccttttgacactgatacagtaaatag

SEQ ID NO: 24082 - DNA, 30 bp, Homo sapiens
atccgaatgacataggcgtcgctgtggctt

SEQ ID NO: 24083 - DNA, 30 bp, Homo sapiens
agatccagggtgtagtgagccatgatcgca

SEQ ID NO: 24084 - DNA, 30 bp, Homo sapiens
agctttctgacatcttatcaagaattagta

SEQ ID NO: 24085 - DNA, 30 bp, Homo sapiens
agatgggggtggtggaggcagctcctttga

SEQ ID NO: 24086 - DNA, 30 bp, Homo sapiens
gcccacggaggtagtcccccgccaggggca

SEQ ID NO: 24087 - DNA, 30 bp, Homo sapiens
gttactggagcaggggctttagaattccag

SEQ ID NO: 24088 - DNA, 30 bp, Homo sapiens
cagcggggccaagcggcactgaattccttc

SEQ ID NO: 24089 - DNA, 30 bp, Homo sapiens
accctggcatgaggccggcctccctctcca

SEQ ID NO: 24090 - DNA, 30 bp, Homo sapiens
ttatccacagtcacatatgttttgaagtca

SEQ ID NO: 24091 - DNA, 30 bp, Homo sapiens
gtgtagaaggtctgtgaggattccccagtg

SEQ ID NO: 24092 - DNA, 30 bp, Homo sapiens
aacaggctgctcctgggccgtcagcagcct

SEQ ID NO: 24093 - DNA, 30 bp, Homo sapiens
atttgggtattgccagcccttttcttcttt

SEQ ID NO: 24094 - DNA, 30 bp, Homo sapiens
tgtacagcggggtctcctgacccgtgagga

SEQ ID NO: 24095 - DNA, 30 bp, Homo sapiens
cacaggtacacgggctgctcctggcctgta

SEQ ID NO: 24096 - DNA, 30 bp, Homo sapiens
catggggtatgggcccccagccgtttgggc

SEQ ID NO: 24097 - DNA, 30 bp, Homo sapiens
gacacgttgcctctcttcttttgcaaagct

SEQ ID NO: 24098 - DNA, 30 bp, Homo sapiens
tttcggtgacagggcgtttctgtttcaaag

SEQ ID NO: 24099 - DNA, 30 bp, Homo sapiens
atatggagcagagagggtttcagccggaag

SEQ ID NO: 24100 - DNA, 30 bp, Homo sapiens
gaatggcgcttaggactttgggttccactg

SEQ ID NO: 24101 - DNA, 30 bp, Homo sapiens
ttccaggagggtggcggaggcagtggccgg

SEQ ID NO: 24102 - DNA, 30 bp, Homo sapiens
cagcagagggacaaggcaggcaagtgcagc

SEQ ID NO: 24103 - DNA, 30 bp, Homo sapiens
cagtggaggaaggccagccctagaactagg

SEQ ID NO: 24104 - DNA, 30 bp, Homo sapiens
acccacaccaagggtttgatgatgacatat

SEQ ID NO: 24105 - DNA, 30 bp, Homo sapiens
tgtgtgcgtagccagagcacagcattcatg

SEQ ID NO: 24106 - DNA, 30 bp, Homo sapiens
atgaacttgtggcccagcatggtggcacat

SEQ ID NO: 24107 - DNA, 30 bp, Homo sapiens
gctaggtatagggtgataggacagtgatca

SEQ ID NO: 24108 - DNA, 30 bp, Homo sapiens
agctgggcctgctccagaggaagaagttgc

SEQ ID NO: 24109 - DNA, 30 bp, Homo sapiens
gtcctcgggtgggatgcgcagggcagaata

SEQ ID NO: 24110 - DNA, 30 bp, Homo sapiens
acaagaggctgcgctgaatacttcggaggg

SEQ ID NO: 24111 - DNA, 30 bp, Homo sapiens
atctggagcgctggttgtaaagaagaaagt

SEQ ID NO: 24112 - DNA, 30 bp, Homo sapiens
ctacgatttcctcgtgtgccccaacctcgg

SEQ ID NO: 24113 - DNA, 30 bp, Homo sapiens
cttcccctgaaggctcctctcataattaaa

SEQ ID NO: 24114 - DNA, 30 bp, Homo sapiens
tctccaactgggagctgtgaaggatcaagt

SEQ ID NO: 24115 - DNA, 30 bp, Homo sapiens
cttccttctcttcatcttcctttcctggtt

SEQ ID NO: 24116 - DNA, 30 bp, Homo sapiens
tccagggaggggccaggaagatggactgga

SEQ ID NO: 24117 - DNA, 30 bp, Homo sapiens
tcaaccacaagggtctcctggctgtagggg

SEQ ID NO: 24118 - DNA, 30 bp, Homo sapiens
cagggtcgttcctccaggaagcggtaagtg

SEQ ID NO: 24119 - DNA, 30 bp, Homo sapiens
aaatctgcatctgctccaggtatttgtagg

SEQ ID NO: 24120 - DNA, 30 bp, Homo sapiens
gcctggaggctgagtctgcagaggaagggg

SEQ ID NO: 24121 - DNA, 30 bp, Homo sapiens
cactgggtgttgagcttcttagtgtactcc

SEQ ID NO: 24122 - DNA, 30 bp, Homo sapiens
cactgggtggcaggctgtgttccaagttcc

SEQ ID NO: 24123 - DNA, 30 bp, Homo sapiens
caaaggggccagcatctgcacctgctcctg

SEQ ID NO: 24124 - DNA, 30 bp, Homo sapiens
caggggtcccccagatggctgtggccctgg

SEQ ID NO: 24125 - DNA, 30 bp, Homo sapiens
tcctggagcaagcttcatgtaggggttcat

SEQ ID NO: 24126 - DNA, 30 bp, Homo sapiens
catctccaagccacagaaggatgtatcagc

SEQ ID NO: 24127 - DNA, 30 bp, Homo sapiens
ttcaggatgtctgccaacttctcctcgtag

SEQ ID NO: 24128 - DNA, 30 bp, Homo sapiens
gtttccctgattctggagaatggcccgcag

SEQ ID NO: 24129 - DNA, 30 bp, Homo sapiens
cactggagaatctcccgtagccttcttttc

SEQ ID NO: 24130 - DNA, 30 bp, Homo sapiens
agggtctgccttgttccctgcctgcggtca

SEQ ID NO: 24131 - DNA, 30 bp, Homo sapiens
actcgagaatctcctgcagcttgctgtcca

SEQ ID NO: 24132 - DNA, 30 bp, Homo sapiens
tactacgtccagttttacgacaaattcggt

SEQ ID NO: 24133 - DNA, 30 bp, Homo sapiens
gttttcctgattctggagaatggcccgcag

SEQ ID NO: 24134 - DNA, 30 bp, Homo sapiens
cctgagaatctcccccagcatgatgtgcag

SEQ ID NO: 24135 - DNA, 30 bp, Homo sapiens
aacgaccctgcgcacgtacccctggaatct

SEQ ID NO: 24136 - DNA, 30 bp, Homo sapiens
aagccgtcgctttatggctcgactgttttt

SEQ ID NO: 24137 - DNA, 30 bp, Homo sapiens
tgctacttgcaaactgttctgtgatttcca

SEQ ID NO: 24138 - DNA, 30 bp, Homo sapiens
cactggggcttaggccggcccagacgggct

SEQ ID NO: 24139 - DNA, 30 bp, Homo sapiens
gagtcaatcttgagtttctccttcactttc

SEQ ID NO: 24140 - DNA, 30 bp, Homo sapiens
ccttcagcacagaaagaacttggtcagtaa

SEQ ID NO: 24141 - DNA, 30 bp, Homo sapiens
ccacggctgaagttggtctgacctcagggt

SEQ ID NO: 24142 - DNA, 30 bp, Homo sapiens
tccttgtccccacagacaagcctggggcac

SEQ ID NO: 24143 - DNA, 30 bp, Homo sapiens
tacgagagcttggggcagttcacctggtct

SEQ ID NO: 24144 - DNA, 30 bp, Homo sapiens
cgctgggcacaggggcggcgctggtgccca

SEQ ID NO: 24145 - DNA, 30 bp, Homo sapiens
cccaggatctaagtcatagctcttgattat

SEQ ID NO: 24146 - DNA, 30 bp, Homo sapiens
tagcatggctttacatcggatgcatcagtt

SEQ ID NO: 24147 - DNA, 30 bp, Homo sapiens
tcttggtccgcctgcagaatcttataatta

SEQ ID NO: 24148 - DNA, 30 bp, Homo sapiens
cattggtcttggcctggctgcagcatctca

SEQ ID NO: 24149 - DNA, 30 bp, Homo sapiens
cagtgggtatggcatggattcagacgctga

SEQ ID NO: 24150 - DNA, 30 bp, Homo sapiens
ctgcttttagactctgatggatatgggtga

SEQ ID NO: 24151 - DNA, 30 bp, Homo sapiens
tcccggggcctgtctcccctttcttgctgg

SEQ ID NO: 24152 - DNA, 30 bp, Homo sapiens
ccacatccacacatgctcccttaactcctt

SEQ ID NO: 24153 - DNA, 30 bp, Homo sapiens
acgctggtcagcagagatcttgaggtcgtg

SEQ ID NO: 24154 - DNA, 30 bp, Homo sapiens
tattggacagctcacaggcctcttgattcc

SEQ ID NO: 24155 - DNA, 30 bp, Homo sapiens
tccaggtgaattcttcacatttcctggctt

SEQ ID NO: 24156 - DNA, 30 bp, Homo sapiens
gggtgggactgcccgtgatccatgagcttg

SEQ ID NO: 24157 - DNA, 30 bp, Homo sapiens
tgctcctcttcttttgtttctgtttaagct

SEQ ID NO: 24158 - DNA, 30 bp, Homo sapiens
cctttccagggccacttttcccatgaagaa

SEQ ID NO: 24159 - DNA, 30 bp, Homo sapiens
agaagtccgccatttcttctgcattcaatg

SEQ ID NO: 24160 - DNA, 30 bp, Homo sapiens
tcagttctcaggcccaggcctttagttttt

SEQ ID NO: 24161 - DNA, 30 bp, Homo sapiens
tgtaggttggattttcgtagccgttctgct

SEQ ID NO: 24162 - DNA, 30 bp, Homo sapiens
gcagctcggtccctcgacattctgagaaat

SEQ ID NO: 24163 - DNA, 30 bp, Homo sapiens
tctcccaaatcactctcttctgactggcta

SEQ ID NO: 24164 - DNA, 30 bp, Homo sapiens
cttcggattctgcgcctctatgttcgtttg

SEQ ID NO: 24165 - DNA, 30 bp, Homo sapiens
tgcaggagagagaagaagggtacaggtgcc

SEQ ID NO: 24166 - DNA, 30 bp, Homo sapiens
gccagcagatcatccacgacgaccaccctc

SEQ ID NO: 24167 - DNA, 30 bp, Homo sapiens
cttcctgagatgttctttcagctgaggaat

SEQ ID NO: 24168 - DNA, 30 bp, Homo sapiens
tcctggctgatcacatgaagatgtacatgg

SEQ ID NO: 24169 - DNA, 30 bp, Homo sapiens
cccaggcacttgcgcaggtgagtcggtgag

SEQ ID NO: 24170 - DNA, 30 bp, Homo sapiens
tatttgggcttcatctccaccctggagttg

SEQ ID NO: 24171 - DNA, 30 bp, Homo sapiens
catagcttacactccagcatctgagctgag

SEQ ID NO: 24172 - DNA, 30 bp, Homo sapiens
ccatggaaggaaaaagctgaacatcaaaat

SEQ ID NO: 24173 - DNA, 30 bp, Homo sapiens
agctggaatgtggcccctcaacaccactgc

SEQ ID NO: 24174 - DNA, 30 bp, Homo sapiens
ggccttggtaccccgtggcaggctctgcgg

SEQ ID NO: 24175 - DNA, 30 bp, Homo sapiens
cagtggatgctcaaggccagggcagcggag

SEQ ID NO: 24176 - DNA, 30 bp, Homo sapiens
cagatctgctccttgtgcttcacatgggcc

SEQ ID NO: 24177 - DNA, 30 bp, Homo sapiens
cagattggtctttccccttcttctcctctc

SEQ ID NO: 24178 - DNA, 30 bp, Homo sapiens
cagcgggtggtcagctccatggtcttcttc

SEQ ID NO: 24179 - DNA, 30 bp, Homo sapiens
ccacggctcccgaacccggctgggattcct

SEQ ID NO: 24180 - DNA, 30 bp, Homo sapiens
aatcctccaatttcaggggctcccgtggga

SEQ ID NO: 24181 - DNA, 30 bp, Homo sapiens
caaaggaatgggcctgggcaggggcagtac

SEQ ID NO: 24182 - DNA, 30 bp, Homo sapiens
tctagggccatggattcatgtaagggtggg

SEQ ID NO: 24183 - DNA, 30 bp, Homo sapiens
cttcaggatgaggcgggtcttcccatctcc

SEQ ID NO: 24184 - DNA, 30 bp, Homo sapiens
catgatgacactgagttcatatttctctgg

SEQ ID NO: 24185 - DNA, 30 bp, Homo sapiens
atgacagcaccaaccaaagggcccactaca

SEQ ID NO: 24186 - DNA, 30 bp, Homo sapiens
acttggtctcttctggggcagatgtggcat

SEQ ID NO: 24187 - DNA, 30 bp, Homo sapiens
tgctggcgcacaggtacttctgtttccctg

SEQ ID NO: 24188 - DNA, 30 bp, Homo sapiens
caatgggcaaaacatggtccctggcagtct

SEQ ID NO: 24189 - DNA, 30 bp, Homo sapiens
tgagactccaaacaccctcaagattctttc

SEQ ID NO: 24190 - DNA, 30 bp, Homo sapiens
gtctggtcattttgagatgcttgcaattgc

SEQ ID NO: 24191 - DNA, 30 bp, Homo sapiens
cactgggtgtggaaatagatgggcttgact

SEQ ID NO: 24192 - DNA, 30 bp, Homo sapiens
gcacaaggcgggctgcgctgagtaggcagg

SEQ ID NO: 24193 - DNA, 30 bp, Homo sapiens
acctgggaccctggggggttagcaactcat

SEQ ID NO: 24194 - DNA, 30 bp, Homo sapiens
tgaaggcagccacactccggcgcatttcat

SEQ ID NO: 24195 - DNA, 30 bp, Homo sapiens
tcaaaatctgctcatcctgtaattcttttg

SEQ ID NO: 24196 - DNA, 30 bp, Homo sapiens
gtgaggggctggctggagggtggactggaa

SEQ ID NO: 24197 - DNA, 30 bp, Homo sapiens
actcgggctgggtccggtcactggccacgg

SEQ ID NO: 24198 - DNA, 30 bp, Homo sapiens
ggaaagtggtctctgtggaaaacctgacgg

SEQ ID NO: 24199 - DNA, 30 bp, Homo sapiens
tcttgtcgaagtttctttcgttcctcagct

SEQ ID NO: 24200 - DNA, 30 bp, Homo sapiens
ccctcgcaaccctcgctgatggccagctgc

SEQ ID NO: 24201 - DNA, 30 bp, Homo sapiens
ttctggttccggagctgattggacagccag

SEQ ID NO: 24202 - DNA, 30 bp, Homo sapiens
agtccaggccttcgtacagcccgtccccgc

SEQ ID NO: 24203 - DNA, 30 bp, Homo sapiens
aagtccttcatacagaccagttccttgtgt

SEQ ID NO: 24204 - DNA, 30 bp, Homo sapiens
tcgtgggacagccagtccagaccatcgtac

SEQ ID NO: 24205 - DNA, 30 bp, Homo sapiens
gagcccctcatagagtccgtcccctgaggt

SEQ ID NO: 24206 - DNA, 30 bp, Homo sapiens
ttttggaagtggtccagaccgctgttctga

SEQ ID NO: 24207 - DNA, 30 bp, Homo sapiens
cagttctggttgtcccagccatcatcagtg

SEQ ID NO: 24208 - DNA, 30 bp, Homo sapiens
agtaggaaccgtagcgatcctgcaaggaat

SEQ ID NO: 24209 - DNA, 30 bp, Homo sapiens
ttgaagtcacgactccattagcaaagacgg

SEQ ID NO: 24210 - DNA, 30 bp, Homo sapiens
tcctgttcaggtggttgtgatatctgaaaa

SEQ ID NO: 24211 - DNA, 30 bp, Homo sapiens
cactggtgacagtgctgctggtacctgtga

SEQ ID NO: 24212 - DNA, 30 bp, Homo sapiens
acacggcccaccctgcccagccactccctc

SEQ ID NO: 24213 - DNA, 30 bp, Homo sapiens
agatggggcatccactccaggggttttcaa

SEQ ID NO: 24214 - DNA, 30 bp, Homo sapiens
gccaggagggtttctcagctcctggaggcc

SEQ ID NO: 24215 - DNA, 30 bp, Homo sapiens
tgatgtccctctgccgcggcggccggtgca

SEQ ID NO: 24216 - DNA, 30 bp, Homo sapiens
cacggggtcacggggtcacagggcagaagc

SEQ ID NO: 24217 - DNA, 30 bp, Homo sapiens
caccctgtgagggccgagcaggcctgggtc

SEQ ID NO: 24218 - DNA, 30 bp, Homo sapiens
aggtgggttaaggtagtcaataggcttgtg

SEQ ID NO: 24219 - DNA, 30 bp, Homo sapiens
ttctcacacgtgcttgattttctgattcat

SEQ ID NO: 24220 - DNA, 30 bp, Homo sapiens
tctaccatattggaggttttctggaattcc

SEQ ID NO: 24221 - DNA, 30 bp, Homo sapiens
tttttaatgagaaggacagttttggcctgg

SEQ ID NO: 24222 - DNA, 30 bp, Homo sapiens
cgctggggtccgggcttgggaacagctccc

SEQ ID NO: 24223 - DNA, 30 bp, Homo sapiens
ctgtggaatcagccccctcttgccgttcag

SEQ ID NO: 24224 - DNA, 30 bp, Homo sapiens
tttcctgattccactctgcaaacttttttg

SEQ ID NO: 24225 - DNA, 30 bp, Homo sapiens
ggatgttttggagaacctttgtaccaggcc

SEQ ID NO: 24226 - DNA, 30 bp, Homo sapiens
cgttgtcttctctttctcttatattcacca

SEQ ID NO: 24227 - DNA, 30 bp, Homo sapiens
agatggaactcagttccagaagaattaatt

SEQ ID NO: 24228 - DNA, 30 bp, Homo sapiens
agccgaagatcttactgtactcactcagca

SEQ ID NO: 24229 - DNA, 30 bp, Homo sapiens
cacagggcagtgctctcggtatcattgtct

SEQ ID NO: 24230 - DNA, 30 bp, Homo sapiens
cagcatttgggttaagctgatataaatcct

SEQ ID NO: 24231 - DNA, 30 bp, Homo sapiens
ttcccctctttcttcccttcagaccacttc

SEQ ID NO: 24232 - DNA, 30 bp, Homo sapiens
ctcaatgtcgcagaccactgtaggccctga

SEQ ID NO: 24233 - DNA, 30 bp, Homo sapiens
taaagacagggatgaaactctgctttactg

SEQ ID NO: 24234 - DNA, 30 bp, Homo sapiens
agtagaaaagctgatccccacgcagcacaa

SEQ ID NO: 24235 - DNA, 30 bp, Homo sapiens
actttggggccctggcaccttttgccccaa

SEQ ID NO: 24236 - DNA, 30 bp, Homo sapiens
tgcaggcgggaggcggccgagcggcgcggg

SEQ ID NO: 24237 - DNA, 30 bp, Homo sapiens
tgtgtttcctctctcggttctcctgggttc

SEQ ID NO: 24238 - DNA, 30 bp, Homo sapiens
agcctcggtcttgggttccttcatggattt

SEQ ID NO: 24239 - DNA, 30 bp, Homo sapiens
tagaggaactccacgtaattctcagggatg

SEQ ID NO: 24240 - DNA, 30 bp, Homo sapiens
tcttcggacagaggtgggcgtcgtgcccga

SEQ ID NO: 24241 - DNA, 30 bp, Homo sapiens
gtgcggcgggaagatgtccgcgcactgctg

SEQ ID NO: 24242 - DNA, 30 bp, Homo sapiens
ttgaggatttatacgatatacatccaatat

SEQ ID NO: 24243 - DNA, 30 bp, Homo sapiens
ttgtggaatttcaccttcgaggtcttcaaa

SEQ ID NO: 24244 - DNA, 30 bp, Homo sapiens
cacagtccttcacctttcccagggttagcc

SEQ ID NO: 24245 - DNA, 30 bp, Homo sapiens
acttcttccatccagaattactgatctccg

SEQ ID NO: 24246 - DNA, 30 bp, Homo sapiens
gcatggatctgtgtttcaggatgctgcaag

SEQ ID NO: 24247 - DNA, 30 bp, Homo sapiens
cttcgggtctggccctcagagtggagggac

SEQ ID NO: 24248 - DNA, 30 bp, Homo sapiens
gttcggcttgaagctgggagggaagcagtg

SEQ ID NO: 24249 - DNA, 30 bp, Homo sapiens
ttttggcctccttctcccggggcacacgga

SEQ ID NO: 24250 - DNA, 30 bp, Homo sapiens
tacagcacaccctccatgaagctggtgtcc

SEQ ID NO: 24251 - DNA, 30 bp, Homo sapiens
gtgtggcttgggggtcgtgtctaggccctg

SEQ ID NO: 24252 - DNA, 30 bp, Homo sapiens
aggtggggttctgtttaaggacccactcac

SEQ ID NO: 24253 - DNA, 30 bp, Homo sapiens
ttgccttcataagttgcctttaaccatcct

SEQ ID NO: 24254 - DNA, 30 bp, Homo sapiens
ccaggggacatgccatctagcatgggggcc

SEQ ID NO: 24255 - DNA, 30 bp, Homo sapiens
cagagggcggtgctctcagactcctcctcc

SEQ ID NO: 24256 - DNA, 30 bp, Homo sapiens
cacacgaattccggctgcctttccctgcag

SEQ ID NO: 24257 - DNA, 30 bp, Homo sapiens
ggatccgtttgtaattgtggttgtatcagc

SEQ ID NO: 24258 - DNA, 30 bp, Homo sapiens
agaaggtccgaagagccccacaccatgcca

SEQ ID NO: 24259 - DNA, 30 bp, Homo sapiens
tctcgggcagggcatcggggttgtcggtcg

SEQ ID NO: 24260 - DNA, 30 bp, Homo sapiens
tagagctgttcattttgttgaagatgctct

SEQ ID NO: 24261 - DNA, 30 bp, Homo sapiens
ttctggctgccatcaggggactcggaggta

SEQ ID NO: 24262 - DNA, 30 bp, Homo sapiens
gcagcacggaaatggggcagcagcagtggt

SEQ ID NO: 24263 - DNA, 30 bp, Homo sapiens
caggggaagaggctggtgaagttggtgagc

SEQ ID NO: 24264 - DNA, 30 bp, Homo sapiens
agtccttcttgatggtgagattccactccc

SEQ ID NO: 24265 - DNA, 30 bp, Homo sapiens
agacgggaccgacagcgacaagggggctgg

SEQ ID NO: 24266 - DNA, 30 bp, Homo sapiens
tcatggttagacgggaccgacagcgacaag

SEQ ID NO: 24267 - DNA, 30 bp, Homo sapiens
cttcttaatcgacaggttccactcccagct

SEQ ID NO: 24268 - DNA, 30 bp, Homo sapiens
agtcctggcagatgcagagaccccactccc

SEQ ID NO: 24269 - DNA, 30 bp, Homo sapiens
gtgcagccaggctgggggacagagttcccc

SEQ ID NO: 24270 - DNA, 30 bp, Homo sapiens
tatatattcagcagagggatctgccagacc

SEQ ID NO: 24271 - DNA, 30 bp, Homo sapiens
tcaagggcacctgccagatgaggagggtgc

SEQ ID NO: 24272 - DNA, 30 bp, Homo sapiens
tcctggtgacgcggctgcgtctgctgtgct

SEQ ID NO: 24273 - DNA, 30 bp, Homo sapiens
agcctttggcaaagaatggtgtaactttcc

SEQ ID NO: 24274 - DNA, 30 bp, Homo sapiens
gggtgggggggcattgggggtgcctgaaga

SEQ ID NO: 24275 - DNA, 30 bp, Homo sapiens
ccacccgcagacgctccatcctgcggacat

SEQ ID NO: 24276 - DNA, 30 bp, Homo sapiens
cacaggaggaggtggtttgtgctgtcgtct

SEQ ID NO: 24277 - DNA, 30 bp, Homo sapiens
agaagaagatgacgtcttctttgctggcgt

SEQ ID NO: 24278 - DNA, 30 bp, Homo sapiens
acacaggagcctcccccagtttgctggtgg

SEQ ID NO: 24279 - DNA, 30 bp, Homo sapiens
tagctctcggaggctacagcctccccgtcg

SEQ ID NO: 24280 - DNA, 30 bp, Homo sapiens
acagctcatcttcatccagcttggcaagtc

SEQ ID NO: 24281 - DNA, 30 bp, Homo sapiens
gctgtgtcccagggcagttatccagcgggc

SEQ ID NO: 24282 - DNA, 30 bp, Homo sapiens
cgttggtctccagtcctagcaagcgtccca

SEQ ID NO: 24283 - DNA, 30 bp, Homo sapiens
ccagtttccccatcttgtctggtcattgtc

SEQ ID NO: 24284 - DNA, 30 bp, Homo sapiens
ctgctgtttccacaggaagagtctgtctgt

SEQ ID NO: 24285 - DNA, 30 bp, Homo sapiens
ccttggtcaaggtcatttgcaagagcaagt

SEQ ID NO: 24286 - DNA, 30 bp, Homo sapiens
caggtgactcctcagtcaaaaaggagccca

SEQ ID NO: 24287 - DNA, 30 bp, Homo sapiens
aagagggcagactccagccccacagaactg

SEQ ID NO: 24288 - DNA, 30 bp, Homo sapiens
ccaaggtagttagctggcacgtatcctttc

SEQ ID NO: 24289 - DNA, 30 bp, Homo sapiens
tttaaggactggatacagtggctcaaatgt

SEQ ID NO: 24290 - DNA, 30 bp, Homo sapiens
tcagactgtggtaccagcgtgacagctcct

SEQ ID NO: 24291 - DNA, 30 bp, Homo sapiens
agctggcttggctttgtggttcagagaagg

SEQ ID NO: 24292 - DNA, 30 bp, Homo sapiens
cacttgcggaagggtgccagccggctgatg

SEQ ID NO: 24293 - DNA, 30 bp, Homo sapiens
cacagaggcgtggtggggtcactcagggct

SEQ ID NO: 24294 - DNA, 30 bp, Homo sapiens
gctgtagtttggcagtcttgactcgatgag

SEQ ID NO: 24295 - DNA, 30 bp, Homo sapiens
ttgaggtcttgctactggactcgcctcgaa

SEQ ID NO: 24296 - DNA, 30 bp, Homo sapiens
ttctggtgagagatatatgagcaacagctc

SEQ ID NO: 24297 - DNA, 30 bp, Homo sapiens
tagattggtctcatcccaggcaggatcatt

SEQ ID NO: 24298 - DNA, 30 bp, Homo sapiens
gaagttttgccagaatggtgactggctgcg

SEQ ID NO: 24299 - DNA, 30 bp, Homo sapiens
gactggccaatcaaaaacagtacatcacaa

SEQ ID NO: 24300 - DNA, 30 bp, Homo sapiens
tgaaacagtacatcacagatgacagatgca

SEQ ID NO: 24301 - DNA, 30 bp, Homo sapiens
accacattctgaatatttaccaatattttt

SEQ ID NO: 24302 - DNA, 30 bp, Homo sapiens
gcaagggtggaggaagcttccatgttacta

SEQ ID NO: 24303 - DNA, 30 bp, Homo sapiens
ttgaggtagatgtggagggtgtggacagcc

SEQ ID NO: 24304 - DNA, 30 bp, Homo sapiens
cagagggaccagctggtggagggctctgcg

SEQ ID NO: 24305 - DNA, 30 bp, Homo sapiens
agggggccctgtggagggtgggggtgcagg

SEQ ID NO: 24306 - DNA, 30 bp, Homo sapiens
ttctacagcaagtacattttgtgggggaga

SEQ ID NO: 24307 - DNA, 30 bp, Homo sapiens
ctcaactgacattccattttgtgatgcgct

SEQ ID NO: 24308 - DNA, 30 bp, Homo sapiens
gcttggtgttgaggtggaagaagtggggcg

SEQ ID NO: 24309 - DNA, 30 bp, Homo sapiens
gttttgtactggggtgcacggatgacagct

SEQ ID NO: 24310 - DNA, 30 bp, Homo sapiens
tgtactcccacagatctttttcatagcctt

SEQ ID NO: 24311 - DNA, 30 bp, Homo sapiens
tatgcatctggttctccaagtcccctctgt

SEQ ID NO: 24312 - DNA, 30 bp, Homo sapiens
aactgggggggattacactggagtttacaa

SEQ ID NO: 24313 - DNA, 30 bp, Homo sapiens
taggtgtcatggaaatctttcagcagggtt

SEQ ID NO: 24314 - DNA, 30 bp, Homo sapiens
catttgacaaccggtcccagaaggtaactg

SEQ ID NO: 24315 - DNA, 30 bp, Homo sapiens
cattgcctcatcaaggccggtgcctttggt

SEQ ID NO: 24316 - DNA, 30 bp, Homo sapiens
gcctggcatataggaggcacttaataatta

SEQ ID NO: 24317 - DNA, 30 bp, Homo sapiens
taggagaggagctccaagagcagtttccag

SEQ ID NO: 24318 - DNA, 30 bp, Homo sapiens
tcagccccatgggctctcgcctgcagacac

SEQ ID NO: 24319 - DNA, 30 bp, Homo sapiens
agtgagtataggattgatttgatggctgta

SEQ ID NO: 24320 - DNA, 30 bp, Homo sapiens
gttaggtcgctgtggcacagccaggggagg

SEQ ID NO: 24321 - DNA, 30 bp, Homo sapiens
ttctgcttgaagaacgccaaagtgtctcct

SEQ ID NO: 24322 - DNA, 30 bp, Homo sapiens
ttgcggtcacagcggcattcagctccacac

SEQ ID NO: 24323 - DNA, 30 bp, Homo sapiens
gtcaggaacattaaacggcagcgtgctgat

SEQ ID NO: 24324 - DNA, 30 bp, Homo sapiens
tcatggtctttttcttctaacaaattaatc

SEQ ID NO: 24325 - DNA, 30 bp, Homo sapiens
cgttggctctgtgggtggcctggagccagg

SEQ ID NO: 24326 - DNA, 30 bp, Homo sapiens
ctgatttccagaggatggaagaagtcagga

SEQ ID NO: 24327 - DNA, 30 bp, Homo sapiens
gtcaggctttgggagtgagcagcttttgtg

SEQ ID NO: 24328 - DNA, 30 bp, Homo sapiens
agatgggatggataagaagttaagcttcca

SEQ ID NO: 24329 - DNA, 30 bp, Homo sapiens
aaaaagcatttacgtgatgcagtccgaggt

SEQ ID NO: 24330 - DNA, 30 bp, Homo sapiens
cagaggtctgattttgaagtggctgccaac

SEQ ID NO: 24331 - DNA, 30 bp, Homo sapiens
cagaggggctctcatctgtaaggaacggag

SEQ ID NO: 24332 - DNA, 30 bp, Homo sapiens
atgcggctggaaatgtcatccaggagccag

SEQ ID NO: 24333 - DNA, 30 bp, Homo sapiens
gccgcagattgttctgggaagctggcagag

SEQ ID NO: 24334 - DNA, 30 bp, Homo sapiens
cgccctctcctgtgagagctgagcaagact

SEQ ID NO: 24335 - DNA, 30 bp, Homo sapiens
tttaggccatctcctatgattgcacaggta

SEQ ID NO: 24336 - DNA, 30 bp, Homo sapiens
cttcttctgcttgagggacttcctgcgttt

SEQ ID NO: 24337 - DNA, 30 bp, Homo sapiens
cttcttgccaccccgagctgccttcttcct

SEQ ID NO: 24338 - DNA, 30 bp, Homo sapiens
aagtccttggcacaatccctcgccagttag

SEQ ID NO: 24339 - DNA, 30 bp, Homo sapiens
atccgggaggtcatccactctagaccttgg

SEQ ID NO: 24340 - DNA, 30 bp, Homo sapiens
attccatccactgaagtctggcaggcagcc

SEQ ID NO: 24341 - DNA, 30 bp, Homo sapiens
tttatctttgatgttctctaaacacagcaa

SEQ ID NO: 24342 - DNA, 30 bp, Homo sapiens
gtctggatctgatcttgaagccagtctaca

SEQ ID NO: 24343 - DNA, 30 bp, Homo sapiens
tcttggccattccaatgtacttcaaaatga

SEQ ID NO: 24344 - DNA, 30 bp, Homo sapiens
gggaagcaacccagctcgcatctggaaggc

SEQ ID NO: 24345 - DNA, 30 bp, Homo sapiens
agctgggggcggatggcaggcagaggggcc

SEQ ID NO: 24346 - DNA, 30 bp, Homo sapiens
ctttgctgatatagtcagtgagtctgttga

SEQ ID NO: 24347 - DNA, 30 bp, Homo sapiens
atgaggcaccatgctacagtaagagcagct

SEQ ID NO: 24348 - DNA, 30 bp, Homo sapiens
gaaccaaccccccatgctgagttctctcct

SEQ ID NO: 24349 - DNA, 30 bp, Homo sapiens
cttcgagtgttgaataagccactgtagggt

SEQ ID NO: 24350 - DNA, 30 bp, Homo sapiens
ccaaggcattaggaagatctctcttgtttc

SEQ ID NO: 24351 - DNA, 30 bp, Homo sapiens
cactgcacatctgcagccagctgtgcaatc

SEQ ID NO: 24352 - DNA, 30 bp, Homo sapiens
agctccaccttctgggtgtgagccgacccg

SEQ ID NO: 24353 - DNA, 30 bp, Homo sapiens
ccttcacctctgcatcatggtgatcaacta

SEQ ID NO: 24354 - DNA, 30 bp, Homo sapiens
ggctggcaggaggagggccgggctctcaag

SEQ ID NO: 24355 - DNA, 30 bp, Homo sapiens
aagagggaatgggcaggggttccaggaagg

SEQ ID NO: 24356 - DNA, 30 bp, Homo sapiens
aagtggggagtgagctccatcctttttctt

SEQ ID NO: 24357 - DNA, 30 bp, Homo sapiens
gacttctcaacttcatcagtccacctggat

SEQ ID NO: 24358 - DNA, 30 bp, Homo sapiens
ctgtagcaagagccagcctgcggatattgg

SEQ ID NO: 24359 - DNA, 30 bp, Homo sapiens
ggcagggacccttgcccccaactcaatccc

SEQ ID NO: 24360 - DNA, 30 bp, Homo sapiens
caatggcagagccaggaaagaagcacagac

SEQ ID NO: 24361 - DNA, 30 bp, Homo sapiens
gccaggttgcccctctggcctgtccacagc

SEQ ID NO: 24362 - DNA, 30 bp, Homo sapiens
gggtctcattctcctccgacagcgaatcga

SEQ ID NO: 24363 - DNA, 30 bp, Homo sapiens
gcgtggtgatggcagacagcaccgtctcct

SEQ ID NO: 24364 - DNA, 30 bp, Homo sapiens
ccgtggggccacgctcctcggcagtgggat

SEQ ID NO: 24365 - DNA, 30 bp, Homo sapiens
ccacggagggattcgacgctgagaaagcta

SEQ ID NO: 24366 - DNA, 30 bp, Homo sapiens
atgccaggtactgctgcagtgccatctttg

SEQ ID NO: 24367 - DNA, 30 bp, Homo sapiens
ctgctggctgtcaggactgggggacgcccc

SEQ ID NO: 24368 - DNA, 30 bp, Homo sapiens
ttcctgtgagactggctgctcggcaggccc

SEQ ID NO: 24369 - DNA, 30 bp, Homo sapiens
cactgggtacccgtttctgtggccgccggg

SEQ ID NO: 24370 - DNA, 30 bp, Homo sapiens
gtttggttaatactttcaggacttttactt

SEQ ID NO: 24371 - DNA, 30 bp, Homo sapiens
tcatggtgatttgctaaggctctaattttc

SEQ ID NO: 24372 - DNA, 30 bp, Homo sapiens
tctttgggaacatatgttcagcaagtttgg

SEQ ID NO: 24373 - DNA, 30 bp, Homo sapiens
ctcagggtcattgcattctgctgctaaggc

SEQ ID NO: 24374 - DNA, 30 bp, Homo sapiens
ttcgggatcactgtgctctgctaagtcttg

SEQ ID NO: 24375 - DNA, 30 bp, Homo sapiens
tatggggcaggggtttccaggagaatctct

SEQ ID NO: 24376 - DNA, 30 bp, Homo sapiens
tgcagtgtggatgatagacagtgtcaggtg

SEQ ID NO: 24377 - DNA, 30 bp, Homo sapiens
caaaggggaccatcgtactgaaatattcca

SEQ ID NO: 24378 - DNA, 30 bp, Homo sapiens
ggggggaaacatagttagatcagggaattc

SEQ ID NO: 24379 - DNA, 30 bp, Homo sapiens
aaacggtggaaacatgcccaggtcggcaaa

SEQ ID NO: 24380 - DNA, 30 bp, Homo sapiens
cagcggccatggcaagtcactaaagtcaac

SEQ ID NO: 24381 - DNA, 30 bp, Homo sapiens
cactggatgtcactgaagtccccagggtct

SEQ ID NO: 24382 - DNA, 30 bp, Homo sapiens
ctgtgtcatcattgtcacatagggcatcga

SEQ ID NO: 24383 - DNA, 30 bp, Homo sapiens
atccggaggccctggatggaagactcgagg

SEQ ID NO: 24384 - DNA, 30 bp, Homo sapiens
ttgaggtccttcaaggctgactccaagctc

SEQ ID NO: 24385 - DNA, 30 bp, Homo sapiens
tagcgggatgaaaacgtcttccccgtgatt

SEQ ID NO: 24386 - DNA, 30 bp, Homo sapiens
actgtccaggtcctgaaagactcttgttca

SEQ ID NO: 24387 - DNA, 30 bp, Homo sapiens
cccaggggactgaacatcagaagccagcct

SEQ ID NO: 24388 - DNA, 30 bp, Homo sapiens
atgcgggcacgggcattgactgacagcttc

SEQ ID NO: 24389 - DNA, 30 bp, Homo sapiens
ggccttgcctgtggtcgacagggccttagt

SEQ ID NO: 24390 - DNA, 30 bp, Homo sapiens
tacacagtttttcttgcagtcaagacacga

SEQ ID NO: 24391 - DNA, 30 bp, Homo sapiens
cctcctactgctaaggccttttcgtgccac

SEQ ID NO: 24392 - DNA, 30 bp, Homo sapiens
cctcgtcctctgccccatccccctgctctc

SEQ ID NO: 24393 - DNA, 30 bp, Homo sapiens
aaatggaatggtcccttcggcctcataacc

SEQ ID NO: 24394 - DNA, 30 bp, Homo sapiens
agcttgctagcaacaagggacggcttccgt

SEQ ID NO: 24395 - DNA, 30 bp, Homo sapiens
gactttcacctcctggtctggcagaagatt

SEQ ID NO: 24396 - DNA, 30 bp, Homo sapiens
gccagccagcctcggtcgatccctcggtcc

SEQ ID NO: 24397 - DNA, 30 bp, Homo sapiens
aaccagcattgctcatacttgcacagtttg

SEQ ID NO: 24398 - DNA, 30 bp, Homo sapiens
atctccctcagcctccacagccttctggct

SEQ ID NO: 24399 - DNA, 30 bp, Homo sapiens
tatctgttgttgagctgtggagagccggta

SEQ ID NO: 24400 - DNA, 30 bp, Homo sapiens
agagttgatcatcatagtcgtcatccttca

SEQ ID NO: 24401 - DNA, 30 bp, Homo sapiens
cacagggacatctgtctccggagcggctga

SEQ ID NO: 24402 - DNA, 30 bp, Homo sapiens
agacggtggggcctctgcgggaagaaagca

SEQ ID NO: 24403 - DNA, 30 bp, Homo sapiens
ctcaggggtcaggctgggttccacgccgcc

SEQ ID NO: 24404 - DNA, 30 bp, Homo sapiens
agcaagtcatgcagcgcggcctcatgtccc

SEQ ID NO: 24405 - DNA, 30 bp, Homo sapiens
acgagaggggcaggatggtctatcatctgc

SEQ ID NO: 24406 - DNA, 30 bp, Homo sapiens
aacaggctggctctcttctacgtcgctagg

SEQ ID NO: 24407 - DNA, 30 bp, Homo sapiens
ttctggtgatctgggttcacgggtaacact

SEQ ID NO: 24408 - DNA, 30 bp, Homo sapiens
ggcatggggatctgggcaatggcagcaagc

SEQ ID NO: 24409 - DNA, 30 bp, Homo sapiens
tccaagggccccacaccccagtggccttgg

SEQ ID NO: 24410 - DNA, 30 bp, Homo sapiens
ctcaggccagtacggtgaagagtccacgaa

SEQ ID NO: 24411 - DNA, 30 bp, Homo sapiens
cagggggtgccatccccatcctcgtggcat

SEQ ID NO: 24412 - DNA, 30 bp, Homo sapiens
cactggtcctctccagggtttcttgaaggc

SEQ ID NO: 24413 - DNA, 30 bp, Homo sapiens
ttgtgggtcatcttccctaaggcaccagca

SEQ ID NO: 24414 - DNA, 30 bp, Homo sapiens
ccgaggctgagagacttcctcttccttgtc

SEQ ID NO: 24415 - DNA, 30 bp, Homo sapiens
aattccactgatgatgccattggttcttga

SEQ ID NO: 24416 - DNA, 30 bp, Homo sapiens
cagcggcaggcaatttggtagggattacag

SEQ ID NO: 24417 - DNA, 30 bp, Homo sapiens
gaaggatgtcatcttccttgtcacacccac

SEQ ID NO: 24418 - DNA, 30 bp, Homo sapiens
gatccgttgggacattagcctggtgttgag

SEQ ID NO: 24419 - DNA, 30 bp, Homo sapiens
tgctggtttacctgagactgctttctgctg

SEQ ID NO: 24420 - DNA, 30 bp, Homo sapiens
gtaacacctgaatggcaagttgaacctgag

SEQ ID NO: 24421 - DNA, 30 bp, Homo sapiens
atatgggttttaagccactgatcaattgca

SEQ ID NO: 24422 - DNA, 30 bp, Homo sapiens
caaaggaggcctggaccatctggaaaggcc

SEQ ID NO: 24423 - DNA, 30 bp, Homo sapiens
caaactgtggaagcagcagtttgcccgagg

SEQ ID NO: 24424 - DNA, 30 bp, Homo sapiens
cactggtcaaaaaggagagagatgcaatag

SEQ ID NO: 24425 - DNA, 30 bp, Homo sapiens
ccctgagagctggaactctccaggggccaa

SEQ ID NO: 24426 - DNA, 30 bp, Homo sapiens
tgctggaggtgcctcttcgtcatatgaagg

SEQ ID NO: 24427 - DNA, 30 bp, Homo sapiens
gcccaggcagccgcaggcggtggcggagag

SEQ ID NO: 24428 - DNA, 30 bp, Homo sapiens
tcccattccatactctggaagaagtagacc

SEQ ID NO: 24429 - DNA, 30 bp, Homo sapiens
cccaggaatcaacgggctgaggcttagcgt

SEQ ID NO: 24430 - DNA, 30 bp, Homo sapiens
gcacacctccttgcccgtgctggtgcccgg

SEQ ID NO: 24431 - DNA, 30 bp, Homo sapiens
cagcctccagcagcatcagggacacatctg

SEQ ID NO: 24432 - DNA, 30 bp, Homo sapiens
tatacaagggtcagggcagtcccgcaggta

SEQ ID NO: 24433 - DNA, 30 bp, Homo sapiens
gccggggaagtgccttcaaatgaaagtatg

SEQ ID NO: 24434 - DNA, 30 bp, Homo sapiens
gacaggatatgaacaaaggacactggaaag

SEQ ID NO: 24435 - DNA, 30 bp, Homo sapiens
caccgggaatgcgcctttgcgaccaggatc

SEQ ID NO: 24436 - DNA, 30 bp, Homo sapiens
tgctgggagactcccagtccttgagccatc

SEQ ID NO: 24437 - DNA, 30 bp, Homo sapiens
tcatggagtagaaacttctttatggggtct

SEQ ID NO: 24438 - DNA, 30 bp, Homo sapiens
aaatccagctgcaggtagcggagcaggcgc

SEQ ID NO: 24439 - DNA, 30 bp, Homo sapiens
tattggtataggaggaatcgttcgagtggc

SEQ ID NO: 24440 - DNA, 30 bp, Homo sapiens
agttggtgttttaggtagctaatcaacatg

SEQ ID NO: 24441 - DNA, 30 bp, Homo sapiens
tgtaggagaggtaatcaatgagccggggcg

SEQ ID NO: 24442 - DNA, 30 bp, Homo sapiens
tcctgtaaaaattccttgtccataaaggtc

SEQ ID NO: 24443 - DNA, 30 bp, Homo sapiens
tggtggtagaggaagcttctccactgaggc

SEQ ID NO: 24444 - DNA, 30 bp, Homo sapiens
cactggatgcacccctccacacgcagcagc

SEQ ID NO: 24445 - DNA, 30 bp, Homo sapiens
agcaggaattagaagtgaaaatattccatc

SEQ ID NO: 24446 - DNA, 30 bp, Homo sapiens
ctgtggctccaaaagtaggtaattctgcag

SEQ ID NO: 24447 - DNA, 30 bp, Homo sapiens
tactgggtgttctcgtatttcaggtatcta

SEQ ID NO: 24448 - DNA, 30 bp, Homo sapiens
tgaatagctgccagttctggaacttcatac

SEQ ID NO: 24449 - DNA, 30 bp, Homo sapiens
ggctctaaaagcaagtactttttcaatgac

SEQ ID NO: 24450 - DNA, 30 bp, Homo sapiens
acttggagatttcagacaaggctgccattt

SEQ ID NO: 24451 - DNA, 30 bp, Homo sapiens
agctggagttgtgggataaggtgcaatctt

SEQ ID NO: 24452 - DNA, 30 bp, Homo sapiens
agatgtcatcttccacggagccactgtgct

SEQ ID NO: 24453 - DNA, 30 bp, Homo sapiens
atctgggcctcctctttgtcccctcccacg

SEQ ID NO: 24454 - DNA, 30 bp, Homo sapiens
ccttggcaattggtagttcatcaagtagct

SEQ ID NO: 24455 - DNA, 30 bp, Homo sapiens
atggtcgactacttccagaaatacttattg

SEQ ID NO: 24456 - DNA, 30 bp, Homo sapiens
aacaggtattccttcaaagaagctggcagt

SEQ ID NO: 24457 - DNA, 30 bp, Homo sapiens
ctctgggaggacgagtttggttatcttatg

SEQ ID NO: 24458 - DNA, 30 bp, Homo sapiens
cttaggttttggcaaagaagcaccttctct

SEQ ID NO: 24459 - DNA, 30 bp, Homo sapiens
tcctggtaggctctgagaatatgcatcaga

SEQ ID NO: 24460 - DNA, 30 bp, Homo sapiens
caggagaagtcaatttgtccacaggaagcg

SEQ ID NO: 24461 - DNA, 30 bp, Homo sapiens
ggatgggatcatgcctttgctcctcttgcg

SEQ ID NO: 24462 - DNA, 30 bp, Homo sapiens
aatctgtcagaagctctgctcatcttctca

SEQ ID NO: 24463 - DNA, 30 bp, Homo sapiens
gtccagcctttacttgcttcaaaacatttt

SEQ ID NO: 24464 - DNA, 30 bp, Homo sapiens
gccaggtcagtcagggaatcagagaccttg

SEQ ID NO: 24465 - DNA, 30 bp, Homo sapiens
agaaccagttggtgaagtcgagaagctcct

SEQ ID NO: 24466 - DNA, 30 bp, Homo sapiens
aaccagctggagaagtcgagtagctcgcgc

SEQ ID NO: 24467 - DNA, 30 bp, Homo sapiens
gcatggtggctggtggttgctatcatggag

SEQ ID NO: 24468 - DNA, 30 bp, Homo sapiens
agttgcaggcacgtaaccaataagggcagg

SEQ ID NO: 24469 - DNA, 30 bp, Homo sapiens
caatgccaggattcctccgactccaagaaa

SEQ ID NO: 24470 - DNA, 30 bp, Homo sapiens
gttcggtcctattcttcttaaggttagaaa

SEQ ID NO: 24471 - DNA, 30 bp, Homo sapiens
atgtgggattctaacatgacatttagtgag

SEQ ID NO: 24472 - DNA, 30 bp, Homo sapiens
ccatggagttctcagggaggaggccaggga

SEQ ID NO: 24473 - DNA, 30 bp, Homo sapiens
tcctggctggccttgtccagctctgtctcg

SEQ ID NO: 24474 - DNA, 30 bp, Homo sapiens
cgccggtggcattccgccttttctcacaca

SEQ ID NO: 24475 - DNA, 30 bp, Homo sapiens
ttctgggataaacaaagtacgccttcgcag

SEQ ID NO: 24476 - DNA, 30 bp, Homo sapiens
cagggttcccatgggggactgcgcctccca

SEQ ID NO: 24477 - DNA, 30 bp, Homo sapiens
agcaggtaaagtcctcgaacgtgcctcggg

SEQ ID NO: 24478 - DNA, 30 bp, Homo sapiens
agcaggcaatctcctccaaggtccccaggg

SEQ ID NO: 24479 - DNA, 30 bp, Homo sapiens
acaaggtagcaggtgcggtgggaggcggag

SEQ ID NO: 24480 - DNA, 30 bp, Homo sapiens
agacggaaaagctacgtgcaggctaggcat

SEQ ID NO: 24481 - DNA, 30 bp, Homo sapiens
gggcggggctccgaggacacagacagcagg

SEQ ID NO: 24482 - DNA, 30 bp, Homo sapiens
tagcaagcaaaatcttcaaagagacctcct

SEQ ID NO: 24483 - DNA, 30 bp, Homo sapiens
acactcctctatcctatttttatttcccag

SEQ ID NO: 24484 - DNA, 30 bp, Homo sapiens
ttgaggctgagcacgcggcaggagcaggcg

SEQ ID NO: 24485 - DNA, 30 bp, Homo sapiens
cctgctgtgcctgcagtagcgcccgcacct

SEQ ID NO: 24486 - DNA, 30 bp, Homo sapiens
taaaatggcatcataaatggctcctgtttt

SEQ ID NO: 24487 - DNA, 30 bp, Homo sapiens
cagggggccactttggtggccaagatggca

SEQ ID NO: 24488 - DNA, 30 bp, Homo sapiens
tactgggcactggggggcttgtagggctcc

SEQ ID NO: 24489 - DNA, 30 bp, Homo sapiens
aagctttgacagctgacttgtagtgggtca

SEQ ID NO: 24490 - DNA, 30 bp, Homo sapiens
acatttatcagatgccttttcattaatttt

SEQ ID NO: 24491 - DNA, 30 bp, Homo sapiens
tcacaaacacggggtacacggtacagtctc

SEQ ID NO: 24492 - DNA, 30 bp, Homo sapiens
agatggatccccggcctggaggggagctgg

SEQ ID NO: 24493 - DNA, 30 bp, Homo sapiens
accaggcagcacttctgggcatggggcctg

SEQ ID NO: 24494 - DNA, 30 bp, Homo sapiens
ttctgggtatttccctttgttaagtgtgca

SEQ ID NO: 24495 - DNA, 30 bp, Homo sapiens
tactggttatgtaaatccaatatgacacaa

SEQ ID NO: 24496 - DNA, 30 bp, Homo sapiens
ggaaggctgcgtctctgctgtggtgtcagt

SEQ ID NO: 24497 - DNA, 30 bp, Homo sapiens
gttcttccacaggaaaaatgcttacttctt

SEQ ID NO: 24498 - DNA, 30 bp, Homo sapiens
caagggtctggggcgaagacaaagtcgagg

SEQ ID NO: 24499 - DNA, 30 bp, Homo sapiens
tcccggagcaaagatgaaatcaagagcctg

SEQ ID NO: 24500 - DNA, 30 bp, Homo sapiens
gtatccatcaccatttgaatagcttgcagg

SEQ ID NO: 24501 - DNA, 30 bp, Homo sapiens
tgcaggttgcatttcccagtatttcaccgg

SEQ ID NO: 24502 - DNA, 30 bp, Homo sapiens
atatggaacaccgtcaccccttcaaatgcc

SEQ ID NO: 24503 - DNA, 30 bp, Homo sapiens
cagtgggatagctcctgccgcccttcttct

SEQ ID NO: 24504 - DNA, 30 bp, Homo sapiens
tgctggccggcagcttcagccacttgggca

SEQ ID NO: 24505 - DNA, 30 bp, Homo sapiens
ggaaggtcggtgatagtagtatcgtcagga

SEQ ID NO: 24506 - DNA, 30 bp, Homo sapiens
atttggcagtgaccttgctctggagacgat

SEQ ID NO: 24507 - DNA, 30 bp, Homo sapiens
tatgttcctctaagttttcaaccattaaca

SEQ ID NO: 24508 - DNA, 30 bp, Homo sapiens
tctaggtacacagccccctggcagagctgg

SEQ ID NO: 24509 - DNA, 30 bp, Homo sapiens
acctaactcatcctcacatcgccaggtgaa

SEQ ID NO: 24510 - DNA, 30 bp, Homo sapiens
agtcgttgtaggggatactcagggtctgct

SEQ ID NO: 24511 - DNA, 30 bp, Homo sapiens
atctacaactcctctgactgtcccaacacg

SEQ ID NO: 24512 - DNA, 30 bp, Homo sapiens
gactccccgtacgtgtttcgggccattgac

SEQ ID NO: 24513 - DNA, 30 bp, Homo sapiens
ttgaggatgctataccacaccatgcctgca

SEQ ID NO: 24514 - DNA, 30 bp, Homo sapiens
caccggcccttggactccccgtacgtgttt

SEQ ID NO: 24515 - DNA, 30 bp, Homo sapiens
tcttatgctgcagaatatagtcggagacct

SEQ ID NO: 24516 - DNA, 30 bp, Homo sapiens
acaccatcttctcctcacacgtgattttgg

SEQ ID NO: 24517 - DNA, 30 bp, Homo sapiens
gcgtgaaaaggctgattcggccaggcagtt

SEQ ID NO: 24518 - DNA, 30 bp, Homo sapiens
ggcacaatacacagagctttgagggtccaa

SEQ ID NO: 24519 - DNA, 30 bp, Homo sapiens
gacaaggcaggagacgcacagtttggaggg

SEQ ID NO: 24520 - DNA, 30 bp, Homo sapiens
accaggcatgctacacaaagttttgaagga

SEQ ID NO: 24521 - DNA, 30 bp, Homo sapiens
gaaagttagcttgcaaatgaaaagaagaaa

SEQ ID NO: 24522 - DNA, 30 bp, Homo sapiens
tgcaggtcctgctgttgaacaggccgaatt

SEQ ID NO: 24523 - DNA, 30 bp, Homo sapiens
atctggaacaactgaagttttctacctctt

SEQ ID NO: 24524 - DNA, 30 bp, Homo sapiens
caagttgtgatttgtcataatctttacgat

SEQ ID NO: 24525 - DNA, 30 bp, Homo sapiens
ggatggggagggctcgtccccacgcccagg

SEQ ID NO: 24526 - DNA, 30 bp, Homo sapiens
aacagggggtgccctggggggcagaacggc

SEQ ID NO: 24527 - DNA, 30 bp, Homo sapiens
atgagggttgctcgtcctcgggcccaggcc

SEQ ID NO: 24528 - DNA, 30 bp, Homo sapiens
aaatagtgcaggaatcttcttttacttttt

SEQ ID NO: 24529 - DNA, 30 bp, Homo sapiens
acctggtgcgacgacgttgagctgggctgc

SEQ ID NO: 24530 - DNA, 30 bp, Homo sapiens
gagcggggaagggagctggtgcgacgacgt

SEQ ID NO: 24531 - DNA, 30 bp, Homo sapiens
ccaaggcctggtgctgcgacgttcctgcag

SEQ ID NO: 24532 - DNA, 30 bp, Homo sapiens
cttctgagaccagagcagacctgttttcca

SEQ ID NO: 24533 - DNA, 30 bp, Homo sapiens
gctcggagcacttctgccccaccaggctgg

SEQ ID NO: 24534 - DNA, 30 bp, Homo sapiens
ctgcaactcggttttccaggcatttcacat

SEQ ID NO: 24535 - DNA, 30 bp, Homo sapiens
ttcttctgcatggcggttacagggcaatct

SEQ ID NO: 24536 - DNA, 30 bp, Homo sapiens
aattggcctgttagaggatggtgcctgggt

SEQ ID NO: 24537 - DNA, 30 bp, Homo sapiens
ggctgtgactgggaggaaggagccataacg

SEQ ID NO: 24538 - DNA, 30 bp, Homo sapiens
ttgcatgagtcaacagcccatatgcaggtc

SEQ ID NO: 24539 - DNA, 30 bp, Homo sapiens
ttctggagtcctcccattctgagcccggac

SEQ ID NO: 24540 - DNA, 30 bp, Homo sapiens
taggggacccttttcttcccccttgccttg

SEQ ID NO: 24541 - DNA, 30 bp, Homo sapiens
tagcagctacgggtcctctggctccgggcc

SEQ ID NO: 24542 - DNA, 30 bp, Homo sapiens
ctcagggatggtgctgacaacgtgggttgc

SEQ ID NO: 24543 - DNA, 30 bp, Homo sapiens
ttgaggtagaggggctggtgggaggcctgg

SEQ ID NO: 24544 - DNA, 30 bp, Homo sapiens
tctgaataccaccagttttttggcaacagt

SEQ ID NO: 24545 - DNA, 30 bp, Homo sapiens
gactgggactgtggggtcatgattacatgc

SEQ ID NO: 24546 - DNA, 30 bp, Homo sapiens
ttggggccatatacaagaaaaatctcttac

SEQ ID NO: 24547 - DNA, 30 bp, Homo sapiens
ctctgggtagaagagatcacatctgttgac

SEQ ID NO: 24548 - DNA, 30 bp, Homo sapiens
ttcaggtagtggtgctggtggttctgggag

SEQ ID NO: 24549 - DNA, 30 bp, Homo sapiens
ccatggggagtggtaaagctttaatttctc

SEQ ID NO: 24550 - DNA, 30 bp, Homo sapiens
acgttgctttggcataactcagaggtagat

SEQ ID NO: 24551 - DNA, 30 bp, Homo sapiens
cagagggcaagggtgtctttgatgagcctg

SEQ ID NO: 24552 - DNA, 30 bp, Homo sapiens
tcttggtctggggaaggagcaaaggactga

SEQ ID NO: 24553 - DNA, 30 bp, Homo sapiens
gcctgagacttgcagtaatgtaaaaccagt

SEQ ID NO: 24554 - DNA, 30 bp, Homo sapiens
tgcagggtttccacaaaggcatcaaactcg

SEQ ID NO: 24555 - DNA, 30 bp, Homo sapiens
taacggtgtccagtgtaagctttaaaccag

SEQ ID NO: 24556 - DNA, 30 bp, Homo sapiens
cagtactgtgcccacagcacagctttgcat

SEQ ID NO: 24557 - DNA, 30 bp, Homo sapiens
tgccagagcacaaccttcctgccctggtcc

SEQ ID NO: 24558 - DNA, 30 bp, Homo sapiens
tcttgggcactgtccgagcgccacttgagg

SEQ ID NO: 24559 - DNA, 30 bp, Homo sapiens
gtcatccccgtggcgccatttctgtgactc

SEQ ID NO: 24560 - DNA, 30 bp, Homo sapiens
tctccccctccttctgcaacagtctcaatg

SEQ ID NO: 24561 - DNA, 30 bp, Homo sapiens
atcttacatacagggaaggatacatatgaa

SEQ ID NO: 24562 - DNA, 30 bp, Homo sapiens
gatcaaactcctccagttgctcagtagagt

SEQ ID NO: 24563 - DNA, 30 bp, Homo sapiens
caaagggacaggatttcaaagtcttcatct

SEQ ID NO: 24564 - DNA, 30 bp, Homo sapiens
cctagggacaggttcaggacgtcggggcag

SEQ ID NO: 24565 - DNA, 30 bp, Homo sapiens
aaaaaaggtcttcttcattggttgtagtag

SEQ ID NO: 24566 - DNA, 30 bp, Homo sapiens
agctggggcgtttggccctgaggagccgcc

SEQ ID NO: 24567 - DNA, 30 bp, Homo sapiens
gtgtgcaactgtccatctgcagccacagga

SEQ ID NO: 24568 - DNA, 30 bp, Homo sapiens
atctgttggctgtgggatgatactaatatg

SEQ ID NO: 24569 - DNA, 30 bp, Homo sapiens
cagatggtctcatcatcgctcatgtcccag

SEQ ID NO: 24570 - DNA, 30 bp, Homo sapiens
gattggtacatagggatttttttctcagca

SEQ ID NO: 24571 - DNA, 30 bp, Homo sapiens
gcacctgagggggtagctcatcctccgagc

SEQ ID NO: 24572 - DNA, 30 bp, Homo sapiens
aagaggcccggtcaggctccttctgggtgt

SEQ ID NO: 24573 - DNA, 30 bp, Homo sapiens
cagtggtggaagagccgaaggttcgtatga

SEQ ID NO: 24574 - DNA, 30 bp, Homo sapiens
ctttggtgtagggaaagcttgatgatacag

SEQ ID NO: 24575 - DNA, 30 bp, Homo sapiens
atctggcatgatgagacacctggtcagtca

SEQ ID NO: 24576 - DNA, 30 bp, Homo sapiens
gcacggtgaaccattcgacgtctagtaact

SEQ ID NO: 24577 - DNA, 30 bp, Homo sapiens
ggatggtcttccaacaactgcatccctcac

SEQ ID NO: 24578 - DNA, 30 bp, Homo sapiens
tactgatttcctgcatctttttctgcctgg

SEQ ID NO: 24579 - DNA, 30 bp, Homo sapiens
ctttccatcctgggaaaagtcggctgagat

SEQ ID NO: 24580 - DNA, 30 bp, Homo sapiens
agttggagactgtgtgtggttccgcagaag

SEQ ID NO: 24581 - DNA, 30 bp, Homo sapiens
cagtggcttgtcgctttccttcttcaggtg

SEQ ID NO: 24582 - DNA, 30 bp, Homo sapiens
ccgagtcactgtaatgggaatggggggaaa

SEQ ID NO: 24583 - DNA, 30 bp, Homo sapiens
aggtggccatctggaagggctcgggctgga

SEQ ID NO: 24584 - DNA, 30 bp, Homo sapiens
gcttcttggcacgtccctcggcctgcaggg

SEQ ID NO: 24585 - DNA, 30 bp, Homo sapiens
tactcaaggccaaggtaggaaacagtcttt

SEQ ID NO: 24586 - DNA, 30 bp, Homo sapiens
tgaagatgctcctataagtagtctgtggtc

SEQ ID NO: 24587 - DNA, 30 bp, Homo sapiens
atatggtcagtgaactctgggatcggcgat

SEQ ID NO: 24588 - DNA, 30 bp, Homo sapiens
tggagggtccagccatctcaaaggccttag

SEQ ID NO: 24589 - DNA, 30 bp, Homo sapiens
gaaactcaggctgctggaagtctgagaaag

SEQ ID NO: 24590 - DNA, 30 bp, Homo sapiens
cacgagcattcccacacgggacctagggca

SEQ ID NO: 24591 - DNA, 30 bp, Homo sapiens
tagctcctctccaacagagtaaagatgata

SEQ ID NO: 24592 - DNA, 30 bp, Homo sapiens
acaagtagatgagtccattgtggagagagt

SEQ ID NO: 24593 - DNA, 30 bp, Homo sapiens
gaaactgtgattgctggaagtttgagaaag

SEQ ID NO: 24594 - DNA, 30 bp, Homo sapiens
tgaaggtctggcggataatgagtcagatgc

SEQ ID NO: 24595 - DNA, 30 bp, Homo sapiens
tcagtatgcttgtaggacaataacataggc

SEQ ID NO: 24596 - DNA, 30 bp, Homo sapiens
tagagcctgatgaagagcttccgcacctca

SEQ ID NO: 24597 - DNA, 30 bp, Homo sapiens
caggaaggcactttcagcttcggggtcccc

SEQ ID NO: 24598 - DNA, 30 bp, Homo sapiens
ctcagggggccggcgggcagcggcggccag

SEQ ID NO: 24599 - DNA, 30 bp, Homo sapiens
ctgaggggagctgggggctgccacccctac

SEQ ID NO: 24600 - DNA, 30 bp, Homo sapiens
ttatggtgatgatttgacatgatccattct

SEQ ID NO: 24601 - DNA, 30 bp, Homo sapiens
gagttgttcttcattgctctcaaatactgg

SEQ ID NO: 24602 - DNA, 30 bp, Homo sapiens
gcctggcccagaaatgctgttctgtgggtt

SEQ ID NO: 24603 - DNA, 30 bp, Homo sapiens
agtaggtttccttctccacccagccgccag

SEQ ID NO: 24604 - DNA, 30 bp, Homo sapiens
ggataccgccgcaggatgagctttcggacc

SEQ ID NO: 24605 - DNA, 30 bp, Homo sapiens
agtaggtttccttctccacccaaccccctg

SEQ ID NO: 24606 - DNA, 30 bp, Homo sapiens
gggtgctgacggatgaggagttttctgatt

SEQ ID NO: 24607 - DNA, 30 bp, Homo sapiens
aaacggtctttctcactgtacccaatgttc

SEQ ID NO: 24608 - DNA, 30 bp, Homo sapiens
gttttgttgatgcggagtttgaaggccacg

SEQ ID NO: 24609 - DNA, 30 bp, Homo sapiens
acttgtcacgatcatcctgactttttaggt

SEQ ID NO: 24610 - DNA, 30 bp, Homo sapiens
ccacaaaacgatcattgatgacatcattta

SEQ ID NO: 24611 - DNA, 30 bp, Homo sapiens
gcccaggagttcgggaccagcctgggcaac

SEQ ID NO: 24612 - DNA, 30 bp, Homo sapiens
acggttttcaaagtctctgtgagcatatct

SEQ ID NO: 24613 - DNA, 30 bp, Homo sapiens
ttctggatcctctaggtagttccgagcaac

SEQ ID NO: 24614 - DNA, 30 bp, Homo sapiens
aggtagttccgagcaacgaacttgaggatt

SEQ ID NO: 24615 - DNA, 30 bp, Homo sapiens
tcaccaggggcattatgagcagcacaaacg

SEQ ID NO: 24616 - DNA, 30 bp, Homo sapiens
agttgcgggccacaaacttgagcgtctcat

SEQ ID NO: 24617 - DNA, 30 bp, Homo sapiens
gtctgaggtacacaccggagactccactct

SEQ ID NO: 24618 - DNA, 30 bp, Homo sapiens
ttctggctcatttcttcgtgcatgtggttc

SEQ ID NO: 24619 - DNA, 30 bp, Homo sapiens
cggtgtggtctggggtccaagaggtggtca

SEQ ID NO: 24620 - DNA, 30 bp, Homo sapiens
ttcctccctctctgagcagctctgacagcg

SEQ ID NO: 24621 - DNA, 30 bp, Homo sapiens
tatgtagtgggcttcctggggatgaagagg

SEQ ID NO: 24622 - DNA, 30 bp, Homo sapiens
agtagtagaagcagtagaagaggaaaacac

SEQ ID NO: 24623 - DNA, 30 bp, Homo sapiens
tgcagcaggaggaaggctggtcggagagga

SEQ ID NO: 24624 - DNA, 30 bp, Homo sapiens
tccaggctgtggatggggctccctggactt

SEQ ID NO: 24625 - DNA, 30 bp, Homo sapiens
tagagggacgtctccacgctgtggagcggg

SEQ ID NO: 24626 - DNA, 30 bp, Homo sapiens
acccggattcccagcagcactggtaggatt

SEQ ID NO: 24627 - DNA, 30 bp, Homo sapiens
ggaggagatgaaacagcaggaacagaagtg

SEQ ID NO: 24628 - DNA, 30 bp, Homo sapiens
gactgggggagctgcacttggttgcaatcc

SEQ ID NO: 24629 - DNA, 30 bp, Homo sapiens
ttctggatcttttccctgctcctttcaacc

SEQ ID NO: 24630 - DNA, 30 bp, Homo sapiens
cagtggcagtcctgtctccagatggggatg

SEQ ID NO: 24631 - DNA, 30 bp, Homo sapiens
gctgtccactcctctcccagagccagaccc

SEQ ID NO: 24632 - DNA, 30 bp, Homo sapiens
cacatcttcagggtgcatctggactctctt

SEQ ID NO: 24633 - DNA, 30 bp, Homo sapiens
aatagtagagttcctggtcccaccagctcc

SEQ ID NO: 24634 - DNA, 30 bp, Homo sapiens
tcccttcatacgggtcgtggggattgttga

SEQ ID NO: 24635 - DNA, 30 bp, Homo sapiens
gccctgatagtgcccaacaaggcttggtgc

SEQ ID NO: 24636 - DNA, 30 bp, Homo sapiens
acgatgaatgctcttcagccagcttatcag

SEQ ID NO: 24637 - DNA, 30 bp, Homo sapiens
gcttggcgggtacggttgaatgtcaatgtc

SEQ ID NO: 24638 - DNA, 30 bp, Homo sapiens
actccagggccttcaccagggcctcgttgg

SEQ ID NO: 24639 - DNA, 30 bp, Homo sapiens
ccagggccttcaccagggcctcgttggcct

SEQ ID NO: 24640 - DNA, 30 bp, Homo sapiens
gtcttctcagcatttgctttgaattctgtc

SEQ ID NO: 24641 - DNA, 30 bp, Homo sapiens
ttgccagcagctttaggtccgcaatgcact

SEQ ID NO: 24642 - DNA, 30 bp, Homo sapiens
atggcgaagaggatgaggaaggcgaccatc

SEQ ID NO: 24643 - DNA, 30 bp, Homo sapiens
acatggcaaagaggatgagaaaggctacca

SEQ ID NO: 24644 - DNA, 30 bp, Homo sapiens
acctggcataaccaatgataaggctgccaa

SEQ ID NO: 24645 - DNA, 30 bp, Homo sapiens
aacaaaagagacccatagcttcagacaagg

SEQ ID NO: 24646 - DNA, 30 bp, Homo sapiens
gtgaggccaatagggatactttttcttgtc

SEQ ID NO: 24647 - DNA, 30 bp, Homo sapiens
ctctggcaatccgtttcagttcatcctgct

SEQ ID NO: 24648 - DNA, 30 bp, Homo sapiens
gcctggggtttttcgatgacttcaaatttg

SEQ ID NO: 24649 - DNA, 30 bp, Homo sapiens
cagtggtatttgcggagccgctcgtgcttg

SEQ ID NO: 24650 - DNA, 30 bp, Homo sapiens
atgccccgcttgcctataatctctccgaca

SEQ ID NO: 24651 - DNA, 30 bp, Homo sapiens
atgccacgcttgcctgtgatctctctgaca

SEQ ID NO: 24652 - DNA, 30 bp, Homo sapiens
tagccctgcccagcttctgaatcttggtct

SEQ ID NO: 24653 - DNA, 30 bp, Homo sapiens
tgatcaaatccaatgctcatgatacaagag

SEQ ID NO: 24654 - DNA, 30 bp, Homo sapiens
gatcaaatccaatgctcatgatacaagagt

SEQ ID NO: 24655 - DNA, 30 bp, Homo sapiens
aaggcagtgctgtcttaaaggcttggacaa

SEQ ID NO: 24656 - DNA, 30 bp, Homo sapiens
atctgggtcaaagaaatagtggggcccttg

SEQ ID NO: 24657 - DNA, 30 bp, Homo sapiens
ccctggctcctcagcagctccttctcttcg

SEQ ID NO: 24658 - DNA, 30 bp, Homo sapiens
gaatcttctggtttgtcatcctataaatga

SEQ ID NO: 24659 - DNA, 30 bp, Homo sapiens
ccgaatatgctcgaaggagaagggtaagaa

SEQ ID NO: 24660 - DNA, 30 bp, Homo sapiens
tgtcgtcgttattgaactttgatgaaagta

SEQ ID NO: 24661 - DNA, 30 bp, Homo sapiens
cctcggctgtgccatccaggatgtgtttaa

SEQ ID NO: 24662 - DNA, 30 bp, Homo sapiens
tgtaggagaaaaccagaagatggaaatgag

SEQ ID NO: 24663 - DNA, 30 bp, Homo sapiens
ttcactctggaggtctgaagaattgcgacg

SEQ ID NO: 24664 - DNA, 30 bp, Homo sapiens
ttgtggagaggatgagggcgacgatgagac

SEQ ID NO: 24665 - DNA, 30 bp, Homo sapiens
gatagggatgtagttgtcgattttggcgcg

SEQ ID NO: 24666 - DNA, 30 bp, Homo sapiens
tgaaatacattctgctatccacacaatatt

SEQ ID NO: 24667 - DNA, 30 bp, Homo sapiens
ggccaatgatacttcagataccagatggtt

SEQ ID NO: 24668 - DNA, 30 bp, Homo sapiens
caggatgggctgagtcctggcatctgcccc

SEQ ID NO: 24669 - DNA, 30 bp, Homo sapiens
acccaatagaggcccccccagttcccagca

SEQ ID NO: 24670 - DNA, 30 bp, Homo sapiens
tcaaggctacggaatgcattctgcatgtct

SEQ ID NO: 24671 - DNA, 30 bp, Homo sapiens
gtcaggcgcgaggtcctgcagcgccccctc

SEQ ID NO: 24672 - DNA, 30 bp, Homo sapiens
tcgagggtaaaattcgctgagggtgctctg

SEQ ID NO: 24673 - DNA, 30 bp, Homo sapiens
agttgcaatcaatcttgtagtacacatagg

SEQ ID NO: 24674 - DNA, 30 bp, Homo sapiens
tcccgggatctccacagatgcatccagtat

SEQ ID NO: 24675 - DNA, 30 bp, Homo sapiens
ccttctcttcagccagaagattagcaggct

SEQ ID NO: 24676 - DNA, 30 bp, Homo sapiens
acttcctgttggcatttgcaccaaacaagg

SEQ ID NO: 24677 - DNA, 30 bp, Homo sapiens
acaaggccattcgtatttctggcatctttt

SEQ ID NO: 24678 - DNA, 30 bp, Homo sapiens
gcgcaggtcttcggcagtgaacatgcccct

SEQ ID NO: 24679 - DNA, 30 bp, Homo sapiens
ttctggccgaatgtcacagacaaaagccaa

SEQ ID NO: 24680 - DNA, 30 bp, Homo sapiens
gcagaaatccggtagttggggtggacctgg

SEQ ID NO: 24681 - DNA, 30 bp, Homo sapiens
tggtggctctgtagttcacatggatttctg

SEQ ID NO: 24682 - DNA, 30 bp, Homo sapiens
cttcgggcggcagcggtctggggctgctcg

SEQ ID NO: 24683 - DNA, 30 bp, Homo sapiens
agtctcccaccaggagtgagtgcttgtcag

SEQ ID NO: 24684 - DNA, 30 bp, Homo sapiens
ccctgccattcaggagcagagaccacttgt

SEQ ID NO: 24685 - DNA, 30 bp, Homo sapiens
caccattcgtcgggcctctgtttcgtggta

SEQ ID NO: 24686 - DNA, 30 bp, Homo sapiens
tttctttttggtggtgtcataagcacggat

SEQ ID NO: 24687 - DNA, 30 bp, Homo sapiens
ccccggtgcgcctgtactccgcggtgccat

SEQ ID NO: 24688 - DNA, 30 bp, Homo sapiens
gcccttgaggggcttgtcggcaccgccact

SEQ ID NO: 24689 - DNA, 30 bp, Homo sapiens
aagaggacttctcgttacttctcaaggact

SEQ ID NO: 24690 - DNA, 30 bp, Homo sapiens
ttttgggctcgaagctgcctcttcatcaga

SEQ ID NO: 24691 - DNA, 30 bp, Homo sapiens
tcctggctaaagctgctcacggtgtctgtg

SEQ ID NO: 24692 - DNA, 30 bp, Homo sapiens
atgtgagctttgagtagctggggggagaga

SEQ ID NO: 24693 - DNA, 30 bp, Homo sapiens
aggaggccagcttgcagtagctgggaggag

SEQ ID NO: 24694 - DNA, 30 bp, Homo sapiens
ccgctttgctccaattcagcgatgacagac

SEQ ID NO: 24695 - DNA, 30 bp, Homo sapiens
tccttcaggagcttgtgcttgactgtggtg

SEQ ID NO: 24696 - DNA, 30 bp, Homo sapiens
tgctggcgaggaaggagagcgtagaggggg

SEQ ID NO: 24697 - DNA, 30 bp, Homo sapiens
gttctctactctgtgctctacaaggacacg

SEQ ID NO: 24698 - DNA, 30 bp, Homo sapiens
aagatacatctggcatagtaagttttcatc

SEQ ID NO: 24699 - DNA, 30 bp, Homo sapiens
tttcggcgctgggtcgcccaaagcagaatg

SEQ ID NO: 24700 - DNA, 30 bp, Homo sapiens
ccacactccacctcggggtcttccacatcg

SEQ ID NO: 24701 - DNA, 30 bp, Homo sapiens
accaggtccataaaattgctgtgctgagag

SEQ ID NO: 24702 - DNA, 30 bp, Homo sapiens
ttttgatgggccaggtgaaattactgacat

SEQ ID NO: 24703 - DNA, 30 bp, Homo sapiens
tgcaggtcccaggctgtgcagggggctgct

SEQ ID NO: 24704 - DNA, 30 bp, Homo sapiens
cgtgttgaaaggtgttttcgattccggact

SEQ ID NO: 24705 - DNA, 30 bp, Homo sapiens
tgctgcttgtataaccatatattgcagaat

SEQ ID NO: 24706 - DNA, 30 bp, Homo sapiens
ggaaggtcctggatttttgcttctcattgg

SEQ ID NO: 24707 - DNA, 30 bp, Homo sapiens
cttgcctacattagaccggccttcaatgca

SEQ ID NO: 24708 - DNA, 30 bp, Homo sapiens
ttcaggatcagcttttcgcctttcttttca

SEQ ID NO: 24709 - DNA, 30 bp, Homo sapiens
cattggaacgcccttcaatggacagcttta

SEQ ID NO: 24710 - DNA, 30 bp, Homo sapiens
aactgctgttggtggtgggcttgtactgaa

SEQ ID NO: 24711 - DNA, 30 bp, Homo sapiens
agtcggggtcactgagagctggggaggcag

SEQ ID NO: 24712 - DNA, 30 bp, Homo sapiens
ccccggggggtggaaggggagctgctggga

SEQ ID NO: 24713 - DNA, 30 bp, Homo sapiens
tcgcggccaggacaatcttcagttccccgg

SEQ ID NO: 24714 - DNA, 30 bp, Homo sapiens
actccccacccagaacccgtgcatcctgcc

SEQ ID NO: 24715 - DNA, 30 bp, Homo sapiens
acatggatgtgaactctgtcctgataggtc

SEQ ID NO: 24716 - DNA, 30 bp, Homo sapiens
acatggtcacagctgcctgaagcatgtctt

SEQ ID NO: 24717 - DNA, 30 bp, Homo sapiens
tggccaaacatgatgaaaccgcgtctctac

SEQ ID NO: 24718 - DNA, 30 bp, Homo sapiens
cagcggcctgtactgtgccttcactgatgt

SEQ ID NO: 24719 - DNA, 30 bp, Homo sapiens
caaaggcatcgtggagtccagagtgctgag

SEQ ID NO: 24720 - DNA, 30 bp, Homo sapiens
ctttggctgatgaaggagggaactgttcat

SEQ ID NO: 24721 - DNA, 30 bp, Homo sapiens
cctgcccgttctgtttgtgttcttctgtcg

SEQ ID NO: 24722 - DNA, 30 bp, Homo sapiens
gcttctctatggcttggctgctctctggtc

SEQ ID NO: 24723 - DNA, 30 bp, Homo sapiens
cagagggtgaaaactgccttcggggaaaac

SEQ ID NO: 24724 - DNA, 30 bp, Homo sapiens
ccttcagggaacagaggtagctccagtacc

SEQ ID NO: 24725 - DNA, 30 bp, Homo sapiens
taatgggcttttgacttcagtgtagagcac

SEQ ID NO: 24726 - DNA, 30 bp, Homo sapiens
cagttgatgtcatcatagatgctgggcgtc

SEQ ID NO: 24727 - DNA, 30 bp, Homo sapiens
ccaatctcaacagagggagccataagaaag

SEQ ID NO: 24728 - DNA, 30 bp, Homo sapiens
tagcgagggggccttttctctttaaaagca

SEQ ID NO: 24729 - DNA, 30 bp, Homo sapiens
cgcagatgtttctgcctcttaaggatagat

SEQ ID NO: 24730 - DNA, 30 bp, Homo sapiens
gagtcctgggtaaagagcaaatcaggcttc

SEQ ID NO: 24731 - DNA, 30 bp, Homo sapiens
tcctgggctcgtctctctgtgaatctcctt

SEQ ID NO: 24732 - DNA, 30 bp, Homo sapiens
actgtttgctagctgattctttgttttggc

SEQ ID NO: 24733 - DNA, 30 bp, Homo sapiens
cgcaggtagatcttgggggtctgccagcct

SEQ ID NO: 24734 - DNA, 30 bp, Homo sapiens
agccctaagagcagattttctggctttatg

SEQ ID NO: 24735 - DNA, 30 bp, Homo sapiens
ggcgacagattgaagggcagagggaggcag

SEQ ID NO: 24736 - DNA, 30 bp, Homo sapiens
gagcacagggaggcagcacccttcgggagt

SEQ ID NO: 24737 - DNA, 30 bp, Homo sapiens
agcaatttgacgagagaaaagaaactctcc

SEQ ID NO: 24738 - DNA, 30 bp, Homo sapiens
tatcgggcctcgatatccttcagcgtgtgg

SEQ ID NO: 24739 - DNA, 30 bp, Homo sapiens
agtcttccagctcttcctcggtaacatttt

SEQ ID NO: 24740 - DNA, 30 bp, Homo sapiens
atttggagctgtttccagccaggcagagct

SEQ ID NO: 24741 - DNA, 30 bp, Homo sapiens
atctggtggctcagtgagactttgggaggt

SEQ ID NO: 24742 - DNA, 30 bp, Homo sapiens
agtaggcgtcgggctgggcgggctcgaagg

SEQ ID NO: 24743 - DNA, 30 bp, Homo sapiens
atctggtggaggtagcttgtggggcctgac

SEQ ID NO: 24744 - DNA, 30 bp, Homo sapiens
aacaggaatgaatttgatggacttggaaga

SEQ ID NO: 24745 - DNA, 30 bp, Homo sapiens
agatgatggtctcagcggtgccttccccat

SEQ ID NO: 24746 - DNA, 30 bp, Homo sapiens
gatgaagtgtccttggccagggaggagctg

SEQ ID NO: 24747 - DNA, 30 bp, Homo sapiens
ccacggctacacccaccttccagaggtgcc

SEQ ID NO: 24748 - DNA, 30 bp, Homo sapiens
cacaggaaaaacagcttttgggtctctgag

SEQ ID NO: 24749 - DNA, 30 bp, Homo sapiens
tcctgggtctctgagataccaaacttggtc

SEQ ID NO: 24750 - DNA, 30 bp, Homo sapiens
tttggagattttgaggaattttctgctgac

SEQ ID NO: 24751 - DNA, 30 bp, Homo sapiens
agtccaccttctccactttgccgatgatct

SEQ ID NO: 24752 - DNA, 30 bp, Homo sapiens
cactttgcccagaatccggccttcatacat

SEQ ID NO: 24753 - DNA, 30 bp, Homo sapiens
tcctgccctggggctgctggggagccccta

SEQ ID NO: 24754 - DNA, 30 bp, Homo sapiens
agctggcctcccagggcaccacgaggggct

SEQ ID NO: 24755 - DNA, 30 bp, Homo sapiens
attgcgccactgcactccaggctgtgctac

SEQ ID NO: 24756 - DNA, 30 bp, Homo sapiens
aagagggaacagtcctcaaaattcatgcta

SEQ ID NO: 24757 - DNA, 30 bp, Homo sapiens
aatgcagtggtggaaggttgggtaaaggca

SEQ ID NO: 24758 - DNA, 30 bp, Homo sapiens
cagcggaaaagctcatcacaggatggaccc

SEQ ID NO: 24759 - DNA, 30 bp, Homo sapiens
taagcttcagcggaaaagctgtcttcttgg

SEQ ID NO: 24760 - DNA, 30 bp, Homo sapiens
cacatgatgctcgctggggtgaagacaggg

SEQ ID NO: 24761 - DNA, 30 bp, Homo sapiens
agcagggtgagtggttcttagacttctgca

SEQ ID NO: 24762 - DNA, 30 bp, Homo sapiens
taggctggccccggtcccgggttgttgaga

SEQ ID NO: 24763 - DNA, 30 bp, Homo sapiens
taactatcttgggctgtgacaaagtcacat

SEQ ID NO: 24764 - DNA, 30 bp, Homo sapiens
catgacctgccaaaaagtgatgatctcctt

SEQ ID NO: 24765 - DNA, 30 bp, Homo sapiens
gcaactccctccacaccttccaagaattca

SEQ ID NO: 24766 - DNA, 30 bp, Homo sapiens
tatcttgcttgacatcgacaaggatcaccg

SEQ ID NO: 24767 - DNA, 30 bp, Homo sapiens
tctgtgcatttcttctggagagatctgatg

SEQ ID NO: 24768 - DNA, 30 bp, Homo sapiens
tgccttttcttttgctgcgttggcacaggc

SEQ ID NO: 24769 - DNA, 30 bp, Homo sapiens
gccaggctattgctcgacaccgcaggatgc

SEQ ID NO: 24770 - DNA, 30 bp, Homo sapiens
agacaggcggacaatcttccccccgggaat

SEQ ID NO: 24771 - DNA, 30 bp, Homo sapiens
caggggatgccctcccttctctggcagcac

SEQ ID NO: 24772 - DNA, 30 bp, Homo sapiens
ccgaggggtcagtgaagcccttcttgccct

SEQ ID NO: 24773 - DNA, 30 bp, Homo sapiens
ttttcactgtgtccaggtggtactttggct

SEQ ID NO: 24774 - DNA, 30 bp, Homo sapiens
cacctcaattgctgggtctgagccccggcc

SEQ ID NO: 24775 - DNA, 30 bp, Homo sapiens
gcagttggcagcccgtggctccaggtcctt

SEQ ID NO: 24776 - DNA, 30 bp, Homo sapiens
gaaaacctttctgtgtctcctgcctggctt

SEQ ID NO: 24777 - DNA, 30 bp, Homo sapiens
tatcaaatgtcctgaagcctttgtgtttct

SEQ ID NO: 24778 - DNA, 30 bp, Homo sapiens
cgcaggtgaggttgggctggttcagcgcat

SEQ ID NO: 24779 - DNA, 30 bp, Homo sapiens
agcgctggggtatggggccagctgcacact

SEQ ID NO: 24780 - DNA, 30 bp, Homo sapiens
acaagggtatgtgtccacatagctaatttt

SEQ ID NO: 24781 - DNA, 30 bp, Homo sapiens
gagacccggtgtccccggtcacagctgagc

SEQ ID NO: 24782 - DNA, 30 bp, Homo sapiens
acctggagcttgcgggagcaggtgagattg

SEQ ID NO: 24783 - DNA, 30 bp, Homo sapiens
cactggagccttgggtcttgcagttgtttc

SEQ ID NO: 24784 - DNA, 30 bp, Homo sapiens
cattggaaggggcctgcagcgacaggctgt

SEQ ID NO: 24785 - DNA, 30 bp, Homo sapiens
gctgaagtgaaggaagtcctggccctcctg

SEQ ID NO: 24786 - DNA, 30 bp, Homo sapiens
cactgggaggtcatgcactgcagccggtgt

SEQ ID NO: 24787 - DNA, 30 bp, Homo sapiens
acaagtctcttcctggggccccccacagtt

SEQ ID NO: 24788 - DNA, 30 bp, Homo sapiens
atgcggcacattggagatggttcttgaagt

SEQ ID NO: 24789 - DNA, 30 bp, Homo sapiens
acagcgtcttcatctggcgacggctccaca

SEQ ID NO: 24790 - DNA, 30 bp, Homo sapiens
gacgcccccgtgcgagagcccttcctgctg

SEQ ID NO: 24791 - DNA, 30 bp, Homo sapiens
gctcggtgtcccgatgtccactgtgatttg

SEQ ID NO: 24792 - DNA, 30 bp, Homo sapiens
ccgagggggccacgacggaggccgcccaat

SEQ ID NO: 24793 - DNA, 30 bp, Homo sapiens
cctcggagggctgtgtggttggcagtagat

SEQ ID NO: 24794 - DNA, 30 bp, Homo sapiens
cagaaatccactgtgatgttgatatataaa

SEQ ID NO: 24795 - DNA, 30 bp, Homo sapiens
agtactcgttcacctgagccagctcgggtg

SEQ ID NO: 24796 - DNA, 30 bp, Homo sapiens
ctctggcatgaggtttacagatatgtttgt

SEQ ID NO: 24797 - DNA, 30 bp, Homo sapiens
cagctgaatgtgcaccagggtgtggcggtc

SEQ ID NO: 24798 - DNA, 30 bp, Homo sapiens
cgtcggggagagttggggtacttggccttc

SEQ ID NO: 24799 - DNA, 30 bp, Homo sapiens
cacagggtaaaatcgcccggccttctgctg

SEQ ID NO: 24800 - DNA, 30 bp, Homo sapiens
gagggtgacttagtatttcccagctgctga

SEQ ID NO: 24801 - DNA, 30 bp, Homo sapiens
gccaggctgggctggggcagagagagaccc

SEQ ID NO: 24802 - DNA, 30 bp, Homo sapiens
aaatggggacaacagtgcctgacccaagcc

SEQ ID NO: 24803 - DNA, 30 bp, Homo sapiens
cttcaccctgagccaccaccttggggtctg

SEQ ID NO: 24804 - DNA, 30 bp, Homo sapiens
tgaaggtggcttcccggccttcaccctgag

SEQ ID NO: 24805 - DNA, 30 bp, Homo sapiens
gcactccacgccgtagcggtcgaagttgcg

SEQ ID NO: 24806 - DNA, 30 bp, Homo sapiens
tgttggatgctatctgttacattaatggtg

SEQ ID NO: 24807 - DNA, 30 bp, Homo sapiens
gactggtcacatctggaatgaggtgcttcc

SEQ ID NO: 24808 - DNA, 30 bp, Homo sapiens
cagtggcctcaacctcaatggcttcatcct

SEQ ID NO: 24809 - DNA, 30 bp, Homo sapiens
agctggattcctccccatctctgttgctct

SEQ ID NO: 24810 - DNA, 30 bp, Homo sapiens
gaggccctccaaggaggccctctggagctt

SEQ ID NO: 24811 - DNA, 30 bp, Homo sapiens
gctttccattggcaaatgctgcctcctgga

SEQ ID NO: 24812 - DNA, 30 bp, Homo sapiens
aagactggtgtttcctagagctttccattg

SEQ ID NO: 24813 - DNA, 30 bp, Homo sapiens
cacttcagcagggagatgtcatcagcaaag

SEQ ID NO: 24814 - DNA, 30 bp, Homo sapiens
atgtctgaccagagaggactcatcattgac

SEQ ID NO: 24815 - DNA, 30 bp, Homo sapiens
ttgagaaaggcccggaaatttcagacactg

SEQ ID NO: 24816 - DNA, 30 bp, Homo sapiens
actctgacgacactgttccgcaggcccagc

SEQ ID NO: 24817 - DNA, 30 bp, Homo sapiens
tcctgggctgttcgtcagttgtacacttat

SEQ ID NO: 24818 - DNA, 30 bp, Homo sapiens
cactgggagggggcggagcttcccctgccc

SEQ ID NO: 24819 - DNA, 30 bp, Homo sapiens
actcggccagggcaaagtttgtagactgca

SEQ ID NO: 24820 - DNA, 30 bp, Homo sapiens
ttttggaaccagctcctttagaatgctcta

SEQ ID NO: 24821 - DNA, 30 bp, Homo sapiens
tgctgggttaccaggggtgtctgtcatgct

SEQ ID NO: 24822 - DNA, 30 bp, Homo sapiens
tggcctgaatcttacaaacagcctcttttc

SEQ ID NO: 24823 - DNA, 30 bp, Homo sapiens
catcagatttcaggtcgagatagctgagaa

SEQ ID NO: 24824 - DNA, 30 bp, Homo sapiens
caaaggcccgctgggcattggggaagcgct

SEQ ID NO: 24825 - DNA, 30 bp, Homo sapiens
gcttggtcaatgtgttctggacaaagcagg

SEQ ID NO: 24826 - DNA, 30 bp, Homo sapiens
ccagttttttggagtgactgagatgtaagt

SEQ ID NO: 24827 - DNA, 30 bp, Homo sapiens
ggttggtacagatttcataattcgttgaag

SEQ ID NO: 24828 - DNA, 30 bp, Homo sapiens
cagaggaactaagagctgaagggtaattat

SEQ ID NO: 24829 - DNA, 30 bp, Homo sapiens
cataggatgggcacgccatcagccgtcacc

SEQ ID NO: 24830 - DNA, 30 bp, Homo sapiens
tactgggggttcttaaggatgcgcccgtgg

SEQ ID NO: 24831 - DNA, 30 bp, Homo sapiens
actgtggacaccagcgtgccgctgccactg

SEQ ID NO: 24832 - DNA, 30 bp, Homo sapiens
gctgaggaggggggcagacctgtcgttggt

SEQ ID NO: 24833 - DNA, 30 bp, Homo sapiens
gccagggtgcgggcgctcccatccccgtgc

SEQ ID NO: 24834 - DNA, 30 bp, Homo sapiens
atctggccacttccacatcggcgctgctca

SEQ ID NO: 24835 - DNA, 30 bp, Homo sapiens
atcgaatgatgggtgccgagcgatcattcg

SEQ ID NO: 24836 - DNA, 30 bp, Homo sapiens
cagcggatgaggggtgctgagcggtcattg

SEQ ID NO: 24837 - DNA, 30 bp, Homo sapiens
caggggtccgcctccatgcacttctccagc

SEQ ID NO: 24838 - DNA, 30 bp, Homo sapiens
aactggcccaacagaaccacacccagaacc

SEQ ID NO: 24839 - DNA, 30 bp, Homo sapiens
tacgaattccagcttcccgtgcccactgta

SEQ ID NO: 24840 - DNA, 30 bp, Homo sapiens
agaaggcgtcgcaccactctcgaaggcatc

SEQ ID NO: 24841 - DNA, 30 bp, Homo sapiens
tacaggaagcaggcacaccactccttgagg

SEQ ID NO: 24842 - DNA, 30 bp, Homo sapiens
tccttttcaacttggggtcgagcaggaagc

SEQ ID NO: 24843 - DNA, 30 bp, Homo sapiens
actgaatctggatggccccgtgctcgagct

SEQ ID NO: 24844 - DNA, 30 bp, Homo sapiens
cactggcgcttggccttgtaggggcgagag

SEQ ID NO: 24845 - DNA, 30 bp, Homo sapiens
caaaggacatcacacagtctataaaccagc

SEQ ID NO: 24846 - DNA, 30 bp, Homo sapiens
ccgaggctgcgcggcgcgtgggaggacgcc

SEQ ID NO: 24847 - DNA, 30 bp, Homo sapiens
caccgggggtgtggggtgcctgggatgggg

SEQ ID NO: 24848 - DNA, 30 bp, Homo sapiens
gtcctcgcggctcctgtcgctgggctcgcc

SEQ ID NO: 24849 - DNA, 30 bp, Homo sapiens
tgggggttccgaagagggtattggcaactc

SEQ ID NO: 24850 - DNA, 30 bp, Homo sapiens
cactctttcacggttacggtttggtcggaa

SEQ ID NO: 24851 - DNA, 30 bp, Homo sapiens
ggctggaagcgcggggagctgacatgaggt

SEQ ID NO: 24852 - DNA, 30 bp, Homo sapiens
cgcagggcagcacccagtagtgagggagga

SEQ ID NO: 24853 - DNA, 30 bp, Homo sapiens
tagaagtggacttgagcagaggagagcaga

SEQ ID NO: 24854 - DNA, 30 bp, Homo sapiens
catcggggcaagcagccggccacagggtcc

SEQ ID NO: 24855 - DNA, 30 bp, Homo sapiens
gtaaggaaaacgcattatagaccacatctg

SEQ ID NO: 24856 - DNA, 30 bp, Homo sapiens
cccatcttcttccagatggtgagtgaggcg

SEQ ID NO: 24857 - DNA, 30 bp, Homo sapiens
ccaaggcagctgggggcctcagcccatctt

SEQ ID NO: 24858 - DNA, 30 bp, Homo sapiens
agccggtggtgtgctaacttggtccacatt

SEQ ID NO: 24859 - DNA, 30 bp, Homo sapiens
tacttcttctgtcttcgtcccctggactgt

SEQ ID NO: 24860 - DNA, 30 bp, Homo sapiens
agattggcctgttttccctgataaaactcc

SEQ ID NO: 24861 - DNA, 30 bp, Homo sapiens
attgtggccagctctgcctatatcagaatc

SEQ ID NO: 24862 - DNA, 30 bp, Homo sapiens
acatggtgcagagaaagtcccccgcgctgg

SEQ ID NO: 24863 - DNA, 30 bp, Homo sapiens
aattgggctccatctcgggggctctgtggc

SEQ ID NO: 24864 - DNA, 30 bp, Homo sapiens
cagtgggttatttgccgttgatccttttct

SEQ ID NO: 24865 - DNA, 30 bp, Homo sapiens
tttggaagaacttcccggaacattgacttc

SEQ ID NO: 24866 - DNA, 30 bp, Homo sapiens
agaaggttcctgtgtcagactcctgaggtt

SEQ ID NO: 24867 - DNA, 30 bp, Homo sapiens
tccaccctctgccttaagatacgaagcctt

SEQ ID NO: 24868 - DNA, 30 bp, Homo sapiens
aggcggccgccagcccctcgctcccaggca

SEQ ID NO: 24869 - DNA, 30 bp, Homo sapiens
ctgagggtgtctcttaacagtgattaccat

SEQ ID NO: 24870 - DNA, 30 bp, Homo sapiens
aatttatctgtgtgtgtccatgtccagtaa

SEQ ID NO: 24871 - DNA, 30 bp, Homo sapiens
aagaagctgtccccactcgcatgattttga

SEQ ID NO: 24872 - DNA, 30 bp, Homo sapiens
cgcaggctctggctccagaggaagagatgg

SEQ ID NO: 24873 - DNA, 30 bp, Homo sapiens
gtccctgtagggtgaatccatccttcaatt

SEQ ID NO: 24874 - DNA, 30 bp, Homo sapiens
tttccaatagaaggggtactttagttttta

SEQ ID NO: 24875 - DNA, 30 bp, Homo sapiens
accatagagtctttcaagatgtgcaggttg

SEQ ID NO: 24876 - DNA, 30 bp, Homo sapiens
tagcttttgggtccctccatcagctggaga

SEQ ID NO: 24877 - DNA, 30 bp, Homo sapiens
ctccttggaggggtgaaacttcaggcctgg

SEQ ID NO: 24878 - DNA, 30 bp, Homo sapiens
cactggtcagcgcaggaaataagtacagga

SEQ ID NO: 24879 - DNA, 30 bp, Homo sapiens
cctcggtaaagacaaggctagggtagtagg

SEQ ID NO: 24880 - DNA, 30 bp, Homo sapiens
acggagcccccttctcccgccgctggcggc

SEQ ID NO: 24881 - DNA, 30 bp, Homo sapiens
cccccgctgccacccctggctcctccggag

SEQ ID NO: 24882 - DNA, 30 bp, Homo sapiens
agggacctggcatggggctggaagggggga

SEQ ID NO: 24883 - DNA, 30 bp, Homo sapiens
gctgcagggggaagaaaaggagtaggatag

SEQ ID NO: 24884 - DNA, 30 bp, Homo sapiens
gttcagagtgttctttcaggagttgatcat

SEQ ID NO: 24885 - DNA, 30 bp, Homo sapiens
atagtgcatttttctgaacttaaattttct

SEQ ID NO: 24886 - DNA, 30 bp, Homo sapiens
ctcttccttcttgtccatgggaccatctac

SEQ ID NO: 24887 - DNA, 30 bp, Homo sapiens
aggcggctgccagctggcctaggacgcggc

SEQ ID NO: 24888 - DNA, 30 bp, Homo sapiens
ttacaggaggaggttccaatttacgcgaga

SEQ ID NO: 24889 - DNA, 30 bp, Homo sapiens
acttggatttgccaactggtccgatggata

SEQ ID NO: 24890 - DNA, 30 bp, Homo sapiens
tgccggatgttttctttgtttgcctctcca

SEQ ID NO: 24891 - DNA, 30 bp, Homo sapiens
tcccgaacgcatgctttgttactgttgggt

SEQ ID NO: 24892 - DNA, 30 bp, Homo sapiens
tacgggaagccagtcgggaagaggctgagg

SEQ ID NO: 24893 - DNA, 30 bp, Homo sapiens
caaaggccgagggcaggtgcgggggtggtg

SEQ ID NO: 24894 - DNA, 30 bp, Homo sapiens
tatacagtgtgggcagctcgtacgtcacgg

SEQ ID NO: 24895 - DNA, 30 bp, Homo sapiens
aggatagcacaattgtccagtcgctctctt

SEQ ID NO: 24896 - DNA, 30 bp, Homo sapiens
caccgggaacatccactcgtgggctctgat

SEQ ID NO: 24897 - DNA, 30 bp, Homo sapiens
gtcatgaaggttccctggaaatcacttaga

SEQ ID NO: 24898 - DNA, 30 bp, Homo sapiens
tttcgttcatcttgtcgcctggaattaaca

SEQ ID NO: 24899 - DNA, 30 bp, Homo sapiens
attgtgctgtatcggaactggttccaatcc

SEQ ID NO: 24900 - DNA, 30 bp, Homo sapiens
cactgcttctggaaacttaatctgttcttt

SEQ ID NO: 24901 - DNA, 30 bp, Homo sapiens
caactttctttcttgctagtgtaatcgtta

SEQ ID NO: 24902 - DNA, 30 bp, Homo sapiens
cagtgggtagtgctccccgtaggtctgcag

SEQ ID NO: 24903 - DNA, 30 bp, Homo sapiens
gtctgggatgtagaatggttcaaaaatgtg

SEQ ID NO: 24904 - DNA, 30 bp, Homo sapiens
atccggaagctttcctcccggccatcgatg

SEQ ID NO: 24905 - DNA, 30 bp, Homo sapiens
gcatgggtcctgactgggcgccactatgca

SEQ ID NO: 24906 - DNA, 30 bp, Homo sapiens
ttaagggaagaaacatctcactagagtttg

SEQ ID NO: 24907 - DNA, 30 bp, Homo sapiens
gaaaactgccacacatcttgagctctctgg

SEQ ID NO: 24908 - DNA, 30 bp, Homo sapiens
tactgtacacgctaaaaggcatcttacaaa

SEQ ID NO: 24909 - DNA, 30 bp, Homo sapiens
tctcggcctgctcgattttgacgtcgttag

SEQ ID NO: 24910 - DNA, 30 bp, Homo sapiens
ttgtggcccagataggcacccagggtgatg

SEQ ID NO: 24911 - DNA, 30 bp, Homo sapiens
cccagactcacatcaccaagtgcacctacc

SEQ ID NO: 24912 - DNA, 30 bp, Homo sapiens
cttgtgggccactgactctaccagcatagg

SEQ ID NO: 24913 - DNA, 30 bp, Homo sapiens
ttcaggagagatagcatttcacagatcttt

SEQ ID NO: 24914 - DNA, 30 bp, Homo sapiens
aatctccgggcaccagctctccacgtgcac

SEQ ID NO: 24915 - DNA, 30 bp, Homo sapiens
gaagagtgagcccagcagaaccacgccggc

SEQ ID NO: 24916 - DNA, 30 bp, Homo sapiens
ataaatgaaggctgttgttaacaagcatga

SEQ ID NO: 24917 - DNA, 30 bp, Homo sapiens
agttgggcaggtagaagcgggttaaaagtt

SEQ ID NO: 24918 - DNA, 30 bp, Homo sapiens
aatgcattctccacaccaggcggacaatgt

SEQ ID NO: 24919 - DNA, 30 bp, Homo sapiens
gcactgagatagtggttgaaggcctggcaa

SEQ ID NO: 24920 - DNA, 30 bp, Homo sapiens
gagtggccactgaacttccctatgaagggc

SEQ ID NO: 24921 - DNA, 30 bp, Homo sapiens
cactgagatagtggttgaaggcctggcaag

SEQ ID NO: 24922 - DNA, 30 bp, Homo sapiens
atgtggtgcacacagcccctgggcagcaca

SEQ ID NO: 24923 - DNA, 30 bp, Homo sapiens
ttgtggttgagttgttctgtatcttgacta

SEQ ID NO: 24924 - DNA, 30 bp, Homo sapiens
atcaggtggaagaggcatcctccttgcata

SEQ ID NO: 24925 - DNA, 30 bp, Homo sapiens
tgcatagtaagcgttaaactcgtctccaat

SEQ ID NO: 24926 - DNA, 30 bp, Homo sapiens
cctccagcagggccaccagcctccgcagta

SEQ ID NO: 24927 - DNA, 30 bp, Homo sapiens
caatggcaagttcaagtccacgggtgaaac

SEQ ID NO: 24928 - DNA, 30 bp, Homo sapiens
atttctttctcagagccagggctaccccga

SEQ ID NO: 24929 - DNA, 30 bp, Homo sapiens
caccgtgctgctggatccatggcgagaagt

SEQ ID NO: 24930 - DNA, 30 bp, Homo sapiens
tgcaggccatcaaaccatcctgtggaaaac

SEQ ID NO: 24931 - DNA, 30 bp, Homo sapiens
ctccctggccctggatgaactcccggatgg

SEQ ID NO: 24932 - DNA, 30 bp, Homo sapiens
cagttaccagggcccccagtgccacggccc

SEQ ID NO: 24933 - DNA, 30 bp, Homo sapiens
cagctgcctcctggagctggggaggggggc

SEQ ID NO: 24934 - DNA, 30 bp, Homo sapiens
agcaggctttggggagctccggaggcaggt

SEQ ID NO: 24935 - DNA, 30 bp, Homo sapiens
gagaatgtggtagtgcactttggtgttggt

SEQ ID NO: 24936 - DNA, 30 bp, Homo sapiens
cttcggagttttgttgagaggcctccagtt

SEQ ID NO: 24937 - DNA, 30 bp, Homo sapiens
ctgcggcactgtgggttggtccacacagaa

SEQ ID NO: 24938 - DNA, 30 bp, Homo sapiens
caggggtcaggggcatttgggcagatgcgc

SEQ ID NO: 24939 - DNA, 30 bp, Homo sapiens
cacctccccttaccctgggggattgttctg

SEQ ID NO: 24940 - DNA, 30 bp, Homo sapiens
ttgccaggtccttggctaaatccacccatg

SEQ ID NO: 24941 - DNA, 30 bp, Homo sapiens
agaagggcaggttggccatgccgcctggtg

SEQ ID NO: 24942 - DNA, 30 bp, Homo sapiens
cttccttgcgtctgtccttcttttcttcat

SEQ ID NO: 24943 - DNA, 30 bp, Homo sapiens
gcaacatctgtatattccttcttttttctc

SEQ ID NO: 24944 - DNA, 30 bp, Homo sapiens
ggtcagaggagccccgtggcagtcggaagc

SEQ ID NO: 24945 - DNA, 30 bp, Homo sapiens
agatgggtatgaaggtaccatggaacccat

SEQ ID NO: 24946 - DNA, 30 bp, Homo sapiens
gttgtctgaggccagatcactggggtggag

SEQ ID NO: 24947 - DNA, 30 bp, Homo sapiens
caactgttgcaagactggaattccacctcg

SEQ ID NO: 24948 - DNA, 30 bp, Homo sapiens
gacttcggtggagaacaggatgctctgtct

SEQ ID NO: 24949 - DNA, 30 bp, Homo sapiens
cacctcctcagagactcagcattgtgaatt

SEQ ID NO: 24950 - DNA, 30 bp, Homo sapiens
cagcggatgtagatcatgtcggagatggct

SEQ ID NO: 24951 - DNA, 30 bp, Homo sapiens
tccatcaatgatgacagggttaccagttac

SEQ ID NO: 24952 - DNA, 30 bp, Homo sapiens
gaaaagttggaagatttctttcctatggga

SEQ ID NO: 24953 - DNA, 30 bp, Homo sapiens
ccagtcctgcagtttgtgaatctggcgttc

SEQ ID NO: 24954 - DNA, 30 bp, Homo sapiens
tcttccccttttaatggtcaatgtacatac

SEQ ID NO: 24955 - DNA, 30 bp, Homo sapiens
cttgaggggcccgcttttgggcacttttat

SEQ ID NO: 24956 - DNA, 30 bp, Homo sapiens
tagaggactggagagccactggggaggctg

SEQ ID NO: 24957 - DNA, 30 bp, Homo sapiens
cacaatcctctctgggccagaggctggggc

SEQ ID NO: 24958 - DNA, 30 bp, Homo sapiens
atttgtctgtcagagactccagatatgaat

SEQ ID NO: 24959 - DNA, 30 bp, Homo sapiens
caagaccccacttaagattcgtcagcatga

SEQ ID NO: 24960 - DNA, 30 bp, Homo sapiens
ggcaacccagatgagactccacttgaaatt

SEQ ID NO: 24961 - DNA, 30 bp, Homo sapiens
gcaaggttccgtagagctgggccttggtga

SEQ ID NO: 24962 - DNA, 30 bp, Homo sapiens
cctcggagagcactaatcttattggggtca

SEQ ID NO: 24963 - DNA, 30 bp, Homo sapiens
aggtgcttgggtcagtggcgtcgggatctc

SEQ ID NO: 24964 - DNA, 30 bp, Homo sapiens
cttctccactttctttgctttcttgaggat

SEQ ID NO: 24965 - DNA, 30 bp, Homo sapiens
atccccagatccatcctgggaacttttatt

SEQ ID NO: 24966 - DNA, 30 bp, Homo sapiens
cccaaggccgcatgagtacttaagctcatc

SEQ ID NO: 24967 - DNA, 30 bp, Homo sapiens
ctttggagagtctctgtgcaatttcagttt

SEQ ID NO: 24968 - DNA, 30 bp, Homo sapiens
agctggttttacagctttgtcccttgaagt

SEQ ID NO: 24969 - DNA, 30 bp, Homo sapiens
actgtcgaagtcggctgttttctttccggg

SEQ ID NO: 24970 - DNA, 30 bp, Homo sapiens
agtctttcatcactgtccgcgatctctgag

SEQ ID NO: 24971 - DNA, 30 bp, Homo sapiens
tgaagggtaagagacttggctgagcctggc

SEQ ID NO: 24972 - DNA, 30 bp, Homo sapiens
ttccaaggcccaataaggatccatgtgatc

SEQ ID NO: 24973 - DNA, 30 bp, Homo sapiens
cttccttcacctggtcccaagaagtcttcc

SEQ ID NO: 24974 - DNA, 30 bp, Homo sapiens
tctcctcctcctcgccaatagggctgggca

SEQ ID NO: 24975 - DNA, 30 bp, Homo sapiens
atttgggtgattcctcagtttccttgttca

SEQ ID NO: 24976 - DNA, 30 bp, Homo sapiens
accaccaggatcactcttagcacactggaa

SEQ ID NO: 24977 - DNA, 30 bp, Homo sapiens
tgaaggcagaatgggtttcatgccagttct

SEQ ID NO: 24978 - DNA, 30 bp, Homo sapiens
ggctccagggcctcgtccccggactccgcc

SEQ ID NO: 24979 - DNA, 30 bp, Homo sapiens
gtttggctccctctggataaaatcttcagt

SEQ ID NO: 24980 - DNA, 30 bp, Homo sapiens
acatgggacataaacctagaaatccagttg

SEQ ID NO: 24981 - DNA, 30 bp, Homo sapiens
tccccagaaacggaggtcagccctccatgg

SEQ ID NO: 24982 - DNA, 30 bp, Homo sapiens
ataaggcaaaactcatcgtgatggtcatgg

SEQ ID NO: 24983 - DNA, 30 bp, Homo sapiens
ataaggcaaaattcatcatgatggtcatgg

SEQ ID NO: 24984 - DNA, 30 bp, Homo sapiens
ttcaggagtttggaagcgcatatagtgcct

SEQ ID NO: 24985 - DNA, 30 bp, Homo sapiens
ataaggcaaaactcatcatgatgatcatgg

SEQ ID NO: 24986 - DNA, 30 bp, Homo sapiens
acaacacctgggtttccagccgccggagtt

SEQ ID NO: 24987 - DNA, 30 bp, Homo sapiens
ttcttcttgtctgactttgtctttccaatc

SEQ ID NO: 24988 - DNA, 30 bp, Homo sapiens
tcctccctgtccagcagggcgtggtaggac

SEQ ID NO: 24989 - DNA, 30 bp, Homo sapiens
gaccgggccgtagaagcgccgataggcctc

SEQ ID NO: 24990 - DNA, 30 bp, Homo sapiens
ctttttgtagttgccaaactggatggccag

SEQ ID NO: 24991 - DNA, 30 bp, Homo sapiens
tctcggaagctgtggatctgcgtggagtac

SEQ ID NO: 24992 - DNA, 30 bp, Homo sapiens
tcccgggggcggatcgcaggtagccccgcg

SEQ ID NO: 24993 - DNA, 30 bp, Homo sapiens
aaatggccatgagtgtattataactcaagt

SEQ ID NO: 24994 - DNA, 30 bp, Homo sapiens
actgtttgcagaggctggaggagacgctgt

SEQ ID NO: 24995 - DNA, 30 bp, Homo sapiens
gcgcggagggcgtcccggagaaggcggcgc

SEQ ID NO: 24996 - DNA, 30 bp, Homo sapiens
ctttggtttctaagtttaaaggggggattg

SEQ ID NO: 24997 - DNA, 30 bp, Homo sapiens
tcctggctgcgagggatcttcctgagcaga

SEQ ID NO: 24998 - DNA, 30 bp, Homo sapiens
cactggaggtgcgggggcagcggcaaggcc

SEQ ID NO: 24999 - DNA, 30 bp, Homo sapiens
ttgtggcttctttctgctgcatcagctcgg

SEQ ID NO: 25000 - DNA, 30 bp, Homo sapiens
aagtctggctttgacagcgaaggacagaaa

SEQ ID NO: 25001 - DNA, 30 bp, Homo sapiens
cagcggccactgacactagcaatgtctgag

SEQ ID NO: 25002 - DNA, 30 bp, Homo sapiens
tagttgtgagcactgtggcggtacggaggc

SEQ ID NO: 25003 - DNA, 30 bp, Homo sapiens
taggggtgaggaggcttggagagacagtgg

SEQ ID NO: 25004 - DNA, 30 bp, Homo sapiens
atcacagtaaatgctgtgcttctcgctgca

SEQ ID NO: 25005 - DNA, 30 bp, Homo sapiens
cttcggggcggctttggcacggccacgccg

SEQ ID NO: 25006 - DNA, 30 bp, Homo sapiens
gaatgagaagagtcgtttgccttcagcgat

SEQ ID NO: 25007 - DNA, 30 bp, Homo sapiens
ggtccttcggaagaggttactgagaaagcc

SEQ ID NO: 25008 - DNA, 30 bp, Homo sapiens
atctggtcaacgtcctggcgccgaggccac

SEQ ID NO: 25009 - DNA, 30 bp, Homo sapiens
tctaggatactatttacagctgcttctaaa

SEQ ID NO: 25010 - DNA, 30 bp, Homo sapiens
cgtaggtgcgtaggttctggttaataaaat

SEQ ID NO: 25011 - DNA, 30 bp, Homo sapiens
ttgagcagcaggtgcaggcccccgctgagc

SEQ ID NO: 25012 - DNA, 30 bp, Homo sapiens
catgggaccctctcagtgaagttctcgggg

SEQ ID NO: 25013 - DNA, 30 bp, Homo sapiens
ttgtggattttcacttgtggatacctcttc

SEQ ID NO: 25014 - DNA, 30 bp, Homo sapiens
catcggccacaatggagagggcccggagct

SEQ ID NO: 25015 - DNA, 30 bp, Homo sapiens
attatacccctgcaaatagggcattttctt

SEQ ID NO: 25016 - DNA, 30 bp, Homo sapiens
acaaggaataaacactatggacacttcttt

SEQ ID NO: 25017 - DNA, 30 bp, Homo sapiens
acattgctaaggggcccacaggaaggctgg

SEQ ID NO: 25018 - DNA, 30 bp, Homo sapiens
tccatggcagccagctgctcgatggcacgg

SEQ ID NO: 25019 - DNA, 30 bp, Homo sapiens
aactggaagtcactggggagttctttgctg

SEQ ID NO: 25020 - DNA, 30 bp, Homo sapiens
acaggaaggtgcgcacgcggctgcggacgg

SEQ ID NO: 25021 - DNA, 30 bp, Homo sapiens
tgcacatgggacatctgtcaactgcttcag

SEQ ID NO: 25022 - DNA, 30 bp, Homo sapiens
gtaatcactgtaaccctggtaaccactgtt

SEQ ID NO: 25023 - DNA, 30 bp, Homo sapiens
ggtgcccacaacgccgggatcatgcgccga

SEQ ID NO: 25024 - DNA, 30 bp, Homo sapiens
tacagggcctcagcagaggaattgcataac

SEQ ID NO: 25025 - DNA, 30 bp, Homo sapiens
agggctgcagctcgtactgccgctcggtgg

SEQ ID NO: 25026 - DNA, 30 bp, Homo sapiens
cttcggtggagccataatccccaatttgct

SEQ ID NO: 25027 - DNA, 30 bp, Homo sapiens
ctcccatggggtcccatgctggcaggataa

SEQ ID NO: 25028 - DNA, 30 bp, Homo sapiens
gtctggtggaatcttttgtgttattctgac

SEQ ID NO: 25029 - DNA, 30 bp, Homo sapiens
ggaaggggcagactgcagctgccctttgta

SEQ ID NO: 25030 - DNA, 30 bp, Homo sapiens
acttggcttccagtttttttgaatatgcat

SEQ ID NO: 25031 - DNA, 30 bp, Homo sapiens
ccgcggccccgggtctttctcaggctcggt

SEQ ID NO: 25032 - DNA, 30 bp, Homo sapiens
gagctgaggcctttcactgcaacaagggaa

SEQ ID NO: 25033 - DNA, 30 bp, Homo sapiens
ccatctcagcatattgttctttaagccttt

SEQ ID NO: 25034 - DNA, 30 bp, Homo sapiens
aagtggtcactatgaatcttttttcgttcc

SEQ ID NO: 25035 - DNA, 30 bp, Homo sapiens
tggcatgatagtgtttagcctcagcaaagt

SEQ ID NO: 25036 - DNA, 30 bp, Homo sapiens
ggctggtctggcagttaactgcttttctct

SEQ ID NO: 25037 - DNA, 30 bp, Homo sapiens
acttccttgaacagcaatatttctggattt

SEQ ID NO: 25038 - DNA, 30 bp, Homo sapiens
tactggtactggtgggaggggtaggtgctg

SEQ ID NO: 25039 - DNA, 30 bp, Homo sapiens
ccccggcagtgattgcagcaattgaaagtt

SEQ ID NO: 25040 - DNA, 30 bp, Homo sapiens
gtaaagagtagtactcattttatcgattaa

SEQ ID NO: 25041 - DNA, 30 bp, Homo sapiens
cctagggcctgccccgttcctgttctcttc

SEQ ID NO: 25042 - DNA, 30 bp, Homo sapiens
aggtatgaaaaaggactggggataaggggg

SEQ ID NO: 25043 - DNA, 30 bp, Homo sapiens
gaagttgctgatgacccatttactgatgat

SEQ ID NO: 25044 - DNA, 30 bp, Homo sapiens
ctgtggagtgtgtcctggaacttggtgctg

SEQ ID NO: 25045 - DNA, 30 bp, Homo sapiens
cactggggggtccggtttcttttctgcact

SEQ ID NO: 25046 - DNA, 30 bp, Homo sapiens
attcggagacggccatgccttcgtatttaa

SEQ ID NO: 25047 - DNA, 30 bp, Homo sapiens
tgcctcaatcataaggacactaattggaac

SEQ ID NO: 25048 - DNA, 30 bp, Homo sapiens
accctccacaaccatgtcctgatagttctt

SEQ ID NO: 25049 - DNA, 30 bp, Homo sapiens
aaatgggtctaattcgactggttgggactg

SEQ ID NO: 25050 - DNA, 30 bp, Homo sapiens
agtgtcccttacttgatcttagaaggtcaa

SEQ ID NO: 25051 - DNA, 30 bp, Homo sapiens
tatctgcaagcgcaagactctactgtcatg

SEQ ID NO: 25052 - DNA, 30 bp, Homo sapiens
cagcggcacccacatccctctactaccatc

SEQ ID NO: 25053 - DNA, 30 bp, Homo sapiens
gagcgtactaccatatttctatattttttc

SEQ ID NO: 25054 - DNA, 30 bp, Homo sapiens
acactggacattctggaggagtcctgatga

SEQ ID NO: 25055 - DNA, 30 bp, Homo sapiens
tagtggcatccacaagctcttacaaccata

SEQ ID NO: 25056 - DNA, 30 bp, Homo sapiens
tagtggcagccacaggcccggaccaccatg

SEQ ID NO: 25057 - DNA, 30 bp, Homo sapiens
cagtggcagccgcaggccttgaccaccatg

SEQ ID NO: 25058 - DNA, 30 bp, Homo sapiens; identical to SEQ ID NO: 25057

SEQ ID NO: 25059 - DNA, 30 bp, Homo sapiens
cgctggggacaaaggactggcttgatgcac

SEQ ID NO: 25060 - DNA, 30 bp, Homo sapiens
tcttggcaagcgtcttcttaattctcaatg

SEQ ID NO: 25061 - DNA, 30 bp, Homo sapiens
agagtttaatgtcctgggactctgacattt

SEQ ID NO: 25062 - DNA, 30 bp, Homo sapiens
tctttagacaccatggttgtagcagtgcct

SEQ ID NO: 25063 - DNA, 30 bp, Homo sapiens
aattggccctcagcccccttcaaactggac

SEQ ID NO: 25064 - DNA, 30 bp, Homo sapiens
gaaaggaatagagctggcttgactttctcc

SEQ ID NO: 25065 - DNA, 30 bp, Homo sapiens
aagtggttcaatggaagacaggagttgctg

SEQ ID NO: 25066 - DNA, 30 bp, Homo sapiens
tactggaggtgacttggagatgaggccagg

SEQ ID NO: 25067 - DNA, 30 bp, Homo sapiens
tgaagggaatgtttttgtggagattagggt

SEQ ID NO: 25068 - DNA, 30 bp, Homo sapiens
tcctggacctatggttctttccatccgtaa

SEQ ID NO: 25069 - DNA, 30 bp, Homo sapiens
aaatggaaagagccgctttttcacaatata

SEQ ID NO: 25070 - DNA, 30 bp, Homo sapiens
tattccatggggacaagttctgctagttct

SEQ ID NO: 25071 - DNA, 30 bp, Homo sapiens
aaaaggtgctggtggaggttgtcagacgcc

SEQ ID NO: 25072 - DNA, 30 bp, Homo sapiens
agtaggtgctggcagagggtgtgctcagtc

SEQ ID NO: 25073 - DNA, 30 bp, Homo sapiens
tgagccatggagatcccggtccagctgtct

SEQ ID NO: 25074 - DNA, 30 bp, Homo sapiens
gaatggtgggggcttcagggtgggagagat

SEQ ID NO: 25075 - DNA, 30 bp, Homo sapiens
ttgtgagaggtggtgtttcaaaagacacac

SEQ ID NO: 25076 - DNA, 30 bp, Homo sapiens
gtctggcgtatttgaaccacactctgcctc

SEQ ID NO: 25077 - DNA, 30 bp, Homo sapiens
cacaggggcttcctccaccctttgctggcc

SEQ ID NO: 25078 - DNA, 30 bp, Homo sapiens
agacggagctggagggtcctggccttctgg

SEQ ID NO: 25079 - DNA, 30 bp, Homo sapiens
ctctggcagcagcacgaagaaggcagcctt

SEQ ID NO: 25080 - DNA, 30 bp, Homo sapiens
cagggggttcctagagttttcttgttccca

SEQ ID NO: 25081 - DNA, 30 bp, Homo sapiens
caaaggcatggatgtgcgggagctcttctg

SEQ ID NO: 25082 - DNA, 30 bp, Homo sapiens
tttctgtcgctcacgtgcccactggtctgg

SEQ ID NO: 25083 - DNA, 30 bp, Homo sapiens
gtagtcagggcactgaggtcaaatttaact

SEQ ID NO: 25084 - DNA, 30 bp, Homo sapiens
ccaaggtcttaagcagcagcatctatgcag

SEQ ID NO: 25085 - DNA, 30 bp, Homo sapiens
gtttggggacagaggtaaatatccgcaatc

SEQ ID NO: 25086 - DNA, 30 bp, Homo sapiens
cacaggcgcaggcatagtgatggcacttgg

SEQ ID NO: 25087 - DNA, 30 bp, Homo sapiens
agctggttcgttgaagctggatctcggcca

SEQ ID NO: 25088 - DNA, 30 bp, Homo sapiens
aagaggcggacagtcccgtctgcccccgag

SEQ ID NO: 25089 - DNA, 30 bp, Homo sapiens
aaaagggcttgctgttttcatccaacacct

SEQ ID NO: 25090 - DNA, 30 bp, Homo sapiens
ctcgcggtcgggcttcatgctgaagggctc

SEQ ID NO: 25091 - DNA, 30 bp, Homo sapiens
cacttgcacagggcctccaacacctccaga

SEQ ID NO: 25092 - DNA, 30 bp, Homo sapiens
gatccgatgactgttcaacattcttctgaa

SEQ ID NO: 25093 - DNA, 30 bp, Homo sapiens
ctgaggagggcgggggtggttcctccgggc

SEQ ID NO: 25094 - DNA, 30 bp, Homo sapiens
ctgtggccctgggcactggcattcatatgg

SEQ ID NO: 25095 - DNA, 30 bp, Homo sapiens
tgttgggtcttctctgaagaggcctggagg

SEQ ID NO: 25096 - DNA, 30 bp, Homo sapiens
gcttggatcgcctcttggtcacccaggaac

SEQ ID NO: 25097 - DNA, 30 bp, Homo sapiens
tgtaggaagtcttctgctaacttgttgaat

SEQ ID NO: 25098 - DNA, 30 bp, Homo sapiens
agcaggaagttctggtgaggctgaagcact

SEQ ID NO: 25099 - DNA, 30 bp, Homo sapiens
tgacaaactgtagtccgtggatcagcatgt

SEQ ID NO: 25100 - DNA, 30 bp, Homo sapiens
cagatgagggtttgcagctgggttttgtgc

SEQ ID NO: 25101 - DNA, 30 bp, Homo sapiens
agctgggggactctccagcctggcatgcag

SEQ ID NO: 25102 - DNA, 30 bp, Homo sapiens
cactgggagacaggagagctgggtttccac

SEQ ID NO: 25103 - DNA, 30 bp, Homo sapiens
ctctggtagaagagtccactggatatcacc

SEQ ID NO: 25104 - DNA, 30 bp, Homo sapiens
gatgccacggtcagcacaacagcattctct

SEQ ID NO: 25105 - DNA, 30 bp, Homo sapiens
aaaaggtcctccaacacgtcaatgtctgca

SEQ ID NO: 25106 - DNA, 30 bp, Homo sapiens
ttcaagtccagcatcagggcattctctact

SEQ ID NO: 25107 - DNA, 30 bp, Homo sapiens
caaggggctgacttccccctccactgtctg

SEQ ID NO: 25108 - DNA, 30 bp, Homo sapiens
gtgtggccaggactcctgcagagttcatat

SEQ ID NO: 25109 - DNA, 30 bp, Homo sapiens
agctttgaagcctttcaatttctgtacaaa

SEQ ID NO: 25110 - DNA, 30 bp, Homo sapiens
atctgggcctcgacactgagccagtgatac

SEQ ID NO: 25111 - DNA, 30 bp, Homo sapiens
cagtggacaggaaacgcaccatatccccct

SEQ ID NO: 25112 - DNA, 30 bp, Homo sapiens
ttgctgcggcccttcctggagggcaacttc

SEQ ID NO: 25113 - DNA, 30 bp, Homo sapiens
agtcggcctcgtccccctgcaggaagcctc

SEQ ID NO: 25114 - DNA, 30 bp, Homo sapiens
tcctctgtccaggcatctggctgcacaacc

SEQ ID NO: 25115 - DNA, 30 bp, Homo sapiens
tagtggctgtgggggatctggggtatcagg

SEQ ID NO: 25116 - DNA, 30 bp, Homo sapiens
tactggcctgggaactctcctgttctttga

SEQ ID NO: 25117 - DNA, 30 bp, Homo sapiens
aatgctgttggttttgctccagtctgtcct

SEQ ID NO: 25118 - DNA, 30 bp, Homo sapiens
gtcaatgtcactgaggtcgctggtcggctc

SEQ ID NO: 25119 - DNA, 30 bp, Homo sapiens
agcctgagtctgaatcactggtgtctgaag

SEQ ID NO: 25120 - DNA, 30 bp, Homo sapiens
cattctgagtcactgctgtcagagctggac

SEQ ID NO: 25121 - DNA, 30 bp, Homo sapiens
cagcaacgagcacactctggggaggggtag

SEQ ID NO: 25122 - DNA, 30 bp, Homo sapiens
caatggtagctgccatggcttcccggcgtc

SEQ ID NO: 25123 - DNA, 30 bp, Homo sapiens
ggcaggacctgtttcggagtcttcgctgtc

SEQ ID NO: 25124 - DNA, 30 bp, Homo sapiens
cttccaccaggtccacactcagcaacatcc

SEQ ID NO: 25125 - DNA, 30 bp, Homo sapiens
tagaaaacaggttttccatcatccactggg

SEQ ID NO: 25126 - DNA, 30 bp, Homo sapiens
cagcggcgtcccctggttcctccatccttc

SEQ ID NO: 25127 - DNA, 30 bp, Homo sapiens
tcttggcagaggccgcaggctctggagact

SEQ ID NO: 25128 - DNA, 30 bp, Homo sapiens
caatggtacccaccattgcttctctcctcc

SEQ ID NO: 25129 - DNA, 30 bp, Homo sapiens
atcctacagaccaaaacttcctgactgggc

SEQ ID NO: 25130 - DNA, 30 bp, Homo sapiens
tcctcatcgccatcacagccatagtcgttg

SEQ ID NO: 25131 - DNA, 30 bp, Homo sapiens
gggagggttagggacactcgtggcagcctg

SEQ ID NO: 25132 - DNA, 30 bp, Homo sapiens
caaaggatacgtgtaaagccaggatgacct

SEQ ID NO: 25133 - DNA, 30 bp, Homo sapiens
aagcgaaggtggctccacagttggggcatc

SEQ ID NO: 25134 - DNA, 30 bp, Homo sapiens
cttgtccttggagcggtccaggctctcgag

SEQ ID NO: 25135 - DNA, 30 bp, Homo sapiens
gtctgggaggtaataaaagcagaccgacac

SEQ ID NO: 25136 - DNA, 30 bp, Homo sapiens
tagcagagtttggctgtcatctggtccgac

SEQ ID NO: 25137 - DNA, 30 bp, Homo sapiens
agctacagagtttgccggtctcatattcca

SEQ ID NO: 25138 - DNA, 30 bp, Homo sapiens
tgtttggcaatttggcattaaacgcctgca

SEQ ID NO: 25139 - DNA, 30 bp, Homo sapiens
tccagttcatttatccaagttgtttttaca

SEQ ID NO: 25140 - DNA, 30 bp, Homo sapiens
gtccatcctctgtttcatttttctttgcct

SEQ ID NO: 25141 - DNA, 30 bp, Homo sapiens
cttcaatgtactctattctccgttcaaggg

SEQ ID NO: 25142 - DNA, 30 bp, Homo sapiens
ccacggccacagctgtgcaggcctcgagga

SEQ ID NO: 25143 - DNA, 30 bp, Homo sapiens
gattttctcttctgaggggacacagctgcc

SEQ ID NO: 25144 - DNA, 30 bp, Homo sapiens
tgtagctgtgaaatgtaaagcttagatttg

SEQ ID NO: 25145 - DNA, 30 bp, Homo sapiens
gtccttttgaggtttgatgtctggttcttt

SEQ ID NO: 25146 - DNA, 30 bp, Homo sapiens
ttctggtttgggtttagtataaatccattt

SEQ ID NO: 25147 - DNA, 30 bp, Homo sapiens
cgctggtctcactgctctgctcgccttgca

SEQ ID NO: 25148 - DNA, 30 bp, Homo sapiens
tacaggtagctggaagtgacgaaggagtgg

SEQ ID NO: 25149 - DNA, 30 bp, Homo sapiens
cctgcttcacactacacccagtgaacgagg

SEQ ID NO: 25150 - DNA, 30 bp, Homo sapiens
cagaggggtcccgttggtggccaggagctt

SEQ ID NO: 25151 - DNA, 30 bp, Homo sapiens
tcgcggcgggcggtgggcgggcccatcttg

SEQ ID NO: 25152 - DNA, 30 bp, Homo sapiens
ttcgggataattccacatttggaaagccgc

SEQ ID NO: 25153 - DNA, 30 bp, Homo sapiens
agctggtggccaccttctggcccttaagcc

SEQ ID NO: 25154 - DNA, 30 bp, Homo sapiens
ataaggtgcaaccattgaaatctaacacat

SEQ ID NO: 25155 - DNA, 30 bp, Homo sapiens
gctgtacgtagcaaagactgccttcctgca

SEQ ID NO: 25156 - DNA, 30 bp, Homo sapiens
tctgaacccccttaaaaaaagcatttttct

SEQ ID NO: 25157 - DNA, 30 bp, Homo sapiens
catgagatggctaaccctggctttttctgt

SEQ ID NO: 25158 - DNA, 30 bp, Homo sapiens
caggggctgctgatctggtttctcctcctc

SEQ ID NO: 25159 - DNA, 30 bp, Homo sapiens
agcaggtggggcgctgtcggagagcacccc

SEQ ID NO: 25160 - DNA, 30 bp, Homo sapiens
ctcccagtcctcccactctacatcttccag

SEQ ID NO: 25161 - DNA, 30 bp, Homo sapiens
acctcagacaggagcagggaccctcctgag

SEQ ID NO: 25162 - DNA, 30 bp, Homo sapiens
gaagagttcctctggcggacgttcttgcct

SEQ ID NO: 25163 - DNA, 30 bp, Homo sapiens
atgaggaaaattttttgccaaaagcagaga

SEQ ID NO: 25164 - DNA, 30 bp, Homo sapiens
ccttgggtgtcaggctcaaaacccagctcc

SEQ ID NO: 25165 - DNA, 30 bp, Homo sapiens
tcttggtcagtgaacaccattttttcccaa

SEQ ID NO: 25166 - DNA, 30 bp, Homo sapiens
atcgatccgtatgtcctctgtgcctctcga

SEQ ID NO: 25167 - DNA, 30 bp, Homo sapiens
cagcggacgatagaaatggtctgatcggcc

SEQ ID NO: 25168 - DNA, 30 bp, Homo sapiens
acagttgagtcctggaagccagcaccagaa

SEQ ID NO: 25169 - DNA, 30 bp, Homo sapiens
ctgaggcccagcagcacaatcagcagctgg

SEQ ID NO: 25170 - DNA, 30 bp, Homo sapiens
gcccagctccccctcgtctccaatgtccac

SEQ ID NO: 25171 - DNA, 30 bp, Homo sapiens
tgtactctgaatcatactgctcttgatccc

SEQ ID NO: 25172 - DNA, 30 bp, Homo sapiens
tctattgaagtgccattattattgccaggg

SEQ ID NO: 25173 - DNA, 30 bp, Homo sapiens
tatgggttccttgaacatgaccctgaatgt

SEQ ID NO: 25174 - DNA, 30 bp, Homo sapiens
cattggattctgtgcatcaggatcgaggtc

SEQ ID NO: 25175 - DNA, 30 bp, Homo sapiens
ccacggaacctttggaagacgacaagtgga

SEQ ID NO: 25176 - DNA, 30 bp, Homo sapiens
tgctgggaagatgaatgcaaaacttacata

SEQ ID NO: 25177 - DNA, 30 bp, Homo sapiens
acttgggggtccggataagggtgtggtata

SEQ ID NO: 25178 - DNA, 30 bp, Homo sapiens
tttctgactctgaggaagggtcaggccaca

SEQ ID NO: 25179 - DNA, 30 bp, Homo sapiens
tgaaggacaggtccagaaagcggtgatgct

SEQ ID NO: 25180 - DNA, 30 bp, Homo sapiens
tgtagaagatgacctcggggatctggccgt

SEQ ID NO: 25181 - DNA, 30 bp, Homo sapiens
ctgtaccccagtgccattggtgctatctga

SEQ ID NO: 25182 - DNA, 30 bp, Homo sapiens
gcatagaaaatgagctcagggatctgccca

SEQ ID NO: 25183 - DNA, 30 bp, Homo sapiens
cagagggcagactttttgtagaggaagtcc

SEQ ID NO: 25184 - DNA, 30 bp, Homo sapiens
cacaggcaggcctgatgactgtagtctcct

SEQ ID NO: 25185 - DNA, 30 bp, Homo sapiens
ctcaggaggtatatttgcaaagcttctctc

SEQ ID NO: 25186 - DNA, 30 bp, Homo sapiens
tattggtgctgccggttgggggagcgtgag

SEQ ID NO: 25187 - DNA, 30 bp, Homo sapiens
tttccatttcttcttctttcttctttcttt

SEQ ID NO: 25188 - DNA, 30 bp, Homo sapiens
ttctggtccctgacttagatcacctctgtg

SEQ ID NO: 25189 - DNA, 30 bp, Homo sapiens
ccctctcatacaagcgcccatagagagccg

SEQ ID NO: 25190 - DNA, 30 bp, Homo sapiens
tcttggaagcctcatcaaaattctccacaa

SEQ ID NO: 25191 - DNA, 30 bp, Homo sapiens
caatgtcttctggttttggtgctttactgt

SEQ ID NO: 25192 - DNA, 30 bp, Homo sapiens
agaagttcctccttacagctgattcggctg

SEQ ID NO: 25193 - DNA, 30 bp, Homo sapiens
agctggagactgccatcacgtagttcttgg

SEQ ID NO: 25194 - DNA, 30 bp, Homo sapiens
gtgaggattaatccagtgattccggtcaca

SEQ ID NO: 25195 - DNA, 30 bp, Homo sapiens
ggtgcatagcaggcctgtaacacttaggat

SEQ ID NO: 25196 - DNA, 30 bp, Homo sapiens
actgtacatgatggtatataccttctctga

SEQ ID NO: 25197 - DNA, 30 bp, Homo sapiens
acatatggatgcatattctgttggtgcttc

SEQ ID NO: 25198 - DNA, 30 bp, Homo sapiens
ggtgccccttggctgggttgggtagggatt

SEQ ID NO: 25199 - DNA, 30 bp, Homo sapiens
tgtaagaatgttcttctccatcgcaattct

SEQ ID NO: 25200 - DNA, 30 bp, Homo sapiens
ctctggtgggtccccactctgtgaagtgtc

SEQ ID NO: 25201 - DNA, 30 bp, Homo sapiens
aattggagctcagcatgtaagaatgttctt

SEQ ID NO: 25202 - DNA, 30 bp, Homo sapiens
tccagtcaggttgacatcagcatgtaagaa

SEQ ID NO: 25203 - DNA, 30 bp, Homo sapiens
tgaagggggttccccatgtagtggccgttt

SEQ ID NO: 25204 - DNA, 30 bp, Homo sapiens
agctttctccaccctcttctgggccccagg

SEQ ID NO: 25205 - DNA, 30 bp, Homo sapiens
cgctggacaaatagtcagggccgtgggctc

SEQ ID NO: 25206 - DNA, 30 bp, Homo sapiens
ctgaagcatttcctcaccaggcttgaagag

SEQ ID NO: 25207 - DNA, 30 bp, Homo sapiens
tattggtatcggacgaagactcctctccac

SEQ ID NO: 25208 - DNA, 30 bp, Homo sapiens
gcttatggttctgattggttgttgcagaag

SEQ ID NO: 25209 - DNA, 30 bp, Homo sapiens
tagaggactcaccgggcaggtggctctcag

SEQ ID NO: 25210 - DNA, 30 bp, Homo sapiens
tcctgggcaggcctacagccacagcaagaa

SEQ ID NO: 25211 - DNA, 30 bp, Homo sapiens
cccaggacactggacatatgaatatgggag

SEQ ID NO: 25212 - DNA, 30 bp, Homo sapiens
cttcgggtgagccgtctctggatccagagt

SEQ ID NO: 25213 - DNA, 30 bp, Homo sapiens
tttcacccctggggaggaagggcgtggttg

SEQ ID NO: 25214 - DNA, 30 bp, Homo sapiens
caccagtccagggcggggtccgcgggctca

SEQ ID NO: 25215 - DNA, 30 bp, Homo sapiens
ttgtggagttagaggcagcctggatacctt

SEQ ID NO: 25216 - DNA, 30 bp, Homo sapiens
agaaggggaacgggggggttcagcttgggc

SEQ ID NO: 25217 - DNA, 30 bp, Homo sapiens
acgtagggccctaatcttgttagtatagtg

SEQ ID NO: 25218 - DNA, 30 bp, Homo sapiens
cccaggactagttaacttccctaccttcca

SEQ ID NO: 25219 - DNA, 30 bp, Homo sapiens
aggtggacttgggttttgtttctgcatctg

SEQ ID NO: 25220 - DNA, 30 bp, Homo sapiens
acttggcgaatgaagataccatcttcagga

SEQ ID NO: 25221 - DNA, 30 bp, Homo sapiens
cactccatttgtaggcaagttcctccactg

SEQ ID NO: 25222 - DNA, 30 bp, Homo sapiens
aagcggggcttgcgcttgcggccggtgtac

SEQ ID NO: 25223 - DNA, 30 bp, Homo sapiens
ccagagcagccacgacagccacagtgtgtg

SEQ ID NO: 25224 - DNA, 30 bp, Homo sapiens
tgatggactttcaatgtatttggagatgcc

SEQ ID NO: 25225 - DNA, 30 bp, Homo sapiens
tccacggtgatgggaacatcttccacatcg

SEQ ID NO: 25226 - DNA, 30 bp, Homo sapiens
tcagcttcagattcagattcttcttcagca

SEQ ID NO: 25227 - DNA, 30 bp, Homo sapiens
cttccgattcggattcttcttctgcatttt

SEQ ID NO: 25228 - DNA, 30 bp, Homo sapiens
tcatggatcaccgggaggtgcgagtagagt

SEQ ID NO: 25229 - DNA, 30 bp, Homo sapiens
cgttgtgaggagaggtcaagggtttgggat

SEQ ID NO: 25230 - DNA, 30 bp, Homo sapiens
gtgaggagattgagaaaaggaggcagatac

SEQ ID NO: 25231 - DNA, 30 bp, Homo sapiens
gcccttctcggctctccgttctgccttacc

SEQ ID NO: 25232 - DNA, 30 bp, Homo sapiens
ccctggaatttaaatccatgcttccctttg

SEQ ID NO: 25233 - DNA, 30 bp, Homo sapiens
actctcttcttccaggctgtaggtcttgac

SEQ ID NO: 25234 - DNA, 30 bp, Homo sapiens
ttttggaactgtaaataaagcagttgccta

SEQ ID NO: 25235 - DNA, 30 bp, Homo sapiens
tcgaggttaataggcatattttgggaaact

SEQ ID NO: 25236 - DNA, 30 bp, Homo sapiens
aggcccccaggcgtgcttttcaggtcggaa

SEQ ID NO: 25237 - DNA, 30 bp, Homo sapiens
aataggcatattttgggaaacttttcactt

SEQ ID NO: 25238 - DNA, 30 bp, Homo sapiens
ataggccctccatgatgcagtggtgacact

SEQ ID NO: 25239 - DNA, 30 bp, Homo sapiens
gctcaatcacctgtgcatctcttttggaga

SEQ ID NO: 25240 - DNA, 30 bp, Homo sapiens
atctggccagatgcttttggagaaattgtg

SEQ ID NO: 25241 - DNA, 30 bp, Homo sapiens
cagcgcatcccagcacctcctccaggagcc

SEQ ID NO: 25242 - DNA, 30 bp, Homo sapiens
gcacggccaggatggctgaggaggagcaca

SEQ ID NO: 25243 - DNA, 30 bp, Homo sapiens
gagtggaaagtaaaaatatcatttcgacat

SEQ ID NO: 25244 - DNA, 30 bp, Homo sapiens
agtagggctgagttcccctcttctctagtc

SEQ ID NO: 25245 - DNA, 30 bp, Homo sapiens
agctggggtcctccggattccatccacagc

SEQ ID NO: 25246 - DNA, 30 bp, Homo sapiens
attaggcaggctgtggctctggtggcttgg

SEQ ID NO: 25247 - DNA, 30 bp, Homo sapiens
cagtggctggtacattcctttgataacagc

SEQ ID NO: 25248 - DNA, 30 bp, Homo sapiens
ataacagctatggcatcagctaactgctga

SEQ ID NO: 25249 - DNA, 30 bp, Homo sapiens
ctgtggcaaagtcctctaggtcatcagtgg

SEQ ID NO: 25250 - DNA, 30 bp, Homo sapiens
gagatagtggagaactccttgagcaggact

SEQ ID NO: 25251 - DNA, 30 bp, Homo sapiens
gcatactttgcggaggacagtggctctaga

SEQ ID NO: 25252 - DNA, 30 bp, Homo sapiens
tcttggccctctccgtgatctccaggaagt

SEQ ID NO: 25253 - DNA, 30 bp, Homo sapiens
gaaagtctttctccagagtcataatgtctt

SEQ ID NO: 25254 - DNA, 30 bp, Homo sapiens
tcttccaaaaaatgcctgctttcctctttt

SEQ ID NO: 25255 - DNA, 30 bp, Homo sapiens
tcctttgaaggagctggtccagtaattgct

SEQ ID NO: 25256 - DNA, 30 bp, Homo sapiens
caggcttcgaaggccgcattcctgaaaccc

SEQ ID NO: 25257 - DNA, 30 bp, Homo sapiens
ctcttcctggggcggccgcgctccgcggct

SEQ ID NO: 25258 - DNA, 30 bp, Homo sapiens
ctgtgggagtgccccaggcaccacccaaag

SEQ ID NO: 25259 - DNA, 30 bp, Homo sapiens
tcggggaggatccagttcaggttgatgtcc

SEQ ID NO: 25260 - DNA, 30 bp, Homo sapiens
taacgggaattcttgttccactgacatatt

SEQ ID NO: 25261 - DNA, 30 bp, Homo sapiens
ggaaggtagaggctgccacctcctggcccg

SEQ ID NO: 25262 - DNA, 30 bp, Homo sapiens
cacatttctgagtccgcatacatcccgttg

SEQ ID NO: 25263 - DNA, 30 bp, Homo sapiens
gaagtagaacacgatccatacagtttttcc

SEQ ID NO: 25264 - DNA, 30 bp, Homo sapiens
ctgaggatagaccctgcagcaggggcaggg

SEQ ID NO: 25265 - DNA, 30 bp, Homo sapiens
gcctggacaacagagcaagactctgtctct

SEQ ID NO: 25266 - DNA, 30 bp, Homo sapiens
gttaggaccaccggaaccaggctgatgggc

SEQ ID NO: 25267 - DNA, 30 bp, Homo sapiens
gtctccgactcgtctgtctcttcagtggag

SEQ ID NO: 25268 - DNA, 30 bp, Homo sapiens
cagctcttcatccattgctgggtcgtgcat

SEQ ID NO: 25269 - DNA, 30 bp, Homo sapiens
tctctgggctcccaccggtaatggtagggc

SEQ ID NO: 25270 - DNA, 30 bp, Homo sapiens
accagggtcccgttcttgctgtcatagcga

SEQ ID NO: 25271 - DNA, 30 bp, Homo sapiens
aataagctctgcggcattcatatgaccccc

SEQ ID NO: 25272 - DNA, 30 bp, Homo sapiens
gaatgcgtctcttttggttgatcaatgcga

SEQ ID NO: 25273 - DNA, 30 bp, Homo sapiens
tagtcatcctctgagctctcagcagacctt

SEQ ID NO: 25274 - DNA, 30 bp, Homo sapiens
cactggatttaacaaacatcattttataat

SEQ ID NO: 25275 - DNA, 30 bp, Homo sapiens
tgaaggactttgaaagcagccacagcctgt

SEQ ID NO: 25276 - DNA, 30 bp, Homo sapiens
aaaaggttttgaatccatcacgtgggagag

SEQ ID NO: 25277 - DNA, 30 bp, Homo sapiens
agttgcttgtagcaatttccttccagctgg

SEQ ID NO: 25278 - DNA, 30 bp, Homo sapiens
ttggggtagaatggtgttgacattagcagg

SEQ ID NO: 25279 - DNA, 30 bp, Homo sapiens
gtagaatcaggcgttaatctagttacattt

SEQ ID NO: 25280 - DNA, 30 bp, Homo sapiens
ggtcagttccacgttgttggcacggtcaag

SEQ ID NO: 25281 - DNA, 30 bp, Homo sapiens
atgatccattgtccagaagaatctgaaagt

SEQ ID NO: 25282 - DNA, 30 bp, Homo sapiens
ccataacagtggtataaaacatgaaggtga

SEQ ID NO: 25283 - DNA, 30 bp, Homo sapiens
aatgcaatcaaacgctgttgcagcacactt

SEQ ID NO: 25284 - DNA, 30 bp, Homo sapiens
taaatcaggggttgcagactcagatagctt

SEQ ID NO: 25285 - DNA, 30 bp, Homo sapiens
cacaggatttctctaagtctgggctggtgt

SEQ ID NO: 25286 - DNA, 30 bp, Homo sapiens
cagggcccagggctgggactcagccactct

SEQ ID NO: 25287 - DNA, 30 bp, Homo sapiens
cctttttccggcttccctgccacagtggtg

SEQ ID NO: 25288 - DNA, 30 bp, Homo sapiens
tacggggaggccggctgactcagagtcacg

SEQ ID NO: 25289 - DNA, 30 bp, Homo sapiens
tttgcaaaaggccctcgccagctgtgtcca

SEQ ID NO: 25290 - DNA, 30 bp, Homo sapiens
tatctgactctgataccactttctttgctt

SEQ ID NO: 25291 - DNA, 30 bp, Homo sapiens
gagagagaggccgacttctttccaggttgc

SEQ ID NO: 25292 - DNA, 30 bp, Homo sapiens
cataggtgtgcatcatagtaatactcggca

SEQ ID NO: 25293 - DNA, 30 bp, Homo sapiens
cgcccgacacacagcgccagacttgaggtc

SEQ ID NO: 25294 - DNA, 30 bp, Homo sapiens
gccatcgcaatgcaaaaataaatatcaatc

SEQ ID NO: 25295 - DNA, 30 bp, Homo sapiens
tgcctggagtagtacttggcttgtggcaat

SEQ ID NO: 25296 - DNA, 30 bp, Homo sapiens
tcaaggtccttcatttctacatcctggggg

SEQ ID NO: 25297 - DNA, 30 bp, Homo sapiens
gggaggtatgagcgctgggccaaggtggca

SEQ ID NO: 25298 - DNA, 30 bp, Homo sapiens
ttcaggttcatgttgataataactggtctt

SEQ ID NO: 25299 - DNA, 30 bp, Homo sapiens
gcttggatgtcagagtgagtgttgatgata

SEQ ID NO: 25300 - DNA, 30 bp, Homo sapiens
ctccagtggtatctgccttaatatttccac

SEQ ID NO: 25301 - DNA, 30 bp, Homo sapiens
tcccatgactgcttagagtgcaattcttcc

SEQ ID NO: 25302 - DNA, 30 bp, Homo sapiens
caccggcctagaaagggcctgtgaacaaac

SEQ ID NO: 25303 - DNA, 30 bp, Homo sapiens
tgcaggtatagctgtagcactctttgctgg

SEQ ID NO: 25304 - DNA, 30 bp, Homo sapiens
ccaccttcagaattgggaagcttaatgtta

SEQ ID NO: 25305 - DNA, 30 bp, Homo sapiens
aagcggggaagagctcgggcgggctttctc

SEQ ID NO: 25306 - DNA, 30 bp, Homo sapiens
agcagtacctccctgtgtttacaacttatc

SEQ ID NO: 25307 - DNA, 30 bp, Homo sapiens
tcttggctctggatatatcttttcactttt

SEQ ID NO: 25308 - DNA, 30 bp, Homo sapiens
tccagggtagtaagctgattgactgaagag

SEQ ID NO: 25309 - DNA, 30 bp, Homo sapiens
tgatggggtaacacaatgggagccttttct

SEQ ID NO: 25310 - DNA, 30 bp, Homo sapiens
aggaggcggccacgctgccaccagcagcag

SEQ ID NO: 25311 - DNA, 30 bp, Homo sapiens
ttgtcactggctttcttaaacacagaaata

SEQ ID NO: 25312 - DNA, 30 bp, Homo sapiens
tacttgactcccacagttctttaagtagct

SEQ ID NO: 25313 - DNA, 30 bp, Homo sapiens
ctttggatccaggtttcagacttgcaaaca

SEQ ID NO: 25314 - DNA, 30 bp, Homo sapiens
ctctggagaagcagcttagaataattcagg

SEQ ID NO: 25315 - DNA, 30 bp, Homo sapiens
tcaagggtttcttgaggttgaattctcttg

SEQ ID NO: 25316 - DNA, 30 bp, Homo sapiens
gttgagaaacttgaggtttgtgttttcttt

SEQ ID NO: 25317 - DNA, 30 bp, Homo sapiens
ctgaggactagggtgtcgtagggtggggct

SEQ ID NO: 25318 - DNA, 30 bp, Homo sapiens
caccggagaaaataaatgcatacacacctg

SEQ ID NO: 25319 - DNA, 30 bp, Homo sapiens
aggtggccacagaaagttccataaacaagt

SEQ ID NO: 25320 - DNA, 30 bp, Homo sapiens
gtctggctgtcaccgacgccgaatgggctt

SEQ ID NO: 25321 - DNA, 30 bp, Homo sapiens
caggaatctccatcttgggtttctttttgt

SEQ ID NO: 25322 - DNA, 30 bp, Homo sapiens
ctgtggcatgtgtagctctgtgagaacatc

SEQ ID NO: 25323 - DNA, 30 bp, Homo sapiens
gctcccaaagtctttctcgaagcagccact

SEQ ID NO: 25324 - DNA, 30 bp, Homo sapiens
agtccttaccagctgtagcagccactgctt

SEQ ID NO: 25325 - DNA, 30 bp, Homo sapiens
agaaggtgaaggcatacaccacgcccacca

SEQ ID NO: 25326 - DNA, 30 bp, Homo sapiens
cctgcccgcctcggcctcccaaagtgccgg

SEQ ID NO: 25327 - DNA, 30 bp, Homo sapiens
tttcccagtctgtggtctgtctttggatca

SEQ ID NO: 25328 - DNA, 30 bp, Homo sapiens
aacagctgcttaaatcttggtgtagcacaa

SEQ ID NO: 25329 - DNA, 30 bp, Homo sapiens
ccatggcatcctcacagccttctgaggtag

SEQ ID NO: 25330 - DNA, 30 bp, Homo sapiens
agagccgcaggaggccgcgccagcaggtga

SEQ ID NO: 25331 - DNA, 30 bp, Homo sapiens
agcagggccagggctcaggctgtctcggag

SEQ ID NO: 25332 - DNA, 30 bp, Homo sapiens
accaggagcaggcgctgaagctttcaaagc

SEQ ID NO: 25333 - DNA, 30 bp, Homo sapiens
atgacaagaggagaaactctgggggtttat

SEQ ID NO: 25334 - DNA, 30 bp, Homo sapiens
tgtcggctaagagcattactcgatcttgca

SEQ ID NO: 25335 - DNA, 30 bp, Homo sapiens
caaacaccagtggcaaaatgttttggattc

SEQ ID NO: 25336 - DNA, 30 bp, Homo sapiens
aaatggaaaactaaaatcatcttttccagc

SEQ ID NO: 25337 - DNA, 30 bp, Homo sapiens
gtcaggacagcaggttttgtggggttggtc

SEQ ID NO: 25338 - DNA, 30 bp, Homo sapiens
atctggtttctgtatcttattaaatgttcc

SEQ ID NO: 25339 - DNA, 30 bp, Homo sapiens
tcctggctgactctcataagatgcctcttc

SEQ ID NO: 25340 - DNA, 30 bp, Homo sapiens
tacaggtgatggctctggctgtccagcagc

SEQ ID NO: 25341 - DNA, 30 bp, Homo sapiens
tctgggaggccgaggcgggaagatcacttg

SEQ ID NO: 25342 - DNA, 30 bp, Homo sapiens
atcaggaatacctgaaacgccctcctgagt

SEQ ID NO: 25343 - DNA, 30 bp, Homo sapiens
tctcttctggagttgtagaagccaaaagct

SEQ ID NO: 25344 - DNA, 30 bp, Homo sapiens
gcttgggcgacagagcaagattttgtctca

SEQ ID NO: 25345 - DNA, 30 bp, Homo sapiens
ccaaggatttgggttctagttgccagcttg

SEQ ID NO: 25346 - DNA, 30 bp, Homo sapiens
agaaaatgtttcctcgctcctgtaattcca

SEQ ID NO: 25347 - DNA, 30 bp, Homo sapiens
gcctggcccaaatcaactggtacttgtaaa

SEQ ID NO: 25348 - DNA, 30 bp, Homo sapiens
ctgtggcataaggtgacaatgttcgtgggg

SEQ ID NO: 25349 - DNA, 30 bp, Homo sapiens
atttggtcaccctttggacattttgcaact

SEQ ID NO: 25350 - DNA, 30 bp, Homo sapiens
tgccgggccagggcgccctgtcctgcgcct

SEQ ID NO: 25351 - DNA, 30 bp, Homo sapiens
gtttgggtggggaaagtaacccccagagga

SEQ ID NO: 25352 - DNA, 30 bp, Homo sapiens
tccaggtcgggtctccgcgaggcggccact

SEQ ID NO: 25353 - DNA, 30 bp, Homo sapiens
gtttttccccctggctttctgtctagtggc

SEQ ID NO: 25354 - DNA, 30 bp, Homo sapiens
acatggcaccttcatcttctttattgagaa

SEQ ID NO: 25355 - DNA, 30 bp, Homo sapiens
tagaagctgggctcgctaggaaactgctcc

SEQ ID NO: 25356 - DNA, 30 bp, Homo sapiens
gtcaggtgcagtatttagagtgttattttg

SEQ ID NO: 25357 - DNA, 30 bp, Homo sapiens
cacaggctgtaccgggctggctgttgcaaa

SEQ ID NO: 25358 - DNA, 30 bp, Homo sapiens
tcttgggaaaactttggtctccagcatttg

SEQ ID NO: 25359 - DNA, 30 bp, Homo sapiens
cagaggatcctgtgggtagagacaggaatg

SEQ ID NO: 25360 - DNA, 30 bp, Homo sapiens
aactgaatggctgctaactaaatatttttg

SEQ ID NO: 25361 - DNA, 30 bp, Homo sapiens
gcctggtaaacaaactttgccagcaaatag

SEQ ID NO: 25362 - DNA, 30 bp, Homo sapiens
cactggtccggccttcacgcttccagaaag

SEQ ID NO: 25363 - DNA, 30 bp, Homo sapiens
tttcgggagacagaagccatgtggccctcc

SEQ ID NO: 25364 - DNA, 30 bp, Homo sapiens
ttgcagagggagtctgagggccagctccgt

SEQ ID NO: 25365 - DNA, 30 bp, Homo sapiens
taggggagttccgctgttctcaggtggcta

SEQ ID NO: 25366 - DNA, 30 bp, Homo sapiens
cagaggaggcatcagggcctccctggctgc

SEQ ID NO: 25367 - DNA, 30 bp, Homo sapiens
ttatgggttggtgagtctgtaatgacatcg

SEQ ID NO: 25368 - DNA, 30 bp, Homo sapiens
caggcttctgggtcgatttctccatcatct

SEQ ID NO: 25369 - DNA, 30 bp, Homo sapiens
tagagggccatgctgggtattccggtgaac

SEQ ID NO: 25370 - DNA, 30 bp, Homo sapiens
cccaggcatggggatccatttacaccgccc

SEQ ID NO: 25371 - DNA, 30 bp, Homo sapiens
ctgaggagagagcggggggacaagtggagc

SEQ ID NO: 25372 - DNA, 30 bp, Homo sapiens
aggaggctgaggcataagaatcacttgaac

SEQ ID NO: 25373 - DNA, 30 bp, Homo sapiens
cgactgaaaacacgaaagccttttcatcag

SEQ ID NO: 25374 - DNA, 30 bp, Homo sapiens
cagcggctgcttggtggtggcggtgtggat

SEQ ID NO: 25375 - DNA, 30 bp, Homo sapiens
ctttgggagcctgaggtgggcggatctctt

SEQ ID NO: 25376 - DNA, 30 bp, Homo sapiens
ggcctctccagggccccagagcgggttctc

SEQ ID NO: 25377 - DNA, 30 bp, Homo sapiens
caagttctcgctctgtaggcagctggagtc

SEQ ID NO: 25378 - DNA, 30 bp, Homo sapiens
ttctggaagtttatgtgggtgcagaactgg

SEQ ID NO: 25379 - DNA, 30 bp, Homo sapiens
acatggaactttctttgtccttggctcctt

SEQ ID NO: 25380 - DNA, 30 bp, Homo sapiens
cactggcgaatggccatgatgaccctcggg

SEQ ID NO: 25381 - DNA, 30 bp, Homo sapiens
aggaggccgaggggcagcagacgcgctgca

SEQ ID NO: 25382 - DNA, 30 bp, Homo sapiens
ctcggggggcttcctgccgactcgggactc

SEQ ID NO: 25383 - DNA, 30 bp, Homo sapiens
ttctggaaccagcagtgttcccaggtgggt

SEQ ID NO: 25384 - DNA, 30 bp, Homo sapiens
catcgggccgttttttcgttctggcgggcg

SEQ ID NO: 25385 - DNA, 30 bp, Homo sapiens
tagaaagttagttccatgaggacaagagct

SEQ ID NO: 25386 - DNA, 30 bp, Homo sapiens
tttattgaagcatctgaagatggagcattc

SEQ ID NO: 25387 - DNA, 30 bp, Homo sapiens
cattttgggagagaagatatctcgtggtat

SEQ ID NO: 25388 - DNA, 30 bp, Homo sapiens
actcaccccgtgtcctgagctcaccggttc

SEQ ID NO: 25389 - DNA, 30 bp, Homo sapiens
aaaagggatggtggatccagttccagtgag

SEQ ID NO: 25390 - DNA, 30 bp, Homo sapiens
cgacccagctctgtagatacatagatgcca

SEQ ID NO: 25391 - DNA, 30 bp, Homo sapiens
agcaggagaggagaggaggatcagcagagg

SEQ ID NO: 25392 - DNA, 30 bp, Homo sapiens
cgaagttgagtttcttagctggaggagttt

SEQ ID NO: 25393 - DNA, 30 bp, Homo sapiens
cagcggcccccgccttacccagatccgggt

SEQ ID NO: 25394 - DNA, 30 bp, Homo sapiens
aacaggttttcaaagaagagggcatgcagc

SEQ ID NO: 25395 - DNA, 30 bp, Homo sapiens
tccaggtcatcttggggaagggctgagatg

SEQ ID NO: 25396 - DNA, 30 bp, Homo sapiens
tactggtcccacagaagaagtcttcaggaa

SEQ ID NO: 25397 - DNA, 30 bp, Homo sapiens
atctgcccttccctttttcgattaaacctt

SEQ ID NO: 25398 - DNA, 30 bp, Homo sapiens
catgtcattgtttcccatcgctcccaaaaa

SEQ ID NO: 25399 - DNA, 30 bp, Homo sapiens
actgcccttggggaagcacctgaccgctgg

SEQ ID NO: 25400 - DNA, 30 bp, Homo sapiens
ctctggagtttctggggcttcctttatcct

SEQ ID NO: 25401 - DNA, 30 bp, Homo sapiens
acacaggatgaatcctgttcctgtcacagt

SEQ ID NO: 25402 - DNA, 30 bp, Homo sapiens
ttttggcttcaggcatttcttcatgttcca

SEQ ID NO: 25403 - DNA, 30 bp, Homo sapiens
cagtggaagtgttcctgggggaaggggcag

SEQ ID NO: 25404 - DNA, 30 bp, Homo sapiens
tggtggataacagtgatctctgcagctttc

SEQ ID NO: 25405 - DNA, 30 bp, Homo sapiens
cccaggtggctggcctcccttcttttgcca

SEQ ID NO: 25406 - DNA, 30 bp, Homo sapiens
atgttttagagcggcaatccccagtcgtct

SEQ ID NO: 25407 - DNA, 30 bp, Homo sapiens
acaacacaggacgaagtatcctgtgaagag

SEQ ID NO: 25408 - DNA, 30 bp, Homo sapiens
agtgtgtccgcagccccggagtccctcggt

SEQ ID NO: 25409 - DNA, 30 bp, Homo sapiens
gagtaggagctaagtcagagtgtagaagct

SEQ ID NO: 25410 - DNA, 30 bp, Homo sapiens
cagagggaagtgggtgacctctccgaagac

SEQ ID NO: 25411 - DNA, 30 bp, Homo sapiens
acatggctgctgctttgcgtcctctgacct

SEQ ID NO: 25412 - DNA, 30 bp, Homo sapiens
tgctctatttccctcccactttcagcattc

SEQ ID NO: 25413 - DNA, 30 bp, Homo sapiens
ttgaggagcaagtagatactgactgtccag

SEQ ID NO: 25414 - DNA, 30 bp, Homo sapiens
ttcagagaagataagaaatttctgaagtcc

SEQ ID NO: 25415 - DNA, 30 bp, Homo sapiens
atcctcatccaaggtaaggtcaacaacttc

SEQ ID NO: 25416 - DNA, 30 bp, Homo sapiens
tgttggtaatccattcatgtctgcaccctt

SEQ ID NO: 25417 - DNA, 30 bp, Homo sapiens
cacattttcggtgaccgttctccattcgta

SEQ ID NO: 25418 - DNA, 30 bp, Homo sapiens
gattggccatagtgcacagtatcggaatga

SEQ ID NO: 25419 - DNA, 30 bp, Homo sapiens
cagtgcaggtcgttagtcacacggagctta

SEQ ID NO: 25420 - DNA, 30 bp, Homo sapiens
tagagcttggtctccaaaaatctgtttgaa

SEQ ID NO: 25421 - DNA, 30 bp, Homo sapiens
catcatactggatctcggcccgcagctcct

SEQ ID NO: 25422 - DNA, 30 bp, Homo sapiens
gcaaggcctgctccatcggacacaaaactg

SEQ ID NO: 25423 - DNA, 30 bp, Homo sapiens
acgcggcgcgctcggcgatcagacgcggct

SEQ ID NO: 25424 - DNA, 30 bp, Homo sapiens
ttccattatgtgacgcattctttgttttgt

SEQ ID NO: 25425 - DNA, 30 bp, Homo sapiens
ctcaaacaccgtctcctcgtcgctgtccag

SEQ ID NO: 25426 - DNA, 30 bp, Homo sapiens
ctgaggaggcagcctcggctgccggtaatg

SEQ ID NO: 25427 - DNA, 30 bp, Homo sapiens
ccgaatcgctggagctgctgctggagtcgg

SEQ ID NO: 25428 - DNA, 30 bp, Homo sapiens
cagtggggagcctccttcttcttgcccttc

SEQ ID NO: 25429 - DNA, 30 bp, Homo sapiens
cactggcaggcccggaaagtgctgaattcg

SEQ ID NO: 25430 - DNA, 30 bp, Homo sapiens
tcacctcctccagggcatcctccatggtca

SEQ ID NO: 25431 - DNA, 30 bp, Homo sapiens
agaaggtcctgcggcccagtcttttgaaca

SEQ ID NO: 25432 - DNA, 30 bp, Homo sapiens
accaggagcagctcccccaggattctggcc

SEQ ID NO: 25433 - DNA, 30 bp, Homo sapiens
ggaaggtgtcttggaggaggtggcggcagc

SEQ ID NO: 25434 - DNA, 30 bp, Homo sapiens
taatggctgcagtcctgtggtgtgaggagc

SEQ ID NO: 25435 - DNA, 30 bp, Homo sapiens
agtgtgccttgtggcccttcctctgacacg

SEQ ID NO: 25436 - DNA, 30 bp, Homo sapiens
ctcaggccagtgattccacttctccaggcc

SEQ ID NO: 25437 - DNA, 30 bp, Homo sapiens
actccctccagggtgggtcccctcgaggga

SEQ ID NO: 25438 - DNA, 30 bp, Homo sapiens
ccctgggcccgccctcctcgtcctccacct

SEQ ID NO: 25439 - DNA, 30 bp, Homo sapiens
cgctgcccaccccgcaggcccggctgcgct

SEQ ID NO: 25440 - DNA, 30 bp, Homo sapiens
acttggtgcgcgccttcacatactcccagc

SEQ ID NO: 25441 - DNA, 30 bp, Homo sapiens
tatcggggagtgggtgtgagggaaggcggg

SEQ ID NO: 25442 - DNA, 30 bp, Homo sapiens
ccgagggcggagggcggaggcagggaccca

SEQ ID NO: 25443 - DNA, 30 bp, Homo sapiens
cgttcggctccgcccccagggcctcgagca

SEQ ID NO: 25444 - DNA, 30 bp, Homo sapiens
actctgtctcccagtcctcagcagccagtg

SEQ ID NO: 25445 - DNA, 30 bp, Homo sapiens
cagagggcattttttacaaatcttgaagct

SEQ ID NO: 25446 - DNA, 30 bp, Homo sapiens
ggtaggttgatatctgtataaataaccata

SEQ ID NO: 25447 - DNA, 30 bp, Homo sapiens
atttggaggtaagaaaaccaatgcatcatt

SEQ ID NO: 25448 - DNA, 30 bp, Homo sapiens
tcattttctgaaccaactggaggcaagaaa

SEQ ID NO: 25449 - DNA, 30 bp, Homo sapiens
aagcggtcgaggattcagcgaaactgtggc

SEQ ID NO: 25450 - DNA, 30 bp, Homo sapiens
ctctggcagtgaattaagcggtcgaggatt

SEQ ID NO: 25451 - DNA, 30 bp, Homo sapiens
actgcctcgttgtcttgcctattggttcct

SEQ ID NO: 25452 - DNA, 30 bp, Homo sapiens
acctggctgatgatctctcctttttcaggt

SEQ ID NO: 25453 - DNA, 30 bp, Homo sapiens
tcttccaggaagaaggaaacattcaatagg

SEQ ID NO: 25454 - DNA, 30 bp, Homo sapiens
ctgtggtacccgtggtctccagatacgcat

SEQ ID NO: 25455 - DNA, 30 bp, Homo sapiens
tttcttggagcgcctccatttccattgaaa

SEQ ID NO: 25456 - DNA, 30 bp, Homo sapiens
aaaccatgtccagcagttccattaactgct

SEQ ID NO: 25457 - DNA, 30 bp, Homo sapiens
tgaaaagagcctggagaaggtctgaaactt

SEQ ID NO: 25458 - DNA, 30 bp, Homo sapiens
agcgcacgaaggataccacgctggtggcta

SEQ ID NO: 25459 - DNA, 30 bp, Homo sapiens
acagtcccagcttcttcagggcctcccttc

SEQ ID NO: 25460 - DNA, 30 bp, Homo sapiens
tccaggctgagagccaagtaccagccactg

SEQ ID NO: 25461 - DNA, 30 bp, Homo sapiens
tgaaggtgttttgtggggctaaaagccccc

SEQ ID NO: 25462 - DNA, 30 bp, Homo sapiens
aactggtgggtgacctcatagattcccaca

SEQ ID NO: 25463 - DNA, 30 bp, Homo sapiens
gtgagggcctctcagaaagcccctccacac

SEQ ID NO: 25464 - DNA, 30 bp, Homo sapiens
ctctggaagaatttattttcttgatatcaa

SEQ ID NO: 25465 - DNA, 30 bp, Homo sapiens
tgctaccctccacaggaacctgagctccac

SEQ ID NO: 25466 - DNA, 30 bp, Homo sapiens
gcgttacattatttagttcatatatatatt

SEQ ID NO: 25467 - DNA, 30 bp, Homo sapiens
aagagaccaacagaatccaatggtttccta

SEQ ID NO: 25468 - DNA, 30 bp, Homo sapiens
aacaggactttgctcaatgatgtaagcttt

SEQ ID NO: 25469 - DNA, 30 bp, Homo sapiens
gtgtgggagaggatgcaggcgatggggagg

SEQ ID NO: 25470 - DNA, 30 bp, Homo sapiens
cagacattgctgatacgggcctcccccggg

SEQ ID NO: 25471 - DNA, 30 bp, Homo sapiens
gaatggttctcagccaagtgattgctcttt

SEQ ID NO: 25472 - DNA, 30 bp, Homo sapiens
agctgggccccatgctctgccccaagcccc

SEQ ID NO: 25473 - DNA, 30 bp, Homo sapiens
catttctgcatcatcgtcgtcgtcatcatc

SEQ ID NO: 25474 - DNA, 30 bp, Homo sapiens
aaatggttgacaggtatgaaaatacttttt

SEQ ID NO: 25475 - DNA, 30 bp, Homo sapiens
gatcatattccgctggctcagacagagcag

SEQ ID NO: 25476 - DNA, 30 bp, Homo sapiens
tgatttagttcctgctggtactgctgatgc

SEQ ID NO: 25477 - DNA, 30 bp, Homo sapiens
aggtggagaagaagccaccatctttctttc

SEQ ID NO: 25478 - DNA, 30 bp, Homo sapiens
ttttatgattggaagctggtagaaccactg

SEQ ID NO: 25479 - DNA, 30 bp, Homo sapiens
gaactttgaagagtactggttagtgttttg

SEQ ID NO: 25480 - DNA, 30 bp, Homo sapiens
aatcaaatcccgtcttcaagacgacattac

SEQ ID NO: 25481 - DNA, 30 bp, Homo sapiens
cttccgaacagtaatcccgacccttttcaa

SEQ ID NO: 25482 - DNA, 30 bp, Homo sapiens
tagaggatttaggagaagagtagcgtaggc

SEQ ID NO: 25483 - DNA, 30 bp, Homo sapiens
ggcctggtcctggggcctggatggtgctgc

SEQ ID NO: 25484 - DNA, 30 bp, Homo sapiens
caaaggacagcaggtctgggtgagggccct

SEQ ID NO: 25485 - DNA, 30 bp, Homo sapiens
attctacatcctcctcgaagtgtgtgaggt

SEQ ID NO: 25486 - DNA, 30 bp, Homo sapiens
ctccggaaagtttgcggcggctgccccggg

SEQ ID NO: 25487 - DNA, 30 bp, Homo sapiens
gcaaggactgcaactgtaaatgctgcaatc

SEQ ID NO: 25488 - DNA, 30 bp, Homo sapiens
ggcctcagagcctctgtcatgccacctgcg

SEQ ID NO: 25489 - DNA, 30 bp, Homo sapiens
tcccatagcgggctgtttcatagccatcca

SEQ ID NO: 25490 - DNA, 30 bp, Homo sapiens
cagagtactctccaatgtgttatagttatc

SEQ ID NO: 25491 - DNA, 30 bp, Homo sapiens
cagtggccagctcactcagggcctcctgat

SEQ ID NO: 25492 - DNA, 30 bp, Homo sapiens
ccctggaagttgggttcagtgcacggaggc

SEQ ID NO: 25493 - DNA, 30 bp, Homo sapiens
tcctggctctactttgcgctttttagaagt

SEQ ID NO: 25494 - DNA, 30 bp, Homo sapiens
cattcacctctttgcaagtgggcaatctgt

SEQ ID NO: 25495 - DNA, 30 bp, Homo sapiens
tcctcttgccagactcccatccaaagagtc

SEQ ID NO: 25496 - DNA, 30 bp, Homo sapiens
acatgaaatacatccccacctgaacaaagg

SEQ ID NO: 25497 - DNA, 30 bp, Homo sapiens
cctctggtttctgtctattggttgcatctc

SEQ ID NO: 25498 - DNA, 30 bp, Homo sapiens
aactgggaaggcttatcagagggaatccag

SEQ ID NO: 25499 - DNA, 30 bp, Homo sapiens
cagagggaatccagcccaaccagatgaagt

SEQ ID NO: 25500 - DNA, 30 bp, Homo sapiens
ctttcagtcaactgggaaggcttatcagag

SEQ ID NO: 25501 - DNA, 30 bp, Homo sapiens
tcatggtcacagcatgcaggacctcgggac

SEQ ID NO: 25502 - DNA, 30 bp, Homo sapiens
cagagggccacagccggcagtgtgactatc

SEQ ID NO: 25503 - DNA, 30 bp, Homo sapiens
agtaccgcagtgctggctccaagagcatat

SEQ ID NO: 25504 - DNA, 30 bp, Homo sapiens
ccactggaagaaaaataggggctgtgcatc

SEQ ID NO: 25505 - DNA, 30 bp, Homo sapiens
agatgggaagatgaggaagccgctgaagac

SEQ ID NO: 25506 - DNA, 30 bp, Homo sapiens
tatctggaaagagcaggaacccggaaaaga

SEQ ID NO: 25507 - DNA, 30 bp, Homo sapiens
tactggctcttgacaaaactcttgaggtct

SEQ ID NO: 25508 - DNA, 30 bp, Homo sapiens
tagtcggggaagagcaggaagccggagaag

SEQ ID NO: 25509 - DNA, 30 bp, Homo sapiens
agtcggagtagatgatgaagccagagaacg

SEQ ID NO: 25510 - DNA, 30 bp, Homo sapiens
atccgggtacagaagaaagcccgagaacgt

SEQ ID NO: 25511 - DNA, 30 bp, Homo sapiens
tgctgccgcttgaggccggcgtagaaggcg

SEQ ID NO: 25512 - DNA, 30 bp, Homo sapiens
cagtcggggtagatgatgaagccggagaag

SEQ ID NO: 25513 - DNA, 30 bp, Homo sapiens
agggctcggtggcgtgcttgaccaggtagc

SEQ ID NO: 25514 - DNA, 30 bp, Homo sapiens
cgtgcccaggagcagcccggagaagctgga

SEQ ID NO: 25515 - DNA, 30 bp, Homo sapiens
cgttggggtcatcctggtcggcatagatta

SEQ ID NO: 25516 - DNA, 30 bp, Homo sapiens
caaaggtggagaagcgttggtggtccccat

SEQ ID NO: 25517 - DNA, 30 bp, Homo sapiens
ccgaggccccgaggcccggcggggcggcgg

SEQ ID NO: 25518 - DNA, 30 bp, Homo sapiens
gactggggagctgtgccagtcggagtacac

SEQ ID NO: 25519 - DNA, 30 bp, Homo sapiens
ggctgggcacaagcttccaggtcagctgcc

SEQ ID NO: 25520 - DNA, 30 bp, Homo sapiens
gtcgtcctcggccttgatgaggtggccgct

SEQ ID NO: 25521 - DNA, 30 bp, Homo sapiens
acccggagaataagctgtctgcccaacctg

SEQ ID NO: 25522 - DNA, 30 bp, Homo sapiens
acagctcggcggccggcttgaccaggtggc

SEQ ID NO: 25523 - DNA, 30 bp, Homo sapiens
cacgggctgctgaacagaaggaaccctgtg

SEQ ID NO: 25524 - DNA, 30 bp, Homo sapiens
cactggctgctgaacagaaggaaccctgtg

SEQ ID NO: 25525 - DNA, 30 bp, Homo sapiens
cctccatctctttcttgatccagtccacgt

SEQ ID NO: 25526 - DNA, 30 bp, Homo sapiens
ctctggttcttcctgagagaaacactgtcc

SEQ ID NO: 25527 - DNA, 30 bp, Homo sapiens
atcactcccttgatccagtccacatagctg

SEQ ID NO: 25528 - DNA, 30 bp, Homo sapiens
aaggcttgaagataccagggtcatggctgg

SEQ ID NO: 25529 - DNA, 30 bp, Homo sapiens
tcacggggggtgctattttcctgcatagtc

SEQ ID NO: 25530 - DNA, 30 bp, Homo sapiens
tggcatgagtataatctgagaagacttctt

SEQ ID NO: 25531 - DNA, 30 bp, Homo sapiens
tagaggggtaaaaaattcaggacatccccc

SEQ ID NO: 25532 - DNA, 30 bp, Homo sapiens
ccaaggatggaggcagaaagccaggccaag

SEQ ID NO: 25533 - DNA, 30 bp, Homo sapiens
ctgcgggcgagggcagcggcaccgtttgcg

SEQ ID NO: 25534 - DNA, 30 bp, Homo sapiens
gggaaccagaccatcttccaaaatcttatc

SEQ ID NO: 25535 - DNA, 30 bp, Homo sapiens
gggcttcagctcaaagaggtcatgatactc

SEQ ID NO: 25536 - DNA, 30 bp, Homo sapiens
ataaggaaaagaatggaattccaaagaact

SEQ ID NO: 25537 - DNA, 30 bp, Homo sapiens
tacaggtctttcattacattctgctgcaag

SEQ ID NO: 25538 - DNA, 30 bp, Homo sapiens
tgtttcttcgttttctcaatgactgctgtg

SEQ ID NO: 25539 - DNA, 30 bp, Homo sapiens
ccacgggcaagtaggttttggaaacatggc

SEQ ID NO: 25540 - DNA, 30 bp, Homo sapiens
taagggagagagcttcgtctgctgtcttcc

SEQ ID NO: 25541 - DNA, 30 bp, Homo sapiens
tgaattggagagaaactgctgcttgctaat

SEQ ID NO: 25542 - DNA, 30 bp, Homo sapiens
taggagtccctggaggccggggcgcgcagc

SEQ ID NO: 25543 - DNA, 30 bp, Homo sapiens
gtcataatggatggcagtgtaaaagatgat

SEQ ID NO: 25544 - DNA, 30 bp, Homo sapiens
taatggatggcagtgtaaaagatgatccaa

SEQ ID NO: 25545 - DNA, 30 bp, Homo sapiens
cagaaaacactgatgcccaacacactgatt

SEQ ID NO: 25546 - DNA, 30 bp, Homo sapiens
tcaaagccgtgccagtcgctgtgctctgag

SEQ ID NO: 25547 - DNA, 30 bp, Homo sapiens
tgatggggtttctccttgttgccttccgag

SEQ ID NO: 25548 - DNA, 30 bp, Homo sapiens
gcttgggccagcacagctctcgtgcaaaag

SEQ ID NO: 25549 - DNA, 30 bp, Homo sapiens
agaagggtagtggctcttccacaggaatgt

SEQ ID NO: 25550 - DNA, 30 bp, Homo sapiens
tagtagttttcccatctccgtactttgcta

SEQ ID NO: 25551 - DNA, 30 bp, Homo sapiens
actcggcgtgctcctgcacctcttccccac

SEQ ID NO: 25552 - DNA, 30 bp, Homo sapiens
agttccagcaccttcctcaccatggctccg

SEQ ID NO: 25553 - DNA, 30 bp, Homo sapiens
ccatgggctcctccctctgggcgctcatcc

SEQ ID NO: 25554 - DNA, 30 bp, Homo sapiens
tgatgttcacccacgcaagtgcggctctcg

SEQ ID NO: 25555 - DNA, 30 bp, Homo sapiens
gggtgggccaggcgtccacaggctgggggc

SEQ ID NO: 25556 - DNA, 30 bp, Homo sapiens
gtccacaggctgggggcgggctggaggaca

SEQ ID NO: 25557 - DNA, 30 bp, Homo sapiens
tcttggcgataattttggttttttcattct

SEQ ID NO: 25558 - DNA, 30 bp, Homo sapiens
gtgtgggcgccagcactgcagaaagcccat

SEQ ID NO: 25559 - DNA, 30 bp, Homo sapiens
tcttggtctccactttatgtctttcactcc

SEQ ID NO: 25560 - DNA, 30 bp, Homo sapiens
atacggtggcaaccccatggggtaaacaat

SEQ ID NO: 25561 - DNA, 30 bp, Homo sapiens
gcttggcattgggaaggttctaaagtaaga

SEQ ID NO: 25562 - DNA, 30 bp, Homo sapiens
tgctgtaatgtggatgctgggtctggacat

SEQ ID NO: 25563 - DNA, 30 bp, Homo sapiens
ggtaggtgcgacttcattcctgttcgccct

SEQ ID NO: 25564 - DNA, 30 bp, Homo sapiens
atcagggccctttctgggccttgaagtggg

SEQ ID NO: 25565 - DNA, 30 bp, Homo sapiens
aagtggtggcaagacccttcctaagttcct

SEQ ID NO: 25566 - DNA, 30 bp, Homo sapiens
actcggagaagatgttgctaatgtaaggtg

SEQ ID NO: 25567 - DNA, 30 bp, Homo sapiens
tcgctccaggtcttgacatggtccaaagac

SEQ ID NO: 25568 - DNA, 30 bp, Homo sapiens
cttgagtacaggctcctcgtggacacctgg

SEQ ID NO: 25569 - DNA, 30 bp, Homo sapiens
tggggagggcacagtgatgctcggggtgct

SEQ ID NO: 25570 - DNA, 30 bp, Homo sapiens
tacaggtgtgagccaccacacttagcacct

SEQ ID NO: 25571 - DNA, 30 bp, Homo sapiens
cctgtggcagagggagatgccagtctggag

SEQ ID NO: 25572 - DNA, 30 bp, Homo sapiens
agccggagaagtcctagaacctggctgctg

SEQ ID NO: 25573 - DNA, 30 bp, Homo sapiens
ctccggtttccccaccatagtgcctggatc

SEQ ID NO: 25574 - DNA, 30 bp, Homo sapiens
gtgcagggctccacgggggcaccgttcatg

SEQ ID NO: 25575 - DNA, 30 bp, Homo sapiens
agctgggggctggggttaccattggccttg

SEQ ID NO: 25576 - DNA, 30 bp, Homo sapiens
attaaggagctgacttgcaacaccaggtta

SEQ ID NO: 25577 - DNA, 30 bp, Homo sapiens
ttctgggagtactgagaagaaaatatccgt

SEQ ID NO: 25578 - DNA, 30 bp, Homo sapiens
gagcagcaggagggcgcccagggacagctc

SEQ ID NO: 25579 - DNA, 30 bp, Homo sapiens
tacaggaaggggagcagggaggtcaggggc

SEQ ID NO: 25580 - DNA, 30 bp, Homo sapiens
tacaggctgagatgggtgggcgccagggat

SEQ ID NO: 25581 - DNA, 30 bp, Homo sapiens
gttgtaacttcgccttcagtacatgatgac

SEQ ID NO: 25582 - DNA, 30 bp, Homo sapiens
gaaaccattcgacgacttgtaaactttcca

SEQ ID NO: 25583 - DNA, 30 bp, Homo sapiens
ttcaggatgattacttttcgtgttttcaga

SEQ ID NO: 25584 - DNA, 30 bp, Homo sapiens
ttctccctttcagctaagtttagattgttg

SEQ ID NO: 25585 - DNA, 30 bp, Homo sapiens
ctgtcatttctagtccatcactttctttga

SEQ ID NO: 25586 - DNA, 30 bp, Homo sapiens
cgagtagcttcaggcctccacacttgccct

SEQ ID NO: 25587 - DNA, 30 bp, Homo sapiens
taggggcaaatggcccagatgcccagctga

SEQ ID NO: 25588 - DNA, 30 bp, Homo sapiens
cgctggctccatgcctaaagccgtaggggc

SEQ ID NO: 25589 - DNA, 30 bp, Homo sapiens
cagaggggccagttccaagggctggtccaa

SEQ ID NO: 25590 - DNA, 30 bp, Homo sapiens
tatggggccctggggggtctgagaatggtg

SEQ ID NO: 25591 - DNA, 30 bp, Homo sapiens
tgcttgtgggggcttcaggttattcatggc

SEQ ID NO: 25592 - DNA, 30 bp, Homo sapiens
agatgggctgcatctggtcctccagcttct

SEQ ID NO: 25593 - DNA, 30 bp, Homo sapiens
cagctctcctcgcctcccagagtcctggtc

SEQ ID NO: 25594 - DNA, 30 bp, Homo sapiens
gactggaaagagagaggtctaggattttca

SEQ ID NO: 25595 - DNA, 30 bp, Homo sapiens
tgttggctctggcgctttgcaatctcctcc

SEQ ID NO: 25596 - DNA, 30 bp, Homo sapiens
agtgattctctatggaaggagcttcctttg

SEQ ID NO: 25597 - DNA, 30 bp, Homo sapiens
ctgtggagagaccctcttccctgatgggaa

SEQ ID NO: 25598 - DNA, 30 bp, Homo sapiens
aggacacctcctcttgctggggctgcgcct

SEQ ID NO: 25599 - DNA, 30 bp, Homo sapiens
tcttgagtctccggtgggctcagcaggagt

SEQ ID NO: 25600 - DNA, 30 bp, Homo sapiens
gaaaagagcatctcctacagttgtttgagt

SEQ ID NO: 25601 - DNA, 30 bp, Homo sapiens
tttatgttctcgagtatagcttcgaggtgt

SEQ ID NO: 25602 - DNA, 30 bp, Homo sapiens
accaggatgaaatgggattagctttgtagt

SEQ ID NO: 25603 - DNA, 30 bp, Homo sapiens
aagaggtgtatttggcagcattctcacgct

SEQ ID NO: 25604 - DNA, 30 bp, Homo sapiens
ctgtggcatttgcttcctttgcagagatgc

SEQ ID NO: 25605 - DNA, 30 bp, Homo sapiens
acctgggctttggggcacctgtctggatgg

SEQ ID NO: 25606 - DNA, 30 bp, Homo sapiens
aggaggcagaaaactttctcagcgcgacga

SEQ ID NO: 25607 - DNA, 30 bp, Homo sapiens
aaaccatctagaatggctccagagcaccga

SEQ ID NO: 25608 - DNA, 30 bp, Homo sapiens
aactggcacttctctcctgaccccgctctt

SEQ ID NO: 25609 - DNA, 30 bp, Homo sapiens
ggcccctcactctcaatgtatggaatgtca

SEQ ID NO: 25610 - DNA, 30 bp, Homo sapiens
aggtggaacctgacatgtaaactcctttac

SEQ ID NO: 25611 - DNA, 30 bp, Homo sapiens
agttggggcacccaaagacaaccatgctct

SEQ ID NO: 25612 - DNA, 30 bp, Homo sapiens
cagtgggtggaacgtgtgagctcctcactg

SEQ ID NO: 25613 - DNA, 30 bp, Homo sapiens
gtttggagttgagatgccttttctgtgtgt

SEQ ID NO: 25614 - DNA, 30 bp, Homo sapiens
gaatggtattttctgcttcattttgatttt

SEQ ID NO: 25615 - DNA, 30 bp, Homo sapiens
acgcatggatggcattggccacatcggtaa

SEQ ID NO: 25616 - DNA, 30 bp, Homo sapiens
tagagcccaagacagggagccgttttcaga

SEQ ID NO: 25617 - DNA, 30 bp, Homo sapiens
tcttggaggcctgcttcttccaactagtta

SEQ ID NO: 25618 - DNA, 30 bp, Homo sapiens
gagaggcccctggacagccctgccgccttg

SEQ ID NO: 25619 - DNA, 30 bp, Homo sapiens
acagcataaaattcagggggtcctctggct

SEQ ID NO: 25620 - DNA, 30 bp, Homo sapiens
cacccttttctacgaaagtttatgcgactt

SEQ ID NO: 25621 - DNA, 30 bp, Homo sapiens
acatagtaggttcttgaaaactttagacca

SEQ ID NO: 25622 - DNA, 30 bp, Homo sapiens
cccaggaaccaagataattctagaatcagg

SEQ ID NO: 25623 - DNA, 30 bp, Homo sapiens
taaattagttgccccgctctgccttgagac

SEQ ID NO: 25624 - DNA, 30 bp, Homo sapiens
acttggtccccagttccactatccgaagcc

SEQ ID NO: 25625 - DNA, 30 bp, Homo sapiens
aagcgacagaacgagaccctgtctcaaaaa

SEQ ID NO: 25626 - DNA, 30 bp, Homo sapiens
actctcacaaccaggtatattctgatcacg

SEQ ID NO: 25627 - DNA, 30 bp, Homo sapiens
aagaggcggcggcgggccctgcagggtgac

SEQ ID NO: 25628 - DNA, 30 bp, Homo sapiens
gcctggaatctgccatagcgcttctttggg

SEQ ID NO: 25629 - DNA, 30 bp, Homo sapiens
ccaagtccagaacagtctcaacaatattat

SEQ ID NO: 25630 - DNA, 30 bp, Homo sapiens
tgtctacctgattctgctgatcttagagga

SEQ ID NO: 25631 - DNA, 30 bp, Homo sapiens
catagtatttccctgtttgggggtcaaagt

SEQ ID NO: 25632 - DNA, 30 bp, Homo sapiens
cataccatccttatcagcagtgtcttgtgg

SEQ ID NO: 25633 - DNA, 30 bp, Homo sapiens
agccggctgttgactgggaggaacgattgg

SEQ ID NO: 25634 - DNA, 30 bp, Homo sapiens
tccaggtcagactgcgagggggagagaagg

SEQ ID NO: 25635 - DNA, 30 bp, Homo sapiens
gactggcatctgtttgatactggtttgcaa

SEQ ID NO: 25636 - DNA, 30 bp, Homo sapiens
aagagggtagcggccctcgccgccgtcggg

SEQ ID NO: 25637 - DNA, 30 bp, Homo sapiens
ttaatgctctggaccagtttagacactcag

SEQ ID NO: 25638 - DNA, 30 bp, Homo sapiens
caaaggtgaaggtattcatatccaaataat

SEQ ID NO: 25639 - DNA, 30 bp, Homo sapiens
tagccagtgtgtttacccacacatctgaac

SEQ ID NO: 25640 - DNA, 30 bp, Homo sapiens
cacctggcacccctgagtgccatactcctg

SEQ ID NO: 25641 - DNA, 30 bp, Homo sapiens
tggattgtcttgcgctgtctctctgtagtt

SEQ ID NO: 25642 - DNA, 30 bp, Homo sapiens
actcagctttcttcagctccagagaatatt

SEQ ID NO: 25643 - DNA, 30 bp, Homo sapiens
ctccggtgtgttgaaggataacatgctctt

SEQ ID NO: 25644 - DNA, 30 bp, Homo sapiens
atcagtctcatccaaatcttctcctgcagt

SEQ ID NO: 25645 - DNA, 30 bp, Homo sapiens
ttctggaaatgtggtcaaaaatgacagctt

SEQ ID NO: 25646 - DNA, 30 bp, Homo sapiens
catcgaaaaggatgaaaagccagaggtcca

SEQ ID NO: 25647 - DNA, 30 bp, Homo sapiens
cacaggtctgattccggttgtttccactct

SEQ ID NO: 25648 - DNA, 30 bp, Homo sapiens
aaccggctggcctttccctcaggagaagct

SEQ ID NO: 25649 - DNA, 30 bp, Homo sapiens
ttggtagcttcggcagcttaggtggtttgg

SEQ ID NO: 25650 - DNA, 30 bp, Homo sapiens
cagtcatcaggtttcaaagaatcatagcct

SEQ ID NO: 25651 - DNA, 30 bp, Homo sapiens
aataggatggtactgaagaagtcttgtagt

SEQ ID NO: 25652 - DNA, 30 bp, Homo sapiens
tgccccgctggccagcaggcacacagggca

SEQ ID NO: 25653 - DNA, 30 bp, Homo sapiens
cagttaaatggcgatgagggtcctccccag

SEQ ID NO: 25654 - DNA, 30 bp, Homo sapiens
tctaggccagtattcaatccaggtcaagga

SEQ ID NO: 25655 - DNA, 30 bp, Homo sapiens
ggctgggcatggtggtgtgtgcctgtaatc

SEQ ID NO: 25656 - DNA, 30 bp, Homo sapiens
ctgcctgggtcttctgggccatagtgtcca

SEQ ID NO: 25657 - DNA, 30 bp, Homo sapiens
tacacctccatctccgagaccaggtcatgg

SEQ ID NO: 25658 - DNA, 30 bp, Homo sapiens
cgatggtattccactgttttggaacaaagg

SEQ ID NO: 25659 - DNA, 30 bp, Homo sapiens
acttggaggtctagatttccatagagggca

SEQ ID NO: 25660 - DNA, 30 bp, Homo sapiens
cactggaacacctgaaggcttgctgctttt

SEQ ID NO: 25661 - DNA, 30 bp, Homo sapiens
cattgggtggtttgacttcactgctagttt

SEQ ID NO: 25662 - DNA, 30 bp, Homo sapiens
aaacacacggtcccctcggagggttaggtg

SEQ ID NO: 25663 - DNA, 30 bp, Homo sapiens
tgaaggatttcagaggtttttttcaatgct

SEQ ID NO: 25664 - DNA, 30 bp, Homo sapiens
ggctcaggaggagccatcctcaagcacagc

SEQ ID NO: 25665 - DNA, 30 bp, Homo sapiens
taccgggagcctgccggctcaggaggagcc

SEQ ID NO: 25666 - DNA, 30 bp, Homo sapiens
gggagcctgccggctcaggaggagccatcc

SEQ ID NO: 25667 - DNA, 30 bp, Homo sapiens
tggcaattcgcaaccaaggcgccccggatc

SEQ ID NO: 25668 - DNA, 30 bp, Homo sapiens
tacaggtccagggcccagtggacagacagg

SEQ ID NO: 25669 - DNA, 30 bp, Homo sapiens
cctgaatcctgagaactcgttgggagttgc

SEQ ID NO: 25670 - DNA, 30 bp, Homo sapiens
gcatttcagcctgtgtctatatttttcatt

SEQ ID NO: 25671 - DNA, 30 bp, Homo sapiens
ggatggagcaatgtgcccaaagccgggttc

SEQ ID NO: 25672 - DNA, 30 bp, Homo sapiens
ttgttctttcaggggtccttcacacacaga

SEQ ID NO: 25673 - DNA, 30 bp, Homo sapiens
aactggtggtggtatcccgaaggttaagta

SEQ ID NO: 25674 - DNA, 30 bp, Homo sapiens
ttgaggtgttcctttccccagctcctgtag

SEQ ID NO: 25675 - DNA, 30 bp, Homo sapiens
tgatgggatgattaaaatgtaggataaggt

SEQ ID NO: 25676 - DNA, 30 bp, Homo sapiens
gagattcccaattgttcgtggatgtcggat

SEQ ID NO: 25677 - DNA, 30 bp, Homo sapiens
ctcaggcaatagaatgccccacagtcactt

SEQ ID NO: 25678 - DNA, 30 bp, Homo sapiens
gtactttgctgctcaagtttcaggagctgt

SEQ ID NO: 25679 - DNA, 30 bp, Homo sapiens
aaatgggaattggagtggattttagaacac

SEQ ID NO: 25680 - DNA, 30 bp, Homo sapiens
accactagctgctgtcagcgcaggccatgg

SEQ ID NO: 25681 - DNA, 30 bp, Homo sapiens
aagaggatttccttaacctgaagctcaggg

SEQ ID NO: 25682 - DNA, 30 bp, Homo sapiens
actttccaggatgcagtatttccatcttcc

SEQ ID NO: 25683 - DNA, 30 bp, Homo sapiens
tgtatttgccttcgcccttttcgagccttt

SEQ ID NO: 25684 - DNA, 30 bp, Homo sapiens
taagactggccgaaggggtaaggcccatgg

SEQ ID NO: 25685 - DNA, 30 bp, Homo sapiens
taaatttccaaaggcccttttattttcttc

SEQ ID NO: 25686 - DNA, 30 bp, Homo sapiens
aacagattcctcctcttgcgaggcgtcttc

SEQ ID NO: 25687 - DNA, 30 bp, Homo sapiens
aggaggtggctttccgatgggcccctgagc

SEQ ID NO: 25688 - DNA, 30 bp, Homo sapiens
gcttggaacacaggtttaagtcaggttctg

SEQ ID NO: 25689 - DNA, 30 bp, Homo sapiens
gccaagtccctggagacggtgaaaccctcc

SEQ ID NO: 25690 - DNA, 30 bp, Homo sapiens
tgcaacctagggcttggaggattagggaag

SEQ ID NO: 25691 - DNA, 30 bp, Homo sapiens
tcctggtgaaagcttaggaaaggtataatt

SEQ ID NO: 25692 - DNA, 30 bp, Homo sapiens
acaaggaaaggaagaaaaaaggaaagtaag

SEQ ID NO: 25693 - DNA, 30 bp, Homo sapiens
ggtaggttctgatatacccagaaggcactg

SEQ ID NO: 25694 - DNA, 30 bp, Homo sapiens
ccgtaacaccactctgtatttttcactttc

SEQ ID NO: 25695 - DNA, 30 bp, Homo sapiens
atctggactttcaaccttaggacttgtgat

SEQ ID NO: 25696 - DNA, 30 bp, Homo sapiens
ttacggcgcgttggcccagcgccgcggagc

SEQ ID NO: 25697 - DNA, 30 bp, Homo sapiens
tgcccagagccgtgcctggcaacatagcgg

SEQ ID NO: 25698 - DNA, 30 bp, Homo sapiens
caggggcccactgtatgccatgaagaaggc

SEQ ID NO: 25699 - DNA, 30 bp, Homo sapiens
aggaaatacagcacctctgcaaaattctct

SEQ ID NO: 25700 - DNA, 30 bp, Homo sapiens
tcccgggtctcccctctgctcctcaccttc

SEQ ID NO: 25701 - DNA, 30 bp, Homo sapiens
aaagcttctctccatgagggggagattcca

SEQ ID NO: 25702 - DNA, 30 bp, Homo sapiens
ttcaggcatttttcccccaataaggtgaca

SEQ ID NO: 25703 - DNA, 30 bp, Homo sapiens
cttcggggtctcatctgggatttcggagtg

SEQ ID NO: 25704 - DNA, 30 bp, Homo sapiens
ctacattctgaaaagcagtaaagtcactga

SEQ ID NO: 25705 - DNA, 30 bp, Homo sapiens
ctctggcatataaggacggaggtgatcctc

SEQ ID NO: 25706 - DNA, 30 bp, Homo sapiens
gttctgagaaagcggttccatcgcagatga

SEQ ID NO: 25707 - DNA, 30 bp, Homo sapiens
tgctggtaaaggcgctaacaaaagcgttgc

SEQ ID NO: 25708 - DNA, 30 bp, Homo sapiens
tactgggtttccgcagcacaaggccttatg

SEQ ID NO: 25709 - DNA, 30 bp, Homo sapiens
ttttggtaagggggtggctagagcctcttt

SEQ ID NO: 25710 - DNA, 30 bp, Homo sapiens
tagcggatgggcctgaagggaaaggtcacg

SEQ ID NO: 25711 - DNA, 30 bp, Homo sapiens
aattggtgcttcatccccgaatgctcatta

SEQ ID NO: 25712 - DNA, 30 bp, Homo sapiens
ttctggaaatccttgtggcctcaacagaat

SEQ ID NO: 25713 - DNA, 30 bp, Homo sapiens
tgacgggttccaccaccaggaccttgcact

SEQ ID NO: 25714 - DNA, 30 bp, Homo sapiens
ctgaaaaagatctcccggacgtatttcagc

SEQ ID NO: 25715 - DNA, 30 bp, Homo sapiens
aatctgaagagacagacgaatccagggagt

SEQ ID NO: 25716 - DNA, 30 bp, Homo sapiens
aggagagcagctgcagcacctgtcggatgc

SEQ ID NO: 25717 - DNA, 30 bp, Homo sapiens
caccggccaaggagggtctgtcggatgcgc

SEQ ID NO: 25718 - DNA, 30 bp, Homo sapiens
acattaatcggctgtcctcttcgaaacggg

SEQ ID NO: 25719 - DNA, 30 bp, Homo sapiens
tgctggtgttgatgcagatacagattcttc

SEQ ID NO: 25720 - DNA, 30 bp, Homo sapiens
tagaggggactttgggcatccagtttcagg

SEQ ID NO: 25721 - DNA, 30 bp, Homo sapiens
ttcctgccttccctctcaggggtccccttt

SEQ ID NO: 25722 - DNA, 30 bp, Homo sapiens
atatgcacctttcacttgagatatgtatcc

SEQ ID NO: 25723 - DNA, 30 bp, Homo sapiens
catttgtgaaaccagcagttatttccatcc

SEQ ID NO: 25724 - DNA, 30 bp, Homo sapiens
catcggggtgcttatagggccagataacat

SEQ ID NO: 25725 - DNA, 30 bp, Homo sapiens
atagctgatctgtcagggtgagtcagacag

SEQ ID NO: 25726 - DNA, 30 bp, Homo sapiens
gcaagcctgcgtctgtactttccgccctgg

SEQ ID NO: 25727 - DNA, 30 bp, Homo sapiens
agcagggcctgaacaggggctacccccatt

SEQ ID NO: 25728 - DNA, 30 bp, Homo sapiens
cgtggaactggtctgcagcctcgcagaagc

SEQ ID NO: 25729 - DNA, 30 bp, Homo sapiens
agaaggtggttcccgtggtgccgagagaat

SEQ ID NO: 25730 - DNA, 30 bp, Homo sapiens
ctcttcatcaggcatgtccagagtggcttt

SEQ ID NO: 25731 - DNA, 30 bp, Homo sapiens
aattccattgcatcatcttcattatcaata

SEQ ID NO: 25732 - DNA, 30 bp, Homo sapiens
tagaccagcgtaggacaagaagagcatgga

SEQ ID NO: 25733 - DNA, 30 bp, Homo sapiens
acccagcgaagctgatgatctgtctgaagg

SEQ ID NO: 25734 - DNA, 30 bp, Homo sapiens
aaggttagagaacagaagactccagaagcc

SEQ ID NO: 25735 - DNA, 30 bp, Homo sapiens
agtcggcctcaaaggcgctgttggtggctc

SEQ ID NO: 25736 - DNA, 30 bp, Homo sapiens
ctctggtttgattagagtaagtcgcttgag

SEQ ID NO: 25737 - DNA, 30 bp, Homo sapiens
agggaggtccctggactcgatccttgtgtc

SEQ ID NO: 25738 - DNA, 30 bp, Homo sapiens
gaaaggttttttgctcgttgcttcttaacc

SEQ ID NO: 25739 - DNA, 30 bp, Homo sapiens
ctgaggaatcagttctttctgcagaggttc

SEQ ID NO: 25740 - DNA, 30 bp, Homo sapiens
acttccttgccttcgctttctttcctttgc

SEQ ID NO: 25741 - DNA, 30 bp, Homo sapiens
agccaagatttgtatctctgtatggaactg

SEQ ID NO: 25742 - DNA, 30 bp, Homo sapiens
cagggcgaccgagccgcgagcagcagcggg

SEQ ID NO: 25743 - DNA, 30 bp, Homo sapiens
ttctgggcggggctggagaatgtgcatttc

SEQ ID NO: 25744 - DNA, 30 bp, Homo sapiens
tcacctgtgccccagaaagcacggcttgct

SEQ ID NO: 25745 - DNA, 30 bp, Homo sapiens
ccactgatgggctctgaagacactcactgt

SEQ ID NO: 25746 - DNA, 30 bp, Homo sapiens
caatgggatgatcaggcagaaagtctggtt

SEQ ID NO: 25747 - DNA, 30 bp, Homo sapiens
cagcggtctcggaggtctcgtttcttgctt

SEQ ID NO: 25748 - DNA, 30 bp, Homo sapiens
tctagggctggcaatccttcagaaattttt

SEQ ID NO: 25749 - DNA, 30 bp, Homo sapiens
cagcggcagctccacccactgtcccagaca

SEQ ID NO: 25750 - DNA, 30 bp, Homo sapiens
aatcgcagatggatggcctgttgatgttgt

SEQ ID NO: 25751 - DNA, 30 bp, Homo sapiens
acgatgcttttctccaggtaaacattgaga

SEQ ID NO: 25752 - DNA, 30 bp, Homo sapiens
tccaggggctgagagacggcgggacgctgg

SEQ ID NO: 25753 - DNA, 30 bp, Homo sapiens
tggtgggtaggggtcgatggttatccaggc

SEQ ID NO: 25754 - DNA, 30 bp, Homo sapiens
agtcaagggatagagtttctgttttacatc

SEQ ID NO: 25755 - DNA, 30 bp, Homo sapiens
acctgggagattatagagttctccaaatgg

SEQ ID NO: 25756 - DNA, 30 bp, Homo sapiens
cggtggatgtctaggaaagacagctccaaa

SEQ ID NO: 25757 - DNA, 30 bp, Homo sapiens
aggaggcctgggtggggtgagatgaggggg

SEQ ID NO: 25758 - DNA, 30 bp, Homo sapiens
tggtggcaagtctgtcctgctgattaatta

SEQ ID NO: 25759 - DNA, 30 bp, Homo sapiens
aagcccaggttccgggcagcttgggagatc

SEQ ID NO: 25760 - DNA, 30 bp, Homo sapiens
cagatcccttagattcatgaattgttttcc

SEQ ID NO: 25761 - DNA, 30 bp, Homo sapiens
taggggctggcatcactgggggcctccccg

SEQ ID NO: 25762 - DNA, 30 bp, Homo sapiens
ccccggtgggaccacagggtttcggaggac

SEQ ID NO: 25763 - DNA, 30 bp, Homo sapiens
tgacatctatcaagaggtttttccaatctg

SEQ ID NO: 25764 - DNA, 30 bp, Homo sapiens
ggttggcgctggccacccagtcgagcgcgc

SEQ ID NO: 25765 - DNA, 30 bp, Homo sapiens
acgatagtcgggataggtctcagacacaaa

SEQ ID NO: 25766 - DNA, 30 bp, Homo sapiens
ccttggcacagcaagcccaggctctaccag

SEQ ID NO: 25767 - DNA, 30 bp, Homo sapiens
tgacggcgggggagttgtaacagcacactg

SEQ ID NO: 25768 - DNA, 30 bp, Homo sapiens
acctgggctgaggacctatccatctgctcc

SEQ ID NO: 25769 - DNA, 30 bp, Homo sapiens
catccgccaacatgtggaaaccttaacacc

SEQ ID NO: 25770 - DNA, 30 bp, Homo sapiens
caacctcagccccttcattcctgccctgaa

SEQ ID NO: 25771 - DNA, 30 bp, Homo sapiens
cagaggactggtcctcctcatcctcatcat

SEQ ID NO: 25772 - DNA, 30 bp, Homo sapiens
aaaacgactgatggaacttctccacgaaca

SEQ ID NO: 25773 - DNA, 30 bp, Homo sapiens
atctggctgcagtgttgcggaggccaggag

SEQ ID NO: 25774 - DNA, 30 bp, Homo sapiens
atgtggacctcttctttacagtactgacca

SEQ ID NO: 25775 - DNA, 30 bp, Homo sapiens
ccattggggcggtggcggctcccttaaact

SEQ ID NO: 25776 - DNA, 30 bp, Homo sapiens
aaacggaattcctttcatatcttccctatg

SEQ ID NO: 25777 - DNA, 30 bp, Homo sapiens
gaatccctggggtgattcccgacctcgcca

SEQ ID NO: 25778 - DNA, 30 bp, Homo sapiens
tgacagctgtcaccaatatcatcatcattg

SEQ ID NO: 25779 - DNA, 30 bp, Homo sapiens
gaaaggtcttccaaagataaaagagtgtag

SEQ ID NO: 25780 - DNA, 30 bp, Homo sapiens
cgttagcaggacgcttgcggttaggagggg

SEQ ID NO: 25781 - DNA, 30 bp, Homo sapiens
aaaaaacctcagccgagtctgcccatcaac

SEQ ID NO: 25782 - DNA, 30 bp, Homo sapiens
gtgtcttctaaatcaatatcaaaatctaaa

SEQ ID NO: 25783 - DNA, 30 bp, Homo sapiens
aataggagactgtagattcggctgtacatt

SEQ ID NO: 25784 - DNA, 30 bp, Homo sapiens
cagaggttgggttgggcggttgttgtgctg

SEQ ID NO: 25785 - DNA, 30 bp, Homo sapiens
ttgaggagccattcatttactctatactga

SEQ ID NO: 25786 - DNA, 30 bp, Homo sapiens
ccatgggggacaccatccacatgcaggcgg

SEQ ID NO: 25787 - DNA, 30 bp, Homo sapiens
gcgtgggcctcagtctccatcttggtggct

SEQ ID NO: 25788 - DNA, 30 bp, Homo sapiens
ttgcggccctttagaggctgtggtgggcgg

SEQ ID NO: 25789 - DNA, 30 bp, Homo sapiens
tcgtggcttgtgctgaggtgaagaccacac

SEQ ID NO: 25790 - DNA, 30 bp, Homo sapiens
tgaaggaagctttgatttgcctgttcttca

SEQ ID NO: 25791 - DNA, 30 bp, Homo sapiens
ttgaaggaagctctcaccaccctgttattg

SEQ ID NO: 25792 - DNA, 30 bp, Homo sapiens
tcgcaggaagccggccagcaggcaggccag

SEQ ID NO: 25793 - DNA, 30 bp, Homo sapiens
gccctcattagtggcctggaaggacgccca

SEQ ID NO: 25794 - DNA, 30 bp, Homo sapiens
gcttggctggtggccggcttgggtttcgct

SEQ ID NO: 25795 - DNA, 30 bp, Homo sapiens
gccaaggggtggcgtgttgaggtgggctgt

SEQ ID NO: 25796 - DNA, 30 bp, Homo sapiens
ttcaatgctcttcttaagtagtcaagaatt

SEQ ID NO: 25797 - DNA, 30 bp, Homo sapiens
gcccggaaggaggcctttaccacgcggccc

SEQ ID NO: 25798 - DNA, 30 bp, Homo sapiens
aagaggctgagtgggccgaaagttgtctcc

SEQ ID NO: 25799 - DNA, 30 bp, Homo sapiens
tccccactttacgtccagactttccattct

SEQ ID NO: 25800 - DNA, 30 bp, Homo sapiens
ggctccagtctcggctacctctgctgggcg

SEQ ID NO: 25801 - DNA, 30 bp, Homo sapiens
ggctggcttttttatatcaccagctttcat

SEQ ID NO: 25802 - DNA, 30 bp, Homo sapiens
agctggtctcttcaaatccctgatctgttt

SEQ ID NO: 25803 - DNA, 30 bp, Homo sapiens
caaggggccgttttcttcaagtctcggatc

SEQ ID NO: 25804 - DNA, 30 bp, Homo sapiens
cctgtatttgcagtttttcgtttatctcgg

SEQ ID NO: 25805 - DNA, 30 bp, Homo sapiens
aaatgtccatgtagtcgtcgtcctcgtctg

SEQ ID NO: 25806 - DNA, 30 bp, Homo sapiens
ctctggaccagccgtctgtagtggggcatg

SEQ ID NO: 25807 - DNA, 30 bp, Homo sapiens
tgctgggtgaggcgcctgtaatgaggtaac

SEQ ID NO: 25808 - DNA, 30 bp, Homo sapiens
cagcgggacatcatccggacaaactcttca

SEQ ID NO: 25809 - DNA, 30 bp, Homo sapiens
catcattcgcacaaactcttcgaagtcgac

SEQ ID NO: 25810 - DNA, 30 bp, Homo sapiens
cagtggcgggagagcatcatcacaaactcg

SEQ ID NO: 25811 - DNA, 30 bp, Homo sapiens
cagcgagacatcatcttcacaaactcttca

SEQ ID NO: 25812 - DNA, 30 bp, Homo sapiens
cgcagcacctggttggccgcaatgagcatg

SEQ ID NO: 25813 - DNA, 30 bp, Homo sapiens
cagttgtggaggtgtcttccttatagtctg

SEQ ID NO: 25814 - DNA, 30 bp, Homo sapiens
tcacggttacctccccagcaataccgtaac

SEQ ID NO: 25815 - DNA, 30 bp, Homo sapiens
tcagctgttgattccccttctggttcaatt

SEQ ID NO: 25816 - DNA, 30 bp, Homo sapiens
acagctccccctccagggtctccgcgagct

SEQ ID NO: 25817 - DNA, 30 bp, Homo sapiens
acttggacccacacagagccagaagagggg

SEQ ID NO: 25818 - DNA, 30 bp, Homo sapiens
tgacggccgcctgtaagtggtggctatgat

SEQ ID NO: 25819 - DNA, 30 bp, Homo sapiens
cgccatgtgctctcggccctcgctgggcga

SEQ ID NO: 25820 - DNA, 30 bp, Homo sapiens
atcgtcactctcgctgtagggttcgtgcag

SEQ ID NO: 25821 - DNA, 30 bp, Homo sapiens
gggaggacacgtaggaagtcctggaggagc

SEQ ID NO: 25822 - DNA, 30 bp, Homo sapiens
cagtggtcttggtcagggtggtggtagctg

SEQ ID NO: 25823 - DNA, 30 bp, Homo sapiens
tacaggctgctgacgtagaccctgctgtcc

SEQ ID NO: 25824 - DNA, 30 bp, Homo sapiens
acaaggtggtgatgcatatcatttcatccg

SEQ ID NO: 25825 - DNA, 30 bp, Homo sapiens
gcatttgtcatcttcttccgtgtcacttag

SEQ ID NO: 25826 - DNA, 30 bp, Homo sapiens
cagagggcgtggacgcaggccatctcgtct

SEQ ID NO: 25827 - DNA, 30 bp, Homo sapiens
caggggtccaggtctgctgggtcagaggat

SEQ ID NO: 25828 - DNA, 30 bp, Homo sapiens
tacacggggtcatctgcaccaccccctggg

SEQ ID NO: 25829 - DNA, 30 bp, Homo sapiens
tctcttcctcttgctggcggcgtctcccgg

SEQ ID NO: 25830 - DNA, 30 bp, Homo sapiens
ccttggaggaataagggtctcctgggagcc

SEQ ID NO: 25831 - DNA, 30 bp, Homo sapiens
ttcgggagaaggagaaatctctttactatc

SEQ ID NO: 25832 - DNA, 30 bp, Homo sapiens
aggcggtgtgtgctgccagataccagccaa

SEQ ID NO: 25833 - DNA, 30 bp, Homo sapiens
cagaggcggcgagaggcgtggacgaggact

SEQ ID NO: 25834 - DNA, 30 bp, Homo sapiens
gaagagcatcaaaagcagagggagcagaag

SEQ ID NO: 25835 - DNA, 30 bp, Homo sapiens
cgcaggagttggggcagtagcccccaggca

SEQ ID NO: 25836 - DNA, 30 bp, Homo sapiens
agcgaatgtagacgcctcgtccccagccct

SEQ ID NO: 25837 - DNA, 30 bp, Homo sapiens
acatggcatgttcctgctcctggggcacca

SEQ ID NO: 25838 - DNA, 30 bp, Homo sapiens
cattggcggatgtaaacatccctgttccac

SEQ ID NO: 25839 - DNA, 30 bp, Homo sapiens
ccttgggccaaggccggttgcgctgccagt

SEQ ID NO: 25840 - DNA, 30 bp, Homo sapiens
tgtcgggagtcatggctatatcccccaggt

SEQ ID NO: 25841 - DNA, 30 bp, Homo sapiens
gctcgggctcagcatccatgcaggactccc

SEQ ID NO: 25842 - DNA, 30 bp, Homo sapiens
atacgggggtggtccggcggttggctgtgt

SEQ ID NO: 25843 - DNA, 30 bp, Homo sapiens
agacgggcgtggtgcgcctgttggccggat

SEQ ID NO: 25844 - DNA, 30 bp, Homo sapiens
cacaggggtcgtccgtcggttcagcatgct

SEQ ID NO: 25845 - DNA, 30 bp, Homo sapiens
agcagggtgaagaggacatctgatcatagt

SEQ ID NO: 25846 - DNA, 30 bp, Homo sapiens
aggtggcccggtgcccccgcttgggacaga

SEQ ID NO: 25847 - DNA, 30 bp, Homo sapiens
agcagggcgaggtggagatgtgcaggtggt

SEQ ID NO: 25848 - DNA, 30 bp, Homo sapiens
cacaggcgtggttttcctgttgagcgtgtt

SEQ ID NO: 25849 - DNA, 30 bp, Homo sapiens
ccgccgatagcggtagcgcttgaagtgaaa

SEQ ID NO: 25850 - DNA, 30 bp, Homo sapiens
ccctggaacttgcacatgctgacgagctat

SEQ ID NO: 25851 - DNA, 30 bp, Homo sapiens
ctcctttggcttgcttctctcttgattcca

SEQ ID NO: 25852 - DNA, 30 bp, Homo sapiens
aaacggcccagcacggtggctaacagagcc

SEQ ID NO: 25853 - DNA, 30 bp, Homo sapiens
tctgcattgattatagctgtgtctgcgtct

SEQ ID NO: 25854 - DNA, 30 bp, Homo sapiens
acttggctgccttcagcattgataatggct

SEQ ID NO: 25855 - DNA, 30 bp, Homo sapiens
tgtcgtcccctcctgactgcccgccttctg

SEQ ID NO: 25856 - DNA, 30 bp, Homo sapiens
tcctcttgtgtccgtcgctgccattgagga

SEQ ID NO: 25857 - DNA, 30 bp, Homo sapiens
cgctgtccttcatgctgatgccctgcagtc

SEQ ID NO: 25858 - DNA, 30 bp, Homo sapiens
tcttcttcgtcactgtctttcatagtaatg

SEQ ID NO: 25859 - DNA, 30 bp, Homo sapiens
cgcccagcctgtatcctataaatatgtaca

SEQ ID NO: 25860 - DNA, 30 bp, Homo sapiens
ctctgggctttctaattaaatcctctaaat

SEQ ID NO: 25861 - DNA, 30 bp, Homo sapiens
cacagagaataagagcaagatccgttcggt

SEQ ID NO: 25862 - DNA, 30 bp, Homo sapiens
tacatggggggctcgctgcagagcacaatc

SEQ ID NO: 25863 - DNA, 30 bp, Homo sapiens
aaaagggcatccagctcatgctcgtcaatg

SEQ ID NO: 25864 - DNA, 30 bp, Homo sapiens
agttggcattctggggcatgctaacatgag

SEQ ID NO: 25865 - DNA, 30 bp, Homo sapiens
tgaaggtccctgcggcgcctgccaaaggct

SEQ ID NO: 25866 - DNA, 30 bp, Homo sapiens; identical to SEQ ID NO: 25865

SEQ ID NO: 25867 - DNA, 30 bp, Homo sapiens
caaaggtgaaggggtcctgggtgctgaaaa

SEQ ID NO: 25868 - DNA, 30 bp, Homo sapiens
gagtggcagaacacgtggtcttcaaagatc

SEQ ID NO: 25869 - DNA, 30 bp, Homo sapiens
ccttggttgttggctggttcattcctcagc

SEQ ID NO: 25870 - DNA, 30 bp, Homo sapiens
aagtgttcactaggacagtcatgactataa

SEQ ID NO: 25871 - DNA, 30 bp, Homo sapiens
tgggggaagtgaccttatccacagattgct

SEQ ID NO: 25872 - DNA, 30 bp, Homo sapiens
actttgctgaagtaggtggccacctcctta

SEQ ID NO: 25873 - DNA, 30 bp, Homo sapiens
taggaggggagcagggccatctccacgttg

SEQ ID NO: 25874 - DNA, 30 bp, Homo sapiens
acgtcggtgtgttgtgacagcctcgtgccc

SEQ ID NO: 25875 - DNA, 30 bp, Homo sapiens
gatctgtcttcctcattatcctcatccacc

SEQ ID NO: 25876 - DNA, 30 bp, Homo sapiens
ttgtgggcagtacccacaaggaccattgtc

SEQ ID NO: 25877 - DNA, 30 bp, Homo sapiens
gaatctacaaagccaagaacaggaatcacc

SEQ ID NO: 25878 - DNA, 30 bp, Homo sapiens
ccatcaatatctgcttctctgatcatttca

SEQ ID NO: 25879 - DNA, 30 bp, Homo sapiens
ccatcaatatctgcttccctgatcatttca

SEQ ID NO: 25880 - DNA, 30 bp, Homo sapiens
ctttgcagtcatcatctgtacaaactcttc

SEQ ID NO: 25881 - DNA, 30 bp, Homo sapiens
acttggacaccagcacacggacaaactcct

SEQ ID NO: 25882 - DNA, 30 bp, Homo sapiens
atagtcccgtccaggaagggtgatcttgtg

SEQ ID NO: 25883 - DNA, 30 bp, Homo sapiens
tcctgggcgagcatcctcgcgaactcctcg

SEQ ID NO: 25884 - DNA, 30 bp, Homo sapiens
tactggatcagcttgaaggactcccccgtc

SEQ ID NO: 25885 - DNA, 30 bp, Homo sapiens
cgctccggagtatctggttggctgcaatca

SEQ ID NO: 25886 - DNA, 30 bp, Homo sapiens
tacagctcgtccttggcctggccggggaca

SEQ ID NO: 25887 - DNA, 30 bp, Homo sapiens
aatttttcccgacagcagctcttcctcctc

SEQ ID NO: 25888 - DNA, 30 bp, Homo sapiens
ctaaggcctccccaaaatctgtggcctggc

SEQ ID NO: 25889 - DNA, 30 bp, Homo sapiens
ccttggtaagcttgccatccaatatactct

SEQ ID NO: 25890 - DNA, 30 bp, Homo sapiens
gcgcgggcgggggcgccgcgctcccggccg

SEQ ID NO: 25891 - DNA, 30 bp, Homo sapiens
agctggtggggcagtgtgggggacagttct

SEQ ID NO: 25892 - DNA, 30 bp, Homo sapiens
ctgagggattctggttttgctacatacgca

SEQ ID NO: 25893 - DNA, 30 bp, Homo sapiens
acttgcttccagagtgcactgccgtcacag

SEQ ID NO: 25894 - DNA, 30 bp, Homo sapiens
tgccctgcccggcagtgggagctgccactg

SEQ ID NO: 25895 - DNA, 30 bp, Homo sapiens
atctgtggaagtggacgatctgccatttgc

SEQ ID NO: 25896 - DNA, 30 bp, Homo sapiens
cacaggcgcgcccgagcagtggaagtgcac

SEQ ID NO: 25897 - DNA, 30 bp, Homo sapiens
gcagaaagctttttggtgttgataattttg

SEQ ID NO: 25898 - DNA, 30 bp, Homo sapiens
gcgatgaaaatgaacattctgccactttcc

SEQ ID NO: 25899 - DNA, 30 bp, Homo sapiens
tgttggtgaccccgagcgatgaaaatgaac

SEQ ID NO: 25900 - DNA, 30 bp, Homo sapiens
atgttttgccacaaagaggtgcctcctgag

SEQ ID NO: 25901 - DNA, 30 bp, Homo sapiens
gcaggggcccctgagcagtgatagtggaca

SEQ ID NO: 25902 - DNA, 30 bp, Homo sapiens
cgcccggcaagaaataagtgagcttgattg

SEQ ID NO: 25903 - DNA, 30 bp, Homo sapiens
accaggaggtgccttgtcggtcatattttt

SEQ ID NO: 25904 - DNA, 30 bp, Homo sapiens
atccctggccgcgcgcggtccgacaccggc

SEQ ID NO: 25905 - DNA, 30 bp, Homo sapiens
ctctggcaggatcacatcttgctgtggaac

SEQ ID NO: 25906 - DNA, 30 bp, Homo sapiens
agtaggtttcctggagcagacatggatcgc

SEQ ID NO: 25907 - DNA, 30 bp, Homo sapiens
cttcctggacgccggggagctctgggctct

SEQ ID NO: 25908 - DNA, 30 bp, Homo sapiens
ccctggttggttttttggtgagcaagtttc

SEQ ID NO: 25909 - DNA, 30 bp, Homo sapiens
actcgggctccatggcctcctccggccgca

SEQ ID NO: 25910 - DNA, 30 bp, Homo sapiens
acaagagcacttcctcctcccccacggggg

SEQ ID NO: 25911 - DNA, 30 bp, Homo sapiens
acccgcctgtccagccagccagcggccacg

SEQ ID NO: 25912 - DNA, 30 bp, Homo sapiens
aagcgggtaatgaaggttttcttcatatat

SEQ ID NO: 25913 - DNA, 30 bp, Homo sapiens
cagctggcctcctccctttgagactcctgg

SEQ ID NO: 25914 - DNA, 30 bp, Homo sapiens
tataggtatccattgatcgatttatcactt

SEQ ID NO: 25915 - DNA, 30 bp, Homo sapiens
tcctgggtacaagattccgcaaaaaatcct

SEQ ID NO: 25916 - DNA, 30 bp, Homo sapiens
gtctgggccttctttggcactgcaggccgc

SEQ ID NO: 25917 - DNA, 30 bp, Homo sapiens
tagtgggtaaaagttttttgggtgttactg

SEQ ID NO: 25918 - DNA, 30 bp, Homo sapiens
atttgggggtgccgccgcccttcttgggag

SEQ ID NO: 25919 - DNA, 30 bp, Homo sapiens
ctaagggatgctgctgtatgtcttcaagtt

SEQ ID NO: 25920 - DNA, 30 bp, Homo sapiens
agtaggtgctagttccgcagaatacacttt

SEQ ID NO: 25921 - DNA, 30 bp, Homo sapiens
ccttggcctttttcaattctttcactcctt

SEQ ID NO: 25922 - DNA, 30 bp, Homo sapiens
gtgcctctcttttggtaaacttgaacattt

SEQ ID NO: 25923 - DNA, 30 bp, Homo sapiens
tcatggctccagctctgtggatccctcttc

SEQ ID NO: 25924 - DNA, 30 bp, Homo sapiens
taagactgcacgaggcgcccccagggtggt

SEQ ID NO: 25925 - DNA, 30 bp, Homo sapiens
catgtggccagtcccggctggggaagccct

SEQ ID NO: 25926 - DNA, 30 bp, Homo sapiens
gctcagggttagaactgatctgtgactgga

SEQ ID NO: 25927 - DNA, 30 bp, Homo sapiens
agtctgtgctgggggctgaagcggaatcct

SEQ ID NO: 25928 - DNA, 30 bp, Homo sapiens
tatttcacgcttccgatcttggtctccggc

SEQ ID NO: 25929 - DNA, 30 bp, Homo sapiens
tcgtggctttctgtttcttggtgatctgtt

SEQ ID NO: 25930 - DNA, 30 bp, Homo sapiens
atttctgtcactgtggtgaccaacttctgc

SEQ ID NO: 25931 - DNA, 30 bp, Homo sapiens
tttctgcaggttcagtgattaacttggatc

SEQ ID NO: 25932 - DNA, 30 bp, Homo sapiens
tttccagtccttgaaaaattgcttgaagat

SEQ ID NO: 25933 - DNA, 30 bp, Homo sapiens
gcaaacatggtcagctgcaaccacttaaac

SEQ ID NO: 25934 - DNA, 30 bp, Homo sapiens
taggttttcatcactgccatgacggagacc

SEQ ID NO: 25935 - DNA, 30 bp, Homo sapiens
tccccacatggtcatctgcagccactgttc

SEQ ID NO: 25936 - DNA, 30 bp, Homo sapiens
agaaggtggccacctccatccactgtctgt

SEQ ID NO: 25937 - DNA, 30 bp, Homo sapiens
accaggctcatccactccatttctgtcagg

SEQ ID NO: 25938 - DNA, 30 bp, Homo sapiens
caggagtacagtgccatcatcatccactct

SEQ ID NO: 25939 - DNA, 30 bp, Homo sapiens
ggtcggggcccatgcagaccggcgacctct

SEQ ID NO: 25940 - DNA, 30 bp, Homo sapiens
ttctcgggatccagctgcttaaatatcttg

SEQ ID NO: 25941 - DNA, 30 bp, Homo sapiens
acatggtgagctgcagccactccagaacgt

SEQ ID NO: 25942 - DNA, 30 bp, Homo sapiens
atgagggaggtgctgctgagaatgtgcacg

SEQ ID NO: 25943 - DNA, 30 bp, Homo sapiens
cgctggaaataaccttgaagctgatgtggc

SEQ ID NO: 25944 - DNA, 30 bp, Homo sapiens
ctgaagttgtgtgatcttgatggggataat

SEQ ID NO: 25945 - DNA, 30 bp, Homo sapiens
cagaccaacacgcagcacagccactcggcc

SEQ ID NO: 25946 - DNA, 30 bp, Homo sapiens
tctttgtactgagagcctggaacacccggc

SEQ ID NO: 25947 - DNA, 30 bp, Homo sapiens
caggaatacatagtcagctgcagccactcc

SEQ ID NO: 25948 - DNA, 30 bp, Homo sapiens
caggaatacatggtcaactgcagccattct

SEQ ID NO: 25949 - DNA, 30 bp, Homo sapiens
caaaatattacctcgtggggctccccgtgg

SEQ ID NO: 25950 - DNA, 30 bp, Homo sapiens
ttgcggcatccctctgttgggtcttggggg

SEQ ID NO: 25951 - DNA, 30 bp, Homo sapiens
aagaatcactccaccctgctgttttattag

SEQ ID NO: 25952 - DNA, 30 bp, Homo sapiens
acttccataaattgctcccctgtgcagacg

SEQ ID NO: 25953 - DNA, 30 bp, Homo sapiens
gccaggcactggtcatcatggccacgaact

SEQ ID NO: 25954 - DNA, 30 bp, Homo sapiens
ccatggagtacgtaagatgttaacaaagtc

SEQ ID NO: 25955 - DNA, 30 bp, Homo sapiens
tcaaccttgccattgccattgtcattcaga

SEQ ID NO: 25956 - DNA, 30 bp, Homo sapiens
tccaggcggttctcatcatgatgatgaagt

SEQ ID NO: 25957 - DNA, 30 bp, Homo sapiens
ttgtagctgagtatcttgttccagtcgatt

SEQ ID NO: 25958 - DNA, 30 bp, Homo sapiens
ttgtagctaaggatcttgttccaatcaatc

SEQ ID NO: 25959 - DNA, 30 bp, Homo sapiens
gcacaacacacttcttgaataaatgacata

SEQ ID NO: 25960 - DNA, 30 bp, Homo sapiens
accaggtcattcttcagagcttcttgtttt

SEQ ID NO: 25961 - DNA, 30 bp, Homo sapiens
caaaggcattgttggcttccacctccagct

SEQ ID NO: 25962 - DNA, 30 bp, Homo sapiens
cattcttcagagcttcttgttttgatttgt

SEQ ID NO: 25963 - DNA, 30 bp, Homo sapiens
atcaggctggatgtagatctggcgctgggt

SEQ ID NO: 25964 - DNA, 30 bp, Homo sapiens
gcctcactgctgctggggcagcctctgctg

SEQ ID NO: 25965 - DNA, 30 bp, Homo sapiens
cacagctggtcctcgtccacccagatggtc

SEQ ID NO: 25966 - DNA, 30 bp, Homo sapiens
cccaggaaagagcagaggcccagcccagag

SEQ ID NO: 25967 - DNA, 30 bp, Homo sapiens
catcgggggctctgctccgtccacaccacc

SEQ ID NO: 25968 - DNA, 30 bp, Homo sapiens
acctggagtagttggggatggtgccgtgcg

SEQ ID NO: 25969 - DNA, 30 bp, Homo sapiens
tccaggtatcggacctgctgagagtcccag

SEQ ID NO: 25970 - DNA, 30 bp, Homo sapiens
tgcaactctttacctaaacctgggattcta

SEQ ID NO: 25971 - DNA, 30 bp, Homo sapiens
aaggaagtactatttgagaatcttgtgtag

SEQ ID NO: 25972 - DNA, 30 bp, Homo sapiens
tttgaggcaagttgagggtcttcttcacag

SEQ ID NO: 25973 - DNA, 30 bp, Homo sapiens
gccaggaaggccagcaggtagcggctgaca

SEQ ID NO: 25974 - DNA, 30 bp, Homo sapiens
cctaggtcatctgccaggaaggccagcagg

SEQ ID NO: 25975 - DNA, 30 bp, Homo sapiens
cctcttctgccctgcttttgagtggtgtgc

SEQ ID NO: 25976 - DNA, 30 bp, Homo sapiens
gtatcatttgtcacacaggcctcagcctga

SEQ ID NO: 25977 - DNA, 30 bp, Homo sapiens
acgaggtaagggtccctttcactaatgctt

SEQ ID NO: 25978 - DNA, 30 bp, Homo sapiens
agctggagatccacttgggcattactttca

SEQ ID NO: 25979 - DNA, 30 bp, Homo sapiens
agcgcgcaggagggggattcaaaggttggc

SEQ ID NO: 25980 - DNA, 30 bp, Homo sapiens
gtgtcggtgttgtcgctgcccgtggtgttc

SEQ ID NO: 25981 - DNA, 30 bp, Homo sapiens
aacaaacggccccaatgcccggcagtccgg

SEQ ID NO: 25982 - DNA, 30 bp, Homo sapiens
acaatgctggttctttgggttcttgtttaa

SEQ ID NO: 25983 - DNA, 30 bp, Homo sapiens
aaatggtactttctggattttcttcaactg

SEQ ID NO: 25984 - DNA, 30 bp, Homo sapiens
ttttagctctcgctctgtcaccaaaaccct

SEQ ID NO: 25985 - DNA, 30 bp, Homo sapiens
agatggtgagaggttgttgcaatggtcata

SEQ ID NO: 25986 - DNA, 30 bp, Homo sapiens
gctcccgtagtgcatggtgttggtcgggat

SEQ ID NO: 25987 - DNA, 30 bp, Homo sapiens
ccccggagtcattagatttgctgccttgat

SEQ ID NO: 25988 - DNA, 30 bp, Homo sapiens
gattggggccgccgcctctttggtctgtgg

SEQ ID NO: 25989 - DNA, 30 bp, Homo sapiens
tcctggctcactggttcctgtggggtcagg

SEQ ID NO: 25990 - DNA, 30 bp, Homo sapiens
ttgtggcttacggaccacaaacaagacaca

SEQ ID NO: 25991 - DNA, 30 bp, Homo sapiens
gacaggaagtgggcaacagggtagctgggc

SEQ ID NO: 25992 - DNA, 30 bp, Homo sapiens
tcttggcttgccctttgctgagctctttgc

SEQ ID NO: 25993 - DNA, 30 bp, Homo sapiens
cactggaagcttccattctgggccatctgc

SEQ ID NO: 25994 - DNA, 30 bp, Homo sapiens
acttggcggtgaagcttgttgaccgttgtc

SEQ ID NO: 25995 - DNA, 30 bp, Homo sapiens
cccgctgatttttggtcttttgtcctttga

SEQ ID NO: 25996 - DNA, 30 bp, Homo sapiens
cataagcacttcaggaggaaggaattgcag

SEQ ID NO: 25997 - DNA, 30 bp, Homo sapiens
atctggtagagagcagcatgtggcacacag

SEQ ID NO: 25998 - DNA, 30 bp, Homo sapiens
gctccaaccaaatgcaaaagcagaacttag

SEQ ID NO: 25999 - DNA, 30 bp, Homo sapiens
gaaatcgctagctgcgcatccgcggaagaa

SEQ ID NO: 26000 - DNA, 30 bp, Homo sapiens
gtggagggggcttgatggtgactggctggg

SEQ ID NO: 26001 - DNA, 30 bp, Homo sapiens
taaaggacatcattgaaatgttgctttcca

SEQ ID NO: 26002 - DNA, 30 bp, Homo sapiens
ttttcaagagagatgagttatctttaggaa

SEQ ID NO: 26003 - DNA, 30 bp, Homo sapiens
agacccaggagacagggacccactgtgggg

SEQ ID NO: 26004 - DNA, 30 bp, Homo sapiens
gcatggcatccagctggtcggccaggtcgt

SEQ ID NO: 26005 - DNA, 30 bp, Homo sapiens
gcatggcgtccagctggtcagccagggcgt

SEQ ID NO: 26006 - DNA, 30 bp, Homo sapiens
aagaggtagaaacatcttgtcaaagtcact

SEQ ID NO: 26007 - DNA, 30 bp, Homo sapiens
ctgtccttcagggaggtaaagctgtggttg

SEQ ID NO: 26008 - DNA, 30 bp, Homo sapiens
gcgcatggggggtcgaggtgtctgcgcaga

SEQ ID NO: 26009 - DNA, 30 bp, Homo sapiens
tccaggggcacagggaatactagttttttc

SEQ ID NO: 26010 - DNA, 30 bp, Homo sapiens
tacaggtcatctggcgagtttccacggtct

SEQ ID NO: 26011 - DNA, 30 bp, Homo sapiens
caatggtgggcagctgggtcagtatatttg

SEQ ID NO: 26012 - DNA, 30 bp, Homo sapiens
ttccggagggtgctttggatttcagggttc

SEQ ID NO: 26013 - DNA, 30 bp, Homo sapiens
agaaggaggtgcccaagggatccaatagca

SEQ ID NO: 26014 - DNA, 30 bp, Homo sapiens
atgtgggagggtgtcctgggaacaggtaga

SEQ ID NO: 26015 - DNA, 30 bp, Homo sapiens
gcatggaaacaatacatggaatctgtttct

SEQ ID NO: 26016 - DNA, 30 bp, Homo sapiens
aagaggtagaaatatcttgtcatggacagt

SEQ ID NO: 26017 - DNA, 30 bp, Homo sapiens
aagaggtagaaatctcttgtcaaggttgct

SEQ ID NO: 26018 - DNA, 30 bp, Homo sapiens
aacagggaacctgcttctttccaattgcac

SEQ ID NO: 26019 - DNA, 30 bp, Homo sapiens
ccctggtgaggatctgcatgatttccaggt

SEQ ID NO: 26020 - DNA, 30 bp, Homo sapiens
ccttggtgagcatggagaccacacagggga

SEQ ID NO: 26021 - DNA, 30 bp, Homo sapiens
tgctgtgaagtttgggcactttctcccgtg

SEQ ID NO: 26022 - DNA, 30 bp, Homo sapiens
atcagaagggaagacaagtttttttcttag

SEQ ID NO: 26023 - DNA, 30 bp, Homo sapiens
tggcggctaaatatgcaaatgttttaaatg

SEQ ID NO: 26024 - DNA, 30 bp, Homo sapiens
gaaattaaagcaaccaggcatctgtttata

SEQ ID NO: 26025 - DNA, 30 bp, Homo sapiens
tgttgatctcgccctccaggacatcctcca

SEQ ID NO: 26026 - DNA, 30 bp, Homo sapiens
agcacatcctcaatccagtcctccagctcc

SEQ ID NO: 26027 - DNA, 30 bp, Homo sapiens
ccactgatgacaaagctctgtgaactggac

SEQ ID NO: 26028 - DNA, 30 bp, Homo sapiens
cccagtgtccctctgaactgccgcgtgtgt

SEQ ID NO: 26029 - DNA, 30 bp, Homo sapiens
gcttggaagtttcctctgttgtctttgctg

SEQ ID NO: 26030 - DNA, 30 bp, Homo sapiens
gaagccaggccttcctgccgccgctggagg

SEQ ID NO: 26031 - DNA, 30 bp, Homo sapiens
tagtgcttctctgcttggctgaccttcagg

SEQ ID NO: 26032 - DNA, 30 bp, Homo sapiens
tcctggaactggaggaatccgggtttgacc

SEQ ID NO: 26033 - DNA, 30 bp, Homo sapiens
gggcgaggaggctgcagtgggcgcggggcc

SEQ ID NO: 26034 - DNA, 30 bp, Homo sapiens
agatttgccttctcccttgccgccaagtga

SEQ ID NO: 26035 - DNA, 30 bp, Homo sapiens
taggccgcccccgagcgggcgtctccctcc

SEQ ID NO: 26036 - DNA, 30 bp, Homo sapiens
gtcctcttctccagcctcaaatgtggtgtc

SEQ ID NO: 26037 - DNA, 30 bp, Homo sapiens
tcatcagtgcctgcactgcaaactcttgta

SEQ ID NO: 26038 - DNA, 30 bp, Homo sapiens
tacttctcatccaccttttccaaggactgg

SEQ ID NO: 26039 - DNA, 30 bp, Homo sapiens
ttaaggagtatttgtgagctagagtcatga

SEQ ID NO: 26040 - DNA, 30 bp, Homo sapiens
ttggaatgtcctccacggatggatgccttg

SEQ ID NO: 26041 - DNA, 30 bp, Homo sapiens
cagtggtcagacctgcctccgtgaggagtg

SEQ ID NO: 26042 - DNA, 30 bp, Homo sapiens
acttcttctagtgggaggtgcttgttaagt

SEQ ID NO: 26043 - DNA, 30 bp, Homo sapiens
aagtggttcataaatatatcgtctataaat

SEQ ID NO: 26044 - DNA, 30 bp, Homo sapiens
ccacggcttccttgggttcagccctgtcct

SEQ ID NO: 26045 - DNA, 30 bp, Homo sapiens
gctccggcgcttcttgagcccttcgatgta

SEQ ID NO: 26046 - DNA, 30 bp, Homo sapiens
atgcggacattgctgaatattttcccaaca

SEQ ID NO: 26047 - DNA, 30 bp, Homo sapiens
tcctggctcagttgcaggctgacagaagag

SEQ ID NO: 26048 - DNA, 30 bp, Homo sapiens
ctccagacctggggtccaagtattcaatcc

SEQ ID NO: 26049 - DNA, 30 bp, Homo sapiens
tccgcagcaccaccttgatgctgctgcaga

SEQ ID NO: 26050 - DNA, 30 bp, Homo sapiens
gcacggcgtccgactcctcggtgatctcca

SEQ ID NO: 26051 - DNA, 30 bp, Homo sapiens
aggaggtctggtgcacctggagcacggcgg

SEQ ID NO: 26052 - DNA, 30 bp, Homo sapiens
ggctacactctccatttggagcagagcttc

SEQ ID NO: 26053 - DNA, 30 bp, Homo sapiens
tacgatgagtgctttaaatctaacaaaaga

SEQ ID NO: 26054 - DNA, 30 bp, Homo sapiens
ctctccctgcttccctcctctggtccatgc

SEQ ID NO: 26055 - DNA, 30 bp, Homo sapiens
cgttggtgtcgatagctgtcacagaagcag

SEQ ID NO: 26056 - DNA, 30 bp, Homo sapiens
cagcggggcacggtgtccagtgggccaggt

SEQ ID NO: 26057 - DNA, 30 bp, Homo sapiens
cctaaattggaaccaggactagggtcttgt

SEQ ID NO: 26058 - DNA, 30 bp, Homo sapiens
actgccagcagctgtgaaactctcacctcc

SEQ ID NO: 26059 - DNA, 30 bp, Homo sapiens
acatgggcaggagaagaaatggaaacaaat

SEQ ID NO: 26060 - DNA, 30 bp, Homo sapiens
acgtggggatactggaggagggaaggcaaa

SEQ ID NO: 26061 - DNA, 30 bp, Homo sapiens
ggccggggcagggtcctggggtcccagcgc

SEQ ID NO: 26062 - DNA, 30 bp, Homo sapiens
atctggatgatgtggtccaggaagtggggt

SEQ ID NO: 26063 - DNA, 30 bp, Homo sapiens
agagaggaaacaccaggaatccggagaagg

SEQ ID NO: 26064 - DNA, 30 bp, Homo sapiens
tagaggaaacaccaagaagcccgagaatgt

SEQ ID NO: 26065 - DNA, 30 bp, Homo sapiens
accaggacctggtcgaagtagatggcccca

SEQ ID NO: 26066 - DNA, 30 bp, Homo sapiens
gggggaacaccagaaagccagaaaacgtgg

SEQ ID NO: 26067 - DNA, 30 bp, Homo sapiens
caccactgttcaactctcttctctgaaaca

SEQ ID NO: 26068 - DNA, 30 bp, Homo sapiens
ttgcacaactttgtcatggaccaactggcc

SEQ ID NO: 26069 - DNA, 30 bp, Homo sapiens
tccactaccagaacatgccctgtaatatac

SEQ ID NO: 26070 - DNA, 30 bp, Homo sapiens
ttctggtcccgctcctgggcggccacgaag

SEQ ID NO: 26071 - DNA, 30 bp, Homo sapiens
cttttctgtttctgtcacagtagctataaa

SEQ ID NO: 26072 - DNA, 30 bp, Homo sapiens
ttcactgaacagcagaggcaaccgtttcta

SEQ ID NO: 26073 - DNA, 30 bp, Homo sapiens
tagtggtatttcacttttaatccatatttt

SEQ ID NO: 26074 - DNA, 30 bp, Homo sapiens
ccgaggggtaggaatgccacgtcagccttt

SEQ ID NO: 26075 - DNA, 30 bp, Homo sapiens
gtacgcatgcttcctgttcctttccgtccc

SEQ ID NO: 26076 - DNA, 30 bp, Homo sapiens
ctcaggttgaagaagcccacgctggtggga

SEQ ID NO: 26077 - DNA, 30 bp, Homo sapiens
tcgccagcaccaagtctgcctcatctgaat

SEQ ID NO: 26078 - DNA, 30 bp, Homo sapiens
acaccgtcacgtactccttgaaagtaacgg

SEQ ID NO: 26079 - DNA, 30 bp, Homo sapiens
gctctttgctgtttctttctctttgttttc

SEQ ID NO: 26080 - DNA, 30 bp, Homo sapiens
cacttgctcgccccaatgctgccaccgccc

SEQ ID NO: 26081 - DNA, 30 bp, Homo sapiens
ctgcggtctcggaagaagccctcagctgcc

SEQ ID NO: 26082 - DNA, 30 bp, Homo sapiens
tccgtgttactttccttaatggtgacggtc

SEQ ID NO: 26083 - DNA, 30 bp, Homo sapiens
ttccggctgatcctcagttcatccagttcc

SEQ ID NO: 26084 - DNA, 30 bp, Homo sapiens
cgcacggctggatcatgagcacgcccgcgc

SEQ ID NO: 26085 - DNA, 30 bp, Homo sapiens
ctgcggagccgctgcagctcactctctacc

SEQ ID NO: 26086 - DNA, 30 bp, Homo sapiens
cacaagcccctgggctccagaaccagccag

SEQ ID NO: 26087 - DNA, 30 bp, Homo sapiens
ggctccagaaccagccagttctcagtgacc

SEQ ID NO: 26088 - DNA, 30 bp, Homo sapiens
gcctctccggactgtcatactcaggaggcg

SEQ ID NO: 26089 - DNA, 30 bp, Homo sapiens
gcctggcctgcccaggctctttttaacaac

SEQ ID NO: 26090 - DNA, 30 bp, Homo sapiens
gcgtataagagaggcaacatagatccaaac

SEQ ID NO: 26091 - DNA, 30 bp, Homo sapiens
agacccacacagataatatgttgtttgggt

SEQ ID NO: 26092 - DNA, 30 bp, Homo sapiens
acctggagaactacttggtacaaaaatatt

SEQ ID NO: 26093 - DNA, 30 bp, Homo sapiens
ccttggatttttgatctttgtcttcattct

SEQ ID NO: 26094 - DNA, 30 bp, Homo sapiens
gttgctaggtgccggctcctccttctccac

SEQ ID NO: 26095 - DNA, 30 bp, Homo sapiens
tatgggtagaagtctctgggggctctcaag

SEQ ID NO: 26096 - DNA, 30 bp, Homo sapiens
acctggatttgcaggtcctcgtcctcgtcc

SEQ ID NO: 26097 - DNA, 30 bp, Homo sapiens
ttgcaagtgcctgagttcagtctctaagtt

SEQ ID NO: 26098 - DNA, 30 bp, Homo sapiens
tcctggaaggtccttccctgaatagtgtga

SEQ ID NO: 26099 - DNA, 30 bp, Homo sapiens
tctcgggctggaggggggctttctaccggg

SEQ ID NO: 26100 - DNA, 30 bp, Homo sapiens
cagtcaacctggtacagctccagcagctcc

SEQ ID NO: 26101 - DNA, 30 bp, Homo sapiens
taggggtccgcgctgctcttgctgcgcggc

SEQ ID NO: 26102 - DNA, 30 bp, Homo sapiens
gaagcggtaggtgatgggcagcagcagctt

SEQ ID NO: 26103 - DNA, 30 bp, Homo sapiens
aaaaagggggtccagctgggccatcaggtt

SEQ ID NO: 26104 - DNA, 30 bp, Homo sapiens
gctgtcgtccctccttcccagccaaggctg

SEQ ID NO: 26105 - DNA, 30 bp, Homo sapiens
tcgtggatggtccatagcttcatgttcaga

SEQ ID NO: 26106 - DNA, 30 bp, Homo sapiens
gatgcttgagagttctgtctttaactttga

SEQ ID NO: 26107 - DNA, 30 bp, Homo sapiens
ctccaggttggaatagccctatgtgggata

SEQ ID NO: 26108 - DNA, 30 bp, Homo sapiens
gcaaggtaatctgcctgcaactgctcattg

SEQ ID NO: 26109 - DNA, 30 bp, Homo sapiens
ccccgggagtctttgctggtggaggagccc

SEQ ID NO: 26110 - DNA, 30 bp, Homo sapiens
cccaggctccagctgcttgagtttctcttg

SEQ ID NO: 26111 - DNA, 30 bp, Homo sapiens
tcatccttgtcctcatcctggtcttcatcc

SEQ ID NO: 26112 - DNA, 30 bp, Homo sapiens
gagtggtgggtcaaggagcccttctcctgc

SEQ ID NO: 26113 - DNA, 30 bp, Homo sapiens
cttcttctgtgctagtagctgtctccaaac

SEQ ID NO: 26114 - DNA, 30 bp, Homo sapiens
agtcggagtcacaggtcttttgttcggtgg

SEQ ID NO: 26115 - DNA, 30 bp, Homo sapiens
tccccggggtctgggtgtcagaactggagg

SEQ ID NO: 26116 - DNA, 30 bp, Homo sapiens
agtaaaagcaccccccatacctgccagaga

SEQ ID NO: 26117 - DNA, 30 bp, Homo sapiens
tttggtgccttggggaagactgggtgtggt

SEQ ID NO: 26118 - DNA, 30 bp, Homo sapiens
ccactgtcgtctatttgactgaagcttgtt

SEQ ID NO: 26119 - DNA, 30 bp, Homo sapiens
acttgggggcattgaagggcacggcccgct

SEQ ID NO: 26120 - DNA, 30 bp, Homo sapiens
ttgaggactgtcctggtcttccatcctctt

SEQ ID NO: 26121 - DNA, 30 bp, Homo sapiens
gaatgggatcttttaagagttctatagttt

SEQ ID NO: 26122 - DNA, 30 bp, Homo sapiens
tcccactagtaccattggtggtgttggctg

SEQ ID NO: 26123 - DNA, 30 bp, Homo sapiens
atttgagatagagccacatgagtctgccat

SEQ ID NO: 26124 - DNA, 30 bp, Homo sapiens
ctccaacaggacaatttgacaaaggggttg

SEQ ID NO: 26125 - DNA, 30 bp, Homo sapiens
tcttgtgtcttcagaaagtcttttgatttt

SEQ ID NO: 26126 - DNA, 30 bp, Homo sapiens
gcttgcctgtcttctgctgccgcagggcct

SEQ ID NO: 26127 - DNA, 30 bp, Homo sapiens
agtcggagtagtccgccacgagggaggagc

SEQ ID NO: 26128 - DNA, 30 bp, Homo sapiens
gactgggatctggagatccttgggcctttt

SEQ ID NO: 26129 - DNA, 30 bp, Homo sapiens
agcaccagagcaaagccgagatgaccacca

SEQ ID NO: 26130 - DNA, 30 bp, Homo sapiens
cagctgcggctctggcttcttccgggaagt

SEQ ID NO: 26131 - DNA, 30 bp, Homo sapiens
tccaggaaaggctgcaaggattctttacac

SEQ ID NO: 26132 - DNA, 30 bp, Homo sapiens
aagaggaggcctgagaagaaaatgaagaga

SEQ ID NO: 26133 - DNA, 30 bp, Homo sapiens
tcatctggagcaaactatcaataacattag

SEQ ID NO: 26134 - DNA, 30 bp, Homo sapiens
taagggcttgcactggagaccagggagtta

SEQ ID NO: 26135 - DNA, 30 bp, Homo sapiens
gaccagtccttaaagacttctggagtctag

SEQ ID NO: 26136 - DNA, 30 bp, Homo sapiens
cctcttccccaattttgaaagagtgagggg

SEQ ID NO: 26137 - DNA, 30 bp, Homo sapiens
gtgaggagccagtacattagggacacacta

SEQ ID NO: 26138 - DNA, 30 bp, Homo sapiens
agaaggtgtgatccatttaatgccattctt

SEQ ID NO: 26139 - DNA, 30 bp, Homo sapiens
gattcaggactggttcccaggcaggaaaaa

SEQ ID NO: 26140 - DNA, 30 bp, Homo sapiens
tataggatccaggttcatatttagtagcag

SEQ ID NO: 26141 - DNA, 30 bp, Homo sapiens
tctttttcctcttgcaaagatgtggtgatg

SEQ ID NO: 26142 - DNA, 30 bp, Homo sapiens
gtgcctcatattggctccaggttcactggg

SEQ ID NO: 26143 - DNA, 30 bp, Homo sapiens
cctttcttggaggtttttgaggactaattt

SEQ ID NO: 26144 - DNA, 30 bp, Homo sapiens
tatgtcttccaactgcagattaaagtcttg

SEQ ID NO: 26145 - DNA, 30 bp, Homo sapiens
caggttttcacggtgctcctcatgcctccg

SEQ ID NO: 26146 - DNA, 30 bp, Homo sapiens
gtgtgcagaagcaaaattatgaattgcgac

SEQ ID NO: 26147 - DNA, 30 bp, Homo sapiens
tacctcagaatgatacttcttgggcatggg

SEQ ID NO: 26148 - DNA, 30 bp, Homo sapiens
agagcgacggtgcttcttgtgactttcgat

SEQ ID NO: 26149 - DNA, 30 bp, Homo sapiens
acgcttaaggtgagaatctttgccaacaga

SEQ ID NO: 26150 - DNA, 30 bp, Homo sapiens
actaggggctggtggcctcaaagatccagg

SEQ ID NO: 26151 - DNA, 30 bp, Homo sapiens
ttctggataaacagtgagggtgtgagctgc

SEQ ID NO: 26152 - DNA, 30 bp, Homo sapiens
acactggagggggctggaggtagcagagct

SEQ ID NO: 26153 - DNA, 30 bp, Homo sapiens
cctgtcgatgaccagctccagcagcacggc

SEQ ID NO: 26154 - DNA, 30 bp, Homo sapiens
acatgggccgctcctggggctggtgtgcag

SEQ ID NO: 26155 - DNA, 30 bp, Homo sapiens
tttgcaagctttctagtctgttctgaagct

SEQ ID NO: 26156 - DNA, 30 bp, Homo sapiens
ttgctgaaaggtggctgggagaggtcctgg

SEQ ID NO: 26157 - DNA, 30 bp, Homo sapiens
taaagtggtcaaggatacttgatgatgtta

SEQ ID NO: 26158 - DNA, 30 bp, Homo sapiens
gaggcttctgccgcagcttcagcgttcacg

SEQ ID NO: 26159 - DNA, 30 bp, Homo sapiens
acatggtccagtaggcatagacgagcgtca

SEQ ID NO: 26160 - DNA, 30 bp, Homo sapiens
gtaagggaccccgagagcgaccccaacaac

SEQ ID NO: 26161 - DNA, 30 bp, Homo sapiens
ccaaggttgaggacccatgtaagcaggcgg

SEQ ID NO: 26162 - DNA, 30 bp, Homo sapiens
ggatggagttctggaagatggtttggtctt

SEQ ID NO: 26163 - DNA, 30 bp, Homo sapiens
cactgggggcaagtcagaactgtggtgagg

SEQ ID NO: 26164 - DNA, 30 bp, Homo sapiens
ttgtgggtgcctctcttgcccagtagtcac

SEQ ID NO: 26165 - DNA, 30 bp, Homo sapiens
tgagttggtctgttggcattagcagacata

SEQ ID NO: 26166 - DNA, 30 bp, Homo sapiens
gatctttctgtgccaatgtcaactccaaaa

SEQ ID NO: 26167 - DNA, 30 bp, Homo sapiens
aaaacctagccttctctttgacttttgaaa

SEQ ID NO: 26168 - DNA, 30 bp, Homo sapiens
tgggggcttgtggtgggttgtcgggggcag

SEQ ID NO: 26169 - DNA, 30 bp, Homo sapiens
cactgggaaatgaacccttgtacgaatgtg

SEQ ID NO: 26170 - DNA, 30 bp, Homo sapiens
ttgcggtccaggctggcgtgtagctgggcc

SEQ ID NO: 26171 - DNA, 30 bp, Homo sapiens
ttttcgcatgtgccatctgtcaaagtctgg

SEQ ID NO: 26172 - DNA, 30 bp, Homo sapiens
tctggaataggagaaggccttgaaaacctt

SEQ ID NO: 26173 - DNA, 30 bp, Homo sapiens
aagcgtgttaaagtcattattctcagaact

SEQ ID NO: 26174 - DNA, 30 bp, Homo sapiens
ttggacttgttgatgcaaattgcttacagt

SEQ ID NO: 26175 - DNA, 30 bp, Homo sapiens
tacaggccttggatagtgtgcagggactgc

SEQ ID NO: 26176 - DNA, 30 bp, Homo sapiens
acttggcactggaagtgtcgttgatgaaca

SEQ ID NO: 26177 - DNA, 30 bp, Homo sapiens
aggtggtgctgtaactgtttagaacgctta

SEQ ID NO: 26178 - DNA, 30 bp, Homo sapiens
gcctggctcttcttggtggcacgcagggcg

SEQ ID NO: 26179 - DNA, 30 bp, Homo sapiens
tcttggccgccttgagcttcccctcgatta

SEQ ID NO: 26180 - DNA, 30 bp, Homo sapiens
cacagggaggcctcgccctccagttgcagc

SEQ ID NO: 26181 - DNA, 30 bp, Homo sapiens
ttctgctgacaggcacggagctgggcctct

SEQ ID NO: 26182 - DNA, 30 bp, Homo sapiens
ttctagttcatgctggtgtttaataagacg

SEQ ID NO: 26183 - DNA, 30 bp, Homo sapiens
atttggtactcgatgttctgcaaactccgt

SEQ ID NO: 26184 - DNA, 30 bp, Homo sapiens
ataacgaggcgtggatgctctccacgtgga

SEQ ID NO: 26185 - DNA, 30 bp, Homo sapiens
agaagggcaggaagccgtccactttgaggc

SEQ ID NO: 26186 - DNA, 30 bp, Homo sapiens
acttggtcttgctcttgcctttacccggag

SEQ ID NO: 26187 - DNA, 30 bp, Homo sapiens
gccaggcccggttcctcttctccctggggc

SEQ ID NO: 26188 - DNA, 30 bp, Homo sapiens
gagaggaagaaacttagaaggcaccctgtt

SEQ ID NO: 26189 - DNA, 30 bp, Homo sapiens
ttgtcttactcaaggaccaagtatctgatt

SEQ ID NO: 26190 - DNA, 30 bp, Homo sapiens
cacaggtgggatgtcatgagtagagaaaac

SEQ ID NO: 26191 - DNA, 30 bp, Homo sapiens
aattcttcagtgcttcatctggcaatgacc

SEQ ID NO: 26192 - DNA, 30 bp, Homo sapiens
tacaggccggagcactctgaagcatggggg

SEQ ID NO: 26193 - DNA, 30 bp, Homo sapiens
tcctggtcctcaccagtgctcgtggcttct

SEQ ID NO: 26194 - DNA, 30 bp, Homo sapiens
cccgggacctctgttcaagatttcatcagg

SEQ ID NO: 26195 - DNA, 30 bp, Homo sapiens
gcctcccggacccggcctaggaggccagcg

SEQ ID NO: 26196 - DNA, 30 bp, Homo sapiens
aggctggggcttggggtgctgcactggaca

SEQ ID NO: 26197 - DNA, 30 bp, Homo sapiens
actcggtgaccagcccttcaggctggggct

SEQ ID NO: 26198 - DNA, 30 bp, Homo sapiens
ttcatccatttccctcttcttcttcatttc

SEQ ID NO: 26199 - DNA, 30 bp, Homo sapiens
atgctattggccttcacaaggtgggcacag

SEQ ID NO: 26200 - DNA, 30 bp, Homo sapiens
acttggaggtccccttcttggatttgctgg

SEQ ID NO: 26201 - DNA, 30 bp, Homo sapiens
aaatggagtttttgtatggaagaattcaat

SEQ ID NO: 26202 - DNA, 30 bp, Homo sapiens
cagcggactgctcctcaggctcggcgttct

SEQ ID NO: 26203 - DNA, 30 bp, Homo sapiens
cctgggtttgggcagtctgtggctaaatct

SEQ ID NO: 26204 - DNA, 30 bp, Homo sapiens
acccccgcaggtagggggggcgcacgggcc

SEQ ID NO: 26205 - DNA, 30 bp, Homo sapiens
gtctccttcagagaagccacatttatgtat

SEQ ID NO: 26206 - DNA, 30 bp, Homo sapiens
atcagaatcaagtccatccacaaagaactc

SEQ ID NO: 26207 - DNA, 30 bp, Homo sapiens
tgctggcttgtccccggctgctggctcgtc

SEQ ID NO: 26208 - DNA, 30 bp, Homo sapiens
gactttgggggtgcggtggcttcctgctcc

SEQ ID NO: 26209 - DNA, 30 bp, Homo sapiens
tagcggtctccttctgggggctcaagggct

SEQ ID NO: 26210 - DNA, 30 bp, Homo sapiens
tcccctccttacttgctcattctttttctg

SEQ ID NO: 26211 - DNA, 30 bp, Homo sapiens
ccaaggcaaagattgctcctggctttatga

SEQ ID NO: 26212 - DNA, 30 bp, Homo sapiens
tcatcactgctatcaaaacccaggtcatag

SEQ ID NO: 26213 - DNA, 30 bp, Homo sapiens
agatggaggttttgaatgaaagacaagtcg

SEQ ID NO: 26214 - DNA, 30 bp, Homo sapiens
agatggcctagaagggctgcctactagtga

SEQ ID NO: 26215 - DNA, 30 bp, Homo sapiens
aggagggccctggtgactcgagcttgttgg

SEQ ID NO: 26216 - DNA, 30 bp, Homo sapiens
tcgcggatccggttatctacagcagcaccg

SEQ ID NO: 26217 - DNA, 30 bp, Homo sapiens
ttcgtgcacgtgcctgcgcgcgtcccttgt

SEQ ID NO: 26218 - DNA, 30 bp, Homo sapiens
taaatccggactcgctgttgttccttcttt

SEQ ID NO: 26219 - DNA, 30 bp, Homo sapiens
tctgtgtcctttttttttccttttccttgc

SEQ ID NO: 26220 - DNA, 30 bp, Homo sapiens
cattggtgtttcggaacagaatcctcttca

SEQ ID NO: 26221 - DNA, 30 bp, Homo sapiens
acatggctttcactttgatttgtttcattt

SEQ ID NO: 26222 - DNA, 30 bp, Homo sapiens
tgagaggactctgattttgagaaatgccgt

SEQ ID NO: 26223 - DNA, 30 bp, Homo sapiens
agctggctttgaatagcatgtagagcacag

SEQ ID NO: 26224 - DNA, 30 bp, Homo sapiens
ttgtggtcaagctcaaaatgggcccagtga

SEQ ID NO: 26225 - DNA, 30 bp, Homo sapiens
tcttggggggcctctggcagcctttagctt

SEQ ID NO: 26226 - DNA, 30 bp, Homo sapiens
tagcgggcacccacctctctcccaagggcc

SEQ ID NO: 26227 - DNA, 30 bp, Homo sapiens
attcggcagcgttcattaaacaccttccag

SEQ ID NO: 26228 - DNA, 30 bp, Homo sapiens
ctttgggcttcttctctctcctgttttctc

SEQ ID NO: 26229 - DNA, 30 bp, Homo sapiens
ggctgggaggaggggtgcgccgaatgttgc

SEQ ID NO: 26230 - DNA, 30 bp, Homo sapiens
tacctcagggcgctgtagggcccaatgggt

SEQ ID NO: 26231 - DNA, 30 bp, Homo sapiens
tatgaccgcatgtccagtcggttcatgtac

SEQ ID NO: 26232 - DNA, 30 bp, Homo sapiens
ttctgggacctctgacttatttgtggcact

SEQ ID NO: 26233 - DNA, 30 bp, Homo sapiens
acatggttactttcttcctggatctgaagt

SEQ ID NO: 26234 - DNA, 30 bp, Homo sapiens
acctggatgggctatacgtatggacaaggg

SEQ ID NO: 26235 - DNA, 30 bp, Homo sapiens
ggcaggagactactttccaactccttttgc

SEQ ID NO: 26236 - DNA, 30 bp, Homo sapiens
catttccgtaacctaatcaacattaaataa

SEQ ID NO: 26237 - DNA, 30 bp, Homo sapiens
atgtggcgaggaaagagacctcagtgggag

SEQ ID NO: 26238 - DNA, 30 bp, Homo sapiens
gtgtggtacagattttcgggcagcagcatg

SEQ ID NO: 26239 - DNA, 30 bp, Homo sapiens
ctttgggcagtgatctgtggatattcttgg

SEQ ID NO: 26240 - DNA, 30 bp, Homo sapiens
cctcgggagaaggccagcaagcgctgccct

SEQ ID NO: 26241 - DNA, 30 bp, Homo sapiens
atatggcagcaatggctggagccgtattac

SEQ ID NO: 26242 - DNA, 30 bp, Homo sapiens
gcccggggcaccgggaagcggcggagcctc

SEQ ID NO: 26243 - DNA, 30 bp, Homo sapiens
tctcttctgcttttcttttctttggctggt

SEQ ID NO: 26244 - DNA, 30 bp, Homo sapiens
tgcaggcgccgtttctgcattgcctgcagc

SEQ ID NO: 26245 - DNA, 30 bp, Homo sapiens
tggtggagaccttggggaaatgcgtggctt

SEQ ID NO: 26246 - DNA, 30 bp, Homo sapiens
gatgcaggcgccgtttctgcattgcctgca

SEQ ID NO: 26247 - DNA, 30 bp, Homo sapiens
caaacactttcgacttaagattcttcagtt

SEQ ID NO: 26248 - DNA, 30 bp, Homo sapiens
gatttcgtgcttgtacctgcccaggtgctg

SEQ ID NO: 26249 - DNA, 30 bp, Homo sapiens
agctggtcttcttgctctccctgctcagct

SEQ ID NO: 26250 - DNA, 30 bp, Homo sapiens
ccatggtgataactctcatgatgacggtag

SEQ ID NO: 26251 - DNA, 30 bp, Homo sapiens
aaccgggagccaggcaggaacttgttcagg

SEQ ID NO: 26252 - DNA, 30 bp, Homo sapiens
attttcttttgaccgcctgaaaattctttc

SEQ ID NO: 26253 - DNA, 30 bp, Homo sapiens
tcatcttgcactacaaagtcatcgataata

SEQ ID NO: 26254 - DNA, 30 bp, Homo sapiens
ttctgggctcctgacatctttatagagttt

SEQ ID NO: 26255 - DNA, 30 bp, Homo sapiens
gcgtccattattccagacgcggccaaaaga

SEQ ID NO: 26256 - DNA, 30 bp, Homo sapiens
tccaggacacgaacctgcagcatctccaag

SEQ ID NO: 26257 - DNA, 30 bp, Homo sapiens
cattggtcctttgtactggtttcctgacaa

SEQ ID NO: 26258 - DNA, 30 bp, Homo sapiens
atcatcgggggaacaggccaggggcaactg

SEQ ID NO: 26259 - DNA, 30 bp, Homo sapiens
caaaggccccttgaactggttcccagacag

SEQ ID NO: 26260 - DNA, 30 bp, Homo sapiens
tcttggctgccggctgctggggcggctgct

SEQ ID NO: 26261 - DNA, 30 bp, Homo sapiens
taaaggctggctgctgagctcctgaacagg

SEQ ID NO: 26262 - DNA, 30 bp, Homo sapiens
agctggtggtgaatcaactgatataggcag

SEQ ID NO: 26263 - DNA, 30 bp, Homo sapiens
cactggctgagggatggggtgaggggacgt

SEQ ID NO: 26264 - DNA, 30 bp, Homo sapiens
tcataccacacggtctgcggatccccgccg

SEQ ID NO: 26265 - DNA, 30 bp, Homo sapiens
ggagagagatggcggagtttgccattgagt

SEQ ID NO: 26266 - DNA, 30 bp, Homo sapiens
aaaaggccaggcctcacccggggagagggc

SEQ ID NO: 26267 - DNA, 30 bp, Homo sapiens
gctattgccaggcaagtaaacaccgaagct

SEQ ID NO: 26268 - DNA, 30 bp, Homo sapiens
cacaggagaggaacagttccaaactggaca

SEQ ID NO: 26269 - DNA, 30 bp, Homo sapiens
ctgagtgcttcctcaccaccttgcctccgt

SEQ ID NO: 26270 - DNA, 30 bp, Homo sapiens
aggaggccttcgctttcaccttggacagca

SEQ ID NO: 26271 - DNA, 30 bp, Homo sapiens
ctgtcgtcactgtccaggtatgcacccagt

SEQ ID NO: 26272 - DNA, 30 bp, Homo sapiens
agaagggagaaaggctttggcctccctgat

SEQ ID NO: 26273 - DNA, 30 bp, Homo sapiens
gtccccatccagctctgggctgggcgcatc

SEQ ID NO: 26274 - DNA, 30 bp, Homo sapiens
ccatgaacagggattcctgtggcactttgg

SEQ ID NO: 26275 - DNA, 30 bp, Homo sapiens
ctcctgagctgctcccccagcgtctctgtc

SEQ ID NO: 26276 - DNA, 30 bp, Homo sapiens
atctggggattggagctggagcatctgtca

SEQ ID NO: 26277 - DNA, 30 bp, Homo sapiens
aagaatcttgcaaggtagcttggctagaca

SEQ ID NO: 26278 - DNA, 30 bp, Homo sapiens
aggaggggtactcatactcctcggcactgc

SEQ ID NO: 26279 - DNA, 30 bp, Homo sapiens
cactggggtggcaccgaggcactcatatgg

SEQ ID NO: 26280 - DNA, 30 bp, Homo sapiens
gccagggcccagtgtgctgatggtggtgta

SEQ ID NO: 26281 - DNA, 30 bp, Homo sapiens
catttttctgtgcctctgaacccatccaac

SEQ ID NO: 26282 - DNA, 30 bp, Homo sapiens
ttttggtccagatacttcatggaatcctgc

SEQ ID NO: 26283 - DNA, 30 bp, Homo sapiens
ttcagggtgtgagctttccggcccaggtgt

SEQ ID NO: 26284 - DNA, 30 bp, Homo sapiens
tgtccttgatatagtcctggacccacttgt

SEQ ID NO: 26285 - DNA, 30 bp, Homo sapiens
ctcccggaccactgggtttggcacagactt

SEQ ID NO: 26286 - DNA, 30 bp, Homo sapiens
cactgggagttgaggagctggggttgacca

SEQ ID NO: 26287 - DNA, 30 bp, Homo sapiens
tcaaggctttgcaggtatttaactgcattc

SEQ ID NO: 26288 - DNA, 30 bp, Homo sapiens
aggcattcagcttcaggtcgctgatgtatt

SEQ ID NO: 26289 - DNA, 30 bp, Homo sapiens
ctgcggcgcttcatcttggctgaggtcctc

SEQ ID NO: 26290 - DNA, 30 bp, Homo sapiens
cttcggagtttgggtttgcttgtccaggtg

SEQ ID NO: 26291 - DNA, 30 bp, Homo sapiens
tctgttttggatttgcgcacacagacaact

SEQ ID NO: 26292 - DNA, 30 bp, Homo sapiens
tttaggggtctgtgaccgctcagtcctctt

SEQ ID NO: 26293 - DNA, 30 bp, Homo sapiens
aggaggcagggaaagtggaatggggggtac

SEQ ID NO: 26294 - DNA, 30 bp, Homo sapiens
tcctggtcttgatccgtgtgtccagcttca

SEQ ID NO: 26295 - DNA, 30 bp, Homo sapiens
gccaggatatctctggacagggcccttgac

SEQ ID NO: 26296 - DNA, 30 bp, Homo sapiens
ttagctgatatcaggagggagacattcctc

SEQ ID NO: 26297 - DNA, 30 bp, Homo sapiens
tttcggagttttcagtaaagaaatgtattt

SEQ ID NO: 26298 - DNA, 30 bp, Homo sapiens
ttccttagcatcccaaaattcagcttgggc

SEQ ID NO: 26299 - DNA, 30 bp, Homo sapiens
gtttcgtgtttcccctgatgtgccctgtta

SEQ ID NO: 26300 - DNA, 30 bp, Homo sapiens
aggcactcagctccaggtcactgacgtatt

SEQ ID NO: 26301 - DNA, 30 bp, Homo sapiens
tccaggtcatacacgtactcctggacccag

SEQ ID NO: 26302 - DNA, 30 bp, Homo sapiens
cctgtggtaggcatcttcctctgcctgacc

SEQ ID NO: 26303 - DNA, 30 bp, Homo sapiens
atctggctttatcccttgcctgtggtaggc

SEQ ID NO: 26304 - DNA, 30 bp, Homo sapiens
ctggctgggagcagaggctgctggtctcat

SEQ ID NO: 26305 - DNA, 30 bp, Homo sapiens
tccctgccagcctggtagtgacttttccac

SEQ ID NO: 26306 - DNA, 30 bp, Homo sapiens
aaggagcgggtggggtaggatagtgagggg

SEQ ID NO: 26307 - DNA, 30 bp, Homo sapiens
tagctcatctccaaagagttgatgtactcc

SEQ ID NO: 26308 - DNA, 30 bp, Homo sapiens
gtttgggttttcttgtccaggtgcttcata

SEQ ID NO: 26309 - DNA, 30 bp, Homo sapiens
gcttcatggaatccctgacccatctctcct

SEQ ID NO: 26310 - DNA, 30 bp, Homo sapiens
tgctgagtcctggtccatgctgcagcccag

SEQ ID NO: 26311 - DNA, 30 bp, Homo sapiens
agcaggcctgtgcaatagtcctggatgggc

SEQ ID NO: 26312 - DNA, 30 bp, Homo sapiens
tgcaggtggctccatgagggacacacacag

SEQ ID NO: 26313 - DNA, 30 bp, Homo sapiens
ctctggtgggttgaggagagaaacaccatg

SEQ ID NO: 26314 - DNA, 30 bp, Homo sapiens
ccacagccttggctaaatcttgaactagtg

SEQ ID NO: 26315 - DNA, 30 bp, Homo sapiens
tagaaacttgctgctgctctaattcacgac

SEQ ID NO: 26316 - DNA, 30 bp, Homo sapiens
accttcctatcagtggggaggcaaggtctt

SEQ ID NO: 26317 - DNA, 30 bp, Homo sapiens
accaggccctgagcctcacaatcacagttc

SEQ ID NO: 26318 - DNA, 30 bp, Homo sapiens
atttggaccctgctctccttcactgtttgg

SEQ ID NO: 26319 - DNA, 30 bp, Homo sapiens
gatgtccacgtcccgcacgtcggtgggtgt

SEQ ID NO: 26320 - DNA, 30 bp, Homo sapiens
cacaggtcgatatcccgcacgtctgtaggg

SEQ ID NO: 26321 - DNA, 30 bp, Homo sapiens
tacaggtgtatggctgtgacatctgtagga

SEQ ID NO: 26322 - DNA, 30 bp, Homo sapiens
atcttctggctgaggggtcacatgacttgc

SEQ ID NO: 26323 - DNA, 30 bp, Homo sapiens
ttccggcccgctgctctgcttcttaccgct

SEQ ID NO: 26324 - DNA, 30 bp, Homo sapiens
tggtggtttttcagtgctcttcggtggtgt

SEQ ID NO: 26325 - DNA, 30 bp, Homo sapiens
acaaggcccaggttcatgtcctcctcctca

SEQ ID NO: 26326 - DNA, 30 bp, Homo sapiens
aagggaccatttcaggaattgttggaaggt

SEQ ID NO: 26327 - DNA, 30 bp, Homo sapiens
cactgggaggagagctgctgagactctcct

SEQ ID NO: 26328 - DNA, 30 bp, Homo sapiens
accaggtcgtcatcagtccattcttcctcc

SEQ ID NO: 26329 - DNA, 30 bp, Homo sapiens
aactgggagctatccatctgtgctttctga

SEQ ID NO: 26330 - DNA, 30 bp, Homo sapiens
aacaggctgcaaaggtggacaaggggaagc

SEQ ID NO: 26331 - DNA, 30 bp, Homo sapiens
agttggcaggtgacacaaagttgtctgtgc

SEQ ID NO: 26332 - DNA, 30 bp, Homo sapiens
gtaagaaacactcagacagggcttaacttc

SEQ ID NO: 26333 - DNA, 30 bp, Homo sapiens
tgtcaaagcagccggtggggaacatgtggc

SEQ ID NO: 26334 - DNA, 30 bp, Homo sapiens
tccaggctgcccgccccagccccccaactg

SEQ ID NO: 26335 - DNA, 30 bp, Homo sapiens
cctgccatgtcctgagcgactgccaccatg

SEQ ID NO: 26336 - DNA, 30 bp, Homo sapiens
ttgaggccaggagttcgtgaccgacctggg

SEQ ID NO: 26337 - DNA, 30 bp, Homo sapiens
cacctccgatgcctgctgtgcccagggtgg

SEQ ID NO: 26338 - DNA, 30 bp, Homo sapiens
cagaggctacccatgaggtctggaccaggt

SEQ ID NO: 26339 - DNA, 30 bp, Homo sapiens
ctcgggggcaggctgcacttctcgcagatc

SEQ ID NO: 26340 - DNA, 30 bp, Homo sapiens
taggggatctctgtgtccatggtataaatc

SEQ ID NO: 26341 - DNA, 30 bp, Homo sapiens
gggtggaagtggtggaggaggttctgatgg

SEQ ID NO: 26342 - DNA, 30 bp, Homo sapiens
gcacttaacagtgagtccagcatgtcgaat

SEQ ID NO: 26343 - DNA, 30 bp, Homo sapiens
cgttggtctccactggcttcttgtccagtt

SEQ ID NO: 26344 - DNA, 30 bp, Homo sapiens
tgatggctggggaccaccggggcagagtca

SEQ ID NO: 26345 - DNA, 30 bp, Homo sapiens
aagagaggatggctttagagcgctgaatac

SEQ ID NO: 26346 - DNA, 30 bp, Homo sapiens
ctttggatttttcctgcatatactcctgaa

SEQ ID NO: 26347 - DNA, 30 bp, Homo sapiens
acctgggtccatatggaggggaaaaagtgt

SEQ ID NO: 26348 - DNA, 30 bp, Homo sapiens
gtcttccattagtgcgaccatatttatgcc

SEQ ID NO: 26349 - DNA, 30 bp, Homo sapiens
agagagttcatgctcccctgtggagggaga

SEQ ID NO: 26350 - DNA, 30 bp, Homo sapiens
ttgtcccaggagagactgtgggtctccgtg

SEQ ID NO: 26351 - DNA, 30 bp, Homo sapiens
ttgtcctgaagactggcttcaggggctctg

SEQ ID NO: 26352 - DNA, 30 bp, Homo sapiens
gagacttcctgctccccagtggaaggcgtg

SEQ ID NO: 26353 - DNA, 30 bp, Homo sapiens
ctgctgtggatggagagacagagctggttc

SEQ ID NO: 26354 - DNA, 30 bp, Homo sapiens
ccatggtggactgcgtgtaagatgagctgg

SEQ ID NO: 26355 - DNA, 30 bp, Homo sapiens
cacaagcccacagatatttcctgctcccca

SEQ ID NO: 26356 - DNA, 30 bp, Homo sapiens
tgaaggacgacgcattgtcgttatctgcgg

SEQ ID NO: 26357 - DNA, 30 bp, Homo sapiens
tatggggagaaggtggtggtggtctcggcc

SEQ ID NO: 26358 - DNA, 30 bp, Homo sapiens
aaaatgtagtctacgctggaggaacgggag

SEQ ID NO: 26359 - DNA, 30 bp, Homo sapiens
cagagggagagtgctcctgaggttgtctcc

SEQ ID NO: 26360 - DNA, 30 bp, Homo sapiens
cttcggtggaatggtcaggttcttccctcg

SEQ ID NO: 26361 - DNA, 30 bp, Homo sapiens
caaaggtgggcagggggctgcgctgactcc

SEQ ID NO: 26362 - DNA, 30 bp, Homo sapiens
agcacctcatgtattctgtcatccacgggt

SEQ ID NO: 26363 - DNA, 30 bp, Homo sapiens
ctgctggcctagagtttgcagctcagtgct

SEQ ID NO: 26364 - DNA, 30 bp, Homo sapiens
cctagggtatgtggtcttgaaaggcactgg

SEQ ID NO: 26365 - DNA, 30 bp, Homo sapiens
tagaggccaaacaatccccagaatgcaaat

SEQ ID NO: 26366 - DNA, 30 bp, Homo sapiens
agtagggtaaacaaaatattccaagagtat

SEQ ID NO: 26367 - DNA, 30 bp, Homo sapiens
ctgcgggcctcgatacgttgtggctttatt

SEQ ID NO: 26368 - DNA, 30 bp, Homo sapiens
ccctgggtgtgatctgtgggtctgggaagg

SEQ ID NO: 26369 - DNA, 30 bp, Homo sapiens
aacaggggtggtgatcagggacacgtttcc

SEQ ID NO: 26370 - DNA, 30 bp, Homo sapiens
tcctggccagcatcaggagccccgccttgc

SEQ ID NO: 26371 - DNA, 30 bp, Homo sapiens
tatcgagtgtttaccacatcatctattttc

SEQ ID NO: 26372 - DNA, 30 bp, Homo sapiens
tccaggcttacgaatgtcatcaatcttcaa

SEQ ID NO: 26373 - DNA, 30 bp, Homo sapiens
agagaagacattccagctcgcatgatctca

SEQ ID NO: 26374 - DNA, 30 bp, Homo sapiens
tcgcataatttcatcaaccaggagaatgtt

SEQ ID NO: 26375 - DNA, 30 bp, Homo sapiens
cagtgggggcggccacgaccacggccccgg

SEQ ID NO: 26376 - DNA, 30 bp, Homo sapiens
ctttcttcccacttggaggcttgggcccac

SEQ ID NO: 26377 - DNA, 30 bp, Homo sapiens
gaggtgggtgtttctttgtcttcttagagt

SEQ ID NO: 26378 - DNA, 30 bp, Homo sapiens
atccaagaagaagatgttgttgaactgcgt

SEQ ID NO: 26379 - DNA, 30 bp, Homo sapiens
tcttcctcctcgtcttccctcctatttgtg

SEQ ID NO: 26380 - DNA, 30 bp, Homo sapiens
tgatgggagcctgaagctccatcctcacaa

SEQ ID NO: 26381 - DNA, 30 bp, Homo sapiens
ccccgggccccttggagcagcaccagggtt

SEQ ID NO: 26382 - DNA, 30 bp, Homo sapiens
tgagactcctgtacaggcagcacgtgaaga

SEQ ID NO: 26383 - DNA, 30 bp, Homo sapiens
ggctggtgaccagcattacccagacctttt

SEQ ID NO: 26384 - DNA, 30 bp, Homo sapiens
cagtgtggctcagaatggcctcctgaggaa

SEQ ID NO: 26385 - DNA, 30 bp, Homo sapiens
ttccttttcagtgtggctcagaatggcctc

SEQ ID NO: 26386 - DNA, 30 bp, Homo sapiens
cagaggcaggaagaactcccaacagcgatg

SEQ ID NO: 26387 - DNA, 30 bp, Homo sapiens
gtgtggtaatttcgttctttagatttgcag

SEQ ID NO: 26388 - DNA, 30 bp, Homo sapiens
gtgtggcatcttatttctgatgtagtaact

SEQ ID NO: 26389 - DNA, 30 bp, Homo sapiens
gtctggtaggtgctgtccttggccttgagg

SEQ ID NO: 26390 - DNA, 30 bp, Homo sapiens
ccttggccttgaggaagtgcagcacaaaga

SEQ ID NO: 26391 - DNA, 30 bp, Homo sapiens
agcaggaagggcaaaccactccccaccaca

SEQ ID NO: 26392 - DNA, 30 bp, Homo sapiens
tgttggtatttccacctgagaaggtattta

SEQ ID NO: 26393 - DNA, 30 bp, Homo sapiens
acctggtgctccaggtgcccatgcggcccc

SEQ ID NO: 26394 - DNA, 30 bp, Homo sapiens
ccaaagcgcaagacctatcagaagaagtaa

SEQ ID NO: 26395 - DNA, 30 bp, Homo sapiens
catgggatattctgatatgaccggcgcctc

SEQ ID NO: 26396 - DNA, 30 bp, Homo sapiens
cacaggatgtcctgatatgagcagtgcttc

SEQ ID NO: 26397 - DNA, 30 bp, Homo sapiens
cacaggacgccctgataggaagtttgcctc

SEQ ID NO: 26398 - DNA, 30 bp, Homo sapiens
agttggtttaggcgtgtcttccacttcttc

SEQ ID NO: 26399 - DNA, 30 bp, Homo sapiens
tgaccagggtaactatcacagtcaaacaga

SEQ ID NO: 26400 - DNA, 30 bp, Homo sapiens
ccatggggaggttttggctgaactcgaggt

SEQ ID NO: 26401 - DNA, 30 bp, Homo sapiens
tccggtgacgtttccagtacagtaagattg

SEQ ID NO: 26402 - DNA, 30 bp, Homo sapiens
atgccttcaccttgtttgtagtatcataga

SEQ ID NO: 26403 - DNA, 30 bp, Homo sapiens
caaatctggtgatgtgaaatacctcaatat

SEQ ID NO: 26404 - DNA, 30 bp, Homo sapiens
gaagaaaacaaatcctgtggtgaccagaat

SEQ ID NO: 26405 - DNA, 30 bp, Homo sapiens
acggttctgatgggacatagggtcgcttac

SEQ ID NO: 26406 - DNA, 30 bp, Homo sapiens
cgcaggaggggggtttggggtggcaggggc

SEQ ID NO: 26407 - DNA, 30 bp, Homo sapiens
ttgaggatcacatagtccacattttcttgt

SEQ ID NO: 26408 - DNA, 30 bp, Homo sapiens
catcgcagtccgggggaggtctctgcatct

SEQ ID NO: 26409 - DNA, 30 bp, Homo sapiens
agaaggttggatagttgacataaatatcct

SEQ ID NO: 26410 - DNA, 30 bp, Homo sapiens
cactggaataaatctgcgtgggtaggagca

SEQ ID NO: 26411 - DNA, 30 bp, Homo sapiens
agagactggctgttgactgcagggcaccac

SEQ ID NO: 26412 - DNA, 30 bp, Homo sapiens
ctttgcggctcaatcgagcagggttctggg

SEQ ID NO: 26413 - DNA, 30 bp, Homo sapiens
atggcctgtgccctgtaatgacgcagcagt

SEQ ID NO: 26414 - DNA, 30 bp, Homo sapiens
cacacgctggttctgcaggtctgcacccct

SEQ ID NO: 26415 - DNA, 30 bp, Homo sapiens
cagggggagcaggcaggctccggttttcgg

SEQ ID NO: 26416 - DNA, 30 bp, Homo sapiens
gctaggggacagtgttagacatattttaat

SEQ ID NO: 26417 - DNA, 30 bp, Homo sapiens
ccaaggcataataagatggctcccagaatt

SEQ ID NO: 26418 - DNA, 30 bp, Homo sapiens
cagaggctgcagggctgtcttggagccttc

SEQ ID NO: 26419 - DNA, 30 bp, Homo sapiens
caggagcgataggctgcgaagtcgcgtggt

SEQ ID NO: 26420 - DNA, 30 bp, Homo sapiens
aagaagacaggacagcttttttcagcttct

SEQ ID NO: 26421 - DNA, 30 bp, Homo sapiens
tagaggtcaaagtcaatgcgtttggagttg

SEQ ID NO: 26422 - DNA, 30 bp, Homo sapiens
tcttccttatcacactgtaatctgaatctg

SEQ ID NO: 26423 - DNA, 30 bp, Homo sapiens
tactggttctcacccttgggccaattctgc

SEQ ID NO: 26424 - DNA, 30 bp, Homo sapiens
tccaggaggagcccactgaggcctgttcac

SEQ ID NO: 26425 - DNA, 30 bp, Homo sapiens
agtcctccaaggcctgttcacccagaggat

SEQ ID NO: 26426 - DNA, 30 bp, Homo sapiens
aagtggccatgtctttagtcagaggttcgg

SEQ ID NO: 26427 - DNA, 30 bp, Homo sapiens
agaccttctttgtggtctgtttacccagag

SEQ ID NO: 26428 - DNA, 30 bp, Homo sapiens
tgatggtgctgtattccgtgggctcctcag

SEQ ID NO: 26429 - DNA, 30 bp, Homo sapiens
caacctgggcagaggaaagcttcgtggtag

SEQ ID NO: 26430 - DNA, 30 bp, Homo sapiens
ccaaggcaggctcagagaaaacatcaggga

SEQ ID NO: 26431 - DNA, 30 bp, Homo sapiens
gctgagacaaacttcgagaagcccagctcc

SEQ ID NO: 26432 - DNA, 30 bp, Homo sapiens
gtcaggctagagatctcaaaggcttcatct

SEQ ID NO: 26433 - DNA, 30 bp, Homo sapiens
accaaaacacagtcttcattataaggtgat

SEQ ID NO: 26434 - DNA, 30 bp, Homo sapiens
ggcagcgaggtcttctgttctgacagcagc

SEQ ID NO: 26435 - DNA, 30 bp, Homo sapiens
aggctgaccctgtggtagggtgggtgtcat

SEQ ID NO: 26436 - DNA, 30 bp, Homo sapiens
cactgggtcctgacctctgagtattcggtg

SEQ ID NO: 26437 - DNA, 30 bp, Homo sapiens
tttctcctgtggggctccagctgcggcgat

SEQ ID NO: 26438 - DNA, 30 bp, Homo sapiens
cacaattcggtatcagccaccacgtgttgt

SEQ ID NO: 26439 - DNA, 30 bp, Homo sapiens
caacactgagtaagatcatttctatcaggc

SEQ ID NO: 26440 - DNA, 30 bp, Homo sapiens
taacggtatcgagcgagccggttgtagacg

SEQ ID NO: 26441 - DNA, 30 bp, Homo sapiens
ctcaggatttttcacacactgaagaaactt

SEQ ID NO: 26442 - DNA, 30 bp, Homo sapiens
ccagtttcctccaaggtggctgtactgagc

SEQ ID NO: 26443 - DNA, 30 bp, Homo sapiens
ttcaggccagaatacaggtcccgctggcct

SEQ ID NO: 26444 - DNA, 30 bp, Homo sapiens
cacaggctgctgctgctgctgcttccgctt

SEQ ID NO: 26445 - DNA, 30 bp, Homo sapiens
caactggtttccttgaaggtggctgtactg

SEQ ID NO: 26446 - DNA, 30 bp, Homo sapiens
aaatggggctacatgtcttctgaaaccggt

SEQ ID NO: 26447 - DNA, 30 bp, Homo sapiens
tggttggcttcttggccacctttttgataa

SEQ ID NO: 26448 - DNA, 30 bp, Homo sapiens
tgtctctcctgcactgagatgcgactctct

SEQ ID NO: 26449 - DNA, 30 bp, Homo sapiens
caaaggacgtgaagccagtgccatggctca

SEQ ID NO: 26450 - DNA, 30 bp, Homo sapiens
ccaaggccaagagggatgccaagatgatca

SEQ ID NO: 26451 - DNA, 30 bp, Homo sapiens
tcttcatgtccacattctgcaggttccttg

SEQ ID NO: 26452 - DNA, 30 bp, Homo sapiens
aactggtctggagtttctgacgactccttg

SEQ ID NO: 26453 - DNA, 30 bp, Homo sapiens
tgctctgctggagtggttgatttagtctgg

SEQ ID NO: 26454 - DNA, 30 bp, Homo sapiens
gttaggtatgtgcctttcttcttcctcctt

SEQ ID NO: 26455 - DNA, 30 bp, Homo sapiens
aggttgtatagtcttctgattggaagccac

SEQ ID NO: 26456 - DNA, 30 bp, Homo sapiens
cactgtgcaaggaggctgaataggaccccc

SEQ ID NO: 26457 - DNA, 30 bp, Homo sapiens
aacaggccaagaatggtgggcaccgtgacc

SEQ ID NO: 26458 - DNA, 30 bp, Homo sapiens
agccccatgcagatcatagtcactgtcgga

SEQ ID NO: 26459 - DNA, 30 bp, Homo sapiens
ctgaagcagaagaggtggattatggcattg

SEQ ID NO: 26460 - DNA, 30 bp, Homo sapiens
ctatggtctggctggttttgtcaatctggc

SEQ ID NO: 26461 - DNA, 30 bp, Homo sapiens
ccatggttactagcgtcccaagcaaacctg

SEQ ID NO: 26462 - DNA, 30 bp, Homo sapiens
tagaggatgcacatcatcttttttgaagaa

SEQ ID NO: 26463 - DNA, 30 bp, Homo sapiens
gggaggccggaaaaatcgcttacggccagg

SEQ ID NO: 26464 - DNA, 30 bp, Homo sapiens
cttgggatacaggttgtcaaaatgattgat

SEQ ID NO: 26465 - DNA, 30 bp, Homo sapiens
acttggttctgtctggttttctgtcacatt

SEQ ID NO: 26466 - DNA, 30 bp, Homo sapiens
tgaaggctccaggctgctgccagaaatgga

SEQ ID NO: 26467 - DNA, 30 bp, Homo sapiens
cttcctggtgggtgcagtcgtgaaaccccc

SEQ ID NO: 26468 - DNA, 30 bp, Homo sapiens
cagatgacagccacatcttcctggtgggtg

SEQ ID NO: 26469 - DNA, 30 bp, Homo sapiens
taggctgcgctgatgtcatcgtagtcatcg

SEQ ID NO: 26470 - DNA, 30 bp, Homo sapiens
catcacctcgtagccacttctgatactctt

SEQ ID NO: 26471 - DNA, 30 bp, Homo sapiens
cagagggcctggtaggcggatgggcgtctc

SEQ ID NO: 26472 - DNA, 30 bp, Homo sapiens
tgctgacctctgtgtttttcagaaaaacac

SEQ ID NO: 26473 - DNA, 30 bp, Homo sapiens
cactggtactggttgggggaggacagcgtg

SEQ ID NO: 26474 - DNA, 30 bp, Homo sapiens
caacggtttacgcctctgttttcctcatct

SEQ ID NO: 26475 - DNA, 30 bp, Homo sapiens
caggggcgcacccactgcactccaaagaag

SEQ ID NO: 26476 - DNA, 30 bp, Homo sapiens
atctggaaacctgaaagctgtcatctcaca

SEQ ID NO: 26477 - DNA, 30 bp, Homo sapiens
acatggggactgggcccagatcctgcttgg

SEQ ID NO: 26478 - DNA, 30 bp, Homo sapiens
ccagaagacgggtcctccagttccagtgac

SEQ ID NO: 26479 - DNA, 30 bp, Homo sapiens
agctggacatctcctatgttgaggctgccc

SEQ ID NO: 26480 - DNA, 30 bp, Homo sapiens
tcctggcctgggtgctcacctacagaccac

SEQ ID NO: 26481 - DNA, 30 bp, Homo sapiens
tacagggcgtacactttcccttctcaatct

SEQ ID NO: 26482 - DNA, 30 bp, Homo sapiens
tacacggagctgttccggatgccacagcac

SEQ ID NO: 26483 - DNA, 30 bp, Homo sapiens
tacttggggaccttgctgtagtcttcggaa

SEQ ID NO: 26484 - DNA, 30 bp, Homo sapiens
cataccagttctgtcttgtgaggagtcact

SEQ ID NO: 26485 - DNA, 30 bp, Homo sapiens
cttcggaataaactgtgttcactggctctt

SEQ ID NO: 26486 - DNA, 30 bp, Homo sapiens
cccaggaggtttactgtcctgtgtgctggc

SEQ ID NO: 26487 - DNA, 30 bp, Homo sapiens
cgctgggcttcatcagatctttcaggtata

SEQ ID NO: 26488 - DNA, 30 bp, Homo sapiens
cacaggcgaagtccagccccctcgtgtgca

SEQ ID NO: 26489 - DNA, 30 bp, Homo sapiens
gaaaggctgggcttgtctcccgatttgacc

SEQ ID NO: 26490 - DNA, 30 bp, Homo sapiens
cacagggttagacgtatctcgccgaaaggc

SEQ ID NO: 26491 - DNA, 30 bp, Homo sapiens
ccatgggttaagcagcttctgtgaggttgt

SEQ ID NO: 26492 - DNA, 30 bp, Homo sapiens
tggaacatttctccagtggatgtaatctta

SEQ ID NO: 26493 - DNA, 30 bp, Homo sapiens
ttttcaggatccatgggttaagcagcttct

SEQ ID NO: 26494 - DNA, 30 bp, Homo sapiens
cgccggcagcacaggtggatggccactccc

SEQ ID NO: 26495 - DNA, 30 bp, Homo sapiens
tcgcggttcctgcggatagcacagcacaag

SEQ ID NO: 26496 - DNA, 30 bp, Homo sapiens
cccaggtgtcggactgtactggttctccat

SEQ ID NO: 26497 - DNA, 30 bp, Homo sapiens
tgctggctggagaaggttgggtgtcaaggg

SEQ ID NO: 26498 - DNA, 30 bp, Homo sapiens
tagagggtctccatctcatgataaggcaga

SEQ ID NO: 26499 - DNA, 30 bp, Homo sapiens
gccaggcacagtggctcacacctgtaatcc

SEQ ID NO: 26500 - DNA, 30 bp, Homo sapiens
ttccggtggctctccatgtccacctcccct

SEQ ID NO: 26501 - DNA, 30 bp, Homo sapiens
gatccgggctggttcgggcggcggcggcgg

SEQ ID NO: 26502 - DNA, 30 bp, Homo sapiens
cactgggtcttctgcaggtcctcaggccca

SEQ ID NO: 26503 - DNA, 30 bp, Homo sapiens
tagtggattccgaggcgcagcttcttgtcc

SEQ ID NO: 26504 - DNA, 30 bp, Homo sapiens
aggctcattttgttcaagaccataagctcc

SEQ ID NO: 26505 - DNA, 30 bp, Homo sapiens
ctctgggccagcacagtgccccggtttggc

SEQ ID NO: 26506 - DNA, 30 bp, Homo sapiens
cagtagagaggtctacaaagtccttgggta

SEQ ID NO: 26507 - DNA, 30 bp, Homo sapiens
gcccggtgtaggagggtcggaggatggtgg

SEQ ID NO: 26508 - DNA, 30 bp, Homo sapiens
agcagggggcttccaagaaagggcttccta

SEQ ID NO: 26509 - DNA, 30 bp, Homo sapiens
agaaggcttccttggcactattaaatttct

SEQ ID NO: 26510 - DNA, 30 bp, Homo sapiens
gaaaacttacctctccaaatcgttccatgt

SEQ ID NO: 26511 - DNA, 30 bp, Homo sapiens
agacagaatagcaggatgggaagaatgtag

SEQ ID NO: 26512 - DNA, 30 bp, Homo sapiens
agcagatctggtggttcttttagtaatgcc

SEQ ID NO: 26513 - DNA, 30 bp, Homo sapiens
ttttggattgtcttctgcttttcaaggccc

SEQ ID NO: 26514 - DNA, 30 bp, Homo sapiens
ctgtggtctgacatagatgtctctaacatc

SEQ ID NO: 26515 - DNA, 30 bp, Homo sapiens
cagcggatgccttggtggatgaggctgctt

SEQ ID NO: 26516 - DNA, 30 bp, Homo sapiens
cagaggccgtcccatcagctgcagcagaaa

SEQ ID NO: 26517 - DNA, 30 bp, Homo sapiens
atggcgtgacagaagacaagttgagtggag

SEQ ID NO: 26518 - DNA, 30 bp, Homo sapiens
gagcttcttcagacgactgtacatctccct

SEQ ID NO: 26519 - DNA, 30 bp, Homo sapiens
cactggtcctgcagccggctacagagctcc

SEQ ID NO: 26520 - DNA, 30 bp, Homo sapiens
catgggctcatgtccttcaccagaagggca

SEQ ID NO: 26521 - DNA, 30 bp, Homo sapiens
gcttgggttggggtttataaccaatccgat

SEQ ID NO: 26522 - DNA, 30 bp, Homo sapiens
ctgtcatgctgctctcctgggattcatctg

SEQ ID NO: 26523 - DNA, 30 bp, Homo sapiens
tattggctcctcatcatctggaagataacg

SEQ ID NO: 26524 - DNA, 30 bp, Homo sapiens
tgccagagtcatcctcatcgtccccgaagc

SEQ ID NO: 26525 - DNA, 30 bp, Homo sapiens
catcgcccgtcttgggaacagcttccagta

SEQ ID NO: 26526 - DNA, 30 bp, Homo sapiens
ttttgggttcatcatcttctttatgtacca

SEQ ID NO: 26527 - DNA, 30 bp, Homo sapiens
tttaatgagaccatcccaaccacatgttat

SEQ ID NO: 26528 - DNA, 30 bp, Homo sapiens
gggttgagtttccggaggctcgagggcagc

SEQ ID NO: 26529 - DNA, 30 bp, Homo sapiens
ctgcggctcttcttcggttctggaggctcc

SEQ ID NO: 26530 - DNA, 30 bp, Homo sapiens
cacgggtcccagctcccgcggtcagtgctc

SEQ ID NO: 26531 - DNA, 30 bp, Homo sapiens
cacaggccggctgctccaggccttcgaggg

SEQ ID NO: 26532 - DNA, 30 bp, Homo sapiens
ttcaggggatagggggaggcttcggggccg

SEQ ID NO: 26533 - DNA, 30 bp, Homo sapiens
acaccttgacctcatcatcctcctcagcat

SEQ ID NO: 26534 - DNA, 30 bp, Homo sapiens
atgtggggatctgcatgctgtccaggtcct

SEQ ID NO: 26535 - DNA, 30 bp, Homo sapiens
cattcagcacctcatccaaaagtgagggcc

SEQ ID NO: 26536 - DNA, 30 bp, Homo sapiens
cacacacggatttcatcctcctcctcctca

SEQ ID NO: 26537 - DNA, 30 bp, Homo sapiens
tagaggccgatgacgtcgttcagctcgagg

SEQ ID NO: 26538 - DNA, 30 bp, Homo sapiens
gaattgctccatggcctatctcggtttccc

SEQ ID NO: 26539 - DNA, 30 bp, Homo sapiens
ttcgtatccacgagctgcatctggacattg

SEQ ID NO: 26540 - DNA, 30 bp, Homo sapiens
acaggagggaaataagtgcgtccagaaact

SEQ ID NO: 26541 - DNA, 30 bp, Homo sapiens
gcaaatcagcatatctatgttgaagttcct

SEQ ID NO: 26542 - DNA, 30 bp, Homo sapiens
tcaaacgggtttccttgtttctctttaatc

SEQ ID NO: 26543 - DNA, 30 bp, Homo sapiens
agctggatttagatctagaagtttatcaag

SEQ ID NO: 26544 - DNA, 30 bp, Homo sapiens
caatgtttcccaaaaccgtaagaacactgg

SEQ ID NO: 26545 - DNA, 30 bp, Homo sapiens
caaggcagtcagagagctctctcccttccc

SEQ ID NO: 26546 - DNA, 30 bp, Homo sapiens
tgccatttgaactgaaataaccaggaaaat

SEQ ID NO: 26547 - DNA, 30 bp, Homo sapiens
gatctgggagtctcagggtcccttgagggc

SEQ ID NO: 26548 - DNA, 30 bp, Homo sapiens
gcatcctctctggccacgataacagggtga

SEQ ID NO: 26549 - DNA, 30 bp, Homo sapiens
tctccaccaagggaaagtgctgattttcct

SEQ ID NO: 26550 - DNA, 30 bp, Homo sapiens
caggtctccaccaggatctccaccacgtgg

SEQ ID NO: 26551 - DNA, 30 bp, Homo sapiens
accaggagatcaaactgctcagcagcttca

SEQ ID NO: 26552 - DNA, 30 bp, Homo sapiens
gccatgatatttggctaaatacacaaggac

SEQ ID NO: 26553 - DNA, 30 bp, Homo sapiens
aattgtcttctaccagctccttttgtaagc

SEQ ID NO: 26554 - DNA, 30 bp, Homo sapiens
ttgtgggtccgtatgctgctgcagatttgg

SEQ ID NO: 26555 - DNA, 30 bp, Homo sapiens
tgctggctccatgggctcctgagtgttcag

SEQ ID NO: 26556 - DNA, 30 bp, Homo sapiens
ttgtggatgttggaccaaaacttggaactg

SEQ ID NO: 26557 - DNA, 30 bp, Homo sapiens
agctggggaaggaggctctgcaatagtgga

SEQ ID NO: 26558 - DNA, 30 bp, Homo sapiens
cgatggcaataaccatgaggattccagcca

SEQ ID NO: 26559 - DNA, 30 bp, Homo sapiens
gacaggatcagcagaagtgtccctgttcca

SEQ ID NO: 26560 - DNA, 30 bp, Homo sapiens
gacaagggtatgaacagctgtgaggatgcc

SEQ ID NO: 26561 - DNA, 30 bp, Homo sapiens
gtcgtcctcgccgcctccgtacatgtcagc

SEQ ID NO: 26562 - DNA, 30 bp, Homo sapiens
caccatacatttctgctagcttattaaacc

SEQ ID NO: 26563 - DNA, 30 bp, Homo sapiens
gtgttgtctctttgggattgtctaatgggg

SEQ ID NO: 26564 - DNA, 30 bp, Homo sapiens
catagaggaaaggaagttttataaagaccc

SEQ ID NO: 26565 - DNA, 30 bp, Homo sapiens
ctttggaaccatacaaatctgctagtttct

SEQ ID NO: 26566 - DNA, 30 bp, Homo sapiens
agtgactttatcagggttataactctcttc

SEQ ID NO: 26567 - DNA, 30 bp, Homo sapiens
ctgaggagcaggactgagggcaggctgaag

SEQ ID NO: 26568 - DNA, 30 bp, Homo sapiens
tgctaggcacagaacttgccaaatcttcat

SEQ ID NO: 26569 - DNA, 30 bp, Homo sapiens
ttcaagagaagttcgctgttaataggattg

SEQ ID NO: 26570 - DNA, 30 bp, Homo sapiens
gtccggcctctgtgtctgggtagcagtgcc

SEQ ID NO: 26571 - DNA, 30 bp, Homo sapiens
agacagtcgccttcaggggcacgctgtctg

SEQ ID NO: 26572 - DNA, 30 bp, Homo sapiens
cagaggtttgacttcagatgcttgagcact

SEQ ID NO: 26573 - DNA, 30 bp, Homo sapiens
aagttgttctttcagattctatttctccat

SEQ ID NO: 26574 - DNA, 30 bp, Homo sapiens
ccgaggacaggaaggcttctgcatggcagg

SEQ ID NO: 26575 - DNA, 30 bp, Homo sapiens
cagagcctgcattttcacaaacataagtct

SEQ ID NO: 26576 - DNA, 30 bp, Homo sapiens
tatttgactgcactgcagaaccaaacatgc

SEQ ID NO: 26577 - DNA, 30 bp, Homo sapiens
ccatacatgtcagcaagtttcttgaaccgt

SEQ ID NO: 26578 - DNA, 30 bp, Homo sapiens
ccacagcggcgcgggtccctccgacgcccc

SEQ ID NO: 26579 - DNA, 30 bp, Homo sapiens
aggaggcctgggcctcgtcgtccccgcggt

SEQ ID NO: 26580 - DNA, 30 bp, Homo sapiens
aacacagctcagggatttgggggtgcctcc

SEQ ID NO: 26581 - DNA, 30 bp, Homo sapiens
cagcccaggcagggtggtgggtctggatgg

SEQ ID NO: 26582 - DNA, 30 bp, Homo sapiens
tagtctggctgtccatctgggaggggtgga

SEQ ID NO: 26583 - DNA, 30 bp, Homo sapiens
tccaggggggtctccatgatcacgtcgcga

SEQ ID NO: 26584 - DNA, 30 bp, Homo sapiens
gattggaagaaatggtgctccctgccccca

SEQ ID NO: 26585 - DNA, 30 bp, Homo sapiens
cagggggccgggggctccttggccccatac

SEQ ID NO: 26586 - DNA, 30 bp, Homo sapiens
acggagtcgcttttgaacccaaagagtcca

SEQ ID NO: 26587 - DNA, 30 bp, Homo sapiens
gagcggcgggtcctgcctcttgccagctgc

SEQ ID NO: 26588 - DNA, 30 bp, Homo sapiens
agtcgtcctccccgccaccgtacatgtctg

SEQ ID NO: 26589 - DNA, 30 bp, Homo sapiens
caccacctccatacatgtccgccagcttct

SEQ ID NO: 26590 - DNA, 30 bp, Homo sapiens
aatacagcagctcctcccgggggtccgagc

SEQ ID NO: 26591 - DNA, 30 bp, Homo sapiens
ctccatacatatctgcaagctttttgaatc

SEQ ID NO: 26592 - DNA, 30 bp, Homo sapiens
ccctggaaacagtacctacccaataatgtc

SEQ ID NO: 26593 - DNA, 30 bp, Homo sapiens
tcttggccagtcccatacatgtccgcgagt

SEQ ID NO: 26594 - DNA, 30 bp, Homo sapiens
gagtagagttcgcccagtctcttaaagcgg

SEQ ID NO: 26595 - DNA, 30 bp, Homo sapiens
agtctcggtcactatcatcacccccataca

SEQ ID NO: 26596 - DNA, 30 bp, Homo sapiens
tgtgcacactcttcttctcaaacttttgct

SEQ ID NO: 26597 - DNA, 30 bp, Homo sapiens
cagtggggatgcaagaacagaccctggctg

SEQ ID NO: 26598 - DNA, 30 bp, Homo sapiens
cacaggtccgtggtgtccaggccagcgttg

SEQ ID NO: 26599 - DNA, 30 bp, Homo sapiens
tactttcctgggtgtggtttggggtaagcc

SEQ ID NO: 26600 - DNA, 30 bp, Homo sapiens
agccagcgccgggctcctgtgtgtgtgtta

SEQ ID NO: 26601 - DNA, 30 bp, Homo sapiens
agatgtaggagtcatcaccaccgggcgcat

SEQ ID NO: 26602 - DNA, 30 bp, Homo sapiens
gcacaggcgcttgtacgtgtagatgtaggc

SEQ ID NO: 26603 - DNA, 30 bp, Homo sapiens
tcttggcgcggtctgctgcgtccagggcag

SEQ ID NO: 26604 - DNA, 30 bp, Homo sapiens
attcgtttggctggatcatagattaacatt

SEQ ID NO: 26605 - DNA, 30 bp, Homo sapiens
actgaccaggagggatagaatccaagtatt

SEQ ID NO: 26606 - DNA, 30 bp, Homo sapiens
gggtttacagcgcttgctctggccctcgga

SEQ ID NO: 26607 - DNA, 30 bp, Homo sapiens
cagcctggctcgcggcacccttcacagaca

SEQ ID NO: 26608 - DNA, 30 bp, Homo sapiens
gaacttgaggctgaagccggggcccgcggc

SEQ ID NO: 26609 - DNA, 30 bp, Homo sapiens
gtaaggaactcctctccctcttccccctct

SEQ ID NO: 26610 - DNA, 30 bp, Homo sapiens
gcctctgcctctgccagttgatgtgctaat

SEQ ID NO: 26611 - DNA, 30 bp, Homo sapiens
ggcccgcatgctttctccagcttctggttg

SEQ ID NO: 26612 - DNA, 30 bp, Homo sapiens
agatggcagggcgctgaaataatcatgaac

SEQ ID NO: 26613 - DNA, 30 bp, Homo sapiens
tttgctaaactgggctgggtggtgaccttt

SEQ ID NO: 26614 - DNA, 30 bp, Homo sapiens
actcggtgtccaccacgcggaaagctggcc

SEQ ID NO: 26615 - DNA, 30 bp, Homo sapiens
tctggataagaagaatttcgaaaacccggg

SEQ ID NO: 26616 - DNA, 30 bp, Homo sapiens
aaatggtttatgacaaacacacctgtctct

SEQ ID NO: 26617 - DNA, 30 bp, Homo sapiens
gttcttccctcgtcctggctgctggaaggc

SEQ ID NO: 26618 - DNA, 30 bp, Homo sapiens
taccggtgggcctggtgagatgggtggtac

SEQ ID NO: 26619 - DNA, 30 bp, Homo sapiens
agatggggtactggcttggtcacatcctgg

SEQ ID NO: 26620 - DNA, 30 bp, Homo sapiens
agacgctgaggaatcggcagctcagatgga

SEQ ID NO: 26621 - DNA, 30 bp, Homo sapiens
tccaggatgaagggccgaatcagctctggg

SEQ ID NO: 26622 - DNA, 30 bp, Homo sapiens
atctggcattccgttccgtttctgccaagc

SEQ ID NO: 26623 - DNA, 30 bp, Homo sapiens
acgtgcgggcgttccgctctgtctctgcca

SEQ ID NO: 26624 - DNA, 30 bp, Homo sapiens
ctcaggacacaaggcagggaggtgccaggc

SEQ ID NO: 26625 - DNA, 30 bp, Homo sapiens
caatggcggaatcgctgcagcacatactgg

SEQ ID NO: 26626 - DNA, 30 bp, Homo sapiens
ctccggattaccttcatccttatgtagata

SEQ ID NO: 26627 - DNA, 30 bp, Homo sapiens
gggcggacagaagtcggagaagtaggggtg

SEQ ID NO: 26628 - DNA, 30 bp, Homo sapiens
tccaggcctaggaggagccgcttcttgtcc

SEQ ID NO: 26629 - DNA, 30 bp, Homo sapiens
tagcggtccaggttcatagtccagtgcttg

SEQ ID NO: 26630 - DNA, 30 bp, Homo sapiens
gagtggtcctgcagagaacatgtcccctaa

SEQ ID NO: 26631 - DNA, 30 bp, Homo sapiens
gcctggtctgctgggactgcatgttcctgg

SEQ ID NO: 26632 - DNA, 30 bp, Homo sapiens
gagaggttcccatcaggttcacagggcgcc

SEQ ID NO: 26633 - DNA, 30 bp, Homo sapiens
agaaggagaatctgtggttttcgcctgata

SEQ ID NO: 26634 - DNA, 30 bp, Homo sapiens
gctgtattcagctccgaggtgttctggctg

SEQ ID NO: 26635 - DNA, 30 bp, Homo sapiens
tctaaggcctctgttcttttcctttttatt

SEQ ID NO: 26636 - DNA, 30 bp, Homo sapiens
tgtctgatgtgagtactgtggaggctgctg

SEQ ID NO: 26637 - DNA, 30 bp, Homo sapiens
gaagacgcgctcaaactccgtctggttggt

SEQ ID NO: 26638 - DNA, 30 bp, Homo sapiens
agagccaagcccacggacatcctcagcgca

SEQ ID NO: 26639 - DNA, 30 bp, Homo sapiens
tattctgttcttgaagcaattggtactctg

SEQ ID NO: 26640 - DNA, 30 bp, Homo sapiens
gtttggaaaacggtagttaagtttcttggt

SEQ ID NO: 26641 - DNA, 30 bp, Homo sapiens
tgctggtgttccatttgaggcaaatcagcc

SEQ ID NO: 26642 - DNA, 30 bp, Homo sapiens
gcaatggccatctccaccctgatagttagc

SEQ ID NO: 26643 - DNA, 30 bp, Homo sapiens
atctggcaagttcttcttcctttcagtttg

SEQ ID NO: 26644 - DNA, 30 bp, Homo sapiens
cactggggtgaaagagatttgaactgagat

SEQ ID NO: 26645 - DNA, 30 bp, Homo sapiens
tgaaggacagtcacctgataaactgcagaa

SEQ ID NO: 26646 - DNA, 30 bp, Homo sapiens
tgttggcgtcttctgtttcttccttcatta

SEQ ID NO: 26647 - DNA, 30 bp, Homo sapiens
agtgccgcattctcatggtatgtcaggagc

SEQ ID NO: 26648 - DNA, 30 bp, Homo sapiens
acaaggctgtctcttttaaatcattcagat

SEQ ID NO: 26649 - DNA, 30 bp, Homo sapiens
tcttggagaagatcagccggcgtttggagt

SEQ ID NO: 26650 - DNA, 30 bp, Homo sapiens
ctgaggccaggcttcttgggcgtctgctcc

SEQ ID NO: 26651 - DNA, 30 bp, Homo sapiens
cctcttgcgcggggtctgctccaccgagcc

SEQ ID NO: 26652 - DNA, 30 bp, Homo sapiens
tcctcttccttggcttcccaagcccccagg

SEQ ID NO: 26653 - DNA, 30 bp, Homo sapiens
gccaggtccacgggcagacggccccaggca

SEQ ID NO: 26654 - DNA, 30 bp, Homo sapiens
aatcggggatgtctgagggaccttccgcgg

SEQ ID NO: 26655 - DNA, 30 bp, Homo sapiens
gcatgcctgcttctacaaacccacaaatgg

SEQ ID NO: 26656 - DNA, 30 bp, Homo sapiens
tgctggaggtaagtttacaggcctcgattc

SEQ ID NO: 26657 - DNA, 30 bp, Homo sapiens
ttgtggcaggtcttccacttcaatcccatc

SEQ ID NO: 26658 - DNA, 30 bp, Homo sapiens
ccgtggctgtgcgcaggtaccctgcaacgt

SEQ ID NO: 26659 - DNA, 30 bp, Homo sapiens
tacgaccgagctcgttcaggctttctgctg

SEQ ID NO: 26660 - DNA, 30 bp, Homo sapiens
gccccgtttgcctgcatcaggctaacaacc

SEQ ID NO: 26661 - DNA, 30 bp, Homo sapiens
ccttgggtctcgtctgaggccccagcagcc

SEQ ID NO: 26662 - DNA, 30 bp, Homo sapiens
tgagaggatccattcccaaaacggactggg

SEQ ID NO: 26663 - DNA, 30 bp, Homo sapiens
ccccggatcctcttaggtctcgcaggctgt

SEQ ID NO: 26664 - DNA, 30 bp, Homo sapiens
ttttggggtgtgtcgctgcatacttggggg

SEQ ID NO: 26665 - DNA, 30 bp, Homo sapiens
agttgttctccagcgagcccgaagttgcat

SEQ ID NO: 26666 - DNA, 30 bp, Homo sapiens
gtttcccggggctgctgaaggacctctgtc

SEQ ID NO: 26667 - DNA, 30 bp, Homo sapiens
ctcaggcctgggccctgaggggcatgtggg

SEQ ID NO: 26668 - DNA, 30 bp, Homo sapiens
aatcagtgtcttccagaaagaaatccaggt

SEQ ID NO: 26669 - DNA, 30 bp, Homo sapiens
gatcggtattttgttctctgttcatctatt

SEQ ID NO: 26670 - DNA, 30 bp, Homo sapiens
ctttggtggcgttgatgtcagccttggtct

SEQ ID NO: 26671 - DNA, 30 bp, Homo sapiens
catcggttttgcgtgggttattacagcaca

SEQ ID NO: 26672 - DNA, 30 bp, Homo sapiens
aaaaggatcagcattgccaacacatgggtc

SEQ ID NO: 26673 - DNA, 30 bp, Homo sapiens
taagggcctgtcccgggcagcacattaggg

SEQ ID NO: 26674 - DNA, 30 bp, Homo sapiens
aagagcccgttcggggcagcacattagggg

SEQ ID NO: 26675 - DNA, 30 bp, Homo sapiens
tgtagggagcatcctcatcataggcttgcg

SEQ ID NO: 26676 - DNA, 30 bp, Homo sapiens
ataccttcaaggtgggttgtaggattcctt

SEQ ID NO: 26677 - DNA, 30 bp, Homo sapiens
ctcgtcctctgtggtggatgtcagcatccc

SEQ ID NO: 26678 - DNA, 30 bp, Homo sapiens
ccttggggtaggaaaacttcagggtcagct

SEQ ID NO: 26679 - DNA, 30 bp, Homo sapiens
ctcagcacgtgtctggtgggccaggcgtgc

SEQ ID NO: 26680 - DNA, 30 bp, Homo sapiens
ttgtattgtgagtggctgcttttctgattt

SEQ ID NO: 26681 - DNA, 30 bp, Homo sapiens
ttctacatgcttggcagttgactgcaggga

SEQ ID NO: 26682 - DNA, 30 bp, Homo sapiens
tcacaggcattggagaggaggtggccagga

SEQ ID NO: 26683 - DNA, 30 bp, Homo sapiens
cactgggtgacggtggggtttagcaccccc

SEQ ID NO: 26684 - DNA, 30 bp, Homo sapiens
gtatctcaataggttgaaatccacgaacag

SEQ ID NO: 26685 - DNA, 30 bp, Homo sapiens
caagggcaccatctctgatcattctgtgtc

SEQ ID NO: 26686 - DNA, 30 bp, Homo sapiens
ccttgggctgagctccagatcttcctcagc

SEQ ID NO: 26687 - DNA, 30 bp, Homo sapiens
caagtactttaacatggagtccatcccctg

SEQ ID NO: 26688 - DNA, 30 bp, Homo sapiens
ggtagctgaaaagggagtcaaggcctttgg

SEQ ID NO: 26689 - DNA, 30 bp, Homo sapiens
ggatggggaggctgaagttggttgtgtggg

SEQ ID NO: 26690 - DNA, 30 bp, Homo sapiens
gagtggtcctgccggtcttcccgaaatgca

SEQ ID NO: 26691 - DNA, 30 bp, Homo sapiens
cccaggggggccacctgcagctccacttcc

SEQ ID NO: 26692 - DNA, 30 bp, Homo sapiens
tgagtagtggttgatcagagcatggatcag

SEQ ID NO: 26693 - DNA, 30 bp, Homo sapiens
aggaagttggcaccagctggcagtaggggg

SEQ ID NO: 26694 - DNA, 30 bp, Homo sapiens
atttggatgtaagtgttgggctctggattc

SEQ ID NO: 26695 - DNA, 30 bp, Homo sapiens
agatggagctgtcagagggtccatggccgg

SEQ ID NO: 26696 - DNA, 30 bp, Homo sapiens
ccacggagcccttctctgtgactgtggtgc

SEQ ID NO: 26697 - DNA, 30 bp, Homo sapiens
ctgctttgtggtccatccggcagtaaatgt

SEQ ID NO: 26698 - DNA, 30 bp, Homo sapiens
tcctggggttgggtaggggggcctgggcag

SEQ ID NO: 26699 - DNA, 30 bp, Homo sapiens
agaccacatctgctttgtggtcgatctggc

SEQ ID NO: 26700 - DNA, 30 bp, Homo sapiens
ccagcactccaatcatgatgccgacagtgg

SEQ ID NO: 26701 - DNA, 30 bp, Homo sapiens
ccctggccagcactccaatcgtgatgccga

SEQ ID NO: 26702 - DNA, 30 bp, Homo sapiens
cagccagtactccaatcatgatgctgacag

SEQ ID NO: 26703 - DNA, 30 bp, Homo sapiens
ccctggccagtactccaatcatgatgctga

SEQ ID NO: 26704 - DNA, 30 bp, Homo sapiens
gcgcagttgcccatggccttgaccaaggag

SEQ ID NO: 26705 - DNA, 30 bp, Homo sapiens
tagcagtggccggaggaggcgagcaggggc

SEQ ID NO: 26706 - DNA, 30 bp, Homo sapiens
taccggcagtctgctgtcccggcggccggc

SEQ ID NO: 26707 - DNA, 30 bp, Homo sapiens
ctgcaaccccccacgcccttgatgaggttg

SEQ ID NO: 26708 - DNA, 30 bp, Homo sapiens
ttgtcgccatctgctgtcgtattttcagtg

SEQ ID NO: 26709 - DNA, 30 bp, Homo sapiens
atcacgttcagcctcccatctaagctgttt

SEQ ID NO: 26710 - DNA, 30 bp, Homo sapiens
attccagacttctcagtggatttgtaataa

SEQ ID NO: 26711 - DNA, 30 bp, Homo sapiens
ccatggctaacaaagataatgcaagtaagt

SEQ ID NO: 26712 - DNA, 30 bp, Homo sapiens
gaagtgttggaggcttatgaggcggcacct

SEQ ID NO: 26713 - DNA, 30 bp, Homo sapiens
gactgcaggcatctgagcttccttggagtc

SEQ ID NO: 26714 - DNA, 30 bp, Homo sapiens
agttggaggcgatgacattatttatccagg

SEQ ID NO: 26715 - DNA, 30 bp, Homo sapiens
tgatccagtcgatgtaattggagacccgcg

SEQ ID NO: 26716 - DNA, 30 bp, Homo sapiens
tgatccagtcgttgtagttggagacccgcg

SEQ ID NO: 26717 - DNA, 30 bp, Homo sapiens
tagtggcttgctatggtctcctcaatccag

SEQ ID NO: 26718 - DNA, 30 bp, Homo sapiens
agtagggcttgctgtcattcttcgaacgtt

SEQ ID NO: 26719 - DNA, 30 bp, Homo sapiens
gtaaggtttgctgtcgtttttggaacgctt

SEQ ID NO: 26720 - DNA, 30 bp, Homo sapiens
gtagggccggttggcatccttaggccgctt

SEQ ID NO: 26721 - DNA, 30 bp, Homo sapiens
ggatggcgtgccctcctcactttgtctggc

SEQ ID NO: 26722 - DNA, 30 bp, Homo sapiens
gtacgggcgattggcgtctttgggccgctt

SEQ ID NO: 26723 - DNA, 30 bp, Homo sapiens
tcagcgcgagactgtggtggatttgactgg

SEQ ID NO: 26724 - DNA, 30 bp, Homo sapiens
cgagtcctggtctcccccgggggacgctcc

SEQ ID NO: 26725 - DNA, 30 bp, Homo sapiens
cacttgctctggttggtagctcgatccata

SEQ ID NO: 26726 - DNA, 30 bp, Homo sapiens
agtaggggtgtcccgggtctttgggccgct

SEQ ID NO: 26727 - DNA, 30 bp, Homo sapiens
gtaaggccggttggcatccttgggccgctt

SEQ ID NO: 26728 - DNA, 30 bp, Homo sapiens
gcctgggcgctcccagtgcgcacattcatg

SEQ ID NO: 26729 - DNA, 30 bp, Homo sapiens
tgcaggaagttaaagaagagaaattcggag

SEQ ID NO: 26730 - DNA, 30 bp, Homo sapiens
aggagtgaccctcacttctgggaacttctg

SEQ ID NO: 26731 - DNA, 30 bp, Homo sapiens
aacttcttcttcttcaccacagggatgggc

SEQ ID NO: 26732 - DNA, 30 bp, Homo sapiens
caccccattagtgtcatcctgccatcttct

SEQ ID NO: 26733 - DNA, 30 bp, Homo sapiens
ttccggaccaggaaggccacaccgagaatc

SEQ ID NO: 26734 - DNA, 30 bp, Homo sapiens
ccctcctcaaggccccggatcctccgggcc

SEQ ID NO: 26735 - DNA, 30 bp, Homo sapiens
cctcgaactcccgcctgcctggcgtggttc

SEQ ID NO: 26736 - DNA, 30 bp, Homo sapiens
acctggggggtgtactcaccttcttcgatg

SEQ ID NO: 26737 - DNA, 30 bp, Homo sapiens
ttccggagatttttgatgttataatagtta

SEQ ID NO: 26738 - DNA, 30 bp, Homo sapiens
ctcaggcacatccttgcctgaggaggcgtg

SEQ ID NO: 26739 - DNA, 30 bp, Homo sapiens
cactggaccttacagttctcactgccgttg

SEQ ID NO: 26740 - DNA, 30 bp, Homo sapiens
ttaagggcaggatcctctgcccaattgact

SEQ ID NO: 26741 - DNA, 30 bp, Homo sapiens
gctctgggaatggaagaatgatgaacacta

SEQ ID NO: 26742 - DNA, 30 bp, Homo sapiens
cagaggactgtttgtaacaggtttcatgtg

SEQ ID NO: 26743 - DNA, 30 bp, Homo sapiens
ccattagcacattaccctccttgtccttaa

SEQ ID NO: 26744 - DNA, 30 bp, Homo sapiens
actgatggaaagcttctaatcttattcggg

SEQ ID NO: 26745 - DNA, 30 bp, Homo sapiens
ccaaggcagagaggacctctaacatttcat

SEQ ID NO: 26746 - DNA, 30 bp, Homo sapiens
gtatgtgctgaagctacagatgttgaaaca

SEQ ID NO: 26747 - DNA, 30 bp, Homo sapiens
attcggggccgattcacactggagggcaaa

SEQ ID NO: 26748 - DNA, 30 bp, Homo sapiens
cacaggtcctccagggaggggccctcagag

SEQ ID NO: 26749 - DNA, 30 bp, Homo sapiens
cacagtagagcagggggctttgataggtgt

SEQ ID NO: 26750 - DNA, 30 bp, Homo sapiens
gtggcgaggaaacacaccttccccaagaag

SEQ ID NO: 26751 - DNA, 30 bp, Homo sapiens
cccagggtgcctcagcaagaagcctacggc

SEQ ID NO: 26752 - DNA, 30 bp, Homo sapiens
gtcggaggtagattttcccagtagcttcta

SEQ ID NO: 26753 - DNA, 30 bp, Homo sapiens
agaaggtacaagtccttctgccagctgctc

SEQ ID NO: 26754 - DNA, 30 bp, Homo sapiens
cagtggagaaagtggagcatctgcaatacc

SEQ ID NO: 26755 - DNA, 30 bp, Homo sapiens
tcatatccaacttttctccttttcttgtaa

SEQ ID NO: 26756 - DNA, 30 bp, Homo sapiens
cacaaagcgattttatcaggctttccagag

SEQ ID NO: 26757 - DNA, 30 bp, Homo sapiens
gtgagggaaccccagtccgtgggaaggtgg

SEQ ID NO: 26758 - DNA, 30 bp, Homo sapiens
tcttataggcttcttcaatgaaggttgaca

SEQ ID NO: 26759 - DNA, 30 bp, Homo sapiens
ctccagcctctgctggctgccttgaatttt

SEQ ID NO: 26760 - DNA, 30 bp, Homo sapiens
aaatggccgcaatggtctgtttgctgaact

SEQ ID NO: 26761 - DNA, 30 bp, Homo sapiens
tactgggcagggaagacagagttgccactg

SEQ ID NO: 26762 - DNA, 30 bp, Homo sapiens
ccctggtcaaggagcttctctaactgatgg

SEQ ID NO: 26763 - DNA, 30 bp, Homo sapiens
tcatggccttctcccaatcgctgccattga

SEQ ID NO: 26764 - DNA, 30 bp, Homo sapiens
ctgcggccagtacatgctccttgttaatga

SEQ ID NO: 26765 - DNA, 30 bp, Homo sapiens
ccacggctgagatccctagaagtccaggag

SEQ ID NO: 26766 - DNA, 30 bp, Homo sapiens
tccaggagcttctccagctggtccacgtcc

SEQ ID NO: 26767 - DNA, 30 bp, Homo sapiens
cagcgcttggcgtacgtcctgctggagctc

SEQ ID NO: 26768 - DNA, 30 bp, Homo sapiens
gccttgatatgtagtcagttcttcctgaag

SEQ ID NO: 26769 - DNA, 30 bp, Homo sapiens
tctctctgatctgtcggtcgagttcactta

SEQ ID NO: 26770 - DNA, 30 bp, Homo sapiens
tgctggttctatcttctctcttctccagaa

SEQ ID NO: 26771 - DNA, 30 bp, Homo sapiens
ttttgggttgtgaacttgttccattcattg

SEQ ID NO: 26772 - DNA, 30 bp, Homo sapiens
cacttggtacttggcgtgggcctcctgtgc

SEQ ID NO: 26773 - DNA, 30 bp, Homo sapiens
tgaaggagacctcagagtggaactaagggg

SEQ ID NO: 26774 - DNA, 30 bp, Homo sapiens
tcttgttggctagatagcggaacaattaat

SEQ ID NO: 26775 - DNA, 30 bp, Homo sapiens
aactggcacaaccactccttgccggtgcag

SEQ ID NO: 26776 - DNA, 30 bp, Homo sapiens
aagcgatacaccttcactctgttgtgctca

SEQ ID NO: 26777 - DNA, 30 bp, Homo sapiens
ccccatcggggttgaatctattgaaatgta

SEQ ID NO: 26778 - DNA, 30 bp, Homo sapiens
atcaggaacctctcggcatcagggaggaag

SEQ ID NO: 26779 - DNA, 30 bp, Homo sapiens
cacaggactgcagttgatcgtcctgtggaa

SEQ ID NO: 26780 - DNA, 30 bp, Homo sapiens
gcttcaccaattagtcgaatagcaatactc

SEQ ID NO: 26781 - DNA, 30 bp, Homo sapiens
acctggaggcggcttgggtagtgctggggc

SEQ ID NO: 26782 - DNA, 30 bp, Homo sapiens
atggggaaattaacaggactttcttcttca

SEQ ID NO: 26783 - DNA, 30 bp, Homo sapiens
ctctgttttgggcataagcttcttgttttg

SEQ ID NO: 26784 - DNA, 30 bp, Homo sapiens
agcatttccgggcttcttcaagaaactgct

SEQ ID NO: 26785 - DNA, 30 bp, Homo sapiens
cttttcactgatctgattcagaacatcaat

SEQ ID NO: 26786 - DNA, 30 bp, Homo sapiens
tccagggtttgccttgcaggtgaccactgc

SEQ ID NO: 26787 - DNA, 30 bp, Homo sapiens
gggaggcagaggttgcagtgagccaagatc

SEQ ID NO: 26788 - DNA, 30 bp, Homo sapiens
cacaggagagaggccaagcaaagctctgtg

SEQ ID NO: 26789 - DNA, 30 bp, Homo sapiens
agtagtgatttggacatttcagtaactctg

SEQ ID NO: 26790 - DNA, 30 bp, Homo sapiens
acatggacaagcagatcgcgatgctcagtg

SEQ ID NO: 26791 - DNA, 30 bp, Homo sapiens
acaaactactgctttgtaatgaattctgta

SEQ ID NO: 26792 - DNA, 30 bp, Homo sapiens
tacactgtcttgatgcttcttcagtttgga

SEQ ID NO: 26793 - DNA, 30 bp, Homo sapiens
gatatcatctcttctcaatttcatttgaag

SEQ ID NO: 26794 - DNA, 30 bp, Homo sapiens
agtgctttagatttgaaactgaagacatta

SEQ ID NO: 26795 - DNA, 30 bp, Homo sapiens
tggcggattgcttgaatcccgaagttcaaa

SEQ ID NO: 26796 - DNA, 30 bp, Homo sapiens
gctctagaatgtgatgagacctcagttcct

SEQ ID NO: 26797 - DNA, 30 bp, Homo sapiens
taaaccccttcacatgggtgctccattgcc

SEQ ID NO: 26798 - DNA, 30 bp, Homo sapiens
cggtatgaggaactcttttgcacagatagg

SEQ ID NO: 26799 - DNA, 30 bp, Homo sapiens
gaggtcttcaggtcctaatacctgcataac

SEQ ID NO: 26800 - DNA, 30 bp, Homo sapiens
ttcatctcctcttctaaaagcaaagagcca

SEQ ID NO: 26801 - DNA, 30 bp, Homo sapiens
caatggcatccaagtcatcaatttctaaga

SEQ ID NO: 26802 - DNA, 30 bp, Homo sapiens
agcaggcctggcagcctccatggctggcgc

SEQ ID NO: 26803 - DNA, 30 bp, Homo sapiens
agcacatgcagattcagggtaagtaaatac

SEQ ID NO: 26804 - DNA, 30 bp, Homo sapiens
tgcaggtcctttccagggtgttgcttatca

SEQ ID NO: 26805 - DNA, 30 bp, Homo sapiens
ttctggacaactcctcttcttttctttgac

SEQ ID NO: 26806 - DNA, 30 bp, Homo sapiens
agttcactttgaatcttattcctttctctt

SEQ ID NO: 26807 - DNA, 30 bp, Homo sapiens
ctccggaagatccaagttcctctagttgtt

SEQ ID NO: 26808 - DNA, 30 bp, Homo sapiens
tgtgtgacacagttttctcccatgtcctgg

SEQ ID NO: 26809 - DNA, 30 bp, Homo sapiens
tcctgagcatagcggtctgatattgtagtc

SEQ ID NO: 26810 - DNA, 30 bp, Homo sapiens
gtttcttcttctcttcactaaataggctta

SEQ ID NO: 26811 - DNA, 30 bp, Homo sapiens
agcaggtgggggcatgagacttcaggtcat

SEQ ID NO: 26812 - DNA, 30 bp, Homo sapiens
catagggagggacttttactgtactgaaag

SEQ ID NO: 26813 - DNA, 30 bp, Homo sapiens
tgcaatagctgaaatgtagaatcacattct

SEQ ID NO: 26814 - DNA, 30 bp, Homo sapiens
tgcaggtgagacgcaatctgattgcaaaca

SEQ ID NO: 26815 - DNA, 30 bp, Homo sapiens
tcctgggataaaggaatcctgggagccagc

SEQ ID NO: 26816 - DNA, 30 bp, Homo sapiens
gctcatctcggggctggggttggaggctgt

SEQ ID NO: 26817 - DNA, 30 bp, Homo sapiens
gtctggcttcggattctcttcaattcctcg

SEQ ID NO: 26818 - DNA, 30 bp, Homo sapiens
ttcctccataaagactgataagtcttggat

SEQ ID NO: 26819 - DNA, 30 bp, Homo sapiens
actcggctttgctgggcttcaggctctggg

SEQ ID NO: 26820 - DNA, 30 bp, Homo sapiens
tagcggcagccgcactcgtccaccaccatg

SEQ ID NO: 26821 - DNA, 30 bp, Homo sapiens
cgatggttgttattgaggatggggtggcca

SEQ ID NO: 26822 - DNA, 30 bp, Homo sapiens
taatggccatgctggccattgggaatgagg

SEQ ID NO: 26823 - DNA, 30 bp, Homo sapiens
tatgtggctgttgtgtgcctgttggtcaga

SEQ ID NO: 26824 - DNA, 30 bp, Homo sapiens
tactcttcagcccagtagctgcctcccatg

SEQ ID NO: 26825 - DNA, 30 bp, Homo sapiens
acctggtggcatgcgcctgtaatcccagct

SEQ ID NO: 26826 - DNA, 30 bp, Homo sapiens
cccgccaggcatagaaaaaaggaaggaggt

SEQ ID NO: 26827 - DNA, 30 bp, Homo sapiens
agcaggagccagtcaggagatacccgttgg

SEQ ID NO: 26828 - DNA, 30 bp, Homo sapiens
gtctggggtggcttctccactgccttcttg

SEQ ID NO: 26829 - DNA, 30 bp, Homo sapiens
ttcaggctcctcgagctcctggatcttttg

SEQ ID NO: 26830 - DNA, 30 bp, Homo sapiens
cagaggtcctcctgggccttcctgttcttc

SEQ ID NO: 26831 - DNA, 30 bp, Homo sapiens
gaattgcctctgcttctcaggtctttgaga

SEQ ID NO: 26832 - DNA, 30 bp, Homo sapiens
cttgtggtaaaatccagctgcaggtacttt

SEQ ID NO: 26833 - DNA, 30 bp, Homo sapiens
tggaggagagagaggaaagttaaggaagaa

SEQ ID NO: 26834 - DNA, 30 bp, Homo sapiens
taaaggctggtcttcttcatgatccgaagg

SEQ ID NO: 26835 - DNA, 30 bp, Homo sapiens
ggctggtctttttcatgatgcgcaggaact

SEQ ID NO: 26836 - DNA, 30 bp, Homo sapiens
tcttggtttacttcactgaagaactcccga

SEQ ID NO: 26837 - DNA, 30 bp, Homo sapiens
ctctggaggaaatccaccagcaggtgctca

SEQ ID NO: 26838 - DNA, 30 bp, Homo sapiens
cctccttgtccatcagtgtgtgctcagact

SEQ ID NO: 26839 - DNA, 30 bp, Homo sapiens
atttggctggtctttggggacctggagtat

SEQ ID NO: 26840 - DNA, 30 bp, Homo sapiens
acttgggacgtaggggaacttcaggaagac

SEQ ID NO: 26841 - DNA, 30 bp, Homo sapiens
tacgggacggggaagccttcatattccagg

SEQ ID NO: 26842 - DNA, 30 bp, Homo sapiens
tcaaggcccatggcctgctccatggctcga

SEQ ID NO: 26843 - DNA, 30 bp, Homo sapiens
tctgaactgggagatacagtttgaactctg

SEQ ID NO: 26844 - DNA, 30 bp, Homo sapiens
ctctagttaagttcaccttgacctcatcgg

SEQ ID NO: 26845 - DNA, 30 bp, Homo sapiens
cgcaggttcctcatctcctcgagcagcttc

SEQ ID NO: 26846 - DNA, 30 bp, Homo sapiens
ctgtcatttctggtttctctgtcatttcct

SEQ ID NO: 26847 - DNA, 30 bp, Homo sapiens
cttctcgtagattgcagcttagggcataat

SEQ ID NO: 26848 - DNA, 30 bp, Homo sapiens
ctgcgggctgtatctctttctctcgtggag

SEQ ID NO: 26849 - DNA, 30 bp, Homo sapiens
agctttgatttgctctctcttccgtgcctt

SEQ ID NO: 26850 - DNA, 30 bp, Homo sapiens
agttcacagaggtagctggcaggatgttag

SEQ ID NO: 26851 - DNA, 30 bp, Homo sapiens
tcacggtctgaatagtcttctggtctaagc

SEQ ID NO: 26852 - DNA, 30 bp, Homo sapiens
gagcacccttgatggtggaagacacccctg

SEQ ID NO: 26853 - DNA, 30 bp, Homo sapiens
tatacccaacaaattcatagccctcaaaac

SEQ ID NO: 26854 - DNA, 30 bp, Homo sapiens
aggaggtatatgggtacttccatcgcaaaa

SEQ ID NO: 26855 - DNA, 30 bp, Homo sapiens
cggtggaagcttactggggcatgccttgcg

SEQ ID NO: 26856 - DNA, 30 bp, Homo sapiens
gaaaaggcttcctcctgataaaatgcaacc

SEQ ID NO: 26857 - DNA, 30 bp, Homo sapiens
cattgggaggttgaagggatgaacaaggca

SEQ ID NO: 26858 - DNA, 30 bp, Homo sapiens
agttggtcttcacctctaagtctacctcgg

SEQ ID NO: 26859 - DNA, 30 bp, Homo sapiens
ttttggttgacctgagaggaaatccgcccc

SEQ ID NO: 26860 - DNA, 30 bp, Homo sapiens
cggtggaagacgtagaggtcctgctcgagg

SEQ ID NO: 26861 - DNA, 30 bp, Homo sapiens
gcctggccacgcgtacatgggcaggtggta

SEQ ID NO: 26862 - DNA, 30 bp, Homo sapiens
atatggcatgttaaaggttttttttgtttg

SEQ ID NO: 26863 - DNA, 30 bp, Homo sapiens
taggccaggagctttggaggagacaaactc

SEQ ID NO: 26864 - DNA, 30 bp, Homo sapiens
ggaaggtcggtaggaagtggcaccaccggg

SEQ ID NO: 26865 - DNA, 30 bp, Homo sapiens
gcaaggctcctcctcgaatgggcagttttt

SEQ ID NO: 26866 - DNA, 30 bp, Homo sapiens
agatggatttccaaagccaactgtttcctg

SEQ ID NO: 26867 - DNA, 30 bp, Homo sapiens
ggcaggggctgcaggctcagcctgacccag

SEQ ID NO: 26868 - DNA, 30 bp, Homo sapiens
taggggccagtcaacacctgggctacaaag

SEQ ID NO: 26869 - DNA, 30 bp, Homo sapiens
taggggtgggtgtagttgcccatccgcagg

SEQ ID NO: 26870 - DNA, 30 bp, Homo sapiens
ttgttccttctgtctgttgagagcactgtg

SEQ ID NO: 26871 - DNA, 30 bp, Homo sapiens
tgtacggacattagggggtttaggtcttct

SEQ ID NO: 26872 - DNA, 30 bp, Homo sapiens
caggcggcctccaggcggcgcgcgggcccg

SEQ ID NO: 26873 - DNA, 30 bp, Homo sapiens
tcctcatcttggagtttctccttcagccag

SEQ ID NO: 26874 - DNA, 30 bp, Homo sapiens
tcccggccttccgcaggggcgccgctcccg

SEQ ID NO: 26875 - DNA, 30 bp, Homo sapiens
gccaggacgctgtcgatccaggccgcatag

SEQ ID NO: 26876 - DNA, 30 bp, Homo sapiens
atctcgctcaatttcaaactgcctgtgatc

SEQ ID NO: 26877 - DNA, 30 bp, Homo sapiens
tcccatcccaacatgttgttcgcaatgtgt

SEQ ID NO: 26878 - DNA, 30 bp, Homo sapiens
cagagggtaaagctgacacggatgcatctg

SEQ ID NO: 26879 - DNA, 30 bp, Homo sapiens
tcccattctgacacattgctcgaaatgaat

SEQ ID NO: 26880 - DNA, 30 bp, Homo sapiens
tcgcatctggggtattccactatcccttcc

SEQ ID NO: 26881 - DNA, 30 bp, Homo sapiens
tataggatattcaaatttcccttcctgaca

SEQ ID NO: 26882 - DNA, 30 bp, Homo sapiens
tacatggtagctaatccagtcaaaataatt

SEQ ID NO: 26883 - DNA, 30 bp, Homo sapiens
caaaggcttgccctccagggagatgacggc

SEQ ID NO: 26884 - DNA, 30 bp, Homo sapiens
aatttctctccaagtgtcgaacggtcctta

SEQ ID NO: 26885 - DNA, 30 bp, Homo sapiens
aatgtccatagctctgccagcctgtgcaga

SEQ ID NO: 26886 - DNA, 30 bp, Homo sapiens
acatggaacaatttccaagaattttcagat

SEQ ID NO: 26887 - DNA, 30 bp, Homo sapiens
gagaggataagtttctttctcagagtgtgc

SEQ ID NO: 26888 - DNA, 30 bp, Homo sapiens
tataggacatctagtaagatgcatccgagg

SEQ ID NO: 26889 - DNA, 30 bp, Homo sapiens
cctcagggtctttgcaagcaggcacgtgta

SEQ ID NO: 26890 - DNA, 30 bp, Homo sapiens
atcttgcacctcttcttctgtctcctcttt

SEQ ID NO: 26891 - DNA, 30 bp, Homo sapiens
gtgtggttctccactttgaaaccccccatt

SEQ ID NO: 26892 - DNA, 30 bp, Homo sapiens
gccccgggagacgggatggacttggaaggc

SEQ ID NO: 26893 - DNA, 30 bp, Homo sapiens
ttgtgggaggatcggggtgtctgagggccc

SEQ ID NO: 26894 - DNA, 30 bp, Homo sapiens
caacaatcttgtgagttgaggagttgattc

SEQ ID NO: 26895 - DNA, 30 bp, Homo sapiens
aacaggagctggtctgtaggttgctctccg

SEQ ID NO: 26896 - DNA, 30 bp, Homo sapiens
atctggctggcgacggtgctgtccttggag

SEQ ID NO: 26897 - DNA, 30 bp, Homo sapiens
ttgcggctgcatcgccttctcccctccatc

SEQ ID NO: 26898 - DNA, 30 bp, Homo sapiens
ccacaaatgtgacccaggatacagagtgtt

SEQ ID NO: 26899 - DNA, 30 bp, Homo sapiens
gaacaatgtgcacctcaaagtcattttggg

SEQ ID NO: 26900 - DNA, 30 bp, Homo sapiens
cttcggtttgtctttatcttgctctttttg

SEQ ID NO: 26901 - DNA, 30 bp, Homo sapiens
caccgcgctgggacagatgcagtccgcagc

SEQ ID NO: 26902 - DNA, 30 bp, Homo sapiens
acaccagcgccagagcctgctcggtggggc

SEQ ID NO: 26903 - DNA, 30 bp, Homo sapiens
cgaaaagatgctcatctgcttcttctggca

SEQ ID NO: 26904 - DNA, 30 bp, Homo sapiens
taatggcggccagctttcttggacctcttg

SEQ ID NO: 26905 - DNA, 30 bp, Homo sapiens
ttatctgctccacactgtcttcctttgatg

SEQ ID NO: 26906 - DNA, 30 bp, Homo sapiens
cagtgggctcgcggtcagggtggccttgcc

SEQ ID NO: 26907 - DNA, 30 bp, Homo sapiens
caagggtccagactttccgtgcctcctttg

SEQ ID NO: 26908 - DNA, 30 bp, Homo sapiens
cagtggcggttcaagagcttccattagctt

SEQ ID NO: 26909 - DNA, 30 bp, Homo sapiens
ggttggtgtccctggctgggcctcgtggct

SEQ ID NO: 26910 - DNA, 30 bp, Homo sapiens
ctgaggtaaggtttgttaggaaacctctgt

SEQ ID NO: 26911 - DNA, 30 bp, Homo sapiens
cagggcagggagctcagaccatggtagtac

SEQ ID NO: 26912 - DNA, 30 bp, Homo sapiens
cgtttgcaagtcggcactgtttcagcacct

SEQ ID NO: 26913 - DNA, 30 bp, Homo sapiens
ctccaggttgaacttcttcattaggccaat

SEQ ID NO: 26914 - DNA, 30 bp, Homo sapiens
ttctcaagcatgctctgtttggcatgattg

SEQ ID NO: 26915 - DNA, 30 bp, Homo sapiens
tccaggtttcacccagagcagctccacttt

SEQ ID NO: 26916 - DNA, 30 bp, Homo sapiens
tcttctttggttgcagtggcctcaatggga

SEQ ID NO: 26917 - DNA, 30 bp, Homo sapiens
aggaggcaggaagtggctgtgcctccacag

SEQ ID NO: 26918 - DNA, 30 bp, Homo sapiens
gggcggcgctcacgcagcgctggtatgcct

SEQ ID NO: 26919 - DNA, 30 bp, Homo sapiens
gctctcaagatttcatctctttctgctgcc

SEQ ID NO: 26920 - DNA, 30 bp, Homo sapiens
gaagtaagtggaacacctttccctgtcata

SEQ ID NO: 26921 - DNA, 30 bp, Homo sapiens
atctggtggaagcatcagattccttacaga

SEQ ID NO: 26922 - DNA, 30 bp, Homo sapiens
cacagccaacagcaacataccatcggcatg

SEQ ID NO: 26923 - DNA, 30 bp, Homo sapiens
actccaggtatgctccggtgtacttttgtg

SEQ ID NO: 26924 - DNA, 30 bp, Homo sapiens
gtcttgaggaggaagatgaagactgtgaat

SEQ ID NO: 26925 - DNA, 30 bp, Homo sapiens
tgcaccaggaatgagctagccagtttagac

SEQ ID NO: 26926 - DNA, 30 bp, Homo sapiens
caaaggagacctatgatccaggggtgactt

SEQ ID NO: 26927 - DNA, 30 bp, Homo sapiens
agtcgtctatacagatcacctccccggctc

SEQ ID NO: 26928 - DNA, 30 bp, Homo sapiens
tgctgggctacctgctgtggggtaggttcg

SEQ ID NO: 26929 - DNA, 30 bp, Homo sapiens
gggcatctggttgtagttgacaatccctcc

SEQ ID NO: 26930 - DNA, 30 bp, Homo sapiens
tgttggagtctttgagtgccccctccccag

SEQ ID NO: 26931 - DNA, 30 bp, Homo sapiens
catcaagtgagtctagctcttcaccctgtg

SEQ ID NO: 26932 - DNA, 30 bp, Homo sapiens
cactggagtctgagttagctggcatcatag

SEQ ID NO: 26933 - DNA, 30 bp, Homo sapiens
atgacgacgatgtactatcagatccagatg

SEQ ID NO: 26934 - DNA, 30 bp, Homo sapiens
cgctgggtggccagcgtcctgggcttgtag

SEQ ID NO: 26935 - DNA, 30 bp, Homo sapiens
atgtggcaggaagccaaatcttctggctgc

SEQ ID NO: 26936 - DNA, 30 bp, Homo sapiens
agctgggcgctttgtggtctcggcaccctc

SEQ ID NO: 26937 - DNA, 30 bp, Homo sapiens
tacactcgtccctggccttcatgcgggcga

SEQ ID NO: 26938 - DNA, 30 bp, Homo sapiens
ctgttcacagatatgattgaatttcatggc

SEQ ID NO: 26939 - DNA, 30 bp, Homo sapiens
cgtagtgcctgcagctggtgggccactttc

SEQ ID NO: 26940 - DNA, 30 bp, Homo sapiens
ctttggctgaatttctcagctatcttctgt

SEQ ID NO: 26941 - DNA, 30 bp, Homo sapiens
tgatggcattggtgagagggaagcgcagat

SEQ ID NO: 26942 - DNA, 30 bp, Homo sapiens
cagggagccaaggcttctcttgactgcttg

SEQ ID NO: 26943 - DNA, 30 bp, Homo sapiens
tgcagcaatcacagctggtgtcgaagacaa

SEQ ID NO: 26944 - DNA, 30 bp, Homo sapiens
gtcaggtcggaatatgggatattttggtaa

SEQ ID NO: 26945 - DNA, 30 bp, Homo sapiens
aatcggtgtctttggtaaaaattctatgag

SEQ ID NO: 26946 - DNA, 30 bp, Homo sapiens
tagagcaggtcgtagaagtagtccaggccc

SEQ ID NO: 26947 - DNA, 30 bp, Homo sapiens
tccaggtgcagcatttgcaggagttgctga

SEQ ID NO: 26948 - DNA, 30 bp, Homo sapiens
gcttcctcttctggtggaaataggcatcaa

SEQ ID NO: 26949 - DNA, 30 bp, Homo sapiens
atgaggagtggacactggtcagctgcccct

SEQ ID NO: 26950 - DNA, 30 bp, Homo sapiens
cgaaggggaaaagttgctgtagaacttcca

SEQ ID NO: 26951 - DNA, 30 bp, Homo sapiens
ttcagaggactcctctaggtttccaaggtt

SEQ ID NO: 26952 - DNA, 30 bp, Homo sapiens
ataacaaaatacttccacatgttgaatagt

SEQ ID NO: 26953 - DNA, 30 bp, Homo sapiens
ctctgggctttctaggtttttgctttcctc

SEQ ID NO: 26954 - DNA, 30 bp, Homo sapiens
ggccacgcaggcctggcaggtgagagacgc

SEQ ID NO: 26955 - DNA, 30 bp, Homo sapiens
tcaaggcggccaacctccgtgacagctggt

SEQ ID NO: 26956 - DNA, 30 bp, Homo sapiens
cacttgatcccgaaggcgggccagtctctg

SEQ ID NO: 26957 - DNA, 30 bp, Homo sapiens
cgcaggttcttaagccgttcctccaggtct

SEQ ID NO: 26958 - DNA, 30 bp, Homo sapiens
gccttgagttgccgttcaatctcttcatct

SEQ ID NO: 26959 - DNA, 30 bp, Homo sapiens
gctgcggagtgtggccagccgggactgcat

SEQ ID NO: 26960 - DNA, 30 bp, Homo sapiens
cagccaactgctttagtgcttcttcatctt

SEQ ID NO: 26961 - DNA, 30 bp, Homo sapiens
tacatggatccagcccagttctccaattcc

SEQ ID NO: 26962 - DNA, 30 bp, Homo sapiens
ctgccaattgtttgatatcatcatcctctt

SEQ ID NO: 26963 - DNA, 30 bp, Homo sapiens
ttctggggtgccataactgcgactcagtgc

SEQ ID NO: 26964 - DNA, 30 bp, Homo sapiens
agcagggatctgtggcaatccaaattcatc

SEQ ID NO: 26965 - DNA, 30 bp, Homo sapiens
tacgaagctgccaccagctccgcctgcctg

SEQ ID NO: 26966 - DNA, 30 bp, Homo sapiens
caatggctttagagtcggttccaattgcct

SEQ ID NO: 26967 - DNA, 30 bp, Homo sapiens
ccagtctctgataccgtatatcattcaatg

SEQ ID NO: 26968 - DNA, 30 bp, Homo sapiens
ttttggtaccgcatatcatgcagggtggtc

SEQ ID NO: 26969 - DNA, 30 bp, Homo sapiens
tcaaatgccattttgacatcttcaatgtgt

SEQ ID NO: 26970 - DNA, 30 bp, Homo sapiens
tgatttcaagccattccaagctattgttct

SEQ ID NO: 26971 - DNA, 30 bp, Homo sapiens
cactttcttttctggtactctttgaaatcc

SEQ ID NO: 26972 - DNA, 30 bp, Homo sapiens
caatctgttgtggcatctttttgtttttcc

SEQ ID NO: 26973 - DNA, 30 bp, Homo sapiens
gtgaagaaatcggatgctcattttctgttc

SEQ ID NO: 26974 - DNA, 30 bp, Homo sapiens
ttcaggatccggatgctcattttttgctca

SEQ ID NO: 26975 - DNA, 30 bp, Homo sapiens
tcctgttcaaagagtagcatggccagctgg

SEQ ID NO: 26976 - DNA, 30 bp, Homo sapiens
tattggcctgctcctgctcaaagagagcca

SEQ ID NO: 26977 - DNA, 30 bp, Homo sapiens
caggtgcttgatgacatgcagtcttgaata

SEQ ID NO: 26978 - DNA, 30 bp, Homo sapiens
tcatggtcactttcattatcattgtcattc

SEQ ID NO: 26979 - DNA, 30 bp, Homo sapiens
gagccttcggcttctttctccagctctgga

SEQ ID NO: 26980 - DNA, 30 bp, Homo sapiens
cagtggcccttttcagatctctccaggtac

SEQ ID NO: 26981 - DNA, 30 bp, Homo sapiens
gtctggactggccgtgaccttcagctccag

SEQ ID NO: 26982 - DNA, 30 bp, Homo sapiens
cattggcgggagggagtgcggtgcacggag

SEQ ID NO: 26983 - DNA, 30 bp, Homo sapiens
agcgcctatgttcttataatgacacatgag

SEQ ID NO: 26984 - DNA, 30 bp, Homo sapiens
acaaggcctgctcgggtgcgcgcttgtgaa

SEQ ID NO: 26985 - DNA, 30 bp, Homo sapiens
tacctggcagtgccgatgttccgatactgg

SEQ ID NO: 26986 - DNA, 30 bp, Homo sapiens
ccagtacaacttctcttccacttttttctt

SEQ ID NO: 26987 - DNA, 30 bp, Homo sapiens
aacacggctagggttccgatgatgcaaaca

SEQ ID NO: 26988 - DNA, 30 bp, Homo sapiens
cacagggcctgcaccagcaccaggaggctc

SEQ ID NO: 26989 - DNA, 30 bp, Homo sapiens
gctaggaacggaggcagaaagaggccgatg

SEQ ID NO: 26990 - DNA, 30 bp, Homo sapiens
ccctggccatcaggggttgcagaaacaatc

SEQ ID NO: 26991 - DNA, 30 bp, Homo sapiens
cccaggttcttgatcggatgtttctgtgga

SEQ ID NO: 26992 - DNA, 30 bp, Homo sapiens
tagatcatgccagccagccagggcggcagg

SEQ ID NO: 26993 - DNA, 30 bp, Homo sapiens
gactgttttcgtactggtcccttcaaaacg

SEQ ID NO: 26994 - DNA, 30 bp, Homo sapiens
aaacatccgatcaagaacctgggctatgaa

SEQ ID NO: 26995 - DNA, 30 bp, Homo sapiens
ttcccaagtagtggctgtagaaatagccct

SEQ ID NO: 26996 - DNA, 30 bp, Homo sapiens
ctttggacacggcctccacgaagttgggag

SEQ ID NO: 26997 - DNA, 30 bp, Homo sapiens
gaagaatcggtctatgactttcgccacctt

SEQ ID NO: 26998 - DNA, 30 bp, Homo sapiens
gaaaggggtctggagggggcaagtggtacg

SEQ ID NO: 26999 - DNA, 30 bp, Homo sapiens
acttggagctgggggctgagtggtctgagt

SEQ ID NO: 27000 - DNA, 30 bp, Homo sapiens
ggtaactatgtagccacatcttcaaagcag

SEQ ID NO: 27001 - DNA, 30 bp, Homo sapiens
gtcacgctgggcagcgtagggcccctcaga

SEQ ID NO: 27002 - DNA, 30 bp, Homo sapiens
gagaggacagcccaggcccccatccttgcc

SEQ ID NO: 27003 - DNA, 30 bp, Homo sapiens
tagatgaagcgcttgtcctgcacgttgtag

SEQ ID NO: 27004 - DNA, 30 bp, Homo sapiens
ggctggatacacggcgcgtaggggagatca

SEQ ID NO: 27005 - DNA, 30 bp, Homo sapiens
gtctggtgagggcaggtaggggcgtggatc

SEQ ID NO: 27006 - DNA, 30 bp, Homo sapiens
cacgagaaggggcggaagtcccgctcctcc

SEQ ID NO: 27007 - DNA, 30 bp, Homo sapiens
ttctggtacccaaagagcttaaagtcccct

SEQ ID NO: 27008 - DNA, 30 bp, Homo sapiens
ttcaggtagcttggcactgagtaattgaac

SEQ ID NO: 27009 - DNA, 30 bp, Homo sapiens
tctcggaggaggttttcgggcttggggtag

SEQ ID NO: 27010 - DNA, 30 bp, Homo sapiens
gagcagccgcaggtaggagggggcggagta

SEQ ID NO: 27011 - DNA, 30 bp, Homo sapiens
ccttggtgacattaggcagtgggtaggcaa

SEQ ID NO: 27012 - DNA, 30 bp, Homo sapiens
ataatggggaacagcatttgcacattaaaa

SEQ ID NO: 27013 - DNA, 30 bp, Homo sapiens
aaacgcctcatccgcgaggacctgcgccag

SEQ ID NO: 27014 - DNA, 30 bp, Homo sapiens
tagagacggggcttccgaagcagggtcttg

SEQ ID NO: 27015 - DNA, 30 bp, Homo sapiens
tacgtgacccagaaggtgcccctctcctcc

SEQ ID NO: 27016 - DNA, 30 bp, Homo sapiens
tagtggatttgctcagggacagtccaggta

SEQ ID NO: 27017 - DNA, 30 bp, Homo sapiens
gtcaggcgatgcccagctgaagtggtctgg

SEQ ID NO: 27018 - DNA, 30 bp, Homo sapiens
atttcgggggtgcgaggcggtggatgatgc

SEQ ID NO: 27019 - DNA, 30 bp, Homo sapiens
acgtggcgccgtcggcatccatctccagcg

SEQ ID NO: 27020 - DNA, 30 bp, Homo sapiens
agtacagatctgcaaagggcttggaatagt

SEQ ID NO: 27021 - DNA, 30 bp, Homo sapiens
aatactgtctcacgacttgagcattggttc

SEQ ID NO: 27022 - DNA, 30 bp, Homo sapiens
tgagccattattattgctgcttttactgta

SEQ ID NO: 27023 - DNA, 30 bp, Homo sapiens
ttcagccagttgcatggttgaggcgaaagt

SEQ ID NO: 27024 - DNA, 30 bp, Homo sapiens
tgtacaggctgcgccgcacggcgttggaga

SEQ ID NO: 27025 - DNA, 30 bp, Homo sapiens
taagggggcaacattccatttgggtacatt

SEQ ID NO: 27026 - DNA, 30 bp, Homo sapiens
gtgaggggagacagaggtaggaagagggtg

SEQ ID NO: 27027 - DNA, 30 bp, Homo sapiens
cattggtttcgggatctgtctgcgccatgt

SEQ ID NO: 27028 - DNA, 30 bp, Homo sapiens
tcctcatttgcctcatgaataatagtgctt

SEQ ID NO: 27029 - DNA, 30 bp, Homo sapiens
ccaaggcagttcaaattttcttctatcatt

SEQ ID NO: 27030 - DNA, 30 bp, Homo sapiens
tcgggggtcatcagggagaatactgatagt

SEQ ID NO: 27031 - DNA, 30 bp, Homo sapiens
aacagacacagcatggtatactcgatcata

SEQ ID NO: 27032 - DNA, 30 bp, Homo sapiens
agtcggttgcaggctctgccgatgtctcat

SEQ ID NO: 27033 - DNA, 30 bp, Homo sapiens
cagaggccttcaggccgctgatacttccag

SEQ ID NO: 27034 - DNA, 30 bp, Homo sapiens
ccccaggtttgaaggctggcatcccaaggt

SEQ ID NO: 27035 - DNA, 30 bp, Homo sapiens
aggcatcatgaagattgctatcactcagaa

SEQ ID NO: 27036 - DNA, 30 bp, Homo sapiens
tagaggttgagaagatgagcatcagcagca

SEQ ID NO: 27037 - DNA, 30 bp, Homo sapiens
cacaggacaatcttaaaggagctggcaaag

SEQ ID NO: 27038 - DNA, 30 bp, Homo sapiens
atccggatgtggaaagtgctgaggaagtca

SEQ ID NO: 27039 - DNA, 30 bp, Homo sapiens
gattcggatgtggaaggtgctgaggaagtc

SEQ ID NO: 27040 - DNA, 30 bp, Homo sapiens
aagtgaatccgaaaggagttcatgaaatct

SEQ ID NO: 27041 - DNA, 30 bp, Homo sapiens
cctgcctgtggcagctgtggagggacctgg

SEQ ID NO: 27042 - DNA, 30 bp, Homo sapiens
ccacacgtgaacctgcccttggcttgtgac

SEQ ID NO: 27043 - DNA, 30 bp, Homo sapiens
agtaggaatggaggcggcccttctgctgcc

SEQ ID NO: 27044 - DNA, 30 bp, Homo sapiens
gacaggtcgggataagggatgaggccttgc

SEQ ID NO: 27045 - DNA, 30 bp, Homo sapiens
ctcaggctgatccgtgaatcctgttgttgc

SEQ ID NO: 27046 - DNA, 30 bp, Homo sapiens
atcaggggctgttgagcaactctaggaaat

SEQ ID NO: 27047 - DNA, 30 bp, Homo sapiens
cactgccggaccctaccccggcgggtgcgg

SEQ ID NO: 27048 - DNA, 30 bp, Homo sapiens
tgtacatctccaagagcttatgcgaaacct

SEQ ID NO: 27049 - DNA, 30 bp, Homo sapiens
gctcggtggcctgtctccagcagcatgctc

SEQ ID NO: 27050 - DNA, 30 bp, Homo sapiens
ttctggatttatttttccaccacttaaact

SEQ ID NO: 27051 - DNA, 30 bp, Homo sapiens
atatggctgggtgatcagagaatgcttcta

SEQ ID NO: 27052 - DNA, 30 bp, Homo sapiens
tcctgggtgctctctgtacattttttctcc

SEQ ID NO: 27053 - DNA, 30 bp, Homo sapiens
tgtaggacccgcccgagctccggtcactgt

SEQ ID NO: 27054 - DNA, 30 bp, Homo sapiens
ctgtcataactgtctctgtaggacccgccc

SEQ ID NO: 27055 - DNA, 30 bp, Homo sapiens
ctgaggacaagaagcaggcacagtgtaaag

SEQ ID NO: 27056 - DNA, 30 bp, Homo sapiens
ttgtctccagtctcttcgttatgttttgtg

SEQ ID NO: 27057 - DNA, 30 bp, Homo sapiens
ctctggttgaaaaacatagtctttctgaac

SEQ ID NO: 27058 - DNA, 30 bp, Homo sapiens
cagagtggggagcccacttctgccttctgc

SEQ ID NO: 27059 - DNA, 30 bp, Homo sapiens
agctggaaggggtactgtcggaggtagtcg

SEQ ID NO: 27060 - DNA, 30 bp, Homo sapiens
tcacctgggacagcggggtcctcacggctc

SEQ ID NO: 27061 - DNA, 30 bp, Homo sapiens
agatggaaagtccgcagtgaagtcaaactc

SEQ ID NO: 27062 - DNA, 30 bp, Homo sapiens
tgctgggctgctgtttgcacacgaagtccg

SEQ ID NO: 27063 - DNA, 30 bp, Homo sapiens
gcagctcacggagccggcgggcggcgcgga

SEQ ID NO: 27064 - DNA, 30 bp, Homo sapiens
ttgaggcgggttgagcgccgaggtagtggg

SEQ ID NO: 27065 - DNA, 30 bp, Homo sapiens
agtacacccggcacagtgctgcattagggc

SEQ ID NO: 27066 - DNA, 30 bp, Homo sapiens
cccctgccagaatggctttctcatagattg

SEQ ID NO: 27067 - DNA, 30 bp, Homo sapiens
tgttacaggcagcgcctcatttctacggaa

SEQ ID NO: 27068 - DNA, 30 bp, Homo sapiens
cgtgaatcttctccactttcacaaacaacc

SEQ ID NO: 27069 - DNA, 30 bp, Homo sapiens
tttttttcaagtcgtctatgttagctgtgg

SEQ ID NO: 27070 - DNA, 30 bp, Homo sapiens
ttctgggcaggcatgaggtcgtcgatggcc

SEQ ID NO: 27071 - DNA, 30 bp, Homo sapiens
accaactgtcaatgttgtggtttctggtat

SEQ ID NO: 27072 - DNA, 30 bp, Homo sapiens
ttctggtaaggaccgctgggattgaacaga

SEQ ID NO: 27073 - DNA, 30 bp, Homo sapiens
ttctgggcggggatcatgtcgtcaatggac

SEQ ID NO: 27074 - DNA, 30 bp, Homo sapiens
gcttggtgtggatgacaggtgtggggatgc

SEQ ID NO: 27075 - DNA, 30 bp, Homo sapiens
tgaggcagagggggtggcaccttaatatct

SEQ ID NO: 27076 - DNA, 30 bp, Homo sapiens
ctttggtttcttgggtagtgggcgccggaa

SEQ ID NO: 27077 - DNA, 30 bp, Homo sapiens
ttctggctcatgaatcatgtaatgaaccca

SEQ ID NO: 27078 - DNA, 30 bp, Homo sapiens
gctgtgcgtggagacatcggaggaggagct

SEQ ID NO: 27079 - DNA, 30 bp, Homo sapiens
acatcagtagtgggatcagctcctccagaa

SEQ ID NO: 27080 - DNA, 30 bp, Homo sapiens
tgtcggtaatgggggcttcgggatcgggac

SEQ ID NO: 27081 - DNA, 30 bp, Homo sapiens
gcgtggagtgaacatccttttccttggaat

SEQ ID NO: 27082 - DNA, 30 bp, Homo sapiens
gtcagggagatatctctccacacttgcacc

SEQ ID NO: 27083 - DNA, 30 bp, Homo sapiens
gctattgacagctgcagttctcctatccac

SEQ ID NO: 27084 - DNA, 30 bp, Homo sapiens
tctttcttgtctgctctctttttcctgctt

SEQ ID NO: 27085 - DNA, 30 bp, Homo sapiens
tggtggtacttaaaataaagttaacaatta

SEQ ID NO: 27086 - DNA, 30 bp, Homo sapiens
gccacaggggctgctgaccggatcctgtcc

SEQ ID NO: 27087 - DNA, 30 bp, Homo sapiens
gcccccaggtgcagggtgactgcagctgct

SEQ ID NO: 27088 - DNA, 30 bp, Homo sapiens
caaaggatcagttcatcctcatcctcctcg

SEQ ID NO: 27089 - DNA, 30 bp, Homo sapiens
cattggcatttgtcgtcgctgtcggaaggg

SEQ ID NO: 27090 - DNA, 30 bp, Homo sapiens
gcggggtcttggtttgccgtctgggccata

SEQ ID NO: 27091 - DNA, 30 bp, Homo sapiens
ccgtttcttctctctcctcatctgtgagat

SEQ ID NO: 27092 - DNA, 30 bp, Homo sapiens
tcctggtttgccatctgggccatatgtctc

SEQ ID NO: 27093 - DNA, 30 bp, Homo sapiens
acttctcggtctaagggaggaacatcatct

SEQ ID NO: 27094 - DNA, 30 bp, Homo sapiens
atcaggatcttggttcgccatctgtgctat

SEQ ID NO: 27095 - DNA, 30 bp, Homo sapiens
agatggtctggtagtgctgcctcagccggg

SEQ ID NO: 27096 - DNA, 30 bp, Homo sapiens
gtctgggccagcgagagctcctccaagcct

SEQ ID NO: 27097 - DNA, 30 bp, Homo sapiens
cactttggagctggcggatttgtcaggttg

SEQ ID NO: 27098 - DNA, 30 bp, Homo sapiens
cactttggggctggcggatttgtcaggttg

SEQ ID NO: 27099 - DNA, 30 bp, Homo sapiens
cgctggaaggtgcaggttttggatagggcc

SEQ ID NO: 27100 - DNA, 30 bp, Homo sapiens
tgatactttgtccgagaagacatgacagat

SEQ ID NO: 27101 - DNA, 30 bp, Homo sapiens
tatacgtgggcactcttcgcatgagtcggg

SEQ ID NO: 27102 - DNA, 30 bp, Homo sapiens
taagtggtgtgtgaaactactggaatgtca

SEQ ID NO: 27103 - DNA, 30 bp, Homo sapiens
cccgctgtgcgtggccgaggtcactgaggg

SEQ ID NO: 27104 - DNA, 30 bp, Homo sapiens
cgtaggcgtttctgccgtatttgccaaagc

SEQ ID NO: 27105 - DNA, 30 bp, Homo sapiens
tgtctacagcatacattttggccgtctctg

SEQ ID NO: 27106 - DNA, 30 bp, Homo sapiens
aactggtggaggtcttactaagcattgtcg

SEQ ID NO: 27107 - DNA, 30 bp, Homo sapiens
gcttggaaggataagattgtacctcgtcct

SEQ ID NO: 27108 - DNA, 30 bp, Homo sapiens
cccatcctatgccccagtggccctgcccag

SEQ ID NO: 27109 - DNA, 30 bp, Homo sapiens
tctcgggcagcagcagagggtccaggccga

SEQ ID NO: 27110 - DNA, 30 bp, Homo sapiens
cccagggggcccttggcggaggcgggcaat

SEQ ID NO: 27111 - DNA, 30 bp, Homo sapiens
gtcaggctgtaggaattgaactcactcttg

SEQ ID NO: 27112 - DNA, 30 bp, Homo sapiens
gattgtgtgtggaattgttctcgagctgtg

SEQ ID NO: 27113 - DNA, 30 bp, Homo sapiens
ttcaggttggtgtttctcgtctccagttct

SEQ ID NO: 27114 - DNA, 30 bp, Homo sapiens
tagaggtcggagtcgcagggcagcgagctg

SEQ ID NO: 27115 - DNA, 30 bp, Homo sapiens
ttccaggtagggacactgagtttgcatttg

SEQ ID NO: 27116 - DNA, 30 bp, Homo sapiens
tcctaggtcttagcatgaggtggaaggagc

SEQ ID NO: 27117 - DNA, 30 bp, Homo sapiens
gacgtagtccttgcggtcgtagcctgtgcc

SEQ ID NO: 27118 - DNA, 30 bp, Homo sapiens
tgcacttggccgtacgggggacatttgtaa

SEQ ID NO: 27119 - DNA, 30 bp, Homo sapiens
acgtagttgctggcagcagcagagcgggca

SEQ ID NO: 27120 - DNA, 30 bp, Homo sapiens
gacgtagttcttcttgtcgtagtcgccggt

SEQ ID NO: 27121 - DNA, 30 bp, Homo sapiens
cagacgtaattcttggtagggtactcagag

SEQ ID NO: 27122 - DNA, 30 bp, Homo sapiens
ccagccaataaagatggcagggccaaactc

SEQ ID NO: 27123 - DNA, 30 bp, Homo sapiens
cacacatactccttggaagagttggactta

SEQ ID NO: 27124 - DNA, 30 bp, Homo sapiens
ttctggagtagacgctcggtgacttctttc

SEQ ID NO: 27125 - DNA, 30 bp, Homo sapiens
cacacgtagtccctcttgtccagtccagat

SEQ ID NO: 27126 - DNA, 30 bp, Homo sapiens
gatatgccttcattaaggtgtactctttcc

SEQ ID NO: 27127 - DNA, 30 bp, Homo sapiens
acacggggaatccactgatggcgtcggtgc

SEQ ID NO: 27128 - DNA, 30 bp, Homo sapiens
tcctggctggtctgacccaggccagcctcg

SEQ ID NO: 27129 - DNA, 30 bp, Homo sapiens
tagaaggggaactcgcagacgtagtagaga

SEQ ID NO: 27130 - DNA, 30 bp, Homo sapiens
gcctccctaaaatatgtagaaccaagctgc

SEQ ID NO: 27131 - DNA, 30 bp, Homo sapiens
tcataccacgagtggaatcttcttcaggag

SEQ ID NO: 27132 - DNA, 30 bp, Homo sapiens
cctcagtcttcactggggcagctgtcttct

SEQ ID NO: 27133 - DNA, 30 bp, Homo sapiens
atagttagagacgtacaaggatggagaggg

SEQ ID NO: 27134 - DNA, 30 bp, Homo sapiens
gcatcactagagccaagaggggactccgcc

SEQ ID NO: 27135 - DNA, 30 bp, Homo sapiens
cgacggggcttctgagagaggaagggcagc

SEQ ID NO: 27136 - DNA, 30 bp, Homo sapiens
cagcggtgcccacaggctcagcacatgcag

SEQ ID NO: 27137 - DNA, 30 bp, Homo sapiens
aacaggaacatttccgctcacaaatccaat

SEQ ID NO: 27138 - DNA, 30 bp, Homo sapiens
tattgggttcctctggctcccagaaggtgc

SEQ ID NO: 27139 - DNA, 30 bp, Homo sapiens
gaccctgggccccaccgggagatgtgctcc

SEQ ID NO: 27140 - DNA, 30 bp, Homo sapiens
gaatggtcagagatgggattttgcagacaa

SEQ ID NO: 27141 - DNA, 30 bp, Homo sapiens
cctaatgtttcaggggggacatggaggctc

SEQ ID NO: 27142 - DNA, 30 bp, Homo sapiens
agttggtccaccttggtcatgccagccttc

SEQ ID NO: 27143 - DNA, 30 bp, Homo sapiens
gaactatggactccatcagcactcaagaaa

SEQ ID NO: 27144 - DNA, 30 bp, Homo sapiens
taaggggtcccagcagaagaagccattgtc

SEQ ID NO: 27145 - DNA, 30 bp, Homo sapiens
aatccattttctttcggtgtaacatctagc

SEQ ID NO: 27146 - DNA, 30 bp, Homo sapiens
caagtataggccatcttgctgcacacccag

SEQ ID NO: 27147 - DNA, 30 bp, Homo sapiens
ttgagggatggtgaactcgcatatgtatct

SEQ ID NO: 27148 - DNA, 30 bp, Homo sapiens
acacgatcccgaactggcagatgtagggca

SEQ ID NO: 27149 - DNA, 30 bp, Homo sapiens
ttgaggaccaagacaattaacatcattcca

SEQ ID NO: 27150 - DNA, 30 bp, Homo sapiens
ctgaggtacatgacagtgaatgtcattcca

SEQ ID NO: 27151 - DNA, 30 bp, Homo sapiens
tccaggtattttacaaatcctacttgcttc

SEQ ID NO: 27152 - DNA, 30 bp, Homo sapiens
atttcacaaatccgaaaataattgaggaaa

SEQ ID NO: 27153 - DNA, 30 bp, Homo sapiens
tcctggtgctgtggctcgctttgttctggg

SEQ ID NO: 27154 - DNA, 30 bp, Homo sapiens
tagtggccgctttgttctgggcggcgttga

SEQ ID NO: 27155 - DNA, 30 bp, Homo sapiens
ctgaggatccagggacagggaggggtgtct

SEQ ID NO: 27156 - DNA, 30 bp, Homo sapiens
ctcacagatccagccgtccttctcgctgtc

SEQ ID NO: 27157 - DNA, 30 bp, Homo sapiens
attgttgggttctccactgttccagtaccg

SEQ ID NO: 27158 - DNA, 30 bp, Homo sapiens
agcaggctgcgggctttttgcagatccagt

SEQ ID NO: 27159 - DNA, 30 bp, Homo sapiens
atttggcattcttctcacagatcctgcggt

SEQ ID NO: 27160 - DNA, 30 bp, Homo sapiens
ccatcctgtaggtttccagaagactattga

SEQ ID NO: 27161 - DNA, 30 bp, Homo sapiens
acaatttggagatgggttttcttgggtagc

SEQ ID NO: 27162 - DNA, 30 bp, Homo sapiens
agttggtcataaatgactgacacgtgaatc

SEQ ID NO: 27163 - DNA, 30 bp, Homo sapiens
aattccacagctttgaaaccagccatggta

SEQ ID NO: 27164 - DNA, 30 bp, Homo sapiens
cagaggatctcaacgcatacttctcacaga

SEQ ID NO: 27165 - DNA, 30 bp, Homo sapiens
acattttcccttatgcaccttccagtcttt

SEQ ID NO: 27166 - DNA, 30 bp, Homo sapiens
gtactcttcttttgcgtactgactttatcg

SEQ ID NO: 27167 - DNA, 30 bp, Homo sapiens
cacatgttccattaggttgactgcgtcatc

SEQ ID NO: 27168 - DNA, 30 bp, Homo sapiens
ttgagggcctttgccacttgctcataggcg

SEQ ID NO: 27169 - DNA, 30 bp, Homo sapiens
tcttctgtttagccacatttgcgtaagtat

SEQ ID NO: 27170 - DNA, 30 bp, Homo sapiens
tagcgggggtgcacggcgggccggtaggcc

SEQ ID NO: 27171 - DNA, 30 bp, Homo sapiens
tatcactgggacaggtattggtgaactcgt

SEQ ID NO: 27172 - DNA, 30 bp, Homo sapiens
gatcggctgaggcgtttggcgacatcagcg

SEQ ID NO: 27173 - DNA, 30 bp, Homo sapiens
cagtggtacttgttccttgaccacatggag

SEQ ID NO: 27174 - DNA, 30 bp, Homo sapiens
agctggacacgtatttgtgaactcatctct

SEQ ID NO: 27175 - DNA, 30 bp, Homo sapiens
gcttgggttgcacagttccagaagtcatgg

SEQ ID NO: 27176 - DNA, 30 bp, Homo sapiens
agaaggtttcgtcgtcattgcagttggtgg

SEQ ID NO: 27177 - DNA, 30 bp, Homo sapiens
gtttctgagctttgtcctgctggtggatgc

SEQ ID NO: 27178 - DNA, 30 bp, Homo sapiens
agactgcatctccgccctcagcatccaggg

SEQ ID NO: 27179 - DNA, 30 bp, Homo sapiens
gggaagaagcagaagttgtgctaaaacttc

SEQ ID NO: 27180 - DNA, 30 bp, Homo sapiens
aattccccgataggtcactctgctcggtcg

SEQ ID NO: 27181 - DNA, 30 bp, Homo sapiens
gaaaggatgctttaaggcttctctgagagt

SEQ ID NO: 27182 - DNA, 30 bp, Homo sapiens
gatatcccgactggagtcccacaacttgtt

SEQ ID NO: 27183 - DNA, 30 bp, Homo sapiens
atctgcttgggttgcggctggtgtggaagg

SEQ ID NO: 27184 - DNA, 30 bp, Homo sapiens
ccaaggtaattctttgagttggatcatatt

SEQ ID NO: 27185 - DNA, 30 bp, Homo sapiens
cttccttcttcccatcatcattgcccaagt

SEQ ID NO: 27186 - DNA, 30 bp, Homo sapiens
aacatccagttgtgggaagagcagcaagca

SEQ ID NO: 27187 - DNA, 30 bp, Homo sapiens
gtttggaaggctctgctctggctggggatc

SEQ ID NO: 27188 - DNA, 30 bp, Homo sapiens
agctggcagaggaagtcatgcagaggcaaa

SEQ ID NO: 27189 - DNA, 30 bp, Homo sapiens
agtgttttgtttctgataggtaaagggatt

SEQ ID NO: 27190 - DNA, 30 bp, Homo sapiens
gctgacgtgaagggtgtagaaagcccaggg

SEQ ID NO: 27191 - DNA, 30 bp, Homo sapiens
catctgaccagtacctgtctaaccccacgc

SEQ ID NO: 27192 - DNA, 30 bp, Homo sapiens
tacagaggcaagaggtgtctggtgagaggg

SEQ ID NO: 27193 - DNA, 30 bp, Homo sapiens
actgtccagcaactgttggtgtggtatcca

SEQ ID NO: 27194 - DNA, 30 bp, Homo sapiens
ctgtggttgaaccttggaagggtcgggcaa

SEQ ID NO: 27195 - DNA, 30 bp, Homo sapiens
aaccggatatccatgatgagaaggaagttc

SEQ ID NO: 27196 - DNA, 30 bp, Homo sapiens
agatggtgttgcacaccttctcagggtgca

SEQ ID NO: 27197 - DNA, 30 bp, Homo sapiens
agctgggacaggttctgctgccggcgctgc

SEQ ID NO: 27198 - DNA, 30 bp, Homo sapiens
gcttggagcgtccagcgtcatggcagatgc

SEQ ID NO: 27199 - DNA, 30 bp, Homo sapiens
tctgccttccaattttctgacaacggccat

SEQ ID NO: 27200 - DNA, 30 bp, Homo sapiens
tcgaaggcaggaagcatggagtagctggca

SEQ ID NO: 27201 - DNA, 30 bp, Homo sapiens
agctggatttggagcaagttggtggcaacc

SEQ ID NO: 27202 - DNA, 30 bp, Homo sapiens
aatcatatggcaccggcgggaacacatcaa

SEQ ID NO: 27203 - DNA, 30 bp, Homo sapiens
tcttgtcctctgctggctttggaggggctt

SEQ ID NO: 27204 - DNA, 30 bp, Homo sapiens
gtccgtgtggggcgcccgcgtggccttctc

SEQ ID NO: 27205 - DNA, 30 bp, Homo sapiens
gcttggcggggccatccttcttcttcaact

SEQ ID NO: 27206 - DNA, 30 bp, Homo sapiens
aaaaggttttccaaaagcattgtacatgaa

SEQ ID NO: 27207 - DNA, 30 bp, Homo sapiens
ctgtggcctttagtcagccagaatgaggtg

SEQ ID NO: 27208 - DNA, 30 bp, Homo sapiens
agtacattagatctgcagctacattagttg

SEQ ID NO: 27209 - DNA, 30 bp, Homo sapiens
ctgtgaccgtggcctcttcgattttggtct

SEQ ID NO: 27210 - DNA, 30 bp, Homo sapiens
ccttggagcatattccattggctttctctg

SEQ ID NO: 27211 - DNA, 30 bp, Homo sapiens
gtgctatcatctgttttgaggtgcttaggt

SEQ ID NO: 27212 - DNA, 30 bp, Homo sapiens
taaccatgtgggtcaaatgaaagcctgaag

SEQ ID NO: 27213 - DNA, 30 bp, Homo sapiens
ctgagggtggagtcatcccactccagctgc

SEQ ID NO: 27214 - DNA, 30 bp, Homo sapiens
agtaggggagggtggagtcatcccactcca

SEQ ID NO: 27215 - DNA, 30 bp, Homo sapiens
tagcggtgtgggggggtctcgatgatgcgt

SEQ ID NO: 27216 - DNA, 30 bp, Homo sapiens
cagcggggcctgcttgagggagatgaggac

SEQ ID NO: 27217 - DNA, 30 bp, Homo sapiens
ttgcataccattcttctagctcctttattg

SEQ ID NO: 27218 - DNA, 30 bp, Homo sapiens
tagcgggacagtggcgtctgcttcagggac

SEQ ID NO: 27219 - DNA, 30 bp, Homo sapiens
gccaggctgtggctgtccatacggtggtgc

SEQ ID NO: 27220 - DNA, 30 bp, Homo sapiens
gcttgcgcagactctccaaggcatccagtt

SEQ ID NO: 27221 - DNA, 30 bp, Homo sapiens
ctttttgcggtattcctgcagcgctttctc

SEQ ID NO: 27222 - DNA, 30 bp, Homo sapiens
tccaggggttcagatttccggacccttcga

SEQ ID NO: 27223 - DNA, 30 bp, Homo sapiens
tatccctgcacgctcggagaagggtccttg

SEQ ID NO: 27224 - DNA, 30 bp, Homo sapiens
cgtagccaatgaagttagaactctcagcac

SEQ ID NO: 27225 - DNA, 30 bp, Homo sapiens
gccaggagtggctgggtgttctcattctct

SEQ ID NO: 27226 - DNA, 30 bp, Homo sapiens
aaagcaatggttgcatgttttcttcctcat

SEQ ID NO: 27227 - DNA, 30 bp, Homo sapiens
tggaggtggcaagcgtaacagtgttctggg

SEQ ID NO: 27228 - DNA, 30 bp, Homo sapiens
tgcaggatctggttgatccagggccggtaa

SEQ ID NO: 27229 - DNA, 30 bp, Homo sapiens
gtaggcaaatgtgctctgcaaattctcgga

SEQ ID NO: 27230 - DNA, 30 bp, Homo sapiens
ggcctcgtcaatgtagggcttgtctgcagg

SEQ ID NO: 27231 - DNA, 30 bp, Homo sapiens
tgcttgttggaagcttctgtagccttttct

SEQ ID NO: 27232 - DNA, 30 bp, Homo sapiens
tggaggattaaaaagtttctttcgcattgc

SEQ ID NO: 27233 - DNA, 30 bp, Homo sapiens
gttaggttttcttcctcttctttttcaaat

SEQ ID NO: 27234 - DNA, 30 bp, Homo sapiens
accaggcttcggtgtagcggacgtccactt

SEQ ID NO: 27235 - DNA, 30 bp, Homo sapiens
tgccggtctccctctcattcatagaagtcc

SEQ ID NO: 27236 - DNA, 30 bp, Homo sapiens
ttgtcaaaaatctgcacaacttcatcaaaa

SEQ ID NO: 27237 - DNA, 30 bp, Homo sapiens
ttctggattaggcttaataccgtctgcagg

SEQ ID NO: 27238 - DNA, 30 bp, Homo sapiens
tttgacgaaacacactgttggcctcaagtt

SEQ ID NO: 27239 - DNA, 30 bp, Homo sapiens
tccaggccttgactcgagtgtgatgaatcc

SEQ ID NO: 27240 - DNA, 30 bp, Homo sapiens
aaaaggcccagtttcaaggattctgacttg

SEQ ID NO: 27241 - DNA, 30 bp, Homo sapiens
gacatagagtaaatgccttcttttcttttc

SEQ ID NO: 27242 - DNA, 30 bp, Homo sapiens
aggcgggcctctgcggggcgtcggggccgg

SEQ ID NO: 27243 - DNA, 30 bp, Homo sapiens
catttctttccctttgctggccctggtggc

SEQ ID NO: 27244 - DNA, 30 bp, Homo sapiens
gtcagagtccgagtcggaattctcttcttc

SEQ ID NO: 27245 - DNA, 30 bp, Homo sapiens
gtgtccaggcgctggatctcagggcgactg

SEQ ID NO: 27246 - DNA, 30 bp, Homo sapiens
attcaaactcagcaggtttgtgggtgattt

SEQ ID NO: 27247 - DNA, 30 bp, Homo sapiens
tgctggtccccctggctggccccgggtgcc

SEQ ID NO: 27248 - DNA, 30 bp, Homo sapiens
aagtggctcagtgagggcttcagccctagt

SEQ ID NO: 27249 - DNA, 30 bp, Homo sapiens
agacggctgcatctgtggactgggttacac

SEQ ID NO: 27250 - DNA, 30 bp, Homo sapiens
tcctggatctccatgctataaaactgaaat

SEQ ID NO: 27251 - DNA, 30 bp, Homo sapiens
gcatctggatgaaggagaggacgtcctcct

SEQ ID NO: 27252 - DNA, 30 bp, Homo sapiens
agcaatggcagcattcaaatcccacaaaaa

SEQ ID NO: 27253 - DNA, 30 bp, Homo sapiens
agaatccgggggctctatccccaggtgcaa

SEQ ID NO: 27254 - DNA, 30 bp, Homo sapiens
ttttggtaatgattgtgcacgtgaaaggaa

SEQ ID NO: 27255 - DNA, 30 bp, Homo sapiens
tccacagtgtgcaccttcacgtaggccccc

SEQ ID NO: 27256 - DNA, 30 bp, Homo sapiens
gttctcggattttgtaccgaggtgctttga

SEQ ID NO: 27257 - DNA, 30 bp, Homo sapiens
cttaggccaggaagtgggatgcaatttatt

SEQ ID NO: 27258 - DNA, 30 bp, Homo sapiens
ttgtgcattcccgtgcaaggtgccctgact

SEQ ID NO: 27259 - DNA, 30 bp, Homo sapiens
agctgggccatctctaagaaaaaggcagca

SEQ ID NO: 27260 - DNA, 30 bp, Homo sapiens
ccttcagctgggagacctcatacaggtacg

SEQ ID NO: 27261 - DNA, 30 bp, Homo sapiens
cctaggtttcaaaattagttttcctgtatc

SEQ ID NO: 27262 - DNA, 30 bp, Homo sapiens
tctcggatcttcagttcccgcgccatctgg

SEQ ID NO: 27263 - DNA, 30 bp, Homo sapiens
cgatgggcccactttccgctccaggtccct

SEQ ID NO: 27264 - DNA, 30 bp, Homo sapiens
ctcagggctgttcatcccatcagacaggta

SEQ ID NO: 27265 - DNA, 30 bp, Homo sapiens
tttttgtagcatccccgggaacttccccat

SEQ ID NO: 27266 - DNA, 30 bp, Homo sapiens
ctctggacctgggggtccctcctggctggc

SEQ ID NO: 27267 - DNA, 30 bp, Homo sapiens
tactccgccttctcctccctttcctccggc

SEQ ID NO: 27268 - DNA, 30 bp, Homo sapiens
cccaggggagtcaggctcctgttcccctat

SEQ ID NO: 27269 - DNA, 30 bp, Homo sapiens
ctccgccctcagcagaaggagccatgctga

SEQ ID NO: 27270 - DNA, 30 bp, Homo sapiens
ttccttctgacaatatgctagaatatctgc

SEQ ID NO: 27271 - DNA, 30 bp, Homo sapiens
tagaaactcaccaacgtataaaccatactg

SEQ ID NO: 27272 - DNA, 30 bp, Homo sapiens
gagaggagatagaaggccagcttacaccag

SEQ ID NO: 27273 - DNA, 30 bp, Homo sapiens
aagtggaaaccaagcttgatcatggcttct

SEQ ID NO: 27274 - DNA, 30 bp, Homo sapiens
gcaagggcagttgctaccactataaagata

SEQ ID NO: 27275 - DNA, 30 bp, Homo sapiens
ggcaacaggtaagttgagaaggaagatgaa

SEQ ID NO: 27276 - DNA, 30 bp, Homo sapiens
cagaggtcaggaggtcggaggctgctctct

SEQ ID NO: 27277 - DNA, 30 bp, Homo sapiens
ttttcccctgctgcctccccttcctcctcc

SEQ ID NO: 27278 - DNA, 30 bp, Homo sapiens
gagaggaagtgattacatctacttcagaag

SEQ ID NO: 27279 - DNA, 30 bp, Homo sapiens
cagtgagtcaacagtttgaggcgcgtaaac

SEQ ID NO: 27280 - DNA, 30 bp, Homo sapiens
ccaagatacgggccacccaccagctacatg

SEQ ID NO: 27281 - DNA, 30 bp, Homo sapiens
aggcggaattgtagtagttgtgtgcgtggt

SEQ ID NO: 27282 - DNA, 30 bp, Homo sapiens
tagccggcctcctcctggtagtaaggggga

SEQ ID NO: 27283 - DNA, 30 bp, Homo sapiens
tcgctatattggtaatctctggggtagtca

SEQ ID NO: 27284 - DNA, 30 bp, Homo sapiens
catgtgatcagaggtgttaaattggagttg

SEQ ID NO: 27285 - DNA, 30 bp, Homo sapiens
agatggcgccttcgttgtgcaggctgtggt

SEQ ID NO: 27286 - DNA, 30 bp, Homo sapiens
tgttggtatgatttgggtttcttgtttgtg

SEQ ID NO: 27287 - DNA, 30 bp, Homo sapiens
aacgcctgggttccgcccagggctgccttc

SEQ ID NO: 27288 - DNA, 30 bp, Homo sapiens
agatggcattctcgtgggaggctttgtgca

SEQ ID NO: 27289 - DNA, 30 bp, Homo sapiens
aactggcacctgtcccttccattacttgct

SEQ ID NO: 27290 - DNA, 30 bp, Homo sapiens
ccatatatagacaaagaaaaaaattattac

SEQ ID NO: 27291 - DNA, 30 bp, Homo sapiens
cagtggtgaaagccggcatttggatgggct

SEQ ID NO: 27292 - DNA, 30 bp, Homo sapiens
agaaggtgtttccccagtatccaatgtctt

SEQ ID NO: 27293 - DNA, 30 bp, Homo sapiens
agcagggttgtagttgaaggtggatggcag

SEQ ID NO: 27294 - DNA, 30 bp, Homo sapiens
cactggaggtcccggtcctccaggtagcgg

SEQ ID NO: 27295 - DNA, 30 bp, Homo sapiens
tagtgtggagacttgtaggctgctgtcctt

SEQ ID NO: 27296 - DNA, 30 bp, Homo sapiens
taatggcggtccagtgttgaactctgtagt

SEQ ID NO: 27297 - DNA, 30 bp, Homo sapiens
gccaggaaggtggatgccgttgacttgggg

SEQ ID NO: 27298 - DNA, 30 bp, Homo sapiens
cctccgattaggcaagtgaacaccattgac

SEQ ID NO: 27299 - DNA, 30 bp, Homo sapiens
ctgtgagcaatgaatcagatcctgcctgat

SEQ ID NO: 27300 - DNA, 30 bp, Homo sapiens
tgttggcttcctcttcatatgcattccctg

SEQ ID NO: 27301 - DNA, 30 bp, Homo sapiens
ctgctgcatgttgttgataatcgccaggat

SEQ ID NO: 27302 - DNA, 30 bp, Homo sapiens
ctgagggggcagggggataccccggggatc

SEQ ID NO: 27303 - DNA, 30 bp, Homo sapiens
gaaagtcaaatctgaaaacctggggttatc

SEQ ID NO: 27304 - DNA, 30 bp, Homo sapiens
tgatggtgcaggactgcaaggcgcccccct

SEQ ID NO: 27305 - DNA, 30 bp, Homo sapiens
tagcctgggaaaacgaaagacttgaggcga

SEQ ID NO: 27306 - DNA, 30 bp, Homo sapiens
gctcagtatgattagcagaagtttcacaca

SEQ ID NO: 27307 - DNA, 30 bp, Homo sapiens
ccagagtgagctactttgtttgggggaaca

SEQ ID NO: 27308 - DNA, 30 bp, Homo sapiens
tgcagggcatggtcacaaagatctgttcgc

SEQ ID NO: 27309 - DNA, 30 bp, Homo sapiens
ggaagtgactcagagctggaaggaagatag

SEQ ID NO: 27310 - DNA, 30 bp, Homo sapiens
gacacactaagatacatgcaggcctgaccc

SEQ ID NO: 27311 - DNA, 30 bp, Homo sapiens
atcaggggggctgtgtgtgagaggggatgc

SEQ ID NO: 27312 - DNA, 30 bp, Homo sapiens
tctcggtcaagtttggggtggcttcctgtc

SEQ ID NO: 27313 - DNA, 30 bp, Homo sapiens
cctcggcagacgtgtctgtggacacagaca

SEQ ID NO: 27314 - DNA, 30 bp, Homo sapiens
cagcaatcagagaggtctagatctctggaa

SEQ ID NO: 27315 - DNA, 30 bp, Homo sapiens
ttggggtcgttgttccaggcactccggcat

SEQ ID NO: 27316 - DNA, 30 bp, Homo sapiens
cagaggaaggactccttgttcacccacatc

SEQ ID NO: 27317 - DNA, 30 bp, Homo sapiens
caatctctatccttttggcaagatcatcaa

SEQ ID NO: 27318 - DNA, 30 bp, Homo sapiens
gagaggtagatccagtgcttcagttctgcc

SEQ ID NO: 27319 - DNA, 30 bp, Homo sapiens
tgtgttagaggaagcaacagtcttcagagc

SEQ ID NO: 27320 - DNA, 30 bp, Homo sapiens
caataattgtctctcattctccgagaccgt

SEQ ID NO: 27321 - DNA, 30 bp, Homo sapiens
tgctgggatcccagtctgatgagaagaaat

SEQ ID NO: 27322 - DNA, 30 bp, Homo sapiens
cagtggcggcagcggcagccagggccagag

SEQ ID NO: 27323 - DNA, 30 bp, Homo sapiens
ccttggaatatctttatattattcatgtgt

SEQ ID NO: 27324 - DNA, 30 bp, Homo sapiens
cttgtcattttcagcatcaatttttgtttt

SEQ ID NO: 27325 - DNA, 30 bp, Homo sapiens
tgagaacctgaagctgctggatcagctctg

SEQ ID NO: 27326 - DNA, 30 bp, Homo sapiens
agacaaggatgccaaaggcaggcagcagta

SEQ ID NO: 27327 - DNA, 30 bp, Homo sapiens
accaggttggaggcaggcttgcacagacgg

SEQ ID NO: 27328 - DNA, 30 bp, Homo sapiens
tccagggagcctatgaggatcagcatcgcc

SEQ ID NO: 27329 - DNA, 30 bp, Homo sapiens
cacaggacatatacaattaagaacagtact

SEQ ID NO: 27330 - DNA, 30 bp, Homo sapiens
tgtgagggaaatcattattgtactgatggc

SEQ ID NO: 27331 - DNA, 30 bp, Homo sapiens
atccctgtggtcttcctagactctctttaa

SEQ ID NO: 27332 - DNA, 30 bp, Homo sapiens
accaggaagttgaaggaatcatcaatgcca

SEQ ID NO: 27333 - DNA, 30 bp, Homo sapiens
gctaggttctaagaattgaattcctctgga

SEQ ID NO: 27334 - DNA, 30 bp, Homo sapiens
acctggactcctccaggatctggggtaggt

SEQ ID NO: 27335 - DNA, 30 bp, Homo sapiens
aaatgagccattcctttttgctttcatcaa

SEQ ID NO: 27336 - DNA, 30 bp, Homo sapiens
gtatggctatggcagtgatgcaaagcaaaa

SEQ ID NO: 27337 - DNA, 30 bp, Homo sapiens
cactgtctacattctctgacctttttgcct

SEQ ID NO: 27338 - DNA, 30 bp, Homo sapiens
tacactcgctcactgtgttttgcaagtcaa

SEQ ID NO: 27339 - DNA, 30 bp, Homo sapiens
atctggctgaggcattcttttcctgatttt

SEQ ID NO: 27340 - DNA, 30 bp, Homo sapiens
tcccccccggctcctcatgctactcggggc

SEQ ID NO: 27341 - DNA, 30 bp, Homo sapiens
tcttgggggctgtagcaaggcggcgaggga

SEQ ID NO: 27342 - DNA, 30 bp, Homo sapiens
tcacttcatcaccgttttccccactgagct

SEQ ID NO: 27343 - DNA, 30 bp, Homo sapiens
ccagactctgcaactccaccaactctgcag

SEQ ID NO: 27344 - DNA, 30 bp, Homo sapiens
taggaccctgacgcccttgccagagctcgg

SEQ ID NO: 27345 - DNA, 30 bp, Homo sapiens
cagtggtgggcaccggcttgttcttgcctc

SEQ ID NO: 27346 - DNA, 30 bp, Homo sapiens
cttcctctgaatcttgccctgttatccaac

SEQ ID NO: 27347 - DNA, 30 bp, Homo sapiens
attttgcagttgtttctgaaggctcaaatt

SEQ ID NO: 27348 - DNA, 30 bp, Homo sapiens
tacccaaatgttaagggttggacacctttc

SEQ ID NO: 27349 - DNA, 30 bp, Homo sapiens
tcgagggcctgatgagtcttgggaatgcgc

SEQ ID NO: 27350 - DNA, 30 bp, Homo sapiens
gccaatatttcagaggtaggtaagacacaa

SEQ ID NO: 27351 - DNA, 30 bp, Homo sapiens
gaagcgcttggcctgagtagggaatgacgc

SEQ ID NO: 27352 - DNA, 30 bp, Homo sapiens
gcaagggcacctttctcagtctcgcagccc

SEQ ID NO: 27353 - DNA, 30 bp, Homo sapiens
taatggccgtcctgggcatcaggggacatg

SEQ ID NO: 27354 - DNA, 30 bp, Homo sapiens
ttgctgggattctaagaaatctctacaaat

SEQ ID NO: 27355 - DNA, 30 bp, Homo sapiens
acaaggagccaggaactgtcgggtcaccag

SEQ ID NO: 27356 - DNA, 30 bp, Homo sapiens
gcctggtccttggcagcagcaacaagctct

SEQ ID NO: 27357 - DNA, 30 bp, Homo sapiens
atggacaggcaatgatctggatgtcttcag

SEQ ID NO: 27358 - DNA, 30 bp, Homo sapiens
tacaggcgcagcctcttgatatcttcactg

SEQ ID NO: 27359 - DNA, 30 bp, Homo sapiens
atgaggaggagcctgtccttttcagatgga

SEQ ID NO: 27360 - DNA, 30 bp, Homo sapiens
gaagcagctgaaccattatgggataaactg

SEQ ID NO: 27361 - DNA, 30 bp, Homo sapiens
catgggccgttgggtggacgcttcactgtg

SEQ ID NO: 27362 - DNA, 30 bp, Homo sapiens
ctgcggcgatcggtgaagaatgttctctgg

SEQ ID NO: 27363 - DNA, 30 bp, Homo sapiens
gcatggtggccacggtggtggccaggcgac

SEQ ID NO: 27364 - DNA, 30 bp, Homo sapiens
agggccccacgctgggcggttcggcctgcg

SEQ ID NO: 27365 - DNA, 30 bp, Homo sapiens
ggcaggttctgtacttgatgtgttacttgg

SEQ ID NO: 27366 - DNA, 30 bp, Homo sapiens
cattggagccactaggaatcctgagaaaga

SEQ ID NO: 27367 - DNA, 30 bp, Homo sapiens
aaacaaacaggaccaacttcaaatccgaac

SEQ ID NO: 27368 - DNA, 30 bp, Homo sapiens
ccatgaagcagacaggccccagcagcaccc

SEQ ID NO: 27369 - DNA, 30 bp, Homo sapiens
aggaggagagatgcctgggtgtcttccctc

SEQ ID NO: 27370 - DNA, 30 bp, Homo sapiens
tagccttgcccgttgtatgggatgctggca

SEQ ID NO: 27371 - DNA, 30 bp, Homo sapiens
gccttggactggtaagccatcttcgcccaa

SEQ ID NO: 27372 - DNA, 30 bp, Homo sapiens
tccagggccccacagttccatggcttccag

SEQ ID NO: 27373 - DNA, 30 bp, Homo sapiens
cttcctagcgtctgtcatgaaactgttttc

SEQ ID NO: 27374 - DNA, 30 bp, Homo sapiens
aaaaggccccttcatggttttcatgggtgg

SEQ ID NO: 27375 - DNA, 30 bp, Homo sapiens
ccgcccagcatagacttggtcacctttgtc

SEQ ID NO: 27376 - DNA, 30 bp, Homo sapiens
acttggaggcagtcatgaagctgttctcaa

SEQ ID NO: 27377 - DNA, 30 bp, Homo sapiens
tgtgcgctgatgggcatgagacacaggata

SEQ ID NO: 27378 - DNA, 30 bp, Homo sapiens
tacaggaagcagacagggccaacgtcgaag

SEQ ID NO: 27379 - DNA, 30 bp, Homo sapiens
tccacaaagaattcctggtcagcaccaccg

SEQ ID NO: 27380 - DNA, 30 bp, Homo sapiens
actcccagaggccctgggtgctagccccct

SEQ ID NO: 27381 - DNA, 30 bp, Homo sapiens
gtttggtccttttctgaacggatctcttct

SEQ ID NO: 27382 - DNA, 30 bp, Homo sapiens
gggacccttcacattacccggccgggcagc

SEQ ID NO: 27383 - DNA, 30 bp, Homo sapiens
gccaggcacaggcagcccgtcggggcccac

SEQ ID NO: 27384 - DNA, 30 bp, Homo sapiens
atgaggaagtttttgtacttcaatcactgg

SEQ ID NO: 27385 - DNA, 30 bp, Homo sapiens
gccaggcatgggtaagccatctggccccaa

SEQ ID NO: 27386 - DNA, 30 bp, Homo sapiens
agcaggagaagaatcaaacaaggtacatgc

SEQ ID NO: 27387 - DNA, 30 bp, Homo sapiens
tgctggcctggtccacgctcttctgtccag

SEQ ID NO: 27388 - DNA, 30 bp, Homo sapiens
cagaggaagcacgcaggtccaacttccagg

SEQ ID NO: 27389 - DNA, 30 bp, Homo sapiens
atgcaggtttcttgacattccttttcactg

SEQ ID NO: 27390 - DNA, 30 bp, Homo sapiens
gaccggccctatgtccacaccgaattcctg

SEQ ID NO: 27391 - DNA, 30 bp, Homo sapiens
tccacaccaaattcttgatcaggaccacca

SEQ ID NO: 27392 - DNA, 30 bp, Homo sapiens
acttggcagcggctgacgtgcgtgcgcagc

SEQ ID NO: 27393 - DNA, 30 bp, Homo sapiens
acaccatctctgccaggcaaacctctgtcg

SEQ ID NO: 27394 - DNA, 30 bp, Homo sapiens
cacaggttcttcatgcacacctggcagcgg

SEQ ID NO: 27395 - DNA, 30 bp, Homo sapiens
aactgggtgggatgccgggcacccatggtg

SEQ ID NO: 27396 - DNA, 30 bp, Homo sapiens
ctttcacagttgatggaataggctttctga

SEQ ID NO: 27397 - DNA, 30 bp, Homo sapiens
gttttttcttggacgtaagaagtaaaacgt

SEQ ID NO: 27398 - DNA, 30 bp, Homo sapiens
acctggcaccggctgattttctggcgttgg

SEQ ID NO: 27399 - DNA, 30 bp, Homo sapiens
catgcacacttgacatcggctaattcgtgt

SEQ ID NO: 27400 - DNA, 30 bp, Homo sapiens
tacaggcttttcatacacacctggcagcga

SEQ ID NO: 27401 - DNA, 30 bp, Homo sapiens
ccatgaagcaagccggccccacttcaaatc

SEQ ID NO: 27402 - DNA, 30 bp, Homo sapiens
ttcaacgccgaattcctggtctgtgccgcc

SEQ ID NO: 27403 - DNA, 30 bp, Homo sapiens
agacggggcccagttcaaacccaaactttt

SEQ ID NO: 27404 - DNA, 30 bp, Homo sapiens
gccaccttcctggagactgtctggtggaag

SEQ ID NO: 27405 - DNA, 30 bp, Homo sapiens
agcacaaaacagctccgtccaaacctgttt

SEQ ID NO: 27406 - DNA, 30 bp, Homo sapiens
cagcggatgaagcggtcgaagaagccgggt

SEQ ID NO: 27407 - DNA, 30 bp, Homo sapiens
cagagggccagcgcggtctcggggtccccc

SEQ ID NO: 27408 - DNA, 30 bp, Homo sapiens
acactgatgactccgggtttggcgagcaca

SEQ ID NO: 27409 - DNA, 30 bp, Homo sapiens
ccaaggagaacctccgacgcccccatctca

SEQ ID NO: 27410 - DNA, 30 bp, Homo sapiens
ttctctgggttgggagaggtcatgttaaca

SEQ ID NO: 27411 - DNA, 30 bp, Homo sapiens
atgaccttgtatcttcaccatcttcttttt

SEQ ID NO: 27412 - DNA, 30 bp, Homo sapiens
attcttaaaggtatgggaggtgcttctcat

SEQ ID NO: 27413 - DNA, 30 bp, Homo sapiens
tcctgggcagtacctgtcccctggctctgg

SEQ ID NO: 27414 - DNA, 30 bp, Homo sapiens
aaggaggagtggacatactgcccggcatac

SEQ ID NO: 27415 - DNA, 30 bp, Homo sapiens
atgtggggcagagcaagaatcctgaaaagg

SEQ ID NO: 27416 - DNA, 30 bp, Homo sapiens
caagggtcaggccctttgttaaatgctcgc

SEQ ID NO: 27417 - DNA, 30 bp, Homo sapiens
tgatggatccaggctctgtaaggcgggcag

SEQ ID NO: 27418 - DNA, 30 bp, Homo sapiens
ttctccccgacccctcctaacacggctcct

SEQ ID NO: 27419 - DNA, 30 bp, Homo sapiens
cagagggaagcttctttctcaaaacagggc

SEQ ID NO: 27420 - DNA, 30 bp, Homo sapiens
atagaaatcactggtggcggctgctgaggg

SEQ ID NO: 27421 - DNA, 30 bp, Homo sapiens
acatggtaagatggcactctgtgtcattcc

SEQ ID NO: 27422 - DNA, 30 bp, Homo sapiens
caaactcacacatgaagtacatggtggtgt

SEQ ID NO: 27423 - DNA, 30 bp, Homo sapiens
tttttcgcaaatgaagttattgacgtcttc

SEQ ID NO: 27424 - DNA, 30 bp, Homo sapiens
agagttcatcccgggcagcactgtccagtg

SEQ ID NO: 27425 - DNA, 30 bp, Homo sapiens
tagctcatcccttgaaggcacagtgtccag

SEQ ID NO: 27426 - DNA, 30 bp, Homo sapiens
cgttggcagtcatcagaaagtgtttggaag

SEQ ID NO: 27427 - DNA, 30 bp, Homo sapiens
ggtgaagtagcggcagggcgtggagtcgat

SEQ ID NO: 27428 - DNA, 30 bp, Homo sapiens
ggctggctgatcagtgtgctgatactttct

SEQ ID NO: 27429 - DNA, 30 bp, Homo sapiens
gtgcttgtatagtctctagcttgttataga

SEQ ID NO: 27430 - DNA, 30 bp, Homo sapiens
gtgatttgtcttcatctcttccaatgcttg

SEQ ID NO: 27431 - DNA, 30 bp, Homo sapiens
tacaactgagttgctctttccaggcttttc

SEQ ID NO: 27432 - DNA, 30 bp, Homo sapiens
cccagggagctcatcagggtctgggcctgc

SEQ ID NO: 27433 - DNA, 30 bp, Homo sapiens
gtctgcgctcacacctcttctccagatctg

SEQ ID NO: 27434 - DNA, 30 bp, Homo sapiens
gtgtttgagccagggcctaactttgggtct

SEQ ID NO: 27435 - DNA, 30 bp, Homo sapiens
tgctggttctgactcgctccatctcgtgca

SEQ ID NO: 27436 - DNA, 30 bp, Homo sapiens
atttcaactgcaggaccaccttattcgctg

SEQ ID NO: 27437 - DNA, 30 bp, Homo sapiens
tactggccacggcagagagttggtctcgga

SEQ ID NO: 27438 - DNA, 30 bp, Homo sapiens
gcttgccgcagctgatgggtctcatagtcc

SEQ ID NO: 27439 - DNA, 30 bp, Homo sapiens
ttcgctgcctgggcccttgtagatggcctt

SEQ ID NO: 27440 - DNA, 30 bp, Homo sapiens
aggaggtcgtgtgtcccagccccactttat

SEQ ID NO: 27441 - DNA, 30 bp, Homo sapiens
cgaaactgcagaggactgatccttaaacca

SEQ ID NO: 27442 - DNA, 30 bp, Homo sapiens
cttaaggccattccctggctctttgcacga

SEQ ID NO: 27443 - DNA, 30 bp, Homo sapiens
tgatatctgttgtgtcaatatcttctaatt

SEQ ID NO: 27444 - DNA, 30 bp, Homo sapiens
gcgctgggagcgtactgtagcaccagcctg

SEQ ID NO: 27445 - DNA, 30 bp, Homo sapiens
atcccacagatgccaagatgatgtctactg

SEQ ID NO: 27446 - DNA, 30 bp, Homo sapiens
gcatggtcactccatcggctaaggccagcc

SEQ ID NO: 27447 - DNA, 30 bp, Homo sapiens
ttctgagggttagtacctgctgtagggtca

SEQ ID NO: 27448 - DNA, 30 bp, Homo sapiens
tcaaagaccatcttggaataatagggtatc

SEQ ID NO: 27449 - DNA, 30 bp, Homo sapiens
tactgactacagcctggttgagagaattta

SEQ ID NO: 27450 - DNA, 30 bp, Homo sapiens
tcatcttcttgtgagcccatactcttttgt

SEQ ID NO: 27451 - DNA, 30 bp, Homo sapiens
atctgggcttccatggcttgtgctgtccat

SEQ ID NO: 27452 - DNA, 30 bp, Homo sapiens
acttggaaacaaagtgattggatctgctta

SEQ ID NO: 27453 - DNA, 30 bp, Homo sapiens
cgttggcagggcttctcgtgctgccatgac

SEQ ID NO: 27454 - DNA, 30 bp, Homo sapiens
acatcaatccatggatagcttctatggtag

SEQ ID NO: 27455 - DNA, 30 bp, Homo sapiens
cagaaaaagagcccgcgcattctcctgccg

SEQ ID NO: 27456 - DNA, 30 bp, Homo sapiens
aattcgacttggaccaaatcttggcgctcc

SEQ ID NO: 27457 - DNA, 30 bp, Homo sapiens
actttggacatcttcttggtgggctgcctc

SEQ ID NO: 27458 - DNA, 30 bp, Homo sapiens
tagtggcggctggagaccagacctttcact

SEQ ID NO: 27459 - DNA, 30 bp, Homo sapiens
aatccgtcagtctggctaactgctgttcat

SEQ ID NO: 27460 - DNA, 30 bp, Homo sapiens
cactggatgtcatcatcatcaaaaagatct

SEQ ID NO: 27461 - DNA, 30 bp, Homo sapiens
atctatgcatggctgtgtggtcttcttccc

SEQ ID NO: 27462 - DNA, 30 bp, Homo sapiens
cgaaggagtgaccacttgatctgttctttg

SEQ ID NO: 27463 - DNA, 30 bp, Homo sapiens
cagactgaagaacctgggccacactctgtt

SEQ ID NO: 27464 - DNA, 30 bp, Homo sapiens
gtctggtgcacctcatggaacatcagttca

SEQ ID NO: 27465 - DNA, 30 bp, Homo sapiens
tgtgtgatggacttcatgaagcattaactc

SEQ ID NO: 27466 - DNA, 30 bp, Homo sapiens
attcccaaggacaatccctaaaaaaactat

SEQ ID NO: 27467 - DNA, 30 bp, Homo sapiens
agctggattggtgcaggcattagcttggag

SEQ ID NO: 27468 - DNA, 30 bp, Homo sapiens
ccctggacgtgcatgggtggtgctgtaatg

SEQ ID NO: 27469 - DNA, 30 bp, Homo sapiens
aacggagatactcgcgaccgagggagcctt

SEQ ID NO: 27470 - DNA, 30 bp, Homo sapiens
tgaatggccacaatgcctgatgttagactt

SEQ ID NO: 27471 - DNA, 30 bp, Homo sapiens
caaaggccataatctgttctttgagtggag

SEQ ID NO: 27472 - DNA, 30 bp, Homo sapiens
tgcatccggcctggataatgctcttcagga

SEQ ID NO: 27473 - DNA, 30 bp, Homo sapiens
tgctgggcctgcctcttgcagtagttgctg

SEQ ID NO: 27474 - DNA, 30 bp, Homo sapiens
atgagggatccacccaggagtcccctttgg

SEQ ID NO: 27475 - DNA, 30 bp, Homo sapiens
accgacgctggtttagacctgtcaagttct

SEQ ID NO: 27476 - DNA, 30 bp, Homo sapiens
gtctggatgtaaatctgtcttttaatccat

SEQ ID NO: 27477 - DNA, 30 bp, Homo sapiens
tcgtggggaaattttctgtgagttggaaat

SEQ ID NO: 27478 - DNA, 30 bp, Homo sapiens
acttggcctggactgtctcctccagcctgt

SEQ ID NO: 27479 - DNA, 30 bp, Homo sapiens
gcatccccgttctccatgcggcccagctgc

SEQ ID NO: 27480 - DNA, 30 bp, Homo sapiens
ggctgctatctttgccatctgctgttctaa

SEQ ID NO: 27481 - DNA, 30 bp, Homo sapiens
cgcaagtttttgatctccagttccaactgt

SEQ ID NO: 27482 - DNA, 30 bp, Homo sapiens
tcttggggctgttgcgcaagtttttcagtt

SEQ ID NO: 27483 - DNA, 30 bp, Homo sapiens
cgtccaccagctcgcacagcatgttctcca

SEQ ID NO: 27484 - DNA, 30 bp, Homo sapiens
cgtcctcgtccacgccttcaaaggagtcct

SEQ ID NO: 27485 - DNA, 30 bp, Homo sapiens
tgcaggaggagaaggtcttccagaagaagt

SEQ ID NO: 27486 - DNA, 30 bp, Homo sapiens
gtctgggcgtcgtaattggctccccccgcc

SEQ ID NO: 27487 - DNA, 30 bp, Homo sapiens
agctgggagggggccctgcgtccccgcctc

SEQ ID NO: 27488 - DNA, 30 bp, Homo sapiens
caaaggtgccaactctctaaaacgtagact

SEQ ID NO: 27489 - DNA, 30 bp, Homo sapiens
aaatggaacaatattgtatgtagaaattcc

SEQ ID NO: 27490 - DNA, 30 bp, Homo sapiens
gcctggaagacaatacctgtattttattga

SEQ ID NO: 27491 - DNA, 30 bp, Homo sapiens
tcctggaactggcaacttgtgcccttcctt

SEQ ID NO: 27492 - DNA, 30 bp, Homo sapiens
ctgaggtcttctgttcttctgcggcctggc

SEQ ID NO: 27493 - DNA, 30 bp, Homo sapiens
aactggcagaaccagagaaaccatgggcac

SEQ ID NO: 27494 - DNA, 30 bp, Homo sapiens
aggaaggggaattctccgagagaggaagta

SEQ ID NO: 27495 - DNA, 30 bp, Homo sapiens
ccagcagagtcactgctgccatcttggtcc

SEQ ID NO: 27496 - DNA, 30 bp, Homo sapiens
tatacgccaaagccagcagagtcactgctg

SEQ ID NO: 27497 - DNA, 30 bp, Homo sapiens
ttttgggactcttcggagttcattcatcag

SEQ ID NO: 27498 - DNA, 30 bp, Homo sapiens
ttctggatttcttccttggaggaggtcagg

SEQ ID NO: 27499 - DNA, 30 bp, Homo sapiens
gctctcatgcattccttgtgggcctcaatt

SEQ ID NO: 27500 - DNA, 30 bp, Homo sapiens
acttggtcgatggtattcggcaaagttggc

SEQ ID NO: 27501 - DNA, 30 bp, Homo sapiens
cagaggcctgacagagagcagacacgggac

SEQ ID NO: 27502 - DNA, 30 bp, Homo sapiens
ttcaggatcgaggtgggtaccttcatataa

SEQ ID NO: 27503 - DNA, 30 bp, Homo sapiens
ttaaggcatttggtaaaccacacagcctct

SEQ ID NO: 27504 - DNA, 30 bp, Homo sapiens
tgtccagcatcctcttggtctgcttggcca

SEQ ID NO: 27505 - DNA, 30 bp, Homo sapiens
cagtggtacaactgtttggcataacaggtt

SEQ ID NO: 27506 - DNA, 30 bp, Homo sapiens
gttcttttcgtagtcccacttggaggctaa

SEQ ID NO: 27507 - DNA, 30 bp, Homo sapiens
taaaggctatggataacaggatctgacaaa

SEQ ID NO: 27508 - DNA, 30 bp, Homo sapiens
cttcttctcatagtcccagcgggaggccag

SEQ ID NO: 27509 - DNA, 30 bp, Homo sapiens
tcaaggcccagttcctccggagtggagatt

SEQ ID NO: 27510 - DNA, 30 bp, Homo sapiens
tgctggggcaccagcttgtaatgggctcca

SEQ ID NO: 27511 - DNA, 30 bp, Homo sapiens
agttggaagtggattcacatgagggttatg

SEQ ID NO: 27512 - DNA, 30 bp, Homo sapiens
caggggtgttcgtagcccgtgggcagaggg

SEQ ID NO: 27513 - DNA, 30 bp, Homo sapiens
cagatcttcccgggaaacgtgccttcagcc

SEQ ID NO: 27514 - DNA, 30 bp, Homo sapiens
cactgggaggtaggggtggataaccgagac

SEQ ID NO: 27515 - DNA, 30 bp, Homo sapiens
ttcctcatctcctcaaaatctttcatgaca

SEQ ID NO: 27516 - DNA, 30 bp, Homo sapiens
gcctgggacacccgaagggcctgcattctg

SEQ ID NO: 27517 - DNA, 30 bp, Homo sapiens
tcttgggaaatgaagccacagccagctcat

SEQ ID NO: 27518 - DNA, 30 bp, Homo sapiens
agacgggcacaccatcagctggaaaaactt

SEQ ID NO: 27519 - DNA, 30 bp, Homo sapiens
ctctggaactttgtttttcccagcataatc

SEQ ID NO: 27520 - DNA, 30 bp, Homo sapiens
tagagggcgatcaggcagtagatggtccct

SEQ ID NO: 27521 - DNA, 30 bp, Homo sapiens
ttcctttggggtaactctgccaacagggga

SEQ ID NO: 27522 - DNA, 30 bp, Homo sapiens
ttttggggtaactctgccaacaggggatag

SEQ ID NO: 27523 - DNA, 30 bp, Homo sapiens
acaaggaagggtgtagcaaatgcagatcca

SEQ ID NO: 27524 - DNA, 30 bp, Homo sapiens
cactctggcctcctgtaggtctccaggtgt

SEQ ID NO: 27525 - DNA, 30 bp, Homo sapiens
aattccttctgaactgcttcaggttgccta

SEQ ID NO: 27526 - DNA, 30 bp, Homo sapiens
aagtggtttccattccagcatgaatgtggt

SEQ ID NO: 27527 - DNA, 30 bp, Homo sapiens
agtaggggtgattcagggtgtgctccatga

SEQ ID NO: 27528 - DNA, 30 bp, Homo sapiens
aataggggtggtctcgcacatgctccatga

SEQ ID NO: 27529 - DNA, 30 bp, Homo sapiens
ttgaggatatacttggcaataaatttgaca

SEQ ID NO: 27530 - DNA, 30 bp, Homo sapiens
tagaggttgtcccgcacatgctccatgatg

SEQ ID NO: 27531 - DNA, 30 bp, Homo sapiens
tgatggtccgaagcgccatccacgtctcct

SEQ ID NO: 27532 - DNA, 30 bp, Homo sapiens; identical to SEQ ID NO: 27527

SEQ ID NO: 27533 - DNA, 30 bp, Homo sapiens
agcaggtgcattgtgatatttttcacagcc

SEQ ID NO: 27534 - DNA, 30 bp, Homo sapiens
tcaaggtgcaggtgtttgacatccataaac

SEQ ID NO: 27535 - DNA, 30 bp, Homo sapiens
tacaggtgttccaggacgtagctggcaaca

SEQ ID NO: 27536 - DNA, 30 bp, Homo sapiens
gacatgccaagctattttagagacagcggc

SEQ ID NO: 27537 - DNA, 30 bp, Homo sapiens
cagtgtctgtttcatcctggaactcatggc

SEQ ID NO: 27538 - DNA, 30 bp, Homo sapiens
ttccatcaattcttccttctcctcttcttt

SEQ ID NO: 27539 - DNA, 30 bp, Homo sapiens
agctggaatctcggttcttctggttccgca

SEQ ID NO: 27540 - DNA, 30 bp, Homo sapiens
cagcggaagtggatctgacgtgggcgatca

SEQ ID NO: 27541 - DNA, 30 bp, Homo sapiens
cagcggaacgggacgtgacgagggcggtcg

SEQ ID NO: 27542 - DNA, 30 bp, Homo sapiens
gttccagcggaatgaaatatgccgagggcg

SEQ ID NO: 27543 - DNA, 30 bp, Homo sapiens
atttgcacacatcctgctgagaaggatttc

SEQ ID NO: 27544 - DNA, 30 bp, Homo sapiens
tctaggaactctctggacatcgacacccaa

SEQ ID NO: 27545 - DNA, 30 bp, Homo sapiens
cagcggcccgggcaggtacttgatgacggt

SEQ ID NO: 27546 - DNA, 30 bp, Homo sapiens
caagtggcagagggggacctctctgaacac

SEQ ID NO: 27547 - DNA, 30 bp, Homo sapiens
gtgtggcctgggccttgtccttgagtgagc

SEQ ID NO: 27548 - DNA, 30 bp, Homo sapiens
acatcacggaacacttctgctccgctgtct

SEQ ID NO: 27549 - DNA, 30 bp, Homo sapiens
gagtggtctggcaaatttctgtatagagga

SEQ ID NO: 27550 - DNA, 30 bp, Homo sapiens
ggcagggcctctctgcagctgcctcatctc

SEQ ID NO: 27551 - DNA, 30 bp, Homo sapiens
tgcccgagcctcgatagacacggtgagccg

SEQ ID NO: 27552 - DNA, 30 bp, Homo sapiens
gcctggggggcctgtgcaggatccttggct

SEQ ID NO: 27553 - DNA, 30 bp, Homo sapiens
aggcgggctccgagttggtggggggcaggt

SEQ ID NO: 27554 - DNA, 30 bp, Homo sapiens
tcgtggctgggttcttgggaggaaggagtt

SEQ ID NO: 27555 - DNA, 30 bp, Homo sapiens
ttctggaagattcatacatttctgatgaac

SEQ ID NO: 27556 - DNA, 30 bp, Homo sapiens
tgcaggggggacgcagggggcgtgcgggct

SEQ ID NO: 27557 - DNA, 30 bp, Homo sapiens
cagagtaacagcttttccgtgaggggcttt

SEQ ID NO: 27558 - DNA, 30 bp, Homo sapiens
cacgggctagggctgggagtcgtagccagt

SEQ ID NO: 27559 - DNA, 30 bp, Homo sapiens
gcctgggctggcctctccggcagggacacc

SEQ ID NO: 27560 - DNA, 30 bp, Homo sapiens
tgtaggtggggtgtatgggggaggcgcagg

SEQ ID NO: 27561 - DNA, 30 bp, Homo sapiens
tacaccacggatgtgccaaggctgcagcaa

SEQ ID NO: 27562 - DNA, 30 bp, Homo sapiens
ggctgctctggagctgggatcgggctgggg

SEQ ID NO: 27563 - DNA, 30 bp, Homo sapiens
tgcaggacaccagcaggcccagcagcatag

SEQ ID NO: 27564 - DNA, 30 bp, Homo sapiens
cccttggatggcgtagaacttccagaattt

SEQ ID NO: 27565 - DNA, 30 bp, Homo sapiens
gatcgtcttctattcctttctcactcagct

SEQ ID NO: 27566 - DNA, 30 bp, Homo sapiens
cctaggcagcatttcttccatgtctgcaac

SEQ ID NO: 27567 - DNA, 30 bp, Homo sapiens
ctgtactgcctgtagtggaaaagactcttg

SEQ ID NO: 27568 - DNA, 30 bp, Homo sapiens
aagtgggcggtgacgcggtccgtctccagc

SEQ ID NO: 27569 - DNA, 30 bp, Homo sapiens
aatccaatgcgtccagtttccgttctgcgg

SEQ ID NO: 27570 - DNA, 30 bp, Homo sapiens
aactggcgtcagggcctcgtacagtctctg

SEQ ID NO: 27571 - DNA, 30 bp, Homo sapiens
agaaaggccaagtgccctttggtgcatctg

SEQ ID NO: 27572 - DNA, 30 bp, Homo sapiens
acgtggcccctcagagtgatgaaacccacg

SEQ ID NO: 27573 - DNA, 30 bp, Homo sapiens
tccaggcagcagcttgaattcccgaatctt

SEQ ID NO: 27574 - DNA, 30 bp, Homo sapiens
tctcggtcacgctctcggtcacggtctcgg

SEQ ID NO: 27575 - DNA, 30 bp, Homo sapiens
ccgttctctatcccggtgtctctcatgctc

SEQ ID NO: 27576 - DNA, 30 bp, Homo sapiens
ttttggaattagaactgagaccaaacaaag

SEQ ID NO: 27577 - DNA, 30 bp, Homo sapiens
acttggtccttgacttataatccccgtctc

SEQ ID NO: 27578 - DNA, 30 bp, Homo sapiens
gaacttggaaaagatcagcaatgtccagca

SEQ ID NO: 27579 - DNA, 30 bp, Homo sapiens
gctgtaggccttgggaacttggaaaagatc

SEQ ID NO: 27580 - DNA, 30 bp, Homo sapiens
agtcggtggatgtcattgaggccttggagg

SEQ ID NO: 27581 - DNA, 30 bp, Homo sapiens
tgatggatttgccttctaaggcatcaaaca

SEQ ID NO: 27582 - DNA, 30 bp, Homo sapiens
ctctggaagctcgcatgtctgctgggccgt

SEQ ID NO: 27583 - DNA, 30 bp, Homo sapiens
taaggatcccatccttttccataaatgaat

SEQ ID NO: 27584 - DNA, 30 bp, Homo sapiens
agagctgcatgaatgttgtcttaattcaga

SEQ ID NO: 27585 - DNA, 30 bp, Homo sapiens
gtccccttagccgctccaggcgcctgcgaa

SEQ ID NO: 27586 - DNA, 30 bp, Homo sapiens
ctgtcgtctcttctgcccccgcagcttcag

SEQ ID NO: 27587 - DNA, 30 bp, Homo sapiens
gcgtggcctgtgggtgctcagcgatgtgaa

SEQ ID NO: 27588 - DNA, 30 bp, Homo sapiens
ttcggggatgaacgctgctgcctccttgag

SEQ ID NO: 27589 - DNA, 30 bp, Homo sapiens
ataagagcatcatgtgaaccagcaccaaca

SEQ ID NO: 27590 - DNA, 30 bp, Homo sapiens
agctggctgggttgtatggatcaacagaat

SEQ ID NO: 27591 - DNA, 30 bp, Homo sapiens
ctctcggacataaattctggtgcagaccac

SEQ ID NO: 27592 - DNA, 30 bp, Homo sapiens
actctcggacgtagaccctggtgcacacaa

SEQ ID NO: 27593 - DNA, 30 bp, Homo sapiens
cagccacagcaggatttcttcttagcaggg

SEQ ID NO: 27594 - DNA, 30 bp, Homo sapiens
gactggtccttccgaccccaggcttctggg

SEQ ID NO: 27595 - DNA, 30 bp, Homo sapiens
caccgggcactgggaaggtggccagagccg

SEQ ID NO: 27596 - DNA, 30 bp, Homo sapiens
catcccgcagccgtgtattcagctccctga

SEQ ID NO: 27597 - DNA, 30 bp, Homo sapiens
gagtgggcaggctcaattctctaggaagcc

SEQ ID NO: 27598 - DNA, 30 bp, Homo sapiens
cagaatctccaggtgagctgtgaagccagg

SEQ ID NO: 27599 - DNA, 30 bp, Homo sapiens
ggtcctcatccccacagtctgacacttttg

SEQ ID NO: 27600 - DNA, 30 bp, Homo sapiens
ctccaacatgtgcaggagcagcgaggggtc

SEQ ID NO: 27601 - DNA, 30 bp, Homo sapiens
cactgggacaggtcactgacagcggggccg

SEQ ID NO: 27602 - DNA, 30 bp, Homo sapiens
gcttggcccgggggtggctctgcagcaggg

SEQ ID NO: 27603 - DNA, 30 bp, Homo sapiens
tcagtctctccattgcagggggtggcatca

SEQ ID NO: 27604 - DNA, 30 bp, Homo sapiens
tgagtctctcctccggtggcaccttgagga

SEQ ID NO: 27605 - DNA, 30 bp, Homo sapiens
ttccggcggcaacttgaggttgggggtcgg

SEQ ID NO: 27606 - DNA, 30 bp, Homo sapiens
agatgggcaggcagccctgcaccgtctcct

SEQ ID NO: 27607 - DNA, 30 bp, Homo sapiens
tcgtgggcaacagagcagatcgcgttaagc

SEQ ID NO: 27608 - DNA, 30 bp, Homo sapiens
caggctaattgtgtcctttttaaaggaaca

SEQ ID NO: 27609 - DNA, 30 bp, Homo sapiens
tgctgggtcctcttcgtccattgccacatt

SEQ ID NO: 27610 - DNA, 30 bp, Homo sapiens
agcagccggagcagcatcctgagctccggt

SEQ ID NO: 27611 - DNA, 30 bp, Homo sapiens
taaaggtccttaagtgcttttagctcctca

SEQ ID NO: 27612 - DNA, 30 bp, Homo sapiens
acaacaacttggttgctgggcactaagatc

SEQ ID NO: 27613 - DNA, 30 bp, Homo sapiens
tatctgtcctgcaaaatgacagaggggcta

SEQ ID NO: 27614 - DNA, 30 bp, Homo sapiens
agagtttgatggtggtgttggggcccagat

SEQ ID NO: 27615 - DNA, 30 bp, Homo sapiens
tagaaagtggtgttcactcttctgtcgagt

SEQ ID NO: 27616 - DNA, 30 bp, Homo sapiens
acaacatctgtggtacaaactcatcccagc

SEQ ID NO: 27617 - DNA, 30 bp, Homo sapiens
gcctccagccctgcacgtcctgagccagtg

SEQ ID NO: 27618 - DNA, 30 bp, Homo sapiens
acgcgggaggcagcatcgttgtgcaaagtt

SEQ ID NO: 27619 - DNA, 30 bp, Homo sapiens
cacatctcatctgcatgcagcacggaccgg

SEQ ID NO: 27620 - DNA, 30 bp, Homo sapiens
gagtggtgagctggctgagggtggagcttc

SEQ ID NO: 27621 - DNA, 30 bp, Homo sapiens
acaaacttctctagcgtgtcccccgtggtg

SEQ ID NO: 27622 - DNA, 30 bp, Homo sapiens
attgctattagcatctgtcttcccagcctt

SEQ ID NO: 27623 - DNA, 30 bp, Homo sapiens
tgttggtatccttaatcctacaaggcctcc

SEQ ID NO: 27624 - DNA, 30 bp, Homo sapiens
gtctggtaagcttgcaagcattataatacc

SEQ ID NO: 27625 - DNA, 30 bp, Homo sapiens
ttccgggcgcacgccgagcagaactccacc

SEQ ID NO: 27626 - DNA, 30 bp, Homo sapiens
ttttggtccaccaaagtagtccaggaccca

SEQ ID NO: 27627 - DNA, 30 bp, Homo sapiens
ggcctttctgggaactgctttgaaatattc

SEQ ID NO: 27628 - DNA, 30 bp, Homo sapiens
tcagactgtctggattgggatcccagcttt

SEQ ID NO: 27629 - DNA, 30 bp, Homo sapiens
atgaagccctccagcacacggtcactgcgc

SEQ ID NO: 27630 - DNA, 30 bp, Homo sapiens
tacaggtcttcgcgggagggcagctgtgtc

SEQ ID NO: 27631 - DNA, 30 bp, Homo sapiens
gttcctcaatgagagtcttgttttggtttt

SEQ ID NO: 27632 - DNA, 30 bp, Homo sapiens
gctagtctgatatatgctagttggtactgc

SEQ ID NO: 27633 - DNA, 30 bp, Homo sapiens
tcaaggtttcaagttcctctataagcttct

SEQ ID NO: 27634 - DNA, 30 bp, Homo sapiens
gcacggagaggaagtgcaaggcaaggaaga

SEQ ID NO: 27635 - DNA, 30 bp, Homo sapiens
atctccatgagtttcctgttgctgtgagct

SEQ ID NO: 27636 - DNA, 30 bp, Homo sapiens
aaacagaattccccgatactgtttccattt

SEQ ID NO: 27637 - DNA, 30 bp, Homo sapiens
cagactgctgtggactgcttgatgctgtga

SEQ ID NO: 27638 - DNA, 30 bp, Homo sapiens
ctgctctggcttctctcttccatgaggccc

SEQ ID NO: 27639 - DNA, 30 bp, Homo sapiens
cagcggccgtctgcttgatgctgtggaagc

SEQ ID NO: 27640 - DNA, 30 bp, Homo sapiens
gtttggtagaaattgtctgcctgtagatgg

SEQ ID NO: 27641 - DNA, 30 bp, Homo sapiens
gtgtggctctcggctccgccccgcccaaag

SEQ ID NO: 27642 - DNA, 30 bp, Homo sapiens
ggctggaccttgccttcggggtcccggtca

SEQ ID NO: 27643 - DNA, 30 bp, Homo sapiens
tcgccaatgttcacacctttggggccaaac

SEQ ID NO: 27644 - DNA, 30 bp, Homo sapiens
ttatctcgaggtgcagagaaatataaaagg

SEQ ID NO: 27645 - DNA, 30 bp, Homo sapiens
ctctactaaaagtaccaaaattagccacgc

SEQ ID NO: 27646 - DNA, 30 bp, Homo sapiens
aagtggctttacagaataggatagttgttg

SEQ ID NO: 27647 - DNA, 30 bp, Homo sapiens
tcgaggtgatccttgttggcggcaagatgc

SEQ ID NO: 27648 - DNA, 30 bp, Homo sapiens
acttttccttgagtaactcatgttcacagc

SEQ ID NO: 27649 - DNA, 30 bp, Homo sapiens
tgcaggaggccttgcaactgtccctgacca

SEQ ID NO: 27650 - DNA, 30 bp, Homo sapiens
ctcctggaggattctgtaaactttctgaga

SEQ ID NO: 27651 - DNA, 30 bp, Homo sapiens
agcaaagatccggaaggcctttccatcccg

SEQ ID NO: 27652 - DNA, 30 bp, Homo sapiens
catcgggattctgttgatccagcagacgga

SEQ ID NO: 27653 - DNA, 30 bp, Homo sapiens
atcagagccgatactgaggcggaggcaggt

SEQ ID NO: 27654 - DNA, 30 bp, Homo sapiens
atctgggttttgagggtcaaagattttgac

SEQ ID NO: 27655 - DNA, 30 bp, Homo sapiens
atctggcaggacctctcgccgtgccccgtc

SEQ ID NO: 27656 - DNA, 30 bp, Homo sapiens
caacgccacgtaggagcggtcattcatcac

SEQ ID NO: 27657 - DNA, 30 bp, Homo sapiens
tccaggatagaaaaatgagcatccaaagta

SEQ ID NO: 27658 - DNA, 30 bp, Homo sapiens
cagtcttccggccataatgatagtaactat

SEQ ID NO: 27659 - DNA, 30 bp, Homo sapiens
ccgaggctggtgatgttggagcggccacca

SEQ ID NO: 27660 - DNA, 30 bp, Homo sapiens
gagcactttgatttttccatgttctttgca

SEQ ID NO: 27661 - DNA, 30 bp, Homo sapiens
atctggatggtgctcagcatcctccttttc

SEQ ID NO: 27662 - DNA, 30 bp, Homo sapiens
gcttggtgcttctcaagtaggaatacagct

SEQ ID NO: 27663 - DNA, 30 bp, Homo sapiens
ctctggggggccggagggtggggagaaggg

SEQ ID NO: 27664 - DNA, 30 bp, Homo sapiens
ctttgggcgtgtcctgtctggaaggcctgg

SEQ ID NO: 27665 - DNA, 30 bp, Homo sapiens
cagtctcgggacaggatttccaggctgaac

SEQ ID NO: 27666 - DNA, 30 bp, Homo sapiens
ttctggtgcaatttttctccaatcccactt

SEQ ID NO: 27667 - DNA, 30 bp, Homo sapiens
ggccacagctggggtttggtgaacacttcg

SEQ ID NO: 27668 - DNA, 30 bp, Homo sapiens
ccaaggcctagagaaagatatgaggcccga

SEQ ID NO: 27669 - DNA, 30 bp, Homo sapiens
cagcagctgggctcgcagctctccttaacc

SEQ ID NO: 27670 - DNA, 30 bp, Homo sapiens
ctctggtacttggatgtgcttttcttctaa

SEQ ID NO: 27671 - DNA, 30 bp, Homo sapiens
agctggtctcctccagttccaagaggtcat

SEQ ID NO: 27672 - DNA, 30 bp, Homo sapiens
cacaggcggtccatccggaaggtgtcctcg

SEQ ID NO: 27673 - DNA, 30 bp, Homo sapiens
cattggagccggtcactgcggaatgactcc

SEQ ID NO: 27674 - DNA, 30 bp, Homo sapiens
cagaggggtccagcaggcccatgctggagt

SEQ ID NO: 27675 - DNA, 30 bp, Homo sapiens
caagatctgaaacttccaggcactctgatc

SEQ ID NO: 27676 - DNA, 30 bp, Homo sapiens
tttaggaccaatactctgtgtgtcctcttc

SEQ ID NO: 27677 - DNA, 30 bp, Homo sapiens
tcggcagctctggggttggcaactctgcca

SEQ ID NO: 27678 - DNA, 30 bp, Homo sapiens
tcttgggggctgcggtgacagcaggcttct

SEQ ID NO: 27679 - DNA, 30 bp, Homo sapiens
tgttggattcggcgaatcgattggatctgc

SEQ ID NO: 27680 - DNA, 30 bp, Homo sapiens
tgctggactctccggatggactgcagctgc

SEQ ID NO: 27681 - DNA, 30 bp, Homo sapiens
cactgctggatcctgcggatgctctgcacc

SEQ ID NO: 27682 - DNA, 30 bp, Homo sapiens
acttggggggctctgtggccaggacaggga

SEQ ID NO: 27683 - DNA, 30 bp, Homo sapiens
agttggaggggtggaaggcaccacgttggt

SEQ ID NO: 27684 - DNA, 30 bp, Homo sapiens
agctgctggggaagcggccccgcttgtgcc

SEQ ID NO: 27685 - DNA, 30 bp, Homo sapiens
ccatggcttcccacacttgtgtaaacttct

SEQ ID NO: 27686 - DNA, 30 bp, Homo sapiens
acgtggatagtccagatctgggatgccctg

SEQ ID NO: 27687 - DNA, 30 bp, Homo sapiens
tctgtgtttcttctccctccaggggctgat

SEQ ID NO: 27688 - DNA, 30 bp, Homo sapiens
aatcggtgacccgtctcaaagagccgactt

SEQ ID NO: 27689 - DNA, 30 bp, Homo sapiens
ctcgtctaagagagccaactttggcatttg

SEQ ID NO: 27690 - DNA, 30 bp, Homo sapiens
ctctccgcaaagagcctgccttagcatcca

SEQ ID NO: 27691 - DNA, 30 bp, Homo sapiens
agagcccactctggcattcgtggcccccca

SEQ ID NO: 27692 - DNA, 30 bp, Homo sapiens
cagaggtttgcagtcaggaaaggtggctgg

SEQ ID NO: 27693 - DNA, 30 bp, Homo sapiens
agccgggaggaccacgctccccgattcctt

SEQ ID NO: 27694 - DNA, 30 bp, Homo sapiens
atgcggcggaaagactggacagctggggag

SEQ ID NO: 27695 - DNA, 30 bp, Homo sapiens
acttggcgagtctcatgaggcactcgtccc

SEQ ID NO: 27696 - DNA, 30 bp, Homo sapiens
gaccaggaatcatagatgagtttggctgca

SEQ ID NO: 27697 - DNA, 30 bp, Homo sapiens
gccccactaccatgaatgatattttcatga

SEQ ID NO: 27698 - DNA, 30 bp, Homo sapiens
ccatggaaacttttgcctcatacagtggaa

SEQ ID NO: 27699 - DNA, 30 bp, Homo sapiens
cttagagtccacaaacttcatcagaccctc

SEQ ID NO: 27700 - DNA, 30 bp, Homo sapiens
cacaggtcctggcctagccgctccagctcg

SEQ ID NO: 27701 - DNA, 30 bp, Homo sapiens
gttcctggaacttccttgatgggtcccttt

SEQ ID NO: 27702 - DNA, 30 bp, Homo sapiens
agcccacgacctggccagaccacgtctcgt

SEQ ID NO: 27703 - DNA, 30 bp, Homo sapiens
tgacggatctttctttctgcaccaaacccc

SEQ ID NO: 27704 - DNA, 30 bp, Homo sapiens
cactggctgcctgaaggtacccttggagat

SEQ ID NO: 27705 - DNA, 30 bp, Homo sapiens
acactggcagttccacctgtctgtcatcct

SEQ ID NO: 27706 - DNA, 30 bp, Homo sapiens
cagaactgatagttgttgggctgcagcaag

SEQ ID NO: 27707 - DNA, 30 bp, Homo sapiens
tcctggactggctcccagcagtcaaagggg

SEQ ID NO: 27708 - DNA, 30 bp, Homo sapiens
tgtcgcggaggcggagatgtccatgccatt

SEQ ID NO: 27709 - DNA, 30 bp, Homo sapiens
ccttggagaagaccccgacccgggagaagg

SEQ ID NO: 27710 - DNA, 30 bp, Homo sapiens
tcacggtcaagacctcttcgcggtagcctt

SEQ ID NO: 27711 - DNA, 30 bp, Homo sapiens
ctgtggaactggcgggaacagccgctgtat

SEQ ID NO: 27712 - DNA, 30 bp, Homo sapiens
cccaggcttgttgacctcccaagggggcag

SEQ ID NO: 27713 - DNA, 30 bp, Homo sapiens
ggctgggcaaggtggcgtagaacgcggtac

SEQ ID NO: 27714 - DNA, 30 bp, Homo sapiens
aagctccccagcgcctccatcccatggacc

SEQ ID NO: 27715 - DNA, 30 bp, Homo sapiens
cattgggtggggctggatggagcatgatct

SEQ ID NO: 27716 - DNA, 30 bp, Homo sapiens
cgaaggtgagcctctatctcgtgcctgaac

SEQ ID NO: 27717 - DNA, 30 bp, Homo sapiens
gcttcactgtttgtcctgtatgcctgttta

SEQ ID NO: 27718 - DNA, 30 bp, Homo sapiens
gtcaggaaatctgaacgatactgacaagtc

SEQ ID NO: 27719 - DNA, 30 bp, Homo sapiens
ccaaaatctcgccaaaagccagaatccttt

SEQ ID NO: 27720 - DNA, 30 bp, Homo sapiens
agccacagctgccctccacagagcggcact

SEQ ID NO: 27721 - DNA, 30 bp, Homo sapiens
aagccagtggggttccaggattggcgaccc

SEQ ID NO: 27722 - DNA, 30 bp, Homo sapiens
agccacagctaccctctacagagcggcact

SEQ ID NO: 27723 - DNA, 30 bp, Homo sapiens
gaagccacagctgccctccacagagcggca

SEQ ID NO: 27724 - DNA, 30 bp, Homo sapiens
cacaggtgcagctcgtgggttttgatgtgc

SEQ ID NO: 27725 - DNA, 30 bp, Homo sapiens
tacagactgtgttcagagttgtgtcaaacc

SEQ ID NO: 27726 - DNA, 30 bp, Homo sapiens
cgctggccatgatgtctgtgggctggatgt

SEQ ID NO: 27727 - DNA, 30 bp, Homo sapiens
tataccattgtgcaaaccgtgttcaagttg

SEQ ID NO: 27728 - DNA, 30 bp, Homo sapiens
tagcatgacgttatttttttcataattttc

SEQ ID NO: 27729 - DNA, 30 bp, Homo sapiens
aactggggcaagtggctgagtcacagggta

SEQ ID NO: 27730 - DNA, 30 bp, Homo sapiens
cgtaggtggagtaactgcaactgtggttgt

SEQ ID NO: 27731 - DNA, 30 bp, Homo sapiens
ggggtttgggcctgctgaccctgcccactg

SEQ ID NO: 27732 - DNA, 30 bp, Homo sapiens
ctgtgggggtttgggcctgctgaccctgcc

SEQ ID NO: 27733 - DNA, 30 bp, Homo sapiens
gtctgggtttgggcctgctgaccctgccca

SEQ ID NO: 27734 - DNA, 30 bp, Homo sapiens
catcggtgcacgacagactgaagaccactg

SEQ ID NO: 27735 - DNA, 30 bp, Homo sapiens
ccgtggtgttcgaaaggaatgctattctgt

SEQ ID NO: 27736 - DNA, 30 bp, Homo sapiens
ttcccgagatggtcaaatggcacacttgtc

SEQ ID NO: 27737 - DNA, 30 bp, Homo sapiens
gccagggtttatgaaacattatacatttag

SEQ ID NO: 27738 - DNA, 30 bp, Homo sapiens
ttgtggcgctgagcagtcttcttccttttc

SEQ ID NO: 27739 - DNA, 30 bp, Homo sapiens
ccacctctgcaggcgctgtgatcggggcgt

SEQ ID NO: 27740 - DNA, 30 bp, Homo sapiens
ttgtggcgctgtatggttttccttttcctt

SEQ ID NO: 27741 - DNA, 30 bp, Homo sapiens
ctgctgagcgccagcggcagctggaacagg

SEQ ID NO: 27742 - DNA, 30 bp, Homo sapiens
gaccactggaaagcacagcattgtctgcac

SEQ ID NO: 27743 - DNA, 30 bp, Homo sapiens
gcagctggaacaggcatcccaagggggttg

SEQ ID NO: 27744 - DNA, 30 bp, Homo sapiens
gactgggctcttgaagttgctggcggcttg

SEQ ID NO: 27745 - DNA, 30 bp, Homo sapiens
acccagtactggccattcttaagggcaggg

SEQ ID NO: 27746 - DNA, 30 bp, Homo sapiens
cagcctggtcacctttgccaccctcaagtt

SEQ ID NO: 27747 - DNA, 30 bp, Homo sapiens
ggcaggacttgagaacctcctggattttgt

SEQ ID NO: 27748 - DNA, 30 bp, Homo sapiens
gcagtcgacaggccctgccaagtgaaagtg

SEQ ID NO: 27749 - DNA, 30 bp, Homo sapiens
caccggcacaggctccattagagatgctgg

SEQ ID NO: 27750 - DNA, 30 bp, Homo sapiens
acactgccagagggagttctaaggaagaat

SEQ ID NO: 27751 - DNA, 30 bp, Homo sapiens
ccacgggtgatttgatgcactcttcatgca

SEQ ID NO: 27752 - DNA, 30 bp, Homo sapiens
tcagagtggaccaaggccccagctccttgc

SEQ ID NO: 27753 - DNA, 30 bp, Homo sapiens
gcagacccccaaaccaaagggagccagatg

SEQ ID NO: 27754 - DNA, 30 bp, Homo sapiens
tactgggcatgaacaagagcccctgctcct

SEQ ID NO: 27755 - DNA, 30 bp, Homo sapiens
gttgtgtaaggcctccaaacccaatacccg

SEQ ID NO: 27756 - DNA, 30 bp, Homo sapiens
gattcttgacacctggatttcaccagggac

SEQ ID NO: 27757 - DNA, 30 bp, Homo sapiens
cactgctgcagcttttgttcaaaattttgt

SEQ ID NO: 27758 - DNA, 30 bp, Homo sapiens
gcttcttgacacctggaattcaccagggac

SEQ ID NO: 27759 - DNA, 30 bp, Homo sapiens
ggcgtcctgacaggtggatttcgacaaggt

SEQ ID NO: 27760 - DNA, 30 bp, Homo sapiens
ggcttcttgacacctggaattcaccaggga

SEQ ID NO: 27761 - DNA, 30 bp, Homo sapiens
gactttccggcacttgtagttcagaatgga

SEQ ID NO: 27762 - DNA, 30 bp, Homo sapiens
tttaggagctgagaggagttctgccaggga

SEQ ID NO: 27763 - DNA, 30 bp, Homo sapiens
caacggagaacaggcacctcgaagtgctgg

SEQ ID NO: 27764 - DNA, 30 bp, Homo sapiens
cagtgaattcaccattccagggaagtgctc

SEQ ID NO: 27765 - DNA, 30 bp, Homo sapiens
gtccctcggaatggctttgtcagctgctcc

SEQ ID NO: 27766 - DNA, 30 bp, Homo sapiens
cagtggaatccctccaagcaggtcttgttc

SEQ ID NO: 27767 - DNA, 30 bp, Homo sapiens
agctcgtcatccttgtttttgtcaacctgg

SEQ ID NO: 27768 - DNA, 30 bp, Homo sapiens
aataggtcagctcatcatgcttggctttgt

SEQ ID NO: 27769 - DNA, 30 bp, Homo sapiens
cagtggtcgatctccggtaccaaaaccgcg

SEQ ID NO: 27770 - DNA, 30 bp, Homo sapiens
aaggtgctccagtggatttctgtatttgtt

SEQ ID NO: 27771 - DNA, 30 bp, Homo sapiens
aagacgctccagtggatttctggatttgtt

SEQ ID NO: 27772 - DNA, 30 bp, Homo sapiens
cgaatccgcttctgctgccgtgctctgtaa

SEQ ID NO: 27773 - DNA, 30 bp, Homo sapiens
cttcaatgtacagtttccagaatctgccag

SEQ ID NO: 27774 - DNA, 30 bp, Homo sapiens
aattggctatgttcctaacttgttttctat

SEQ ID NO: 27775 - DNA, 30 bp, Homo sapiens
tctgaggtttctgcccacatgctcggcctc

SEQ ID NO: 27776 - DNA, 30 bp, Homo sapiens
tgcagtaggtccttgcactccttcaagcat

SEQ ID NO: 27777 - DNA, 30 bp, Homo sapiens
tttctgcatccttctctttttcttgttctt

SEQ ID NO: 27778 - DNA, 30 bp, Homo sapiens
tttccacatccttctctttttcttgttctt

SEQ ID NO: 27779 - DNA, 30 bp, Homo sapiens
ttcccttttgggccgtcccaggcctccgtc

SEQ ID NO: 27780 - DNA, 30 bp, Homo sapiens
cactggggtgatagaaatcgctctccaaat

SEQ ID NO: 27781 - DNA, 30 bp, Homo sapiens
tatctcctctgaccagatgtggggtgagaa

SEQ ID NO: 27782 - DNA, 30 bp, Homo sapiens
aggtggatttccggtgaggtgatgcacctc

SEQ ID NO: 27783 - DNA, 30 bp, Homo sapiens
ccctgagggaggctgagccaaaaacacggg

SEQ ID NO: 27784 - DNA, 30 bp, Homo sapiens
gtgaggggcagagaacatcacattaaaggc

SEQ ID NO: 27785 - DNA, 30 bp, Homo sapiens
ccctgagggagcctgagccaaaaacacggg

SEQ ID NO: 27786 - DNA, 30 bp, Homo sapiens
gaatgtgggggctggggggaaaaatgcagg

SEQ ID NO: 27787 - DNA, 30 bp, Homo sapiens
gaatgcggggttggggtaaaatccaggtct

SEQ ID NO: 27788 - DNA, 30 bp, Homo sapiens
gaatgtggggttggggtaaaatccaggtct

SEQ ID NO: 27789 - DNA, 30 bp, Homo sapiens
tacaactggtcactggcgtggtctctatcc

SEQ ID NO: 27790 - DNA, 30 bp, Homo sapiens
cgttggggtgctctcgattgtccccgtgtt

SEQ ID NO: 27791 - DNA, 30 bp, Homo sapiens
ctttggctttaagacttcccacatttcttc

SEQ ID NO: 27792 - DNA, 30 bp, Homo sapiens
aacaggaggaagcaaggatccccagagagc

SEQ ID NO: 27793 - DNA, 30 bp, Homo sapiens
caccggtccatcatgctgaggatcatctcg

SEQ ID NO: 27794 - DNA, 30 bp, Homo sapiens
acatggtaaaaccccatctctactaaaaat

SEQ ID NO: 27795 - DNA, 30 bp, Homo sapiens
cacttatccatcgtgttgaggagcatttca

SEQ ID NO: 27796 - DNA, 30 bp, Homo sapiens
gacgcgcctactccctcttcgccttctgcc

SEQ ID NO: 27797 - DNA, 30 bp, Homo sapiens
agagaggtccctgtagcaaggaactgaggc

SEQ ID NO: 27798 - DNA, 30 bp, Homo sapiens
ctaagatgccatgaagcttcaagtccaaga

SEQ ID NO: 27799 - DNA, 30 bp, Homo sapiens
gggaaaagcctttgccacacttggagcatt

SEQ ID NO: 27800 - DNA, 30 bp, Homo sapiens
ttgtggttttaagccactccattttgaggt

SEQ ID NO: 27801 - DNA, 30 bp, Homo sapiens
ccgatgttggtgaaggtttcggctcagcac

SEQ ID NO: 27802 - DNA, 30 bp, Homo sapiens
cattcagcttcctcttgtggcctctctttg

SEQ ID NO: 27803 - DNA, 30 bp, Homo sapiens
atgaggtcgttgagctccgcctccagcgcc

SEQ ID NO: 27804 - DNA, 30 bp, Homo sapiens
ttgtggcctctgggcccccggccccctgcc

SEQ ID NO: 27805 - DNA, 30 bp, Homo sapiens
tagctccctggccgtggctgcctgagcact

SEQ ID NO: 27806 - DNA, 30 bp, Homo sapiens
taaggggcccgcagctgcccaaggctggtg

SEQ ID NO: 27807 - DNA, 30 bp, Homo sapiens
gcagagtctgtgcagcatgctgtacacgtc

SEQ ID NO: 27808 - DNA, 30 bp, Homo sapiens
tgggggcagcaaatcatgcaagcgaaatct

SEQ ID NO: 27809 - DNA, 30 bp, Homo sapiens
ccccgggcagcagctggcccaggtcgccct

SEQ ID NO: 27810 - DNA, 30 bp, Homo sapiens
ctccgtacatcttcctgtagtacagcgatt

SEQ ID NO: 27811 - DNA, 30 bp, Homo sapiens
acttggagggtgtgctgccttcaaagcttg

SEQ ID NO: 27812 - DNA, 30 bp, Homo sapiens
agtagaagcatctccttttgggtaatctga

SEQ ID NO: 27813 - DNA, 30 bp, Homo sapiens
ttctggatggttctgttgtagtactgcgtg

SEQ ID NO: 27814 - DNA, 30 bp, Homo sapiens
tgttgggggcattttcacatagacccctgt

SEQ ID NO: 27815 - DNA, 30 bp, Homo sapiens
ctttgaactcgctgagggcctgcaccgggt

SEQ ID NO: 27816 - DNA, 30 bp, Homo sapiens
acatggcgctgtccacccagtgagtggcca

SEQ ID NO: 27817 - DNA, 30 bp, Homo sapiens
agaaggaatccattgctttgaattcactta

SEQ ID NO: 27818 - DNA, 30 bp, Homo sapiens
caatggatggatttttttctttgctgagcc

SEQ ID NO: 27819 - DNA, 30 bp, Homo sapiens
aataatgcattcctccaacaatttgatttt

SEQ ID NO: 27820 - DNA, 30 bp, Homo sapiens
ttgtaactgagacccatccgttattttcca

SEQ ID NO: 27821 - DNA, 30 bp, Homo sapiens
tcatggatcttgtcttcgtaatacacttgt

SEQ ID NO: 27822 - DNA, 30 bp, Homo sapiens
accaggccagctgattgctgtcacctggag

SEQ ID NO: 27823 - DNA, 30 bp, Homo sapiens
cagaagatgagacaggccggggtcatcatt

SEQ ID NO: 27824 - DNA, 30 bp, Homo sapiens
gaagttctccagcaagcccaggatgcgctt

SEQ ID NO: 27825 - DNA, 30 bp, Homo sapiens
tcaagggtgttgttcccttcaatggctcca

SEQ ID NO: 27826 - DNA, 30 bp, Homo sapiens
tcatcatccaaaaccaacacatccaactct

SEQ ID NO: 27827 - DNA, 30 bp, Homo sapiens
acccaggagtcgggggaggccgggtagtgg

SEQ ID NO: 27828 - DNA, 30 bp, Homo sapiens
aagctgcttgcagaaacgctggtagtttgg

SEQ ID NO: 27829 - DNA, 30 bp, Homo sapiens
agctggtcataccccggtctctttctgtac

SEQ ID NO: 27830 - DNA, 30 bp, Homo sapiens
gtcaggggagctgcttccactcctgtcact

SEQ ID NO: 27831 - DNA, 30 bp, Homo sapiens
cagctatccttggctctgaaaagctgtcat

SEQ ID NO: 27832 - DNA, 30 bp, Homo sapiens
cactatcatctgacccatgttctgagcctc

SEQ ID NO: 27833 - DNA, 30 bp, Homo sapiens
agttggcagccaggatcttctgcacccaag

SEQ ID NO: 27834 - DNA, 30 bp, Homo sapiens
ctgaggctctgtggggagcagggtcggagg

SEQ ID NO: 27835 - DNA, 30 bp, Homo sapiens
agttggcggccaggatcttctgcacccagg

SEQ ID NO: 27836 - DNA, 30 bp, Homo sapiens
gatgtaggcggacacccgggtgtagactac

SEQ ID NO: 27837 - DNA, 30 bp, Homo sapiens
tgtaggctatgacctggttgatccaggtgc

SEQ ID NO: 27838 - DNA, 30 bp, Homo sapiens
gtatggctgcttgttcaggaagcgggagaa

SEQ ID NO: 27839 - DNA, 30 bp, Homo sapiens
actgatcggtgcgtggaattccagccacca

SEQ ID NO: 27840 - DNA, 30 bp, Homo sapiens
tttaggaattggtgtggctgccactgctat

SEQ ID NO: 27841 - DNA, 30 bp, Homo sapiens
tgttcctcagatgtggcaaatcatatatcc

SEQ ID NO: 27842 - DNA, 30 bp, Homo sapiens
tcatggccagtttgttcctcagatgtggca

SEQ ID NO: 27843 - DNA, 30 bp, Homo sapiens
tagaggcgggcagcctcggcgaagcccacc

SEQ ID NO: 27844 - DNA, 30 bp, Homo sapiens
gacaggcaggcacagacacaaggcccctcc

SEQ ID NO: 27845 - DNA, 30 bp, Homo sapiens
taggggactgctggggccagtcccacacgg

SEQ ID NO: 27846 - DNA, 30 bp, Homo sapiens
cagtccaccaccgccgagctggccatggtg

SEQ ID NO: 27847 - DNA, 30 bp, Homo sapiens
cacaggggggtctccatctgatccagcagt

SEQ ID NO: 27848 - DNA, 30 bp, Homo sapiens
cagagggatggggtaggaggcgcaggcagc

SEQ ID NO: 27849 - DNA, 30 bp, Homo sapiens
tcttggggaagctggccaggttggcaatgc

SEQ ID NO: 27850 - DNA, 30 bp, Homo sapiens
cacacagtggggtagctggctgctgaggca

SEQ ID NO: 27851 - DNA, 30 bp, Homo sapiens
ttgacatgggcataaccatctactccccaa

SEQ ID NO: 27852 - DNA, 30 bp, Homo sapiens
gatttctgggtaagagggaaagctagcaat

SEQ ID NO: 27853 - DNA, 30 bp, Homo sapiens
cattggggtagctggctgctgtggcgattc

SEQ ID NO: 27854 - DNA, 30 bp, Homo sapiens
gggagggcaggagactcggggcttcatatc

SEQ ID NO: 27855 - DNA, 30 bp, Homo sapiens
acgatggggtccccaaatgtacagtgctcc

SEQ ID NO: 27856 - DNA, 30 bp, Homo sapiens
cacgggcactccgggacccaagtcccgaga

SEQ ID NO: 27857 - DNA, 30 bp, Homo sapiens
tgccgcagctccacatagttggctgggaag

SEQ ID NO: 27858 - DNA, 30 bp, Homo sapiens
gttaggtttttctaggtgttcatttttgtg

SEQ ID NO: 27859 - DNA, 30 bp, Homo sapiens
tgctggtaggcaaaagtaactcaacatcct

SEQ ID NO: 27860 - DNA, 30 bp, Homo sapiens
agaaggtggggacggccttggaggcggggg

SEQ ID NO: 27861 - DNA, 30 bp, Homo sapiens
ctctggcccgcctcgtcgtcactgtcctca

SEQ ID NO: 27862 - DNA, 30 bp, Homo sapiens
tcagacagtcccggatctcctgcaagcccc

SEQ ID NO: 27863 - DNA, 30 bp, Homo sapiens
acaccaacgcgtagtcgaactgcccgcgct

SEQ ID NO: 27864 - DNA, 30 bp, Homo sapiens
tagaggaaggcatgctactatatgggtcta

SEQ ID NO: 27865 - DNA, 30 bp, Homo sapiens
taagcaagggcatggtcgaactgccctttc

SEQ ID NO: 27866 - DNA, 30 bp, Homo sapiens
ctttcctgccaagacactgaaaagtcccaa

SEQ ID NO: 27867 - DNA, 30 bp, Homo sapiens
tagctgtcccaagttaatcggaatgcggat

SEQ ID NO: 27868 - DNA, 30 bp, Homo sapiens
cgcaggccttcctccaccttgggtgcctcc

SEQ ID NO: 27869 - DNA, 30 bp, Homo sapiens
caatggaagcggtactttctggctggcttg

SEQ ID NO: 27870 - DNA, 30 bp, Homo sapiens
aactgtaggtgtccttttcaccatccactc

SEQ ID NO: 27871 - DNA, 30 bp, Homo sapiens
gcctggctgcgttctatgtattgtttgtct

SEQ ID NO: 27872 - DNA, 30 bp, Homo sapiens
ctcaggtgttcgtgccaaatattctctctc

SEQ ID NO: 27873 - DNA, 30 bp, Homo sapiens
tagtggtactgattcggattgtctttgtct

SEQ ID NO: 27874 - DNA, 30 bp, Homo sapiens
agtcccggtcaattaaagattctattctct

SEQ ID NO: 27875 - DNA, 30 bp, Homo sapiens
ttcttagtattcgtagttgaactattcctt

SEQ ID NO: 27876 - DNA, 30 bp, Homo sapiens
taccggaaggtagagaagctctgggtggca

SEQ ID NO: 27877 - DNA, 30 bp, Homo sapiens
cagtcataggcctcatcttcatcctcttcc

SEQ ID NO: 27878 - DNA, 30 bp, Homo sapiens
ggcaggactgtgatagagtcagaaactgac

SEQ ID NO: 27879 - DNA, 30 bp, Homo sapiens
accaggatgttctttgcgatagcattcaaa

SEQ ID NO: 27880 - DNA, 30 bp, Homo sapiens
gtcaccagccgcagccccgttgtcattctc

SEQ ID NO: 27881 - DNA, 30 bp, Homo sapiens
agaactcccattcgataggttcctcccggc

SEQ ID NO: 27882 - DNA, 30 bp, Homo sapiens
gaactcccactccagggcctcctcccgatt

SEQ ID NO: 27883 - DNA, 30 bp, Homo sapiens
ttctggtatttgtagtctgcccgttgattt

SEQ ID NO: 27884 - DNA, 30 bp, Homo sapiens
gcacagttcttgaagacaacgtcatcatcc

SEQ ID NO: 27885 - DNA, 30 bp, Homo sapiens
cgccggtcctgatttttctttgattctctg

SEQ ID NO: 27886 - DNA, 30 bp, Homo sapiens
ctaccgaagttctctgtaaagagtagatat

SEQ ID NO: 27887 - DNA, 30 bp, Homo sapiens
actgaagtacatgtgacatcctgatcttcc

SEQ ID NO: 27888 - DNA, 30 bp, Homo sapiens
gccaggtgatccgttgagtgagtttgaagt

SEQ ID NO: 27889 - DNA, 30 bp, Homo sapiens
ttcttttattcactggattccgaggatcat

SEQ ID NO: 27890 - DNA, 30 bp, Homo sapiens
agttgggccgggctgtaggctgggctccaa

SEQ ID NO: 27891 - DNA, 30 bp, Homo sapiens
taaagtcatagggctcaaagtctttccgga

SEQ ID NO: 27892 - DNA, 30 bp, Homo sapiens
ctgagcaaactgcagtgcttttttcctctg

SEQ ID NO: 27893 - DNA, 30 bp, Homo sapiens
ttgtaggatccaaatctgggattaaaatga

SEQ ID NO: 27894 - DNA, 30 bp, Homo sapiens
acacgggcaccaggacatatgaattactac

SEQ ID NO: 27895 - DNA, 30 bp, Homo sapiens
agagaaggagcaatgcatctccatcactcg

SEQ ID NO: 27896 - DNA, 30 bp, Homo sapiens
cttgctctgtgctggaatcatcacaggaat

SEQ ID NO: 27897 - DNA, 30 bp, Homo sapiens
tagcttctggcagtggacgtacggctcttt

SEQ ID NO: 27898 - DNA, 30 bp, Homo sapiens
gtcttgtaagggtacttgaacttagcaggt

SEQ ID NO: 27899 - DNA, 30 bp, Homo sapiens
agcaggtgggagagtcggactctgaggagt

SEQ ID NO: 27900 - DNA, 30 bp, Homo sapiens
agttggatttgtcactgttcagcatctttt

SEQ ID NO: 27901 - DNA, 30 bp, Homo sapiens
cttgctaactgctttcagtaaattcttgat

SEQ ID NO: 27902 - DNA, 30 bp, Homo sapiens
ttgcttcgatttgggatttaggcatcgttg

SEQ ID NO: 27903 - DNA, 30 bp, Homo sapiens
tccaggacttcatatgttttgatattttta

SEQ ID NO: 27904 - DNA, 30 bp, Homo sapiens
cacatccccaggagagggccagctccattc

SEQ ID NO: 27905 - DNA, 30 bp, Homo sapiens
actcctgaatccactttagcttcgggtcaa

SEQ ID NO: 27906 - DNA, 30 bp, Homo sapiens
tccaggtactcctgaatccactttagcttc

SEQ ID NO: 27907 - DNA, 30 bp, Homo sapiens
ctgggcagcctttctcttcttctgtcgctt

SEQ ID NO: 27908 - DNA, 30 bp, Homo sapiens
cccaggttgactggtcctggcacccccagg

SEQ ID NO: 27909 - DNA, 30 bp, Homo sapiens
aactggtagagttgaagaacttctttttct

SEQ ID NO: 27910 - DNA, 30 bp, Homo sapiens
cttctcgttccaggcgttgtaccacttgat

SEQ ID NO: 27911 - DNA, 30 bp, Homo sapiens
gtcaggtgccacaggtatataatgaaccgg

SEQ ID NO: 27912 - DNA, 30 bp, Homo sapiens
caaaggcagagcaaagcttcttagctgaca

SEQ ID NO: 27913 - DNA, 30 bp, Homo sapiens
agttggatttgccatttttcagcatctttt

SEQ ID NO: 27914 - DNA, 30 bp, Homo sapiens
agttggtgctccccttgttcagtatctttt

SEQ ID NO: 27915 - DNA, 30 bp, Homo sapiens
ttctggatcaagacaaatttccttcccgtt

SEQ ID NO: 27916 - DNA, 30 bp, Homo sapiens
caaaaacttctccacaaccctctgcaccca

SEQ ID NO: 27917 - DNA, 30 bp, Homo sapiens
catctgctgaatctgggtttagacatgttt

SEQ ID NO: 27918 - DNA, 30 bp, Homo sapiens
cagaggttggaagagacattgacagacgaa

SEQ ID NO: 27919 - DNA, 30 bp, Homo sapiens
tagtggaagtgtgccctgaagaagagccaa

SEQ ID NO: 27920 - DNA, 30 bp, Homo sapiens
aagcccgagtaggaggcctctgaggtctca

SEQ ID NO: 27921 - DNA, 30 bp, Homo sapiens
agctggagtgaaaacttgaagactcagact

SEQ ID NO: 27922 - DNA, 30 bp, Homo sapiens
acgtggtgagagaggtggcattctctgact

SEQ ID NO: 27923 - DNA, 30 bp, Homo sapiens
aactggaacatgctggtggcctccacattg

SEQ ID NO: 27924 - DNA, 30 bp, Homo sapiens
tatggatttacattgctatactgagaaata

SEQ ID NO: 27925 - DNA, 30 bp, Homo sapiens
cacaggaactttagttctctctggccctgg

SEQ ID NO: 27926 - DNA, 30 bp, Homo sapiens
gataggcaaatctggagtcacacgttctca

SEQ ID NO: 27927 - DNA, 30 bp, Homo sapiens
gccttcctgtcaggtgtttgtctcccaggt

SEQ ID NO: 27928 - DNA, 30 bp, Homo sapiens
tgtcaggtgtttgtctcccaggttcctgtg

SEQ ID NO: 27929 - DNA, 30 bp, Homo sapiens
ctcctttcctaggtatgggctccagtaacc

SEQ ID NO: 27930 - DNA, 30 bp, Homo sapiens
caaagggatcaggtgctctgggatgtctac

SEQ ID NO: 27931 - DNA, 30 bp, Homo sapiens
atcactcctcgaccaaacttttcccctttc

SEQ ID NO: 27932 - DNA, 30 bp, Homo sapiens
acttgtcagtgaggaactgcatggccgcta

SEQ ID NO: 27933 - DNA, 30 bp, Homo sapiens
ctgaggtctcgctttgctctttgtcggcct

SEQ ID NO: 27934 - DNA, 30 bp, Homo sapiens
tatttgaactggttgtcaatcaaggtcccc

SEQ ID NO: 27935 - DNA, 30 bp, Homo sapiens
taccgacgatatgcactctatccagttcag

SEQ ID NO: 27936 - DNA, 30 bp, Homo sapiens
gagtggagatgatagttatcctttgtacct

SEQ ID NO: 27937 - DNA, 30 bp, Homo sapiens
agttggcgacctttattcttcctgaagtct

SEQ ID NO: 27938 - DNA, 30 bp, Homo sapiens
tttagggttacttcagaggtgacttgattg

SEQ ID NO: 27939 - DNA, 30 bp, Homo sapiens
ctcaggcggtgttgcggggtgagctgtgct

SEQ ID NO: 27940 - DNA, 30 bp, Homo sapiens
cagcggtcggcactggagcgcaggtcggta

SEQ ID NO: 27941 - DNA, 30 bp, Homo sapiens
gaatgcttcagcgctgggaacaggtgttct

SEQ ID NO: 27942 - DNA, 30 bp, Homo sapiens
ctgaaaccaccggaaggcggctcccgtcgg

SEQ ID NO: 27943 - DNA, 30 bp, Homo sapiens
cactgggagccggggctatctccctccgtc

SEQ ID NO: 27944 - DNA, 30 bp, Homo sapiens
accaggatttgtagggctgcctgccggtga

SEQ ID NO: 27945 - DNA, 30 bp, Homo sapiens
agcaggggctgtctgtcggtcaggatcccc

SEQ ID NO: 27946 - DNA, 30 bp, Homo sapiens
tcttcctcggcaagtaggatctggaaatct

SEQ ID NO: 27947 - DNA, 30 bp, Homo sapiens
ggttggatcctcttgcggtataggtaggca

SEQ ID NO: 27948 - DNA, 30 bp, Homo sapiens
ccatgtataggcgatacatcaaggcgacgg

SEQ ID NO: 27949 - DNA, 30 bp, Homo sapiens
gcttgtttaactttggtctgtcatctggat

SEQ ID NO: 27950 - DNA, 30 bp, Homo sapiens
caggaggatttgctttccgatgtgtagtag

SEQ ID NO: 27951 - DNA, 30 bp, Homo sapiens
atatttccacgtgtagctccagtgtgtgct

SEQ ID NO: 27952 - DNA, 30 bp, Homo sapiens
actccgtgagatcatcattgaagtacagaa

SEQ ID NO: 27953 - DNA, 30 bp, Homo sapiens
gagtggaaaggagcatgtgatggctagcgg

SEQ ID NO: 27954 - DNA, 30 bp, Homo sapiens
agtaggtgaatcgcatcttttgtgagtagc

SEQ ID NO: 27955 - DNA, 30 bp, Homo sapiens
agtaggtgaaaatcatgtcctgggtataac

SEQ ID NO: 27956 - DNA, 30 bp, Homo sapiens
tgtcggcagtaacgaagcctgagctgtact

SEQ ID NO: 27957 - DNA, 30 bp, Homo sapiens
gaagacgaagcagcgctccgtggggtggcc

SEQ ID NO: 27958 - DNA, 30 bp, Homo sapiens
tctgtaaatggcactggtccacaaatgcag

SEQ ID NO: 27959 - DNA, 30 bp, Homo sapiens
aagaggaaataggagtcctcagtgaggcct

SEQ ID NO: 27960 - DNA, 30 bp, Homo sapiens
gctagcaaatagcaaagcagggctgtgaag

SEQ ID NO: 27961 - DNA, 30 bp, Homo sapiens
cgtcggtcaccgggatggggttgacctggg

SEQ ID NO: 27962 - DNA, 30 bp, Homo sapiens
ccgagggccagactcagagttggagatgct

SEQ ID NO: 27963 - DNA, 30 bp, Homo sapiens
gacgtttccattgcggtctggtgactatcc

SEQ ID NO: 27964 - DNA, 30 bp, Homo sapiens
ctcatccagagctaagtttcttttccttgc

SEQ ID NO: 27965 - DNA, 30 bp, Homo sapiens
acttgggcggccgatatgccagcttccgac

SEQ ID NO: 27966 - DNA, 30 bp, Homo sapiens
tcttaatgccgacaaagatcatttttgttc

SEQ ID NO: 27967 - DNA, 30 bp, Homo sapiens
gctgctggcgagggactggtggatgggcgg

SEQ ID NO: 27968 - DNA, 30 bp, Homo sapiens
aagtggtggccaaggactggtggatgggtg

SEQ ID NO: 27969 - DNA, 30 bp, Homo sapiens
gccccgaagagggcagtgtggccggtgggg

SEQ ID NO: 27970 - DNA, 30 bp, Homo sapiens
cactggaggcgctgtgtatgcagggcccgg

SEQ ID NO: 27971 - DNA, 30 bp, Homo sapiens
tacttctgtatctggaacaggaagagccgc

SEQ ID NO: 27972 - DNA, 30 bp, Homo sapiens
ccacggtgcttcaggagtaactgttatttg

SEQ ID NO: 27973 - DNA, 30 bp, Homo sapiens
tgcccttcttctttgcatccttcttttcat

SEQ ID NO: 27974 - DNA, 30 bp, Homo sapiens
ctctggtacatgcacatatatgcatcacaa

SEQ ID NO: 27975 - DNA, 30 bp, Homo sapiens
tgctgggttgcttcctggttaaagggccag

SEQ ID NO: 27976 - DNA, 30 bp, Homo sapiens
tgatggctctgaaggtgaggagggggaaca

SEQ ID NO: 27977 - DNA, 30 bp, Homo sapiens
gtgaggaggggggacgtgccaggcctcaat

SEQ ID NO: 27978 - DNA, 30 bp, Homo sapiens
ggtgctaccctcagcctgggcttccctcca

SEQ ID NO: 27979 - DNA, 30 bp, Homo sapiens
acctgtctgagtttcttggggtaaagatca

SEQ ID NO: 27980 - DNA, 30 bp, Homo sapiens
agcgcagctgcatttggaagtgctcacagc

SEQ ID NO: 27981 - DNA, 30 bp, Homo sapiens
tgatggagaagcgcagccgcgcctggacat

SEQ ID NO: 27982 - DNA, 30 bp, Homo sapiens
tattggcaagtttccttggcttgtaaattt

SEQ ID NO: 27983 - DNA, 30 bp, Homo sapiens
ttcttcccttgatgatgttaccagttcata

SEQ ID NO: 27984 - DNA, 30 bp, Homo sapiens
cactggctctggcccgggctgtgggccccc

SEQ ID NO: 27985 - DNA, 30 bp, Homo sapiens
cgatggggagttcccggctgggcaccaggg

SEQ ID NO: 27986 - DNA, 30 bp, Homo sapiens
ccatggaaatgggtgaatcttgcagggaga

SEQ ID NO: 27987 - DNA, 30 bp, Homo sapiens
ctgtggcgctcagcatggcctccgtctccg

SEQ ID NO: 27988 - DNA, 30 bp, Homo sapiens
ccccgcaaccgaaggcgtgagggggtggaa

SEQ ID NO: 27989 - DNA, 30 bp, Homo sapiens
tgcaggaactgcaggcccactttcttattg

SEQ ID NO: 27990 - DNA, 30 bp, Homo sapiens
actgtaggttgatgctcctttcaggtacca

SEQ ID NO: 27991 - DNA, 30 bp, Homo sapiens
acgtggatgggcccccctggcgtcaggagc

SEQ ID NO: 27992 - DNA, 30 bp, Homo sapiens
cagcggggcaggaagctcatggtgtagttt

SEQ ID NO: 27993 - DNA, 30 bp, Homo sapiens; identical to SEQ ID NO: 27992

SEQ ID NO: 27994 - DNA, 30 bp, Homo sapiens
cagcggggcaggaagcggatctggtatgtt

SEQ ID NO: 27995 - DNA, 30 bp, Homo sapiens
gacaggaatgaagcagagctggtacaaggg

SEQ ID NO: 27996 - DNA, 30 bp, Homo sapiens
gacaggaatgaagcacagctgatagaaggg

SEQ ID NO: 27997 - DNA, 30 bp, Homo sapiens
gacagggatgaagcagatctggtatgaggg

SEQ ID NO: 27998 - DNA, 30 bp, Homo sapiens
gacaggaatgaagcacagctggtagaaggg

SEQ ID NO: 27999 - DNA, 30 bp, Homo sapiens
tagcggggcacagcacaaagctcatagggg

SEQ ID NO: 28000 - DNA, 30 bp, Homo sapiens
gagcggggaatgacacagagtttgtaacgt

SEQ ID NO: 28001 - DNA, 30 bp, Homo sapiens
gcgcgggcgcaggcacagctggaaaggccg

SEQ ID NO: 28002 - DNA, 30 bp, Homo sapiens
gaacagcgcagaggcggtgactgactgggg

SEQ ID NO: 28003 - DNA, 30 bp, Homo sapiens
atgaggtagggttggggctgcaatgtcatg

SEQ ID NO: 28004 - DNA, 30 bp, Homo sapiens
atctggtctgcgtggtggagtgaaggtcag

SEQ ID NO: 28005 - DNA, 30 bp, Homo sapiens
cttccagtcaggaggggcttcttagaatcc

SEQ ID NO: 28006 - DNA, 30 bp, Homo sapiens
gcctgggcaccgcacacagggcctgggccc

SEQ ID NO: 28007 - DNA, 30 bp, Homo sapiens
ttccggctgggggacacccaccaaatggag

SEQ ID NO: 28008 - DNA, 30 bp, Homo sapiens
ttacggtgccatcccttgactcaaccttta

SEQ ID NO: 28009 - DNA, 30 bp, Homo sapiens
ctcaggctctgtccagtactttgggtcatg

SEQ ID NO: 28010 - DNA, 30 bp, Homo sapiens
gtaatcccatctcttaagtgcacttttaga

SEQ ID NO: 28011 - DNA, 30 bp, Homo sapiens
agagaaaaagacaaactccatgttgtgact

SEQ ID NO: 28012 - DNA, 30 bp, Homo sapiens
agggttccatctcttgaatccacctttaga

SEQ ID NO: 28013 - DNA, 30 bp, Homo sapiens
ttacggtctcatcccttgactcagccttta

SEQ ID NO: 28014 - DNA, 30 bp, Homo sapiens
cagcgggatctgatggtaggacaaagtagt

SEQ ID NO: 28015 - DNA, 30 bp, Homo sapiens
cagcaggggggtggtgggggtgcgggctgc

SEQ ID NO: 28016 - DNA, 30 bp, Homo sapiens
aagctggtccttgtcttcacaagggttagg

SEQ ID NO: 28017 - DNA, 30 bp, Homo sapiens
tcctcctgagaagggcaggaaagcgtggct

SEQ ID NO: 28018 - DNA, 30 bp, Homo sapiens
cccagggcccagtggcttcaggtggaggtg

SEQ ID NO: 28019 - DNA, 30 bp, Homo sapiens
cccaggggctccacccgcagccaaagtcca

SEQ ID NO: 28020 - DNA, 30 bp, Homo sapiens
ttcaggggctccacccgcagccaaagcccg

SEQ ID NO: 28021 - DNA, 30 bp, Homo sapiens
ctcaggggctccacccgcagccaaagtccg

SEQ ID NO: 28022 - DNA, 30 bp, Homo sapiens
ccgcggaggcagcggctccaccttgagcca

SEQ ID NO: 28023 - DNA, 30 bp, Homo sapiens
cccaggggttctactcgcagccaaagtccg

SEQ ID NO: 28024 - DNA, 30 bp, Homo sapiens
caacttgatccagatgccattacttggacg

SEQ ID NO: 28025 - DNA, 30 bp, Homo sapiens
ttcaggtgcaaatacatcccattcttgggc

SEQ ID NO: 28026 - DNA, 30 bp, Homo sapiens
tcttggacttgaggacaacttgacgaacag

SEQ ID NO: 28027 - DNA, 30 bp, Homo sapiens
aactgggttttcaggggtgtgaatcatagt

SEQ ID NO: 28028 - DNA, 30 bp, Homo sapiens
cctgcccgggactggtccaaaggtggacat

SEQ ID NO: 28029 - DNA, 30 bp, Homo sapiens
ttctcttctccacttttctctactgtaggc

SEQ ID NO: 28030 - DNA, 30 bp, Homo sapiens
aacaagcggctgtagtttagtcctatgggc

SEQ ID NO: 28031 - DNA, 30 bp, Homo sapiens
tgtaggatgcaggcggtagcggaagcgcac

SEQ ID NO: 28032 - DNA, 30 bp, Homo sapiens
agaagggaaacgctgcttcattggcatgcg

SEQ ID NO: 28033 - DNA, 30 bp, Homo sapiens
cagcggcagtactcccgctcgatgctcgcc

SEQ ID NO: 28034 - DNA, 30 bp, Homo sapiens
tctggcaaagaggccttctttctgggtaca

SEQ ID NO: 28035 - DNA, 30 bp, Homo sapiens
tcaaccacacactaacagggaaaacacact

SEQ ID NO: 28036 - DNA, 30 bp, Homo sapiens
ctgtggcagcggcagaagggggggcagtgg

SEQ ID NO: 28037 - DNA, 30 bp, Homo sapiens
gacagcagcaacagagagccgtccagcagg

SEQ ID NO: 28038 - DNA, 30 bp, Homo sapiens
tcgtggaggagaccttctttttccgtgctg

SEQ ID NO: 28039 - DNA, 30 bp, Homo sapiens
tcttcttgactgaaatccgcttctttctcg

SEQ ID NO: 28040 - DNA, 30 bp, Homo sapiens
tttcctcgttgccaacatgtcatagaaggg

SEQ ID NO: 28041 - DNA, 30 bp, Homo sapiens
tgctggcaatcttcttcttccgagtagaga

SEQ ID NO: 28042 - DNA, 30 bp, Homo sapiens
aaagcgactttcttcctcttccacagcacg

SEQ ID NO: 28043 - DNA, 30 bp, Homo sapiens
gcgctgacgatctggcaggaccgtagtcac

SEQ ID NO: 28044 - DNA, 30 bp, Homo sapiens
gtttccaggataaggagggggtggagaacg

SEQ ID NO: 28045 - DNA, 30 bp, Homo sapiens
ggcctggctgggcagcgtcttgtaggggtt

SEQ ID NO: 28046 - DNA, 30 bp, Homo sapiens
atctggttggtaatacgtttgcgattccgt

SEQ ID NO: 28047 - DNA, 30 bp, Homo sapiens
caataatttagccggtttattgcccgctcc

SEQ ID NO: 28048 - DNA, 30 bp, Homo sapiens
agccctctcgactcatcctccggctgcagt

SEQ ID NO: 28049 - DNA, 30 bp, Homo sapiens
taccggcctgtggacttatattatcaccac

SEQ ID NO: 28050 - DNA, 30 bp, Homo sapiens
aaatggatccctatacatctcagaagatac

SEQ ID NO: 28051 - DNA, 30 bp, Homo sapiens
atgaggcgggcattggcggcatccaacgag

SEQ ID NO: 28052 - DNA, 30 bp, Homo sapiens
tggtggggttggtgggggagatgccgttac

SEQ ID NO: 28053 - DNA, 30 bp, Homo sapiens
agcatctgttctgccgccactgcggtcagc

SEQ ID NO: 28054 - DNA, 30 bp, Homo sapiens
aggctgaatacaactgttgtgccatttcta

SEQ ID NO: 28055 - DNA, 30 bp, Homo sapiens
atgaggagtcccattgttttctatttcaat

SEQ ID NO: 28056 - DNA, 30 bp, Homo sapiens
tcatcagtttcaaagagccagaccgaaagc

SEQ ID NO: 28057 - DNA, 30 bp, Homo sapiens
cagaggccacactttcctctcaaaccagaa

SEQ ID NO: 28058 - DNA, 30 bp, Homo sapiens
accatggtcatgaccttcagggccgtcggc

SEQ ID NO: 28059 - DNA, 30 bp, Homo sapiens
gagaacccgaacggaaacgcagtatctttt

SEQ ID NO: 28060 - DNA, 30 bp, Homo sapiens
tgcaggatggtgctggcaaagagaaaatca

SEQ ID NO: 28061 - DNA, 30 bp, Homo sapiens
aggtgggacatagggaggaggtgaccggta

SEQ ID NO: 28062 - DNA, 30 bp, Homo sapiens
catcttgcttggcggggctggctccgtggc

SEQ ID NO: 28063 - DNA, 30 bp, Homo sapiens
caggccacgtccacactggagaccccttgt

SEQ ID NO: 28064 - DNA, 30 bp, Homo sapiens
atgtggctcagtggagggagacccagcata

SEQ ID NO: 28065 - DNA, 30 bp, Homo sapiens
gcacagctctcagaagctgcaggcggacga

SEQ ID NO: 28066 - DNA, 30 bp, Homo sapiens
ttttgggctgcagtgacacccctcgatcag

SEQ ID NO: 28067 - DNA, 30 bp, Homo sapiens
cagaggtgggatggtggcattctggacaat

SEQ ID NO: 28068 - DNA, 30 bp, Homo sapiens
ctttggtagaagttatttccttgtggttgc

SEQ ID NO: 28069 - DNA, 30 bp, Homo sapiens
acaaggacgtcaggtgactgctgaaataga

SEQ ID NO: 28070 - DNA, 30 bp, Homo sapiens
tagaggtaggcacagtgccgctccagcagc

SEQ ID NO: 28071 - DNA, 30 bp, Homo sapiens
caccgggatacaacagagctaatggaattg

SEQ ID NO: 28072 - DNA, 30 bp, Homo sapiens
aggaggtgctgctcctcctccgtgggtgga

SEQ ID NO: 28073 - DNA, 30 bp, Homo sapiens
gcagcccgcactccacgccctgcagcttct

SEQ ID NO: 28074 - DNA, 30 bp, Homo sapiens
tcgaggctgctgaataatgtagatcctttt

SEQ ID NO: 28075 - DNA, 30 bp, Homo sapiens
taatatcttgatccactcatcagcttctac

SEQ ID NO: 28076 - DNA, 30 bp, Homo sapiens
gatcggatcgtgccttccccttggttgagc

SEQ ID NO: 28077 - DNA, 30 bp, Homo sapiens
gtttgggatcacgagggaacatggaggtct

SEQ ID NO: 28078 - DNA, 30 bp, Homo sapiens
ctttggagtctgttggcttggagactcgga

SEQ ID NO: 28079 - DNA, 30 bp, Homo sapiens
cctacaggtattatccttgctgcctgtaat

SEQ ID NO: 28080 - DNA, 30 bp, Homo sapiens
ttctggatcgcattgtgtggccacacttgt

SEQ ID NO: 28081 - DNA, 30 bp, Homo sapiens
tttgtatgcttcggtccacagatttctcct

SEQ ID NO: 28082 - DNA, 30 bp, Homo sapiens
cactgctcagcctgaccataagactgtaaa

SEQ ID NO: 28083 - DNA, 30 bp, Homo sapiens
cgtcggtaggggtggaacccttgcacgttg

SEQ ID NO: 28084 - DNA, 30 bp, Homo sapiens
cctttccaagttgttatcaccgttgtcttc

SEQ ID NO: 28085 - DNA, 30 bp, Homo sapiens
cagatggtgtagccaccatctgaaccaccc

SEQ ID NO: 28086 - DNA, 30 bp, Homo sapiens
gggaggtactgctaccattacatggttcct

SEQ ID NO: 28087 - DNA, 30 bp, Homo sapiens
ttcttctaaagtgatgcactcttttatcct

SEQ ID NO: 28088 - DNA, 30 bp, Homo sapiens
ttttctgtgtagcttgtgaaacccaaaaat

SEQ ID NO: 28089 - DNA, 30 bp, Homo sapiens
agacggcaaggcctgtgacatgtgtgactt

SEQ ID NO: 28090 - DNA, 30 bp, Homo sapiens
acctgagtctacagccaggaagccgcaatg

SEQ ID NO: 28091 - DNA, 30 bp, Homo sapiens
cagcctttgcccccaccaatgctgacaacg

SEQ ID NO: 28092 - DNA, 30 bp, Homo sapiens
ccttggaagtccctttcagctcattccagg

SEQ ID NO: 28093 - DNA, 30 bp, Homo sapiens
gttgcttgtttgtagtggccatagatgaac

SEQ ID NO: 28094 - DNA, 30 bp, Homo sapiens
atcaccaccctcgaagccctcctcctcttc

SEQ ID NO: 28095 - DNA, 30 bp, Homo sapiens
aagtgggagcaggtacacagaaggagctca

SEQ ID NO: 28096 - DNA, 30 bp, Homo sapiens
tcctggggcctctccacagtgagaaacgtg

SEQ ID NO: 28097 - DNA, 30 bp, Homo sapiens
tgcaggctccaggctctgcccctccatcac

SEQ ID NO: 28098 - DNA, 30 bp, Homo sapiens
atccggctctggctgactggcactgaagtc

SEQ ID NO: 28099 - DNA, 30 bp, Homo sapiens
tcaatgagctccacgtagttggcagggaac

SEQ ID NO: 28100 - DNA, 30 bp, Homo sapiens
cacagggccccgtgctgggcctggtatcgg

SEQ ID NO: 28101 - DNA, 30 bp, Homo sapiens
cagcgtaaatggcttgattcctcctcttaa

SEQ ID NO: 28102 - DNA, 30 bp, Homo sapiens
agctgggttttctaaataggatttccacaa

SEQ ID NO: 28103 - DNA, 30 bp, Homo sapiens
acacggtgatttcctcctgttcctcgccct

SEQ ID NO: 28104 - DNA, 30 bp, Homo sapiens
agacagccccagtaagtacacccttgcttc

SEQ ID NO: 28105 - DNA, 30 bp, Homo sapiens
tcattcagagataagatgatgtcatcttcc

SEQ ID NO: 28106 - DNA, 30 bp, Homo sapiens
cactaaggcaccctgaggcaatctgacaat

SEQ ID NO: 28107 - DNA, 30 bp, Homo sapiens
tactggggtgaggaaaagggtgtagaggat

SEQ ID NO: 28108 - DNA, 30 bp, Homo sapiens
cccagcatagtttccatggagccctgaagg

SEQ ID NO: 28109 - DNA, 30 bp, Homo sapiens
ctccagaggcctgcatagttcccatggagg

SEQ ID NO: 28110 - DNA, 30 bp, Homo sapiens
ctccagaggcctgcgtagttcccatggagg

SEQ ID NO: 28111 - DNA, 30 bp, Homo sapiens
cgtgtttcttcttctctgacacaagtggca

SEQ ID NO: 28112 - DNA, 30 bp, Homo sapiens
cagcacgatccacgtatatcgctcgctgtc

SEQ ID NO: 28113 - DNA, 30 bp, Homo sapiens
gttaggagtttgttaactgccttttggaag

SEQ ID NO: 28114 - DNA, 30 bp, Homo sapiens
tgtcacatatcatctggtaaacatagcagc

SEQ ID NO: 28115 - DNA, 30 bp, Homo sapiens
atgaggctggaaatggaggcagcacttgcc

SEQ ID NO: 28116 - DNA, 30 bp, Homo sapiens
tgtaggagtaacagtaaaggtcctgcccga

SEQ ID NO: 28117 - DNA, 30 bp, Homo sapiens
tgaaggggaaacaataaaggtcctgccgga

SEQ ID NO: 28118 - DNA, 30 bp, Homo sapiens
cgtaggagaaacaataaaggtcctcccgga

SEQ ID NO: 28119 - DNA, 30 bp, Homo sapiens
ttgaggccactgtggccatgaacagccctg

SEQ ID NO: 28120 - DNA, 30 bp, Homo sapiens
ttaagtcaacatcagcatctccattcctgg

SEQ ID NO: 28121 - DNA, 30 bp, Homo sapiens
cctcattttcattctcttgaccagagcctt

SEQ ID NO: 28122 - DNA, 30 bp, Homo sapiens
tccaggcagttgttgtagcagatggcgatc

SEQ ID NO: 28123 - DNA, 30 bp, Homo sapiens
agatggcatgcactgcacccggtcagggcc

SEQ ID NO: 28124 - DNA, 30 bp, Homo sapiens
ggatggtatgcactgcactcgatcttggcc

SEQ ID NO: 28125 - DNA, 30 bp, Homo sapiens
ggatggcatgcactgcactcggtcttggac

SEQ ID NO: 28126 - DNA, 30 bp, Homo sapiens
taggcgtaaggcagaaggtagtgggtgagc

SEQ ID NO: 28127 - DNA, 30 bp, Homo sapiens
ctcaggcacgtgggctgccctgcggtggga

SEQ ID NO: 28128 - DNA, 30 bp, Homo sapiens
atatcacttgtgatgagatctaacttttgt

SEQ ID NO: 28129 - DNA, 30 bp, Homo sapiens
caaaggatttctttaaaaacatcacattcc

SEQ ID NO: 28130 - DNA, 30 bp, Homo sapiens
tgatggcattaagctgcttcatgagtcctt

SEQ ID NO: 28131 - DNA, 30 bp, Homo sapiens
tcaaggacgtctttaacgtcatggacggct

SEQ ID NO: 28132 - DNA, 30 bp, Homo sapiens
ggacggctcacagaagtcagagggatggag

SEQ ID NO: 28133 - DNA, 30 bp, Homo sapiens
acagcagcttcgtggatggtgacaccacaa

SEQ ID NO: 28134 - DNA, 30 bp, Homo sapiens
gtaatctcatgcccatcctgccccatgcca

SEQ ID NO: 28135 - DNA, 30 bp, Homo sapiens
cagcatagtccttgttttgttggttgtttt

SEQ ID NO: 28136 - DNA, 30 bp, Homo sapiens
agatggcagagctggggctgaggctgagat

SEQ ID NO: 28137 - DNA, 30 bp, Homo sapiens
tacaggtttccactcccgggccatctttct

SEQ ID NO: 28138 - DNA, 30 bp, Homo sapiens
catcaggtggctccaggccagactctgcgc

SEQ ID NO: 28139 - DNA, 30 bp, Homo sapiens
gtcaggattttgtttgtttgtttgtttgtt

SEQ ID NO: 28140 - DNA, 30 bp, Homo sapiens
atgtgtgttcctaataattctccttctctc

SEQ ID NO: 28141 - DNA, 30 bp, Homo sapiens
ttaagataggcacctcttgaagataatcga

SEQ ID NO: 28142 - DNA, 30 bp, Homo sapiens
gcaaggttaatgcaaatatgcataaatgag

SEQ ID NO: 28143 - DNA, 30 bp, Homo sapiens
atcctggttgcgtcttcgtcggaaaacctg

SEQ ID NO: 28144 - DNA, 30 bp, Homo sapiens
gttaggggagcgaacagtctcggaggagct

SEQ ID NO: 28145 - DNA, 30 bp, Homo sapiens
tctcggtggcggcgccaggttcctgcccgc

SEQ ID NO: 28146 - DNA, 30 bp, Homo sapiens
ccacaaccctcttgtgctggctccggaagt

SEQ ID NO: 28147 - DNA, 30 bp, Homo sapiens
tccaatttccactctctaaaatatttctcc

SEQ ID NO: 28148 - DNA, 30 bp, Homo sapiens
agcagggtttatggtatttttccacttgct

SEQ ID NO: 28149 - DNA, 30 bp, Homo sapiens
taaaggatacagggagtcatgatggcacca

SEQ ID NO: 28150 - DNA, 30 bp, Homo sapiens
gccagcttctcatataaatattgtaaatgc

SEQ ID NO: 28151 - DNA, 30 bp, Homo sapiens
cccaggcttattaaattgtctgcattgata

SEQ ID NO: 28152 - DNA, 30 bp, Homo sapiens
tgaatggcagagcgcacgtagacacatctg

SEQ ID NO: 28153 - DNA, 30 bp, Homo sapiens
cataggttgtggttgtctttgttcttggtc

SEQ ID NO: 28154 - DNA, 30 bp, Homo sapiens
gataggcttcatagattatatttaagaagt

SEQ ID NO: 28155 - DNA, 30 bp, Homo sapiens
atagccactgataccaaatgcaaacacaat

SEQ ID NO: 28156 - DNA, 30 bp, Homo sapiens
caaaggtccaagattttcattatagcatta

SEQ ID NO: 28157 - DNA, 30 bp, Homo sapiens
gcaagagcttgagcagggggtcgtcagccc

SEQ ID NO: 28158 - DNA, 30 bp, Homo sapiens
caccccgcgtaggcagtgtcgtcgttgctg

SEQ ID NO: 28159 - DNA, 30 bp, Homo sapiens
tggggggtgggtgggaaggatcaggaagag

SEQ ID NO: 28160 - DNA, 30 bp, Homo sapiens
ccatttgcttcttcctaatcattttcagga

SEQ ID NO: 28161 - DNA, 30 bp, Homo sapiens
gactggaagccagaaatgaatttcctcctt

SEQ ID NO: 28162 - DNA, 30 bp, Homo sapiens
gcttcttctgtgtatctcttgctgcttaaa

SEQ ID NO: 28163 - DNA, 30 bp, Homo sapiens
actcggtctgctgttaattgaatcaaagtc

SEQ ID NO: 28164 - DNA, 30 bp, Homo sapiens
atgaggcgactgtgaagctggtgcagctgc

SEQ ID NO: 28165 - DNA, 30 bp, Homo sapiens
ttcttcatccgttcatcaatgctggcaaag

SEQ ID NO: 28166 - DNA, 30 bp, Homo sapiens
tgctggcttcacttgcgtggcggcctctag

SEQ ID NO: 28167 - DNA, 30 bp, Homo sapiens
tgatttccacacactggtcctgtagggcca

SEQ ID NO: 28168 - DNA, 30 bp, Homo sapiens
aaggaagaagtgggcccaagctaagttcca

SEQ ID NO: 28169 - DNA, 30 bp, Homo sapiens
aagacagtgaatggtggaaccacagtttct

SEQ ID NO: 28170 - DNA, 30 bp, Homo sapiens
gtcaggggcaaaaacttctggtagtagctc

SEQ ID NO: 28171 - DNA, 30 bp, Homo sapiens
caccaggccccaccactctctattgttcac

SEQ ID NO: 28172 - DNA, 30 bp, Homo sapiens
tggtggtaatttggcaagattttcatcaag

SEQ ID NO: 28173 - DNA, 30 bp, Homo sapiens
ttgaggtctggcctgtggagtcacagggaa

SEQ ID NO: 28174 - DNA, 30 bp, Homo sapiens
aatttgagggcgtgcaaattccacaaagtc

SEQ ID NO: 28175 - DNA, 30 bp, Homo sapiens
aaaaggctgcgttttccacctgtgactact

SEQ ID NO: 28176 - DNA, 30 bp, Homo sapiens
agtctgctcctcgggacacaagccctcagg

SEQ ID NO: 28177 - DNA, 30 bp, Homo sapiens
acatctgtttgtctttataccactccacaa

SEQ ID NO: 28178 - DNA, 30 bp, Homo sapiens
tgacggactttttgccactcaacaaattca

SEQ ID NO: 28179 - DNA, 30 bp, Homo sapiens
acatggaatcaccaagcgagtccgagtcat

SEQ ID NO: 28180 - DNA, 30 bp, Homo sapiens
agcaggcccagaagcccccttccaccggca

SEQ ID NO: 28181 - DNA, 30 bp, Homo sapiens
ggttgggaaccccctccccccatcctggta

SEQ ID NO: 28182 - DNA, 30 bp, Homo sapiens
caccttttccagttcagacatgctcacggg

SEQ ID NO: 28183 - DNA, 30 bp, Homo sapiens
gctgtgggggcgtgtgctgagcaccaagca

SEQ ID NO: 28184 - DNA, 30 bp, Homo sapiens
taatggatccgagttagctcctccacaacc

SEQ ID NO: 28185 - DNA, 30 bp, Homo sapiens
tcctggcttcctcctggctccagatgagaa

SEQ ID NO: 28186 - DNA, 30 bp, Homo sapiens
ccctctctgctcgcagcacgtcggccgcca

SEQ ID NO: 28187 - DNA, 30 bp, Homo sapiens
caccaccgcactgactaagcaggttttctt

SEQ ID NO: 28188 - DNA, 30 bp, Homo sapiens
gattggatctaaattgggttttgcatcatc

SEQ ID NO: 28189 - DNA, 30 bp, Homo sapiens
tgaatgtcaacagagatgttctcaactcct

SEQ ID NO: 28190 - DNA, 30 bp, Homo sapiens
tcaaggaagataccctgggtttggtagatc

SEQ ID NO: 28191 - DNA, 30 bp, Homo sapiens
tccatgactgaatgtgtaatttccttgtcc

SEQ ID NO: 28192 - DNA, 30 bp, Homo sapiens
ctgatttttgaagggcttctgctaattctt

SEQ ID NO: 28193 - DNA, 30 bp, Homo sapiens
acttcgagtttcacacactgaaggtgggcc

SEQ ID NO: 28194 - DNA, 30 bp, Homo sapiens
gcttggtgcagattcaccattcggtcaatc

SEQ ID NO: 28195 - DNA, 30 bp, Homo sapiens
tgagcagctgttccgagctgtacagcttct

SEQ ID NO: 28196 - DNA, 30 bp, Homo sapiens
taggacccttcaatcactgttgttccaatc

SEQ ID NO: 28197 - DNA, 30 bp, Homo sapiens
actgcctcttcctatttccctgttgggtcc

SEQ ID NO: 28198 - DNA, 30 bp, Homo sapiens
acttgggaatgggggtcctgagggcatgga

SEQ ID NO: 28199 - DNA, 30 bp, Homo sapiens
agtcggacttctccttctccttcatgtgca

SEQ ID NO: 28200 - DNA, 30 bp, Homo sapiens
tgagtgcatcctctgccaggaaccgatgca

SEQ ID NO: 28201 - DNA, 30 bp, Homo sapiens
cacaggtgcaccagagccattggggacaca

SEQ ID NO: 28202 - DNA, 30 bp, Homo sapiens
tgaaggagcagaaggtggatttcttggaat

SEQ ID NO: 28203 - DNA, 30 bp, Homo sapiens
ggctggggcttgggcaggggactcccggcc

SEQ ID NO: 28204 - DNA, 30 bp, Homo sapiens
ctatcttgccaatctgccaggactccaagg

SEQ ID NO: 28205 - DNA, 30 bp, Homo sapiens
attatctctcctgggcatctggggccacca

SEQ ID NO: 28206 - DNA, 30 bp, Homo sapiens
agctggttaggaaggtagccaagatgcagg

SEQ ID NO: 28207 - DNA, 30 bp, Homo sapiens
cttcatcctctgctaaagacaggccggtat

SEQ ID NO: 28208 - DNA, 30 bp, Homo sapiens
ttcaggattcccccattttctcctacggga

SEQ ID NO: 28209 - DNA, 30 bp, Homo sapiens
aggaagaggccgacttctcccggtgaaact

SEQ ID NO: 28210 - DNA, 30 bp, Homo sapiens
tgaaggaggaggagggggaggaggaggagg

SEQ ID NO: 28211 - DNA, 30 bp, Homo sapiens
gtcagatgatttcttgctaatgtgtttaaa

SEQ ID NO: 28212 - DNA, 30 bp, Homo sapiens
agttggctattttctcaatctcgtccaaat

SEQ ID NO: 28213 - DNA, 30 bp, Homo sapiens
aacttggatgtctctgagcattccaataat

SEQ ID NO: 28214 - DNA, 30 bp, Homo sapiens
gctttactgaaactccgcttctggcctttg

SEQ ID NO: 28215 - DNA, 30 bp, Homo sapiens
agatggtctcttcccggcgcttcttggtga

SEQ ID NO: 28216 - DNA, 30 bp, Homo sapiens
ctgtggctgttccggctgtggctccttcgg

SEQ ID NO: 28217 - DNA, 30 bp, Homo sapiens
cttcagcgttgagttgcttaatactgctgt

SEQ ID NO: 28218 - DNA, 30 bp, Homo sapiens
cgtctctggtggggcaagcccaactgtttc

SEQ ID NO: 28219 - DNA, 30 bp, Homo sapiens
gcttggggcaaaggctctttcaccgaggat

SEQ ID NO: 28220 - DNA, 30 bp, Homo sapiens
gtacacctttttgggtttttctccatttta

SEQ ID NO: 28221 - DNA, 30 bp, Homo sapiens
cctctgttcttcttcgtaaaatgtggataa

SEQ ID NO: 28222 - DNA, 30 bp, Homo sapiens
ttctggaatgtgaaaattcctgaaacactg

SEQ ID NO: 28223 - DNA, 30 bp, Homo sapiens
taccggctctgctcgatgtatgtggagatg

SEQ ID NO: 28224 - DNA, 30 bp, Homo sapiens
atcaggcagctcactaatattgacctcaaa

SEQ ID NO: 28225 - DNA, 30 bp, Homo sapiens
cagtcaaccccctgggagttataatttcct

SEQ ID NO: 28226 - DNA, 30 bp, Homo sapiens
actcatcatctactggattgggagcttgtg

SEQ ID NO: 28227 - DNA, 30 bp, Homo sapiens
ccatggagctgtgggccaggtagtccttgc

SEQ ID NO: 28228 - DNA, 30 bp, Homo sapiens
taactgtcccatcgacttttcttgcgttta

SEQ ID NO: 28229 - DNA, 30 bp, Homo sapiens
ttgaggtctttccatttttctttccatttc

SEQ ID NO: 28230 - DNA, 30 bp, Homo sapiens
cagctcttcttttatgagcctggtgatttc

SEQ ID NO: 28231 - DNA, 30 bp, Homo sapiens
cgcttcttcatttttcctccagccaccttg

SEQ ID NO: 28232 - DNA, 30 bp, Homo sapiens
accaggccctgggaggggactgggcctgag

SEQ ID NO: 28233 - DNA, 30 bp, Homo sapiens
tgttggcattggataaccaatcataggtgc

SEQ ID NO: 28234 - DNA, 30 bp, Homo sapiens
ttgtggcccccacttcttgatcgatttcta

SEQ ID NO: 28235 - DNA, 30 bp, Homo sapiens
taggccgccctctgcttgcgctcttccttg

SEQ ID NO: 28236 - DNA, 30 bp, Homo sapiens
caatggtttcttaatcatctttttcttttg

SEQ ID NO: 28237 - DNA, 30 bp, Homo sapiens
gtctttgtccaggttttcttgatcgtgttt

SEQ ID NO: 28238 - DNA, 30 bp, Homo sapiens
atcctcttccgcatcttgcccttcttggag

SEQ ID NO: 28239 - DNA, 30 bp, Homo sapiens
ctgagatccctaaatccactgtcttgattg

SEQ ID NO: 28240 - DNA, 30 bp, Homo sapiens
aggagggcttggctgtgggtctgaatttct

SEQ ID NO: 28241 - DNA, 30 bp, Homo sapiens
atttggacatttctgctggatcaaatggta

SEQ ID NO: 28242 - DNA, 30 bp, Homo sapiens
ccttggatgacacgttacctcttgtaccat

SEQ ID NO: 28243 - DNA, 30 bp, Homo sapiens
acaaggcaataagagatgcgttgatattaa

SEQ ID NO: 28244 - DNA, 30 bp, Homo sapiens
gattagctcctgtaaccagatcattctgtg

SEQ ID NO: 28245 - DNA, 30 bp, Homo sapiens
tacaggctcgctgtggtattctgccacata

SEQ ID NO: 28246 - DNA, 30 bp, Homo sapiens
caaaggctaagacaacgttgtcgtcttcat

SEQ ID NO: 28247 - DNA, 30 bp, Homo sapiens
ctacattgtcacgcttattttcacatagtt

SEQ ID NO: 28248 - DNA, 30 bp, Homo sapiens
agactgagtcttgggcaaaaacaacagatt

SEQ ID NO: 28249 - DNA, 30 bp, Homo sapiens
acacggtcaccttctccatcacgctttcag

SEQ ID NO: 28250 - DNA, 30 bp, Homo sapiens
gcagccttgggcctggcaagagatacagca

SEQ ID NO: 28251 - DNA, 30 bp, Homo sapiens
gtcttcctgatgagttcttctatggtgtcc

SEQ ID NO: 28252 - DNA, 30 bp, Homo sapiens
gcttagcagagaaggatgcgaaatccggca

SEQ ID NO: 28253 - DNA, 30 bp, Homo sapiens
ctcaggagtttctgtcggcccagctcatag

SEQ ID NO: 28254 - DNA, 30 bp, Homo sapiens
aggaggcctctgtcgggcgccgcccccctt

SEQ ID NO: 28255 - DNA, 30 bp, Homo sapiens
ttctggtgctggatccagtttatcttcctg

SEQ ID NO: 28256 - DNA, 30 bp, Homo sapiens
cagcggaggcaggaactttggtctctctca

SEQ ID NO: 28257 - DNA, 30 bp, Homo sapiens
catcgggacctggctcctggaagagcgact

SEQ ID NO: 28258 - DNA, 30 bp, Homo sapiens
gtcttccctggtagatgcaggttccatagc

SEQ ID NO: 28259 - DNA, 30 bp, Homo sapiens
atgaggcagttcccaacacgaagttctgtt

SEQ ID NO: 28260 - DNA, 30 bp, Homo sapiens
tagaggcggccactgatttcacacaccccg

SEQ ID NO: 28261 - DNA, 30 bp, Homo sapiens
cagaggcagcagaatctgtggttaataccc

SEQ ID NO: 28262 - DNA, 30 bp, Homo sapiens
cacttgcagcacttggccttccctctgtaa

SEQ ID NO: 28263 - DNA, 30 bp, Homo sapiens
tttcggccacgcgtcgagcacttgccgatc

SEQ ID NO: 28264 - DNA, 30 bp, Homo sapiens
ttctcaaacagcatgcataggtgttgggac

SEQ ID NO: 28265 - DNA, 30 bp, Homo sapiens
tctgcagcagagaaagttcagcctgcaatt

SEQ ID NO: 28266 - DNA, 30 bp, Homo sapiens
acatggctggatggtccgacagcatttcag

SEQ ID NO: 28267 - DNA, 30 bp, Homo sapiens
atctttacttcaaaggtaagacattcggct

SEQ ID NO: 28268 - DNA, 30 bp, Homo sapiens
tgggtgtagtgctctcaattcttggttgat

SEQ ID NO: 28269 - DNA, 30 bp, Homo sapiens
actttttcgcatctttcaaatctatacttt

SEQ ID NO: 28270 - DNA, 30 bp, Homo sapiens
tccaggtcttatgcagtaagcaatcctaat

SEQ ID NO: 28271 - DNA, 30 bp, Homo sapiens
ttgagtccctactgagtcctttgggatcca

SEQ ID NO: 28272 - DNA, 30 bp, Homo sapiens
ccgcacagcaggggttaacattgcagtaat

SEQ ID NO: 28273 - DNA, 30 bp, Homo sapiens
tcttggtaaggaacatatgtctatttgctt

SEQ ID NO: 28274 - DNA, 30 bp, Homo sapiens
ttttggtcgtgaatgtgtgatagtttatcc

SEQ ID NO: 28275 - DNA, 30 bp, Homo sapiens
agttggagttagagtcgtaatcctccttca

SEQ ID NO: 28276 - DNA, 30 bp, Homo sapiens
ctatggtgaacatttggaagagaggtctca

SEQ ID NO: 28277 - DNA, 30 bp, Homo sapiens
tcttggccactgcttctcataagaccagtc

SEQ ID NO: 28278 - DNA, 30 bp, Homo sapiens
ttgtggacatctgaggagtggtccagccaa

SEQ ID NO: 28279 - DNA, 30 bp, Homo sapiens
tccaggcttgtatttgtgtctgttaatttt

SEQ ID NO: 28280 - DNA, 30 bp, Homo sapiens
aaatggccaccacctttcttttggctggta

SEQ ID NO: 28281 - DNA, 30 bp, Homo sapiens
gaccggtggaggtttcaatgcataggagag

SEQ ID NO: 28282 - DNA, 30 bp, Homo sapiens
agaaggtggtggcatagtctcggaagtagc

SEQ ID NO: 28283 - DNA, 30 bp, Homo sapiens
cagtgggagaaacgggggtaggagccatcg

SEQ ID NO: 28284 - DNA, 30 bp, Homo sapiens
ttcaggcttgggaaattttctattattgta

SEQ ID NO: 28285 - DNA, 30 bp, Homo sapiens
tgatggtgggtaagatgatgtaatcctgca

SEQ ID NO: 28286 - DNA, 30 bp, Homo sapiens
tactgctcttctgcttcctctagctccagt

SEQ ID NO: 28287 - DNA, 30 bp, Homo sapiens
ggaaccggagttggatagggctcaagtatc

SEQ ID NO: 28288 - DNA, 30 bp, Homo sapiens
cttttgtccgtcaatttcaatgatcttcag

SEQ ID NO: 28289 - DNA, 30 bp, Homo sapiens
ttctggttggaggaactgtggacatcaagg

SEQ ID NO: 28290 - DNA, 30 bp, Homo sapiens
tgtgtttcttctccttgattgccagtggtt

SEQ ID NO: 28291 - DNA, 30 bp, Homo sapiens
aattggtttttcaaaatcatgacactcatg

SEQ ID NO: 28292 - DNA, 30 bp, Homo sapiens
tgcaggatttcctttgacacagcactccag

SEQ ID NO: 28293 - DNA, 30 bp, Homo sapiens
agtaccttgcagtcgccaacatgaagcaaa

SEQ ID NO: 28294 - DNA, 30 bp, Homo sapiens
gatctttggcttgcgggggttgaaaacgtg

SEQ ID NO: 28295 - DNA, 30 bp, Homo sapiens
catggctttttgcagcattttgttccaggg

SEQ ID NO: 28296 - DNA, 30 bp, Homo sapiens
ccatctctcctttttggtgcctcttcattc

SEQ ID NO: 28297 - DNA, 30 bp, Homo sapiens
cacccatccaggaaactccagctcagtgga

SEQ ID NO: 28298 - DNA, 30 bp, Homo sapiens
tttgccagcctgtacacccgcttcaccctg

SEQ ID NO: 28299 - DNA, 30 bp, Homo sapiens
tagcactggccagtaatttctttattgttt

SEQ ID NO: 28300 - DNA, 30 bp, Homo sapiens
caaagtggactgtgattggccgccggtctt

SEQ ID NO: 28301 - DNA, 30 bp, Homo sapiens
aagaggtccagcctctcgtcgggaacttgg

SEQ ID NO: 28302 - DNA, 30 bp, Homo sapiens
cactcgaaggtctcccactgcttcctgagc

SEQ ID NO: 28303 - DNA, 30 bp, Homo sapiens
caaaagccacctgaagtgatctcttcttca

SEQ ID NO: 28304 - DNA, 30 bp, Homo sapiens
atgcggtttcagccggtacaaggtctaccc

SEQ ID NO: 28305 - DNA, 30 bp, Homo sapiens
tttctcccaaggaacaaaagtcgatgaatg

SEQ ID NO: 28306 - DNA, 30 bp, Homo sapiens
agcacttcttaagatcagcgactctgggcc

SEQ ID NO: 28307 - DNA, 30 bp, Homo sapiens
cccttcaggaacttattgacaccgctgtgc

SEQ ID NO: 28308 - DNA, 30 bp, Homo sapiens
tagagggtccaagagcgactgtcattcaaa

SEQ ID NO: 28309 - DNA, 30 bp, Homo sapiens
ctccgcaaaattctattcatcccactgggc

SEQ ID NO: 28310 - DNA, 30 bp, Homo sapiens
tttcttctgtttcttctgttcctcatattc

SEQ ID NO: 28311 - DNA, 30 bp, Homo sapiens
caaatggcgactttcccctcctccctgccc

SEQ ID NO: 28312 - DNA, 30 bp, Homo sapiens
cctcggccaggaaaggcagtccttgaggga

SEQ ID NO: 28313 - DNA, 30 bp, Homo sapiens
gtttttcgacattccatcacccctgtactt

SEQ ID NO: 28314 - DNA, 30 bp, Homo sapiens
ttctggaggtgctccaaaacattttcggca

SEQ ID NO: 28315 - DNA, 30 bp, Homo sapiens
cacttcctgcaccactcgacactggcactt

SEQ ID NO: 28316 - DNA, 30 bp, Homo sapiens
acaagggacgtctccagcgtgatgttgaac

SEQ ID NO: 28317 - DNA, 30 bp, Homo sapiens
cctcatacatgtgtgcagtgatggggcagt

SEQ ID NO: 28318 - DNA, 30 bp, Homo sapiens
ctttgatgagtgatccttctaggactatgg

SEQ ID NO: 28319 - DNA, 30 bp, Homo sapiens
ttgagcagtatgccttgcaagtcctctggc

SEQ ID NO: 28320 - DNA, 30 bp, Homo sapiens
gggagggcacaagacagcctgcaggtcttt

SEQ ID NO: 28321 - DNA, 30 bp, Homo sapiens
tcttcgatgctgtcatcatctacctctggc

SEQ ID NO: 28322 - DNA, 30 bp, Homo sapiens
ctttggttttcttaaaatcagcattggttg

SEQ ID NO: 28323 - DNA, 30 bp, Homo sapiens
ttagcagctgtggtttcggtttgggttttt

SEQ ID NO: 28324 - DNA, 30 bp, Homo sapiens
ctgtagatgtgtagctgttattttcagcca

SEQ ID NO: 28325 - DNA, 30 bp, Homo sapiens
gcttggaataagttctctgtctaggcaagt

SEQ ID NO: 28326 - DNA, 30 bp, Homo sapiens
tctaggcaagtgttagtgataacaagatct

SEQ ID NO: 28327 - DNA, 30 bp, Homo sapiens
cacggggcactggcatgcatcttctccagg

SEQ ID NO: 28328 - DNA, 30 bp, Homo sapiens
cctaggtgctctcgagtgctggtgtatccc

SEQ ID NO: 28329 - DNA, 30 bp, Homo sapiens
tgttggaatagtcacgttgatcaattctct

SEQ ID NO: 28330 - DNA, 30 bp, Homo sapiens
tgacttccatgacaatcgtccgtgggcccg

SEQ ID NO: 28331 - DNA, 30 bp, Homo sapiens
cattggaagatcatgataagctgcatatct

SEQ ID NO: 28332 - DNA, 30 bp, Homo sapiens
cactggtctccaagtcgaaagccctggccc

SEQ ID NO: 28333 - DNA, 30 bp, Homo sapiens
agccgctggccctcaccccaggcgaagcct

SEQ ID NO: 28334 - DNA, 30 bp, Homo sapiens
cataaagtgcttctggagttaaaatctgcc

SEQ ID NO: 28335 - DNA, 30 bp, Homo sapiens
ggaaggtgccgcgagctctcctgccgtccc

SEQ ID NO: 28336 - DNA, 30 bp, Homo sapiens
ctgcgggggtggcagatggggtcctggctg

SEQ ID NO: 28337 - DNA, 30 bp, Homo sapiens
cacaggaagccaggggtctgcaggagcctc

SEQ ID NO: 28338 - DNA, 30 bp, Homo sapiens
gtgtggcctcactgacgacctccccatccc

SEQ ID NO: 28339 - DNA, 30 bp, Homo sapiens
agctctggccgttgggtctgcccacggagc

SEQ ID NO: 28340 - DNA, 30 bp, Homo sapiens
gcccgggtctggagcctgctgcagtgcttg

SEQ ID NO: 28341 - DNA, 30 bp, Homo sapiens
tgcagcagtgtcgcatatggaagttgacaa

SEQ ID NO: 28342 - DNA, 30 bp, Homo sapiens
agaaggaaatgctgtgcagccaaagatgct

SEQ ID NO: 28343 - DNA, 30 bp, Homo sapiens
aaacggagctgggagtcgcttttgcgtgtg

SEQ ID NO: 28344 - DNA, 30 bp, Homo sapiens
atgtgggatcctgtctggctcgcttaggat

SEQ ID NO: 28345 - DNA, 30 bp, Homo sapiens
ccctggtttccgcccacctccaaatcctga

SEQ ID NO: 28346 - DNA, 30 bp, Homo sapiens
cactggcgtttccgcacaggctgcttccgc

SEQ ID NO: 28347 - DNA, 30 bp, Homo sapiens
gcacagagtccattcagggttatacaaaga

SEQ ID NO: 28348 - DNA, 30 bp, Homo sapiens
ccgctggggcctcatagttgagcacgtagt

SEQ ID NO: 28349 - DNA, 30 bp, Homo sapiens
tccaggacctcagtctccgggaggccgaac

SEQ ID NO: 28350 - DNA, 30 bp, Homo sapiens
atgtaattgtcagctcttgggtctcaggga

SEQ ID NO: 28351 - DNA, 30 bp, Homo sapiens
acaccacagtattgagggagctgcggctgt

SEQ ID NO: 28352 - DNA, 30 bp, Homo sapiens
tggtgggacagggctgcctttctggtcaca

SEQ ID NO: 28353 - DNA, 30 bp, Homo sapiens
cacgtccacggtgcacaggggctcaccgcc

SEQ ID NO: 28354 - DNA, 30 bp, Homo sapiens
tagctcaagaagccaaagaaattggtggag

SEQ ID NO: 28355 - DNA, 30 bp, Homo sapiens
cttcggtttcttgtccttttgacgagggag

SEQ ID NO: 28356 - DNA, 30 bp, Homo sapiens
gcatggggtctgcatccatggctccccatc

SEQ ID NO: 28357 - DNA, 30 bp, Homo sapiens
cgacggcgggggcgctgcggctcagctcct

SEQ ID NO: 28358 - DNA, 30 bp, Homo sapiens
attcagtcgcctttatatcttcttgatccg

SEQ ID NO: 28359 - DNA, 30 bp, Homo sapiens
caacgagaagaagctgctcttctggggagg

SEQ ID NO: 28360 - DNA, 30 bp, Homo sapiens
actgtggagtgctccttccaagctctttaa

SEQ ID NO: 28361 - DNA, 30 bp, Homo sapiens
ccctggagaattcgcttcacatgacccact

SEQ ID NO: 28362 - DNA, 30 bp, Homo sapiens
tccaggtcctcatggccaatgaccttatag

SEQ ID NO: 28363 - DNA, 30 bp, Homo sapiens
cgatggtgttagaggatcatcaccctctgc

SEQ ID NO: 28364 - DNA, 30 bp, Homo sapiens
cctaggatcgctctcaggggcaggcgcagc

SEQ ID NO: 28365 - DNA, 30 bp, Homo sapiens
acacagccgtctcctggtcctcccgctgga

SEQ ID NO: 28366 - DNA, 30 bp, Homo sapiens
ccgtggtgacgtccaccagcttctggatca

SEQ ID NO: 28367 - DNA, 30 bp, Homo sapiens
caggcgggtttctggcttgggcgatggagt

SEQ ID NO: 28368 - DNA, 30 bp, Homo sapiens
tcatgaggtcttcttgtttggttacttcct

SEQ ID NO: 28369 - DNA, 30 bp, Homo sapiens
cagtgcctggcggccttgcagatcttgtcg

SEQ ID NO: 28370 - DNA, 30 bp, Homo sapiens
gaagattccaggcagcaggcggtaaggcac

SEQ ID NO: 28371 - DNA, 30 bp, Homo sapiens
agacgggccagccagtcagctcgcttgagt

SEQ ID NO: 28372 - DNA, 30 bp, Homo sapiens
tcttgggggaaggtgactccaatggccttc

SEQ ID NO: 28373 - DNA, 30 bp, Homo sapiens
cggtggccagggcaggtccccgttcttgcc

SEQ ID NO: 28374 - DNA, 30 bp, Homo sapiens
tcctcctggacatcagagagaacacctggg

SEQ ID NO: 28375 - DNA, 30 bp, Homo sapiens
acctgggtatcttataaacagaactgccac

SEQ ID NO: 28376 - DNA, 30 bp, Homo sapiens
tcctggacatcagagagaacacctgggtat

SEQ ID NO: 28377 - DNA, 30 bp, Homo sapiens
agctcctccgctaagcggtagaggagccga

SEQ ID NO: 28378 - DNA, 30 bp, Homo sapiens
ctccgatgatctgctccaatggcatctgtg

SEQ ID NO: 28379 - DNA, 30 bp, Homo sapiens
agtcctcgttcttctcatgcatgaaggcat

SEQ ID NO: 28380 - DNA, 30 bp, Homo sapiens
tagagggcaataatccacttgggcacacgg

SEQ ID NO: 28381 - DNA, 30 bp, Homo sapiens
ccgtgggcctcatctggatgtctccaatct

SEQ ID NO: 28382 - DNA, 30 bp, Homo sapiens
taaatgtctgagccagctgttccaggattt

SEQ ID NO: 28383 - DNA, 30 bp, Homo sapiens
tttgtagaggaggaaagagctgcagagagc

SEQ ID NO: 28384 - DNA, 30 bp, Homo sapiens
cagccagggaggaagtcaccttgaaagaag

SEQ ID NO: 28385 - DNA, 30 bp, Homo sapiens
agctggatctcaggctcaactttagcctga

SEQ ID NO: 28386 - DNA, 30 bp, Homo sapiens
aagtgggtaccaccctgaggtcccttgtcc

SEQ ID NO: 28387 - DNA, 30 bp, Homo sapiens
caggctcctgggcctgggaccacagctacg

SEQ ID NO: 28388 - DNA, 30 bp, Homo sapiens
agagccgagtggagtagcctgccaccgcaa

SEQ ID NO: 28389 - DNA, 30 bp, Homo sapiens
tttgaaagtgttcatgcaggtgtaggttcc

SEQ ID NO: 28390 - DNA, 30 bp, Homo sapiens
cacaggaaagacacgatgccagcacaatcc

SEQ ID NO: 28391 - DNA, 30 bp, Homo sapiens
cagaggcgggacggggttcctccacccacc

SEQ ID NO: 28392 - DNA, 30 bp, Homo sapiens; identical to SEQ ID NO: 28391

SEQ ID NO: 28393 - DNA, 30 bp, Homo sapiens
tttccttgtccatccagagcatcctgctga

SEQ ID NO: 28394 - DNA, 30 bp, Homo sapiens
aagctccagctccagcggaggatgctccag

SEQ ID NO: 28395 - DNA, 30 bp, Homo sapiens
cactcttaaagttctcaatccttttcttcc

SEQ ID NO: 28396 - DNA, 30 bp, Homo sapiens
tcttggatttccgctcttttctggccctgg

SEQ ID NO: 28397 - DNA, 30 bp, Homo sapiens
ctccgggacattgagcttctccttcacccc

SEQ ID NO: 28398 - DNA, 30 bp, Homo sapiens
ccttgggattagccagctctgctttctgtt

SEQ ID NO: 28399 - DNA, 30 bp, Homo sapiens
cacagggtcacatcaaggaccccagtcatc

SEQ ID NO: 28400 - DNA, 30 bp, Homo sapiens
cgaaggtcttggcgaggatatcttcatgct

SEQ ID NO: 28401 - DNA, 30 bp, Homo sapiens
ccttggattgaagtttggcaatgatgcggt

SEQ ID NO: 28402 - DNA, 30 bp, Homo sapiens
ctcttctcgtgttttgcctatttttttggg

SEQ ID NO: 28403 - DNA, 30 bp, Homo sapiens
caggggcctgaaaatagatccagccatcaa

SEQ ID NO: 28404 - DNA, 30 bp, Homo sapiens
cacagggtcctcgcagcagctctgccagta

SEQ ID NO: 28405 - DNA, 30 bp, Homo sapiens
cactggagagtgcatctctgttcagtttca

SEQ ID NO: 28406 - DNA, 30 bp, Homo sapiens
ttctggcggttctcagcttcctcctaaagt

SEQ ID NO: 28407 - DNA, 30 bp, Homo sapiens
cacacgtgctgcttccggtggcgcagcacc

SEQ ID NO: 28408 - DNA, 30 bp, Homo sapiens
cacgggtcctggaccttggcccttttggct

SEQ ID NO: 28409 - DNA, 30 bp, Homo sapiens
tcctggaatcgtggcggaaagttcctggga

SEQ ID NO: 28410 - DNA, 30 bp, Homo sapiens
cagtggacagtggtggggggccaggctttc

SEQ ID NO: 28411 - DNA, 30 bp, Homo sapiens
aagcgggctggcgtgcggcgaggggtcatg

SEQ ID NO: 28412 - DNA, 30 bp, Homo sapiens
tagcctgtttcctttcgtgtgtcactgtgg

SEQ ID NO: 28413 - DNA, 30 bp, Homo sapiens
atccgggatcctcgaggacacgtacacaga

SEQ ID NO: 28414 - DNA, 30 bp, Homo sapiens
tccagggagaggtccgacaagttctcggca

SEQ ID NO: 28415 - DNA, 30 bp, Homo sapiens
agtgatgagcagtttgttcctgatttccat

SEQ ID NO: 28416 - DNA, 30 bp, Homo sapiens
agcgccgtcggaaagctcgagatattctcc

SEQ ID NO: 28417 - DNA, 30 bp, Homo sapiens
tcttgggaaatacattctggctgtctgttg

SEQ ID NO: 28418 - DNA, 30 bp, Homo sapiens
ccagttctttgttcaaatcctcaaacttgg

SEQ ID NO: 28419 - DNA, 30 bp, Homo sapiens
cctcctcttccctgtccaaagtagccagtt

SEQ ID NO: 28420 - DNA, 30 bp, Homo sapiens
atcctcacgcaggtaggcctcctgctccga

SEQ ID NO: 28421 - DNA, 30 bp, Homo sapiens
acccggccttcctgttggcaatttaaaggt

SEQ ID NO: 28422 - DNA, 30 bp, Homo sapiens
tagcttgcacggccaaccaactccttggct

SEQ ID NO: 28423 - DNA, 30 bp, Homo sapiens
ttgtggcgagagcgtgacctttccaaaggt

SEQ ID NO: 28424 - DNA, 30 bp, Homo sapiens
atgtagctgatcttggattagcccttgttg

SEQ ID NO: 28425 - DNA, 30 bp, Homo sapiens
agcagggcttcaacttcgggaactgattca

SEQ ID NO: 28426 - DNA, 30 bp, Homo sapiens
aagtggaaagtacatacaaataaaaggtat

SEQ ID NO: 28427 - DNA, 30 bp, Homo sapiens
aacaggcctctgagacattggactgagact

SEQ ID NO: 28428 - DNA, 30 bp, Homo sapiens
acttccacagtgactctgaccttcccgtcg

SEQ ID NO: 28429 - DNA, 30 bp, Homo sapiens
tattgggaacctgaggttgattagctttga

SEQ ID NO: 28430 - DNA, 30 bp, Homo sapiens
tcctggacaggcccaggggatggctatcca

SEQ ID NO: 28431 - DNA, 30 bp, Homo sapiens
gcgaggcggtgccagcgtcggaggccctcg

SEQ ID NO: 28432 - DNA, 30 bp, Homo sapiens
ctccacccagaaagccggcgcttacctggt

SEQ ID NO: 28433 - DNA, 30 bp, Homo sapiens
atgaagaggtggacattcttgttggactgt

SEQ ID NO: 28434 - DNA, 30 bp, Homo sapiens
gcgttgaatccatgtagcaatctgatgaag

SEQ ID NO: 28435 - DNA, 30 bp, Homo sapiens
cacaggatacacagcagcactgacaatatt

SEQ ID NO: 28436 - DNA, 30 bp, Homo sapiens
ttcagcaccagtggcctattaccttgcata

SEQ ID NO: 28437 - DNA, 30 bp, Homo sapiens
ataaactcccaaatgttgcacctctgtcct

SEQ ID NO: 28438 - DNA, 30 bp, Homo sapiens
taactgtggagcttttccagaacagcacga

SEQ ID NO: 28439 - DNA, 30 bp, Homo sapiens
tgaccagtgacatgggcctggagaagtctt

SEQ ID NO: 28440 - DNA, 30 bp, Homo sapiens
ttgagaaccagcgggcggttcccttgcgcg

SEQ ID NO: 28441 - DNA, 30 bp, Homo sapiens
accttctctgactgccagtgctggtacagg

SEQ ID NO: 28442 - DNA, 30 bp, Homo sapiens
cataggccgtgccggggcgcccacctgcag

SEQ ID NO: 28443 - DNA, 30 bp, Homo sapiens
tgtaggcgacatagatggggtccagctggt

SEQ ID NO: 28444 - DNA, 30 bp, Homo sapiens
tctgtagacaaacttcatgggctccacggc

SEQ ID NO: 28445 - DNA, 30 bp, Homo sapiens
agatggggtctaactggtcagctaggaagc

SEQ ID NO: 28446 - DNA, 30 bp, Homo sapiens
tgtaggccacatagatggggtctagctggt

SEQ ID NO: 28447 - DNA, 30 bp, Homo sapiens
atgagggtgcatttgcccttgacgcggtct

SEQ ID NO: 28448 - DNA, 30 bp, Homo sapiens
catgatcacgcacttgcctttgagcttctc

SEQ ID NO: 28449 - DNA, 30 bp, Homo sapiens
cagtggtgttgggcatctgggatttcttct

SEQ ID NO: 28450 - DNA, 30 bp, Homo sapiens
gtaaggcttagttggtttaatattttccac

SEQ ID NO: 28451 - DNA, 30 bp, Homo sapiens
caagatagagtctgtcataggattccctga

SEQ ID NO: 28452 - DNA, 30 bp, Homo sapiens
aggtccatgtttgaagtatcagtaggaatg

SEQ ID NO: 28453 - DNA, 30 bp, Homo sapiens
gagctaggtcccgtatctcctctagaagtg

SEQ ID NO: 28454 - DNA, 30 bp, Homo sapiens
agctggtgcttgagtcctcgggctcaccgt

SEQ ID NO: 28455 - DNA, 30 bp, Homo sapiens
atttggacacgtggagaaaatctgtaggca

SEQ ID NO: 28456 - DNA, 30 bp, Homo sapiens
aactgggttgtctgctcctctactcttatc

SEQ ID NO: 28457 - DNA, 30 bp, Homo sapiens
tctgcctccggtttctcagcaggcagtccc

SEQ ID NO: 28458 - DNA, 30 bp, Homo sapiens
gcttgtgcttcgtggacaccagctgtcatg

SEQ ID NO: 28459 - DNA, 30 bp, Homo sapiens
gcaagttgctgacttctctgtgtccaggac

SEQ ID NO: 28460 - DNA, 30 bp, Homo sapiens
gactggtagcaacttcctccaacaaacctt

SEQ ID NO: 28461 - DNA, 30 bp, Homo sapiens
gtgaggtctttagccgtccagaaatggttt

SEQ ID NO: 28462 - DNA, 30 bp, Homo sapiens
gccaggcacagtggctcatgtctgtaatcc

SEQ ID NO: 28463 - DNA, 30 bp, Homo sapiens
ttatggtttccggtggctctgcatggaagg

SEQ ID NO: 28464 - DNA, 30 bp, Homo sapiens
gagtggccccacggcgcaaggcagcctgga

SEQ ID NO: 28465 - DNA, 30 bp, Homo sapiens
ctgcacagtttattcttaagtgtttccatg

SEQ ID NO: 28466 - DNA, 30 bp, Homo sapiens
cataggcagtctcctggtgctccacttctc

SEQ ID NO: 28467 - DNA, 30 bp, Homo sapiens
ggtttccggtggctctgcatggaagggaat

SEQ ID NO: 28468 - DNA, 30 bp, Homo sapiens
tcgaggcttccatggtggatccaaagcaat

SEQ ID NO: 28469 - DNA, 30 bp, Homo sapiens
gacaggcttcccctggcttcctggagctgt

SEQ ID NO: 28470 - DNA, 30 bp, Homo sapiens
gcctccggtttctcagcaggcagtcccgca

SEQ ID NO: 28471 - DNA, 30 bp, Homo sapiens
aaatggtttcctccttatggtttccggtgg

SEQ ID NO: 28472 - DNA, 30 bp, Homo sapiens
tggagcatggtcccaaagcaccccttagaa

SEQ ID NO: 28473 - DNA, 30 bp, Homo sapiens
agttccgagtgtgttaatacagcaggcaca

SEQ ID NO: 28474 - DNA, 30 bp, Homo sapiens
cagctgctatagcctgacgtgtgagtgctg

SEQ ID NO: 28475 - DNA, 30 bp, Homo sapiens
tatagggaggcccctgcgggcaggggaatc

SEQ ID NO: 28476 - DNA, 30 bp, Homo sapiens
ccatggtcttcttccacccaagctacaatt

SEQ ID NO: 28477 - DNA, 30 bp, Homo sapiens
acctggagcagctggattcagacggggacc

SEQ ID NO: 28478 - DNA, 30 bp, Homo sapiens
cctgtagtcaacatactcctgcttccaggt

SEQ ID NO: 28479 - DNA, 30 bp, Homo sapiens
tggtggtatcactgtccccatctccaggct

SEQ ID NO: 28480 - DNA, 30 bp, Homo sapiens
agaattactggcttgatggtgatctttctg

SEQ ID NO: 28481 - DNA, 30 bp, Homo sapiens
gtctggctttggaggagtaggtggcatctt

SEQ ID NO: 28482 - DNA, 30 bp, Homo sapiens
ccagcagtgcagcggcggcagccgcaggct

SEQ ID NO: 28483 - DNA, 30 bp, Homo sapiens
tgctggtcaattggcttcgacacagtagtc

SEQ ID NO: 28484 - DNA, 30 bp, Homo sapiens
cagctgccgagagggcctgaggatgtacag

SEQ ID NO: 28485 - DNA, 30 bp, Homo sapiens
cactgggctccaactgctccatccaccacc

SEQ ID NO: 28486 - DNA, 30 bp, Homo sapiens
tgtcaacttaccagccttttccttctctga

SEQ ID NO: 28487 - DNA, 30 bp, Homo sapiens
atttggtgtctttggtttcagtgttctggt

SEQ ID NO: 28488 - DNA, 30 bp, Homo sapiens
gacgcagcaagatttgcttctctaaaagct

SEQ ID NO: 28489 - DNA, 30 bp, Homo sapiens
ggctggtgaggcaacatgtatctctcatca

SEQ ID NO: 28490 - DNA, 30 bp, Homo sapiens
tgttagctctgaggacatatcatgagggcc

SEQ ID NO: 28491 - DNA, 30 bp, Homo sapiens
gccaggagttgaagcttcaggtgaatggga

SEQ ID NO: 28492 - DNA, 30 bp, Homo sapiens
gtctgggagattctgtaagatctgtctcaa

SEQ ID NO: 28493 - DNA, 30 bp, Homo sapiens
cccagatgtaagaaccagattgttcttcta

SEQ ID NO: 28494 - DNA, 30 bp, Homo sapiens
agggaatccagatgaaaggcccagattgct

SEQ ID NO: 28495 - DNA, 30 bp, Homo sapiens
ttcaggggatgggacccaaatgtagtgccc

SEQ ID NO: 28496 - DNA, 30 bp, Homo sapiens
tctcgggctggaacccagatgtaggggcct

SEQ ID NO: 28497 - DNA, 30 bp, Homo sapiens
gagcgggcaggctggaatccacaggacttt

SEQ ID NO: 28498 - DNA, 30 bp, Homo sapiens
agccgggtctgcgcctcggggatgtagatc

SEQ ID NO: 28499 - DNA, 30 bp, Homo sapiens
tagactgtccagtgtttgtgcaggttttta

SEQ ID NO: 28500 - DNA, 30 bp, Homo sapiens
gagccgggtctgggcctcggggatgtagat

SEQ ID NO: 28501 - DNA, 30 bp, Homo sapiens
acagcctggtctgggcctcggggatgtaga

SEQ ID NO: 28502 - DNA, 30 bp, Homo sapiens
gcctggtctgggcctccgggacataaatct

SEQ ID NO: 28503 - DNA, 30 bp, Homo sapiens
acctggctgtagtcccagctactcgggagg

SEQ ID NO: 28504 - DNA, 30 bp, Homo sapiens
tgtagaggtgaaaaagtaatcaggttacca

SEQ ID NO: 28505 - DNA, 30 bp, Homo sapiens
cgccggcctccttgctgaaggtggtcatgt

SEQ ID NO: 28506 - DNA, 30 bp, Homo sapiens
cagtgctgtggtctttccaggctcaggggg

SEQ ID NO: 28507 - DNA, 30 bp, Homo sapiens
ttgctatgacgcactcatccttctcctcgg

SEQ ID NO: 28508 - DNA, 30 bp, Homo sapiens
catttcacggacagaatcgaggaagggtag

SEQ ID NO: 28509 - DNA, 30 bp, Homo sapiens
gagcgtagatggaaggagcagatatgacat

SEQ ID NO: 28510 - DNA, 30 bp, Homo sapiens
tggcaatgacacattcattcctctcctctg

SEQ ID NO: 28511 - DNA, 30 bp, Homo sapiens
aaagatccaggaggaggactctgggatcct

SEQ ID NO: 28512 - DNA, 30 bp, Homo sapiens
cccaagagggaacactggagaccttgacca

SEQ ID NO: 28513 - DNA, 30 bp, Homo sapiens
ataagttggggttgctgcatagcttcttgg

SEQ ID NO: 28514 - DNA, 30 bp, Homo sapiens
agagccgccccaccctgcttcatcagcttc

SEQ ID NO: 28515 - DNA, 30 bp, Homo sapiens
gctcaccggggcgcccccgccgccgtgatg

SEQ ID NO: 28516 - DNA, 30 bp, Homo sapiens
cccagggttgggcgggggcccgggagaggc

SEQ ID NO: 28517 - DNA, 30 bp, Homo sapiens
ctgaggcgaagccaggacatctgaggagtg

SEQ ID NO: 28518 - DNA, 30 bp, Homo sapiens
taatagagtgtcccggaggccagcgccagc

SEQ ID NO: 28519 - DNA, 30 bp, Homo sapiens
ctgtggtctctgcatcgtgtcctggtgtgg

SEQ ID NO: 28520 - DNA, 30 bp, Homo sapiens
tagtgatgtctgtccatgtacaagtgtctg

SEQ ID NO: 28521 - DNA, 30 bp, Homo sapiens
acgcggtaggccttccctttggggtctgcc

SEQ ID NO: 28522 - DNA, 30 bp, Homo sapiens
cactggaggtggtggaggcaggcgaggccc

SEQ ID NO: 28523 - DNA, 30 bp, Homo sapiens
ggcagggacagggctggctgtgtcccgagg

SEQ ID NO: 28524 - DNA, 30 bp, Homo sapiens
gcccagtcgactcccacaacctcgcaattg

SEQ ID NO: 28525 - DNA, 30 bp, Homo sapiens
acggcttcttggctttcttcacggaagatg

SEQ ID NO: 28526 - DNA, 30 bp, Homo sapiens
accgaggctcctcttctcggcgtggggggg

SEQ ID NO: 28527 - DNA, 30 bp, Homo sapiens
agttgggcagcgtatcgagtcccagggagg

SEQ ID NO: 28528 - DNA, 30 bp, Homo sapiens
actccttggcatccccaattcctccagcag

SEQ ID NO: 28529 - DNA, 30 bp, Homo sapiens
tcattggctttccaggggtatttcttcctc

SEQ ID NO: 28530 - DNA, 30 bp, Homo sapiens
tcatctgtcatgactgatactaaggactcc

SEQ ID NO: 28531 - DNA, 30 bp, Homo sapiens
tgtccccctctaagacagtctgcactggca

SEQ ID NO: 28532 - DNA, 30 bp, Homo sapiens
caccttttttctgaagccggtttctggttg

SEQ ID NO: 28533 - DNA, 30 bp, Homo sapiens
aaaacttcacccactgcagcaggccaggtt

SEQ ID NO: 28534 - DNA, 30 bp, Homo sapiens
cacgggatgcgagagcttctctggtccttg

SEQ ID NO: 28535 - DNA, 30 bp, Homo sapiens
tcttggcagtcattgtcatcttggtcccca

SEQ ID NO: 28536 - DNA, 30 bp, Homo sapiens
ttcagggagcgcgggcggctcctgggcggc

SEQ ID NO: 28537 - DNA, 30 bp, Homo sapiens
ctgtggctccctctgcctgcagcaactcca

SEQ ID NO: 28538 - DNA, 30 bp, Homo sapiens
gcgcgggcggctcctgggcggcgccagact

SEQ ID NO: 28539 - DNA, 30 bp, Homo sapiens
cgatgacgggagtgactgtgaagctgctgg

SEQ ID NO: 28540 - DNA, 30 bp, Homo sapiens
actgagagacacgagtgatggcagatgaag

SEQ ID NO: 28541 - DNA, 30 bp, Homo sapiens
ctgaggagtcagacctctcgtcatagtcgt

SEQ ID NO: 28542 - DNA, 30 bp, Homo sapiens
atttggtctgaagtacagtctgccacaagt

SEQ ID NO: 28543 - DNA, 30 bp, Homo sapiens
tgcttctccggagcgccgttgaccataggc

SEQ ID NO: 28544 - DNA, 30 bp, Homo sapiens
agtcggactgctcctgagacgatggctggc

SEQ ID NO: 28545 - DNA, 30 bp, Homo sapiens
tcaagagggagatgcatcccagatgtccaa

SEQ ID NO: 28546 - DNA, 30 bp, Homo sapiens
ctcaggagggagatggaccccagacggcca

SEQ ID NO: 28547 - DNA, 30 bp, Homo sapiens
cttcgacatcctttgaatcttctgaaacag

SEQ ID NO: 28548 - DNA, 30 bp, Homo sapiens
gaagagagaggccttcttcttgagctcatt

SEQ ID NO: 28549 - DNA, 30 bp, Homo sapiens
tgccactcggggagttgcctggttgggagg

SEQ ID NO: 28550 - DNA, 30 bp, Homo sapiens
atctggcagtattctcattttcattgttcc

SEQ ID NO: 28551 - DNA, 30 bp, Homo sapiens
ccctggttttcagcgtgccatctgcaccac

SEQ ID NO: 28552 - DNA, 30 bp, Homo sapiens
atgtggcaaagactttcatgttctcttgat

SEQ ID NO: 28553 - DNA, 30 bp, Homo sapiens
tttcggtgctgggaatgcagtgaggtccca

SEQ ID NO: 28554 - DNA, 30 bp, Homo sapiens
cactaccatcctgcatattggtttctttta

SEQ ID NO: 28555 - DNA, 30 bp, Homo sapiens
ttttggagtctgactcacagttgggcggag

SEQ ID NO: 28556 - DNA, 30 bp, Homo sapiens
cataatcctgtaggccttctacatacaatt

SEQ ID NO: 28557 - DNA, 30 bp, Homo sapiens
ctagggatatgatggcttagcttgggctca

SEQ ID NO: 28558 - DNA, 30 bp, Homo sapiens
gtgtggctggcacggcctgcacatgctgca

SEQ ID NO: 28559 - DNA, 30 bp, Homo sapiens
tccagggcacagatgagggccacaccacgc

SEQ ID NO: 28560 - DNA, 30 bp, Homo sapiens
gtgaggcatactccttgcagcacccagtga

SEQ ID NO: 28561 - DNA, 30 bp, Homo sapiens
gcttctagaagcagagccactccagccaga

SEQ ID NO: 28562 - DNA, 30 bp, Homo sapiens
ccacccagcaatccagctcctctgtatatt

SEQ ID NO: 28563 - DNA, 30 bp, Homo sapiens
tagtcatccaactgacaaagcaaagcaacc

SEQ ID NO: 28564 - DNA, 30 bp, Homo sapiens
ccgaggaaggcaataaacaaattctccatc

SEQ ID NO: 28565 - DNA, 30 bp, Homo sapiens
cggaaatcagaaaatatcttgaattgccgt

SEQ ID NO: 28566 - DNA, 30 bp, Homo sapiens
ttgtgatccagtgactaggaggtttcttcg

SEQ ID NO: 28567 - DNA, 30 bp, Homo sapiens
aaaatggcattccagcagaaccattaaata

SEQ ID NO: 28568 - DNA, 30 bp, Homo sapiens
tgtaggagcagcgccacggctgccaggatc

SEQ ID NO: 28569 - DNA, 30 bp, Homo sapiens
cctcccgggctcaggcgatcctcccacctc

SEQ ID NO: 28570 - DNA, 30 bp, Homo sapiens
tccaggctcatgagtagagcagtgcccctc

SEQ ID NO: 28571 - DNA, 30 bp, Homo sapiens
gttatccagctggcacagtgaggccacccc

SEQ ID NO: 28572 - DNA, 30 bp, Homo sapiens
agaagggcaaccccacggagcacccagtgt

SEQ ID NO: 28573 - DNA, 30 bp, Homo sapiens
cattcgctcagctggcagagcaaagctgat

SEQ ID NO: 28574 - DNA, 30 bp, Homo sapiens
ccaatccagtgttccttgggttggtcagag

SEQ ID NO: 28575 - DNA, 30 bp, Homo sapiens
ctctcaggatccagtgatccggggacaaca

SEQ ID NO: 28576 - DNA, 30 bp, Homo sapiens
atctggagaagcaaggctactccagccaga

SEQ ID NO: 28577 - DNA, 30 bp, Homo sapiens
aggtcttgattttcacttccctcaccaggt

SEQ ID NO: 28578 - DNA, 30 bp, Homo sapiens
cttcatccccttcttcccccgctgcttcct

SEQ ID NO: 28579 - DNA, 30 bp, Homo sapiens
aagaggtctgacactgaacaccacctctgg

SEQ ID NO: 28580 - DNA, 30 bp, Homo sapiens
tgatgggcacactgcactccaggtccatga

SEQ ID NO: 28581 - DNA, 30 bp, Homo sapiens
tagtttccagtggatctttttccagagctg

SEQ ID NO: 28582 - DNA, 30 bp, Homo sapiens
tcgtcctccccagcctcacgcctagccttg

SEQ ID NO: 28583 - DNA, 30 bp, Homo sapiens
catgccgtctggcactgcactccagcctgg

SEQ ID NO: 28584 - DNA, 30 bp, Homo sapiens
tattggaagaacctgctcaagtacggttct

SEQ ID NO: 28585 - DNA, 30 bp, Homo sapiens
agtccattgtataccttctgcactgaccct

SEQ ID NO: 28586 - DNA, 30 bp, Homo sapiens
tgcagggaggcctgcacctctgacagtcgg

SEQ ID NO: 28587 - DNA, 30 bp, Homo sapiens
gcctggcgcagcatctgcttcttctggggt

SEQ ID NO: 28588 - DNA, 30 bp, Homo sapiens
taaagactggtaagccgctctaattcttta

SEQ ID NO: 28589 - DNA, 30 bp, Homo sapiens
acttggtctttggtatagccttttccacct

SEQ ID NO: 28590 - DNA, 30 bp, Homo sapiens
cagaggatgaggcagcgagaggccttctcc

SEQ ID NO: 28591 - DNA, 30 bp, Homo sapiens
ctgcgggtttcttcccagctgcctccatct

SEQ ID NO: 28592 - DNA, 30 bp, Homo sapiens
tcctccacttccaccctttcttggccattc

SEQ ID NO: 28593 - DNA, 30 bp, Homo sapiens
ggcaggaagatgtttcctaagtacttcttt

SEQ ID NO: 28594 - DNA, 30 bp, Homo sapiens
aacagggtaggtgctgcttaaggatctgtc

SEQ ID NO: 28595 - DNA, 30 bp, Homo sapiens
tagtgattgcctttggtcgacttcttcttc

SEQ ID NO: 28596 - DNA, 30 bp, Homo sapiens
gcagcagctgctccttaccatttattgtta

SEQ ID NO: 28597 - DNA, 30 bp, Homo sapiens
ggtagacttcttttgcacctctttacgctt

SEQ ID NO: 28598 - DNA, 30 bp, Homo sapiens
tgctgtccatccatttgagctgctccttgc

SEQ ID NO: 28599 - DNA, 30 bp, Homo sapiens
cagtcagtgtatgtagtaaccatatttcct

SEQ ID NO: 28600 - DNA, 30 bp, Homo sapiens
caaccagcaacttgtacctagcgatacagt

SEQ ID NO: 28601 - DNA, 30 bp, Homo sapiens
tcctcttgccttgatttcggagagtttcca

SEQ ID NO: 28602 - DNA, 30 bp, Homo sapiens
ctgtgggactgctttggtatccggagggcc

SEQ ID NO: 28603 - DNA, 30 bp, Homo sapiens
gagaaacccaccgtcttcactgagtcattc

SEQ ID NO: 28604 - DNA, 30 bp, Homo sapiens
ctcaggagttctgagggagcatccttggac

SEQ ID NO: 28605 - DNA, 30 bp, Homo sapiens
ccaaggtcgcctgcctcatggtctacagga

SEQ ID NO: 28606 - DNA, 30 bp, Homo sapiens
cgttggaagggcctcctcactttcttccgc

SEQ ID NO: 28607 - DNA, 30 bp, Homo sapiens
gtttggtggttgtttctagcaagtcttttg

SEQ ID NO: 28608 - DNA, 30 bp, Homo sapiens
agtctagttcaggccatgatgggatataaa

SEQ ID NO: 28609 - DNA, 30 bp, Homo sapiens
cgtaggcggcccctcctggtcttcctgctg

SEQ ID NO: 28610 - DNA, 30 bp, Homo sapiens
agccacctctgcgtaggccaatgagtttgg

SEQ ID NO: 28611 - DNA, 30 bp, Homo sapiens
gtcaggatgatttaaaagcataattcgtcg

SEQ ID NO: 28612 - DNA, 30 bp, Homo sapiens
atcgtttcatgcagtccttctttgtcctgc

SEQ ID NO: 28613 - DNA, 30 bp, Homo sapiens
ctgtggcctttagatggtcaaaaagtttat

SEQ ID NO: 28614 - DNA, 30 bp, Homo sapiens
ctccgggatccccagggcttcctgggttga

SEQ ID NO: 28615 - DNA, 30 bp, Homo sapiens
catccttggaaacactgtattttccaccac

SEQ ID NO: 28616 - DNA, 30 bp, Homo sapiens
atgttaaccgcccaggcccttcattcttca

SEQ ID NO: 28617 - DNA, 30 bp, Homo sapiens
acatctcattaatgccttctccagtttgtg

SEQ ID NO: 28618 - DNA, 30 bp, Homo sapiens
aggagggctgtccgagcattcacaactgct

SEQ ID NO: 28619 - DNA, 30 bp, Homo sapiens
ccttgatcaaggttatttgggtttctatct

SEQ ID NO: 28620 - DNA, 30 bp, Homo sapiens
gagctgaagggattgaacccttgccatgag

SEQ ID NO: 28621 - DNA, 30 bp, Homo sapiens
tctcgggtatcctcccagcggaggcctttc

SEQ ID NO: 28622 - DNA, 30 bp, Homo sapiens
ccgttgtcgctcctgctgaaggatgcctct

SEQ ID NO: 28623 - DNA, 30 bp, Homo sapiens
caggggccggcgccccggggcacgatctcg

SEQ ID NO: 28624 - DNA, 30 bp, Homo sapiens
agtgtggtagctggggtgggagtcggctgt

SEQ ID NO: 28625 - DNA, 30 bp, Homo sapiens
ggctggagaaaaactggaaagtccacatct

SEQ ID NO: 28626 - DNA, 30 bp, Homo sapiens
cttggaggctgactctggacattctgctga

SEQ ID NO: 28627 - DNA, 30 bp, Homo sapiens
ccttggttttcaaattcagaccaggcatca

SEQ ID NO: 28628 - DNA, 30 bp, Homo sapiens
ggaccgccaaagaatgccttgaagatattg

SEQ ID NO: 28629 - DNA, 30 bp, Homo sapiens
ttactttcggtggtctcaggaaggtccgat

SEQ ID NO: 28630 - DNA, 30 bp, Homo sapiens
tcctttggaagatttgcagtactttgcttc

SEQ ID NO: 28631 - DNA, 30 bp, Homo sapiens
cccctttaattactggagtaccatccagct

SEQ ID NO: 28632 - DNA, 30 bp, Homo sapiens
gcacacagccagggtgcccccgaagtacag

SEQ ID NO: 28633 - DNA, 30 bp, Homo sapiens
agttgggccttcagctgctgatttgttcgc

SEQ ID NO: 28634 - DNA, 30 bp, Homo sapiens
cactggatagtggtcactgatggcttgggc

SEQ ID NO: 28635 - DNA, 30 bp, Homo sapiens
agcagggcacagctgaggggacaggagtga

SEQ ID NO: 28636 - DNA, 30 bp, Homo sapiens
catcggtggaacttgagggtcacctccact

SEQ ID NO: 28637 - DNA, 30 bp, Homo sapiens
tgttggtgaaggcccttgaagactgtagtt

SEQ ID NO: 28638 - DNA, 30 bp, Homo sapiens
tgctgggcttcctggccatgccattacagg

SEQ ID NO: 28639 - DNA, 30 bp, Homo sapiens
cttctgaaggcttggtgtggactccgattt

SEQ ID NO: 28640 - DNA, 30 bp, Homo sapiens
ccatggtacctgcctcagccccagcagacc

SEQ ID NO: 28641 - DNA, 30 bp, Homo sapiens
ccaagggtttgtcatcaggactgtaatctt

SEQ ID NO: 28642 - DNA, 30 bp, Homo sapiens
cagaatacctgcaaggcagaggtcttgaca

SEQ ID NO: 28643 - DNA, 30 bp, Homo sapiens
gacaggggtgggctgcacacatggaccctc

SEQ ID NO: 28644 - DNA, 30 bp, Homo sapiens
gctcggctccgtcttgccagggctgggggg

SEQ ID NO: 28645 - DNA, 30 bp, Homo sapiens
tagaggtcgaaggggggcctggggctctca

SEQ ID NO: 28646 - DNA, 30 bp, Homo sapiens
gggtcactgatagtgattctggggaccccg

SEQ ID NO: 28647 - DNA, 30 bp, Homo sapiens
caggggtcactgatagtgattctggggacc

SEQ ID NO: 28648 - DNA, 30 bp, Homo sapiens
atgagtctcccggatttcagcaataatttg

SEQ ID NO: 28649 - DNA, 30 bp, Homo sapiens
cgagcagggatggctcggctgggcggataa

SEQ ID NO: 28650 - DNA, 30 bp, Homo sapiens
ggatggtcgtcctggaactgcaggaggggg

SEQ ID NO: 28651 - DNA, 30 bp, Homo sapiens
aacagggaggattctagtgggcggattata

SEQ ID NO: 28652 - DNA, 30 bp, Homo sapiens
caagctttccgcagtaaggacgaaccagta

SEQ ID NO: 28653 - DNA, 30 bp, Homo sapiens
actcggttttgcggatataattggagggaa

SEQ ID NO: 28654 - DNA, 30 bp, Homo sapiens
cagcttcctcctcctttattttagctgagg

SEQ ID NO: 28655 - DNA, 30 bp, Homo sapiens
cacacacgcaaaatactccttcagcggagc

SEQ ID NO: 28656 - DNA, 30 bp, Homo sapiens
tgctggtgggcccagaagaggctgcccctg

SEQ ID NO: 28657 - DNA, 30 bp, Homo sapiens
cagaggggcgaagaggtgtcggatgacagg

SEQ ID NO: 28658 - DNA, 30 bp, Homo sapiens
gcttggtgggccacttggccgcgagcttcg

SEQ ID NO: 28659 - DNA, 30 bp, Homo sapiens
agagattatggcttagagaagggaacagct

SEQ ID NO: 28660 - DNA, 30 bp, Homo sapiens
accagggaaggagctgagggctgggtccat

SEQ ID NO: 28661 - DNA, 30 bp, Homo sapiens
ggttgggtcaggggaggcagccacctgccc

SEQ ID NO: 28662 - DNA, 30 bp, Homo sapiens
catttctttcccacggttcaatataatcca

SEQ ID NO: 28663 - DNA, 30 bp, Homo sapiens
gtctgtggaggtgcttcaacagcacgatgc

SEQ ID NO: 28664 - DNA, 30 bp, Homo sapiens
gcatttgctgctttttcagccatgatctct

SEQ ID NO: 28665 - DNA, 30 bp, Homo sapiens
aggctgaggacagagccccggccgcagggg

SEQ ID NO: 28666 - DNA, 30 bp, Homo sapiens
ccctgggagctcgctggtgagcgtgtgcca

SEQ ID NO: 28667 - DNA, 30 bp, Homo sapiens
tcccggagtccaccgatgtctgcttgcgag

SEQ ID NO: 28668 - DNA, 30 bp, Homo sapiens
gacttcagcactagatgagatggagaccgt

SEQ ID NO: 28669 - DNA, 30 bp, Homo sapiens
acttcagcgtatcttggggaaccataacct

SEQ ID NO: 28670 - DNA, 30 bp, Homo sapiens
cacaggtccgtggacagcgagtctgggatc

SEQ ID NO: 28671 - DNA, 30 bp, Homo sapiens
actgctcccctcggccgtgctcccaggcca

SEQ ID NO: 28672 - DNA, 30 bp, Homo sapiens
ttgcggggcaggggcctgggccgcgggccg

SEQ ID NO: 28673 - DNA, 30 bp, Homo sapiens
tactgggatccaggctcggaagtagggatg

SEQ ID NO: 28674 - DNA, 30 bp, Homo sapiens
atttcggtattgtgggggtcctggaaccaa

SEQ ID NO: 28675 - DNA, 30 bp, Homo sapiens
cagaggtctgcctttcggaaacttgctctg

SEQ ID NO: 28676 - DNA, 30 bp, Homo sapiens
aagaagtgagaagatgctatggtagcacca

SEQ ID NO: 28677 - DNA, 30 bp, Homo sapiens
tgcgaaggctcattcgactgaaggaatctc

SEQ ID NO: 28678 - DNA, 30 bp, Homo sapiens
gacaactgggtttcacatttcctgaaacta

SEQ ID NO: 28679 - DNA, 30 bp, Homo sapiens
ccatttccctgtagttggctttcatttctt

SEQ ID NO: 28680 - DNA, 30 bp, Homo sapiens
tattggctccaagacactttcagagtgatg

SEQ ID NO: 28681 - DNA, 30 bp, Homo sapiens
aggagggggccccgcgcagctgctccaggc

SEQ ID NO: 28682 - DNA, 30 bp, Homo sapiens
caggtagagccctctgacttgaccccagtc

SEQ ID NO: 28683 - DNA, 30 bp, Homo sapiens
ctttgggcctttctttagtacaacattgtc

SEQ ID NO: 28684 - DNA, 30 bp, Homo sapiens
ccaagggtgtgtgcagctgaggtggagttg

SEQ ID NO: 28685 - DNA, 30 bp, Homo sapiens
ggccggtcacaaggggctgggcccttcctc

SEQ ID NO: 28686 - DNA, 30 bp, Homo sapiens
cactgggatggggtcttggcctcactgctg

SEQ ID NO: 28687 - DNA, 30 bp, Homo sapiens
tgtaggctggaaaagtctctgttcgatgaa

SEQ ID NO: 28688 - DNA, 30 bp, Homo sapiens
aaaaggtcttaaatccctctttagaaggtt

SEQ ID NO: 28689 - DNA, 30 bp, Homo sapiens
cattggatgaggctggagctgtagctgaat

SEQ ID NO: 28690 - DNA, 30 bp, Homo sapiens
aggaggggggtttaccttgagtcctccaca

SEQ ID NO: 28691 - DNA, 30 bp, Homo sapiens
accaggccccgccgtctcgtgcccagccag

SEQ ID NO: 28692 - DNA, 30 bp, Homo sapiens
ctgcggggctgccttcctctgctccagctc

SEQ ID NO: 28693 - DNA, 30 bp, Homo sapiens
gcaatatcaggaggtagagaggcagaagga

SEQ ID NO: 28694 - DNA, 30 bp, Homo sapiens
cttgcgttgtctgttcctggcttctgcccg

SEQ ID NO: 28695 - DNA, 30 bp, Homo sapiens
tgttagggtgcaaaccacagttagtaagct

SEQ ID NO: 28696 - DNA, 30 bp, Homo sapiens
tttgctggaacatggtttgtggttctccag

SEQ ID NO: 28697 - DNA, 30 bp, Homo sapiens
ttctggatgttccagaaaatcatattcgat

SEQ ID NO: 28698 - DNA, 30 bp, Homo sapiens
actgtgccgcctgccaccccggaaaagctg

SEQ ID NO: 28699 - DNA, 30 bp, Homo sapiens
gaatggagaaggtgatggcactgcccagga

SEQ ID NO: 28700 - DNA, 30 bp, Homo sapiens
gcaaggcgtcatccagaggtagctggtgtc

SEQ ID NO: 28701 - DNA, 30 bp, Homo sapiens
tactgggtcttgcagtccccatcgttgctg

SEQ ID NO: 28702 - DNA, 30 bp, Homo sapiens
cccatcccagaggaggccgaagggaatcga

SEQ ID NO: 28703 - DNA, 30 bp, Homo sapiens
gaatggagaacttcttgtagtacctcagag

SEQ ID NO: 28704 - DNA, 30 bp, Homo sapiens
ccgtggggaagggatctggcccatgccaag

SEQ ID NO: 28705 - DNA, 30 bp, Homo sapiens
cacaggagagacagacagaggaccagggga

SEQ ID NO: 28706 - DNA, 30 bp, Homo sapiens
aataaggactgggaaggtggccacaactgc

SEQ ID NO: 28707 - DNA, 30 bp, Homo sapiens
cactgggtgaaggttgggatggtggcagca

SEQ ID NO: 28708 - DNA, 30 bp, Homo sapiens
taggtgagggtgatgtaagcagaagccttt

SEQ ID NO: 28709 - DNA, 30 bp, Homo sapiens
caagaggagttctggttctggtagatggaa

SEQ ID NO: 28710 - DNA, 30 bp, Homo sapiens
cctggcagccaaaggctgaggctttctctt

SEQ ID NO: 28711 - DNA, 30 bp, Homo sapiens
ttatctgctgtgggcgaaccccggccactg

SEQ ID NO: 28712 - DNA, 30 bp, Homo sapiens
cagcggcgccaccttctcgtccctgcagct

SEQ ID NO: 28713 - DNA, 30 bp, Homo sapiens
ccctcatcctcataggcgatggcaatccct

SEQ ID NO: 28714 - DNA, 30 bp, Homo sapiens
tgaaggggctgggactgtttctccacacac

SEQ ID NO: 28715 - DNA, 30 bp, Homo sapiens
agaagggtgatagcctatctttatatattt

SEQ ID NO: 28716 - DNA, 30 bp, Homo sapiens
tgaaggcactggcactgtttctccacacgc

SEQ ID NO: 28717 - DNA, 30 bp, Homo sapiens
atgctttgagattctgagctattttctggt

SEQ ID NO: 28718 - DNA, 30 bp, Homo sapiens
gtcaggcactgaggacaccttgtcctccaa

SEQ ID NO: 28719 - DNA, 30 bp, Homo sapiens
aggaggaaatgtgtgtttatcaaacttgct

SEQ ID NO: 28720 - DNA, 30 bp, Homo sapiens
gtctttcatccagcaatcgctcaacacgtc

SEQ ID NO: 28721 - DNA, 30 bp, Homo sapiens
gccttttggcagttgaggatcttaaagcca

SEQ ID NO: 28722 - DNA, 30 bp, Homo sapiens
ccactcccagaggtggagcgcatggtcata

SEQ ID NO: 28723 - DNA, 30 bp, Homo sapiens
aacttggattcaccataaacacgatccaca

SEQ ID NO: 28724 - DNA, 30 bp, Homo sapiens
ctgagccttcttggtcactctcttggtctt

SEQ ID NO: 28725 - DNA, 30 bp, Homo sapiens
ctgcgggctaagtcggctcgggcctcctgt

SEQ ID NO: 28726 - DNA, 30 bp, Homo sapiens
atctgggtagactgtcagcagttccatgaa

SEQ ID NO: 28727 - DNA, 30 bp, Homo sapiens
ctgtggtagcacagatatttcttccttcaa

SEQ ID NO: 28728 - DNA, 30 bp, Homo sapiens
gcttggccagatggggcctcactggggccc

SEQ ID NO: 28729 - DNA, 30 bp, Homo sapiens
atgtgggtatatatatgttggtgtgctgtg

SEQ ID NO: 28730 - DNA, 30 bp, Homo sapiens
actcggttgctctctggcccgaaatctgcc

SEQ ID NO: 28731 - DNA, 30 bp, Homo sapiens
cctcgtcctctttcgctgtgactgtcagca

SEQ ID NO: 28732 - DNA, 30 bp, Homo sapiens
cagaggctgagtctgggccccccacgcaga

SEQ ID NO: 28733 - DNA, 30 bp, Homo sapiens
ccaaggttttcttgaaggtagtgcaaaaga

SEQ ID NO: 28734 - DNA, 30 bp, Homo sapiens
cagaggtattcctgtagaaagtgcagcaac

SEQ ID NO: 28735 - DNA, 30 bp, Homo sapiens
caagtgccagctgtagaacagtcaaccaga

SEQ ID NO: 28736 - DNA, 30 bp, Homo sapiens
agcacagtcggggcataacatattatcttc

SEQ ID NO: 28737 - DNA, 30 bp, Homo sapiens
gcttggtgtcttgattccctattctagcat

SEQ ID NO: 28738 - DNA, 30 bp, Homo sapiens
gtgcgggggtggaaaattggaggcaggaag

SEQ ID NO: 28739 - DNA, 30 bp, Homo sapiens
cattggaggctttttattaagaccttgttc

SEQ ID NO: 28740 - DNA, 30 bp, Homo sapiens
ccaagggcctagttcgagggcattcatggc

SEQ ID NO: 28741 - DNA, 30 bp, Homo sapiens
ctttggttagatgaacaggcaggagagcca

SEQ ID NO: 28742 - DNA, 30 bp, Homo sapiens
atccggcacattatgaacttccactggcga

SEQ ID NO: 28743 - DNA, 30 bp, Homo sapiens
ttctggaatacagtggtgaagtgaggtttg

SEQ ID NO: 28744 - DNA, 30 bp, Homo sapiens
gtaaggcctggcgtcttcgagcaggacgct

SEQ ID NO: 28745 - DNA, 30 bp, Homo sapiens
ttctggacagcttgtaaacgtggaaggttt

SEQ ID NO: 28746 - DNA, 30 bp, Homo sapiens
gacaaaatcgcccatattttgagtaggtta

SEQ ID NO: 28747 - DNA, 30 bp, Homo sapiens
tggtggtctttcctttgcaagcacagcaag

SEQ ID NO: 28748 - DNA, 30 bp, Homo sapiens
ctttcctttgcaagcacagcaagtccctgt

SEQ ID NO: 28749 - DNA, 30 bp, Homo sapiens
atattaatgggtccctcttcagtggcatat

SEQ ID NO: 28750 - DNA, 30 bp, Homo sapiens
cacaccggattcacagataagggtacgcct

SEQ ID NO: 28751 - DNA, 30 bp, Homo sapiens
caggggtgggcctgtttcctggtccctgct

SEQ ID NO: 28752 - DNA, 30 bp, Homo sapiens
cccaggctggtgatgttggcacggccaccg

SEQ ID NO: 28753 - DNA, 30 bp, Homo sapiens
gcctgggggcgccacgatgcgcttgctggc

SEQ ID NO: 28754 - DNA, 30 bp, Homo sapiens
gagaggtgatgttggagcggccgccaggtg

SEQ ID NO: 28755 - DNA, 30 bp, Homo sapiens
ccaaatgccactcgacctgcctccgggagg

SEQ ID NO: 28756 - DNA, 30 bp, Homo sapiens
tgcaggacacagggatctctgaactcctgg

SEQ ID NO: 28757 - DNA, 30 bp, Homo sapiens
aagatcccgcctgattagatgcactggctg

SEQ ID NO: 28758 - DNA, 30 bp, Homo sapiens
atttctgtggatatccttagggtgacactc

SEQ ID NO: 28759 - DNA, 30 bp, Homo sapiens
gcaaggtgcagtgtcatagagggttaatcc

SEQ ID NO: 28760 - DNA, 30 bp, Homo sapiens
catcaggtgctgaggggcccgggggcgctg

SEQ ID NO: 28761 - DNA, 30 bp, Homo sapiens
gacgttgatgaaggatccctggtcgccgtt

SEQ ID NO: 28762 - DNA, 30 bp, Homo sapiens
cattttgtgggtacccgcaacacctgagtg

SEQ ID NO: 28763 - DNA, 30 bp, Homo sapiens
tctaggatgtcgccacattccaggttgtcc

SEQ ID NO: 28764 - DNA, 30 bp, Homo sapiens
gcctccacataattgaacttttggaaacga

SEQ ID NO: 28765 - DNA, 30 bp, Homo sapiens
cccaggcgtgggtccttgtagagcttttcc

SEQ ID NO: 28766 - DNA, 30 bp, Homo sapiens
ggttgggtgctgaccgttttgtgtgatggg

SEQ ID NO: 28767 - DNA, 30 bp, Homo sapiens
cagtggaggatcttcaggaaggccttgcgg

SEQ ID NO: 28768 - DNA, 30 bp, Homo sapiens
gcaagacaggatcttgaggaaggctttccg

SEQ ID NO: 28769 - DNA, 30 bp, Homo sapiens
cagcagcaggcacgcagggccttgcggaag

SEQ ID NO: 28770 - DNA, 30 bp, Homo sapiens
tcggggtgaaaggtgttattttgtctaaag

SEQ ID NO: 28771 - DNA, 30 bp, Homo sapiens
cctccaacgtatggtctttacccactttct

SEQ ID NO: 28772 - DNA, 30 bp, Homo sapiens
cgctgcggactgtacttggtgctggtgcct

SEQ ID NO: 28773 - DNA, 30 bp, Homo sapiens
cttcttcacgatctggatgacgtcctcatg

SEQ ID NO: 28774 - DNA, 30 bp, Homo sapiens
tctgttccttggtgggagaggtcttttcct

SEQ ID NO: 28775 - DNA, 30 bp, Homo sapiens
ccctggatgaatctcttcatcacttagact

SEQ ID NO: 28776 - DNA, 30 bp, Homo sapiens
atctggctctctctcttgatgctctctttc

SEQ ID NO: 28777 - DNA, 30 bp, Homo sapiens
aagaggccagcagggtgttggcagtcacat

SEQ ID NO: 28778 - DNA, 30 bp, Homo sapiens
taatggattcttcgccaagccgaggttggg

SEQ ID NO: 28779 - DNA, 30 bp, Homo sapiens
tttgggttccaggtgatctagaaactccag

SEQ ID NO: 28780 - DNA, 30 bp, Homo sapiens
atttgggctccaaattatccaaaaattcaa

SEQ ID NO: 28781 - DNA, 30 bp, Homo sapiens
tcttcctgcttttcactgcagcagcccaca

SEQ ID NO: 28782 - DNA, 30 bp, Homo sapiens
tgtcctctaatggattcttcaccgagacgg

SEQ ID NO: 28783 - DNA, 30 bp, Homo sapiens
accagggtgtaagattttgcgtaaggattg

SEQ ID NO: 28784 - DNA, 30 bp, Homo sapiens
accagggtgtaggatttggagtaggccccg

SEQ ID NO: 28785 - DNA, 30 bp, Homo sapiens
tgcatcgaagaatgagaatatttagtgagt

SEQ ID NO: 28786 - DNA, 30 bp, Homo sapiens
tatatcctgcagagcttcagcgggaagttc

SEQ ID NO: 28787 - DNA, 30 bp, Homo sapiens
gattgggaacaagaagagtacaaccataat

SEQ ID NO: 28788 - DNA, 30 bp, Homo sapiens
cgatccatcagagtccagcagatgttttca

SEQ ID NO: 28789 - DNA, 30 bp, Homo sapiens
tacttgctatattgcacggtactatacttt

SEQ ID NO: 28790 - DNA, 30 bp, Homo sapiens
gcttggtaactctggtggaagatgtggtta

SEQ ID NO: 28791 - DNA, 30 bp, Homo sapiens
gacgggagcaaggatcctctgtacagagca

SEQ ID NO: 28792 - DNA, 30 bp, Homo sapiens
tgttgggtgtaatgtatgttactgtatcgt

SEQ ID NO: 28793 - DNA, 30 bp, Homo sapiens
ccagatccatgtatggcaggtgggttctgt

SEQ ID NO: 28794 - DNA, 30 bp, Homo sapiens
agtaggaataagagtaggaagaattccctg

SEQ ID NO: 28795 - DNA, 30 bp, Homo sapiens
gagtggttactgtcactgccttcactgtca

SEQ ID NO: 28796 - DNA, 30 bp, Homo sapiens
ttgaggacttgtccaatttgctggcaggtg

SEQ ID NO: 28797 - DNA, 30 bp, Homo sapiens
ggaagaatagtagaggctagaaattcctgt

SEQ ID NO: 28798 - DNA, 30 bp, Homo sapiens
cacagggcatccttcaaaggctacaattaa

SEQ ID NO: 28799 - DNA, 30 bp, Homo sapiens
gtttggctgctcagaattggacttgcagag

SEQ ID NO: 28800 - DNA, 30 bp, Homo sapiens
gaatggcatgaacccgggaggtggagcttg

SEQ ID NO: 28801 - DNA, 30 bp, Homo sapiens
cagaggacacgtcgccctcagccccgctgc

SEQ ID NO: 28802 - DNA, 30 bp, Homo sapiens
cgttggtgtccagctttaacacctgcctgt

SEQ ID NO: 28803 - DNA, 30 bp, Homo sapiens
ctcaggggctacatcaaaacactgctgtgg

SEQ ID NO: 28804 - DNA, 30 bp, Homo sapiens
aagtcctcctgggactttctatggaagtat

SEQ ID NO: 28805 - DNA, 30 bp, Homo sapiens
aagcttcatcttgcagcttctgtttcaggt

SEQ ID NO: 28806 - DNA, 30 bp, Homo sapiens
aacaggccccaaaagtaaatctggagagcc

SEQ ID NO: 28807 - DNA, 30 bp, Homo sapiens
agtaggggacataacttactccctgcttca

SEQ ID NO: 28808 - DNA, 30 bp, Homo sapiens
agacgcatccaccaaaagcaccgtccgagc

SEQ ID NO: 28809 - DNA, 30 bp, Homo sapiens
atcaggagtttgagaccagcttggccaaca

SEQ ID NO: 28810 - DNA, 30 bp, Homo sapiens
gcgaaggcctcctgcacgtctcccccgact

SEQ ID NO: 28811 - DNA, 30 bp, Homo sapiens
gcaacttcatcagctcttccagctggacca

SEQ ID NO: 28812 - DNA, 30 bp, Homo sapiens
tactgggtcacagagaacacagtgatcttc

SEQ ID NO: 28813 - DNA, 30 bp, Homo sapiens
tgcagggctgtgcagggggaggcccactag

SEQ ID NO: 28814 - DNA, 30 bp, Homo sapiens
tctttcccattctgcatcttctcttcttct

SEQ ID NO: 28815 - DNA, 30 bp, Homo sapiens
tggagctccttcaccagggatgacatggtg

SEQ ID NO: 28816 - DNA, 30 bp, Homo sapiens
cgcgatcctgtgtgacagaggctctctggg

SEQ ID NO: 28817 - DNA, 30 bp, Homo sapiens
gagcggggccgtgcttctgatgggggttga

SEQ ID NO: 28818 - DNA, 30 bp, Homo sapiens
taagagtcgctgtcctcaccaccatccgga

SEQ ID NO: 28819 - DNA, 30 bp, Homo sapiens
gactggcagatggttctcacgtctcacctt

SEQ ID NO: 28820 - DNA, 30 bp, Homo sapiens
tccttatctccagagcatttggcattcttt

SEQ ID NO: 28821 - DNA, 30 bp, Homo sapiens
tcctgagtttgcgtttgttctttggcattg

SEQ ID NO: 28822 - DNA, 30 bp, Homo sapiens
gccttggctgcagcctcggatacgccctgg

SEQ ID NO: 28823 - DNA, 30 bp, Homo sapiens
tccaggcagtcctcggtcaccccctgggca

SEQ ID NO: 28824 - DNA, 30 bp, Homo sapiens
gtcatctgtgatacccttcgctctcagctc

SEQ ID NO: 28825 - DNA, 30 bp, Homo sapiens
gctttcagctcctctttgacacgtttcagg

SEQ ID NO: 28826 - DNA, 30 bp, Homo sapiens
tccttctcctgggcagtgctgtcctcagag

SEQ ID NO: 28827 - DNA, 30 bp, Homo sapiens
ctcccccagcggcttctctgtggcagtgcg

SEQ ID NO: 28828 - DNA, 30 bp, Homo sapiens
atcaggacaggggagagggcaggagactgc

SEQ ID NO: 28829 - DNA, 30 bp, Homo sapiens
agttctcataatggtgggagaagtgagtcc

SEQ ID NO: 28830 - DNA, 30 bp, Homo sapiens
tagtggtgcatgaagtgggctcggtcctgc

SEQ ID NO: 28831 - DNA, 30 bp, Homo sapiens
ctttggggtgtgcctccttacagtatgcct

SEQ ID NO: 28832 - DNA, 30 bp, Homo sapiens
gtgtggcgggaggtaacacaaggggtaggc

SEQ ID NO: 28833 - DNA, 30 bp, Homo sapiens
cacaggttagtggtgatacattttaagtct

SEQ ID NO: 28834 - DNA, 30 bp, Homo sapiens
gctccctgccatcctcctcctcaccgtcct

SEQ ID NO: 28835 - DNA, 30 bp, Homo sapiens
ggccagggcactgcccatgacttcggagaa

SEQ ID NO: 28836 - DNA, 30 bp, Homo sapiens
ttccagggggctttcttcaccacttcccaa

SEQ ID NO: 28837 - DNA, 30 bp, Homo sapiens
cgttggccttgtgcttcggcaagaaggcga

SEQ ID NO: 28838 - DNA, 30 bp, Homo sapiens
taatggtctgtaaggtaatctatgattgct

SEQ ID NO: 28839 - DNA, 30 bp, Homo sapiens
agcagctgggagaggtcgtaatggggctct

SEQ ID NO: 28840 - DNA, 30 bp, Homo sapiens
ccacgcccatcagctttggtgtaaggattc

SEQ ID NO: 28841 - DNA, 30 bp, Homo sapiens
cactgggtccattcccaacaggctggatag

SEQ ID NO: 28842 - DNA, 30 bp, Homo sapiens
tgtgatcccaaaacaggcaatattttcatt

SEQ ID NO: 28843 - DNA, 30 bp, Homo sapiens
cagaaccgccccgtctcccgccccagtcgg

SEQ ID NO: 28844 - DNA, 30 bp, Homo sapiens
gtaaggcatcaggtgtcgggactccttctc

SEQ ID NO: 28845 - DNA, 30 bp, Homo sapiens
cagcgggtacaagaagaggaagcggctcgc

SEQ ID NO: 28846 - DNA, 30 bp, Homo sapiens
ttgccgcccttgcgggacagacaccggggg

SEQ ID NO: 28847 - DNA, 30 bp, Homo sapiens
tgatttccatgctgcccgaaaagctagact

SEQ ID NO: 28848 - DNA, 30 bp, Homo sapiens
cagtggaatcatcaaacggacttccttctc

SEQ ID NO: 28849 - DNA, 30 bp, Homo sapiens
tgatatgtacgaagctgctccatgaagcca

SEQ ID NO: 28850 - DNA, 30 bp, Homo sapiens
caaagaaccaaagctcacaataacgtatga

SEQ ID NO: 28851 - DNA, 30 bp, Homo sapiens
cagtgacacagcacctgggtctcaaactgc

SEQ ID NO: 28852 - DNA, 30 bp, Homo sapiens
catagatgtcagggatgttacctaccggcg

SEQ ID NO: 28853 - DNA, 30 bp, Homo sapiens
gaaaggcccagaacttcagaattcccggag

SEQ ID NO: 28854 - DNA, 30 bp, Homo sapiens
cgtaggtcagcggagccagtgccggaaaac

SEQ ID NO: 28855 - DNA, 30 bp, Homo sapiens
atttcgttcgctggtagaactggaagactg

SEQ ID NO: 28856 - DNA, 30 bp, Homo sapiens
atgcttccagaccctgccgcagcctgcggt

SEQ ID NO: 28857 - DNA, 30 bp, Homo sapiens
cagtcctccctccttttctgcagcttggtc

SEQ ID NO: 28858 - DNA, 30 bp, Homo sapiens
ctcagggcccaaccctaaggctgggggctc

SEQ ID NO: 28859 - DNA, 30 bp, Homo sapiens
ggtttcaacttcccctccttggctagtctg

SEQ ID NO: 28860 - DNA, 30 bp, Homo sapiens
agctgggagaggtggtgatggggctgtgca

SEQ ID NO: 28861 - DNA, 30 bp, Homo sapiens
agcaggatgtggccgttgccacagggcttc

SEQ ID NO: 28862 - DNA, 30 bp, Homo sapiens
acctggtatacattctggttggaaggggtg

SEQ ID NO: 28863 - DNA, 30 bp, Homo sapiens
acgtggactccagcgtattgagtgggaaca

SEQ ID NO: 28864 - DNA, 30 bp, Homo sapiens
tgacctccacgctgcccgagaagctcgcct

SEQ ID NO: 28865 - DNA, 30 bp, Homo sapiens
aggtgggggccagctcgaaggcgccatcac

SEQ ID NO: 28866 - DNA, 30 bp, Homo sapiens
gaaccaaaacctcctgaacccctttcggtg

SEQ ID NO: 28867 - DNA, 30 bp, Homo sapiens
tctctggccagctcttccctggcagcaatg

SEQ ID NO: 28868 - DNA, 30 bp, Homo sapiens
ccgcgcggaggcggaggcgtccgggggcgc

SEQ ID NO: 28869 - DNA, 30 bp, Homo sapiens
ttctggctccagagaaatgagagtcactag

SEQ ID NO: 28870 - DNA, 30 bp, Homo sapiens
gagagggtcccattcagcaagcagagcctg

SEQ ID NO: 28871 - DNA, 30 bp, Homo sapiens
agaactcgcaggggttccccatagccttct

SEQ ID NO: 28872 - DNA, 30 bp, Homo sapiens
agaactcgctgggattgcccatggccatgt

SEQ ID NO: 28873 - DNA, 30 bp, Homo sapiens
cacatcacatccacaaagaactcactgggg

SEQ ID NO: 28874 - DNA, 30 bp, Homo sapiens
cctaggaaggtctccaatttctgggctcaa

SEQ ID NO: 28875 - DNA, 30 bp, Homo sapiens
gagagggagtcttggggggtgatgggaggt

SEQ ID NO: 28876 - DNA, 30 bp, Homo sapiens
tgctcaagttaggtgctccataacgatcgc

SEQ ID NO: 28877 - DNA, 30 bp, Homo sapiens
aaggagatttggagccaggaggcatttcat

SEQ ID NO: 28878 - DNA, 30 bp, Homo sapiens
agtcggaatccatggtgaacagctggatgt

SEQ ID NO: 28879 - DNA, 30 bp, Homo sapiens
tataggttctgtggaagtggtggcagctgt

SEQ ID NO: 28880 - DNA, 30 bp, Homo sapiens
tcgtagaagctgcgaggatcctcctttgta

SEQ ID NO: 28881 - DNA, 30 bp, Homo sapiens
taggaggattgcttgagtccaggaattttg

SEQ ID NO: 28882 - DNA, 30 bp, Homo sapiens
ggcagataactcaacagtgccttcctcctc

SEQ ID NO: 28883 - DNA, 30 bp, Homo sapiens
agcaggtattcgggtagctgcttcctcctc

SEQ ID NO: 28884 - DNA, 30 bp, Homo sapiens
cgtaggagatgtaggtgttgtgggagaaac

SEQ ID NO: 28885 - DNA, 30 bp, Homo sapiens
agtctggctttcgagtcattctatccagtt

SEQ ID NO: 28886 - DNA, 30 bp, Homo sapiens
tgaatccactggtcttggttgcccccacat

SEQ ID NO: 28887 - DNA, 30 bp, Homo sapiens
acttggaagaacttcttttgtactgttcca

SEQ ID NO: 28888 - DNA, 30 bp, Homo sapiens
agcaggtacacacatctacagattggaatg

SEQ ID NO: 28889 - DNA, 30 bp, Homo sapiens
ataatcccaaacagcaactcacaggatgat

SEQ ID NO: 28890 - DNA, 30 bp, Homo sapiens
ttgaacagaagaatggccacttggcccagg

SEQ ID NO: 28891 - DNA, 30 bp, Homo sapiens
agcctgacttgaagaggaggattgcaactt

SEQ ID NO: 28892 - DNA, 30 bp, Homo sapiens
ccaagggcgacaaagtgaactgaaggtcag

SEQ ID NO: 28893 - DNA, 30 bp, Homo sapiens
actcctcgggccctgcttggatcctctgga

SEQ ID NO: 28894 - DNA, 30 bp, Homo sapiens
attcggttggattctgaatcacaatcagga

SEQ ID NO: 28895 - DNA, 30 bp, Homo sapiens
acatggattctgaatgacgatcagaagata

SEQ ID NO: 28896 - DNA, 30 bp, Homo sapiens
cgaaggcactgacgatgcagtacatggtct

SEQ ID NO: 28897 - DNA, 30 bp, Homo sapiens
gtagagctgtcccagaagcaggaacttgct

SEQ ID NO: 28898 - DNA, 30 bp, Homo sapiens
tcatggtccggttctcccatcttacggtac

SEQ ID NO: 28899 - DNA, 30 bp, Homo sapiens
acctggcatccagtgctgctccacctgaga

SEQ ID NO: 28900 - DNA, 30 bp, Homo sapiens
caaccaagaggagcaggaaattgctgacgc

SEQ ID NO: 28901 - DNA, 30 bp, Homo sapiens
tacaggactctgttgcacacaaactcctgt

SEQ ID NO: 28902 - DNA, 30 bp, Homo sapiens
agctggctgctgtgctctggggtacaccac

SEQ ID NO: 28903 - DNA, 30 bp, Homo sapiens
ttttggcaacactgtcctctgctgaatatt

SEQ ID NO: 28904 - DNA, 30 bp, Homo sapiens
gctaatcagttttggcaatacactgcatag

SEQ ID NO: 28905 - DNA, 30 bp, Homo sapiens
aatagggggtaaaacgtttgtgttcttgag

SEQ ID NO: 28906 - DNA, 30 bp, Homo sapiens
ctgaagggcttcaccagcttcatggcagca

SEQ ID NO: 28907 - DNA, 30 bp, Homo sapiens
cacttcaaattgggcaaggcaatttgatca

SEQ ID NO: 28908 - DNA, 30 bp, Homo sapiens
tccaggctgaggctcctagtttgagcgagt

SEQ ID NO: 28909 - DNA, 30 bp, Homo sapiens
agtcacagttactaagctgctttttaatgt

SEQ ID NO: 28910 - DNA, 30 bp, Homo sapiens
accaggcagggaccctgggttggccagagc

SEQ ID NO: 28911 - DNA, 30 bp, Homo sapiens
ggctgcccgtctggctgggacaccacagcg

SEQ ID NO: 28912 - DNA, 30 bp, Homo sapiens
tgccggctggggtgaccagggaattcttct

SEQ ID NO: 28913 - DNA, 30 bp, Homo sapiens
cagaaatccaggggggtgaggtccccaaag

SEQ ID NO: 28914 - DNA, 30 bp, Homo sapiens
aattaatcaacaggtccccaaggtcgtagg

SEQ ID NO: 28915 - DNA, 30 bp, Homo sapiens
cagtgggagcttttccaaatcgtaagcatc

SEQ ID NO: 28916 - DNA, 30 bp, Homo sapiens
cagaggttgagaacaggcacatcaaagagg

SEQ ID NO: 28917 - DNA, 30 bp, Homo sapiens
tgccggggtaggagaaagccttaagagagg

SEQ ID NO: 28918 - DNA, 30 bp, Homo sapiens
gttgcttacttcaagcaattcttcactttg

SEQ ID NO: 28919 - DNA, 30 bp, Homo sapiens
cgctggggatttctagtctcctctgggccg

SEQ ID NO: 28920 - DNA, 30 bp, Homo sapiens
taatggacatcctctgttgagacttccagt

SEQ ID NO: 28921 - DNA, 30 bp, Homo sapiens
gcacctccagctggccctccggcgaggcga

SEQ ID NO: 28922 - DNA, 30 bp, Homo sapiens
tgatgtggctgtccacctctgtctgggtgc

SEQ ID NO: 28923 - DNA, 30 bp, Homo sapiens
tcactcaactgcaagtcatttctgagggtg

SEQ ID NO: 28924 - DNA, 30 bp, Homo sapiens
tcactcagctgcaaatcatttcttaaagta

SEQ ID NO: 28925 - DNA, 30 bp, Homo sapiens
gaatggcttgctaaaacattgaaaaaatga

SEQ ID NO: 28926 - DNA, 30 bp, Homo sapiens
atttggaacaggctgttgttgacgtgatct

SEQ ID NO: 28927 - DNA, 30 bp, Homo sapiens
agctggaaaccaccttctggatccgttccc

SEQ ID NO: 28928 - DNA, 30 bp, Homo sapiens
gccaggaaatgtaagttcaaaggatcaatg

SEQ ID NO: 28929 - DNA, 30 bp, Homo sapiens
tcattagccgttgtgcttccttttccattt

SEQ ID NO: 28930 - DNA, 30 bp, Homo sapiens
cataggaggaacaatcatgccagatatcgc

SEQ ID NO: 28931 - DNA, 30 bp, Homo sapiens
cccgggagagaccctgcactggagaacttg

SEQ ID NO: 28932 - DNA, 30 bp, Homo sapiens
atcgggggtacaacaagtccggtcatggct

SEQ ID NO: 28933 - DNA, 30 bp, Homo sapiens
cattggcgggactaccagcccagacatagc

SEQ ID NO: 28934 - DNA, 30 bp, Homo sapiens
gccaggccctgaagcccccgggctggagag

SEQ ID NO: 28935 - DNA, 30 bp, Homo sapiens
tacttgcccaggctcattgtggcagtggcg

SEQ ID NO: 28936 - DNA, 30 bp, Homo sapiens
atcccataaccgcgaaggatgttaagtgta

SEQ ID NO: 28937 - DNA, 30 bp, Homo sapiens
tagaggggattcaaagtctccaaatagaag

SEQ ID NO: 28938 - DNA, 30 bp, Homo sapiens
tccaggtctcttatttgaccctttcttgcc

SEQ ID NO: 28939 - DNA, 30 bp, Homo sapiens
ttcttcttgctcttggcttttgtggccttg

SEQ ID NO: 28940 - DNA, 30 bp, Homo sapiens
aactggtttctttctgatgcattttcttga

SEQ ID NO: 28941 - DNA, 30 bp, Homo sapiens
cccaggccactctgtcccggtaatattttt

SEQ ID NO: 28942 - DNA, 30 bp, Homo sapiens
gatcggtgttgtcaggcagctgcactccca

SEQ ID NO: 28943 - DNA, 30 bp, Homo sapiens
cagacttcgcacttgtgaggcgggttcatg

SEQ ID NO: 28944 - DNA, 30 bp, Homo sapiens
acacggaacacttgtgggcagggttcatgg

SEQ ID NO: 28945 - DNA, 30 bp, Homo sapiens
gcttggagaaggtgacggttttcagttcct

SEQ ID NO: 28946 - DNA, 30 bp, Homo sapiens
cccaatgcccaaccttgaaccagcgcaaca

SEQ ID NO: 28947 - DNA, 30 bp, Homo sapiens
ttagcaatagcctctaaatttgcaggccca

SEQ ID NO: 28948 - DNA, 30 bp, Homo sapiens
aatttgggagtccgcttctccctgaaggct

SEQ ID NO: 28949 - DNA, 30 bp, Homo sapiens
acactggctcgtgtgaccagacaggttttc

SEQ ID NO: 28950 - DNA, 30 bp, Homo sapiens
cactggtctttgaagttggcctttctcttt

SEQ ID NO: 28951 - DNA, 30 bp, Homo sapiens
taagtacatctgcagggacttctggatgga

SEQ ID NO: 28952 - DNA, 30 bp, Homo sapiens
catttgtgcattcatctgatagccatcttc

SEQ ID NO: 28953 - DNA, 30 bp, Homo sapiens
ccttgggctcagaggtggagctgatatttg

SEQ ID NO: 28954 - DNA, 30 bp, Homo sapiens
ttgagtcatcatcctcttcagcattgcaaa

SEQ ID NO: 28955 - DNA, 30 bp, Homo sapiens
ccagagaggaaaggccacatctgatctgtt

SEQ ID NO: 28956 - DNA, 30 bp, Homo sapiens
ctgctgagagactttgtttgccattattca

SEQ ID NO: 28957 - DNA, 30 bp, Homo sapiens
ataagggtgatgctgtctttctctccattg

SEQ ID NO: 28958 - DNA, 30 bp, Homo sapiens
atactccaggtccagctgcatcgggtagta

SEQ ID NO: 28959 - DNA, 30 bp, Homo sapiens
ctctggccctgctgctgtcgctgcaggttg

SEQ ID NO: 28960 - DNA, 30 bp, Homo sapiens
cactcctcacatactccaggtccagctgca

SEQ ID NO: 28961 - DNA, 30 bp, Homo sapiens
accaggagtactgagagcgcccaccagtag

SEQ ID NO: 28962 - DNA, 30 bp, Homo sapiens
aaagaaggaaggaaggctgacaagggaggg

SEQ ID NO: 28963 - DNA, 30 bp, Homo sapiens
cataggaacttatcatcctctatttctgta

SEQ ID NO: 28964 - DNA, 30 bp, Homo sapiens
cattggtgtccctggtgcccgtcctgggag

SEQ ID NO: 28965 - DNA, 30 bp, Homo sapiens
tgcaggggcttcacccagcctgatggcccc

SEQ ID NO: 28966 - DNA, 30 bp, Homo sapiens
tgtaggccataagagaatgaaatgatgtag

SEQ ID NO: 28967 - DNA, 30 bp, Homo sapiens
ggctgggaacttcaaagggcacattgagct

SEQ ID NO: 28968 - DNA, 30 bp, Homo sapiens
ttcaggcccctgctgctgttgtggtatagg

SEQ ID NO: 28969 - DNA, 30 bp, Homo sapiens
atgtggctgggaggcaggtggcacaacccc

SEQ ID NO: 28970 - DNA, 30 bp, Homo sapiens
cacagccccaccaccaggtcagtgatgaag

SEQ ID NO: 28971 - DNA, 30 bp, Homo sapiens
aagcagagtgcagtgggataacaaacttgc

SEQ ID NO: 28972 - DNA, 30 bp, Homo sapiens
taagggaggctgggggtcacgaggccatgc

SEQ ID NO: 28973 - DNA, 30 bp, Homo sapiens
gataggttctataatcctcaggtcttctat

SEQ ID NO: 28974 - DNA, 30 bp, Homo sapiens
gataggttctaccatctttaggtcttctat

SEQ ID NO: 28975 - DNA, 30 bp, Homo sapiens
atctggtcaatctgtcgcatgtagatgctc

SEQ ID NO: 28976 - DNA, 30 bp, Homo sapiens
tctaggaaaacctgtcccagtaatgccaac

SEQ ID NO: 28977 - DNA, 30 bp, Homo sapiens
ccatcatttcaaatgcttctatatcttcat

SEQ ID NO: 28978 - DNA, 30 bp, Homo sapiens
cactgggctctcagcacacgagcactcctg

SEQ ID NO: 28979 - DNA, 30 bp, Homo sapiens
cagcggacccggcgaagggtggagggacac

SEQ ID NO: 28980 - DNA, 30 bp, Homo sapiens
cctaggccccttctcgatgggctttccaat

SEQ ID NO: 28981 - DNA, 30 bp, Homo sapiens
attcctcctctgtgcagcccagcagctctg

SEQ ID NO: 28982 - DNA, 30 bp, Homo sapiens
tgctcggttgtgggtcacataacgctctct

SEQ ID NO: 28983 - DNA, 30 bp, Homo sapiens
acctggaatgtgtggaccgaggctcccgca

SEQ ID NO: 28984 - DNA, 30 bp, Homo sapiens
tgctttgttggtccttgacttcaacctcct

SEQ ID NO: 28985 - DNA, 30 bp, Homo sapiens
taaggggctccttcctgaaagaggcagcgg

SEQ ID NO: 28986 - DNA, 30 bp, Homo sapiens
ttatggctgctccggtctgtgttgtggttg

SEQ ID NO: 28987 - DNA, 30 bp, Homo sapiens
ccaaggactgtttttcttcaaatgactggc

SEQ ID NO: 28988 - DNA, 30 bp, Homo sapiens
tgttgggttttggtttactgtaccatcaca

SEQ ID NO: 28989 - DNA, 30 bp, Homo sapiens
gaacggcattgctgctcgctgcactgccgg

SEQ ID NO: 28990 - DNA, 30 bp, Homo sapiens
tccttgcaagtcattgaaacatgcatcaca

SEQ ID NO: 28991 - DNA, 30 bp, Homo sapiens
gccaaatactggcatcatcacaaacagcta

SEQ ID NO: 28992 - DNA, 30 bp, Homo sapiens
ctttgatgacacccaccgcaactgtctgtc

SEQ ID NO: 28993 - DNA, 30 bp, Homo sapiens
ttctgcgccttctgcgccgacttggtgacc

SEQ ID NO: 28994 - DNA, 30 bp, Homo sapiens
gtccagcccagaatcataattcacataaca

SEQ ID NO: 28995 - DNA, 30 bp, Homo sapiens
agggcctggcatggtataatcccagcactt

SEQ ID NO: 28996 - DNA, 30 bp, Homo sapiens
ctgctacactgtttccagatctgcctccaa

SEQ ID NO: 28997 - DNA, 30 bp, Homo sapiens
agcaggtcttggttccctgtgcctggccct

SEQ ID NO: 28998 - DNA, 30 bp, Homo sapiens
tgatggtaacatccccccctgacagagctt

SEQ ID NO: 28999 - DNA, 30 bp, Homo sapiens
agctgaatggcactaaggaagtcctcatga

SEQ ID NO: 29000 - DNA, 30 bp, Homo sapiens
ctcacacagctgccctgggttcatggggga

SEQ ID NO: 29001 - DNA, 30 bp, Homo sapiens
ccatggactgcacatagtcctcaaaagcag

SEQ ID NO: 29002 - DNA, 30 bp, Homo sapiens
acttggtgatctcctcctccagcaagtctg

SEQ ID NO: 29003 - DNA, 30 bp, Homo sapiens
ctctgtgtgcctcagcttccttattataaa

SEQ ID NO: 29004 - DNA, 30 bp, Homo sapiens
tagtgggaattagtatatagtctgttcttg

SEQ ID NO: 29005 - DNA, 30 bp, Homo sapiens
ttgaaggctttgcccacatgctggaaggcc

SEQ ID NO: 29006 - DNA, 30 bp, Homo sapiens
acaatttgtccaggaagttgtccagggcag

SEQ ID NO: 29007 - DNA, 30 bp, Homo sapiens
tactcctccatctgggcccaggcctcttca

SEQ ID NO: 29008 - DNA, 30 bp, Homo sapiens
tacagggtgagattcagcattgccatctcc

SEQ ID NO: 29009 - DNA, 30 bp, Homo sapiens
gcttgtgggtgtcgaagacataacgcttga

SEQ ID NO: 29010 - DNA, 30 bp, Homo sapiens
tgttggcttcacttcgctccaaggccaccc

SEQ ID NO: 29011 - DNA, 30 bp, Homo sapiens
atctggctctttggatcaggaagacatggc

SEQ ID NO: 29012 - DNA, 30 bp, Homo sapiens
gtccatagttcagggcatattcaaagtctc

SEQ ID NO: 29013 - DNA, 30 bp, Homo sapiens
gaacagtcctttccggtaatttgggagcca

SEQ ID NO: 29014 - DNA, 30 bp, Homo sapiens
ccttggcggcatcataatgggcgtgggtca

SEQ ID NO: 29015 - DNA, 30 bp, Homo sapiens
ctttaactatcgaatcctgtattgttttta

SEQ ID NO: 29016 - DNA, 30 bp, Homo sapiens
ttcaggtacatgtcttaacattacagtaag

SEQ ID NO: 29017 - DNA, 30 bp, Homo sapiens
gctacccttagctccaggaatgagtatctt

SEQ ID NO: 29018 - DNA, 30 bp, Homo sapiens
cctcttgagaaaaaggctcaccttcttcag

SEQ ID NO: 29019 - DNA, 30 bp, Homo sapiens
cgacggagcgaaactccatcttcttcagtc

SEQ ID NO: 29020 - DNA, 30 bp, Homo sapiens
tctgtgtaacattcactggtatctgatgag

SEQ ID NO: 29021 - DNA, 30 bp, Homo sapiens
aagaggaaaaaacttccttctttccctgta

SEQ ID NO: 29022 - DNA, 30 bp, Homo sapiens
ccctggcatttttgcatacatataattgtc

SEQ ID NO: 29023 - DNA, 30 bp, Homo sapiens
tactggaggaatgcccggaggaagtcgttg

SEQ ID NO: 29024 - DNA, 30 bp, Homo sapiens
tagatttgggtcccacttctactgcaaata

SEQ ID NO: 29025 - DNA, 30 bp, Homo sapiens
atgggagctccccttcacagaggacatgaa

SEQ ID NO: 29026 - DNA, 30 bp, Homo sapiens
ttttctgcctcttctgtaatttgtcagtgt

SEQ ID NO: 29027 - DNA, 30 bp, Homo sapiens
agcaggagacgaggagggggttggtgagcg

SEQ ID NO: 29028 - DNA, 30 bp, Homo sapiens
gtgcggaaggtccctatactgctgactgtc

SEQ ID NO: 29029 - DNA, 30 bp, Homo sapiens
agaaggtgtaggcccctacaaagacggtga

SEQ ID NO: 29030 - DNA, 30 bp, Homo sapiens
atccggtctgcatgccgtagctcatctaga

SEQ ID NO: 29031 - DNA, 30 bp, Homo sapiens
ccatgagagcacatcctgattaactcctta

SEQ ID NO: 29032 - DNA, 30 bp, Homo sapiens
ctaagccaaacgcgtccttcaaaaaggtcc

SEQ ID NO: 29033 - DNA, 30 bp, Homo sapiens
agttggccttgagtttctggaaggctgcct

SEQ ID NO: 29034 - DNA, 30 bp, Homo sapiens
tacttaaaggtggactgcagctccttgaag

SEQ ID NO: 29035 - DNA, 30 bp, Homo sapiens
cttttctgcatgctccacaatcttttcttc

SEQ ID NO: 29036 - DNA, 30 bp, Homo sapiens
cacggggtttgcagcagcagaagtggaagg

SEQ ID NO: 29037 - DNA, 30 bp, Homo sapiens
cccaggagggtccagagcacggggatggtg

SEQ ID NO: 29038 - DNA, 30 bp, Homo sapiens
aggaggccaagaacgtcatgaggaagaagg

SEQ ID NO: 29039 - DNA, 30 bp, Homo sapiens
atgaggggacaggctcctgcaagagtcacc

SEQ ID NO: 29040 - DNA, 30 bp, Homo sapiens
caatgctccatcttgtcggtctgaattggc

SEQ ID NO: 29041 - DNA, 30 bp, Homo sapiens
cagagggggctgggagtgtccccccctcgc

SEQ ID NO: 29042 - DNA, 30 bp, Homo sapiens
gccaggaggaacagtaggattgccaaaagg

SEQ ID NO: 29043 - DNA, 30 bp, Homo sapiens
agtagatgttcgccgggctctggggcggca

SEQ ID NO: 29044 - DNA, 30 bp, Homo sapiens
cagaccttgtagtaaatgttcgccgggctc

SEQ ID NO: 29045 - DNA, 30 bp, Homo sapiens
taccttgtagtagatgtttggagggctctg

SEQ ID NO: 29046 - DNA, 30 bp, Homo sapiens
agtacacacacagatctggaaacttcatct

SEQ ID NO: 29047 - DNA, 30 bp, Homo sapiens
atcgggaaacttcatttcatagacggggat

SEQ ID NO: 29048 - DNA, 30 bp, Homo sapiens
tggagccaggctagtgagcagggtagtgaa

SEQ ID NO: 29049 - DNA, 30 bp, Homo sapiens
acatggggtaattgagcacaacatcctgtt

SEQ ID NO: 29050 - DNA, 30 bp, Homo sapiens
atttggtgtggtgggtccagggccctttgt

SEQ ID NO: 29051 - DNA, 30 bp, Homo sapiens
ataaaaggctatctggacataagcctgaaa

SEQ ID NO: 29052 - DNA, 30 bp, Homo sapiens
tgcaggagcaggaccccagctgctcctcca

SEQ ID NO: 29053 - DNA, 30 bp, Homo sapiens
ccgaggcccaggctgttgtcctcacaggag

SEQ ID NO: 29054 - DNA, 30 bp, Homo sapiens
acttggctccacaagtgttgatgtttttcc

SEQ ID NO: 29055 - DNA, 30 bp, Homo sapiens
atttcctttacggttttcagaatatccagt

SEQ ID NO: 29056 - DNA, 30 bp, Homo sapiens
actgtgtctgcaaatctgccactgtttccc

SEQ ID NO: 29057 - DNA, 30 bp, Homo sapiens
cagtggcaggaggaggccgtgatgatcaca

SEQ ID NO: 29058 - DNA, 30 bp, Homo sapiens
ggtgcagtttggatggcacaggtggcacac

SEQ ID NO: 29059 - DNA, 30 bp, Homo sapiens
cttaggtattctgcattttcagctgtggag

SEQ ID NO: 29060 - DNA, 30 bp, Homo sapiens
gaatctgaaggtttattgagttcaaccctc

SEQ ID NO: 29061 - DNA, 30 bp, Homo sapiens
aggtgggcgtaggcggctgtgatacaggta

SEQ ID NO: 29062 - DNA, 30 bp, Homo sapiens
gtgagggcagattcagttttcctagttaaa

SEQ ID NO: 29063 - DNA, 30 bp, Homo sapiens
agaaaaggttgctgtcatgtccgaaagccc

SEQ ID NO: 29064 - DNA, 30 bp, Homo sapiens
gtccgggtccgagaggagcaaggggcgagc

SEQ ID NO: 29065 - DNA, 30 bp, Homo sapiens
gcgcaggtggtgaccacgggggccagcgac

SEQ ID NO: 29066 - DNA, 30 bp, Homo sapiens
cgaaggagaggcccagcgagtaaaagccga

SEQ ID NO: 29067 - DNA, 30 bp, Homo sapiens
tcttggccatcttgcctttgttttgctcca

SEQ ID NO: 29068 - DNA, 30 bp, Homo sapiens
ctcagcacgcagcgctcccgccggctcaac

SEQ ID NO: 29069 - DNA, 30 bp, Homo sapiens
ctcatgtctgcgcttggagggcggcaccag

SEQ ID NO: 29070 - DNA, 30 bp, Homo sapiens
cactcggcggagcccttgtggcgtcgcttg

SEQ ID NO: 29071 - DNA, 30 bp, Homo sapiens
cactcggcaactttcctcttggacgggggc

SEQ ID NO: 29072 - DNA, 30 bp, Homo sapiens
agtcggccttgggcagggacttcctgtgcg

SEQ ID NO: 29073 - DNA, 30 bp, Homo sapiens
cctcgggcattcttcccaaatttatatacc

SEQ ID NO: 29074 - DNA, 30 bp, Homo sapiens
aagctttgccattctttcaggggagggttt

SEQ ID NO: 29075 - DNA, 30 bp, Homo sapiens
catagggggtcggcggcagccgcggagctg

SEQ ID NO: 29076 - DNA, 30 bp, Homo sapiens
ctctgggtctcttgagactccgtataaact

SEQ ID NO: 29077 - DNA, 30 bp, Homo sapiens
caaaggcagcccctcgaccttgggcttccc

SEQ ID NO: 29078 - DNA, 30 bp, Homo sapiens
gacagggggcagggagccgagctcgggcag

SEQ ID NO: 29079 - DNA, 30 bp, Homo sapiens
ccaaggagaagaggcgcaactggaagagat

SEQ ID NO: 29080 - DNA, 30 bp, Homo sapiens
gtagccttcagtttggcaggcgacggatgc

SEQ ID NO: 29081 - DNA, 30 bp, Homo sapiens
tcttcggtcagacgattgacaaccatcagt

SEQ ID NO: 29082 - DNA, 30 bp, Homo sapiens
tcttctatcagagggttgataacttcagag

SEQ ID NO: 29083 - DNA, 30 bp, Homo sapiens
cagtcggccagaggactgagggcctcggag

SEQ ID NO: 29084 - DNA, 30 bp, Homo sapiens
aaatttcaaaagctgccacaatgtttttcc

SEQ ID NO: 29085 - DNA, 30 bp, Homo sapiens
aaccttcagctgatcgtccttagccagtcc

SEQ ID NO: 29086 - DNA, 30 bp, Homo sapiens
cctcttcactctcctcctcactctcatgat

SEQ ID NO: 29087 - DNA, 30 bp, Homo sapiens
tccaggaccaaatgtatcagtttcattgat

SEQ ID NO: 29088 - DNA, 30 bp, Homo sapiens
aactggatttcatcatcatctccaggacca

SEQ ID NO: 29089 - DNA, 30 bp, Homo sapiens
accttaagctgttcctcctttacaatgcca

SEQ ID NO: 29090 - DNA, 30 bp, Homo sapiens
tccaaatcttccagctcctggagaagggct

SEQ ID NO: 29091 - DNA, 30 bp, Homo sapiens
cccccatcctttccgtcatccctcacccct

SEQ ID NO: 29092 - DNA, 30 bp, Homo sapiens
ctctgggcttttcttccacacagtcaaggt

SEQ ID NO: 29093 - DNA, 30 bp, Homo sapiens
gcttggcaaagggctatgggagttgttgga

SEQ ID NO: 29094 - DNA, 30 bp, Homo sapiens
ggcaggcgtgacagcagctgcttcacagtt

SEQ ID NO: 29095 - DNA, 30 bp, Homo sapiens
ctgagggtgtcagcacgcccaggtctgtaa

SEQ ID NO: 29096 - DNA, 30 bp, Homo sapiens
atcaggcggtagatgtaggaaggtgcattc

SEQ ID NO: 29097 - DNA, 30 bp, Homo sapiens
tccacagtgactgagttcatgagaaggcaa

SEQ ID NO: 29098 - DNA, 30 bp, Homo sapiens
tctttgcctcaagtgggtacagggggaaac

SEQ ID NO: 29099 - DNA, 30 bp, Homo sapiens
agctggtcattccccacgatcacctcattc

SEQ ID NO: 29100 - DNA, 30 bp, Homo sapiens
cactggtcactgctcttgactcgtagaaca

SEQ ID NO: 29101 - DNA, 30 bp, Homo sapiens
ctgcctcttttagccactggatgaacctct

SEQ ID NO: 29102 - DNA, 30 bp, Homo sapiens
gccaggtttgagggccttttctagaccttg

SEQ ID NO: 29103 - DNA, 30 bp, Homo sapiens
cttctgcatcatcatctccatccacttcgg

SEQ ID NO: 29104 - DNA, 30 bp, Homo sapiens
acagcctggaagccggttttgatactggca

SEQ ID NO: 29105 - DNA, 30 bp, Homo sapiens
tgttggcttgattgtcactcctcttcttat

SEQ ID NO: 29106 - DNA, 30 bp, Homo sapiens
ctgtggtccatccatcttcatcagtctcat

SEQ ID NO: 29107 - DNA, 30 bp, Homo sapiens
cactcctgattcccgaggggaatgatttct

SEQ ID NO: 29108 - DNA, 30 bp, Homo sapiens
agtaggccgtctgagactgctgctggcggt

SEQ ID NO: 29109 - DNA, 30 bp, Homo sapiens
cctcttcctcctcatcttcatcagagctga

SEQ ID NO: 29110 - DNA, 30 bp, Homo sapiens
tcttgagttgcccagttaggagcctctgac

SEQ ID NO: 29111 - DNA, 30 bp, Homo sapiens
cacaggtttacaagtttttcattgagtgca

SEQ ID NO: 29112 - DNA, 30 bp, Homo sapiens
agttggtggacggcttggcccactcgacgt

SEQ ID NO: 29113 - DNA, 30 bp, Homo sapiens
gcctgggccatgaagagcttgcctaagttt

SEQ ID NO: 29114 - DNA, 30 bp, Homo sapiens
ctgtgggtcgaagtaatggatacggacgta

SEQ ID NO: 29115 - DNA, 30 bp, Homo sapiens
tcataaccaccataatctgccagatcatct

SEQ ID NO: 29116 - DNA, 30 bp, Homo sapiens
gggaggaggccatgatgctggacacactgt

SEQ ID NO: 29117 - DNA, 30 bp, Homo sapiens
ttcttcagggttcgattaagctcctcaaat

SEQ ID NO: 29118 - DNA, 30 bp, Homo sapiens
aaaaggctgtttttcactttgttcagattt

SEQ ID NO: 29119 - DNA, 30 bp, Homo sapiens
agatgaggtcagcaacattgaggggcattt

SEQ ID NO: 29120 - DNA, 30 bp, Homo sapiens
cggccaaaccgtccacctcgaccgattctg

SEQ ID NO: 29121 - DNA, 30 bp, Homo sapiens
tcatgggcatctcctccactgtagtattgt

SEQ ID NO: 29122 - DNA, 30 bp, Homo sapiens
gagtggaatagtactgctcgatatctctga

SEQ ID NO: 29123 - DNA, 30 bp, Homo sapiens
attcggcataatcttctccctcattttcat

SEQ ID NO: 29124 - DNA, 30 bp, Homo sapiens
tttagtggtggagccgctcttagtagctgt

SEQ ID NO: 29125 - DNA, 30 bp, Homo sapiens
cacaccacaaacttgttcttggctagggag

SEQ ID NO: 29126 - DNA, 30 bp, Homo sapiens
cagcggccgctgctgttcaccaggccatga

SEQ ID NO: 29127 - DNA, 30 bp, Homo sapiens
tggtgttgggaggtaggttaagcactcgcc

SEQ ID NO: 29128 - DNA, 30 bp, Homo sapiens
ccgcggcttccagaggttttgaaaaaggag

SEQ ID NO: 29129 - DNA, 30 bp, Homo sapiens
ccaccttcaaaagcatgatgctcttcatgg

SEQ ID NO: 29130 - DNA, 30 bp, Homo sapiens
attcggaaggaagggttcgttcttgtccac

SEQ ID NO: 29131 - DNA, 30 bp, Homo sapiens
agcagggctacagataagaaaatgctggga

SEQ ID NO: 29132 - DNA, 30 bp, Homo sapiens
cactgtcggtattccaattcatctacactg

SEQ ID NO: 29133 - DNA, 30 bp, Homo sapiens
gttgtggtcagactcctcctctgcttcacg

SEQ ID NO: 29134 - DNA, 30 bp, Homo sapiens
accaggttagccactgattcacctggaaca

SEQ ID NO: 29135 - DNA, 30 bp, Homo sapiens
ttctgggacagggctccttcttgaatttaa

SEQ ID NO: 29136 - DNA, 30 bp, Homo sapiens
actcctcttctgcttcccgcagccacgtga

SEQ ID NO: 29137 - DNA, 30 bp, Homo sapiens
gaacgacttcctctctaggcctggcacccc

SEQ ID NO: 29138 - DNA, 30 bp, Homo sapiens
aaatggcatcaatatcgatgtcgtcatcct

SEQ ID NO: 29139 - DNA, 30 bp, Homo sapiens
attttgccatggccttgattgcaacagctg

SEQ ID NO: 29140 - DNA, 30 bp, Homo sapiens
tgcagggttttatggctacagcatattctt

SEQ ID NO: 29141 - DNA, 30 bp, Homo sapiens
taagctgccagtcactcttctgcatttcat

SEQ ID NO: 29142 - DNA, 30 bp, Homo sapiens
gtgaggctgtcaatgagggaatcccgcatg

SEQ ID NO: 29143 - DNA, 30 bp, Homo sapiens
agcaggatgtggtacttcagggccctgggc

SEQ ID NO: 29144 - DNA, 30 bp, Homo sapiens
tcttggagatctaacactgattcagcttgc

SEQ ID NO: 29145 - DNA, 30 bp, Homo sapiens
cactgggctctgaccttcttggcctgtggc

SEQ ID NO: 29146 - DNA, 30 bp, Homo sapiens
cagtgggtcctgctggccgggtccgggtcc

SEQ ID NO: 29147 - DNA, 30 bp, Homo sapiens
ttgtgggacttgttggttttgaaggaaacc

SEQ ID NO: 29148 - DNA, 30 bp, Homo sapiens
cggtatccattgaggctagctatcgccatg

SEQ ID NO: 29149 - DNA, 30 bp, Homo sapiens
gctgtttgctggtcttgaaggagacctgca

SEQ ID NO: 29150 - DNA, 30 bp, Homo sapiens
ttgtgggctttgttggttttaaaggaaact

SEQ ID NO: 29151 - DNA, 30 bp, Homo sapiens
cagaggtaaacagtggcctttatggttttg

SEQ ID NO: 29152 - DNA, 30 bp, Homo sapiens
gttcgttttgtttcatagctacctgagaag

SEQ ID NO: 29153 - DNA, 30 bp, Homo sapiens
tgaaggcgcactgacaaccactacgtgggt

SEQ ID NO: 29154 - DNA, 30 bp, Homo sapiens
gttccgactctggagaacctcttcctcctt

SEQ ID NO: 29155 - DNA, 30 bp, Homo sapiens
tcatggggctccatcttaatgagggaagta

SEQ ID NO: 29156 - DNA, 30 bp, Homo sapiens
acccgtgtgcattttttccaaatttgtaca

SEQ ID NO: 29157 - DNA, 30 bp, Homo sapiens
tgctgggccgacacgcccttccagtagtcc

SEQ ID NO: 29158 - DNA, 30 bp, Homo sapiens
tgctgggcggagacccccttccagtaatca

SEQ ID NO: 29159 - DNA, 30 bp, Homo sapiens
ttctggggccctggggagagcaccacgggg

SEQ ID NO: 29160 - DNA, 30 bp, Homo sapiens
tacggggcgcaatgggactcagggtaggac

SEQ ID NO: 29161 - DNA, 30 bp, Homo sapiens
tactggagaagcagctctgtccagactggg

SEQ ID NO: 29162 - DNA, 30 bp, Homo sapiens
tgtaggtctggggaaaatgggccaggggtg

SEQ ID NO: 29163 - DNA, 30 bp, Homo sapiens
agagcgagcaagctacctgtgaaaaaaatg

SEQ ID NO: 29164 - DNA, 30 bp, Homo sapiens
ctgcagctgccgctggtcgtactcggcgat

SEQ ID NO: 29165 - DNA, 30 bp, Homo sapiens
ctctgcttgctgttggtcaaattcacctat

SEQ ID NO: 29166 - DNA, 30 bp, Homo sapiens
ttcttttcctcaaactccaggatgagacct

SEQ ID NO: 29167 - DNA, 30 bp, Homo sapiens
cagttacagtcatagacgaagtcatagttg

SEQ ID NO: 29168 - DNA, 30 bp, Homo sapiens
tgctgggctccttggggatggggggtgggg

SEQ ID NO: 29169 - DNA, 30 bp, Homo sapiens
agttggtggggggtgggggcacagggggtg

SEQ ID NO: 29170 - DNA, 30 bp, Homo sapiens
ccgaggcagcaaaatgtgggcacagcgcca

SEQ ID NO: 29171 - DNA, 30 bp, Homo sapiens
tgttggtataccaggaacaaggttatagag

SEQ ID NO: 29172 - DNA, 30 bp, Homo sapiens
gccttcggatgagtgagactgcaggtcact

SEQ ID NO: 29173 - DNA, 30 bp, Homo sapiens
tacctgccacattttttacaggggaaagtg

SEQ ID NO: 29174 - DNA, 30 bp, Homo sapiens
ttccggccacaagctttccccaggcaggcc

SEQ ID NO: 29175 - DNA, 30 bp, Homo sapiens
cgtcgggagaatctgttcttgaaagcttta

SEQ ID NO: 29176 - DNA, 30 bp, Homo sapiens
cgtcgggagaatcttctcttgtagtctcga

SEQ ID NO: 29177 - DNA, 30 bp, Homo sapiens
tagtctcgaattgccttggccatcagcggg

SEQ ID NO: 29178 - DNA, 30 bp, Homo sapiens
gcgtgggtggacctgtgtgggtccgtcttg

SEQ ID NO: 29179 - DNA, 30 bp, Homo sapiens
tgcacggcttgttcattggcactgcttccc

SEQ ID NO: 29180 - DNA, 30 bp, Homo sapiens
gcagttccagtgcaatttcaggtgcaattg

SEQ ID NO: 29181 - DNA, 30 bp, Homo sapiens
gattggccgcctcgcaggcgtctatccaat

SEQ ID NO: 29182 - DNA, 30 bp, Homo sapiens
agttggccttgaccttggcaatacctggag

SEQ ID NO: 29183 - DNA, 30 bp, Homo sapiens
gctgcagtgaagtaggctttggaaaaacca

SEQ ID NO: 29184 - DNA, 30 bp, Homo sapiens
cactggctcttggtcttggctttgaccttg

SEQ ID NO: 29185 - DNA, 30 bp, Homo sapiens
atggctgtttttccagcttttggtttctta

SEQ ID NO: 29186 - DNA, 30 bp, Homo sapiens
ggcaggggcatgtgaagcaattgtggccag

SEQ ID NO: 29187 - DNA, 30 bp, Homo sapiens
gcagcttccttggcttcacattgttttcca

SEQ ID NO: 29188 - DNA, 30 bp, Homo sapiens
tttgccgatgtaggcctcaaagaagaaatg

SEQ ID NO: 29189 - DNA, 30 bp, Homo sapiens
ttcacagttttgggcaacctctgacctttg

SEQ ID NO: 29190 - DNA, 30 bp, Homo sapiens
agcaggctcagcttccactgggttcttctg

SEQ ID NO: 29191 - DNA, 30 bp, Homo sapiens
cttgcaaagtgtaaccactcagcaccttct

SEQ ID NO: 29192 - DNA, 30 bp, Homo sapiens
tttcagcatcttcaccatgtacgggccttg

SEQ ID NO: 29193 - DNA, 30 bp, Homo sapiens
aagtccaggtgcttcttgcctccggccatc

SEQ ID NO: 29194 - DNA, 30 bp, Homo sapiens
gtctggaggcaaatgcagtcgcctttgcaa

SEQ ID NO: 29195 - DNA, 30 bp, Homo sapiens
aggaggaatccctagaagtccaggtgcttc

SEQ ID NO: 29196 - DNA, 30 bp, Homo sapiens
aatccctgaccccacccccaacctctgcag

SEQ ID NO: 29197 - DNA, 30 bp, Homo sapiens
aaatatccaggtcgtcatctgggtcttctt

SEQ ID NO: 29198 - DNA, 30 bp, Homo sapiens
agcaggagacattcctttggcaaaaaagga

SEQ ID NO: 29199 - DNA, 30 bp, Homo sapiens
cccaggtgtggtcttggtcgtagttgtaag

SEQ ID NO: 29200 - DNA, 30 bp, Homo sapiens
tggtggccactaaaagaatcacctcagcca

SEQ ID NO: 29201 - DNA, 30 bp, Homo sapiens
gccaggcccgattcaggagcttcacctgtg

SEQ ID NO: 29202 - DNA, 30 bp, Homo sapiens
caccggccactacccccaccaccaccccca

SEQ ID NO: 29203 - DNA, 30 bp, Homo sapiens
gtggcggtggcgcgggccctggcgcagcag

SEQ ID NO: 29204 - DNA, 30 bp, Homo sapiens
acaatagacaaatgtcttcattctgtttct

SEQ ID NO: 29205 - DNA, 30 bp, Homo sapiens
gactgggtgatctgcaatgtttccaacatg

SEQ ID NO: 29206 - DNA, 30 bp, Homo sapiens
tagaggtctgtaattcctttttgaacatgc

SEQ ID NO: 29207 - DNA, 30 bp, Homo sapiens
ccactgaactccattctctcagggggctca

SEQ ID NO: 29208 - DNA, 30 bp, Homo sapiens
agaaggatgtaaataagacccaaatacata

SEQ ID NO: 29209 - DNA, 30 bp, Homo sapiens
cagtagacgtgcaccatgccgtagaggaac

SEQ ID NO: 29210 - DNA, 30 bp, Homo sapiens
tacctccttttgccagccccacttttgcct

SEQ ID NO: 29211 - DNA, 30 bp, Homo sapiens
tagcacaagtgtaggacagctttattgatc

SEQ ID NO: 29212 - DNA, 30 bp, Homo sapiens
cctcggcgattctggaggccaccttctctg

SEQ ID NO: 29213 - DNA, 30 bp, Homo sapiens
ccattagtgggaccaacccactgggtgatt

SEQ ID NO: 29214 - DNA, 30 bp, Homo sapiens
tcttggtttttccttgtgcagagtgctcac

SEQ ID NO: 29215 - DNA, 30 bp, Homo sapiens
agaaggggttgccttcttcagcctgcatga

SEQ ID NO: 29216 - DNA, 30 bp, Homo sapiens
atgtggctgtaaagtggtcatctgaaggta

SEQ ID NO: 29217 - DNA, 30 bp, Homo sapiens
tccagcaggagatcagggttggctgtggtc

SEQ ID NO: 29218 - DNA, 30 bp, Homo sapiens
atacttcctcaaaggctgtggtaagttttg

SEQ ID NO: 29219 - DNA, 30 bp, Homo sapiens
gcctctctcgtcccggctcctgggggccac

SEQ ID NO: 29220 - DNA, 30 bp, Homo sapiens
tacgcgtgttcaagctctgggtccccatag

SEQ ID NO: 29221 - DNA, 30 bp, Homo sapiens
tagaggtgggaaaggaaaggatataagaaa

SEQ ID NO: 29222 - DNA, 30 bp, Homo sapiens
tagttggcttgccctggccgcacctgctca

SEQ ID NO: 29223 - DNA, 30 bp, Homo sapiens
catgatgcttgtgtctttcccgcccgtgga

SEQ ID NO: 29224 - DNA, 30 bp, Homo sapiens
cagaccacccgccactgtagcacactggtg

SEQ ID NO: 29225 - DNA, 30 bp, Homo sapiens
tcgagggaggaggcgggggacagggagggg

SEQ ID NO: 29226 - DNA, 30 bp, Homo sapiens
tgcaggggcgccgttcgcgccctccaggaa

SEQ ID NO: 29227 - DNA, 30 bp, Homo sapiens
acgagggcgaagggtcttgctggtcctcca

SEQ ID NO: 29228 - DNA, 30 bp, Homo sapiens
gtgaggtgtatgtacacatttccagacaaa

SEQ ID NO: 29229 - DNA, 30 bp, Homo sapiens
gtgctgaccacatacttgtcatcataagag

SEQ ID NO: 29230 - DNA, 30 bp, Homo sapiens
ttctttctcaggaccagatagagaacgccg

SEQ ID NO: 29231 - DNA, 30 bp, Homo sapiens
ggatgggtcctctgaggctctagaaatagg

SEQ ID NO: 29232 - DNA, 30 bp, Homo sapiens
tccgtaggtggatgtagatgatgccgctga

SEQ ID NO: 29233 - DNA, 30 bp, Homo sapiens
agcagagctctgagaagggctgggttcagt

SEQ ID NO: 29234 - DNA, 30 bp, Homo sapiens
tagtcattggaggtgacatcgatgtcctcc

SEQ ID NO: 29235 - DNA, 30 bp, Homo sapiens
ctccggactcgcctgcttggtggcgattct

SEQ ID NO: 29236 - DNA, 30 bp, Homo sapiens
aatatggtgcgtcccttttttcttttgttg

SEQ ID NO: 29237 - DNA, 30 bp, Homo sapiens
tcctggaccgtggtggtggagtggttgtac

SEQ ID NO: 29238 - DNA, 30 bp, Homo sapiens
tactcgctgtccgacttgccctccttggct

SEQ ID NO: 29239 - DNA, 30 bp, Homo sapiens
tgcagtatttgacttgctcagttcctgcct

SEQ ID NO: 29240 - DNA, 30 bp, Homo sapiens
ggcctgaagtagtaagcagtcttgtacctg

SEQ ID NO: 29241 - DNA, 30 bp, Homo sapiens
tccaggtgctgacaaatgcagtaggaatca

SEQ ID NO: 29242 - DNA, 30 bp, Homo sapiens
agccaatccgcttgcagacactaaaaacca

SEQ ID NO: 29243 - DNA, 30 bp, Homo sapiens
cttactgcccgccgtgatggccttgaggct

SEQ ID NO: 29244 - DNA, 30 bp, Homo sapiens
aggtggaagacactatgtaggctgtggcga

SEQ ID NO: 29245 - DNA, 30 bp, Homo sapiens
ccccacctggtgctgggctgtgctgcggcg

SEQ ID NO: 29246 - DNA, 30 bp, Homo sapiens
tctcctttggggcatgccactggcctctgc

SEQ ID NO: 29247 - DNA, 30 bp, Homo sapiens
tactgccagtccttgcccgcctgctcctgg

SEQ ID NO: 29248 - DNA, 30 bp, Homo sapiens
ctgtgggggcctggggtactcacgcgtgtg

SEQ ID NO: 29249 - DNA, 30 bp, Homo sapiens
tgctggtggagcagggggtgctctgggtgc

SEQ ID NO: 29250 - DNA, 30 bp, Homo sapiens
atgcaggggctgaataaagcagaactgccc

SEQ ID NO: 29251 - DNA, 30 bp, Homo sapiens
gggctgcagcaggtagctgccttcatggct

SEQ ID NO: 29252 - DNA, 30 bp, Homo sapiens
tcacgaagactttgggccgagaaaagatct

SEQ ID NO: 29253 - DNA, 30 bp, Homo sapiens
tcgtgttctagttgtttcatttcttcttcc

SEQ ID NO: 29254 - DNA, 30 bp, Homo sapiens
acttggccaaggggtttctgaagttcctgc

SEQ ID NO: 29255 - DNA, 30 bp, Homo sapiens
cactgggattacggaagttatgtccggcaa

SEQ ID NO: 29256 - DNA, 30 bp, Homo sapiens
acttggccttcgggttacggaacttgcgtc

SEQ ID NO: 29257 - DNA, 30 bp, Homo sapiens
ccagaggatgctcctgtttcggctgattcc

SEQ ID NO: 29258 - DNA, 30 bp, Homo sapiens
ttgaggaaggcaggtatagttcactgaagg

SEQ ID NO: 29259 - DNA, 30 bp, Homo sapiens
agcaggaaggagtttcttccaaacttcacc

SEQ ID NO: 29260 - DNA, 30 bp, Homo sapiens
aaggcacacagcttccatcttttttccagc

SEQ ID NO: 29261 - DNA, 30 bp, Homo sapiens
aagccacagaatttccatctcttttccagg

SEQ ID NO: 29262 - DNA, 30 bp, Homo sapiens
tctgatggtgtttctatgttgttttagcca

SEQ ID NO: 29263 - DNA, 30 bp, Homo sapiens
taaaggttggcaaatgtgttttcaacttta

SEQ ID NO: 29264 - DNA, 30 bp, Homo sapiens
tgcaggtatgtcttgagtgtcaggatttct

SEQ ID NO: 29265 - DNA, 30 bp, Homo sapiens
gacaggctgcactttatcctgatagaagtc

SEQ ID NO: 29266 - DNA, 30 bp, Homo sapiens
taaaggatcatcatcatcttcttgtagctg

SEQ ID NO: 29267 - DNA, 30 bp, Homo sapiens
gtaaggcaggtatttgactgtgaattaaat

SEQ ID NO: 29268 - DNA, 30 bp, Homo sapiens
agcaggaagagaagaatcagtgccagggca

SEQ ID NO: 29269 - DNA, 30 bp, Homo sapiens
acagaagaatcacggtccccagcagtccca

SEQ ID NO: 29270 - DNA, 30 bp, Homo sapiens
acttggccacccgcaagcttgctggtgacg

SEQ ID NO: 29271 - DNA, 30 bp, Homo sapiens
aagcttgctggtgacgagcgaggactttct

SEQ ID NO: 29272 - DNA, 30 bp, Homo sapiens
cttctgttcaacaacaaaacctccagaaaa

SEQ ID NO: 29273 - DNA, 30 bp, Homo sapiens
agaagactgggggacctgggaagactggct

SEQ ID NO: 29274 - DNA, 30 bp, Homo sapiens
tgcaggagacagagtggattcatcctgtat

SEQ ID NO: 29275 - DNA, 30 bp, Homo sapiens
atatgaaggcttgtgaaagataagcaagcc

SEQ ID NO: 29276 - DNA, 30 bp, Homo sapiens
aaatggtgcttggcagcttggcggagtgca

SEQ ID NO: 29277 - DNA, 30 bp, Homo sapiens
ctcctctgtgaatttgtaaccgttcacaaa

SEQ ID NO: 29278 - DNA, 30 bp, Homo sapiens
gcatggtcaaaggcatgctcggagtgcctc

SEQ ID NO: 29279 - DNA, 30 bp, Homo sapiens
acaaggtccccggggcattctgggcgggaa

SEQ ID NO: 29280 - DNA, 30 bp, Homo sapiens
caatgggagatgcccagagactgcaacagg

SEQ ID NO: 29281 - DNA, 30 bp, Homo sapiens
ccatcctttaacagggctgtgatgtagctg

SEQ ID NO: 29282 - DNA, 30 bp, Homo sapiens
acctcagtacggcagcctgtaagactgtgc

SEQ ID NO: 29283 - DNA, 30 bp, Homo sapiens
atgaggctggactcttctgtctgttcaggg

SEQ ID NO: 29284 - DNA, 30 bp, Homo sapiens
aaagccgaactcctggagtagcaggctgac

SEQ ID NO: 29285 - DNA, 30 bp, Homo sapiens
ggccccacctgtactcccatcatgggcacc

SEQ ID NO: 29286 - DNA, 30 bp, Homo sapiens
agtcctgcaaccagaagagctggaccaagg

SEQ ID NO: 29287 - DNA, 30 bp, Homo sapiens
gcaaggaatgttcttattctttgtaggagc

SEQ ID NO: 29288 - DNA, 30 bp, Homo sapiens
ctttgggtgttgcaatacgtggtctgcagc

SEQ ID NO: 29289 - DNA, 30 bp, Homo sapiens
catgccttttgaggtgtctttactatactc

SEQ ID NO: 29290 - DNA, 30 bp, Homo sapiens
gagaggtttgaattcaagtctgagttatcg

SEQ ID NO: 29291 - DNA, 30 bp, Homo sapiens
tactggcacggaggcttagtaggtgtcttt

SEQ ID NO: 29292 - DNA, 30 bp, Homo sapiens
aggtggcctggtccagggctctgaggaggt

SEQ ID NO: 29293 - DNA, 30 bp, Homo sapiens
cctgtggggatttgcccattgatgttaaga

SEQ ID NO: 29294 - DNA, 30 bp, Homo sapiens
tctcggtctcctggtggacgaccaccttgg

SEQ ID NO: 29295 - DNA, 30 bp, Homo sapiens
gcttcttgtccctctcctctggggatgggt

SEQ ID NO: 29296 - DNA, 30 bp, Homo sapiens
cctcagccaactctgtttctttgtgtacca

SEQ ID NO: 29297 - DNA, 30 bp, Homo sapiens
catcttctggtgtgatctctgtctctttat

SEQ ID NO: 29298 - DNA, 30 bp, Homo sapiens
catggtcaatgtctgcatcccccgtgatga

SEQ ID NO: 29299 - DNA, 30 bp, Homo sapiens
tatggcttcttcaagttcttccttctgatc

SEQ ID NO: 29300 - DNA, 30 bp, Homo sapiens
ttgaggcgggaagcttgtatagtttttatt

SEQ ID NO: 29301 - DNA, 30 bp, Homo sapiens
ccaaccacagcagccaaggaggtggggctc

SEQ ID NO: 29302 - DNA, 30 bp, Homo sapiens
gttcggtcatcaacagtcttttcatcatct

SEQ ID NO: 29303 - DNA, 30 bp, Homo sapiens
taagttcttctggttctggtcgtggacata

SEQ ID NO: 29304 - DNA, 30 bp, Homo sapiens
tcatggctgtatggccaggaaaatgaacat

SEQ ID NO: 29305 - DNA, 30 bp, Homo sapiens
cagtggtcagtaaacacttctgcttcagga

SEQ ID NO: 29306 - DNA, 30 bp, Homo sapiens
gagctcagtggtcagtaaacacttctgctt

SEQ ID NO: 29307 - DNA, 30 bp, Homo sapiens
caggggctaccacggtgacgcttttatagt

SEQ ID NO: 29308 - DNA, 30 bp, Homo sapiens
tcgctactgtgttgtctgctatgttgttca

SEQ ID NO: 29309 - DNA, 30 bp, Homo sapiens
ctactgttgtctctgctattccatttaagc

SEQ ID NO: 29310 - DNA, 30 bp, Homo sapiens
gcatctcacccatctcctttatctcagcct

SEQ ID NO: 29311 - DNA, 30 bp, Homo sapiens
tctcgtccagcacccgcacgcgctggttga

SEQ ID NO: 29312 - DNA, 30 bp, Homo sapiens
accaggagcagtcttcgctcatcttctcca

SEQ ID NO: 29313 - DNA, 30 bp, Homo sapiens
atgtggtccaaataatgcacttctggatac

SEQ ID NO: 29314 - DNA, 30 bp, Homo sapiens
cagtggtcgtctttctccagaacagacatt

SEQ ID NO: 29315 - DNA, 30 bp, Homo sapiens
atccctgaatactgcaaagaatgcgcttct

SEQ ID NO: 29316 - DNA, 30 bp, Homo sapiens
acacctgcaccccctggccctgcagctgga

SEQ ID NO: 29317 - DNA, 30 bp, Homo sapiens
ccacggcccccagccaactggataccttcg

SEQ ID NO: 29318 - DNA, 30 bp, Homo sapiens
agatggggatccccacagtgttcacctggt

SEQ ID NO: 29319 - DNA, 30 bp, Homo sapiens
tccagcggctgttcgggctcggatttggaa

SEQ ID NO: 29320 - DNA, 30 bp, Homo sapiens
acacgggaactgggccattctttgattgcg

SEQ ID NO: 29321 - DNA, 30 bp, Homo sapiens
agacgggaaccattctgccgtgcatctgct

SEQ ID NO: 29322 - DNA, 30 bp, Homo sapiens
tcacctgagccacagcgtccattgaactgt

SEQ ID NO: 29323 - DNA, 30 bp, Homo sapiens
cgtttaccagctgcaccttcatttcttgaa

SEQ ID NO: 29324 - DNA, 30 bp, Homo sapiens
tcctgtatgtgcatcatgtgtaaacgtaaa

SEQ ID NO: 29325 - DNA, 30 bp, Homo sapiens
gtttggaagaggtcagttgttgtataagca

SEQ ID NO: 29326 - DNA, 30 bp, Homo sapiens
agaagcagcggcctttggaggctccatggc

SEQ ID NO: 29327 - DNA, 30 bp, Homo sapiens
tgctggtagcctgctttgcagatacatttt

SEQ ID NO: 29328 - DNA, 30 bp, Homo sapiens
ccatgtaaatgtagcatttgtgctctcata

SEQ ID NO: 29329 - DNA, 30 bp, Homo sapiens
gctctgggtcctggtgaggagcgcagggcc

SEQ ID NO: 29330 - DNA, 30 bp, Homo sapiens
cagaggtgccggcggggcccctgggtgctg

SEQ ID NO: 29331 - DNA, 30 bp, Homo sapiens
ccgttggtgactgacttatctggaccctca

SEQ ID NO: 29332 - DNA, 30 bp, Homo sapiens
cagactgaatctggttcatctgcgcccgca

SEQ ID NO: 29333 - DNA, 30 bp, Homo sapiens
caagaacagtcattgctttccttatgagaa

SEQ ID NO: 29334 - DNA, 30 bp, Homo sapiens
cacaggcagcgtctggttcatctgcagccg

SEQ ID NO: 29335 - DNA, 30 bp, Homo sapiens
ctgcggggccggtcctcctgtcccacccgg

SEQ ID NO: 29336 - DNA, 30 bp, Homo sapiens
ctgagccctgctgcctcaggtgttgctgaa

SEQ ID NO: 29337 - DNA, 30 bp, Homo sapiens
cagcaccgacaggaacttgcggatgtcctg

SEQ ID NO: 29338 - DNA, 30 bp, Homo sapiens
caccggtgggttccgggcatcagaatccag

SEQ ID NO: 29339 - DNA, 30 bp, Homo sapiens
gtccagcaggtcttgcaagaaggcccacat

SEQ ID NO: 29340 - DNA, 30 bp, Homo sapiens
ggttggtcttgctgaagccaatgactggct

SEQ ID NO: 29341 - DNA, 30 bp, Homo sapiens
tcctggctagctgcctcttcgtcaatgtag

SEQ ID NO: 29342 - DNA, 30 bp, Homo sapiens
tacaggctacacacagaagaacgaaccttc

SEQ ID NO: 29343 - DNA, 30 bp, Homo sapiens
aaccgggctccatttcagttgtggcaaccc

SEQ ID NO: 29344 - DNA, 30 bp, Homo sapiens
tataggaggaagggattagtgttgggggcc

SEQ ID NO: 29345 - DNA, 30 bp, Homo sapiens
agaaggaaagggttggttgtgccagtggcc

SEQ ID NO: 29346 - DNA, 30 bp, Homo sapiens
cagaggaaggggttggtgccggtctgcggg

SEQ ID NO: 29347 - DNA, 30 bp, Homo sapiens
catctgtcccctgtcctgcaggcctcccct

SEQ ID NO: 29348 - DNA, 30 bp, Homo sapiens
tgatcccccagaatttgaggccagggggct

SEQ ID NO: 29349 - DNA, 30 bp, Homo sapiens
agcaagccacatagctggggggcagaggct

SEQ ID NO: 29350 - DNA, 30 bp, Homo sapiens
agttggctttggattggaagttgttattgt

SEQ ID NO: 29351 - DNA, 30 bp, Homo sapiens
ttcaggcagttggctttggattggaagttg

SEQ ID NO: 29352 - DNA, 30 bp, Homo sapiens
gagaggcctttctgaagtctaaacatttct

SEQ ID NO: 29353 - DNA, 30 bp, Homo sapiens
cactgtagagagagagaaagaaataggagc

SEQ ID NO: 29354 - DNA, 30 bp, Homo sapiens
gtagctgcgaccaaataaggtgtagtactt

SEQ ID NO: 29355 - DNA, 30 bp, Homo sapiens
ctaagtcttcttgttcctgctgatttagtc

SEQ ID NO: 29356 - DNA, 30 bp, Homo sapiens
cagaggtgaagtctgcaaagcccgaggcag

SEQ ID NO: 29357 - DNA, 30 bp, Homo sapiens
aggcggcaggcatgtcagccttgctgagcg

SEQ ID NO: 29358 - DNA, 30 bp, Homo sapiens
ccatggctccaaaactgcccctctctgcca

SEQ ID NO: 29359 - DNA, 30 bp, Homo sapiens
tacaggtgtacttttaccttggacatctgg

SEQ ID NO: 29360 - DNA, 30 bp, Homo sapiens
tcaaaagattccactcctgaatcactagcg

SEQ ID NO: 29361 - DNA, 30 bp, Homo sapiens
tttccacctcgccttccaccttcttctttt

SEQ ID NO: 29362 - DNA, 30 bp, Homo sapiens
tgtcctcccccctcctctgattcatggaat

SEQ ID NO: 29363 - DNA, 30 bp, Homo sapiens
taagggcttatccccagcatccttctgaca

SEQ ID NO: 29364 - DNA, 30 bp, Homo sapiens
aacatgcataaatgaggacaaggagaagcc

SEQ ID NO: 29365 - DNA, 30 bp, Homo sapiens
tgttaccgctattcatattccaacagcctc

SEQ ID NO: 29366 - DNA, 30 bp, Homo sapiens
gtccctcgccaggctgataggttcaacctg

SEQ ID NO: 29367 - DNA, 30 bp, Homo sapiens
aacaggcagacgaggtagacacatgtatgc

SEQ ID NO: 29368 - DNA, 30 bp, Homo sapiens
caccgggtaaccgactcatcgttttcatgc

SEQ ID NO: 29369 - DNA, 30 bp, Homo sapiens
ttgaggagcttcacagagaggcggatgtca

SEQ ID NO: 29370 - DNA, 30 bp, Homo sapiens
gcgtcagcttcaggatcatgttcaagcttt

SEQ ID NO: 29371 - DNA, 30 bp, Homo sapiens
aaccgatgttttcttcaatggtttcaattg

SEQ ID NO: 29372 - DNA, 30 bp, Homo sapiens
gccaagtcctcagagtcggaagattcttct

SEQ ID NO: 29373 - DNA, 30 bp, Homo sapiens
ttggagagtggatagtagatatcaaagtac

SEQ ID NO: 29374 - DNA, 30 bp, Homo sapiens
ggccacagagcagccacagtggcaggtggc

SEQ ID NO: 29375 - DNA, 30 bp, Homo sapiens
gagtgggtgcagttgatggggcaaggctgg

SEQ ID NO: 29376 - DNA, 30 bp, Homo sapiens
cactggcacgtccagacccaggtactctgg

SEQ ID NO: 29377 - DNA, 30 bp, Homo sapiens
agatgagctgcggtgcctgtggtggaccat

SEQ ID NO: 29378 - DNA, 30 bp, Homo sapiens
ctctgggcattagccttggggaaaagcctg

SEQ ID NO: 29379 - DNA, 30 bp, Homo sapiens
gacagcggccaaggtgacaggcaccttgga

SEQ ID NO: 29380 - DNA, 30 bp, Homo sapiens
tattccggtgtctgtaaggtggaggcggca

SEQ ID NO: 29381 - DNA, 30 bp, Homo sapiens
atgaggaaacttctcgtacaatgatgagtt

SEQ ID NO: 29382 - DNA, 30 bp, Homo sapiens
aagaggactcttccagggcgttgaccactt

SEQ ID NO: 29383 - DNA, 30 bp, Homo sapiens
ctttgggatgcaacggattctgcccccggg

SEQ ID NO: 29384 - DNA, 30 bp, Homo sapiens
tatgcccatatgccctcctcgtcatcctgg

SEQ ID NO: 29385 - DNA, 30 bp, Homo sapiens
aggcggaagccactgtgtctggtctttggt

SEQ ID NO: 29386 - DNA, 30 bp, Homo sapiens
agaagggctcgtgcaggacatcaaacagcc

SEQ ID NO: 29387 - DNA, 30 bp, Homo sapiens
cagagctgctgagcaatctgctctatcctc

SEQ ID NO: 29388 - DNA, 30 bp, Homo sapiens
gcttccacagtgctgagcctggcctttggc

SEQ ID NO: 29389 - DNA, 30 bp, Homo sapiens
gcgcttgaagagcgggtgtacatgtttgct

SEQ ID NO: 29390 - DNA, 30 bp, Homo sapiens
gatacgacttctgcaaaagaggtgtgaatg

SEQ ID NO: 29391 - DNA, 30 bp, Homo sapiens
tcttcccctcgcacgtcttagtttccttct

SEQ ID NO: 29392 - DNA, 30 bp, Homo sapiens
tccttcaccaccagaagttctatggaaagt

SEQ ID NO: 29393 - DNA, 30 bp, Homo sapiens
ttcaggatctgcactttttatgtcaagcgc

SEQ ID NO: 29394 - DNA, 30 bp, Homo sapiens
tccaggatgtccttcgtaagacaagaccct

SEQ ID NO: 29395 - DNA, 30 bp, Homo sapiens
tattggttgcgttttcatctgtatcacttg

SEQ ID NO: 29396 - DNA, 30 bp, Homo sapiens
agaatgtgagaacaggatccagacttcaag

SEQ ID NO: 29397 - DNA, 30 bp, Homo sapiens
tcatcactgctgctccaggcatcttcaaag

SEQ ID NO: 29398 - DNA, 30 bp, Homo sapiens
agacttgcggcaactctggatcccctgagg

SEQ ID NO: 29399 - DNA, 30 bp, Homo sapiens
ggagtctcggtgctccagggagagctgggc

SEQ ID NO: 29400 - DNA, 30 bp, Homo sapiens
acacgcccaggaggacagcactgaagtggg

SEQ ID NO: 29401 - DNA, 30 bp, Homo sapiens
tgagaaggcatatggctggtggggagccta

SEQ ID NO: 29402 - DNA, 30 bp, Homo sapiens
tttgcaaggcggctacttgttggtccaaga

SEQ ID NO: 29403 - DNA, 30 bp, Homo sapiens
gtgtggtctttgaatgaaatggtttgagtg

SEQ ID NO: 29404 - DNA, 30 bp, Homo sapiens
tttctcttcttctgtctggatactggttct

SEQ ID NO: 29405 - DNA, 30 bp, Homo sapiens
agctggatcttcttccaggcctcagaggct

SEQ ID NO: 29406 - DNA, 30 bp, Homo sapiens
gtgtggccatcctcaaaaggaacagaattg

SEQ ID NO: 29407 - DNA, 30 bp, Homo sapiens
ttctggatggctcgtgctgagtggtagatg

SEQ ID NO: 29408 - DNA, 30 bp, Homo sapiens
ctgttgggcctgccgacgaaggagcacgta

SEQ ID NO: 29409 - DNA, 30 bp, Homo sapiens
tggtggtggagtgccctctattggtaagga

SEQ ID NO: 29410 - DNA, 30 bp, Homo sapiens
tgaaggcctgagtctcaaagaatttttggt

SEQ ID NO: 29411 - DNA, 30 bp, Homo sapiens
cagacatgccagtgacagccacaccattgt

SEQ ID NO: 29412 - DNA, 30 bp, Homo sapiens
agaacggcttcgatgtctgcttgaagatga

SEQ ID NO: 29413 - DNA, 30 bp, Homo sapiens
tgttggcaatgttcttgcagtcgtcttttt

SEQ ID NO: 29414 - DNA, 30 bp, Homo sapiens
tagtcactgctcttctcaggaaggatatgt

SEQ ID NO: 29415 - DNA, 30 bp, Homo sapiens
gtcagggcaggaggcatcgtgcaatgttct

SEQ ID NO: 29416 - DNA, 30 bp, Homo sapiens
tgtttgttctttgctgtctttacagtatct

SEQ ID NO: 29417 - DNA, 30 bp, Homo sapiens
tcaccttcgtcagagctctcgtcactcagc

SEQ ID NO: 29418 - DNA, 30 bp, Homo sapiens
cctgcacgttgttgggggaaacatctgcag

SEQ ID NO: 29419 - DNA, 30 bp, Homo sapiens
atcatcatctcaaagtcaggtggatgtggg

SEQ ID NO: 29420 - DNA, 30 bp, Homo sapiens
atgtggctgctgaaaggtccaccacttctc

SEQ ID NO: 29421 - DNA, 30 bp, Homo sapiens
ctgtgacaaagggcaattagttttagagaa

SEQ ID NO: 29422 - DNA, 30 bp, Homo sapiens
taaaaccagagtttagagagcatcttcttc

SEQ ID NO: 29423 - DNA, 30 bp, Homo sapiens
gttggggagagaaagaagtccattttcatc

SEQ ID NO: 29424 - DNA, 30 bp, Homo sapiens
ctctctttgttttggatgacgttctctcca

SEQ ID NO: 29425 - DNA, 30 bp, Homo sapiens
tggccgtctccaagggttcatcttctaagc

SEQ ID NO: 29426 - DNA, 30 bp, Homo sapiens
tatgaagattcctgggaaaaatcattttcc

SEQ ID NO: 29427 - DNA, 30 bp, Homo sapiens
aaagaaggagccttgagctcctgaagggct

SEQ ID NO: 29428 - DNA, 30 bp, Homo sapiens
gttcttttcgtaactggtgtaagccaccag

SEQ ID NO: 29429 - DNA, 30 bp, Homo sapiens
ctgattttccgataggatattgtattgtat

SEQ ID NO: 29430 - DNA, 30 bp, Homo sapiens
cccaggcagagggaaatgtccaatctggga

SEQ ID NO: 29431 - DNA, 30 bp, Homo sapiens
cagagggcgtctggagtcactgggggctgg

SEQ ID NO: 29432 - DNA, 30 bp, Homo sapiens
cacctccctgtggccccagggcatggcctc

SEQ ID NO: 29433 - DNA, 30 bp, Homo sapiens
ttctggcatatttgctatcaatttctcaga

SEQ ID NO: 29434 - DNA, 30 bp, Homo sapiens
tgtcgggtgagttggaagcctttagatgga

SEQ ID NO: 29435 - DNA, 30 bp, Homo sapiens
ctttggagtctttccttctgattcacgatt

SEQ ID NO: 29436 - DNA, 30 bp, Homo sapiens
tacagctcctctttctcggcccccttcttc

SEQ ID NO: 29437 - DNA, 30 bp, Homo sapiens
ttcactgggtgctagtttctggaaggagct

SEQ ID NO: 29438 - DNA, 30 bp, Homo sapiens
cataggataaatgtttacgcttcacgtggc

SEQ ID NO: 29439 - DNA, 30 bp, Homo sapiens
caagtctgaactgggatgtgagctaacttt

SEQ ID NO: 29440 - DNA, 30 bp, Homo sapiens
tagaagggtgactcttgaatattgcgagga

SEQ ID NO: 29441 - DNA, 30 bp, Homo sapiens
ccgcgggcgattttcagggggagttgttgg

SEQ ID NO: 29442 - DNA, 30 bp, Homo sapiens
ttgccctatttgaaacttgacatgaagttt

SEQ ID NO: 29443 - DNA, 30 bp, Homo sapiens
aagaggagaaagcaggctattaagtgcagc

SEQ ID NO: 29444 - DNA, 30 bp, Homo sapiens
tagtttcccggaatctttgcccactggcat

SEQ ID NO: 29445 - DNA, 30 bp, Homo sapiens
ctcaggaggggtgcctttgatgtcattaac

SEQ ID NO: 29446 - DNA, 30 bp, Homo sapiens
agccagcttgactctgggcaggcaccatca

SEQ ID NO: 29447 - DNA, 30 bp, Homo sapiens
attgaccagtgccacagtactgtgttgcaa

SEQ ID NO: 29448 - DNA, 30 bp, Homo sapiens
acttggttgcaaataacttgccatctggtg

SEQ ID NO: 29449 - DNA, 30 bp, Homo sapiens
ttcaggtatttagcatgatgtctgatgtgg

SEQ ID NO: 29450 - DNA, 30 bp, Homo sapiens
ttttggtttttatagatttaatcaacattg

SEQ ID NO: 29451 - DNA, 30 bp, Homo sapiens
gcgtggatttaaccatttcctcattacggg

SEQ ID NO: 29452 - DNA, 30 bp, Homo sapiens
agagacaggcaagccataggctataggtgc

SEQ ID NO: 29453 - DNA, 30 bp, Homo sapiens
gtacttagcgatgtcccccttcttcaggat

SEQ ID NO: 29454 - DNA, 30 bp, Homo sapiens
ttgaacatctcagcttccttctccttccag

SEQ ID NO: 29455 - DNA, 30 bp, Homo sapiens
acgaggaaaccacttgtttccaaatatttt

SEQ ID NO: 29456 - DNA, 30 bp, Homo sapiens
ccgtggcagggaaaccctctgcctcccccg

SEQ ID NO: 29457 - DNA, 30 bp, Homo sapiens
ctgtgggttctgggagccctctttgctttt

SEQ ID NO: 29458 - DNA, 30 bp, Homo sapiens
ttgcttcaggcaaaagagtctccatcttca

SEQ ID NO: 29459 - DNA, 30 bp, Homo sapiens
gtgggacaggagcatcaggaggttagccag

SEQ ID NO: 29460 - DNA, 30 bp, Homo sapiens
atgcctgacgtgggacaggagcatcaggag

SEQ ID NO: 29461 - DNA, 30 bp, Homo sapiens
ctccagtattgtaggccaggccctgcattc

SEQ ID NO: 29462 - DNA, 30 bp, Homo sapiens
ctttgggtagagtcctggcctggtcatttg

SEQ ID NO: 29463 - DNA, 30 bp, Homo sapiens
tgctgggtagtacgctgtggagggctgcag

SEQ ID NO: 29464 - DNA, 30 bp, Homo sapiens
aacacacccattccttgggggcttgtaaca

SEQ ID NO: 29465 - DNA, 30 bp, Homo sapiens
tccatcatggcctcgagcatctccaagaac

SEQ ID NO: 29466 - DNA, 30 bp, Homo sapiens
acatggtgagccagagatgctttccctggc

SEQ ID NO: 29467 - DNA, 30 bp, Homo sapiens
ccttggcctccaacatttccaaaaaaagtt

SEQ ID NO: 29468 - DNA, 30 bp, Homo sapiens
ctttgcgccgggcagggagctgcagcaggt

SEQ ID NO: 29469 - DNA, 30 bp, Homo sapiens
tgatgtgtacaggagccaggccagtgtgag

SEQ ID NO: 29470 - DNA, 30 bp, Homo sapiens
agctgcccttgtccttgttgtccatcaggt

SEQ ID NO: 29471 - DNA, 30 bp, Homo sapiens
ctgaggcctcgtcccatcttccgtgaggtc

SEQ ID NO: 29472 - DNA, 30 bp, Homo sapiens
ttctgggctgtccatttggagtcagctcat

SEQ ID NO: 29473 - DNA, 30 bp, Homo sapiens
tcctttcttctgtgtgagccaagtggccta

SEQ ID NO: 29474 - DNA, 30 bp, Homo sapiens
atgaggctcgtgctttagccattctccgaa

SEQ ID NO: 29475 - DNA, 30 bp, Homo sapiens
agtcatcaaggtcaaaaaattcatcgtctc

SEQ ID NO: 29476 - DNA, 30 bp, Homo sapiens
tctgccacttggaaaattggagcttctggg

SEQ ID NO: 29477 - DNA, 30 bp, Homo sapiens
aatctccttcagcttggccaccaggtcctc

SEQ ID NO: 29478 - DNA, 30 bp, Homo sapiens
actgtgcttgttgtcagtccactgttttcc

SEQ ID NO: 29479 - DNA, 30 bp, Homo sapiens
taagcaggtcctcctccaccttcaggtacc

SEQ ID NO: 29480 - DNA, 30 bp, Homo sapiens
ctaaggaagtacaaagcttctagctctttc

SEQ ID NO: 29481 - DNA, 30 bp, Homo sapiens
cagtgggtgtctgcaccccacagcgcatgt

SEQ ID NO: 29482 - DNA, 30 bp, Homo sapiens
ctcaggcttcattttaaagtactggttaaa

SEQ ID NO: 29483 - DNA, 30 bp, Homo sapiens
ccctctgcagccggttaatccaaaacatct

SEQ ID NO: 29484 - DNA, 30 bp, Homo sapiens
cgatggtggagtactggttctggatgaggg

SEQ ID NO: 29485 - DNA, 30 bp, Homo sapiens
ctttggcatctccaaggctgacgcttgagg

SEQ ID NO: 29486 - DNA, 30 bp, Homo sapiens
actgagcagtgaatgtgtatccgtgcacat

SEQ ID NO: 29487 - DNA, 30 bp, Homo sapiens
ctcgtcggcatctggcttgacgtccagcat

SEQ ID NO: 29488 - DNA, 30 bp, Homo sapiens
tcctccgtgtcgggctggacgcccaggatg

SEQ ID NO: 29489 - DNA, 30 bp, Homo sapiens
ttgtaggggtgggggttgcagcagccccct

SEQ ID NO: 29490 - DNA, 30 bp, Homo sapiens
ccgcctcccgcacagtccggataggctagg

SEQ ID NO: 29491 - DNA, 30 bp, Homo sapiens
ccctggggtcctgacccattccagagaaac

SEQ ID NO: 29492 - DNA, 30 bp, Homo sapiens
gaccgaatgttgatgaatgggtagttgggc

SEQ ID NO: 29493 - DNA, 30 bp, Homo sapiens
aggaggatccaagggccacactgctttgag

SEQ ID NO: 29494 - DNA, 30 bp, Homo sapiens
ccttggggccaaatggctgggcggggccag

SEQ ID NO: 29495 - DNA, 30 bp, Homo sapiens
cttcggcataggggaggctgctgcagcggt

SEQ ID NO: 29496 - DNA, 30 bp, Homo sapiens
gcattcatcttcttggtatatttgttcatc

SEQ ID NO: 29497 - DNA, 30 bp, Homo sapiens
acggagagatttctggcctcttgtccttga

SEQ ID NO: 29498 - DNA, 30 bp, Homo sapiens
cactggaaactccatatgaatatgaagatc

SEQ ID NO: 29499 - DNA, 30 bp, Homo sapiens
tagtagcgattcaggctcctggtcccgggc

SEQ ID NO: 29500 - DNA, 30 bp, Homo sapiens
agtaatagtgcatgcggcccagggtgcccg

SEQ ID NO: 29501 - DNA, 30 bp, Homo sapiens
aactggcccatgtttcttgggagcgaggtg

SEQ ID NO: 29502 - DNA, 30 bp, Homo sapiens
gtccccagcttcactttcttgctgactcag

SEQ ID NO: 29503 - DNA, 30 bp, Homo sapiens
tccctgtgtctctatgtcttctcatggcct

SEQ ID NO: 29504 - DNA, 30 bp, Homo sapiens
ccaaggccctcatggcctttttggcattca

SEQ ID NO: 29505 - DNA, 30 bp, Homo sapiens
tcatcttttctttcccttgtagctgtgagc

SEQ ID NO: 29506 - DNA, 30 bp, Homo sapiens
aggtggaggtggcagggattcattaagatc

SEQ ID NO: 29507 - DNA, 30 bp, Homo sapiens
aaaaggaggttggcctgagaagcccctctg

SEQ ID NO: 29508 - DNA, 30 bp, Homo sapiens
cagtggttgaatacgactctcttcttctcg

SEQ ID NO: 29509 - DNA, 30 bp, Homo sapiens
ttgtccagaccctggctgtagggcgcggcc

SEQ ID NO: 29510 - DNA, 30 bp, Homo sapiens
acgtggtgctgatcccactcagctcctgcc

SEQ ID NO: 29511 - DNA, 30 bp, Homo sapiens
cagcgaagggagcgcgggacggtgggggag

SEQ ID NO: 29512 - DNA, 30 bp, Homo sapiens
atgaggagaggaagatggacacagaatccg

SEQ ID NO: 29513 - DNA, 30 bp, Homo sapiens
atctagtgaggggcacctcctccctctggt

SEQ ID NO: 29514 - DNA, 30 bp, Homo sapiens
ccctctggtccggcgggctcacggccgtct

SEQ ID NO: 29515 - DNA, 30 bp, Homo sapiens
tttcattatgctgccggctgagtactgagt

SEQ ID NO: 29516 - DNA, 30 bp, Homo sapiens
agtagggccgatctctgcgctcctgacggt

SEQ ID NO: 29517 - DNA, 30 bp, Homo sapiens
aaaaggacttatccaggaatcgatcttctc

SEQ ID NO: 29518 - DNA, 30 bp, Homo sapiens
agctggatgggaagatcttccccgaatttc

SEQ ID NO: 29519 - DNA, 30 bp, Homo sapiens
actcgggagaagagggctgtgctcctgcca

SEQ ID NO: 29520 - DNA, 30 bp, Homo sapiens
agaagggactgctggccgggctgggggctg

SEQ ID NO: 29521 - DNA, 30 bp, Homo sapiens
tttttccagagctcattgagtttgatctgt

SEQ ID NO: 29522 - DNA, 30 bp, Homo sapiens
tactggaatattgctctttgaacacggcca

SEQ ID NO: 29523 - DNA, 30 bp, Homo sapiens
tagagctgagcactccactgccctttctcc

SEQ ID NO: 29524 - DNA, 30 bp, Homo sapiens
tagtgggactgtgcaatgctggaacaataa

SEQ ID NO: 29525 - DNA, 30 bp, Homo sapiens
gagtggcaagggacatagggacaagcacac

SEQ ID NO: 29526 - DNA, 30 bp, Homo sapiens
gcttggaaacaggtgagctgcaagtgcatg

SEQ ID NO: 29527 - DNA, 30 bp, Homo sapiens
gcttggccacgttcaggctgggcaccacaa

SEQ ID NO: 29528 - DNA, 30 bp, Homo sapiens
agcagggctcgggcgcaggaccccgagggc

SEQ ID NO: 29529 - DNA, 30 bp, Homo sapiens
gcgctgggcccgaggtcgcgctagagacgg

SEQ ID NO: 29530 - DNA, 30 bp, Homo sapiens
cgcaggtgatcagcacagccatggcactgg

SEQ ID NO: 29531 - DNA, 30 bp, Homo sapiens
taaacggtagttatcttcttgtccttggtg

SEQ ID NO: 29532 - DNA, 30 bp, Homo sapiens
agttctccactccgactatagagctccctt

SEQ ID NO: 29533 - DNA, 30 bp, Homo sapiens
gcaaggcgggcagatctataatcagcacga

SEQ ID NO: 29534 - DNA, 30 bp, Homo sapiens
tgctgggacataccattcaccaaacttctc

SEQ ID NO: 29535 - DNA, 30 bp, Homo sapiens
atgagtggtggctgctgatgagtcctcgga

SEQ ID NO: 29536 - DNA, 30 bp, Homo sapiens
cactgggtttacccggaggtacttgcagtt

SEQ ID NO: 29537 - DNA, 30 bp, Homo sapiens
cagaggtgtcgaaaaggcgatcgatcatgt

SEQ ID NO: 29538 - DNA, 30 bp, Homo sapiens
tgagaccagggcagagactgatatccccaa

SEQ ID NO: 29539 - DNA, 30 bp, Homo sapiens
atgttgtactttcaggattcacacgaataa

SEQ ID NO: 29540 - DNA, 30 bp, Homo sapiens
atctgggttcctgactgctccttagctttg

SEQ ID NO: 29541 - DNA, 30 bp, Homo sapiens
accttgtctttttcagttgctcggacatct

SEQ ID NO: 29542 - DNA, 30 bp, Homo sapiens
attcgggttgtactcgggctactttccgga

SEQ ID NO: 29543 - DNA, 30 bp, Homo sapiens
ctgtggccagttgtacctgaagcctctgtc

SEQ ID NO: 29544 - DNA, 30 bp, Homo sapiens
tatccctcctgttccaaaagcctctggcgt

SEQ ID NO: 29545 - DNA, 30 bp, Homo sapiens
atctggagaagatctgttttctttgatctg

SEQ ID NO: 29546 - DNA, 30 bp, Homo sapiens
atctggagctaatagcctgcacatttggtc

SEQ ID NO: 29547 - DNA, 30 bp, Homo sapiens
gcaagatagaggcctcacgcacatgctgcc

SEQ ID NO: 29548 - DNA, 30 bp, Homo sapiens
ctcttggagtaacgcctctgcagcgattcc

SEQ ID NO: 29549 - DNA, 30 bp, Homo sapiens
ggctgggcggcggcgcccctgcggcgggcg

SEQ ID NO: 29550 - DNA, 30 bp, Homo sapiens
cccaggaatccaactttctgtctcttgggc

SEQ ID NO: 29551 - DNA, 30 bp, Homo sapiens
atttgggtttcatactcttaattacttcat

SEQ ID NO: 29552 - DNA, 30 bp, Homo sapiens
cactggtggtctgtgttcttattttctttg

SEQ ID NO: 29553 - DNA, 30 bp, Homo sapiens
agttctgactctttgtcattttcatccagg

SEQ ID NO: 29554 - DNA, 30 bp, Homo sapiens
agtcgctcaatgtctcggtatttcttcctc

SEQ ID NO: 29555 - DNA, 30 bp, Homo sapiens
tgttggggaagctcttcagcttctcaggaa

SEQ ID NO: 29556 - DNA, 30 bp, Homo sapiens
tagggcttctccaggctgcggtacttcttg

SEQ ID NO: 29557 - DNA, 30 bp, Homo sapiens
aactgggaaatcataatgttggagtatctt

SEQ ID NO: 29558 - DNA, 30 bp, Homo sapiens
gatgaacttgaagcacttggtcttgtcatg

SEQ ID NO: 29559 - DNA, 30 bp, Homo sapiens
tacaggtactccagttccaaggcatggtgc

SEQ ID NO: 29560 - DNA, 30 bp, Homo sapiens
ataaatactccagctccagggcgtgcctca

SEQ ID NO: 29561 - DNA, 30 bp, Homo sapiens
aactggatgaagagtatcagggcagttggt

SEQ ID NO: 29562 - DNA, 30 bp, Homo sapiens
gcctggtgaagggatactaggtctccatgg

SEQ ID NO: 29563 - DNA, 30 bp, Homo sapiens
gcttggtggagagccaggaggtctgagtga

SEQ ID NO: 29564 - DNA, 30 bp, Homo sapiens
acatgttgccagcccatctgagaaaacata

SEQ ID NO: 29565 - DNA, 30 bp, Homo sapiens
tttgttcatctccatcataaacattgtatc

SEQ ID NO: 29566 - DNA, 30 bp, Homo sapiens
acctggtcatgctgtataaacctttctata

SEQ ID NO: 29567 - DNA, 30 bp, Homo sapiens
taaaggacgtcggtctccctctcgatcccc

SEQ ID NO: 29568 - DNA, 30 bp, Homo sapiens
caagggatttccatttctctttcgatgccg

SEQ ID NO: 29569 - DNA, 30 bp, Homo sapiens
tacagggcctcgaactcgtcgatgcgctgc

SEQ ID NO: 29570 - DNA, 30 bp, Homo sapiens
atgcggaaggtgatgggggtcttgagccgg

SEQ ID NO: 29571 - DNA, 30 bp, Homo sapiens
taatggagaggacgttatgacctccggggc

SEQ ID NO: 29572 - DNA, 30 bp, Homo sapiens
cacactgcttgagttttctccagaatccag

SEQ ID NO: 29573 - DNA, 30 bp, Homo sapiens
accaggaatgacgaggtctgtttgaattct

SEQ ID NO: 29574 - DNA, 30 bp, Homo sapiens
aaacggtgtgctcccggatccaggccaggt

SEQ ID NO: 29575 - DNA, 30 bp, Homo sapiens
acatggaaggtcgtctttgaatctgcacgt

SEQ ID NO: 29576 - DNA, 30 bp, Homo sapiens
gtcacattgcattctaagtatagatccagt

SEQ ID NO: 29577 - DNA, 30 bp, Homo sapiens
actctccaaactgatcaatgaccttctgta

SEQ ID NO: 29578 - DNA, 30 bp, Homo sapiens
agcaggtatccattttacttgccatcaact

SEQ ID NO: 29579 - DNA, 30 bp, Homo sapiens
aataggaggtcttaacagtggttgaacttg

SEQ ID NO: 29580 - DNA, 30 bp, Homo sapiens
ttctggtttttgacatgagaaaataaagga

SEQ ID NO: 29581 - DNA, 30 bp, Homo sapiens
cactggagcaaagaggagtgggtgcccatg

SEQ ID NO: 29582 - DNA, 30 bp, Homo sapiens
tgaaacattcagtggggagttctccttcca

SEQ ID NO: 29583 - DNA, 30 bp, Homo sapiens
agctctgccccactcctgcctttctacact

SEQ ID NO: 29584 - DNA, 30 bp, Homo sapiens
agttccaggcgaagtgcaatactttgattc

SEQ ID NO: 29585 - DNA, 30 bp, Homo sapiens
aaatggggctcgcaggaggactcctgggcg

SEQ ID NO: 29586 - DNA, 30 bp, Homo sapiens
gtagaggtcctgtgcctcgcagcccagaac

SEQ ID NO: 29587 - DNA, 30 bp, Homo sapiens
cctgagggggagatggtttcttgcagaacg

SEQ ID NO: 29588 - DNA, 30 bp, Homo sapiens
tccagttgacataccgggataccttggtat

SEQ ID NO: 29589 - DNA, 30 bp, Homo sapiens
ttcaggtggggtttctctggagtgagggtg

SEQ ID NO: 29590 - DNA, 30 bp, Homo sapiens
ggatgactgcttttcaggggtcatcagtcg

SEQ ID NO: 29591 - DNA, 30 bp, Homo sapiens
aaaactttcctggacagacccagcccccaa

SEQ ID NO: 29592 - DNA, 30 bp, Homo sapiens
cacagcaggatgaggctggggtggcgcagc

SEQ ID NO: 29593 - DNA, 30 bp, Homo sapiens
cacgtcttctgtgctttcggccaagcactg

SEQ ID NO: 29594 - DNA, 30 bp, Homo sapiens
caaagggctgggattacaggcgtgagccac

SEQ ID NO: 29595 - DNA, 30 bp, Homo sapiens
atgcggtttccaaggtgcacattttccacg

SEQ ID NO: 29596 - DNA, 30 bp, Homo sapiens
ggcgaactccttctggcacatggggcagct

SEQ ID NO: 29597 - DNA, 30 bp, Homo sapiens
cagcgggacacaggtgggggcgggagttga

SEQ ID NO: 29598 - DNA, 30 bp, Homo sapiens
actgccagggtcattcaaagtcttgcacat

SEQ ID NO: 29599 - DNA, 30 bp, Homo sapiens
aaagggctgggattacaggcgtgagccacc

SEQ ID NO: 29600 - DNA, 30 bp, Homo sapiens
acctgggctgcgtgaagaaggcatggatct

SEQ ID NO: 29601 - DNA, 30 bp, Homo sapiens
tcatggtattggtgattatgtcgccgttga

SEQ ID NO: 29602 - DNA, 30 bp, Homo sapiens
gagtttgagactgagtttgatgatactttc

SEQ ID NO: 29603 - DNA, 30 bp, Homo sapiens
ggcttctactccttcatatacataagtctg

SEQ ID NO: 29604 - DNA, 30 bp, Homo sapiens
tctcataagtgcgagtgcaaactgcagtgc

SEQ ID NO: 29605 - DNA, 30 bp, Homo sapiens
tcgtggaagtgacgcctttcatgacgcatt

SEQ ID NO: 29606 - DNA, 30 bp, Homo sapiens
tacaggtgacattgttcatgacacactcca

SEQ ID NO: 29607 - DNA, 30 bp, Homo sapiens
tcttgctcacgcgctcataggtcacgcctc

SEQ ID NO: 29608 - DNA, 30 bp, Homo sapiens
gaatggaaggaggagggaagaagaaggaag

SEQ ID NO: 29609 - DNA, 30 bp, Homo sapiens
catagtggcgaacagcaaccacatcaccaa

SEQ ID NO: 29610 - DNA, 30 bp, Homo sapiens
cgtagattctggtgctgacaatattattca

SEQ ID NO: 29611 - DNA, 30 bp, Homo sapiens
aggacgcttcggaggtagatgcgtctgagt

SEQ ID NO: 29612 - DNA, 30 bp, Homo sapiens
tattggtgaagataggcatctagccagagc

SEQ ID NO: 29613 - DNA, 30 bp, Homo sapiens
tgaaggtaggcgtccagccacagcttccca

SEQ ID NO: 29614 - DNA, 30 bp, Homo sapiens
ctgatggaggtaggcgtccagccagatgtc

SEQ ID NO: 29615 - DNA, 30 bp, Homo sapiens
tacagccccacaagctcagtgatgggtggg

SEQ ID NO: 29616 - DNA, 30 bp, Homo sapiens
aaaagggtttcttgagggaacaactttacc

SEQ ID NO: 29617 - DNA, 30 bp, Homo sapiens
gtccggcctcctgtagcgtagggggattgg

SEQ ID NO: 29618 - DNA, 30 bp, Homo sapiens
tgatggcaggagagcaggcagcacttttcc

SEQ ID NO: 29619 - DNA, 30 bp, Homo sapiens
attcctgtagtctcacaggaagtgttgctg

SEQ ID NO: 29620 - DNA, 30 bp, Homo sapiens
aaacgggaagctgagggaggattgcttgac

SEQ ID NO: 29621 - DNA, 30 bp, Homo sapiens
cgtgtatgccagcctcgatctcatcgtttt

SEQ ID NO: 29622 - DNA, 30 bp, Homo sapiens
tgatgggcccagtgactagggagggcagtg

SEQ ID NO: 29623 - DNA, 30 bp, Homo sapiens
caccaccttgttgatgatgacacctagttc

SEQ ID NO: 29624 - DNA, 30 bp, Homo sapiens
tttccgcttcccactactgacagcctttat

SEQ ID NO: 29625 - DNA, 30 bp, Homo sapiens
tctcggttagtgccaaaaagctgcaggaag

SEQ ID NO: 29626 - DNA, 30 bp, Homo sapiens
caatggctttcaatcacaactggctcgtag

SEQ ID NO: 29627 - DNA, 30 bp, Homo sapiens
tggaagatgatgactgccaaaggttgtact

SEQ ID NO: 29628 - DNA, 30 bp, Homo sapiens
gtaaggaggccgctggttgtaaccataatg

SEQ ID NO: 29629 - DNA, 30 bp, Homo sapiens
cagaggccgccctcggtgctgtaggctgtg

SEQ ID NO: 29630 - DNA, 30 bp, Homo sapiens
ttccggcccgctggccctgtccgggctatt

SEQ ID NO: 29631 - DNA, 30 bp, Homo sapiens
aagtctgaagtgcacactctagaggataaa

SEQ ID NO: 29632 - DNA, 30 bp, Homo sapiens
ctgctgcaggctgttgaagtgagcctcctt

SEQ ID NO: 29633 - DNA, 30 bp, Homo sapiens
ctgctgtgaagtattgagttttatttcagg

SEQ ID NO: 29634 - DNA, 30 bp, Homo sapiens
gactggaatgtggtagtggcggtcgttctc

SEQ ID NO: 29635 - DNA, 30 bp, Homo sapiens
gttctgtgcctattacacccagatttatga

SEQ ID NO: 29636 - DNA, 30 bp, Homo sapiens
agctctctctcttcgctggtcagtgtggca

SEQ ID NO: 29637 - DNA, 30 bp, Homo sapiens
actcctgggcttgggcgacttcttggcctg

SEQ ID NO: 29638 - DNA, 30 bp, Homo sapiens
gtcattttctgctccagctcgaggcattta

SEQ ID NO: 29639 - DNA, 30 bp, Homo sapiens
cagagcctgcatcccccaaaaccaggccac

SEQ ID NO: 29640 - DNA, 30 bp, Homo sapiens
ctgttcctcacattttgagtggctcccctg

SEQ ID NO: 29641 - DNA, 30 bp, Homo sapiens
cttcagctgctgggctctcccgagcctgcc

SEQ ID NO: 29642 - DNA, 30 bp, Homo sapiens
acatgggagaccttctgtgactctctagct

SEQ ID NO: 29643 - DNA, 30 bp, Homo sapiens
atcgggaaggtttgcttcctcgggtccggc

SEQ ID NO: 29644 - DNA, 30 bp, Homo sapiens
cctcggactcgcgcggcggtccgcgggcgc

SEQ ID NO: 29645 - DNA, 30 bp, Homo sapiens
cactcatcatttctacatcctgctgattta

SEQ ID NO: 29646 - DNA, 30 bp, Homo sapiens
gttcaatctgatgatcttgaagtgatgact

SEQ ID NO: 29647 - DNA, 30 bp, Homo sapiens
cccttgtcattctgcttgtatacagtgaag

SEQ ID NO: 29648 - DNA, 30 bp, Homo sapiens
tagaggaggagagcaatgagccagctacaa

SEQ ID NO: 29649 - DNA, 30 bp, Homo sapiens
cacggctgtgctttcaaacaactggtctgg

SEQ ID NO: 29650 - DNA, 30 bp, Homo sapiens
agctcatgtctgtgtgattcaatcttgttc

SEQ ID NO: 29651 - DNA, 30 bp, Homo sapiens
gaccatcagggagctctggaaaagcacagg

SEQ ID NO: 29652 - DNA, 30 bp, Homo sapiens
cttcagcttcctcaattggttctggtggtg

SEQ ID NO: 29653 - DNA, 30 bp, Homo sapiens
tcttctaacttcctctttgcacagtcctgg

SEQ ID NO: 29654 - DNA, 30 bp, Homo sapiens
atttcactgtgtgctgcagatgagccattt

SEQ ID NO: 29655 - DNA, 30 bp, Homo sapiens
gagcagcttctctgcggcaagcgctgtctg

SEQ ID NO: 29656 - DNA, 30 bp, Homo sapiens
acgaggtaccgaggaaaacaaacaatggat

SEQ ID NO: 29657 - DNA, 30 bp, Homo sapiens
cataggaatggccactcatcaaataacaga

SEQ ID NO: 29658 - DNA, 30 bp, Homo sapiens
tggtggttttgtggttttctttgagacttt

SEQ ID NO: 29659 - DNA, 30 bp, Homo sapiens
ccactggtcatgctcatactgtctgcttcc

SEQ ID NO: 29660 - DNA, 30 bp, Homo sapiens
tccgttgtgccacagtttctagcttttgct

SEQ ID NO: 29661 - DNA, 30 bp, Homo sapiens
acatggcagcttgcttgacccggaagcgga

SEQ ID NO: 29662 - DNA, 30 bp, Homo sapiens
acctgggagcgagaccgaccttgatgaagc

SEQ ID NO: 29663 - DNA, 30 bp, Homo sapiens
tagtggaataaatggagaagccgcttgggc

SEQ ID NO: 29664 - DNA, 30 bp, Homo sapiens
acttgggtgagagatcatccatcaagatga

SEQ ID NO: 29665 - DNA, 30 bp, Homo sapiens
atctggtcaaggcaggaatttcttctcctt

SEQ ID NO: 29666 - DNA, 30 bp, Homo sapiens
tcagaaggtgacacaggagagtttgtgaca

SEQ ID NO: 29667 - DNA, 30 bp, Homo sapiens
ttgtgggccatacactagatttggggtttg

SEQ ID NO: 29668 - DNA, 30 bp, Homo sapiens
aagaggtctttgggcttctgttcaacagaa

SEQ ID NO: 29669 - DNA, 30 bp, Homo sapiens
aaagtagctggaagtagacttcccagtctt

SEQ ID NO: 29670 - DNA, 30 bp, Homo sapiens
ccattgatcaaaggggcactgttgactctt

SEQ ID NO: 29671 - DNA, 30 bp, Homo sapiens
cttcctttggaagaggagggggtggggatg

SEQ ID NO: 29672 - DNA, 30 bp, Homo sapiens
tgtcgttatccccggggccagccgaccctg

SEQ ID NO: 29673 - DNA, 30 bp, Homo sapiens
ttgaggcaaagctaactggtttctcaggtc

SEQ ID NO: 29674 - DNA, 30 bp, Homo sapiens
aggtgaagacctcagggagctatgatggca

SEQ ID NO: 29675 - DNA, 30 bp, Homo sapiens
acttgcagatgaaggagacattctgaaatt

SEQ ID NO: 29676 - DNA, 30 bp, Homo sapiens
aggaggtctctgctgacctgattgatgctt

SEQ ID NO: 29677 - DNA, 30 bp, Homo sapiens
acctgggatattagctgcatattgaaactt

SEQ ID NO: 29678 - DNA, 30 bp, Homo sapiens
cactcctctgagggcagctctgggaaactc

SEQ ID NO: 29679 - DNA, 30 bp, Homo sapiens
actcagtctgcacccctgcactgtcctcgg

SEQ ID NO: 29680 - DNA, 30 bp, Homo sapiens
tcttggggtaggccgaaaactccagacaga

SEQ ID NO: 29681 - DNA, 30 bp, Homo sapiens
ctccggaatgttcctggagaaggcggtggg

SEQ ID NO: 29682 - DNA, 30 bp, Homo sapiens
ctctggctctgcctcatcctcatctaagga

SEQ ID NO: 29683 - DNA, 30 bp, Homo sapiens
tgttggcctcgccttcctcctcatcaaagg

SEQ ID NO: 29684 - DNA, 30 bp, Homo sapiens
cagttatagaacacctcgtcctcctcccag

SEQ ID NO: 29685 - DNA, 30 bp, Homo sapiens
cttgtgacttgatccagacttctttttctt

SEQ ID NO: 29686 - DNA, 30 bp, Homo sapiens
gtcaggacttgaactagcagccttcttttt

SEQ ID NO: 29687 - DNA, 30 bp, Homo sapiens
gagtgaatcagctgtattgggcaatgcatt

SEQ ID NO: 29688 - DNA, 30 bp, Homo sapiens
cttgaagtagttgagtcctgccaccaagaa

SEQ ID NO: 29689 - DNA, 30 bp, Homo sapiens
gataagagagcctccttcatcttcttggtc

SEQ ID NO: 29690 - DNA, 30 bp, Homo sapiens
acatggacttggaatcagtgtctctcttgc

SEQ ID NO: 29691 - DNA, 30 bp, Homo sapiens
gcttggctttaattttcttgtactctctgt

SEQ ID NO: 29692 - DNA, 30 bp, Homo sapiens
atagttttggccacatcttgcttgctgatg

SEQ ID NO: 29693 - DNA, 30 bp, Homo sapiens
ctgcaaaaaattgcagctcatttttaacag

SEQ ID NO: 29694 - DNA, 30 bp, Homo sapiens
acttggaatctcctcttgaaagtcaaagtt

SEQ ID NO: 29695 - DNA, 30 bp, Homo sapiens
ggtccctgcctggttcgagagactggtctg

SEQ ID NO: 29696 - DNA, 30 bp, Homo sapiens
tgagccagcaagtccttgtggtagccctgg

SEQ ID NO: 29697 - DNA, 30 bp, Homo sapiens
caaatagtcaggctgtacctgtttgatttc

SEQ ID NO: 29698 - DNA, 30 bp, Homo sapiens
atttcaggacattccaccggcttttcttgc

SEQ ID NO: 29699 - DNA, 30 bp, Homo sapiens
ctcctcattggttgagttttcttccagcgt

SEQ ID NO: 29700 - DNA, 30 bp, Homo sapiens
gtcaggccctcctctagggcaggcagtgtc

SEQ ID NO: 29701 - DNA, 30 bp, Homo sapiens
accactgcttgagcagcctctgaaacatta

SEQ ID NO: 29702 - DNA, 30 bp, Homo sapiens
cataggtcagggttgggtacagaggcttcc

SEQ ID NO: 29703 - DNA, 30 bp, Homo sapiens
ttgagggctttggtttttccatttgacttg

SEQ ID NO: 29704 - DNA, 30 bp, Homo sapiens
agtcacccaagatcttgtagcacagaatgg

SEQ ID NO: 29705 - DNA, 30 bp, Homo sapiens
ttgaggggcccacagcctgagatgagaggg

SEQ ID NO: 29706 - DNA, 30 bp, Homo sapiens
tggaggaagcatgatattttacaaatgcga

SEQ ID NO: 29707 - DNA, 30 bp, Homo sapiens
taccaccatgaaggcaacgtctgcataggg

SEQ ID NO: 29708 - DNA, 30 bp, Homo sapiens
cttccggggctggggagacgttctggcgag

SEQ ID NO: 29709 - DNA, 30 bp, Homo sapiens
cattggcttcatctttttccttgtaagaat

SEQ ID NO: 29710 - DNA, 30 bp, Homo sapiens
ttctggtgactgatgagacagctcctccag

SEQ ID NO: 29711 - DNA, 30 bp, Homo sapiens
ttttggccttcatagctgcttcctctttca

SEQ ID NO: 29712 - DNA, 30 bp, Homo sapiens
cagccaatgcagcttcttcacgccacttag

SEQ ID NO: 29713 - DNA, 30 bp, Homo sapiens
ccttggattggtgaaggcctcacgcccaga

SEQ ID NO: 29714 - DNA, 30 bp, Homo sapiens
cagccgtccgtatgtaaaagggggagctgt

SEQ ID NO: 29715 - DNA, 30 bp, Homo sapiens
ccctgccacgagcctgggggctccccaagc

SEQ ID NO: 29716 - DNA, 30 bp, Homo sapiens
ccttccagtaggccctccgggtgctgttgc

SEQ ID NO: 29717 - DNA, 30 bp, Homo sapiens
aaccattttctctttgtgttcccccaccct

SEQ ID NO: 29718 - DNA, 30 bp, Homo sapiens
cccaggttctgagggtatgttctgggaagt

SEQ ID NO: 29719 - DNA, 30 bp, Homo sapiens
ccaagagctgcttctggaaggtgctgaggc

SEQ ID NO: 29720 - DNA, 30 bp, Homo sapiens
cagagagagaacctccgagagttgatgttc

SEQ ID NO: 29721 - DNA, 30 bp, Homo sapiens
cagagggtgaagcgccgggcgctgatgttc

SEQ ID NO: 29722 - DNA, 30 bp, Homo sapiens
gtgtgggggcacgtagctgtacgcaggggt

SEQ ID NO: 29723 - DNA, 30 bp, Homo sapiens
ctgagggggcacatagctgtaagtgggcgt

SEQ ID NO: 29724 - DNA, 30 bp, Homo sapiens
ggtcagcttagctttcttcttagcaggtcc

SEQ ID NO: 29725 - DNA, 30 bp, Homo sapiens
gactggaccttgtaagcttgcctggtggct

SEQ ID NO: 29726 - DNA, 30 bp, Homo sapiens
ctttggagaatgaaacacacagcctggaca

SEQ ID NO: 29727 - DNA, 30 bp, Homo sapiens
gctgtgctgagagcacctcaccctggggcc

SEQ ID NO: 29728 - DNA, 30 bp, Homo sapiens
caggggcctctcctcccgtttctgccaggg

SEQ ID NO: 29729 - DNA, 30 bp, Homo sapiens
cagcggccgctcctcccgccgctgccacgg

SEQ ID NO: 29730 - DNA, 30 bp, Homo sapiens
ttatgggaatcagtgggcgttcctctcgct

SEQ ID NO: 29731 - DNA, 30 bp, Homo sapiens
acagctcttcgtgcttgatgcggtgggagc

SEQ ID NO: 29732 - DNA, 30 bp, Homo sapiens
agctggcctgagaaataaggccccccggga

SEQ ID NO: 29733 - DNA, 30 bp, Homo sapiens
cgccaagcgcggtatctggaataccaaact

SEQ ID NO: 29734 - DNA, 30 bp, Homo sapiens
agctggaaatgcatcgatgtacagggcctc

SEQ ID NO: 29735 - DNA, 30 bp, Homo sapiens
catcctgttctaaaggtgtcaattccatat

SEQ ID NO: 29736 - DNA, 30 bp, Homo sapiens
cttcatcatcctcttcatttagtggcgcca

SEQ ID NO: 29737 - DNA, 30 bp, Homo sapiens
gactggattttgcttgctttccataattac

SEQ ID NO: 29738 - DNA, 30 bp, Homo sapiens
ctgaggaatggcctctgtcacatcctgttg

SEQ ID NO: 29739 - DNA, 30 bp, Homo sapiens
agatgtctttccaggggctgaaatactggg

SEQ ID NO: 29740 - DNA, 30 bp, Homo sapiens
gggaggtactcccggctgtgaggagcgcat

SEQ ID NO: 29741 - DNA, 30 bp, Homo sapiens
caggggaaggggtcaaggatggaggcccag

SEQ ID NO: 29742 - DNA, 30 bp, Homo sapiens
tagaggtagccaaagacattgaagatgggt

SEQ ID NO: 29743 - DNA, 30 bp, Homo sapiens
tcccggtgcgccccctcctcccccggcgcc

SEQ ID NO: 29744 - DNA, 30 bp, Homo sapiens
ttgtggtgatcatctcctaagccccacgtt

SEQ ID NO: 29745 - DNA, 30 bp, Homo sapiens
taccgggcaaaccactcctggcgctgggga

SEQ ID NO: 29746 - DNA, 30 bp, Homo sapiens
tcctggtgcggagagccctgtttctgctgg

SEQ ID NO: 29747 - DNA, 30 bp, Homo sapiens
gtttcagggactgaaaccaactttgccttc

SEQ ID NO: 29748 - DNA, 30 bp, Homo sapiens
ttggagggatgcaagagattttcggaaggt

SEQ ID NO: 29749 - DNA, 30 bp, Homo sapiens
tcaacagccggggaatatctgggtgtcccc

SEQ ID NO: 29750 - DNA, 30 bp, Homo sapiens
tagggggagaagctgggacaacagtgaaat

SEQ ID NO: 29751 - DNA, 30 bp, Homo sapiens
gcacctgtgtgcttctcctgcccggggaag

SEQ ID NO: 29752 - DNA, 30 bp, Homo sapiens
tacctggtccagaacgtcagcgccgaagac

SEQ ID NO: 29753 - DNA, 30 bp, Homo sapiens
cacaggacagtctctcggatgaccccaatg

SEQ ID NO: 29754 - DNA, 30 bp, Homo sapiens
ctcccggctgcccccgttgaggctgaggct

SEQ ID NO: 29755 - DNA, 30 bp, Homo sapiens
tagggggcctcgaggaaggtgttggttcgg

SEQ ID NO: 29756 - DNA, 30 bp, Homo sapiens
ttgaggccaggagttcgagaccagcctggg

SEQ ID NO: 29757 - DNA, 30 bp, Homo sapiens
cagtgggcagcaaaggtggcttttttcaag

SEQ ID NO: 29758 - DNA, 30 bp, Homo sapiens
tgagctgtgctaggagtggttttcttgagg

SEQ ID NO: 29759 - DNA, 30 bp, Homo sapiens
taaaggaaccagagtttccatcttccgtgc

SEQ ID NO: 29760 - DNA, 30 bp, Homo sapiens
cagatccaccagaagcatttctttttcacc

SEQ ID NO: 29761 - DNA, 30 bp, Homo sapiens
tatgggtcctcgtccctgaagagtgtgagg

SEQ ID NO: 29762 - DNA, 30 bp, Homo sapiens
gtgcattgatataggtgataagaattttgg

SEQ ID NO: 29763 - DNA, 30 bp, Homo sapiens
tcatggtcttcctcagtcactttcaaggac

SEQ ID NO: 29764 - DNA, 30 bp, Homo sapiens
tcttgggtgaattctcgtggtcttaatttt

SEQ ID NO: 29765 - DNA, 30 bp, Homo sapiens
taatgggttaccctagttgttttgacttta

SEQ ID NO: 29766 - DNA, 30 bp, Homo sapiens
tggttttgactttgtgtccactgctgcagc

SEQ ID NO: 29767 - DNA, 30 bp, Homo sapiens
ttgtccaggccgtgacccccaagagctatc

SEQ ID NO: 29768 - DNA, 30 bp, Homo sapiens
ctacaggaccaacctgagtaatctggcagc

SEQ ID NO: 29769 - DNA, 30 bp, Homo sapiens
tggtctttatcctcccgccgggctgcgtgc

SEQ ID NO: 29770 - DNA, 30 bp, Homo sapiens
agtcaggaacacatgaagataatgctaccc

SEQ ID NO: 29771 - DNA, 30 bp, Homo sapiens
cataagttcattccagtctggaacacagga

SEQ ID NO: 29772 - DNA, 30 bp, Homo sapiens
ttgcttttggtttcccatctcttctttgct

SEQ ID NO: 29773 - DNA, 30 bp, Homo sapiens
ggttgggtgccctggtttgttggcacaagc

SEQ ID NO: 29774 - DNA, 30 bp, Homo sapiens
cactgggggcatcacagaagatcaggcctt

SEQ ID NO: 29775 - DNA, 30 bp, Homo sapiens
gacgtagctgttgtggcattaatgcgtttc

SEQ ID NO: 29776 - DNA, 30 bp, Homo sapiens
cagagctggccgccatcttccagctgcatc

SEQ ID NO: 29777 - DNA, 30 bp, Homo sapiens
tcccagctccaaaggggttaatgtcaaaac

SEQ ID NO: 29778 - DNA, 30 bp, Homo sapiens
gcctggaagaatcacttttcccccaactta

SEQ ID NO: 29779 - DNA, 30 bp, Homo sapiens
gctactcctaaatggagctgctattttttc

SEQ ID NO: 29780 - DNA, 30 bp, Homo sapiens
agctagagctttcttctccccatattttac

SEQ ID NO: 29781 - DNA, 30 bp, Homo sapiens
gcttgtcaagttagcctggccagagtctgg

SEQ ID NO: 29782 - DNA, 30 bp, Homo sapiens
gagaggcatcctgtcttccaccagtactgt

SEQ ID NO: 29783 - DNA, 30 bp, Homo sapiens
ccgaggcggctctgtgctcagtgtccaggt

SEQ ID NO: 29784 - DNA, 30 bp, Homo sapiens
tctctgtgataagctcctttgtctcttcca

SEQ ID NO: 29785 - DNA, 30 bp, Homo sapiens
agctggaggtttaaaaaatcccacttttcg

SEQ ID NO: 29786 - DNA, 30 bp, Homo sapiens
cagaggtagctgacatcattgcagatgatg

SEQ ID NO: 29787 - DNA, 30 bp, Homo sapiens
ggtgagtgctccagggccttggggcagctt

SEQ ID NO: 29788 - DNA, 30 bp, Homo sapiens
tctgtggtttgatcatcttagcagcttcca

SEQ ID NO: 29789 - DNA, 30 bp, Homo sapiens
cacctctctgtcacactgaggcgggtcgct

SEQ ID NO: 29790 - DNA, 30 bp, Homo sapiens
ctgaggcgggtcgctggcacagacctccgc

SEQ ID NO: 29791 - DNA, 30 bp, Homo sapiens
tcttggtgaaaactgagggtttgttggtga

SEQ ID NO: 29792 - DNA, 30 bp, Homo sapiens
caaaggtgaataacgtggattatgaggggc

SEQ ID NO: 29793 - DNA, 30 bp, Homo sapiens
ccttggtcttctaaaaatcttcagtgactt

SEQ ID NO: 29794 - DNA, 30 bp, Homo sapiens
cacttggcgccttttactttgggccctagg

SEQ ID NO: 29795 - DNA, 30 bp, Homo sapiens
caataagggaaggcgacaaacagtttagct

SEQ ID NO: 29796 - DNA, 30 bp, Homo sapiens
cagtggcatgaccacagctctctgcctttc

SEQ ID NO: 29797 - DNA, 30 bp, Homo sapiens
tataggacaggtgagcccagcgggagccag

SEQ ID NO: 29798 - DNA, 30 bp, Homo sapiens
actgaatgtggcaggcggtggaggacgtgg

SEQ ID NO: 29799 - DNA, 30 bp, Homo sapiens
tactggagggtacaggaagaagagtcccca

SEQ ID NO: 29800 - DNA, 30 bp, Homo sapiens
ctatggcataatgtatttgctaattcaaaa

SEQ ID NO: 29801 - DNA, 30 bp, Homo sapiens
tgaaggttttgtagctgatggcaatggagc

SEQ ID NO: 29802 - DNA, 30 bp, Homo sapiens
caaaggcctgtgccagttgctgacagtgtc

SEQ ID NO: 29803 - DNA, 30 bp, Homo sapiens
ctgtagacgggtaggcggatgtgggcatgc

SEQ ID NO: 29804 - DNA, 30 bp, Homo sapiens
tataccctgggtgctgaatatgaagacttc

SEQ ID NO: 29805 - DNA, 30 bp, Homo sapiens
ggcttggaagtgagtggaaagaaatgttca

SEQ ID NO: 29806 - DNA, 30 bp, Homo sapiens
agttgtagttgtctgttgatgatggtgatg

SEQ ID NO: 29807 - DNA, 30 bp, Homo sapiens
ctgattttgcaggtgcttttttgctaccat

SEQ ID NO: 29808 - DNA, 30 bp, Homo sapiens
ttctggaaccagtatgtgctgctcgtgggt

SEQ ID NO: 29809 - DNA, 30 bp, Homo sapiens
tcagcagccccaaacgcggggagggagacc

SEQ ID NO: 29810 - DNA, 30 bp, Homo sapiens
acgtggcgcgggcccgggggctcccgccca

SEQ ID NO: 29811 - DNA, 30 bp, Homo sapiens
tgctttgtgcaggtggctttctcgttgttg

SEQ ID NO: 29812 - DNA, 30 bp, Homo sapiens
ggccactgtgcctcccgcagcaaccaggcc

SEQ ID NO: 29813 - DNA, 30 bp, Homo sapiens
ggctactgtgcctcctgcagcaaccaggcc

SEQ ID NO: 29814 - DNA, 30 bp, Homo sapiens
cgcctcactctggtaccgcagccgggagaa

SEQ ID NO: 29815 - DNA, 30 bp, Homo sapiens
gagaaatcttcgcagctccccacggccaat

SEQ ID NO: 29816 - DNA, 30 bp, Homo sapiens
gcccggtatcctcccctgaagcacttgatg

SEQ ID NO: 29817 - DNA, 30 bp, Homo sapiens
tcacttttccaatgacactagacccactcc

SEQ ID NO: 29818 - DNA, 30 bp, Homo sapiens
agtgcctctgtgtatagtatataaggcctt

SEQ ID NO: 29819 - DNA, 30 bp, Homo sapiens
ccaagggcttgcaggccaaggaaccacagc

SEQ ID NO: 29820 - DNA, 30 bp, Homo sapiens
ccacttgtcctaaacaataaagtagccaat

SEQ ID NO: 29821 - DNA, 30 bp, Homo sapiens
cagaggccctcatttatgtcacaacagcaa

SEQ ID NO: 29822 - DNA, 30 bp, Homo sapiens
cagaggccctcatttatgtcgcaacagcaa

SEQ ID NO: 29823 - DNA, 30 bp, Homo sapiens
ttgtccagactctctgctgcatgggtgatg

SEQ ID NO: 29824 - DNA, 30 bp, Homo sapiens
ttgtccagactttctgctgcatgggtgatg

SEQ ID NO: 29825 - DNA, 30 bp, Homo sapiens
ttgcccagactctctgctgcatgggtgatg

SEQ ID NO: 29826 - DNA, 30 bp, Homo sapiens
gactttgggaatgtcgtaatgctccgtgag

SEQ ID NO: 29827 - DNA, 30 bp, Homo sapiens
agacgggcattggctccatgctttacaatg

SEQ ID NO: 29828 - DNA, 30 bp, Homo sapiens
tagctggccgtgcttctccgcgggatacag

SEQ ID NO: 29829 - DNA, 30 bp, Homo sapiens
ctttgggtatgcagccttctatctggatct

SEQ ID NO: 29830 - DNA, 30 bp, Homo sapiens
gtcttgcttctgggggatgcatccttccat

SEQ ID NO: 29831 - DNA, 30 bp, Homo sapiens
taaaatggcttcgggggcatgcagccctcc

SEQ ID NO: 29832 - DNA, 30 bp, Homo sapiens
gagtggggctcgtctgcactggcgccgtcg

SEQ ID NO: 29833 - DNA, 30 bp, Homo sapiens
gcctggcccgcccgctccctggggccggcc

SEQ ID NO: 29834 - DNA, 30 bp, Homo sapiens
taaaggaagttttctgttgctggtggaaat

SEQ ID NO: 29835 - DNA, 30 bp, Homo sapiens
aagtggagtaggtctgttgctggcacgtga

SEQ ID NO: 29836 - DNA, 30 bp, Homo sapiens
acaaggcagccaggtgggataggcgtgagc

SEQ ID NO: 29837 - DNA, 30 bp, Homo sapiens
tacagggcagccaggtagggtaaggctggc

SEQ ID NO: 29838 - DNA, 30 bp, Homo sapiens
gatccacgaaagtgcagtgggtggtatggc

SEQ ID NO: 29839 - DNA, 30 bp, Homo sapiens
cttcttccgatgcctctacgatttctttgt

SEQ ID NO: 29840 - DNA, 30 bp, Homo sapiens
aataggagtcttaacagagtcgtaagtcca

SEQ ID NO: 29841 - DNA, 30 bp, Homo sapiens
aatcttcttccgatgcatctgtgacgtctt

SEQ ID NO: 29842 - DNA, 30 bp, Homo sapiens
cgatatacatattctcaaggaaacgtggcg

SEQ ID NO: 29843 - DNA, 30 bp, Homo sapiens
ctttcttgaagatgctctgttcctgcagct

SEQ ID NO: 29844 - DNA, 30 bp, Homo sapiens
gtttggaagttgattcatcgttcaagtgct

SEQ ID NO: 29845 - DNA, 30 bp, Homo sapiens
gcatggatttaatttgcttggaggtagtct

SEQ ID NO: 29846 - DNA, 30 bp, Homo sapiens
cagcggatcgtgtacttgtcccacttcttt

SEQ ID NO: 29847 - DNA, 30 bp, Homo sapiens
tagcggatggtgtacttgtcccacttcttc

SEQ ID NO: 29848 - DNA, 30 bp, Homo sapiens
ttgttctcgatctgctccaggtccagctcc

SEQ ID NO: 29849 - DNA, 30 bp, Homo sapiens
ttgagggagcaaaggctttttgaatttttt

SEQ ID NO: 29850 - DNA, 30 bp, Homo sapiens
cagttcttctctatctgctcaatgtccaac

SEQ ID NO: 29851 - DNA, 30 bp, Homo sapiens
tcaaattcaagtccaggtccccaaagtccc

SEQ ID NO: 29852 - DNA, 30 bp, Homo sapiens
tttttggcttggggagtgtcaaagagccgg

SEQ ID NO: 29853 - DNA, 30 bp, Homo sapiens
tcctgggcctggcaggccgggggcggccgg

SEQ ID NO: 29854 - DNA, 30 bp, Homo sapiens
agtaggtagtctttgagtaactgacaagct

SEQ ID NO: 29855 - DNA, 30 bp, Homo sapiens
tgctggtccttaaagagactatagaccatt

SEQ ID NO: 29856 - DNA, 30 bp, Homo sapiens
caagagtacttggtgttggagatcttcttc

SEQ ID NO: 29857 - DNA, 30 bp, Homo sapiens
gcagctccctcagtgtggcttggaggagtt

SEQ ID NO: 29858 - DNA, 30 bp, Homo sapiens
taatgggcttcaaaggtcactgtctccatg

SEQ ID NO: 29859 - DNA, 30 bp, Homo sapiens
aaatggatttggtttcaaagacgatcatct

SEQ ID NO: 29860 - DNA, 30 bp, Homo sapiens
ggctcctctgcacttcctccaacacagatg

SEQ ID NO: 29861 - DNA, 30 bp, Homo sapiens
agaaaggggcagacagatgaggcacaagtt

SEQ ID NO: 29862 - DNA, 30 bp, Homo sapiens
tgaagggcacagcagaagcagagaggaagc

SEQ ID NO: 29863 - DNA, 30 bp, Homo sapiens
catccggccactcggagtgctgggagtgct

SEQ ID NO: 29864 - DNA, 30 bp, Homo sapiens
ggtggggccagctgtggcccggtggaggct

SEQ ID NO: 29865 - DNA, 30 bp, Homo sapiens
aagtgctctcctaggtaactggctatatga

SEQ ID NO: 29866 - DNA, 30 bp, Homo sapiens
ctgagatatttaacacatcttcatctgtac

SEQ ID NO: 29867 - DNA, 30 bp, Homo sapiens
tgtgaaacatccagaagtgtctgttgttgc

SEQ ID NO: 29868 - DNA, 30 bp, Homo sapiens
ctctggcaagttgccccgaagtaggacgtt

SEQ ID NO: 29869 - DNA, 30 bp, Homo sapiens
gagaggttatagctcctgacttctctgact

SEQ ID NO: 29870 - DNA, 30 bp, Homo sapiens
gataatgctgcgacctgtttgagtagttct

SEQ ID NO: 29871 - DNA, 30 bp, Homo sapiens
caccggtgcttgggcgggatcaccaccagc

SEQ ID NO: 29872 - DNA, 30 bp, Homo sapiens
cttaggagggatcacaaccagaggtggccc

SEQ ID NO: 29873 - DNA, 30 bp, Homo sapiens
tctaggatttgaatgcacagtagctgctgc

SEQ ID NO: 29874 - DNA, 30 bp, Homo sapiens
acatgggggtctctggcttctgcatcagct

SEQ ID NO: 29875 - DNA, 30 bp, Homo sapiens
gttccactatcttgcgctgtaatttcttta

SEQ ID NO: 29876 - DNA, 30 bp, Homo sapiens
gaagtgaggggaggcctgcaggaagggcct

SEQ ID NO: 29877 - DNA, 30 bp, Homo sapiens
tggctgcctgccgagcggccgctgaagggg

SEQ ID NO: 29878 - DNA, 30 bp, Homo sapiens
atcaggaaccaaagtgttgtttgttttttt

SEQ ID NO: 29879 - DNA, 30 bp, Homo sapiens
cagaggtctctgaggcaatgatctggaagc

SEQ ID NO: 29880 - DNA, 30 bp, Homo sapiens
aacttgttctcattgggttgatatgagcga

SEQ ID NO: 29881 - DNA, 30 bp, Homo sapiens
aagcggcttcggagctgcttgaacttggac

SEQ ID NO: 29882 - DNA, 30 bp, Homo sapiens
gataggaaggataaagtgctacatctctaa

SEQ ID NO: 29883 - DNA, 30 bp, Homo sapiens
cagggttgccccccaagtcctgcccggggg

SEQ ID NO: 29884 - DNA, 30 bp, Homo sapiens
gctaggcttggcagaactgggacttgtttt

SEQ ID NO: 29885 - DNA, 30 bp, Homo sapiens
taggggtctttgcggtcccggggggcttga

SEQ ID NO: 29886 - DNA, 30 bp, Homo sapiens
cccaggatcttgggcacgaacttgcccacc

SEQ ID NO: 29887 - DNA, 30 bp, Homo sapiens
cgtccacgaggtcggcgagctcctggagca

SEQ ID NO: 29888 - DNA, 30 bp, Homo sapiens
agtgtgccactgcctctccgtcctcctcct

SEQ ID NO: 29889 - DNA, 30 bp, Homo sapiens
gtgaggttcagcattgccatctccaagtgc

SEQ ID NO: 29890 - DNA, 30 bp, Homo sapiens
ccaagtgctctctgtagggaaacagtttct

SEQ ID NO: 29891 - DNA, 30 bp, Homo sapiens
agatggactccagaatccagtcgctgctgg

SEQ ID NO: 29892 - DNA, 30 bp, Homo sapiens
tattgggacgggtcctggagcccttccagg

SEQ ID NO: 29893 - DNA, 30 bp, Homo sapiens
tggttcctgctacaatgtcataagctgttc

SEQ ID NO: 29894 - DNA, 30 bp, Homo sapiens
aggaggagggaacctgaaggtcctcataga

SEQ ID NO: 29895 - DNA, 30 bp, Homo sapiens
atttggactttttggtttttgttacctgga

SEQ ID NO: 29896 - DNA, 30 bp, Homo sapiens
ggaaggtgaccgtccactccattctgataa

SEQ ID NO: 29897 - DNA, 30 bp, Homo sapiens
catcttctgcttgttgatcctttcttagtc

SEQ ID NO: 29898 - DNA, 30 bp, Homo sapiens
tcctggaagcatgagatgcccaccctgccc

SEQ ID NO: 29899 - DNA, 30 bp, Homo sapiens
agcaatgaggtactgttggcgtgaacctga

SEQ ID NO: 29900 - DNA, 30 bp, Homo sapiens
gtcaggttcaaggacacactgttccacaat

SEQ ID NO: 29901 - DNA, 30 bp, Homo sapiens
gagcgggctgacaggcactgattcacaacc

SEQ ID NO: 29902 - DNA, 30 bp, Homo sapiens
ctagtgtaatgtcttccctgtccaaatcca

SEQ ID NO: 29903 - DNA, 30 bp, Homo sapiens
ccaccaccacctcctccatatggatctcca

SEQ ID NO: 29904 - DNA, 30 bp, Homo sapiens
cactgggggcctccatcctctcttcggctc

SEQ ID NO: 29905 - DNA, 30 bp, Homo sapiens
cactggaagaaatgatgcaataattgtctt

SEQ ID NO: 29906 - DNA, 30 bp, Homo sapiens
catcggaaaaaactctgtcacaaaggtctt

SEQ ID NO: 29907 - DNA, 30 bp, Homo sapiens
ccatcttgttgccacctcttttgttgctct

SEQ ID NO: 29908 - DNA, 30 bp, Homo sapiens
tccaggcttattcttgccccaagtgcagac

SEQ ID NO: 29909 - DNA, 30 bp, Homo sapiens
gcaaccacatggcagacttctacttcagcc

SEQ ID NO: 29910 - DNA, 30 bp, Homo sapiens
agaagagatgaggctcctgggacaggtcag

SEQ ID NO: 29911 - DNA, 30 bp, Homo sapiens
gtgagaagctctttttcgggcaccgaggta

SEQ ID NO: 29912 - DNA, 30 bp, Homo sapiens
gatcttgtgagtggaggactcctcctgtac

SEQ ID NO: 29913 - DNA, 30 bp, Homo sapiens
acttttaggttcgtttgcaacattttcttc

SEQ ID NO: 29914 - DNA, 30 bp, Homo sapiens
agacttgagttcgcagctctttaaggagct

SEQ ID NO: 29915 - DNA, 30 bp, Homo sapiens
ttggggaagaagggtcttcgttttgcagga

SEQ ID NO: 29916 - DNA, 30 bp, Homo sapiens
tggagggaatggaaatgggcatagaagcat

SEQ ID NO: 29917 - DNA, 30 bp, Homo sapiens
ctccagcacttacttcgtcttcttcaccat

SEQ ID NO: 29918 - DNA, 30 bp, Homo sapiens
acttggagtgctgcaaggcaaaggtgcact

SEQ ID NO: 29919 - DNA, 30 bp, Homo sapiens
caggggcccaaatgtttcaaggcggccttc

SEQ ID NO: 29920 - DNA, 30 bp, Homo sapiens
cagaactgaggcctgcgctgagacccaaaa

SEQ ID NO: 29921 - DNA, 30 bp, Homo sapiens
tacaggtcacaagactttggcagagatgtc

SEQ ID NO: 29922 - DNA, 30 bp, Homo sapiens
cttcttggctggttctttgttctgtccccc

SEQ ID NO: 29923 - DNA, 30 bp, Homo sapiens
tgagaattatcacacacttgatcaggaatg

SEQ ID NO: 29924 - DNA, 30 bp, Homo sapiens
ccttctgatgagttacttgtgcatacatgg

SEQ ID NO: 29925 - DNA, 30 bp, Homo sapiens
ctataggaaaagatagatgactttcgctgc

SEQ ID NO: 29926 - DNA, 30 bp, Homo sapiens
ctttggcctctgcttttttttcctttcttc

SEQ ID NO: 29927 - DNA, 30 bp, Homo sapiens
tttaggaagtgggtcatgtgggtgtataag

SEQ ID NO: 29928 - DNA, 30 bp, Homo sapiens
tgctggatgctcggaagtatgacaaaaact

SEQ ID NO: 29929 - DNA, 30 bp, Homo sapiens
tgctggatgctctaaagtaggagaggaatt

SEQ ID NO: 29930 - DNA, 30 bp, Homo sapiens
atacacaagagactctttgtgactcaacac

SEQ ID NO: 29931 - DNA, 30 bp, Homo sapiens
agcttctacttccagcccagtttgtgtaag

SEQ ID NO: 29932 - DNA, 30 bp, Homo sapiens
acgtggtgaactcatgagcagcctttaact

SEQ ID NO: 29933 - DNA, 30 bp, Homo sapiens
tccccctgaccatcccctccagccctgagg

SEQ ID NO: 29934 - DNA, 30 bp, Homo sapiens
ttgtgacccctgctacatgcccttcgtgga

SEQ ID NO: 29935 - DNA, 30 bp, Homo sapiens
ctccacacccaacagctggactgcagcctc

SEQ ID NO: 29936 - DNA, 30 bp, Homo sapiens
cacgcagcctcctgtgtgggagggggcctc

SEQ ID NO: 29937 - DNA, 30 bp, Homo sapiens
aaaagggtccaacattgatttctagggagg

SEQ ID NO: 29938 - DNA, 30 bp, Homo sapiens
aattagtggaattggcaaaagaagaagaca

SEQ ID NO: 29939 - DNA, 30 bp, Homo sapiens
ccttggttttcctttctgtgctttctgcat

SEQ ID NO: 29940 - DNA, 30 bp, Homo sapiens
ctttggatttcatttctgaagtttgaattt

SEQ ID NO: 29941 - DNA, 30 bp, Homo sapiens
ctcctttttttcagggggtggactggggtg

SEQ ID NO: 29942 - DNA, 30 bp, Homo sapiens
aacgtctgagattcctcaaaattgaccaga

SEQ ID NO: 29943 - DNA, 30 bp, Homo sapiens
cctcccgcacgctcacgcgtggctcagcca

SEQ ID NO: 29944 - DNA, 30 bp, Homo sapiens
agcccccttcaggcccccagcgcaggccca

SEQ ID NO: 29945 - DNA, 30 bp, Homo sapiens
gagcatcctttgttgacagtgccatagagt

SEQ ID NO: 29946 - DNA, 30 bp, Homo sapiens
aacaggaagagcttctactgaatagatttt

SEQ ID NO: 29947 - DNA, 30 bp, Homo sapiens
attcacgtcttgattttagcatcccaatct

SEQ ID NO: 29948 - DNA, 30 bp, Homo sapiens
agagagcagaggtgaatactttctcatgaa

SEQ ID NO: 29949 - DNA, 30 bp, Homo sapiens
gctgctgggaatccaggggcgggatcgtca

SEQ ID NO: 29950 - DNA, 30 bp, Homo sapiens
cacagctgccataatcactctccaccatgt

SEQ ID NO: 29951 - DNA, 30 bp, Homo sapiens
caaagggaatgtgaaggctggcgaggctga

SEQ ID NO: 29952 - DNA, 30 bp, Homo sapiens
ctttggggactggtttagttgtcccagctt

SEQ ID NO: 29953 - DNA, 30 bp, Homo sapiens
cactggttcatccacagccacaggttggca

SEQ ID NO: 29954 - DNA, 30 bp, Homo sapiens
cattggggcccttcttcttgccaaaggtgg

SEQ ID NO: 29955 - DNA, 30 bp, Homo sapiens
tcgtggtctgtatagtcatccatgtccaca

SEQ ID NO: 29956 - DNA, 30 bp, Homo sapiens
tctttggggagtctgggatgctctcagaga

SEQ ID NO: 29957 - DNA, 30 bp, Homo sapiens
caggctgaatgagatgtcaaattgtaggac

SEQ ID NO: 29958 - DNA, 30 bp, Homo sapiens
ccttggggggtggcctgtacactcccacga

SEQ ID NO: 29959 - DNA, 30 bp, Homo sapiens
agcactccgcttcacatggcatggcttgca

SEQ ID NO: 29960 - DNA, 30 bp, Homo sapiens
ccagccctgtaatattctttataataaacc

SEQ ID NO: 29961 - DNA, 30 bp, Homo sapiens
taggcatcaaggtgggtatcctccaacccc

SEQ ID NO: 29962 - DNA, 30 bp, Homo sapiens
gcttggccacaaaggagctgacggtgccgt

SEQ ID NO: 29963 - DNA, 30 bp, Homo sapiens
ctcagggcactcgaaggccaggcagcggaa

SEQ ID NO: 29964 - DNA, 30 bp, Homo sapiens
gaaccagtactcagagacgaagatgtggac

SEQ ID NO: 29965 - DNA, 30 bp, Homo sapiens
cacagggcaaaggtggtgaagaagatgtgc

SEQ ID NO: 29966 - DNA, 30 bp, Homo sapiens
gaatgggtactgcgacacatatatccgcag

SEQ ID NO: 29967 - DNA, 30 bp, Homo sapiens
gaagtcatagggggatacaaagatggtgac

SEQ ID NO: 29968 - DNA, 30 bp, Homo sapiens
tcaccactgaggtagtctttgtcatatttg

SEQ ID NO: 29969 - DNA, 30 bp, Homo sapiens
tctgagagcctccccaagctcccctaggag

SEQ ID NO: 29970 - DNA, 30 bp, Homo sapiens
taaagcaactgcagctgcaccttcagcctc

SEQ ID NO: 29971 - DNA, 30 bp, Homo sapiens
cactgggcagagtgcttctcatacaccttc

SEQ ID NO: 29972 - DNA, 30 bp, Homo sapiens
tgatttttctgcacacaggtgagatattcc

SEQ ID NO: 29973 - DNA, 30 bp, Homo sapiens
acctgtcagcccgagctgggccagggcccc

SEQ ID NO: 29974 - DNA, 30 bp, Homo sapiens
ctccacctccgggggatttcgggacgggga

SEQ ID NO: 29975 - DNA, 30 bp, Homo sapiens
gtccatagactctttggggcaagccctgac

SEQ ID NO: 29976 - DNA, 30 bp, Homo sapiens
gcttggtcttcactgctgtatgttgacttt

SEQ ID NO: 29977 - DNA, 30 bp, Homo sapiens
ccttctggagcttccccgagttctcacagt

SEQ ID NO: 29978 - DNA, 30 bp, Homo sapiens
tgcaggttgacaaaaggtgcgaagcccgcc

SEQ ID NO: 29979 - DNA, 30 bp, Homo sapiens
acgaggcagcggggcaggtgctgcgagaaa

SEQ ID NO: 29980 - DNA, 30 bp, Homo sapiens
aggaggaggcggcagacatgttgggggtcc

SEQ ID NO: 29981 - DNA, 30 bp, Homo sapiens
atagtggtgcacacttgtaatcccagctgc

SEQ ID NO: 29982 - DNA, 30 bp, Homo sapiens
accaccacaggttcggcggttcctcggcca

SEQ ID NO: 29983 - DNA, 30 bp, Homo sapiens
tagctgtccttgagaagcagcttctcctca

SEQ ID NO: 29984 - DNA, 30 bp, Homo sapiens
cagtcgctgtccacttcctgccactgctgt

SEQ ID NO: 29985 - DNA, 30 bp, Homo sapiens
cataggatgatgcagcatctgcagaagcgc

SEQ ID NO: 29986 - DNA, 30 bp, Homo sapiens
accagagaggcatcacatcagggaaccata

SEQ ID NO: 29987 - DNA, 30 bp, Homo sapiens
ctgcgggaacgcatccgccccaggaaaggt

SEQ ID NO: 29988 - DNA, 30 bp, Homo sapiens
aagtgggcatcatgtcgggaaaccacaccc

SEQ ID NO: 29989 - DNA, 30 bp, Homo sapiens
agaaggacacatcaagtaaagaaagatctt

SEQ ID NO: 29990 - DNA, 30 bp, Homo sapiens
gagcggcagcaggctcgaaaaccacactgc

SEQ ID NO: 29991 - DNA, 30 bp, Homo sapiens
agctgggtgaggggctggtgagcagctgct

SEQ ID NO: 29992 - DNA, 30 bp, Homo sapiens
agaagaaagccgggttggtgtgctcgatga

SEQ ID NO: 29993 - DNA, 30 bp, Homo sapiens
cacgccacgagcgtaggcctccagggatgc

SEQ ID NO: 29994 - DNA, 30 bp, Homo sapiens
cacaggatggtgcagaagacactgcggttg

SEQ ID NO: 29995 - DNA, 30 bp, Homo sapiens
tgtaggctcaccagctaatgtacaaggatt

SEQ ID NO: 29996 - DNA, 30 bp, Homo sapiens
caatggttgatttttgcgatactaagataa

SEQ ID NO: 29997 - DNA, 30 bp, Homo sapiens
tctgtcctgcaatttatttttcttatcatg

SEQ ID NO: 29998 - DNA, 30 bp, Homo sapiens
agacggatcctgaccctcacactggagtgg

SEQ ID NO: 29999 - DNA, 30 bp, Homo sapiens
aagacgaggaagagcagggcctcatgccgg

SEQ ID NO: 30000 - DNA, 30 bp, Homo sapiens
cgctgctgttggtcacccgggccccgaacc

SEQ ID NO: 30001 - DNA, 30 bp, Homo sapiens
catagacaaactccagatcttctggatacc

SEQ ID NO: 30002 - DNA, 30 bp, Homo sapiens
atgtatgagtgccattattgttgtatagct

SEQ ID NO: 30003 - DNA, 30 bp, Homo sapiens
attcacagacgaaatcagaagcacacaaga

SEQ ID NO: 30004 - DNA, 30 bp, Homo sapiens
ctcaggggctgggggccctacaccaccccc

SEQ ID NO: 30005 - DNA, 30 bp, Homo sapiens
aaacttgaagaggtcgatgaagtgctgcgg

SEQ ID NO: 30006 - DNA, 30 bp, Homo sapiens
agacggactcgcacgatcacactggagttg

SEQ ID NO: 30007 - DNA, 30 bp, Homo sapiens
agacggtcctggaactttcctgggatgaag

SEQ ID NO: 30008 - DNA, 30 bp, Homo sapiens
agagtctatggcttccgtggccttttttcg

SEQ ID NO: 30009 - DNA, 30 bp, Homo sapiens
aaaaggcgtgagcagcggcgtctgcgaatg

SEQ ID NO: 30010 - DNA, 30 bp, Homo sapiens
gggctatagacaccctgaatgttggacatg

SEQ ID NO: 30011 - DNA, 30 bp, Homo sapiens
ttagtgagttctcgtgtcacacacatacat

SEQ ID NO: 30012 - DNA, 30 bp, Homo sapiens
aggaggtgagggactgaatgttcttgagca

SEQ ID NO: 30013 - DNA, 30 bp, Homo sapiens
tcctggggtgaaagtgaaacggagcagctc

SEQ ID NO: 30014 - DNA, 30 bp, Homo sapiens
ctgcatgccaaggttgacccaggcccaggg

SEQ ID NO: 30015 - DNA, 30 bp, Homo sapiens
cagcttcagtcccttttgctttcttatgga

SEQ ID NO: 30016 - DNA, 30 bp, Homo sapiens
gttgcttttctctcaggtttccatattttt

SEQ ID NO: 30017 - DNA, 30 bp, Homo sapiens
acatcacaatagtggataaaaattgccact

SEQ ID NO: 30018 - DNA, 30 bp, Homo sapiens
aatttcctgcagggtcttgtcctcttcatt

SEQ ID NO: 30019 - DNA, 30 bp, Homo sapiens
tacaacttcacacactttttgaatctgtgg

SEQ ID NO: 30020 - DNA, 30 bp, Homo sapiens
tcctggacttttatgagcttcagcatttgc

SEQ ID NO: 30021 - DNA, 30 bp, Homo sapiens
cttcaagaatccactcaatgccattcaaaa

SEQ ID NO: 30022 - DNA, 30 bp, Homo sapiens
tcgtggtctgattctaaaggtggagactaa

SEQ ID NO: 30023 - DNA, 30 bp, Homo sapiens
tagcagccgccttccaccttgatgtgcaga

SEQ ID NO: 30024 - DNA, 30 bp, Homo sapiens
acaaggcgtttgtttttggatagtacttca

SEQ ID NO: 30025 - DNA, 30 bp, Homo sapiens
actctgggcacttcctgggagagcatcttt

SEQ ID NO: 30026 - DNA, 30 bp, Homo sapiens
agggttcagcagatgggggctcagggggtg

SEQ ID NO: 30027 - DNA, 30 bp, Homo sapiens
cagcgggggcccgatggtgatgctgctgtt

SEQ ID NO: 30028 - DNA, 30 bp, Homo sapiens
caaaggttttccaaggtaaaccaaagtcac

SEQ ID NO: 30029 - DNA, 30 bp, Homo sapiens
ctcctcccggccggcccggcccccgcctgg

SEQ ID NO: 30030 - DNA, 30 bp, Homo sapiens
cagaggagtattcatggtcaaatacaggac

SEQ ID NO: 30031 - DNA, 30 bp, Homo sapiens
atctttccagttctgcttctagaatttccc

SEQ ID NO: 30032 - DNA, 30 bp, Homo sapiens
ggcaggggacctattttacaactggctttg

SEQ ID NO: 30033 - DNA, 30 bp, Homo sapiens
atctggacaacagctcggtagggcgattgg

SEQ ID NO: 30034 - DNA, 30 bp, Homo sapiens
agccggccatcagttggccgacccctgctg

SEQ ID NO: 30035 - DNA, 30 bp, Homo sapiens
acatggccaataaggtagatattgtcataa

SEQ ID NO: 30036 - DNA, 30 bp, Homo sapiens
cagaggcctttctgagaaagctgtgtagct

SEQ ID NO: 30037 - DNA, 30 bp, Homo sapiens
tcaggggccgctgttttcccttgcttcgtg

SEQ ID NO: 30038 - DNA, 30 bp, Homo sapiens
ttctggagggagaacgggtctcattctggg

SEQ ID NO: 30039 - DNA, 30 bp, Homo sapiens
tgctggagtcacttactttcctcaccctaa

SEQ ID NO: 30040 - DNA, 30 bp, Homo sapiens
tccttccacaacaccaggtgaatactgtgg

SEQ ID NO: 30041 - DNA, 30 bp, Homo sapiens
catgggttttgaaaatccaggacgtggagg

SEQ ID NO: 30042 - DNA, 30 bp, Homo sapiens
cgcctctggctggcaagccaggagaagaag

SEQ ID NO: 30043 - DNA, 30 bp, Homo sapiens
caaagtccagcaccagcagcttggtttctt

SEQ ID NO: 30044 - DNA, 30 bp, Homo sapiens
gggaggagagttggtgaacgggcaggtcca

SEQ ID NO: 30045 - DNA, 30 bp, Homo sapiens
acatggttatagggaaaggccagtgcgagg

SEQ ID NO: 30046 - DNA, 30 bp, Homo sapiens
caggcctgcagcctccagacctctagcgac

SEQ ID NO: 30047 - DNA, 30 bp, Homo sapiens
gggtcctggatttctctctggggcagtcag

SEQ ID NO: 30048 - DNA, 30 bp, Homo sapiens
tctccagagcttcctttgcaatagaaccag

SEQ ID NO: 30049 - DNA, 30 bp, Homo sapiens
acttggtgttcgtgcaaaggtcaatcctgg

SEQ ID NO: 30050 - DNA, 30 bp, Homo sapiens
gtatggccaagagagccacgaggaccagtc

SEQ ID NO: 30051 - DNA, 30 bp, Homo sapiens
gtttggcttaggatgtgggttcagaagtct

SEQ ID NO: 30052 - DNA, 30 bp, Homo sapiens
tggtggtttctcatgcttcagagtctcgta

SEQ ID NO: 30053 - DNA, 30 bp, Homo sapiens
gagtggagaggggcagagggggtgggcagg

SEQ ID NO: 30054 - DNA, 30 bp, Homo sapiens
tcatctggcatccgttcaatgttgtatcta

SEQ ID NO: 30055 - DNA, 30 bp, Homo sapiens
ctctccatttctccatcgctggcttctcct

SEQ ID NO: 30056 - DNA, 30 bp, Homo sapiens
acgtggccccctggggctccttccggtgca

SEQ ID NO: 30057 - DNA, 30 bp, Homo sapiens; identical to SEQ ID NO: 30056

SEQ ID NO: 30058 - DNA, 30 bp, Homo sapiens
accaggcctctgcaagagcaactttgtttc

SEQ ID NO: 30059 - DNA, 30 bp, Homo sapiens
cgttgggaggaagagtcaggtagatgtttt

SEQ ID NO: 30060 - DNA, 30 bp, Homo sapiens
ttctggtcatcaggctcttccagagcatcc

SEQ ID NO: 30061 - DNA, 30 bp, Homo sapiens
ttgagggtcctttctccatttaaatttatg

SEQ ID NO: 30062 - DNA, 30 bp, Homo sapiens
tccactgcaaaaaggagtaccatcaccaag

SEQ ID NO: 30063 - DNA, 30 bp, Homo sapiens
aggcggtggctggaatcacatttacatcct

SEQ ID NO: 30064 - DNA, 30 bp, Homo sapiens
accaggtacatccctgtggcaaacctcctc

SEQ ID NO: 30065 - DNA, 30 bp, Homo sapiens
acaatccgccaggtatcgtccagtagcaaa

SEQ ID NO: 30066 - DNA, 30 bp, Homo sapiens
ggtgaggggatctgggtggccaggatccgg

SEQ ID NO: 30067 - DNA, 30 bp, Homo sapiens
tgatttccacatcttcaatcttctctgctg

SEQ ID NO: 30068 - DNA, 30 bp, Homo sapiens
gcggggcggggggcaacggcgctccggggc

SEQ ID NO: 30069 - DNA, 30 bp, Homo sapiens
ggcaggaacattgatgtagtcatctgaatc

SEQ ID NO: 30070 - DNA, 30 bp, Homo sapiens
taggcgggccgcaccttcatctctgacacc

SEQ ID NO: 30071 - DNA, 30 bp, Homo sapiens
ggcaggtcgcaccttcatctctgacacctt

SEQ ID NO: 30072 - DNA, 30 bp, Homo sapiens
cgaagcatcatccgaaccctgcggtagggg

SEQ ID NO: 30073 - DNA, 30 bp, Homo sapiens
gcctggaatagatgtctaaggaaaccttgt

SEQ ID NO: 30074 - DNA, 30 bp, Homo sapiens
cctccatatgtgtccccagggtttctgagc

SEQ ID NO: 30075 - DNA, 30 bp, Homo sapiens
acttgggagtcctgggttcattagtggcag

SEQ ID NO: 30076 - DNA, 30 bp, Homo sapiens
tagtggtctgaggccagtaatacacgtggt

SEQ ID NO: 30077 - DNA, 30 bp, Homo sapiens
acatggaaaatcttgaactttgttctttct

SEQ ID NO: 30078 - DNA, 30 bp, Homo sapiens
agctgatctttccagctgagttatctgggt

SEQ ID NO: 30079 - DNA, 30 bp, Homo sapiens
gtgaggagctgaggaagccaagaacaggga

SEQ ID NO: 30080 - DNA, 30 bp, Homo sapiens
caatgctgcttctcccccaaggggaacttt

SEQ ID NO: 30081 - DNA, 30 bp, Homo sapiens
cacagtcgctaaggggttcttggagagtcc

SEQ ID NO: 30082 - DNA, 30 bp, Homo sapiens
cactgggctgcaggcatctcacctccgcac

SEQ ID NO: 30083 - DNA, 30 bp, Homo sapiens
ttgtggtcccaggcttccggtggccagata

SEQ ID NO: 30084 - DNA, 30 bp, Homo sapiens
gattgttccaagggcgtcggcggagcgcag

SEQ ID NO: 30085 - DNA, 30 bp, Homo sapiens
cagctctccacaggagtggtctctggggtt

SEQ ID NO: 30086 - DNA, 30 bp, Homo sapiens
accaggagccaaggctgcggcccatggagc

SEQ ID NO: 30087 - DNA, 30 bp, Homo sapiens
ggaaggggagttgtaggggcagattcaggt

SEQ ID NO: 30088 - DNA, 30 bp, Homo sapiens
tgaacatagtcttctgttacctgggagaga

SEQ ID NO: 30089 - DNA, 30 bp, Homo sapiens
gtagattttgcgcgcaagccccagaaagac

SEQ ID NO: 30090 - DNA, 30 bp, Homo sapiens
aggaggtcttgcccacatcaatggattgtc

SEQ ID NO: 30091 - DNA, 30 bp, Homo sapiens
cagtggggcttggggacatggccatccacg

SEQ ID NO: 30092 - DNA, 30 bp, Homo sapiens
taccgaggtataacatataggtgttgttga

SEQ ID NO: 30093 - DNA, 30 bp, Homo sapiens
cagtggcccaggaggcgcagcatctcctga

SEQ ID NO: 30094 - DNA, 30 bp, Homo sapiens
tgctggctggtgaagaaggatttagtctcc

SEQ ID NO: 30095 - DNA, 30 bp, Homo sapiens
gatcttccgggatgaagcccttgtaaggga

SEQ ID NO: 30096 - DNA, 30 bp, Homo sapiens
aactcttcaagagttctggggatctggtct

SEQ ID NO: 30097 - DNA, 30 bp, Homo sapiens
ttctgggatatgccctttataatatattct

SEQ ID NO: 30098 - DNA, 30 bp, Homo sapiens
ttaaacttccctgctgccccagtctttgcc

SEQ ID NO: 30099 - DNA, 30 bp, Homo sapiens
tcatctctgcctctatctgctgatgaacac

SEQ ID NO: 30100 - DNA, 30 bp, Homo sapiens
cttagggcgattttcaggtttataatccca

SEQ ID NO: 30101 - DNA, 30 bp, Homo sapiens
tcctggggctggaagttctgggaaaatatc

SEQ ID NO: 30102 - DNA, 30 bp, Homo sapiens
tgagcccacaacgatccttcggctgatggc

SEQ ID NO: 30103 - DNA, 30 bp, Homo sapiens
tccttcttctcacagctctccaagagctcg

SEQ ID NO: 30104 - DNA, 30 bp, Homo sapiens
cgccggtcaatttgtggaacaagtcctcat

SEQ ID NO: 30105 - DNA, 30 bp, Homo sapiens
cacacccaaccactggtaagtttgtagaac

SEQ ID NO: 30106 - DNA, 30 bp, Homo sapiens
tgatttcccagttgacattccactgtttca

SEQ ID NO: 30107 - DNA, 30 bp, Homo sapiens
agaaggcctcatggcccccggtgagctgca

SEQ ID NO: 30108 - DNA, 30 bp, Homo sapiens
cgatgccgctttcggatgctctgcagctcc

SEQ ID NO: 30109 - DNA, 30 bp, Homo sapiens
tggcggaaggacaagagggctggcattctg

SEQ ID NO: 30110 - DNA, 30 bp, Homo sapiens
tctaggagccaggcggaaatgcactggagt

SEQ ID NO: 30111 - DNA, 30 bp, Homo sapiens
cctgaagggtctcctcctcctcttggatct

SEQ ID NO: 30112 - DNA, 30 bp, Homo sapiens
ggtagggcagagcacttttaaaatgtagtc

SEQ ID NO: 30113 - DNA, 30 bp, Homo sapiens
tgtaggacacagaactttcagaatataatc

SEQ ID NO: 30114 - DNA, 30 bp, Homo sapiens
cactggtggccctggtggagcccgggctgc

SEQ ID NO: 30115 - DNA, 30 bp, Homo sapiens
gtcaggtcctttgcggagggggcagcaggg

SEQ ID NO: 30116 - DNA, 30 bp, Homo sapiens
tgcgttcttgccgcacacactgtcttcagg

SEQ ID NO: 30117 - DNA, 30 bp, Homo sapiens
acttggcatcccttctccttgacccacacc

SEQ ID NO: 30118 - DNA, 30 bp, Homo sapiens
tttcagcacaggccacctggccaccagttc

SEQ ID NO: 30119 - DNA, 30 bp, Homo sapiens
ttctgggaaccagaagcagcaaaaaatttt

SEQ ID NO: 30120 - DNA, 30 bp, Homo sapiens
gacagggaaggcttccccaaaggagaagtg

SEQ ID NO: 30121 - DNA, 30 bp, Homo sapiens
tattgggtcacaaggggcctaattttcatg

SEQ ID NO: 30122 - DNA, 30 bp, Homo sapiens
ctgtgggaagaagggcctgatcttcatact

SEQ ID NO: 30123 - DNA, 30 bp, Homo sapiens
aggtcttgtctcgggtctggggggattcgg

SEQ ID NO: 30124 - DNA, 30 bp, Homo sapiens
agtcggacaggtccccatcgttgggccagc

SEQ ID NO: 30125 - DNA, 30 bp, Homo sapiens
catagggacctgaagctgcagggcccccgg

SEQ ID NO: 30126 - DNA, 30 bp, Homo sapiens
ctcttgttctacagattttgagtccgctgt

SEQ ID NO: 30127 - DNA, 30 bp, Homo sapiens
ccaaggtggctggatgctcatttggaccac

SEQ ID NO: 30128 - DNA, 30 bp, Homo sapiens
ccatggcctcgatccacctctgagctgaat

SEQ ID NO: 30129 - DNA, 30 bp, Homo sapiens
tgaaatgcttctatccacttctgagccgaa

SEQ ID NO: 30130 - DNA, 30 bp, Homo sapiens
gactggcagggggagaaacaagattgcttt

SEQ ID NO: 30131 - DNA, 30 bp, Homo sapiens
ttggaagaaagtgagcagaggtgtttttcc

SEQ ID NO: 30132 - DNA, 30 bp, Homo sapiens
cagggggcagggggactggaaggggaggcc

SEQ ID NO: 30133 - DNA, 30 bp, Homo sapiens
ttcatggttggtgttccagaacttttcctt

SEQ ID NO: 30134 - DNA, 30 bp, Homo sapiens
ttgtggctcatggatttgcctccgttcagc

SEQ ID NO: 30135 - DNA, 30 bp, Homo sapiens
gactggtttgcctccattcattattgcaga

SEQ ID NO: 30136 - DNA, 30 bp, Homo sapiens
ccattcatggctatatacaaccctgttttc

SEQ ID NO: 30137 - DNA, 30 bp, Homo sapiens
gtgaaagaggtctctggacatggagggcaa

SEQ ID NO: 30138 - DNA, 30 bp, Homo sapiens
tacgtgaggggctggggccgccgtgtgcgc

SEQ ID NO: 30139 - DNA, 30 bp, Homo sapiens
ggcagggtgtgtgggccggatccgacggga

SEQ ID NO: 30140 - DNA, 30 bp, Homo sapiens
gaccgggaggcggtgcttctcggatcggta

SEQ ID NO: 30141 - DNA, 30 bp, Homo sapiens
cattggaagaaaaagtatagctttctgccc

SEQ ID NO: 30142 - DNA, 30 bp, Homo sapiens
agtaggtccttgtacaattctggaactctt

SEQ ID NO: 30143 - DNA, 30 bp, Homo sapiens
agctggggcttcggccctgggaaggtccca

SEQ ID NO: 30144 - DNA, 30 bp, Homo sapiens
cgggcaggaagtgggcggacaggtggtacc

SEQ ID NO: 30145 - DNA, 30 bp, Homo sapiens
agggcctcaggagaccaggacgggcaggaa

SEQ ID NO: 30146 - DNA, 30 bp, Homo sapiens
atgaacttggcgaaggggcggcagccttcc

SEQ ID NO: 30147 - DNA, 30 bp, Homo sapiens
tagtgcgcactggcctccagctgggagccc

SEQ ID NO: 30148 - DNA, 30 bp, Homo sapiens
gcctggggaggaagtgggtgaccttcatgg

SEQ ID NO: 30149 - DNA, 30 bp, Homo sapiens
acttggcttaacatattggcttcgtgggat

SEQ ID NO: 30150 - DNA, 30 bp, Homo sapiens
cgaaacttgagtctgtatttcactgagttg

SEQ ID NO: 30151 - DNA, 30 bp, Homo sapiens
atcctgggaaggaaatgagtgacagtcatg

SEQ ID NO: 30152 - DNA, 30 bp, Homo sapiens
gaagaaagtgggctgttttttgttctttct

SEQ ID NO: 30153 - DNA, 30 bp, Homo sapiens
tatcggggctcgggggcccaagtcctctgg

SEQ ID NO: 30154 - DNA, 30 bp, Homo sapiens
tgtcggggtccactggtctaggtaaaaaat

SEQ ID NO: 30155 - DNA, 30 bp, Homo sapiens
tagcatgacgtgtcctgcactatgctgagg

SEQ ID NO: 30156 - DNA, 30 bp, Homo sapiens
accctcggaagaagctgatgagaaaggcgc

SEQ ID NO: 30157 - DNA, 30 bp, Homo sapiens
cagagggagtgccacttctcagcgcagtag

SEQ ID NO: 30158 - DNA, 30 bp, Homo sapiens
ggtaggtgccccctccccagcccaacccca

SEQ ID NO: 30159 - DNA, 30 bp, Homo sapiens
cagcggcgtttgagtccgccattggcaagc

SEQ ID NO: 30160 - DNA, 30 bp, Homo sapiens
aatccgcaacatcactgagctgggatacag

SEQ ID NO: 30161 - DNA, 30 bp, Homo sapiens
gcaaggcaccaatagagagcagacattcca

SEQ ID NO: 30162 - DNA, 30 bp, Homo sapiens
actcaaatcactgttggtcactaatgctga

SEQ ID NO: 30163 - DNA, 30 bp, Homo sapiens
gccttctctccagtccatgttgaggtgctt

SEQ ID NO: 30164 - DNA, 30 bp, Homo sapiens
atgtgtggatactgaggaaggcatggttcg

SEQ ID NO: 30165 - DNA, 30 bp, Homo sapiens
tactggtccacagccagtacgcacggcagg

SEQ ID NO: 30166 - DNA, 30 bp, Homo sapiens
cttctaccaactgcttgaacgttggtctct

SEQ ID NO: 30167 - DNA, 30 bp, Homo sapiens
acgtccgcgagcccccactgctgggtgggg

SEQ ID NO: 30168 - DNA, 30 bp, Homo sapiens
acccgaaggggaaggagctggatcccaatg

SEQ ID NO: 30169 - DNA, 30 bp, Homo sapiens
agcactgatagtggatgtgctggtggacct

SEQ ID NO: 30170 - DNA, 30 bp, Homo sapiens
tggctccccccaggtggtgttgctgtcctt

SEQ ID NO: 30171 - DNA, 30 bp, Homo sapiens
ggtaaagtgagtcatattctgtttccgcag

SEQ ID NO: 30172 - DNA, 30 bp, Homo sapiens
gtctcgggaacacaactttcccaactttgc

SEQ ID NO: 30173 - DNA, 30 bp, Homo sapiens
cagtcatcattcatgatcgccaaatactcc

SEQ ID NO: 30174 - DNA, 30 bp, Homo sapiens
atttcagagaataccaccacccatgccagg

SEQ ID NO: 30175 - DNA, 30 bp, Homo sapiens
tgaaggaggacttgtagccaccagggtgtg

SEQ ID NO: 30176 - DNA, 30 bp, Homo sapiens
ccccgggctggtactgtggttcagcggagg

SEQ ID NO: 30177 - DNA, 30 bp, Homo sapiens
atgtccttaggttttacccattcgtcaaac

SEQ ID NO: 30178 - DNA, 30 bp, Homo sapiens
cactgggcttagaatgcaaaaggctctggc

SEQ ID NO: 30179 - DNA, 30 bp, Homo sapiens
acttccgtaagggattgaggattctcccca

SEQ ID NO: 30180 - DNA, 30 bp, Homo sapiens
caagggccagggttttctcccctccagctc

SEQ ID NO: 30181 - DNA, 30 bp, Homo sapiens
gagctgcggcttctgctgccatttcctcct

SEQ ID NO: 30182 - DNA, 30 bp, Homo sapiens
ttttggcacagtcgggacaatacacttgct

SEQ ID NO: 30183 - DNA, 30 bp, Homo sapiens
cagtggaagcagtagtcgtgccaggattgt

SEQ ID NO: 30184 - DNA, 30 bp, Homo sapiens
agtcggggcacaggatgtcgtccctctctg

SEQ ID NO: 30185 - DNA, 30 bp, Homo sapiens
agtaggcaaagtcatcgcgagctgtgaagc

SEQ ID NO: 30186 - DNA, 30 bp, Homo sapiens
gcctggctacagccctggcagagcacttgg

SEQ ID NO: 30187 - DNA, 30 bp, Homo sapiens
tgtcagtgtccattccggagccacattttt

SEQ ID NO: 30188 - DNA, 30 bp, Homo sapiens
cacctccaggccaggacccttgcttagtcc

SEQ ID NO: 30189 - DNA, 30 bp, Homo sapiens
ccgaggtgccaaccaagcccagggctctgg

SEQ ID NO: 30190 - DNA, 30 bp, Homo sapiens
tagcggtcctcccggaccggccggatcttc

SEQ ID NO: 30191 - DNA, 30 bp, Homo sapiens
tagtcgggtcccatggctcctaatggtgag

SEQ ID NO: 30192 - DNA, 30 bp, Homo sapiens
tcatgatacaggcgcaggaggcagccgcgg

SEQ ID NO: 30193 - DNA, 30 bp, Homo sapiens
cacaggaagcgtctccttgaacccagagtg

SEQ ID NO: 30194 - DNA, 30 bp, Homo sapiens
cacaggtagcggttcctgatgtactctcgg

SEQ ID NO: 30195 - DNA, 30 bp, Homo sapiens
ttctgggaatctatccagacttctggttgg

SEQ ID NO: 30196 - DNA, 30 bp, Homo sapiens
gagatatgctaggctgaatcttgcagaaag

SEQ ID NO: 30197 - DNA, 30 bp, Homo sapiens
tactttccacaaccaaaagttttgttccag

SEQ ID NO: 30198 - DNA, 30 bp, Homo sapiens
gtgtccggagccgtacattttgtcccactc

SEQ ID NO: 30199 - DNA, 30 bp, Homo sapiens
catctggagttcattcgtaactggtgaatg

SEQ ID NO: 30200 - DNA, 30 bp, Homo sapiens
gcccttcccccctccgagagaggtggtgct

SEQ ID NO: 30201 - DNA, 30 bp, Homo sapiens
atgaggcagaagaagtggttccactgtaat

SEQ ID NO: 30202 - DNA, 30 bp, Homo sapiens
tcgaggaagaggtgtggctgttggtgtgat

SEQ ID NO: 30203 - DNA, 30 bp, Homo sapiens
ctgcaggtgtagcttcggtgctctcctgtt

SEQ ID NO: 30204 - DNA, 30 bp, Homo sapiens
ggatttggacttggacacagcaagtccgat

SEQ ID NO: 30205 - DNA, 30 bp, Homo sapiens
ggctggagtggggacgggggaagagcccat

SEQ ID NO: 30206 - DNA, 30 bp, Homo sapiens
ctctggggaggaagtcctggggaaaaggct

SEQ ID NO: 30207 - DNA, 30 bp, Homo sapiens
ccccggtgcagcttcaggtgcctggagagg

SEQ ID NO: 30208 - DNA, 30 bp, Homo sapiens
gaccggcggccgtacttggccttacagtgc

SEQ ID NO: 30209 - DNA, 30 bp, Homo sapiens
agagctcctcgtggacccgctcctcgtcct

SEQ ID NO: 30210 - DNA, 30 bp, Homo sapiens
gcttctttttggagactttgggtctattgg

SEQ ID NO: 30211 - DNA, 30 bp, Homo sapiens
tactggctgctggaggtcatgccaggtggc

SEQ ID NO: 30212 - DNA, 30 bp, Homo sapiens
ccaaagcatcatgatgactttcattcacca

SEQ ID NO: 30213 - DNA, 30 bp, Homo sapiens
cagtcaatgtcatcgtcatcatcatcatct

SEQ ID NO: 30214 - DNA, 30 bp, Homo sapiens
attccagttttagaagctccacatcgaaga

SEQ ID NO: 30215 - DNA, 30 bp, Homo sapiens
gtctggaggcaccagatccctccatggcag

SEQ ID NO: 30216 - DNA, 30 bp, Homo sapiens
ctctaagttgagcagctccacgtcaaagat

SEQ ID NO: 30217 - DNA, 30 bp, Homo sapiens
agcagggatgggggcagatggggagaggag

SEQ ID NO: 30218 - DNA, 30 bp, Homo sapiens
cgaacaccagggttgcaccgcctggaatct

SEQ ID NO: 30219 - DNA, 30 bp, Homo sapiens
caaaagtgagttttgcatttggtggaattt

SEQ ID NO: 30220 - DNA, 30 bp, Homo sapiens
gagactggctccctgccgtgttgctcttct

SEQ ID NO: 30221 - DNA, 30 bp, Homo sapiens
acgtggccctcaggtttctcttcttccatt

SEQ ID NO: 30222 - DNA, 30 bp, Homo sapiens
catagggactcacacaccttgaagtatacg

SEQ ID NO: 30223 - DNA, 30 bp, Homo sapiens
actttctcctgctgtagaaccatcgccaca

SEQ ID NO: 30224 - DNA, 30 bp, Homo sapiens
tgttggtatacattgtattccttgggagaa

SEQ ID NO: 30225 - DNA, 30 bp, Homo sapiens
tcctggcagcgatgaccacagagagtgcca

SEQ ID NO: 30226 - DNA, 30 bp, Homo sapiens
gtttggcttcctggtctttgagtttaaatt

SEQ ID NO: 30227 - DNA, 30 bp, Homo sapiens
atcttgcgcagaccctgagccagccctgca

SEQ ID NO: 30228 - DNA, 30 bp, Homo sapiens
cccgtcagactcagcagtgccgggttgggg

SEQ ID NO: 30229 - DNA, 30 bp, Homo sapiens
tcgagggtttcacagggtacatggaccttc

SEQ ID NO: 30230 - DNA, 30 bp, Homo sapiens
cccactcagaaataggccagattccattgg

SEQ ID NO: 30231 - DNA, 30 bp, Homo sapiens
cagtgtaaacttcggaaacaggtatcttta

SEQ ID NO: 30232 - DNA, 30 bp, Homo sapiens
gtgcgggagttccgctcctcttcttcgttc

SEQ ID NO: 30233 - DNA, 30 bp, Homo sapiens
atctggggtgccaccaatggctttgggcat

SEQ ID NO: 30234 - DNA, 30 bp, Homo sapiens
ccctcggtcatacaggatacagtatgggac

SEQ ID NO: 30235 - DNA, 30 bp, Homo sapiens
gatcggagggtgagcttcccgaaggctcgt

SEQ ID NO: 30236 - DNA, 30 bp, Homo sapiens
ctccgaggctgtggggctgcggaccgtgga

SEQ ID NO: 30237 - DNA, 30 bp, Homo sapiens
aaacctgggtccttattaatatacgttgca

SEQ ID NO: 30238 - DNA, 30 bp, Homo sapiens
gaaaggtgagaattactgatgctttttctg

SEQ ID NO: 30239 - DNA, 30 bp, Homo sapiens
tgtgaaggcacgtgggtgttaggatggcgg

SEQ ID NO: 30240 - DNA, 30 bp, Homo sapiens
gccagggccttgcagaaggcgctccaggcg

SEQ ID NO: 30241 - DNA, 30 bp, Homo sapiens
ttctggtagtttttgaaattagcaaggatg

SEQ ID NO: 30242 - DNA, 30 bp, Homo sapiens
tcagacaagggacagataccaacaagccag

SEQ ID NO: 30243 - DNA, 30 bp, Homo sapiens
acgcggtaggggctgcctgggatgtgctcg

SEQ ID NO: 30244 - DNA, 30 bp, Homo sapiens
aaaagggctgccagggatgtgttcctcccc

SEQ ID NO: 30245 - DNA, 30 bp, Homo sapiens
caagggaccttgactttgaaggggcttcca

SEQ ID NO: 30246 - DNA, 30 bp, Homo sapiens
caaaggcttgtgattcacctgggagatgct

SEQ ID NO: 30247 - DNA, 30 bp, Homo sapiens
acctgcacaccagtggccttcttgatcagg

SEQ ID NO: 30248 - DNA, 30 bp, Homo sapiens
tgtaggagtagtctatgtcggggatgccgc

SEQ ID NO: 30249 - DNA, 30 bp, Homo sapiens
gtatggcagtgctccaggtctggcacgctg

SEQ ID NO: 30250 - DNA, 30 bp, Homo sapiens
gtctggaataccactgtctctgtagcttcg

SEQ ID NO: 30251 - DNA, 30 bp, Homo sapiens
gaaaacagcctttttgttgcagtgctcacc

SEQ ID NO: 30252 - DNA, 30 bp, Homo sapiens
agttggaagagaagcttgtaggtggcaaca

SEQ ID NO: 30253 - DNA, 30 bp, Homo sapiens
agatgggtggggtggagtacaggaccaccg

SEQ ID NO: 30254 - DNA, 30 bp, Homo sapiens
cgatggtgacgttgatgtatacagttcagg

SEQ ID NO: 30255 - DNA, 30 bp, Homo sapiens
cgaatcttcgacctgagcctgcggagagag

SEQ ID NO: 30256 - DNA, 30 bp, Homo sapiens
cagtgctccacaagcagcaggtcctgggga

SEQ ID NO: 30257 - DNA, 30 bp, Homo sapiens
acaagggctttgtacagagttgggtaaatg

SEQ ID NO: 30258 - DNA, 30 bp, Homo sapiens
gccgctttcttgtctatgcctgctctctat

SEQ ID NO: 30259 - DNA, 30 bp, Homo sapiens
agacggggagcagtggtcctcctcgcttgg

SEQ ID NO: 30260 - DNA, 30 bp, Homo sapiens
gcttggacaacataaccgtttttggttctt

SEQ ID NO: 30261 - DNA, 30 bp, Homo sapiens
agagatgatcctctgacacagcagtgggca

SEQ ID NO: 30262 - DNA, 30 bp, Homo sapiens
aatctgctggctttcaggagaacacgtctt

SEQ ID NO: 30263 - DNA, 30 bp, Homo sapiens
cactgggactcgccatccagtctgacgtct

SEQ ID NO: 30264 - DNA, 30 bp, Homo sapiens
tacagggacttgccgggcgccacagagcag

SEQ ID NO: 30265 - DNA, 30 bp, Homo sapiens
ccttccctccaggctgatggggcaacttga

SEQ ID NO: 30266 - DNA, 30 bp, Homo sapiens
tctactctccttcccttttccagcttcttc

SEQ ID NO: 30267 - DNA, 30 bp, Homo sapiens
tagtggtcacactggcttccttctgacgca

SEQ ID NO: 30268 - DNA, 30 bp, Homo sapiens
tcatgtcttggttttattttataaagtgat

SEQ ID NO: 30269 - DNA, 30 bp, Homo sapiens
cccaggctggcctcacagaggagccgggat

SEQ ID NO: 30270 - DNA, 30 bp, Homo sapiens
acagaacgcaagttctgatcatcaaagcgc

SEQ ID NO: 30271 - DNA, 30 bp, Homo sapiens
cagtgggggcctggagcccgagggggacca

SEQ ID NO: 30272 - DNA, 30 bp, Homo sapiens
gcaaagccagaaagctaaagactttaagaa

SEQ ID NO: 30273 - DNA, 30 bp, Homo sapiens
agttggcaaaaaaaggccacaacaacagca

SEQ ID NO: 30274 - DNA, 30 bp, Homo sapiens
acaaggaaaacagcgattaacagaatagga

SEQ ID NO: 30275 - DNA, 30 bp, Homo sapiens
caaagacttactaggtaaggggacattctg

SEQ ID NO: 30276 - DNA, 30 bp, Homo sapiens
gcccctttattccgggacaatttctcagac

SEQ ID NO: 30277 - DNA, 30 bp, Homo sapiens
aactactcttgtcatcagaggcttcctgat

SEQ ID NO: 30278 - DNA, 30 bp, Homo sapiens
gtgagggcaatgtctttagacctgtgttta

SEQ ID NO: 30279 - DNA, 30 bp, Homo sapiens
atgaggctggcaaggcgcaggcagaggggc

SEQ ID NO: 30280 - DNA, 30 bp, Homo sapiens
acgagtggttgctgaccatccacgctgtct

SEQ ID NO: 30281 - DNA, 30 bp, Homo sapiens
tcctcacgtcctcttgctgctttctgtaac

SEQ ID NO: 30282 - DNA, 30 bp, Homo sapiens
ccaaggtttctgggtgggatactcacaggt

SEQ ID NO: 30283 - DNA, 30 bp, Homo sapiens
ctcgggaatcttctctgtcagcctgtacat

SEQ ID NO: 30284 - DNA, 30 bp, Homo sapiens
cttgagcagccttcgcatggtgcccaagga

SEQ ID NO: 30285 - DNA, 30 bp, Homo sapiens
cacttgaccagattcctcatgatgttcagg

SEQ ID NO: 30286 - DNA, 30 bp, Homo sapiens
agacttcgacatatgaagtggggacataac

SEQ ID NO: 30287 - DNA, 30 bp, Homo sapiens
acgtgggaacgtagccttcttcaccgttct

SEQ ID NO: 30288 - DNA, 30 bp, Homo sapiens
tccttctcttcagccttgctctccaatcct

SEQ ID NO: 30289 - DNA, 30 bp, Homo sapiens
tccagggatggagaccccacactcgtacca

SEQ ID NO: 30290 - DNA, 30 bp, Homo sapiens
caggggtgtctgcgcaggccggggcgcgcg

SEQ ID NO: 30291 - DNA, 30 bp, Homo sapiens
gagtggctgagggcgggcccctccaggggc

SEQ ID NO: 30292 - DNA, 30 bp, Homo sapiens
acaaggatgacggcagcacactgctcgtca

SEQ ID NO: 30293 - DNA, 30 bp, Homo sapiens
acaatgatggctgcaaactgttcatcagta

SEQ ID NO: 30294 - DNA, 30 bp, Homo sapiens
cgatggtgttgatagatggtgactttttct

SEQ ID NO: 30295 - DNA, 30 bp, Homo sapiens
gccctggtgctctggtgtgctggtttctga

SEQ ID NO: 30296 - DNA, 30 bp, Homo sapiens
catgaggcacagggtggcccacccaggccc

SEQ ID NO: 30297 - DNA, 30 bp, Homo sapiens
aagagggcaatgacacctgcccacatgaac

SEQ ID NO: 30298 - DNA, 30 bp, Homo sapiens
caagtgtacttccagagcaagttactgaat

SEQ ID NO: 30299 - DNA, 30 bp, Homo sapiens
taacagggaaataggtattccagatcctcc

SEQ ID NO: 30300 - DNA, 30 bp, Homo sapiens
aatgaggcagtatagcgggtgggtcaccac

SEQ ID NO: 30301 - DNA, 30 bp, Homo sapiens
tgtgcccaaagtgggttatatggatgagtc

SEQ ID NO: 30302 - DNA, 30 bp, Homo sapiens
atatggagagtgagtgcttgctacagcagc

SEQ ID NO: 30303 - DNA, 30 bp, Homo sapiens
ataaggagaatgagtactggcaatagcagt

SEQ ID NO: 30304 - DNA, 30 bp, Homo sapiens
tgaagggatcttccaatgtatctccaatat

SEQ ID NO: 30305 - DNA, 30 bp, Homo sapiens
atatgctctggtccatacagctttcttctt

SEQ ID NO: 30306 - DNA, 30 bp, Homo sapiens
aggctacttcactcaaagtctctgcagctg

SEQ ID NO: 30307 - DNA, 30 bp, Homo sapiens
cagcattagggccaggctaagcaggaaagg

SEQ ID NO: 30308 - DNA, 30 bp, Homo sapiens
ccaaggagccagagttgcagcatcagggcc

SEQ ID NO: 30309 - DNA, 30 bp, Homo sapiens
agacggggccccagcattcatggccgcagc

SEQ ID NO: 30310 - DNA, 30 bp, Homo sapiens
ctctggttgacctgccggatccagggcccc

SEQ ID NO: 30311 - DNA, 30 bp, Homo sapiens
caacggaactacaggttgaccagattctgc

SEQ ID NO: 30312 - DNA, 30 bp, Homo sapiens
aaacatgaagatcttcaatgttagtacttt

SEQ ID NO: 30313 - DNA, 30 bp, Homo sapiens
cacagggccagcagcgtgggtgagctgagc

SEQ ID NO: 30314 - DNA, 30 bp, Homo sapiens
gcgaggagggagggcgagttcaggggatcg

SEQ ID NO: 30315 - DNA, 30 bp, Homo sapiens
aaagcgaggagggttggagagccaaggggg

SEQ ID NO: 30316 - DNA, 30 bp, Homo sapiens
gcaggaagtcggtcagttccttcctccggt

SEQ ID NO: 30317 - DNA, 30 bp, Homo sapiens
gagtgggggagttcaaggagtctgatgatt

SEQ ID NO: 30318 - DNA, 30 bp, Homo sapiens
tttaggacgggtctggaatacacaccttgg

SEQ ID NO: 30319 - DNA, 30 bp, Homo sapiens
aagaggagttcataatgggccgggagtaca

SEQ ID NO: 30320 - DNA, 30 bp, Homo sapiens
taggatgcattaagcaaagagcgggaatag

SEQ ID NO: 30321 - DNA, 30 bp, Homo sapiens
ccgagtgcaaggcggaggccgggctggtga

SEQ ID NO: 30322 - DNA, 30 bp, Homo sapiens
gcaaggagccgcccttgctttcggccgagg

SEQ ID NO: 30323 - DNA, 30 bp, Homo sapiens
ctccggacgtgcggtacagagactggctgg

SEQ ID NO: 30324 - DNA, 30 bp, Homo sapiens
cgtaggagtagggggctgcgtggcgataga

SEQ ID NO: 30325 - DNA, 30 bp, Homo sapiens
agtaaagttctcgacactggacagggcagt

SEQ ID NO: 30326 - DNA, 30 bp, Homo sapiens
aagtggcagccactaaggccggcgactttg

SEQ ID NO: 30327 - DNA, 30 bp, Homo sapiens
tgcgccggccatttggcttgagcggcggcc

SEQ ID NO: 30328 - DNA, 30 bp, Homo sapiens
aggagggccctgcggactcggccagggaac

SEQ ID NO: 30329 - DNA, 30 bp, Homo sapiens
gccctctgccaccgcctgataccgcagcag

SEQ ID NO: 30330 - DNA, 30 bp, Homo sapiens
aggccgacaggtgcccgcccagcaccgcgc

SEQ ID NO: 30331 - DNA, 30 bp, Homo sapiens
cagcgccgacgaggccgacaggtgcccgcc

SEQ ID NO: 30332 - DNA, 30 bp, Homo sapiens
agcagggccgacgaggccgacaggtgcccg

SEQ ID NO: 30333 - DNA, 30 bp, Homo sapiens
acatggcggacacgaaccgatctatcccac

SEQ ID NO: 30334 - DNA, 30 bp, Homo sapiens
cagcgggcagcgggccggggccggggcgcg

SEQ ID NO: 30335 - DNA, 30 bp, Homo sapiens
atcacgcaaggcttgatgtcttggtaggtg

SEQ ID NO: 30336 - DNA, 30 bp, Homo sapiens
acatgacgcagggcttaatatcctgacaga

SEQ ID NO: 30337 - DNA, 30 bp, Homo sapiens
gacagtcccgtcgtaaaacttggcaaagag

SEQ ID NO: 30338 - DNA, 30 bp, Homo sapiens
cacaggctgcaccaggagagcagccagcct

SEQ ID NO: 30339 - DNA, 30 bp, Homo sapiens
cctcggtgccctccctggggtagaggacac

SEQ ID NO: 30340 - DNA, 30 bp, Homo sapiens
aaacttcggtcccttcccggctgtagagga

SEQ ID NO: 30341 - DNA, 30 bp, Homo sapiens
cctcggagccctctcgggggtagatgaggc

SEQ ID NO: 30342 - DNA, 30 bp, Homo sapiens
acaagaaggcccccacgctggcccagtcct

SEQ ID NO: 30343 - DNA, 30 bp, Homo sapiens
cgaagtcatcagggatctcctcattggcac

SEQ ID NO: 30344 - DNA, 30 bp, Homo sapiens
caattgaatcccaatcaaagtcatcctgga

SEQ ID NO: 30345 - DNA, 30 bp, Homo sapiens
tccccggtgcctggcccctgggggccggca

SEQ ID NO: 30346 - DNA, 30 bp, Homo sapiens
ttctggacacccttttcccttacggctgcc

SEQ ID NO: 30347 - DNA, 30 bp, Homo sapiens
tactggaagtggagtaccgtgtcgggaacc

SEQ ID NO: 30348 - DNA, 30 bp, Homo sapiens
tcgaggcgcgaatgcagcgcgccggtcttg

SEQ ID NO: 30349 - DNA, 30 bp, Homo sapiens
gctagccaagcaccgcagaggccatccctc

SEQ ID NO: 30350 - DNA, 30 bp, Homo sapiens
ctcaggaataaactgggaccagttgatgtt

SEQ ID NO: 30351 - DNA, 30 bp, Homo sapiens
gccagggccacgggcttggagctggggctg

SEQ ID NO: 30352 - DNA, 30 bp, Homo sapiens
catgtacgaattccagcaaggtggagcaga

SEQ ID NO: 30353 - DNA, 30 bp, Homo sapiens
gctctttctgcccctttgccgtccgattgg

SEQ ID NO: 30354 - DNA, 30 bp, Homo sapiens
agcagggctataggcttgttcccctgtgca

SEQ ID NO: 30355 - DNA, 30 bp, Homo sapiens
gcctgacacccagctatgtgtcgttgtctt

SEQ ID NO: 30356 - DNA, 30 bp, Homo sapiens
gcctggcacccagctctgagatgaggcctg

SEQ ID NO: 30357 - DNA, 30 bp, Homo sapiens
cctcgccctcatccatgaggtcactgatga

SEQ ID NO: 30358 - DNA, 30 bp, Homo sapiens
gcccggcacccagctctggttggggggcgg

SEQ ID NO: 30359 - DNA, 30 bp, Homo sapiens
gttaggctgacacacaggtccactcatctt

SEQ ID NO: 30360 - DNA, 30 bp, Homo sapiens
cctcgtttactggttcatcttcgtaatctc

SEQ ID NO: 30361 - DNA, 30 bp, Homo sapiens
gtttgggagatggtttgggctctgagggtc

SEQ ID NO: 30362 - DNA, 30 bp, Homo sapiens
cttcagataaaggctcttcttcaatctctc

SEQ ID NO: 30363 - DNA, 30 bp, Homo sapiens
caggggccaggtgtagggttggaacacctg

SEQ ID NO: 30364 - DNA, 30 bp, Homo sapiens
ggacagttcttctcccggcagctcctcctc

SEQ ID NO: 30365 - DNA, 30 bp, Homo sapiens
gctaggagcgtctccaccgggtacggcagg

SEQ ID NO: 30366 - DNA, 30 bp, Homo sapiens
aagaggaagggcatcacatctggctggctc

SEQ ID NO: 30367 - DNA, 30 bp, Homo sapiens
ctctggctgactcatgcactcttggattct

SEQ ID NO: 30368 - DNA, 30 bp, Homo sapiens
tcctggatcttctctcccaagtaaaagcgg

SEQ ID NO: 30369 - DNA, 30 bp, Homo sapiens
tgttgctatcgacggactgagccagaggcc

SEQ ID NO: 30370 - DNA, 30 bp, Homo sapiens
tcctggcgtccggtataggcagggggtcag

SEQ ID NO: 30371 - DNA, 30 bp, Homo sapiens
tactgggacagtgcgggctccagcagcttc

SEQ ID NO: 30372 - DNA, 30 bp, Homo sapiens
ttcaggctgaatgctgacttgttcttaaca

SEQ ID NO: 30373 - DNA, 30 bp, Homo sapiens
cccaaaacgatcttcatttttcttcttaag

SEQ ID NO: 30374 - DNA, 30 bp, Homo sapiens
cactttgcctgtaactccacctctgcagaa

SEQ ID NO: 30375 - DNA, 30 bp, Homo sapiens
attgcctgtaactcagtctctgcaggaggt

SEQ ID NO: 30376 - DNA, 30 bp, Homo sapiens
attgcttgtaactccgtctcctcaggaggt

SEQ ID NO: 30377 - DNA, 30 bp, Homo sapiens
ctctggtagtggacccttccaaagttcaga

SEQ ID NO: 30378 - DNA, 30 bp, Homo sapiens
aacgtgtaagccgcctcaggctcactcagg

SEQ ID NO: 30379 - DNA, 30 bp, Homo sapiens
tcaagggctcaacctttccaacttccaaag

SEQ ID NO: 30380 - DNA, 30 bp, Homo sapiens
gccaggcacaagaacgccgtcgccagttct

SEQ ID NO: 30381 - DNA, 30 bp, Homo sapiens
gcaaggagcctgagggctgcagggcaatgc

SEQ ID NO: 30382 - DNA, 30 bp, Homo sapiens
gtcttttgtttgccatttcccttgtctttg

SEQ ID NO: 30383 - DNA, 30 bp, Homo sapiens
tgatggctctgtgggggcaccatgggctca

SEQ ID NO: 30384 - DNA, 30 bp, Homo sapiens
tgatggtgtcctcgatgaaaatggtagttt

SEQ ID NO: 30385 - DNA, 30 bp, Homo sapiens
cacttgcagtatctgtcggctttcaatttg

SEQ ID NO: 30386 - DNA, 30 bp, Homo sapiens
ctgatccactgacagtctcagttatctcct

SEQ ID NO: 30387 - DNA, 30 bp, Homo sapiens
ttagcctcatctgatccactgacaggctca

SEQ ID NO: 30388 - DNA, 30 bp, Homo sapiens
cagtgtctcaaatgtaggtcgttccttagg

SEQ ID NO: 30389 - DNA, 30 bp, Homo sapiens
ccacaaactcctgtggtggagcctctccga

SEQ ID NO: 30390 - DNA, 30 bp, Homo sapiens
atgtagaggatgaggtggactttcccagcc

SEQ ID NO: 30391 - DNA, 30 bp, Homo sapiens
gcatggagactgactccaaaaggaggagga

SEQ ID NO: 30392 - DNA, 30 bp, Homo sapiens
ttcatcagtactttggtgaggtggagactc

SEQ ID NO: 30393 - DNA, 30 bp, Homo sapiens
tccaggctttgaatcttcatgccaaaagag

SEQ ID NO: 30394 - DNA, 30 bp, Homo sapiens
cctgatgctgctgttgctgtagcggtggtc

SEQ ID NO: 30395 - DNA, 30 bp, Homo sapiens
caggtgtcaatgagcaggctcaccactgag

SEQ ID NO: 30396 - DNA, 30 bp, Homo sapiens
agcaggctcaccactgagcggattttgcag

SEQ ID NO: 30397 - DNA, 30 bp, Homo sapiens
ctctggaacttcatcatgagtgagatccag

SEQ ID NO: 30398 - DNA, 30 bp, Homo sapiens
ttcagcagttggtgtgttgaaataagcatc

SEQ ID NO: 30399 - DNA, 30 bp, Homo sapiens
ccctgctccaggctgtcgccgggctgcacc

SEQ ID NO: 30400 - DNA, 30 bp, Homo sapiens
tacagggccgtggatgcccggaacttctgg

SEQ ID NO: 30401 - DNA, 30 bp, Homo sapiens
tagaggagatgagaaggaatatcttccaag

SEQ ID NO: 30402 - DNA, 30 bp, Homo sapiens
ataagggtttttaaggagtgggtgaatgtg

SEQ ID NO: 30403 - DNA, 30 bp, Homo sapiens
tcttggggagccgatggcatccatctctca

SEQ ID NO: 30404 - DNA, 30 bp, Homo sapiens
cagacatgaccccagtcttccaagtgagaa

SEQ ID NO: 30405 - DNA, 30 bp, Homo sapiens
tagggggttcccatcaataggtagaaggtc

SEQ ID NO: 30406 - DNA, 30 bp, Homo sapiens
acatgggcagatcagtactattgtgtctag

SEQ ID NO: 30407 - DNA, 30 bp, Homo sapiens
cagaggcaggtcggtgctgttgtgccgggt

SEQ ID NO: 30408 - DNA, 30 bp, Homo sapiens
agagactagtgccagaaacactggagtctg

SEQ ID NO: 30409 - DNA, 30 bp, Homo sapiens
ctcaccatatttcccattggtttggcctgt

SEQ ID NO: 30410 - DNA, 30 bp, Homo sapiens
tgccgggggttcgagttcctgccagacttc

SEQ ID NO: 30411 - DNA, 30 bp, Homo sapiens
gcgaattgctttcagcttctccacttcaat

SEQ ID NO: 30412 - DNA, 30 bp, Homo sapiens
tacagttcaggaggacgttgttttaattct

SEQ ID NO: 30413 - DNA, 30 bp, Homo sapiens
tactcccagagcgaggcggggtccacggtt

SEQ ID NO: 30414 - DNA, 30 bp, Homo sapiens
tactcccaaagcgcggtcccggccggggcg

SEQ ID NO: 30415 - DNA, 30 bp, Homo sapiens
attcccagatacactctctggtaatgtctt

SEQ ID NO: 30416 - DNA, 30 bp, Homo sapiens
acctggaagctgccacaccataccgtgaaa

SEQ ID NO: 30417 - DNA, 30 bp, Homo sapiens
gtgaggctggtgttggagctgctggtagca

SEQ ID NO: 30418 - DNA, 30 bp, Homo sapiens
tccagggcattattacattgactaatctga

SEQ ID NO: 30419 - DNA, 30 bp, Homo sapiens
acttggaacctgcatcccagtactcaaaga

SEQ ID NO: 30420 - DNA, 30 bp, Homo sapiens
tgtacctttagacacccaggcttttccaaa

SEQ ID NO: 30421 - DNA, 30 bp, Homo sapiens
gagcagtagctgggccccaggcctcgcaca

SEQ ID NO: 30422 - DNA, 30 bp, Homo sapiens
tagagggacaagtatgtaagtggaaccact

SEQ ID NO: 30423 - DNA, 30 bp, Homo sapiens
tgttggtcttctgatgaaaggctcacactg

SEQ ID NO: 30424 - DNA, 30 bp, Homo sapiens
tcctggtgagctggtgaggaagatctggaa

SEQ ID NO: 30425 - DNA, 30 bp, Homo sapiens
tcctggtcttcatcttcctcctcttcctcg

SEQ ID NO: 30426 - DNA, 30 bp, Homo sapiens
tgctttacttccagtagcacacctgaggag

SEQ ID NO: 30427 - DNA, 30 bp, Homo sapiens
tagatctctttggtgctcactctcttggtc

SEQ ID NO: 30428 - DNA, 30 bp, Homo sapiens
ctgcagactcaccacctggcggctcctcag

SEQ ID NO: 30429 - DNA, 30 bp, Homo sapiens
atacctcacccacccacaccactgtggtcc

SEQ ID NO: 30430 - DNA, 30 bp, Homo sapiens
tctaggatgaagagagagtccttggaaggt

SEQ ID NO: 30431 - DNA, 30 bp, Homo sapiens
ctcctgccgggtctccaagcagtccagcac

SEQ ID NO: 30432 - DNA, 30 bp, Homo sapiens
agcgtcgaaggtcctgctgtccctggggtt

SEQ ID NO: 30433 - DNA, 30 bp, Homo sapiens
gggtctccaagcagtccagcaccagtgcag

SEQ ID NO: 30434 - DNA, 30 bp, Homo sapiens
ggctgcaccaacccagcgctcctggaaaga

SEQ ID NO: 30435 - DNA, 30 bp, Homo sapiens
tattccactgtgacaccagagagagggtaa

SEQ ID NO: 30436 - DNA, 30 bp, Homo sapiens
ggcttggttgcgcttgtccaccaacttatc

SEQ ID NO: 30437 - DNA, 30 bp, Homo sapiens
tcagaacctgttaaaccacatctttgggaa

SEQ ID NO: 30438 - DNA, 30 bp, Homo sapiens
cccagggtgtgcttgtcaaagagatattcc

SEQ ID NO: 30439 - DNA, 30 bp, Homo sapiens
ttctggctgcggcccagggtgagcttgtta

SEQ ID NO: 30440 - DNA, 30 bp, Homo sapiens
acgcggccgcccagggtgagcttgtcgaac

SEQ ID NO: 30441 - DNA, 30 bp, Homo sapiens
gaagagatactcgcccagcccagcctccgg

SEQ ID NO: 30442 - DNA, 30 bp, Homo sapiens
ccaagggtatgtgtgtcaaaaaggtactcc

SEQ ID NO: 30443 - DNA, 30 bp, Homo sapiens
agggttttgcttccagaagctgacctctga

SEQ ID NO: 30444 - DNA, 30 bp, Homo sapiens
gggtgtggcactgaggggcggccaggggct

SEQ ID NO: 30445 - DNA, 30 bp, Homo sapiens
gttgctgtgctctttggtccttcttcatcc

SEQ ID NO: 30446 - DNA, 30 bp, Homo sapiens
gtgctggaggatgctgtggcattccctggg

SEQ ID NO: 30447 - DNA, 30 bp, Homo sapiens
tgtgggcctgcgcctgccctaacgtctgtc

SEQ ID NO: 30448 - DNA, 30 bp, Homo sapiens
agctttatagtccaagcaaactctgcgggg

SEQ ID NO: 30449 - DNA, 30 bp, Homo sapiens
cccatttacacggcatctgatgaatggtta

SEQ ID NO: 30450 - DNA, 30 bp, Homo sapiens
catgggaaagggcaacaggttgaggcctcg

SEQ ID NO: 30451 - DNA, 30 bp, Homo sapiens
gatgcaagtccgagcaaaaagcctcccaca

SEQ ID NO: 30452 - DNA, 30 bp, Homo sapiens
gatgccatgccaagcagaaagcctccgaaa

SEQ ID NO: 30453 - DNA, 30 bp, Homo sapiens
gccacaacagcaaaagccttcttagcccgt

SEQ ID NO: 30454 - DNA, 30 bp, Homo sapiens
agcagggggttgagggcaagcacccccttc

SEQ ID NO: 30455 - DNA, 30 bp, Homo sapiens
cagagggcgctctggtctttgataaaggcg

SEQ ID NO: 30456 - DNA, 30 bp, Homo sapiens
atacggcctctccctgcgatcctgtctgtg

SEQ ID NO: 30457 - DNA, 30 bp, Homo sapiens
tccagagtggagacaagtctgcattaatgc

SEQ ID NO: 30458 - DNA, 30 bp, Homo sapiens
atactaggccccaaaactcttgagatgaaa

SEQ ID NO: 30459 - DNA, 30 bp, Homo sapiens
atttcgtctgctctgtttcattgttgtgga

SEQ ID NO: 30460 - DNA, 30 bp, Homo sapiens
tttttccgagtggggccaaagaaatcttaa

SEQ ID NO: 30461 - DNA, 30 bp, Homo sapiens
gtaagggggacaggtctgcggcaatccctg

SEQ ID NO: 30462 - DNA, 30 bp, Homo sapiens
aggtgaaccaagccgctatgctgcgcaccg

SEQ ID NO: 30463 - DNA, 30 bp, Homo sapiens
gaaccagctggccaagttccgtatgctctt

SEQ ID NO: 30464 - DNA, 30 bp, Homo sapiens
accaaccctcaaggtcctcatagacttggc

SEQ ID NO: 30465 - DNA, 30 bp, Homo sapiens
ctcaggatatgtggggtacttgaccgtttc

SEQ ID NO: 30466 - DNA, 30 bp, Homo sapiens
cacatgatcgcaagccaaacatgcatgtga

SEQ ID NO: 30467 - DNA, 30 bp, Homo sapiens
aagtggggtgagggcatgcagagtgtgggt

SEQ ID NO: 30468 - DNA, 30 bp, Homo sapiens
ggatggaacagccacaggagccacgttaac

SEQ ID NO: 30469 - DNA, 30 bp, Homo sapiens
ctgcggccagcagctcatggagggacacgc

SEQ ID NO: 30470 - DNA, 30 bp, Homo sapiens
ttccggaataggccaaggaagacaagtcca

SEQ ID NO: 30471 - DNA, 30 bp, Homo sapiens
aggactgctgcttcttgagtgttttcttct

SEQ ID NO: 30472 - DNA, 30 bp, Homo sapiens
ccattttcattaactgaagctgtatcagat

SEQ ID NO: 30473 - DNA, 30 bp, Homo sapiens
tcaccatactacccaactccaagggggcgg

SEQ ID NO: 30474 - DNA, 30 bp, Homo sapiens
ctgcgggtggacagacggcggatggagctg

SEQ ID NO: 30475 - DNA, 30 bp, Homo sapiens
cttcttattgcccccacagcggaatcttct

SEQ ID NO: 30476 - DNA, 30 bp, Homo sapiens
cagctttgggctgagcctggggtgatgaga

SEQ ID NO: 30477 - DNA, 30 bp, Homo sapiens
acccggacttctggccaaacttgcatttgc

SEQ ID NO: 30478 - DNA, 30 bp, Homo sapiens
gtcaggccccaaccctgtatgggaaccctt

SEQ ID NO: 30479 - DNA, 30 bp, Homo sapiens
tagtggcagagcctggagtgatgagtggga

SEQ ID NO: 30480 - DNA, 30 bp, Homo sapiens
gacctttgagaacccagccctccgtcataa

SEQ ID NO: 30481 - DNA, 30 bp, Homo sapiens
acgattccggcataaccgggacagctgcct

SEQ ID NO: 30482 - DNA, 30 bp, Homo sapiens
aggagtcgggctggctgggaggcgcgtcct

SEQ ID NO: 30483 - DNA, 30 bp, Homo sapiens
ttctggggctctgttgcattggcggtgatg

SEQ ID NO: 30484 - DNA, 30 bp, Homo sapiens
cagcggaatcttctgccatagtagaacggg

SEQ ID NO: 30485 - DNA, 30 bp, Homo sapiens
accaggggctgaagagggaagctcagactt

SEQ ID NO: 30486 - DNA, 30 bp, Homo sapiens
ggtaactccgaaggacataaccatatttcc

SEQ ID NO: 30487 - DNA, 30 bp, Homo sapiens
cggtggtatcaatgacttccaattcttctc

SEQ ID NO: 30488 - DNA, 30 bp, Homo sapiens
tacaggaaatcacttccatcgtagatcaca

SEQ ID NO: 30489 - DNA, 30 bp, Homo sapiens
tacaggttttcaccaggttggtactggggc

SEQ ID NO: 30490 - DNA, 30 bp, Homo sapiens
ccacggtgacaaagcggcttccccctttgt

SEQ ID NO: 30491 - DNA, 30 bp, Homo sapiens
gtttgctgttggtgagcctcgtgtagaact

SEQ ID NO: 30492 - DNA, 30 bp, Homo sapiens
cacacgcaggtgggcgactgggcagggatc

SEQ ID NO: 30493 - DNA, 30 bp, Homo sapiens
acacggtggtctcaccgtgtcggctgttgg

SEQ ID NO: 30494 - DNA, 30 bp, Homo sapiens
cactggttccatcttcttcaataacccgat

SEQ ID NO: 30495 - DNA, 30 bp, Homo sapiens
accacagtctcactgccttttccaggcttc

SEQ ID NO: 30496 - DNA, 30 bp, Homo sapiens
acacgtgcgacagggacacctgcttgtggt

SEQ ID NO: 30497 - DNA, 30 bp, Homo sapiens
ccctgctcttttctcactcctgaaaccggg

SEQ ID NO: 30498 - DNA, 30 bp, Homo sapiens
tctcccccttgctgctgtggctaagtctgt

SEQ ID NO: 30499 - DNA, 30 bp, Homo sapiens
agacctgggacaatggcatctgctttggat

SEQ ID NO: 30500 - DNA, 30 bp, Homo sapiens
tagaggtgtgtggggttctccaaagagggg

SEQ ID NO: 30501 - DNA, 30 bp, Homo sapiens
taccggatcctggtgaagaggttgagcaca

SEQ ID NO: 30502 - DNA, 30 bp, Homo sapiens
aggaggcgtgctgccggttggacagggccc

SEQ ID NO: 30503 - DNA, 30 bp, Homo sapiens
ggaaaatccacatgcagacactcaattgaa

SEQ ID NO: 30504 - DNA, 30 bp, Homo sapiens
ccgtggcgcaagcccccttcccactccaaa

SEQ ID NO: 30505 - DNA, 30 bp, Homo sapiens
aagcggccctccatttgcccggttcctctt

SEQ ID NO: 30506 - DNA, 30 bp, Homo sapiens
ctgtggatgtggctgaaagtttctgcaaca

SEQ ID NO: 30507 - DNA, 30 bp, Homo sapiens
gtgcggctggcccaggacctgggcgaggca

SEQ ID NO: 30508 - DNA, 30 bp, Homo sapiens
tactgactcttctttccgctttgtttcatt

SEQ ID NO: 30509 - DNA, 30 bp, Homo sapiens
gagtggatgggcggtgcttcctgggcactg

SEQ ID NO: 30510 - DNA, 30 bp, Homo sapiens
acaccacttgaaggctaggctgatggacca

SEQ ID NO: 30511 - DNA, 30 bp, Homo sapiens
ttgtgggggttcacccacttgtaggtgccc

SEQ ID NO: 30512 - DNA, 30 bp, Homo sapiens
taacaccagctgacgagaaactgctctccc

SEQ ID NO: 30513 - DNA, 30 bp, Homo sapiens
cgctggcgtttctgattctgtggactgtct

SEQ ID NO: 30514 - DNA, 30 bp, Homo sapiens
gcttggcacccttggaaggctctgaggact

SEQ ID NO: 30515 - DNA, 30 bp, Homo sapiens
atactttggattgcctttcatccgtccact

SEQ ID NO: 30516 - DNA, 30 bp, Homo sapiens
cacagcttggcgcccctgggaggctctgag

SEQ ID NO: 30517 - DNA, 30 bp, Homo sapiens
acactttcgtcactgtaggcaatgtagaga

SEQ ID NO: 30518 - DNA, 30 bp, Homo sapiens
atttcccatagacactctcatcactgtagg

SEQ ID NO: 30519 - DNA, 30 bp, Homo sapiens
gaagccaaaagtgttctctccgctgtaggc

SEQ ID NO: 30520 - DNA, 30 bp, Homo sapiens
acagctaagccggtcggggggctcaggggg

SEQ ID NO: 30521 - DNA, 30 bp, Homo sapiens
tacaggcccgagaccatgactcggaaggag

SEQ ID NO: 30522 - DNA, 30 bp, Homo sapiens
ccgtttgcagagaagcagtagccagagcta

SEQ ID NO: 30523 - DNA, 30 bp, Homo sapiens
tctgtctgtaggcctctgcttcctgttctt

SEQ ID NO: 30524 - DNA, 30 bp, Homo sapiens
caccgggtaaaagactccttacttctattt

SEQ ID NO: 30525 - DNA, 30 bp, Homo sapiens
ccatggaaactctagtgtgaggctctgtgg

SEQ ID NO: 30526 - DNA, 30 bp, Homo sapiens
cttcaaccatggtgaaatcaactccattgg

SEQ ID NO: 30527 - DNA, 30 bp, Homo sapiens
gtgtgggggcttttagctgaggctctctgt

SEQ ID NO: 30528 - DNA, 30 bp, Homo sapiens
atacaggttctctgtttaaatatgtagccc

SEQ ID NO: 30529 - DNA, 30 bp, Homo sapiens
ttgcggatcatgcccttgatagctgactcc

SEQ ID NO: 30530 - DNA, 30 bp, Homo sapiens
taaatgccccaaatgtgactggaaagagaa

SEQ ID NO: 30531 - DNA, 30 bp, Homo sapiens
attttggagaggcggctccttttatcaccg

SEQ ID NO: 30532 - DNA, 30 bp, Homo sapiens
ctttggaaagataaactacccagtacacaa

SEQ ID NO: 30533 - DNA, 30 bp, Homo sapiens
tgtacatagtaaagccaatagacgacatta

SEQ ID NO: 30534 - DNA, 30 bp, Homo sapiens
gacgatgttgaagaaggaaaaaaccactgg

SEQ ID NO: 30535 - DNA, 30 bp, Homo sapiens
tcctggaccatctgtctatggcattcacat

SEQ ID NO: 30536 - DNA, 30 bp, Homo sapiens
acatggcgtatgccgcccagtagatgacat

SEQ ID NO: 30537 - DNA, 30 bp, Homo sapiens
agttaaggcaaacaagccagtagagcacat

SEQ ID NO: 30538 - DNA, 30 bp, Homo sapiens
caataaaccaagttgaacagggcaaaagcg

SEQ ID NO: 30539 - DNA, 30 bp, Homo sapiens
cacaggtagaggtaggagacccaatagacc

SEQ ID NO: 30540 - DNA, 30 bp, Homo sapiens
gcctctctggcttttgagagctgtgcctct

SEQ ID NO: 30541 - DNA, 30 bp, Homo sapiens
tacaggtatccaacccagtagaccaggtta

SEQ ID NO: 30542 - DNA, 30 bp, Homo sapiens
caggttcttgcagggactgaatcgagagag

SEQ ID NO: 30543 - DNA, 30 bp, Homo sapiens
aaatacattggctagcataaaaatcaaagg

SEQ ID NO: 30544 - DNA, 30 bp, Homo sapiens
atatggtatacccagtaaacaatgttgaac

SEQ ID NO: 30545 - DNA, 30 bp, Homo sapiens
tcctggagtatttatcaatggcgtgggtgt

SEQ ID NO: 30546 - DNA, 30 bp, Homo sapiens
ggaaaacactgaccaataaattaagttgaa

SEQ ID NO: 30547 - DNA, 30 bp, Homo sapiens
ataggtgtcaatgacatggttgttttccag

SEQ ID NO: 30548 - DNA, 30 bp, Homo sapiens
tcctggcccagtctttctatctcctcaatg

SEQ ID NO: 30549 - DNA, 30 bp, Homo sapiens
caccgtagcaaccaacactccctcatgtct

SEQ ID NO: 30550 - DNA, 30 bp, Homo sapiens
cgttctatttcttcaatcaggaagtcaatg

SEQ ID NO: 30551 - DNA, 30 bp, Homo sapiens
attgagatgaatgtggattacgttgagcag

SEQ ID NO: 30552 - DNA, 30 bp, Homo sapiens
ccgttcagggagattaatcactggaaccca

SEQ ID NO: 30553 - DNA, 30 bp, Homo sapiens
cgttcctgaagagagatgtaggggacccac

SEQ ID NO: 30554 - DNA, 30 bp, Homo sapiens
actcggggagggtgatgctgggcacccagt

SEQ ID NO: 30555 - DNA, 30 bp, Homo sapiens
gagctgggtgccccagaggctgctgggtct

SEQ ID NO: 30556 - DNA, 30 bp, Homo sapiens
aagtctatctcatccaggaggaagtccatg

SEQ ID NO: 30557 - DNA, 30 bp, Homo sapiens
tcaggccttttcacctcctctggatttggc

SEQ ID NO: 30558 - DNA, 30 bp, Homo sapiens
tcctggctatgagcttcaggcttcggccct

SEQ ID NO: 30559 - DNA, 30 bp, Homo sapiens
gttgagttgctggttccccttcttcaggtg

SEQ ID NO: 30560 - DNA, 30 bp, Homo sapiens
tcctggctatcagcttcaggcttcggccct

SEQ ID NO: 30561 - DNA, 30 bp, Homo sapiens
aagaggggccgggagccctggttctcaaac

SEQ ID NO: 30562 - DNA, 30 bp, Homo sapiens
gatgtcttctgaggaggctgcggcggggag

SEQ ID NO: 30563 - DNA, 30 bp, Homo sapiens
cgcaggaaatcgcgaatgaacttccagagc

SEQ ID NO: 30564 - DNA, 30 bp, Homo sapiens
tacgcccccaggaacgggatgttcttgagg

SEQ ID NO: 30565 - DNA, 30 bp, Homo sapiens
ttgagggccgcgaggcagcactcggatggg

SEQ ID NO: 30566 - DNA, 30 bp, Homo sapiens
atggggagagtggccttgaagtcttgaggg

SEQ ID NO: 30567 - DNA, 30 bp, Homo sapiens
gtgtggcttccacaagaaagttgtcaaact

SEQ ID NO: 30568 - DNA, 30 bp, Homo sapiens
gcttgcgtgccaaagcctgaaggattctgc

SEQ ID NO: 30569 - DNA, 30 bp, Homo sapiens
aagcacagcaccttggctccatcggctgct

SEQ ID NO: 30570 - DNA, 30 bp, Homo sapiens
ttggtagcaaacaaactttgcttctccggt

SEQ ID NO: 30571 - DNA, 30 bp, Homo sapiens
gcaaaaccaaagccccacctccaggtttgg

SEQ ID NO: 30572 - DNA, 30 bp, Homo sapiens
gccacagaaaacttgaaccaggtggtgtgg

SEQ ID NO: 30573 - DNA, 30 bp, Homo sapiens
tagtgggaccagaggcacttcttgggaatg

SEQ ID NO: 30574 - DNA, 30 bp, Homo sapiens
ggcagggtgacgtttcgaagaagccactgc

SEQ ID NO: 30575 - DNA, 30 bp, Homo sapiens
ctgttgagttggtgtgttcaaacagccact

SEQ ID NO: 30576 - DNA, 30 bp, Homo sapiens
taaccttccaaatgccactgctgtgaagag

SEQ ID NO: 30577 - DNA, 30 bp, Homo sapiens
ctgatgatccgagttggtgcagtctcgtaa

SEQ ID NO: 30578 - DNA, 30 bp, Homo sapiens
ccaaggtcatgttccttagcagccactgtt

SEQ ID NO: 30579 - DNA, 30 bp, Homo sapiens
tacaggtttccacagtaggatgctgggagc

SEQ ID NO: 30580 - DNA, 30 bp, Homo sapiens
atgtgggaaccagttttggtccattgctgt

SEQ ID NO: 30581 - DNA, 30 bp, Homo sapiens
gagctcaccatgtcccagtgctggctcatg

SEQ ID NO: 30582 - DNA, 30 bp, Homo sapiens
cattgttcacaatctgctgaaaagttaaag

SEQ ID NO: 30583 - DNA, 30 bp, Homo sapiens
cattgatctggtcaaaacgccactgctggc

SEQ ID NO: 30584 - DNA, 30 bp, Homo sapiens
tgtgtgtggcaacagctgccactgctgggc

SEQ ID NO: 30585 - DNA, 30 bp, Homo sapiens
acttgatggagttcttaatggtccacctct

SEQ ID NO: 30586 - DNA, 30 bp, Homo sapiens
gcgaggctcctcaggacgttggtgatgctc

SEQ ID NO: 30587 - DNA, 30 bp, Homo sapiens
tactgctgcaggttgagcgtgaacttccac

SEQ ID NO: 30588 - DNA, 30 bp, Homo sapiens
ttggagtggatctgatgggttgcatgacac

SEQ ID NO: 30589 - DNA, 30 bp, Homo sapiens
ggtcggccctccggtgtccgataagcacta

SEQ ID NO: 30590 - DNA, 30 bp, Homo sapiens
ttgatatggcttcactgggtcacaggcagc

SEQ ID NO: 30591 - DNA, 30 bp, Homo sapiens
aggtctggtgtcttcaatggctctatccac

SEQ ID NO: 30592 - DNA, 30 bp, Homo sapiens
caaagagccacaactgatgggggtcactgg

SEQ ID NO: 30593 - DNA, 30 bp, Homo sapiens
aattggagatgaatacttgatgcaggacct

SEQ ID NO: 30594 - DNA, 30 bp, Homo sapiens
cactggctgttggtctgaccccagtctctg

SEQ ID NO: 30595 - DNA, 30 bp, Homo sapiens
gtgtttgatccagtttctgatcatccactt

SEQ ID NO: 30596 - DNA, 30 bp, Homo sapiens
acaggctgttcacagatgcctccaactctg

SEQ ID NO: 30597 - DNA, 30 bp, Homo sapiens
agttggcatggtggttaaatttttctaaaa

SEQ ID NO: 30598 - DNA, 30 bp, Homo sapiens
ttcaggacatcttcctccttgggaattttc

SEQ ID NO: 30599 - DNA, 30 bp, Homo sapiens
tgatggtggggtgtctattcgacttttact

SEQ ID NO: 30600 - DNA, 30 bp, Homo sapiens
caaccgtcaggatgctgtcgcctgcctttg

SEQ ID NO: 30601 - DNA, 30 bp, Homo sapiens
ttccggtcctcgggcagcctctccgccgtg

SEQ ID NO: 30602 - DNA, 30 bp, Homo sapiens
cgatggttgctgtctccctgtccttctgcc

SEQ ID NO: 30603 - DNA, 30 bp, Homo sapiens
ctttggtcaccaggggcgtgatcatctgtg

SEQ ID NO: 30604 - DNA, 30 bp, Homo sapiens
tcggccttccacagtgctgggattatagac

SEQ ID NO: 30605 - DNA, 30 bp, Homo sapiens
caaggggaatgaacacgaatacggaataag

SEQ ID NO: 30606 - DNA, 30 bp, Homo sapiens
cgcaggtgaatactccaatcagatgccaca

SEQ ID NO: 30607 - DNA, 30 bp, Homo sapiens
agtcagtggcaatgttgagtgagagcttct

SEQ ID NO: 30608 - DNA, 30 bp, Homo sapiens
tcccgggatccagaggatggtctaatagtt

SEQ ID NO: 30609 - DNA, 30 bp, Homo sapiens
agaaggtgtaggtcctgtcagcagaaaaac

SEQ ID NO: 30610 - DNA, 30 bp, Homo sapiens
tcttggtcagcctcaggttcctcttcttta

SEQ ID NO: 30611 - DNA, 30 bp, Homo sapiens
ccttggaggccatgtgggccatgaggtcca

SEQ ID NO: 30612 - DNA, 30 bp, Homo sapiens
cacttgtctcggctgaacatgtagcggagg

SEQ ID NO: 30613 - DNA, 30 bp, Homo sapiens
agaaggacgaggcttctggaagttataata

SEQ ID NO: 30614 - DNA, 30 bp, Homo sapiens
tttcggtcatcgatggttttaatgaattct

SEQ ID NO: 30615 - DNA, 30 bp, Homo sapiens
tgctggagatagctgaggtgtattgtaggg

SEQ ID NO: 30616 - DNA, 30 bp, Homo sapiens
cctctgaaaccaccacctcttcctcctctg

SEQ ID NO: 30617 - DNA, 30 bp, Homo sapiens
gccattaatgaattgcattatcttcttcac

SEQ ID NO: 30618 - DNA, 30 bp, Homo sapiens
tcttgggcctccagcctttgatgaactgca

SEQ ID NO: 30619 - DNA, 30 bp, Homo sapiens
agctggaaggggctgctgccggagaccggg

SEQ ID NO: 30620 - DNA, 30 bp, Homo sapiens
tcctcgattgtctcttttttaccagtctct

SEQ ID NO: 30621 - DNA, 30 bp, Homo sapiens
acctgggctgctggaggaaagctatggcac

SEQ ID NO: 30622 - DNA, 30 bp, Homo sapiens
taacccaacagatcttgccattttctccaa

SEQ ID NO: 30623 - DNA, 30 bp, Homo sapiens
gagcggcccaagcagcagcagcaagatgga

SEQ ID NO: 30624 - DNA, 30 bp, Homo sapiens
atatggtcctaatgaagaggatcttttctc

SEQ ID NO: 30625 - DNA, 30 bp, Homo sapiens
tagccttataactggcagagaccaccaagt

SEQ ID NO: 30626 - DNA, 30 bp, Homo sapiens
catccaggaatctggctcagccctcggggt

SEQ ID NO: 30627 - DNA, 30 bp, Homo sapiens
acccaggactcctcctcaggtggaagtgga

SEQ ID NO: 30628 - DNA, 30 bp, Homo sapiens
agtaggttttttatctccactatctgcatc

SEQ ID NO: 30629 - DNA, 30 bp, Homo sapiens
ctgcggcgggctccacgggggggcaggagt

SEQ ID NO: 30630 - DNA, 30 bp, Homo sapiens
tagatctccatgtccacagggcggatgttg

SEQ ID NO: 30631 - DNA, 30 bp, Homo sapiens
cgtcggggtgcccaccagtcccgcggggcc

SEQ ID NO: 30632 - DNA, 30 bp, Homo sapiens
cactgcggcggccgaagtccatccatccat

SEQ ID NO: 30633 - DNA, 30 bp, Homo sapiens
tgagctgagcggagccaccacagtagtgct

SEQ ID NO: 30634 - DNA, 30 bp, Homo sapiens
cccatggcggtcaccatgctggacgggtgg

SEQ ID NO: 30635 - DNA, 30 bp, Homo sapiens
ccatggcggtgaccatgctggaggggtggt

SEQ ID NO: 30636 - DNA, 30 bp, Homo sapiens
gactgtcggccaagaccaggctgttccaag

SEQ ID NO: 30637 - DNA, 30 bp, Homo sapiens
ccaaggccagcgcacaccaggcctcttggc

SEQ ID NO: 30638 - DNA, 30 bp, Homo sapiens
gccagggccagggcgcaccaggaatccggt

SEQ ID NO: 30639 - DNA, 30 bp, Homo sapiens
atgagtccatatgtagcccttctctggtct

SEQ ID NO: 30640 - DNA, 30 bp, Homo sapiens
acgtggctgactgggggatggagcggggtg

SEQ ID NO: 30641 - DNA, 30 bp, Homo sapiens
tgatggactgcgatatagaccggggaggga

SEQ ID NO: 30642 - DNA, 30 bp, Homo sapiens
tccaggatctcctttatcatgactggatct

SEQ ID NO: 30643 - DNA, 30 bp, Homo sapiens
gtgtgggaatggctcttgttcatccagctt

SEQ ID NO: 30644 - DNA, 30 bp, Homo sapiens
gccacagaggaagagcaggttctgcacggc

SEQ ID NO: 30645 - DNA, 30 bp, Homo sapiens
caccggctgccacagaggaagagcaggttc

SEQ ID NO: 30646 - DNA, 30 bp, Homo sapiens
cagtccaagtaggactgtaaggtgcctcgg

SEQ ID NO: 30647 - DNA, 30 bp, Homo sapiens
accacaggatggtgaactctgatgacaacg

SEQ ID NO: 30648 - DNA, 30 bp, Homo sapiens
cactggcgacgccacaggtaggtgtgaatg

SEQ ID NO: 30649 - DNA, 30 bp, Homo sapiens
gaagagccacttccactggatagatggagg

SEQ ID NO: 30650 - DNA, 30 bp, Homo sapiens
ctctgggctcaggtttgccatggcttcctt

SEQ ID NO: 30651 - DNA, 30 bp, Homo sapiens
gatgtgcttcaaggccattgtttcggatga

SEQ ID NO: 30652 - DNA, 30 bp, Homo sapiens
caattcggcagatccacattctgaaggatg

SEQ ID NO: 30653 - DNA, 30 bp, Homo sapiens
ttgacctcagaggtgggtatgggatctgtg

SEQ ID NO: 30654 - DNA, 30 bp, Homo sapiens
aggtggctttcctcccgccaggcagccatg

SEQ ID NO: 30655 - DNA, 30 bp, Homo sapiens
ctcaggcagctgatatccttgtccagtgta

SEQ ID NO: 30656 - DNA, 30 bp, Homo sapiens
ttatggtacatgcctttcgtcgtctcattt

SEQ ID NO: 30657 - DNA, 30 bp, Homo sapiens
atttgcttctcatctggatatcccatatgt

SEQ ID NO: 30658 - DNA, 30 bp, Homo sapiens
acaaggtgatgcatttggatacctgaagtt

SEQ ID NO: 30659 - DNA, 30 bp, Homo sapiens
ccttggcatctctcctttagtactcgggcc

SEQ ID NO: 30660 - DNA, 30 bp, Homo sapiens
tattttgtccctactccaagtagcttggaa

SEQ ID NO: 30661 - DNA, 30 bp, Homo sapiens
ctctgggcgtgctggagctcactgagaagg

SEQ ID NO: 30662 - DNA, 30 bp, Homo sapiens
aaggggagcttatgctttttaaagagtgag

SEQ ID NO: 30663 - DNA, 30 bp, Homo sapiens
tttctcagcctattacataatgagctaaga

SEQ ID NO: 30664 - DNA, 30 bp, Homo sapiens
cccctgctccatttgttggtgctggctccg

SEQ ID NO: 30665 - DNA, 30 bp, Homo sapiens
tgtagtccacatcgctctccagcgagaagc

SEQ ID NO: 30666 - DNA, 30 bp, Homo sapiens
gggccgggcctgttctagctgctgatgctg

SEQ ID NO: 30667 - DNA, 30 bp, Homo sapiens
tacaggatattcttcaattcagcatcaatc

SEQ ID NO: 30668 - DNA, 30 bp, Homo sapiens
ttgcaagtggtctcttttcctaaagaaatc

SEQ ID NO: 30669 - DNA, 30 bp, Homo sapiens
gcagtcgccccacttccacgaaggcctcca

SEQ ID NO: 30670 - DNA, 30 bp, Homo sapiens
agaaggccaccagctggcactggttgggag

SEQ ID NO: 30671 - DNA, 30 bp, Homo sapiens
gaagtccagaccaactatgaagataggatg

SEQ ID NO: 30672 - DNA, 30 bp, Homo sapiens
tccaggttcatggcgtgccggatcacgtga

SEQ ID NO: 30673 - DNA, 30 bp, Homo sapiens
tgctggccgtgaacgcctggattcccgtga

SEQ ID NO: 30674 - DNA, 30 bp, Homo sapiens
ttgattcctcagccatcctttgtctaagtg

SEQ ID NO: 30675 - DNA, 30 bp, Homo sapiens
tgaaggattctgcttgattcaaagctttta

SEQ ID NO: 30676 - DNA, 30 bp, Homo sapiens
agtgattttggtctgaatcaaccagtttat

SEQ ID NO: 30677 - DNA, 30 bp, Homo sapiens
agaaggggctctcagccaatctagggaggc

SEQ ID NO: 30678 - DNA, 30 bp, Homo sapiens
gagagtcaggaactcttcccgagtctttgg

SEQ ID NO: 30679 - DNA, 30 bp, Homo sapiens
ccccgactccagcaggccgcaaggcttccg

SEQ ID NO: 30680 - DNA, 30 bp, Homo sapiens
aaaggtggcaagaagaaagtagagggctca

SEQ ID NO: 30681 - DNA, 30 bp, Homo sapiens
gcagacaccacaccagcgtctggcccaccc

SEQ ID NO: 30682 - DNA, 30 bp, Homo sapiens
cactggcccagcatacaggccttcttacag

SEQ ID NO: 30683 - DNA, 30 bp, Homo sapiens
gtcaggctctaggatctcgagggggtccgc

SEQ ID NO: 30684 - DNA, 30 bp, Homo sapiens
tgctgatccaagtaactctgggcattcaca

SEQ ID NO: 30685 - DNA, 30 bp, Homo sapiens
cttttcacaatgaccgaataccgcagtagc

SEQ ID NO: 30686 - DNA, 30 bp, Homo sapiens
caaaggacacaggttcagaagcatatcatt

SEQ ID NO: 30687 - DNA, 30 bp, Homo sapiens
ctgtctgagtaactgactgcggagcccagc

SEQ ID NO: 30688 - DNA, 30 bp, Homo sapiens
atgtcaggatggtgtcgtccacctgctccg

SEQ ID NO: 30689 - DNA, 30 bp, Homo sapiens
acgtggggcacaatacgggtcccatctttc

SEQ ID NO: 30690 - DNA, 30 bp, Homo sapiens
ctttgtgtctcaaatgctcatccaaacact

SEQ ID NO: 30691 - DNA, 30 bp, Homo sapiens
agctgggttgtatcgcagtttcactctgat

SEQ ID NO: 30692 - DNA, 30 bp, Homo sapiens
agatggccttataacgtaggtattcttcta

SEQ ID NO: 30693 - DNA, 30 bp, Homo sapiens
tctctgctgttcttcaagcttttctgccaa

SEQ ID NO: 30694 - DNA, 30 bp, Homo sapiens
tagcggttcagtctcatattgaaatgactc

SEQ ID NO: 30695 - DNA, 30 bp, Homo sapiens
tagaagatcacagcccactcctatctctct

SEQ ID NO: 30696 - DNA, 30 bp, Homo sapiens
aaatgggaaaactgagtctcagaaggggcc

SEQ ID NO: 30697 - DNA, 30 bp, Homo sapiens
ttttcgcaggagataatttcccatcttttc

SEQ ID NO: 30698 - DNA, 30 bp, Homo sapiens
gtgtggaaacacaacttcataatcatgctc

SEQ ID NO: 30699 - DNA, 30 bp, Homo sapiens
ttttctgcaagagcttcattaatttcagtt

SEQ ID NO: 30700 - DNA, 30 bp, Homo sapiens
aaatggtggaggatggggtgaggaggctgg

SEQ ID NO: 30701 - DNA, 30 bp, Homo sapiens
aacattaaggaaatggtggaggatggggtg

SEQ ID NO: 30702 - DNA, 30 bp, Homo sapiens
agctggaaaacggaaccacctgctttccgc

SEQ ID NO: 30703 - DNA, 30 bp, Homo sapiens
aataatttggtctgggtctaaatgctaata

SEQ ID NO: 30704 - DNA, 30 bp, Homo sapiens
agtaggcaaagtagcccatcccacccaggg

SEQ ID NO: 30705 - DNA, 30 bp, Homo sapiens
atctggtgatgggggatatgatgtatagta

SEQ ID NO: 30706 - DNA, 30 bp, Homo sapiens
caggtgagggagaacttctggtacttctta

SEQ ID NO: 30707 - DNA, 30 bp, Homo sapiens
gtgaggttcgcagtcttctaccatgctgtc

SEQ ID NO: 30708 - DNA, 30 bp, Homo sapiens
caccggcaggcacaggtgtccacggacatg

SEQ ID NO: 30709 - DNA, 30 bp, Homo sapiens
taagagcagccacagcgatccaccaccatg

SEQ ID NO: 30710 - DNA, 30 bp, Homo sapiens
cagtggcagtctttggctaacaagtcatca

SEQ ID NO: 30711 - DNA, 30 bp, Homo sapiens
cccacactctgccacgctcatgccctcgta

SEQ ID NO: 30712 - DNA, 30 bp, Homo sapiens
cacacccacattcatcgactaccatgtctt

SEQ ID NO: 30713 - DNA, 30 bp, Homo sapiens
gccacacgactccacgaccatgtcctcata

SEQ ID NO: 30714 - DNA, 30 bp, Homo sapiens
ccgaggtcccgtggtcaggaagcagaggta

SEQ ID NO: 30715 - DNA, 30 bp, Homo sapiens
cctgcagccgcacgactccaccaccatgtc

SEQ ID NO: 30716 - DNA, 30 bp, Homo sapiens
gccgcaggcctccaccaccatgtcctcgta

SEQ ID NO: 30717 - DNA, 30 bp, Homo sapiens
gacaggtgcactttgtagctatcatatctt

SEQ ID NO: 30718 - DNA, 30 bp, Homo sapiens
acgtcgttctgtttgcgcttcatgttctca

SEQ ID NO: 30719 - DNA, 30 bp, Homo sapiens
atgtcattcttcttgcgcttcatttcctca

SEQ ID NO: 30720 - DNA, 30 bp, Homo sapiens
cttttagcggaatgctttcttagaatatgg

SEQ ID NO: 30721 - DNA, 30 bp, Homo sapiens
gctttgttggatagtctgtcatcaccccag

SEQ ID NO: 30722 - DNA, 30 bp, Homo sapiens
acttacttgaatgcctcgagcagttaggtg

SEQ ID NO: 30723 - DNA, 30 bp, Homo sapiens
agctgcaatggccttcaaaatttcttttac

SEQ ID NO: 30724 - DNA, 30 bp, Homo sapiens
cagcagcactgctgtttctaagccagtttt

SEQ ID NO: 30725 - DNA, 30 bp, Homo sapiens
aggaggtccgggcagctggtccatggttgt

SEQ ID NO: 30726 - DNA, 30 bp, Homo sapiens
tcttacttccactctgagtatctgtgcgag

SEQ ID NO: 30727 - DNA, 30 bp, Homo sapiens
ccgctctatgagggtcttggtgtggctgcc

SEQ ID NO: 30728 - DNA, 30 bp, Homo sapiens
tcctgggacatcagggccaccagtgctgcc

SEQ ID NO: 30729 - DNA, 30 bp, Homo sapiens
gtacagagaggtcatggcaggatttggact

SEQ ID NO: 30730 - DNA, 30 bp, Homo sapiens
agatggctcatcagctaaatcacgttggtc

SEQ ID NO: 30731 - DNA, 30 bp, Homo sapiens
agagcctcacttcagagcaccttcttgcaa

SEQ ID NO: 30732 - DNA, 30 bp, Homo sapiens
cagaagctgctcatcttctgcaacagggtt

SEQ ID NO: 30733 - DNA, 30 bp, Homo sapiens
gtctggcagtgtcttctgtaagttttcgtg

SEQ ID NO: 30734 - DNA, 30 bp, Homo sapiens
cattgggaagctgtaagatgtccttcaata

SEQ ID NO: 30735 - DNA, 30 bp, Homo sapiens
cttgcacacctatgggagtctgcagctgtg

SEQ ID NO: 30736 - DNA, 30 bp, Homo sapiens
ttcagggggatgaccggccagtacttgggc

SEQ ID NO: 30737 - DNA, 30 bp, Homo sapiens
taaaggaagagggctatccaaacaagtacc

SEQ ID NO: 30738 - DNA, 30 bp, Homo sapiens
cagtccagctcgatggggctgccgtcgctg

SEQ ID NO: 30739 - DNA, 30 bp, Homo sapiens
atcacatccttgtgctcctgcttggactcc

SEQ ID NO: 30740 - DNA, 30 bp, Homo sapiens
agccggcggcgttccatttacaatctggtg

SEQ ID NO: 30741 - DNA, 30 bp, Homo sapiens
cgaaggcccccagggagagctggatccctt

SEQ ID NO: 30742 - DNA, 30 bp, Homo sapiens
agtcacaggagccatccttccagccgtcgc

SEQ ID NO: 30743 - DNA, 30 bp, Homo sapiens
ctgcgtctcccggtgccttcggaggtccac

SEQ ID NO: 30744 - DNA, 30 bp, Homo sapiens
ttgagattgtgctggctctcgcggtgccgc

SEQ ID NO: 30745 - DNA, 30 bp, Homo sapiens
gtgtggatggtaaacatggctgatacctgc

SEQ ID NO: 30746 - DNA, 30 bp, Homo sapiens
ctacagcaggcacaaactgctttggaatat

SEQ ID NO: 30747 - DNA, 30 bp, Homo sapiens
ctccggttgagcagtgtattttgatcttga

SEQ ID NO: 30748 - DNA, 30 bp, Homo sapiens
atacctggctgcttagacagtgatgggggt

SEQ ID NO: 30749 - DNA, 30 bp, Homo sapiens
ctaagggcttgaaacctgtcccctgggact

SEQ ID NO: 30750 - DNA, 30 bp, Homo sapiens
tagagggacatcctgctgcggcgcatggcc

SEQ ID NO: 30751 - DNA, 30 bp, Homo sapiens
cagaggagaggagtgaccctcagaggactg

SEQ ID NO: 30752 - DNA, 30 bp, Homo sapiens
cataggttgttccgctgaagtgcctcacac

SEQ ID NO: 30753 - DNA, 30 bp, Homo sapiens
tctacagtcacagatttggcaagattccgt

SEQ ID NO: 30754 - DNA, 30 bp, Homo sapiens
tccacagttacagacttggccagatttctg

SEQ ID NO: 30755 - DNA, 30 bp, Homo sapiens
gagcggttaccaccaggaccagcagtgggc

SEQ ID NO: 30756 - DNA, 30 bp, Homo sapiens
acaaggccagtttcagcatcaggacagaca

SEQ ID NO: 30757 - DNA, 30 bp, Homo sapiens
accataggctcaggagcagaatcaagggaa

SEQ ID NO: 30758 - DNA, 30 bp, Homo sapiens
cagagcagggccgggagagccaggacagga

SEQ ID NO: 30759 - DNA, 30 bp, Homo sapiens
tccaggtatttggatcgatgaaggatctct

SEQ ID NO: 30760 - DNA, 30 bp, Homo sapiens
gcgtggcgggggacagggcctccagacgct

SEQ ID NO: 30761 - DNA, 30 bp, Homo sapiens
tagaggctaccccaggtttcaggtgggggg

SEQ ID NO: 30762 - DNA, 30 bp, Homo sapiens
acagccaggtctgggaagtctttcacttct

SEQ ID NO: 30763 - DNA, 30 bp, Homo sapiens
aagaggtagtcagtaggatggcctgtcccc

SEQ ID NO: 30764 - DNA, 30 bp, Homo sapiens
cataggttcccccactgttccacaggaggg

SEQ ID NO: 30765 - DNA, 30 bp, Homo sapiens
tatctgttctcccgggggttgtagcgcagc

SEQ ID NO: 30766 - DNA, 30 bp, Homo sapiens
cagcggcaaaccattttcttttgcacccat

SEQ ID NO: 30767 - DNA, 30 bp, Homo sapiens
ttttgatgatgtcttcaatttcttctgaga

SEQ ID NO: 30768 - DNA, 30 bp, Homo sapiens
cagaactctgagtggacaggatcaggattt

SEQ ID NO: 30769 - DNA, 30 bp, Homo sapiens
aatatttcccacagttcccctcacccagaa

SEQ ID NO: 30770 - DNA, 30 bp, Homo sapiens
attaggtgcatgggaaatgccatccaaatt

SEQ ID NO: 30771 - DNA, 30 bp, Homo sapiens
agttggaatgggtggcctgcaagtcgtagt

SEQ ID NO: 30772 - DNA, 30 bp, Homo sapiens
gttgtcaaccagccactacaaatgggcctc

SEQ ID NO: 30773 - DNA, 30 bp, Homo sapiens
ctcagggttcccaccacgtgcatcaatctg

SEQ ID NO: 30774 - DNA, 30 bp, Homo sapiens
agccggcaggctccccgcctttcctggagt

SEQ ID NO: 30775 - DNA, 30 bp, Homo sapiens
ctgcggcctccccactcttcctcaggtccg

SEQ ID NO: 30776 - DNA, 30 bp, Homo sapiens
gggagccaaggtggcaggatcacttgaggc

SEQ ID NO: 30777 - DNA, 30 bp, Homo sapiens
agaacccctggaaggggcagcaggcatggg

SEQ ID NO: 30778 - DNA, 30 bp, Homo sapiens
tagtggtagacttggccaccaggttgctga

SEQ ID NO: 30779 - DNA, 30 bp, Homo sapiens
acgtggtgacccctggcttccaggaactca

SEQ ID NO: 30780 - DNA, 30 bp, Homo sapiens
tacaggatggtggctccagctgcatctggg

SEQ ID NO: 30781 - DNA, 30 bp, Homo sapiens
agcaggttccccacctttcctggagtccga

SEQ ID NO: 30782 - DNA, 30 bp, Homo sapiens
ctgccctccacagagcggcactgcacgatg

SEQ ID NO: 30783 - DNA, 30 bp, Homo sapiens
tggtgggcactggagtagcaccttccacga

SEQ ID NO: 30784 - DNA, 30 bp, Homo sapiens
tgtaggactgattgaagatctgcccagtcc

SEQ ID NO: 30785 - DNA, 30 bp, Homo sapiens
cagcgccacaaacacctcgtagtggggagc

SEQ ID NO: 30786 - DNA, 30 bp, Homo sapiens
tctcctgcagacactgggccaggtgcctgt

SEQ ID NO: 30787 - DNA, 30 bp, Homo sapiens
gttgccagcatagttgcaactcgcataaat

SEQ ID NO: 30788 - DNA, 30 bp, Homo sapiens
agttggtctgtgctcacatagccacatgat

SEQ ID NO: 30789 - DNA, 30 bp, Homo sapiens
ctgaggaagtgttacatagagcacctcact

SEQ ID NO: 30790 - DNA, 30 bp, Homo sapiens
ccctgggagttcctgctgtgcttctgcagc

SEQ ID NO: 30791 - DNA, 30 bp, Homo sapiens
acatagatgtcagcacctttgccgccgagc

SEQ ID NO: 30792 - DNA, 30 bp, Homo sapiens
tgtcggctggggcctctttggcctcttccc

SEQ ID NO: 30793 - DNA, 30 bp, Homo sapiens
cacagggagaggataggacccgcgagagaa

SEQ ID NO: 30794 - DNA, 30 bp, Homo sapiens
ccgagaactttcatctttcagagtggagag

SEQ ID NO: 30795 - DNA, 30 bp, Homo sapiens
caccggaattcatagatgggtgcactgtgt

SEQ ID NO: 30796 - DNA, 30 bp, Homo sapiens
acttgggctcctcaatcacacccttgctga

SEQ ID NO: 30797 - DNA, 30 bp, Homo sapiens
aattggctgtgatgtgctcgtggttgaagg

SEQ ID NO: 30798 - DNA, 30 bp, Homo sapiens
tctcgatctcaccagaagatccgtgcaggg

SEQ ID NO: 30799 - DNA, 30 bp, Homo sapiens
tctcgatttcacccatgttgagtcgctccg

SEQ ID NO: 30800 - DNA, 30 bp, Homo sapiens
gtcaggcccgacctccgcaacggcctccga

SEQ ID NO: 30801 - DNA, 30 bp, Homo sapiens
ctgaggagcgccttgtatgcccagttactc

SEQ ID NO: 30802 - DNA, 30 bp, Homo sapiens
cctaggagtcttgcgttctagtctaataac

SEQ ID NO: 30803 - DNA, 30 bp, Homo sapiens
acagacgtaacaaaataaaggaagcaatct

SEQ ID NO: 30804 - DNA, 30 bp, Homo sapiens
caaaggtcagccttccccagcaggcatctg

SEQ ID NO: 30805 - DNA, 30 bp, Homo sapiens
ccatatttctgaaagcatcttccaaatcct

SEQ ID NO: 30806 - DNA, 30 bp, Homo sapiens
gcttgggacatttcctggacatttttaatt

SEQ ID NO: 30807 - DNA, 30 bp, Homo sapiens
ttcagggtatcagaggcctcatgtaaatat

SEQ ID NO: 30808 - DNA, 30 bp, Homo sapiens
ttgaagagtccaacagactgaaagtctgct

SEQ ID NO: 30809 - DNA, 30 bp, Homo sapiens
ctctggaccatctggatataagttgatagc

SEQ ID NO: 30810 - DNA, 30 bp, Homo sapiens
gacaggatgtgctccaggactccttgtctg

SEQ ID NO: 30811 - DNA, 30 bp, Homo sapiens
actgagtactctccagaggctggaggttcg

SEQ ID NO: 30812 - DNA, 30 bp, Homo sapiens
acgaggttggaagctgtgatctgagaagcc

SEQ ID NO: 30813 - DNA, 30 bp, Homo sapiens
gcaaccagaggtgcaatggttttgtatcgg

SEQ ID NO: 30814 - DNA, 30 bp, Homo sapiens
cctgcagaggtttgtctgatccagcaagca

SEQ ID NO: 30815 - DNA, 30 bp, Homo sapiens
tagcggccgaccttggcgtccccaatggcg

SEQ ID NO: 30816 - DNA, 30 bp, Homo sapiens
cgtttggcatcaccaatgactccccaaaca

SEQ ID NO: 30817 - DNA, 30 bp, Homo sapiens
tacggccccccgcggtaagggcgggctcct

SEQ ID NO: 30818 - DNA, 30 bp, Homo sapiens
agcagtaactttccaactcccggctggcct

SEQ ID NO: 30819 - DNA, 30 bp, Homo sapiens
tctcgggtggtgatggtgaccagctgcttg

SEQ ID NO: 30820 - DNA, 30 bp, Homo sapiens
cagttgttgttctctttggtggtgatggta

SEQ ID NO: 30821 - DNA, 30 bp, Homo sapiens
ttagctgctgtatcttggcctcagaagcca

SEQ ID NO: 30822 - DNA, 30 bp, Homo sapiens
tgttttgcttgcagtggtttccaaatctgt

SEQ ID NO: 30823 - DNA, 30 bp, Homo sapiens
tccaggtcatcaggccgaggtctgctgctg

SEQ ID NO: 30824 - DNA, 30 bp, Homo sapiens
ataatctccccctccatctgcctctctgtc

SEQ ID NO: 30825 - DNA, 30 bp, Homo sapiens
agatggccaagtcctccggtctggcccgcc

SEQ ID NO: 30826 - DNA, 30 bp, Homo sapiens
tgctgggacgacttgggggtttttggccat

SEQ ID NO: 30827 - DNA, 30 bp, Homo sapiens
gataggtcatctgaccttgccttgctgctg

SEQ ID NO: 30828 - DNA, 30 bp, Homo sapiens
acctggctcggctgctggctttgcttagcc

SEQ ID NO: 30829 - DNA, 30 bp, Homo sapiens
ctgtgggaacccgcctaccaatgagattgt

SEQ ID NO: 30830 - DNA, 30 bp, Homo sapiens
agcaggccgagcagcggtcgctcttttcag

SEQ ID NO: 30831 - DNA, 30 bp, Homo sapiens
aactggcttttttgacttcccagaacaata

SEQ ID NO: 30832 - DNA, 30 bp, Homo sapiens
agatgggggtcaggttgggtgctgaagcct

SEQ ID NO: 30833 - DNA, 30 bp, Homo sapiens
tgcatccactggggccgacccagccttcat

SEQ ID NO: 30834 - DNA, 30 bp, Homo sapiens
acaagatggttttcttcacatggtctcggg

SEQ ID NO: 30835 - DNA, 30 bp, Homo sapiens
attgcattttgaccactatctgaaatcagc

SEQ ID NO: 30836 - DNA, 30 bp, Homo sapiens
ctgaggacttgaggtttttttaaatatttt

SEQ ID NO: 30837 - DNA, 30 bp, Homo sapiens
agacggaggtcttcccatcccctgatttgc

SEQ ID NO: 30838 - DNA, 30 bp, Homo sapiens
gatccacacggtggtcttcccgtccctgct

SEQ ID NO: 30839 - DNA, 30 bp, Homo sapiens
caggcatctctgggtccaactggtctttgt

SEQ ID NO: 30840 - DNA, 30 bp, Homo sapiens
cacacataggcagagtcactggactgagtc

SEQ ID NO: 30841 - DNA, 30 bp, Homo sapiens
agatggccagatctcggcggccggtggccg

SEQ ID NO: 30842 - DNA, 30 bp, Homo sapiens
cagacttcctggctctcaggtggggagcac

SEQ ID NO: 30843 - DNA, 30 bp, Homo sapiens
tctggagattgagttgtaacccaacccatt

SEQ ID NO: 30844 - DNA, 30 bp, Homo sapiens
atgtaccttgctccgattaacattaccatg

SEQ ID NO: 30845 - DNA, 30 bp, Homo sapiens
atatatcttgctccaattagcattaccatg

SEQ ID NO: 30846 - DNA, 30 bp, Homo sapiens
catggagcgtttcactgctttggcccagtt

SEQ ID NO: 30847 - DNA, 30 bp, Homo sapiens
cactggtcggattcagagtttcttttccct

SEQ ID NO: 30848 - DNA, 30 bp, Homo sapiens
tgtctccacagaaggaaatgtccacaatcc

SEQ ID NO: 30849 - DNA, 30 bp, Homo sapiens
catgaatgtctgcacagattgaaattccca

SEQ ID NO: 30850 - DNA, 30 bp, Homo sapiens
ctgtgggatttatgtgacttcttaaccttg

SEQ ID NO: 30851 - DNA, 30 bp, Homo sapiens
acatggtccagccatgaatctttgtttttt

SEQ ID NO: 30852 - DNA, 30 bp, Homo sapiens
agtgcccacttaactccattggttcagagg

SEQ ID NO: 30853 - DNA, 30 bp, Homo sapiens
acttaatgtactggttcctgcccaggtggg

SEQ ID NO: 30854 - DNA, 30 bp, Homo sapiens
gcgtgggcttgtctgtagatttgatatctg

SEQ ID NO: 30855 - DNA, 30 bp, Homo sapiens
atgtggtcctcaccctgcagttcctgcagg

SEQ ID NO: 30856 - DNA, 30 bp, Homo sapiens
tgcctttaaggtagcttttccacctcttga

SEQ ID NO: 30857 - DNA, 30 bp, Homo sapiens
tcgccataaagcagccctttggcacagtcc

SEQ ID NO: 30858 - DNA, 30 bp, Homo sapiens
aaatggagactcataaacttccatgggtgg

SEQ ID NO: 30859 - DNA, 30 bp, Homo sapiens
ttaaggtagttgacaaaaactgcacaggat

SEQ ID NO: 30860 - DNA, 30 bp, Homo sapiens
acctgggaaagtagtcctctttgatgagaa

SEQ ID NO: 30861 - DNA, 30 bp, Homo sapiens
agaaggaggaagtcagaaagcccttgggga

SEQ ID NO: 30862 - DNA, 30 bp, Homo sapiens
ggctggactgcctgtcacatcctgagacca

SEQ ID NO: 30863 - DNA, 30 bp, Homo sapiens
cttgagctctcgtgtcactcgcttggtgat

SEQ ID NO: 30864 - DNA, 30 bp, Homo sapiens
ttgaggaattctgtttccccaggtagggat

SEQ ID NO: 30865 - DNA, 30 bp, Homo sapiens
ggtcatcatgttcaggaacttgctctcctc

SEQ ID NO: 30866 - DNA, 30 bp, Homo sapiens
gcataactgcaaggaatttgctttcttccg

SEQ ID NO: 30867 - DNA, 30 bp, Homo sapiens
tactcgcggtagtgcacccgctggtgctgg

SEQ ID NO: 30868 - DNA, 30 bp, Homo sapiens
aaatggtaattataacagacagtattagaa

SEQ ID NO: 30869 - DNA, 30 bp, Homo sapiens
ctgaatggattaaaggctgtctgctgaggt

SEQ ID NO: 30870 - DNA, 30 bp, Homo sapiens
cctccatcttttctttttgtgtttcctcct

SEQ ID NO: 30871 - DNA, 30 bp, Homo sapiens
tcataaggtcttctcgtcagtgttcctcct

SEQ ID NO: 30872 - DNA, 30 bp, Homo sapiens
cagaggtgggggagggggagcttcaggcct

SEQ ID NO: 30873 - DNA, 30 bp, Homo sapiens
cggcggcaggacgttttcttcgaagaagcc

SEQ ID NO: 30874 - DNA, 30 bp, Homo sapiens
ggtgtctgtgtagatggaggggatgtggcc

SEQ ID NO: 30875 - DNA, 30 bp, Homo sapiens
agccggtttgagcagcaccgagcccggcgg

SEQ ID NO: 30876 - DNA, 30 bp, Homo sapiens
cttcggtgtagacagaggagagctggctag

SEQ ID NO: 30877 - DNA, 30 bp, Homo sapiens
gagctagaacactttcaatcaaatcaaatg

SEQ ID NO: 30878 - DNA, 30 bp, Homo sapiens
ttatggactggtactctgagtacttcttgt

SEQ ID NO: 30879 - DNA, 30 bp, Homo sapiens
ctccagagagcgggccttaatttatggact

SEQ ID NO: 30880 - DNA, 30 bp, Homo sapiens
ttaaggttgccattttgttaggattcaaaa

SEQ ID NO: 30881 - DNA, 30 bp, Homo sapiens
acctgaagctttgggtttattgtgtttggc

SEQ ID NO: 30882 - DNA, 30 bp, Homo sapiens
acgaggagatgtagttggacacctcaatca

SEQ ID NO: 30883 - DNA, 30 bp, Homo sapiens
tgcaggaggcctggcaagtggctgtgtaca

SEQ ID NO: 30884 - DNA, 30 bp, Homo sapiens
tagatctcactctcttccagaatctcctcc

SEQ ID NO: 30885 - DNA, 30 bp, Homo sapiens
cactggttgtggacgtcctctctacggaca

SEQ ID NO: 30886 - DNA, 30 bp, Homo sapiens
ttgtggacatcttcatgccgaatgatcttg

SEQ ID NO: 30887 - DNA, 30 bp, Homo sapiens
agcaggctcgggagatggtatcaatcttct

SEQ ID NO: 30888 - DNA, 30 bp, Homo sapiens
agagtttccgcgtggtttctccttccctta

SEQ ID NO: 30889 - DNA, 30 bp, Homo sapiens
ccaaggtaaatggtgagcaggagggcacat

SEQ ID NO: 30890 - DNA, 30 bp, Homo sapiens
ggcactctggcagcactcgcgtccgggttg

SEQ ID NO: 30891 - DNA, 30 bp, Homo sapiens
gaaaggaaacaatgctcttgcataaagatc

SEQ ID NO: 30892 - DNA, 30 bp, Homo sapiens
tgctttagccgcgtcagcagttccccactc

SEQ ID NO: 30893 - DNA, 30 bp, Homo sapiens
ttgtgaagcctatgagtgtcagttgcacct

SEQ ID NO: 30894 - DNA, 30 bp, Homo sapiens
agtataggcagcaattcaccattttctttc

SEQ ID NO: 30895 - DNA, 30 bp, Homo sapiens
acttggagtcttggtctttcttttcatcta

SEQ ID NO: 30896 - DNA, 30 bp, Homo sapiens
ttgactcaggtgacacttttttccatactg

SEQ ID NO: 30897 - DNA, 30 bp, Homo sapiens
agattcttatggacggtttgattttccttc

SEQ ID NO: 30898 - DNA, 30 bp, Homo sapiens
gagtgggtgttgggagaaggggaaaaatta

SEQ ID NO: 30899 - DNA, 30 bp, Homo sapiens
gacagggcctcagctgctgcctcagcctga

SEQ ID NO: 30900 - DNA, 30 bp, Homo sapiens
atcttcagtgcttccttccagcttcctgat

SEQ ID NO: 30901 - DNA, 30 bp, Homo sapiens
aggtgggtttattgaggtaaaaatatttgt

SEQ ID NO: 30902 - DNA, 30 bp, Homo sapiens
cttcggattaggttgaatttgcctgttggg

SEQ ID NO: 30903 - DNA, 30 bp, Homo sapiens
ctatggtgattgagtttaaatatccctgca

SEQ ID NO: 30904 - DNA, 30 bp, Homo sapiens
ccttgtagttaagctcagcgttcatctggg

SEQ ID NO: 30905 - DNA, 30 bp, Homo sapiens
taggccagctggagcaggccgcgctcggcc

SEQ ID NO: 30906 - DNA, 30 bp, Homo sapiens
atgtgaaggtcacaccagcttcattgtaca

SEQ ID NO: 30907 - DNA, 30 bp, Homo sapiens
cgccggtttcattgagaagacacgtgcgga

SEQ ID NO: 30908 - DNA, 30 bp, Homo sapiens
cagaggtacacagttccactggttccagct

SEQ ID NO: 30909 - DNA, 30 bp, Homo sapiens
ccttgggtttgccaccattgggagataaaa

SEQ ID NO: 30910 - DNA, 30 bp, Homo sapiens
aaatggaactagattctgtgggtagcaagt

SEQ ID NO: 30911 - DNA, 30 bp, Homo sapiens
atgccagccacaaggacaaatcttaaaccc

SEQ ID NO: 30912 - DNA, 30 bp, Homo sapiens
tagaggtgaggcaggccagagaaagtcgca

SEQ ID NO: 30913 - DNA, 30 bp, Homo sapiens
agtcggcccgagacagcacagtcttcacag

SEQ ID NO: 30914 - DNA, 30 bp, Homo sapiens
ccgaggccgcaggaacaagaggtgggtgtc

SEQ ID NO: 30915 - DNA, 30 bp, Homo sapiens
tgtaggctcggtacacggcggacatatcgt

SEQ ID NO: 30916 - DNA, 30 bp, Homo sapiens
ggtcagggctgcttgccccagcctaaaatg

SEQ ID NO: 30917 - DNA, 30 bp, Homo sapiens
tatatgccctttagagaggcagcgatcttg

SEQ ID NO: 30918 - DNA, 30 bp, Homo sapiens
gtccaagttcatcaccacttgttcctgatc

SEQ ID NO: 30919 - DNA, 30 bp, Homo sapiens
cattggggtttgtcctcatgagctccacgt

SEQ ID NO: 30920 - DNA, 30 bp, Homo sapiens
taatcctctaagaccacaatctccacattg

SEQ ID NO: 30921 - DNA, 30 bp, Homo sapiens
tcgtggtcctctgccatggcagccacctca

SEQ ID NO: 30922 - DNA, 30 bp, Homo sapiens
ttctcacgtaaccattcttcagttaggtct

SEQ ID NO: 30923 - DNA, 30 bp, Homo sapiens
gccaggcctcagtgaggtcatcagtggtgc

SEQ ID NO: 30924 - DNA, 30 bp, Homo sapiens
agatggtcctcggcttcctcaggctggacg

SEQ ID NO: 30925 - DNA, 30 bp, Homo sapiens
ggcaatatattgctgactatgatagaggca

SEQ ID NO: 30926 - DNA, 30 bp, Homo sapiens
cttagggacccaggtaaacttccagcctcc

SEQ ID NO: 30927 - DNA, 30 bp, Homo sapiens
tagaggaagatacagttccttcagcacacg

SEQ ID NO: 30928 - DNA, 30 bp, Homo sapiens
cagaggatgatctggttggtgaagcttcgg

SEQ ID NO: 30929 - DNA, 30 bp, Homo sapiens
acatgatgatacgaggctctggcactgact

SEQ ID NO: 30930 - DNA, 30 bp, Homo sapiens
acacggtgttgtgctgctgggtcacccgga

SEQ ID NO: 30931 - DNA, 30 bp, Homo sapiens
tgaagattggattcacctgctgggtgactc

SEQ ID NO: 30932 - DNA, 30 bp, Homo sapiens
cagtagttcctgggggctttgatgttaagt

SEQ ID NO: 30933 - DNA, 30 bp, Homo sapiens
accaggttgtactccttgaggttgagctgc

SEQ ID NO: 30934 - DNA, 30 bp, Homo sapiens
ttcaggttctcctgcaggatggtgtctttc

SEQ ID NO: 30935 - DNA, 30 bp, Homo sapiens
ttgaggttgtcatgcagaatagtatccttc

SEQ ID NO: 30936 - DNA, 30 bp, Homo sapiens
acaaggttgaattcccttaggtttagctgt

SEQ ID NO: 30937 - DNA, 30 bp, Homo sapiens
agcaggttgatctcgtccaggtagcgggcg

SEQ ID NO: 30938 - DNA, 30 bp, Homo sapiens
ctgtggcacatgtgaagtgggtgtatattt

SEQ ID NO: 30939 - DNA, 30 bp, Homo sapiens
agaagaggccgcagtccttcaggttgttct

SEQ ID NO: 30940 - DNA, 30 bp, Homo sapiens
ctgtggcacaggtgaagtgagtatagatct

SEQ ID NO: 30941 - DNA, 30 bp, Homo sapiens
aagagctcatactgcttgaggtgcatccgc

SEQ ID NO: 30942 - DNA, 30 bp, Homo sapiens
ccccgcaggtttttggcgatgatgacgtcc

SEQ ID NO: 30943 - DNA, 30 bp, Homo sapiens
ccccggaggttgttggcaatgatgatgtcg

SEQ ID NO: 30944 - DNA, 30 bp, Homo sapiens
tgtactccttcaggttcaactggaggatgg

SEQ ID NO: 30945 - DNA, 30 bp, Homo sapiens
ctgttgctccttgcagcctgcgggtcctct

SEQ ID NO: 30946 - DNA, 30 bp, Homo sapiens
tagagcagctcgtactgacgaaggtgcatg

SEQ ID NO: 30947 - DNA, 30 bp, Homo sapiens
caatggtgcttttaccagattctccagcac

SEQ ID NO: 30948 - DNA, 30 bp, Homo sapiens
aagaggccacagtctttgaggttctccttg

SEQ ID NO: 30949 - DNA, 30 bp, Homo sapiens
aagaggccgcagtccttgaggttttctttg

SEQ ID NO: 30950 - DNA, 30 bp, Homo sapiens
cacaggtcatgtgggaataaatttccttat

SEQ ID NO: 30951 - DNA, 30 bp, Homo sapiens
caaaggccaatgtacttgagattgttctgt

SEQ ID NO: 30952 - DNA, 30 bp, Homo sapiens
cttgaggaagctatcccaggaccctgtcgc

SEQ ID NO: 30953 - DNA, 30 bp, Homo sapiens
gcgtgggtagagtgaccagaggctgatccg

SEQ ID NO: 30954 - DNA, 30 bp, Homo sapiens
gttccagatcttgaggaaggagtcccagga

SEQ ID NO: 30955 - DNA, 30 bp, Homo sapiens
cagttccagattttgaggaagctgtcccag

SEQ ID NO: 30956 - DNA, 30 bp, Homo sapiens
tctaagaaaactgtcccaagagcctgttgc

SEQ ID NO: 30957 - DNA, 30 bp, Homo sapiens
atccagagcagaaagcagtcccatcggggg

SEQ ID NO: 30958 - DNA, 30 bp, Homo sapiens
tgttgtgtagtccagaaccatgctggcagc

SEQ ID NO: 30959 - DNA, 30 bp, Homo sapiens
cacaggatctaggctcccggaaggggttac

SEQ ID NO: 30960 - DNA, 30 bp, Homo sapiens
taaaggggttcttgtcttctggaattccct

SEQ ID NO: 30961 - DNA, 30 bp, Homo sapiens
gagaggtaaaatcttcctctctcctaaaca

SEQ ID NO: 30962 - DNA, 30 bp, Homo sapiens
cacaggatggtgcatttgcccttttccacc

SEQ ID NO: 30963 - DNA, 30 bp, Homo sapiens
cataggatggcatagggcttcttctccttg

SEQ ID NO: 30964 - DNA, 30 bp, Homo sapiens
taaaggatggcacagaaaaacttcttctcc

SEQ ID NO: 30965 - DNA, 30 bp, Homo sapiens
cagaggagagcacagaagaacttcttctcc

SEQ ID NO: 30966 - DNA, 30 bp, Homo sapiens
cagtggacacaccatccctgcagcctgcca

SEQ ID NO: 30967 - DNA, 30 bp, Homo sapiens
gcctgggaaacttttacgcggttgagtccg

SEQ ID NO: 30968 - DNA, 30 bp, Homo sapiens
agagtccttcagagtcactccaagatcatg

SEQ ID NO: 30969 - DNA, 30 bp, Homo sapiens
tcgcggaaggggttctccgcggcgggtact

SEQ ID NO: 30970 - DNA, 30 bp, Homo sapiens
ttgagctccttgaagggatttttgtcctct

SEQ ID NO: 30971 - DNA, 30 bp, Homo sapiens
atgagagtagagggaaaagacggaggggtt

SEQ ID NO: 30972 - DNA, 30 bp, Homo sapiens
ccagcagggcataagggtttcggccagcca

SEQ ID NO: 30973 - DNA, 30 bp, Homo sapiens
gagtcattggtcttctttttgttcctgttc

SEQ ID NO: 30974 - DNA, 30 bp, Homo sapiens
gtagtctcctcagacagtgcctcccctgtc

SEQ ID NO: 30975 - DNA, 30 bp, Homo sapiens
ccatcatcagcattgccagagaggtcgaga

SEQ ID NO: 30976 - DNA, 30 bp, Homo sapiens
cagaggggacctgtagaaggtatacacaac

SEQ ID NO: 30977 - DNA, 30 bp, Homo sapiens
gagcacgtggatgaagtagcagggaatgta

SEQ ID NO: 30978 - DNA, 30 bp, Homo sapiens
ggctggttttcctattggtgtcttacaacc

SEQ ID NO: 30979 - DNA, 30 bp, Homo sapiens
gtatggtttcttcgaagattggcttttctc

SEQ ID NO: 30980 - DNA, 30 bp, Homo sapiens
gtttattgtgcacatgcattagacctttaa

SEQ ID NO: 30981 - DNA, 30 bp, Homo sapiens
acacatgtagttttcttcagatacagtata

SEQ ID NO: 30982 - DNA, 30 bp, Homo sapiens
ttctgggaaatatcttccgcttaagtgcaa

SEQ ID NO: 30983 - DNA, 30 bp, Homo sapiens
cagtcctgggtcaccccgcagctgctctgg

SEQ ID NO: 30984 - DNA, 30 bp, Homo sapiens
ttcctcttcaatcagactttccagagctcc

SEQ ID NO: 30985 - DNA, 30 bp, Homo sapiens
actttattggaggatggcggggcggggcgg

SEQ ID NO: 30986 - DNA, 30 bp, Homo sapiens
ccaaattcctaggacatagtagggagtcca

SEQ ID NO: 30987 - DNA, 30 bp, Homo sapiens
ataagtggatcaaagcatgggtttaaaaag

SEQ ID NO: 30988 - DNA, 30 bp, Homo sapiens
gtttggaaaatcttcgagtcctgacactgc

SEQ ID NO: 30989 - DNA, 30 bp, Homo sapiens
taggaccatggtatccgagggtttgagata

SEQ ID NO: 30990 - DNA, 30 bp, Homo sapiens
cattctcgtcagcccggtaaaaaaaaggaa

SEQ ID NO: 30991 - DNA, 30 bp, Homo sapiens
tcccggcccttctttggaagccctgctctg

SEQ ID NO: 30992 - DNA, 30 bp, Homo sapiens
agaaggtggcaacaccaaaagtagcaacgc

SEQ ID NO: 30993 - DNA, 30 bp, Homo sapiens
gcgaggtgaagtaaacatcagccgagcatc

SEQ ID NO: 30994 - DNA, 30 bp, Homo sapiens
atcttctctttccaaaattttctgagtctg

SEQ ID NO: 30995 - DNA, 30 bp, Homo sapiens
atatggttggtcgtggtgcatttctggtgt

SEQ ID NO: 30996 - DNA, 30 bp, Homo sapiens
tgtcctgcatgacaggagacagctgcacga

SEQ ID NO: 30997 - DNA, 30 bp, Homo sapiens
gggagggaggcagggctctgagcaccgctc

SEQ ID NO: 30998 - DNA, 30 bp, Homo sapiens
agatggcagcttccaggtgctcctggtgtt

SEQ ID NO: 30999 - DNA, 30 bp, Homo sapiens
gttcctgcatcttctcctcctgctgccgca

SEQ ID NO: 31000 - DNA, 30 bp, Homo sapiens
tgatggtgatgtttagctccctgttctcgg

SEQ ID NO: 31001 - DNA, 30 bp, Homo sapiens
ctcatgcctctgtcttcataaatggtaatt

SEQ ID NO: 31002 - DNA, 30 bp, Homo sapiens
aaatggtaatttcaatctaaaaactcgcag

SEQ ID NO: 31003 - DNA, 30 bp, Homo sapiens
ctcaaattcagatctgatgtggagtggtgt

SEQ ID NO: 31004 - DNA, 30 bp, Homo sapiens
tctcggcagccaagcccagcaaaagcatgg

SEQ ID NO: 31005 - DNA, 30 bp, Homo sapiens
ccagcaaaagaatggcacacagcagttgct

SEQ ID NO: 31006 - DNA, 30 bp, Homo sapiens
ccagcacaacaatggcacacagcagttgct

SEQ ID NO: 31007 - DNA, 30 bp, Homo sapiens
ccagcacaagaatggcacacagcagttgct

SEQ ID NO: 31008 - DNA, 30 bp, Homo sapiens
ccaacaaaataatggcacacagcagttgct

SEQ ID NO: 31009 - DNA, 30 bp, Homo sapiens
aaacacagaatgagcaggacatgaatcatt

SEQ ID NO: 31010 - DNA, 30 bp, Homo sapiens
catttcagctcttcgatgtgatttctcagc

SEQ ID NO: 31011 - DNA, 30 bp, Homo sapiens
ttcacgctgatcaagtaaatttatggtgtc

SEQ ID NO: 31012 - DNA, 30 bp, Homo sapiens
acttggtgaacgccgccaccaccgcccaca

SEQ ID NO: 31013 - DNA, 30 bp, Homo sapiens
cagcccagatcatttctgtggcactaggct

SEQ ID NO: 31014 - DNA, 30 bp, Homo sapiens
agctagtgccttgaagtctccggaacagcg

SEQ ID NO: 31015 - DNA, 30 bp, Homo sapiens
tgttgctttctccaactttatctacaaatg

SEQ ID NO: 31016 - DNA, 30 bp, Homo sapiens
tgcagcaagcaagcaggtggcatatcaata

SEQ ID NO: 31017 - DNA, 30 bp, Homo sapiens
cctcttcagacagaaggtccccatggtcag

SEQ ID NO: 31018 - DNA, 30 bp, Homo sapiens
tgcagatggtccatcgaagttagttctgtt

SEQ ID NO: 31019 - DNA, 30 bp, Homo sapiens
tctagcggagtttcacttgcagtgcccagg

SEQ ID NO: 31020 - DNA, 30 bp, Homo sapiens
atgtggccaaagcagctgaaatgtcattac

SEQ ID NO: 31021 - DNA, 30 bp, Homo sapiens
caccgagcgtatgaatagtctaagctggcc

SEQ ID NO: 31022 - DNA, 30 bp, Homo sapiens
ctgtggtagagatctgggcctggctgtcca

SEQ ID NO: 31023 - DNA, 30 bp, Homo sapiens
cattggcatccacagccgcagaaacaggct

SEQ ID NO: 31024 - DNA, 30 bp, Homo sapiens
caatggaacgcatacagcagcaacaggatg

SEQ ID NO: 31025 - DNA, 30 bp, Homo sapiens
agaccttcctccaaagtgtgctgtctggca

SEQ ID NO: 31026 - DNA, 30 bp, Homo sapiens
atgaggctaaaacaagaggccttctctctg

SEQ ID NO: 31027 - DNA, 30 bp, Homo sapiens
gtcaggtactgcaccacgaggaacatgacc

SEQ ID NO: 31028 - DNA, 30 bp, Homo sapiens
ttcaaatccaagcctgagttcaaaaggtat

SEQ ID NO: 31029 - DNA, 30 bp, Homo sapiens
cactggattttggtgactgcttcatggatg

SEQ ID NO: 31030 - DNA, 30 bp, Homo sapiens
gaagacacatctctgagctctctgtgagga

SEQ ID NO: 31031 - DNA, 30 bp, Homo sapiens
acttggtgacctggtgaatggcatgggcaa

SEQ ID NO: 31032 - DNA, 30 bp, Homo sapiens
cagaggctgtggccagagtacctaatgctc

SEQ ID NO: 31033 - DNA, 30 bp, Homo sapiens
gactcgtcggttccggctcgctcggccacc

SEQ ID NO: 31034 - DNA, 30 bp, Homo sapiens
gccaggaggacagtcaggaggaccataggc

SEQ ID NO: 31035 - DNA, 30 bp, Homo sapiens
ccaagggctctctctctgattaattttcga

SEQ ID NO: 31036 - DNA, 30 bp, Homo sapiens
atcagggtaattgacatattcatccctgta

SEQ ID NO: 31037 - DNA, 30 bp, Homo sapiens
tccagggcctctgtggtggcacacagcagg

SEQ ID NO: 31038 - DNA, 30 bp, Homo sapiens
cactggtcgaggtggtccggggattcacgc

SEQ ID NO: 31039 - DNA, 30 bp, Homo sapiens
gagcacattccagaaaagcagccagcaggg

SEQ ID NO: 31040 - DNA, 30 bp, Homo sapiens
ccgtgtgaaaatctggtgtttagttctcta

SEQ ID NO: 31041 - DNA, 30 bp, Homo sapiens
gcaccacaaaactcagaatatattctagaa

SEQ ID NO: 31042 - DNA, 30 bp, Homo sapiens
tcgaggttcatgtaagtccttagatcccgc

SEQ ID NO: 31043 - DNA, 30 bp, Homo sapiens
ggtctctgaaggtccagacagcactgatgg

SEQ ID NO: 31044 - DNA, 30 bp, Homo sapiens
tgccggatgaactgttctagtttttcctga

SEQ ID NO: 31045 - DNA, 30 bp, Homo sapiens
agctgagagatccattgcccacaatcatct

SEQ ID NO: 31046 - DNA, 30 bp, Homo sapiens
gagcggctcctgtccttgtggttccccacg

SEQ ID NO: 31047 - DNA, 30 bp, Homo sapiens
tagtggaagacttttcagccgtctcagcag

SEQ ID NO: 31048 - DNA, 30 bp, Homo sapiens
agttggtcctggacaatttgaagataggtc

SEQ ID NO: 31049 - DNA, 30 bp, Homo sapiens
cactggtccagtttgtagccattgaagttg

SEQ ID NO: 31050 - DNA, 30 bp, Homo sapiens
aggcggattttcctgcattgggggtagtag

SEQ ID NO: 31051 - DNA, 30 bp, Homo sapiens
atccagcaatggacatgtgatttgtttcca

SEQ ID NO: 31052 - DNA, 30 bp, Homo sapiens
tccagggctcttttcttgtggcattttaaa

SEQ ID NO: 31053 - DNA, 30 bp, Homo sapiens
aactcacctctttgagctggccgagaaggt

SEQ ID NO: 31054 - DNA, 30 bp, Homo sapiens
tctccatgagtcactcctatgattattcaa

SEQ ID NO: 31055 - DNA, 30 bp, Homo sapiens
aagaggaattagctgcagtttttaccagta

SEQ ID NO: 31056 - DNA, 30 bp, Homo sapiens
cactggtgaagagtccgataacagatgtat

SEQ ID NO: 31057 - DNA, 30 bp, Homo sapiens
acacggtacatgctcaataaatgataactg

SEQ ID NO: 31058 - DNA, 30 bp, Homo sapiens
cagtcaggcaatgaggggctgtctgaagca

SEQ ID NO: 31059 - DNA, 30 bp, Homo sapiens
ctgcatgctctgctctctgcttccctggtt

SEQ ID NO: 31060 - DNA, 30 bp, Homo sapiens
cacgtgccatggctggggggatgttgcagg

SEQ ID NO: 31061 - DNA, 30 bp, Homo sapiens
gttcaagtccaggtcgacactgctttggct

SEQ ID NO: 31062 - DNA, 30 bp, Homo sapiens
cacatcgtcgtcatctgatgtatcactgct

SEQ ID NO: 31063 - DNA, 30 bp, Homo sapiens
tccaggcatcgtcatctgatgtttcactgc

SEQ ID NO: 31064 - DNA, 30 bp, Homo sapiens
caccggggcctggctactgtaagggccagg

SEQ ID NO: 31065 - DNA, 30 bp, Homo sapiens
tatcgaggtccaagcagggccagggctgag

SEQ ID NO: 31066 - DNA, 30 bp, Homo sapiens
accaggaagaagaagcacaccaccgagatg

SEQ ID NO: 31067 - DNA, 30 bp, Homo sapiens
tctctgcataaccaggaacaagatgcagaa

SEQ ID NO: 31068 - DNA, 30 bp, Homo sapiens
tcccgggaagtaacatcaccacacttatca

SEQ ID NO: 31069 - DNA, 30 bp, Homo sapiens
gccaggacaatgcaggtgagagaccaggag

SEQ ID NO: 31070 - DNA, 30 bp, Homo sapiens
tatcaatgccgttggcatccacatggatat

SEQ ID NO: 31071 - DNA, 30 bp, Homo sapiens
cacatatgttctggatgattctgcaggcag

SEQ ID NO: 31072 - DNA, 30 bp, Homo sapiens
ggatggctctgaagacaagacaacatctct

SEQ ID NO: 31073 - DNA, 30 bp, Homo sapiens
caactacggtccactggaattggaactctt

SEQ ID NO: 31074 - DNA, 30 bp, Homo sapiens
acacggcactgctgaacctcacatccgact

SEQ ID NO: 31075 - DNA, 30 bp, Homo sapiens
gagaggcgacacatgtcacactggcaggcc

SEQ ID NO: 31076 - DNA, 30 bp, Homo sapiens
agatggtctcacactccgtggtggcagtgg

SEQ ID NO: 31077 - DNA, 30 bp, Homo sapiens
tagccgtccaatgaccatgacatccaccac

SEQ ID NO: 31078 - DNA, 30 bp, Homo sapiens
tattggactctggcctcgcgctgctgcttg

SEQ ID NO: 31079 - DNA, 30 bp, Homo sapiens
caccgtcttggtgatgggctggcagctgtc

SEQ ID NO: 31080 - DNA, 30 bp, Homo sapiens
tcctggcccccattgctccaaggccggcaa

SEQ ID NO: 31081 - DNA, 30 bp, Homo sapiens
actagggcccatgtactggcagatggcatc

SEQ ID NO: 31082 - DNA, 30 bp, Homo sapiens
ccaaggctatagacgtgaagtgccccggag

SEQ ID NO: 31083 - DNA, 30 bp, Homo sapiens
ctttggagcgagtagagtggatgtcatgaa

SEQ ID NO: 31084 - DNA, 30 bp, Homo sapiens
gactggatatcttgcagttcctgttcttcc

SEQ ID NO: 31085 - DNA, 30 bp, Homo sapiens
agcagggcaatgacggtggcaccagctcct

SEQ ID NO: 31086 - DNA, 30 bp, Homo sapiens
ttgtgccatcgattcttgcataaaattctg

SEQ ID NO: 31087 - DNA, 30 bp, Homo sapiens
gcatggcttcctgctccactgactggttcg

SEQ ID NO: 31088 - DNA, 30 bp, Homo sapiens
tcctggcattcttgaaaatattcgtcaaac

SEQ ID NO: 31089 - DNA, 30 bp, Homo sapiens
tcctggtttcccgggaagaacacggctttt

SEQ ID NO: 31090 - DNA, 30 bp, Homo sapiens
tccaggagacacagattcttggtttctgag

SEQ ID NO: 31091 - DNA, 30 bp, Homo sapiens
cgtaggaagggacaatcttgccttcagtcc

SEQ ID NO: 31092 - DNA, 30 bp, Homo sapiens
ccaagtcttcttcttcctgagaaagttgta

SEQ ID NO: 31093 - DNA, 30 bp, Homo sapiens
acacggcgccttcccactcgccctggggct

SEQ ID NO: 31094 - DNA, 30 bp, Homo sapiens
cgctggctgttttgttgactttggagaggc

SEQ ID NO: 31095 - DNA, 30 bp, Homo sapiens
tagccatcaaactctgagctggagatagtg

SEQ ID NO: 31096 - DNA, 30 bp, Homo sapiens
cactgggcgagcgcgctctctgggcgagac

SEQ ID NO: 31097 - DNA, 30 bp, Homo sapiens
agcaggactcctcaatcagcctctttgcag

SEQ ID NO: 31098 - DNA, 30 bp, Homo sapiens
tagaggctggtatccccagcttcggattta

SEQ ID NO: 31099 - DNA, 30 bp, Homo sapiens
tagggggacggcacaagctcactatgacag

SEQ ID NO: 31100 - DNA, 30 bp, Homo sapiens
cacgcccgatggcaccataccagctcccag

SEQ ID NO: 31101 - DNA, 30 bp, Homo sapiens
ctgtggggtggagtagagactgtggtggtg

SEQ ID NO: 31102 - DNA, 30 bp, Homo sapiens
ccaaggcttggtttgtcaggatccaaagtt

SEQ ID NO: 31103 - DNA, 30 bp, Homo sapiens
ttgtggtgtcacatataagctatgatgatt

SEQ ID NO: 31104 - DNA, 30 bp, Homo sapiens
cacggggatacttttataggttttccattt

SEQ ID NO: 31105 - DNA, 30 bp, Homo sapiens
taacggcacaaaacacaattccataagcca

SEQ ID NO: 31106 - DNA, 30 bp, Homo sapiens
tggggagtcccggaggctccatcacaggct

SEQ ID NO: 31107 - DNA, 30 bp, Homo sapiens
cataggtctccatgggttgggagagcaggg

SEQ ID NO: 31108 - DNA, 30 bp, Homo sapiens
acgccagcacctgctgcacccccatgtggt

SEQ ID NO: 31109 - DNA, 30 bp, Homo sapiens
aaatggtaaagatggcctggtgcctcctgg

SEQ ID NO: 31110 - DNA, 30 bp, Homo sapiens
aactacccttgctttcttcctctctttttc

SEQ ID NO: 31111 - DNA, 30 bp, Homo sapiens
agagtgacacagacctcttcctcctcctgg

SEQ ID NO: 31112 - DNA, 30 bp, Homo sapiens
agaaggcactttcgcaggagcaaggcaggg

SEQ ID NO: 31113 - DNA, 30 bp, Homo sapiens
cctgtctcttgatcttcatgttcccagggg

SEQ ID NO: 31114 - DNA, 30 bp, Homo sapiens
cgtggggcctgcgcccggggccgcctctgg

SEQ ID NO: 31115 - DNA, 30 bp, Homo sapiens
acgcggagcccagcgagtccgagtgcagcg

SEQ ID NO: 31116 - DNA, 30 bp, Homo sapiens
cttaggggaatgtgagggtggggatgaatg

SEQ ID NO: 31117 - DNA, 30 bp, Homo sapiens
gcgtgggtttcaagtcatctttgaagttca

SEQ ID NO: 31118 - DNA, 30 bp, Homo sapiens
ccctggggtcccttgggattcctgagattc

SEQ ID NO: 31119 - DNA, 30 bp, Homo sapiens
tctcttctttcctaggccctgctatcttat

SEQ ID NO: 31120 - DNA, 30 bp, Homo sapiens
gacaaatggatccaaaggtaatccaatgtc

SEQ ID NO: 31121 - DNA, 30 bp, Homo sapiens
tctctgctcggcagctaaaacatctccttc

SEQ ID NO: 31122 - DNA, 30 bp, Homo sapiens
cacagggtcagctggggaaagatggggttg

SEQ ID NO: 31123 - DNA, 30 bp, Homo sapiens
cacagctctgacttggcactcagcgagctc

SEQ ID NO: 31124 - DNA, 30 bp, Homo sapiens
tctctttaggtgaggcaaaagtctcagtga

SEQ ID NO: 31125 - DNA, 30 bp, Homo sapiens
agtagggttctctgggagccggggcacctc

SEQ ID NO: 31126 - DNA, 30 bp, Homo sapiens
tcatggtggaagctgtatggttactcacaa

SEQ ID NO: 31127 - DNA, 30 bp, Homo sapiens
taggaatccacctttggaaaaatgctcact

SEQ ID NO: 31128 - DNA, 30 bp, Homo sapiens
cccaaggatagacagtgggaggggtgaatt

SEQ ID NO: 31129 - DNA, 30 bp, Homo sapiens
actaccagatcggaaactttttctgcgcat

SEQ ID NO: 31130 - DNA, 30 bp, Homo sapiens
gatatggtcagtggtagtgttactgaagaa

SEQ ID NO: 31131 - DNA, 30 bp, Homo sapiens
agctgggtgtaagaggctgagtgggagaga

SEQ ID NO: 31132 - DNA, 30 bp, Homo sapiens
acttggaatgtatcatcatctgcgtttctg

SEQ ID NO: 31133 - DNA, 30 bp, Homo sapiens
aagctttttttccttggcttctctgtcaaa

SEQ ID NO: 31134 - DNA, 30 bp, Homo sapiens
cctcgggcccattagccagggcctgggtga

SEQ ID NO: 31135 - DNA, 30 bp, Homo sapiens
cagatatgacatccattaagagggcctttg

SEQ ID NO: 31136 - DNA, 30 bp, Homo sapiens
ctgaggcactaaacatttttctcttatttc

SEQ ID NO: 31137 - DNA, 30 bp, Homo sapiens
accaggaggccgaggcagtgttcgcggcct

SEQ ID NO: 31138 - DNA, 30 bp, Homo sapiens
ctcagacaccggcagaatgttctggctgtg

SEQ ID NO: 31139 - DNA, 30 bp, Homo sapiens
taaaccaatgcctttcaggtcgcagggatg

SEQ ID NO: 31140 - DNA, 30 bp, Homo sapiens
cactgggggagcgggatcggaaggggatct

SEQ ID NO: 31141 - DNA, 30 bp, Homo sapiens
atctgggggctctgctgcctgccctttgcc

SEQ ID NO: 31142 - DNA, 30 bp, Homo sapiens
ttcccggggggcgttgccacggggacagga

SEQ ID NO: 31143 - DNA, 30 bp, Homo sapiens
tgaaattctccccaacaaataagtagagtg

SEQ ID NO: 31144 - DNA, 30 bp, Homo sapiens
atgtatcatgcagggagtatcctggtttaa

SEQ ID NO: 31145 - DNA, 30 bp, Homo sapiens
aggcgagggtcacgcacagagagtcctggc

SEQ ID NO: 31146 - DNA, 30 bp, Homo sapiens
gcaatgagttccgacagaagcaaaagtgga

SEQ ID NO: 31147 - DNA, 30 bp, Homo sapiens
gcaaggtgtgcccaggggcaggagtggggg

SEQ ID NO: 31148 - DNA, 30 bp, Homo sapiens
aaccattctctgcagcagaattggctggtt

SEQ ID NO: 31149 - DNA, 30 bp, Homo sapiens
tgctggcggcagcatcttcagctgcacctg

SEQ ID NO: 31150 - DNA, 30 bp, Homo sapiens; identical to SEQ ID NO: 30118

SEQ ID NO: 31151 - DNA, 30 bp, Homo sapiens
aaaccgcagactggttttcattgcacacgt

SEQ ID NO: 31152 - DNA, 30 bp, Homo sapiens
catcaggatcatcttcaacatcaataacca

SEQ ID NO: 31153 - DNA, 30 bp, Homo sapiens
aaatggagcaagaattagcccgtttcctag

SEQ ID NO: 31154 - DNA, 30 bp, Homo sapiens
gccccgggagatcgtggtgtcctgcaggac

SEQ ID NO: 31155 - DNA, 30 bp, Homo sapiens
agacctcgctgggagacctggaacgaaagg

SEQ ID NO: 31156 - DNA, 30 bp, Homo sapiens
atgactccagccggggtgaggcggcaggac

SEQ ID NO: 31157 - DNA, 30 bp, Homo sapiens
caggagagagaactctcaggtggcccctgg

SEQ ID NO: 31158 - DNA, 30 bp, Homo sapiens
tccgatgttccccacacacatagacagcac

SEQ ID NO: 31159 - DNA, 30 bp, Homo sapiens
tcaaggacctctaattccatagtatctttt

SEQ ID NO: 31160 - DNA, 30 bp, Homo sapiens
taggccaacctgcccgtggggaacccgccc

SEQ ID NO: 31161 - DNA, 30 bp, Homo sapiens
aaacggaggggactggaatctgcttggctg

SEQ ID NO: 31162 - DNA, 30 bp, Homo sapiens
gtgtgtctgctgcaggcaggaatcattctc

SEQ ID NO: 31163 - DNA, 30 bp, Homo sapiens
gattgcatatgtgctgaattagactttgta

SEQ ID NO: 31164 - DNA, 30 bp, Homo sapiens
caatgggttccacagatgacaggtctgtct

SEQ ID NO: 31165 - DNA, 30 bp, Homo sapiens
taatggagcctatggaaactccggggccct

SEQ ID NO: 31166 - DNA, 30 bp, Homo sapiens
gtaaggttcccttggtaacctggattttct

SEQ ID NO: 31167 - DNA, 30 bp, Homo sapiens
ttctcacactttgcagtgatctgatgcttt

SEQ ID NO: 31168 - DNA, 30 bp, Homo sapiens
tgctggcccgcggcgcgggtgcccagttgc

SEQ ID NO: 31169 - DNA, 30 bp, Homo sapiens
gcttctctggtgcctgtttgtgagccaaat

SEQ ID NO: 31170 - DNA, 30 bp, Homo sapiens
ttcagggtcattttgattgtctgttttgcc

SEQ ID NO: 31171 - DNA, 30 bp, Homo sapiens
ctcaggatcattttggttgtctatttgggc

SEQ ID NO: 31172 - DNA, 30 bp, Homo sapiens
gctcggccaagcgtgggcccgtgggatgga

SEQ ID NO: 31173 - DNA, 30 bp, Homo sapiens
gtgtcttcctgtgtgacttggcggagcagt

SEQ ID NO: 31174 - DNA, 30 bp, Homo sapiens
cgtaggggtttctaaagacctgagagttct

SEQ ID NO: 31175 - DNA, 30 bp, Homo sapiens
gcatcttgctgggggcttagtttagcctgt

SEQ ID NO: 31176 - DNA, 30 bp, Homo sapiens
atatgtgtgcaaatgcttgtgcctgaagat

SEQ ID NO: 31177 - DNA, 30 bp, Homo sapiens
gtcccgcccgcgagcagcaccgcggccggc

SEQ ID NO: 31178 - DNA, 30 bp, Homo sapiens
actcgggggccgcgccggagcagccgcagc

SEQ ID NO: 31179 - DNA, 30 bp, Homo sapiens
gacggggcaggacggacgcagcagttgggg

SEQ ID NO: 31180 - DNA, 30 bp, Homo sapiens
acatgttggtgctcatccgggactggctgt

SEQ ID NO: 31181 - DNA, 30 bp, Homo sapiens
ttgtggtagaatcgcgggttctggctgtgt

SEQ ID NO: 31182 - DNA, 30 bp, Homo sapiens
gcccctggggcccatctcaggctccagcag

SEQ ID NO: 31183 - DNA, 30 bp, Homo sapiens
gcctgtgctgtccctgaggccaagaagaac

SEQ ID NO: 31184 - DNA, 30 bp, Homo sapiens
ctcgcaccaggctggcactgctgctggggc

SEQ ID NO: 31185 - DNA, 30 bp, Homo sapiens
gcccaaagtcagtgtctctgttttgatctc

SEQ ID NO: 31186 - DNA, 30 bp, Homo sapiens
agcaggtgtgtgtggggggccgggaccttt

SEQ ID NO: 31187 - DNA, 30 bp, Homo sapiens
tcgagggtgaacttggcatggaacctgctc

SEQ ID NO: 31188 - DNA, 30 bp, Homo sapiens
gcgtacttctccaggaagttgatgtggaag

SEQ ID NO: 31189 - DNA, 30 bp, Homo sapiens
gcacagctgggcccttgagacagcagggct

SEQ ID NO: 31190 - DNA, 30 bp, Homo sapiens
tccaggcaacatcgttgcgacacaccggag

SEQ ID NO: 31191 - DNA, 30 bp, Homo sapiens
atatggcaactttaaggaggcgcttgatgt

SEQ ID NO: 31192 - DNA, 30 bp, Homo sapiens
cagtgggagatgctggccccaaggttgagg

SEQ ID NO: 31193 - DNA, 30 bp, Homo sapiens
tgagtgccggtggaaggctccaagggcgtg

SEQ ID NO: 31194 - DNA, 30 bp, Homo sapiens
cactgggaggccacgttggtgacgatgcac

SEQ ID NO: 31195 - DNA, 30 bp, Homo sapiens
taaccatgtgcccgtcgatgtccttggcgg

SEQ ID NO: 31196 - DNA, 30 bp, Homo sapiens
atttggttttgaattgcttcaagtacgcca

SEQ ID NO: 31197 - DNA, 30 bp, Homo sapiens
acatcccctttctcaaaaagctggaaacta

SEQ ID NO: 31198 - DNA, 30 bp, Homo sapiens
aataggcggccacattgacaaacaggacgt

SEQ ID NO: 31199 - DNA, 30 bp, Homo sapiens
agtaggatgagcttcctcacgagcgctgtg

SEQ ID NO: 31200 - DNA, 30 bp, Homo sapiens
ctcagggttgacaagatacttccaaaaatt

SEQ ID NO: 31201 - DNA, 30 bp, Homo sapiens
ctgctatgtcaggcctgatgacttcaatgg

SEQ ID NO: 31202 - DNA, 30 bp, Homo sapiens
gaaaagctgtcatcgggccggggctgggtg

SEQ ID NO: 31203 - DNA, 30 bp, Homo sapiens
caatgatagcgattcctcttttcttcactt

SEQ ID NO: 31204 - DNA, 30 bp, Homo sapiens
tctcggagcactccctttaaacgatgggcc

SEQ ID NO: 31205 - DNA, 30 bp, Homo sapiens
cccagggactgggtcatcccaactcaagga

SEQ ID NO: 31206 - DNA, 30 bp, Homo sapiens
tcaagcaacttctgtaagttattttgtatc

SEQ ID NO: 31207 - DNA, 30 bp, Homo sapiens
cagacgctgccgctgaggtgatcttgatgt

SEQ ID NO: 31208 - DNA, 30 bp, Homo sapiens
ttcagtccaaggccgtccactgagccccgt

SEQ ID NO: 31209 - DNA, 30 bp, Homo sapiens
cacaggtgcacgggctgcacgtaactccgt

SEQ ID NO: 31210 - DNA, 30 bp, Homo sapiens
tatcgggtcatgggtgccacgtagttggca

SEQ ID NO: 31211 - DNA, 30 bp, Homo sapiens
tctgctgtgtgattttgggcccaggcaggg

SEQ ID NO: 31212 - DNA, 30 bp, Homo sapiens
cagctggctctcctcctcctccagggagcg

SEQ ID NO: 31213 - DNA, 30 bp, Homo sapiens
ataaggccactcggatgcagtggtgcttga

SEQ ID NO: 31214 - DNA, 30 bp, Homo sapiens
gctgtattagatctgtaaatcttgtgtggc

SEQ ID NO: 31215 - DNA, 30 bp, Homo sapiens
ttccggttcacgggggtgacataattgcgg

SEQ ID NO: 31216 - DNA, 30 bp, Homo sapiens
cagagggccacccgcgtgcagcaatggcgc

SEQ ID NO: 31217 - DNA, 30 bp, Homo sapiens
tgcaggtggcacaaagagaggacaaagccc

SEQ ID NO: 31218 - DNA, 30 bp, Homo sapiens
atgtgtcgtcccgtcagaaaaaagagcggc

SEQ ID NO: 31219 - DNA, 30 bp, Homo sapiens
gtccggatttcgtatttgatgtgccagctg

SEQ ID NO: 31220 - DNA, 30 bp, Homo sapiens
ataagctccggggcgatgcaggttctgccg

SEQ ID NO: 31221 - DNA, 30 bp, Homo sapiens
agaaagtagagaggcttgtcatcactgctg

SEQ ID NO: 31222 - DNA, 30 bp, Homo sapiens
cgatggatatgcaacgacactgcttcacac

SEQ ID NO: 31223 - DNA, 30 bp, Homo sapiens
cgctcaggttcacggacatgcaccggcact

SEQ ID NO: 31224 - DNA, 30 bp, Homo sapiens
gatctccgtcagggtgagcttgtaagaccc

SEQ ID NO: 31225 - DNA, 30 bp, Homo sapiens
gcgtgaccttgaagccctccaccatgctct

SEQ ID NO: 31226 - DNA, 30 bp, Homo sapiens
ttacagtgaagtgcaggctgttgacggtgg

SEQ ID NO: 31227 - DNA, 30 bp, Homo sapiens
agctccttaaggatgatctgaattttgccg

SEQ ID NO: 31228 - DNA, 30 bp, Homo sapiens
actaggcatcggctcccctctcaggccagc

SEQ ID NO: 31229 - DNA, 30 bp, Homo sapiens
acaatcccgtggctcccaagggcatccctg

SEQ ID NO: 31230 - DNA, 30 bp, Homo sapiens
acgttgtaaccttccttataagttgcaaaa

SEQ ID NO: 31231 - DNA, 30 bp, Homo sapiens
atacaataggcccagttttggcgggcccca

SEQ ID NO: 31232 - DNA, 30 bp, Homo sapiens
atcttaacactctctgttccatacacgttg

SEQ ID NO: 31233 - DNA, 30 bp, Homo sapiens
acgttgtaaccttctctataggttgctaaa

SEQ ID NO: 31234 - DNA, 30 bp, Homo sapiens
caatgacagccaatcctgaactttgtctga

SEQ ID NO: 31235 - DNA, 30 bp, Homo sapiens
ttctgttctcaatagcagctgtgtcattgc

SEQ ID NO: 31236 - DNA, 30 bp, Homo sapiens
agatggaggtcccgtgggaggtgtccagag

SEQ ID NO: 31237 - DNA, 30 bp, Homo sapiens
tggaggtgcctcggtctggatcattaccca

SEQ ID NO: 31238 - DNA, 30 bp, Homo sapiens
accaggccaggggtgaaaccatcccggagc

SEQ ID NO: 31239 - DNA, 30 bp, Homo sapiens
gctcaggcccctcttggccagctccacctg

SEQ ID NO: 31240 - DNA, 30 bp, Homo sapiens
tctcttttctctgagttcgtctctgatgac

SEQ ID NO: 31241 - DNA, 30 bp, Homo sapiens
cagttccttcctctttgagactaataatgt

SEQ ID NO: 31242 - DNA, 30 bp, Homo sapiens
ctgaggactgttttcgaatccctctctcct

SEQ ID NO: 31243 - DNA, 30 bp, Homo sapiens
ggatggtatggtggcactaaccaaatagaa

SEQ ID NO: 31244 - DNA, 30 bp, Homo sapiens
ccatggtttctttacctggcaaccttctgt

SEQ ID NO: 31245 - DNA, 30 bp, Homo sapiens
aaatggaaactgactccaaaatagggagga

SEQ ID NO: 31246 - DNA, 30 bp, Homo sapiens
taggggaacacaggggctaaggatgtgctg

SEQ ID NO: 31247 - DNA, 30 bp, Homo sapiens
actcgggctcgctgctgttggtggttttct

SEQ ID NO: 31248 - DNA, 30 bp, Homo sapiens
aagaggctgttcctctcccgcataccgact

SEQ ID NO: 31249 - DNA, 30 bp, Homo sapiens
acatggaagttgctggtgacaagagtggct

SEQ ID NO: 31250 - DNA, 30 bp, Homo sapiens
gctcccgggggccggcggggccaggccgcg

SEQ ID NO: 31251 - DNA, 30 bp, Homo sapiens
tgacgggaacacagctgcagctggccctcc

SEQ ID NO: 31252 - DNA, 30 bp, Homo sapiens
accacggtgctgaccgagggatctgagagg

SEQ ID NO: 31253 - DNA, 30 bp, Homo sapiens
gcctgggatggcaacgagtgtttgtaaggg

SEQ ID NO: 31254 - DNA, 30 bp, Homo sapiens
tgcaggaatttaaaaccctgggggtagagt

SEQ ID NO: 31255 - DNA, 30 bp, Homo sapiens
tgctggagccattgaaagccctggggtttt

SEQ ID NO: 31256 - DNA, 30 bp, Homo sapiens
aaactttggcctgtgtggggaggggtgggc

SEQ ID NO: 31257 - DNA, 30 bp, Homo sapiens
gactggagatccgtctccaggtgcagggtc

SEQ ID NO: 31258 - DNA, 30 bp, Homo sapiens
catacctcggactcgaggctagagaagtgc

SEQ ID NO: 31259 - DNA, 30 bp, Homo sapiens
actcacaagtccgacttgtcctttgatact

SEQ ID NO: 31260 - DNA, 30 bp, Homo sapiens
cattcctggctccccggtcggccagagtgt

SEQ ID NO: 31261 - DNA, 30 bp, Homo sapiens
ccttggcgcggccaatgatggtgaggatgt

SEQ ID NO: 31262 - DNA, 30 bp, Homo sapiens
taccaccgtggctaggctgctggaaaaaag

SEQ ID NO: 31263 - DNA, 30 bp, Homo sapiens
atccggggactgctggggcctggcgatcgg

SEQ ID NO: 31264 - DNA, 30 bp, Homo sapiens
agctggtttctcctggctctaggtctgggt

SEQ ID NO: 31265 - DNA, 30 bp, Homo sapiens
aaaccagacacatccctgacttggacgagg

SEQ ID NO: 31266 - DNA, 30 bp, Homo sapiens
cagaggccgttggcactgccgcgctggacc

SEQ ID NO: 31267 - DNA, 30 bp, Homo sapiens
tagaggccgttgctgtttctgtgacagagg

SEQ ID NO: 31268 - DNA, 30 bp, Homo sapiens
gcttgggttccacttccttctcactgggga

SEQ ID NO: 31269 - DNA, 30 bp, Homo sapiens
ttccggtggagttcgagctgacatggtttg

SEQ ID NO: 31270 - DNA, 30 bp, Homo sapiens
gcgactgaagagtctctgcagcagtccctt

SEQ ID NO: 31271 - DNA, 30 bp, Homo sapiens
actgctggtgggggcctcgggctgggggct

SEQ ID NO: 31272 - DNA, 30 bp, Homo sapiens
tagaggcgggtggggagctcttcctcgctg

SEQ ID NO: 31273 - DNA, 30 bp, Homo sapiens
acttggatgaattaccctcctcacaacccg

SEQ ID NO: 31274 - DNA, 30 bp, Homo sapiens
tacagggtggaagagctttgcttgtagtcc

SEQ ID NO: 31275 - DNA, 30 bp, Homo sapiens
cgacggacattggctggtgggcgagaattc

SEQ ID NO: 31276 - DNA, 30 bp, Homo sapiens
cattggtcttcacgtgcacagagaggcggt

SEQ ID NO: 31277 - DNA, 30 bp, Homo sapiens
cctcacggccattgcaaacagtggggacaa

SEQ ID NO: 31278 - DNA, 30 bp, Homo sapiens
atgaggtggtggagtcgaggacttcccgcc

SEQ ID NO: 31279 - DNA, 30 bp, Homo sapiens
gcatggttggtgtaagtgacgtaagtctgt

SEQ ID NO: 31280 - DNA, 30 bp, Homo sapiens
acgaggagctctgagtgtaatctcttatga

SEQ ID NO: 31281 - DNA, 30 bp, Homo sapiens
tacttgtgggcctctgcatcctcgcccttg

SEQ ID NO: 31282 - DNA, 30 bp, Homo sapiens
accaggttattataactgacatacttcttt

SEQ ID NO: 31283 - DNA, 30 bp, Homo sapiens
tgttggtgggatagtgtaccaagtaacaga

SEQ ID NO: 31284 - DNA, 30 bp, Homo sapiens
catttggtctgtcatttcctttttggatca

SEQ ID NO: 31285 - DNA, 30 bp, Homo sapiens
cttgaccatcggaaactctacagatgactt

SEQ ID NO: 31286 - DNA, 30 bp, Homo sapiens
cagcagctgtctcaaggctgggtccctcaa

SEQ ID NO: 31287 - DNA, 30 bp, Homo sapiens
agctgggggttccttccttcacgttgagaa

SEQ ID NO: 31288 - DNA, 30 bp, Homo sapiens
tgctggttcagctgggggttccttccttca

SEQ ID NO: 31289 - DNA, 30 bp, Homo sapiens
ccacccccaccagggcgggtctcagagtgc

SEQ ID NO: 31290 - DNA, 30 bp, Homo sapiens
cacagtcttctctgagactccactgccact

SEQ ID NO: 31291 - DNA, 30 bp, Homo sapiens
gtgacagatgtttccattgatgaggctaaa

SEQ ID NO: 31292 - DNA, 30 bp, Homo sapiens
ggacatgaattcaggaacagttcaatatac

SEQ ID NO: 31293 - DNA, 30 bp, Homo sapiens
ctctggaaaggggcatcgtcagtgtagaga

SEQ ID NO: 31294 - DNA, 30 bp, Homo sapiens
gcccactggtgcccgtcctgtgcaccctcc

SEQ ID NO: 31295 - DNA, 30 bp, Homo sapiens
tgccagcagccgggccctgcagctctcgcg

SEQ ID NO: 31296 - DNA, 30 bp, Homo sapiens
acgctgatggtgcggaagatggtgaagcct

SEQ ID NO: 31297 - DNA, 30 bp, Homo sapiens
aaccagcacagttcttacaacgctgaagac

SEQ ID NO: 31298 - DNA, 30 bp, Homo sapiens
gcaaggctgtaggccattctcattgcaggc

SEQ ID NO: 31299 - DNA, 30 bp, Homo sapiens
caaattctgcatccacattgtcatgtcctt

SEQ ID NO: 31300 - DNA, 30 bp, Homo sapiens
agcatcgcggtgtgtttcagagctgcttcc

SEQ ID NO: 31301 - DNA, 30 bp, Homo sapiens
gctgtccgagtccaaatcgcttttaccttc

SEQ ID NO: 31302 - DNA, 30 bp, Homo sapiens
cggggacttcttgacgccgggcaggagcct

SEQ ID NO: 31303 - DNA, 30 bp, Homo sapiens
aggaggccttggtaagctgctgaaggagag

SEQ ID NO: 31304 - DNA, 30 bp, Homo sapiens
cagaggtaggcccctcagccagctccagca

SEQ ID NO: 31305 - DNA, 30 bp, Homo sapiens
ccagctgctgcagcaacgagagagtcccat

SEQ ID NO: 31306 - DNA, 30 bp, Homo sapiens
tagtggggctcctggctcagtcctgatagc

SEQ ID NO: 31307 - DNA, 30 bp, Homo sapiens
acctgggatatcccttcaggtagcccctag

SEQ ID NO: 31308 - DNA, 30 bp, Homo sapiens
ccatcctggtgtacgtgttgaaggtggtga

SEQ ID NO: 31309 - DNA, 30 bp, Homo sapiens
actgctcttcctctacagatgacctaactg

SEQ ID NO: 31310 - DNA, 30 bp, Homo sapiens
gccccaagacccagcactgtcggttcagct

SEQ ID NO: 31311 - DNA, 30 bp, Homo sapiens
agctggatggttgagtaatgaggatgtgtg

SEQ ID NO: 31312 - DNA, 30 bp, Homo sapiens
gcctggggcgcctggtgggaggtgtccaga

SEQ ID NO: 31313 - DNA, 30 bp, Homo sapiens
aggaggagttagtgagggtaggtgtggcat

SEQ ID NO: 31314 - DNA, 30 bp, Homo sapiens
aggtggagttggaagctgatgcagaagcag

SEQ ID NO: 31315 - DNA, 30 bp, Homo sapiens
cttttcaaagcttccagtctttgaagcagt

SEQ ID NO: 31316 - DNA, 30 bp, Homo sapiens
caggcagccagctcagccatggccctgtcc

SEQ ID NO: 31317 - DNA, 30 bp, Homo sapiens
gcaatggtcttaccctcatctcttaaggtg

SEQ ID NO: 31318 - DNA, 30 bp, Homo sapiens
ctctgggaccaatttcagaacttttccaat

SEQ ID NO: 31319 - DNA, 30 bp, Homo sapiens
cttctgaagaggtagggtgaatggcgactg

SEQ ID NO: 31320 - DNA, 30 bp, Homo sapiens
cacagggtatgggttgtccaggactgccac

SEQ ID NO: 31321 - DNA, 30 bp, Homo sapiens
aatcttccttgcttcttctaaagatttctc

SEQ ID NO: 31322 - DNA, 30 bp, Homo sapiens
gggaggcttccttgggctgccaggctgtag

SEQ ID NO: 31323 - DNA, 30 bp, Homo sapiens
aatctttctggcttcttctaaagcttttgc

SEQ ID NO: 31324 - DNA, 30 bp, Homo sapiens
gatgttgtagacggttctcacataaatttc

SEQ ID NO: 31325 - DNA, 30 bp, Homo sapiens
ctctggctccatggatatcacttgaacgga

SEQ ID NO: 31326 - DNA, 30 bp, Homo sapiens
gtctggcattcacggctggaggtatagggc

SEQ ID NO: 31327 - DNA, 30 bp, Homo sapiens
ttgttgccccagacagccatctttgagaac

SEQ ID NO: 31328 - DNA, 30 bp, Homo sapiens
ttcaggtttgggaaggcatccaggcagctg

SEQ ID NO: 31329 - DNA, 30 bp, Homo sapiens
cagcatacaggcttgttgccccactgggcc

SEQ ID NO: 31330 - DNA, 30 bp, Homo sapiens
acagccacccttgtgtacagaggttttggg

SEQ ID NO: 31331 - DNA, 30 bp, Homo sapiens
cattatgccacaggaaacctcaaagcggga

SEQ ID NO: 31332 - DNA, 30 bp, Homo sapiens
ttgctgttccatgtagctgactttccaaac

SEQ ID NO: 31333 - DNA, 30 bp, Homo sapiens
cagagcccatagtcacaggcctcagggctg

SEQ ID NO: 31334 - DNA, 30 bp, Homo sapiens
gtcaaaggcattagggttgttctgaaaata

SEQ ID NO: 31335 - DNA, 30 bp, Homo sapiens
ctgtttcccgttgccattgatggggaggtt

SEQ ID NO: 31336 - DNA, 30 bp, Homo sapiens
caggggatcctggcgattcgaagcagcata

SEQ ID NO: 31337 - DNA, 30 bp, Homo sapiens
gctcagtgggtgtatctggctgccggcagg

SEQ ID NO: 31338 - DNA, 30 bp, Homo sapiens
gagtgaccgtaagatcccggtcgtccttcc

SEQ ID NO: 31339 - DNA, 30 bp, Homo sapiens
ataagggggaaatctccttgtcatcgttgg

SEQ ID NO: 31340 - DNA, 30 bp, Homo sapiens
gtgaggccagacaatgtgtagcagtctttg

SEQ ID NO: 31341 - DNA, 30 bp, Homo sapiens
cctaggttctgttgtaagcagagacctgaa

SEQ ID NO: 31342 - DNA, 30 bp, Homo sapiens
ttctggagcctttttgaaagctgttcaggt

SEQ ID NO: 31343 - DNA, 30 bp, Homo sapiens
tgcatctccaatggctttggaaaatatata

SEQ ID NO: 31344 - DNA, 30 bp, Homo sapiens
caggctacaattttcactttatccacttta

SEQ ID NO: 31345 - DNA, 30 bp, Homo sapiens
ctgtggtagtttgtccactggggtgtcaaa

SEQ ID NO: 31346 - DNA, 30 bp, Homo sapiens
aagaggtcctcaaacatgcgttgtcccatt

SEQ ID NO: 31347 - DNA, 30 bp, Homo sapiens
tgctggaagtaatgtcagagtaatccttca

SEQ ID NO: 31348 - DNA, 30 bp, Homo sapiens
tccacagaaaactgacagctcttatcattg

SEQ ID NO: 31349 - DNA, 30 bp, Homo sapiens
tccttgagggagaagtgcattttgtcgttg

SEQ ID NO: 31350 - DNA, 30 bp, Homo sapiens
tagtgtctgtactctggcttcagctcccat

SEQ ID NO: 31351 - DNA, 30 bp, Homo sapiens
cacgttttcttcatcagacgccgtgactgc

SEQ ID NO: 31352 - DNA, 30 bp, Homo sapiens
tgaaggagctggaatcttatgaatacagcc

SEQ ID NO: 31353 - DNA, 30 bp, Homo sapiens
gcagacactttcagtttctttttcttggct

SEQ ID NO: 31354 - DNA, 30 bp, Homo sapiens
ccaaaagcgcttgacgtcgctgtgcccggc

SEQ ID NO: 31355 - DNA, 30 bp, Homo sapiens
ctttatgagaggaatgcgcaggggaactgt

SEQ ID NO: 31356 - DNA, 30 bp, Homo sapiens
cttctgctggtacttccatttctgtgcctt

SEQ ID NO: 31357 - DNA, 30 bp, Homo sapiens
acgtggggtctggttcttgcttgatctgag

SEQ ID NO: 31358 - DNA, 30 bp, Homo sapiens
aagaggtcccgggagctgcacgttcaggcc

SEQ ID NO: 31359 - DNA, 30 bp, Homo sapiens
atccttttgagattgggaatacaaaggata

SEQ ID NO: 31360 - DNA, 30 bp, Homo sapiens
cgttgcgatgtggagtacagaatcccactg

SEQ ID NO: 31361 - DNA, 30 bp, Homo sapiens
ccaagggtaagtactgcaactgtcgagagc

SEQ ID NO: 31362 - DNA, 30 bp, Homo sapiens
tagaggtggatccacttgttccagttgacc

SEQ ID NO: 31363 - DNA, 30 bp, Homo sapiens
gagtgggcagaaggcgatggctggttggag

SEQ ID NO: 31364 - DNA, 30 bp, Homo sapiens
acttcactgtgatatctattggcacgccat

SEQ ID NO: 31365 - DNA, 30 bp, Homo sapiens
ttccggtattcccactgctctgatagatga

SEQ ID NO: 31366 - DNA, 30 bp, Homo sapiens
gaaagggcaggggctttgcagtaacctctt

SEQ ID NO: 31367 - DNA, 30 bp, Homo sapiens
cacacgtagtccagaatctctgtctccatt

SEQ ID NO: 31368 - DNA, 30 bp, Homo sapiens
gtctcagaaggtatatcaataagaggacca

SEQ ID NO: 31369 - DNA, 30 bp, Homo sapiens
cgctggcaggagtcacacaggccccctggg

SEQ ID NO: 31370 - DNA, 30 bp, Homo sapiens
tggaagtagtaacagcatgctttgatggtg

SEQ ID NO: 31371 - DNA, 30 bp, Homo sapiens
tgttggcctgggcttctcctgctgtaatgg

SEQ ID NO: 31372 - DNA, 30 bp, Homo sapiens
acttgcccacacagaagtcctggaagatga

SEQ ID NO: 31373 - DNA, 30 bp, Homo sapiens
ctttttaccagctttcctcttcccagacag

SEQ ID NO: 31374 - DNA, 30 bp, Homo sapiens
atcctggaaagagcttccggaatttgccgt

SEQ ID NO: 31375 - DNA, 30 bp, Homo sapiens
gtcaagacttcctgttacactggctataaa

SEQ ID NO: 31376 - DNA, 30 bp, Homo sapiens
agatggtagtgatgtctttctatcctgatt

SEQ ID NO: 31377 - DNA, 30 bp, Homo sapiens
ttgaggagtggggaatccacgttctccttg

SEQ ID NO: 31378 - DNA, 30 bp, Homo sapiens
cagaacatacggcagagatttgggaactcg

SEQ ID NO: 31379 - DNA, 30 bp, Homo sapiens
tcctggtctgaggatcttctggggactggt

SEQ ID NO: 31380 - DNA, 30 bp, Homo sapiens
agccggctgcctcagcggcctcgtcagccc

SEQ ID NO: 31381 - DNA, 30 bp, Homo sapiens
aacatggcacttttccgtctctgctgagcg

SEQ ID NO: 31382 - DNA, 30 bp, Homo sapiens
ctagaccagccttgtcaggagatttggagg

SEQ ID NO: 31383 - DNA, 30 bp, Homo sapiens
tagcatccggtacaggcagcgtaggcacag

SEQ ID NO: 31384 - DNA, 30 bp, Homo sapiens
cagaggcagccggtacacgcaacgttcaca

SEQ ID NO: 31385 - DNA, 30 bp, Homo sapiens
agacaaagaggatgtcctcatctgtgccat

SEQ ID NO: 31386 - DNA, 30 bp, Homo sapiens
ctgcggtctgtggggagaccattgccatgg

SEQ ID NO: 31387 - DNA, 30 bp, Homo sapiens
cagaggcttgtctcccggaggaacatggtg

SEQ ID NO: 31388 - DNA, 30 bp, Homo sapiens
ctttcttttggaagcatggttttgagtttg

SEQ ID NO: 31389 - DNA, 30 bp, Homo sapiens
agttgttgggctgacattgatttttcgtgg

SEQ ID NO: 31390 - DNA, 30 bp, Homo sapiens
tcatggacactgggcctctgtgctccaagt

SEQ ID NO: 31391 - DNA, 30 bp, Homo sapiens
ctgtggtattcagctgcaagtattccagag

SEQ ID NO: 31392 - DNA, 30 bp, Homo sapiens
aactggcccggccgcgccttctccagcttc

SEQ ID NO: 31393 - DNA, 30 bp, Homo sapiens
ggcttgtttctcaccaactgcctttctgct

SEQ ID NO: 31394 - DNA, 30 bp, Homo sapiens
cttttttttcccttctgcttgtctcttcaa

SEQ ID NO: 31395 - DNA, 30 bp, Homo sapiens
gcgccggtcctttgagctttcttgatttcc

SEQ ID NO: 31396 - DNA, 30 bp, Homo sapiens
cccaggatgttccaaccacaggggcagcat

SEQ ID NO: 31397 - DNA, 30 bp, Homo sapiens
ttaaatgggtcaaaaggttctgctccaaac

SEQ ID NO: 31398 - DNA, 30 bp, Homo sapiens
gtctaacgggtcgagacaaaatactgtgcc

SEQ ID NO: 31399 - DNA, 30 bp, Homo sapiens
aacaggctgttttccaaacattgtgacttg

SEQ ID NO: 31400 - DNA, 30 bp, Homo sapiens
cacaggttcctgggcatggtggtgcgcgcc

SEQ ID NO: 31401 - DNA, 30 bp, Homo sapiens
ctttggtgatctggcataacgatctcttac

SEQ ID NO: 31402 - DNA, 30 bp, Homo sapiens
ggttggggccaacatggatgatgacgtgtt

SEQ ID NO: 31403 - DNA, 30 bp, Homo sapiens
aagtggatgtgttcacagaaaaatgcagtg

SEQ ID NO: 31404 - DNA, 30 bp, Homo sapiens
tggaggtaagtgtcaagtttcctcttgatg

SEQ ID NO: 31405 - DNA, 30 bp, Homo sapiens
tactgcaggaaccggtccagcttctcctgg

SEQ ID NO: 31406 - DNA, 30 bp, Homo sapiens
gtcaggtgaggggagaggttttacatcaga

SEQ ID NO: 31407 - DNA, 30 bp, Homo sapiens
ataccagccatcacacacaaaataatgagt

SEQ ID NO: 31408 - DNA, 30 bp, Homo sapiens
tggtgggggtggaggtctccattctgccat

SEQ ID NO: 31409 - DNA, 30 bp, Homo sapiens
tgttctgggaggaggaagatgatttcagcc

SEQ ID NO: 31410 - DNA, 30 bp, Homo sapiens
acaacaagcatcacctcaaaaataacacga

SEQ ID NO: 31411 - DNA, 30 bp, Homo sapiens
cccagggagctggtggggctgaggggctcg

SEQ ID NO: 31412 - DNA, 30 bp, Homo sapiens
agctttttcttcccatgaggaacgtggctc

SEQ ID NO: 31413 - DNA, 30 bp, Homo sapiens
tgatggtggtggccaggagggtgtcctggg

SEQ ID NO: 31414 - DNA, 30 bp, Homo sapiens
tgctcaaagagtgaagctgtgtgggcatcg

SEQ ID NO: 31415 - DNA, 30 bp, Homo sapiens
gaggtgtttctttgagagaagaatatagac

SEQ ID NO: 31416 - DNA, 30 bp, Homo sapiens
tcatggttttctttatccagtgtacaaagc

SEQ ID NO: 31417 - DNA, 30 bp, Homo sapiens
tagaggcgcttcattgttctctttatccag

SEQ ID NO: 31418 - DNA, 30 bp, Homo sapiens
acaaggttgcttttgatccaagtctggtat

SEQ ID NO: 31419 - DNA, 30 bp, Homo sapiens
gatcggccggtgaccttcctgatccaggac

SEQ ID NO: 31420 - DNA, 30 bp, Homo sapiens
tagtactcctgggaggcctgggtggccttc

SEQ ID NO: 31421 - DNA, 30 bp, Homo sapiens
gacagtcttctgttgtcctttcttcccaat

SEQ ID NO: 31422 - DNA, 30 bp, Homo sapiens
tcccaggaaggcgtcgtagtccatgtacca

SEQ ID NO: 31423 - DNA, 30 bp, Homo sapiens
cccaggggcttcttgcaggcagggtcctgg

SEQ ID NO: 31424 - DNA, 30 bp, Homo sapiens
aagccactttcacttttgatggtggctttg

SEQ ID NO: 31425 - DNA, 30 bp, Homo sapiens
cgcagggaaatcttccgggtcatctgggtt

SEQ ID NO: 31426 - DNA, 30 bp, Homo sapiens
ctacaatcacctctccatgaagcacctttc

SEQ ID NO: 31427 - DNA, 30 bp, Homo sapiens
gaaaggatctttcttctctggtgtatcatg

SEQ ID NO: 31428 - DNA, 30 bp, Homo sapiens
cgccgtctgcgctgtttataaaggtgacga

SEQ ID NO: 31429 - DNA, 30 bp, Homo sapiens
ccgaggatgtctcttctttctgagtataga

SEQ ID NO: 31430 - DNA, 30 bp, Homo sapiens
tgtaaccatagctgccacaatgtagtgcca

SEQ ID NO: 31431 - DNA, 30 bp, Homo sapiens
ccttccgtgtggcttgtggctcaatcatga

SEQ ID NO: 31432 - DNA, 30 bp, Homo sapiens
ccagtcttcttgccgaacttgttctctgct

SEQ ID NO: 31433 - DNA, 30 bp, Homo sapiens
cactggtagaacttcttgttagggctgtta

SEQ ID NO: 31434 - DNA, 30 bp, Homo sapiens
gcatggccctgccctccagctgcacacgca

SEQ ID NO: 31435 - DNA, 30 bp, Homo sapiens
tgtaggtaaactcctctgccagggtggatg

SEQ ID NO: 31436 - DNA, 30 bp, Homo sapiens
tcccggggcatcttgaactggtccttctcc

SEQ ID NO: 31437 - DNA, 30 bp, Homo sapiens
cggaggccccgtgtgccccacttcccagac

SEQ ID NO: 31438 - DNA, 30 bp, Homo sapiens
gtgtggggctgcactcaggagcccccactg

SEQ ID NO: 31439 - DNA, 30 bp, Homo sapiens
aacagagcgcaccaggtcatagaccttctc

SEQ ID NO: 31440 - DNA, 30 bp, Homo sapiens
taaaggtcctcagactccgggattttggtg

SEQ ID NO: 31441 - DNA, 30 bp, Homo sapiens
ctttgatcgatgacagcagccgcagcagaa

SEQ ID NO: 31442 - DNA, 30 bp, Homo sapiens
cactggtttaactccagcgcccagacttgc

SEQ ID NO: 31443 - DNA, 30 bp, Homo sapiens
cactgcttgagctccagggcccagacgtgc

SEQ ID NO: 31444 - DNA, 30 bp, Homo sapiens
tcttggaaacggccaaaggatttttcctca

SEQ ID NO: 31445 - DNA, 30 bp, Homo sapiens
gcctggaaaactggaccaagtttcgattga

SEQ ID NO: 31446 - DNA, 30 bp, Homo sapiens
catcggcacgacgatctgcagcttgtccgg

SEQ ID NO: 31447 - DNA, 30 bp, Homo sapiens
aagcgcactgcagcctcagtaggactgcag

SEQ ID NO: 31448 - DNA, 30 bp, Homo sapiens
tctcggcgtagcagtaggtcccataggctg

SEQ ID NO: 31449 - DNA, 30 bp, Homo sapiens
tgctggcggtagcagtaaacaccgtacaag

SEQ ID NO: 31450 - DNA, 30 bp, Homo sapiens
tagacgtgcagaggggtccaggcagcagga

SEQ ID NO: 31451 - DNA, 30 bp, Homo sapiens
gaatacggtcagcctctaagtccagggact

SEQ ID NO: 31452 - DNA, 30 bp, Homo sapiens
cagaggggctggcctgttctccttttgatt

SEQ ID NO: 31453 - DNA, 30 bp, Homo sapiens
ctctgctggccactgaacggatcttgatga

SEQ ID NO: 31454 - DNA, 30 bp, Homo sapiens
acctggacgcggtagcccccggtccgccgc

SEQ ID NO: 31455 - DNA, 30 bp, Homo sapiens
catattgttgtcccttcttccgcctgccac

SEQ ID NO: 31456 - DNA, 30 bp, Homo sapiens
acgtggcgttggtgaacggaccatgcttcc

SEQ ID NO: 31457 - DNA, 30 bp, Homo sapiens
cacacctcagcaaaagccaagctgtactgc

SEQ ID NO: 31458 - DNA, 30 bp, Homo sapiens
tgctggcagagcaagtcagtggcagagctg

SEQ ID NO: 31459 - DNA, 30 bp, Homo sapiens
cgccggtaatcttccactagttcctgaaaa

SEQ ID NO: 31460 - DNA, 30 bp, Homo sapiens
tgtctactcttcttgtaagttcagcttcaa

SEQ ID NO: 31461 - DNA, 30 bp, Homo sapiens
gagtatattctctgccagttcttctgtctc

SEQ ID NO: 31462 - DNA, 30 bp, Homo sapiens
aaacgggagaattgaggccatgagttcgag

SEQ ID NO: 31463 - DNA, 30 bp, Homo sapiens
gtgaggagatgatttagcttattcagttga

SEQ ID NO: 31464 - DNA, 30 bp, Homo sapiens
caacggtagaccttgctgaactcctggagg

SEQ ID NO: 31465 - DNA, 30 bp, Homo sapiens
tgcagggccccctgggcctgaacccagcgc

SEQ ID NO: 31466 - DNA, 30 bp, Homo sapiens
agacggtggttcttttgcatcaaggctctt

SEQ ID NO: 31467 - DNA, 30 bp, Homo sapiens
cagcagatctgctcgccttgctgcttcttc

SEQ ID NO: 31468 - DNA, 30 bp, Homo sapiens
ctgaacgagagagagagggcgggacttctg

SEQ ID NO: 31469 - DNA, 30 bp, Homo sapiens
ccgtggcataaagactattctcaatgtaga

SEQ ID NO: 31470 - DNA, 30 bp, Homo sapiens
atcactgacatgttggaatgccagatgaaa

SEQ ID NO: 31471 - DNA, 30 bp, Homo sapiens
caaaggttgtgagggttgctgcctgctgct

SEQ ID NO: 31472 - DNA, 30 bp, Homo sapiens
taccgggaccggaaccaacgtcccaggaat

SEQ ID NO: 31473 - DNA, 30 bp, Homo sapiens
taacggtatttggaggtcagcacggtgctc

SEQ ID NO: 31474 - DNA, 30 bp, Homo sapiens
ttgtgggccagggcattagccacaccagcc

SEQ ID NO: 31475 - DNA, 30 bp, Homo sapiens
caatggtacttgtgagccagggcattagcc

SEQ ID NO: 31476 - DNA, 30 bp, Homo sapiens
cagtggtacttatgggccagggcaatggcg

SEQ ID NO: 31477 - DNA, 30 bp, Homo sapiens
cagtgggaattagtcatgcccaacttcact

SEQ ID NO: 31478 - DNA, 30 bp, Homo sapiens
cagtggtatctggaggacagggcactggcc

SEQ ID NO: 31479 - DNA, 30 bp, Homo sapiens
cagcggtatttttcggtcagcaccacggcc

SEQ ID NO: 31480 - DNA, 30 bp, Homo sapiens
ccaacagtcaggatttaaacgtttctgttc

SEQ ID NO: 31481 - DNA, 30 bp, Homo sapiens
cagcggtactcggaaaccagcgccgagata

SEQ ID NO: 31482 - DNA, 30 bp, Homo sapiens
aagtggacttatttctttgtcctttacatc

SEQ ID NO: 31483 - DNA, 30 bp, Homo sapiens
gctattgtagaaccaccgtaacgtagcatg

SEQ ID NO: 31484 - DNA, 30 bp, Homo sapiens
cagcggtacttctcggtcaggacagaggat

SEQ ID NO: 31485 - DNA, 30 bp, Homo sapiens
aacaatgtggggatcccattgcccatcaga

SEQ ID NO: 31486 - DNA, 30 bp, Homo sapiens
gagaggttgggcccagataagaggggctcc

SEQ ID NO: 31487 - DNA, 30 bp, Homo sapiens
tgtttctccagagatgctggttcttggtga

SEQ ID NO: 31488 - DNA, 30 bp, Homo sapiens
acgaggtccaacgccaccaagcgactttca

SEQ ID NO: 31489 - DNA, 30 bp, Homo sapiens
actgaccatcggccttagatttctttggag

SEQ ID NO: 31490 - DNA, 30 bp, Homo sapiens
tgtccccagctggggttgcagggtaggggg

SEQ ID NO: 31491 - DNA, 30 bp, Homo sapiens
agccaccgaacttgtgtagctggtccatat

SEQ ID NO: 31492 - DNA, 30 bp, Homo sapiens
agaaggtgagtgtcaccatgtttagtggtt

SEQ ID NO: 31493 - DNA, 30 bp, Homo sapiens
catggctgctgttggtactggctctctgtg

SEQ ID NO: 31494 - DNA, 30 bp, Homo sapiens
gcttgacataatttgcagggaagagtccaa

SEQ ID NO: 31495 - DNA, 30 bp, Homo sapiens
gtctgggtctgtgtttaagactgaggaaga

SEQ ID NO: 31496 - DNA, 30 bp, Homo sapiens
agttggacgagaggcgcgagcgcgcggagt

SEQ ID NO: 31497 - DNA, 30 bp, Homo sapiens
agctggagaccccggggtgtggctggctca

SEQ ID NO: 31498 - DNA, 30 bp, Homo sapiens
catagattggatggcagtttggagcgcact

SEQ ID NO: 31499 - DNA, 30 bp, Homo sapiens
tcccggactgtcctccgggcgcgacggagg

SEQ ID NO: 31500 - DNA, 30 bp, Homo sapiens
ctgtggtgacgctggtgagcaccacatgct

SEQ ID NO: 31501 - DNA, 30 bp, Homo sapiens
ttgaagtggtcctgctccattggctgctgg

SEQ ID NO: 31502 - DNA, 30 bp, Homo sapiens
gcctggcatgttgatgtagactttgccatc

SEQ ID NO: 31503 - DNA, 30 bp, Homo sapiens
aggccaacttgacctcctccttgacccctt

SEQ ID NO: 31504 - DNA, 30 bp, Homo sapiens
accaggtgaggatggcactgcaacatcttc

SEQ ID NO: 31505 - DNA, 30 bp, Homo sapiens
tgcagggggaagcagcggtgtgtctgagtt

SEQ ID NO: 31506 - DNA, 30 bp, Homo sapiens
caggggttgctgagctgttctgatttggtt

SEQ ID NO: 31507 - DNA, 30 bp, Homo sapiens
cgctttccttgtcattgtcatggtctccat

SEQ ID NO: 31508 - DNA, 30 bp, Homo sapiens
tacaggggcggctcctcttccatgggctcc

SEQ ID NO: 31509 - DNA, 30 bp, Homo sapiens
cacagggcaggctcctgctccatgggctcc

SEQ ID NO: 31510 - DNA, 30 bp, Homo sapiens
gtgtgggtggggcatatcctccccaaactt

SEQ ID NO: 31511 - DNA, 30 bp, Homo sapiens
cctgtgaaccaacatcagctcttccttttc

SEQ ID NO: 31512 - DNA, 30 bp, Homo sapiens
cataggttcttcctcctccaccagctgctc

SEQ ID NO: 31513 - DNA, 30 bp, Homo sapiens
tccagaccagttaattgctactttgcacat

SEQ ID NO: 31514 - DNA, 30 bp, Homo sapiens
tacaggcctggatttggggcaggaggttcg

SEQ ID NO: 31515 - DNA, 30 bp, Homo sapiens
tgttggattcggtggggctcattgcggtct

SEQ ID NO: 31516 - DNA, 30 bp, Homo sapiens
aaagtgccacatacacacacgtctctttct

SEQ ID NO: 31517 - DNA, 30 bp, Homo sapiens
gctaaatctttgcctattacctgttgcata

SEQ ID NO: 31518 - DNA, 30 bp, Homo sapiens
ctttggtggagaatatcttctgcaagtggc

SEQ ID NO: 31519 - DNA, 30 bp, Homo sapiens
agttgggaggcagagctgggaaaggggatt

SEQ ID NO: 31520 - DNA, 30 bp, Homo sapiens
acaaggctggctcctcttccataggctcac

SEQ ID NO: 31521 - DNA, 30 bp, Homo sapiens
ccatggcctgcagagggcaacagggcagct

SEQ ID NO: 31522 - DNA, 30 bp, Homo sapiens
gtgtggctcactggcagctgcagctatgtt

SEQ ID NO: 31523 - DNA, 30 bp, Homo sapiens
gggtgcagcgattcaggtccctcagattgt

SEQ ID NO: 31524 - DNA, 30 bp, Homo sapiens
ctgcttgaacagatgctttagagcctcttc

SEQ ID NO: 31525 - DNA, 30 bp, Homo sapiens
tacaggctctcatgatctctgatgcctggg

SEQ ID NO: 31526 - DNA, 30 bp, Homo sapiens
tacaggctgtcgcgatctccgccgcccggt

SEQ ID NO: 31527 - DNA, 30 bp, Homo sapiens
tccagggcctccgagtccccccgtgccctc

SEQ ID NO: 31528 - DNA, 30 bp, Homo sapiens
actggttttctgcaagtctgaagttgtgtt

SEQ ID NO: 31529 - DNA, 30 bp, Homo sapiens
atgtggtccacagcatgagggaaactctca

SEQ ID NO: 31530 - DNA, 30 bp, Homo sapiens
agccctggagttgagccctctaggcagtca

SEQ ID NO: 31531 - DNA, 30 bp, Homo sapiens
ctccaaagcccagccctccttgcggaagac

SEQ ID NO: 31532 - DNA, 30 bp, Homo sapiens
gctctaggccccatgccatcgtctcggccc

SEQ ID NO: 31533 - DNA, 30 bp, Homo sapiens
ccaagggagggtcttgggagccacctgagc

SEQ ID NO: 31534 - DNA, 30 bp, Homo sapiens
atcaggctccagtgaggcatgattgaaatc

SEQ ID NO: 31535 - DNA, 30 bp, Homo sapiens
gagtggctctcccaggacagtttccagttg

SEQ ID NO: 31536 - DNA, 30 bp, Homo sapiens
ggaattctttcagagcagataataatttaa

SEQ ID NO: 31537 - DNA, 30 bp, Homo sapiens
tttccagagggagaagacatgatgggagaa

SEQ ID NO: 31538 - DNA, 30 bp, Homo sapiens
aattggatgcttgagttttttccaggactc

SEQ ID NO: 31539 - DNA, 30 bp, Homo sapiens
gtatggcgggggctggttgtctggcagccg

SEQ ID NO: 31540 - DNA, 30 bp, Homo sapiens
ccctgggagtgccccttgtgatccagatga

SEQ ID NO: 31541 - DNA, 30 bp, Homo sapiens
acccggagctgtttcttgatccttggctgc

SEQ ID NO: 31542 - DNA, 30 bp, Homo sapiens
ctcattgcgccgtccgtagggcttcatggg

SEQ ID NO: 31543 - DNA, 30 bp, Homo sapiens
ccaggctccacgtagcttgtcactggagct

SEQ ID NO: 31544 - DNA, 30 bp, Homo sapiens
tggtgggttcatttttttgaatcaaccaca

SEQ ID NO: 31545 - DNA, 30 bp, Homo sapiens
tgaaggaggaaaatggcttcacgaagtggt

SEQ ID NO: 31546 - DNA, 30 bp, Homo sapiens
tccattgtagcagctagcaggcgctctctc

SEQ ID NO: 31547 - DNA, 30 bp, Homo sapiens
tgctcttgtaggggggaaggcaaagttgat

SEQ ID NO: 31548 - DNA, 30 bp, Homo sapiens
gtcttcaatggtgttaaatgaggcagtggc

SEQ ID NO: 31549 - DNA, 30 bp, Homo sapiens
tcctcccaagggctcatgtcagtgtcgatg

SEQ ID NO: 31550 - DNA, 30 bp, Homo sapiens
agccactgagggggtcttcacggtagtgaa

SEQ ID NO: 31551 - DNA, 30 bp, Homo sapiens
tcaagtccaaaggtgctggtttcctctact

SEQ ID NO: 31552 - DNA, 30 bp, Homo sapiens
cactcaagtccaaaagtactggtttcttca

SEQ ID NO: 31553 - DNA, 30 bp, Homo sapiens
gacgggttatactgtccggggaaaatgcaa

SEQ ID NO: 31554 - DNA, 30 bp, Homo sapiens
gcctgggaattaaattattcagtctcaaat

SEQ ID NO: 31555 - DNA, 30 bp, Homo sapiens
tctctttaattggtcctgaagcattcattt

SEQ ID NO: 31556 - DNA, 30 bp, Homo sapiens
aattgggcataaaggtctctcactttgctg

SEQ ID NO: 31557 - DNA, 30 bp, Homo sapiens
cagtggaagaagccacagcaccagggaaat

SEQ ID NO: 31558 - DNA, 30 bp, Homo sapiens
caccggggggtgctggggcgtgtgcaggtt

SEQ ID NO: 31559 - DNA, 30 bp, Homo sapiens
ctgccagatgagctccctaggctcagttcc

SEQ ID NO: 31560 - DNA, 30 bp, Homo sapiens
ggaaggcatagttggcctcctgcagacgcg

SEQ ID NO: 31561 - DNA, 30 bp, Homo sapiens
tgctggtattcctggctcttctttgggttt

SEQ ID NO: 31562 - DNA, 30 bp, Homo sapiens
tatggcccagacctccggatatgcaggaac

SEQ ID NO: 31563 - DNA, 30 bp, Homo sapiens
ctgcagaaccatcactgctcagaggaattg

SEQ ID NO: 31564 - DNA, 30 bp, Homo sapiens
caccgggccggcctcgtcttgctcgcggat

SEQ ID NO: 31565 - DNA, 30 bp, Homo sapiens
tgctgggcagggatgtgctgaataacttca

SEQ ID NO: 31566 - DNA, 30 bp, Homo sapiens
tccaggatggacctcctattgcgtcgtagc

SEQ ID NO: 31567 - DNA, 30 bp, Homo sapiens
ccgtggggagagcacaggactggacttgct

SEQ ID NO: 31568 - DNA, 30 bp, Homo sapiens
tgtagccaggacatgcccatgccaccgcct

SEQ ID NO: 31569 - DNA, 30 bp, Homo sapiens
tgtcggagccctcggcgttgtccacgtttc

SEQ ID NO: 31570 - DNA, 30 bp, Homo sapiens
caaaggagtcgacatcctcgttatctgaat

SEQ ID NO: 31571 - DNA, 30 bp, Homo sapiens
acaatcattcttaccagctcgggctgaaag

SEQ ID NO: 31572 - DNA, 30 bp, Homo sapiens
gccaaactaaacccttcatagttgtcaagg

SEQ ID NO: 31573 - DNA, 30 bp, Homo sapiens
cacctcctgtggactggatgactagtttca

SEQ ID NO: 31574 - DNA, 30 bp, Homo sapiens
cactccggcctgggaaacaagagcgaaact

SEQ ID NO: 31575 - DNA, 30 bp, Homo sapiens
cctctgttgttgttgatggcttcttgaagc

SEQ ID NO: 31576 - DNA, 30 bp, Homo sapiens
gcatgggtgagacaaatcctctgttgttgt

SEQ ID NO: 31577 - DNA, 30 bp, Homo sapiens
gtttgcgatggctggggggccttctggaag

SEQ ID NO: 31578 - DNA, 30 bp, Homo sapiens
gtcaggaggaggaccatcatttgggaagtt

SEQ ID NO: 31579 - DNA, 30 bp, Homo sapiens
aattggcaacctggggaggcccctctggta

SEQ ID NO: 31580 - DNA, 30 bp, Homo sapiens
cagttccgccacggcctccacatggagtcc

SEQ ID NO: 31581 - DNA, 30 bp, Homo sapiens
ccacggccgccagaggccagggccgcaggg

SEQ ID NO: 31582 - DNA, 30 bp, Homo sapiens
gttcaggtcatccccggggcttccccaggg

SEQ ID NO: 31583 - DNA, 30 bp, Homo sapiens
cgcagccacggcctccagggcccacccggg

SEQ ID NO: 31584 - DNA, 30 bp, Homo sapiens
caccagggccgccagaggccgcaggcgggc

SEQ ID NO: 31585 - DNA, 30 bp, Homo sapiens
ccaaggcctccagacactccgggcaatttg

SEQ ID NO: 31586 - DNA, 30 bp, Homo sapiens
ccaaggtctccagaaagcgggcggcggggg

SEQ ID NO: 31587 - DNA, 30 bp, Homo sapiens
cagttttgcacgccgattttgaaaccaaat

SEQ ID NO: 31588 - DNA, 30 bp, Homo sapiens
cacagaagcctacattgaggggttgggcct

SEQ ID NO: 31589 - DNA, 30 bp, Homo sapiens
taaagaggttgtgcagctattccacgttcg

SEQ ID NO: 31590 - DNA, 30 bp, Homo sapiens
aagcgggtctccctgtgctgcttccttctg

SEQ ID NO: 31591 - DNA, 30 bp, Homo sapiens
caggggtcctgagcaacgtccctgccaggg

SEQ ID NO: 31592 - DNA, 30 bp, Homo sapiens
acttggaaagcggcgctcgctcctgctgcc

SEQ ID NO: 31593 - DNA, 30 bp, Homo sapiens
ggtacccggctcctcatcacagcggcagcc

SEQ ID NO: 31594 - DNA, 30 bp, Homo sapiens
tccgtcccccaaggtctatagggcttgcca

SEQ ID NO: 31595 - DNA, 30 bp, Homo sapiens
tctgtcccccagggtcggtaaggtttattg

SEQ ID NO: 31596 - DNA, 30 bp, Homo sapiens
tttcagtgatttcagagacccaggagtggt

SEQ ID NO: 31597 - DNA, 30 bp, Homo sapiens
ccatggctcctcttgaaccctgcctcttcc

SEQ ID NO: 31598 - DNA, 30 bp, Homo sapiens
aataggaaatgaaatgacataggtgtatgt

SEQ ID NO: 31599 - DNA, 30 bp, Homo sapiens
aacaagatgacgacaaaaacagcaattcca

SEQ ID NO: 31600 - DNA, 30 bp, Homo sapiens
actgaatgcaaagccacagaacaaagagcc

SEQ ID NO: 31601 - DNA, 30 bp, Homo sapiens
atcaggatgatacatactgaaatcaacttc

SEQ ID NO: 31602 - DNA, 30 bp, Homo sapiens
gcagtgtgtgtgtggggagcaggaggcagt

SEQ ID NO: 31603 - DNA, 30 bp, Homo sapiens
attaggttctgctgggttcctggagttggg

SEQ ID NO: 31604 - DNA, 30 bp, Homo sapiens
ctgtggtaccttatatgttaaaataatttt

SEQ ID NO: 31605 - DNA, 30 bp, Homo sapiens
gaacactgaggaatgtcacagacttcgtag

SEQ ID NO: 31606 - DNA, 30 bp, Homo sapiens
cagcgggtgtgagggtcaagagtatagcac

SEQ ID NO: 31607 - DNA, 30 bp, Homo sapiens
aggagggagccacaagccgcctgggaggcc

SEQ ID NO: 31608 - DNA, 30 bp, Homo sapiens
aggtgggtgtggccctctccacccatggct

SEQ ID NO: 31609 - DNA, 30 bp, Homo sapiens
agctgggcctcgctgccctgtgccggcggc

SEQ ID NO: 31610 - DNA, 30 bp, Homo sapiens
cagagggcagtggcgacgatgttctgagtc

SEQ ID NO: 31611 - DNA, 30 bp, Homo sapiens
ccgtggcgtaggtctgggcccaggcaatgc

SEQ ID NO: 31612 - DNA, 30 bp, Homo sapiens
tactccggcttctctttgtcctgcttctgc

SEQ ID NO: 31613 - DNA, 30 bp, Homo sapiens
atgtccacttcctgatcagaatcctctgaa

SEQ ID NO: 31614 - DNA, 30 bp, Homo sapiens
agtaagatgtcatgtcaatgatctgatcaa

SEQ ID NO: 31615 - DNA, 30 bp, Homo sapiens
ctgtaaaatgaacggctgagacgtcaatga

SEQ ID NO: 31616 - DNA, 30 bp, Homo sapiens
tacaggtcggggttctggtggctgcacacg

SEQ ID NO: 31617 - DNA, 30 bp, Homo sapiens
caagggagacttctgccagctcgcttctgc

SEQ ID NO: 31618 - DNA, 30 bp, Homo sapiens
acagacttgcagatattctcaaggcacttt

SEQ ID NO: 31619 - DNA, 30 bp, Homo sapiens
cttttcctgaaagaggcacattttcttcgc

SEQ ID NO: 31620 - DNA, 30 bp, Homo sapiens
atgctctcttggggtctggatagggacccc

SEQ ID NO: 31621 - DNA, 30 bp, Homo sapiens
gcttgggctcagaggtctgacacacatcac

SEQ ID NO: 31622 - DNA, 30 bp, Homo sapiens
agaaggtctcctcctctcgtaggaactgga

SEQ ID NO: 31623 - DNA, 30 bp, Homo sapiens
ttttggactctggtctttatcaattaaaac

SEQ ID NO: 31624 - DNA, 30 bp, Homo sapiens
catgagttgccttagtgtgatctttagaga

SEQ ID NO: 31625 - DNA, 30 bp, Homo sapiens
aggtgggagagaaacggtcgatggtccggc

SEQ ID NO: 31626 - DNA, 30 bp, Homo sapiens
aggagggggaggtgtgcatgcgcaggtggc

SEQ ID NO: 31627 - DNA, 30 bp, Homo sapiens
acccgctgtatctcaaacagcttcacgtcg

SEQ ID NO: 31628 - DNA, 30 bp, Homo sapiens
gcttgaaaaagtgaaccatcatgttccatt

SEQ ID NO: 31629 - DNA, 30 bp, Homo sapiens
ctctgagtaattcttcaccctgcagtaggt

SEQ ID NO: 31630 - DNA, 30 bp, Homo sapiens
tatcggcccttgatcattgtgttcaacaag

SEQ ID NO: 31631 - DNA, 30 bp, Homo sapiens
cagtcagcctgggctgagcctgcccttggc

SEQ ID NO: 31632 - DNA, 30 bp, Homo sapiens
tgggtgacaaagtgaaaacccaggggctca

SEQ ID NO: 31633 - DNA, 30 bp, Homo sapiens
cttaggttttgcccagaattcccgatacat

SEQ ID NO: 31634 - DNA, 30 bp, Homo sapiens
tctctccagcatcctgtgccatcctcttga

SEQ ID NO: 31635 - DNA, 30 bp, Homo sapiens
tcgtggtctaatgtaatccttatacataga

SEQ ID NO: 31636 - DNA, 30 bp, Homo sapiens
ccagcaagatggctgcgaccgtgaaaccct

SEQ ID NO: 31637 - DNA, 30 bp, Homo sapiens
gggtggagacttcatagcggtggcagctag

SEQ ID NO: 31638 - DNA, 30 bp, Homo sapiens
gagagggttctgtgctagtcgtctttgaaa

SEQ ID NO: 31639 - DNA, 30 bp, Homo sapiens
acacctgtgcattaaacaggctttttcttt

SEQ ID NO: 31640 - DNA, 30 bp, Homo sapiens
aaccatctggatctctggctcctcagctat

SEQ ID NO: 31641 - DNA, 30 bp, Homo sapiens
gcagccgcatatagccatcttcatgttcct

SEQ ID NO: 31642 - DNA, 30 bp, Homo sapiens
accaggaggccaatgcatttgccgacctcc

SEQ ID NO: 31643 - DNA, 30 bp, Homo sapiens
acctggaggccactggagctgccggccccc

SEQ ID NO: 31644 - DNA, 30 bp, Homo sapiens
tggataagaagccaagctgatccactggtg

SEQ ID NO: 31645 - DNA, 30 bp, Homo sapiens
cttgcagtgtaggtggagatgcctctgttc

SEQ ID NO: 31646 - DNA, 30 bp, Homo sapiens
agttcacgagttgagctgggtagatgccat

SEQ ID NO: 31647 - DNA, 30 bp, Homo sapiens
cagtggtgctgctgcatctggggaggccat

SEQ ID NO: 31648 - DNA, 30 bp, Homo sapiens
agtaggaatactggctgatcttggtaggac

SEQ ID NO: 31649 - DNA, 30 bp, Homo sapiens
agaagcagggttctccagaaagtaacaaca

SEQ ID NO: 31650 - DNA, 30 bp, Homo sapiens
gtaagggtactggttgaccttggcggggct

SEQ ID NO: 31651 - DNA, 30 bp, Homo sapiens
tgttggactcagtggaaatccagtatatgc

SEQ ID NO: 31652 - DNA, 30 bp, Homo sapiens
cagtggtgcccggtgacatgctggaggaag

SEQ ID NO: 31653 - DNA, 30 bp, Homo sapiens
ctcaggatgtcgagctgttcctgacactcg

SEQ ID NO: 31654 - DNA, 30 bp, Homo sapiens
ctgctgatgatgccacgcatatgtgaccag

SEQ ID NO: 31655 - DNA, 30 bp, Homo sapiens
tcttcttgggcgccgccttcttaggcttga

SEQ ID NO: 31656 - DNA, 30 bp, Homo sapiens
tctttggcttggctgccttgggcttggcgg

SEQ ID NO: 31657 - DNA, 30 bp, Homo sapiens
cttgcccttagctttgtggtggctctcagt

SEQ ID NO: 31658 - DNA, 30 bp, Homo sapiens
acttggaactggtgtacttggtgacggcct

SEQ ID NO: 31659 - DNA, 30 bp, Homo sapiens
ctccgcgaatgcggcgagcgagctggatgt

SEQ ID NO: 31660 - DNA, 30 bp, Homo sapiens
cgccgcggatacgacgtgcgagctggatgt

SEQ ID NO: 31661 - DNA, 30 bp, Homo sapiens
aagccatacagagtgcgcccctgacgtttt

SEQ ID NO: 31662 - DNA, 30 bp, Homo sapiens
aagccataaagagtgcgtccctggcgcttg

SEQ ID NO: 31663 - DNA, 30 bp, Homo sapiens
ccaccgaagccgtaaagagtgcgtccctgt

SEQ ID NO: 31664 - DNA, 30 bp, Homo sapiens
aaaccgtagagggtgcggccctggcgcttg

SEQ ID NO: 31665 - DNA, 30 bp, Homo sapiens
ttgccctttgccttgtggtgactctccgtc

SEQ ID NO: 31666 - DNA, 30 bp, Homo sapiens
ctccacggatgcggcgggccagctggatgt

SEQ ID NO: 31667 - DNA, 30 bp, Homo sapiens
ctccgaagccgtacagggtgcgcccctggc

SEQ ID NO: 31668 - DNA, 30 bp, Homo sapiens
ttgcccttggccttgtggtggctctccgtc

SEQ ID NO: 31669 - DNA, 30 bp, Homo sapiens
acttggagctggtgtacttggtgacagcct

SEQ ID NO: 31670 - DNA, 30 bp, Homo sapiens
ggttgctatcacaagcctgtcctcgtcatc

SEQ ID NO: 31671 - DNA, 30 bp, Homo sapiens
tgaaggatctttgctttcctctgtgcttga

SEQ ID NO: 31672 - DNA, 30 bp, Homo sapiens
cgttggggggaaccctgtcctcaggctgat

SEQ ID NO: 31673 - DNA, 30 bp, Homo sapiens
tgtaagacgtgttctctcctctctcttctg

SEQ ID NO: 31674 - DNA, 30 bp, Homo sapiens
tgcgtaaccgcacgcccacggccgtgatga

SEQ ID NO: 31675 - DNA, 30 bp, Homo sapiens
tcacggatgcggcaggccacagcagtgatg

SEQ ID NO: 31676 - DNA, 30 bp, Homo sapiens
acacgagtcaactgcgcaaggcggcaggca

SEQ ID NO: 31677 - DNA, 30 bp, Homo sapiens
tctccttctgtgcctgctgtaacctcttgg

SEQ ID NO: 31678 - DNA, 30 bp, Homo sapiens
tgtgtcctctgatgtctgataaggttggac

SEQ ID NO: 31679 - DNA, 30 bp, Homo sapiens
gcctggcaacagagcaaggctccatctgga

SEQ ID NO: 31680 - DNA, 30 bp, Homo sapiens
ccctgggcactgttgctgcacgcagcctga

SEQ ID NO: 31681 - DNA, 30 bp, Homo sapiens
caaggcttccggaagtagatgatgagaaca

SEQ ID NO: 31682 - DNA, 30 bp, Homo sapiens
gaataattggacccaggaagaggagtgtaa

SEQ ID NO: 31683 - DNA, 30 bp, Homo sapiens
gacactggacacatatgtgcccatgatgat

SEQ ID NO: 31684 - DNA, 30 bp, Homo sapiens
catgactgagggagcagaacagctcttgag

SEQ ID NO: 31685 - DNA, 30 bp, Homo sapiens
ccctgggcccgggggtcatggccagaacgc

SEQ ID NO: 31686 - DNA, 30 bp, Homo sapiens
tatgcagatcctcgttgaactttcttgctc

SEQ ID NO: 31687 - DNA, 30 bp, Homo sapiens
caatggcccttggtgtctggaagcaccaac

SEQ ID NO: 31688 - DNA, 30 bp, Homo sapiens
ccttggtgtctggaagcaccaactgaacgc

SEQ ID NO: 31689 - DNA, 30 bp, Homo sapiens
tgactcctttgacggatgataaggcccagc

SEQ ID NO: 31690 - DNA, 30 bp, Homo sapiens
ggtggaggcccttgaggtcctttctgactc

SEQ ID NO: 31691 - DNA, 30 bp, Homo sapiens
ccgaggaagatcagccccagcacgaagcct

SEQ ID NO: 31692 - DNA, 30 bp, Homo sapiens
tgcaggagtcctgctggtggaggccctcga

SEQ ID NO: 31693 - DNA, 30 bp, Homo sapiens
cagaggccccctgcgttctgctgcattgct

SEQ ID NO: 31694 - DNA, 30 bp, Homo sapiens
tgattcctgaagtagatgaacagcccggcc

SEQ ID NO: 31695 - DNA, 30 bp, Homo sapiens
ctcaggaatcctgttggctgaagtccagag

SEQ ID NO: 31696 - DNA, 30 bp, Homo sapiens
ggctgaagtccagagtgtcctttctgattc

SEQ ID NO: 31697 - DNA, 30 bp, Homo sapiens
gggtgaagtccagagtgccctttctgattc

SEQ ID NO: 31698 - DNA, 30 bp, Homo sapiens
ccctgggcactgtcgctccactcagcctta

SEQ ID NO: 31699 - DNA, 30 bp, Homo sapiens
agtagctccctctgtttctatctgagctct

SEQ ID NO: 31700 - DNA, 30 bp, Homo sapiens
tcataagatggtgccaagaacgaagaagga

SEQ ID NO: 31701 - DNA, 30 bp, Homo sapiens
cacagcagcgaccgcagctccagtgactac

SEQ ID NO: 31702 - DNA, 30 bp, Homo sapiens
gtttggggaggatgaggtttctcagcatgt

SEQ ID NO: 31703 - DNA, 30 bp, Homo sapiens
tacaggggcccgtgcctggcctcatacttg

SEQ ID NO: 31704 - DNA, 30 bp, Homo sapiens
atttggttttttagttccaaaggctcctgc

SEQ ID NO: 31705 - DNA, 30 bp, Homo sapiens
gcgccttgggctggctcggggcttttggga

SEQ ID NO: 31706 - DNA, 30 bp, Homo sapiens
acatggcgctgggattctgcgggcgccggc

SEQ ID NO: 31707 - DNA, 30 bp, Homo sapiens
ccctgtactggttcccgagaaagctgcttc

SEQ ID NO: 31708 - DNA, 30 bp, Homo sapiens
ccttcgatgctgatgcctctgttccctctt

SEQ ID NO: 31709 - DNA, 30 bp, Homo sapiens
ctttggaaagggtaagtccctgctcagagt

SEQ ID NO: 31710 - DNA, 30 bp, Homo sapiens
ctcttcttctaccttctctgcttctctgcc

SEQ ID NO: 31711 - DNA, 30 bp, Homo sapiens
cagtcatcatccagggcctctgtcttgatt

SEQ ID NO: 31712 - DNA, 30 bp, Homo sapiens
taatgggcatcgttaagctgccgtgcaaca

SEQ ID NO: 31713 - DNA, 30 bp, Homo sapiens
cactggctgtaaggacgcttggccacaggt

SEQ ID NO: 31714 - DNA, 30 bp, Homo sapiens
gtatggataggcggacacagctatataaac

SEQ ID NO: 31715 - DNA, 30 bp, Homo sapiens
tagtaggggtagggggacacggcgatgagc

SEQ ID NO: 31716 - DNA, 30 bp, Homo sapiens
cgatcgagtctgttcacaacttctcgaact

SEQ ID NO: 31717 - DNA, 30 bp, Homo sapiens
cacaggtgctcgctggcgacctgggccagg

SEQ ID NO: 31718 - DNA, 30 bp, Homo sapiens
ccgaggactcctgcgagatgccctcctctt

SEQ ID NO: 31719 - DNA, 30 bp, Homo sapiens
tcctaggtctgcctcttggccgtttttctc

SEQ ID NO: 31720 - DNA, 30 bp, Homo sapiens
ttttggtactgtttcccagagatgttttct

SEQ ID NO: 31721 - DNA, 30 bp, Homo sapiens
gggtggtccttcccaggcaaggcaacattg

SEQ ID NO: 31722 - DNA, 30 bp, Homo sapiens
agtcctcttcggcagactcttgtgaggatg

SEQ ID NO: 31723 - DNA, 30 bp, Homo sapiens
cctcctcatcctcttcatcttcctcatctt

SEQ ID NO: 31724 - DNA, 30 bp, Homo sapiens
cctcctcatcttcatcttcttcttcctcct

SEQ ID NO: 31725 - DNA, 30 bp, Homo sapiens
cctcttcttcatcttcctcttccacctttt

SEQ ID NO: 31726 - DNA, 30 bp, Homo sapiens
gctctgcctgactcttttccctctgcaccg

SEQ ID NO: 31727 - DNA, 30 bp, Homo sapiens
tacaggtagcctgagccactttggagctag

SEQ ID NO: 31728 - DNA, 30 bp, Homo sapiens
tgaaggaggcttgtgctactttagagtttg

SEQ ID NO: 31729 - DNA, 30 bp, Homo sapiens
tcttggtgcaagctccttggaggtcttgta

SEQ ID NO: 31730 - DNA, 30 bp, Homo sapiens
tactaatgacagctgcttcaggttctgctg

SEQ ID NO: 31731 - DNA, 30 bp, Homo sapiens
gacgggacgccgggcatactttcggcgatg

SEQ ID NO: 31732 - DNA, 30 bp, Homo sapiens
atctgtggaatgttaagctgacacccgaga

SEQ ID NO: 31733 - DNA, 30 bp, Homo sapiens
tcgcggatcttctctgtggttcgtccttca

SEQ ID NO: 31734 - DNA, 30 bp, Homo sapiens
tactgacagtgtgctgggtggggtgcctct

SEQ ID NO: 31735 - DNA, 30 bp, Homo sapiens
cagtgggaggtatttatggaaagtacctct

SEQ ID NO: 31736 - DNA, 30 bp, Homo sapiens
tttccagcttcctgcttttcctccttcttc

SEQ ID NO: 31737 - DNA, 30 bp, Homo sapiens
ttatctacagattcagttttctgtgctgtt

SEQ ID NO: 31738 - DNA, 30 bp, Homo sapiens
agttggctaagaatagccaagacactccaa

SEQ ID NO: 31739 - DNA, 30 bp, Homo sapiens
ttccttcttcctcttcttttaaatcttctt

SEQ ID NO: 31740 - DNA, 30 bp, Homo sapiens
ctgcggccacctcctcttcctcaccctcct

SEQ ID NO: 31741 - DNA, 30 bp, Homo sapiens
tcccggcatgatgtaagcaatgttgtctaa

SEQ ID NO: 31742 - DNA, 30 bp, Homo sapiens
ccgacttccaaacatgcagagaacctcttt

SEQ ID NO: 31743 - DNA, 30 bp, Homo sapiens
ttcttgacactccataggagctcggtaaca

SEQ ID NO: 31744 - DNA, 30 bp, Homo sapiens
acatggcataaagccctacagcaactgtcg

SEQ ID NO: 31745 - DNA, 30 bp, Homo sapiens
accaggccaagagtccagcagctagggcca

SEQ ID NO: 31746 - DNA, 30 bp, Homo sapiens
gttttatcagcaacccaggagtttacacgt

SEQ ID NO: 31747 - DNA, 30 bp, Homo sapiens
actcgggggtccaggctgacaaaggctcca

SEQ ID NO: 31748 - DNA, 30 bp, Homo sapiens
accaggccaggcatctgcgcccgcagaaag

SEQ ID NO: 31749 - DNA, 30 bp, Homo sapiens
agtagtcgagcttgttgtataggttgtaga

SEQ ID NO: 31750 - DNA, 30 bp, Homo sapiens
gtagcagcggcacggaagagaccaccgggt

SEQ ID NO: 31751 - DNA, 30 bp, Homo sapiens
tactgggaggaagaggccatctgggtggag

SEQ ID NO: 31752 - DNA, 30 bp, Homo sapiens
accaggcttgtagaggacactgtttacttg

SEQ ID NO: 31753 - DNA, 30 bp, Homo sapiens
cactgggcttttccatgacagctgcccaga

SEQ ID NO: 31754 - DNA, 30 bp, Homo sapiens
aagcggcacagtggggaagccaaggagctg

SEQ ID NO: 31755 - DNA, 30 bp, Homo sapiens
gcttggtgatggtcggctgggggatggcag

SEQ ID NO: 31756 - DNA, 30 bp, Homo sapiens
tgctggtgtgaaatgactgatgcttggttt

SEQ ID NO: 31757 - DNA, 30 bp, Homo sapiens
atgcctggcagcttcttgtccatgaattcc

SEQ ID NO: 31758 - DNA, 30 bp, Homo sapiens
tcactatgaaactcagagtattattaaaaa

SEQ ID NO: 31759 - DNA, 30 bp, Homo sapiens
tgaaggaaactaggaatgagggaaatgcag

SEQ ID NO: 31760 - DNA, 30 bp, Homo sapiens
tagccacccccaccgccatagccgcctctg

SEQ ID NO: 31761 - DNA, 30 bp, Homo sapiens
ctactgctgctgctggaaccgccatagcca

SEQ ID NO: 31762 - DNA, 30 bp, Homo sapiens
tatcggctcctcccaccataacccccactt

SEQ ID NO: 31763 - DNA, 30 bp, Homo sapiens
gctaccatatccaccacttccaccaccaga

SEQ ID NO: 31764 - DNA, 30 bp, Homo sapiens
cagtatggcttgtagttattctgatggcca

SEQ ID NO: 31765 - DNA, 30 bp, Homo sapiens
cattggcgctgtctctgtcatcctctcctt

SEQ ID NO: 31766 - DNA, 30 bp, Homo sapiens
tcctggccattggtgctgtctctgttatcc

SEQ ID NO: 31767 - DNA, 30 bp, Homo sapiens
cgcctggataccttcccataaccactctgc

SEQ ID NO: 31768 - DNA, 30 bp, Homo sapiens
gtatggctggtaattgttttggtgattgcc

SEQ ID NO: 31769 - DNA, 30 bp, Homo sapiens
atgctgttctgcccactgtagccggccccg

SEQ ID NO: 31770 - DNA, 30 bp, Homo sapiens
acttggtcgtatccactcatgctgctctgg

SEQ ID NO: 31771 - DNA, 30 bp, Homo sapiens
gcaaggtttgactgatagtcactggagttt

SEQ ID NO: 31772 - DNA, 30 bp, Homo sapiens
ccatccacctccactcatgccgccttgccc

SEQ ID NO: 31773 - DNA, 30 bp, Homo sapiens
atctggtcctgtgttcctgtaatggtaatg

SEQ ID NO: 31774 - DNA, 30 bp, Homo sapiens
acatctgcatactgcttcacactgttctgc

SEQ ID NO: 31775 - DNA, 30 bp, Homo sapiens
taggaggcgtgctgagcagtggagaaacac

SEQ ID NO: 31776 - DNA, 30 bp, Homo sapiens
gattggaaccattcggcactcttatctgat

SEQ ID NO: 31777 - DNA, 30 bp, Homo sapiens
tctcggccactcagcttcatgccattcatc

SEQ ID NO: 31778 - DNA, 30 bp, Homo sapiens
ttgcccataagtatcctgataaaattcctg

SEQ ID NO: 31779 - DNA, 30 bp, Homo sapiens
tgataatgctgactccatggcttctgaccc

SEQ ID NO: 31780 - DNA, 30 bp, Homo sapiens
tgtgtgttcccggagtagctcccgtagtcg

SEQ ID NO: 31781 - DNA, 30 bp, Homo sapiens
cccttggtacccgtagtaattcctgtagta

SEQ ID NO: 31782 - DNA, 30 bp, Homo sapiens
gagccagccgttgctggtgaaatccatgcg

SEQ ID NO: 31783 - DNA, 30 bp, Homo sapiens
ctgcattctagtagcttggccaagttatct

SEQ ID NO: 31784 - DNA, 30 bp, Homo sapiens
tgaaaatggcaatgcattctgagttggttc

SEQ ID NO: 31785 - DNA, 30 bp, Homo sapiens
ttatcggtgcccagcttggagagccctcgg

SEQ ID NO: 31786 - DNA, 30 bp, Homo sapiens
cagggcgcagcctcagccaggcgggccagg

SEQ ID NO: 31787 - DNA, 30 bp, Homo sapiens
cagtcttgtatgatcacatcatcatcatca

SEQ ID NO: 31788 - DNA, 30 bp, Homo sapiens
tgttggtgatgtgccgttgctgcgctaaga

SEQ ID NO: 31789 - DNA, 30 bp, Homo sapiens
cagtggggcgaaggttcagagatgccaggc

SEQ ID NO: 31790 - DNA, 30 bp, Homo sapiens
ctgtggccggctgcacgtggcctgggtatg

SEQ ID NO: 31791 - DNA, 30 bp, Homo sapiens
gcacggcagactatcatgggggtagccttc

SEQ ID NO: 31792 - DNA, 30 bp, Homo sapiens
tctgtgacggatctgcactctgagggcagg

SEQ ID NO: 31793 - DNA, 30 bp, Homo sapiens
tggcactgactcttgactagaagaatcaaa

SEQ ID NO: 31794 - DNA, 30 bp, Homo sapiens
cactggttcactgaccttcctcttcttcct

SEQ ID NO: 31795 - DNA, 30 bp, Homo sapiens
cagtgggcaggtggccttggggcagaggtc

SEQ ID NO: 31796 - DNA, 30 bp, Homo sapiens
cagtgggaggtagtcagagtgtctgaggta

SEQ ID NO: 31797 - DNA, 30 bp, Homo sapiens
aaaagtctgcgctggagaagatgtctccga

SEQ ID NO: 31798 - DNA, 30 bp, Homo sapiens
tcccggatccggttttctcgattcattttc

SEQ ID NO: 31799 - DNA, 30 bp, Homo sapiens
tagaggagtggatttgctgagtagtactgt

SEQ ID NO: 31800 - DNA, 30 bp, Homo sapiens
tgttctggaaccagattgtgacctgccgct

SEQ ID NO: 31801 - DNA, 30 bp, Homo sapiens
ttgtggtgagtgtgtctgtaaaaaagtcta

SEQ ID NO: 31802 - DNA, 30 bp, Homo sapiens
cacaggtgggtgagcttgggtgcttcctga

SEQ ID NO: 31803 - DNA, 30 bp, Homo sapiens
aggagggaacgggtgtggaggtgctcgggt

SEQ ID NO: 31804 - DNA, 30 bp, Homo sapiens
ggacggaaggcccctcctgccgcggccatg

SEQ ID NO: 31805 - DNA, 30 bp, Homo sapiens
tttgcctctgagtcctccccgctgggctgc

SEQ ID NO: 31806 - DNA, 30 bp, Homo sapiens
attcctcctcgtcttcctcttcttcatcat

SEQ ID NO: 31807 - DNA, 30 bp, Homo sapiens
gctcggtctttgttgattttcttcattttc

SEQ ID NO: 31808 - DNA, 30 bp, Homo sapiens
aggaggtgacagagctgggtgaggcttccg

SEQ ID NO: 31809 - DNA, 30 bp, Homo sapiens
taaggggtagcgctgttcttcaccttggcg

SEQ ID NO: 31810 - DNA, 30 bp, Homo sapiens
tgcaggtcgatggcacagagcgtactggtg

SEQ ID NO: 31811 - DNA, 30 bp, Homo sapiens
cacaggtgtgttaatttgggcgcttcttgg

SEQ ID NO: 31812 - DNA, 30 bp, Homo sapiens
gggagggcagatagatttttccggggccca

SEQ ID NO: 31813 - DNA, 30 bp, Homo sapiens
ggctggaaggcgctgccagctgtagccagg

SEQ ID NO: 31814 - DNA, 30 bp, Homo sapiens
actcggcctgtttttcttcctcctcctcgg

SEQ ID NO: 31815 - DNA, 30 bp, Homo sapiens
ctcttcctcttcctcctctgcttcagccct

SEQ ID NO: 31816 - DNA, 30 bp, Homo sapiens
tcttgtcgcccttctgcgcgtcgccctcgt

SEQ ID NO: 31817 - DNA, 30 bp, Homo sapiens
cgccggttctgaaaccagattttgacttgt

SEQ ID NO: 31818 - DNA, 30 bp, Homo sapiens
tcccggatccgattctctcggttcattttc

SEQ ID NO: 31819 - DNA, 30 bp, Homo sapiens
cagaggatttcccgagaaatactgcagccg

SEQ ID NO: 31820 - DNA, 30 bp, Homo sapiens
aagaaggagagagcttgctccctcaacaga

SEQ ID NO: 31821 - DNA, 30 bp, Homo sapiens
aggtggagtggagatgaggcgctttcgatt

SEQ ID NO: 31822 - DNA, 30 bp, Homo sapiens
aatgtcctctgcccgttgctgctccggcgg

SEQ ID NO: 31823 - DNA, 30 bp, Homo sapiens
aagagcctctttgcttttcattttggaatc

SEQ ID NO: 31824 - DNA, 30 bp, Homo sapiens
cactctttctgcttctcctcttctgtctct

SEQ ID NO: 31825 - DNA, 30 bp, Homo sapiens
tttcttccttttcctcctcttctttctcct

SEQ ID NO: 31826 - DNA, 30 bp, Homo sapiens
tgtcggttttctctttattcatctttttca

SEQ ID NO: 31827 - DNA, 30 bp, Homo sapiens
cgaaggctcttgggactgagaagggctgcc

SEQ ID NO: 31828 - DNA, 30 bp, Homo sapiens
aaaacgtgaggttggcggtcagttctcgga

SEQ ID NO: 31829 - DNA, 30 bp, Homo sapiens
ataaggggtttccagtgaaatactgcagac

SEQ ID NO: 31830 - DNA, 30 bp, Homo sapiens
cctgctcccgaagcaccacgcgcttcttct

SEQ ID NO: 31831 - DNA, 30 bp, Homo sapiens
caggagacagtatctttgagcttggagaca

SEQ ID NO: 31832 - DNA, 30 bp, Homo sapiens
cagatgcgtcagtttgggagcctccggcag

SEQ ID NO: 31833 - DNA, 30 bp, Homo sapiens
ataaggtcgtcaggtccgtgtggtggtctt

SEQ ID NO: 31834 - DNA, 30 bp, Homo sapiens
cttcggctctgtcttcctccagctcttggg

SEQ ID NO: 31835 - DNA, 30 bp, Homo sapiens
cagtctcctttggggcatttctccttgctc

SEQ ID NO: 31836 - DNA, 30 bp, Homo sapiens
ctatggtcttctgaacccagtcctggatgg

SEQ ID NO: 31837 - DNA, 30 bp, Homo sapiens
tcatggtggatttgcccttgcccggcaatt

SEQ ID NO: 31838 - DNA, 30 bp, Homo sapiens
agaactgggaggcgctgctggggtcgcact

SEQ ID NO: 31839 - DNA, 30 bp, Homo sapiens
gactggcactgctggggtcgcactgcagca

SEQ ID NO: 31840 - DNA, 30 bp, Homo sapiens
caatggatgggtcactcttggctgcctcct

SEQ ID NO: 31841 - DNA, 30 bp, Homo sapiens
tgccgggcaccaccccattggtctccatgt

SEQ ID NO: 31842 - DNA, 30 bp, Homo sapiens
gcttcctggctcctggcagattgctcctgt

SEQ ID NO: 31843 - DNA, 30 bp, Homo sapiens
agttggtctatgttctcttgacttctgttt

SEQ ID NO: 31844 - DNA, 30 bp, Homo sapiens
caatggtgggtccaaaattccatagtattt

SEQ ID NO: 31845 - DNA, 30 bp, Homo sapiens
gtttggtttggggccttcgttttatccagt

SEQ ID NO: 31846 - DNA, 30 bp, Homo sapiens
agagctgggtcaccatgccgctggcttcgg

SEQ ID NO: 31847 - DNA, 30 bp, Homo sapiens
acaaacttgtctggaatttcaaatccaaca

SEQ ID NO: 31848 - DNA, 30 bp, Homo sapiens
gctttcctccggtcctcacctgagctctga

SEQ ID NO: 31849 - DNA, 30 bp, Homo sapiens
agcagggggatacgggaggcctcccagagg

SEQ ID NO: 31850 - DNA, 30 bp, Homo sapiens
cttaggaggcacgggggtccactggagcct

SEQ ID NO: 31851 - DNA, 30 bp, Homo sapiens
atatggcaagaaaaatgttgcagtaccatc

SEQ ID NO: 31852 - DNA, 30 bp, Homo sapiens
tgctggttttctccttcccagtcacctcct

SEQ ID NO: 31853 - DNA, 30 bp, Homo sapiens
gcttcagcagcttctgctttgctttgccgg

SEQ ID NO: 31854 - DNA, 30 bp, Homo sapiens
aagaggtacaactgacagtcatttcataaa

SEQ ID NO: 31855 - DNA, 30 bp, Homo sapiens
aggcctgctgggaccagagaaaccgatcgc

SEQ ID NO: 31856 - DNA, 30 bp, Homo sapiens
cataggtcccgaggtggagtcgggggtgga

SEQ ID NO: 31857 - DNA, 30 bp, Homo sapiens
ctttggcatttcttatcacaaaaaaactat

SEQ ID NO: 31858 - DNA, 30 bp, Homo sapiens
gtattgacatctttgggttttggactttag

SEQ ID NO: 31859 - DNA, 30 bp, Homo sapiens
tatcggtagcggcaggccaaagcattgaca

SEQ ID NO: 31860 - DNA, 30 bp, Homo sapiens
agtgagtgcagcccaggagactggtcacat

SEQ ID NO: 31861 - DNA, 30 bp, Homo sapiens
atttggcctcctgtaatgtccccacggcca

SEQ ID NO: 31862 - DNA, 30 bp, Homo sapiens
agccggggccactctcatcaggagggttca

SEQ ID NO: 31863 - DNA, 30 bp, Homo sapiens
acatgggtcccggggggtcccagagggtcc

SEQ ID NO: 31864 - DNA, 30 bp, Homo sapiens
ggaaacaagcccaggaatgagaagacacca

SEQ ID NO: 31865 - DNA, 30 bp, Homo sapiens
ccgcttgcttctggccagcaggatccccac

SEQ ID NO: 31866 - DNA, 30 bp, Homo sapiens
cagctgaaataactgctccagcagccttcg

SEQ ID NO: 31867 - DNA, 30 bp, Homo sapiens
ggcagttattggtttgggctttatgctatc

SEQ ID NO: 31868 - DNA, 30 bp, Homo sapiens
ttccggcgtttccagcatgtctgccagggc

SEQ ID NO: 31869 - DNA, 30 bp, Homo sapiens
cgagcgtggcggggatggtggcggtggggg

SEQ ID NO: 31870 - DNA, 30 bp, Homo sapiens
cttgaacttccctggacatgattcagagac

SEQ ID NO: 31871 - DNA, 30 bp, Homo sapiens
ggagcgaatatgcagaattctcttgaatgt

SEQ ID NO: 31872 - DNA, 30 bp, Homo sapiens
ctgtggctccctggggggccgtgacttctg

SEQ ID NO: 31873 - DNA, 30 bp, Homo sapiens
atgtggtgggaattggatgaatgtttgcaa

SEQ ID NO: 31874 - DNA, 30 bp, Homo sapiens
acttccagcagtgctccagggagctgtggg

SEQ ID NO: 31875 - DNA, 30 bp, Homo sapiens
gtgttgtgatggtagaggttgcttttttat

SEQ ID NO: 31876 - DNA, 30 bp, Homo sapiens
ctctggccaacatggtaaaaccccatctcc

SEQ ID NO: 31877 - DNA, 30 bp, Homo sapiens
ctcttggacatattcatagggtgaagtgct

SEQ ID NO: 31878 - DNA, 30 bp, Homo sapiens
aagaggctgggggcggcctgggctggtgta

SEQ ID NO: 31879 - DNA, 30 bp, Homo sapiens
cttagggtaaatcttttcatagaaaaagtt

SEQ ID NO: 31880 - DNA, 30 bp, Homo sapiens
ccagcattcggagctatggccacagaagaa

SEQ ID NO: 31881 - DNA, 30 bp, Homo sapiens
aaatgttctgccaacaagctcgaagaactt

SEQ ID NO: 31882 - DNA, 30 bp, Homo sapiens
tgaagtcctgcccaacggtttcataaaatt

SEQ ID NO: 31883 - DNA, 30 bp, Homo sapiens
cagccaaagtcgtgcccggtcatctggtag

SEQ ID NO: 31884 - DNA, 30 bp, Homo sapiens
caaagtcgtgcccggtcatctggtagaact

SEQ ID NO: 31885 - DNA, 30 bp, Homo sapiens
ttatcaccctcttcctgttcccactgaaaa

SEQ ID NO: 31886 - DNA, 30 bp, Homo sapiens
caatgtcctcccagtgatctggtaaaattt

SEQ ID NO: 31887 - DNA, 30 bp, Homo sapiens
agccccagccgaagtcctggcccgtcatct

SEQ ID NO: 31888 - DNA, 30 bp, Homo sapiens
ccacttctcaatgatgtggctcatgtagtc

SEQ ID NO: 31889 - DNA, 30 bp, Homo sapiens
aacgccatttctctacactgcctatgtagt

SEQ ID NO: 31890 - DNA, 30 bp, Homo sapiens
caccacctggctgttgtagtcctcggtgac

SEQ ID NO: 31891 - DNA, 30 bp, Homo sapiens
actcttttgcgtggcaggtatcttgttttc

SEQ ID NO: 31892 - DNA, 30 bp, Homo sapiens
tgcaccattaagtccttgacattcttctgt

SEQ ID NO: 31893 - DNA, 30 bp, Homo sapiens
cttcttcaaagtcatcttgttcaaaagcac

SEQ ID NO: 31894 - DNA, 30 bp, Homo sapiens
ctcaggggggccaggagggtcttataggca

SEQ ID NO: 31895 - DNA, 30 bp, Homo sapiens
tccaggatcttcctgcatggatttctgatc

SEQ ID NO: 31896 - DNA, 30 bp, Homo sapiens
caggggtgtctctgtgagtgttctggctcc

SEQ ID NO: 31897 - DNA, 30 bp, Homo sapiens
tcatggccaaacaggtgaggccttgcaagt

SEQ ID NO: 31898 - DNA, 30 bp, Homo sapiens
ccgcggccgtgacgttgagctcctggcgga

SEQ ID NO: 31899 - DNA, 30 bp, Homo sapiens
cactgctggggaagggccggggctcaggtt

SEQ ID NO: 31900 - DNA, 30 bp, Homo sapiens
ctgcggggcggccggaggatcgccgagctc

SEQ ID NO: 31901 - DNA, 30 bp, Homo sapiens
aaggctgcatacgaatggccccatccagcc

SEQ ID NO: 31902 - DNA, 30 bp, Homo sapiens
aacgctcaggaaggatcctttccaatgttg

SEQ ID NO: 31903 - DNA, 30 bp, Homo sapiens
aggcaggtttgagattatcgagcccataag

SEQ ID NO: 31904 - DNA, 30 bp, Homo sapiens
actgcttcaaattgaatattctgcatacga

SEQ ID NO: 31905 - DNA, 30 bp, Homo sapiens
ggaagggatatcgggggcgtccacgggggt

SEQ ID NO: 31906 - DNA, 30 bp, Homo sapiens
aggtggcctttttcttgtagttaggcattc

SEQ ID NO: 31907 - DNA, 30 bp, Homo sapiens
tacctgaccttggtgttgagcttcaggtat

SEQ ID NO: 31908 - DNA, 30 bp, Homo sapiens
agagcttggcgtagtctttaagaatcatct

SEQ ID NO: 31909 - DNA, 30 bp, Homo sapiens
gcctgggctggtttgggccaagatctagtc

SEQ ID NO: 31910 - DNA, 30 bp, Homo sapiens
gcttctttaccaggataaaatggccaaaga

SEQ ID NO: 31911 - DNA, 30 bp, Homo sapiens
cttaagttccttggaggcccggaagaccga

SEQ ID NO: 31912 - DNA, 30 bp, Homo sapiens
agcctggcctgattatctgttttttgaata

SEQ ID NO: 31913 - DNA, 30 bp, Homo sapiens
acttccactgaggtccctgtgatgtatcca

SEQ ID NO: 31914 - DNA, 30 bp, Homo sapiens
tcttggacttcagggtctccttgtgccggt

SEQ ID NO: 31915 - DNA, 30 bp, Homo sapiens
agggttgcccgctgctccagctcccgggct

SEQ ID NO: 31916 - DNA, 30 bp, Homo sapiens
cactgggctgaacccgtagcggcctgtacc

SEQ ID NO: 31917 - DNA, 30 bp, Homo sapiens
tgcaggataaggcttccttacgtagtgaac

SEQ ID NO: 31918 - DNA, 30 bp, Homo sapiens
cagtctggcattcatctgattcattagctt

SEQ ID NO: 31919 - DNA, 30 bp, Homo sapiens
ggagacagtggggtccttggctttgggagg

SEQ ID NO: 31920 - DNA, 30 bp, Homo sapiens
cagaggtgcaggagcaagttcacataaata

SEQ ID NO: 31921 - DNA, 30 bp, Homo sapiens
aacaggttcttcttttgggctccattagtg

SEQ ID NO: 31922 - DNA, 30 bp, Homo sapiens
cattatgctccagagtgcggagatcttcca

SEQ ID NO: 31923 - DNA, 30 bp, Homo sapiens
tagggggagggactggcttccgggcccaag

SEQ ID NO: 31924 - DNA, 30 bp, Homo sapiens
ttggaaagcgctcctgcttgcaggccacgt

SEQ ID NO: 31925 - DNA, 30 bp, Homo sapiens
atgtgctctggtctgcgtagtctgggtacg

SEQ ID NO: 31926 - DNA, 30 bp, Homo sapiens
tactcctcctcatcgtcagagggctcattt

SEQ ID NO: 31927 - DNA, 30 bp, Homo sapiens
catcgtcagagggctcatttggagacatga

SEQ ID NO: 31928 - DNA, 30 bp, Homo sapiens
gaaaggtggctagaaaggcagatctttgaa

SEQ ID NO: 31929 - DNA, 30 bp, Homo sapiens
attagggtgatatttgtccagtggtgatgg

SEQ ID NO: 31930 - DNA, 30 bp, Homo sapiens
tgacggcttcctttcctttgattggtgaca

SEQ ID NO: 31931 - DNA, 30 bp, Homo sapiens
cccaggggcaaagggtggcggttgttggta

SEQ ID NO: 31932 - DNA, 30 bp, Homo sapiens
gtgatgtgtcgtcatctccttcaaggggtg

SEQ ID NO: 31933 - DNA, 30 bp, Homo sapiens
cgacttcttccatgcgagacgcatcctcat

SEQ ID NO: 31934 - DNA, 30 bp, Homo sapiens
ctgtttcttcttcttcatctgttcccacat

SEQ ID NO: 31935 - DNA, 30 bp, Homo sapiens
tttgacactcttcgaagtggctatatcaat

SEQ ID NO: 31936 - DNA, 30 bp, Homo sapiens
agttggaaagaaagtcgatggacgcgcgca

SEQ ID NO: 31937 - DNA, 30 bp, Homo sapiens
agttggttttttgtaaatgcttattgggaa

SEQ ID NO: 31938 - DNA, 30 bp, Homo sapiens
tcttgatctgtgcatgtcacatgtaaagat

SEQ ID NO: 31939 - DNA, 30 bp, Homo sapiens
ttttggtattcgaaatcaacctctgaagca

SEQ ID NO: 31940 - DNA, 30 bp, Homo sapiens
atctacctcctcaatggtggggcctgaccc

SEQ ID NO: 31941 - DNA, 30 bp, Homo sapiens
atccacctcctcaatggtagggcctgaccc

SEQ ID NO: 31942 - DNA, 30 bp, Homo sapiens
ctgtggcaggccttccaggcacataccctg

SEQ ID NO: 31943 - DNA, 30 bp, Homo sapiens
cttcgatggtgggtcccccggaggctcctg

SEQ ID NO: 31944 - DNA, 30 bp, Homo sapiens
caggaagcttcttgtctgaatccgaaggca

SEQ ID NO: 31945 - DNA, 30 bp, Homo sapiens
ccatctctccagaggatttagtatgctgtg

SEQ ID NO: 31946 - DNA, 30 bp, Homo sapiens
caccagttgggggagggcctgcacttccat

SEQ ID NO: 31947 - DNA, 30 bp, Homo sapiens
aatcaacctcctcaatgatggggccggtgc

SEQ ID NO: 31948 - DNA, 30 bp, Homo sapiens
caatggtgggccctgaggaagcaccaccag

SEQ ID NO: 31949 - DNA, 30 bp, Homo sapiens
tttgatcttccttttgttccccagtgccag

SEQ ID NO: 31950 - DNA, 30 bp, Homo sapiens
acttggcggcagtctcatcggattttgcag

SEQ ID NO: 31951 - DNA, 30 bp, Homo sapiens
gcagaaacgctatgcacagatgcaaaatga

SEQ ID NO: 31952 - DNA, 30 bp, Homo sapiens
ctatggctgcctcctcctcttcctctggat

SEQ ID NO: 31953 - DNA, 30 bp, Homo sapiens
aactggatcctttacttccaccaccaaaat

SEQ ID NO: 31954 - DNA, 30 bp, Homo sapiens
tacttggctgcggctggcggtggggcctgg

SEQ ID NO: 31955 - DNA, 30 bp, Homo sapiens
gtccggaaggtctgctggacgtgttctgta

SEQ ID NO: 31956 - DNA, 30 bp, Homo sapiens
tacaggtgacttcctggctgtcctggggaa

SEQ ID NO: 31957 - DNA, 30 bp, Homo sapiens
taccgggtcaggttggaagccttagagccg

SEQ ID NO: 31958 - DNA, 30 bp, Homo sapiens
atcaaaagttgtgccactatcctggttact

SEQ ID NO: 31959 - DNA, 30 bp, Homo sapiens
catgctgtcgtccgctgggctggagaaaca

SEQ ID NO: 31960 - DNA, 30 bp, Homo sapiens
cccataccacctcccattccacccattgca

SEQ ID NO: 31961 - DNA, 30 bp, Homo sapiens
tattctgggagaagaactttatctccaact

SEQ ID NO: 31962 - DNA, 30 bp, Homo sapiens
acgaggggcaggggcgtgtgttggccccgg

SEQ ID NO: 31963 - DNA, 30 bp, Homo sapiens
tgatgtggaggttcagcaccaaaattgttt

SEQ ID NO: 31964 - DNA, 30 bp, Homo sapiens
ggagttctttccagtttgggtgattcaatt

SEQ ID NO: 31965 - DNA, 30 bp, Homo sapiens
gctttccccaggtcatggatggccttgttc

SEQ ID NO: 31966 - DNA, 30 bp, Homo sapiens
aacaggcacaaagaaaaagagtgagcaaga

SEQ ID NO: 31967 - DNA, 30 bp, Homo sapiens
cagtggataggggcccttcttcaacactcc

SEQ ID NO: 31968 - DNA, 30 bp, Homo sapiens
tccccataaaatggaaattctcgatgtgaa

SEQ ID NO: 31969 - DNA, 30 bp, Homo sapiens
tgtgaatgatgcttttcatggaattttctt

SEQ ID NO: 31970 - DNA, 30 bp, Homo sapiens
cactggcggcagaacttacacttaatgatc

SEQ ID NO: 31971 - DNA, 30 bp, Homo sapiens
cattggacatggtatagattatggggttga

SEQ ID NO: 31972 - DNA, 30 bp, Homo sapiens
aggaggccttccggaaagggacaattttct

SEQ ID NO: 31973 - DNA, 30 bp, Homo sapiens
tctcggcatctaatgagctttttaaaagcc

SEQ ID NO: 31974 - DNA, 30 bp, Homo sapiens
ttttggaatgctttcttgaagtcttcatta

SEQ ID NO: 31975 - DNA, 30 bp, Homo sapiens
acacacagctcaccttttcattcactccgt

SEQ ID NO: 31976 - DNA, 30 bp, Homo sapiens
ttttcagtgaggagaagcgtatctagtaga

SEQ ID NO: 31977 - DNA, 30 bp, Homo sapiens
gctaaccacactggagggatttactggtaa

SEQ ID NO: 31978 - DNA, 30 bp, Homo sapiens
caagcgtactgccagatggaccagagcata

SEQ ID NO: 31979 - DNA, 30 bp, Homo sapiens
cacagtgcccagagggagcacagagtgatg

SEQ ID NO: 31980 - DNA, 30 bp, Homo sapiens
tgttccagaggacaatgacagtaaggatgg

SEQ ID NO: 31981 - DNA, 30 bp, Homo sapiens
taggtgttccagaggcatatgacggtgatg

SEQ ID NO: 31982 - DNA, 30 bp, Homo sapiens
tgtcactgggctgagcagccaccaaaggag

SEQ ID NO: 31983 - DNA, 30 bp, Homo sapiens
ctaaaacatgactttctccccaacagaatt

SEQ ID NO: 31984 - DNA, 30 bp, Homo sapiens
gacaggaactggtctattgcagaagagcag

SEQ ID NO: 31985 - DNA, 30 bp, Homo sapiens
taatggttgtggttgaacaagggacagtct

SEQ ID NO: 31986 - DNA, 30 bp, Homo sapiens
tccagggattctgggtcattgtgtatgggc

SEQ ID NO: 31987 - DNA, 30 bp, Homo sapiens
gtgttgcctagaaaagaagttcttgaaggc

SEQ ID NO: 31988 - DNA, 30 bp, Homo sapiens
cagttcgtggggatgccaagtggatgcggc

SEQ ID NO: 31989 - DNA, 30 bp, Homo sapiens
gtgatggtctggagattgtagcacccacac

SEQ ID NO: 31990 - DNA, 30 bp, Homo sapiens
ctctggcctctcagcaagcttcagggcttc

SEQ ID NO: 31991 - DNA, 30 bp, Homo sapiens
tatgggtcaatttcttcgggaatcactgtg

SEQ ID NO: 31992 - DNA, 30 bp, Homo sapiens
ctcaggggtcacatataaggtcagtgtttc

SEQ ID NO: 31993 - DNA, 30 bp, Homo sapiens
acatgaccacctcaggtgcgatgctgaaga

SEQ ID NO: 31994 - DNA, 30 bp, Homo sapiens
gtgagggggctttgatctgcttgtcttgga

SEQ ID NO: 31995 - DNA, 30 bp, Homo sapiens
gtcaggagcaaattatcttttccccgaaga

SEQ ID NO: 31996 - DNA, 30 bp, Homo sapiens
agcaggtggtgaccttgtggacatttcgta

SEQ ID NO: 31997 - DNA, 30 bp, Homo sapiens
tagcactgggtcttgaccccatcggccatg

SEQ ID NO: 31998 - DNA, 30 bp, Homo sapiens
cgcagggatgaaatactgaagggacacgtc

SEQ ID NO: 31999 - DNA, 30 bp, Homo sapiens
acaaggcaggaatgaaatactgaagagaga

SEQ ID NO: 32000 - DNA, 30 bp, Homo sapiens
taggccagcccaaagccttcagagcactcc

SEQ ID NO: 32001 - DNA, 30 bp, Homo sapiens
agtccatgctgtcgcaatagtttgttaagt

SEQ ID NO: 32002 - DNA, 30 bp, Homo sapiens
accacatgctcttccgctcacaccacggtg

SEQ ID NO: 32003 - DNA, 30 bp, Homo sapiens
acaaggtccaggtaaaggccagggctgcca

SEQ ID NO: 32004 - DNA, 30 bp, Homo sapiens
tttaggcccaggcctgggctcctggcaggt

SEQ ID NO: 32005 - DNA, 30 bp, Homo sapiens
accaggagaaggggaaaccccagagcagcc

SEQ ID NO: 32006 - DNA, 30 bp, Homo sapiens
taaagggtgatccccttcagataataaacc

SEQ ID NO: 32007 - DNA, 30 bp, Homo sapiens
accctgggagtagcagaatagccttcgagt

SEQ ID NO: 32008 - DNA, 30 bp, Homo sapiens
ctaaaatgtgcccccaaattgagttctgga

SEQ ID NO: 32009 - DNA, 30 bp, Homo sapiens
aagcctttgtagccttcatcttccagcagt

SEQ ID NO: 32010 - DNA, 30 bp, Homo sapiens
cactggccagcctctgggtggccccgccta

SEQ ID NO: 32011 - DNA, 30 bp, Homo sapiens
acatggagatcccagattcataggatttgg

SEQ ID NO: 32012 - DNA, 30 bp, Homo sapiens
tgaacagatgaatgacatgctcaacaatct

SEQ ID NO: 32013 - DNA, 30 bp, Homo sapiens
ggaagggaagcttcctgggtatgacaccat

SEQ ID NO: 32014 - DNA, 30 bp, Homo sapiens
caaaggccgcttctgtcctgtcgattgttc

SEQ ID NO: 32015 - DNA, 30 bp, Homo sapiens
agttggttagggcaataagcgcctctacca

SEQ ID NO: 32016 - DNA, 30 bp, Homo sapiens
tcctggatttgggcatctcatcaaacaaaa

SEQ ID NO: 32017 - DNA, 30 bp, Homo sapiens
taatggtctccatctcccagcagacttaat

SEQ ID NO: 32018 - DNA, 30 bp, Homo sapiens
taaaggggcaagtaattcagtggctctctc

SEQ ID NO: 32019 - DNA, 30 bp, Homo sapiens
tgttggtaacacagaaacatacacagtctt

SEQ ID NO: 32020 - DNA, 30 bp, Homo sapiens
acaacttctgcacatcgaggacacagtgta

SEQ ID NO: 32021 - DNA, 30 bp, Homo sapiens
acttggagactgtaggccaccagtctggca

SEQ ID NO: 32022 - DNA, 30 bp, Homo sapiens
cactggtggtggtagtaattctgaccatca

SEQ ID NO: 32023 - DNA, 30 bp, Homo sapiens
ttattccacataggtactgccagtggtccc

SEQ ID NO: 32024 - DNA, 30 bp, Homo sapiens
agcatcaggatttgagagtgggtcgaggtc

SEQ ID NO: 32025 - DNA, 30 bp, Homo sapiens
gctttaaggtgtctgggtccagctcttggg

SEQ ID NO: 32026 - DNA, 30 bp, Homo sapiens
gcatctgggtttgaaagtggatccaagtct

SEQ ID NO: 32027 - DNA, 30 bp, Homo sapiens
gggaggcgtggcttgtgtgttcggtttcat

SEQ ID NO: 32028 - DNA, 30 bp, Homo sapiens
ggccggaaggcctggggcagcctcctccaa

SEQ ID NO: 32029 - DNA, 30 bp, Homo sapiens
ctctggacggttcttcccccattgcttctg

SEQ ID NO: 32030 - DNA, 30 bp, Homo sapiens
tacgcctgggacttcatagctaggcacttg

SEQ ID NO: 32031 - DNA, 30 bp, Homo sapiens
tgtatggccatttccccagattgtttcata

SEQ ID NO: 32032 - DNA, 30 bp, Homo sapiens
tcagctgtatggcgaagacctcgccctccg

SEQ ID NO: 32033 - DNA, 30 bp, Homo sapiens
cagccaagctcctctgtgctcagggcactg

SEQ ID NO: 32034 - DNA, 30 bp, Homo sapiens
cttcagtttcaacttgctgagcaggcaagc

SEQ ID NO: 32035 - DNA, 30 bp, Homo sapiens
taggggaaaaaaaaagcattacatacgtcc

SEQ ID NO: 32036 - DNA, 30 bp, Homo sapiens
tgcgtacttggaagcccagtctgtccggcc

SEQ ID NO: 32037 - DNA, 30 bp, Homo sapiens
cacaggtccaccttgaccccctttatgaaa

SEQ ID NO: 32038 - DNA, 30 bp, Homo sapiens
tatagggtcacatctgtgagtctagatttt

SEQ ID NO: 32039 - DNA, 30 bp, Homo sapiens
agaaggagcaggttccaggattcagtgagc

SEQ ID NO: 32040 - DNA, 30 bp, Homo sapiens
acgtggccagtgagctctgtctccggactc

SEQ ID NO: 32041 - DNA, 30 bp, Homo sapiens
tagtggtcggatctggatctcacctcggcc

SEQ ID NO: 32042 - DNA, 30 bp, Homo sapiens
cgcaggaacgcatgccgcctcggccgtcag

SEQ ID NO: 32043 - DNA, 30 bp, Homo sapiens
agtgctttgctgtcatttgacattaactca

SEQ ID NO: 32044 - DNA, 30 bp, Homo sapiens
cagtggcaaaagctccttttgtcgttggag

SEQ ID NO: 32045 - DNA, 30 bp, Homo sapiens
cagcggcacagaatgctgtcgccctgcttg

SEQ ID NO: 32046 - DNA, 30 bp, Homo sapiens
atgtggtttcacaaggggaaacagtggcag

SEQ ID NO: 32047 - DNA, 30 bp, Homo sapiens
ctagtttgatcttcaagttttctccaagtt

SEQ ID NO: 32048 - DNA, 30 bp, Homo sapiens
actgcctgcccagggctctgtccaggttgc

SEQ ID NO: 32049 - DNA, 30 bp, Homo sapiens
tgaagtctgagcattttgcattgcctccca

SEQ ID NO: 32050 - DNA, 30 bp, Homo sapiens
agtctgcaggtgaccgatgacagacttgat

SEQ ID NO: 32051 - DNA, 30 bp, Homo sapiens
cagaggttcgaacctttagtctgcaggtga

SEQ ID NO: 32052 - DNA, 30 bp, Homo sapiens
agatggcccatgaaaagggcagtggatgga

SEQ ID NO: 32053 - DNA, 30 bp, Homo sapiens
tatgggtggggcaaggcagcaatgacagcc

SEQ ID NO: 32054 - DNA, 30 bp, Homo sapiens
tacaggaggctgcagggggagactgggcgg

SEQ ID NO: 32055 - DNA, 30 bp, Homo sapiens
taggcctccacggcccggccgttgatgacg

SEQ ID NO: 32056 - DNA, 30 bp, Homo sapiens
gctgcttttttcagaagttcttttagttct

SEQ ID NO: 32057 - DNA, 30 bp, Homo sapiens
acactctgtgtattttgtgaagctccacaa

SEQ ID NO: 32058 - DNA, 30 bp, Homo sapiens
tgctgggggctccagagtctcaaactggga

SEQ ID NO: 32059 - DNA, 30 bp, Homo sapiens
ttcaaaagggatttctcagttgtacttctt

SEQ ID NO: 32060 - DNA, 30 bp, Homo sapiens
aaccacgtgggtgaaggattgactccaagg

SEQ ID NO: 32061 - DNA, 30 bp, Homo sapiens
aactggaaaagatctccaccttgggaatca

SEQ ID NO: 32062 - DNA, 30 bp, Homo sapiens
atgaggaaaccatgatccgaggtaaatgca

SEQ ID NO: 32063 - DNA, 30 bp, Homo sapiens
gcccggggatgggggccctcttggcacagg

SEQ ID NO: 32064 - DNA, 30 bp, Homo sapiens
agaaggccaccacggcccgcacgagcacgt

SEQ ID NO: 32065 - DNA, 30 bp, Homo sapiens
agaaggcggccgggtgttgctggaggaaag

SEQ ID NO: 32066 - DNA, 30 bp, Homo sapiens
ataaggttcattagctgtgatttaattccc

SEQ ID NO: 32067 - DNA, 30 bp, Homo sapiens
agaaggccacgatggctgtgctccaggggt

SEQ ID NO: 32068 - DNA, 30 bp, Homo sapiens
agaaggcgacaatggctcgagtccaggcgc

SEQ ID NO: 32069 - DNA, 30 bp, Homo sapiens
tcatggagctgtcagatgagacatcgcgat

SEQ ID NO: 32070 - DNA, 30 bp, Homo sapiens
ccatgggctccacatccgcctcgcgctcga

SEQ ID NO: 32071 - DNA, 30 bp, Homo sapiens
ttgaatcaggattgagtatgtctttcttgt

SEQ ID NO: 32072 - DNA, 30 bp, Homo sapiens
aatgacagccgcaatggcagacccaatgga

SEQ ID NO: 32073 - DNA, 30 bp, Homo sapiens
ggatggctgggtgccttctcccctggcatg

SEQ ID NO: 32074 - DNA, 30 bp, Homo sapiens
agctggaagggggtgaacccagccaggccc

SEQ ID NO: 32075 - DNA, 30 bp, Homo sapiens
gtttctctgacttgagtgggggttttggag

SEQ ID NO: 32076 - DNA, 30 bp, Homo sapiens
cttgaagcaaacactcctgagggagctggt

SEQ ID NO: 32077 - DNA, 30 bp, Homo sapiens
gcctgactcagaggtgaagactgctaggcc

SEQ ID NO: 32078 - DNA, 30 bp, Homo sapiens
agaagtcatctgcagcccatagcattcgtc

SEQ ID NO: 32079 - DNA, 30 bp, Homo sapiens
tgcagggctgtaacgctctctcaattgcac

SEQ ID NO: 32080 - DNA, 30 bp, Homo sapiens
cctcctcactatcgagatacttgtgggtgg

SEQ ID NO: 32081 - DNA, 30 bp, Homo sapiens
gataggtaattctacccactttttgtattg

SEQ ID NO: 32082 - DNA, 30 bp, Homo sapiens
gaccttgtctcacagagttctcaaagtcag

SEQ ID NO: 32083 - DNA, 30 bp, Homo sapiens
tcagagccctctcatagcacagcaaagcat

SEQ ID NO: 32084 - DNA, 30 bp, Homo sapiens
tccagcttgatgctgaagggatgaggcttc

SEQ ID NO: 32085 - DNA, 30 bp, Homo sapiens
gagaggagctctctgggactggagctgact

SEQ ID NO: 32086 - DNA, 30 bp, Homo sapiens
gtcaggaattctgcattttctggatctatc

SEQ ID NO: 32087 - DNA, 30 bp, Homo sapiens
accagtaacaggatgaatccaatggtcatg

SEQ ID NO: 32088 - DNA, 30 bp, Homo sapiens
acatggtccccaccctgtcccctctctcga

SEQ ID NO: 32089 - DNA, 30 bp, Homo sapiens
cgctgggcctggacgaccaacactgggatg

SEQ ID NO: 32090 - DNA, 30 bp, Homo sapiens
cataggcctggaagatcagcactgggatga

SEQ ID NO: 32091 - DNA, 30 bp, Homo sapiens
agtcatagtccgcgtcatcaaacttggtgc

SEQ ID NO: 32092 - DNA, 30 bp, Homo sapiens
tccttaatctttcttgcaagtttgttgata

SEQ ID NO: 32093 - DNA, 30 bp, Homo sapiens
acaagggctgtatttcttccccatcagata

SEQ ID NO: 32094 - DNA, 30 bp, Homo sapiens
tccttaatctttcttgaaaaatttttgata

SEQ ID NO: 32095 - DNA, 30 bp, Homo sapiens
gagagggatctcatgatttctgctctgaca

SEQ ID NO: 32096 - DNA, 30 bp, Homo sapiens
tccttaacctttcttgcaagtttcttgatg

SEQ ID NO: 32097 - DNA, 30 bp, Homo sapiens
aggcacaagagctgtatttcttctctgtca

SEQ ID NO: 32098 - DNA, 30 bp, Homo sapiens
gtagttcttcacttgttttactttcgcttt

SEQ ID NO: 32099 - DNA, 30 bp, Homo sapiens
cacagggatgcacgcttgtaatcccagcta

SEQ ID NO: 32100 - DNA, 30 bp, Homo sapiens
caggtggaaggagggtgcattttaagggag

SEQ ID NO: 32101 - DNA, 30 bp, Homo sapiens
ccaaggtcaacatctgactcagaagtgtca

SEQ ID NO: 32102 - DNA, 30 bp, Homo sapiens
tttcggaggtaacctgtaagtctgttaatg

SEQ ID NO: 32103 - DNA, 30 bp, Homo sapiens
acctcgggcttctaaactctgtagtaagct

SEQ ID NO: 32104 - DNA, 30 bp, Homo sapiens
tactgggatgctcttcgacctcgaaacagc

SEQ ID NO: 32105 - DNA, 30 bp, Homo sapiens
tcaaggactctttaccgctatcatccacaa

SEQ ID NO: 32106 - DNA, 30 bp, Homo sapiens
gtttggagaacatcttcttgctccttttcc

SEQ ID NO: 32107 - DNA, 30 bp, Homo sapiens
gaatagagctgtaaatttgtaaaagtaata

SEQ ID NO: 32108 - DNA, 30 bp, Homo sapiens
aggtggactcagggtgggttgacgttctca

SEQ ID NO: 32109 - DNA, 30 bp, Homo sapiens
cacaggtccccactggcaacacaattcagg

SEQ ID NO: 32110 - DNA, 30 bp, Homo sapiens
cacaggtccccgctggcaacacaattcagg

SEQ ID NO: 32111 - DNA, 30 bp, Homo sapiens
cagaggcaaggcccagagtgtgcagccagc

SEQ ID NO: 32112 - DNA, 30 bp, Homo sapiens
acctggccatgtaatgccccaatgtccggc

SEQ ID NO: 32113 - DNA, 30 bp, Homo sapiens
cccaggtctctatctttacttctcagtctt

SEQ ID NO: 32114 - DNA, 30 bp, Homo sapiens
tctgctctcttatctcgacatttgcttcta

SEQ ID NO: 32115 - DNA, 30 bp, Homo sapiens
cacaggatgtctgcccgcttgtcccgcaca

SEQ ID NO: 32116 - DNA, 30 bp, Homo sapiens
catgggccagggtcatccttgcacctgcgg

SEQ ID NO: 32117 - DNA, 30 bp, Homo sapiens
caggggtcgtcatctgcctcttccaccacc

SEQ ID NO: 32118 - DNA, 30 bp, Homo sapiens
actgaaaggaaaagctggtgctggggagcc

SEQ ID NO: 32119 - DNA, 30 bp, Homo sapiens
cgatggccttcatcttttcattttctgctt

SEQ ID NO: 32120 - DNA, 30 bp, Homo sapiens
attttctgaaactggccaattttgtccaca

SEQ ID NO: 32121 - DNA, 30 bp, Homo sapiens
tgtctctgctctcagacatggagttgatta

SEQ ID NO: 32122 - DNA, 30 bp, Homo sapiens
gccagggcccggaaaacctccaccttctcc

SEQ ID NO: 32123 - DNA, 30 bp, Homo sapiens
gcctggcctgccccgcagggtcctccttct

SEQ ID NO: 32124 - DNA, 30 bp, Homo sapiens
cataggtggaacagatcatgaccaccaaga

SEQ ID NO: 32125 - DNA, 30 bp, Homo sapiens
tgaaggttaatgtctccatgtctccagctt

SEQ ID NO: 32126 - DNA, 30 bp, Homo sapiens
ttctggaatgctgtttcacttgtatcgatg

SEQ ID NO: 32127 - DNA, 30 bp, Homo sapiens
gtgccttctcagaggagaacgtttcatcta

SEQ ID NO: 32128 - DNA, 30 bp, Homo sapiens
actccagcctgggaaaccctgtctctttga

SEQ ID NO: 32129 - DNA, 30 bp, Homo sapiens
gctggttctggaataactgtggcatgcatg

SEQ ID NO: 32130 - DNA, 30 bp, Homo sapiens
ggtaggatcttggtgttcctctaaatccat

SEQ ID NO: 32131 - DNA, 30 bp, Homo sapiens
cgctggtgctatgtaaagcatccacgatgg

SEQ ID NO: 32132 - DNA, 30 bp, Homo sapiens
gattttaaagctggcaaatcattatatatc

SEQ ID NO: 32133 - DNA, 30 bp, Homo sapiens
ctcttgctggattggctgcttgatgattgc

SEQ ID NO: 32134 - DNA, 30 bp, Homo sapiens
aggaggctgaggtaggaggatcacttgagc

SEQ ID NO: 32135 - DNA, 30 bp, Homo sapiens
ctccccaccctcctgaattacctgaccaat

SEQ ID NO: 32136 - DNA, 30 bp, Homo sapiens
gcacttccttctcttttgccacgggagccc

SEQ ID NO: 32137 - DNA, 30 bp, Homo sapiens
cgatccttttcttggctgcagtttttggtc

SEQ ID NO: 32138 - DNA, 30 bp, Homo sapiens
ttctgtcggttcccatagcccctaggatgg

SEQ ID NO: 32139 - DNA, 30 bp, Homo sapiens
gagctggctgggtaacccgggccgctgcag

SEQ ID NO: 32140 - DNA, 30 bp, Homo sapiens
cagaggaggagaccggggatctgggcaggc

SEQ ID NO: 32141 - DNA, 30 bp, Homo sapiens
tcctgtagttcttgtttcctgcactccctc

SEQ ID NO: 32142 - DNA, 30 bp, Homo sapiens
acttgcgttcttcaaatgtacttcctttcc

SEQ ID NO: 32143 - DNA, 30 bp, Homo sapiens
ttgcctctgcattcagcatttctacttcca

SEQ ID NO: 32144 - DNA, 30 bp, Homo sapiens
agcaggtcgaagactggggcagcggcaagg

SEQ ID NO: 32145 - DNA, 30 bp, Homo sapiens
tgctggccatctctgggggggcgcccccgt

SEQ ID NO: 32146 - DNA, 30 bp, Homo sapiens
tgcctgggcctggttactctgtcccttctg

SEQ ID NO: 32147 - DNA, 30 bp, Homo sapiens
ttgctgcgctgtgaggcgactccctgaggg

SEQ ID NO: 32148 - DNA, 30 bp, Homo sapiens
cttccgtcttgactgaggtggtccactttg

SEQ ID NO: 32149 - DNA, 30 bp, Homo sapiens
aagaggtcctcgtcgctgtcgtcatggaag

SEQ ID NO: 32150 - DNA, 30 bp, Homo sapiens
cagcagggagcaaagtgggcctcgctgagg

SEQ ID NO: 32151 - DNA, 30 bp, Homo sapiens
atctctggagacccagggatcctcttccca

SEQ ID NO: 32152 - DNA, 30 bp, Homo sapiens
cgctgggtgtgcaccccgcgagcctcctgc

SEQ ID NO: 32153 - DNA, 30 bp, Homo sapiens
tccccttggtggtgtagcctgggagaggct

SEQ ID NO: 32154 - DNA, 30 bp, Homo sapiens
tctcgaaagctgtcagccagctggtggcag

SEQ ID NO: 32155 - DNA, 30 bp, Homo sapiens
cgaaggtgtggcactgaaagtccccgtcaa

SEQ ID NO: 32156 - DNA, 30 bp, Homo sapiens
ctcccagtggggcaggaggagcttccattg

SEQ ID NO: 32157 - DNA, 30 bp, Homo sapiens
taatttttgctgatgctgaagcctgtcctt

SEQ ID NO: 32158 - DNA, 30 bp, Homo sapiens
gctcggcaccttcaccttttttcactggta

SEQ ID NO: 32159 - DNA, 30 bp, Homo sapiens
catgcggtcatcgggagctgggaagtggaa

SEQ ID NO: 32160 - DNA, 30 bp, Homo sapiens
atccgaggtccgggctgagtcgcagttctg

SEQ ID NO: 32161 - DNA, 30 bp, Homo sapiens
gagtggcactgggaattcacaccctgaacc

SEQ ID NO: 32162 - DNA, 30 bp, Homo sapiens
acagctccgggagatgggagataagtgaca

SEQ ID NO: 32163 - DNA, 30 bp, Homo sapiens
atgaggtcagatcttgacacagggcttttt

SEQ ID NO: 32164 - DNA, 30 bp, Homo sapiens
caggagtggaagtagtgaggcctccttcca

SEQ ID NO: 32165 - DNA, 30 bp, Homo sapiens
aaaccccagatgagccaagcttggacagca

SEQ ID NO: 32166 - DNA, 30 bp, Homo sapiens
tgctgggttctatgacaatgagggtggcag

SEQ ID NO: 32167 - DNA, 30 bp, Homo sapiens
acgtccccctctccttcctccggctggtcc

SEQ ID NO: 32168 - DNA, 30 bp, Homo sapiens
gatgcacaacacgtttgcttggtttccaca

SEQ ID NO: 32169 - DNA, 30 bp, Homo sapiens
aacattctgcaggggccaccgtcttctcca

SEQ ID NO: 32170 - DNA, 30 bp, Homo sapiens
cagaggacggcgggaacagagtgaccgagg

SEQ ID NO: 32171 - DNA, 30 bp, Homo sapiens
aacattctgtaggggccactgtcttctcca

SEQ ID NO: 32172 - DNA, 30 bp, Homo sapiens
ttctccaccacagccagcccagggcggaga

SEQ ID NO: 32173 - DNA, 30 bp, Homo sapiens
agattctctgagaggttgatgaaggagaat

SEQ ID NO: 32174 - DNA, 30 bp, Homo sapiens
atgatacctgggacaacaattgccagatgc

SEQ ID NO: 32175 - DNA, 30 bp, Homo sapiens
aagtgggttctttgctgtgcatttgtatat

SEQ ID NO: 32176 - DNA, 30 bp, Homo sapiens
ccaaggacccggcccgactctgggctggta

SEQ ID NO: 32177 - DNA, 30 bp, Homo sapiens
cgtcagctccagaatcactgtcagggcgag

SEQ ID NO: 32178 - DNA, 30 bp, Homo sapiens
atgaggtgctttgatttcttctgcagactc

SEQ ID NO: 32179 - DNA, 30 bp, Homo sapiens
ctctgcctgtcagtccttaggctctggatg

SEQ ID NO: 32180 - DNA, 30 bp, Homo sapiens
tagtctatggcccctggatggatactgaga

SEQ ID NO: 32181 - DNA, 30 bp, Homo sapiens
ctcaggactggccagattaaaagaagcctg

SEQ ID NO: 32182 - DNA, 30 bp, Homo sapiens
agttggaaagtactcttctgttttcataag

SEQ ID NO: 32183 - DNA, 30 bp, Homo sapiens
tcgaagcctcttcatgaagcagcaagtgat

SEQ ID NO: 32184 - DNA, 30 bp, Homo sapiens
gagtggcctgttcggggtgggggactggct

SEQ ID NO: 32185 - DNA, 30 bp, Homo sapiens
aagtggcatgtcctgggtcatcgtggtcca

SEQ ID NO: 32186 - DNA, 30 bp, Homo sapiens
agctccctgccccggacatgcccagtgggt

SEQ ID NO: 32187 - DNA, 30 bp, Homo sapiens
cagcttccatcttcttcctcttctcaatga

SEQ ID NO: 32188 - DNA, 30 bp, Homo sapiens
tctcagcttggactattgttaaattagata

SEQ ID NO: 32189 - DNA, 30 bp, Homo sapiens
tctcctgtacttgagtatgctataaaatca

SEQ ID NO: 32190 - DNA, 30 bp, Homo sapiens
catgaggcctgctccaggcagctgtgctct

SEQ ID NO: 32191 - DNA, 30 bp, Homo sapiens
atcaggaggtgctgggactctatttagccg

SEQ ID NO: 32192 - DNA, 30 bp, Homo sapiens
gcttcatcccctcgcagagctcttgcatgc

SEQ ID NO: 32193 - DNA, 30 bp, Homo sapiens
tcaatgcactccatgacatgtatctgcagg

SEQ ID NO: 32194 - DNA, 30 bp, Homo sapiens
agtcatcagccccatatgtaaccacgactc

SEQ ID NO: 32195 - DNA, 30 bp, Homo sapiens
atgtggaagcggtgctcccctcgcgttatg

SEQ ID NO: 32196 - DNA, 30 bp, Homo sapiens
gcatctgcgaagtaacaatcccatcagtgc

SEQ ID NO: 32197 - DNA, 30 bp, Homo sapiens
tagtggaatgtgtgctcccctcgaacaatg

SEQ ID NO: 32198 - DNA, 30 bp, Homo sapiens
agcagggctctgtgttctcctctggctatg

SEQ ID NO: 32199 - DNA, 30 bp, Homo sapiens
accagggcacattcaaatcttgcagtctta

SEQ ID NO: 32200 - DNA, 30 bp, Homo sapiens
ttatgctccccccggacaatgtgggaagag

SEQ ID NO: 32201 - DNA, 30 bp, Homo sapiens
tgcaaaatgacaggcaaaatcatacttgtt

SEQ ID NO: 32202 - DNA, 30 bp, Homo sapiens
tgtaggcttctatgtagttgatgaagatgt

SEQ ID NO: 32203 - DNA, 30 bp, Homo sapiens
cactcacttgactgcaggctagagatgagg

SEQ ID NO: 32204 - DNA, 30 bp, Homo sapiens
ctttggggcccctgcccaggcggggtcccg

SEQ ID NO: 32205 - DNA, 30 bp, Homo sapiens
cacagccgagtcttcagcagcagcagtccc

SEQ ID NO: 32206 - DNA, 30 bp, Homo sapiens
tacaggtttggagctcctggacgcctgtcc

SEQ ID NO: 32207 - DNA, 30 bp, Homo sapiens
ttctgaaagcatgaagaagtatgcagagct

SEQ ID NO: 32208 - DNA, 30 bp, Homo sapiens
tgcagggcacagatgcccattcgctccaag

SEQ ID NO: 32209 - DNA, 30 bp, Homo sapiens
tccaaggacaactctgtatccagggccagc

SEQ ID NO: 32210 - DNA, 30 bp, Homo sapiens
ggaaggcggaggttgcagtgagctgagatc

SEQ ID NO: 32211 - DNA, 30 bp, Homo sapiens
acctgtctccatcctccaaggacaactctg

SEQ ID NO: 32212 - DNA, 30 bp, Homo sapiens
gcgtgggccagtctatcaggagcctgtcca

SEQ ID NO: 32213 - DNA, 30 bp, Homo sapiens
ccaagggcagctgtgtcttctcttttgctg

SEQ ID NO: 32214 - DNA, 30 bp, Homo sapiens
agagcatgagggagtcacacctcatcttta

SEQ ID NO: 32215 - DNA, 30 bp, Homo sapiens
caaactgggccacctcgattttggtgtctc

SEQ ID NO: 32216 - DNA, 30 bp, Homo sapiens
ctgagaggctttcttcaggttttctatcag

SEQ ID NO: 32217 - DNA, 30 bp, Homo sapiens
gaccggttacaaatataactaatattaaga

SEQ ID NO: 32218 - DNA, 30 bp, Homo sapiens
gttcctcacattctttgcatccagattctg

SEQ ID NO: 32219 - DNA, 30 bp, Homo sapiens
cataggtggtgagagcagttttccaagtct

SEQ ID NO: 32220 - DNA, 30 bp, Homo sapiens
gagcatgtatgtccagcactgcggggatgg

SEQ ID NO: 32221 - DNA, 30 bp, Homo sapiens
taggagtctccagcagctgtggtttccttg

SEQ ID NO: 32222 - DNA, 30 bp, Homo sapiens
acatggtggacaatcggggtgacacaggtg

SEQ ID NO: 32223 - DNA, 30 bp, Homo sapiens
tgcaggtgcagcccacagcgatggtctcca

SEQ ID NO: 32224 - DNA, 30 bp, Homo sapiens
gaacggggcagcacgcaggtgcagccgacg

SEQ ID NO: 32225 - DNA, 30 bp, Homo sapiens
caggggccagcgggcgcgtcgttggggccc

SEQ ID NO: 32226 - DNA, 30 bp, Homo sapiens
actgcacatggtggatgacaggggtgacgc

SEQ ID NO: 32227 - DNA, 30 bp, Homo sapiens
tgcactgggcccctctgactctgaccccat

SEQ ID NO: 32228 - DNA, 30 bp, Homo sapiens
acaaggagcagcagccatcgtggcaggctt

SEQ ID NO: 32229 - DNA, 30 bp, Homo sapiens
ccccgccccaggtcccgcgcctggtcccac

SEQ ID NO: 32230 - DNA, 30 bp, Homo sapiens
gcgtggagttcatcagtgtagctgcggcaa

SEQ ID NO: 32231 - DNA, 30 bp, Homo sapiens
ctcccaccaggcgccgctgcgcctccgagt

SEQ ID NO: 32232 - DNA, 30 bp, Homo sapiens
cctaggtctgcaagtcgggcggcctctcgt

SEQ ID NO: 32233 - DNA, 30 bp, Homo sapiens
ggaaggcaaaagcaggggcggctgccaggt

SEQ ID NO: 32234 - DNA, 30 bp, Homo sapiens
tcctgggacacttctctgaaagaatatgat

SEQ ID NO: 32235 - DNA, 30 bp, Homo sapiens
cacaggctgctctggcagagcccacccttt

SEQ ID NO: 32236 - DNA, 30 bp, Homo sapiens
tgctgtggactgctgtggctggagggcagg

SEQ ID NO: 32237 - DNA, 30 bp, Homo sapiens
tgctggccctgtgctgagtcttaaccctgc

SEQ ID NO: 32238 - DNA, 30 bp, Homo sapiens
aacaggcaagacttccggttcgtctctacc

SEQ ID NO: 32239 - DNA, 30 bp, Homo sapiens
cttaggctgggagctcctcccagtggtttc

SEQ ID NO: 32240 - DNA, 30 bp, Homo sapiens
tagaaagacgtcgagctctcccagggattt

SEQ ID NO: 32241 - DNA, 30 bp, Homo sapiens
gcctggttttccagtatctgaaagtcagtg

SEQ ID NO: 32242 - DNA, 30 bp, Homo sapiens
gcatggtgaagtcagttatatcctggccgc

SEQ ID NO: 32243 - DNA, 30 bp, Homo sapiens
cagctctgttcaaagtaaaacttggtacgg

SEQ ID NO: 32244 - DNA, 30 bp, Homo sapiens
aagggcacacaagtcctccgtctcctgcaa

SEQ ID NO: 32245 - DNA, 30 bp, Homo sapiens
tacccgagaggcacgtgagcctctctttgc

SEQ ID NO: 32246 - DNA, 30 bp, Homo sapiens
cacagtcagaccatctgcttttccagttct

SEQ ID NO: 32247 - DNA, 30 bp, Homo sapiens
tactggcgtggcccctcggtcacgcggcct

SEQ ID NO: 32248 - DNA, 30 bp, Homo sapiens
ctattacctttctgcttcaccttggctgct

SEQ ID NO: 32249 - DNA, 30 bp, Homo sapiens
tataggatataaaagtcgttgttattggat

SEQ ID NO: 32250 - DNA, 30 bp, Homo sapiens
tcatcactgctagaccgcctgggacttttc

SEQ ID NO: 32251 - DNA, 30 bp, Homo sapiens
cacactggatatactggtctcccttggcaa

SEQ ID NO: 32252 - DNA, 30 bp, Homo sapiens
ctttggaggataaaggcagcaaagaactgt

SEQ ID NO: 32253 - DNA, 30 bp, Homo sapiens
ttctgggcagccaagggagtcaaactagag

SEQ ID NO: 32254 - DNA, 30 bp, Homo sapiens
acttggatttttcctacttagtcttacggt

SEQ ID NO: 32255 - DNA, 30 bp, Homo sapiens
gtgagagtacacttctttcttcttgagcct

SEQ ID NO: 32256 - DNA, 30 bp, Homo sapiens
tcctggaagtagaatttggtgaccatgacg

SEQ ID NO: 32257 - DNA, 30 bp, Homo sapiens
aaaaggtaatccatctgttcagaaattcta

SEQ ID NO: 32258 - DNA, 30 bp, Homo sapiens
attctgtctcctccatccattgcagaagaa

SEQ ID NO: 32259 - DNA, 30 bp, Homo sapiens
gcacatataacccccattcctccatgaatt

SEQ ID NO: 32260 - DNA, 30 bp, Homo sapiens
agatccaggccctgaggagttcctcaggag

SEQ ID NO: 32261 - DNA, 30 bp, Homo sapiens
gaatcttcacttccgtgtgttctagaggac

SEQ ID NO: 32262 - DNA, 30 bp, Homo sapiens
gggtggttttttctcataagaatcacatga

SEQ ID NO: 32263 - DNA, 30 bp, Homo sapiens
tagctggcctggggtccagggctcgaaagt

SEQ ID NO: 32264 - DNA, 30 bp, Homo sapiens
tgcaggcatttctcagagacataaacagca

SEQ ID NO: 32265 - DNA, 30 bp, Homo sapiens
aggactcccactgcacagtcagggccaggc

SEQ ID NO: 32266 - DNA, 30 bp, Homo sapiens
atctctcttcacttctctgacttcttctgt

SEQ ID NO: 32267 - DNA, 30 bp, Homo sapiens
agggagtgaaccgcggcgtcatgctccatt

SEQ ID NO: 32268 - DNA, 30 bp, Homo sapiens
gggactcagggttgctgctccatgggcaaa

SEQ ID NO: 32269 - DNA, 30 bp, Homo sapiens
gaagtggctttccaaaatattttgtggaaa

SEQ ID NO: 32270 - DNA, 30 bp, Homo sapiens
tagcagaaaccgcctgtgtgcactgtctct

SEQ ID NO: 32271 - DNA, 30 bp, Homo sapiens
tccaggtcagaagaatgtccacttccccaa

SEQ ID NO: 32272 - DNA, 30 bp, Homo sapiens
agcccatcacacggggccgcacacacacac

SEQ ID NO: 32273 - DNA, 30 bp, Homo sapiens
aagaagaatatccagttcactgatggcttt

SEQ ID NO: 32274 - DNA, 30 bp, Homo sapiens
agggctgggggctcaatgttgggaacccca

SEQ ID NO: 32275 - DNA, 30 bp, Homo sapiens
cctgtggcctggggggccccagaaggccca

SEQ ID NO: 32276 - DNA, 30 bp, Homo sapiens
ccaggtgagcccactcaggaggaggacgct

SEQ ID NO: 32277 - DNA, 30 bp, Homo sapiens
gagttgggtcctgaccctggagttcttgga

SEQ ID NO: 32278 - DNA, 30 bp, Homo sapiens
ttcaggctttagggtgtaacatgggggggc

SEQ ID NO: 32279 - DNA, 30 bp, Homo sapiens
gcgaggctcaaagtcgtctgttgagcctgc

SEQ ID NO: 32280 - DNA, 30 bp, Homo sapiens
aagtggtggcctgttgggctccagaggtca

SEQ ID NO: 32281 - DNA, 30 bp, Homo sapiens
atttcctcaggactctcctctcaggtactg

SEQ ID NO: 32282 - DNA, 30 bp, Homo sapiens
ggcaggaagacagaattctagtcccattct

SEQ ID NO: 32283 - DNA, 30 bp, Homo sapiens
ccttggtgtgctctggaagtttttcagaca

SEQ ID NO: 32284 - DNA, 30 bp, Homo sapiens
ttctggggtgtcagctcctccttgtccccc

SEQ ID NO: 32285 - DNA, 30 bp, Homo sapiens
cacctataaacactccaggatcagtcttgc

SEQ ID NO: 32286 - DNA, 30 bp, Homo sapiens
aagaggccctcgccctgtgccctgaccggc

SEQ ID NO: 32287 - DNA, 30 bp, Homo sapiens
gtcagtagtgttggctttccccagttcttg

SEQ ID NO: 32288 - DNA, 30 bp, Homo sapiens
tccttggtgagaaagatgggctgtcctgat

SEQ ID NO: 32289 - DNA, 30 bp, Homo sapiens
tcctggcattcctatgttggtccgcatgga

SEQ ID NO: 32290 - DNA, 30 bp, Homo sapiens
ttctgaagtcagaatgatgggctggtctct

SEQ ID NO: 32291 - DNA, 30 bp, Homo sapiens
tcacactgctggaagtagaagtctgtgatg

SEQ ID NO: 32292 - DNA, 30 bp, Homo sapiens
cgctgacctcactggggctcatttcagctt

SEQ ID NO: 32293 - DNA, 30 bp, Homo sapiens
cttcagtcaccagacactcctccaggccgg

SEQ ID NO: 32294 - DNA, 30 bp, Homo sapiens
caagaagttttccaacgtactctggttggc

SEQ ID NO: 32295 - DNA, 30 bp, Homo sapiens
gcgaggtcctcgtgtgggtcgtgttttgga

SEQ ID NO: 32296 - DNA, 30 bp, Homo sapiens
agaccctcatgtatgtgggtcccacggaga

SEQ ID NO: 32297 - DNA, 30 bp, Homo sapiens
ggtgttcattacaccaagaaactcttgcag

SEQ ID NO: 32298 - DNA, 30 bp, Homo sapiens
cactggacccagctttattttacagataag

SEQ ID NO: 32299 - DNA, 30 bp, Homo sapiens
tccagggtctcaactccaggcttctctata

SEQ ID NO: 32300 - DNA, 30 bp, Homo sapiens
taaataggttggctccactcactccagagc

SEQ ID NO: 32301 - DNA, 30 bp, Homo sapiens
tacatttgccgaagagccctcaggctggac

SEQ ID NO: 32302 - DNA, 30 bp, Homo sapiens
aggcagaagttgccgtgagctgtgattgca

SEQ ID NO: 32303 - DNA, 30 bp, Homo sapiens
atctggggaagaagtagtctgtattgctga

SEQ ID NO: 32304 - DNA, 30 bp, Homo sapiens
gagcccgcagcttccacgtcttcttgaacc

SEQ ID NO: 32305 - DNA, 30 bp, Homo sapiens
ctgaggcatgtagccgccttgccgtacagt

SEQ ID NO: 32306 - DNA, 30 bp, Homo sapiens
cagtgcagttcaacagtattgttgtgcctt

SEQ ID NO: 32307 - DNA, 30 bp, Homo sapiens
tctttgttggttgggcttcacccagggcag

SEQ ID NO: 32308 - DNA, 30 bp, Homo sapiens
attgatcgatgctgaccattagaacactct

SEQ ID NO: 32309 - DNA, 30 bp, Homo sapiens
cactggttttggtagaagctggacatggtg

SEQ ID NO: 32310 - DNA, 30 bp, Homo sapiens
atccctctcatcttttctttctggaaaatt

SEQ ID NO: 32311 - DNA, 30 bp, Homo sapiens
atgtccaggaccgagccttgctgaggacag

SEQ ID NO: 32312 - DNA, 30 bp, Homo sapiens
caccggccccgtgggcccccatccaagtct

SEQ ID NO: 32313 - DNA, 30 bp, Homo sapiens
tccttccactatgagagctgtctttctccg

SEQ ID NO: 32314 - DNA, 30 bp, Homo sapiens
acaagggacatcctggttggaaagtcattg

SEQ ID NO: 32315 - DNA, 30 bp, Homo sapiens
tttccatgctttcttcttcctctccttgag

SEQ ID NO: 32316 - DNA, 30 bp, Homo sapiens
atcatgatagccgtagcagtctgtgaaaaa

SEQ ID NO: 32317 - DNA, 30 bp, Homo sapiens
tactggtagttcatgctgtggtctgcgttt

SEQ ID NO: 32318 - DNA, 30 bp, Homo sapiens
gtcgccgagttgcctccgtacccatagctt

SEQ ID NO: 32319 - DNA, 30 bp, Homo sapiens
tgtcctgcatcttctcaaggataggcacaa

SEQ ID NO: 32320 - DNA, 30 bp, Homo sapiens
agtgccctatccgcaccaccatcacagtga

SEQ ID NO: 32321 - DNA, 30 bp, Homo sapiens
acagcaatggagccatcgcggaagtccgtc

SEQ ID NO: 32322 - DNA, 30 bp, Homo sapiens
attagggctggcacgtaaaaatccaaaatc

SEQ ID NO: 32323 - DNA, 30 bp, Homo sapiens
atacaatgtcaccacggtgtacttcaaaat

SEQ ID NO: 32324 - DNA, 30 bp, Homo sapiens
aatatctccttcaagagcaatcactctctt

SEQ ID NO: 32325 - DNA, 30 bp, Homo sapiens
ctctctgtactggtaagcgctctggaggaa

SEQ ID NO: 32326 - DNA, 30 bp, Homo sapiens
cagttttctcccatctctgacaatatctcc

SEQ ID NO: 32327 - DNA, 30 bp, Homo sapiens
ctctggctgcacctgagtggttcctattcc

SEQ ID NO: 32328 - DNA, 30 bp, Homo sapiens
ggcttccagatcgaagtcatcgcgctcctc

SEQ ID NO: 32329 - DNA, 30 bp, Homo sapiens
actcggtgctcaggaagactctcttgcgtg

SEQ ID NO: 32330 - DNA, 30 bp, Homo sapiens
caaaggtataacctgaatttctttagctat

SEQ ID NO: 32331 - DNA, 30 bp, Homo sapiens
gcacgccaccagcttcagtaacaataatgc

SEQ ID NO: 32332 - DNA, 30 bp, Homo sapiens
catagttaatcgtctgtaaggcctgagcta

SEQ ID NO: 32333 - DNA, 30 bp, Homo sapiens
gccttagatgactcctcaggtgaatttgtg

SEQ ID NO: 32334 - DNA, 30 bp, Homo sapiens
ttttctagatctgggagttttctgaccagg

SEQ ID NO: 32335 - DNA, 30 bp, Homo sapiens
tacagccgcttttcgtaagagtgcaggcca

SEQ ID NO: 32336 - DNA, 30 bp, Homo sapiens
cagaaaagccgcttctcatacgaatggagg

SEQ ID NO: 32337 - DNA, 30 bp, Homo sapiens
caatcttgatggttaaattcttcatattct

SEQ ID NO: 32338 - DNA, 30 bp, Homo sapiens
ctcaggatcattggcatacagttccaaaac

SEQ ID NO: 32339 - DNA, 30 bp, Homo sapiens
atctgggaggttttcttagaggctacctta

SEQ ID NO: 32340 - DNA, 30 bp, Homo sapiens
acccgggtcttcgcccctccgcggcctctg

SEQ ID NO: 32341 - DNA, 30 bp, Homo sapiens
tcccgggcgccgccgccgtttcctcttcgt

SEQ ID NO: 32342 - DNA, 30 bp, Homo sapiens
tcttcagacgctgccaactccatcccccag

SEQ ID NO: 32343 - DNA, 30 bp, Homo sapiens
tgcttcttcaggctgtaggccaggctgctg

SEQ ID NO: 32344 - DNA, 30 bp, Homo sapiens
acttggccttgggcctgggcctgaggcctt

SEQ ID NO: 32345 - DNA, 30 bp, Homo sapiens
tggatcacacacagtttctttgttttatta

SEQ ID NO: 32346 - DNA, 30 bp, Homo sapiens
cgcaggcgagccaggacgtccagcagctgc

SEQ ID NO: 32347 - DNA, 30 bp, Homo sapiens
gtaagccctctcttttttggatttctccag

SEQ ID NO: 32348 - DNA, 30 bp, Homo sapiens
cactttgggcaataccatttcccctttggt

SEQ ID NO: 32349 - DNA, 30 bp, Homo sapiens
tttgtgtctgctgcctcttctcttcattgc

SEQ ID NO: 32350 - DNA, 30 bp, Homo sapiens
gaaccttctcatctgcatcttccaaagctt

SEQ ID NO: 32351 - DNA, 30 bp, Homo sapiens
cacaggcaaaatggaaccactcaatggaac

SEQ ID NO: 32352 - DNA, 30 bp, Homo sapiens
tcttgggagcagcgtgggcaaaaccatttc

SEQ ID NO: 32353 - DNA, 30 bp, Homo sapiens
acttcttcttcctcttttcctggacacacc

SEQ ID NO: 32354 - DNA, 30 bp, Homo sapiens
ggtttcgtggtaaggtccacgcaggcaaag

SEQ ID NO: 32355 - DNA, 30 bp, Homo sapiens
gatgacccgtctgcccacctgcaccatcct

SEQ ID NO: 32356 - DNA, 30 bp, Homo sapiens
gatacaagcacagtgctgcgtgagaaggtt

SEQ ID NO: 32357 - DNA, 30 bp, Homo sapiens
ctcctccacgatcatgttctgaatgtcctt

SEQ ID NO: 32358 - DNA, 30 bp, Homo sapiens
tcctccacaatcatgttgggcacgtcccgc

SEQ ID NO: 32359 - DNA, 30 bp, Homo sapiens
cacaggcctctactaccatgtcaggtatgt

SEQ ID NO: 32360 - DNA, 30 bp, Homo sapiens
cacaggcctccaccaccatatctggcacat

SEQ ID NO: 32361 - DNA, 30 bp, Homo sapiens
agttggggaatgacttcgtgaccatccagt

SEQ ID NO: 32362 - DNA, 30 bp, Homo sapiens
tcaaggcgaggtaaaacaggaagaataagg

SEQ ID NO: 32363 - DNA, 30 bp, Homo sapiens
cccaggcttcttgcgagccacaatgaagca

SEQ ID NO: 32364 - DNA, 30 bp, Homo sapiens
tccagaggggttggtgcctttgccctgttt

SEQ ID NO: 32365 - DNA, 30 bp, Homo sapiens
gtagccaaaaggggggatccaggaccctcg

SEQ ID NO: 32366 - DNA, 30 bp, Homo sapiens
tcgtggccttcctcagggccaggtagccgg

SEQ ID NO: 32367 - DNA, 30 bp, Homo sapiens
gttaggggagggaaagggagaagatgcatt

SEQ ID NO: 32368 - DNA, 30 bp, Homo sapiens
aactggactccctgcccgcagcctctccca

SEQ ID NO: 32369 - DNA, 30 bp, Homo sapiens
ctccgggatgtcgatcaccaggtcatcgtc

SEQ ID NO: 32370 - DNA, 30 bp, Homo sapiens
ggtatgcgtctctgcaggtgccaggttttg

SEQ ID NO: 32371 - DNA, 30 bp, Homo sapiens
gtcccttcgggaggcctgtaatgcttgggg

SEQ ID NO: 32372 - DNA, 30 bp, Homo sapiens
accaggtatgctatgctcagaaagagccac

SEQ ID NO: 32373 - DNA, 30 bp, Homo sapiens
gtcccctctggaggtctgtagtacttgggg

SEQ ID NO: 32374 - DNA, 30 bp, Homo sapiens
ttaaaataagccacacaactagcaggtgtg

SEQ ID NO: 32375 - DNA, 30 bp, Homo sapiens
cactgcacgacacaacacttgtgcacatgg

SEQ ID NO: 32376 - DNA, 30 bp, Homo sapiens
gagtgggttgcagaggaactggtgaataaa

SEQ ID NO: 32377 - DNA, 30 bp, Homo sapiens
tagaggccctggtggcccctcctccggccg

SEQ ID NO: 32378 - DNA, 30 bp, Homo sapiens
agatggtgctggagttctgactctgtagtg

SEQ ID NO: 32379 - DNA, 30 bp, Homo sapiens
gtctggcattgtataaacatctttttaagt

SEQ ID NO: 32380 - DNA, 30 bp, Homo sapiens
cttcttcccaagtgcaaaccctgctctacg

SEQ ID NO: 32381 - DNA, 30 bp, Homo sapiens
gggccccaggcccccttcctccagcccccg

SEQ ID NO: 32382 - DNA, 30 bp, Homo sapiens
ctgtggctgtgcttcacccagtgggtcctc

SEQ ID NO: 32383 - DNA, 30 bp, Homo sapiens
tgcagggtgtccagaaggaggcgcttgtga

SEQ ID NO: 32384 - DNA, 30 bp, Homo sapiens
agctggtagagggagcagatgctggtacag

SEQ ID NO: 32385 - DNA, 30 bp, Homo sapiens
ttctgggagcgctggggtcgcctgggccac

SEQ ID NO: 32386 - DNA, 30 bp, Homo sapiens
tgttgctgcagagtaagaaggagtccacca

SEQ ID NO: 32387 - DNA, 30 bp, Homo sapiens
taaaaaccacagcaggagggcagagatgtt

SEQ ID NO: 32388 - DNA, 30 bp, Homo sapiens
ttccccaccgtgacgcctcctgagaaaaat

SEQ ID NO: 32389 - DNA, 30 bp, Homo sapiens
atggggcttttcaggaacacccatagctaa

SEQ ID NO: 32390 - DNA, 30 bp, Homo sapiens
tcagattttcttccaaaatcttccttgctc

SEQ ID NO: 32391 - DNA, 30 bp, Homo sapiens
tcattcctgatgagatttttctgcgataac

SEQ ID NO: 32392 - DNA, 30 bp, Homo sapiens
gagatttttctgcgataactttacattcgt

SEQ ID NO: 32393 - DNA, 30 bp, Homo sapiens
agcaggtcttgttgggtacagccactgagg

SEQ ID NO: 32394 - DNA, 30 bp, Homo sapiens
agtagggacagagggtcagcaggtcttgtt

SEQ ID NO: 32395 - DNA, 30 bp, Homo sapiens
tcacaaattacttcacaacagaatggatca

SEQ ID NO: 32396 - DNA, 30 bp, Homo sapiens
tcatggaacagccatcagtgcaacacaaag

SEQ ID NO: 32397 - DNA, 30 bp, Homo sapiens
agacaacacttttctgaatatcctctgcgt

SEQ ID NO: 32398 - DNA, 30 bp, Homo sapiens
agcaggccgggcgcacgggcacctgcagga

SEQ ID NO: 32399 - DNA, 30 bp, Homo sapiens
gcagccaggccgcagtggcatctgcagcag

SEQ ID NO: 32400 - DNA, 30 bp, Homo sapiens
ggaaggattggaccgaggcaaggtcagaat

SEQ ID NO: 32401 - DNA, 30 bp, Homo sapiens
acccccattttgagggctgcagtctcttgg

SEQ ID NO: 32402 - DNA, 30 bp, Homo sapiens
tcacggcctccatatgcaggatcctcaggg

SEQ ID NO: 32403 - DNA, 30 bp, Homo sapiens
aggtcagagtctgaaggagcaagatcttct

SEQ ID NO: 32404 - DNA, 30 bp, Homo sapiens
agctgggggcctgggggaggcccttcttca

SEQ ID NO: 32405 - DNA, 30 bp, Homo sapiens
gtaatcgcttcatagcattgagctgtgatt

SEQ ID NO: 32406 - DNA, 30 bp, Homo sapiens
tgccggctggcttttccattttctgttgtc

SEQ ID NO: 32407 - DNA, 30 bp, Homo sapiens
gaagtccgtgtgcaaaggtgtgatgttctg

SEQ ID NO: 32408 - DNA, 30 bp, Homo sapiens
atcaggatccatgcttccagtgtccctgga

SEQ ID NO: 32409 - DNA, 30 bp, Homo sapiens
tcactgtcagagcccactgcagaggaccct

SEQ ID NO: 32410 - DNA, 30 bp, Homo sapiens
cgccgtgcaggtttgggcattatataaact

SEQ ID NO: 32411 - DNA, 30 bp, Homo sapiens
tcgaaggagagtggacggtgaaggtgcctg

SEQ ID NO: 32412 - DNA, 30 bp, Homo sapiens
agttctccagttgttctattagcattcgtt

SEQ ID NO: 32413 - DNA, 30 bp, Homo sapiens
tgcccatagttgtctatgccagttactaat

SEQ ID NO: 32414 - DNA, 30 bp, Homo sapiens
cagaggttgggggcagcctcaagtgcactt

SEQ ID NO: 32415 - DNA, 30 bp, Homo sapiens
tgaaggtggtgggaatttattttttctagt

SEQ ID NO: 32416 - DNA, 30 bp, Homo sapiens
tgtaggcattgcgttgctgctgctgctgta

SEQ ID NO: 32417 - DNA, 30 bp, Homo sapiens
gcttggagaaacttttttttccttctctgc

SEQ ID NO: 32418 - DNA, 30 bp, Homo sapiens
cagaacttctgtaagaatttgaggacaagg

SEQ ID NO: 32419 - DNA, 30 bp, Homo sapiens
acaaggttaacccaaagaacaatttaaaag

SEQ ID NO: 32420 - DNA, 30 bp, Homo sapiens
tgcaggttataagaaaagttctttgatctt

SEQ ID NO: 32421 - DNA, 30 bp, Homo sapiens
tactggttctcgtcccgcatctgttccatg

SEQ ID NO: 32422 - DNA, 30 bp, Homo sapiens
tctcctcacttatctctgtgacaatgtcta

SEQ ID NO: 32423 - DNA, 30 bp, Homo sapiens
accagggattgaaaactgagggtgtgagat

SEQ ID NO: 32424 - DNA, 30 bp, Homo sapiens
ttccctgtggccacaggggaaaggaccagg

SEQ ID NO: 32425 - DNA, 30 bp, Homo sapiens
agcaggtgccgacgagcgccttacaaacga

SEQ ID NO: 32426 - DNA, 30 bp, Homo sapiens
tcttggatatcctgcaggatcctgatgagg

SEQ ID NO: 32427 - DNA, 30 bp, Homo sapiens
aaatggaattttcaacagagggagaagaag

SEQ ID NO: 32428 - DNA, 30 bp, Homo sapiens
tctattgtgttgctagggaacacatgagca

SEQ ID NO: 32429 - DNA, 30 bp, Homo sapiens
aaaaactcctgtagctgggtgacaatctcc

SEQ ID NO: 32430 - DNA, 30 bp, Homo sapiens
agtagtcagctgtgtaatctgtgccatgga

SEQ ID NO: 32431 - DNA, 30 bp, Homo sapiens
gagaggcccagtacagcctggagctcctga

SEQ ID NO: 32432 - DNA, 30 bp, Homo sapiens
acgcagagttcaggagctcctgaatggcgg

SEQ ID NO: 32433 - DNA, 30 bp, Homo sapiens
ccctggtgctgggcctccaaaattgaaaga

SEQ ID NO: 32434 - DNA, 30 bp, Homo sapiens
gttgttgctgggcacagtcccaaaattaaa

SEQ ID NO: 32435 - DNA, 30 bp, Homo sapiens
tagatgccgatggtctgtagaactcgcctc

SEQ ID NO: 32436 - DNA, 30 bp, Homo sapiens
tgttagagtcttgtgatcattgaaaagaat

SEQ ID NO: 32437 - DNA, 30 bp, Homo sapiens
tcacaacgactggtgatcatgttaccaatt

SEQ ID NO: 32438 - DNA, 30 bp, Homo sapiens
ttgtggagaactaatgtgcaatcttcgctt

SEQ ID NO: 32439 - DNA, 30 bp, Homo sapiens
ccctttgtcctttgccttttctgtgctgcc

SEQ ID NO: 32440 - DNA, 30 bp, Homo sapiens
cttccttttcttcttctccttgtccagctt

SEQ ID NO: 32441 - DNA, 30 bp, Homo sapiens
aggtggtttggttccaccaatgaataaatt

SEQ ID NO: 32442 - DNA, 30 bp, Homo sapiens
gccaggtggttctgttttccatggcctgcc

SEQ ID NO: 32443 - DNA, 30 bp, Homo sapiens
cccttctccttgcctttctgcttgcccttc

SEQ ID NO: 32444 - DNA, 30 bp, Homo sapiens
aactggaaagttcttcgtgggcagagacgg

SEQ ID NO: 32445 - DNA, 30 bp, Homo sapiens
cagaggcagctccagatgggacactcctcc

SEQ ID NO: 32446 - DNA, 30 bp, Homo sapiens
gcaaggccctgagtccagcaagatctccag

SEQ ID NO: 32447 - DNA, 30 bp, Homo sapiens
ggagttgatgatctcaatgtggaactgcag

SEQ ID NO: 32448 - DNA, 30 bp, Homo sapiens
gataggatttcaatgtggaactctggctgc

SEQ ID NO: 32449 - DNA, 30 bp, Homo sapiens
taatggaaggggtatgcattgttgcacctt

SEQ ID NO: 32450 - DNA, 30 bp, Homo sapiens
gtcatgaggatttcgatgtcaagctccagc

SEQ ID NO: 32451 - DNA, 30 bp, Homo sapiens
ctcttatccttgcctttacctttgcctttt

SEQ ID NO: 32452 - DNA, 30 bp, Homo sapiens
tcctgggttcttggctaatgtcccagggat

SEQ ID NO: 32453 - DNA, 30 bp, Homo sapiens
ttcgcatttacagcagctctgtggtggatg

SEQ ID NO: 32454 - DNA, 30 bp, Homo sapiens
tgatggatgatgaagagatggcgagcaaag

SEQ ID NO: 32455 - DNA, 30 bp, Homo sapiens
atgtggtgggtaatagaggttgctgataga

SEQ ID NO: 32456 - DNA, 30 bp, Homo sapiens
tcttgggtttagagaggtttttatcatctt

SEQ ID NO: 32457 - DNA, 30 bp, Homo sapiens
cactggagggtgagaaaaccaagtctttct

SEQ ID NO: 32458 - DNA, 30 bp, Homo sapiens
gtcaggacatagaaaaagaaacatgacact

SEQ ID NO: 32459 - DNA, 30 bp, Homo sapiens
aattttgacttgctggtgaatgtgcttggc

SEQ ID NO: 32460 - DNA, 30 bp, Homo sapiens
tgcaggtactgcatcgtcctccattttgca

SEQ ID NO: 32461 - DNA, 30 bp, Homo sapiens
atcaggaggttgacatttactttagctcta

SEQ ID NO: 32462 - DNA, 30 bp, Homo sapiens
aacttcttgttcagcaggtatatgagaagg

SEQ ID NO: 32463 - DNA, 30 bp, Homo sapiens
aaacttcttgttgaggaggaagatgagaag

SEQ ID NO: 32464 - DNA, 30 bp, Homo sapiens
cgctgggtttggccttgctgctggtggggg

SEQ ID NO: 32465 - DNA, 30 bp, Homo sapiens
tgatggaccccggcttccgagaggtcccgc

SEQ ID NO: 32466 - DNA, 30 bp, Homo sapiens
tgacggctgcagtggctcgaaaggctgaaa

SEQ ID NO: 32467 - DNA, 30 bp, Homo sapiens
ccacggtgctgatccggcttggcttggcct

SEQ ID NO: 32468 - DNA, 30 bp, Homo sapiens
tcagagaggtctcgcagggaactgctgagt

SEQ ID NO: 32469 - DNA, 30 bp, Homo sapiens
gagtggcagagggcatggggtgaggccttc

SEQ ID NO: 32470 - DNA, 30 bp, Homo sapiens
accaggctccttgagccactggagtagcgg

SEQ ID NO: 32471 - DNA, 30 bp, Homo sapiens
gtcgggctggggaggcattgattaatacct

SEQ ID NO: 32472 - DNA, 30 bp, Homo sapiens
atgaggaggcctctgggattctataatctt

SEQ ID NO: 32473 - DNA, 30 bp, Homo sapiens
cctgtcctgttccaggcccaagcctgggag

SEQ ID NO: 32474 - DNA, 30 bp, Homo sapiens
gtctggatgactggtgatcatctatttggc

SEQ ID NO: 32475 - DNA, 30 bp, Homo sapiens
caggggccaaagagctcaatgctgtccact

SEQ ID NO: 32476 - DNA, 30 bp, Homo sapiens
cccaggaaaatttggaggaacagctgctct

SEQ ID NO: 32477 - DNA, 30 bp, Homo sapiens
taatgtctggtctcttatttttcttttcat

SEQ ID NO: 32478 - DNA, 30 bp, Homo sapiens
acaacatctatggatgtaacaaaagggttt

SEQ ID NO: 32479 - DNA, 30 bp, Homo sapiens
catcttcaaacgaagcaatcacgctgaata

SEQ ID NO: 32480 - DNA, 30 bp, Homo sapiens
tacggtgcacagggaatggcctggatggag

SEQ ID NO: 32481 - DNA, 30 bp, Homo sapiens
acgcgggcctgggtgatatccgatgttttc

SEQ ID NO: 32482 - DNA, 30 bp, Homo sapiens
taggggtcccgttctttcttaactttgatg

SEQ ID NO: 32483 - DNA, 30 bp, Homo sapiens
gcaaggatggttgcaatttccccttgcata

SEQ ID NO: 32484 - DNA, 30 bp, Homo sapiens
caagggtctctctcctttttcactttaaca

SEQ ID NO: 32485 - DNA, 30 bp, Homo sapiens
tattggttgaggtggtggggaacagggggg

SEQ ID NO: 32486 - DNA, 30 bp, Homo sapiens
cccagggccctggaaatccatgccctccac

SEQ ID NO: 32487 - DNA, 30 bp, Homo sapiens
tggcggatagatctgtggtaatcttctgga

SEQ ID NO: 32488 - DNA, 30 bp, Homo sapiens
tattgcatgccagctgggtgcataggccag

SEQ ID NO: 32489 - DNA, 30 bp, Homo sapiens
tactggggaggcagggcagggggcagttgc

SEQ ID NO: 32490 - DNA, 30 bp, Homo sapiens
aggcgggctgctccagctccataaggaagc

SEQ ID NO: 32491 - DNA, 30 bp, Homo sapiens
agacggtgatctgttggttttctctgaaaa

SEQ ID NO: 32492 - DNA, 30 bp, Homo sapiens
accagggacagaatggctgcctgctgctct

SEQ ID NO: 32493 - DNA, 30 bp, Homo sapiens
gtccagaatgtacttaagaaggaggccgag

SEQ ID NO: 32494 - DNA, 30 bp, Homo sapiens
cagatttacgtatagttttcttctggaagg

SEQ ID NO: 32495 - DNA, 30 bp, Homo sapiens
ccttctggagattttccaggacattttctc

SEQ ID NO: 32496 - DNA, 30 bp, Homo sapiens
cactgggcaggctcagggggtgccagcaca

SEQ ID NO: 32497 - DNA, 30 bp, Homo sapiens
tgacggtcctctggctgcttctggaaactg

SEQ ID NO: 32498 - DNA, 30 bp, Homo sapiens
tcaagtggtgggacaagaagtcaatgctgg

SEQ ID NO: 32499 - DNA, 30 bp, Homo sapiens
tcttttgggagagtcgaactgattatcacg

SEQ ID NO: 32500 - DNA, 30 bp, Homo sapiens
aggcggacgggagggctgctaggatccgcg

SEQ ID NO: 32501 - DNA, 30 bp, Homo sapiens
tataggtagggctggacgcccccgccaacc

SEQ ID NO: 32502 - DNA, 30 bp, Homo sapiens
agaccagggcggcgtccagatggttctggg

SEQ ID NO: 32503 - DNA, 30 bp, Homo sapiens
caggcgcagaagggtttgccgccggccttg

SEQ ID NO: 32504 - DNA, 30 bp, Homo sapiens
taaatgtcggacatacctttcttcaattca

SEQ ID NO: 32505 - DNA, 30 bp, Homo sapiens
gggtactggcactgcactacaggctcgctc

SEQ ID NO: 32506 - DNA, 30 bp, Homo sapiens
ccacaagtccctttgatgtttgggttattg

SEQ ID NO: 32507 - DNA, 30 bp, Homo sapiens
cgcaactgtctgtgaggcggatctgccctt

SEQ ID NO: 32508 - DNA, 30 bp, Homo sapiens
cacaggagcagccttgctgtgcttgaggat

SEQ ID NO: 32509 - DNA, 30 bp, Homo sapiens
cttttttgggttcttgtttcaatttgtaat

SEQ ID NO: 32510 - DNA, 30 bp, Homo sapiens
tgctggaaacagcacagatttggagcagtg

SEQ ID NO: 32511 - DNA, 30 bp, Homo sapiens
tcgatgcattaaggctaatgtttctcattc

SEQ ID NO: 32512 - DNA, 30 bp, Homo sapiens
gctccgcccgccaggctctgtgccgcctcc

SEQ ID NO: 32513 - DNA, 30 bp, Homo sapiens
gccaggcggggcagccctcggcgggctcgg

SEQ ID NO: 32514 - DNA, 30 bp, Homo sapiens
gtctgtagggggattccgggctaggtgctc

SEQ ID NO: 32515 - DNA, 30 bp, Homo sapiens
gcctcaataggactggctaccatgctgtta

SEQ ID NO: 32516 - DNA, 30 bp, Homo sapiens
cacgtctccacgggactcggcaccatactg

SEQ ID NO: 32517 - DNA, 30 bp, Homo sapiens
agaaggaggtgaggaagaagaagaggagga

SEQ ID NO: 32518 - DNA, 30 bp, Homo sapiens
gtctgcctgtagttgccattaatctcctgg

SEQ ID NO: 32519 - DNA, 30 bp, Homo sapiens
ccctggcctcttggaactgcttgatgtagt

SEQ ID NO: 32520 - DNA, 30 bp, Homo sapiens
ccttggcctcctgcaactgtgctaggtact

SEQ ID NO: 32521 - DNA, 30 bp, Homo sapiens
ctcacagctgtccacatcttgatcatgcat

SEQ ID NO: 32522 - DNA, 30 bp, Homo sapiens
ctttggaaagcagacccgactctggagcac

SEQ ID NO: 32523 - DNA, 30 bp, Homo sapiens
cagtggaggagggagttctggccttggaag

SEQ ID NO: 32524 - DNA, 30 bp, Homo sapiens
cttaaactctcctgtagcttctgatcatcc

SEQ ID NO: 32525 - DNA, 30 bp, Homo sapiens
ctccgggaaagatcatcaaagtcaatgtct

SEQ ID NO: 32526 - DNA, 30 bp, Homo sapiens
atttggggtgtggaggtggaaggatgcata

SEQ ID NO: 32527 - DNA, 30 bp, Homo sapiens
accccaggagccttctggcttcttcacttt

SEQ ID NO: 32528 - DNA, 30 bp, Homo sapiens
atcctcaatccagtgaggcaccgacaggaa

SEQ ID NO: 32529 - DNA, 30 bp, Homo sapiens
aggtggtgggcattgggggctcctcttgca

SEQ ID NO: 32530 - DNA, 30 bp, Homo sapiens
gtttcttctatggcaaacaacagcttttcc

SEQ ID NO: 32531 - DNA, 30 bp, Homo sapiens
aatgtaaaatgccaattattgccaagatga

SEQ ID NO: 32532 - DNA, 30 bp, Homo sapiens
cggtgggcttcttgtcgtttttctctatca

SEQ ID NO: 32533 - DNA, 30 bp, Homo sapiens
aggtgggatcctggaggcttgagggagcac

SEQ ID NO: 32534 - DNA, 30 bp, Homo sapiens
tgctaaaatgagcagcattaacagcaacaa

SEQ ID NO: 32535 - DNA, 30 bp, Homo sapiens
ctcagggattttcttatgggcaaagaagcc

SEQ ID NO: 32536 - DNA, 30 bp, Homo sapiens
tccagcactttgggggtggggtccagacca

SEQ ID NO: 32537 - DNA, 30 bp, Homo sapiens
ctgtggtctcatcaatctcatctggatttt

SEQ ID NO: 32538 - DNA, 30 bp, Homo sapiens
ctccccctcttcatcatcttcttccagggg

SEQ ID NO: 32539 - DNA, 30 bp, Homo sapiens
cagtagtcgtcggtcagcctctctgtctct

SEQ ID NO: 32540 - DNA, 30 bp, Homo sapiens
gtctcttctgttttcttcttgtaggataga

SEQ ID NO: 32541 - DNA, 30 bp, Homo sapiens
tctgtacttgctgatgctaccttgataaca

SEQ ID NO: 32542 - DNA, 30 bp, Homo sapiens
cagaggtggctggaggcttgagctgagctt

SEQ ID NO: 32543 - DNA, 30 bp, Homo sapiens
tatgagtagctttcattttcgttccacttt

SEQ ID NO: 32544 - DNA, 30 bp, Homo sapiens
tttatcagatggctgagcatggatctcagc

SEQ ID NO: 32545 - DNA, 30 bp, Homo sapiens
aggcggtgcctggccctggatgcccatcgg

SEQ ID NO: 32546 - DNA, 30 bp, Homo sapiens
ctcaggggtcttgtcatttgtcagctgttc

SEQ ID NO: 32547 - DNA, 30 bp, Homo sapiens
cactggtttttctggacccagtcccaactg

SEQ ID NO: 32548 - DNA, 30 bp, Homo sapiens
atttggggccacacagctgaaatcgtcccc

SEQ ID NO: 32549 - DNA, 30 bp, Homo sapiens
tctcttcttcgagcagattctctgatttca

SEQ ID NO: 32550 - DNA, 30 bp, Homo sapiens
caccaccactctcagagtccttctcatgga

SEQ ID NO: 32551 - DNA, 30 bp, Homo sapiens
tactggggttcggcccccgggggaccccct

SEQ ID NO: 32552 - DNA, 30 bp, Homo sapiens
ccattttcatgaggttgaagctgctccctt

SEQ ID NO: 32553 - DNA, 30 bp, Homo sapiens
cactgggcgggctgggggtctgtgtcccgt

SEQ ID NO: 32554 - DNA, 30 bp, Homo sapiens
ctgagggtaatggggagtgggcgggctggg

SEQ ID NO: 32555 - DNA, 30 bp, Homo sapiens
ttacgtccgtagtttggattcttgaaatta

SEQ ID NO: 32556 - DNA, 30 bp, Homo sapiens
tacttcggattgaccacagttgttacggca

SEQ ID NO: 32557 - DNA, 30 bp, Homo sapiens
cggtggataaaaccttgcaaatggcttgtg

SEQ ID NO: 32558 - DNA, 30 bp, Homo sapiens
ttgcttcctcctcttcctcctcctctgtcc

SEQ ID NO: 32559 - DNA, 30 bp, Homo sapiens
tctcagcaaacttggggttcatgaccgtcg

SEQ ID NO: 32560 - DNA, 30 bp, Homo sapiens
ccccggtacgtgatattggtgaaggtagac

SEQ ID NO: 32561 - DNA, 30 bp, Homo sapiens
agattttcaagctctctactgccctccaaa

SEQ ID NO: 32562 - DNA, 30 bp, Homo sapiens
agttggtgctcatggtgagtgcatttcttc

SEQ ID NO: 32563 - DNA, 30 bp, Homo sapiens
gtttggaagaactgttggtccatgtgggtg

SEQ ID NO: 32564 - DNA, 30 bp, Homo sapiens
tgccattgtaggatttgttgaacttgttga

SEQ ID NO: 32565 - DNA, 30 bp, Homo sapiens
ctgtggaaaggtctaccttttgtttttccc

SEQ ID NO: 32566 - DNA, 30 bp, Homo sapiens
gagagtgggactgtctgcctcttgaaagcg

SEQ ID NO: 32567 - DNA, 30 bp, Homo sapiens
cgtcggtaggtgactgctcttgtgcaaaca

SEQ ID NO: 32568 - DNA, 30 bp, Homo sapiens
cagatttcacatgcatttccattccatcca

SEQ ID NO: 32569 - DNA, 30 bp, Homo sapiens
tgtcggggacgatataatcagtgtaggcac

SEQ ID NO: 32570 - DNA, 30 bp, Homo sapiens
aggccgtttgagaaagctgtagagctgagg

SEQ ID NO: 32571 - DNA, 30 bp, Homo sapiens
aacaggttggggacaatgtagtcagtgtgg

SEQ ID NO: 32572 - DNA, 30 bp, Homo sapiens
accagcaggaaatctccactcccgggggcc

SEQ ID NO: 32573 - DNA, 30 bp, Homo sapiens
tgctggcaaaaggaaatttcatgacatttg

SEQ ID NO: 32574 - DNA, 30 bp, Homo sapiens
ccctggacattccccggccaagtgtcatcc

SEQ ID NO: 32575 - DNA, 30 bp, Homo sapiens
cacaggacataggagaggtaggggtggccc

SEQ ID NO: 32576 - DNA, 30 bp, Homo sapiens
tctgcaatttcagccagttgacgcagcagt

SEQ ID NO: 32577 - DNA, 30 bp, Homo sapiens
ttatctcacggctgctgctgtaaccaacat

SEQ ID NO: 32578 - DNA, 30 bp, Homo sapiens
ccgttatctcccgactgcagctgctcttaa

SEQ ID NO: 32579 - DNA, 30 bp, Homo sapiens
actcttgacagatcttggtctcaacaataa

SEQ ID NO: 32580 - DNA, 30 bp, Homo sapiens
tgcgaaacaattgctggcttcacgtttctg

SEQ ID NO: 32581 - DNA, 30 bp, Homo sapiens
accaccccgcagatgagcgtctccaccacg

SEQ ID NO: 32582 - DNA, 30 bp, Homo sapiens
cagggggtgcctgcccgatgcgggaggttt

SEQ ID NO: 32583 - DNA, 30 bp, Homo sapiens
tgccaaagtactcctgcagctccagcaggg

SEQ ID NO: 32584 - DNA, 30 bp, Homo sapiens
tactgccactccacccccactctggggagg

SEQ ID NO: 32585 - DNA, 30 bp, Homo sapiens
agtcggtcttccagccttctataaagcaca

SEQ ID NO: 32586 - DNA, 30 bp, Homo sapiens
tactgggaggaggccttggtggccagggag

SEQ ID NO: 32587 - DNA, 30 bp, Homo sapiens
ctctcagccaggctggccaggatgccaatg

SEQ ID NO: 32588 - DNA, 30 bp, Homo sapiens
gagtggggcatcctgggacatctcggtcag

SEQ ID NO: 32589 - DNA, 30 bp, Homo sapiens
cctgcaggaggcagatcatgttgtccaggc

SEQ ID NO: 32590 - DNA, 30 bp, Homo sapiens
ttgtgggttgacattcatgtgaggaggatg

SEQ ID NO: 32591 - DNA, 30 bp, Homo sapiens
gtgtggtggcatgtgatgattcacatgggg

SEQ ID NO: 32592 - DNA, 30 bp, Homo sapiens
cagcggctaatgcagttctggacatccaca

SEQ ID NO: 32593 - DNA, 30 bp, Homo sapiens
ttttggggtaggctggtctgaggggacatg

SEQ ID NO: 32594 - DNA, 30 bp, Homo sapiens
cagtggggcatgaggcagagttttcacctg

SEQ ID NO: 32595 - DNA, 30 bp, Homo sapiens
tcaaggaagccctgggtgcgctgactccgg

SEQ ID NO: 32596 - DNA, 30 bp, Homo sapiens
gcttgggtccatgtctgtggtcagcttcac

SEQ ID NO: 32597 - DNA, 30 bp, Homo sapiens
gctcatcaaacaactgcaggtccaagcgga

SEQ ID NO: 32598 - DNA, 30 bp, Homo sapiens
tacaggagagttttttgctcaaaaagctgc

SEQ ID NO: 32599 - DNA, 30 bp, Homo sapiens
gagctagccagcagcagcctcctcacctcg

SEQ ID NO: 32600 - DNA, 30 bp, Homo sapiens
accccgttgatctctccttgccaccaatca

SEQ ID NO: 32601 - DNA, 30 bp, Homo sapiens
tgaaggctctgccgatgaccagccgcctca

SEQ ID NO: 32602 - DNA, 30 bp, Homo sapiens
gtttgggtggccactgcacctcctgcttct

SEQ ID NO: 32603 - DNA, 30 bp, Homo sapiens
tcaaggttatagacttccaccgtattcaga

SEQ ID NO: 32604 - DNA, 30 bp, Homo sapiens
caatggcattttgttgccctcaatgctgat

SEQ ID NO: 32605 - DNA, 30 bp, Homo sapiens
ccttcaggataatttttccaaaaacctgca

SEQ ID NO: 32606 - DNA, 30 bp, Homo sapiens
tacactgtcaccatgatctggtccagaggt

SEQ ID NO: 32607 - DNA, 30 bp, Homo sapiens
gtgcggggcggcccaggagcaccctcagtc

SEQ ID NO: 32608 - DNA, 30 bp, Homo sapiens
atctgtggccttttcttttgggacctgggt

SEQ ID NO: 32609 - DNA, 30 bp, Homo sapiens
tccaggatcatgtcttccatttgaggaact

SEQ ID NO: 32610 - DNA, 30 bp, Homo sapiens
aacagggagcagaccatgatggtgtaggac

SEQ ID NO: 32611 - DNA, 30 bp, Homo sapiens
aggcagcggttgcagtgagccaaggtcgca

SEQ ID NO: 32612 - DNA, 30 bp, Homo sapiens
tactgcagcaggagttttcggttttgtctg

SEQ ID NO: 32613 - DNA, 30 bp, Homo sapiens
tctcatctatcttccccattaattcttcaa

SEQ ID NO: 32614 - DNA, 30 bp, Homo sapiens
ccaaggtcaggttggccaagtgtgggggct

SEQ ID NO: 32615 - DNA, 30 bp, Homo sapiens
tgcttctcctgataatgtctgtccttctgc

SEQ ID NO: 32616 - DNA, 30 bp, Homo sapiens
tccaggtcctgccgcaggtgcgtgaacagc

SEQ ID NO: 32617 - DNA, 30 bp, Homo sapiens
aggaggccagtacgcccatgcggaccacct

SEQ ID NO: 32618 - DNA, 30 bp, Homo sapiens
cattgaactgtgggaaaggggatgtgtctt

SEQ ID NO: 32619 - DNA, 30 bp, Homo sapiens
attcggtttaagctctgggcactttccaag

SEQ ID NO: 32620 - DNA, 30 bp, Homo sapiens
ctccttgccggcgtagcgggcctcattgat

SEQ ID NO: 32621 - DNA, 30 bp, Homo sapiens
tgctggtgaaccaagagtctaggagcttct

SEQ ID NO: 32622 - DNA, 30 bp, Homo sapiens
ataaggttctgaaagcttgtccgattggat

SEQ ID NO: 32623 - DNA, 30 bp, Homo sapiens
atgttatcccttatttgatccactcgaaga

SEQ ID NO: 32624 - DNA, 30 bp, Homo sapiens
aaaaggacagggagtggtgtttgccctctg

SEQ ID NO: 32625 - DNA, 30 bp, Homo sapiens
ccttggcgtcttgcatttcattcttcagct

SEQ ID NO: 32626 - DNA, 30 bp, Homo sapiens
aatgaatgctagtgagaaaaacaaaaaaag

SEQ ID NO: 32627 - DNA, 30 bp, Homo sapiens
aataaaggcaagagagaagaacaagaatag

SEQ ID NO: 32628 - DNA, 30 bp, Homo sapiens
tttcggttactcttttcttctaagtctttt

SEQ ID NO: 32629 - DNA, 30 bp, Homo sapiens
aatgaaagctaaggagaaaaataagaacaa

SEQ ID NO: 32630 - DNA, 30 bp, Homo sapiens
ctctgttgtttctgaaaatcttcctccaga

SEQ ID NO: 32631 - DNA, 30 bp, Homo sapiens
gatccgcccgccgcggccttccaaagtgct

SEQ ID NO: 32632 - DNA, 30 bp, Homo sapiens
ctctgagcatagcatacaccaaggccacaa

SEQ ID NO: 32633 - DNA, 30 bp, Homo sapiens
cgtcagtgcggatgtagttaactccatctg

SEQ ID NO: 32634 - DNA, 30 bp, Homo sapiens
aaaaggcttgctgtgtttttggcattcccc

SEQ ID NO: 32635 - DNA, 30 bp, Homo sapiens
ttttggatgaactggaggctgacagacggg

SEQ ID NO: 32636 - DNA, 30 bp, Homo sapiens
aatctcagccgacaccgggggatggaaatt

SEQ ID NO: 32637 - DNA, 30 bp, Homo sapiens
ccactctgctagggtcataggaatctgggc

SEQ ID NO: 32638 - DNA, 30 bp, Homo sapiens
atctggggttaaggctgtttccaccatttt

SEQ ID NO: 32639 - DNA, 30 bp, Homo sapiens
cagtgggttgccttctgactcgggggtctt

SEQ ID NO: 32640 - DNA, 30 bp, Homo sapiens
ccaactgcctgaagcacggttaaaattggg

SEQ ID NO: 32641 - DNA, 30 bp, Homo sapiens
cattggctccttctgagagtatccttgaag

SEQ ID NO: 32642 - DNA, 30 bp, Homo sapiens
cctctacttcatcctcgtgtatcttcaagg

SEQ ID NO: 32643 - DNA, 30 bp, Homo sapiens
tatggggccgcagcagcatcaacagcctct

SEQ ID NO: 32644 - DNA, 30 bp, Homo sapiens
acctggaggagctgcgctctttgctgacac

SEQ ID NO: 32645 - DNA, 30 bp, Homo sapiens
caggggtgagcccggcctccacaagtgtcc

SEQ ID NO: 32646 - DNA, 30 bp, Homo sapiens
gtcaaggcctgaagccttggtgagggagtc

SEQ ID NO: 32647 - DNA, 30 bp, Homo sapiens
cagctgccgcctcctcgggtgtccgccgga

SEQ ID NO: 32648 - DNA, 30 bp, Homo sapiens
cagtggggcctgcgctgccgcctccgctgc

SEQ ID NO: 32649 - DNA, 30 bp, Homo sapiens
cagcggtcggggaagtacagcaccagcccg

SEQ ID NO: 32650 - DNA, 30 bp, Homo sapiens
ccgaggaaggtggagatgaagacgctggtg

SEQ ID NO: 32651 - DNA, 30 bp, Homo sapiens
ctgtgcaaggtaaagcctcctcttcgtcct

SEQ ID NO: 32652 - DNA, 30 bp, Homo sapiens
catcggtcctccaactctgatgagcctcta

SEQ ID NO: 32653 - DNA, 30 bp, Homo sapiens
ccagctgcccttctcctccacctccttggt

SEQ ID NO: 32654 - DNA, 30 bp, Homo sapiens
cgatattcaacagcatgacaaggacaatca

SEQ ID NO: 32655 - DNA, 30 bp, Homo sapiens
tcagcataggtctcggtgccatagccgtct

SEQ ID NO: 32656 - DNA, 30 bp, Homo sapiens
gtcaggaggtgaacaaagaggatggccagg

SEQ ID NO: 32657 - DNA, 30 bp, Homo sapiens
ttgagcaagatcaccatgaccaccaggata

SEQ ID NO: 32658 - DNA, 30 bp, Homo sapiens
ctgaggagtggatatcggagagtccaggca

SEQ ID NO: 32659 - DNA, 30 bp, Homo sapiens
agatgggcctccctcctccctccagcagcc

SEQ ID NO: 32660 - DNA, 30 bp, Homo sapiens
gtgaggagctgggagaacaggaatgccagg

SEQ ID NO: 32661 - DNA, 30 bp, Homo sapiens
cactgggcaaacgtcaaaggaggaagcgaa

SEQ ID NO: 32662 - DNA, 30 bp, Homo sapiens
acgaggctggacttgccgccagggggattt

SEQ ID NO: 32663 - DNA, 30 bp, Homo sapiens
gatgtacagtcaggctcaagttgtgcagtt

SEQ ID NO: 32664 - DNA, 30 bp, Homo sapiens
cccaggctgcctggcaagtctgtgtccaca

SEQ ID NO: 32665 - DNA, 30 bp, Homo sapiens
agaaggagatgctggatttgcctcccggtg

SEQ ID NO: 32666 - DNA, 30 bp, Homo sapiens
tagaggcctccaggcagcacttaggaattg

SEQ ID NO: 32667 - DNA, 30 bp, Homo sapiens
gttgtcacctgctgtggatgagcagggcaa

SEQ ID NO: 32668 - DNA, 30 bp, Homo sapiens
tatcaggtagaatcatatcaccttgttgtt

SEQ ID NO: 32669 - DNA, 30 bp, Homo sapiens
cagtcccgccccttgcctgcgcggagcttc

SEQ ID NO: 32670 - DNA, 30 bp, Homo sapiens
atatggactcgatttgcttccggacctttt

SEQ ID NO: 32671 - DNA, 30 bp, Homo sapiens
agttggcacccactgttaacgtggttcatg

SEQ ID NO: 32672 - DNA, 30 bp, Homo sapiens
agaaggcgtgtcccttgaccccaagcagca

SEQ ID NO: 32673 - DNA, 30 bp, Homo sapiens
acgcgggcacctggtgctggggcagcagct

SEQ ID NO: 32674 - DNA, 30 bp, Homo sapiens
aggccagcatgtggtctgcagtggggtacg

SEQ ID NO: 32675 - DNA, 30 bp, Homo sapiens
cttctctttcacctgtggattcgtcagttt

SEQ ID NO: 32676 - DNA, 30 bp, Homo sapiens
actactttctgctgctgtggctttggtgag

SEQ ID NO: 32677 - DNA, 30 bp, Homo sapiens
aagtggagaaaggatctccaggtcccaggt

SEQ ID NO: 32678 - DNA, 30 bp, Homo sapiens
ccttggttcacccggttgacaatgtagctc

SEQ ID NO: 32679 - DNA, 30 bp, Homo sapiens
cggtgggtggggccaggagacgtcttcctt

SEQ ID NO: 32680 - DNA, 30 bp, Homo sapiens
ccgaggatgatgtagggctctcgtcatctg

SEQ ID NO: 32681 - DNA, 30 bp, Homo sapiens
acctgggggttctctccattgtcaccgcat

SEQ ID NO: 32682 - DNA, 30 bp, Homo sapiens
cagccccagggacctgccctgctccgcgtg

SEQ ID NO: 32683 - DNA, 30 bp, Homo sapiens
catctgtgagtcgggcgctgagctgtggct

SEQ ID NO: 32684 - DNA, 30 bp, Homo sapiens
caaaggttttgtattcttccattccatctg

SEQ ID NO: 32685 - DNA, 30 bp, Homo sapiens
ttctggcttcccatttgcagtagccaatcc

SEQ ID NO: 32686 - DNA, 30 bp, Homo sapiens
tgctggaggcaggcgctgtgagctggaggg

SEQ ID NO: 32687 - DNA, 30 bp, Homo sapiens
agctggagggcagcacctgggaagaggact

SEQ ID NO: 32688 - DNA, 30 bp, Homo sapiens
gttgtgctttccagtgtatcagtggttgct

SEQ ID NO: 32689 - DNA, 30 bp, Homo sapiens
cgccggagcctcagaaagaatgcgtgttta

SEQ ID NO: 32690 - DNA, 30 bp, Homo sapiens
tgtcaatgaggcctccctccttgagcttga

SEQ ID NO: 32691 - DNA, 30 bp, Homo sapiens
tccaggatattggcacatttgtagtattca

SEQ ID NO: 32692 - DNA, 30 bp, Homo sapiens
ccccctcttgctccagtccttgggagtgaa

SEQ ID NO: 32693 - DNA, 30 bp, Homo sapiens
gtaaggtccgttgagtgactgcttgggcac

SEQ ID NO: 32694 - DNA, 30 bp, Homo sapiens
tcctggcactgtggctcttcgttttctcct

SEQ ID NO: 32695 - DNA, 30 bp, Homo sapiens
catgtaggagccattgagagactgtttgga

SEQ ID NO: 32696 - DNA, 30 bp, Homo sapiens
ccttgggaggggtccattttaagcagctgg

SEQ ID NO: 32697 - DNA, 30 bp, Homo sapiens
ataaggaggccttgactcctaccagtccat

SEQ ID NO: 32698 - DNA, 30 bp, Homo sapiens
tcttggagagcttgacttgcttgtgcttgg

SEQ ID NO: 32699 - DNA, 30 bp, Homo sapiens
cgaaatcctccatagttgtaggcatgtgca

SEQ ID NO: 32700 - DNA, 30 bp, Homo sapiens
ggcaaaggaatatagattcgtttctcaagg

SEQ ID NO: 32701 - DNA, 30 bp, Homo sapiens
ctgcagcagagacagacttagcaattttct

SEQ ID NO: 32702 - DNA, 30 bp, Homo sapiens
caggggtttccgcttcttgcgtcttcctca

SEQ ID NO: 32703 - DNA, 30 bp, Homo sapiens
gcatgaaaatggactagtacactttttttt

SEQ ID NO: 32704 - DNA, 30 bp, Homo sapiens
ttgcaggcagggaggacagcttcttcctgg

SEQ ID NO: 32705 - DNA, 30 bp, Homo sapiens
tgagtatctctgagccagattctttgcgga

SEQ ID NO: 32706 - DNA, 30 bp, Homo sapiens
tccagactggccatgagcaggtgcagctcg

SEQ ID NO: 32707 - DNA, 30 bp, Homo sapiens
tatcctggaaccaaagtaagatggttttcc

SEQ ID NO: 32708 - DNA, 30 bp, Homo sapiens
agtaatcgtcattctcttcactctcagcct

SEQ ID NO: 32709 - DNA, 30 bp, Homo sapiens
atatggatgtgacacgatctggggccctgg

SEQ ID NO: 32710 - DNA, 30 bp, Homo sapiens
cgcgtcctcctctatgtaataatcaggggc

SEQ ID NO: 32711 - DNA, 30 bp, Homo sapiens
acgttggtgacctccaggctgttgtagcct

SEQ ID NO: 32712 - DNA, 30 bp, Homo sapiens
tacggggcgccctgctcccctcggggcggc

SEQ ID NO: 32713 - DNA, 30 bp, Homo sapiens
tgctcattgccttcttccaccaaatctgaa

SEQ ID NO: 32714 - DNA, 30 bp, Homo sapiens
tcgaagtcacaggcccaggagcgccaggag

SEQ ID NO: 32715 - DNA, 30 bp, Homo sapiens
tatacaggtggtagtgcaaccatttctcca

SEQ ID NO: 32716 - DNA, 30 bp, Homo sapiens
cattggtgaaacttcttcccattcagacct

SEQ ID NO: 32717 - DNA, 30 bp, Homo sapiens
gccaacacaaactgcaaattggtaagcagc

SEQ ID NO: 32718 - DNA, 30 bp, Homo sapiens
ctgaggcgctacacgcacccaaaaatcatc

SEQ ID NO: 32719 - DNA, 30 bp, Homo sapiens
tgatcctgtgcatttcgctgaggtgctact

SEQ ID NO: 32720 - DNA, 30 bp, Homo sapiens
ctgaggatacagtttagcaacagcacattc

SEQ ID NO: 32721 - DNA, 30 bp, Homo sapiens
aagaggaggtggtggaggctcatttccttt

SEQ ID NO: 32722 - DNA, 30 bp, Homo sapiens
ttttggttagcagtggtgcaattggcagtt

SEQ ID NO: 32723 - DNA, 30 bp, Homo sapiens
cttctctgtggaacagccaccattggtctt

SEQ ID NO: 32724 - DNA, 30 bp, Homo sapiens
ccaaggtacagttggctgttttcaagtttt

SEQ ID NO: 32725 - DNA, 30 bp, Homo sapiens
caatgtagttacagctggtgtctgcctgtc

SEQ ID NO: 32726 - DNA, 30 bp, Homo sapiens
agttgggattattgttcgtggtgcaggtgg

SEQ ID NO: 32727 - DNA, 30 bp, Homo sapiens
cctttgcattagaacagttgtttttatctg

SEQ ID NO: 32728 - DNA, 30 bp, Homo sapiens
acaaatctgtttcccggctggtgtccaggc

SEQ ID NO: 32729 - DNA, 30 bp, Homo sapiens
tgagcattcttttctctgcataggcccgat

SEQ ID NO: 32730 - DNA, 30 bp, Homo sapiens
acttcggtgaccaggtgtttccctgggggt

SEQ ID NO: 32731 - DNA, 30 bp, Homo sapiens
tgctgtagggcttgttgcgcagtatgttat

SEQ ID NO: 32732 - DNA, 30 bp, Homo sapiens
tgtagggtttattgcccaaaatactatcaa

SEQ ID NO: 32733 - DNA, 30 bp, Homo sapiens
tcttggaatgcggcttgtttcccaggagcc

SEQ ID NO: 32734 - DNA, 30 bp, Homo sapiens
ccatgggctcctccccctggcaacacacgg

SEQ ID NO: 32735 - DNA, 30 bp, Homo sapiens
tgctggtttcacgtgtgggacaataacctg

SEQ ID NO: 32736 - DNA, 30 bp, Homo sapiens
aagaggtttcctacctgctctgttaatttc

SEQ ID NO: 32737 - DNA, 30 bp, Homo sapiens
caagtcactctcacagcctctgtcggcata

SEQ ID NO: 32738 - DNA, 30 bp, Homo sapiens
tagtccttggtatggctaaattccactgtc

SEQ ID NO: 32739 - DNA, 30 bp, Homo sapiens
tccaggtgatgtaggatggaatgcccattt

SEQ ID NO: 32740 - DNA, 30 bp, Homo sapiens
ggatgggagatcgagagcgcctcagaggac

SEQ ID NO: 32741 - DNA, 30 bp, Homo sapiens
cctcggcttgcgtgtaaccagtaatgacaa

SEQ ID NO: 32742 - DNA, 30 bp, Homo sapiens
tagggggatatccaggccgcggcgttggcg

SEQ ID NO: 32743 - DNA, 30 bp, Homo sapiens
atgtggcaggaacagagtcccagcagttgg

SEQ ID NO: 32744 - DNA, 30 bp, Homo sapiens
taagagagggtgaggacttcagcctgggca

SEQ ID NO: 32745 - DNA, 30 bp, Homo sapiens
cacagggatgagatcttgacagtctcgggg

SEQ ID NO: 32746 - DNA, 30 bp, Homo sapiens
gagtactcaggggattctggcctatcgtct

SEQ ID NO: 32747 - DNA, 30 bp, Homo sapiens
acaaggcggagaccttgacaacattgctgg

SEQ ID NO: 32748 - DNA, 30 bp, Homo sapiens
catggggaaggcttcgtctcaggaaggtgt

SEQ ID NO: 32749 - DNA, 30 bp, Homo sapiens
cagggggacattttgaacccagccgcacca

SEQ ID NO: 32750 - DNA, 30 bp, Homo sapiens
acacggttcttgatatacacatgatagggg

SEQ ID NO: 32751 - DNA, 30 bp, Homo sapiens
tgatggatgttctccgaggacccttcgctg

SEQ ID NO: 32752 - DNA, 30 bp, Homo sapiens
cagcgccctgggcgagggcaggcagcccct

SEQ ID NO: 32753 - DNA, 30 bp, Homo sapiens
acttgcaactctggagccgggtcctgtggt

SEQ ID NO: 32754 - DNA, 30 bp, Homo sapiens
ctctggtgtccgaggaggcacttccgaaca

SEQ ID NO: 32755 - DNA, 30 bp, Homo sapiens
ccgcacccacagcgcatccgcggagtcgtc

SEQ ID NO: 32756 - DNA, 30 bp, Homo sapiens
gagaggctcctactatacctagcagatcta

SEQ ID NO: 32757 - DNA, 30 bp, Homo sapiens
gataggcaaggctgggccctccaggattag

SEQ ID NO: 32758 - DNA, 30 bp, Homo sapiens
agctggctccaaaaatgtctctctctgatt

SEQ ID NO: 32759 - DNA, 30 bp, Homo sapiens
ttgtggcggatcctgaagggaaggagaatg

SEQ ID NO: 32760 - DNA, 30 bp, Homo sapiens
taactgcccgggtccgagccgtgtctgtgc

SEQ ID NO: 32761 - DNA, 30 bp, Homo sapiens
tgccttcttcctgggtccactggactgtgc

SEQ ID NO: 32762 - DNA, 30 bp, Homo sapiens
cagtggaacgtgtctgacctggactggaaa

SEQ ID NO: 32763 - DNA, 30 bp, Homo sapiens
cctcatcatcctggatgacttccaaggatc

SEQ ID NO: 32764 - DNA, 30 bp, Homo sapiens
ttcaggccttgagacactaaaaatatcctg

SEQ ID NO: 32765 - DNA, 30 bp, Homo sapiens
cagtggccccaactccctgcaaatccagga

SEQ ID NO: 32766 - DNA, 30 bp, Homo sapiens
ttttggctatcactataatgcctgcggcac

SEQ ID NO: 32767 - DNA, 30 bp, Homo sapiens
aagaccaggatcagaaacatgcctatgaag

SEQ ID NO: 32768 - DNA, 30 bp, Homo sapiens
cagtggaaggttctccaaaggttttgtaga

SEQ ID NO: 32769 - DNA, 30 bp, Homo sapiens
agctggagagacctcatgatgttgtcgtcc

SEQ ID NO: 32770 - DNA, 30 bp, Homo sapiens
tccaggtcagggtaatgtagagggcaggga

SEQ ID NO: 32771 - DNA, 30 bp, Homo sapiens
gcatggacctcatgatgttctcatcctttt

SEQ ID NO: 32772 - DNA, 30 bp, Homo sapiens
tgacattctcaaacagctgcatggagctca

SEQ ID NO: 32773 - DNA, 30 bp, Homo sapiens
gcatggagcgcattatgttttcatcttttt

SEQ ID NO: 32774 - DNA, 30 bp, Homo sapiens
agttggggttgtcatagcctctcttcatcc

SEQ ID NO: 32775 - DNA, 30 bp, Homo sapiens
ctaagggcactgccctccttctcagcttgc

SEQ ID NO: 32776 - DNA, 30 bp, Homo sapiens
gacagggaatctggagagatgctgaacttg

SEQ ID NO: 32777 - DNA, 30 bp, Homo sapiens
tgtagggccgctgctccaggaccccgccgc

SEQ ID NO: 32778 - DNA, 30 bp, Homo sapiens
atgtggatatccaggtcagtcctgtttggg

SEQ ID NO: 32779 - DNA, 30 bp, Homo sapiens
tggaggcagggtcagcgccagggttggtgt

SEQ ID NO: 32780 - DNA, 30 bp, Homo sapiens
ttctctttccctctgatcctcctgcctgta

SEQ ID NO: 32781 - DNA, 30 bp, Homo sapiens
ataaggtgtttccctatattcatgtgtggc

SEQ ID NO: 32782 - DNA, 30 bp, Homo sapiens
tctgtagggccgctgctccaggaccccgcc

SEQ ID NO: 32783 - DNA, 30 bp, Homo sapiens
ctcgccgtaagggcctgggctctagaggta

SEQ ID NO: 32784 - DNA, 30 bp, Homo sapiens
gcgcggagaccatgtggctgttgcgcaggt

SEQ ID NO: 32785 - DNA, 30 bp, Homo sapiens
gtttccacaatgccttctaggatgacgaca

SEQ ID NO: 32786 - DNA, 30 bp, Homo sapiens
catcctagctgctcctccagccatcttttg

SEQ ID NO: 32787 - DNA, 30 bp, Homo sapiens
ccgcgggtttgggggacgcaggtctcccgg

SEQ ID NO: 32788 - DNA, 30 bp, Homo sapiens
agatggcagactccctgcggtaggagatgt

SEQ ID NO: 32789 - DNA, 30 bp, Homo sapiens
acaccgagcccctggcctccctggacccac

SEQ ID NO: 32790 - DNA, 30 bp, Homo sapiens
ctttggattcattctccaggtttgccacat

SEQ ID NO: 32791 - DNA, 30 bp, Homo sapiens
ggagtcataaattgcacctttggtaccatg

SEQ ID NO: 32792 - DNA, 30 bp, Homo sapiens
ccttggactcactctctgggggtggcaggc

SEQ ID NO: 32793 - DNA, 30 bp, Homo sapiens
caatggtttgcagggccatccacgcaggca

SEQ ID NO: 32794 - DNA, 30 bp, Homo sapiens
ctccggctcccggtctttggtgtccgtggg

SEQ ID NO: 32795 - DNA, 30 bp, Homo sapiens
acctggaggcgctggtctcggccagccggt

SEQ ID NO: 32796 - DNA, 30 bp, Homo sapiens
cccactggtctctgccaacctgttgttcat

SEQ ID NO: 32797 - DNA, 30 bp, Homo sapiens
agatggacttccaccgggccccaagcctgg

SEQ ID NO: 32798 - DNA, 30 bp, Homo sapiens
cttcccagtcctttcttggatatggggaag

SEQ ID NO: 32799 - DNA, 30 bp, Homo sapiens
gcagagatggggatcttctgaggcctgggg

SEQ ID NO: 32800 - DNA, 30 bp, Homo sapiens
acctgtgcagaggaacccagccacatagga

SEQ ID NO: 32801 - DNA, 30 bp, Homo sapiens
tgcccggccagaaatctgtattttaacaag

SEQ ID NO: 32802 - DNA, 30 bp, Homo sapiens
cacagcctgcagcgtgagcagaaggttcca

SEQ ID NO: 32803 - DNA, 30 bp, Homo sapiens
ttgcaccaacttgaaagcaatgaacacaat

SEQ ID NO: 32804 - DNA, 30 bp, Homo sapiens
cagtgtggcgtcaaaccattcagatagata

SEQ ID NO: 32805 - DNA, 30 bp, Homo sapiens
acacggagctcctgcgcttcatgaggccgc

SEQ ID NO: 32806 - DNA, 30 bp, Homo sapiens
caccggcacgcctttgtctcggggacgccc

SEQ ID NO: 32807 - DNA, 30 bp, Homo sapiens
gtgcccttggggctgttagccttgttgtac

SEQ ID NO: 32808 - DNA, 30 bp, Homo sapiens
tacctggggatggaagcgtagtcggtgtgg

SEQ ID NO: 32809 - DNA, 30 bp, Homo sapiens
tccaggctcctcttcccccttcccccacac

SEQ ID NO: 32810 - DNA, 30 bp, Homo sapiens
agcaggggcttgtcctgaagctggggccgc

SEQ ID NO: 32811 - DNA, 30 bp, Homo sapiens
ccacgccgtgccctggagtgaggtccctcc

SEQ ID NO: 32812 - DNA, 30 bp, Homo sapiens
aaacggacttccggcgtttcatcagcctct

SEQ ID NO: 32813 - DNA, 30 bp, Homo sapiens
actccctggacttgggccggttctgtcggt

SEQ ID NO: 32814 - DNA, 30 bp, Homo sapiens
aaccatacatcgaaggtgtcgccagcctca

SEQ ID NO: 32815 - DNA, 30 bp, Homo sapiens
ttcctgcacgtacttctgtttgtcccggga

SEQ ID NO: 32816 - DNA, 30 bp, Homo sapiens
tcttgcccccgcagtggcagcacacggtcc

SEQ ID NO: 32817 - DNA, 30 bp, Homo sapiens
cccaaaggatttttcccttctttctgaccc

SEQ ID NO: 32818 - DNA, 30 bp, Homo sapiens
acatctagccacctcgagcgccagggaaga

SEQ ID NO: 32819 - DNA, 30 bp, Homo sapiens
ttctgggccgccaggatggacaggtactgg

SEQ ID NO: 32820 - DNA, 30 bp, Homo sapiens
gatcctctcacatagtagggagaggtactg

SEQ ID NO: 32821 - DNA, 30 bp, Homo sapiens
taagatttctctgctcttcctttgctcctc

SEQ ID NO: 32822 - DNA, 30 bp, Homo sapiens
acctggatggctgaggttcacaaacacctg

SEQ ID NO: 32823 - DNA, 30 bp, Homo sapiens
taagagaacttgcgcttcttcatggcttcc

SEQ ID NO: 32824 - DNA, 30 bp, Homo sapiens
cccgcagtccgagggggccacgggcgtcca

SEQ ID NO: 32825 - DNA, 30 bp, Homo sapiens
agttggtggtgctgtggaagaggaccgccg

SEQ ID NO: 32826 - DNA, 30 bp, Homo sapiens
gtacggggtcgggaaggaggtggagctgac

SEQ ID NO: 32827 - DNA, 30 bp, Homo sapiens
acttggactgctggctgggttctggaagct

SEQ ID NO: 32828 - DNA, 30 bp, Homo sapiens
caggacccctcatcggggcccctcctgggc

SEQ ID NO: 32829 - DNA, 30 bp, Homo sapiens
cacttcctgggcccggcccagcccacgtca

SEQ ID NO: 32830 - DNA, 30 bp, Homo sapiens
aaatggaaaataaaaaatgaaacagttgct

SEQ ID NO: 32831 - DNA, 30 bp, Homo sapiens
aaatgggcttattggaaggggtccatactg

SEQ ID NO: 32832 - DNA, 30 bp, Homo sapiens
gtccatgttggtgctgaccgagcgggagat

SEQ ID NO: 32833 - DNA, 30 bp, Homo sapiens
ctgagggcatctgtactttctcctgcctta

SEQ ID NO: 32834 - DNA, 30 bp, Homo sapiens
aggcggaggttgtggtgagccgagatcacg

SEQ ID NO: 32835 - DNA, 30 bp, Homo sapiens
ctctggtatgatgatagtctctggttttgg

SEQ ID NO: 32836 - DNA, 30 bp, Homo sapiens
ctgagggtgtggaggctcactgggggcctg

SEQ ID NO: 32837 - DNA, 30 bp, Homo sapiens
taacgtagggaatcatttaaactgagttca

SEQ ID NO: 32838 - DNA, 30 bp, Homo sapiens
cattttgctgtgcaattctccaaggaggtg

SEQ ID NO: 32839 - DNA, 30 bp, Homo sapiens
tctcggggttgcaggacgacagcttgtggc

SEQ ID NO: 32840 - DNA, 30 bp, Homo sapiens
gagaatcttgaccagtgacattgcagatgc

SEQ ID NO: 32841 - DNA, 30 bp, Homo sapiens
tagtggctctgaatatgcaaagggatcctc

SEQ ID NO: 32842 - DNA, 30 bp, Homo sapiens
atcatctcccccgctgctcctagtacttgc

SEQ ID NO: 32843 - DNA, 30 bp, Homo sapiens
ctgtgggttgcttccaagcaaacactcagc

SEQ ID NO: 32844 - DNA, 30 bp, Homo sapiens
tagggcagtaaagattattctgacccagcc

SEQ ID NO: 32845 - DNA, 30 bp, Homo sapiens
tcctggggctcccggctggggctgggccga

SEQ ID NO: 32846 - DNA, 30 bp, Homo sapiens
agtccagaggctcttgctttatccggatga

SEQ ID NO: 32847 - DNA, 30 bp, Homo sapiens
cactggtggaggtgggcccggtcatcaggg

SEQ ID NO: 32848 - DNA, 30 bp, Homo sapiens
tgccggacaaagcgcagagacctggagttg

SEQ ID NO: 32849 - DNA, 30 bp, Homo sapiens
agaagacgtactcggtgtagctggtccaga

SEQ ID NO: 32850 - DNA, 30 bp, Homo sapiens
agacaatttgttggccatgaggacgctcgt

SEQ ID NO: 32851 - DNA, 30 bp, Homo sapiens
ccgagttgagccggcagtagccattgagcg

SEQ ID NO: 32852 - DNA, 30 bp, Homo sapiens
ctcggacgctaggagacccgccagagtctg

SEQ ID NO: 32853 - DNA, 30 bp, Homo sapiens
atgttttctctcaggaaaccgatctggaat

SEQ ID NO: 32854 - DNA, 30 bp, Homo sapiens
atccgggtgcctctggcttgtaacagcttg

SEQ ID NO: 32855 - DNA, 30 bp, Homo sapiens
gtccctggaggtgatctggggcctcacatc

SEQ ID NO: 32856 - DNA, 30 bp, Homo sapiens
ctgcaagctcagcctcaggtctgagagggt

SEQ ID NO: 32857 - DNA, 30 bp, Homo sapiens
ttcttcccgttctcagtccgcactcccaag

SEQ ID NO: 32858 - DNA, 30 bp, Homo sapiens
tcctcttgtaggtactttcccaggatggag

SEQ ID NO: 32859 - DNA, 30 bp, Homo sapiens
tcctctctcctgaagaatcttcgccttttc

SEQ ID NO: 32860 - DNA, 30 bp, Homo sapiens
tcctgaaagtcgttagaagccatctgagaa

SEQ ID NO: 32861 - DNA, 30 bp, Homo sapiens
catgtgggtgagaagaatcgatgcagaagc

SEQ ID NO: 32862 - DNA, 30 bp, Homo sapiens
ctgaagaatcactttttttatgccgaggag

SEQ ID NO: 32863 - DNA, 30 bp, Homo sapiens
ctttggaacaatccaggctggtcagcagtc

SEQ ID NO: 32864 - DNA, 30 bp, Homo sapiens
catccttgagcctcgttcttgcaaaatctt

SEQ ID NO: 32865 - DNA, 30 bp, Homo sapiens
ttccgggctagcctacagaaagtccagttg

SEQ ID NO: 32866 - DNA, 30 bp, Homo sapiens
tgtgatcttgaactcatagatggggcgctt

SEQ ID NO: 32867 - DNA, 30 bp, Homo sapiens
gatcttgaactcatagatggggcgcttgca

SEQ ID NO: 32868 - DNA, 30 bp, Homo sapiens
cttctgcaacagttcagattgccattggcg

SEQ ID NO: 32869 - DNA, 30 bp, Homo sapiens
tagtggtgtcagcatctcttcaaatatagc

SEQ ID NO: 32870 - DNA, 30 bp, Homo sapiens
ctttggtctttttcctatggcaagtacaag

SEQ ID NO: 32871 - DNA, 30 bp, Homo sapiens
tgaaggctttttcctgtggcactggcagat

SEQ ID NO: 32872 - DNA, 30 bp, Homo sapiens
tgccggcaaactcaacttcttcccctttag

SEQ ID NO: 32873 - DNA, 30 bp, Homo sapiens
tgctggcaaactgagcttctttcccttgag

SEQ ID NO: 32874 - DNA, 30 bp, Homo sapiens
ttctggctcttttcctctgcgtttttacag

SEQ ID NO: 32875 - DNA, 30 bp, Homo sapiens
gattggcattggaagacttaacttctttcc

SEQ ID NO: 32876 - DNA, 30 bp, Homo sapiens
cttaggccagtgtcagcattgctgtcatcc

SEQ ID NO: 32877 - DNA, 30 bp, Homo sapiens
acctggagcaagggtgcccccgacgagtct

SEQ ID NO: 32878 - DNA, 30 bp, Homo sapiens
gcttggggactgctgtgcaggaacacctgg

SEQ ID NO: 32879 - DNA, 30 bp, Homo sapiens
aaatatgcccctgtaacagtttgtgggaaa

SEQ ID NO: 32880 - DNA, 30 bp, Homo sapiens
gacaggcagtagaggctgttgatggacaag

SEQ ID NO: 32881 - DNA, 30 bp, Homo sapiens
aaacgggtggttgaacagcttctcccttgg

SEQ ID NO: 32882 - DNA, 30 bp, Homo sapiens
tgcaggagtttttcttctacttgcccaaac

SEQ ID NO: 32883 - DNA, 30 bp, Homo sapiens
aactggattcactggctttcagcatagcaa

SEQ ID NO: 32884 - DNA, 30 bp, Homo sapiens
accttgccagtttggattcatgagccttga

SEQ ID NO: 32885 - DNA, 30 bp, Homo sapiens
ccatgatggcccggtatagtgcaggctcaa

SEQ ID NO: 32886 - DNA, 30 bp, Homo sapiens
agaagggggctccgggccggccctgcacct

SEQ ID NO: 32887 - DNA, 30 bp, Homo sapiens
ggataatgtctgctccataaaacgtgtctt

SEQ ID NO: 32888 - DNA, 30 bp, Homo sapiens
ttctggcacttcttctggaaagagctcttc

SEQ ID NO: 32889 - DNA, 30 bp, Homo sapiens
catatatgctcccattaatatctgcaccat

SEQ ID NO: 32890 - DNA, 30 bp, Homo sapiens
taaaggtattctgcctacatctatttgtgt

SEQ ID NO: 32891 - DNA, 30 bp, Homo sapiens
cacaggggcccagctgcacccagaagcctt

SEQ ID NO: 32892 - DNA, 30 bp, Homo sapiens
caaagggacagatttgtcatcaaatcattg

SEQ ID NO: 32893 - DNA, 30 bp, Homo sapiens
aactggtctctttaagatcctccattggta

SEQ ID NO: 32894 - DNA, 30 bp, Homo sapiens
gcttggtgcgtccttcacagtacagcgcac

SEQ ID NO: 32895 - DNA, 30 bp, Homo sapiens
accagggagggaagactccaggggccggcc

SEQ ID NO: 32896 - DNA, 30 bp, Homo sapiens
ttctctctgggaggcctgatggttggtttc

SEQ ID NO: 32897 - DNA, 30 bp, Homo sapiens
ctgaggcggctgctgtgggcagggcagatg

SEQ ID NO: 32898 - DNA, 30 bp, Homo sapiens
tcatcaggggcataacctccagaagtgtgc

SEQ ID NO: 32899 - DNA, 30 bp, Homo sapiens
agtaggagagttgtagcaaaggcattaaag

SEQ ID NO: 32900 - DNA, 30 bp, Homo sapiens
aggcggatggtaatggaggagctaatgtaa

SEQ ID NO: 32901 - DNA, 30 bp, Homo sapiens
cgcgacgtgctggctggggcctggggggag

SEQ ID NO: 32902 - DNA, 30 bp, Homo sapiens
gcatggccatttctgttcaacttaaggatc

SEQ ID NO: 32903 - DNA, 30 bp, Homo sapiens
tacgaccaccagaagctgaccgagaagctc

SEQ ID NO: 32904 - DNA, 30 bp, Homo sapiens
aaacaggaggagagctcagtgtggtccccg

SEQ ID NO: 32905 - DNA, 30 bp, Homo sapiens
ccaaggtaaaacaaagcaatagtgcggaaa

SEQ ID NO: 32906 - DNA, 30 bp, Homo sapiens
aacaggtacagttctgctggtcaatctgct

SEQ ID NO: 32907 - DNA, 30 bp, Homo sapiens
taccagagctggcagcggctggaggggttc

SEQ ID NO: 32908 - DNA, 30 bp, Homo sapiens
gaagtctgaagcaggtcattaaagccattg

SEQ ID NO: 32909 - DNA, 30 bp, Homo sapiens
aaatggaaacccgaacaaccaatcacttgg

SEQ ID NO: 32910 - DNA, 30 bp, Homo sapiens
ctccggtgtacggtggcaggctaacggagg

SEQ ID NO: 32911 - DNA, 30 bp, Homo sapiens
taatctagtaactgggtcccgggcatcctc

SEQ ID NO: 32912 - DNA, 30 bp, Homo sapiens
gggtgctctctgtatgctcccttcactggc

SEQ ID NO: 32913 - DNA, 30 bp, Homo sapiens
atatctaccataggggtgttccctgtatcc

SEQ ID NO: 32914 - DNA, 30 bp, Homo sapiens
atatggctggtctctgtagacgccctttgc

SEQ ID NO: 32915 - DNA, 30 bp, Homo sapiens
aagccctgcaggccacacttcttgccggcc

SEQ ID NO: 32916 - DNA, 30 bp, Homo sapiens
agcagggcctcagacagttggttgatgtcc

SEQ ID NO: 32917 - DNA, 30 bp, Homo sapiens
gctgtccctgctgcgtgggcggcggctggg

SEQ ID NO: 32918 - DNA, 30 bp, Homo sapiens
agatggtgtatgggggccttgctggttagg

SEQ ID NO: 32919 - DNA, 30 bp, Homo sapiens
ctttagaacaggtgaactagacccttgggt

SEQ ID NO: 32920 - DNA, 30 bp, Homo sapiens
catttgcgcctgccaaagatggacttcttg

SEQ ID NO: 32921 - DNA, 30 bp, Homo sapiens
ccaaaacctagtcttacaacactcctttcc

SEQ ID NO: 32922 - DNA, 30 bp, Homo sapiens
cctagtcttacaacactcctttccagtggg

SEQ ID NO: 32923 - DNA, 30 bp, Homo sapiens
cactagggcccacccactcgcctccgcctt

SEQ ID NO: 32924 - DNA, 30 bp, Homo sapiens
ttccattctttcctgttcatccatgttatc

SEQ ID NO: 32925 - DNA, 30 bp, Homo sapiens
tctgtcctttgagcaataactgaaggaagc

SEQ ID NO: 32926 - DNA, 30 bp, Homo sapiens
tacaggatctcctcccgcgggctcctggcc

SEQ ID NO: 32927 - DNA, 30 bp, Homo sapiens
tactggggcagataggctggcctgcgctca

SEQ ID NO: 32928 - DNA, 30 bp, Homo sapiens
gttcaggtctgctgtctggctccatagtag

SEQ ID NO: 32929 - DNA, 30 bp, Homo sapiens
tggtggaggcaaagccatttggttggtact

SEQ ID NO: 32930 - DNA, 30 bp, Homo sapiens
atgcttcggatcgcagagaaatggtatagt

SEQ ID NO: 32931 - DNA, 30 bp, Homo sapiens
cagatgggctgttgcttcaggtgcgtgtac

SEQ ID NO: 32932 - DNA, 30 bp, Homo sapiens
cagtggccatttgctcaatgtggtcactaa

SEQ ID NO: 32933 - DNA, 30 bp, Homo sapiens
agcagcgccgtcgtctcgtctccttctcgc

SEQ ID NO: 32934 - DNA, 30 bp, Homo sapiens
tgatggtttgtgttcaacttgcttaacatc

SEQ ID NO: 32935 - DNA, 30 bp, Homo sapiens
gcataaacactgtgctggctgtctcttccc

SEQ ID NO: 32936 - DNA, 30 bp, Homo sapiens
cagaaggtatctgcccccgaagactccatg

SEQ ID NO: 32937 - DNA, 30 bp, Homo sapiens
tgtagcagcctctaagaattctgaggtgaa

SEQ ID NO: 32938 - DNA, 30 bp, Homo sapiens
accaggtcagccctgcaaatctcactttac

SEQ ID NO: 32939 - DNA, 30 bp, Homo sapiens
gcatgcactgctcctctatgcttgctggag

SEQ ID NO: 32940 - DNA, 30 bp, Homo sapiens
tgttatctgaggcagaagagttctgtgggg

SEQ ID NO: 32941 - DNA, 30 bp, Homo sapiens
cagtcagttcattcacttccatgatcttct

SEQ ID NO: 32942 - DNA, 30 bp, Homo sapiens
agtcgggtagcaggcgacccagctccgcct

SEQ ID NO: 32943 - DNA, 30 bp, Homo sapiens
gagccatccagaatggcatctgttgtttag

SEQ ID NO: 32944 - DNA, 30 bp, Homo sapiens
atcaggatgggcttctgccgaacttccagg

SEQ ID NO: 32945 - DNA, 30 bp, Homo sapiens
agatgggcacgacaataacgaggatgacgg

SEQ ID NO: 32946 - DNA, 30 bp, Homo sapiens
agatggagataacgacaagtaaaatcagac

SEQ ID NO: 32947 - DNA, 30 bp, Homo sapiens
ccagaattgtccactcgccttgaggcgaac

SEQ ID NO: 32948 - DNA, 30 bp, Homo sapiens
catcctgtagtgcagtaccgagctttttga

SEQ ID NO: 32949 - DNA, 30 bp, Homo sapiens
aggaggctactatttttaatttgtttttgt

SEQ ID NO: 32950 - DNA, 30 bp, Homo sapiens
ttggcagcctttatttctgctttaattttc

SEQ ID NO: 32951 - DNA, 30 bp, Homo sapiens
tacgggcaacaggggttgtcgataaccagc

SEQ ID NO: 32952 - DNA, 30 bp, Homo sapiens
cagtgggtgtgagcacattcaggtcacggg

SEQ ID NO: 32953 - DNA, 30 bp, Homo sapiens
atgtggctccatgctttggctttcttcctg

SEQ ID NO: 32954 - DNA, 30 bp, Homo sapiens
ctttgctttccttttggccaaagccagcca

SEQ ID NO: 32955 - DNA, 30 bp, Homo sapiens
attttataatctggggcatgtcactccaag

SEQ ID NO: 32956 - DNA, 30 bp, Homo sapiens
gatattggcggggatcctgcagtttggact

SEQ ID NO: 32957 - DNA, 30 bp, Homo sapiens
ctgtggatggggtggctttgcttgaacttc

SEQ ID NO: 32958 - DNA, 30 bp, Homo sapiens
atggccgttctggccacaagacaagcagga

SEQ ID NO: 32959 - DNA, 30 bp, Homo sapiens
agatggggctgttccctttcttcttcctga

SEQ ID NO: 32960 - DNA, 30 bp, Homo sapiens
cacaggtccatgtctaggcctcctgaggat

SEQ ID NO: 32961 - DNA, 30 bp, Homo sapiens
ggagtcctctgaaagagagatggtgacagg

SEQ ID NO: 32962 - DNA, 30 bp, Homo sapiens
ttgaggttttcagttgaacagattcaaaat

SEQ ID NO: 32963 - DNA, 30 bp, Homo sapiens
tctgattctcctccaactcttcaggggttc

SEQ ID NO: 32964 - DNA, 30 bp, Homo sapiens
aatcacaacctctctttttctctgcaatga

SEQ ID NO: 32965 - DNA, 30 bp, Homo sapiens
cagtccgtaaacatctgagaccaggtaaaa

SEQ ID NO: 32966 - DNA, 30 bp, Homo sapiens
acatggcacctgatgttgtcaactggccca

SEQ ID NO: 32967 - DNA, 30 bp, Homo sapiens
aggcccatcttctcctctgggcccaccagc

SEQ ID NO: 32968 - DNA, 30 bp, Homo sapiens
gagcggatggagagcgcgtcctctgctgtg

SEQ ID NO: 32969 - DNA, 30 bp, Homo sapiens
agctgtggaagttctgcacggtgctctgtt

SEQ ID NO: 32970 - DNA, 30 bp, Homo sapiens
acctggaactcaaacatgtctgtctgtttt

SEQ ID NO: 32971 - DNA, 30 bp, Homo sapiens
ccaaggcttctgcttctcttctccaggtac

SEQ ID NO: 32972 - DNA, 30 bp, Homo sapiens
gattctcatggaagacttttgttgactttt

SEQ ID NO: 32973 - DNA, 30 bp, Homo sapiens
accagaaaagcctctgaccacagccagaag

SEQ ID NO: 32974 - DNA, 30 bp, Homo sapiens
cagcggtgggctgtgagcatctccccgcaa

SEQ ID NO: 32975 - DNA, 30 bp, Homo sapiens
caaacttggttctcataaagactttgcctc

SEQ ID NO: 32976 - DNA, 30 bp, Homo sapiens
tgccaggccaatgcatgtgccgtgagctgg

SEQ ID NO: 32977 - DNA, 30 bp, Homo sapiens
tagagggaggcaaggggacttgtctggggt

SEQ ID NO: 32978 - DNA, 30 bp, Homo sapiens
ccaaaacgacttttagaccttgtgtttttc

SEQ ID NO: 32979 - DNA, 30 bp, Homo sapiens
tttctgttgctcttagacacagtgccgtct

SEQ ID NO: 32980 - DNA, 30 bp, Homo sapiens
cactggcagcagctgtgggagccaagcctc

SEQ ID NO: 32981 - DNA, 30 bp, Homo sapiens
cgttggtcatgcaccaataacgccacacat

SEQ ID NO: 32982 - DNA, 30 bp, Homo sapiens
ggcctgggtatttgtaggaactggaaataa

SEQ ID NO: 32983 - DNA, 30 bp, Homo sapiens
cactgggatcttccttactcctgaagaggg

SEQ ID NO: 32984 - DNA, 30 bp, Homo sapiens
gtcaggcttctctaagcccgacgactgaaa

SEQ ID NO: 32985 - DNA, 30 bp, Homo sapiens
acatggcaactaacactgacttggaaatgc

SEQ ID NO: 32986 - DNA, 30 bp, Homo sapiens
cctgtgctctcagaagaggctgctgcatgg

SEQ ID NO: 32987 - DNA, 30 bp, Homo sapiens
aagagctatctatctcaaggccagcatttt

SEQ ID NO: 32988 - DNA, 30 bp, Homo sapiens
taaaggttgatctgggctcgcagaggtaat

SEQ ID NO: 32989 - DNA, 30 bp, Homo sapiens
caatggggagggaggacttggcctgggctc

SEQ ID NO: 32990 - DNA, 30 bp, Homo sapiens
gtgctggaattagagatgtgagccactgtg

SEQ ID NO: 32991 - DNA, 30 bp, Homo sapiens
gtgaggttgtgcctccctggtcattctcta

SEQ ID NO: 32992 - DNA, 30 bp, Homo sapiens
aaaaggctgcctctggaattattacctggt

SEQ ID NO: 32993 - DNA, 30 bp, Homo sapiens
agctggcccaggatttccggttctcagggt

SEQ ID NO: 32994 - DNA, 30 bp, Homo sapiens
gaatcctactgggtgtgcattcctctgagc

SEQ ID NO: 32995 - DNA, 30 bp, Homo sapiens
caagcctgacattttccttctttagtcgca

SEQ ID NO: 32996 - DNA, 30 bp, Homo sapiens
cccgtggctgctgtagtcaaagactccttt

SEQ ID NO: 32997 - DNA, 30 bp, Homo sapiens
tagagtcttgtcaaatgtgagattagccaa

SEQ ID NO: 32998 - DNA, 30 bp, Homo sapiens
cagaggctcactgccaaagttgcttttgct

SEQ ID NO: 32999 - DNA, 30 bp, Homo sapiens
gtttggcaaatccagaatttacgtctgcag

SEQ ID NO: 33000 - DNA, 30 bp, Homo sapiens
tgccagtcacctgggagtacaaggggccca

SEQ ID NO: 33001 - DNA, 30 bp, Homo sapiens
ccttggtgacgccgttccctgctgagagtg

SEQ ID NO: 33002 - DNA, 30 bp, Homo sapiens
agttatgccgggagcatccatctttgccat

SEQ ID NO: 33003 - DNA, 30 bp, Homo sapiens
atctgggcagacctccttctggagagcttg

SEQ ID NO: 33004 - DNA, 30 bp, Homo sapiens
gactggctcgggcatctgcgggaaagcttt

SEQ ID NO: 33005 - DNA, 30 bp, Homo sapiens
ttgagattgggtgctgagaactgtctcctc

SEQ ID NO: 33006 - DNA, 30 bp, Homo sapiens
tcttggttctgaatctctccatttttgttg

SEQ ID NO: 33007 - DNA, 30 bp, Homo sapiens
tctccttgaggtcaggggcagaacgctgcc

SEQ ID NO: 33008 - DNA, 30 bp, Homo sapiens
ggcccagatttgagtaaaggggaacgccgt

SEQ ID NO: 33009 - DNA, 30 bp, Homo sapiens
atctggtgatcactctccttcattttctgg

SEQ ID NO: 33010 - DNA, 30 bp, Homo sapiens
gatctcctgtgtcagagatctgaccatctt

SEQ ID NO: 33011 - DNA, 30 bp, Homo sapiens
gggtgggccgctgtggggtaaccgccggac

SEQ ID NO: 33012 - DNA, 30 bp, Homo sapiens
ggcagggtggtggcgcggccctttatggcc

SEQ ID NO: 33013 - DNA, 30 bp, Homo sapiens
aggaggcgccacagcgctggccggcggcga

SEQ ID NO: 33014 - DNA, 30 bp, Homo sapiens
tccaggtcccagctgggatcctgctctcat

SEQ ID NO: 33015 - DNA, 30 bp, Homo sapiens
agacggcactgttccctcaggggctgcggt

SEQ ID NO: 33016 - DNA, 30 bp, Homo sapiens
tcctcttcccctccgtttgggagctgggcg

SEQ ID NO: 33017 - DNA, 30 bp, Homo sapiens
acgtccacctcctgcggccccgggatggca

SEQ ID NO: 33018 - DNA, 30 bp, Homo sapiens
taccggcgcctggaggtgatgtcgaagcag

SEQ ID NO: 33019 - DNA, 30 bp, Homo sapiens
gtttcctagatacttcgatggaatcagcag

SEQ ID NO: 33020 - DNA, 30 bp, Homo sapiens
taaagggcacggggtctcttcgggttgatt

SEQ ID NO: 33021 - DNA, 30 bp, Homo sapiens
tcttcacgtggaggtcagctagtaataatt

SEQ ID NO: 33022 - DNA, 30 bp, Homo sapiens
cactggggccgtttcttgctgcttatttgt

SEQ ID NO: 33023 - DNA, 30 bp, Homo sapiens
ctttggccttgctttcccctttgaagttcg

SEQ ID NO: 33024 - DNA, 30 bp, Homo sapiens
ctttggaaccagcccccgagactgtggata

SEQ ID NO: 33025 - DNA, 30 bp, Homo sapiens
tcatggtccgccactgttgcagggcgcaga

SEQ ID NO: 33026 - DNA, 30 bp, Homo sapiens
cagtgggcctcttcttcgataggggagcag

SEQ ID NO: 33027 - DNA, 30 bp, Homo sapiens
agctggctgctgtctcttggtggagaggga

SEQ ID NO: 33028 - DNA, 30 bp, Homo sapiens
ccacctcgcactgccactggctggctgttc

SEQ ID NO: 33029 - DNA, 30 bp, Homo sapiens
ccccctcgaatggcatggacggccgttgga

SEQ ID NO: 33030 - DNA, 30 bp, Homo sapiens
gtctggccttgatgaaggcgatgatgtccg

SEQ ID NO: 33031 - DNA, 30 bp, Homo sapiens
catcactcagccccttcctgtttgtagaag

SEQ ID NO: 33032 - DNA, 30 bp, Homo sapiens
cctgaagaccttgggaactgcagacttgct

SEQ ID NO: 33033 - DNA, 30 bp, Homo sapiens
tacagggggtttttccggacatcaatcatc

SEQ ID NO: 33034 - DNA, 30 bp, Homo sapiens
tgctggaggcccatcatggttttcaagtaa

SEQ ID NO: 33035 - DNA, 30 bp, Homo sapiens
ccatagtagtaaggttcatcagggcggaat

SEQ ID NO: 33036 - DNA, 30 bp, Homo sapiens
tgttggcctgagcagtaccaataacacact

SEQ ID NO: 33037 - DNA, 30 bp, Homo sapiens
ctgccagcagagacctggcctgagacccca

SEQ ID NO: 33038 - DNA, 30 bp, Homo sapiens
gctgcagcttcctccggatggatccagggc

SEQ ID NO: 33039 - DNA, 30 bp, Homo sapiens
cacaggcagtggccgcgacttccccgaggg

SEQ ID NO: 33040 - DNA, 30 bp, Homo sapiens
actctgcgtccttttaaagggccagtttca

SEQ ID NO: 33041 - DNA, 30 bp, Homo sapiens
atttggaagttccgtgtacacgatgatatc

SEQ ID NO: 33042 - DNA, 30 bp, Homo sapiens
gattccagctgctggtacattagagctggc

SEQ ID NO: 33043 - DNA, 30 bp, Homo sapiens
atgaaggagaaagaagggaaggatggtaaa

SEQ ID NO: 33044 - DNA, 30 bp, Homo sapiens
aagatcccctcaaggcctgactgtggtgct

SEQ ID NO: 33045 - DNA, 30 bp, Homo sapiens
atgcgtatgacacctcctgatggtcttgtt

SEQ ID NO: 33046 - DNA, 30 bp, Homo sapiens
cagaacatgtaggtgtctggggttaccggt

SEQ ID NO: 33047 - DNA, 30 bp, Homo sapiens
aaaaccccctcaagacctgactgtggtgct

SEQ ID NO: 33048 - DNA, 30 bp, Homo sapiens
tacacgctggtatctgttgggggtgtcttg

SEQ ID NO: 33049 - DNA, 30 bp, Homo sapiens
aggctcttggtccattacagcagcattttt

SEQ ID NO: 33050 - DNA, 30 bp, Homo sapiens
cacgtgagtctgcatgcgctgctggaatcg

SEQ ID NO: 33051 - DNA, 30 bp, Homo sapiens
gtctggagacgcgggtggctaggtgtgggg

SEQ ID NO: 33052 - DNA, 30 bp, Homo sapiens
tggcaagttggagatcccaggactcttcca

SEQ ID NO: 33053 - DNA, 30 bp, Homo sapiens
ttcattgcactcctgcttacttgctctccg

SEQ ID NO: 33054 - DNA, 30 bp, Homo sapiens
acgtgagtctgcatccgccgctgcaggggt

SEQ ID NO: 33055 - DNA, 30 bp, Homo sapiens
gccccgcccagcgcttctgccgtggttccc

SEQ ID NO: 33056 - DNA, 30 bp, Homo sapiens
agagaggggcgttgtcctcccccaggacgc

SEQ ID NO: 33057 - DNA, 30 bp, Homo sapiens
cagaggctgggaggaggaagcggtgctgcc

SEQ ID NO: 33058 - DNA, 30 bp, Homo sapiens
taagacttggctgtctcttcttccagtata

SEQ ID NO: 33059 - DNA, 30 bp, Homo sapiens
ttatggtttctggggcgtaaagcagcctca

SEQ ID NO: 33060 - DNA, 30 bp, Homo sapiens
aagactttcgggtgtgaaaaaaactgcact

SEQ ID NO: 33061 - DNA, 30 bp, Homo sapiens
taatggtatgtgttgtaagttttttgcttt

SEQ ID NO: 33062 - DNA, 30 bp, Homo sapiens
cactgctgctgctgtcgttttccacaaaaa

SEQ ID NO: 33063 - DNA, 30 bp, Homo sapiens
cgagcttcattttcctcatcccgttccact

SEQ ID NO: 33064 - DNA, 30 bp, Homo sapiens
accagggagcttcgtcgggagaggtccatg

SEQ ID NO: 33065 - DNA, 30 bp, Homo sapiens
tagtgggggctcaggtcctgggtgctggcg

SEQ ID NO: 33066 - DNA, 30 bp, Homo sapiens
gagaggtccatggtgctggcactgaggccc

SEQ ID NO: 33067 - DNA, 30 bp, Homo sapiens
gagaggccaaaacagcaatggtggggggtg

SEQ ID NO: 33068 - DNA, 30 bp, Homo sapiens
caaaggtggcgcttcatgtgcaaggccagg

SEQ ID NO: 33069 - DNA, 30 bp, Homo sapiens
gtgtgggagcaggggttggaggtagagcaa

SEQ ID NO: 33070 - DNA, 30 bp, Homo sapiens
aggcagaggctggcatgctcaccagtgggc

SEQ ID NO: 33071 - DNA, 30 bp, Homo sapiens
accaacatatgcctccggcggtgcagggcc

SEQ ID NO: 33072 - DNA, 30 bp, Homo sapiens
gcccctgggcttctcaggaaacaggctgag

SEQ ID NO: 33073 - DNA, 30 bp, Homo sapiens
agctggccgggctgatggtggggctgctgg

SEQ ID NO: 33074 - DNA, 30 bp, Homo sapiens
tacaggcaggtggtgaagctgggcgccggg

SEQ ID NO: 33075 - DNA, 30 bp, Homo sapiens
tcacggagcgcacggagcggctgctccgcg

SEQ ID NO: 33076 - DNA, 30 bp, Homo sapiens
tacaggcctgcgggggctgggctgggcgcg

SEQ ID NO: 33077 - DNA, 30 bp, Homo sapiens
gaccagcagcaggaggactgtcctgctctc

SEQ ID NO: 33078 - DNA, 30 bp, Homo sapiens
tacatgtgccgtttcatgtgcagcgccagg

SEQ ID NO: 33079 - DNA, 30 bp, Homo sapiens
atgtggcgtttcctatggagggcaagatgg

SEQ ID NO: 33080 - DNA, 30 bp, Homo sapiens
catgtgtaaggcgaggtggtccgacctgga

SEQ ID NO: 33081 - DNA, 30 bp, Homo sapiens
ttctggtgcctcttcatatgcagggccagg

SEQ ID NO: 33082 - DNA, 30 bp, Homo sapiens
cagaggtgcctcttcatgtgcagggccagg

SEQ ID NO: 33083 - DNA, 30 bp, Homo sapiens
catgtgcagggccaggtggtcagacctgga

SEQ ID NO: 33084 - DNA, 30 bp, Homo sapiens
tggagggcaagatggtcagacctggaaaaa

SEQ ID NO: 33085 - DNA, 30 bp, Homo sapiens
ataaggcttctctctcttgctgtagtccct

SEQ ID NO: 33086 - DNA, 30 bp, Homo sapiens
acatggtgtcatggcgacggcgatgcaggg

SEQ ID NO: 33087 - DNA, 30 bp, Homo sapiens
aaagcgttggccagcgcctttttcgatcgc

SEQ ID NO: 33088 - DNA, 30 bp, Homo sapiens
tctcggtgattagctgcagcccaaaatgtt

SEQ ID NO: 33089 - DNA, 30 bp, Homo sapiens
ttcaagcgttcgatgagtccctgtgtgagt

SEQ ID NO: 33090 - DNA, 30 bp, Homo sapiens
gatccagaagtgttgttactaccaaacctc

SEQ ID NO: 33091 - DNA, 30 bp, Homo sapiens
acccatgggaggagacgatggggcgactga

SEQ ID NO: 33092 - DNA, 30 bp, Homo sapiens
caccgctctcctctccgctgtcttcgtcgt

SEQ ID NO: 33093 - DNA, 30 bp, Homo sapiens
ccctggtctgaggcaaatcgggggtgggca

SEQ ID NO: 33094 - DNA, 30 bp, Homo sapiens
agagtgaggtctgcagccggtcctcagggg

SEQ ID NO: 33095 - DNA, 30 bp, Homo sapiens
cacagggcctccactgcgtcactcagaccc

SEQ ID NO: 33096 - DNA, 30 bp, Homo sapiens
gaccccatcacgcagacacagtgcctccac

SEQ ID NO: 33097 - DNA, 30 bp, Homo sapiens
tgcaaacctgtggactggctgtcctgccat

SEQ ID NO: 33098 - DNA, 30 bp, Homo sapiens
ctctggtcagagtttctccaccaaacagca

SEQ ID NO: 33099 - DNA, 30 bp, Homo sapiens
cacaggcacctgctctcccaatattcaagg

SEQ ID NO: 33100 - DNA, 30 bp, Homo sapiens
tacaggtagggtacttgtcgaagcagaata

SEQ ID NO: 33101 - DNA, 30 bp, Homo sapiens
attcaatctgagagcttggcactcgcctca

SEQ ID NO: 33102 - DNA, 30 bp, Homo sapiens
tcgcggagaacacaaacaccagcatcacag

SEQ ID NO: 33103 - DNA, 30 bp, Homo sapiens
aagaggggactctctagaaggtgatggtgt

SEQ ID NO: 33104 - DNA, 30 bp, Homo sapiens
gtatggtacacaagagggcagaataactgt

SEQ ID NO: 33105 - DNA, 30 bp, Homo sapiens
ctcatccagtacatagtccggaaaatgcag

SEQ ID NO: 33106 - DNA, 30 bp, Homo sapiens
cagaggctggtggaggacacggacagcgtc

SEQ ID NO: 33107 - DNA, 30 bp, Homo sapiens
agatggtgaggagagggatgcagcccacac

SEQ ID NO: 33108 - DNA, 30 bp, Homo sapiens
taatggtttatcaataactgtgacccctgc

SEQ ID NO: 33109 - DNA, 30 bp, Homo sapiens
atatgggattcacaatgtgtcattttaata

SEQ ID NO: 33110 - DNA, 30 bp, Homo sapiens
cgttcctcgtcgggttgtacacgtccacct

SEQ ID NO: 33111 - DNA, 30 bp, Homo sapiens
catcggggtcccgcggcggccggggtcggc

SEQ ID NO: 33112 - DNA, 30 bp, Homo sapiens
cctcactggagttgtcaaactcctcccagt

SEQ ID NO: 33113 - DNA, 30 bp, Homo sapiens
agaccgcatggcactgggaagattacccac

SEQ ID NO: 33114 - DNA, 30 bp, Homo sapiens
gataggacactggcctgggcattgcagcta

SEQ ID NO: 33115 - DNA, 30 bp, Homo sapiens
acgcgggcaggtgcttccaggtgctgacaa

SEQ ID NO: 33116 - DNA, 30 bp, Homo sapiens
gccagggtcccgggggtcttgggggctacg

SEQ ID NO: 33117 - DNA, 30 bp, Homo sapiens
gcactgcactccagcctgaagtagtcgctg

SEQ ID NO: 33118 - DNA, 30 bp, Homo sapiens
tcctggtcccggcccggggcagcaggacgg

SEQ ID NO: 33119 - DNA, 30 bp, Homo sapiens
gttgcagcgacagtatatcatgccagctga

SEQ ID NO: 33120 - DNA, 30 bp, Homo sapiens
ctgaacacagggcagggcatgtgggggagg

SEQ ID NO: 33121 - DNA, 30 bp, Homo sapiens
acaaggacttgtgaatcacggcaacacctg

SEQ ID NO: 33122 - DNA, 30 bp, Homo sapiens
tcctgggtggggccggagggctgggtccac

SEQ ID NO: 33123 - DNA, 30 bp, Homo sapiens
gactggcacagaagataccgaactggcccg

SEQ ID NO: 33124 - DNA, 30 bp, Homo sapiens
tgaggtatgttctacctgatatccaaagaa

SEQ ID NO: 33125 - DNA, 30 bp, Homo sapiens
gcttggacaagggggtgggacagggcaact

SEQ ID NO: 33126 - DNA, 30 bp, Homo sapiens
agatggtgccaatcctgtgatgaggcactt

SEQ ID NO: 33127 - DNA, 30 bp, Homo sapiens
cacccagcaggtttggtttggtgtggggtg

SEQ ID NO: 33128 - DNA, 30 bp, Homo sapiens
cagcccagcaccaaatctagcgcctctcca

SEQ ID NO: 33129 - DNA, 30 bp, Homo sapiens
caagctctggatgatggtgacacagccgtg

SEQ ID NO: 33130 - DNA, 30 bp, Homo sapiens
cactggccccggtcctggtgcctcttgcct

SEQ ID NO: 33131 - DNA, 30 bp, Homo sapiens
catgggaggccagacgtgcggggtatgcac

SEQ ID NO: 33132 - DNA, 30 bp, Homo sapiens
agtctctttcagcttctgtgtggtatagaa

SEQ ID NO: 33133 - DNA, 30 bp, Homo sapiens
caacacatgcaccagctcttccaatgttaa

SEQ ID NO: 33134 - DNA, 30 bp, Homo sapiens
gtcaggcacagcacattgagccgcactggt

SEQ ID NO: 33135 - DNA, 30 bp, Homo sapiens
gctaggcaactagctcctgaagcataacgt

SEQ ID NO: 33136 - DNA, 30 bp, Homo sapiens
agttatgtccaaaagctggaaaacgccgaa

SEQ ID NO: 33137 - DNA, 30 bp, Homo sapiens
cttcctaggcacagtggagcaacctgggtc

SEQ ID NO: 33138 - DNA, 30 bp, Homo sapiens
gacagacactgctccgggcacgatcctgcg

SEQ ID NO: 33139 - DNA, 30 bp, Homo sapiens
ctctggaaggctctgatcaactttttctgc

SEQ ID NO: 33140 - DNA, 30 bp, Homo sapiens
gtatcgacaacacaaattaaacaacttgtg

SEQ ID NO: 33141 - DNA, 30 bp, Homo sapiens
tattggatccatgacctacatctcgaattt

SEQ ID NO: 33142 - DNA, 30 bp, Homo sapiens
aatgatctgaaggtgctgaaagaggtgatt

SEQ ID NO: 33143 - DNA, 30 bp, Homo sapiens
ctatggtgtcctcgatccacttcacataag

SEQ ID NO: 33144 - DNA, 30 bp, Homo sapiens
agttggagcgtatgactttattgatccagg

SEQ ID NO: 33145 - DNA, 30 bp, Homo sapiens
taattgttcttcatcgtctcctggatccag

SEQ ID NO: 33146 - DNA, 30 bp, Homo sapiens
gatcatccggatccagtccacatacttgca

SEQ ID NO: 33147 - DNA, 30 bp, Homo sapiens
agaagggctggcaggagttaaagttccaag

SEQ ID NO: 33148 - DNA, 30 bp, Homo sapiens
tcaaggatggtccatttataggacatatat

SEQ ID NO: 33149 - DNA, 30 bp, Homo sapiens
aaccatttttgctgctgggtttcatatttt

SEQ ID NO: 33150 - DNA, 30 bp, Homo sapiens
tttgtcccgcatcgtttcctcaatccagct

SEQ ID NO: 33151 - DNA, 30 bp, Homo sapiens
tcatggtttccctgatccactccaagtagt

SEQ ID NO: 33152 - DNA, 30 bp, Homo sapiens
gaccgggggctcccagcggtcccaggctcg

SEQ ID NO: 33153 - DNA, 30 bp, Homo sapiens
caggggttggctgcgatggtgtccttgatc

SEQ ID NO: 33154 - DNA, 30 bp, Homo sapiens
ccctccagatgttgggagtagggatgactc

SEQ ID NO: 33155 - DNA, 30 bp, Homo sapiens
caggggttggccacgatggtgtccttgatc

SEQ ID NO: 33156 - DNA, 30 bp, Homo sapiens
ctccagggcactagggagccatggaggacc

SEQ ID NO: 33157 - DNA, 30 bp, Homo sapiens
acaagggggcactgtgtacagggagagtct

SEQ ID NO: 33158 - DNA, 30 bp, Homo sapiens
aactggcctggacggttttctctatccact

SEQ ID NO: 33159 - DNA, 30 bp, Homo sapiens
agttggcctggatggtttcctggatccact

SEQ ID NO: 33160 - DNA, 30 bp, Homo sapiens
gtcagggtcacttggcctgaatggtttttt

SEQ ID NO: 33161 - DNA, 30 bp, Homo sapiens
acttggcctgaatggttttttggatccagt

SEQ ID NO: 33162 - DNA, 30 bp, Homo sapiens
tcatggtgtcatttatccacttggtgaact

SEQ ID NO: 33163 - DNA, 30 bp, Homo sapiens
atcttcttgatccagtccaggtagcggcag

SEQ ID NO: 33164 - DNA, 30 bp, Homo sapiens
ctgcctatgatcttcttgatccagtccagg

SEQ ID NO: 33165 - DNA, 30 bp, Homo sapiens
tttcttggatccagtcaaggtagtggcata

SEQ ID NO: 33166 - DNA, 30 bp, Homo sapiens
tgctggtgactgcatctgagcttttccatc

SEQ ID NO: 33167 - DNA, 30 bp, Homo sapiens
ccccagctggtgatgcccaccaaacgccac

SEQ ID NO: 33168 - DNA, 30 bp, Homo sapiens
ctttggcttgctcttagggtagcaggcgag

SEQ ID NO: 33169 - DNA, 30 bp, Homo sapiens
ttttggcagatccatctgatttctgtacta

SEQ ID NO: 33170 - DNA, 30 bp, Homo sapiens
tgggctgatttaagtcgatttacttgtagc

SEQ ID NO: 33171 - DNA, 30 bp, Homo sapiens
cactgggctgatttaagtcgatttacttgt

SEQ ID NO: 33172 - DNA, 30 bp, Homo sapiens
cactggtctgatataagtccacgtacatgt

SEQ ID NO: 33173 - DNA, 30 bp, Homo sapiens
cacaggccagcaaactctttcttcccaagt

SEQ ID NO: 33174 - DNA, 30 bp, Homo sapiens
ggattatacgctatgcagttctttgtatta

SEQ ID NO: 33175 - DNA, 30 bp, Homo sapiens
gaaaacactgctgcaggtttcagagaaaat

SEQ ID NO: 33176 - DNA, 30 bp, Homo sapiens
ggatcaaggagatcaaagtcaaagtgagaa

SEQ ID NO: 33177 - DNA, 30 bp, Homo sapiens
gttccattgtgcgtcaagatcgcatctctc

SEQ ID NO: 33178 - DNA, 30 bp, Homo sapiens
gtaaaggaacttcacagcttgaggcttgaa

SEQ ID NO: 33179 - DNA, 30 bp, Homo sapiens
tacacacccagtgtaaaggaacttcacagc

SEQ ID NO: 33180 - DNA, 30 bp, Homo sapiens
cactgggtccccttggcacagacccagggt

SEQ ID NO: 33181 - DNA, 30 bp, Homo sapiens
catgcagatgtacgtatttggagttgaaca

SEQ ID NO: 33182 - DNA, 30 bp, Homo sapiens
gattggaaatttgttctagggagtccacgg

SEQ ID NO: 33183 - DNA, 30 bp, Homo sapiens
tttaggaacttccggcatttcttggcgcca

SEQ ID NO: 33184 - DNA, 30 bp, Homo sapiens
ttaaggaaccgacggcagcgcttggcgcca

SEQ ID NO: 33185 - DNA, 30 bp, Homo sapiens
ttccggcagttcacagctccacagtgacac

SEQ ID NO: 33186 - DNA, 30 bp, Homo sapiens
ccgacaattccaggctccacagtggcaggg

SEQ ID NO: 33187 - DNA, 30 bp, Homo sapiens
taatgccaccctgacccatggtaattgttt

SEQ ID NO: 33188 - DNA, 30 bp, Homo sapiens
aatgcttcagccacgggtgggcttcaatgg

SEQ ID NO: 33189 - DNA, 30 bp, Homo sapiens
attaacctcaagcgcttagctggaggaaga

SEQ ID NO: 33190 - DNA, 30 bp, Homo sapiens
gagtggtatctgcatcagtgttagagctga

SEQ ID NO: 33191 - DNA, 30 bp, Homo sapiens
acagctcttcaccgccgacatccaggtcga

SEQ ID NO: 33192 - DNA, 30 bp, Homo sapiens
agccgggttagagcaagggactggggcatc

SEQ ID NO: 33193 - DNA, 30 bp, Homo sapiens
tactggaatgtagccttcatcctccgtagc

SEQ ID NO: 33194 - DNA, 30 bp, Homo sapiens
cacgaaccaaggtgaggactactgtggcgg

SEQ ID NO: 33195 - DNA, 30 bp, Homo sapiens
cactggccagggctctcaaaggtgttcccg

SEQ ID NO: 33196 - DNA, 30 bp, Homo sapiens
ccatgggcttcgtgacagtaggaaccacca

SEQ ID NO: 33197 - DNA, 30 bp, Homo sapiens
tccaggggcgtccaggacattttggggagg

SEQ ID NO: 33198 - DNA, 30 bp, Homo sapiens
tctcagatgctggctctgcccctgcctttg

SEQ ID NO: 33199 - DNA, 30 bp, Homo sapiens
tagtggtagaaatggcagtcctgaaacaga

SEQ ID NO: 33200 - DNA, 30 bp, Homo sapiens
tgactgacttggaagcgttcctgtcaatgt

SEQ ID NO: 33201 - DNA, 30 bp, Homo sapiens
ccttaagggctgttgttaaatcatttactt

SEQ ID NO: 33202 - DNA, 30 bp, Homo sapiens
gcaaagtttctaacagcaactggatcaagg

SEQ ID NO: 33203 - DNA, 30 bp, Homo sapiens
catttggtgcaatatcccatgattcatcca

SEQ ID NO: 33204 - DNA, 30 bp, Homo sapiens
gtctggaggcacaggtttcccgcagtgctt

SEQ ID NO: 33205 - DNA, 30 bp, Homo sapiens
agctggaaaccttccataggagcctcacac

SEQ ID NO: 33206 - DNA, 30 bp, Homo sapiens
cccaggagccccatcctgaacttggaaagt

SEQ ID NO: 33207 - DNA, 30 bp, Homo sapiens
tgttggatcaaaattgtaggtacctccttg

SEQ ID NO: 33208 - DNA, 30 bp, Homo sapiens
tgttggtacattggcagatgaattgaaacc

SEQ ID NO: 33209 - DNA, 30 bp, Homo sapiens
attggtgcttcctgctgctgaaatataaac

SEQ ID NO: 33210 - DNA, 30 bp, Homo sapiens
agctggaagccctccatgggggcctcaggc

SEQ ID NO: 33211 - DNA, 30 bp, Homo sapiens
gtttggctctcatcttcttcctcaccaaag

SEQ ID NO: 33212 - DNA, 30 bp, Homo sapiens
ttcttttgttgcccatgtagcaagggtttt

SEQ ID NO: 33213 - DNA, 30 bp, Homo sapiens
tcactccagcaaaggcattgccttggtctc

SEQ ID NO: 33214 - DNA, 30 bp, Homo sapiens
aagaggctgcattctcagcaggccctgcac

SEQ ID NO: 33215 - DNA, 30 bp, Homo sapiens
ttgtctttgctgatgtttcaataaaaggaa

SEQ ID NO: 33216 - DNA, 30 bp, Homo sapiens
gtcttttcttctttgctgatttttttcaat

SEQ ID NO: 33217 - DNA, 30 bp, Homo sapiens
atgcgccccccatctcgggtccctgtgctc

SEQ ID NO: 33218 - DNA, 30 bp, Homo sapiens
cagaggagaccggaagtcccttgtgaggtg

SEQ ID NO: 33219 - DNA, 30 bp, Homo sapiens
ttcccagcattgacgatttcgaaaaatttt

SEQ ID NO: 33220 - DNA, 30 bp, Homo sapiens
atgaggcaaaaatggatacatctggcctgt

SEQ ID NO: 33221 - DNA, 30 bp, Homo sapiens
tcatccttcagtgtttccttgcctatgaat

SEQ ID NO: 33222 - DNA, 30 bp, Homo sapiens
atagactggtcccaaagcatttcctcctct

SEQ ID NO: 33223 - DNA, 30 bp, Homo sapiens
acaaggggattgcggtcatcttgttgactc

SEQ ID NO: 33224 - DNA, 30 bp, Homo sapiens
ttctgggctgcccctgagaccagatgagtg

SEQ ID NO: 33225 - DNA, 30 bp, Homo sapiens
gagcggagatgagcgagcgcagggagctct

SEQ ID NO: 33226 - DNA, 30 bp, Homo sapiens
cagaggccggtagcccgcggcagaaccctc

SEQ ID NO: 33227 - DNA, 30 bp, Homo sapiens
tcttgggcccctgttgtttcctccgctgcc

SEQ ID NO: 33228 - DNA, 30 bp, Homo sapiens
tatggatctgaaaacaagtatcagtatctc

SEQ ID NO: 33229 - DNA, 30 bp, Homo sapiens
tcttaagtgcaatttcttcagctgtaagag

SEQ ID NO: 33230 - DNA, 30 bp, Homo sapiens
atctggttactccggaataagtggtagaaa

SEQ ID NO: 33231 - DNA, 30 bp, Homo sapiens
gatgaagactcgcccacggacccggaagag

SEQ ID NO: 33232 - DNA, 30 bp, Homo sapiens
cttgagatgagaccacctcaccattcacca

SEQ ID NO: 33233 - DNA, 30 bp, Homo sapiens
ctacggacatcagaagtgcggcgaccagag

SEQ ID NO: 33234 - DNA, 30 bp, Homo sapiens
tacgggggctgacgcttcttggcgtcctgg

SEQ ID NO: 33235 - DNA, 30 bp, Homo sapiens
ttcttggtgcgaaggacctgctcgtgggtg

SEQ ID NO: 33236 - DNA, 30 bp, Homo sapiens
ttgtgggaagaaaccacctgtccatccact

SEQ ID NO: 33237 - DNA, 30 bp, Homo sapiens
ctctggccctggctgaagctggatgagctc

SEQ ID NO: 33238 - DNA, 30 bp, Homo sapiens
cagcgggtggtctggtggacctgctcgcgg

SEQ ID NO: 33239 - DNA, 30 bp, Homo sapiens
aactttggtgtcattggtctcagacaccac

SEQ ID NO: 33240 - DNA, 30 bp, Homo sapiens
cagaggaccttggaggcagacaaattgttg

SEQ ID NO: 33241 - DNA, 30 bp, Homo sapiens
cgctggaaccaaaagcttcacctgagctac

SEQ ID NO: 33242 - DNA, 30 bp, Homo sapiens
ctttgacttcagatgacacgaccttgccat

SEQ ID NO: 33243 - DNA, 30 bp, Homo sapiens
tagagggaatactgcatgatcttctcatga

SEQ ID NO: 33244 - DNA, 30 bp, Homo sapiens
ttttggatttcattcacttgacaaagaact

SEQ ID NO: 33245 - DNA, 30 bp, Homo sapiens
aaatactgctgacttgagacgagacaacct

SEQ ID NO: 33246 - DNA, 30 bp, Homo sapiens
tccagggagtggagcctggtggtaagtatt

SEQ ID NO: 33247 - DNA, 30 bp, Homo sapiens
tatggtgctttagaaggtactcgttgctct

SEQ ID NO: 33248 - DNA, 30 bp, Homo sapiens
ttcattcttgttgttgactttggtggattt

SEQ ID NO: 33249 - DNA, 30 bp, Homo sapiens
gttctgtcttgccgttggtcattttagatg

SEQ ID NO: 33250 - DNA, 30 bp, Homo sapiens
atctggagtagcgctgggaggactgggagg

SEQ ID NO: 33251 - DNA, 30 bp, Homo sapiens
cgaaggaattgcagggcccacagcgggggc

SEQ ID NO: 33252 - DNA, 30 bp, Homo sapiens
tagcggccctgggggcagggtgagcaaggc

SEQ ID NO: 33253 - DNA, 30 bp, Homo sapiens
gtacccaaatgtgttgcaaggcccacaccg

SEQ ID NO: 33254 - DNA, 30 bp, Homo sapiens
caaaggtgttgcaaggcccacagcgggaac

SEQ ID NO: 33255 - DNA, 30 bp, Homo sapiens
tgagaggtgccacagggtccacaggagttg

SEQ ID NO: 33256 - DNA, 30 bp, Homo sapiens
ccctgggcagggcacacaaatggggcgggg

SEQ ID NO: 33257 - DNA, 30 bp, Homo sapiens
cagcgggcgggactgcacgtgctccctgga

SEQ ID NO: 33258 - DNA, 30 bp, Homo sapiens
tgctggctccatggccagagggagacccac

SEQ ID NO: 33259 - DNA, 30 bp, Homo sapiens
aatcggcttccggtggtgctggctccacag

SEQ ID NO: 33260 - DNA, 30 bp, Homo sapiens
ctttggcaggtctgatgatgaaacaaggct

SEQ ID NO: 33261 - DNA, 30 bp, Homo sapiens
tcgtctcttgttcagggtggtggtagagat

SEQ ID NO: 33262 - DNA, 30 bp, Homo sapiens
cataggctgagcatggctcacaagtgttgc

SEQ ID NO: 33263 - DNA, 30 bp, Homo sapiens
ttccgggaggaggaggtggtggagacaaat

SEQ ID NO: 33264 - DNA, 30 bp, Homo sapiens
tgctggaggaggaggtggtggtgtacttga

SEQ ID NO: 33265 - DNA, 30 bp, Homo sapiens; identical to SEQ ID NO: 33264

SEQ ID NO: 33266 - DNA, 30 bp, Homo sapiens
tcgcgggcactcctgcgactggcggatgcg

SEQ ID NO: 33267 - DNA, 30 bp, Homo sapiens
gactggttttcttggagggtgcactcaggc

SEQ ID NO: 33268 - DNA, 30 bp, Homo sapiens
atctggaggcctttttggtggcacagctgc

SEQ ID NO: 33269 - DNA, 30 bp, Homo sapiens
tcatggtttttttggtgggtgagcttagag

SEQ ID NO: 33270 - DNA, 30 bp, Homo sapiens
tagcgggtggctttccttgctgggatgctg

SEQ ID NO: 33271 - DNA, 30 bp, Homo sapiens
ttctggctggaggatgtggtggagacaaac

SEQ ID NO: 33272 - DNA, 30 bp, Homo sapiens
acttggtggagctatgctggcttgagctcg

SEQ ID NO: 33273 - DNA, 30 bp, Homo sapiens
ctccaagatccgcctgtgggaggtgttggt

SEQ ID NO: 33274 - DNA, 30 bp, Homo sapiens
agtaggtgatggatgtcttcagactcgact

SEQ ID NO: 33275 - DNA, 30 bp, Homo sapiens
ctctggctggacgtcttgaccgtagtggtc

SEQ ID NO: 33276 - DNA, 30 bp, Homo sapiens
acttgggcaggacgtcagaggactcagaca

SEQ ID NO: 33277 - DNA, 30 bp, Homo sapiens
tacagggaacataaggggtaggggagggaa

SEQ ID NO: 33278 - DNA, 30 bp, Homo sapiens
tactctgagacctccgactcctgcgagaag

SEQ ID NO: 33279 - DNA, 30 bp, Homo sapiens
atttccggcagctgctgccgcaagacccca

SEQ ID NO: 33280 - DNA, 30 bp, Homo sapiens
ttgtggctgggggagctgcccccagctcct

SEQ ID NO: 33281 - DNA, 30 bp, Homo sapiens
aatgcctcccctggccgcaggagccccctc

SEQ ID NO: 33282 - DNA, 30 bp, Homo sapiens
acttggtccggcaggaggtggtggtggaca

SEQ ID NO: 33283 - DNA, 30 bp, Homo sapiens
aagcggaccgaccggctactcccgcagctg

SEQ ID NO: 33284 - DNA, 30 bp, Homo sapiens
agcacctcttacagctgccgccgcagacgc

SEQ ID NO: 33285 - DNA, 30 bp, Homo sapiens
gaatgggatgattttccgcttcctcctccg

SEQ ID NO: 33286 - DNA, 30 bp, Homo sapiens
aagtgggctcagagcagtagcagcagcaga

SEQ ID NO: 33287 - DNA, 30 bp, Homo sapiens
agcaggtgggctcacaggagtagcagcagc

SEQ ID NO: 33288 - DNA, 30 bp, Homo sapiens
agcaggtgggctcacagcagtggcagcagc

SEQ ID NO: 33289 - DNA, 30 bp, Homo sapiens
aagtgggctcacagcagcagactgggcggc

SEQ ID NO: 33290 - DNA, 30 bp, Homo sapiens
agctggacttcttgcctgagcagaggctgt

SEQ ID NO: 33291 - DNA, 30 bp, Homo sapiens
gcagctagacttttggcctgaggaaaagct

SEQ ID NO: 33292 - DNA, 30 bp, Homo sapiens
agcagctggacttctggcctgaggagaggc

SEQ ID NO: 33293 - DNA, 30 bp, Homo sapiens
cagaggagggacacgcaggaggctgggcgg

SEQ ID NO: 33294 - DNA, 30 bp, Homo sapiens
agcaggccaggggggagcacgcggggcggc

SEQ ID NO: 33295 - DNA, 30 bp, Homo sapiens
agctggacttctggccagagcagaggctgt

SEQ ID NO: 33296 - DNA, 30 bp, Homo sapiens
agctggacttctgggttgaggtggggccac

SEQ ID NO: 33297 - DNA, 30 bp, Homo sapiens
gcagctggacttctggcctgaggagaagct

SEQ ID NO: 33298 - DNA, 30 bp, Homo sapiens
agcaggttcttcggcagctggacacgcagg

SEQ ID NO: 33299 - DNA, 30 bp, Homo sapiens
agcaggaaggggtgctgcaggagatgggtc

SEQ ID NO: 33300 - DNA, 30 bp, Homo sapiens; identical to SEQ ID NO: 33299

SEQ ID NO: 33301 - DNA, 30 bp, Homo sapiens
cagcagccagtgggggtgctccaggtgaca

SEQ ID NO: 33302 - DNA, 30 bp, Homo sapiens
ccacaagttggtctgtagcaagaagactgg

SEQ ID NO: 33303 - DNA, 30 bp, Homo sapiens
agaaggttgatccataggctggtctgtaac

SEQ ID NO: 33304 - DNA, 30 bp, Homo sapiens
ctacagaatggctgataacaagatgaatgg

SEQ ID NO: 33305 - DNA, 30 bp, Homo sapiens
gattggtctgtaacaagaagactgccaggc

SEQ ID NO: 33306 - DNA, 30 bp, Homo sapiens
gcctggaaattcctggatgaaaaggtagtt

SEQ ID NO: 33307 - DNA, 30 bp, Homo sapiens
agcaggctgagctgctgcggcctcacgggt

SEQ ID NO: 33308 - DNA, 30 bp, Homo sapiens
gtgtgggctggcagcacacaggcccacagc

SEQ ID NO: 33309 - DNA, 30 bp, Homo sapiens
atgctgaaggcaatagaatggatttttgga

SEQ ID NO: 33310 - DNA, 30 bp, Homo sapiens
ccacagcctctgtggccacaaccatatctg

SEQ ID NO: 33311 - DNA, 30 bp, Homo sapiens
tgctggggcagtagtttaatagaatccaga

SEQ ID NO: 33312 - DNA, 30 bp, Homo sapiens
atatcgtgtcctcagggtaggatttcagta

SEQ ID NO: 33313 - DNA, 30 bp, Homo sapiens
aatccatatcctccatagcatgatggacgg

SEQ ID NO: 33314 - DNA, 30 bp, Homo sapiens
tgaagcatacgggcaagatcttggagttag

SEQ ID NO: 33315 - DNA, 30 bp, Homo sapiens
gaccagtatcccccatagcatgatgggtgg

SEQ ID NO: 33316 - DNA, 30 bp, Homo sapiens
agaaggcagagaatccatatcctccgtagt

SEQ ID NO: 33317 - DNA, 30 bp, Homo sapiens
agcaggaggaggtcctgcaggtggtgctgc

SEQ ID NO: 33318 - DNA, 30 bp, Homo sapiens; identical to SEQ ID NO: 33317

SEQ ID NO: 33319 - DNA, 30 bp, Homo sapiens; identical to SEQ ID NO: 33317

SEQ ID NO: 33320 - DNA, 30 bp, Homo sapiens
caagatgggcagtagtagccatttccatag

SEQ ID NO: 33321 - DNA, 30 bp, Homo sapiens
atgtggaagagaccacgaggttgagttgcc

SEQ ID NO: 33322 - DNA, 30 bp, Homo sapiens
cccaccacagccacatctgtagccacagtc

SEQ ID NO: 33323 - DNA, 30 bp, Homo sapiens
acctggcagagtaagatgagtggcagccat

SEQ ID NO: 33324 - DNA, 30 bp, Homo sapiens
acagtgatgttttagcaggaagaatagcat

SEQ ID NO: 33325 - DNA, 30 bp, Homo sapiens
aagaggaatagcatcttctgtagcaaagtg

SEQ ID NO: 33326 - DNA, 30 bp, Homo sapiens
taaccgttacagccacagtgggtgctgtgt

SEQ ID NO: 33327 - DNA, 30 bp, Homo sapiens
cagatcagcaatctctaatttctcagaagc

SEQ ID NO: 33328 - DNA, 30 bp, Homo sapiens
aataggaatcttccataggagcacggaaag

SEQ ID NO: 33329 - DNA, 30 bp, Homo sapiens
aagtctcctgaaagcccttgcagagagagg

SEQ ID NO: 33330 - DNA, 30 bp, Homo sapiens
cagaggtctgctaccactgcacaaatacct

SEQ ID NO: 33331 - DNA, 30 bp, Homo sapiens
cacaaaatcagaacaagctggttggaaact

SEQ ID NO: 33332 - DNA, 30 bp, Homo sapiens
caagatggacgacacgtgctgaacacatgg

SEQ ID NO: 33333 - DNA, 30 bp, Homo sapiens
actaggcaattgagaaccaccagtaacaca

SEQ ID NO: 33334 - DNA, 30 bp, Homo sapiens
agaagctggactcacagctgggttggcatg

SEQ ID NO: 33335 - DNA, 30 bp, Homo sapiens
cagcggggctcacagggactctcacagcca

SEQ ID NO: 33336 - DNA, 30 bp, Homo sapiens
gcagcctcttgggaggcagggctcacagca

SEQ ID NO: 33337 - DNA, 30 bp, Homo sapiens; identical to SEQ ID NO: 33336

SEQ ID NO: 33338 - DNA, 30 bp, Homo sapiens
aagaggatccacagcagctggggcggcagc

SEQ ID NO: 33339 - DNA, 30 bp, Homo sapiens
aagaggaggcacagcacaaggggcgggggc

SEQ ID NO: 33340 - DNA, 30 bp, Homo sapiens
gagcaggttgggcggcagcaggtggacaca

SEQ ID NO: 33341 - DNA, 30 bp, Homo sapiens
cagatggggtggaagcaggttgttctacag

SEQ ID NO: 33342 - DNA, 30 bp, Homo sapiens
gactggccacaatggggcctgtagcacctg

SEQ ID NO: 33343 - DNA, 30 bp, Homo sapiens; identical to SEQ ID NO: 33339

SEQ ID NO: 33344 - DNA, 30 bp, Homo sapiens
aagaggaggcacagcacaagggacgggggc

SEQ ID NO: 33345 - DNA, 30 bp, Homo sapiens
aagaggaggcgcagcacacggggcgggggc

SEQ ID NO: 33346 - DNA, 30 bp, Homo sapiens
cactggcagcacacggggacacagcaactg

SEQ ID NO: 33347 - DNA, 30 bp, Homo sapiens
atcttacactggcagcacacagggacacag

SEQ ID NO: 33348 - DNA, 30 bp, Homo sapiens
attttgcactggcagcaaatggggacacag

SEQ ID NO: 33349 - DNA, 30 bp, Homo sapiens
atcttgcactggcagcaaattgggacacag

SEQ ID NO: 33350 - DNA, 30 bp, Homo sapiens
atcttgcactggtagcacacagggacacag

SEQ ID NO: 33351 - DNA, 30 bp, Homo sapiens
taatagtagccagagccagagccgcatcca

SEQ ID NO: 33352 - DNA, 30 bp, Homo sapiens
ccgcatccatagccacagccacagaagaag

SEQ ID NO: 33353 - DNA, 30 bp, Homo sapiens
aattggtgaattgcaatgtcacaggataga

SEQ ID NO: 33354 - DNA, 30 bp, Homo sapiens
agtaggtgctgtagccaaagccagagccag

SEQ ID NO: 33355 - DNA, 30 bp, Homo sapiens
gccaggggaggcagcttgaggaagcgtctg

SEQ ID NO: 33356 - DNA, 30 bp, Homo sapiens
gcaaggactgcagcaacagctggggcggca

SEQ ID NO: 33357 - DNA, 30 bp, Homo sapiens
agaaggctggcagcagctgtacacacaggt

SEQ ID NO: 33358 - DNA, 30 bp, Homo sapiens
aaaaggctgacagcagctggacacacaggt

SEQ ID NO: 33359 - DNA, 30 bp, Homo sapiens
agctggacacacagcaggctgggcagtagc

SEQ ID NO: 33360 - DNA, 30 bp, Homo sapiens
agctggtcacacaggtgggctggaagcaag

SEQ ID NO: 33361 - DNA, 30 bp, Homo sapiens
agaaggctggcagcagctggacacacaggt

SEQ ID NO: 33362 - DNA, 30 bp, Homo sapiens; identical to SEQ ID NO: 33361

SEQ ID NO: 33363 - DNA, 30 bp, Homo sapiens
accttggctggtgtgaggactggagctgct

SEQ ID NO: 33364 - DNA, 30 bp, Homo sapiens
cccaacttctctgtgatgcccggatttctt

SEQ ID NO: 33365 - DNA, 30 bp, Homo sapiens
cactgggcatcaggagttgcgctcctcagt

SEQ ID NO: 33366 - DNA, 30 bp, Homo sapiens
gtgtccagggtgggagagccgccggttcag

SEQ ID NO: 33367 - DNA, 30 bp, Homo sapiens
atgtccagggtgagacaggcgacggtttcg

SEQ ID NO: 33368 - DNA, 30 bp, Homo sapiens
tgcaggctctggctcaaatactgaagaaac

SEQ ID NO: 33369 - DNA, 30 bp, Homo sapiens
agtgctctttctcctttgtgagctgttggt

SEQ ID NO: 33370 - DNA, 30 bp, Homo sapiens
atctcctcgtcatctgtctggctgcggccg

SEQ ID NO: 33371 - DNA, 30 bp, Homo sapiens
cactgggcattcactttgtatttcaggatg

SEQ ID NO: 33372 - DNA, 30 bp, Homo sapiens
tgatgtggcctatggcccttccctgccctg

SEQ ID NO: 33373 - DNA, 30 bp, Homo sapiens
tccacttccgcagcttctcgtccatggcct

SEQ ID NO: 33374 - DNA, 30 bp, Homo sapiens
cttgatgatttcttcagcagcatccagtgt

SEQ ID NO: 33375 - DNA, 30 bp, Homo sapiens
gattggtaaatttataaacatcatggaaag

SEQ ID NO: 33376 - DNA, 30 bp, Homo sapiens
tgaaggcaccagcaattcctcctgctcctg

SEQ ID NO: 33377 - DNA, 30 bp, Homo sapiens
ttctagggccacggcagggttgatggggga

SEQ ID NO: 33378 - DNA, 30 bp, Homo sapiens
taattctctcaaggtgggcatatgcaaaac

SEQ ID NO: 33379 - DNA, 30 bp, Homo sapiens
attgcaatggaagaagtagcagcaggagaa

SEQ ID NO: 33380 - DNA, 30 bp, Homo sapiens
agtaggttagttgccagagttccagcccag

SEQ ID NO: 33381 - DNA, 30 bp, Homo sapiens
ctcaggcctctccagtctcatgagtgacac

SEQ ID NO: 33382 - DNA, 30 bp, Homo sapiens
ctcaatgggtcgtcatcttctattataaag

SEQ ID NO: 33383 - DNA, 30 bp, Homo sapiens
gtttggcaagcaaatgagtgggtagagagc

SEQ ID NO: 33384 - DNA, 30 bp, Homo sapiens
tgatgttctcgacggagacaggcagctctg

SEQ ID NO: 33385 - DNA, 30 bp, Homo sapiens
atcaggatggaattgaaaattttgagagca

SEQ ID NO: 33386 - DNA, 30 bp, Homo sapiens
catcccctgacttcttggcctgaggcaata

SEQ ID NO: 33387 - DNA, 30 bp, Homo sapiens
ttaaggccatctcggacatgggagaaaaac

SEQ ID NO: 33388 - DNA, 30 bp, Homo sapiens
gtttggaaggaggcaggaagcagttataca

SEQ ID NO: 33389 - DNA, 30 bp, Homo sapiens
ccatggttttaatagactgaatttcttcag

SEQ ID NO: 33390 - DNA, 30 bp, Homo sapiens
cagtcgtcagcatatccaagtcatggaata

SEQ ID NO: 33391 - DNA, 30 bp, Homo sapiens
agtagggtatagccaaaagttgaatacaaa

SEQ ID NO: 33392 - DNA, 30 bp, Homo sapiens
aagcggtgctattgaggccaacagattgca

SEQ ID NO: 33393 - DNA, 30 bp, Homo sapiens
cttgtcaggatctgtgttgctaaatatttt

SEQ ID NO: 33394 - DNA, 30 bp, Homo sapiens
tgccccgcagccgcagcactctgtacgtgt

SEQ ID NO: 33395 - DNA, 30 bp, Homo sapiens
cgtccagcgaggagtcagatttctgtcccc

SEQ ID NO: 33396 - DNA, 30 bp, Homo sapiens
cagagctgctccggctcgggctcgggctcg

SEQ ID NO: 33397 - DNA, 30 bp, Homo sapiens
tagcgggaaacggggggcccaaagcgctgc

SEQ ID NO: 33398 - DNA, 30 bp, Homo sapiens
gtctggcaacggctgcatacgtgatggact

SEQ ID NO: 33399 - DNA, 30 bp, Homo sapiens
atccggaggcttcagtgcctggcacagtcc

SEQ ID NO: 33400 - DNA, 30 bp, Homo sapiens
ttccagcttctcagtgcagagggctttatg

SEQ ID NO: 33401 - DNA, 30 bp, Homo sapiens
actcggtcccaggacaggaatgaaggaaaa

SEQ ID NO: 33402 - DNA, 30 bp, Homo sapiens
tacaggttgaacgcccctcagttccagggc

SEQ ID NO: 33403 - DNA, 30 bp, Homo sapiens
ctgaggtcacatagcgagcacaactaatac

SEQ ID NO: 33404 - DNA, 30 bp, Homo sapiens
tactggtcaggacaaccattcagactgaca

SEQ ID NO: 33405 - DNA, 30 bp, Homo sapiens
tgctggacaggagttgatgcttacggcgcc

SEQ ID NO: 33406 - DNA, 30 bp, Homo sapiens
tgacctagcccaggtgaaactctcaaggca

SEQ ID NO: 33407 - DNA, 30 bp, Homo sapiens
aggcggctgggcagccactggcccccactg

SEQ ID NO: 33408 - DNA, 30 bp, Homo sapiens
ttctggcttatatcctttaggagtgaacgg

SEQ ID NO: 33409 - DNA, 30 bp, Homo sapiens
cactggcaggtgttgtagatctgcacctgc

SEQ ID NO: 33410 - DNA, 30 bp, Homo sapiens
tgcaggtggcatagtagagcacgcgcccat

SEQ ID NO: 33411 - DNA, 30 bp, Homo sapiens
ctcaggaggcggaggttgcagtgagccgag

SEQ ID NO: 33412 - DNA, 30 bp, Homo sapiens
gcctggtcacagtggctactttgagaggtc

SEQ ID NO: 33413 - DNA, 30 bp, Homo sapiens
tatagcacctagcatattttttttcttgtt

SEQ ID NO: 33414 - DNA, 30 bp, Homo sapiens
caatggacggggtgttgaagcagccagatg

SEQ ID NO: 33415 - DNA, 30 bp, Homo sapiens
agatgcaggaggccgtctaatgtgttgagt

SEQ ID NO: 33416 - DNA, 30 bp, Homo sapiens
gcctgggtattgtagcagcctgggggcagg

SEQ ID NO: 33417 - DNA, 30 bp, Homo sapiens
ctgccagctggcacagttctcgggcaggct

SEQ ID NO: 33418 - DNA, 30 bp, Homo sapiens
tagatagtctggtagcctgcgtgactcctc

SEQ ID NO: 33419 - DNA, 30 bp, Homo sapiens
cgacttttccttcttccaatcatataagag

SEQ ID NO: 33420 - DNA, 30 bp, Homo sapiens
tgatggtgcttgagaccaataaaataagcc

SEQ ID NO: 33421 - DNA, 30 bp, Homo sapiens
taactttttcttctgccaattacgtaagca

SEQ ID NO: 33422 - DNA, 30 bp, Homo sapiens
ctctggtatccagatgattgacaccttagg

SEQ ID NO: 33423 - DNA, 30 bp, Homo sapiens
gcccatgtgcttatactgggatctgtcccg

SEQ ID NO: 33424 - DNA, 30 bp, Homo sapiens
catgggatcccaaactgtacaaccagctcc

SEQ ID NO: 33425 - DNA, 30 bp, Homo sapiens
agatgccgccacttgggtgaggggctcctc

SEQ ID NO: 33426 - DNA, 30 bp, Homo sapiens
cttgtctcagttcttcaaacaatggagcaa

SEQ ID NO: 33427 - DNA, 30 bp, Homo sapiens
ccagcagtgtgtgttctccaaagaccactg

SEQ ID NO: 33428 - DNA, 30 bp, Homo sapiens
caatgggctcccgacctcggttctgcctct

SEQ ID NO: 33429 - DNA, 30 bp, Homo sapiens
aagaggccattttgtgcactgccaccgtga

SEQ ID NO: 33430 - DNA, 30 bp, Homo sapiens
agagttcaaatgcagggaacctggcttttg

SEQ ID NO: 33431 - DNA, 30 bp, Homo sapiens
aatccctcttcgaagagtcaagttcaaatg

SEQ ID NO: 33432 - DNA, 30 bp, Homo sapiens
agccggtacagcagcaggaagacataggca

SEQ ID NO: 33433 - DNA, 30 bp, Homo sapiens
aaacaaagacgctgaagagtgggaattcag

SEQ ID NO: 33434 - DNA, 30 bp, Homo sapiens
ttgtgggcctcccagtcatgcctttccgta

SEQ ID NO: 33435 - DNA, 30 bp, Homo sapiens
ggcaggtaagtaaggaggtggtggttcttt

SEQ ID NO: 33436 - DNA, 30 bp, Homo sapiens
gtaaggtggcggtggctccttggcagcacc

SEQ ID NO: 33437 - DNA, 30 bp, Homo sapiens
agtatgggggtggtgctgggcccccctctg

SEQ ID NO: 33438 - DNA, 30 bp, Homo sapiens
tctcggctgtgagatatttcagggcagcaa

SEQ ID NO: 33439 - DNA, 30 bp, Homo sapiens
cctcgggcagggctctggggctgctgcagg

SEQ ID NO: 33440 - DNA, 30 bp, Homo sapiens
gtctgtgtgttcgagtgctggcttgtccat

SEQ ID NO: 33441 - DNA, 30 bp, Homo sapiens
tgttggccagaaacaattacctttatggct

SEQ ID NO: 33442 - DNA, 30 bp, Homo sapiens
aacccactgttacatcgtttgctctagaag

SEQ ID NO: 33443 - DNA, 30 bp, Homo sapiens
gcttggcctggtacaaactctggacaatca

SEQ ID NO: 33444 - DNA, 30 bp, Homo sapiens
ctccggtgaaatattccttctgggagagtt

SEQ ID NO: 33445 - DNA, 30 bp, Homo sapiens
cctaccatagtccccattctgttccacctg

SEQ ID NO: 33446 - DNA, 30 bp, Homo sapiens
ttcatagcagcagcatttgttttataagat

SEQ ID NO: 33447 - DNA, 30 bp, Homo sapiens
cgatggctttgtagtacttggaggagaaac

SEQ ID NO: 33448 - DNA, 30 bp, Homo sapiens
gggtggcacatattgctctttgccattacg

SEQ ID NO: 33449 - DNA, 30 bp, Homo sapiens
ctgaggagacttggggggagtgctctgctc

SEQ ID NO: 33450 - DNA, 30 bp, Homo sapiens
tgctgggtgctgtgctaggtgctgaagata

SEQ ID NO: 33451 - DNA, 30 bp, Homo sapiens
tcctctcatggccatgaaatcctctggtgt

SEQ ID NO: 33452 - DNA, 30 bp, Homo sapiens
ttcttttcccgaggctgattaagttttgcc

SEQ ID NO: 33453 - DNA, 30 bp, Homo sapiens
agattattgtatcgccaatatccaccctta

SEQ ID NO: 33454 - DNA, 30 bp, Homo sapiens
accaggaagttgatgagggcagttctcggg

SEQ ID NO: 33455 - DNA, 30 bp, Homo sapiens
gaagagctgcaggccagttttgagcccatg

SEQ ID NO: 33456 - DNA, 30 bp, Homo sapiens
agatggcctccacgtagttggccggcagca

SEQ ID NO: 33457 - DNA, 30 bp, Homo sapiens
gttcagctcctgcagattctcgtaatctgg

SEQ ID NO: 33458 - DNA, 30 bp, Homo sapiens
gcttctgtggctgccacctccccattcacg

SEQ ID NO: 33459 - DNA, 30 bp, Homo sapiens
gctgctctgagccttgtgaattaatgtatt

SEQ ID NO: 33460 - DNA, 30 bp, Homo sapiens
gctcttcatctttcttgtttttcctaacag

SEQ ID NO: 33461 - DNA, 30 bp, Homo sapiens
tacacgtacacaggctggcagccttcagtc

SEQ ID NO: 33462 - DNA, 30 bp, Homo sapiens
atcaggaaggagctgagtgccaggcccctg

SEQ ID NO: 33463 - DNA, 30 bp, Homo sapiens
atccagactccttactcctccccatttggt

SEQ ID NO: 33464 - DNA, 30 bp, Homo sapiens
acacagcaagaccaggacaggtgattcagg

SEQ ID NO: 33465 - DNA, 30 bp, Homo sapiens
tcctggctggctttgaaggggcttccactt

SEQ ID NO: 33466 - DNA, 30 bp, Homo sapiens
actctcatgtattggacattggcacccaag

SEQ ID NO: 33467 - DNA, 30 bp, Homo sapiens
ccacgccgtatttcttcttacagtggtact

SEQ ID NO: 33468 - DNA, 30 bp, Homo sapiens
aatcgtccacgtcgatctcttcgtcttcct

SEQ ID NO: 33469 - DNA, 30 bp, Homo sapiens
gtatctcctcgtctgacaggtggggccggg

SEQ ID NO: 33470 - DNA, 30 bp, Homo sapiens
tgctggtttatcgtctgcatgttttaatcg

SEQ ID NO: 33471 - DNA, 30 bp, Homo sapiens
gtaggtgacgatggcttaatagaatttacc

SEQ ID NO: 33472 - DNA, 30 bp, Homo sapiens
ttcaggaggcgggggctctgggctggcagt

SEQ ID NO: 33473 - DNA, 30 bp, Homo sapiens
tagcagcagcctccagagtgctggccactc

SEQ ID NO: 33474 - DNA, 30 bp, Homo sapiens
cagcagcagcctccagagtgctggccactc

SEQ ID NO: 33475 - DNA, 30 bp, Homo sapiens
agctgtggcagcagccagagcccccagaag

SEQ ID NO: 33476 - DNA, 30 bp, Homo sapiens
cagcagcagcccccagagctgtggcagcag

SEQ ID NO: 33477 - DNA, 30 bp, Homo sapiens
gaactgtggccacagctggagctcccgcct

SEQ ID NO: 33478 - DNA, 30 bp, Homo sapiens
gagccatagccacagtcggaggcaccatct

SEQ ID NO: 33479 - DNA, 30 bp, Homo sapiens
gaaccgtggcagcagccagagcccccgcct

SEQ ID NO: 33480 - DNA, 30 bp, Homo sapiens
cagcaacagccccctccagagcagcagcca

SEQ ID NO: 33481 - DNA, 30 bp, Homo sapiens
cagcagcagcctccagagctgtggcagcag

SEQ ID NO: 33482 - DNA, 30 bp, Homo sapiens
cactcttcctctttgcagtggtaggttgtg

SEQ ID NO: 33483 - DNA, 30 bp, Homo sapiens
aaggctgaggctggtactggccctctgtgg

SEQ ID NO: 33484 - DNA, 30 bp, Homo sapiens
agtcggtaacatgcaagttctatgatctcc

SEQ ID NO: 33485 - DNA, 30 bp, Homo sapiens
tcatttcctcctttggttgcccagcaaagg

SEQ ID NO: 33486 - DNA, 30 bp, Homo sapiens
tgcccagcacttaaggaagaaaggtctaat

SEQ ID NO: 33487 - DNA, 30 bp, Homo sapiens
accaggagagggggcgcagggcagggggaa

SEQ ID NO: 33488 - DNA, 30 bp, Homo sapiens
tcgctccctggagagcaggtttcgctctgc

SEQ ID NO: 33489 - DNA, 30 bp, Homo sapiens
ggcaggatggtgtgtgtacgggacgcgtct

SEQ ID NO: 33490 - DNA, 30 bp, Homo sapiens
acagacgctggcctggggtgaccagccagt

SEQ ID NO: 33491 - DNA, 30 bp, Homo sapiens
tgctctcagggttgcatgcatctgactggg

SEQ ID NO: 33492 - DNA, 30 bp, Homo sapiens
cactggtcgattgggacagggaagacgatg

SEQ ID NO: 33493 - DNA, 30 bp, Homo sapiens
actgtgacaggaagcccaggctcctgctcc

SEQ ID NO: 33494 - DNA, 30 bp, Homo sapiens
tcaggagctcggcacaccgcccaggccggg

SEQ ID NO: 33495 - DNA, 30 bp, Homo sapiens
cgggctcctgtaatgcttggagtagcaggg

SEQ ID NO: 33496 - DNA, 30 bp, Homo sapiens
ccttggagtccaggaagtcctggtcatctg

SEQ ID NO: 33497 - DNA, 30 bp, Homo sapiens
actttgcatccagccgcctccgtttgctgt

SEQ ID NO: 33498 - DNA, 30 bp, Homo sapiens
ccctggggatctaattcaatctttacagaa

SEQ ID NO: 33499 - DNA, 30 bp, Homo sapiens
ctctcctttactttgtactccagtgtactg

SEQ ID NO: 33500 - DNA, 30 bp, Homo sapiens
cacaggcttgctgctgtttttgcagctgcc

SEQ ID NO: 33501 - DNA, 30 bp, Homo sapiens
ttttggttatgaactgtacagctcgttaga

SEQ ID NO: 33502 - DNA, 30 bp, Homo sapiens
accctcttcattcctttccccatgaggcag

SEQ ID NO: 33503 - DNA, 30 bp, Homo sapiens
tatgggtaccctgcagcatgcgttaatgtg

SEQ ID NO: 33504 - DNA, 30 bp, Homo sapiens
caccgggctcaattcctgttggcttcgttg

SEQ ID NO: 33505 - DNA, 30 bp, Homo sapiens
ctcaggaggagcattagtagaacagcagtg

SEQ ID NO: 33506 - DNA, 30 bp, Homo sapiens
ttttggacaagtcatcctttagggagtcag

SEQ ID NO: 33507 - DNA, 30 bp, Homo sapiens
tttcttggcccccaaggtaggcagcattag

SEQ ID NO: 33508 - DNA, 30 bp, Homo sapiens
tactgggaggcctgtgacgtggggttctcc

SEQ ID NO: 33509 - DNA, 30 bp, Homo sapiens
aatgcttctccttaaattggccagaagggg

SEQ ID NO: 33510 - DNA, 30 bp, Homo sapiens
tgcgcagcctgacactggagaacgagcaat

SEQ ID NO: 33511 - DNA, 30 bp, Homo sapiens
tattgggaagcctggggtggggggttttct

SEQ ID NO: 33512 - DNA, 30 bp, Homo sapiens
acaagttgatggtgtgtgcgtgcttcttgc

SEQ ID NO: 33513 - DNA, 30 bp, Homo sapiens
gaaaggccatggtgccagttgcgcaatttg

SEQ ID NO: 33514 - DNA, 30 bp, Homo sapiens
ggatcccccaaagtgtatctgcactcttct

SEQ ID NO: 33515 - DNA, 30 bp, Homo sapiens
cctagaatcctgttgtagcctagacagtga

SEQ ID NO: 33516 - DNA, 30 bp, Homo sapiens
aaccacctgcttgtgaacctctttccactg

SEQ ID NO: 33517 - DNA, 30 bp, Homo sapiens
gaatttcccaaagtgtttctgcactctttt

SEQ ID NO: 33518 - DNA, 30 bp, Homo sapiens
cttcaggggtcagctttatctttataaggt

SEQ ID NO: 33519 - DNA, 30 bp, Homo sapiens
cacaggtcttttaggtccttctggatgtcc

SEQ ID NO: 33520 - DNA, 30 bp, Homo sapiens
tgtttctgcactcttcttgaaaagggcctc

SEQ ID NO: 33521 - DNA, 30 bp, Homo sapiens
cacagcactttgcctggattcatgaggcct

SEQ ID NO: 33522 - DNA, 30 bp, Homo sapiens
catcctccagactgaccatctgtctcgagg

SEQ ID NO: 33523 - DNA, 30 bp, Homo sapiens
cagggtccgggacaggcatactcatcggac

SEQ ID NO: 33524 - DNA, 30 bp, Homo sapiens
agttgttagtgccatcacatttttggtctg

SEQ ID NO: 33525 - DNA, 30 bp, Homo sapiens
cagtggagccttccaaagctgcgtcttgtc

SEQ ID NO: 33526 - DNA, 30 bp, Homo sapiens
ccctggctgggctcagagtccctgggctca

SEQ ID NO: 33527 - DNA, 30 bp, Homo sapiens
accaggttcccaggcttcctatctttgcct

SEQ ID NO: 33528 - DNA, 30 bp, Homo sapiens
gaagctgaagaggtcatcctgctctgtgcc

SEQ ID NO: 33529 - DNA, 30 bp, Homo sapiens
aatcatcctcctcttcttcgtcgtcgtcgt

SEQ ID NO: 33530 - DNA, 30 bp, Homo sapiens
tcctgggccacacttaaggaacagcgtctt

SEQ ID NO: 33531 - DNA, 30 bp, Homo sapiens
tacaggtatgcagtagggtcactcgagtca

SEQ ID NO: 33532 - DNA, 30 bp, Homo sapiens
tcttggacctgtacctgatgcagattcctg

SEQ ID NO: 33533 - DNA, 30 bp, Homo sapiens
ccagaagaggtcctggggtcgctgccttgg

SEQ ID NO: 33534 - DNA, 30 bp, Homo sapiens
ggctggagcctccttggcacgagcgcacca

SEQ ID NO: 33535 - DNA, 30 bp, Homo sapiens
ggctggagcctccttggcacgagcgcccca

SEQ ID NO: 33536 - DNA, 30 bp, Homo sapiens
tctcctaagaatggcagccagtctctgtct

SEQ ID NO: 33537 - DNA, 30 bp, Homo sapiens
actcacgttcagctttcaagcccttacgta

SEQ ID NO: 33538 - DNA, 30 bp, Homo sapiens
ctctgggggagggcagggaggtgggcaagc

SEQ ID NO: 33539 - DNA, 30 bp, Homo sapiens
cactgggaaaccttcttctctccagctctc

SEQ ID NO: 33540 - DNA, 30 bp, Homo sapiens
agcgacttattttccacagtcaggtagaca

SEQ ID NO: 33541 - DNA, 30 bp, Homo sapiens
agaaggaagagggcttagtccatctccaca

SEQ ID NO: 33542 - DNA, 30 bp, Homo sapiens
gaattggttaggccagtccgaagacgaaga

SEQ ID NO: 33543 - DNA, 30 bp, Homo sapiens
atccagcagttccttgatacaccagcagca

SEQ ID NO: 33544 - DNA, 30 bp, Homo sapiens
gtaaggtgagggtcctgctggcgggggcgc

SEQ ID NO: 33545 - DNA, 30 bp, Homo sapiens
agaaggctgacagctgcgccaggctgaggc

SEQ ID NO: 33546 - DNA, 30 bp, Homo sapiens
tccagggggatctcagccaggggctggaaa

SEQ ID NO: 33547 - DNA, 30 bp, Homo sapiens
ttccggaaggttcacctcatcactggtaag

SEQ ID NO: 33548 - DNA, 30 bp, Homo sapiens
catcgctgatcacatacttcttatgctttt

SEQ ID NO: 33549 - DNA, 30 bp, Homo sapiens
cacccagggctgaggtccagctgccacagc

SEQ ID NO: 33550 - DNA, 30 bp, Homo sapiens
cagaggaccctgtggccttccgcagtgttt

SEQ ID NO: 33551 - DNA, 30 bp, Homo sapiens
tcaaccaacctccacccagtagttcctttg

SEQ ID NO: 33552 - DNA, 30 bp, Homo sapiens
gcccaggaacaattcttggggttcggaaca

SEQ ID NO: 33553 - DNA, 30 bp, Homo sapiens
tcttatgagtctgagtagaacaagtttgga

SEQ ID NO: 33554 - DNA, 30 bp, Homo sapiens
ctcccagctaaaatcatctcctcttccaaa

SEQ ID NO: 33555 - DNA, 30 bp, Homo sapiens
ttgtggcatctccataatcctctaaggcac

SEQ ID NO: 33556 - DNA, 30 bp, Homo sapiens
ctgccagctgaagtcgtcattgcttccaaa

SEQ ID NO: 33557 - DNA, 30 bp, Homo sapiens
gagagggagggcaaagcaggaatcctagag

SEQ ID NO: 33558 - DNA, 30 bp, Homo sapiens
cgacctccttctctgccttctctttggcct

SEQ ID NO: 33559 - DNA, 30 bp, Homo sapiens
gaactagccttgctgttctgggccgtcatt

SEQ ID NO: 33560 - DNA, 30 bp, Homo sapiens
cttcgtctctctcgtctggtcaggacctgt

SEQ ID NO: 33561 - DNA, 30 bp, Homo sapiens
cagtcagctggccaatccccagctttgcca

SEQ ID NO: 33562 - DNA, 30 bp, Homo sapiens
cccaaggtagttggtggagagcaggaccac

SEQ ID NO: 33563 - DNA, 30 bp, Homo sapiens
tcccagccaagttcgacacctatcgatttt

SEQ ID NO: 33564 - DNA, 30 bp, Homo sapiens
tcaaggcatactggaaaaagatattgattt

SEQ ID NO: 33565 - DNA, 30 bp, Homo sapiens
agtaggatctgaattgtaatccacagttgg

SEQ ID NO: 33566 - DNA, 30 bp, Homo sapiens
cattggtgagaggccaaaattgatgacttc

SEQ ID NO: 33567 - DNA, 30 bp, Homo sapiens
gaagatggcagtgcggggacaccagggtgt

SEQ ID NO: 33568 - DNA, 30 bp, Homo sapiens
ggatgggtcggcctccaccgagaagggccc

SEQ ID NO: 33569 - DNA, 30 bp, Homo sapiens
caaaggccacacatttgatcttgaagtcac

SEQ ID NO: 33570 - DNA, 30 bp, Homo sapiens
gagtggacacagtagagctggacacttcca

SEQ ID NO: 33571 - DNA, 30 bp, Homo sapiens
attgcagacacacactgaggtcagggagat

SEQ ID NO: 33572 - DNA, 30 bp, Homo sapiens
atcgctgataagcactctggtcagggagat

SEQ ID NO: 33573 - DNA, 30 bp, Homo sapiens
attgttgacaagcactgagtccagggagac

SEQ ID NO: 33574 - DNA, 30 bp, Homo sapiens
ccttacgctcaggtagctcaggtggctgtg

SEQ ID NO: 33575 - DNA, 30 bp, Homo sapiens
gttctcattgaagcgtgggttaaagtggaa

SEQ ID NO: 33576 - DNA, 30 bp, Homo sapiens
tcatggtatatgaagcactggtgaggtcta

SEQ ID NO: 33577 - DNA, 30 bp, Homo sapiens
agtccacacctgaggagttggtcaggtaga

SEQ ID NO: 33578 - DNA, 30 bp, Homo sapiens
atctggacataggacaaggtgacatcaccc

SEQ ID NO: 33579 - DNA, 30 bp, Homo sapiens
tcacggagtccagctgcacgtccccgccca

SEQ ID NO: 33580 - DNA, 30 bp, Homo sapiens
ccttacttccagtaagtggatgtctccatt

SEQ ID NO: 33581 - DNA, 30 bp, Homo sapiens
atgtctgcacatgggtcagctggatgtcgc

SEQ ID NO: 33582 - DNA, 30 bp, Homo sapiens
gcgatggtagtattcaaacaggtgctgacc

SEQ ID NO: 33583 - DNA, 30 bp, Homo sapiens
atgtctgcacgtgggtcagctggatgtcgc

SEQ ID NO: 33584 - DNA, 30 bp, Homo sapiens
gcttggtgatctggaggtctccatttatct

SEQ ID NO: 33585 - DNA, 30 bp, Homo sapiens
ggaaggtcttttccacatggtcccattcaa

SEQ ID NO: 33586 - DNA, 30 bp, Homo sapiens
tcttggtgcctgaacatttaattcctgaaa

SEQ ID NO: 33587 - DNA, 30 bp, Homo sapiens
cggtggagacagctgtgaatgaacgaggcg

SEQ ID NO: 33588 - DNA, 30 bp, Homo sapiens
aggcactgagatccaccacaatgtgtctat

SEQ ID NO: 33589 - DNA, 30 bp, Homo sapiens
ctgaggtcgatctcgtgatgctggtagatc

SEQ ID NO: 33590 - DNA, 30 bp, Homo sapiens
ccaaggcacacgtggtccatggacaatttt

SEQ ID NO: 33591 - DNA, 30 bp, Homo sapiens
caaagggaatcctctactctggtagaagca

SEQ ID NO: 33592 - DNA, 30 bp, Homo sapiens
cagaggaaagatggcagctctcagtcactg

SEQ ID NO: 33593 - DNA, 30 bp, Homo sapiens
caaaggccaagccagagggctgaaagccgc

SEQ ID NO: 33594 - DNA, 30 bp, Homo sapiens
aaccattttttcccagtgatcgtgagctgc

SEQ ID NO: 33595 - DNA, 30 bp, Homo sapiens
catatttcttcatggcaacaaaatatcgaa

SEQ ID NO: 33596 - DNA, 30 bp, Homo sapiens
tagaggaagaggaggcctgagagttggggg

SEQ ID NO: 33597 - DNA, 30 bp, Homo sapiens
tctaggagagctgtaccttgacagtgcaat

SEQ ID NO: 33598 - DNA, 30 bp, Homo sapiens
ttgaggcaatggtcaagctccatagcataa

SEQ ID NO: 33599 - DNA, 30 bp, Homo sapiens
taaaggaggcagatcagatttttcccctct

SEQ ID NO: 33600 - DNA, 30 bp, Homo sapiens
gttcctctgccatcaagctgtcttgtcgat

SEQ ID NO: 33601 - DNA, 30 bp, Homo sapiens
agggtccctgtgagtgagccacggggcagg

SEQ ID NO: 33602 - DNA, 30 bp, Homo sapiens
gccttgtagtcgtcagggaggagcttgtcc

SEQ ID NO: 33603 - DNA, 30 bp, Homo sapiens
cagtatgggtagtgcttctgtttcttgccc

SEQ ID NO: 33604 - DNA, 30 bp, Homo sapiens
ctatcgcttgcagggcagacttgaaaaact

SEQ ID NO: 33605 - DNA, 30 bp, Homo sapiens
cttgtcggcgtgctgcagcagcaggtccac

SEQ ID NO: 33606 - DNA, 30 bp, Homo sapiens
cactgggcctggtgggcttccactcctatc

SEQ ID NO: 33607 - DNA, 30 bp, Homo sapiens
taccacacggccgcctcgttcatttcgggg

SEQ ID NO: 33608 - DNA, 30 bp, Homo sapiens
aaaaggttggtaagagtcgtttgtgagggg

SEQ ID NO: 33609 - DNA, 30 bp, Homo sapiens
gcgtggtctacctcatccagccaggaggcg

SEQ ID NO: 33610 - DNA, 30 bp, Homo sapiens
aaaaggaggatgatccatttcatcgagcca

SEQ ID NO: 33611 - DNA, 30 bp, Homo sapiens
cacacggcggcttcgttgagctcggggttg

SEQ ID NO: 33612 - DNA, 30 bp, Homo sapiens
cagcggctgaggggcagctgtggggcgccc

SEQ ID NO: 33613 - DNA, 30 bp, Homo sapiens
aaaaggatgaccttctcaccccggttggag

SEQ ID NO: 33614 - DNA, 30 bp, Homo sapiens
gaatggggtaacaagggctggagtccaaga

SEQ ID NO: 33615 - DNA, 30 bp, Homo sapiens
gaggggcttccggattcgtggctgtccatg

SEQ ID NO: 33616 - DNA, 30 bp, Homo sapiens
catgatcgtggctgtggcggtggcatattc

SEQ ID NO: 33617 - DNA, 30 bp, Homo sapiens
tagaggtcttttgtttttcttttagccact

SEQ ID NO: 33618 - DNA, 30 bp, Homo sapiens
ggtgacgccttgttggctgcatatattgtc

SEQ ID NO: 33619 - DNA, 30 bp, Homo sapiens
tagaggttgaggctggccctaccatgatcg

SEQ ID NO: 33620 - DNA, 30 bp, Homo sapiens
caaaggctctgtgattcagtgatgctgtgc

SEQ ID NO: 33621 - DNA, 30 bp, Homo sapiens
agaaggcctgggccaacacggcgatgatct

SEQ ID NO: 33622 - DNA, 30 bp, Homo sapiens
gtttggtttgttctgaaaaaagtttgtaaa

SEQ ID NO: 33623 - DNA, 30 bp, Homo sapiens
agtaggtatcttcagggtcagagcctgagt

SEQ ID NO: 33624 - DNA, 30 bp, Homo sapiens
tgctggcacagttcttcctctctgctcact

SEQ ID NO: 33625 - DNA, 30 bp, Homo sapiens
agcagggagctaccagtctccgtttccgga

SEQ ID NO: 33626 - DNA, 30 bp, Homo sapiens
ctaaacaagaaactacttttgctccatgaa

SEQ ID NO: 33627 - DNA, 30 bp, Homo sapiens
cagaggcttctctggctgtgctgagcctca

SEQ ID NO: 33628 - DNA, 30 bp, Homo sapiens
tcaccagccttggaatcggacttgttttgt

SEQ ID NO: 33629 - DNA, 30 bp, Homo sapiens
tcccggctgcatcttgtaggcttctctggc

SEQ ID NO: 33630 - DNA, 30 bp, Homo sapiens
gcacagaggcctccaggtgagcacaggagg

SEQ ID NO: 33631 - DNA, 30 bp, Homo sapiens
tcaccagccttggagtcggacttgttttgt

SEQ ID NO: 33632 - DNA, 30 bp, Homo sapiens
ccaaggctccaccactctgaagggtgcatt

SEQ ID NO: 33633 - DNA, 30 bp, Homo sapiens
agcaggggctgccctgcctgtaaagctctc

SEQ ID NO: 33634 - DNA, 30 bp, Homo sapiens
agctgcagcttgggggcttctctggctgtg

SEQ ID NO: 33635 - DNA, 30 bp, Homo sapiens
ggctgcatcttgggggtttctctggctgtg

SEQ ID NO: 33636 - DNA, 30 bp, Homo sapiens
actcaccactctggggatccgacccggtgg

SEQ ID NO: 33637 - DNA, 30 bp, Homo sapiens
tagtggatggccagagtggcgtagatgctg

SEQ ID NO: 33638 - DNA, 30 bp, Homo sapiens
tagtggatggccagggtggcgtagatgctg

SEQ ID NO: 33639 - DNA, 30 bp, Homo sapiens
cgtcggcagctgggctggactcgatgtcca

SEQ ID NO: 33640 - DNA, 30 bp, Homo sapiens
actcaccactttggggatccgacccagtgg

SEQ ID NO: 33641 - DNA, 30 bp, Homo sapiens; identical to SEQ ID NO: 33637

SEQ ID NO: 33642 - DNA, 30 bp, Homo sapiens
actcaccactgtgggggactgaccctgtag

SEQ ID NO: 33643 - DNA, 30 bp, Homo sapiens
tagtggatggccagagtggcatagacactg

SEQ ID NO: 33644 - DNA, 30 bp, Homo sapiens
tagtggatggccaggggggcgtagatgctg

SEQ ID NO: 33645 - DNA, 30 bp, Homo sapiens
cagcggggtgtagacaggcgccggcattca

SEQ ID NO: 33646 - DNA, 30 bp, Homo sapiens
cctcatcataataccgatttctctttatct

SEQ ID NO: 33647 - DNA, 30 bp, Homo sapiens
cacaatgttgtaggctgcccggcacttctg

SEQ ID NO: 33648 - DNA, 30 bp, Homo sapiens
aagtggtgctggtgaagggctgtagatgag

SEQ ID NO: 33649 - DNA, 30 bp, Homo sapiens
caatggtgtgtcagggaactgacacccact

SEQ ID NO: 33650 - DNA, 30 bp, Homo sapiens
tcttcccctgctgtggctcttggggactgc

SEQ ID NO: 33651 - DNA, 30 bp, Homo sapiens
ggcagggaggcagggaggggtctccagccc

SEQ ID NO: 33652 - DNA, 30 bp, Homo sapiens
agtcggggacctcagggtgggcaggcagtc

SEQ ID NO: 33653 - DNA, 30 bp, Homo sapiens
cttcttctggggtgtgctcagcttctgcat

SEQ ID NO: 33654 - DNA, 30 bp, Homo sapiens
gggaggtgagtcccgggtcaggccgtactg

SEQ ID NO: 33655 - DNA, 30 bp, Homo sapiens
ctaaggtctcagctagtttcttaagtcttt

SEQ ID NO: 33656 - DNA, 30 bp, Homo sapiens
ggcagagttgaggtctgtggccttgggctg

SEQ ID NO: 33657 - DNA, 30 bp, Homo sapiens
agaagagtccttctgggaactgctggaagc

SEQ ID NO: 33658 - DNA, 30 bp, Homo sapiens
ctccgggagcagggtagggctgtggatttc

SEQ ID NO: 33659 - DNA, 30 bp, Homo sapiens
ttgaactgaaggcccctttttgctttgctc

SEQ ID NO: 33660 - DNA, 30 bp, Homo sapiens
cgtaggatcttcatgctttctgagtaacga

SEQ ID NO: 33661 - DNA, 30 bp, Homo sapiens
tcttgggcttctctagaatattgaggaatt

SEQ ID NO: 33662 - DNA, 30 bp, Homo sapiens
tcatggcacaagggtcactttttgcctttc

SEQ ID NO: 33663 - DNA, 30 bp, Homo sapiens
acatgtggttttgttgtgtttgttgctgct

SEQ ID NO: 33664 - DNA, 30 bp, Homo sapiens
ccaaggacgagtagctctgatgctgttggc

SEQ ID NO: 33665 - DNA, 30 bp, Homo sapiens
ttttgctgatctcattttttcaaagcgcga

SEQ ID NO: 33666 - DNA, 30 bp, Homo sapiens
tgttggtgttatttgctgcaaaggcatgta

SEQ ID NO: 33667 - DNA, 30 bp, Homo sapiens
aagcggaactggaagacatgaagcagcact

SEQ ID NO: 33668 - DNA, 30 bp, Homo sapiens
tcctccggctttggcctggcccaggtgggt

SEQ ID NO: 33669 - DNA, 30 bp, Homo sapiens
gagtggggattcgactctgcatctctacat

SEQ ID NO: 33670 - DNA, 30 bp, Homo sapiens
cacaggagctgctcttcaactgtttctgtt

SEQ ID NO: 33671 - DNA, 30 bp, Homo sapiens
acttgggaggctgaggcaagagaatggctt

SEQ ID NO: 33672 - DNA, 30 bp, Homo sapiens
ctcacagatgtaaacaggagactctgattt

SEQ ID NO: 33673 - DNA, 30 bp, Homo sapiens
gacaggggaaaggttctggaagctggaggc

SEQ ID NO: 33674 - DNA, 30 bp, Homo sapiens
tccccccagccacagctctttgggggctgc

SEQ ID NO: 33675 - DNA, 30 bp, Homo sapiens
ttgcggggcgcgtcggcggagctgatgcct

SEQ ID NO: 33676 - DNA, 30 bp, Homo sapiens
tcctgggtccagctacctccccttccacaa

SEQ ID NO: 33677 - DNA, 30 bp, Homo sapiens
agatcatcttcatgttgaacttgcgcgcgc

SEQ ID NO: 33678 - DNA, 30 bp, Homo sapiens
gcttggcagtgacccggttacccccagagt

SEQ ID NO: 33679 - DNA, 30 bp, Homo sapiens
agttggattatatgggaaaagatttttctt

SEQ ID NO: 33680 - DNA, 30 bp, Homo sapiens
aggggcatccaggccccaaatgaagtcaag

SEQ ID NO: 33681 - DNA, 30 bp, Homo sapiens
ggttgggcgaagtagtaggtcatctgtgtt

SEQ ID NO: 33682 - DNA, 30 bp, Homo sapiens
gcagcccccgtctacccccgcagcccccgt

SEQ ID NO: 33683 - DNA, 30 bp, Homo sapiens
cccagataaagtccaagtgattgtaaaaag

SEQ ID NO: 33684 - DNA, 30 bp, Homo sapiens
gggaagctccacagtgggactggtttcgtt

SEQ ID NO: 33685 - DNA, 30 bp, Homo sapiens
ctctgggcaaagaataggttggaagactgt

SEQ ID NO: 33686 - DNA, 30 bp, Homo sapiens
ctttggtgtacatgtgtttggattaagaaa

SEQ ID NO: 33687 - DNA, 30 bp, Homo sapiens
tgatggaagaaggcatcttatgtgttcttt

SEQ ID NO: 33688 - DNA, 30 bp, Homo sapiens
caaattgcagttgccacattcatgtttgtc

SEQ ID NO: 33689 - DNA, 30 bp, Homo sapiens
ctgaggtgcatcctctccaaggtaaaaatc

SEQ ID NO: 33690 - DNA, 30 bp, Homo sapiens
atacggcctcacaccgtccctgggaaaggt

SEQ ID NO: 33691 - DNA, 30 bp, Homo sapiens
ttgaggggcatcgaggccccagacaaaatc

SEQ ID NO: 33692 - DNA, 30 bp, Homo sapiens
ttgtggacatgttctaagtaatatatttgt

SEQ ID NO: 33693 - DNA, 30 bp, Homo sapiens
ccaaccagtccacagggcacgatgtgctca

SEQ ID NO: 33694 - DNA, 30 bp, Homo sapiens
agttggggctgtcctctgagatcagtgtgc

SEQ ID NO: 33695 - DNA, 30 bp, Homo sapiens
agctgggcggattgcaggagcccaggagat

SEQ ID NO: 33696 - DNA, 30 bp, Homo sapiens
aacgcttgtaggtgcccaggagagctctgc

SEQ ID NO: 33697 - DNA, 30 bp, Homo sapiens
tagtgatagccacacagggccgtaaggctc

SEQ ID NO: 33698 - DNA, 30 bp, Homo sapiens
agttggaagaatgcatattgcccaactgcc

SEQ ID NO: 33699 - DNA, 30 bp, Homo sapiens
ccgcgggaagatggtgccatccacgttctc

SEQ ID NO: 33700 - DNA, 30 bp, Homo sapiens
ggctggggcgcgtcgcacactctcagtcgc

SEQ ID NO: 33701 - DNA, 30 bp, Homo sapiens
agttggatatttgggaatgtccgcctcaat

SEQ ID NO: 33702 - DNA, 30 bp, Homo sapiens
ttgatcaggatggcacaggcgtgggcctcg

SEQ ID NO: 33703 - DNA, 30 bp, Homo sapiens
ccctgggcacccactcccgaagctctccta

SEQ ID NO: 33704 - DNA, 30 bp, Homo sapiens
ttgctgaggctgcaccccacggcggctcga

SEQ ID NO: 33705 - DNA, 30 bp, Homo sapiens
gcctggacgctcagccactcactctgctcc

SEQ ID NO: 33706 - DNA, 30 bp, Homo sapiens
accaggccaaaccctttgccactttcactg

SEQ ID NO: 33707 - DNA, 30 bp, Homo sapiens
tgatggaaatggtggtagttctgggcattt

SEQ ID NO: 33708 - DNA, 30 bp, Homo sapiens
ggcaggcatgctggcagggagaggctgcct

SEQ ID NO: 33709 - DNA, 30 bp, Homo sapiens
agtagaagcgcttgttccgctcctgccgct

SEQ ID NO: 33710 - DNA, 30 bp, Homo sapiens
tttcggctctgttcctgccatttgttgtag

SEQ ID NO: 33711 - DNA, 30 bp, Homo sapiens
tacagaaggcttggctgtttctgaatccct

SEQ ID NO: 33712 - DNA, 30 bp, Homo sapiens
cactggtgctgggtcttcctagatgcctgg

SEQ ID NO: 33713 - DNA, 30 bp, Homo sapiens
cagagggctcatcatcacttatgtctgaat

SEQ ID NO: 33714 - DNA, 30 bp, Homo sapiens
accaggctgataccttcctgattcagattc

SEQ ID NO: 33715 - DNA, 30 bp, Homo sapiens
aggagcgtttggacttgctgcaagttgggc

SEQ ID NO: 33716 - DNA, 30 bp, Homo sapiens
gagtgggactggcttgtattccacttcttt

SEQ ID NO: 33717 - DNA, 30 bp, Homo sapiens
tttctggtgcacgtctagaggggcccgggc

SEQ ID NO: 33718 - DNA, 30 bp, Homo sapiens
tagaggggcccgggcagaggccacccacgg

SEQ ID NO: 33719 - DNA, 30 bp, Homo sapiens
cgccgggtggtcctcgaactactggagcag

SEQ ID NO: 33720 - DNA, 30 bp, Homo sapiens
gccatatacacagaagaaatccagccagca

SEQ ID NO: 33721 - DNA, 30 bp, Homo sapiens
tacatgatgctgcagttctgggggctctgg

SEQ ID NO: 33722 - DNA, 30 bp, Homo sapiens
cagcggcggctaccactcacgtggtggtga

SEQ ID NO: 33723 - DNA, 30 bp, Homo sapiens
ggaaggcagctcaaactcacctttcttctc

SEQ ID NO: 33724 - DNA, 30 bp, Homo sapiens
tcttggggttccctgctggtggaaaagttc

SEQ ID NO: 33725 - DNA, 30 bp, Homo sapiens
ttgaggtggtcctcgggtccccctgttggt

SEQ ID NO: 33726 - DNA, 30 bp, Homo sapiens
gctcgattaggtctggttgaccgagtcctg

SEQ ID NO: 33727 - DNA, 30 bp, Homo sapiens
ggcgccgcggcaggtgtccgcggtgaccgg

SEQ ID NO: 33728 - DNA, 30 bp, Homo sapiens
acttgggattcaaaggtgccattgagctgc

SEQ ID NO: 33729 - DNA, 30 bp, Homo sapiens
gatcttagtccactcgtagatgtcctgttc

SEQ ID NO: 33730 - DNA, 30 bp, Homo sapiens
acctggggtgcataaccttctttcattaaa

SEQ ID NO: 33731 - DNA, 30 bp, Homo sapiens
ggtctggcagtagtggattgctctgaagtg

SEQ ID NO: 33732 - DNA, 30 bp, Homo sapiens
acatggcggttggccgtccagatttgaatc

SEQ ID NO: 33733 - DNA, 30 bp, Homo sapiens
cttcttctatctgcaacagtgctttcgtat

SEQ ID NO: 33734 - DNA, 30 bp, Homo sapiens
ttctcattttaccagcttcggcccaagcct

SEQ ID NO: 33735 - DNA, 30 bp, Homo sapiens
gaagcagtttgggcacttccaccttcttga

SEQ ID NO: 33736 - DNA, 30 bp, Homo sapiens
ttctggaacttccacccgctttagctgttt

SEQ ID NO: 33737 - DNA, 30 bp, Homo sapiens
acgccagttcttttggcagttgcacaggtt

SEQ ID NO: 33738 - DNA, 30 bp, Homo sapiens
agtccttttctccgtcttcgctgcttccgc

SEQ ID NO: 33739 - DNA, 30 bp, Homo sapiens
ccacggggcctgcgggccgggcgtcggggg

SEQ ID NO: 33740 - DNA, 30 bp, Homo sapiens
gcatggagtacagatggtcaatggggtttc

SEQ ID NO: 33741 - DNA, 30 bp, Homo sapiens
aggaggcgaagtaggaactctgcatggagt

SEQ ID NO: 33742 - DNA, 30 bp, Homo sapiens
ttcaggccctttttcaaacaggggagccat

SEQ ID NO: 33743 - DNA, 30 bp, Homo sapiens
tgtgagacttttgaggttcttctccatcca

SEQ ID NO: 33744 - DNA, 30 bp, Homo sapiens
aagattctccacttagttcaggatcaggaa

SEQ ID NO: 33745 - DNA, 30 bp, Homo sapiens
caagaaacaatagttagagtaattcttcct

SEQ ID NO: 33746 - DNA, 30 bp, Homo sapiens
gccaggccaacaaataacggtcagagtgac

SEQ ID NO: 33747 - DNA, 30 bp, Homo sapiens
gaatggttgttcttagtatcttctagatgt

SEQ ID NO: 33748 - DNA, 30 bp, Homo sapiens
tactggttcaaagcagtgactgagacaacc

SEQ ID NO: 33749 - DNA, 30 bp, Homo sapiens
cacctgccctgccgtctcttctttctcctc

SEQ ID NO: 33750 - DNA, 30 bp, Homo sapiens
caaagggagggatggagacccagaagacag

SEQ ID NO: 33751 - DNA, 30 bp, Homo sapiens
ttgcttgccattgccctctcaacccatctg

SEQ ID NO: 33752 - DNA, 30 bp, Homo sapiens
tgctggggtccgtgcaccaactgtgactct

SEQ ID NO: 33753 - DNA, 30 bp, Homo sapiens
catcgatctttttctccagatacagagatg

SEQ ID NO: 33754 - DNA, 30 bp, Homo sapiens
gcagaaatttgcgtaagtaacaagtaaccg

SEQ ID NO: 33755 - DNA, 30 bp, Homo sapiens
ggagtgggagaagcaggaagcaggtgctgc

SEQ ID NO: 33756 - DNA, 30 bp, Homo sapiens
ccaaggatggacacccctgagtctgagagg

SEQ ID NO: 33757 - DNA, 30 bp, Homo sapiens
cagaggaaagagataaatgtcattgcattt

SEQ ID NO: 33758 - DNA, 30 bp, Homo sapiens
ctgccctgccgtctcttctttctcctccta

SEQ ID NO: 33759 - DNA, 30 bp, Homo sapiens
agcttctgtggggtcagtctcctgccacga

SEQ ID NO: 33760 - DNA, 30 bp, Homo sapiens
agatcccggaacccagaggctgtgtcggtc

SEQ ID NO: 33761 - DNA, 30 bp, Homo sapiens
ctctggggtccaaacgccacttcaaatctc

SEQ ID NO: 33762 - DNA, 30 bp, Homo sapiens
cagatggagggttcgtcggcctctccccgt

SEQ ID NO: 33763 - DNA, 30 bp, Homo sapiens
ttgagggaccaagaagtgggtcctgtagag

SEQ ID NO: 33764 - DNA, 30 bp, Homo sapiens
gctggttctgatgttttgtttcatctagtt

SEQ ID NO: 33765 - DNA, 30 bp, Homo sapiens
agccggaaacagtcagagccaccagccaat

SEQ ID NO: 33766 - DNA, 30 bp, Homo sapiens
agacgtgggttcccgtcctgaaagggccat

SEQ ID NO: 33767 - DNA, 30 bp, Homo sapiens
acttggcggctttgggtttacaagatcgtt

SEQ ID NO: 33768 - DNA, 30 bp, Homo sapiens
ccgcagctgaggaactactgtatgtggagc

SEQ ID NO: 33769 - DNA, 30 bp, Homo sapiens
ctttgggaggccaaggtgggaggatccctt

SEQ ID NO: 33770 - DNA, 30 bp, Homo sapiens
ttccggaagagattagcatttgaattggta

SEQ ID NO: 33771 - DNA, 30 bp, Homo sapiens
accatggggtgaaccaattctcagctaccc

SEQ ID NO: 33772 - DNA, 30 bp, Homo sapiens
taatggccttctctgtgtctgcagtgatgt

SEQ ID NO: 33773 - DNA, 30 bp, Homo sapiens
tctttcttctggaatgtcctttgactctgg

SEQ ID NO: 33774 - DNA, 30 bp, Homo sapiens
aggaggcagtaaaagccaggtctggcttct

SEQ ID NO: 33775 - DNA, 30 bp, Homo sapiens
aggccacgtcgacgcgagcgaagctctggt

SEQ ID NO: 33776 - DNA, 30 bp, Homo sapiens
aaagcctggcacagctggtgttgggtctgc

SEQ ID NO: 33777 - DNA, 30 bp, Homo sapiens
tgtcccaaacgaagccatagttttcaaagg

SEQ ID NO: 33778 - DNA, 30 bp, Homo sapiens
ccatggtcttccctgaaaggatccggggaa

SEQ ID NO: 33779 - DNA, 30 bp, Homo sapiens
cagaggttttgtctttctttgtctttcttc

SEQ ID NO: 33780 - DNA, 30 bp, Homo sapiens
gccaggagtccaaatcggctttcctgggcc

SEQ ID NO: 33781 - DNA, 30 bp, Homo sapiens
tgcctggcccccttgttgcttttcttaaat

SEQ ID NO: 33782 - DNA, 30 bp, Homo sapiens
gtgtacgccgcgggccctcagcggcagacg

SEQ ID NO: 33783 - DNA, 30 bp, Homo sapiens
aagaggtctgtatgtagataccaatctgca

SEQ ID NO: 33784 - DNA, 30 bp, Homo sapiens
ttcaggttgggttttccctttttcttctgg

SEQ ID NO: 33785 - DNA, 30 bp, Homo sapiens
ctttgggagctcagacgtgtcgctggccct

SEQ ID NO: 33786 - DNA, 30 bp, Homo sapiens
ctggcctctgcttccaggatcgactgcctg

SEQ ID NO: 33787 - DNA, 30 bp, Homo sapiens
gcagcaaccaggccagggggaatctggatt

SEQ ID NO: 33788 - DNA, 30 bp, Homo sapiens
gcccgggctctgagtgcatcctttaacagg

SEQ ID NO: 33789 - DNA, 30 bp, Homo sapiens
cgagtggaggagggagtggcgcccctgtct

SEQ ID NO: 33790 - DNA, 30 bp, Homo sapiens
taggacgagggagccgaggtgggcttctcc

SEQ ID NO: 33791 - DNA, 30 bp, Homo sapiens
tccttggcttgcagctggctgtcttctcgc

SEQ ID NO: 33792 - DNA, 30 bp, Homo sapiens
atgtggattgaatggatgactgaacccagt

SEQ ID NO: 33793 - DNA, 30 bp, Homo sapiens
caggggacgtaagaagcaaatacataggta

SEQ ID NO: 33794 - DNA, 30 bp, Homo sapiens
tcttgtccagtcatcccccatcttcccgag

SEQ ID NO: 33795 - DNA, 30 bp, Homo sapiens
ggcggcccaagacactgcgattctggaggc

SEQ ID NO: 33796 - DNA, 30 bp, Homo sapiens
ccccgggccggggctgctgggtcctcggag

SEQ ID NO: 33797 - DNA, 30 bp, Homo sapiens
accagcaactgttgcacgggcccatcagca

SEQ ID NO: 33798 - DNA, 30 bp, Homo sapiens
aactgggaagctgatagctcgtcttctaac

SEQ ID NO: 33799 - DNA, 30 bp, Homo sapiens
cgccattttcttggaaacctgcaccatgag

SEQ ID NO: 33800 - DNA, 30 bp, Homo sapiens
tagaggatcagaaaaatcccaggttgcctg

SEQ ID NO: 33801 - DNA, 30 bp, Homo sapiens
tgcagggcctaggctagtgtggagctgagc

SEQ ID NO: 33802 - DNA, 30 bp, Homo sapiens
ttcaggagaggaggaagctccggcctcgtg

SEQ ID NO: 33803 - DNA, 30 bp, Homo sapiens
gtgcggcctgtcgtctgctgttgtcatgtg

SEQ ID NO: 33804 - DNA, 30 bp, Homo sapiens
tcctgtgattgttgaataaattgctgagca

SEQ ID NO: 33805 - DNA, 30 bp, Homo sapiens
agctcatggtggtgccatcaaaggaagggg

SEQ ID NO: 33806 - DNA, 30 bp, Homo sapiens
cacagctgacttctgcacaccatgccatta

SEQ ID NO: 33807 - DNA, 30 bp, Homo sapiens
cacagggagacccctccaacctccctggcc

SEQ ID NO: 33808 - DNA, 30 bp, Homo sapiens
ggccactgtgcctcccatagcaaccaggcc

SEQ ID NO: 33809 - DNA, 30 bp, Homo sapiens
tcacttctcgtgggctggcggatagagccc

SEQ ID NO: 33810 - DNA, 30 bp, Homo sapiens
catcaacagtggtctcaacatgtctttgat

SEQ ID NO: 33811 - DNA, 30 bp, Homo sapiens
ggccccgcccactccgcgcagctcgcttcc

SEQ ID NO: 33812 - DNA, 30 bp, Homo sapiens
acatgggcgctgggtgagaggagaaggcag

SEQ ID NO: 33813 - DNA, 30 bp, Homo sapiens
gcctggtgaagaataaatacatatgtcaat

SEQ ID NO: 33814 - DNA, 30 bp, Homo sapiens
attcggttgcgcttttggattggggagtct

SEQ ID NO: 33815 - DNA, 30 bp, Homo sapiens
cgctggtaggtcaagaccggctcacacaag

SEQ ID NO: 33816 - DNA, 30 bp, Homo sapiens
ctggcccagggctagctccttggtgagaaa

SEQ ID NO: 33817 - DNA, 30 bp, Homo sapiens
ccgcgggcactcggttggcggggaaattcg

SEQ ID NO: 33818 - DNA, 30 bp, Homo sapiens
cactcagatttttcagctggatccagctcc

SEQ ID NO: 33819 - DNA, 30 bp, Homo sapiens
aagcggaaggtcatcttcatctttcccagg

SEQ ID NO: 33820 - DNA, 30 bp, Homo sapiens
tctgcttcttcttcagcaatttcatcatct

SEQ ID NO: 33821 - DNA, 30 bp, Homo sapiens
ctgaggagatgtcccctgaatctaatgtag

SEQ ID NO: 33822 - DNA, 30 bp, Homo sapiens
tcgtggctgtcttcatcctcatttggctga

SEQ ID NO: 33823 - DNA, 30 bp, Homo sapiens
gagtgcgccagctctgggcctgcgtgccgg

SEQ ID NO: 33824 - DNA, 30 bp, Homo sapiens
atcctagcactttgggcagcagaagtggga

SEQ ID NO: 33825 - DNA, 30 bp, Homo sapiens
gcgtgggccaccacgcctgccctgccgtct

SEQ ID NO: 33826 - DNA, 30 bp, Homo sapiens
ggctggctgggcagcggcggtggggctgcg

SEQ ID NO: 33827 - DNA, 30 bp, Homo sapiens
agatggcaaaggtgtttgaaagctatcagg

SEQ ID NO: 33828 - DNA, 30 bp, Homo sapiens
catgcaactgtagttttcttagcccctgaa

SEQ ID NO: 33829 - DNA, 30 bp, Homo sapiens
ccgttccacggccagcgcctctgcctgctc

SEQ ID NO: 33830 - DNA, 30 bp, Homo sapiens
accaggtctggtcttgacagtaaagccacc

SEQ ID NO: 33831 - DNA, 30 bp, Homo sapiens
tcttggtcaaccgttctttcaaagacttca

SEQ ID NO: 33832 - DNA, 30 bp, Homo sapiens
cattagccagctcttgccgactattcatct

SEQ ID NO: 33833 - DNA, 30 bp, Homo sapiens
ttttggtttcgggatatgaaggccaggact

SEQ ID NO: 33834 - DNA, 30 bp, Homo sapiens
atttggacggccaggtaggcgcctgcttct

SEQ ID NO: 33835 - DNA, 30 bp, Homo sapiens
ctgaggcatacgcatgatgtcctgtgtagc

SEQ ID NO: 33836 - DNA, 30 bp, Homo sapiens
agacagaagggaagaggtctctccaggtga

SEQ ID NO: 33837 - DNA, 30 bp, Homo sapiens
tctgcagcaagtcccagcctggtcactacc

SEQ ID NO: 33838 - DNA, 30 bp, Homo sapiens
tccagcgtctccaggaagaagcggtctgtg

SEQ ID NO: 33839 - DNA, 30 bp, Homo sapiens
tagtgaatgttgcatctcaccacgttgttg

SEQ ID NO: 33840 - DNA, 30 bp, Homo sapiens
ctgcggggacagctggttgtttaagagccc

SEQ ID NO: 33841 - DNA, 30 bp, Homo sapiens
atctggttgctggtctggccagggtagcgt

SEQ ID NO: 33842 - DNA, 30 bp, Homo sapiens
atgaggttgttcctgagacgctgttcctgc

SEQ ID NO: 33843 - DNA, 30 bp, Homo sapiens
atccaagtaacaaaccttgaaacacgagca

SEQ ID NO: 33844 - DNA, 30 bp, Homo sapiens
taaaccacagagtggtcattgctgtgaact

SEQ ID NO: 33845 - DNA, 30 bp, Homo sapiens
taaagggtggagtccatcagtgggtggccg

SEQ ID NO: 33846 - DNA, 30 bp, Homo sapiens
ccttggctaatactatcctctatgtactgg

SEQ ID NO: 33847 - DNA, 30 bp, Homo sapiens
aggtggattctagcattaattcaccaccat

SEQ ID NO: 33848 - DNA, 30 bp, Homo sapiens
cagagggcggaatcctggggacactgtgtg

SEQ ID NO: 33849 - DNA, 30 bp, Homo sapiens
acttcagagaatctgaagtcacttctcctg

SEQ ID NO: 33850 - DNA, 30 bp, Homo sapiens
ccagcttcttgcgaacaggcttccgcccag

SEQ ID NO: 33851 - DNA, 30 bp, Homo sapiens
ctgaggtactctcttcatgcttttcagggc

SEQ ID NO: 33852 - DNA, 30 bp, Homo sapiens
caccattgctttgtgaatataaggcaatat

SEQ ID NO: 33853 - DNA, 30 bp, Homo sapiens
tgcttgggtgcttgcacagtcccattggcc

SEQ ID NO: 33854 - DNA, 30 bp, Homo sapiens
aacaggcaatggtaaaaatactgaatgatg

SEQ ID NO: 33855 - DNA, 30 bp, Homo sapiens
ctgaggcagaatgaatgtcctggttttcaa

SEQ ID NO: 33856 - DNA, 30 bp, Homo sapiens
caagacaggtcatccaggtccacttcaggg

SEQ ID NO: 33857 - DNA, 30 bp, Homo sapiens
tccagggtatcaaggtccacagcaggcagt

SEQ ID NO: 33858 - DNA, 30 bp, Homo sapiens
ttcttattcagagacttgtcatggcatttc

SEQ ID NO: 33859 - DNA, 30 bp, Homo sapiens
attcttcactgaggcccagggtgacaggtc

SEQ ID NO: 33860 - DNA, 30 bp, Homo sapiens
taaaggtcagtgctcgccttggcggtcaac

SEQ ID NO: 33861 - DNA, 30 bp, Homo sapiens
cagtgggaagagcttattgaagcaaggttg

SEQ ID NO: 33862 - DNA, 30 bp, Homo sapiens
atccataggaagaatggaataaaaattgca

SEQ ID NO: 33863 - DNA, 30 bp, Homo sapiens
gtagcgggtttggtattcatgatgccaccg

SEQ ID NO: 33864 - DNA, 30 bp, Homo sapiens
ttacggtgatgtctagtaatgcttgaatgg

SEQ ID NO: 33865 - DNA, 30 bp, Homo sapiens
atgcggacagagcattccagtggtaagtga

SEQ ID NO: 33866 - DNA, 30 bp, Homo sapiens
aaagctgagatgccttggttgttggtaatt

SEQ ID NO: 33867 - DNA, 30 bp, Homo sapiens
gtgagggaacatgaatgcttgggacagatc

SEQ ID NO: 33868 - DNA, 30 bp, Homo sapiens
aacccaggagccgagtgtaggtgacataga

SEQ ID NO: 33869 - DNA, 30 bp, Homo sapiens
aggccggtccagcagggcgtggacgacagc

SEQ ID NO: 33870 - DNA, 30 bp, Homo sapiens
tcccggtccggggaatgcagcggaaggggc

SEQ ID NO: 33871 - DNA, 30 bp, Homo sapiens
acacggtactctccagcatccactcggtgc

SEQ ID NO: 33872 - DNA, 30 bp, Homo sapiens
tagaccgtgctctccatcacccattcggag

SEQ ID NO: 33873 - DNA, 30 bp, Homo sapiens
tagggtcccacaggttcgtggccgggcccc

SEQ ID NO: 33874 - DNA, 30 bp, Homo sapiens
caccacactctcttccagccgctcggcgct

SEQ ID NO: 33875 - DNA, 30 bp, Homo sapiens
atgatgtagcttctgccaccacaattttat

SEQ ID NO: 33876 - DNA, 30 bp, Homo sapiens
caatctggtcaacattagtcagcaaagcat

SEQ ID NO: 33877 - DNA, 30 bp, Homo sapiens
cactgggacttggccactgccaggagcgtc

SEQ ID NO: 33878 - DNA, 30 bp, Homo sapiens
ctgcggccctgagggattggagggagggtg

SEQ ID NO: 33879 - DNA, 30 bp, Homo sapiens
ctccggtggtgtcactgggaaaatatcttc

SEQ ID NO: 33880 - DNA, 30 bp, Homo sapiens
tttttggtgccaacagcagtggcaccctct

SEQ ID NO: 33881 - DNA, 30 bp, Homo sapiens
ctaccatcttgaatgttccgagtcctacta

SEQ ID NO: 33882 - DNA, 30 bp, Homo sapiens
tttcccatcttcctctgacccagagtccaa

SEQ ID NO: 33883 - DNA, 30 bp, Homo sapiens
gcagaagtactcattgattctcctgccccc

SEQ ID NO: 33884 - DNA, 30 bp, Homo sapiens
ctcctttctccttgtccccctcagtgtcta

SEQ ID NO: 33885 - DNA, 30 bp, Homo sapiens
caataatactctggtctggaaccttcactt

SEQ ID NO: 33886 - DNA, 30 bp, Homo sapiens
agctggtcatctcggataaacctgttgccc

SEQ ID NO: 33887 - DNA, 30 bp, Homo sapiens
cactggtggtggcccattgtgtcggagtct

SEQ ID NO: 33888 - DNA, 30 bp, Homo sapiens
gccaaggggtcccctatctcgtcctcaggg

SEQ ID NO: 33889 - DNA, 30 bp, Homo sapiens
tgacgacggcgggcacctgggccacctcct

SEQ ID NO: 33890 - DNA, 30 bp, Homo sapiens
aggtaagcagtggctcatcctctgcctcag

SEQ ID NO: 33891 - DNA, 30 bp, Homo sapiens
tatgaggtagtccgattcctcagatgtaat

SEQ ID NO: 33892 - DNA, 30 bp, Homo sapiens
aaagtaacaaagcctcatcatcactcgttt

SEQ ID NO: 33893 - DNA, 30 bp, Homo sapiens
tctctcttataccaatttctattttctttg

SEQ ID NO: 33894 - DNA, 30 bp, Homo sapiens
aataggttggagttgggtctcttctcgaag

SEQ ID NO: 33895 - DNA, 30 bp, Homo sapiens
atgcgggattcagacgacaagctttagaat

SEQ ID NO: 33896 - DNA, 30 bp, Homo sapiens
aacagggcctcatcatcgctggcctccagc

SEQ ID NO: 33897 - DNA, 30 bp, Homo sapiens
acctggctctctgaggagagcttgcgttca

SEQ ID NO: 33898 - DNA, 30 bp, Homo sapiens
tgcagggggacggagggggcgggaagagat

SEQ ID NO: 33899 - DNA, 30 bp, Homo sapiens
tccaggccctagatggggcagccaaaccgg

SEQ ID NO: 33900 - DNA, 30 bp, Homo sapiens
caggaggagtctgtacagggagagggtggc

SEQ ID NO: 33901 - DNA, 30 bp, Homo sapiens
ggtagtccatcatcttcaaggcttaatgcc

SEQ ID NO: 33902 - DNA, 30 bp, Homo sapiens
gagttcgttgtgccgagctctggagatcct

SEQ ID NO: 33903 - DNA, 30 bp, Homo sapiens
attttcttagctgctgtgcataaaattcaa

SEQ ID NO: 33904 - DNA, 30 bp, Homo sapiens
gtgtgggcaacagaatgcagattcatggta

SEQ ID NO: 33905 - DNA, 30 bp, Homo sapiens
aagtggtcactcggtcaatggcatgattga

SEQ ID NO: 33906 - DNA, 30 bp, Homo sapiens
gagttggtaggaggaagtagagggactggt

SEQ ID NO: 33907 - DNA, 30 bp, Homo sapiens
tcctggagcggcttccagggcgcggaagct

SEQ ID NO: 33908 - DNA, 30 bp, Homo sapiens
cataggctgaagtagtccgcagccagtcgc

SEQ ID NO: 33909 - DNA, 30 bp, Homo sapiens
ctctggagaagttttctagagcagttttga

SEQ ID NO: 33910 - DNA, 30 bp, Homo sapiens
taacactcattgggtgccttcatctgcatc

SEQ ID NO: 33911 - DNA, 30 bp, Homo sapiens
tcgatgaattcaatgccattgctgctgagg

SEQ ID NO: 33912 - DNA, 30 bp, Homo sapiens
ttgcggtgtgatctctatgttttttttccc

SEQ ID NO: 33913 - DNA, 30 bp, Homo sapiens
ttcccaggagtccttggccatggaattggg

SEQ ID NO: 33914 - DNA, 30 bp, Homo sapiens
tcatctaccacaaatgaatgtaattgttca

SEQ ID NO: 33915 - DNA, 30 bp, Homo sapiens
ctttggtggtatagctgggaacagattctc

SEQ ID NO: 33916 - DNA, 30 bp, Homo sapiens
acaaggagaaaccccactccagggcacaag

SEQ ID NO: 33917 - DNA, 30 bp, Homo sapiens
ggtaggggggctcttgcgccttccggagac

SEQ ID NO: 33918 - DNA, 30 bp, Homo sapiens
caccccattctgcaccccacactgcccaga

SEQ ID NO: 33919 - DNA, 30 bp, Homo sapiens
gttcgggttccaggtcacgctggggctcag

SEQ ID NO: 33920 - DNA, 30 bp, Homo sapiens
cagtggatctcgtaggcgaccggcgggggc

SEQ ID NO: 33921 - DNA, 30 bp, Homo sapiens
gcccggggatcacgtactcctcttcatcca

SEQ ID NO: 33922 - DNA, 30 bp, Homo sapiens
aggcttgggcggcagcggcggggctccccg

SEQ ID NO: 33923 - DNA, 30 bp, Homo sapiens
caggttgggtggggtctccatgaagtggct

SEQ ID NO: 33924 - DNA, 30 bp, Homo sapiens
gagcctgcttctcctggagctctcggagcg

SEQ ID NO: 33925 - DNA, 30 bp, Homo sapiens
tgatgaccgtgtcagggcctggaatactct

SEQ ID NO: 33926 - DNA, 30 bp, Homo sapiens
cactggtatctgcgaacatttcctgattct

SEQ ID NO: 33927 - DNA, 30 bp, Homo sapiens
agcaggtcaaaagtctgcagacactgggtg

SEQ ID NO: 33928 - DNA, 30 bp, Homo sapiens
agtgttagggtcaggtcagcccctcccacg

SEQ ID NO: 33929 - DNA, 30 bp, Homo sapiens
ccccgggccgatggggtccttggaggcggg

SEQ ID NO: 33930 - DNA, 30 bp, Homo sapiens
caggtgtgttttttgtccttcaggtagccg

SEQ ID NO: 33931 - DNA, 30 bp, Homo sapiens
gagccacatcctctgtcaccagggaacagc

SEQ ID NO: 33932 - DNA, 30 bp, Homo sapiens
ccatggtcaaagtgaatgcttcttttttta

SEQ ID NO: 33933 - DNA, 30 bp, Homo sapiens
tgccggcggacgcagcagcaggcggccagc

SEQ ID NO: 33934 - DNA, 30 bp, Homo sapiens
taacgctttaagactcctgttgtgtgaagt

SEQ ID NO: 33935 - DNA, 30 bp, Homo sapiens
tactggaacaagagcaaaacctgcattaga

SEQ ID NO: 33936 - DNA, 30 bp, Homo sapiens
gccaggctctggggcagcatccaagacgct

SEQ ID NO: 33937 - DNA, 30 bp, Homo sapiens
atggcagggcttcactctcctcctcctccg

SEQ ID NO: 33938 - DNA, 30 bp, Homo sapiens
attgatgggttgtctttgtatttttctgat

SEQ ID NO: 33939 - DNA, 30 bp, Homo sapiens
cctcgtcttcatcctccgcatctttgttgg

SEQ ID NO: 33940 - DNA, 30 bp, Homo sapiens
ctcttgtatgtatgtgtgcataaactgaag

SEQ ID NO: 33941 - DNA, 30 bp, Homo sapiens
gtatttatggagattggtaaagtagttgaa

SEQ ID NO: 33942 - DNA, 30 bp, Homo sapiens
tgctaatatcatcaggttcatctgctttct

SEQ ID NO: 33943 - DNA, 30 bp, Homo sapiens
tgctgaggatggaggagtcctcggaacgca

SEQ ID NO: 33944 - DNA, 30 bp, Homo sapiens
ccttgtccttggtatgggtctgaattatat

SEQ ID NO: 33945 - DNA, 30 bp, Homo sapiens
taagtaggaattcggtctctcaaatattca

SEQ ID NO: 33946 - DNA, 30 bp, Homo sapiens
cacatggtgctaacataatctgcgaaggcc

SEQ ID NO: 33947 - DNA, 30 bp, Homo sapiens
cttccacagcaagacatacatatttctgct

SEQ ID NO: 33948 - DNA, 30 bp, Homo sapiens
acacggcgaacatgcgcagagcctcctccg

SEQ ID NO: 33949 - DNA, 30 bp, Homo sapiens
ctttggggggctcagggtcctcacggggga

SEQ ID NO: 33950 - DNA, 30 bp, Homo sapiens
ttttggttgtgctgggggcctcagccacag

SEQ ID NO: 33951 - DNA, 30 bp, Homo sapiens
acgtggggaggggcagtggccaggtcggcc

SEQ ID NO: 33952 - DNA, 30 bp, Homo sapiens
tgtaggcagagcttcatataggaattttta

SEQ ID NO: 33953 - DNA, 30 bp, Homo sapiens
cagatctgcgtctcttgcacgttctccttg

SEQ ID NO: 33954 - DNA, 30 bp, Homo sapiens
gtgtggttgaagggagatttgtatgagtta

SEQ ID NO: 33955 - DNA, 30 bp, Homo sapiens
ctgagggaactcctggaccgagctcgtctg

SEQ ID NO: 33956 - DNA, 30 bp, Homo sapiens
cactggccttgctccagcggtggcagcagt

SEQ ID NO: 33957 - DNA, 30 bp, Homo sapiens
aagtggggacggggctggggtgagagagtt

SEQ ID NO: 33958 - DNA, 30 bp, Homo sapiens
tcttggtggctgtgaacctctccatgtact

SEQ ID NO: 33959 - DNA, 30 bp, Homo sapiens
caaccaagaagaactttctgcattctgcgt

SEQ ID NO: 33960 - DNA, 30 bp, Homo sapiens
agtcggtctggaggacccactggaggatct

SEQ ID NO: 33961 - DNA, 30 bp, Homo sapiens
cagcggaggcacttcagggttgtcttcaaa

SEQ ID NO: 33962 - DNA, 30 bp, Homo sapiens
cgaaggaagaggtggggcccgcagagctga

SEQ ID NO: 33963 - DNA, 30 bp, Homo sapiens
ctagagctattcttctactaggactaccat

SEQ ID NO: 33964 - DNA, 30 bp, Homo sapiens
tcatggaaggcagccttatcaggatctgag

SEQ ID NO: 33965 - DNA, 30 bp, Homo sapiens
caattccaaagaggttagggtcacgttgag

SEQ ID NO: 33966 - DNA, 30 bp, Homo sapiens
actaggtctactgtgttctggaaactcttc

SEQ ID NO: 33967 - DNA, 30 bp, Homo sapiens
cagaaggtttgaatggatttccttgtccac

SEQ ID NO: 33968 - DNA, 30 bp, Homo sapiens
cctcattttcaggaacaatttgtttatgaa

SEQ ID NO: 33969 - DNA, 30 bp, Homo sapiens
taggggaagaatgccatggcctcatcctcc

SEQ ID NO: 33970 - DNA, 30 bp, Homo sapiens
tcttcaaggtacctttcctctcgtgttgga

SEQ ID NO: 33971 - DNA, 30 bp, Homo sapiens
tctcggtctcagccaacagactgtccccta

SEQ ID NO: 33972 - DNA, 30 bp, Homo sapiens
ctgtcttctcatcgagcttctttatcacct

SEQ ID NO: 33973 - DNA, 30 bp, Homo sapiens
cttagggacagacgctggcagggctgatct

SEQ ID NO: 33974 - DNA, 30 bp, Homo sapiens
gtgaggtcgcgcagcacggcccgggtcaac

SEQ ID NO: 33975 - DNA, 30 bp, Homo sapiens
cacgtctgagctgcagctacagtctccttg

SEQ ID NO: 33976 - DNA, 30 bp, Homo sapiens
acctggcacagcaggcctggggctcgggtc

SEQ ID NO: 33977 - DNA, 30 bp, Homo sapiens
ccttgtcagccctccacagccgctccttca

SEQ ID NO: 33978 - DNA, 30 bp, Homo sapiens
tacagggagaggaagagtattgagcaagtt

SEQ ID NO: 33979 - DNA, 30 bp, Homo sapiens
tcccggacgtcagaaggcagagtttcaaac

SEQ ID NO: 33980 - DNA, 30 bp, Homo sapiens
tgacttcgagtggcagggtatcaaaaaggt

SEQ ID NO: 33981 - DNA, 30 bp, Homo sapiens
ccatcttgtcccgcacttctgccggcagac

SEQ ID NO: 33982 - DNA, 30 bp, Homo sapiens
gtgctatttcagcttgatgagcttcaacaa

SEQ ID NO: 33983 - DNA, 30 bp, Homo sapiens
atagttagtgctcgaattagttgatctctt

SEQ ID NO: 33984 - DNA, 30 bp, Homo sapiens
acatggtacagtcttctttgcttttgccct

SEQ ID NO: 33985 - DNA, 30 bp, Homo sapiens
tgctgggacaagagtgcactccgatttgct

SEQ ID NO: 33986 - DNA, 30 bp, Homo sapiens
tgctgggccagaagtgctgtcctattggcc

SEQ ID NO: 33987 - DNA, 30 bp, Homo sapiens
cttacttgaagatcctgctgagtgtctgtg

SEQ ID NO: 33988 - DNA, 30 bp, Homo sapiens
caatcgtatgtcttttttaatgattggctt

SEQ ID NO: 33989 - DNA, 30 bp, Homo sapiens
cacaggctttttcaaaggcaatcatatcca

SEQ ID NO: 33990 - DNA, 30 bp, Homo sapiens
ctggttttccttttacatccttctttcctt

SEQ ID NO: 33991 - DNA, 30 bp, Homo sapiens
cttgcgagtgcaagcctccagccggcccag

SEQ ID NO: 33992 - DNA, 30 bp, Homo sapiens
aaacggtcaagcaagattgtatctctttct

SEQ ID NO: 33993 - DNA, 30 bp, Homo sapiens
gtaatagcttctggatgtgtcgacctgggt

SEQ ID NO: 33994 - DNA, 30 bp, Homo sapiens
ctgaggatctgggcagcttcctccctggat

SEQ ID NO: 33995 - DNA, 30 bp, Homo sapiens
tcccagagatttatcagaggaggataaagc

SEQ ID NO: 33996 - DNA, 30 bp, Homo sapiens
tgacggtctggagccccagcgggtaatcat

SEQ ID NO: 33997 - DNA, 30 bp, Homo sapiens
cagagcgcccctgcggctcgggcggcggct

SEQ ID NO: 33998 - DNA, 30 bp, Homo sapiens
attccctcgcgggctgctggtggcaggtac

SEQ ID NO: 33999 - DNA, 30 bp, Homo sapiens
atgatgatgaagggtccttcatgggtgggt

SEQ ID NO: 34000 - DNA, 30 bp, Homo sapiens
ttatggtcactgattcggccagctgttgtg

SEQ ID NO: 34001 - DNA, 30 bp, Homo sapiens
attccctggagccagagatggtatatgtgc

SEQ ID NO: 34002 - DNA, 30 bp, Homo sapiens
agatggccggtgctgccgacctggcgatgg

SEQ ID NO: 34003 - DNA, 30 bp, Homo sapiens
ctgtggtagatgcggaggcgctgggcgatg

SEQ ID NO: 34004 - DNA, 30 bp, Homo sapiens
ggctggtgagctgtcaaatcgctctttttc

SEQ ID NO: 34005 - DNA, 30 bp, Homo sapiens
aagagatctgcttctggtcctcgtgctcgc

SEQ ID NO: 34006 - DNA, 30 bp, Homo sapiens
agtgtattctgcttggtccaggccttcttg

SEQ ID NO: 34007 - DNA, 30 bp, Homo sapiens
gcctggtccagcataggtgagctgagctat

SEQ ID NO: 34008 - DNA, 30 bp, Homo sapiens
atggaggcctgtgaggcatctctacagacc

SEQ ID NO: 34009 - DNA, 30 bp, Homo sapiens
ccctttctcttcctccatggggttcccatg

SEQ ID NO: 34010 - DNA, 30 bp, Homo sapiens
ccagatggctacgatgttggagtccgtcag

SEQ ID NO: 34011 - DNA, 30 bp, Homo sapiens
gccacagtggtacggccagactgatggatc

SEQ ID NO: 34012 - DNA, 30 bp, Homo sapiens
atatccaggtgcttgtagagtctacgactt

SEQ ID NO: 34013 - DNA, 30 bp, Homo sapiens
agtgtccttccatctcgaagcagaaccaag

SEQ ID NO: 34014 - DNA, 30 bp, Homo sapiens
tcgaggaatggaaagacctcggtccttcag

SEQ ID NO: 34015 - DNA, 30 bp, Homo sapiens
tgaggctggcggtgccaggcatatagttca

SEQ ID NO: 34016 - DNA, 30 bp, Homo sapiens
ttacagttttttgggggaaattcccaccgg

SEQ ID NO: 34017 - DNA, 30 bp, Homo sapiens
agcaggacattctcgcctcgaatgaaaatc

SEQ ID NO: 34018 - DNA, 30 bp, Homo sapiens
gacagggcagcctccttctgtggttgctgg

SEQ ID NO: 34019 - DNA, 30 bp, Homo sapiens
agggtccaaaagctgtggttttcctatatt

SEQ ID NO: 34020 - DNA, 30 bp, Homo sapiens
actcccggcccccacgacctcctctgaatc

SEQ ID NO: 34021 - DNA, 30 bp, Homo sapiens
caccctgccagtcccggccctgtgggaagt

SEQ ID NO: 34022 - DNA, 30 bp, Homo sapiens
ctgtttctgctgcagggcttccttccttgc

SEQ ID NO: 34023 - DNA, 30 bp, Homo sapiens
ctcagtggaggggcaaccaggacaacgcca

SEQ ID NO: 34024 - DNA, 30 bp, Homo sapiens
tgtctgccaggcttcttctctggctggcct

SEQ ID NO: 34025 - DNA, 30 bp, Homo sapiens
cattccagtgagactctccaaaaaaaaaaa

SEQ ID NO: 34026 - DNA, 30 bp, Homo sapiens
ttcaggtccttctcctccaggaaccagcat

SEQ ID NO: 34027 - DNA, 30 bp, Homo sapiens
cttctgtgtactgatgtacaacacattgtt

SEQ ID NO: 34028 - DNA, 30 bp, Homo sapiens
taggcgtcctgctgctggatgaaggggttg

SEQ ID NO: 34029 - DNA, 30 bp, Homo sapiens
tgtgctacagaatttaaaggttctgctcga

SEQ ID NO: 34030 - DNA, 30 bp, Homo sapiens
gttttgttcagagtccagttggttgagttg

SEQ ID NO: 34031 - DNA, 30 bp, Homo sapiens
agctgggtgcttgggcctcactggagttga

SEQ ID NO: 34032 - DNA, 30 bp, Homo sapiens
gagccgggcccccttccacaagcaccttct

SEQ ID NO: 34033 - DNA, 30 bp, Homo sapiens
ctcagggccaagttcttcttgagcctgcgc

SEQ ID NO: 34034 - DNA, 30 bp, Homo sapiens
caggggtggccagcaagggctctctcaggg

SEQ ID NO: 34035 - DNA, 30 bp, Homo sapiens
aggtgggtttgttctcagcaatgcaggcat

SEQ ID NO: 34036 - DNA, 30 bp, Homo sapiens
tactggctggaccacagggggaccctgtcc

SEQ ID NO: 34037 - DNA, 30 bp, Homo sapiens
cgaaggctccaaagaagacagtactagggc

SEQ ID NO: 34038 - DNA, 30 bp, Homo sapiens
ttagcgccaaaggaattgcgtcctcccact

SEQ ID NO: 34039 - DNA, 30 bp, Homo sapiens
ttaagtctttccccaccagcattgcagtca

SEQ ID NO: 34040 - DNA, 30 bp, Homo sapiens
aggtgggcagctgggagcccggggctgaga

SEQ ID NO: 34041 - DNA, 30 bp, Homo sapiens
ccccaccatcacggccccaaagaaggtctt

SEQ ID NO: 34042 - DNA, 30 bp, Homo sapiens
gagagggctggaggcagtgaggctctcgga

SEQ ID NO: 34043 - DNA, 30 bp, Homo sapiens
caaaggtcccattccggaccgtccttctcc

SEQ ID NO: 34044 - DNA, 30 bp, Homo sapiens
tccaggtcactgtctttctctaaattcaag

SEQ ID NO: 34045 - DNA, 30 bp, Homo sapiens
ccttggcagtgcagtgggggggccctgcct

SEQ ID NO: 34046 - DNA, 30 bp, Homo sapiens
cagcggcggcgctggggaacgcaggccccg

SEQ ID NO: 34047 - DNA, 30 bp, Homo sapiens
gcccggggccgtgcgggcgcacagtggtgc

SEQ ID NO: 34048 - DNA, 30 bp, Homo sapiens
tcatgggtgataaattggttccttgggccc

SEQ ID NO: 34049 - DNA, 30 bp, Homo sapiens
ccacggcagcagcgtccggagccgtccgag

SEQ ID NO: 34050 - DNA, 30 bp, Homo sapiens
ctgaggaattcacaggcttccaggaggggg

SEQ ID NO: 34051 - DNA, 30 bp, Homo sapiens
aagtgggattccaaaggttctgaggttgga

SEQ ID NO: 34052 - DNA, 30 bp, Homo sapiens
cagtggacaagtggatttgttgctagatgt

SEQ ID NO: 34053 - DNA, 30 bp, Homo sapiens
gctcttcttttatagcttgctttcttgctc

SEQ ID NO: 34054 - DNA, 30 bp, Homo sapiens
cgccggcctccttctcttctgacctccgtg

SEQ ID NO: 34055 - DNA, 30 bp, Homo sapiens
tcccgggaagcccgacgatgtccccggctg

SEQ ID NO: 34056 - DNA, 30 bp, Homo sapiens
cttcgcgctcttcagagctcctcctgtctt

SEQ ID NO: 34057 - DNA, 30 bp, Homo sapiens
attcagtgtttgtgtcttcactctgctttt

SEQ ID NO: 34058 - DNA, 30 bp, Homo sapiens
atgtgggcgataatttccaaagaggcacac

SEQ ID NO: 34059 - DNA, 30 bp, Homo sapiens
cggtggaagactggtttctgagatgcgatt

SEQ ID NO: 34060 - DNA, 30 bp, Homo sapiens
tcctggcactgctcccagaaccagtgggcc

SEQ ID NO: 34061 - DNA, 30 bp, Homo sapiens
taggacgcttgtgtagtgcctgtgagtcct

SEQ ID NO: 34062 - DNA, 30 bp, Homo sapiens
cacagggcctggttggccgtaatcgttcct

SEQ ID NO: 34063 - DNA, 30 bp, Homo sapiens
cttcaaagctggtcaatggtttttctgggg

SEQ ID NO: 34064 - DNA, 30 bp, Homo sapiens
gagtatctctgatgtctttctgattggcca

SEQ ID NO: 34065 - DNA, 30 bp, Homo sapiens
cactggagaagagctttgattgcctggttg

SEQ ID NO: 34066 - DNA, 30 bp, Homo sapiens
ccacgcagctatcctggcacttagcttctt

SEQ ID NO: 34067 - DNA, 30 bp, Homo sapiens
gtacttcctttggcagacggctattatgtt

SEQ ID NO: 34068 - DNA, 30 bp, Homo sapiens
cacaggctgggggctaagatgacggccagg

SEQ ID NO: 34069 - DNA, 30 bp, Homo sapiens
caggggccaaaccgcagcagggccggcagc

SEQ ID NO: 34070 - DNA, 30 bp, Homo sapiens
ggaagggtgaggtgtcaagagtccagcctg

SEQ ID NO: 34071 - DNA, 30 bp, Homo sapiens
gttttgagggtcattgcagaaatccaggaa

SEQ ID NO: 34072 - DNA, 30 bp, Homo sapiens
cagaggccaaggccagccaaggaggtaagg

SEQ ID NO: 34073 - DNA, 30 bp, Homo sapiens
cacagtcctggcaagagacaggtcagggcg

SEQ ID NO: 34074 - DNA, 30 bp, Homo sapiens
acctgggcttgtgggcaggtgggccaagac

SEQ ID NO: 34075 - DNA, 30 bp, Homo sapiens
atccgctccacagtcctggcaagagacagg

SEQ ID NO: 34076 - DNA, 30 bp, Homo sapiens
ccagaggagggcaggccccaggctgagcag

SEQ ID NO: 34077 - DNA, 30 bp, Homo sapiens
ttgaggtaaaagaagggcatgggctcttcc

SEQ ID NO: 34078 - DNA, 30 bp, Homo sapiens
gacaggctgaggccggctgcaatggaggcc

SEQ ID NO: 34079 - DNA, 30 bp, Homo sapiens
caaaggtgcacagtcaactggggcaccaag

SEQ ID NO: 34080 - DNA, 30 bp, Homo sapiens
gcatatcgaactgatgagaaacccgccagg

SEQ ID NO: 34081 - DNA, 30 bp, Homo sapiens
cattggcacaggccacggtggaccgttttt

SEQ ID NO: 34082 - DNA, 30 bp, Homo sapiens
cctcccgcacgctcacacgtggctcagcca

SEQ ID NO: 34083 - DNA, 30 bp, Homo sapiens
ttcaggaatctcaagatcattctgttgtgg

SEQ ID NO: 34084 - DNA, 30 bp, Homo sapiens
aaaagagcatttcttctgggctcccagaaa

SEQ ID NO: 34085 - DNA, 30 bp, Homo sapiens
gttcctcttcggatctgtgatgctcatctg

SEQ ID NO: 34086 - DNA, 30 bp, Homo sapiens
ctcttgaggtacttggctcgtgcaaggaca

SEQ ID NO: 34087 - DNA, 30 bp, Homo sapiens
cgatggggtggcaatcgcttcaattcctga

SEQ ID NO: 34088 - DNA, 30 bp, Homo sapiens
ctctgggctcaaagcggtttgctccatctt

SEQ ID NO: 34089 - DNA, 30 bp, Homo sapiens
tgctggtattgcccttccgtggctgtgtag

SEQ ID NO: 34090 - DNA, 30 bp, Homo sapiens
gtcatggttgcagaggctggtctggcagca

SEQ ID NO: 34091 - DNA, 30 bp, Homo sapiens
cgccttcatgagagatgacgaatcagatgc

SEQ ID NO: 34092 - DNA, 30 bp, Homo sapiens
tgctcgtgtctgcccagggctgattgttgt

SEQ ID NO: 34093 - DNA, 30 bp, Homo sapiens
cactggtagcactggatttgcagcgcaaag

SEQ ID NO: 34094 - DNA, 30 bp, Homo sapiens
aagagggctaatttgaggaacaggatggtg

SEQ ID NO: 34095 - DNA, 30 bp, Homo sapiens
agtcggaggctcaagagtgggaggagcgtg

SEQ ID NO: 34096 - DNA, 30 bp, Homo sapiens
agtaggacaccagcagccacggccaacaga

SEQ ID NO: 34097 - DNA, 30 bp, Homo sapiens
tgaaggcaaacaggaggcctaagacgacac

SEQ ID NO: 34098 - DNA, 30 bp, Homo sapiens
cagcaggaggactgggaggagcagggccag

SEQ ID NO: 34099 - DNA, 30 bp, Homo sapiens
taacatgagccctaaccacaaccacaagca

SEQ ID NO: 34100 - DNA, 30 bp, Homo sapiens
caatggaagcacaaagacccaggcaagcac

SEQ ID NO: 34101 - DNA, 30 bp, Homo sapiens
ggcagcagtccccgaagaaggaggctggca

SEQ ID NO: 34102 - DNA, 30 bp, Homo sapiens
aattggaggtaggagtttatcaatgaattg

SEQ ID NO: 34103 - DNA, 30 bp, Homo sapiens
gacaggaggcagcagcttctcaagaaattc

SEQ ID NO: 34104 - DNA, 30 bp, Homo sapiens
ctcctggcagctttgtaagaatccataact

SEQ ID NO: 34105 - DNA, 30 bp, Homo sapiens
tactggtttggaaagtttcctcagtttctc

SEQ ID NO: 34106 - DNA, 30 bp, Homo sapiens
gctgcatattgccttgagtaatcatcatcc

SEQ ID NO: 34107 - DNA, 30 bp, Homo sapiens
ggccaacttgtgcagggcttccccaggctc

SEQ ID NO: 34108 - DNA, 30 bp, Homo sapiens
gacgaattactccaaggtctctcttggctt

SEQ ID NO: 34109 - DNA, 30 bp, Homo sapiens
gcctgggcgacagagtgagagtccatctgt

SEQ ID NO: 34110 - DNA, 30 bp, Homo sapiens
tcctgggcatgtctcgattctcaatgatca

SEQ ID NO: 34111 - DNA, 30 bp, Homo sapiens
cataggttcaaatgtcccatgatcttgagg

SEQ ID NO: 34112 - DNA, 30 bp, Homo sapiens
agttggtgcatcacaatatggcacattttc

SEQ ID NO: 34113 - DNA, 30 bp, Homo sapiens
tacacacacacacacacacaaatgaacatc

SEQ ID NO: 34114 - DNA, 30 bp, Homo sapiens
ctgtggctgagtgcccttggggaatactca

SEQ ID NO: 34115 - DNA, 30 bp, Homo sapiens
tcctggtcccgtagtgtccgggtccgagag

SEQ ID NO: 34116 - DNA, 30 bp, Homo sapiens
tgtgatagagggaagttgcatagggacttt

SEQ ID NO: 34117 - DNA, 30 bp, Homo sapiens
agctggcaaaatttcctgttgttcggaaga

SEQ ID NO: 34118 - DNA, 30 bp, Homo sapiens
gagcagcaggtgactgagaatcttgactat

SEQ ID NO: 34119 - DNA, 30 bp, Homo sapiens
gcttgggtggtctgactgaactggctgtct

SEQ ID NO: 34120 - DNA, 30 bp, Homo sapiens
acccggctgcatagctgctaaggaaggaat

SEQ ID NO: 34121 - DNA, 30 bp, Homo sapiens
tccaggcatcgcacggtagttttgcttgga

SEQ ID NO: 34122 - DNA, 30 bp, Homo sapiens
ccttgaacatactgacggacatctctgttt

SEQ ID NO: 34123 - DNA, 30 bp, Homo sapiens
taggaaacctcacagccttttttccactcg

SEQ ID NO: 34124 - DNA, 30 bp, Homo sapiens
taggaaacctcacagtcttttttccagtcg

SEQ ID NO: 34125 - DNA, 30 bp, Homo sapiens
agccaccgtgccagggtatcggagtactgg

SEQ ID NO: 34126 - DNA, 30 bp, Homo sapiens
ctcaggcggcatcctgtcagccagtagaag

SEQ ID NO: 34127 - DNA, 30 bp, Homo sapiens
cacaggtcctggatctttaacaggaagcta

SEQ ID NO: 34128 - DNA, 30 bp, Homo sapiens
aacttgccagagcaagaattttgtctccag

SEQ ID NO: 34129 - DNA, 30 bp, Homo sapiens
ttttcctcagatctttgatttggtcattct

SEQ ID NO: 34130 - DNA, 30 bp, Homo sapiens
gcagctgctcctgaaccctgagtagatcgt

SEQ ID NO: 34131 - DNA, 30 bp, Homo sapiens
atgtcggcgcccagctctgcgcactgcttg

SEQ ID NO: 34132 - DNA, 30 bp, Homo sapiens
agatctcagtggctatgatgtcctcgtagg

SEQ ID NO: 34133 - DNA, 30 bp, Homo sapiens
atctcagtagcagtgatctcctccaggcag

SEQ ID NO: 34134 - DNA, 30 bp, Homo sapiens
ctgtggactcaatgcgctcgaggcgggagg

SEQ ID NO: 34135 - DNA, 30 bp, Homo sapiens
acctggggacatgggtactcaccagcaggc

SEQ ID NO: 34136 - DNA, 30 bp, Homo sapiens
ttgagggatccttctcccactctgaaggca

SEQ ID NO: 34137 - DNA, 30 bp, Homo sapiens
cttctgactcctcccccagctggtcatccc

SEQ ID NO: 34138 - DNA, 30 bp, Homo sapiens
ttgaggcctcatcttgctctccctcagtta

SEQ ID NO: 34139 - DNA, 30 bp, Homo sapiens
ttttcgggttggtcaggatctctcttgcca

SEQ ID NO: 34140 - DNA, 30 bp, Homo sapiens
agtttgtccaggcttttgggattggtgaga

SEQ ID NO: 34141 - DNA, 30 bp, Homo sapiens
gggcgggccgatctgggggttcttcaggaa

SEQ ID NO: 34142 - DNA, 30 bp, Homo sapiens
aagtggagaatgcagttactctcaaaacct

SEQ ID NO: 34143 - DNA, 30 bp, Homo sapiens
gcttgggacctggagtcctgggggaggcag

SEQ ID NO: 34144 - DNA, 30 bp, Homo sapiens
ggaagtagtgggggagccggctccggtaga

SEQ ID NO: 34145 - DNA, 30 bp, Homo sapiens
ctttgttccttcgcttcatcttgtgcccct

SEQ ID NO: 34146 - DNA, 30 bp, Homo sapiens
ccacggtctggcggctgaagagctcgaggg

SEQ ID NO: 34147 - DNA, 30 bp, Homo sapiens
tcattgacaggaattttgtaggccaccatg

SEQ ID NO: 34148 - DNA, 30 bp, Homo sapiens
tcgcggaagcctttaaatgtcactggtgcc

SEQ ID NO: 34149 - DNA, 30 bp, Homo sapiens
cagctgcctttatgagcgcgctcttccacg

SEQ ID NO: 34150 - DNA, 30 bp, Homo sapiens
aggaggggctgatcccgacctggccggtcc

SEQ ID NO: 34151 - DNA, 30 bp, Homo sapiens
tccagggtcacctgcagcaggccaccctca

SEQ ID NO: 34152 - DNA, 30 bp, Homo sapiens
gctagagacaggccggggcggggttctgag

SEQ ID NO: 34153 - DNA, 30 bp, Homo sapiens
tgatgtacaccttctcggcttgtgagaagt

SEQ ID NO: 34154 - DNA, 30 bp, Homo sapiens
ttttgggacatgtaaggtgagagtgaagtg

SEQ ID NO: 34155 - DNA, 30 bp, Homo sapiens
tgctggggcttccaaaatgtggcgtatccc

SEQ ID NO: 34156 - DNA, 30 bp, Homo sapiens
actcgggagaggacgggttgtcgctgctcg

SEQ ID NO: 34157 - DNA, 30 bp, Homo sapiens
caaatacagatcactgggaccctgtcctcc

SEQ ID NO: 34158 - DNA, 30 bp, Homo sapiens
tacaggaagaagtcggccgtgcccttggcc

SEQ ID NO: 34159 - DNA, 30 bp, Homo sapiens
actcgggagaggaggggctgtcgctggtgg

SEQ ID NO: 34160 - DNA, 30 bp, Homo sapiens
agcaggaggccgggccgtgggcggggtccg

SEQ ID NO: 34161 - DNA, 30 bp, Homo sapiens
tattggataaaaatcccaccatccataggg

SEQ ID NO: 34162 - DNA, 30 bp, Homo sapiens
gcatcctggtcctgcccctcaaggctttcc

SEQ ID NO: 34163 - DNA, 30 bp, Homo sapiens
tccagggtagaaacctctttggactcgtac

SEQ ID NO: 34164 - DNA, 30 bp, Homo sapiens
cttgacccggatttcagcatactcagctag

SEQ ID NO: 34165 - DNA, 30 bp, Homo sapiens
tcctcctctctcaaagctgcttcacgcagg

SEQ ID NO: 34166 - DNA, 30 bp, Homo sapiens
ggtaggagaagctacctgtagcgctagaac

SEQ ID NO: 34167 - DNA, 30 bp, Homo sapiens
ccctcctctctcaaagcatcttcatacagg

SEQ ID NO: 34168 - DNA, 30 bp, Homo sapiens
ctctaaaagcccattcatgcaggggtgggt

SEQ ID NO: 34169 - DNA, 30 bp, Homo sapiens
ctcaaagcccgttcatgcaggggtgggtag

SEQ ID NO: 34170 - DNA, 30 bp, Homo sapiens
ctctcaaaacccactcatgcaggggtgggt

SEQ ID NO: 34171 - DNA, 30 bp, Homo sapiens
tcctcctctaacaaagctgcttcacgcagg

SEQ ID NO: 34172 - DNA, 30 bp, Homo sapiens
ttgaggagcagaaaatgaatcaagtcagcc

SEQ ID NO: 34173 - DNA, 30 bp, Homo sapiens
ctctcaaagcccactcatgcaggagtgggt

SEQ ID NO: 34174 - DNA, 30 bp, Homo sapiens
caaactcctttctcctctcccaaagcctct

SEQ ID NO: 34175 - DNA, 30 bp, Homo sapiens
tgctcctctcccaaaacctcttcataaagg

SEQ ID NO: 34176 - DNA, 30 bp, Homo sapiens
acatggggtgggaggacctgctgaatgggg

SEQ ID NO: 34177 - DNA, 30 bp, Homo sapiens
agttgggaggacttgctggacttaaccttg

SEQ ID NO: 34178 - DNA, 30 bp, Homo sapiens
ttctggctctagctctctcttcttcctctt

SEQ ID NO: 34179 - DNA, 30 bp, Homo sapiens
agccctggccctggcgctatccctggctac

SEQ ID NO: 34180 - DNA, 30 bp, Homo sapiens
gcatgggagaagctgctagacgtggttctg

SEQ ID NO: 34181 - DNA, 30 bp, Homo sapiens
ctccggctttctcttcatctttcaaagctt

SEQ ID NO: 34182 - DNA, 30 bp, Homo sapiens
gcgtgggaagagctgctagccttggccttg

SEQ ID NO: 34183 - DNA, 30 bp, Homo sapiens
acatgggttgggaagagctactggatgtgg

SEQ ID NO: 34184 - DNA, 30 bp, Homo sapiens
gacagtcttggccactgcagtagtgccagt

SEQ ID NO: 34185 - DNA, 30 bp, Homo sapiens
gctctcagtctcaatgctctctctacctca

SEQ ID NO: 34186 - DNA, 30 bp, Homo sapiens
agctgggggacatgacactggagcttgcac

SEQ ID NO: 34187 - DNA, 30 bp, Homo sapiens
aaaaggagacgttgctggacatgacactga

SEQ ID NO: 34188 - DNA, 30 bp, Homo sapiens
tactggatagcttggataaaaactctaaga

SEQ ID NO: 34189 - DNA, 30 bp, Homo sapiens
cactggggcttgcactggccatggcagtag

SEQ ID NO: 34190 - DNA, 30 bp, Homo sapiens
agaaaccaatggcaccaaagttggcagcga

SEQ ID NO: 34191 - DNA, 30 bp, Homo sapiens
cacaggcaccagagctgccactggtgctgg

SEQ ID NO: 34192 - DNA, 30 bp, Homo sapiens
caacggtgctggatccaggagaagaagctg

SEQ ID NO: 34193 - DNA, 30 bp, Homo sapiens
tccaggagaagaagctggcgccagctctgg

SEQ ID NO: 34194 - DNA, 30 bp, Homo sapiens
cctgaagttgtgaacaaagatttgcctgtg

SEQ ID NO: 34195 - DNA, 30 bp, Homo sapiens
acgtggggtcaaggaaaaacatgatagttg

SEQ ID NO: 34196 - DNA, 30 bp, Homo sapiens
ccagaggtggatgccggccctagcactggc

SEQ ID NO: 34197 - DNA, 30 bp, Homo sapiens
taaggggcggaataacccctagcacctgaa

SEQ ID NO: 34198 - DNA, 30 bp, Homo sapiens
tagcggggagggggcctgctggtggggccg

SEQ ID NO: 34199 - DNA, 30 bp, Homo sapiens
cttccggaacaccttgtggaccggtggcgg

SEQ ID NO: 34200 - DNA, 30 bp, Homo sapiens
ctgaggtcggtgctacattctttgtaaggt

SEQ ID NO: 34201 - DNA, 30 bp, Homo sapiens
gccagggaaggaaggaatgttttcatagtt

SEQ ID NO: 34202 - DNA, 30 bp, Homo sapiens
tgctggcggccgaggcgccgggtttgagga

SEQ ID NO: 34203 - DNA, 30 bp, Homo sapiens
ctcagccataccaatagtgcctgtgacttt

SEQ ID NO: 34204 - DNA, 30 bp, Homo sapiens
tgttgctcgggtttcacgtaggagcacaga

SEQ ID NO: 34205 - DNA, 30 bp, Homo sapiens
ttccggctgccatctcctgagcgagctgcg

SEQ ID NO: 34206 - DNA, 30 bp, Homo sapiens
agactgaagaccaaacacttcaggtcctgg

SEQ ID NO: 34207 - DNA, 30 bp, Homo sapiens
ttcaggatcctttgactgatttacatcaat

SEQ ID NO: 34208 - DNA, 30 bp, Homo sapiens
tccatgtcagaggtagcagcttcacataaa

SEQ ID NO: 34209 - DNA, 30 bp, Homo sapiens
caatggtccagtcaggctttactccttgtg

SEQ ID NO: 34210 - DNA, 30 bp, Homo sapiens
gaagccggtggctgctcgctccttaggtgg

SEQ ID NO: 34211 - DNA, 30 bp, Homo sapiens
gagtggctgctcttcctgaagaaatatcga

SEQ ID NO: 34212 - DNA, 30 bp, Homo sapiens
taccggtggcctccatacttggccacccag

SEQ ID NO: 34213 - DNA, 30 bp, Homo sapiens
acgtggttttggctttggccacgggctctg

SEQ ID NO: 34214 - DNA, 30 bp, Homo sapiens
ccatggacctctggaaagatctgttgggtg

SEQ ID NO: 34215 - DNA, 30 bp, Homo sapiens
gattaaagagaacaccgcatggaccacgta

SEQ ID NO: 34216 - DNA, 30 bp, Homo sapiens
tcgtaaagccagacccaaactgcaaccata

SEQ ID NO: 34217 - DNA, 30 bp, Homo sapiens
cagtggtaatagatgctgaaggcatggaga

SEQ ID NO: 34218 - DNA, 30 bp, Homo sapiens
gacagggtctccaggcttcctgatgttgtg

SEQ ID NO: 34219 - DNA, 30 bp, Homo sapiens
gagtcacagatgaagtatcatcttctattc

SEQ ID NO: 34220 - DNA, 30 bp, Homo sapiens
agagaaactaaatggtatttcatcagttgt

SEQ ID NO: 34221 - DNA, 30 bp, Homo sapiens
aatatcctgatgattgttgagttgtatctt

SEQ ID NO: 34222 - DNA, 30 bp, Homo sapiens
agaaggaaccaaccctaccgacatcttgat

SEQ ID NO: 34223 - DNA, 30 bp, Homo sapiens
cactggtgacagatgccgggagggtgacac

SEQ ID NO: 34224 - DNA, 30 bp, Homo sapiens
ctgagaccctaacaggtcgtccaaatcact

SEQ ID NO: 34225 - DNA, 30 bp, Homo sapiens
atcattaccaggctctgtcttcaataaaga

SEQ ID NO: 34226 - DNA, 30 bp, Homo sapiens
taggggttaccaaacaattcatcaagctcc

SEQ ID NO: 34227 - DNA, 30 bp, Homo sapiens
catcctgggtgacttgcccagaattctggg

SEQ ID NO: 34228 - DNA, 30 bp, Homo sapiens
caggggtcattgccataagacctgatctct

SEQ ID NO: 34229 - DNA, 30 bp, Homo sapiens
ccatggatcctccagcaggtcccacagccg

SEQ ID NO: 34230 - DNA, 30 bp, Homo sapiens
tgatttcaacttcctttttatctttaggga

SEQ ID NO: 34231 - DNA, 30 bp, Homo sapiens
agcaggattacctgaaagtgtggtgttggc

SEQ ID NO: 34232 - DNA, 30 bp, Homo sapiens
taggcaggggtccagataggcagagggtgg

SEQ ID NO: 34233 - DNA, 30 bp, Homo sapiens
gaaagaagctctgctgcttgttgtcgtggt

SEQ ID NO: 34234 - DNA, 30 bp, Homo sapiens
cccaggctctgccggagctgtctgagtggt

SEQ ID NO: 34235 - DNA, 30 bp, Homo sapiens
aactggattcggaatgtgctgatttccatt

SEQ ID NO: 34236 - DNA, 30 bp, Homo sapiens
cccaagcggaggcgaaaggtagcaatctcc

SEQ ID NO: 34237 - DNA, 30 bp, Homo sapiens
catccacctccttccattgaactgaggcca

SEQ ID NO: 34238 - DNA, 30 bp, Homo sapiens
ttcctttgggtggacggtgatgatggggcc

SEQ ID NO: 34239 - DNA, 30 bp, Homo sapiens
gtgtggcggaggctgaagcacgagcaacag

SEQ ID NO: 34240 - DNA, 30 bp, Homo sapiens
cattcttgctggtgggctcccaagggtaaa

SEQ ID NO: 34241 - DNA, 30 bp, Homo sapiens
cttcttagtctctttcttgggcctcttgtt

SEQ ID NO: 34242 - DNA, 30 bp, Homo sapiens
agctggcgatctaatgcataagttgctctt

SEQ ID NO: 34243 - DNA, 30 bp, Homo sapiens
tcccggcccttgtagggttggatgtggaag

SEQ ID NO: 34244 - DNA, 30 bp, Homo sapiens
acatgagccactgctccttctctttgatga

SEQ ID NO: 34245 - DNA, 30 bp, Homo sapiens
aatcggtccgtgcactggctgccttggggg

SEQ ID NO: 34246 - DNA, 30 bp, Homo sapiens
atgtccacatagatcccattgatcaaataa

SEQ ID NO: 34247 - DNA, 30 bp, Homo sapiens
atatggttacggtttttaatttgcaaggat

SEQ ID NO: 34248 - DNA, 30 bp, Homo sapiens
ccgtggcaggagcttgtatttgtacagcac

SEQ ID NO: 34249 - DNA, 30 bp, Homo sapiens
ccccggggagcccgggggcggagccgatcc

SEQ ID NO: 34250 - DNA, 30 bp, Homo sapiens
tttgtgggccaggaagccaagagccgttgc

SEQ ID NO: 34251 - DNA, 30 bp, Homo sapiens
tcatcattgccttcttcaaagtgatctgat

SEQ ID NO: 34252 - DNA, 30 bp, Homo sapiens
tgcaggcagggaaggactcatcctgcatca

SEQ ID NO: 34253 - DNA, 30 bp, Homo sapiens
tgcagggaaggattcatcttgcataaccac

SEQ ID NO: 34254 - DNA, 30 bp, Homo sapiens
cgaaggtttcctgggaggcgtagaccatat

SEQ ID NO: 34255 - DNA, 30 bp, Homo sapiens
cgtctcctgggaggcatagaccatgtacag

SEQ ID NO: 34256 - DNA, 30 bp, Homo sapiens
cgtctcctgggaggcacagaccatgtacag

SEQ ID NO: 34257 - DNA, 30 bp, Homo sapiens
gagaggattgcagggtctgtcctcaaggct

SEQ ID NO: 34258 - DNA, 30 bp, Homo sapiens
tgcaggccgggaaggcgtcatcctgcatgg

SEQ ID NO: 34259 - DNA, 30 bp, Homo sapiens
ttagcgagtgcagcagtgacatcctcagcc

SEQ ID NO: 34260 - DNA, 30 bp, Homo sapiens
gcatgggttggtgtgctgggctggttaagg

SEQ ID NO: 34261 - DNA, 30 bp, Homo sapiens
acacggcggtgcgcgtgggtgtgccgggct

SEQ ID NO: 34262 - DNA, 30 bp, Homo sapiens
tgagtcttctcccaggatctccttcacgaa

SEQ ID NO: 34263 - DNA, 30 bp, Homo sapiens
acatgggagagctgggagtagctggcattt

SEQ ID NO: 34264 - DNA, 30 bp, Homo sapiens
cacgggggcccctgctggctccgcctctcc

SEQ ID NO: 34265 - DNA, 30 bp, Homo sapiens
ctgttcctttggattcatgtagggtgaaaa

SEQ ID NO: 34266 - DNA, 30 bp, Homo sapiens
agaagggcaggtggggctggctcaggacgc

SEQ ID NO: 34267 - DNA, 30 bp, Homo sapiens
agtacgaaagactggatgcttcagtagctc

SEQ ID NO: 34268 - DNA, 30 bp, Homo sapiens
tagtgggagccgtgggccccgcacaggggc

SEQ ID NO: 34269 - DNA, 30 bp, Homo sapiens
caaggccccgcttccggcacccacggggcc

SEQ ID NO: 34270 - DNA, 30 bp, Homo sapiens
tggagggagggaagctgggggccgcaaggc

SEQ ID NO: 34271 - DNA, 30 bp, Homo sapiens
accaggtagcagagctgtagtgtttattgg

SEQ ID NO: 34272 - DNA, 30 bp, Homo sapiens
ctccagctggccatgcttgaccctccagct

SEQ ID NO: 34273 - DNA, 30 bp, Homo sapiens
ctttggtttctgaggcctcctgagcccttc

SEQ ID NO: 34274 - DNA, 30 bp, Homo sapiens
ctagtgagaccacagtatacctctcttcat

SEQ ID NO: 34275 - DNA, 30 bp, Homo sapiens
agaaggagtgcttcaggagctggagagcag

SEQ ID NO: 34276 - DNA, 30 bp, Homo sapiens
gagttcatcagctgaaggtctcagtttggc

SEQ ID NO: 34277 - DNA, 30 bp, Homo sapiens
ccacggtggtcccctctggctctctcttta

SEQ ID NO: 34278 - DNA, 30 bp, Homo sapiens
cattatcctcctcctcaccgtcatcatcat

SEQ ID NO: 34279 - DNA, 30 bp, Homo sapiens
gacaggaattctttctccagttcatatata

SEQ ID NO: 34280 - DNA, 30 bp, Homo sapiens
aagtggtgtgtgagcagctcctcagctgaa

SEQ ID NO: 34281 - DNA, 30 bp, Homo sapiens
caaacgaatggtcgaggagctggctggcgg

SEQ ID NO: 34282 - DNA, 30 bp, Homo sapiens
acagtgtgcacagcatccctccccttagtc

SEQ ID NO: 34283 - DNA, 30 bp, Homo sapiens
cagaggtgactggtgtggatcctgctcgct

SEQ ID NO: 34284 - DNA, 30 bp, Homo sapiens
catcctggtccagttctgcaactagttctt

SEQ ID NO: 34285 - DNA, 30 bp, Homo sapiens
cgtttctgctgctgacttctgatgacctct

SEQ ID NO: 34286 - DNA, 30 bp, Homo sapiens
ggggagctggggatttccacgggcacagta

SEQ ID NO: 34287 - DNA, 30 bp, Homo sapiens
ctcttctgatactgtattcgaagtttctcc

SEQ ID NO: 34288 - DNA, 30 bp, Homo sapiens
agcaggtaccctggctgtgctgatcatgtg

SEQ ID NO: 34289 - DNA, 30 bp, Homo sapiens
gccatattcaagcgttggtggtccccgaac

SEQ ID NO: 34290 - DNA, 30 bp, Homo sapiens
ctcctgctggatctcataaggggcaggcct

SEQ ID NO: 34291 - DNA, 30 bp, Homo sapiens
tactccatgaccaccattggctaggagtgt

SEQ ID NO: 34292 - DNA, 30 bp, Homo sapiens
tagtggacagcccgggaaagggggccaagg

SEQ ID NO: 34293 - DNA, 30 bp, Homo sapiens
tctggctgtccaaggtctgggcctcccttt

SEQ ID NO: 34294 - DNA, 30 bp, Homo sapiens
tcctggatgtagaggttgctgggagcagta

SEQ ID NO: 34295 - DNA, 30 bp, Homo sapiens
tacaggcctgtaatcccagctactcgggag

SEQ ID NO: 34296 - DNA, 30 bp, Homo sapiens
agtaggtgctctggtggcccgtgaggatgt

SEQ ID NO: 34297 - DNA, 30 bp, Homo sapiens
gccaggatgtacaaattgctatttgctgtg

SEQ ID NO: 34298 - DNA, 30 bp, Homo sapiens
cagaagagaagtcctgcctaaggtcatgaa

SEQ ID NO: 34299 - DNA, 30 bp, Homo sapiens
aagatgtagagattgctgtgtgcagtagga

SEQ ID NO: 34300 - DNA, 30 bp, Homo sapiens
ccagtttattgttcatctctttgctttgct

SEQ ID NO: 34301 - DNA, 30 bp, Homo sapiens
caaggggagctctcaatgtattccgtatgg

SEQ ID NO: 34302 - DNA, 30 bp, Homo sapiens
atccggggagctgaggcctgaaagatggcg

SEQ ID NO: 34303 - DNA, 30 bp, Homo sapiens
acctgaggcaggggcccaagtgtcccttca

SEQ ID NO: 34304 - DNA, 30 bp, Homo sapiens
taaaggacttctgtgacctgcggggactgc

SEQ ID NO: 34305 - DNA, 30 bp, Homo sapiens
agaaggtgttgagaggagtttcttggccag

SEQ ID NO: 34306 - DNA, 30 bp, Homo sapiens
ctgaggactttggcaagatgtcatggaatc

SEQ ID NO: 34307 - DNA, 30 bp, Homo sapiens
gcttggagggctccacggaggaagtgcctc

SEQ ID NO: 34308 - DNA, 30 bp, Homo sapiens
ggctggaatctagcagtctcttcaaaaatt

SEQ ID NO: 34309 - DNA, 30 bp, Homo sapiens
acaacccaggggtcctgccgaggcttccag

SEQ ID NO: 34310 - DNA, 30 bp, Homo sapiens
gcttgtcatatatctgaggtggaggcgcct

SEQ ID NO: 34311 - DNA, 30 bp, Homo sapiens
tgctcaatctccaggctgccaggtggcttc

SEQ ID NO: 34312 - DNA, 30 bp, Homo sapiens
cagaggcgtctccttggagaccctggcccc

SEQ ID NO: 34313 - DNA, 30 bp, Homo sapiens
agcttcatgccactccggcgccgtgagtcc

SEQ ID NO: 34314 - DNA, 30 bp, Homo sapiens
cttcttggtcaaggggtggtggcacaaagc

SEQ ID NO: 34315 - DNA, 30 bp, Homo sapiens
caatatccatgaggtgaggatatatggtca

SEQ ID NO: 34316 - DNA, 30 bp, Homo sapiens
aggaggtccctgctttcaaaggactgatca

SEQ ID NO: 34317 - DNA, 30 bp, Homo sapiens
acatggtgcccctccagcaggggcaggtgg

SEQ ID NO: 34318 - DNA, 30 bp, Homo sapiens
accaggcattggtggagcaccagaaggtcc

SEQ ID NO: 34319 - DNA, 30 bp, Homo sapiens
tgctcccctgcccccagccccactgctgct

SEQ ID NO: 34320 - DNA, 30 bp, Homo sapiens
tagggggcctccagcactccgggctggaag

SEQ ID NO: 34321 - DNA, 30 bp, Homo sapiens
cacagggtaccagcaaagagcattctcccc

SEQ ID NO: 34322 - DNA, 30 bp, Homo sapiens
ccacctttctttggagaaggcctcggtctg

SEQ ID NO: 34323 - DNA, 30 bp, Homo sapiens
atgaggaatttgaggggaagatttcatagc

SEQ ID NO: 34324 - DNA, 30 bp, Homo sapiens
caggggtcctggaggtcaggcaggtcagcc

SEQ ID NO: 34325 - DNA, 30 bp, Homo sapiens
cagaggcccagctgctgcttctagactgct

SEQ ID NO: 34326 - DNA, 30 bp, Homo sapiens
tataactccattcttggttctctcctccaa

SEQ ID NO: 34327 - DNA, 30 bp, Homo sapiens
tccaggtagatatcttctgtggggcaggtg

SEQ ID NO: 34328 - DNA, 30 bp, Homo sapiens
tccaggtagatgtcctccgtggggcaggcg

SEQ ID NO: 34329 - DNA, 30 bp, Homo sapiens
actcgggggtgtaggacacctgccacacga

SEQ ID NO: 34330 - DNA, 30 bp, Homo sapiens
cccaggatgacttcgggcgcccggtagtac

SEQ ID NO: 34331 - DNA, 30 bp, Homo sapiens
gcatggcggggccaaggtcgcggggaagga

SEQ ID NO: 34332 - DNA, 30 bp, Homo sapiens
atcgacagccttcaaggggtcccgtcgagg

SEQ ID NO: 34333 - DNA, 30 bp, Homo sapiens
ttgcttctttcttcccaatccatgacttct

SEQ ID NO: 34334 - DNA, 30 bp, Homo sapiens
gcccggatttcttctccttctggaagctga

SEQ ID NO: 34335 - DNA, 30 bp, Homo sapiens
actttctgggatccttttcttcgcttcact

SEQ ID NO: 34336 - DNA, 30 bp, Homo sapiens
acctggtcagccaagtggcctggtcgctgt

SEQ ID NO: 34337 - DNA, 30 bp, Homo sapiens
cagtgggccagagccgcagcctccagggcc

SEQ ID NO: 34338 - DNA, 30 bp, Homo sapiens
tactggttgttgcagccctgtgaggcagag

SEQ ID NO: 34339 - DNA, 30 bp, Homo sapiens
tattgggattcgtgggacgtggtttgctct

SEQ ID NO: 34340 - DNA, 30 bp, Homo sapiens
gccgttccacggctcgaagcaacagttctg

SEQ ID NO: 34341 - DNA, 30 bp, Homo sapiens
ctgtgggcccccttcatcaggtatcacaaa

SEQ ID NO: 34342 - DNA, 30 bp, Homo sapiens
ctgcgggggctgctgttcgtgggcttgctc

SEQ ID NO: 34343 - DNA, 30 bp, Homo sapiens
gtactcgtcctggtcttcttgttgatgctc

SEQ ID NO: 34344 - DNA, 30 bp, Homo sapiens
cacaaaccctgcttggccagggaggcagac

SEQ ID NO: 34345 - DNA, 30 bp, Homo sapiens
tactggcccagcaggtacacagggtctccc

SEQ ID NO: 34346 - DNA, 30 bp, Homo sapiens
tcctggttgctgaagcctcctcaaaagcat

SEQ ID NO: 34347 - DNA, 30 bp, Homo sapiens
gatacacagggtcaccaactctcaggcttc

SEQ ID NO: 34348 - DNA, 30 bp, Homo sapiens
gactgatacaacttcaggggggccaccctc

SEQ ID NO: 34349 - DNA, 30 bp, Homo sapiens
tagacgacctggctttgagaaatgctgcct

SEQ ID NO: 34350 - DNA, 30 bp, Homo sapiens
aaatggcaggactggcccccaaaacctact

SEQ ID NO: 34351 - DNA, 30 bp, Homo sapiens
ccgagctgttatcttctgataagtcttcat

SEQ ID NO: 34352 - DNA, 30 bp, Homo sapiens
tactggtgtctcctctgccaccttcttcag

SEQ ID NO: 34353 - DNA, 30 bp, Homo sapiens
agttcctcttgaccgaatggaggcccagca

SEQ ID NO: 34354 - DNA, 30 bp, Homo sapiens
tctcggctgctgcctgggggacttcgctgt

SEQ ID NO: 34355 - DNA, 30 bp, Homo sapiens
gtaaatattgctgctgtttgaagtaaactt

SEQ ID NO: 34356 - DNA, 30 bp, Homo sapiens
ctgtggaggtggtggagatgagccttgttt

SEQ ID NO: 34357 - DNA, 30 bp, Homo sapiens
atggtctccgtcttcttcggaatcatcctc

SEQ ID NO: 34358 - DNA, 30 bp, Homo sapiens
tcttcaggctctgtgcaacaagaagagttt

SEQ ID NO: 34359 - DNA, 30 bp, Homo sapiens
cagactgtagtgaccctcatgacaacctct

SEQ ID NO: 34360 - DNA, 30 bp, Homo sapiens
ccgctgggggggcttctggactgcactcgg

SEQ ID NO: 34361 - DNA, 30 bp, Homo sapiens
tactcattctgctcagcgctggctggtgta

SEQ ID NO: 34362 - DNA, 30 bp, Homo sapiens
cagacgctgcactccacgcctgcgtcctcc

SEQ ID NO: 34363 - DNA, 30 bp, Homo sapiens
gcttggttataggtgctaaggaaaagttgg

SEQ ID NO: 34364 - DNA, 30 bp, Homo sapiens
gtagactggtaggatttagctgagttttgt

SEQ ID NO: 34365 - DNA, 30 bp, Homo sapiens
tattcgcttgaagcgaaccccattaagtga

SEQ ID NO: 34366 - DNA, 30 bp, Homo sapiens
aaagcttcagctcgttggctattttggagg

SEQ ID NO: 34367 - DNA, 30 bp, Homo sapiens
cattggcaattttggaagcaatatttttga

SEQ ID NO: 34368 - DNA, 30 bp, Homo sapiens
tcgaggtcgttggagatgcgggtgacgagg

SEQ ID NO: 34369 - DNA, 30 bp, Homo sapiens
tccaggggaatcggagcagccggggggcgg

SEQ ID NO: 34370 - DNA, 30 bp, Homo sapiens
ggggcttcagggggtttcccctcagctaca

SEQ ID NO: 34371 - DNA, 30 bp, Homo sapiens
gtccggtgggctttcaccagccaagtcctg

SEQ ID NO: 34372 - DNA, 30 bp, Homo sapiens
gccacctcctgcttgccctggcagcgacgc

SEQ ID NO: 34373 - DNA, 30 bp, Homo sapiens
ggctttccgaatgatgtggcaatctgctca

SEQ ID NO: 34374 - DNA, 30 bp, Homo sapiens
cacagatattccggtgcatcactgtaactt

SEQ ID NO: 34375 - DNA, 30 bp, Homo sapiens
ttttcggtagccctttatggccaggacagc

SEQ ID NO: 34376 - DNA, 30 bp, Homo sapiens
ccgaggttgcatttcatctttgaaagccct

SEQ ID NO: 34377 - DNA, 30 bp, Homo sapiens
cgaccctgtgctccctgggaagaaggttct

SEQ ID NO: 34378 - DNA, 30 bp, Homo sapiens
cccatccttcagacactcaatctggaatgt

SEQ ID NO: 34379 - DNA, 30 bp, Homo sapiens
ctccggtgaccctctggatccagtccttgt

SEQ ID NO: 34380 - DNA, 30 bp, Homo sapiens
cacctggggctccacaacactttgtggtaa

SEQ ID NO: 34381 - DNA, 30 bp, Homo sapiens
tccagggaatatagttaataacttttgtgt

SEQ ID NO: 34382 - DNA, 30 bp, Homo sapiens
tagaggctctgctctgagcaggtgcgcttg

SEQ ID NO: 34383 - DNA, 30 bp, Homo sapiens
tcccgggggtgcgggactggacactccttt

SEQ ID NO: 34384 - DNA, 30 bp, Homo sapiens
ccaaatcccgatgcttttgatggccccctg

SEQ ID NO: 34385 - DNA, 30 bp, Homo sapiens
ttccggtgggcccgagagctactggcacgg

SEQ ID NO: 34386 - DNA, 30 bp, Homo sapiens
ccaaggggtgatgttctcccagcatttgga

SEQ ID NO: 34387 - DNA, 30 bp, Homo sapiens
tacaaggcctttttgtgagggctgctacgc

SEQ ID NO: 34388 - DNA, 30 bp, Homo sapiens
acagtcaggtgctgagcagtattcctggct

SEQ ID NO: 34389 - DNA, 30 bp, Homo sapiens
tcctgggaacctcccatgggaactcgcttc

SEQ ID NO: 34390 - DNA, 30 bp, Homo sapiens
ccatgggaagctgtccctaccaaagtggcc

SEQ ID NO: 34391 - DNA, 30 bp, Homo sapiens
gtctccatctcttgtcaatgaggaaaggcc

SEQ ID NO: 34392 - DNA, 30 bp, Homo sapiens
tcctggcttcggggcgaggtggagccgtcg

SEQ ID NO: 34393 - DNA, 30 bp, Homo sapiens
acaactgtgttctccaggatggccagccgc

SEQ ID NO: 34394 - DNA, 30 bp, Homo sapiens
tccagggcttccattctctgtgtcatttct

SEQ ID NO: 34395 - DNA, 30 bp, Homo sapiens
tcctggaatgccagtgtagcttcacatcca

SEQ ID NO: 34396 - DNA, 30 bp, Homo sapiens
cttctggttggccagctggttctccagatc

SEQ ID NO: 34397 - DNA, 30 bp, Homo sapiens
tctgtctgcgttcttctgccaatttattca

SEQ ID NO: 34398 - DNA, 30 bp, Homo sapiens
cacaggaggctggccaggctggtgttgggt

SEQ ID NO: 34399 - DNA, 30 bp, Homo sapiens
cgccggtacagcaccaccaggagtgtgact

SEQ ID NO: 34400 - DNA, 30 bp, Homo sapiens
tgctccagaagagcattctgccgcttgagg

SEQ ID NO: 34401 - DNA, 30 bp, Homo sapiens
tgaaggtgtggcatttctgcatcaaacttt

SEQ ID NO: 34402 - DNA, 30 bp, Homo sapiens
agctggcctccatccggagcttcttcctgc

SEQ ID NO: 34403 - DNA, 30 bp, Homo sapiens
cagaaaacagttggaaaaggcaagtgttca

SEQ ID NO: 34404 - DNA, 30 bp, Homo sapiens
accagggttgggagggaagtggctgagagc

SEQ ID NO: 34405 - DNA, 30 bp, Homo sapiens
cagcaggtgggctgtggctggggggcgtct

SEQ ID NO: 34406 - DNA, 30 bp, Homo sapiens
ccctggaagcccagctccttgtagttggag

SEQ ID NO: 34407 - DNA, 30 bp, Homo sapiens
ctgaggcactgaagaaagtatgtcacgcag

SEQ ID NO: 34408 - DNA, 30 bp, Homo sapiens
gacatcgtcaggattgataaagacagagat

SEQ ID NO: 34409 - DNA, 30 bp, Homo sapiens
tactggggttgggtggttggttccacgggt

SEQ ID NO: 34410 - DNA, 30 bp, Homo sapiens
catcgaagctggaggtggtgagagactgac

SEQ ID NO: 34411 - DNA, 30 bp, Homo sapiens
accaggacggacctgcagcacaggtggtaa

SEQ ID NO: 34412 - DNA, 30 bp, Homo sapiens
tactgctttctagctccaggttttttaagg

SEQ ID NO: 34413 - DNA, 30 bp, Homo sapiens
tcttctgcaggacacccacatcatcgaagc

SEQ ID NO: 34414 - DNA, 30 bp, Homo sapiens
tccatttcaatatccatctcttctgtatca

SEQ ID NO: 34415 - DNA, 30 bp, Homo sapiens
tggaggaaaggattggttctgcctggagta

SEQ ID NO: 34416 - DNA, 30 bp, Homo sapiens
acgtgctccatctccgggtccgggtcgggc

SEQ ID NO: 34417 - DNA, 30 bp, Homo sapiens
ggacggccttcttggtctctcactttctct

SEQ ID NO: 34418 - DNA, 30 bp, Homo sapiens
gtcagcatttctgcccgcctggccagcctg

SEQ ID NO: 34419 - DNA, 30 bp, Homo sapiens
gcctggccagcctgtctgcctgcaaggcct

SEQ ID NO: 34420 - DNA, 30 bp, Homo sapiens
tgtcagcatttctgcctgcctggccagcct

SEQ ID NO: 34421 - DNA, 30 bp, Homo sapiens
ccatgaagctcaattggatacttccactgc

SEQ ID NO: 34422 - DNA, 30 bp, Homo sapiens
agaccaaatgtgctgaattatggatgggag

SEQ ID NO: 34423 - DNA, 30 bp, Homo sapiens
tccactcattgacacaaaaaattcggtaag

SEQ ID NO: 34424 - DNA, 30 bp, Homo sapiens
atctggagatcttcctcctcttgggtttgg

SEQ ID NO: 34425 - DNA, 30 bp, Homo sapiens
tatggggccagtttcctcctcttgtttttg

SEQ ID NO: 34426 - DNA, 30 bp, Homo sapiens
gtgggcctcaatattttgtagtcgttcttc

SEQ ID NO: 34427 - DNA, 30 bp, Homo sapiens
ggaaggtggtgggttgccatggattctgct

SEQ ID NO: 34428 - DNA, 30 bp, Homo sapiens
agatagggaactcacagacggccagatggg

SEQ ID NO: 34429 - DNA, 30 bp, Homo sapiens
tgcagggcgggctcctcgtctccgaccacc

SEQ ID NO: 34430 - DNA, 30 bp, Homo sapiens
gcgaggtcctagaatttgttacacgtagag

SEQ ID NO: 34431 - DNA, 30 bp, Homo sapiens
ttgtggctagtcagatgttcggcagatatt

SEQ ID NO: 34432 - DNA, 30 bp, Homo sapiens
gttcggcagatattatgggtatcaacactt

SEQ ID NO: 34433 - DNA, 30 bp, Homo sapiens
ttgaggaggaaacaggatagtatgtacagt

SEQ ID NO: 34434 - DNA, 30 bp, Homo sapiens
cgaaggggacacttgttgcaggagttgttg

SEQ ID NO: 34435 - DNA, 30 bp, Homo sapiens
gttggtgcagcgaacggaacgctggtggca

SEQ ID NO: 34436 - DNA, 30 bp, Homo sapiens
ctgaggccgcctttgcgtatgagcttgtgg

SEQ ID NO: 34437 - DNA, 30 bp, Homo sapiens
cactgctttagtgatgaatgtctcgaggct

SEQ ID NO: 34438 - DNA, 30 bp, Homo sapiens
ccatgggaaagacactgttgtacgaattac

SEQ ID NO: 34439 - DNA, 30 bp, Homo sapiens
cgcaggacataggaacgggcaggtgcgctc

SEQ ID NO: 34440 - DNA, 30 bp, Homo sapiens
tcccggagcttctccggggcaaggctggtg

SEQ ID NO: 34441 - DNA, 30 bp, Homo sapiens
ctcctcagagctcaccttgccagagccccg

SEQ ID NO: 34442 - DNA, 30 bp, Homo sapiens
ccatgggtgatccagagcgactatctcttc

SEQ ID NO: 34443 - DNA, 30 bp, Homo sapiens
catggctcttgtttgatgtagaagttggca

SEQ ID NO: 34444 - DNA, 30 bp, Homo sapiens
acaccgaaggggtctttggcgggtgaacct

SEQ ID NO: 34445 - DNA, 30 bp, Homo sapiens
tgtaaccatccagagtcccagggtcacatt

SEQ ID NO: 34446 - DNA, 30 bp, Homo sapiens
accaggagcatgtcagcacctccttgagcg

SEQ ID NO: 34447 - DNA, 30 bp, Homo sapiens
taccagtacctgctgcagaagatcatcttt

SEQ ID NO: 34448 - DNA, 30 bp, Homo sapiens
ttcatgccgttgcagccacagagaatctcc

SEQ ID NO: 34449 - DNA, 30 bp, Homo sapiens
caaaggcctcccaggggatagcaacagatg

SEQ ID NO: 34450 - DNA, 30 bp, Homo sapiens
ttctgggaaagctgcaggcgatcctgaaac

SEQ ID NO: 34451 - DNA, 30 bp, Homo sapiens
atcgatgtatttctctccctggtctcccgg

SEQ ID NO: 34452 - DNA, 30 bp, Homo sapiens
tagaggaattcttctggagaaaccgtagag

SEQ ID NO: 34453 - DNA, 30 bp, Homo sapiens
tctcgggggctcctgagggtccaggtccac

SEQ ID NO: 34454 - DNA, 30 bp, Homo sapiens
gtgtggcctggagttctcctcctctagcag

SEQ ID NO: 34455 - DNA, 30 bp, Homo sapiens
cccttttgtctgattcttcctcctcaaact

SEQ ID NO: 34456 - DNA, 30 bp, Homo sapiens
acatcctgaagataccgaagtcagtcttct

SEQ ID NO: 34457 - DNA, 30 bp, Homo sapiens
ccaaggctctcttggtgcctcctcatctgt

SEQ ID NO: 34458 - DNA, 30 bp, Homo sapiens
ccacaaggactccaccacagtctttaggat

SEQ ID NO: 34459 - DNA, 30 bp, Homo sapiens
gtgaggactgtggcattttctgcagcacct

SEQ ID NO: 34460 - DNA, 30 bp, Homo sapiens
cacaggtcttcatcattctgctgaagagaa

SEQ ID NO: 34461 - DNA, 30 bp, Homo sapiens
tcggggggctttgtcagtggcgctgagctg

SEQ ID NO: 34462 - DNA, 30 bp, Homo sapiens
tacccctgcaggtcggagaagggggcctgg

SEQ ID NO: 34463 - DNA, 30 bp, Homo sapiens
tcctgggcggaggtcctcgggcgcagcgcc

SEQ ID NO: 34464 - DNA, 30 bp, Homo sapiens
tagtggtgcctgttcactcccttcctcctt

SEQ ID NO: 34465 - DNA, 30 bp, Homo sapiens
agttttcagaagatgtatggaaatgcctca

SEQ ID NO: 34466 - DNA, 30 bp, Homo sapiens
ctttctgtcctctcctcgtcagccgtctga

SEQ ID NO: 34467 - DNA, 30 bp, Homo sapiens
cagtcgctcttctttggatttgaggcagac

SEQ ID NO: 34468 - DNA, 30 bp, Homo sapiens
aactggggacccagcggaacttgtaacccc

SEQ ID NO: 34469 - DNA, 30 bp, Homo sapiens
cagctcctactccagcaacacctgcaaaag

SEQ ID NO: 34470 - DNA, 30 bp, Homo sapiens
ttaaggctgttcagaaatttagcatgttct

SEQ ID NO: 34471 - DNA, 30 bp, Homo sapiens
aactgctgcaggatcattttccttttcagg

SEQ ID NO: 34472 - DNA, 30 bp, Homo sapiens
cagatgaggaagatgatgccctcagacacc

SEQ ID NO: 34473 - DNA, 30 bp, Homo sapiens
tgtctagcagcgcagagagatggagctcag

SEQ ID NO: 34474 - DNA, 30 bp, Homo sapiens
gcacggtcttcccagtcactgtcaggaaat

SEQ ID NO: 34475 - DNA, 30 bp, Homo sapiens
ttgaggcggtagagaaccttgcgctgcatg

SEQ ID NO: 34476 - DNA, 30 bp, Homo sapiens
gttagggttaactaccaagtagggatcttc

SEQ ID NO: 34477 - DNA, 30 bp, Homo sapiens
gtccgggaagcattgacctgccagacattg

SEQ ID NO: 34478 - DNA, 30 bp, Homo sapiens
ttcaagaggtaaccctggtcatttagtgat

SEQ ID NO: 34479 - DNA, 30 bp, Homo sapiens
ctagtagatccaattcctgtggtcagcaca

SEQ ID NO: 34480 - DNA, 30 bp, Homo sapiens
cacaatcaaatgcttcatcacctagttctg

SEQ ID NO: 34481 - DNA, 30 bp, Homo sapiens
acacatttttgctgctgaagcctcgttctt

SEQ ID NO: 34482 - DNA, 30 bp, Homo sapiens
ttcaatgtgagggatgtttcaaatagtaag

SEQ ID NO: 34483 - DNA, 30 bp, Homo sapiens
acagagcctgttctgattctgcgacttgct

SEQ ID NO: 34484 - DNA, 30 bp, Homo sapiens
cccaggtccatatgtggcaataaattgttc

SEQ ID NO: 34485 - DNA, 30 bp, Homo sapiens
gcgaatgctcctccgaggggtcccttccgc

SEQ ID NO: 34486 - DNA, 30 bp, Homo sapiens
ccgacagcagatgcaggacaggaaggctga

SEQ ID NO: 34487 - DNA, 30 bp, Homo sapiens
tggagggtcatcttctaatctgtattttcc

SEQ ID NO: 34488 - DNA, 30 bp, Homo sapiens
tatcctccgggtaagttttccttctcttct

SEQ ID NO: 34489 - DNA, 30 bp, Homo sapiens
aataggtagttttcaggggcacagaccttg

SEQ ID NO: 34490 - DNA, 30 bp, Homo sapiens
caggggcacagaccttgtgctgggtgatgg

SEQ ID NO: 34491 - DNA, 30 bp, Homo sapiens
tcttggcatcctgcgtgctccggcgcttca

SEQ ID NO: 34492 - DNA, 30 bp, Homo sapiens
ggaacagctggtgattctcgccaggaactg

SEQ ID NO: 34493 - DNA, 30 bp, Homo sapiens
ctgtggtgtgatcttggcagcctcagccct

SEQ ID NO: 34494 - DNA, 30 bp, Homo sapiens
atctggtttcagttcttggtattgcaccac

SEQ ID NO: 34495 - DNA, 30 bp, Homo sapiens
agagcgctgcgcttcttccgcagggggctg

SEQ ID NO: 34496 - DNA, 30 bp, Homo sapiens
tcaccagagaaaagggtacatttcatagac

SEQ ID NO: 34497 - DNA, 30 bp, Homo sapiens
catagagcatgctgttttccttctgccatg

SEQ ID NO: 34498 - DNA, 30 bp, Homo sapiens
tgtcggagaggcagatgtacttgtaatggg

SEQ ID NO: 34499 - DNA, 30 bp, Homo sapiens
ttcagggattctttagccttagcaaggtct

SEQ ID NO: 34500 - DNA, 30 bp, Homo sapiens
cacaggcgataaaatcccagagctactgtt

SEQ ID NO: 34501 - DNA, 30 bp, Homo sapiens
aggtggatgacatctccaaaggggagagga

SEQ ID NO: 34502 - DNA, 30 bp, Homo sapiens
aggaggagaagcagagcccacagcactcca

SEQ ID NO: 34503 - DNA, 30 bp, Homo sapiens
ctgcggcagtcctggatctgctgaagagac

SEQ ID NO: 34504 - DNA, 30 bp, Homo sapiens
cattccatacagatttccaagcagtctgat

SEQ ID NO: 34505 - DNA, 30 bp, Homo sapiens
aagaggaagatggccatgggcccccacagc

SEQ ID NO: 34506 - DNA, 30 bp, Homo sapiens
tcgaggacttaagatagagatgaggacgat

SEQ ID NO: 34507 - DNA, 30 bp, Homo sapiens
cagaggaaagaaattcaaaagcactttctt

SEQ ID NO: 34508 - DNA, 30 bp, Homo sapiens
ccacggttttgccttcaaattcatttagga

SEQ ID NO: 34509 - DNA, 30 bp, Homo sapiens
ttcagggtcttcacgaaatcttcccccttc

SEQ ID NO: 34510 - DNA, 30 bp, Homo sapiens
ccttccctttcttggctttggcctttgctt

SEQ ID NO: 34511 - DNA, 30 bp, Homo sapiens
aaattctccttccttttcttagctcgtgcc

SEQ ID NO: 34512 - DNA, 30 bp, Homo sapiens
tagaatgttccagttccacattttcattaa

SEQ ID NO: 34513 - DNA, 30 bp, Homo sapiens
atgtggagcagaccaagatgagaagggatg

SEQ ID NO: 34514 - DNA, 30 bp, Homo sapiens
taggggaaataagttagcacaatcatttga

SEQ ID NO: 34515 - DNA, 30 bp, Homo sapiens
gtagcagtggctaaagtgacaagattcttt

SEQ ID NO: 34516 - DNA, 30 bp, Homo sapiens
taaccagctgaatctctttcttgcaaatag

SEQ ID NO: 34517 - DNA, 30 bp, Homo sapiens
ctgaggtaggcagtgtggggatatcgtctt

SEQ ID NO: 34518 - DNA, 30 bp, Homo sapiens
gggtggtcagaggctgtcaccaactcaaac

SEQ ID NO: 34519 - DNA, 30 bp, Homo sapiens
cactcagtacccagtttgctgacgtctaca

SEQ ID NO: 34520 - DNA, 30 bp, Homo sapiens
aaatgggctctcctcaaggctggacctcaa

SEQ ID NO: 34521 - DNA, 30 bp, Homo sapiens
ggctggacctcaaaggcccagtttgggcct

SEQ ID NO: 34522 - DNA, 30 bp, Homo sapiens
agttgtggaggctgggaagtccaagattaa

SEQ ID NO: 34523 - DNA, 30 bp, Homo sapiens
ggtcaactttggtctgtattttctgcacct

SEQ ID NO: 34524 - DNA, 30 bp, Homo sapiens
acctggtgtaaagactcgcccatctgtaag

SEQ ID NO: 34525 - DNA, 30 bp, Homo sapiens
cacaggagggcttgatgcagattctggcca

SEQ ID NO: 34526 - DNA, 30 bp, Homo sapiens
accgtctgaacattcatggcttccttgggc

SEQ ID NO: 34527 - DNA, 30 bp, Homo sapiens
tccaggcaggggatgcctgccgggcttgga

SEQ ID NO: 34528 - DNA, 30 bp, Homo sapiens
agctggtgccagccagttttgggggagaca

SEQ ID NO: 34529 - DNA, 30 bp, Homo sapiens
agacgggctgtgccggtttttattctttcg

SEQ ID NO: 34530 - DNA, 30 bp, Homo sapiens
ctgtggtgactccctgaggaagtagaagaa

SEQ ID NO: 34531 - DNA, 30 bp, Homo sapiens
acgtggcttatggactggatagcactggat

SEQ ID NO: 34532 - DNA, 30 bp, Homo sapiens
tctcggtcacgggcgtccggctgtccacag

SEQ ID NO: 34533 - DNA, 30 bp, Homo sapiens
acatggtgagaatctgctttgaagatatga

SEQ ID NO: 34534 - DNA, 30 bp, Homo sapiens
tcccaatcagggccacatccataagatcat

SEQ ID NO: 34535 - DNA, 30 bp, Homo sapiens
agaaggcgggtgatcctccccccggatgct

SEQ ID NO: 34536 - DNA, 30 bp, Homo sapiens
tttgaatttgttaggccatctggtagctgg

SEQ ID NO: 34537 - DNA, 30 bp, Homo sapiens
tctccagcatctgctcacaggttcgagcca

SEQ ID NO: 34538 - DNA, 30 bp, Homo sapiens
atgttggtactgggctgtggctgggtatta

SEQ ID NO: 34539 - DNA, 30 bp, Homo sapiens
tgaaggatgcccatacggagtcactccttg

SEQ ID NO: 34540 - DNA, 30 bp, Homo sapiens
aatgaattgggagacatgagcgtctgtcct

SEQ ID NO: 34541 - DNA, 30 bp, Homo sapiens
aagtggacgggaaggcaggaagtacggtcc

SEQ ID NO: 34542 - DNA, 30 bp, Homo sapiens
accagggggcagtgtaagattagccattaa

SEQ ID NO: 34543 - DNA, 30 bp, Homo sapiens
atgcggcattcatagtgaagtcgagaggag

SEQ ID NO: 34544 - DNA, 30 bp, Homo sapiens
aggcggctgagaggcaggcctggtggacgc

SEQ ID NO: 34545 - DNA, 30 bp, Homo sapiens
cggacggtcctctggatgcagatggtccag

SEQ ID NO: 34546 - DNA, 30 bp, Homo sapiens
aacttctttgaatggcccacgaagatgact

SEQ ID NO: 34547 - DNA, 30 bp, Homo sapiens
tcttggggtctattttctctaggtgaacca

SEQ ID NO: 34548 - DNA, 30 bp, Homo sapiens
agcgtaggctgctgctgctgctggcctggg

SEQ ID NO: 34549 - DNA, 30 bp, Homo sapiens
aactgggtttacctggggggacaggatcct

SEQ ID NO: 34550 - DNA, 30 bp, Homo sapiens
caccggcacctgctgctgcttgcggatctt

SEQ ID NO: 34551 - DNA, 30 bp, Homo sapiens
cacaggggccatactccacctggtgccccg

SEQ ID NO: 34552 - DNA, 30 bp, Homo sapiens
gtctggaagagactggctatgggtaccact

SEQ ID NO: 34553 - DNA, 30 bp, Homo sapiens
aattggagctccaatggctttcaaggccat

SEQ ID NO: 34554 - DNA, 30 bp, Homo sapiens
cagtggggccagggccaccagcatgggagt

SEQ ID NO: 34555 - DNA, 30 bp, Homo sapiens
gttcatggcttgtggaggcactgcagctgg

SEQ ID NO: 34556 - DNA, 30 bp, Homo sapiens
tactggtaaagacacgggcacctgattaga

SEQ ID NO: 34557 - DNA, 30 bp, Homo sapiens
tagactgaggtgctggagacccactgttca

SEQ ID NO: 34558 - DNA, 30 bp, Homo sapiens
agagtgcagcaatggctttagcagccacct

SEQ ID NO: 34559 - DNA, 30 bp, Homo sapiens
atgaggatgtcgtcctccatgacgctgggc

SEQ ID NO: 34560 - DNA, 30 bp, Homo sapiens
agtccaagcagacataaggcagaatgttca

SEQ ID NO: 34561 - DNA, 30 bp, Homo sapiens
caatggaatattcttggaatagaaagttgc

SEQ ID NO: 34562 - DNA, 30 bp, Homo sapiens
tgccggcaggtgtcatggaaggcttcgagg

SEQ ID NO: 34563 - DNA, 30 bp, Homo sapiens
cgttggcttcagaggtgcagggatgttggc

SEQ ID NO: 34564 - DNA, 30 bp, Homo sapiens
cacagagtgcccccagggccagcaggtggt

SEQ ID NO: 34565 - DNA, 30 bp, Homo sapiens
gcacaccacccaccaaccactgcctgcccc

SEQ ID NO: 34566 - DNA, 30 bp, Homo sapiens
tgccaacatggcatttatatcccagatgag

SEQ ID NO: 34567 - DNA, 30 bp, Homo sapiens
ccaaggcttgctgaaggcgcatccgcttcc

SEQ ID NO: 34568 - DNA, 30 bp, Homo sapiens
ttgaggagtccgttgacataatctctacat

SEQ ID NO: 34569 - DNA, 30 bp, Homo sapiens
ttcaggggggcctttagcactcactgtctg

SEQ ID NO: 34570 - DNA, 30 bp, Homo sapiens
gttttacagtttctggtataggttctgcct

SEQ ID NO: 34571 - DNA, 30 bp, Homo sapiens
acaaggcagcatctttctctataatctgat

SEQ ID NO: 34572 - DNA, 30 bp, Homo sapiens
ctgcaggtgggcatttttttttccttcctg

SEQ ID NO: 34573 - DNA, 30 bp, Homo sapiens
cgctggtagggatgcatggaagccgacttg

SEQ ID NO: 34574 - DNA, 30 bp, Homo sapiens
ccttggggatttcgaacatgcagaggctct

SEQ ID NO: 34575 - DNA, 30 bp, Homo sapiens
cacttggaaatggtaattctgccaaaagag

SEQ ID NO: 34576 - DNA, 30 bp, Homo sapiens
gtcacccacgcgtccatcctcattcgcttt

SEQ ID NO: 34577 - DNA, 30 bp, Homo sapiens
taccggggccagccgtcggccaagggcagc

SEQ ID NO: 34578 - DNA, 30 bp, Homo sapiens
cttcagaaagtcgcatgcgcttgactgagg

SEQ ID NO: 34579 - DNA, 30 bp, Homo sapiens
atcaagccgcatcctcttcacagctgagcc

SEQ ID NO: 34580 - DNA, 30 bp, Homo sapiens
gtcaggcccctgaccacccactggacagat

SEQ ID NO: 34581 - DNA, 30 bp, Homo sapiens
ctctggaactacggagaaaaatcagatagg

SEQ ID NO: 34582 - DNA, 30 bp, Homo sapiens
ctgtcctcttgcttaggggaggatgaactg

SEQ ID NO: 34583 - DNA, 30 bp, Homo sapiens
catccggggaggcagcggcaatggcccgtg

SEQ ID NO: 34584 - DNA, 30 bp, Homo sapiens
taagattgcttgtcctgggacggcccattg

SEQ ID NO: 34585 - DNA, 30 bp, Homo sapiens
cgctggtccaccgctccgggatgtgggtct

SEQ ID NO: 34586 - DNA, 30 bp, Homo sapiens
cagagggacatgctggtgaggttgtcctgg

SEQ ID NO: 34587 - DNA, 30 bp, Homo sapiens
gtcagggtcagctgcccattgggagccact

SEQ ID NO: 34588 - DNA, 30 bp, Homo sapiens
atgtgggacagggatacagccacccctccc

SEQ ID NO: 34589 - DNA, 30 bp, Homo sapiens
agttggaaaatagtttcatcatgcttctga

SEQ ID NO: 34590 - DNA, 30 bp, Homo sapiens
tctgaagtttcttcacatatcctgtctccg

SEQ ID NO: 34591 - DNA, 30 bp, Homo sapiens
tcctggtgatgttctaataatacaacatat

SEQ ID NO: 34592 - DNA, 30 bp, Homo sapiens
aagtttctgcttgcctcagtaggatctgca

SEQ ID NO: 34593 - DNA, 30 bp, Homo sapiens
ctctggttcattggattgctactatttatg

SEQ ID NO: 34594 - DNA, 30 bp, Homo sapiens
cccctccatgcccatattcatgcccattcc

SEQ ID NO: 34595 - DNA, 30 bp, Homo sapiens
cccatccatgcccatattcatgcccattcc

SEQ ID NO: 34596 - DNA, 30 bp, Homo sapiens
cctgtccgccaacattgggatctacagaat

SEQ ID NO: 34597 - DNA, 30 bp, Homo sapiens
tccttccaagttcaaactcatccccactga

SEQ ID NO: 34598 - DNA, 30 bp, Homo sapiens
agctagataggatgtcttccactaatcttt

SEQ ID NO: 34599 - DNA, 30 bp, Homo sapiens
atatccctactctttgcccgttttccaaat

SEQ ID NO: 34600 - DNA, 30 bp, Homo sapiens
cagagggcgggcgggagcaggcgggcggcg

SEQ ID NO: 34601 - DNA, 30 bp, Homo sapiens
cagtggaccgtgagtgctccagctgcataa

SEQ ID NO: 34602 - DNA, 30 bp, Homo sapiens
cagaggcctttgcgctgccgcttgaggaaa

SEQ ID NO: 34603 - DNA, 30 bp, Homo sapiens
ggtcctgcccattgggggagatgggctgac

SEQ ID NO: 34604 - DNA, 30 bp, Homo sapiens
acttggagaggctgtggagtccccatcctc

SEQ ID NO: 34605 - DNA, 30 bp, Homo sapiens
ctgtggtcactgtcgtgactgtcttcattt

SEQ ID NO: 34606 - DNA, 30 bp, Homo sapiens
ccttggcctttgggaaaggatggcgatgat

SEQ ID NO: 34607 - DNA, 30 bp, Homo sapiens
acgatatttcttcctggtgcaatagacact

SEQ ID NO: 34608 - DNA, 30 bp, Homo sapiens
tagtggctgggggatcgggccttgtggaac

SEQ ID NO: 34609 - DNA, 30 bp, Homo sapiens
ctctcacttgaactgccactgtcagatgac

SEQ ID NO: 34610 - DNA, 30 bp, Homo sapiens
atcaggacttctgagccttctgaggagtcg

SEQ ID NO: 34611 - DNA, 30 bp, Homo sapiens
cacaggtcttctcttttattcccagctcga

SEQ ID NO: 34612 - DNA, 30 bp, Homo sapiens
cacttgggctcctcaggcagccactccaga

SEQ ID NO: 34613 - DNA, 30 bp, Homo sapiens
agtagaagatgcccaggcgggccccctcca

SEQ ID NO: 34614 - DNA, 30 bp, Homo sapiens
cagaaggagttgatgaagcccatatatgca

SEQ ID NO: 34615 - DNA, 30 bp, Homo sapiens
agaaggaggctggtcgtgtgtccacctcat

SEQ ID NO: 34616 - DNA, 30 bp, Homo sapiens
tgcaggaatcccacctctatatttagctcg

SEQ ID NO: 34617 - DNA, 30 bp, Homo sapiens
actgtcaagtcgccgggttaggatttcaca

SEQ ID NO: 34618 - DNA, 30 bp, Homo sapiens
gcctcatggggtagtttggtcaggatctgc

SEQ ID NO: 34619 - DNA, 30 bp, Homo sapiens
ctgacaacttctttacatgttggacgcaac

SEQ ID NO: 34620 - DNA, 30 bp, Homo sapiens
agtgcagcgccacctcgcaggggtggaggt

SEQ ID NO: 34621 - DNA, 30 bp, Homo sapiens
caacctcacaagggttcagccccctctcct

SEQ ID NO: 34622 - DNA, 30 bp, Homo sapiens
accaggcaggctggtttgggaggtcactgc

SEQ ID NO: 34623 - DNA, 30 bp, Homo sapiens
cagtgggtgctcttcgaaatgagtgcacat

SEQ ID NO: 34624 - DNA, 30 bp, Homo sapiens
acacggggatgcactgctctgggaagccat

SEQ ID NO: 34625 - DNA, 30 bp, Homo sapiens
gaacgggcctagctcctgcacagtcacagt

SEQ ID NO: 34626 - DNA, 30 bp, Homo sapiens
tgagcatatctgacaagacatacgtgtcat

SEQ ID NO: 34627 - DNA, 30 bp, Homo sapiens
aggtggaaagccacctctgtgtgctcctcc

SEQ ID NO: 34628 - DNA, 30 bp, Homo sapiens
aaagagtttgggccactgggaaatatgttt

SEQ ID NO: 34629 - DNA, 30 bp, Homo sapiens
gcctggaaagtcttggtggcaatatgggta

SEQ ID NO: 34630 - DNA, 30 bp, Homo sapiens
gcttggctgagcgccctctggggttatctt

SEQ ID NO: 34631 - DNA, 30 bp, Homo sapiens
atttggttacgtatgtaggtgcaaagctgg

SEQ ID NO: 34632 - DNA, 30 bp, Homo sapiens
cagagggatcctgagccgtagatggaggaa

SEQ ID NO: 34633 - DNA, 30 bp, Homo sapiens
caactctcagagggatcctgagccgtagat

SEQ ID NO: 34634 - DNA, 30 bp, Homo sapiens
cctacaccaaaataatgtgctttgctggcc

SEQ ID NO: 34635 - DNA, 30 bp, Homo sapiens
agggcagccactatgcccaccagccccgtg

SEQ ID NO: 34636 - DNA, 30 bp, Homo sapiens
gtctgtgaaagtttgtttccttgtctttga

SEQ ID NO: 34637 - DNA, 30 bp, Homo sapiens
ataagtcctccttctggtttctcttctgtg

SEQ ID NO: 34638 - DNA, 30 bp, Homo sapiens
ctctggatattcagccaacagtgttgtgtc

SEQ ID NO: 34639 - DNA, 30 bp, Homo sapiens
tactggttctgcgatgatcttccagagctc

SEQ ID NO: 34640 - DNA, 30 bp, Homo sapiens
caaaggaaatgaccagcatttcaactgtat

SEQ ID NO: 34641 - DNA, 30 bp, Homo sapiens
tgtattcacccaactcagagtataacagct

SEQ ID NO: 34642 - DNA, 30 bp, Homo sapiens
ttcagggcaataacagcataacatctggga

SEQ ID NO: 34643 - DNA, 30 bp, Homo sapiens
ttccggaagatcaggcatttgttgttggct

SEQ ID NO: 34644 - DNA, 30 bp, Homo sapiens
tagggaggcagggttcgtgcctcacagagc

SEQ ID NO: 34645 - DNA, 30 bp, Homo sapiens
acctgggtcgccttccactttcggtacagg

SEQ ID NO: 34646 - DNA, 30 bp, Homo sapiens
agctggtgctggacagaaggggcttgcagt

SEQ ID NO: 34647 - DNA, 30 bp, Homo sapiens; identical to SEQ ID NO: 34646

SEQ ID NO: 34648 - DNA, 30 bp, Homo sapiens
atctgggtacctttgcttgaaccgtgcaac

SEQ ID NO: 34649 - DNA, 30 bp, Homo sapiens
tagtccaacctggctgtaaatttcgagcaa

SEQ ID NO: 34650 - DNA, 30 bp, Homo sapiens
tccacagcaataaaataatccacatgctga

SEQ ID NO: 34651 - DNA, 30 bp, Homo sapiens
aaaaggaaaaccgaattaggtccacttcaa

SEQ ID NO: 34652 - DNA, 30 bp, Homo sapiens
agaaggcttgtgagctcttcaagggcaggg

SEQ ID NO: 34653 - DNA, 30 bp, Homo sapiens
acttcagaggctgaggtgggagaactgctt

SEQ ID NO: 34654 - DNA, 30 bp, Homo sapiens
cttaggatccaggcccaggaccacaggaga

SEQ ID NO: 34655 - DNA, 30 bp, Homo sapiens
cttcataacctgtgtccataaagagctgag

SEQ ID NO: 34656 - DNA, 30 bp, Homo sapiens
atatgagggcgcaccaactcccaggacagt

SEQ ID NO: 34657 - DNA, 30 bp, Homo sapiens
ccatgatgtggggcccaacaggtagccact

SEQ ID NO: 34658 - DNA, 30 bp, Homo sapiens
gaaaggagtgtagataccatattggagcta

SEQ ID NO: 34659 - DNA, 30 bp, Homo sapiens
aggatgaatagaagagagcacaaagacaag

SEQ ID NO: 34660 - DNA, 30 bp, Homo sapiens
tactggtttgagaacaaagacagcgtcatc

SEQ ID NO: 34661 - DNA, 30 bp, Homo sapiens
attcggatggcttgcgtggctgtgatgtgg

SEQ ID NO: 34662 - DNA, 30 bp, Homo sapiens
agaaaagatgcggatggcctgagtgaccgc

SEQ ID NO: 34663 - DNA, 30 bp, Homo sapiens
taacagctgtctggcaaactggacatgatg

SEQ ID NO: 34664 - DNA, 30 bp, Homo sapiens
gcctgggtggccggcgtgcggcaggcggga

SEQ ID NO: 34665 - DNA, 30 bp, Homo sapiens
aatactgtcgttgaagggctgaggcgccgc

SEQ ID NO: 34666 - DNA, 30 bp, Homo sapiens
gtagttttccgcttcttggcagatggccgc

SEQ ID NO: 34667 - DNA, 30 bp, Homo sapiens
tagcagctcccacagctcctggcacaggag

SEQ ID NO: 34668 - DNA, 30 bp, Homo sapiens
tcatcaggtggactgaaatgactgctgcct

SEQ ID NO: 34669 - DNA, 30 bp, Homo sapiens
acatggctttcgtaaataatgcaggtgttt

SEQ ID NO: 34670 - DNA, 30 bp, Homo sapiens
aggcccggcggattttcatctcagtgcgtt

SEQ ID NO: 34671 - DNA, 30 bp, Homo sapiens
cattgggtctctgcaaatccacattttcac

SEQ ID NO: 34672 - DNA, 30 bp, Homo sapiens
tagcggcgaaaccagagccagctattaagc

SEQ ID NO: 34673 - DNA, 30 bp, Homo sapiens
acagcccagcagctccaggcgcagggcgat

SEQ ID NO: 34674 - DNA, 30 bp, Homo sapiens
cactggtttctgtgcttttcaccaacattc

SEQ ID NO: 34675 - DNA, 30 bp, Homo sapiens
tgaaggtagaaactgcttagtaaaattctc

SEQ ID NO: 34676 - DNA, 30 bp, Homo sapiens
atctgctgggctgcaggtactggtgtgtga

SEQ ID NO: 34677 - DNA, 30 bp, Homo sapiens
catcgggcacccagctggggacaccagggt

SEQ ID NO: 34678 - DNA, 30 bp, Homo sapiens
gcacgattcaccaaatagagtaagaccaca

SEQ ID NO: 34679 - DNA, 30 bp, Homo sapiens
gcgtctgtgccgggtaactcagcttctgca

SEQ ID NO: 34680 - DNA, 30 bp, Homo sapiens
cagatacttcggtagtcagagccgcgggct

SEQ ID NO: 34681 - DNA, 30 bp, Homo sapiens
ggccgggcatcacggtcccagcgtcgcagg

SEQ ID NO: 34682 - DNA, 30 bp, Homo sapiens
taacatccagggtttgggcctgtgacaggt

SEQ ID NO: 34683 - DNA, 30 bp, Homo sapiens
tcctggagtaaaggttctttggcctctcct

SEQ ID NO: 34684 - DNA, 30 bp, Homo sapiens
cccaggctcctcaaatgaagagagctccca

SEQ ID NO: 34685 - DNA, 30 bp, Homo sapiens
tagaggatgctagccagctctgtggagtct

SEQ ID NO: 34686 - DNA, 30 bp, Homo sapiens
gccaggctgtagctggtcctcctccgaagg

SEQ ID NO: 34687 - DNA, 30 bp, Homo sapiens
gaaaggtgctgggtgctaggtccaggtaca

SEQ ID NO: 34688 - DNA, 30 bp, Homo sapiens
ctctggtagcactcagagttttccattcca

SEQ ID NO: 34689 - DNA, 30 bp, Homo sapiens
tgtcctggtttctggcaagtgcttcacatg

SEQ ID NO: 34690 - DNA, 30 bp, Homo sapiens
ctcaggggcatagggctcctcagtaggtga

SEQ ID NO: 34691 - DNA, 30 bp, Homo sapiens
gtgtcctcccgcggccagctgagcctgctg

SEQ ID NO: 34692 - DNA, 30 bp, Homo sapiens
cagtctgagtgttcctccctcatggccttc

SEQ ID NO: 34693 - DNA, 30 bp, Homo sapiens
ccacggggaggagaaggaggagtgagaccc

SEQ ID NO: 34694 - DNA, 30 bp, Homo sapiens
tcctcccatatcttacagaaagagcaatga

SEQ ID NO: 34695 - DNA, 30 bp, Homo sapiens
accactagagtgtcgcttgtttagagacat

SEQ ID NO: 34696 - DNA, 30 bp, Homo sapiens
agaacttggtgaggcccccgagttgcccaa

SEQ ID NO: 34697 - DNA, 30 bp, Homo sapiens
tcgtggggtcattgttgaaggagggtgtta

SEQ ID NO: 34698 - DNA, 30 bp, Homo sapiens
ttatggcatttgcaatataagtaggtgcag

SEQ ID NO: 34699 - DNA, 30 bp, Homo sapiens
gccgaagcagcctcagagccaacactggct

SEQ ID NO: 34700 - DNA, 30 bp, Homo sapiens
gctaggatcatagccctcccacgtcagtgg

SEQ ID NO: 34701 - DNA, 30 bp, Homo sapiens
tatctccccaccctccattttttctaggtg

SEQ ID NO: 34702 - DNA, 30 bp, Homo sapiens
cgtccagtttgccccgggcgggcggccttc

SEQ ID NO: 34703 - DNA, 30 bp, Homo sapiens
aacagcaatggtgcctgaggtccttctgct

SEQ ID NO: 34704 - DNA, 30 bp, Homo sapiens
agttggtggcttttttaatatgaatctcat

SEQ ID NO: 34705 - DNA, 30 bp, Homo sapiens
agtcggcctttttcaggaagatctcgctca

SEQ ID NO: 34706 - DNA, 30 bp, Homo sapiens
cttttgtgttttggtgacatatatcctcat

SEQ ID NO: 34707 - DNA, 30 bp, Homo sapiens
tgctggaaaagagaaggtttatactgaata

SEQ ID NO: 34708 - DNA, 30 bp, Homo sapiens
tataggcagtctttgcagagagccacctgg

SEQ ID NO: 34709 - DNA, 30 bp, Homo sapiens
ccctggcacaaggccacctggcccttgcgg

SEQ ID NO: 34710 - DNA, 30 bp, Homo sapiens
cacaggctccgaccaagtataaccacatcc

SEQ ID NO: 34711 - DNA, 30 bp, Homo sapiens
gggtggggacgcagttcctgccgtggctgt

SEQ ID NO: 34712 - DNA, 30 bp, Homo sapiens
ttctggtttctgaatattctggttcttttt

SEQ ID NO: 34713 - DNA, 30 bp, Homo sapiens
cactggagtaaacagcaatatatgttccca

SEQ ID NO: 34714 - DNA, 30 bp, Homo sapiens
tttcggccagcaggcggggagcccgaggta

SEQ ID NO: 34715 - DNA, 30 bp, Homo sapiens
atttggtccctcggcgcttcctgaagtagc

SEQ ID NO: 34716 - DNA, 30 bp, Homo sapiens
gagtggggtcagctcggcggcgctgggatc

SEQ ID NO: 34717 - DNA, 30 bp, Homo sapiens
tactcgtctataccaacagagcaggagtcg

SEQ ID NO: 34718 - DNA, 30 bp, Homo sapiens
ctcagggtttgtttgattctgcgtacacgt

SEQ ID NO: 34719 - DNA, 30 bp, Homo sapiens
acacggtaaagcatacttttcacttcattt

SEQ ID NO: 34720 - DNA, 30 bp, Homo sapiens
agccatggaaagagtaactccatatccaac

SEQ ID NO: 34721 - DNA, 30 bp, Homo sapiens
cagtttcttggcaatattgaggtccagata

SEQ ID NO: 34722 - DNA, 30 bp, Homo sapiens
aagtataggtgacggccatatatgtacacc

SEQ ID NO: 34723 - DNA, 30 bp, Homo sapiens
cccaagccacttttaacccaaccaagatgc

SEQ ID NO: 34724 - DNA, 30 bp, Homo sapiens
cactggcagtagaaatcccatttgtctgtc

SEQ ID NO: 34725 - DNA, 30 bp, Homo sapiens
ttctggggccctcctaggcccctacctgaa

SEQ ID NO: 34726 - DNA, 30 bp, Homo sapiens
gactatttagcagggtattttccacagatc

SEQ ID NO: 34727 - DNA, 30 bp, Homo sapiens
ctgtggttctggatgttcagtagcaggctc

SEQ ID NO: 34728 - DNA, 30 bp, Homo sapiens
aacagtcctggctagtgctctgagaggcag

SEQ ID NO: 34729 - DNA, 30 bp, Homo sapiens
ttcaatagccttgcgacagataggacattc

SEQ ID NO: 34730 - DNA, 30 bp, Homo sapiens
atctggatgcggtcgcggatgggctggcgg

SEQ ID NO: 34731 - DNA, 30 bp, Homo sapiens
acctggcacctgatgcacttcttcatcctg

SEQ ID NO: 34732 - DNA, 30 bp, Homo sapiens
gcaacagcagaaacatggaatgtctgccaa

SEQ ID NO: 34733 - DNA, 30 bp, Homo sapiens
gtggagccagtggacccaagatctgacatc

SEQ ID NO: 34734 - DNA, 30 bp, Homo sapiens
ccctgggcccctgtccccaaggccagctcg

SEQ ID NO: 34735 - DNA, 30 bp, Homo sapiens
cagcggagcttgactgggaagcacctgagc

SEQ ID NO: 34736 - DNA, 30 bp, Homo sapiens
aagtgggtgtagcactggaaggctgaaatg

SEQ ID NO: 34737 - DNA, 30 bp, Homo sapiens
aggaggctctagaaccttcacgaactccac

SEQ ID NO: 34738 - DNA, 30 bp, Homo sapiens
ctgtgggaggctgaggtgggtggatcattt

SEQ ID NO: 34739 - DNA, 30 bp, Homo sapiens
cactgggccacagcctgccagtggaactcc

SEQ ID NO: 34740 - DNA, 30 bp, Homo sapiens
ttaaggctgaagcccttggacagcatggca

SEQ ID NO: 34741 - DNA, 30 bp, Homo sapiens
caagtcctgctcagctgacagcctctggag

SEQ ID NO: 34742 - DNA, 30 bp, Homo sapiens
ctctgggggacttgctcttggcatcacgtt

SEQ ID NO: 34743 - DNA, 30 bp, Homo sapiens
tactgggaggggctgcttttgctttttggt

SEQ ID NO: 34744 - DNA, 30 bp, Homo sapiens
cagtggaaccagtggacccagtagctgaca

SEQ ID NO: 34745 - DNA, 30 bp, Homo sapiens
gtttgggtaaagcgaagtcccaggcagttt

SEQ ID NO: 34746 - DNA, 30 bp, Homo sapiens
ccagcttgtttccagacttcttttactcct

SEQ ID NO: 34747 - DNA, 30 bp, Homo sapiens
ttcaggcaggatttgaaagtggggtacttc

SEQ ID NO: 34748 - DNA, 30 bp, Homo sapiens
cattgggcaactctgggaaacagtacagaa

SEQ ID NO: 34749 - DNA, 30 bp, Homo sapiens
ttgtcttcctttgaagtttaaattcaggaa

SEQ ID NO: 34750 - DNA, 30 bp, Homo sapiens
aaatggtctgggatagggagcccagtgata

SEQ ID NO: 34751 - DNA, 30 bp, Homo sapiens
cagtggccccaattgccgaagccgatctcc

SEQ ID NO: 34752 - DNA, 30 bp, Homo sapiens
gacaggttttcatcccagaaacataagggg

SEQ ID NO: 34753 - DNA, 30 bp, Homo sapiens
ccaccacgaactctgacttgatgtcagggt

SEQ ID NO: 34754 - DNA, 30 bp, Homo sapiens
gtctgcagcagcacctctggctcagacaat

SEQ ID NO: 34755 - DNA, 30 bp, Homo sapiens
aaagcagggcctgtctgggtagaaaacatg

SEQ ID NO: 34756 - DNA, 30 bp, Homo sapiens
tagagcagcccctcgggctcctgtaggcca

SEQ ID NO: 34757 - DNA, 30 bp, Homo sapiens
gcacggcccagcagcgagggtccctcgcca

SEQ ID NO: 34758 - DNA, 30 bp, Homo sapiens
cacaggatgacgcagggaggacggctgttg

SEQ ID NO: 34759 - DNA, 30 bp, Homo sapiens
tgagctagaggagtggaatgacaggatgat

SEQ ID NO: 34760 - DNA, 30 bp, Homo sapiens
tgatggctgaaaaatgaactggaagaagca

SEQ ID NO: 34761 - DNA, 30 bp, Homo sapiens
tgagactgcttcttggaaaaattcagaaga

SEQ ID NO: 34762 - DNA, 30 bp, Homo sapiens
tgtcagctgatggatcaaattcatggtcat

SEQ ID NO: 34763 - DNA, 30 bp, Homo sapiens
agcaggtcatcacgttacagtgtgacaggg

SEQ ID NO: 34764 - DNA, 30 bp, Homo sapiens
tgtagggccgcgtgctgatgcagagcatgg

SEQ ID NO: 34765 - DNA, 30 bp, Homo sapiens
cgaaggtggagttgttccagcccacattgg

SEQ ID NO: 34766 - DNA, 30 bp, Homo sapiens
agtcggagacttcgctgtagtaatacttgt

SEQ ID NO: 34767 - DNA, 30 bp, Homo sapiens
gcccagtggacataacatgaccatgactgc

SEQ ID NO: 34768 - DNA, 30 bp, Homo sapiens
ctgcagctcccccaggggcccattctctcg

SEQ ID NO: 34769 - DNA, 30 bp, Homo sapiens
ggcttctgccgtgggacgtggggccgaggg

SEQ ID NO: 34770 - DNA, 30 bp, Homo sapiens
tcctggaacacgggggtggcatactgtagc

SEQ ID NO: 34771 - DNA, 30 bp, Homo sapiens
cttcggcctctgccgacgctccccggctgg

SEQ ID NO: 34772 - DNA, 30 bp, Homo sapiens
gtttacgttcactattcccagattgtcttc

SEQ ID NO: 34773 - DNA, 30 bp, Homo sapiens
ctgtggtccagagtaactcaatgtatggcc

SEQ ID NO: 34774 - DNA, 30 bp, Homo sapiens
cacaggatggggtctgagccgttccagttc

SEQ ID NO: 34775 - DNA, 30 bp, Homo sapiens
ccagttgatggtggcctcgctccacttggt

SEQ ID NO: 34776 - DNA, 30 bp, Homo sapiens
caccagttcatgatgcagttacggttcaga

SEQ ID NO: 34777 - DNA, 30 bp, Homo sapiens
ttcccaacccctgcatttcttacaagcagg

SEQ ID NO: 34778 - DNA, 30 bp, Homo sapiens
gccaggaaagcgaggagccagggagtggtg

SEQ ID NO: 34779 - DNA, 30 bp, Homo sapiens
ctttgacatattttccatgtagaagatatg

SEQ ID NO: 34780 - DNA, 30 bp, Homo sapiens
cactggtttgacaactctgaaggatgtcct

SEQ ID NO: 34781 - DNA, 30 bp, Homo sapiens
taggggttccttgtctttgaagtagcccat

SEQ ID NO: 34782 - DNA, 30 bp, Homo sapiens
ggctggacagtctctgcaggtaccagattc

SEQ ID NO: 34783 - DNA, 30 bp, Homo sapiens
ctcaggatgccagggcagtacttgtcaatg

SEQ ID NO: 34784 - DNA, 30 bp, Homo sapiens
tacagggcctgggtgttcagttcaacaggt

SEQ ID NO: 34785 - DNA, 30 bp, Homo sapiens
ggaaagtttcgaagtccagatccaagtcgg

SEQ ID NO: 34786 - DNA, 30 bp, Homo sapiens
tcatggtcccggttccaaccttcttcctca

SEQ ID NO: 34787 - DNA, 30 bp, Homo sapiens
agcagtggctccagccatagcagaggaggc

SEQ ID NO: 34788 - DNA, 30 bp, Homo sapiens
tgtctctaatgttctgtagttttctggagt

SEQ ID NO: 34789 - DNA, 30 bp, Homo sapiens
aagtggcaaaggacaatttggattcggcct

SEQ ID NO: 34790 - DNA, 30 bp, Homo sapiens
ccagagttttctcctaagtctgtgttaaat

SEQ ID NO: 34791 - DNA, 30 bp, Homo sapiens
cactggcgtagatgcgggattcccagcgct

SEQ ID NO: 34792 - DNA, 30 bp, Homo sapiens
ggtttgcgctcctcctgctccaggccgttc

SEQ ID NO: 34793 - DNA, 30 bp, Homo sapiens
acatggtcttaaatcaaaatcacaatatcc

SEQ ID NO: 34794 - DNA, 30 bp, Homo sapiens
ccaatcttaatcatccatccattgttgaac

SEQ ID NO: 34795 - DNA, 30 bp, Homo sapiens
cttccatgctcatactgctcctccggctgc

SEQ ID NO: 34796 - DNA, 30 bp, Homo sapiens
ccatggggctgttgggtgcgctgctccccg

SEQ ID NO: 34797 - DNA, 30 bp, Homo sapiens
aagttaccaaaggcagaaaagatgtgttcc

SEQ ID NO: 34798 - DNA, 30 bp, Homo sapiens
ttctggttcttattttcttgacacacacat

SEQ ID NO: 34799 - DNA, 30 bp, Homo sapiens
tcaaattggctgtctctacagccacctgta

SEQ ID NO: 34800 - DNA, 30 bp, Homo sapiens
agcaggaatcccagtgcagctgcaaatcat

SEQ ID NO: 34801 - DNA, 30 bp, Homo sapiens
agaaggtgatggctgtgctgccagggggga

SEQ ID NO: 34802 - DNA, 30 bp, Homo sapiens
ccatggcagcggtaggtcctgtgggtctag

SEQ ID NO: 34803 - DNA, 30 bp, Homo sapiens
atgaggtctaccaggttgcctttaggagga

SEQ ID NO: 34804 - DNA, 30 bp, Homo sapiens
ctgcgaagagcgtcaggtccattgtgctgc

SEQ ID NO: 34805 - DNA, 30 bp, Homo sapiens
ctgtgggcgggctcctgtcttcaccacggc

SEQ ID NO: 34806 - DNA, 30 bp, Homo sapiens
gcgtggtctcccaccaggaccactggggcc

SEQ ID NO: 34807 - DNA, 30 bp, Homo sapiens
taacggttctgaccagtcctccaggtcgca

SEQ ID NO: 34808 - DNA, 30 bp, Homo sapiens
catcatgaaacaagtcccactcatcttcag

SEQ ID NO: 34809 - DNA, 30 bp, Homo sapiens
cttgcgaatgcacttgagacagtaggtgtg

SEQ ID NO: 34810 - DNA, 30 bp, Homo sapiens
cagaaaggtgcatgaagaggtccccgagct

SEQ ID NO: 34811 - DNA, 30 bp, Homo sapiens
ccctcagggggttgtgcctgctgctgggga

SEQ ID NO: 34812 - DNA, 30 bp, Homo sapiens
cataatgaagcaagtcccactggtcctcag

SEQ ID NO: 34813 - DNA, 30 bp, Homo sapiens
tgctggctgaacccttccagacggtccaac

SEQ ID NO: 34814 - DNA, 30 bp, Homo sapiens
aagaggcaggagagcactggcctcagatat

SEQ ID NO: 34815 - DNA, 30 bp, Homo sapiens
accagggttccagaggggctcactaggtcc

SEQ ID NO: 34816 - DNA, 30 bp, Homo sapiens
cagcggcactttgacagtctttacttctgc

SEQ ID NO: 34817 - DNA, 30 bp, Homo sapiens
ataaggtggtggtgactgttctgcagagag

SEQ ID NO: 34818 - DNA, 30 bp, Homo sapiens
cactgggccatttgcaccacgacggctctc

SEQ ID NO: 34819 - DNA, 30 bp, Homo sapiens
aaccggcagaggcagaagagggttggaatg

SEQ ID NO: 34820 - DNA, 30 bp, Homo sapiens
atgtggagtttgtcccccaaaacatttgat

SEQ ID NO: 34821 - DNA, 30 bp, Homo sapiens
ccagtcatagcggcgggactgtcgggaagg

SEQ ID NO: 34822 - DNA, 30 bp, Homo sapiens
ggcaggttagcaagctgcaggatatttcca

SEQ ID NO: 34823 - DNA, 30 bp, Homo sapiens
tggtggctcacagggaggcatggattgctg

SEQ ID NO: 34824 - DNA, 30 bp, Homo sapiens
ttcaggaatagccaccattggatgactcag

SEQ ID NO: 34825 - DNA, 30 bp, Homo sapiens
cagaggagccaaggaccagacgtgtcactt

SEQ ID NO: 34826 - DNA, 30 bp, Homo sapiens
agggccgcacagagggatcatgggcccggc

SEQ ID NO: 34827 - DNA, 30 bp, Homo sapiens
atgtggccacggcctccaggcagctctgca

SEQ ID NO: 34828 - DNA, 30 bp, Homo sapiens
tacaggcccagttttatcactaagtcttgc

SEQ ID NO: 34829 - DNA, 30 bp, Homo sapiens
ctccttcttgaaacgccaaatgacaactga

SEQ ID NO: 34830 - DNA, 30 bp, Homo sapiens
ccatggatggtgagaaatgggttggtggta

SEQ ID NO: 34831 - DNA, 30 bp, Homo sapiens
agatggagggagtgcctcgggagctccggg

SEQ ID NO: 34832 - DNA, 30 bp, Homo sapiens
gatgttccagatgtttccaggtaactctgt

SEQ ID NO: 34833 - DNA, 30 bp, Homo sapiens
tcctggttggctgaggctcctttgtcagcg

SEQ ID NO: 34834 - DNA, 30 bp, Homo sapiens
acttggctgcatgctggggaagcatctcac

SEQ ID NO: 34835 - DNA, 30 bp, Homo sapiens
gtcttcacgttagcgcttgtctcggtgtag

SEQ ID NO: 34836 - DNA, 30 bp, Homo sapiens
aggactggtgggccaccacaggtttcgcga

SEQ ID NO: 34837 - DNA, 30 bp, Homo sapiens
acactgtcattgaaggccaggcagacaaca

SEQ ID NO: 34838 - DNA, 30 bp, Homo sapiens
agtaaagctggtttttcaattggtgcagga

SEQ ID NO: 34839 - DNA, 30 bp, Homo sapiens
ctcttgccaatcctggtgacagccttggac

SEQ ID NO: 34840 - DNA, 30 bp, Homo sapiens
taaaggtttgccaagggtgccctctgtgac

SEQ ID NO: 34841 - DNA, 30 bp, Homo sapiens
aactgggccactaggctgaggacctgctca

SEQ ID NO: 34842 - DNA, 30 bp, Homo sapiens
tcctggggacagggccccaatgagaacctt

SEQ ID NO: 34843 - DNA, 30 bp, Homo sapiens
gactcggccgatgggtcatttttcatgtat

SEQ ID NO: 34844 - DNA, 30 bp, Homo sapiens
caagggccaggggatgcaggtggtgagacc

SEQ ID NO: 34845 - DNA, 30 bp, Homo sapiens
gtctggtgttgcattagtgaagatactccc

SEQ ID NO: 34846 - DNA, 30 bp, Homo sapiens
aaagtccgtaggacttcggtaaaggtattt

SEQ ID NO: 34847 - DNA, 30 bp, Homo sapiens
atttggacaccttggtctgcagggtgctgg

SEQ ID NO: 34848 - DNA, 30 bp, Homo sapiens
gcctctttagacaagtcatgccaggcctca

SEQ ID NO: 34849 - DNA, 30 bp, Homo sapiens
acccggcacttcttttctggattcatgtat

SEQ ID NO: 34850 - DNA, 30 bp, Homo sapiens
acgcggcatcgctccttggggtgcatgggg

SEQ ID NO: 34851 - DNA, 30 bp, Homo sapiens
tcttggtttgaagaatttgctgtatccgaa

SEQ ID NO: 34852 - DNA, 30 bp, Homo sapiens
gttgaaccagctattagctttctggagagt

SEQ ID NO: 34853 - DNA, 30 bp, Homo sapiens
aatgtaaccagctgttactctttaatatgt

SEQ ID NO: 34854 - DNA, 30 bp, Homo sapiens
cagaggaaagtgttggcaggctcggcacag

SEQ ID NO: 34855 - DNA, 30 bp, Homo sapiens
cagctattgcttttcagtgttttggtgata

SEQ ID NO: 34856 - DNA, 30 bp, Homo sapiens
aaatggaatttgctggcatgacgcgaacaa

SEQ ID NO: 34857 - DNA, 30 bp, Homo sapiens
ccagcagggaacgctggcagtagagcagtc

SEQ ID NO: 34858 - DNA, 30 bp, Homo sapiens
cctgcagcgagcgcttgcagtaaagcagga

SEQ ID NO: 34859 - DNA, 30 bp, Homo sapiens
cttgcatagagcgtttacagtacagtatgt

SEQ ID NO: 34860 - DNA, 30 bp, Homo sapiens
gtcagggcctgggccgctgtccacagggcg

SEQ ID NO: 34861 - DNA, 30 bp, Homo sapiens
acgtggtttctgtggctgagagagtggtat

SEQ ID NO: 34862 - DNA, 30 bp, Homo sapiens
tgttcgaggcgagtagacagcagcatccag

SEQ ID NO: 34863 - DNA, 30 bp, Homo sapiens
cagcagcctagccagtcggatttgatgctt

SEQ ID NO: 34864 - DNA, 30 bp, Homo sapiens
tccaggaactagatttcaccacactaacca

SEQ ID NO: 34865 - DNA, 30 bp, Homo sapiens
atatggacgtcacaaacatcaaaccacttc

SEQ ID NO: 34866 - DNA, 30 bp, Homo sapiens
acacggactcgccaggagtaggtggtcagc

SEQ ID NO: 34867 - DNA, 30 bp, Homo sapiens
tcctggactggccgcttatagtaggtgaca

SEQ ID NO: 34868 - DNA, 30 bp, Homo sapiens
cagcgggaggctacaccccccaccagcagg

SEQ ID NO: 34869 - DNA, 30 bp, Homo sapiens
aaatgctggatcctttggatatcatcggca

SEQ ID NO: 34870 - DNA, 30 bp, Homo sapiens
gaatgtgctttttccttgttgatatcaaaa

SEQ ID NO: 34871 - DNA, 30 bp, Homo sapiens
tttgcaaagcgtttcttacgcctcattttg

SEQ ID NO: 34872 - DNA, 30 bp, Homo sapiens
gaacagggcgctccccgagttggcatgcca

SEQ ID NO: 34873 - DNA, 30 bp, Homo sapiens
ttcaatgacactgccgcagcctcaatgttg

SEQ ID NO: 34874 - DNA, 30 bp, Homo sapiens
gttactcttcaaagtgtgtgtcactttctt

SEQ ID NO: 34875 - DNA, 30 bp, Homo sapiens
ccataggttggatacatcactgcattagga

SEQ ID NO: 34876 - DNA, 30 bp, Homo sapiens
attgcctcttgcaactctggtaactctctg

SEQ ID NO: 34877 - DNA, 30 bp, Homo sapiens
tcctcagggcactgcaggatgtcataggtc

SEQ ID NO: 34878 - DNA, 30 bp, Homo sapiens
aatgtagtaacagggggaaacttggctgga

SEQ ID NO: 34879 - DNA, 30 bp, Homo sapiens
atcaggaagcccccaaatgcagtgcccgac

SEQ ID NO: 34880 - DNA, 30 bp, Homo sapiens
gccagggctccccaacagaaaccactcccc

SEQ ID NO: 34881 - DNA, 30 bp, Homo sapiens
tctgcatctcatcttgtcccatctgtccaa

SEQ ID NO: 34882 - DNA, 30 bp, Homo sapiens
atgtcccaaatctgttggagatgtcagaat

SEQ ID NO: 34883 - DNA, 30 bp, Homo sapiens
aagcccactgaatgcatcctgtagtgctct

SEQ ID NO: 34884 - DNA, 30 bp, Homo sapiens
cacatcggccaattttagctttctcaatgc

SEQ ID NO: 34885 - DNA, 30 bp, Homo sapiens
ttctggaattccaaaagttctatcaatttt

SEQ ID NO: 34886 - DNA, 30 bp, Homo sapiens
ttgtttttcttggccttgatgaccttgatg

SEQ ID NO: 34887 - DNA, 30 bp, Homo sapiens
ctcttcaccaagcagatcaatatcatcctc

SEQ ID NO: 34888 - DNA, 30 bp, Homo sapiens
gccagcttgagtgtgctgactgggaaggag

SEQ ID NO: 34889 - DNA, 30 bp, Homo sapiens
tactggggcgcgggctggtggctgggccgc

SEQ ID NO: 34890 - DNA, 30 bp, Homo sapiens
aatattgcctggagaagggcctcctcctcc

SEQ ID NO: 34891 - DNA, 30 bp, Homo sapiens
cacgcctatcaatcagattaaactcctgaa

SEQ ID NO: 34892 - DNA, 30 bp, Homo sapiens
gattggctttttaatattagtaccatctgc

SEQ ID NO: 34893 - DNA, 30 bp, Homo sapiens
aactggtcctgaacccaagtcatcaagtaa

SEQ ID NO: 34894 - DNA, 30 bp, Homo sapiens
gagtggtgcaagttctcttctatcaataag

SEQ ID NO: 34895 - DNA, 30 bp, Homo sapiens
aagcgggtctcagccttccgctggtgcagc

SEQ ID NO: 34896 - DNA, 30 bp, Homo sapiens
acgtggttctgtgctcccgggcccccgctg

SEQ ID NO: 34897 - DNA, 30 bp, Homo sapiens
cagtggcacatccgggcggtcatttctttc

SEQ ID NO: 34898 - DNA, 30 bp, Homo sapiens
ggtctatgaggttcatctctgtgacaaagt

SEQ ID NO: 34899 - DNA, 30 bp, Homo sapiens
cagtggcagatccgctctgtcatctccctc

SEQ ID NO: 34900 - DNA, 30 bp, Homo sapiens
atgcttcactttccccagaaactgaattct

SEQ ID NO: 34901 - DNA, 30 bp, Homo sapiens
cctagaagctttgacgggggaccccccacg

SEQ ID NO: 34902 - DNA, 30 bp, Homo sapiens
gccagggatagaagggaatatttggaggac

SEQ ID NO: 34903 - DNA, 30 bp, Homo sapiens
agctttgacgggggaccccccacggctggc

SEQ ID NO: 34904 - DNA, 30 bp, Homo sapiens
tcctggtgtttctcagatgcaggtaaatca

SEQ ID NO: 34905 - DNA, 30 bp, Homo sapiens
gatgaggatcatgggccggttcttcatctg

SEQ ID NO: 34906 - DNA, 30 bp, Homo sapiens
agcactctttgtttcctttccaagttgatg

SEQ ID NO: 34907 - DNA, 30 bp, Homo sapiens
tactgtggaaatgttccatcgattttggca

SEQ ID NO: 34908 - DNA, 30 bp, Homo sapiens
catggcagagaccatcctgtgttgctctcc

SEQ ID NO: 34909 - DNA, 30 bp, Homo sapiens
agaagggatttcgtagctcttcaaggaatt

SEQ ID NO: 34910 - DNA, 30 bp, Homo sapiens
ccagagagggcttccaggtggaagagtagc

SEQ ID NO: 34911 - DNA, 30 bp, Homo sapiens
ctctggaatgccatactttcctttgtgttc

SEQ ID NO: 34912 - DNA, 30 bp, Homo sapiens
tgctggtcagcagggatgttgaacttaagt

SEQ ID NO: 34913 - DNA, 30 bp, Homo sapiens
tgaaggtgaggcaggtggaagcggggaccc

SEQ ID NO: 34914 - DNA, 30 bp, Homo sapiens
gaaaggccgcggccaggcctagatgaaggt

SEQ ID NO: 34915 - DNA, 30 bp, Homo sapiens
agtagtcttcagccatggccagtaagacaa

SEQ ID NO: 34916 - DNA, 30 bp, Homo sapiens
ttccgcactatggtgggcaggcgacactgc

SEQ ID NO: 34917 - DNA, 30 bp, Homo sapiens
aataggtgaggggcgtgagaatgaagaggc

SEQ ID NO: 34918 - DNA, 30 bp, Homo sapiens
aacaagccattatgggcagcttggtccgta

SEQ ID NO: 34919 - DNA, 30 bp, Homo sapiens
gggtggtattccaaataggctgatacaagc

SEQ ID NO: 34920 - DNA, 30 bp, Homo sapiens
aagattctccattttgaactctggatgctg

SEQ ID NO: 34921 - DNA, 30 bp, Homo sapiens
tccaggtcaccttctggaccacccagttgg

SEQ ID NO: 34922 - DNA, 30 bp, Homo sapiens
gtcccccttggtgatgaggtcctcaatgta

SEQ ID NO: 34923 - DNA, 30 bp, Homo sapiens
atcaggcacaatcatagccagcagttgtcc

SEQ ID NO: 34924 - DNA, 30 bp, Homo sapiens
tgtgatttgcctccagcaccgtgtacagga

SEQ ID NO: 34925 - DNA, 30 bp, Homo sapiens
gtgagggaggacagaagtaaggagatagct

SEQ ID NO: 34926 - DNA, 30 bp, Homo sapiens
acacagctttccgatggtactcaggaggag

SEQ ID NO: 34927 - DNA, 30 bp, Homo sapiens
cacagggctttgcggtggtactcagcagaa

SEQ ID NO: 34928 - DNA, 30 bp, Homo sapiens
aggccaccaggggtgtcctcctggccatgg

SEQ ID NO: 34929 - DNA, 30 bp, Homo sapiens
ccgaggcgctggcggctctggggtgcagct

SEQ ID NO: 34930 - DNA, 30 bp, Homo sapiens
gtctggagcagctgtaaaatgaaagttacc

SEQ ID NO: 34931 - DNA, 30 bp, Homo sapiens
tctgtcttcctgaacatggccaaggcctcc

SEQ ID NO: 34932 - DNA, 30 bp, Homo sapiens
ttctggctgacttggaggcgctctgggccc

SEQ ID NO: 34933 - DNA, 30 bp, Homo sapiens
cctttcgacaggtacgggtgatccactcat

SEQ ID NO: 34934 - DNA, 30 bp, Homo sapiens
tgactgggttatagaagccgtctccacaat

SEQ ID NO: 34935 - DNA, 30 bp, Homo sapiens
tcagctttcaaagaggtgagatccaccaaa

SEQ ID NO: 34936 - DNA, 30 bp, Homo sapiens
gtatggccattgtgataagacctggttgaa

SEQ ID NO: 34937 - DNA, 30 bp, Homo sapiens
gggtggactgcagtccatttcacagctgga

SEQ ID NO: 34938 - DNA, 30 bp, Homo sapiens
ttaaggaaagcagcagctgctggaaccaga

SEQ ID NO: 34939 - DNA, 30 bp, Homo sapiens
gtccggaggaacaccatggtgaggaggccc

SEQ ID NO: 34940 - DNA, 30 bp, Homo sapiens
ctctggctccacttgcagagacaggccccc

SEQ ID NO: 34941 - DNA, 30 bp, Homo sapiens
agctgggctcctgatgcttctctggtcctg

SEQ ID NO: 34942 - DNA, 30 bp, Homo sapiens
cagatcagctgggctcctgatgcttctctg

SEQ ID NO: 34943 - DNA, 30 bp, Homo sapiens
agaaggcaaacaagcaagttgatggagaaa

SEQ ID NO: 34944 - DNA, 30 bp, Homo sapiens
tccctggatgagctgggctacttcatttgt

SEQ ID NO: 34945 - DNA, 30 bp, Homo sapiens
tcgggggctgggaacccgggctggtggcag

SEQ ID NO: 34946 - DNA, 30 bp, Homo sapiens
acgaaaaagctgagaggctcctgctgcccc

SEQ ID NO: 34947 - DNA, 30 bp, Homo sapiens
caggggatctccggtttcctgaatggaagt

SEQ ID NO: 34948 - DNA, 30 bp, Homo sapiens
tctgcttgtggggaggctttgcattccagt

SEQ ID NO: 34949 - DNA, 30 bp, Homo sapiens
caagagagaaccatcaaagtgacagtgcct

SEQ ID NO: 34950 - DNA, 30 bp, Homo sapiens
agctggactctgcccctgctcttggtaagt

SEQ ID NO: 34951 - DNA, 30 bp, Homo sapiens
tgtcctgctcagccactctgtcgaccacac

SEQ ID NO: 34952 - DNA, 30 bp, Homo sapiens
ttaaggccttgtctttaccttcatccttta

SEQ ID NO: 34953 - DNA, 30 bp, Homo sapiens
taatcctggggctttaagaacatcttcttt

SEQ ID NO: 34954 - DNA, 30 bp, Homo sapiens
cagagggtgcttctgtcaaccttatgaaga

SEQ ID NO: 34955 - DNA, 30 bp, Homo sapiens
acatggaatttctttagcgtcatgcgaact

SEQ ID NO: 34956 - DNA, 30 bp, Homo sapiens
cagcagacagcaggcacggaatatcagcag

SEQ ID NO: 34957 - DNA, 30 bp, Homo sapiens
gccagggacctcctttcaggtaggcatggg

SEQ ID NO: 34958 - DNA, 30 bp, Homo sapiens
cccatccccatgcccttaccggttcctggt

SEQ ID NO: 34959 - DNA, 30 bp, Homo sapiens
agcagggtccgctgtggacagccggcgggg

SEQ ID NO: 34960 - DNA, 30 bp, Homo sapiens
aactacaactgcatagatggtggaggcatc

SEQ ID NO: 34961 - DNA, 30 bp, Homo sapiens
ggctgctgccaatagcttagtggtaggtag

SEQ ID NO: 34962 - DNA, 30 bp, Homo sapiens
aatgtttgagtattgctgtattgttggctt

SEQ ID NO: 34963 - DNA, 30 bp, Homo sapiens
cttgaggacgccgcacacctgttccaggac

SEQ ID NO: 34964 - DNA, 30 bp, Homo sapiens
aggaggcttccctccaggaagccaggttca

SEQ ID NO: 34965 - DNA, 30 bp, Homo sapiens
cccaggagacaggcacccactgtggagaac

SEQ ID NO: 34966 - DNA, 30 bp, Homo sapiens
tgacaggcacccactggggctctgtccgta

SEQ ID NO: 34967 - DNA, 30 bp, Homo sapiens
ccaactaacaggtacccagtgagtgtcctt

SEQ ID NO: 34968 - DNA, 30 bp, Homo sapiens
ctgaggaaatccatgttgctggtacccact

SEQ ID NO: 34969 - DNA, 30 bp, Homo sapiens
ccaagtggatggtacccactgaggttcagt

SEQ ID NO: 34970 - DNA, 30 bp, Homo sapiens
tgattgggacccactgtggttccattctca

SEQ ID NO: 34971 - DNA, 30 bp, Homo sapiens
cactggcacccaatgggtctctgtctctaa

SEQ ID NO: 34972 - DNA, 30 bp, Homo sapiens
aagttcaaaccagaaagaaaaggtgaggct

SEQ ID NO: 34973 - DNA, 30 bp, Homo sapiens
ttccggggtgtggggaggtcgatgactatg

SEQ ID NO: 34974 - DNA, 30 bp, Homo sapiens
tgccttggagatgctcacagggtttacttc

SEQ ID NO: 34975 - DNA, 30 bp, Homo sapiens
ctgtgggtttggaaggtcaaatataattgg

SEQ ID NO: 34976 - DNA, 30 bp, Homo sapiens
ctttcttcaagtccctggattcaaagagct

SEQ ID NO: 34977 - DNA, 30 bp, Homo sapiens
agacctgctcaattacggacttggacctga

SEQ ID NO: 34978 - DNA, 30 bp, Homo sapiens
cagtgggtcttcccccggccctctgagatg

SEQ ID NO: 34979 - DNA, 30 bp, Homo sapiens
tgccttccaggacaggtaggagttccagat

SEQ ID NO: 34980 - DNA, 30 bp, Homo sapiens
cttcgggtacccttctgtggcactggtccc

SEQ ID NO: 34981 - DNA, 30 bp, Homo sapiens
ccactctgctgggaaaaacagatgaaggtg

SEQ ID NO: 34982 - DNA, 30 bp, Homo sapiens
gctcgggtgtccagggccacacagcctggg

SEQ ID NO: 34983 - DNA, 30 bp, Homo sapiens
tttcttatccttgcgagactcccccagccc

SEQ ID NO: 34984 - DNA, 30 bp, Homo sapiens
gagtgctcccatacagaattagcgcataat

SEQ ID NO: 34985 - DNA, 30 bp, Homo sapiens
acaccacagactctgacttgttaatcttgt

SEQ ID NO: 34986 - DNA, 30 bp, Homo sapiens
gactgggccccagtgtaatcccgtttagag

SEQ ID NO: 34987 - DNA, 30 bp, Homo sapiens
tctcttggttgagcctttcctcttcttttg

SEQ ID NO: 34988 - DNA, 30 bp, Homo sapiens
tccaggcactcagcgcaacggacacaaagc

SEQ ID NO: 34989 - DNA, 30 bp, Homo sapiens
atctggtgttggaaggtagatggctccatt

SEQ ID NO: 34990 - DNA, 30 bp, Homo sapiens
gagaggtcctgtctccagggggaggctcgc

SEQ ID NO: 34991 - DNA, 30 bp, Homo sapiens
caggccgccccttcctctctaggggcttgg

SEQ ID NO: 34992 - DNA, 30 bp, Homo sapiens
tccaggtctttgtgtgaggtctgggaaagt

SEQ ID NO: 34993 - DNA, 30 bp, Homo sapiens
acaagatcacacattgcagtttgtgggtgc

SEQ ID NO: 34994 - DNA, 30 bp, Homo sapiens
agatctttcatatcactagttcctgggctt

SEQ ID NO: 34995 - DNA, 30 bp, Homo sapiens
ctgacaccaggatgttcttctcagtggcct

SEQ ID NO: 34996 - DNA, 30 bp, Homo sapiens
tcgatacttgactctgggacatgattttgc

SEQ ID NO: 34997 - DNA, 30 bp, Homo sapiens
gggacttggaaacggaaggtagtgcagttc

SEQ ID NO: 34998 - DNA, 30 bp, Homo sapiens
ttttaccctgtgtttggagggtggcctctt

SEQ ID NO: 34999 - DNA, 30 bp, Homo sapiens
cgccggaccagctccaccagcatctctgcc

SEQ ID NO: 35000 - DNA, 30 bp, Homo sapiens
agaagactcgcttctctctattcgccagac

SEQ ID NO: 35001 - DNA, 30 bp, Homo sapiens
gtgcggcgccgcttggcagcactgggactg

SEQ ID NO: 35002 - DNA, 30 bp, Homo sapiens
tctcattggtgcccacggtgggcgtctccc

SEQ ID NO: 35003 - DNA, 30 bp, Homo sapiens
accaggccccggcgggaggtctccctgacg

SEQ ID NO: 35004 - DNA, 30 bp, Homo sapiens
aggaggcgttccccgggggacactgcatct

SEQ ID NO: 35005 - DNA, 30 bp, Homo sapiens
ggcagggactgtcccctggcacccagctcg

SEQ ID NO: 35006 - DNA, 30 bp, Homo sapiens
tgcttctcgacatctccggggtgccctgac

SEQ ID NO: 35007 - DNA, 30 bp, Homo sapiens
tgctccaatctgcttcccgacagctccagg

SEQ ID NO: 35008 - DNA, 30 bp, Homo sapiens
tggccccaatctgcttcccgacagctccag

SEQ ID NO: 35009 - DNA, 30 bp, Homo sapiens
atctggggtccatctagggttccatccctg

SEQ ID NO: 35010 - DNA, 30 bp, Homo sapiens
ctcaggaggccaaggtaggagtattgtttg

SEQ ID NO: 35011 - DNA, 30 bp, Homo sapiens
tttaccagtcatatccagaattatcccgct

SEQ ID NO: 35012 - DNA, 30 bp, Homo sapiens
cagccctcattttgcctctctttctctggg

SEQ ID NO: 35013 - DNA, 30 bp, Homo sapiens
tgcttcacagtgcccttccttccgtggtac

SEQ ID NO: 35014 - DNA, 30 bp, Homo sapiens
cagtggtaactcctgtccctgctcaagtcc

SEQ ID NO: 35015 - DNA, 30 bp, Homo sapiens
cacacatcatcatcgaagtcttccccagtt

SEQ ID NO: 35016 - DNA, 30 bp, Homo sapiens
tgcaggatctctggatgatagtggctcagc

SEQ ID NO: 35017 - DNA, 30 bp, Homo sapiens
gcgagcttcaccaggcggcccagggcctca

SEQ ID NO: 35018 - DNA, 30 bp, Homo sapiens
acgcgggcgcggccgttagatcagcaggct

SEQ ID NO: 35019 - DNA, 30 bp, Homo sapiens
aggacattccttggggtgaagccagaaacc

SEQ ID NO: 35020 - DNA, 30 bp, Homo sapiens
cagaggaatgcttgtctctttacaccttct

SEQ ID NO: 35021 - DNA, 30 bp, Homo sapiens
gcttgggtctggccgacaccttctggagga

SEQ ID NO: 35022 - DNA, 30 bp, Homo sapiens
gctcggcggggtccggagcagccccagcgg

SEQ ID NO: 35023 - DNA, 30 bp, Homo sapiens
tcaaggacatcttccaggagcccagtgcct

SEQ ID NO: 35024 - DNA, 30 bp, Homo sapiens
caagggcttacagccacagccacatatgcc

SEQ ID NO: 35025 - DNA, 30 bp, Homo sapiens
cagaggacctgcccatgagcttctgcaacc

SEQ ID NO: 35026 - DNA, 30 bp, Homo sapiens
ttcagagggagagatacgagaaactggaat

SEQ ID NO: 35027 - DNA, 30 bp, Homo sapiens
tgtaggactgtctatctggccattgggtga

SEQ ID NO: 35028 - DNA, 30 bp, Homo sapiens
cttgttgaactacgaaggaaagcacgtacc

SEQ ID NO: 35029 - DNA, 30 bp, Homo sapiens
gtccggaacagtgtcaggatctggcttccc

SEQ ID NO: 35030 - DNA, 30 bp, Homo sapiens
tcttggcagcttcttcttgggcagccaaat

SEQ ID NO: 35031 - DNA, 30 bp, Homo sapiens
cacactgaacttctcccacttggatccttc

SEQ ID NO: 35032 - DNA, 30 bp, Homo sapiens
ccacggtgccgcccaccgcctccagggccg

SEQ ID NO: 35033 - DNA, 30 bp, Homo sapiens
ttcaggtggagtccacaatcttgggaaggc

SEQ ID NO: 35034 - DNA, 30 bp, Homo sapiens
caatggccagcaccttggaatactcgcctt

SEQ ID NO: 35035 - DNA, 30 bp, Homo sapiens
atgaggtataatacttaaggagattttcat

SEQ ID NO: 35036 - DNA, 30 bp, Homo sapiens
gtttgggcatgtagaacttgccccagtatt

SEQ ID NO: 35037 - DNA, 30 bp, Homo sapiens
aaatccctggtgtttgagctgtgtgggagc

SEQ ID NO: 35038 - DNA, 30 bp, Homo sapiens
gaaccacaccaccttctgtcatggcacttt

SEQ ID NO: 35039 - DNA, 30 bp, Homo sapiens
cgacgcttcaatttccttccatattgcagc

SEQ ID NO: 35040 - DNA, 30 bp, Homo sapiens
ctttgggcagaagcagaaggcagcttcacg

SEQ ID NO: 35041 - DNA, 30 bp, Homo sapiens
cgttggatactcggcctactgttgctacgc

SEQ ID NO: 35042 - DNA, 30 bp, Homo sapiens
cagtggtactgcaccactctggaaaaaatg

SEQ ID NO: 35043 - DNA, 30 bp, Homo sapiens
gtaaccctttaagccaacctggaagtgcct

SEQ ID NO: 35044 - DNA, 30 bp, Homo sapiens
acacggagcaatctcaatgctgtttatccg

SEQ ID NO: 35045 - DNA, 30 bp, Homo sapiens
catagagtgtgaacgatggtccggctgcga

SEQ ID NO: 35046 - DNA, 30 bp, Homo sapiens
cacagcccgaaccagctggggacgccgccc

SEQ ID NO: 35047 - DNA, 30 bp, Homo sapiens
tgtatttccgggtctccttgatccccatgg

SEQ ID NO: 35048 - DNA, 30 bp, Homo sapiens
tgaaggtgccctcaggcttggcaggaacca

SEQ ID NO: 35049 - DNA, 30 bp, Homo sapiens
cactggccactggctctcttctgcaccacc

SEQ ID NO: 35050 - DNA, 30 bp, Homo sapiens
caccgggctgacacacgttttcatcataca

SEQ ID NO: 35051 - DNA, 30 bp, Homo sapiens
cacaggtttcagatgccactgcactactaa

SEQ ID NO: 35052 - DNA, 30 bp, Homo sapiens
ttctgggtgaaccaggatggtcgctttctg

SEQ ID NO: 35053 - DNA, 30 bp, Homo sapiens
agaggactctttgtttcacaactggatcat

SEQ ID NO: 35054 - DNA, 30 bp, Homo sapiens
cctcagtcttctctttataaatcaaagtca

SEQ ID NO: 35055 - DNA, 30 bp, Homo sapiens
caatggctcagcgacttgcggcccttgagc

SEQ ID NO: 35056 - DNA, 30 bp, Homo sapiens
tcgcctcttccagaaggacgtcgtcatttt

SEQ ID NO: 35057 - DNA, 30 bp, Homo sapiens
ccagaaggacgtcgtcattttatctaagag

SEQ ID NO: 35058 - DNA, 30 bp, Homo sapiens
cctcggatgggttttacagtagacgtacca

SEQ ID NO: 35059 - DNA, 30 bp, Homo sapiens
tcttgggcacagtttttgttcctggtgcat

SEQ ID NO: 35060 - DNA, 30 bp, Homo sapiens
acgcagcaccatgcaaatatagagctaaaa

SEQ ID NO: 35061 - DNA, 30 bp, Homo sapiens
tagatgccataggtgggctcatgactgtcc

SEQ ID NO: 35062 - DNA, 30 bp, Homo sapiens
tggaggaggtacgactcaggcgaggtagtg

SEQ ID NO: 35063 - DNA, 30 bp, Homo sapiens
ttgctttactttgatcttcagttaccattt

SEQ ID NO: 35064 - DNA, 30 bp, Homo sapiens
cagcggagcctgcacatgcgcactctaggg

SEQ ID NO: 35065 - DNA, 30 bp, Homo sapiens
cagtggtacggggtggccgctgggccctgg

SEQ ID NO: 35066 - DNA, 30 bp, Homo sapiens
gtgtgtacaccttggtgatgtcattgtacc

SEQ ID NO: 35067 - DNA, 30 bp, Homo sapiens
tagcgcaggaagttcctggggtagagctgg

SEQ ID NO: 35068 - DNA, 30 bp, Homo sapiens
catctgtcttttggaggattcagattctta

SEQ ID NO: 35069 - DNA, 30 bp, Homo sapiens
tagtggatgacaagggttcaggacggtaat

SEQ ID NO: 35070 - DNA, 30 bp, Homo sapiens
ggacggtaatgggtatttccccaaggaaga

SEQ ID NO: 35071 - DNA, 30 bp, Homo sapiens
agcaggcactgggctggggcaggatcctga

SEQ ID NO: 35072 - DNA, 30 bp, Homo sapiens
cgctgagcacacagtggtcagtgcagggac

SEQ ID NO: 35073 - DNA, 30 bp, Homo sapiens
acctgggctggggcaggatcctgaacctct

SEQ ID NO: 35074 - DNA, 30 bp, Homo sapiens
agctggcagtgatgctcttttctgctctca

SEQ ID NO: 35075 - DNA, 30 bp, Homo sapiens
ctgaggcttctgggcctctccttgtgcctc

SEQ ID NO: 35076 - DNA, 30 bp, Homo sapiens
cagaggtctgaaacaaacctcctaacttgg

SEQ ID NO: 35077 - DNA, 30 bp, Homo sapiens
atgtggaaacttttttaaaagaatttttgc

SEQ ID NO: 35078 - DNA, 30 bp, Homo sapiens
acttggccaacagttcttccagttctggtc

SEQ ID NO: 35079 - DNA, 30 bp, Homo sapiens
aagcctttctccaagagccaggctttaagc

SEQ ID NO: 35080 - DNA, 30 bp, Homo sapiens
gattttcaaattggggggcagattactggc

SEQ ID NO: 35081 - DNA, 30 bp, Homo sapiens
tgtcggttaaagtgtttgtagagatagcgg

SEQ ID NO: 35082 - DNA, 30 bp, Homo sapiens
tcctttgttcttcctgcaacttctgctgcc

SEQ ID NO: 35083 - DNA, 30 bp, Homo sapiens
ctttgggtttaagagcattttcctgcttcc

SEQ ID NO: 35084 - DNA, 30 bp, Homo sapiens
tcagcgcccggcttgtccccgctgcccgcc

SEQ ID NO: 35085 - DNA, 30 bp, Homo sapiens
tacaacctcttgttcttgctcagccggttg

SEQ ID NO: 35086 - DNA, 30 bp, Homo sapiens
tcttggtcctggtccagaactgtcggtagc

SEQ ID NO: 35087 - DNA, 30 bp, Homo sapiens
atgcggggggaacttggaagtggcggccgc

SEQ ID NO: 35088 - DNA, 30 bp, Homo sapiens
cgaccctcctgcttgtctttacagcagaat

SEQ ID NO: 35089 - DNA, 30 bp, Homo sapiens
ggtgtgaaagtcctctcagctgcagctgcc

SEQ ID NO: 35090 - DNA, 30 bp, Homo sapiens
atctgggggctggtgggggccatagccttg

SEQ ID NO: 35091 - DNA, 30 bp, Homo sapiens
gattggctccttgatgtgttctggtaactg

SEQ ID NO: 35092 - DNA, 30 bp, Homo sapiens
tgagaagggattttcatgcatactccccat

SEQ ID NO: 35093 - DNA, 30 bp, Homo sapiens
cttggtgtggctgggagccgcgttctgttc

SEQ ID NO: 35094 - DNA, 30 bp, Homo sapiens
acagcttccgagccttcctggggcggcagc

SEQ ID NO: 35095 - DNA, 30 bp, Homo sapiens
cttcttctgcacgtggccacagtcgtactt

SEQ ID NO: 35096 - DNA, 30 bp, Homo sapiens
cgctcgctggatcccagaaagttgcccatg

SEQ ID NO: 35097 - DNA, 30 bp, Homo sapiens
ctttggtatggctttggcagggctgtctgg

SEQ ID NO: 35098 - DNA, 30 bp, Homo sapiens
tatctgtagcttctgcatctgttttctgag

SEQ ID NO: 35099 - DNA, 30 bp, Homo sapiens
cactgtgctgaagagatattgagttcttcc

SEQ ID NO: 35100 - DNA, 30 bp, Homo sapiens
cggtgggccatcttcacacactcctcgatc

SEQ ID NO: 35101 - DNA, 30 bp, Homo sapiens
ccaaggtgttcttgagtagcagacattgtc

SEQ ID NO: 35102 - DNA, 30 bp, Homo sapiens
gagcactctgagggcctgtctgcccagtgg

SEQ ID NO: 35103 - DNA, 30 bp, Homo sapiens
tgctggatacctgttgtgaacaacctcttc

SEQ ID NO: 35104 - DNA, 30 bp, Homo sapiens
gatatgcaggatccttgtatgtaactggca

SEQ ID NO: 35105 - DNA, 30 bp, Homo sapiens
accaggtcctcattgctggatacctgttgt

SEQ ID NO: 35106 - DNA, 30 bp, Homo sapiens
cacagggaatggctcatgtcagccccagga

SEQ ID NO: 35107 - DNA, 30 bp, Homo sapiens
cagccctgccacggatctgcccgattcttt

SEQ ID NO: 35108 - DNA, 30 bp, Homo sapiens
gaatggcgactgagtgcttcttgataagtc

SEQ ID NO: 35109 - DNA, 30 bp, Homo sapiens
gggaggcaagagacctttcgactggtctgc

SEQ ID NO: 35110 - DNA, 30 bp, Homo sapiens
tcctgggcatcggctttcagagcggctttg

SEQ ID NO: 35111 - DNA, 30 bp, Homo sapiens
ggagtccctgcgttgtggcctgaccaccag

SEQ ID NO: 35112 - DNA, 30 bp, Homo sapiens
taggcagatgcctttgctgctttctgagcc

SEQ ID NO: 35113 - DNA, 30 bp, Homo sapiens
tcctggattcccaagagaactgcattagcc

SEQ ID NO: 35114 - DNA, 30 bp, Homo sapiens
gctgtgatttttcttcttttggtctattca

SEQ ID NO: 35115 - DNA, 30 bp, Homo sapiens
tatgtgttcaaccttctgtttaacactaag

SEQ ID NO: 35116 - DNA, 30 bp, Homo sapiens
tgctgctcttttcccttctcctttctttgg

SEQ ID NO: 35117 - DNA, 30 bp, Homo sapiens
agacgggggtgcccttggcccttcctttgt

SEQ ID NO: 35118 - DNA, 30 bp, Homo sapiens
taaagggcactcttaagactactactcgtg

SEQ ID NO: 35119 - DNA, 30 bp, Homo sapiens
atctggagaagcgtttccaggatatttctt

SEQ ID NO: 35120 - DNA, 30 bp, Homo sapiens
ttcaggacctccacgttggataaattccat

SEQ ID NO: 35121 - DNA, 30 bp, Homo sapiens
acgtggcggctctcttcaaattagaccaca

SEQ ID NO: 35122 - DNA, 30 bp, Homo sapiens
ttgtggaatataatttttctgcgagtggga

SEQ ID NO: 35123 - DNA, 30 bp, Homo sapiens
cagcggtagtgggccagggcacggttggcc

SEQ ID NO: 35124 - DNA, 30 bp, Homo sapiens
gcgtttcttccacgtaaactttctgcgggc

SEQ ID NO: 35125 - DNA, 30 bp, Homo sapiens
ggtgtcctctgagactgtatccttggattt

SEQ ID NO: 35126 - DNA, 30 bp, Homo sapiens
ccaaggagttctttggtcttcactgccaga

SEQ ID NO: 35127 - DNA, 30 bp, Homo sapiens
gcctgtccagttctgccactgtgtcatcgg

SEQ ID NO: 35128 - DNA, 30 bp, Homo sapiens
taacggtttgttaggatgctccttcctgat

SEQ ID NO: 35129 - DNA, 30 bp, Homo sapiens
taccataggaggcaatggagcttctagctg

SEQ ID NO: 35130 - DNA, 30 bp, Homo sapiens
cagtcatcatcttctgagtctgactcttct

SEQ ID NO: 35131 - DNA, 30 bp, Homo sapiens
gctctgtaggctgctcatgctggagtcctg

SEQ ID NO: 35132 - DNA, 30 bp, Homo sapiens
tattggtgaggattcctgatcttggggagg

SEQ ID NO: 35133 - DNA, 30 bp, Homo sapiens
gtctgggtccagatcgcagctccgtcagtg

SEQ ID NO: 35134 - DNA, 30 bp, Homo sapiens
atctgggaggagctgaagaagacgctggtg

SEQ ID NO: 35135 - DNA, 30 bp, Homo sapiens
taacagatgtaagatcattttgtcttcgaa

SEQ ID NO: 35136 - DNA, 30 bp, Homo sapiens
gtcaggggattcttggccaaaagattgaca

SEQ ID NO: 35137 - DNA, 30 bp, Homo sapiens
ccttgggcatatgccacattgtcataggca

SEQ ID NO: 35138 - DNA, 30 bp, Homo sapiens
accaggcctggtgaacaccaggctgacagt

SEQ ID NO: 35139 - DNA, 30 bp, Homo sapiens
tcttggtacgagggttcgggggtacattgc

SEQ ID NO: 35140 - DNA, 30 bp, Homo sapiens
ccctgggtcttccaactcactgtaagtagc

SEQ ID NO: 35141 - DNA, 30 bp, Homo sapiens
gggaggtgaggaaatttcctctcttgaatt

SEQ ID NO: 35142 - DNA, 30 bp, Homo sapiens
acctcattaagtggtgtgggagatgctgtt

SEQ ID NO: 35143 - DNA, 30 bp, Homo sapiens
gggcggagacactcctcacctcccagatgg

SEQ ID NO: 35144 - DNA, 30 bp, Homo sapiens
gagtggcaccccaaaattgagaaaggcaga

SEQ ID NO: 35145 - DNA, 30 bp, Homo sapiens
agccggccagcacactcaccccagggaagt

SEQ ID NO: 35146 - DNA, 30 bp, Homo sapiens
tcatgagtcatttttgaggacatgccagaa

SEQ ID NO: 35147 - DNA, 30 bp, Homo sapiens
tccaccgcagcacagcagtgagcacagcta

SEQ ID NO: 35148 - DNA, 30 bp, Homo sapiens
cagcacagcagtgagcacagctaggcagaa

SEQ ID NO: 35149 - DNA, 30 bp, Homo sapiens
ccgtgaagaactctttttgacctgttggat

SEQ ID NO: 35150 - DNA, 30 bp, Homo sapiens
gcttggatctcactggaataacttggtggt

SEQ ID NO: 35151 - DNA, 30 bp, Homo sapiens
cgctggacttggtgatgatcctctccagca

SEQ ID NO: 35152 - DNA, 30 bp, Homo sapiens
gctttttccaggcactcaactaaagagcct

SEQ ID NO: 35153 - DNA, 30 bp, Homo sapiens
aagtcccagaaaggatgattgacaattcca

SEQ ID NO: 35154 - DNA, 30 bp, Homo sapiens
aattgggaaagggccggttaaatgaggaaa

SEQ ID NO: 35155 - DNA, 30 bp, Homo sapiens
ttctgaattcgaagtctgtctttctctacc

SEQ ID NO: 35156 - DNA, 30 bp, Homo sapiens
taagcggtggttccacatagtctgttggct

SEQ ID NO: 35157 - DNA, 30 bp, Homo sapiens
ccgcggttaaggaggtctgtgagttccccg

SEQ ID NO: 35158 - DNA, 30 bp, Homo sapiens
ccttggacaggaactcctgaataatttttt

SEQ ID NO: 35159 - DNA, 30 bp, Homo sapiens
tgaactcctctgtccacttctgcaggtctt

SEQ ID NO: 35160 - DNA, 30 bp, Homo sapiens
tcctgggaaaatcttctttgtacttcttct

SEQ ID NO: 35161 - DNA, 30 bp, Homo sapiens
cagaggatgctggtggcagcaggcagcact

SEQ ID NO: 35162 - DNA, 30 bp, Homo sapiens
actagccaggcaaacttcccgaaataatcg

SEQ ID NO: 35163 - DNA, 30 bp, Homo sapiens
cagtggtacccattggtgaaggctgtggca

SEQ ID NO: 35164 - DNA, 30 bp, Homo sapiens
gcttggagcaaatccggggtagccacggcc

SEQ ID NO: 35165 - DNA, 30 bp, Homo sapiens
caatggtatccatttgtaaaggccgttgca

SEQ ID NO: 35166 - DNA, 30 bp, Homo sapiens
cgtccggtgaggtgtttgcttcttctggat

SEQ ID NO: 35167 - DNA, 30 bp, Homo sapiens
tactggggaccctgtgacatttattacact

SEQ ID NO: 35168 - DNA, 30 bp, Homo sapiens
gcctggcactgactaaacacaaagtacacg

SEQ ID NO: 35169 - DNA, 30 bp, Homo sapiens
ggttcttggtgctgtaatgtgcctcacagg

SEQ ID NO: 35170 - DNA, 30 bp, Homo sapiens
ggccagggtggaggctaggagcagtgccag

SEQ ID NO: 35171 - DNA, 30 bp, Homo sapiens
actgacagaacaggtcttttttgggtcctt

SEQ ID NO: 35172 - DNA, 30 bp, Homo sapiens
attcgatcccaccatgtaaatgttgaagca

SEQ ID NO: 35173 - DNA, 30 bp, Homo sapiens
agctggagtggggagcaggagccccaggaa

SEQ ID NO: 35174 - DNA, 30 bp, Homo sapiens
gcttggtgttgccctgccggatctggcgca

SEQ ID NO: 35175 - DNA, 30 bp, Homo sapiens
aagagggccctgccctaatatgatcagtga

SEQ ID NO: 35176 - DNA, 30 bp, Homo sapiens
tcttcagaatgtgaacaggctcttgtcccc

SEQ ID NO: 35177 - DNA, 30 bp, Homo sapiens
gggcaggacacgccggtgcccccaaggccg

SEQ ID NO: 35178 - DNA, 30 bp, Homo sapiens
aatcgggactgccccggcttggggccgtcg

SEQ ID NO: 35179 - DNA, 30 bp, Homo sapiens
ccttggtttgaacttcaaagccacactgtt

SEQ ID NO: 35180 - DNA, 30 bp, Homo sapiens
tgtctgcctgggccgggctggcgaccccac

SEQ ID NO: 35181 - DNA, 30 bp, Homo sapiens
gtccactttctcttctaattgcctattatc

SEQ ID NO: 35182 - DNA, 30 bp, Homo sapiens
ccagtctcatgaccttgtgaatccagtcca

SEQ ID NO: 35183 - DNA, 30 bp, Homo sapiens
aagtgggccgaggaggctctgagagtggcc

SEQ ID NO: 35184 - DNA, 30 bp, Homo sapiens
cagcggtctactaccatcgctggaattttc

SEQ ID NO: 35185 - DNA, 30 bp, Homo sapiens
cagcatccatgaagctggcccagcgccgca

SEQ ID NO: 35186 - DNA, 30 bp, Homo sapiens
acgaggctgtcaccaccctggtagcactgg

SEQ ID NO: 35187 - DNA, 30 bp, Homo sapiens
atgtcaggtggtacatgctgtagcccacat

SEQ ID NO: 35188 - DNA, 30 bp, Homo sapiens
gacaggtggtacatgccatatcccactggc

SEQ ID NO: 35189 - DNA, 30 bp, Homo sapiens
tgcagatgcagccctgggcacacttggcac

SEQ ID NO: 35190 - DNA, 30 bp, Homo sapiens
cagcggcacttctctgatgagcctttgcag

SEQ ID NO: 35191 - DNA, 30 bp, Homo sapiens
caggcacagcagctgcacttctccgatgcc

SEQ ID NO: 35192 - DNA, 30 bp, Homo sapiens
ccacagccccagaccatggagatggcctca

SEQ ID NO: 35193 - DNA, 30 bp, Homo sapiens
tgcaaacacagccctgggcacacttgctac

SEQ ID NO: 35194 - DNA, 30 bp, Homo sapiens
cccctttgcagatgcagccctgggcacact

SEQ ID NO: 35195 - DNA, 30 bp, Homo sapiens
cccctttgcggatgcagccctgggcacact

SEQ ID NO: 35196 - DNA, 30 bp, Homo sapiens
tgtgcagcttgttctattaacatctgggag

SEQ ID NO: 35197 - DNA, 30 bp, Homo sapiens
gcagatgcagccctgggcacacttggcaca

SEQ ID NO: 35198 - DNA, 30 bp, Homo sapiens; identical to SEQ ID NO: 35194

SEQ ID NO: 35199 - DNA, 30 bp, Homo sapiens
tcgaggagagcagcagctggaggcggtgaa

SEQ ID NO: 35200 - DNA, 30 bp, Homo sapiens
catgggcagcagctgcacttgtctgagcct

SEQ ID NO: 35201 - DNA, 30 bp, Homo sapiens
tcctggcctctctccatctaaccgggttgg

SEQ ID NO: 35202 - DNA, 30 bp, Homo sapiens
gtcctcgatgacgatgggctcgtcgttgac

SEQ ID NO: 35203 - DNA, 30 bp, Homo sapiens
tccaggacaataggctcattggtgctggca

SEQ ID NO: 35204 - DNA, 30 bp, Homo sapiens
cattgtgatgactgtagtttcttttcccca

SEQ ID NO: 35205 - DNA, 30 bp, Homo sapiens
taatggcagcataattaatagcaacaaacg

SEQ ID NO: 35206 - DNA, 30 bp, Homo sapiens
tcttggtaataaaacagaaaactgggccat

SEQ ID NO: 35207 - DNA, 30 bp, Homo sapiens
cagcattgttgtttgctgttttcttcattt

SEQ ID NO: 35208 - DNA, 30 bp, Homo sapiens
tccagggcaaagcatgatcctgatgacacc

SEQ ID NO: 35209 - DNA, 30 bp, Homo sapiens
caaaggggaccttccggaaaaataagctat

SEQ ID NO: 35210 - DNA, 30 bp, Homo sapiens
cccagggggcagttagcaagacagtttggt

SEQ ID NO: 35211 - DNA, 30 bp, Homo sapiens
tagtcatcaggcaaaagcttaagcaacagc

SEQ ID NO: 35212 - DNA, 30 bp, Homo sapiens
gtctggcttttttcttcttttttatttgtt

SEQ ID NO: 35213 - DNA, 30 bp, Homo sapiens
gcaaatctgcttaactttttcaatttagct

SEQ ID NO: 35214 - DNA, 30 bp, Homo sapiens
cacagggttaaataatggccttactttttt

SEQ ID NO: 35215 - DNA, 30 bp, Homo sapiens
atgtggtggggaatgctcatcacattgtgc

SEQ ID NO: 35216 - DNA, 30 bp, Homo sapiens
ctgatgctttggcaatctcttcacaaaata

SEQ ID NO: 35217 - DNA, 30 bp, Homo sapiens
cagggcgcttagcgtagctggaatgcgcag

SEQ ID NO: 35218 - DNA, 30 bp, Homo sapiens
cgtcgtcgtcctcatcctcatcattgtcct

SEQ ID NO: 35219 - DNA, 30 bp, Homo sapiens
acttggagaagctgctggtgaggcccatct

SEQ ID NO: 35220 - DNA, 30 bp, Homo sapiens
cattccacaagatactgcacctttccatca

SEQ ID NO: 35221 - DNA, 30 bp, Homo sapiens
cattggcttggttgagcttgggaatttttc

SEQ ID NO: 35222 - DNA, 30 bp, Homo sapiens
aggaggagctgggcttccccactgttgggt

SEQ ID NO: 35223 - DNA, 30 bp, Homo sapiens
caaacccacccaggtgccagggtctttgga

SEQ ID NO: 35224 - DNA, 30 bp, Homo sapiens
ctttggaacttacagatgacacaggtgaat

SEQ ID NO: 35225 - DNA, 30 bp, Homo sapiens
tttttcctgttggcttcaacatgtgtggcc

SEQ ID NO: 35226 - DNA, 30 bp, Homo sapiens
gagcaaacttcctccttaggacctcagaga

SEQ ID NO: 35227 - DNA, 30 bp, Homo sapiens
atgtctgcaaagctgctggccttggacaaa

SEQ ID NO: 35228 - DNA, 30 bp, Homo sapiens
gtttagaaggcttgtgttgctgataccttg

SEQ ID NO: 35229 - DNA, 30 bp, Homo sapiens
agccggggggtggccccgcaggacgtcgag

SEQ ID NO: 35230 - DNA, 30 bp, Homo sapiens
gagcggctggcggccctggcccagctcggc

SEQ ID NO: 35231 - DNA, 30 bp, Homo sapiens
acctgttctgtttcagggtccaaatcaata

SEQ ID NO: 35232 - DNA, 30 bp, Homo sapiens
tcacgcgcctgcactccagcctggtgacag

SEQ ID NO: 35233 - DNA, 30 bp, Homo sapiens
agaacaagcctttaacttgttctgtttcgg

SEQ ID NO: 35234 - DNA, 30 bp, Homo sapiens
gctctttagacttcagcacttctcgctctt

SEQ ID NO: 35235 - DNA, 30 bp, Homo sapiens
atctggtgctgctcctttctgctgttttca

SEQ ID NO: 35236 - DNA, 30 bp, Homo sapiens
atggggacaagtggggaggcagacagtggc

SEQ ID NO: 35237 - DNA, 30 bp, Homo sapiens
agaagggtgttcttcagaagcattgccact

SEQ ID NO: 35238 - DNA, 30 bp, Homo sapiens
cactccagcatgggaaatagagagagaccc

SEQ ID NO: 35239 - DNA, 30 bp, Homo sapiens
tttctctcgcattctgggtgggcctgttga

SEQ ID NO: 35240 - DNA, 30 bp, Homo sapiens
gctgcctggccagcgccaccctcagggtgt

SEQ ID NO: 35241 - DNA, 30 bp, Homo sapiens
tcccaagaagtcttggcttgaatttgcttt

SEQ ID NO: 35242 - DNA, 30 bp, Homo sapiens
tctttgttcaaagtgtctctttcctgggtc

SEQ ID NO: 35243 - DNA, 30 bp, Homo sapiens
cagaagtgagtttgcacatggggcatcatt

SEQ ID NO: 35244 - DNA, 30 bp, Homo sapiens
atgaggctagctgtatcctgataccaaagc

SEQ ID NO: 35245 - DNA, 30 bp, Homo sapiens
agaccgaggtgtggacggaggtggcggagt

SEQ ID NO: 35246 - DNA, 30 bp, Homo sapiens
tttggccccacttaaaaatttgcttaatgg

SEQ ID NO: 35247 - DNA, 30 bp, Homo sapiens
ccccagatccccctctgccctgcctttgag

SEQ ID NO: 35248 - DNA, 30 bp, Homo sapiens
agaagggatgggattggcctttgagaatgc

SEQ ID NO: 35249 - DNA, 30 bp, Homo sapiens
cctaggtccacgaactcatcttctcgtttg

SEQ ID NO: 35250 - DNA, 30 bp, Homo sapiens
acaaggcattgctgctgatgctccggagtc

SEQ ID NO: 35251 - DNA, 30 bp, Homo sapiens
tgcaggagagctggctctctctgaggatga

SEQ ID NO: 35252 - DNA, 30 bp, Homo sapiens
agttggaagtggcagcaatgggcttatcca

SEQ ID NO: 35253 - DNA, 30 bp, Homo sapiens
aactggaagctgtagcaatgggtttcttca

SEQ ID NO: 35254 - DNA, 30 bp, Homo sapiens
catactctaagctgaccacagcaggttctg

SEQ ID NO: 35255 - DNA, 30 bp, Homo sapiens
acacggcttcatcagaatcccggtccttgc

SEQ ID NO: 35256 - DNA, 30 bp, Homo sapiens
gcttggagtagtctgcctccttggtgctgg

SEQ ID NO: 35257 - DNA, 30 bp, Homo sapiens
agggactctcctgcatcccgtcctctgttt

SEQ ID NO: 35258 - DNA, 30 bp, Homo sapiens
cagtggagacggtttccatttaaccctatc

SEQ ID NO: 35259 - DNA, 30 bp, Homo sapiens
tagagagcatctgcctggtgctgcacacca

SEQ ID NO: 35260 - DNA, 30 bp, Homo sapiens
gtcttcgttgagtggtcttcacaaatctca

SEQ ID NO: 35261 - DNA, 30 bp, Homo sapiens
gaaagggcaccagccaatatagcactggca

SEQ ID NO: 35262 - DNA, 30 bp, Homo sapiens
cactggtttttgtgaaattttctgttctgt

SEQ ID NO: 35263 - DNA, 30 bp, Homo sapiens
atgggtccaagccatttctcaacctcagcc

SEQ ID NO: 35264 - DNA, 30 bp, Homo sapiens
gttcagcaatggcttcttcatctgctgatt

SEQ ID NO: 35265 - DNA, 30 bp, Homo sapiens
ctgatgcttcagctgagttatttctttttg

SEQ ID NO: 35266 - DNA, 30 bp, Homo sapiens
atccggacagcactgtccgtggtatttaca

SEQ ID NO: 35267 - DNA, 30 bp, Homo sapiens
atgactgtacaagttcatccagtagataat

SEQ ID NO: 35268 - DNA, 30 bp, Homo sapiens
aacatatgtcactgggcaggtggtgcctct

SEQ ID NO: 35269 - DNA, 30 bp, Homo sapiens
cttcgcggataggtcaatttccctgattaa

SEQ ID NO: 35270 - DNA, 30 bp, Homo sapiens
atgtggaggagaatgctttcatgttactta

SEQ ID NO: 35271 - DNA, 30 bp, Homo sapiens
ccgaggtcaccccaaccaaaatttttaatg

SEQ ID NO: 35272 - DNA, 30 bp, Homo sapiens
agcatacctgtgttggattaatggtataaa

SEQ ID NO: 35273 - DNA, 30 bp, Homo sapiens
tccgtaggcttgtcactgctactaatgaat

SEQ ID NO: 35274 - DNA, 30 bp, Homo sapiens
cacaggcaggtcagtttcactggttggaag

SEQ ID NO: 35275 - DNA, 30 bp, Homo sapiens
tcttggacaaccagctatcaccaggctcca

SEQ ID NO: 35276 - DNA, 30 bp, Homo sapiens
tcttcacgggcaggtcaatttcactggttg

SEQ ID NO: 35277 - DNA, 30 bp, Homo sapiens
cacgggcaggtcagttgcagtggttgaaag

SEQ ID NO: 35278 - DNA, 30 bp, Homo sapiens
atcctgaaggtagcgtttttcttcttttaa

SEQ ID NO: 35279 - DNA, 30 bp, Homo sapiens
aaaagcgaggggctgagcgatcgtttgtcg

SEQ ID NO: 35280 - DNA, 30 bp, Homo sapiens
taagatgcggggcgccgacctgtcgttggt

SEQ ID NO: 35281 - DNA, 30 bp, Homo sapiens
cgctggaagtactatccggctgaggggcaa

SEQ ID NO: 35282 - DNA, 30 bp, Homo sapiens
tgctggctgacccccatctgggggtggtcc

SEQ ID NO: 35283 - DNA, 30 bp, Homo sapiens
atctgggtgaaatgctggggctagggaagg

SEQ ID NO: 35284 - DNA, 30 bp, Homo sapiens
atctgggtgttgtgctgactctggccggag

SEQ ID NO: 35285 - DNA, 30 bp, Homo sapiens
catcctcctcagccatgcccagggtccggg

SEQ ID NO: 35286 - DNA, 30 bp, Homo sapiens
agtaggcctggtccagagtcttctttcccc

SEQ ID NO: 35287 - DNA, 30 bp, Homo sapiens
tttaccacgatcttcaaaatagtgctgttc

SEQ ID NO: 35288 - DNA, 30 bp, Homo sapiens
ataactgctcaggatgtcatcacaaaagcg

SEQ ID NO: 35289 - DNA, 30 bp, Homo sapiens
cgttggaaggaattattttcttcttctgct

SEQ ID NO: 35290 - DNA, 30 bp, Homo sapiens
caagttggcagaagtggctgccactgctgg

SEQ ID NO: 35291 - DNA, 30 bp, Homo sapiens
tagggggcacatagcgcccatgggtgtggt

SEQ ID NO: 35292 - DNA, 30 bp, Homo sapiens
cagtggatgctaccatctccggcctctgga

SEQ ID NO: 35293 - DNA, 30 bp, Homo sapiens
aatagggattttgcatctggctgtctctgg

SEQ ID NO: 35294 - DNA, 30 bp, Homo sapiens
aagtggaggtatgtcatccataggaatgcc

SEQ ID NO: 35295 - DNA, 30 bp, Homo sapiens
attgcagatcctccaggtctaggtgtgact

SEQ ID NO: 35296 - DNA, 30 bp, Homo sapiens
ctgaggcctctgaattcggatctttgtttc

SEQ ID NO: 35297 - DNA, 30 bp, Homo sapiens
tgaaggtcgtatatagttggcatatgtcta

SEQ ID NO: 35298 - DNA, 30 bp, Homo sapiens
cacccgctccccagatgcctaggggagcgc

SEQ ID NO: 35299 - DNA, 30 bp, Homo sapiens
gcctctcctgacacgcagtaaggagacctg

SEQ ID NO: 35300 - DNA, 30 bp, Homo sapiens
gttcctcccgctcatctccatggctatcga

SEQ ID NO: 35301 - DNA, 30 bp, Homo sapiens
cagtggcctcctccatgtccataatgcccg

SEQ ID NO: 35302 - DNA, 30 bp, Homo sapiens
ctgaggacgaggtcatctcgggtctcttga

SEQ ID NO: 35303 - DNA, 30 bp, Homo sapiens
caaggcaaggcctcagctgagttcaggaaa

SEQ ID NO: 35304 - DNA, 30 bp, Homo sapiens
gcatgggggacactgggacgcctctctccc

SEQ ID NO: 35305 - DNA, 30 bp, Homo sapiens
cagtggcctcctgggccgggaagccacggg

SEQ ID NO: 35306 - DNA, 30 bp, Homo sapiens
tagtctccacaggccacagagctgcacacg

SEQ ID NO: 35307 - DNA, 30 bp, Homo sapiens
tgtcgtcaataattctgtttagtagattct

SEQ ID NO: 35308 - DNA, 30 bp, Homo sapiens
cagggacacactctaccattcgggagatcc

SEQ ID NO: 35309 - DNA, 30 bp, Homo sapiens
caggggtatcacccgggtgatcgcctgtct

SEQ ID NO: 35310 - DNA, 30 bp, Homo sapiens
ccgacggcgccggttccgctcttcaaggag

SEQ ID NO: 35311 - DNA, 30 bp, Homo sapiens
agcctagacatggtccttttagatactttg

SEQ ID NO: 35312 - DNA, 30 bp, Homo sapiens
tcaaggggccgtagctgcagtagagctggg

SEQ ID NO: 35313 - DNA, 30 bp, Homo sapiens
acactcacagttccctctgccctctcacac

SEQ ID NO: 35314 - DNA, 30 bp, Homo sapiens
acactcttggtgggtccggctttgggcttc

SEQ ID NO: 35315 - DNA, 30 bp, Homo sapiens
gaacggcagcctttggaattcgagtcccag

SEQ ID NO: 35316 - DNA, 30 bp, Homo sapiens
cactgggctgcactgttgaggctgtgtgca

SEQ ID NO: 35317 - DNA, 30 bp, Homo sapiens
cgctggggggcaggcgggcagccgcggtct

SEQ ID NO: 35318 - DNA, 30 bp, Homo sapiens
acctgggaaggttgggggctggggtggagg

SEQ ID NO: 35319 - DNA, 30 bp, Homo sapiens
gactgcgggatctgctgacacctggtgggg

SEQ ID NO: 35320 - DNA, 30 bp, Homo sapiens
agctggcttcggcaggccgtcaggacccag

SEQ ID NO: 35321 - DNA, 30 bp, Homo sapiens
cagaggccatccagggcttgctggactcgg

SEQ ID NO: 35322 - DNA, 30 bp, Homo sapiens
tacaggcaccacgtggttgtctccaggagc

SEQ ID NO: 35323 - DNA, 30 bp, Homo sapiens
tacggggctggacagagtgtggttaaccgg

SEQ ID NO: 35324 - DNA, 30 bp, Homo sapiens
aaccggggaactgggcaagccggcgccgag

SEQ ID NO: 35325 - DNA, 30 bp, Homo sapiens
cagtggatctctttgctggagaattgacag

SEQ ID NO: 35326 - DNA, 30 bp, Homo sapiens
cacgccttgtgactgtcctgcagctttatt

SEQ ID NO: 35327 - DNA, 30 bp, Homo sapiens
tgatgggaactgatattatttcctcttcca

SEQ ID NO: 35328 - DNA, 30 bp, Homo sapiens
gccaggcgccgccgccgtgcgagtagctgt

SEQ ID NO: 35329 - DNA, 30 bp, Homo sapiens
gagagggcggggcggcccagccgccggcag

SEQ ID NO: 35330 - DNA, 30 bp, Homo sapiens
cactggcactggagtaaccctcgtcactcc

SEQ ID NO: 35331 - DNA, 30 bp, Homo sapiens
acgtggatgtaagttgttttggagtcactg

SEQ ID NO: 35332 - DNA, 30 bp, Homo sapiens
ccagctcctctttggtcatcatcttcttgt

SEQ ID NO: 35333 - DNA, 30 bp, Homo sapiens
agccggagctgctcctgcacgtcgccgtcg

SEQ ID NO: 35334 - DNA, 30 bp, Homo sapiens
tacagggaagtgaggtcagaggtcagctca

SEQ ID NO: 35335 - DNA, 30 bp, Homo sapiens
cagcgggcagagcccagaagggtctttgtc

SEQ ID NO: 35336 - DNA, 30 bp, Homo sapiens
tatttgcagttctccttccggaaccctttg

SEQ ID NO: 35337 - DNA, 30 bp, Homo sapiens
caaaaaccaggtgggcagagtgcaccaggt

SEQ ID NO: 35338 - DNA, 30 bp, Homo sapiens
tacaggctgggcacgaagcgaatcctctgg

SEQ ID NO: 35339 - DNA, 30 bp, Homo sapiens
gtccgggctgagaatgcattcacgtattta

SEQ ID NO: 35340 - DNA, 30 bp, Homo sapiens
tctgaagcaggctgggactcctgatgacca

SEQ ID NO: 35341 - DNA, 30 bp, Homo sapiens
cttcctcacctgtgctttcttcttggcccc

SEQ ID NO: 35342 - DNA, 30 bp, Homo sapiens
tactggtagctgtgtaagtactcagatatc

SEQ ID NO: 35343 - DNA, 30 bp, Homo sapiens
gacaagatgagggtccgagatgtgtggctg

SEQ ID NO: 35344 - DNA, 30 bp, Homo sapiens
gtttgcattcaatctccactgtcccaaggt

SEQ ID NO: 35345 - DNA, 30 bp, Homo sapiens
caggaagactggttgtccaggggtatttac

SEQ ID NO: 35346 - DNA, 30 bp, Homo sapiens
gtattcctcaggattgcttgagtgtaagtc

SEQ ID NO: 35347 - DNA, 30 bp, Homo sapiens
aagaggagtctgcagaaggagagcccacct

SEQ ID NO: 35348 - DNA, 30 bp, Homo sapiens
ctgcggcactcggacctccagcttgcactc

SEQ ID NO: 35349 - DNA, 30 bp, Homo sapiens
ctgaggcactcgcacctccaggcggcactc

SEQ ID NO: 35350 - DNA, 30 bp, Homo sapiens
gtgcggctgaggctttgacctccagccggc

SEQ ID NO: 35351 - DNA, 30 bp, Homo sapiens
attaggaactttcacatccacccgacagtc

SEQ ID NO: 35352 - DNA, 30 bp, Homo sapiens
gcacaagagttccgtagctgttcaagtttg

SEQ ID NO: 35353 - DNA, 30 bp, Homo sapiens
cagcacgcttctcctcctgaggtggttcat

SEQ ID NO: 35354 - DNA, 30 bp, Homo sapiens
gtgtgggcatttctgcacactccacatccc

SEQ ID NO: 35355 - DNA, 30 bp, Homo sapiens
cagaggcgcaaagcctcctcgacattcttt

SEQ ID NO: 35356 - DNA, 30 bp, Homo sapiens
gagaggcggagatggcccaagagcttgaga

SEQ ID NO: 35357 - DNA, 30 bp, Homo sapiens
gtgaggtatgcaattcttttctgcaactgc

SEQ ID NO: 35358 - DNA, 30 bp, Homo sapiens
atttttccttttccagcaaaagctggtgct

SEQ ID NO: 35359 - DNA, 30 bp, Homo sapiens
cagaggtcttgttcctaagggggcgcgtcc

SEQ ID NO: 35360 - DNA, 30 bp, Homo sapiens
caggaatctgggaatgccttgatgatggac

SEQ ID NO: 35361 - DNA, 30 bp, Homo sapiens
ggcagggacaaggccttggcaaggcgagtc

SEQ ID NO: 35362 - DNA, 30 bp, Homo sapiens
tgatgggcacctggagagaggctgagtgca

SEQ ID NO: 35363 - DNA, 30 bp, Homo sapiens
ccttggccacaatcaccagcttggacagct

SEQ ID NO: 35364 - DNA, 30 bp, Homo sapiens
gaacatcaatttctctgccactgattttta

SEQ ID NO: 35365 - DNA, 30 bp, Homo sapiens
caagtgaggatgatgatgaggaggaggagg

SEQ ID NO: 35366 - DNA, 30 bp, Homo sapiens
gcctggaactagaagcccctggagttgcag

SEQ ID NO: 35367 - DNA, 30 bp, Homo sapiens
cttcctccacgcaggggagtttgcgttcct

SEQ ID NO: 35368 - DNA, 30 bp, Homo sapiens
tgctcttcaccctcagcttgttgacctggg

SEQ ID NO: 35369 - DNA, 30 bp, Homo sapiens
gactggggtggctgcgtctcgttgacatca

SEQ ID NO: 35370 - DNA, 30 bp, Homo sapiens
ccttggttccattgaagtctgcgtctcgag

SEQ ID NO: 35371 - DNA, 30 bp, Homo sapiens
ctgtggggggggccctctgagcttgctctt

SEQ ID NO: 35372 - DNA, 30 bp, Homo sapiens
tctcggctcttggccctcagcttgttgacc

SEQ ID NO: 35373 - DNA, 30 bp, Homo sapiens
cactgggggtgggctggtggggacccctca

SEQ ID NO: 35374 - DNA, 30 bp, Homo sapiens
tcccaaactctcttgctttaattttgagtt

SEQ ID NO: 35375 - DNA, 30 bp, Homo sapiens
tcccggctcttcacccgcagtttgttcacc

SEQ ID NO: 35376 - DNA, 30 bp, Homo sapiens
tcgtggaccaccatcctgctggaggtgaag

SEQ ID NO: 35377 - DNA, 30 bp, Homo sapiens
gactcttcactctcagcttgttgacttggg

SEQ ID NO: 35378 - DNA, 30 bp, Homo sapiens
tcacggctcttggctcgaagcttgttgacc

SEQ ID NO: 35379 - DNA, 30 bp, Homo sapiens
tgccaatgtcacggctcttggcccgcagct

SEQ ID NO: 35380 - DNA, 30 bp, Homo sapiens
gcgtcccgggtccgtgcccgcagcttgttg

SEQ ID NO: 35381 - DNA, 30 bp, Homo sapiens
tctcggctcttcactcgcaatttgttgacc

SEQ ID NO: 35382 - DNA, 30 bp, Homo sapiens
attcggcaggtttggcctcagccccatccg

SEQ ID NO: 35383 - DNA, 30 bp, Homo sapiens
agatagacatgatgtgcttgacaaaagctt

SEQ ID NO: 35384 - DNA, 30 bp, Homo sapiens
atccttctcttcaccgtgagtgatgacgta

SEQ ID NO: 35385 - DNA, 30 bp, Homo sapiens
ttcaggatgcgtgtgaactcgatgtaattg

SEQ ID NO: 35386 - DNA, 30 bp, Homo sapiens
tagtccttctcttctccgtgggtgatgatg

SEQ ID NO: 35387 - DNA, 30 bp, Homo sapiens
cattggagtcctcttgcccagccatcaact

SEQ ID NO: 35388 - DNA, 30 bp, Homo sapiens
catgatgtgcttgacaaaggcttcataatt

SEQ ID NO: 35389 - DNA, 30 bp, Homo sapiens
tctcctccccgtgggtgatcacgtagctga

SEQ ID NO: 35390 - DNA, 30 bp, Homo sapiens
accccgacaggatatgcctcacaaacgctt

SEQ ID NO: 35391 - DNA, 30 bp, Homo sapiens
ccattcagcaccatgcggacgagctcttca

SEQ ID NO: 35392 - DNA, 30 bp, Homo sapiens
agaaggcctcgtagttgatgcagccgttgc

SEQ ID NO: 35393 - DNA, 30 bp, Homo sapiens
attcctctttctcgtctccatgggtgatga

SEQ ID NO: 35394 - DNA, 30 bp, Homo sapiens
cgtctttatccttggcgccatgtttgagga

SEQ ID NO: 35395 - DNA, 30 bp, Homo sapiens
gctcggcacgcacttctcctggcctgtttc

SEQ ID NO: 35396 - DNA, 30 bp, Homo sapiens
gactggtgtgcgttggcagatagacgtgct

SEQ ID NO: 35397 - DNA, 30 bp, Homo sapiens
ccccttccccttcaccttcctccatcgttt

SEQ ID NO: 35398 - DNA, 30 bp, Homo sapiens
gagccatcagtgcccccgagctgctgatct

SEQ ID NO: 35399 - DNA, 30 bp, Homo sapiens
agttggaaatttccttaacctgttggcagc

SEQ ID NO: 35400 - DNA, 30 bp, Homo sapiens
atttggtcacaaagtcctgggcatcagagc

SEQ ID NO: 35401 - DNA, 30 bp, Homo sapiens
ctcctggtccttggcgtcgccgtgcgtgat

SEQ ID NO: 35402 - DNA, 30 bp, Homo sapiens
cacagggtggagcagtccagcttggccggg

SEQ ID NO: 35403 - DNA, 30 bp, Homo sapiens
ttttgggggcctaacctctccctcctctcc

SEQ ID NO: 35404 - DNA, 30 bp, Homo sapiens
cacagttgacctcaacaatgtatctgatgt

SEQ ID NO: 35405 - DNA, 30 bp, Homo sapiens
acctggagctgccctggctgctggcggagc

SEQ ID NO: 35406 - DNA, 30 bp, Homo sapiens
agcagggtgatctcgctggggggcaatgtg

SEQ ID NO: 35407 - DNA, 30 bp, Homo sapiens
agttgatgctgggccactcagtgcaagagg

SEQ ID NO: 35408 - DNA, 30 bp, Homo sapiens
caaatggtggtgtcccagagctcagacggc

SEQ ID NO: 35409 - DNA, 30 bp, Homo sapiens
gcttggcctctgtgtcgctgtcactcagat

SEQ ID NO: 35410 - DNA, 30 bp, Homo sapiens
tctggaggtatttcttcattatgctcgcaa

SEQ ID NO: 35411 - DNA, 30 bp, Homo sapiens
caaagggctgcccgtcatctctgccaaact

SEQ ID NO: 35412 - DNA, 30 bp, Homo sapiens
cccagtgaaggcagaagaggtcacgtggat

SEQ ID NO: 35413 - DNA, 30 bp, Homo sapiens
cactgcacagtcacctccaagcaatgactc

SEQ ID NO: 35414 - DNA, 30 bp, Homo sapiens
taagggacagcaacttcaaggagacggttg

SEQ ID NO: 35415 - DNA, 30 bp, Homo sapiens
attcagccgtggggcgaccacagccaggtg

SEQ ID NO: 35416 - DNA, 30 bp, Homo sapiens
gatcccttcccgctggtattcctcttgttc

SEQ ID NO: 35417 - DNA, 30 bp, Homo sapiens
tcccgggcacgctgaggatgaagcccgagc

SEQ ID NO: 35418 - DNA, 30 bp, Homo sapiens
ctccaacaagttctccaattcgactctcat

SEQ ID NO: 35419 - DNA, 30 bp, Homo sapiens
atcttggtcacatagttgttggggaacagg

SEQ ID NO: 35420 - DNA, 30 bp, Homo sapiens
cagatcttctccacgtagtttcctgggaaa

SEQ ID NO: 35421 - DNA, 30 bp, Homo sapiens
cagcggctgggccagagcagggtgaaggag

SEQ ID NO: 35422 - DNA, 30 bp, Homo sapiens
ctccggactgacaccactgttaattgtcca

SEQ ID NO: 35423 - DNA, 30 bp, Homo sapiens
tgctggacgaggcgccggcgctgggaggtt

SEQ ID NO: 35424 - DNA, 30 bp, Homo sapiens
ttgaggatgaagaaaaaaaggaagggtggg

SEQ ID NO: 35425 - DNA, 30 bp, Homo sapiens
aaatgaagcccaggccgaggctggctggaa

SEQ ID NO: 35426 - DNA, 30 bp, Homo sapiens
ttgaggaattccagattgagacacgctggg

SEQ ID NO: 35427 - DNA, 30 bp, Homo sapiens
cagaaagcctagcttgaaactgctggggat

SEQ ID NO: 35428 - DNA, 30 bp, Homo sapiens
gcatggctgttgcataggtgggccgagcct

SEQ ID NO: 35429 - DNA, 30 bp, Homo sapiens
ccctggtgtccccgcctcccggcactgacc

SEQ ID NO: 35430 - DNA, 30 bp, Homo sapiens
tcctggagccccgctgtttgctcatggctg

SEQ ID NO: 35431 - DNA, 30 bp, Homo sapiens
tgctggccagggctggggccttggagcccc

SEQ ID NO: 35432 - DNA, 30 bp, Homo sapiens
agtgctagctgttggttggaggtgcagtct

SEQ ID NO: 35433 - DNA, 30 bp, Homo sapiens
cattggtctggcccgaggcggggggcaggc

SEQ ID NO: 35434 - DNA, 30 bp, Homo sapiens
tactgaccttccgaggccccccgcccggcc

SEQ ID NO: 35435 - DNA, 30 bp, Homo sapiens
tcttggagagcttgatgtcataagtgacca

SEQ ID NO: 35436 - DNA, 30 bp, Homo sapiens
ctgcaagtgaaggtccatggaagaattcaa

SEQ ID NO: 35437 - DNA, 30 bp, Homo sapiens
agagcacctggtatatcgggttggggttcg

SEQ ID NO: 35438 - DNA, 30 bp, Homo sapiens
gcacggccacgaagagcagcaggataagca

SEQ ID NO: 35439 - DNA, 30 bp, Homo sapiens
agttgggcatggtttcatctgggaaggcca

SEQ ID NO: 35440 - DNA, 30 bp, Homo sapiens
acttggccttcttgccacctttcagggact

SEQ ID NO: 35441 - DNA, 30 bp, Homo sapiens
cactggcctgccgctgaggcagacgcgggg

SEQ ID NO: 35442 - DNA, 30 bp, Homo sapiens
ccttgggctcgtccccgtgcttgaacacac

SEQ ID NO: 35443 - DNA, 30 bp, Homo sapiens
cccaggtaaagtaggcgatctcatccaggt

SEQ ID NO: 35444 - DNA, 30 bp, Homo sapiens
tgagctgccaaacgctgaaattctccttct

SEQ ID NO: 35445 - DNA, 30 bp, Homo sapiens
agctcctctgtttctccatccaaggggatg

SEQ ID NO: 35446 - DNA, 30 bp, Homo sapiens
ttctggtacagtggtatcatctgtaggttc

SEQ ID NO: 35447 - DNA, 30 bp, Homo sapiens
cctcggactctgggaggttacggacccagc

SEQ ID NO: 35448 - DNA, 30 bp, Homo sapiens
cactccgagaagagcatgaatacaccatcg

SEQ ID NO: 35449 - DNA, 30 bp, Homo sapiens
catcggccgcgccttttccgtgtagggaaa

SEQ ID NO: 35450 - DNA, 30 bp, Homo sapiens
cacaggcggtagaagtggaagtggtagtct

SEQ ID NO: 35451 - DNA, 30 bp, Homo sapiens
aaataaggatcagttgaacagtcagctaaa

SEQ ID NO: 35452 - DNA, 30 bp, Homo sapiens
agcaggctccatcaaatccttggtggtgcc

SEQ ID NO: 35453 - DNA, 30 bp, Homo sapiens
tacagttctcttcggttactccattctctt

SEQ ID NO: 35454 - DNA, 30 bp, Homo sapiens
acctggatgcccctcacagcctgcttgatg

SEQ ID NO: 35455 - DNA, 30 bp, Homo sapiens
gtgcggcagctggatgttagccaggctgtg

SEQ ID NO: 35456 - DNA, 30 bp, Homo sapiens
ttcctctcacagcctgctttatattttcca

SEQ ID NO: 35457 - DNA, 30 bp, Homo sapiens
gcggcagctggatgttagccaggctgtgga

SEQ ID NO: 35458 - DNA, 30 bp, Homo sapiens
tccaggactcttgtgtatggggtgtagttc

SEQ ID NO: 35459 - DNA, 30 bp, Homo sapiens
ttgtggctgacaccttctctgagcaggccc

SEQ ID NO: 35460 - DNA, 30 bp, Homo sapiens
agcaggttgctgcgttggctgaacaccttg

SEQ ID NO: 35461 - DNA, 30 bp, Homo sapiens
actcggcgctgtggacgcgctggtgctgaa

SEQ ID NO: 35462 - DNA, 30 bp, Homo sapiens
gtgcttcagtagccttgcgaagctccttaa

SEQ ID NO: 35463 - DNA, 30 bp, Homo sapiens
taggtgctgccctgcgtagggctcttccca

SEQ ID NO: 35464 - DNA, 30 bp, Homo sapiens
taggtgctgccccgtgtagggctcttccca

SEQ ID NO: 35465 - DNA, 30 bp, Homo sapiens
tgctggggacaaagatgcaacaagtctctg

SEQ ID NO: 35466 - DNA, 30 bp, Homo sapiens
ccatggcagaaagcgcatttagatctttca

SEQ ID NO: 35467 - DNA, 30 bp, Homo sapiens
ccctggtttaatttcagagaacctgaagct

SEQ ID NO: 35468 - DNA, 30 bp, Homo sapiens
ataaggcccggaaaaactagatgactgacc

SEQ ID NO: 35469 - DNA, 30 bp, Homo sapiens
tttcattcggtggattttttctcttgagac

SEQ ID NO: 35470 - DNA, 30 bp, Homo sapiens
cggtggattttttctcttgagacaccatga

SEQ ID NO: 35471 - DNA, 30 bp, Homo sapiens
actgaatggggtccatgaactcggatttta

SEQ ID NO: 35472 - DNA, 30 bp, Homo sapiens
atatccatggtgacaaccgccccttctgtg

SEQ ID NO: 35473 - DNA, 30 bp, Homo sapiens
gagcctccccacctctgtctcccctgtgga

SEQ ID NO: 35474 - DNA, 30 bp, Homo sapiens
acatcttccattgcaagtagatcatcttta

SEQ ID NO: 35475 - DNA, 30 bp, Homo sapiens
atcttggaggactcgagccggggactccag

SEQ ID NO: 35476 - DNA, 30 bp, Homo sapiens
acttggtgaacttgaggactgaaagagttt

SEQ ID NO: 35477 - DNA, 30 bp, Homo sapiens
aggaggctgagtcggaggcctctgagctgt

SEQ ID NO: 35478 - DNA, 30 bp, Homo sapiens
aggtggaatccgagctttctgagctgtcct

SEQ ID NO: 35479 - DNA, 30 bp, Homo sapiens
cttcagcttctgcagaactatctccattaa

SEQ ID NO: 35480 - DNA, 30 bp, Homo sapiens
attaggattgtcgacttcattcacagcagg

SEQ ID NO: 35481 - DNA, 30 bp, Homo sapiens
ccaaagaatactgtccaagtttatcaaagt

SEQ ID NO: 35482 - DNA, 30 bp, Homo sapiens
acaagagtcaaaggtaatcttctgggtgta

SEQ ID NO: 35483 - DNA, 30 bp, Homo sapiens
ttcaggcctcacaggatgaggtaatggtat

SEQ ID NO: 35484 - DNA, 30 bp, Homo sapiens
ccctggaaagtgctttcctcatatctttct

SEQ ID NO: 35485 - DNA, 30 bp, Homo sapiens
tttccagaagtgagtgcagataactgctct

SEQ ID NO: 35486 - DNA, 30 bp, Homo sapiens
tttaagtcgcagtgcatcaactccatttaa

SEQ ID NO: 35487 - DNA, 30 bp, Homo sapiens
aacaggaaaatatttatgagcagagaaatc

SEQ ID NO: 35488 - DNA, 30 bp, Homo sapiens
atacggaggcccggtcagactctccctctg

SEQ ID NO: 35489 - DNA, 30 bp, Homo sapiens
cagtggcagcagccaccacagtgcccaccc

SEQ ID NO: 35490 - DNA, 30 bp, Homo sapiens
agaaggaactttgaggtttttctgcagcac

SEQ ID NO: 35491 - DNA, 30 bp, Homo sapiens
attgcgcccccttgttccgaggctcctgtg

SEQ ID NO: 35492 - DNA, 30 bp, Homo sapiens
acatggtccggctgtactcgatgccactct

SEQ ID NO: 35493 - DNA, 30 bp, Homo sapiens
gaatggagcatgccaaggtccgacgggcag

SEQ ID NO: 35494 - DNA, 30 bp, Homo sapiens
ggctgaggtttgcttgtcctgtagcattaa

SEQ ID NO: 35495 - DNA, 30 bp, Homo sapiens
actcgggtttctgatcctagtcatgtactt

SEQ ID NO: 35496 - DNA, 30 bp, Homo sapiens
gctgcttgaattgtaaaagctgcaatagaa

SEQ ID NO: 35497 - DNA, 30 bp, Homo sapiens
cagaggtcagccacaggcctcagggtggct

SEQ ID NO: 35498 - DNA, 30 bp, Homo sapiens
caagacactcttgaacacatcaagtcctgc

SEQ ID NO: 35499 - DNA, 30 bp, Homo sapiens
ttcaggctctgttttgatgactttcttttc

SEQ ID NO: 35500 - DNA, 30 bp, Homo sapiens
ctgccggctggcctcagcctccactttcac

SEQ ID NO: 35501 - DNA, 30 bp, Homo sapiens
ccgagggtccctgccattacttattgtggt

SEQ ID NO: 35502 - DNA, 30 bp, Homo sapiens
ctccgggtttctttgccgttactaacaggg

SEQ ID NO: 35503 - DNA, 30 bp, Homo sapiens
caaaggcttgaacacttaccataatcgcat

SEQ ID NO: 35504 - DNA, 30 bp, Homo sapiens
gctcggactgcctttgctctcgacacattt

SEQ ID NO: 35505 - DNA, 30 bp, Homo sapiens; identical to SEQ ID NO: 35504

SEQ ID NO: 35506 - DNA, 30 bp, Homo sapiens
acatggtcagttccatgatggcgttgacga

SEQ ID NO: 35507 - DNA, 30 bp, Homo sapiens
tgcagggcttcagccgagggacccgcctcg

SEQ ID NO: 35508 - DNA, 30 bp, Homo sapiens
acaaggtccctgcataggtgccctccggcc

SEQ ID NO: 35509 - DNA, 30 bp, Homo sapiens
cctcctcctcctcctcctcctcctcctcga

SEQ ID NO: 35510 - DNA, 30 bp, Homo sapiens
ctgttcaagaagcacagttcgaagctcatc

SEQ ID NO: 35511 - DNA, 30 bp, Homo sapiens
tccacgccgtccagggactgtggctctgcc

SEQ ID NO: 35512 - DNA, 30 bp, Homo sapiens
aactggaaagttgctgaagtttgtgacatg

SEQ ID NO: 35513 - DNA, 30 bp, Homo sapiens
agtttgtgtgactcacttgactgcaatggt

SEQ ID NO: 35514 - DNA, 30 bp, Homo sapiens
gtaaggtccaaaatgagaattactatctcc

SEQ ID NO: 35515 - DNA, 30 bp, Homo sapiens
tgctgggacatctccaggttcttgatggga

SEQ ID NO: 35516 - DNA, 30 bp, Homo sapiens
aggaaaaggtgtaggaatagaaggcaatgg

SEQ ID NO: 35517 - DNA, 30 bp, Homo sapiens
agccggccacccagcgggggtaatatttga

SEQ ID NO: 35518 - DNA, 30 bp, Homo sapiens
tgaaggggttgtgggcgccccctggctgct

SEQ ID NO: 35519 - DNA, 30 bp, Homo sapiens
gcctgggtcagaagctggcttgtgaaagga

SEQ ID NO: 35520 - DNA, 30 bp, Homo sapiens
cactggatgatgctgtctggctgcccattc

SEQ ID NO: 35521 - DNA, 30 bp, Homo sapiens
gaacggcagtatccatttctggagaatagt

SEQ ID NO: 35522 - DNA, 30 bp, Homo sapiens
aaatatccagaaggtcatccccactttcgt

SEQ ID NO: 35523 - DNA, 30 bp, Homo sapiens
gatgtgctgcttccagttcaatattcagct

SEQ ID NO: 35524 - DNA, 30 bp, Homo sapiens
ttcaggttgcatgttcatggagtagtttag

SEQ ID NO: 35525 - DNA, 30 bp, Homo sapiens
ggcaggagttcgagaccagccttggcaaca

SEQ ID NO: 35526 - DNA, 30 bp, Homo sapiens
gcgcagcttcttgccaggcgggccgtccct

SEQ ID NO: 35527 - DNA, 30 bp, Homo sapiens
gtccggccgagttgcgcccgctgcggcggt

SEQ ID NO: 35528 - DNA, 30 bp, Homo sapiens
aggtggacatggagggagagcaggagggcg

SEQ ID NO: 35529 - DNA, 30 bp, Homo sapiens
aagtggacatactgactttgcagtctatac

SEQ ID NO: 35530 - DNA, 30 bp, Homo sapiens
cttccatgatggtgtcatcctcttcaacag

SEQ ID NO: 35531 - DNA, 30 bp, Homo sapiens
cgttggaaaagtttactgcagcttttgact

SEQ ID NO: 35532 - DNA, 30 bp, Homo sapiens
tgctgggttttgatccttctttgggtcata

SEQ ID NO: 35533 - DNA, 30 bp, Homo sapiens
tcaaggtttttgcaacaagctttaacttcc

SEQ ID NO: 35534 - DNA, 30 bp, Homo sapiens
acttctccagtatagtaatagattgatttc

SEQ ID NO: 35535 - DNA, 30 bp, Homo sapiens
ggttaatttccgcatcatcctcgtcttctc

SEQ ID NO: 35536 - DNA, 30 bp, Homo sapiens
tacttcttggcgtcatcaggcatctcggcg

SEQ ID NO: 35537 - DNA, 30 bp, Homo sapiens
cgcaggtcctcctcatcgccctggatggtc

SEQ ID NO: 35538 - DNA, 30 bp, Homo sapiens
ccttctccatccccttggatggactttttg

SEQ ID NO: 35539 - DNA, 30 bp, Homo sapiens
ctctctagagcttcattcagcttcactgga

SEQ ID NO: 35540 - DNA, 30 bp, Homo sapiens
gagtattcatcttcctcttcatcagcagcc

SEQ ID NO: 35541 - DNA, 30 bp, Homo sapiens
cagggggactgccccgcacacagactgttc

SEQ ID NO: 35542 - DNA, 30 bp, Homo sapiens
acccggggaactgcgcctgcgcagtctctc

SEQ ID NO: 35543 - DNA, 30 bp, Homo sapiens
gatgtccaggctgtgtgtgccacgctcctg

SEQ ID NO: 35544 - DNA, 30 bp, Homo sapiens
ccaccggatgcccaggccagtgctggcctt

SEQ ID NO: 35545 - DNA, 30 bp, Homo sapiens
cgctggacaaatcgagggtataagcacacg

SEQ ID NO: 35546 - DNA, 30 bp, Homo sapiens
ataaaaggcatgaatgaggaaaccttggga

SEQ ID NO: 35547 - DNA, 30 bp, Homo sapiens
taacatgcagtgctttcaactgtagctcca

SEQ ID NO: 35548 - DNA, 30 bp, Homo sapiens
ttgggcacaagctttctctgcaaggaaata

SEQ ID NO: 35549 - DNA, 30 bp, Homo sapiens
gtttgggttcttgtttggcctctaacttcc

SEQ ID NO: 35550 - DNA, 30 bp, Homo sapiens
cacaggtctttgctgaattccctcaccagc

SEQ ID NO: 35551 - DNA, 30 bp, Homo sapiens
atgtcggcctccagcaggtactgttcagta

SEQ ID NO: 35552 - DNA, 30 bp, Homo sapiens
accaggtttgggcacgagatttctccccaa

SEQ ID NO: 35553 - DNA, 30 bp, Homo sapiens
atgtctttttccatccagaatatggggcgc

SEQ ID NO: 35554 - DNA, 30 bp, Homo sapiens
cttagaagaagggaggtggtagatgaaatg

SEQ ID NO: 35555 - DNA, 30 bp, Homo sapiens
ctgagcagaagggaggtgatagatgaaatg

SEQ ID NO: 35556 - DNA, 30 bp, Homo sapiens
gcagctgcaggcggtagcggtggtagcgga

SEQ ID NO: 35557 - DNA, 30 bp, Homo sapiens
agcagggctctgccgacccatctctgtaag

SEQ ID NO: 35558 - DNA, 30 bp, Homo sapiens
acatggaccaaacgggaaaatcaggaaagc

SEQ ID NO: 35559 - DNA, 30 bp, Homo sapiens
caaggggcagggatgtcgggggtactcagg

SEQ ID NO: 35560 - DNA, 30 bp, Homo sapiens
aagtgttgcctgaaggttggggtccaggat

SEQ ID NO: 35561 - DNA, 30 bp, Homo sapiens
cacagagtggactccaaagaggagtccaag

SEQ ID NO: 35562 - DNA, 30 bp, Homo sapiens
tagagggtagattcaagagatgaatccaaa

SEQ ID NO: 35563 - DNA, 30 bp, Homo sapiens
tgaaggcggcccccacctcggcgatcatgt

SEQ ID NO: 35564 - DNA, 30 bp, Homo sapiens
ctgcagacgatagacacactcggtgtcagg

SEQ ID NO: 35565 - DNA, 30 bp, Homo sapiens
cacccagtgctgtgctgcgcggagggctgt

SEQ ID NO: 35566 - DNA, 30 bp, Homo sapiens
cggaggaggagggtgcgacttcaggccggc

SEQ ID NO: 35567 - DNA, 30 bp, Homo sapiens
gccatgccagtgatcagagtcctctggtca

SEQ ID NO: 35568 - DNA, 30 bp, Homo sapiens
gaaatctggctgagccgcttgctcgatccc

SEQ ID NO: 35569 - DNA, 30 bp, Homo sapiens
agtagggttgtattccgtctctcccgagga

SEQ ID NO: 35570 - DNA, 30 bp, Homo sapiens
tcctcagccccctcttcctctgtgtggggg

SEQ ID NO: 35571 - DNA, 30 bp, Homo sapiens
ccactcttctagttctgtattctttcgagc

SEQ ID NO: 35572 - DNA, 30 bp, Homo sapiens
ctgtgggaatatgactcccatctggaagac

SEQ ID NO: 35573 - DNA, 30 bp, Homo sapiens
tggaacaccaggtggagacttgtcaccgtc

SEQ ID NO: 35574 - DNA, 30 bp, Homo sapiens
gcacgctgctgagcctggggcatggtgggt

SEQ ID NO: 35575 - DNA, 30 bp, Homo sapiens
ttgtgggaatatgactcccatctggaacac

SEQ ID NO: 35576 - DNA, 30 bp, Homo sapiens; identical to SEQ ID NO: 35575

SEQ ID NO: 35577 - DNA, 30 bp, Homo sapiens
ttgtgggaatatgactaacatctggaacac

SEQ ID NO: 35578 - DNA, 30 bp, Homo sapiens; identical to SEQ ID NO: 35575

SEQ ID NO: 35579 - DNA, 30 bp, Homo sapiens
gtgtgggaatatgactcccatctggaaggc

SEQ ID NO: 35580 - DNA, 30 bp, Homo sapiens
atcctttgcgtccttccagcagtatttggt

SEQ ID NO: 35581 - DNA, 30 bp, Homo sapiens
atcctttgcatcctttcagcagtatttggt

SEQ ID NO: 35582 - DNA, 30 bp, Homo sapiens
tgaaggagccctgcagtgttgtgtttggaa

SEQ ID NO: 35583 - DNA, 30 bp, Homo sapiens
ttgtgggaatatgacttccatctggaacac

SEQ ID NO: 35584 - DNA, 30 bp, Homo sapiens
accaggagaatgcttcactcggggctttca

SEQ ID NO: 35585 - DNA, 30 bp, Homo sapiens
atctgatcagggactgaagaaacttctggt

SEQ ID NO: 35586 - DNA, 30 bp, Homo sapiens
tagcgttggctgtaccagtcgttgttgttt

SEQ ID NO: 35587 - DNA, 30 bp, Homo sapiens
aactggccggcactgctcgggtcgcactgc

SEQ ID NO: 35588 - DNA, 30 bp, Homo sapiens
atgctttgctctcgttctcctttgtctgtg

SEQ ID NO: 35589 - DNA, 30 bp, Homo sapiens
agagcaaaagaagagtcactgcagagaaaa

SEQ ID NO: 35590 - DNA, 30 bp, Homo sapiens
cattctttctccaccactccaactttaata

SEQ ID NO: 35591 - DNA, 30 bp, Homo sapiens
ttatggctataatgaaagaaaacccagcag

SEQ ID NO: 35592 - DNA, 30 bp, Homo sapiens
aattctgcttgcagcttcacagtcatatct

SEQ ID NO: 35593 - DNA, 30 bp, Homo sapiens
ttcttcctttaaaggcaatttttcaggttc

SEQ ID NO: 35594 - DNA, 30 bp, Homo sapiens
ccatgggagcgtacaattttccagatttct

SEQ ID NO: 35595 - DNA, 30 bp, Homo sapiens
gtccttctcccagtcctccgttgggtgttt

SEQ ID NO: 35596 - DNA, 30 bp, Homo sapiens
atctgtgcctgcgagccgatgctctgagaa

SEQ ID NO: 35597 - DNA, 30 bp, Homo sapiens
agttggctgttttcagaggggtctttcgga

SEQ ID NO: 35598 - DNA, 30 bp, Homo sapiens
gcaaggttaagtttacttttttctagtgct

SEQ ID NO: 35599 - DNA, 30 bp, Homo sapiens
ttcttgatgatgattcatagagaaatcttt

SEQ ID NO: 35600 - DNA, 30 bp, Homo sapiens
caattgggactgaggcagaaggatagattg

SEQ ID NO: 35601 - DNA, 30 bp, Homo sapiens
ctcacaagaacatcagagaggtcctctgtt

SEQ ID NO: 35602 - DNA, 30 bp, Homo sapiens
cacagctcaggttctgcaggcctccatgtg

SEQ ID NO: 35603 - DNA, 30 bp, Homo sapiens
cagggctgggccatggagggggcagcgtag

SEQ ID NO: 35604 - DNA, 30 bp, Homo sapiens
ggcctgcagggcacagaactgctggaacac

SEQ ID NO: 35605 - DNA, 30 bp, Homo sapiens
cactggttctgtgccagttttccatagcct

SEQ ID NO: 35606 - DNA, 30 bp, Homo sapiens
cctcctctaccagaatgaaaatcttcacga

SEQ ID NO: 35607 - DNA, 30 bp, Homo sapiens
aaccagagctgctttcccgactaacttcaa

SEQ ID NO: 35608 - DNA, 30 bp, Homo sapiens
actcccggagctgcacagacacggaggagt

SEQ ID NO: 35609 - DNA, 30 bp, Homo sapiens
agggctctgacaggcactgctccaaggcag

SEQ ID NO: 35610 - DNA, 30 bp, Homo sapiens
tacaggttttgatctagccacttgatgtaa

SEQ ID NO: 35611 - DNA, 30 bp, Homo sapiens
agacggcagacgccagcttccgcttggtgc

SEQ ID NO: 35612 - DNA, 30 bp, Homo sapiens
cttctctccgagtgctttccaaatctgtag

SEQ ID NO: 35613 - DNA, 30 bp, Homo sapiens
aataggggagtgctgctgagatcttcctcc

SEQ ID NO: 35614 - DNA, 30 bp, Homo sapiens
agttgtccttctgcgtgatgtgcagcttcc

SEQ ID NO: 35615 - DNA, 30 bp, Homo sapiens
ccatggtgctgaatttacgctgcccaatgc

SEQ ID NO: 35616 - DNA, 30 bp, Homo sapiens
ctgcagggccctgacgaggtagagcttctc

SEQ ID NO: 35617 - DNA, 30 bp, Homo sapiens
aagctggccggccgggtgggctcgagtgtg

SEQ ID NO: 35618 - DNA, 30 bp, Homo sapiens
gcatggtatgcatttctcagcaagacataa

SEQ ID NO: 35619 - DNA, 30 bp, Homo sapiens
tttaggtggaaggcccgagacacctcccga

SEQ ID NO: 35620 - DNA, 30 bp, Homo sapiens
ccagctccaaaaccattatctccatagtcc

SEQ ID NO: 35621 - DNA, 30 bp, Homo sapiens
agccctgactcccacaagaggacagcgagt

SEQ ID NO: 35622 - DNA, 30 bp, Homo sapiens
agctgggagcctcccccagcaccaggaatt

SEQ ID NO: 35623 - DNA, 30 bp, Homo sapiens
ttgtggcttgtggtcacctcctcctcctct

SEQ ID NO: 35624 - DNA, 30 bp, Homo sapiens
tcttggccttcacgagcagcctctggacgg

SEQ ID NO: 35625 - DNA, 30 bp, Homo sapiens
acctggacgtcaacaggactgaaggtcaca

SEQ ID NO: 35626 - DNA, 30 bp, Homo sapiens
tgaaggaggctcttctgctgggcctggggg

SEQ ID NO: 35627 - DNA, 30 bp, Homo sapiens
gtctgtagtcaccacagagaagaactcttc

SEQ ID NO: 35628 - DNA, 30 bp, Homo sapiens
tgtgtctccctcctgcttaatcatatccat

SEQ ID NO: 35629 - DNA, 30 bp, Homo sapiens
ggcatgccagacatgggcatggggttcatg

SEQ ID NO: 35630 - DNA, 30 bp, Homo sapiens
tacaggcaaagagatcacaaactgcaggga

SEQ ID NO: 35631 - DNA, 30 bp, Homo sapiens
gggatctgaaaattcccaacggttacatct

SEQ ID NO: 35632 - DNA, 30 bp, Homo sapiens
gcgaggcacccgaggtcgccccgagtggtt

SEQ ID NO: 35633 - DNA, 30 bp, Homo sapiens
ctctggtaagatcccatgggggcctgtggc

SEQ ID NO: 35634 - DNA, 30 bp, Homo sapiens
acttggattttcttcgcttggattgcaccg

SEQ ID NO: 35635 - DNA, 30 bp, Homo sapiens
cctccagatcctgaactatgaagtcttcct

SEQ ID NO: 35636 - DNA, 30 bp, Homo sapiens
ttcccactctctgtttggactcttggatgt

SEQ ID NO: 35637 - DNA, 30 bp, Homo sapiens
gacagggtctcgtactgtgctgagagcagt

SEQ ID NO: 35638 - DNA, 30 bp, Homo sapiens
tgtcggagagtgtctcgtactgcgagcaga

SEQ ID NO: 35639 - DNA, 30 bp, Homo sapiens
cctgccttcccaagtggaagctctgctggc

SEQ ID NO: 35640 - DNA, 30 bp, Homo sapiens
tggttttccaccatatgtcccccctggtgc

SEQ ID NO: 35641 - DNA, 30 bp, Homo sapiens
gtgaggaaactgaggtccagggaaggtccg

SEQ ID NO: 35642 - DNA, 30 bp, Homo sapiens
agttgggggaatccggagagagtagatttg

SEQ ID NO: 35643 - DNA, 30 bp, Homo sapiens
tcctgggactgggggaagcagatgtgctga

SEQ ID NO: 35644 - DNA, 30 bp, Homo sapiens
atctgggctctggaatcactcctcggggcc

SEQ ID NO: 35645 - DNA, 30 bp, Homo sapiens
tgtaggggtaacagtaaagttgggggttgg

SEQ ID NO: 35646 - DNA, 30 bp, Homo sapiens
cgtcgtagagggacagcgcctgcacaatgg

SEQ ID NO: 35647 - DNA, 30 bp, Homo sapiens
cagtatgacacagctcctggctcccgggga

SEQ ID NO: 35648 - DNA, 30 bp, Homo sapiens
ggcttcctgaaatccggggtggtttactgg

SEQ ID NO: 35649 - DNA, 30 bp, Homo sapiens
gatcttctgacatgcattcttcatattctc

SEQ ID NO: 35650 - DNA, 30 bp, Homo sapiens
agcaggagctggacgacctggttgttgatt

SEQ ID NO: 35651 - DNA, 30 bp, Homo sapiens
aacaacgtgggaaatatgactttttcttgc

SEQ ID NO: 35652 - DNA, 30 bp, Homo sapiens
gagaggcagcatacccggcgctgacgatgg

SEQ ID NO: 35653 - DNA, 30 bp, Homo sapiens
ctttccgtaagagatcccccacgatgttta

SEQ ID NO: 35654 - DNA, 30 bp, Homo sapiens
tcctggggagatttgagaaagtttctggca

SEQ ID NO: 35655 - DNA, 30 bp, Homo sapiens
tctatgagcagctgccatactttcagacat

SEQ ID NO: 35656 - DNA, 30 bp, Homo sapiens
agacactgctgcgagggtagtgggcagtgg

SEQ ID NO: 35657 - DNA, 30 bp, Homo sapiens
atgtcctatgacataaacatccagcaggta

SEQ ID NO: 35658 - DNA, 30 bp, Homo sapiens
gcccacgtctctgtctggaagcgccgtgtc

SEQ ID NO: 35659 - DNA, 30 bp, Homo sapiens
cgtccgctggcatggacttggcgttgcctg

SEQ ID NO: 35660 - DNA, 30 bp, Homo sapiens
gaattgcattcctcgcagtgacaggagagg

SEQ ID NO: 35661 - DNA, 30 bp, Homo sapiens
agcaggagacctccatggacttgggcccgg

SEQ ID NO: 35662 - DNA, 30 bp, Homo sapiens
aacaggagacctccatggtgtgccccgggg

SEQ ID NO: 35663 - DNA, 30 bp, Homo sapiens
agcaggacacctccatggtctggtgtctgt

SEQ ID NO: 35664 - DNA, 30 bp, Homo sapiens
aacaggacacctccatggtgtggttgacct

SEQ ID NO: 35665 - DNA, 30 bp, Homo sapiens
acctggtgttctggaggtcctctcgtagcc

SEQ ID NO: 35666 - DNA, 30 bp, Homo sapiens
gactggaatgctgcagttcttcccgaagcc

SEQ ID NO: 35667 - DNA, 30 bp, Homo sapiens
tagacagcgagtcttaccaccttcaagtcc

SEQ ID NO: 35668 - DNA, 30 bp, Homo sapiens
tggcagaggctgacccagtttgtgcagcag

SEQ ID NO: 35669 - DNA, 30 bp, Homo sapiens
tcagccacgatggcagaggctgtcccagtc

SEQ ID NO: 35670 - DNA, 30 bp, Homo sapiens
acacatagtaacgatcaactccagagatgc

SEQ ID NO: 35671 - DNA, 30 bp, Homo sapiens
ccacttgtctcccacctcggtgttgtaccc

SEQ ID NO: 35672 - DNA, 30 bp, Homo sapiens
aactatcttggacacgatcagcttcaagga

SEQ ID NO: 35673 - DNA, 30 bp, Homo sapiens
cacttcagccagatccacttgtctcccacc

SEQ ID NO: 35674 - DNA, 30 bp, Homo sapiens
atctggtacagggtttgggccgcacacggg

SEQ ID NO: 35675 - DNA, 30 bp, Homo sapiens
ccttgggttttgcaaacacctcccagccct

SEQ ID NO: 35676 - DNA, 30 bp, Homo sapiens
ttgtcttcccccactaatgtaccaaccttc

SEQ ID NO: 35677 - DNA, 30 bp, Homo sapiens
aggtgggatccactcctgaatcttctttct

SEQ ID NO: 35678 - DNA, 30 bp, Homo sapiens
tgtaccacatgaagccgtggctggcatgga

SEQ ID NO: 35679 - DNA, 30 bp, Homo sapiens
agaacgttctccagggctctggttacctga

SEQ ID NO: 35680 - DNA, 30 bp, Homo sapiens
ccctggaggcgtagcgggcccagagcttgg

SEQ ID NO: 35681 - DNA, 30 bp, Homo sapiens
tccaggctggggccctgagggtcctggggg

SEQ ID NO: 35682 - DNA, 30 bp, Homo sapiens
tcagcttgctgtaatccacattcactgagt

SEQ ID NO: 35683 - DNA, 30 bp, Homo sapiens
cagaggcccctgcttcttgttggctcacgt

SEQ ID NO: 35684 - DNA, 30 bp, Homo sapiens
ccactgatcggcaggaggctcttccactaa

SEQ ID NO: 35685 - DNA, 30 bp, Homo sapiens
tcgtggccaacatagaacttggataggaaa

SEQ ID NO: 35686 - DNA, 30 bp, Homo sapiens
cacaggtaaggctggtccgaggacagctcc

SEQ ID NO: 35687 - DNA, 30 bp, Homo sapiens
acttggtccagaaataaaagcggctgccat

SEQ ID NO: 35688 - DNA, 30 bp, Homo sapiens
acagttctcccaggtcaggccgcacccagc

SEQ ID NO: 35689 - DNA, 30 bp, Homo sapiens
tgacggtcttggccggcttcacatcctcaa

SEQ ID NO: 35690 - DNA, 30 bp, Homo sapiens
tcgtcttccatggccatgataatctccact

SEQ ID NO: 35691 - DNA, 30 bp, Homo sapiens
gttaagctctggagaattttcataggcaaa

SEQ ID NO: 35692 - DNA, 30 bp, Homo sapiens
tcgtggcatccaggatcctggctgaaaggt

SEQ ID NO: 35693 - DNA, 30 bp, Homo sapiens
gcttggcccaaagatgtaagtgaagtccct

SEQ ID NO: 35694 - DNA, 30 bp, Homo sapiens
ttcaggagggaagatttcgacttcaaaagt

SEQ ID NO: 35695 - DNA, 30 bp, Homo sapiens
cggtggcataaggttgtttatttttcctag

SEQ ID NO: 35696 - DNA, 30 bp, Homo sapiens
tcagagtattaaagccagctctcccaagca

SEQ ID NO: 35697 - DNA, 30 bp, Homo sapiens
gggtggaatatatcaaaatccactcgctga

SEQ ID NO: 35698 - DNA, 30 bp, Homo sapiens
aagttcactaaacccagctacaacggatgc

SEQ ID NO: 35699 - DNA, 30 bp, Homo sapiens
taacagcctccctccagcgtcttcttggcc

SEQ ID NO: 35700 - DNA, 30 bp, Homo sapiens
ccgaggaatgtcacatcttcgccattccca

SEQ ID NO: 35701 - DNA, 30 bp, Homo sapiens
accaacgggaaagcaaaggaaagccggggc

SEQ ID NO: 35702 - DNA, 30 bp, Homo sapiens
tccaggtaacttcttcactgggttgcaatt

SEQ ID NO: 35703 - DNA, 30 bp, Homo sapiens
aggaggtggcagcggcggcctcttttgcag

SEQ ID NO: 35704 - DNA, 30 bp, Homo sapiens
ctctggcagctggatcttgctggggtcgaa

SEQ ID NO: 35705 - DNA, 30 bp, Homo sapiens
gtcttcatcatcaggagggatacctaattc

SEQ ID NO: 35706 - DNA, 30 bp, Homo sapiens
tccaggtaatattcagctcctacagctacc

SEQ ID NO: 35707 - DNA, 30 bp, Homo sapiens
gagaggtgaaatgttcgatccaattttcct

SEQ ID NO: 35708 - DNA, 30 bp, Homo sapiens
tccacacagagctcccatgagtgagttttt

SEQ ID NO: 35709 - DNA, 30 bp, Homo sapiens
tccatctcctctcacatgcatcaattttcg

SEQ ID NO: 35710 - DNA, 30 bp, Homo sapiens
tttcggagaatgatcaataagttccttgtc

SEQ ID NO: 35711 - DNA, 30 bp, Homo sapiens
tggtggaattacttctccagtctccagaat

SEQ ID NO: 35712 - DNA, 30 bp, Homo sapiens
tacagggccaccttggggtccacttccccg

SEQ ID NO: 35713 - DNA, 30 bp, Homo sapiens
ccaaggcagagagaaagcctaaattgtaag

SEQ ID NO: 35714 - DNA, 30 bp, Homo sapiens
cagatctcatagtgaaccacccgctctggt

SEQ ID NO: 35715 - DNA, 30 bp, Homo sapiens
acatgggccgctcccggggtctggtcacaa

SEQ ID NO: 35716 - DNA, 30 bp, Homo sapiens
gtcaggtttggcattcggcggctctcgcac

SEQ ID NO: 35717 - DNA, 30 bp, Homo sapiens
catttcttcttttgtactctaaaatatctt

SEQ ID NO: 35718 - DNA, 30 bp, Homo sapiens
ggatggaatttttcaaaaatttcaccatat

SEQ ID NO: 35719 - DNA, 30 bp, Homo sapiens
tatatagaagctggcgatgcaaaccagccg

SEQ ID NO: 35720 - DNA, 30 bp, Homo sapiens
accaggtgaaggtgaatgaataaatgttaa

SEQ ID NO: 35721 - DNA, 30 bp, Homo sapiens
atatggatggttcctctactgcctgggcac

SEQ ID NO: 35722 - DNA, 30 bp, Homo sapiens
caccgatctacttctccaaatacaatatct

SEQ ID NO: 35723 - DNA, 30 bp, Homo sapiens
aataggcctcgtacctatgatggcaacgac

SEQ ID NO: 35724 - DNA, 30 bp, Homo sapiens
acttggcatcaggcttcttgtctccggctt

SEQ ID NO: 35725 - DNA, 30 bp, Homo sapiens
tattttgtggatactcttgttcttttgttc

SEQ ID NO: 35726 - DNA, 30 bp, Homo sapiens
ccatcaaaggattttcccatcgctctctgg

SEQ ID NO: 35727 - DNA, 30 bp, Homo sapiens
ccgaggctcccccttgccaatgtggtgagg

SEQ ID NO: 35728 - DNA, 30 bp, Homo sapiens
tagtggtggtgctgtctgaactggagccca

SEQ ID NO: 35729 - DNA, 30 bp, Homo sapiens
ctgcggtaccagatctgcagcctccgctcc

SEQ ID NO: 35730 - DNA, 30 bp, Homo sapiens
caagtagtcagcctggatgttggcggcgat

SEQ ID NO: 35731 - DNA, 30 bp, Homo sapiens
aagaggcagcctgccgggcctgatgctgct

SEQ ID NO: 35732 - DNA, 30 bp, Homo sapiens
tgtacaccaaatccaggtcccttgggtggt

SEQ ID NO: 35733 - DNA, 30 bp, Homo sapiens
gtgtcgaggtgactcccggcctgaggaggg

SEQ ID NO: 35734 - DNA, 30 bp, Homo sapiens
ggctgggagcattccggtcctgccagtcct

SEQ ID NO: 35735 - DNA, 30 bp, Homo sapiens
cgctgggagcattcctgttctccctgttct

SEQ ID NO: 35736 - DNA, 30 bp, Homo sapiens
tcctgggcactgtaatcgtacatggctcgg

SEQ ID NO: 35737 - DNA, 30 bp, Homo sapiens
ttcaggatccaccacgaagcaggaactagc

SEQ ID NO: 35738 - DNA, 30 bp, Homo sapiens
ccaccgtgcaccaagcagctggcaccaaga

SEQ ID NO: 35739 - DNA, 30 bp, Homo sapiens
aggaggctgggaagaacacagtggtgaggg

SEQ ID NO: 35740 - DNA, 30 bp, Homo sapiens
agaactggacccagttggatggctgtggtg

SEQ ID NO: 35741 - DNA, 30 bp, Homo sapiens
aactggacccagcctgtgcctggctgggtc

SEQ ID NO: 35742 - DNA, 30 bp, Homo sapiens
acacaggccagctgaggagggcttcgtcct

SEQ ID NO: 35743 - DNA, 30 bp, Homo sapiens
aacatcctagctcttgtcctccctttgccc

SEQ ID NO: 35744 - DNA, 30 bp, Homo sapiens
cttcttggaaatgaaagacccgtcgttctg

SEQ ID NO: 35745 - DNA, 30 bp, Homo sapiens
ggttcggttgtccttaccgaggggtggtag

SEQ ID NO: 35746 - DNA, 30 bp, Homo sapiens
cacacataaactgcccgccgtgagatgagg

SEQ ID NO: 35747 - DNA, 30 bp, Homo sapiens
acatggcccgggacatgacaaagcctttgc

SEQ ID NO: 35748 - DNA, 30 bp, Homo sapiens
tcgtgggtcgatgtagactctcttagggtc

SEQ ID NO: 35749 - DNA, 30 bp, Homo sapiens
ttgagggatgccactgaattgtaggctgaa

SEQ ID NO: 35750 - DNA, 30 bp, Homo sapiens
cctcctggaaattacggaaccatctacatg

SEQ ID NO: 35751 - DNA, 30 bp, Homo sapiens
accaggtgtccccgcccattgatgtagatg

SEQ ID NO: 35752 - DNA, 30 bp, Homo sapiens
aaccttcattcactgagtatctttccagca

SEQ ID NO: 35753 - DNA, 30 bp, Homo sapiens
aagccctgggtgttttcaattgccatctga

SEQ ID NO: 35754 - DNA, 30 bp, Homo sapiens
cttcaaatccttgagcattttccacggcca

SEQ ID NO: 35755 - DNA, 30 bp, Homo sapiens
ctgcctaagaccacctcctcctctcagagc

SEQ ID NO: 35756 - DNA, 30 bp, Homo sapiens
ccagcaaagagcgcttgaacagctgggcat

SEQ ID NO: 35757 - DNA, 30 bp, Homo sapiens
agctggtttgtttagaggctctcactaaga

SEQ ID NO: 35758 - DNA, 30 bp, Homo sapiens
ttccccttggcggccttgtcttctgtggcc

SEQ ID NO: 35759 - DNA, 30 bp, Homo sapiens
cagcaccttcaactttcttctcctcctctt

SEQ ID NO: 35760 - DNA, 30 bp, Homo sapiens
ctctgggtgacttcctttactatggcgtgt

SEQ ID NO: 35761 - DNA, 30 bp, Homo sapiens
ttcaggtagaatatgctggtgaaagaggac

SEQ ID NO: 35762 - DNA, 30 bp, Homo sapiens
aagaggctgaggtcccctctggttccaagg

SEQ ID NO: 35763 - DNA, 30 bp, Homo sapiens
cagaggttgctgccatctttggcctcaccc

SEQ ID NO: 35764 - DNA, 30 bp, Homo sapiens
gagaactggcactgctctggctcctctgac

SEQ ID NO: 35765 - DNA, 30 bp, Homo sapiens
tccaggaataatttttattcctggcccatt

SEQ ID NO: 35766 - DNA, 30 bp, Homo sapiens
gccatgactaaatgaagaatcttggcataa

SEQ ID NO: 35767 - DNA, 30 bp, Homo sapiens
atgtggccagagcaggagcaggagagcgaa

SEQ ID NO: 35768 - DNA, 30 bp, Homo sapiens
tcttggtcccccatggataggaatgatacc

SEQ ID NO: 35769 - DNA, 30 bp, Homo sapiens
tatccaaggtcagatgtggcatcctctaca

SEQ ID NO: 35770 - DNA, 30 bp, Homo sapiens
tcagatgtggcatcctctacaattgattca

SEQ ID NO: 35771 - DNA, 30 bp, Homo sapiens
tacaggagctggtccacttcaaaacagtcg

SEQ ID NO: 35772 - DNA, 30 bp, Homo sapiens
agatggttctggagagtaggttcttttccc

SEQ ID NO: 35773 - DNA, 30 bp, Homo sapiens
tagcgcatgcccaggatctgtctgcttttc

SEQ ID NO: 35774 - DNA, 30 bp, Homo sapiens
tctgttgaccaagttgattctcatacctgg

SEQ ID NO: 35775 - DNA, 30 bp, Homo sapiens
ctctggattacttgccagagacaggaactt

SEQ ID NO: 35776 - DNA, 30 bp, Homo sapiens
cacaggccttgccatccagctcgcttcttc

SEQ ID NO: 35777 - DNA, 30 bp, Homo sapiens
tatcaaattcatcctcctcctccaaaagat

SEQ ID NO: 35778 - DNA, 30 bp, Homo sapiens
tgctcccgcaaacgtacctctctatcaaat

SEQ ID NO: 35779 - DNA, 30 bp, Homo sapiens
atcaggatgagcactgggctgtacgggtcc

SEQ ID NO: 35780 - DNA, 30 bp, Homo sapiens
tgctggacatccagatgtgcatctgcttgg

SEQ ID NO: 35781 - DNA, 30 bp, Homo sapiens
tgctacgtcataaacataggtgacgtctgg

SEQ ID NO: 35782 - DNA, 30 bp, Homo sapiens
cagggggggaccggctcatctgtgaccgat

SEQ ID NO: 35783 - DNA, 30 bp, Homo sapiens
ggctgggtctacaggagtctgttcccagga

SEQ ID NO: 35784 - DNA, 30 bp, Homo sapiens
cattggtcatgggcttgtacttcttgaagc

SEQ ID NO: 35785 - DNA, 30 bp, Homo sapiens
gagcggggcaggggcgggcacgctggggag

SEQ ID NO: 35786 - DNA, 30 bp, Homo sapiens
cagggtcatgctcgccttccgttttgatgg

SEQ ID NO: 35787 - DNA, 30 bp, Homo sapiens
aagccatccacaaggttttccttgtagacg

SEQ ID NO: 35788 - DNA, 30 bp, Homo sapiens
aacaacagactcttccattcttgcatttac

SEQ ID NO: 35789 - DNA, 30 bp, Homo sapiens
tgaaggcactgtggatccactgagcaacag

SEQ ID NO: 35790 - DNA, 30 bp, Homo sapiens
gccaggaatgtttcttgataaatctgtgtc

SEQ ID NO: 35791 - DNA, 30 bp, Homo sapiens
ttagaaagttgttctgtgtgatagcaggac

SEQ ID NO: 35792 - DNA, 30 bp, Homo sapiens
actcgggttaaagagctgctcttccaagaa

SEQ ID NO: 35793 - DNA, 30 bp, Homo sapiens
tgtcaaaatggggctggtcttcaggcttga

SEQ ID NO: 35794 - DNA, 30 bp, Homo sapiens
tttaggtccttcattagtccttccaggtgg

SEQ ID NO: 35795 - DNA, 30 bp, Homo sapiens
taatggttcctgatgtactgtttttattta

SEQ ID NO: 35796 - DNA, 30 bp, Homo sapiens
cctcccctgaggaccaggactctctatctc

SEQ ID NO: 35797 - DNA, 30 bp, Homo sapiens
tctctttccgtttgccaccagaaagggctt

SEQ ID NO: 35798 - DNA, 30 bp, Homo sapiens
ttcaggtgtgaaattgtatcgagctgaaaa

SEQ ID NO: 35799 - DNA, 30 bp, Homo sapiens
atgaggcagaaccgctggacggctttatcg

SEQ ID NO: 35800 - DNA, 30 bp, Homo sapiens
caatggatatggatgcttgtgcagaatctt

SEQ ID NO: 35801 - DNA, 30 bp, Homo sapiens
gacactgattttggccacggagatgctctc

SEQ ID NO: 35802 - DNA, 30 bp, Homo sapiens
agctgggaaggcttgcttcagggtgaacat

SEQ ID NO: 35803 - DNA, 30 bp, Homo sapiens
accagggctggtgcagtccccctgcaggtg

SEQ ID NO: 35804 - DNA, 30 bp, Homo sapiens
aggagggccagcagcacccccgaggcttgt

SEQ ID NO: 35805 - DNA, 30 bp, Homo sapiens
ctgcggtaggtcttgatgatgtccttgatg

SEQ ID NO: 35806 - DNA, 30 bp, Homo sapiens
gatcttaatgacgtccttgatgggccgccg

SEQ ID NO: 35807 - DNA, 30 bp, Homo sapiens
gttctttgggcaggtggagcccatcaatgg

SEQ ID NO: 35808 - DNA, 30 bp, Homo sapiens
aggcggcacagagtctgcagggatggcact

SEQ ID NO: 35809 - DNA, 30 bp, Homo sapiens
cggcccagagcggggcgccgacgggcacgc

SEQ ID NO: 35810 - DNA, 30 bp, Homo sapiens
atgagccttcctcaaccctcagagcaggag

SEQ ID NO: 35811 - DNA, 30 bp, Homo sapiens
attccacccgtaccagcagggcacagagga

SEQ ID NO: 35812 - DNA, 30 bp, Homo sapiens
agctgggcactcatgactcgctcatgatgt

SEQ ID NO: 35813 - DNA, 30 bp, Homo sapiens
acatggggccccggtcgtggtgaaggtgca

SEQ ID NO: 35814 - DNA, 30 bp, Homo sapiens
tcagtgaagactgtattgagttgggtccca

SEQ ID NO: 35815 - DNA, 30 bp, Homo sapiens
gattggctgcgcagatgtaagtcgtaaggg

SEQ ID NO: 35816 - DNA, 30 bp, Homo sapiens
tagtggtaaggaatgaaacagggcgttgtg

SEQ ID NO: 35817 - DNA, 30 bp, Homo sapiens
ccctggctatggggaggtgaggtgcatagc

SEQ ID NO: 35818 - DNA, 30 bp, Homo sapiens
tgcctgggctcaagcaggcggaaaaggtgg

SEQ ID NO: 35819 - DNA, 30 bp, Homo sapiens
cacaggtaaaacccaaaaggttgtttctgc

SEQ ID NO: 35820 - DNA, 30 bp, Homo sapiens
tcttctgggaaagtttctggtaagtaaagg

SEQ ID NO: 35821 - DNA, 30 bp, Homo sapiens
cttctttgcttctgcacttggcttgcggat

SEQ ID NO: 35822 - DNA, 30 bp, Homo sapiens
atgtttctacaggagcatcaggattccaca

SEQ ID NO: 35823 - DNA, 30 bp, Homo sapiens
agagctcttcaaagaaggccactcgggact

SEQ ID NO: 35824 - DNA, 30 bp, Homo sapiens
gataggtcttctgccttgggcttgaggctt

SEQ ID NO: 35825 - DNA, 30 bp, Homo sapiens
aaagccctccttgccatgtgtgcttgcagg

SEQ ID NO: 35826 - DNA, 30 bp, Homo sapiens
ggccagagagtagatagcattgacaggtga

SEQ ID NO: 35827 - DNA, 30 bp, Homo sapiens
gccagggtgagcatgggcagttacctagca

SEQ ID NO: 35828 - DNA, 30 bp, Homo sapiens
aaaaggagccagtcaagttgttcccttggt

SEQ ID NO: 35829 - DNA, 30 bp, Homo sapiens
ccgggggtggctgcccgggcgagccggggt

SEQ ID NO: 35830 - DNA, 30 bp, Homo sapiens
gcgctcatgttcacggcttacggttagaaa

SEQ ID NO: 35831 - DNA, 30 bp, Homo sapiens
gagtgggtgctcgtgctggagaggtcattt

SEQ ID NO: 35832 - DNA, 30 bp, Homo sapiens
aaggtgtgtgtctatcagctcatcatccaa

SEQ ID NO: 35833 - DNA, 30 bp, Homo sapiens
ggcaggaggtcctgaaaactccttcctgat

SEQ ID NO: 35834 - DNA, 30 bp, Homo sapiens
acctcaatgaggtccccagattccatgccc

SEQ ID NO: 35835 - DNA, 30 bp, Homo sapiens
gattctccagaaaggagctggacatgagag

SEQ ID NO: 35836 - DNA, 30 bp, Homo sapiens
atatcttcctgctgggactggccaaaacgt

SEQ ID NO: 35837 - DNA, 30 bp, Homo sapiens
agatcttcctaaatccagggactcaggact

SEQ ID NO: 35838 - DNA, 30 bp, Homo sapiens
ggcaggaggctcttctccaggaggtgcagg

SEQ ID NO: 35839 - DNA, 30 bp, Homo sapiens
gcaaacatgcagagcaatctcttgcacaca

SEQ ID NO: 35840 - DNA, 30 bp, Homo sapiens
cagtctgtggcctccatcttggtcccccgg

SEQ ID NO: 35841 - DNA, 30 bp, Homo sapiens
ctccggtcctttggcttcctctcctgccgc

SEQ ID NO: 35842 - DNA, 30 bp, Homo sapiens
ttttgggaacaaggaaaacattgccatctc

SEQ ID NO: 35843 - DNA, 30 bp, Homo sapiens
ttttgggtttcctttttgtggcctgaggcc

SEQ ID NO: 35844 - DNA, 30 bp, Homo sapiens
gctcagatgaagcgatggtagttgctgggg

SEQ ID NO: 35845 - DNA, 30 bp, Homo sapiens
tacagagttgagaaggggtcaggtggtctg

SEQ ID NO: 35846 - DNA, 30 bp, Homo sapiens
cccaggtaccaggactgtgtctgttgaggg

SEQ ID NO: 35847 - DNA, 30 bp, Homo sapiens
gttgcttgtttctgcttgaaggaaaggttc

SEQ ID NO: 35848 - DNA, 30 bp, Homo sapiens
tagcccaggtaccaggactggctggtttgt

SEQ ID NO: 35849 - DNA, 30 bp, Homo sapiens
cccacaaaggaacggtttgcaggggacgtg

SEQ ID NO: 35850 - DNA, 30 bp, Homo sapiens
accaggactgtgcctgataaatgcccgcag

SEQ ID NO: 35851 - DNA, 30 bp, Homo sapiens
gtctgaagcagagattggttgtgtggctat

SEQ ID NO: 35852 - DNA, 30 bp, Homo sapiens
cagaggaaccaggactgagactgctgtggg

SEQ ID NO: 35853 - DNA, 30 bp, Homo sapiens
tcccggggtccgatgctgacaaaccggttg

SEQ ID NO: 35854 - DNA, 30 bp, Homo sapiens
tagaggtccttcctgcccataatcatgggg

SEQ ID NO: 35855 - DNA, 30 bp, Homo sapiens
ctgaggctgggggtgcccgtggcagagccc

SEQ ID NO: 35856 - DNA, 30 bp, Homo sapiens
cgctggcctccaaacacacagtcatcatag

SEQ ID NO: 35857 - DNA, 30 bp, Homo sapiens
acggggcgggggtcgtcaggaagaggtttt

SEQ ID NO: 35858 - DNA, 30 bp, Homo sapiens
aagaggacaggcctggcggcgccacacggc

SEQ ID NO: 35859 - DNA, 30 bp, Homo sapiens
agtcggtacacagcagcagtttccctgaga

SEQ ID NO: 35860 - DNA, 30 bp, Homo sapiens
ttgagggcctctgcatggcgattcagggcc

SEQ ID NO: 35861 - DNA, 30 bp, Homo sapiens
atacggtggagctctctgctgaatggactt

SEQ ID NO: 35862 - DNA, 30 bp, Homo sapiens
ctcaggtgcctgtttaggagacggagctgt

SEQ ID NO: 35863 - DNA, 30 bp, Homo sapiens
tgttgggtccacttgatgctcttgaggtca

SEQ ID NO: 35864 - DNA, 30 bp, Homo sapiens
ctacgccttctacctccggaatataaaact

SEQ ID NO: 35865 - DNA, 30 bp, Homo sapiens
tcctggacgtcaaaatagtcaattattggc

SEQ ID NO: 35866 - DNA, 30 bp, Homo sapiens
tgcaggtatctttttcatataatgacttct

SEQ ID NO: 35867 - DNA, 30 bp, Homo sapiens
accaggcaaacactacaaccacaactccac

SEQ ID NO: 35868 - DNA, 30 bp, Homo sapiens
actcggatgatctgtgtcattgcttcttca

SEQ ID NO: 35869 - DNA, 30 bp, Homo sapiens
ctgtggttattaagccagctggtaactggt

SEQ ID NO: 35870 - DNA, 30 bp, Homo sapiens
gtcgccggtcacctggggggcctgcccgtc

SEQ ID NO: 35871 - DNA, 30 bp, Homo sapiens
actcgccatcccagcctcgactcatggcct

SEQ ID NO: 35872 - DNA, 30 bp, Homo sapiens
ttcttccgacctttctgaggtatcttcttc

SEQ ID NO: 35873 - DNA, 30 bp, Homo sapiens
ttccggctgcccagcttcctgcggtccttg

SEQ ID NO: 35874 - DNA, 30 bp, Homo sapiens
tgctgagcacacacacacaggccgtatcta

SEQ ID NO: 35875 - DNA, 30 bp, Homo sapiens
caccggggatgtggcagtggactcactgca

SEQ ID NO: 35876 - DNA, 30 bp, Homo sapiens
taacttcagtggcaccagaaaaatcagcat

SEQ ID NO: 35877 - DNA, 30 bp, Homo sapiens
agctgggtgtgttgccaagcgacatcacca

SEQ ID NO: 35878 - DNA, 30 bp, Homo sapiens
caaattctgtacaggaagttcccgttgctg

SEQ ID NO: 35879 - DNA, 30 bp, Homo sapiens
ccttggcttcttcctcttgacctttgacag

SEQ ID NO: 35880 - DNA, 30 bp, Homo sapiens
acgtggttcaggtaggagatatagcagatg

SEQ ID NO: 35881 - DNA, 30 bp, Homo sapiens
tacacgtccaggacgtggttgagataggag

SEQ ID NO: 35882 - DNA, 30 bp, Homo sapiens
acccccagtcaactttatagacttttatag

SEQ ID NO: 35883 - DNA, 30 bp, Homo sapiens
ctctactggagctatgcaaccttgctgtgt

SEQ ID NO: 35884 - DNA, 30 bp, Homo sapiens
tctgctacatagactgctccagtctttctg

SEQ ID NO: 35885 - DNA, 30 bp, Homo sapiens
cccacaggacccagacatatgagggacctc

SEQ ID NO: 35886 - DNA, 30 bp, Homo sapiens
cacaggtggggcgcttggagcctgcggctg

SEQ ID NO: 35887 - DNA, 30 bp, Homo sapiens
cataggggtaggggcagggactgcacctcc

SEQ ID NO: 35888 - DNA, 30 bp, Homo sapiens
ctctgggaggaacggtcgtcatgtgggctc

SEQ ID NO: 35889 - DNA, 30 bp, Homo sapiens
ctctcctcgctcagagaaccgccacactgt

SEQ ID NO: 35890 - DNA, 30 bp, Homo sapiens
cagtgggttagtggtcttcagaagttcagc

SEQ ID NO: 35891 - DNA, 30 bp, Homo sapiens
aagtgtaggagagcaagttcaggtcataac

SEQ ID NO: 35892 - DNA, 30 bp, Homo sapiens
ccaaggtgttgtcagggcaacggcaggtcc

SEQ ID NO: 35893 - DNA, 30 bp, Homo sapiens
gggcagtaggggtagactgcagttatcccg

SEQ ID NO: 35894 - DNA, 30 bp, Homo sapiens
gaagagggtccctgtcagtctctgatagga

SEQ ID NO: 35895 - DNA, 30 bp, Homo sapiens
ccttgggaagcagcatccaaagtatcatga

SEQ ID NO: 35896 - DNA, 30 bp, Homo sapiens
atgtgtaggtgtttgagtctcttgtatttc

SEQ ID NO: 35897 - DNA, 30 bp, Homo sapiens
gtagacacgggacccttttttgaggtctct

SEQ ID NO: 35898 - DNA, 30 bp, Homo sapiens
cacaggtgcccaatccttctgtaggaatct

SEQ ID NO: 35899 - DNA, 30 bp, Homo sapiens
caaaggaggtgtagaagtcaatggcgctgg

SEQ ID NO: 35900 - DNA, 30 bp, Homo sapiens
agctggaatgtgaggtgggtgaacagagat

SEQ ID NO: 35901 - DNA, 30 bp, Homo sapiens
ccagtggccatccgtagggccaaaggcagt

SEQ ID NO: 35902 - DNA, 30 bp, Homo sapiens
gagaggattccttgaggccctggcagccag

SEQ ID NO: 35903 - DNA, 30 bp, Homo sapiens
gagagggctgcgggggcaatcctactgacg

SEQ ID NO: 35904 - DNA, 30 bp, Homo sapiens
atattccccaatgtctgcttgatgaaatac

SEQ ID NO: 35905 - DNA, 30 bp, Homo sapiens
ccaaggttgaaattgaactctttgaacacc

SEQ ID NO: 35906 - DNA, 30 bp, Homo sapiens
cttcgggagacattttcaccagtgtgttgt

SEQ ID NO: 35907 - DNA, 30 bp, Homo sapiens
tcctggggctgaacactccaagttctctag

SEQ ID NO: 35908 - DNA, 30 bp, Homo sapiens
tcttctctccactttggctctttgttgagt

SEQ ID NO: 35909 - DNA, 30 bp, Homo sapiens
atctggttgtattttgtccaacatttgttt

SEQ ID NO: 35910 - DNA, 30 bp, Homo sapiens
tcttggtgtgctctaggactcggtagggga

SEQ ID NO: 35911 - DNA, 30 bp, Homo sapiens
caaaggctctccaaattgtgatgtggtaaa

SEQ ID NO: 35912 - DNA, 30 bp, Homo sapiens
tgacagagcaagacaagtaacgccaccaag

SEQ ID NO: 35913 - DNA, 30 bp, Homo sapiens
gaatggattataaatactttgggtttctct

SEQ ID NO: 35914 - DNA, 30 bp, Homo sapiens
ccgcctcacccctgaagtgcctcctcctct

SEQ ID NO: 35915 - DNA, 30 bp, Homo sapiens
ccttggcggcatacagggatcgtaaagtct

SEQ ID NO: 35916 - DNA, 30 bp, Homo sapiens
cagaggcgagatcttcaaggggatcatgat

SEQ ID NO: 35917 - DNA, 30 bp, Homo sapiens
tactggaggggcgaggtcttcagtgggatc

SEQ ID NO: 35918 - DNA, 30 bp, Homo sapiens
tgtaggaatcagaagcatattctgctgaga

SEQ ID NO: 35919 - DNA, 30 bp, Homo sapiens
tgcaggaatcagaagcatattctgctgaga

SEQ ID NO: 35920 - DNA, 30 bp, Homo sapiens
aattgggagtcctcaccaagcaagcaacag

SEQ ID NO: 35921 - DNA, 30 bp, Homo sapiens
ccgaggatgccttggttagagaggatgggc

SEQ ID NO: 35922 - DNA, 30 bp, Homo sapiens
agccggtgagctcgacaggcagctcacggc

SEQ ID NO: 35923 - DNA, 30 bp, Homo sapiens
cagtgggtgacccagattgccatagaggtc

SEQ ID NO: 35924 - DNA, 30 bp, Homo sapiens
aagaggagacgggctcccagtgggctgggc

SEQ ID NO: 35925 - DNA, 30 bp, Homo sapiens
catagaggtctgatcgcttctgtctaaaaa

SEQ ID NO: 35926 - DNA, 30 bp, Homo sapiens
tgtacagaggctgcagctgtaaatgcgacg

SEQ ID NO: 35927 - DNA, 30 bp, Homo sapiens
ctgaggcccttgatagccataagagtcaaa

SEQ ID NO: 35928 - DNA, 30 bp, Homo sapiens
gtcaagttcagcagccgcatttctggttca

SEQ ID NO: 35929 - DNA, 30 bp, Homo sapiens
cgcaggcaagtacacctgcttggacaagag

SEQ ID NO: 35930 - DNA, 30 bp, Homo sapiens
ctttggtctttctgtaaaccatttctcgaa

SEQ ID NO: 35931 - DNA, 30 bp, Homo sapiens
tctcggaaactggctaaaatcttactttct

SEQ ID NO: 35932 - DNA, 30 bp, Homo sapiens
gtctggtagaagtggtggtaatggtggtga

SEQ ID NO: 35933 - DNA, 30 bp, Homo sapiens
ggacgggtggaagtggtggtggtggtggtg

SEQ ID NO: 35934 - DNA, 30 bp, Homo sapiens
agacggccaccagccctgaagggaaggggc

SEQ ID NO: 35935 - DNA, 30 bp, Homo sapiens
acaaggtttcatagccaggacggggaccgc

SEQ ID NO: 35936 - DNA, 30 bp, Homo sapiens
gtttttcctcccaggcaaaggaaagcttga

SEQ ID NO: 35937 - DNA, 30 bp, Homo sapiens
ccaaggagccgctgcccttgttcttccggc

SEQ ID NO: 35938 - DNA, 30 bp, Homo sapiens
tccactcacccagccccgggcacctgcccc

SEQ ID NO: 35939 - DNA, 30 bp, Homo sapiens
aaggcccacctgggctggattgccctggac

SEQ ID NO: 35940 - DNA, 30 bp, Homo sapiens
taatggcccacttggccttcctgtttgagc

SEQ ID NO: 35941 - DNA, 30 bp, Homo sapiens
cactggggctccggtgatgagagtaacttc

SEQ ID NO: 35942 - DNA, 30 bp, Homo sapiens
aggcgggcgccccgtaggtctgcgagccca

SEQ ID NO: 35943 - DNA, 30 bp, Homo sapiens
acgcggggcgtagaagggggtcaggtagga

SEQ ID NO: 35944 - DNA, 30 bp, Homo sapiens
accaggtccgaccgtatagcaaggtggagc

SEQ ID NO: 35945 - DNA, 30 bp, Homo sapiens
ccactgctgggcctggaccagggggtgtgc

SEQ ID NO: 35946 - DNA, 30 bp, Homo sapiens
accaggcccggatgccctgcaaggtgccct

SEQ ID NO: 35947 - DNA, 30 bp, Homo sapiens
cctgccatagagcaggttggcgcccaggac

SEQ ID NO: 35948 - DNA, 30 bp, Homo sapiens
accaggctcggataccatgcagcgtggaca

SEQ ID NO: 35949 - DNA, 30 bp, Homo sapiens
ccttggctgggtcggggtcgctgtaggcac

SEQ ID NO: 35950 - DNA, 30 bp, Homo sapiens
gcactgggagccaccgacacgtctcactca

SEQ ID NO: 35951 - DNA, 30 bp, Homo sapiens
cctgacaccctgcagcgtggctgccagatg

SEQ ID NO: 35952 - DNA, 30 bp, Homo sapiens
cagttccaggagaccagggcgggggatgct

SEQ ID NO: 35953 - DNA, 30 bp, Homo sapiens
agctgggctccagctgcccacgcagtacag

SEQ ID NO: 35954 - DNA, 30 bp, Homo sapiens
cactgggtgcctgcggcagctgcgcaggtg

SEQ ID NO: 35955 - DNA, 30 bp, Homo sapiens
ctccggctcggacgcgtgcagtaggaggcc

SEQ ID NO: 35956 - DNA, 30 bp, Homo sapiens
acaaggcgtcccccgcgccgccgccgcacg

SEQ ID NO: 35957 - DNA, 30 bp, Homo sapiens
cccaggctgagcaccgagaaggcggcgcgg

SEQ ID NO: 35958 - DNA, 30 bp, Homo sapiens
gcatttgtccttcccaccacttgccactct

SEQ ID NO: 35959 - DNA, 30 bp, Homo sapiens
ccctggttgttgaatgtgaatgggggtggg

SEQ ID NO: 35960 - DNA, 30 bp, Homo sapiens
atacccgagtggtggagtgggggtggggta

SEQ ID NO: 35961 - DNA, 30 bp, Homo sapiens
acccgggtagtggagtgtgagtggggcagc

SEQ ID NO: 35962 - DNA, 30 bp, Homo sapiens
tagtggtggaatgtccgtggggtaaatttg

SEQ ID NO: 35963 - DNA, 30 bp, Homo sapiens; identical to SEQ ID NO: 35962

SEQ ID NO: 35964 - DNA, 30 bp, Homo sapiens
caaacgtgcctcttgcatacctagtattcc

SEQ ID NO: 35965 - DNA, 30 bp, Homo sapiens
ctcccacaccagaggagatgggggcatctc

SEQ ID NO: 35966 - DNA, 30 bp, Homo sapiens
cacggagcatgcaggcctctactcattagg

SEQ ID NO: 35967 - DNA, 30 bp, Homo sapiens
acgtgggagcatttgtcttgatggcctctg

SEQ ID NO: 35968 - DNA, 30 bp, Homo sapiens
aacaagcctagcttcttgcagaaaagttaa

SEQ ID NO: 35969 - DNA, 30 bp, Homo sapiens
agtaccccaaggggcctggggctggttgtc

SEQ ID NO: 35970 - DNA, 30 bp, Homo sapiens
tcctggcgtctctgttgcacctgaggttcc

SEQ ID NO: 35971 - DNA, 30 bp, Homo sapiens
gagtggcaggagtccctttttgctgccctt

SEQ ID NO: 35972 - DNA, 30 bp, Homo sapiens
tccctctgccttttccagtagaagcttcct

SEQ ID NO: 35973 - DNA, 30 bp, Homo sapiens
aaggggttgcctagatgctgtatttgacgt

SEQ ID NO: 35974 - DNA, 30 bp, Homo sapiens
agcagccaatgtccaaataaggttttgtta

SEQ ID NO: 35975 - DNA, 30 bp, Homo sapiens
tttctgcagcctgcatgtcgactttttcaa

SEQ ID NO: 35976 - DNA, 30 bp, Homo sapiens
tgcaggtctttttgaagcatagcatcttga

SEQ ID NO: 35977 - DNA, 30 bp, Homo sapiens
ccaagacacatcttcttcattatgatagtt

SEQ ID NO: 35978 - DNA, 30 bp, Homo sapiens
agaaggcctttctgcccagggatgatgttt

SEQ ID NO: 35979 - DNA, 30 bp, Homo sapiens
agcaggcagttgtgggttgttttcttctat

SEQ ID NO: 35980 - DNA, 30 bp, Homo sapiens
aagaaggctcaaagacgacggtcagctcag

SEQ ID NO: 35981 - DNA, 30 bp, Homo sapiens
tgattgtgtcacagtcgtctgtgatggtca

SEQ ID NO: 35982 - DNA, 30 bp, Homo sapiens
gtaccggtcatcttcatcaaaagaatgcca

SEQ ID NO: 35983 - DNA, 30 bp, Homo sapiens
agaaggtcgagatgagttccttgggaggtt

SEQ ID NO: 35984 - DNA, 30 bp, Homo sapiens
gcacggaggtgccgttgccccggaagcatt

SEQ ID NO: 35985 - DNA, 30 bp, Homo sapiens
gattaatctgggataggcagtcactttttc

SEQ ID NO: 35986 - DNA, 30 bp, Homo sapiens
cagaggagcacacccctgatcttgtattcc

SEQ ID NO: 35987 - DNA, 30 bp, Homo sapiens
cttcccagctgctccaggagggccctgacc

SEQ ID NO: 35988 - DNA, 30 bp, Homo sapiens
agatggggccatcaacagggtcccattcag

SEQ ID NO: 35989 - DNA, 30 bp, Homo sapiens
ctgaggctcacgcccagagccttctttagc

SEQ ID NO: 35990 - DNA, 30 bp, Homo sapiens
cctgcttcatgctgtgcccatttagtaaaa

SEQ ID NO: 35991 - DNA, 30 bp, Homo sapiens
tcaccagtggcatcttgggaaatatgaagg

SEQ ID NO: 35992 - DNA, 30 bp, Homo sapiens
cacttggcccctcagtgacttctgactcta

SEQ ID NO: 35993 - DNA, 30 bp, Homo sapiens
attcatagatccagttctgagcacagctcg

SEQ ID NO: 35994 - DNA, 30 bp, Homo sapiens
attcatagacccagtcatgagcacaagact

SEQ ID NO: 35995 - DNA, 30 bp, Homo sapiens
ccacaaccggccctgagttcatgtacttca

SEQ ID NO: 35996 - DNA, 30 bp, Homo sapiens
tactcatacagccagtgcccagcgctgtcc

SEQ ID NO: 35997 - DNA, 30 bp, Homo sapiens
ggctgggtggatgctgctgtgctggccccc

SEQ ID NO: 35998 - DNA, 30 bp, Homo sapiens
ctgaggaatcccagggaccatctgctgctc

SEQ ID NO: 35999 - DNA, 30 bp, Homo sapiens
aaagcgctggatcacgtccccaacgagccg

SEQ ID NO: 36000 - DNA, 30 bp, Homo sapiens
ggatggtgacaaagtttgggtttgttagga

SEQ ID NO: 36001 - DNA, 30 bp, Homo sapiens
acatagtggacacctccctctgggctatag

SEQ ID NO: 36002 - DNA, 30 bp, Homo sapiens
ggctggtcctaggcctcctgttccagctac

SEQ ID NO: 36003 - DNA, 30 bp, Homo sapiens
ataggccatcctctggcagatcagtacagt

SEQ ID NO: 36004 - DNA, 30 bp, Homo sapiens
gatcctcaaagagtctattaacaacctctt

SEQ ID NO: 36005 - DNA, 30 bp, Homo sapiens
caatccacatcctcaggaaagcaaagcgcc

SEQ ID NO: 36006 - DNA, 30 bp, Homo sapiens
ccttggctgtgtactggactcaccctgagg

SEQ ID NO: 36007 - DNA, 30 bp, Homo sapiens
gtgaggttgacctagagaacacttgaccac

SEQ ID NO: 36008 - DNA, 30 bp, Homo sapiens
cctcttccttccaggcctttctagagtagg

SEQ ID NO: 36009 - DNA, 30 bp, Homo sapiens
tcttagcttctgcagtgtttctctgcaaag

SEQ ID NO: 36010 - DNA, 30 bp, Homo sapiens
agccggaggcattgatgtacagctggcttt

SEQ ID NO: 36011 - DNA, 30 bp, Homo sapiens
tagcttgtcttgccctcagtgctctgggtg

SEQ ID NO: 36012 - DNA, 30 bp, Homo sapiens
gtctggggctttctggggcaagaagtggga

SEQ ID NO: 36013 - DNA, 30 bp, Homo sapiens
agcaggttgaagtcccctttgtgctgttcc

SEQ ID NO: 36014 - DNA, 30 bp, Homo sapiens
cagattttgttccatccaggtacacaactt

SEQ ID NO: 36015 - DNA, 30 bp, Homo sapiens
tgctgggacgctgcaggcctggccgttctg

SEQ ID NO: 36016 - DNA, 30 bp, Homo sapiens
cttcaatgtttcttccattcctgggcctga

SEQ ID NO: 36017 - DNA, 30 bp, Homo sapiens
ttctctgcccccatgctggggcatttccaa

SEQ ID NO: 36018 - DNA, 30 bp, Homo sapiens
attgtagtactagtccaaccttttcagaat

SEQ ID NO: 36019 - DNA, 30 bp, Homo sapiens
taaatgaaccctgctgaccttcttccattc

SEQ ID NO: 36020 - DNA, 30 bp, Homo sapiens
aggatggatcggtctcttgctgcgcctctg

SEQ ID NO: 36021 - DNA, 30 bp, Homo sapiens
gagagggctgctgggaggtgagagttgtgc

SEQ ID NO: 36022 - DNA, 30 bp, Homo sapiens
actgaccttgccaagtgctcctctggcgag

SEQ ID NO: 36023 - DNA, 30 bp, Homo sapiens
agttgggggctcgctgcctgcgctccccca

SEQ ID NO: 36024 - DNA, 30 bp, Homo sapiens
caggggtctgctccccctatcccccctcct

SEQ ID NO: 36025 - DNA, 30 bp, Homo sapiens
cacaggggtctgctcagcttcctcgccacc

SEQ ID NO: 36026 - DNA, 30 bp, Homo sapiens
gcctggagcgcgtcacatgttttcttggca

SEQ ID NO: 36027 - DNA, 30 bp, Homo sapiens
ttcttcctcacgttgtacataagggaagga

SEQ ID NO: 36028 - DNA, 30 bp, Homo sapiens
cgttgggatttaagcgtctccgcccagctc

SEQ ID NO: 36029 - DNA, 30 bp, Homo sapiens
ctctggcctcctccagtgctgagggctgat

SEQ ID NO: 36030 - DNA, 30 bp, Homo sapiens
tcgtcctctgagagctgcagatcctccagc

SEQ ID NO: 36031 - DNA, 30 bp, Homo sapiens
gcgattcagtagcaacttcactggagtatc

SEQ ID NO: 36032 - DNA, 30 bp, Homo sapiens
tgctgggcacagagttcacccggccgtccc

SEQ ID NO: 36033 - DNA, 30 bp, Homo sapiens
gattcctcagtaaagctgaagtcacacact

SEQ ID NO: 36034 - DNA, 30 bp, Homo sapiens
agaaacagataatccgcttctcatcttcat

SEQ ID NO: 36035 - DNA, 30 bp, Homo sapiens
gtctggtgtccctgcagccgagcttgtcaa

SEQ ID NO: 36036 - DNA, 30 bp, Homo sapiens
cagaggcacccacattcttccacgatcatg

SEQ ID NO: 36037 - DNA, 30 bp, Homo sapiens
actcggaaatgatggggtactggatgggaa

SEQ ID NO: 36038 - DNA, 30 bp, Homo sapiens
caatgaaacgaccgtcctcttttgtgtctt

SEQ ID NO: 36039 - DNA, 30 bp, Homo sapiens
tgcttctggcatcattacaacaacagtaaa

SEQ ID NO: 36040 - DNA, 30 bp, Homo sapiens
tgtgccgtgctttgcctgtgagacggcggc

SEQ ID NO: 36041 - DNA, 30 bp, Homo sapiens
cctcgaagtcgggctcgggctctgggtccg

SEQ ID NO: 36042 - DNA, 30 bp, Homo sapiens
cagcatgggcggggcaccgcctgtcagagc

SEQ ID NO: 36043 - DNA, 30 bp, Homo sapiens
catctgcagatcgcaataaaaatgcagctg

SEQ ID NO: 36044 - DNA, 30 bp, Homo sapiens
cagtgggtcctgctgtctctccagacgcat

SEQ ID NO: 36045 - DNA, 30 bp, Homo sapiens
tgtaggatgaggttttccagttcatctgca

SEQ ID NO: 36046 - DNA, 30 bp, Homo sapiens
atgctgaggtccgtgggccctgactccatg

SEQ ID NO: 36047 - DNA, 30 bp, Homo sapiens
ctcacttcgggcctccacagtctgcaccag

SEQ ID NO: 36048 - DNA, 30 bp, Homo sapiens
accgtcttttaaacctcttggcattttgtt

SEQ ID NO: 36049 - DNA, 30 bp, Homo sapiens
gcaggttggttgttctggcctcccaagagt

SEQ ID NO: 36050 - DNA, 30 bp, Homo sapiens
cttcggtatggtttctctttatgtgcctcc

SEQ ID NO: 36051 - DNA, 30 bp, Homo sapiens
cagagattgagcctccccggtagctgcccc

SEQ ID NO: 36052 - DNA, 30 bp, Homo sapiens
tacattctcagggaagcttttccttgcaga

SEQ ID NO: 36053 - DNA, 30 bp, Homo sapiens
caagtccgccttgtcttctgtttcttggct

SEQ ID NO: 36054 - DNA, 30 bp, Homo sapiens
cacgtccgccttgtcttctgtttcttggct

SEQ ID NO: 36055 - DNA, 30 bp, Homo sapiens
aatagtggatacaggttgccgtggtttcca

SEQ ID NO: 36056 - DNA, 30 bp, Homo sapiens
gtttggggcaaattcagctccaggagctgc

SEQ ID NO: 36057 - DNA, 30 bp, Homo sapiens
cagaggacagggcgcggttgctgggtcatg

SEQ ID NO: 36058 - DNA, 30 bp, Homo sapiens
ctgtggctcacacctataattggggggcca

SEQ ID NO: 36059 - DNA, 30 bp, Homo sapiens
cagagccttccattcgccttcctgtgtagc

SEQ ID NO: 36060 - DNA, 30 bp, Homo sapiens
ctgaaaacagcaggttctggcttttccgtg

SEQ ID NO: 36061 - DNA, 30 bp, Homo sapiens
actccacctccatcttcctcttctgcaaag

SEQ ID NO: 36062 - DNA, 30 bp, Homo sapiens
cagacgctttcggttgacactgtaaccaaa

SEQ ID NO: 36063 - DNA, 30 bp, Homo sapiens
aagatagcagcagctggctgttgcccctgg

SEQ ID NO: 36064 - DNA, 30 bp, Homo sapiens
cgacaaagcaagacaccgtctgtctgggac

SEQ ID NO: 36065 - DNA, 30 bp, Homo sapiens
tctccaccagcttcaccttgtacttgcgtt

SEQ ID NO: 36066 - DNA, 30 bp, Homo sapiens
atgctttatggaactttttcttcttcttgg

SEQ ID NO: 36067 - DNA, 30 bp, Homo sapiens
acatggttcttcctcagaaagtggttcttc

SEQ ID NO: 36068 - DNA, 30 bp, Homo sapiens
tcttcaagtatggagttcaatgcccgcctc

SEQ ID NO: 36069 - DNA, 30 bp, Homo sapiens
tcctggttctgctccccaagctcagcagca

SEQ ID NO: 36070 - DNA, 30 bp, Homo sapiens
caatggactcagatctaaggcggttggtca

SEQ ID NO: 36071 - DNA, 30 bp, Homo sapiens
acacggcgatctcatcatccaggccgtcgc

SEQ ID NO: 36072 - DNA, 30 bp, Homo sapiens
gagcgctgacatctccaggctgctgggctg

SEQ ID NO: 36073 - DNA, 30 bp, Homo sapiens
ctgtggtgacagacacttctggcagggaga

SEQ ID NO: 36074 - DNA, 30 bp, Homo sapiens
tacttgggaggttgaagtgggaggattgct

SEQ ID NO: 36075 - DNA, 30 bp, Homo sapiens
ctttgggaggccgaggcaggtggattgctt

SEQ ID NO: 36076 - DNA, 30 bp, Homo sapiens
caggggctgttggtgtctgagccgggaggg

SEQ ID NO: 36077 - DNA, 30 bp, Homo sapiens
tcaccggccgtgatttctccgcttgcagct

SEQ ID NO: 36078 - DNA, 30 bp, Homo sapiens
tagctgtgttgccagcatttgaaggtaact

SEQ ID NO: 36079 - DNA, 30 bp, Homo sapiens
acttgaaggcctccggaatgcgggcgatct

SEQ ID NO: 36080 - DNA, 30 bp, Homo sapiens
tgttgttgtgtggtggctcagacatgtgtg

SEQ ID NO: 36081 - DNA, 30 bp, Homo sapiens
ccctggatggaaaatggataaggatgattt

SEQ ID NO: 36082 - DNA, 30 bp, Homo sapiens
cagacttccctgtctctttcccagagctct

SEQ ID NO: 36083 - DNA, 30 bp, Homo sapiens
cttgcctcttgggggtaacttccggctggg

SEQ ID NO: 36084 - DNA, 30 bp, Homo sapiens
cctccttggtttatgggcatttcttggagg

SEQ ID NO: 36085 - DNA, 30 bp, Homo sapiens
actcctgactcggcatcatcactctggata

SEQ ID NO: 36086 - DNA, 30 bp, Homo sapiens
ttccgttgctcagcatccccagcagctcac

SEQ ID NO: 36087 - DNA, 30 bp, Homo sapiens
ctctggtagtcttcagctccagctcctgga

SEQ ID NO: 36088 - DNA, 30 bp, Homo sapiens
ttctgaggattggcagcccgaactccttgc

SEQ ID NO: 36089 - DNA, 30 bp, Homo sapiens
tccaggagatattatgcttctgattagctc

SEQ ID NO: 36090 - DNA, 30 bp, Homo sapiens
cccactttctgggggtttgaggccctcact

SEQ ID NO: 36091 - DNA, 30 bp, Homo sapiens
taggatccagactggaatatcggtgacagc

SEQ ID NO: 36092 - DNA, 30 bp, Homo sapiens
ctggggtcagctgatgaatacaagtggcac

SEQ ID NO: 36093 - DNA, 30 bp, Homo sapiens
gagttgttctggttactcagtttatgaaga

SEQ ID NO: 36094 - DNA, 30 bp, Homo sapiens
tcttggaaaaatctgaagccgaacttctca

SEQ ID NO: 36095 - DNA, 30 bp, Homo sapiens
tgctgggatcggggcaggcggccgggggct

SEQ ID NO: 36096 - DNA, 30 bp, Homo sapiens
tcgtggggtgcggcacagagtccacgcacc

SEQ ID NO: 36097 - DNA, 30 bp, Homo sapiens
tattgggatggaaagcctgtggaaatgact

SEQ ID NO: 36098 - DNA, 30 bp, Homo sapiens
agttggaaacagacatgtctcctaacatat

SEQ ID NO: 36099 - DNA, 30 bp, Homo sapiens
cacaggccacgctggctggaagctggaagg

SEQ ID NO: 36100 - DNA, 30 bp, Homo sapiens
tcccccttccgcggcagcctggtgcccgcg

SEQ ID NO: 36101 - DNA, 30 bp, Homo sapiens
tatcggggcggctgctggaggcctgacgac

SEQ ID NO: 36102 - DNA, 30 bp, Homo sapiens
tcctccttgcgctccagagtctgtgccgcg

SEQ ID NO: 36103 - DNA, 30 bp, Homo sapiens
acttggctctggagttgatgcaactcatca

SEQ ID NO: 36104 - DNA, 30 bp, Homo sapiens
ctgctggaaatgaactgggaagcttctttt

SEQ ID NO: 36105 - DNA, 30 bp, Homo sapiens
aggcggcgaggcagtcggctgcgcgcaggg

SEQ ID NO: 36106 - DNA, 30 bp, Homo sapiens
ggcaagttatcagctggcggaggttcctgc

SEQ ID NO: 36107 - DNA, 30 bp, Homo sapiens
tatgctgcggaagttcttccggaagttgtc

SEQ ID NO: 36108 - DNA, 30 bp, Homo sapiens
gcgctctgttcctttgtatcgctcttcagt

SEQ ID NO: 36109 - DNA, 30 bp, Homo sapiens
attgttgggcaagaagttgctgatggcacc

SEQ ID NO: 36110 - DNA, 30 bp, Homo sapiens
actcgagaacaaagatgaagatgttatcag

SEQ ID NO: 36111 - DNA, 30 bp, Homo sapiens
agaagagactttggtttttgtcatcctgaa

SEQ ID NO: 36112 - DNA, 30 bp, Homo sapiens
catggcagtgcaggcggtgagctgggggcc

SEQ ID NO: 36113 - DNA, 30 bp, Homo sapiens
tctcttggagtccctccccaggtccccctc

SEQ ID NO: 36114 - DNA, 30 bp, Homo sapiens
ctgtgggtggtgaggccttccgctgaagga

SEQ ID NO: 36115 - DNA, 30 bp, Homo sapiens
gcgttgaggggcagccaggctccagaactg

SEQ ID NO: 36116 - DNA, 30 bp, Homo sapiens
ctggaatggtgaggggcaggtgggagcagc

SEQ ID NO: 36117 - DNA, 30 bp, Homo sapiens
ctaattcctgttggggtttttcagcacttt

SEQ ID NO: 36118 - DNA, 30 bp, Homo sapiens
aagtcataggtctgctctgaaaggtcaaaa

SEQ ID NO: 36119 - DNA, 30 bp, Homo sapiens
tccttgctgaaggaaaacattaggagaatg

SEQ ID NO: 36120 - DNA, 30 bp, Homo sapiens
cactggtagatgaccttcacgcaaaatgcc

SEQ ID NO: 36121 - DNA, 30 bp, Homo sapiens
gtcccctcagctcgaagggcagagaatcgg

SEQ ID NO: 36122 - DNA, 30 bp, Homo sapiens
tataacatgggagagtctttctttttagga

SEQ ID NO: 36123 - DNA, 30 bp, Homo sapiens
acttgggaggtgtcttgagattatcatccg

SEQ ID NO: 36124 - DNA, 30 bp, Homo sapiens
cccgccgccgcaacgcttgcgcacgttgaa

SEQ ID NO: 36125 - DNA, 30 bp, Homo sapiens
ctcaggaggtgtcttgagattatcatccgc

SEQ ID NO: 36126 - DNA, 30 bp, Homo sapiens
tcttgggttcgggtgatgatggttccacgt

SEQ ID NO: 36127 - DNA, 30 bp, Homo sapiens
gcgtgggttttgttttgttttttgattttt

SEQ ID NO: 36128 - DNA, 30 bp, Homo sapiens
cctcttgggttcgggtaatgatggttccac

SEQ ID NO: 36129 - DNA, 30 bp, Homo sapiens
cccaggcttgagtgcaatggcgtgttctca

SEQ ID NO: 36130 - DNA, 30 bp, Homo sapiens
gctccagttgctcccatcaccagagcactc

SEQ ID NO: 36131 - DNA, 30 bp, Homo sapiens
tccaagtttccatcctttaaatcagtgaaa

SEQ ID NO: 36132 - DNA, 30 bp, Homo sapiens
cagtggaggaaggggaagtttgtggtgccc

SEQ ID NO: 36133 - DNA, 30 bp, Homo sapiens
gtcctggggaggctgcacatctcgcagtgg

SEQ ID NO: 36134 - DNA, 30 bp, Homo sapiens
atcttgaatagcctcttggtcagtcatccg

SEQ ID NO: 36135 - DNA, 30 bp, Homo sapiens
tttaggagttttttcctgtttcttgaagga

SEQ ID NO: 36136 - DNA, 30 bp, Homo sapiens
ttcttgaatcctggcttcttggctctggct

SEQ ID NO: 36137 - DNA, 30 bp, Homo sapiens
cgctggctcttatttcctcttcttcttttt

SEQ ID NO: 36138 - DNA, 30 bp, Homo sapiens
cccctgctttttggcaggaaggatggggca

SEQ ID NO: 36139 - DNA, 30 bp, Homo sapiens
cagtggccttttttcaagctcacatcatct

SEQ ID NO: 36140 - DNA, 30 bp, Homo sapiens
gctgttacagcccagtccgctctgggctcc

SEQ ID NO: 36141 - DNA, 30 bp, Homo sapiens
aatgccgcctcagcactttgcagcccaggc

SEQ ID NO: 36142 - DNA, 30 bp, Homo sapiens
taacatcccaggccgctcatggagccgatt

SEQ ID NO: 36143 - DNA, 30 bp, Homo sapiens
cctcgggtgctactccccctctccccaagg

SEQ ID NO: 36144 - DNA, 30 bp, Homo sapiens
tacaggagtccaggaggtcctttccgctct

SEQ ID NO: 36145 - DNA, 30 bp, Homo sapiens
tgatggaatcttcccgtaattcccgatgtt

SEQ ID NO: 36146 - DNA, 30 bp, Homo sapiens
ttccagcagatgatgatgttggggtcattt

SEQ ID NO: 36147 - DNA, 30 bp, Homo sapiens
caggggagcagagcctggaagacggcaatg

SEQ ID NO: 36148 - DNA, 30 bp, Homo sapiens
gccaactccattgcgaaaggaccttttcac

SEQ ID NO: 36149 - DNA, 30 bp, Homo sapiens
ccttggaagagcccaggaaggtacacctgg

SEQ ID NO: 36150 - DNA, 30 bp, Homo sapiens
ttctggcttggacagaatctgcatctcatg

SEQ ID NO: 36151 - DNA, 30 bp, Homo sapiens
agttctctcccggaacgtcattctggaatc

SEQ ID NO: 36152 - DNA, 30 bp, Homo sapiens
agttggttttcattggtccagctggttcat

SEQ ID NO: 36153 - DNA, 30 bp, Homo sapiens
atctggcgacaggcctcgaaggtccacttg

SEQ ID NO: 36154 - DNA, 30 bp, Homo sapiens
tcaaggagacgctcctcacacgtctccacg

SEQ ID NO: 36155 - DNA, 30 bp, Homo sapiens
atgccttggccctccccttgcagacatcga

SEQ ID NO: 36156 - DNA, 30 bp, Homo sapiens
ctgtttttgatcgggattctggatttcttg

SEQ ID NO: 36157 - DNA, 30 bp, Homo sapiens
gaacggtccgggggccaggcagggcaggcc

SEQ ID NO: 36158 - DNA, 30 bp, Homo sapiens
accacattgcagggtcttcaagccgagttc

SEQ ID NO: 36159 - DNA, 30 bp, Homo sapiens
ttttggaaacatctgtgtgcatcgtggaca

SEQ ID NO: 36160 - DNA, 30 bp, Homo sapiens
acattggtagcctctgtgaaagagtcattg

SEQ ID NO: 36161 - DNA, 30 bp, Homo sapiens
taaatgggattggacctgccacttagcctc

SEQ ID NO: 36162 - DNA, 30 bp, Homo sapiens
ggaaaaggtgtagtggcatccaactaacag

SEQ ID NO: 36163 - DNA, 30 bp, Homo sapiens
agttgggatggacttgcccaagtgatggcc

SEQ ID NO: 36164 - DNA, 30 bp, Homo sapiens
gtgccagtgggctgtgcaggggatgggctc

SEQ ID NO: 36165 - DNA, 30 bp, Homo sapiens
tcatatcatccatgctgactgtgccgatga

SEQ ID NO: 36166 - DNA, 30 bp, Homo sapiens
caaaagcatgtccccaagaaggccagcgat

SEQ ID NO: 36167 - DNA, 30 bp, Homo sapiens
cactgggcgtccacccggaaggacagcagc

SEQ ID NO: 36168 - DNA, 30 bp, Homo sapiens
gggtgaactttaaaggccaagagctcctca

SEQ ID NO: 36169 - DNA, 30 bp, Homo sapiens
actcgtggacgtcccagatctccgacagca

SEQ ID NO: 36170 - DNA, 30 bp, Homo sapiens
tctcagagagcagcggtgggagctttttgt

SEQ ID NO: 36171 - DNA, 30 bp, Homo sapiens
cactgcacgtcccagatttcacagagaagt

SEQ ID NO: 36172 - DNA, 30 bp, Homo sapiens
agctacctgtgatgccgaacaactcctgca

SEQ ID NO: 36173 - DNA, 30 bp, Homo sapiens
ctgcagatctcctggagcagcggcatcatg

SEQ ID NO: 36174 - DNA, 30 bp, Homo sapiens
cactgggctccctttgaacccggcccaatc

SEQ ID NO: 36175 - DNA, 30 bp, Homo sapiens
cactgggcaagaccaagagtaaaaagttca

SEQ ID NO: 36176 - DNA, 30 bp, Homo sapiens
atgagggctgcaattaccttggcatcttgt

SEQ ID NO: 36177 - DNA, 30 bp, Homo sapiens
agctggcaatctgagtagtagtctggataa

SEQ ID NO: 36178 - DNA, 30 bp, Homo sapiens
gactggctccggtgatctggccattatact

SEQ ID NO: 36179 - DNA, 30 bp, Homo sapiens
ccccaagcacccgcaggtggtagatgacca

SEQ ID NO: 36180 - DNA, 30 bp, Homo sapiens
ttgaggttcctggggtgagtcctcggttct

SEQ ID NO: 36181 - DNA, 30 bp, Homo sapiens
cactggatttgtacatatctgaaagcagtc

SEQ ID NO: 36182 - DNA, 30 bp, Homo sapiens
tcacgggctggctggggtggtgggccttgc

SEQ ID NO: 36183 - DNA, 30 bp, Homo sapiens
cattggagtattccctatggtcttgcggaa

SEQ ID NO: 36184 - DNA, 30 bp, Homo sapiens
cactggatggacatgtaaggccagttgaag

SEQ ID NO: 36185 - DNA, 30 bp, Homo sapiens
acggccagttaaaactgctgccggacagta

SEQ ID NO: 36186 - DNA, 30 bp, Homo sapiens
cactggcccgagccgtagggccagttgaag

SEQ ID NO: 36187 - DNA, 30 bp, Homo sapiens
ttctggttttaaccacataacattttcatg

SEQ ID NO: 36188 - DNA, 30 bp, Homo sapiens
ctcggggaattcaatactcatggtcttatc

SEQ ID NO: 36189 - DNA, 30 bp, Homo sapiens
tgaagagagaagcagtaaggttttcataca

SEQ ID NO: 36190 - DNA, 30 bp, Homo sapiens
ttccggtggaagtagagcggcttggcgttc

SEQ ID NO: 36191 - DNA, 30 bp, Homo sapiens
agaagggcagcgtgtccatgaagatcttgt

SEQ ID NO: 36192 - DNA, 30 bp, Homo sapiens
gaaaggtaaagtgtccaggaaaagtttgtc

SEQ ID NO: 36193 - DNA, 30 bp, Homo sapiens
atagagaccctgatcattcatttgaaagca

SEQ ID NO: 36194 - DNA, 30 bp, Homo sapiens
tagaaaggtagggtgtccaggaagagcttg

SEQ ID NO: 36195 - DNA, 30 bp, Homo sapiens
gcttggcttgcagcatttcgatgagcaggt

SEQ ID NO: 36196 - DNA, 30 bp, Homo sapiens
ttcaggtgcttgtagtagaggtattcttca

SEQ ID NO: 36197 - DNA, 30 bp, Homo sapiens
ccacactggtcttgcaggaatgcagcacca

SEQ ID NO: 36198 - DNA, 30 bp, Homo sapiens
agcagggccttcttctttttgacgtgcaga

SEQ ID NO: 36199 - DNA, 30 bp, Homo sapiens
caccggccgctggccgcgtacttcgccttg

SEQ ID NO: 36200 - DNA, 30 bp, Homo sapiens
atggcaatcccatacaaccctgagtcccat

SEQ ID NO: 36201 - DNA, 30 bp, Homo sapiens
agaatatcctcagagagctccataagagga

SEQ ID NO: 36202 - DNA, 30 bp, Homo sapiens
aagaggagacggtgacagcggctgagttga

SEQ ID NO: 36203 - DNA, 30 bp, Homo sapiens
caggcctgggtcccacggtacttgaggaag

SEQ ID NO: 36204 - DNA, 30 bp, Homo sapiens
gacaggagaaggtgcctctgagctttcgtt

SEQ ID NO: 36205 - DNA, 30 bp, Homo sapiens
agaaggttgagtgttgttgtgaaagccctg

SEQ ID NO: 36206 - DNA, 30 bp, Homo sapiens
gcagcagctccagctcctccagcggcaggc

SEQ ID NO: 36207 - DNA, 30 bp, Homo sapiens
tcttggggagcggagttcactgctgcccag

SEQ ID NO: 36208 - DNA, 30 bp, Homo sapiens
tcaccacctccacagcttggccgtccatgg

SEQ ID NO: 36209 - DNA, 30 bp, Homo sapiens
ttcaggcagagacagaaagggagtggacgt

SEQ ID NO: 36210 - DNA, 30 bp, Homo sapiens
aaatggggaatggaagaagatctaagatga

SEQ ID NO: 36211 - DNA, 30 bp, Homo sapiens
actatgaggagagtctcggtaggaatcagg

SEQ ID NO: 36212 - DNA, 30 bp, Homo sapiens
tcgaggggtttgaaaggtctttcaccatga

SEQ ID NO: 36213 - DNA, 30 bp, Homo sapiens
tcttggttagcaattacactagacagcctg

SEQ ID NO: 36214 - DNA, 30 bp, Homo sapiens
gagtggcgccgagtcctgcttggcccgcgg

SEQ ID NO: 36215 - DNA, 30 bp, Homo sapiens
acttggtcaatgcagagtctctttgtattt

SEQ ID NO: 36216 - DNA, 30 bp, Homo sapiens
accaggttgatatcatactggactgaactg

SEQ ID NO: 36217 - DNA, 30 bp, Homo sapiens
ctccgctggggccgccgcccgcgcctcccc

SEQ ID NO: 36218 - DNA, 30 bp, Homo sapiens
agtccataaacttctccatttgcgctgtgt

SEQ ID NO: 36219 - DNA, 30 bp, Homo sapiens
cactggccaggctcttggtacaaaggcagg

SEQ ID NO: 36220 - DNA, 30 bp, Homo sapiens
aaaagggatttcttccttgtctgtcttccc

SEQ ID NO: 36221 - DNA, 30 bp, Homo sapiens
gtcatgaagtaaacccggctgtggtgattg

SEQ ID NO: 36222 - DNA, 30 bp, Homo sapiens
cagaggaagaggtgggaggggtccccggac

SEQ ID NO: 36223 - DNA, 30 bp, Homo sapiens
tctgcctccccatcctggggccgagagagc

SEQ ID NO: 36224 - DNA, 30 bp, Homo sapiens
acctgcaaggccagggcagtgcaggccaca

SEQ ID NO: 36225 - DNA, 30 bp, Homo sapiens
agccaggcccaggtagagggtaaggaggaa

SEQ ID NO: 36226 - DNA, 30 bp, Homo sapiens
agaaggaaagccaggtcgctaaagctgccg

SEQ ID NO: 36227 - DNA, 30 bp, Homo sapiens
cagaggcctcaggaggtaggccagagccag

SEQ ID NO: 36228 - DNA, 30 bp, Homo sapiens
cccaggctctctcagaacaataaggtactc

SEQ ID NO: 36229 - DNA, 30 bp, Homo sapiens
tgtatggtgctgtctatgaccgtgggcttt

SEQ ID NO: 36230 - DNA, 30 bp, Homo sapiens
tgcctccgaataagtactctgtgtattcag

SEQ ID NO: 36231 - DNA, 30 bp, Homo sapiens
tgcctcggagcagcacttttggtggttcat

SEQ ID NO: 36232 - DNA, 30 bp, Homo sapiens
gcagtgcgagccacggtcttgctctagctt

SEQ ID NO: 36233 - DNA, 30 bp, Homo sapiens
cagaggcctccaagaacagcctacctttgg

SEQ ID NO: 36234 - DNA, 30 bp, Homo sapiens
cagtaaacggaggaccagtggcagcggctc

SEQ ID NO: 36235 - DNA, 30 bp, Homo sapiens
tagaggctggacattttgaaccctggacaa

SEQ ID NO: 36236 - DNA, 30 bp, Homo sapiens
tcttgggctggatagtctgcacagaagatt

SEQ ID NO: 36237 - DNA, 30 bp, Homo sapiens
cgcaggcgcactcgcgcgccgacagctcgt

SEQ ID NO: 36238 - DNA, 30 bp, Homo sapiens
gagtggaaaaggaacagagcccataccttg

SEQ ID NO: 36239 - DNA, 30 bp, Homo sapiens
tcgcccatcatcaggtgcgccagaccttcc

SEQ ID NO: 36240 - DNA, 30 bp, Homo sapiens
cctgagttgttatggagcacagaaggatca

SEQ ID NO: 36241 - DNA, 30 bp, Homo sapiens
tgctgggttgtttctcctttacaacagccc

SEQ ID NO: 36242 - DNA, 30 bp, Homo sapiens
ctttgttcttcttggccttgctgggcgtct

SEQ ID NO: 36243 - DNA, 30 bp, Homo sapiens
cttgtttttctgtttcttgtggccgctctt

SEQ ID NO: 36244 - DNA, 30 bp, Homo sapiens
ttttcaggattgttggtaacctgggcatat

SEQ ID NO: 36245 - DNA, 30 bp, Homo sapiens
gactggaaggagcctggttaagagctggaa

SEQ ID NO: 36246 - DNA, 30 bp, Homo sapiens
agctgggttcaaatccaacttgactggtgt

SEQ ID NO: 36247 - DNA, 30 bp, Homo sapiens
gtgactctccgccagcccctccgccgccgc

SEQ ID NO: 36248 - DNA, 30 bp, Homo sapiens
tctcagttaaggatgcagaaggagatgaac

SEQ ID NO: 36249 - DNA, 30 bp, Homo sapiens
tttcctcaatcgctgcggagacggagctgt

SEQ ID NO: 36250 - DNA, 30 bp, Homo sapiens
tcttgtgattcccatttacattttatcttg

SEQ ID NO: 36251 - DNA, 30 bp, Homo sapiens
cttgaccctccgcaggtggcgaaagctctg

SEQ ID NO: 36252 - DNA, 30 bp, Homo sapiens
tctcttaagagggccaagaattttctcaca

SEQ ID NO: 36253 - DNA, 30 bp, Homo sapiens
cacgatgacagcattgagcaggttggcttc

SEQ ID NO: 36254 - DNA, 30 bp, Homo sapiens
aagctgacttctcagccgcttcagtctcct

SEQ ID NO: 36255 - DNA, 30 bp, Homo sapiens
tagtggccctgggtcttgggcggcttgggc

SEQ ID NO: 36256 - DNA, 30 bp, Homo sapiens
ctgcccctagagctagtccaccaggcttgg

SEQ ID NO: 36257 - DNA, 30 bp, Homo sapiens
ctactgtttcccctctgcatttcaaatttt

SEQ ID NO: 36258 - DNA, 30 bp, Homo sapiens
tgcaggcaaggactggatcagggtcatatt

SEQ ID NO: 36259 - DNA, 30 bp, Homo sapiens
caatggataccattttctctgggggcagtc

SEQ ID NO: 36260 - DNA, 30 bp, Homo sapiens
ctgtgatgatactgctacactgttcattca

SEQ ID NO: 36261 - DNA, 30 bp, Homo sapiens
gcctggaccgcagggactttttgttcgatt

SEQ ID NO: 36262 - DNA, 30 bp, Homo sapiens
actcggaatgacgatgtcttttcttgttat

SEQ ID NO: 36263 - DNA, 30 bp, Homo sapiens
ttcaaaaagccgaaccaaagcaaagcatgt

SEQ ID NO: 36264 - DNA, 30 bp, Homo sapiens
aagaggatggagctgggccactaggctgag

SEQ ID NO: 36265 - DNA, 30 bp, Homo sapiens
acttggcttctgctgcctctgacttggagt

SEQ ID NO: 36266 - DNA, 30 bp, Homo sapiens
cacaggacgtcgtcaaagtccagcagcttc

SEQ ID NO: 36267 - DNA, 30 bp, Homo sapiens
ccatctgcctggccaagtacctgtctctag

SEQ ID NO: 36268 - DNA, 30 bp, Homo sapiens
caccggggtggatggacccccgccgggtca

SEQ ID NO: 36269 - DNA, 30 bp, Homo sapiens
tcctgtgctccatgatttcttcaatttggc

SEQ ID NO: 36270 - DNA, 30 bp, Homo sapiens
cattttgcagaagtacatggggccaaaatt

SEQ ID NO: 36271 - DNA, 30 bp, Homo sapiens
ccttggcacctcgacccgttcaattacagc

SEQ ID NO: 36272 - DNA, 30 bp, Homo sapiens
gcccggagcctctgctatgtgcaaggcggt

SEQ ID NO: 36273 - DNA, 30 bp, Homo sapiens
gcaaggcggtgtgcaagcaccggctgcggc

SEQ ID NO: 36274 - DNA, 30 bp, Homo sapiens
gagtccttattagccagacgcaacatgtct

SEQ ID NO: 36275 - DNA, 30 bp, Homo sapiens
ccgaggaggcctgagtagggaggaaggtgt

SEQ ID NO: 36276 - DNA, 30 bp, Homo sapiens
agaagggtcccgctgtaaggttgtccttta

SEQ ID NO: 36277 - DNA, 30 bp, Homo sapiens
cattcccgctgcgcagctccgcgcttgcta

SEQ ID NO: 36278 - DNA, 30 bp, Homo sapiens
ttgcaggtgcagtccgccggggtgtctgtg

SEQ ID NO: 36279 - DNA, 30 bp, Homo sapiens
gctgcgatggaacctaacctctgtgcccct

SEQ ID NO: 36280 - DNA, 30 bp, Homo sapiens
cctaggctcttcctctgtgccccttcaatg

SEQ ID NO: 36281 - DNA, 30 bp, Homo sapiens
tattcttcctcctcctcctcctcttcatca

SEQ ID NO: 36282 - DNA, 30 bp, Homo sapiens
cattggccactccatctgccattcttaagt

SEQ ID NO: 36283 - DNA, 30 bp, Homo sapiens
caggggccttgcatctccagctggaccccc

SEQ ID NO: 36284 - DNA, 30 bp, Homo sapiens
cagtggaggatttggatagtagccagctgt

SEQ ID NO: 36285 - DNA, 30 bp, Homo sapiens
cagcggatgtgggccatgtcaccaaggaag

SEQ ID NO: 36286 - DNA, 30 bp, Homo sapiens
acttggcctgggcctcctgcaggagagggg

SEQ ID NO: 36287 - DNA, 30 bp, Homo sapiens
agatggcagaagacaaacagctctttgctg

SEQ ID NO: 36288 - DNA, 30 bp, Homo sapiens
cagtgacttcctgtggaaaacttgatccga

SEQ ID NO: 36289 - DNA, 30 bp, Homo sapiens
cagcagggccgcttgctgtccagaatggcc

SEQ ID NO: 36290 - DNA, 30 bp, Homo sapiens
gaagagatcttttcccacaagccatcttca

SEQ ID NO: 36291 - DNA, 30 bp, Homo sapiens
tttctcgacaaggcacacacacaggacgtg

SEQ ID NO: 36292 - DNA, 30 bp, Homo sapiens
gcccggccagtccggctgaggagtgtgcag

SEQ ID NO: 36293 - DNA, 30 bp, Homo sapiens
gagaccctgggcggccgggcagagggcttg

SEQ ID NO: 36294 - DNA, 30 bp, Homo sapiens
aagaggcagcagccagacgcagcctgccct

SEQ ID NO: 36295 - DNA, 30 bp, Homo sapiens
cagagcacagtctcaccaaatagcatgatg

SEQ ID NO: 36296 - DNA, 30 bp, Homo sapiens
catctcagggcaaagctatagacatggtag

SEQ ID NO: 36297 - DNA, 30 bp, Homo sapiens
tcctgggccatgttgtctttgatgacgatg

SEQ ID NO: 36298 - DNA, 30 bp, Homo sapiens
tgcacttgcccttcttctcacgctgctgga

SEQ ID NO: 36299 - DNA, 30 bp, Homo sapiens
aggcggcgctgcagcgcccccgccgttcgc

SEQ ID NO: 36300 - DNA, 30 bp, Homo sapiens
cttttcttccaagagaaggtttccagtgct

SEQ ID NO: 36301 - DNA, 30 bp, Homo sapiens
ctccggcctggggctgggtgtgggtgcccg

SEQ ID NO: 36302 - DNA, 30 bp, Homo sapiens
acaccagggggctggcggttcccagcagcg

SEQ ID NO: 36303 - DNA, 30 bp, Homo sapiens
cagcggcccaggcgggcggccagccccagc

SEQ ID NO: 36304 - DNA, 30 bp, Homo sapiens
ttaaggctaatttgatcttttaaacatttt

SEQ ID NO: 36305 - DNA, 30 bp, Homo sapiens
gctctgcacgcacgtcacgatatctggcag

SEQ ID NO: 36306 - DNA, 30 bp, Homo sapiens
agcccaggacatccaggtagacaggaggtg

SEQ ID NO: 36307 - DNA, 30 bp, Homo sapiens
tcttgggggaacctctgggccatgtgtctg

SEQ ID NO: 36308 - DNA, 30 bp, Homo sapiens
cctagaatgtccaggtagaccggagatgcc

SEQ ID NO: 36309 - DNA, 30 bp, Homo sapiens
cagtgggatcttatgaaacaaaacaaaacc

SEQ ID NO: 36310 - DNA, 30 bp, Homo sapiens
aataatccgtgctgtagacatctctggaca

SEQ ID NO: 36311 - DNA, 30 bp, Homo sapiens
gccaagaatgtccaggtagattggggtggc

SEQ ID NO: 36312 - DNA, 30 bp, Homo sapiens
cgtcctttgctgaaataaacattgacatcc

SEQ ID NO: 36313 - DNA, 30 bp, Homo sapiens
ttctgggtttattctcatacagctgccgtt

SEQ ID NO: 36314 - DNA, 30 bp, Homo sapiens
acagcgtctcgcgggtggcattgctggaga

SEQ ID NO: 36315 - DNA, 30 bp, Homo sapiens
gtccgggtttctgggggatccccaaagcct

SEQ ID NO: 36316 - DNA, 30 bp, Homo sapiens
cttgcttgtagacctgagtcacatcatcca

SEQ ID NO: 36317 - DNA, 30 bp, Homo sapiens
aggtgagctttgagcagaccctcagtgcct

SEQ ID NO: 36318 - DNA, 30 bp, Homo sapiens
ttgagtcaagatagtcttcctcatgctctg

SEQ ID NO: 36319 - DNA, 30 bp, Homo sapiens
acgtggctggggaatctggggcgtcaatga

SEQ ID NO: 36320 - DNA, 30 bp, Homo sapiens
atgaggttctcttcttttgactgatggaga

SEQ ID NO: 36321 - DNA, 30 bp, Homo sapiens
actgtgtggacacgcggctgccaggggcac

SEQ ID NO: 36322 - DNA, 30 bp, Homo sapiens
caggggaggcacgcgggcgtcgcgtccaga

SEQ ID NO: 36323 - DNA, 30 bp, Homo sapiens
tgaaggtgatggcaatcttcttaccacttc

SEQ ID NO: 36324 - DNA, 30 bp, Homo sapiens
tgctggggcacctcaacctcagggagccgc

SEQ ID NO: 36325 - DNA, 30 bp, Homo sapiens
agctggccctgatggaggaattccttgttg

SEQ ID NO: 36326 - DNA, 30 bp, Homo sapiens
cagaaggggcttcatcttcagacccttcat

SEQ ID NO: 36327 - DNA, 30 bp, Homo sapiens
ccttggaaaaatccatctccggatgttgat

SEQ ID NO: 36328 - DNA, 30 bp, Homo sapiens
ctacttgcctgccttcctttctgttgtaaa

SEQ ID NO: 36329 - DNA, 30 bp, Homo sapiens
atctggtccacctttagtgtagtttcctga

SEQ ID NO: 36330 - DNA, 30 bp, Homo sapiens
ccccggggagatgttgaacatggcagggtc

SEQ ID NO: 36331 - DNA, 30 bp, Homo sapiens
agaccgtgtccacctcgcggagtgtgtagt

SEQ ID NO: 36332 - DNA, 30 bp, Homo sapiens
gcgaggatggggccatggagtttccattgg

SEQ ID NO: 36333 - DNA, 30 bp, Homo sapiens
ggatggggccatggagtttccattggttgg

SEQ ID NO: 36334 - DNA, 30 bp, Homo sapiens
gcttggtggcacaaagaatgcctgctgctt

SEQ ID NO: 36335 - DNA, 30 bp, Homo sapiens
actagggaagggccaatgctgggatgcata

SEQ ID NO: 36336 - DNA, 30 bp, Homo sapiens
taagcaggcagggaagaacaggtctgtttt

SEQ ID NO: 36337 - DNA, 30 bp, Homo sapiens
cactggagatccaggttgggggccacctgg

SEQ ID NO: 36338 - DNA, 30 bp, Homo sapiens
tgtggcgacccggcgcagatcagagggggc

SEQ ID NO: 36339 - DNA, 30 bp, Homo sapiens
agagatgatttcctttgtatcccaccagat

SEQ ID NO: 36340 - DNA, 30 bp, Homo sapiens
gaccacttgctctcctgaaagaaaaatgca

SEQ ID NO: 36341 - DNA, 30 bp, Homo sapiens
acatggatgagtgtgttctagaaaggatct

SEQ ID NO: 36342 - DNA, 30 bp, Homo sapiens
agaaaacattcccacgtccttccctccctc

SEQ ID NO: 36343 - DNA, 30 bp, Homo sapiens
gtgatgagctggaatcttaaggcctgaaat

SEQ ID NO: 36344 - DNA, 30 bp, Homo sapiens
aagaggaggccgggagcaacttctccaggg

SEQ ID NO: 36345 - DNA, 30 bp, Homo sapiens
tcacgaaggcgttgctcaggaagttgggga

SEQ ID NO: 36346 - DNA, 30 bp, Homo sapiens
ccctggtttgggggaagagggtccatgttc

SEQ ID NO: 36347 - DNA, 30 bp, Homo sapiens
tatctgttcactgggacaacagaggatccc

SEQ ID NO: 36348 - DNA, 30 bp, Homo sapiens
aaatggctttttcttactacagagttctta

SEQ ID NO: 36349 - DNA, 30 bp, Homo sapiens
ctatggagcaaagaaactggtgtccttctt

SEQ ID NO: 36350 - DNA, 30 bp, Homo sapiens
caacagctgagggagactagaaatgatggg

SEQ ID NO: 36351 - DNA, 30 bp, Homo sapiens
ggcgggagtagggctggggaccctagggcc

SEQ ID NO: 36352 - DNA, 30 bp, Homo sapiens
atcgagctctgagcagaaaccgagtatgtg

SEQ ID NO: 36353 - DNA, 30 bp, Homo sapiens
agatggcaacccagaggtctgtgcagcggt

SEQ ID NO: 36354 - DNA, 30 bp, Homo sapiens
aaatggctttgcatttgcatgtttcagtgc

SEQ ID NO: 36355 - DNA, 30 bp, Homo sapiens
taaactgctggaagttcttccacagtcagg

SEQ ID NO: 36356 - DNA, 30 bp, Homo sapiens
ggaataactcttcagaggatgctaatacat

SEQ ID NO: 36357 - DNA, 30 bp, Homo sapiens
catatcccccagctcacctcctccgagttg

SEQ ID NO: 36358 - DNA, 30 bp, Homo sapiens
ttcagtcctggagtggagctggcctgacag

SEQ ID NO: 36359 - DNA, 30 bp, Homo sapiens
gcatggcagtcagcttcagagtcctcgctc

SEQ ID NO: 36360 - DNA, 30 bp, Homo sapiens
cagttcagctgtcttctcatctatcttagc

SEQ ID NO: 36361 - DNA, 30 bp, Homo sapiens
acactgcaaaatcacatttctttcatgtcg

SEQ ID NO: 36362 - DNA, 30 bp, Homo sapiens
ttgatctggactatccatggcttcattgta

SEQ ID NO: 36363 - DNA, 30 bp, Homo sapiens
tcccgggggggccagccttgctgggggatg

SEQ ID NO: 36364 - DNA, 30 bp, Homo sapiens
ccttggctcgaggggtggcaccaatggcgg

SEQ ID NO: 36365 - DNA, 30 bp, Homo sapiens
cactggagaaagggttggtaggggagggat

SEQ ID NO: 36366 - DNA, 30 bp, Homo sapiens
tgcaggtcgccagaaaaggggttggagggt

SEQ ID NO: 36367 - DNA, 30 bp, Homo sapiens
tgggtcaagtccctggtctaggagcattag

SEQ ID NO: 36368 - DNA, 30 bp, Homo sapiens
gattggactttaagcttccaagctgatccg

SEQ ID NO: 36369 - DNA, 30 bp, Homo sapiens
tttcctgcgtctaacagcagtctttatctt

SEQ ID NO: 36370 - DNA, 30 bp, Homo sapiens
gatggcttgtactgctactgacgagctcat

SEQ ID NO: 36371 - DNA, 30 bp, Homo sapiens
cattttaagcggtagctatcaaagtatgct

SEQ ID NO: 36372 - DNA, 30 bp, Homo sapiens
cacaaggtccgacgatataataaatcccgt

SEQ ID NO: 36373 - DNA, 30 bp, Homo sapiens
ctttgcatatgccggacaaacgcctgcacc

SEQ ID NO: 36374 - DNA, 30 bp, Homo sapiens
tatcctcaagaggccacggatacgtctgac

SEQ ID NO: 36375 - DNA, 30 bp, Homo sapiens
tagtgggaggcataggctgggctccacagc

SEQ ID NO: 36376 - DNA, 30 bp, Homo sapiens
ccaatgttgcagccgactttgggccaatgg

SEQ ID NO: 36377 - DNA, 30 bp, Homo sapiens
gcttcgccagccaccaaaaccctggacaga

SEQ ID NO: 36378 - DNA, 30 bp, Homo sapiens
aaacatgtactccattgctttggatacaag

SEQ ID NO: 36379 - DNA, 30 bp, Homo sapiens
acaacagcttgtggtctcctccaattacac

SEQ ID NO: 36380 - DNA, 30 bp, Homo sapiens
acaagacaaggacctaaaacatccaaagtg

SEQ ID NO: 36381 - DNA, 30 bp, Homo sapiens
cgctggtttttacccgaatcaacatggtga

SEQ ID NO: 36382 - DNA, 30 bp, Homo sapiens
ctgatgtggatggtttcattcaatccatgt

SEQ ID NO: 36383 - DNA, 30 bp, Homo sapiens
ttgtttccagctggaggtttcttcaactga

SEQ ID NO: 36384 - DNA, 30 bp, Homo sapiens
caaaggtgatccggaagctgcgctcctgct

SEQ ID NO: 36385 - DNA, 30 bp, Homo sapiens
atctggtggagatctccacatgctcctcat

SEQ ID NO: 36386 - DNA, 30 bp, Homo sapiens
agtgagccttctcttataattgcccgagca

SEQ ID NO: 36387 - DNA, 30 bp, Homo sapiens
cccttatatgttcaccctcctctttcagga

SEQ ID NO: 36388 - DNA, 30 bp, Homo sapiens
atgaggacctccatctgcaccagcctcgca

SEQ ID NO: 36389 - DNA, 30 bp, Homo sapiens
cacaggctcccaacagccagttctcgcaga

SEQ ID NO: 36390 - DNA, 30 bp, Homo sapiens
ttctctacctgaggtggaggtgcaggtttg

SEQ ID NO: 36391 - DNA, 30 bp, Homo sapiens
aggtggaggctttaatggaatttttcccag

SEQ ID NO: 36392 - DNA, 30 bp, Homo sapiens
ccctcgcttcttcctctctgaattctgcag

SEQ ID NO: 36393 - DNA, 30 bp, Homo sapiens
tcttgggatgcagctggcgctggcggcgct

SEQ ID NO: 36394 - DNA, 30 bp, Homo sapiens
ctttcccagacgctgttcacaggctgcata

SEQ ID NO: 36395 - DNA, 30 bp, Homo sapiens
tgaggccccttcgcattcccaaaacctttg

SEQ ID NO: 36396 - DNA, 30 bp, Homo sapiens
ttgtgcagggcgagcctgaacatgtcattg

SEQ ID NO: 36397 - DNA, 30 bp, Homo sapiens
tactggctacgacgtcgtttcttccttctg

SEQ ID NO: 36398 - DNA, 30 bp, Homo sapiens
tactggctacaatgctgcttcttctccttc

SEQ ID NO: 36399 - DNA, 30 bp, Homo sapiens
catctgtcagtccctggagcatctgaaggg

SEQ ID NO: 36400 - DNA, 30 bp, Homo sapiens
catctgtcagtccccagagcatctgaaggg

SEQ ID NO: 36401 - DNA, 30 bp, Homo sapiens
tactggctacaatgccgcttcttcttcctc

SEQ ID NO: 36402 - DNA, 30 bp, Homo sapiens
caccggctgagggactcctgcaaacgttca

SEQ ID NO: 36403 - DNA, 30 bp, Homo sapiens
agcagggtgccgtgtagctcatctcgaatt

SEQ ID NO: 36404 - DNA, 30 bp, Homo sapiens
ccctgggcactttctgactccaagtcctgg

SEQ ID NO: 36405 - DNA, 30 bp, Homo sapiens
ctgtggcccctggcttctagggccgagcat

SEQ ID NO: 36406 - DNA, 30 bp, Homo sapiens
cccagggggtgaaggtccccaggaggggag

SEQ ID NO: 36407 - DNA, 30 bp, Homo sapiens
ttctgggatctcgcccttggccttgagatg

SEQ ID NO: 36408 - DNA, 30 bp, Homo sapiens
ccgcggggatcttgccctcggtctggagca

SEQ ID NO: 36409 - DNA, 30 bp, Homo sapiens
cgaaggcagcattttctgctgctcctggga

SEQ ID NO: 36410 - DNA, 30 bp, Homo sapiens
gagtggtcttaggctctggctctctgggcc

SEQ ID NO: 36411 - DNA, 30 bp, Homo sapiens
tagatgggctccggtttgagcttctctgct

SEQ ID NO: 36412 - DNA, 30 bp, Homo sapiens
ccccggccccgccctcctccccaccccctc

SEQ ID NO: 36413 - DNA, 30 bp, Homo sapiens
ctaaggctagagaatcacttgaacccagga

SEQ ID NO: 36414 - DNA, 30 bp, Homo sapiens
ccacccagtcctggaagcaggccaaccccc

SEQ ID NO: 36415 - DNA, 30 bp, Homo sapiens
acatgatcaggtgggtggatagtgtcagtg

SEQ ID NO: 36416 - DNA, 30 bp, Homo sapiens
cggtggatgggcattgttggtgcaatatgc

SEQ ID NO: 36417 - DNA, 30 bp, Homo sapiens
ccaaggggcacacaaaggacaagaacatgt

SEQ ID NO: 36418 - DNA, 30 bp, Homo sapiens
acatgttgaggtgggtgtacattatttgtg

SEQ ID NO: 36419 - DNA, 30 bp, Homo sapiens
tcccgagggaaagtaaggtgtgtcactgtg

SEQ ID NO: 36420 - DNA, 30 bp, Homo sapiens
gataagtatggggtctcactatggtaattg

SEQ ID NO: 36421 - DNA, 30 bp, Homo sapiens
cacccagatgggtagtagggggtatcacta

SEQ ID NO: 36422 - DNA, 30 bp, Homo sapiens
agtaggggtgctcactctggaagttatagt

SEQ ID NO: 36423 - DNA, 30 bp, Homo sapiens
tagctggcccagtcctggaagcggaagcag

SEQ ID NO: 36424 - DNA, 30 bp, Homo sapiens
ttgaaaacggaagcaatcacttgcaatctt

SEQ ID NO: 36425 - DNA, 30 bp, Homo sapiens
cagatggcggtgtcccagaggaccgtgtgc

SEQ ID NO: 36426 - DNA, 30 bp, Homo sapiens
gattggctaacgatgatggtacctggctct

SEQ ID NO: 36427 - DNA, 30 bp, Homo sapiens
cactgctccaagaccttgaaggacagcggg

SEQ ID NO: 36428 - DNA, 30 bp, Homo sapiens
cagtccatctgcaggccaaacaccacgtgc

SEQ ID NO: 36429 - DNA, 30 bp, Homo sapiens
tagcctgggtagggatcctcatcccagaga

SEQ ID NO: 36430 - DNA, 30 bp, Homo sapiens
atacctcctcgatcatcgcagatacatttt

SEQ ID NO: 36431 - DNA, 30 bp, Homo sapiens
tctcttcagaacagccacttctccagattt

SEQ ID NO: 36432 - DNA, 30 bp, Homo sapiens
gcagacgatcaagaccacatccaatcgttg

SEQ ID NO: 36433 - DNA, 30 bp, Homo sapiens
tattggtatagttccttctgccaaccagtg

SEQ ID NO: 36434 - DNA, 30 bp, Homo sapiens
acctgggttctgtcctggattatacaccag

SEQ ID NO: 36435 - DNA, 30 bp, Homo sapiens
cagaggatggtgcaggtccagtcctcttct

SEQ ID NO: 36436 - DNA, 30 bp, Homo sapiens
tcatggagaggggcagggatgaatggcagg

SEQ ID NO: 36437 - DNA, 30 bp, Homo sapiens
ttctggatgagaacatctcattgacaatag

SEQ ID NO: 36438 - DNA, 30 bp, Homo sapiens
tagaggttgcacagagctgtctggcacccg

SEQ ID NO: 36439 - DNA, 30 bp, Homo sapiens
gatgacttttaccggcactttccaaggtgg

SEQ ID NO: 36440 - DNA, 30 bp, Homo sapiens
ctggccatggctggatggggatgccattcc

SEQ ID NO: 36441 - DNA, 30 bp, Homo sapiens
ttcaggcactgggaggccctctgagcaacg

SEQ ID NO: 36442 - DNA, 30 bp, Homo sapiens
aactggctggaaacagagcctctcctttct

SEQ ID NO: 36443 - DNA, 30 bp, Homo sapiens
gaaagacaagatggtcttgttaataatttc

SEQ ID NO: 36444 - DNA, 30 bp, Homo sapiens
ccgaggccccggacccgggttactacagca

SEQ ID NO: 36445 - DNA, 30 bp, Homo sapiens
acacaataggcaaccctcaccctgagcccc

SEQ ID NO: 36446 - DNA, 30 bp, Homo sapiens
cctcaaagcgttggaataagcatgttcaag

SEQ ID NO: 36447 - DNA, 30 bp, Homo sapiens
gttcgagaacgcagcttcccgtctgcaggg

SEQ ID NO: 36448 - DNA, 30 bp, Homo sapiens
aggtgggtgggagcagggaagggtcatggc

SEQ ID NO: 36449 - DNA, 30 bp, Homo sapiens
gttcgggaacgcagcttcccgtctgcaggg

SEQ ID NO: 36450 - DNA, 30 bp, Homo sapiens
gcgcacctgggccaggttgtgcctcttgta

SEQ ID NO: 36451 - DNA, 30 bp, Homo sapiens
catccccatccctgtctgggcagatgtgaa

SEQ ID NO: 36452 - DNA, 30 bp, Homo sapiens
accagcagccgtgtgtgggtgctgtcctgg

SEQ ID NO: 36453 - DNA, 30 bp, Homo sapiens
gttcgtcgccatggggggaagcgggaccag

SEQ ID NO: 36454 - DNA, 30 bp, Homo sapiens
gagaggacggggcactcacgcctcacgctg

SEQ ID NO: 36455 - DNA, 30 bp, Homo sapiens
aagaggcccgatccccaagggacccagtga

SEQ ID NO: 36456 - DNA, 30 bp, Homo sapiens
caccaccacatgagccacaaggagataaca

SEQ ID NO: 36457 - DNA, 30 bp, Homo sapiens
acacggagccctcgctgtctccttggtcat

SEQ ID NO: 36458 - DNA, 30 bp, Homo sapiens
ggagcagattcattcatagaagaactgaat

SEQ ID NO: 36459 - DNA, 30 bp, Homo sapiens
ccttggacaatatgatcagtaataccagtg

SEQ ID NO: 36460 - DNA, 30 bp, Homo sapiens
cataggcctgactgaggggtcagtcttttg

SEQ ID NO: 36461 - DNA, 30 bp, Homo sapiens
tgaaggctgagagtctcccttctcacttaa

SEQ ID NO: 36462 - DNA, 30 bp, Homo sapiens
aggtaaggaggcagtgcgtgcaactttggg

SEQ ID NO: 36463 - DNA, 30 bp, Homo sapiens
tagccatataataccacttttataaaggat

SEQ ID NO: 36464 - DNA, 30 bp, Homo sapiens
atcttcttgatgtgtgacaatttgctcttt

SEQ ID NO: 36465 - DNA, 30 bp, Homo sapiens
tcctggaattcctctgctccaattttccca

SEQ ID NO: 36466 - DNA, 30 bp, Homo sapiens
tcttcttcgctcccaagcagaaagcccaga

SEQ ID NO: 36467 - DNA, 30 bp, Homo sapiens
atccaggcctatcatgcccagtatttcctt

SEQ ID NO: 36468 - DNA, 30 bp, Homo sapiens
cttaggctgtcagtcttgtccttctcttct

SEQ ID NO: 36469 - DNA, 30 bp, Homo sapiens
cagctttcctcagatgagcttcctctctgg

SEQ ID NO: 36470 - DNA, 30 bp, Homo sapiens
cacaggctgctctgtggcgtttcatcccac

SEQ ID NO: 36471 - DNA, 30 bp, Homo sapiens
ggaaaatcggcttccacagggataacacgg

SEQ ID NO: 36472 - DNA, 30 bp, Homo sapiens
ggcaggaggagatcgggagcggatgggaga

SEQ ID NO: 36473 - DNA, 30 bp, Homo sapiens
tcttggtatgcgggcccctgctcgggtcag

SEQ ID NO: 36474 - DNA, 30 bp, Homo sapiens
ctctggatcactgttcattttgcaaacaag

SEQ ID NO: 36475 - DNA, 30 bp, Homo sapiens
tctaaagcagcttccagttgtctggccaat

SEQ ID NO: 36476 - DNA, 30 bp, Homo sapiens
caaccagcaggggagtcatgtaatcagagt

SEQ ID NO: 36477 - DNA, 30 bp, Homo sapiens
cgtcggtcaccagcggggccaggtagtccg

SEQ ID NO: 36478 - DNA, 30 bp, Homo sapiens
tcacgaatgtcgatgaccagtgggcacagg

SEQ ID NO: 36479 - DNA, 30 bp, Homo sapiens
agcagcggccgggcagcctgtgccccgcag

SEQ ID NO: 36480 - DNA, 30 bp, Homo sapiens
gctcaggatccaggactccctcctgggtga

SEQ ID NO: 36481 - DNA, 30 bp, Homo sapiens
gtcgtctagttcttcatgagaaaagcctgt

SEQ ID NO: 36482 - DNA, 30 bp, Homo sapiens
tgttggtgagcggaactccatgctggaaca

SEQ ID NO: 36483 - DNA, 30 bp, Homo sapiens
tccaggtcgaaggccgtgtccaggaggcgc

SEQ ID NO: 36484 - DNA, 30 bp, Homo sapiens
caaaggcctggagattgaaggcagtatcca

SEQ ID NO: 36485 - DNA, 30 bp, Homo sapiens
aacctgttctgtttgggaaggttttctttt

SEQ ID NO: 36486 - DNA, 30 bp, Homo sapiens
ccgtggcgggctcctctcgggtgaagccat

SEQ ID NO: 36487 - DNA, 30 bp, Homo sapiens
tcgcatgtgtctctcccctctcgggcgggt

SEQ ID NO: 36488 - DNA, 30 bp, Homo sapiens
tacgggaacgctgggtcctcgatgccatgg

SEQ ID NO: 36489 - DNA, 30 bp, Homo sapiens
ggcttcccagacttggcagaagactccacc

SEQ ID NO: 36490 - DNA, 30 bp, Homo sapiens
tcatggcaatttgtatttccaggattttca

SEQ ID NO: 36491 - DNA, 30 bp, Homo sapiens
tagccttccggccctttggaaccctttctg

SEQ ID NO: 36492 - DNA, 30 bp, Homo sapiens
aatgcattgccaaggaggccctccaagtct

SEQ ID NO: 36493 - DNA, 30 bp, Homo sapiens
aggaggcatctgatccagccgcttgggccc

SEQ ID NO: 36494 - DNA, 30 bp, Homo sapiens
atatcccccaccccatcttgttgtgcaaac

SEQ ID NO: 36495 - DNA, 30 bp, Homo sapiens
gggaggacacctaggtacactcaccgcttg

SEQ ID NO: 36496 - DNA, 30 bp, Homo sapiens
agctggcttgcatcacatgaccaattactg

SEQ ID NO: 36497 - DNA, 30 bp, Homo sapiens
cccaggacgattggattgccctccaggcgt

SEQ ID NO: 36498 - DNA, 30 bp, Homo sapiens
aacaggcttaatcatgtggtcaggtttgtt

SEQ ID NO: 36499 - DNA, 30 bp, Homo sapiens
ttctggcttggactggtcaggagtcacttc

SEQ ID NO: 36500 - DNA, 30 bp, Homo sapiens
agtcgatgcggatcgggccgcctgttagcg

SEQ ID NO: 36501 - DNA, 30 bp, Homo sapiens
ttgaggtgtgttaaatttgaagaagataat

SEQ ID NO: 36502 - DNA, 30 bp, Homo sapiens
cgcaggatccagaagataaaagtgaccccc

SEQ ID NO: 36503 - DNA, 30 bp, Homo sapiens
cgtcggagcggatgacgtggaagagggtca

SEQ ID NO: 36504 - DNA, 30 bp, Homo sapiens
actgcctggccaggtgttgcttatgactct

SEQ ID NO: 36505 - DNA, 30 bp, Homo sapiens
caggggtccccagaggtgctgatgacgtga

SEQ ID NO: 36506 - DNA, 30 bp, Homo sapiens
tgtcatcctctgtcttgatgatatggaaaa

SEQ ID NO: 36507 - DNA, 30 bp, Homo sapiens
tactggggcttctgcaagacagaaagatca

SEQ ID NO: 36508 - DNA, 30 bp, Homo sapiens
cagaggcagctttctctttgtctggagttt

SEQ ID NO: 36509 - DNA, 30 bp, Homo sapiens
agaccacgaagtggagggtgtaggtgagct

SEQ ID NO: 36510 - DNA, 30 bp, Homo sapiens
agtaggcaaagatgacatggtaagtgacct

SEQ ID NO: 36511 - DNA, 30 bp, Homo sapiens
acctcctcctctttcttcctcatctccagc

SEQ ID NO: 36512 - DNA, 30 bp, Homo sapiens
acttggagaattgcgcctgcacggcggcca

SEQ ID NO: 36513 - DNA, 30 bp, Homo sapiens
acttggcgtcggaggtgaggcgcggcaggc

SEQ ID NO: 36514 - DNA, 30 bp, Homo sapiens
ccttggactcggccgacagccgggccatgt

SEQ ID NO: 36515 - DNA, 30 bp, Homo sapiens
acaagcacttctcttggctcttttcccagt

SEQ ID NO: 36516 - DNA, 30 bp, Homo sapiens
tcccagagccatgggtagctggggttcctc

SEQ ID NO: 36517 - DNA, 30 bp, Homo sapiens
cttaggtttgccttcttctgacatatactg

SEQ ID NO: 36518 - DNA, 30 bp, Homo sapiens
gtctggattagacagtggtggacaattaca

SEQ ID NO: 36519 - DNA, 30 bp, Homo sapiens
tgctccttcttgttctgggctctcatgagc

SEQ ID NO: 36520 - DNA, 30 bp, Homo sapiens
gacagccagcatgaccacaacattgagcaa

SEQ ID NO: 36521 - DNA, 30 bp, Homo sapiens
cggaggccttgaggttggcgggctccacac

SEQ ID NO: 36522 - DNA, 30 bp, Homo sapiens
tgctttggtacaagtgcttgatgaagaaga

SEQ ID NO: 36523 - DNA, 30 bp, Homo sapiens
tgctttggtacacgtgctggaggtggacga

SEQ ID NO: 36524 - DNA, 30 bp, Homo sapiens
agaaagtggccgtggcgccggcggggcccc

SEQ ID NO: 36525 - DNA, 30 bp, Homo sapiens
aacaggatcctggggagagtgggggtctga

SEQ ID NO: 36526 - DNA, 30 bp, Homo sapiens
gtttggactagaagataataatcctaactc

SEQ ID NO: 36527 - DNA, 30 bp, Homo sapiens
gaagagcttcaatgaaagcatcaagttttt

SEQ ID NO: 36528 - DNA, 30 bp, Homo sapiens
atttctcggacgccggcgcaactgggggtg

SEQ ID NO: 36529 - DNA, 30 bp, Homo sapiens
tcttggacgcaggcactgcgtgggaagcgg

SEQ ID NO: 36530 - DNA, 30 bp, Homo sapiens
catgggagtgaaagtgaaagcctgtcccaa

SEQ ID NO: 36531 - DNA, 30 bp, Homo sapiens
tccaggctcagtctgggcacaagccaccac

SEQ ID NO: 36532 - DNA, 30 bp, Homo sapiens
aagagggtccctgatagccagagacaagcc

SEQ ID NO: 36533 - DNA, 30 bp, Homo sapiens
ctttcatctccaggaagtctgccttgagaa

SEQ ID NO: 36534 - DNA, 30 bp, Homo sapiens
acacggcctcctgggcccggcgatactcat

SEQ ID NO: 36535 - DNA, 30 bp, Homo sapiens
tgcaggcgataccgaggacacagatgagac

SEQ ID NO: 36536 - DNA, 30 bp, Homo sapiens
agttggggccaacttgggtagacgagacag

SEQ ID NO: 36537 - DNA, 30 bp, Homo sapiens
caaaggacgaacttggattacatcaacttt

SEQ ID NO: 36538 - DNA, 30 bp, Homo sapiens
tcctggggtcctggctggggatcagcccct

SEQ ID NO: 36539 - DNA, 30 bp, Homo sapiens
cagcagaagacttcctgactgtggttacgg

SEQ ID NO: 36540 - DNA, 30 bp, Homo sapiens
caggcggcagcgccaccgccgggaccatcg

SEQ ID NO: 36541 - DNA, 30 bp, Homo sapiens
tactggtttattcatcccatcgatgtccct

SEQ ID NO: 36542 - DNA, 30 bp, Homo sapiens
catgcgggccgcggtaccgtctcagaggtc

SEQ ID NO: 36543 - DNA, 30 bp, Homo sapiens
tattggccgtggaggggtggtctctagtgt

SEQ ID NO: 36544 - DNA, 30 bp, Homo sapiens
agatttctgtcttctttctctctgatgatt

SEQ ID NO: 36545 - DNA, 30 bp, Homo sapiens
tagggcaacggagcagtttctgcttccaga

SEQ ID NO: 36546 - DNA, 30 bp, Homo sapiens
aagaggggtattgcagcaacatctatgaat

SEQ ID NO: 36547 - DNA, 30 bp, Homo sapiens
agacgggctgggagcagtatttccacgaag

SEQ ID NO: 36548 - DNA, 30 bp, Homo sapiens
gattagttctatccactgtattggccgtgg

SEQ ID NO: 36549 - DNA, 30 bp, Homo sapiens
catgtaatcattgcaggttttctcacgatg

SEQ ID NO: 36550 - DNA, 30 bp, Homo sapiens
gtatgctcacagttgagtaaagatgacttt

SEQ ID NO: 36551 - DNA, 30 bp, Homo sapiens
caagacgacccggcaagttggtcagcaaca

SEQ ID NO: 36552 - DNA, 30 bp, Homo sapiens
accaggaagtttccgaagagccccaccacg

SEQ ID NO: 36553 - DNA, 30 bp, Homo sapiens
tcctgggaagggaaatggagactgccctgc

SEQ ID NO: 36554 - DNA, 30 bp, Homo sapiens
tagtgggaaatgtaggtttggataacccgg

SEQ ID NO: 36555 - DNA, 30 bp, Homo sapiens
acttttaaaggctgggctgcttaatatagt

SEQ ID NO: 36556 - DNA, 30 bp, Homo sapiens
tacgtgaagcggccgatggggagccgaggc

SEQ ID NO: 36557 - DNA, 30 bp, Homo sapiens
cgtgaatctgtaacgtgtctatgtcaggca

SEQ ID NO: 36558 - DNA, 30 bp, Homo sapiens
gctagggccttagagaccgtcctgctgagg

SEQ ID NO: 36559 - DNA, 30 bp, Homo sapiens
catctcactgtttcgtaagctatagatgag

SEQ ID NO: 36560 - DNA, 30 bp, Homo sapiens
gtcctgtggataagccgcttcagtgcagcc

SEQ ID NO: 36561 - DNA, 30 bp, Homo sapiens
gccttcgccataatttcatcaaagccctct

SEQ ID NO: 36562 - DNA, 30 bp, Homo sapiens
gacagcccctttcacttcattgttcctcag

SEQ ID NO: 36563 - DNA, 30 bp, Homo sapiens
gagctcgcgcagatccccgcctggagcttg

SEQ ID NO: 36564 - DNA, 30 bp, Homo sapiens
gcctggttcttccaagtgccctcaccatgg

SEQ ID NO: 36565 - DNA, 30 bp, Homo sapiens
tgatatctttgttcctcagggtatatataa

SEQ ID NO: 36566 - DNA, 30 bp, Homo sapiens
caaatctccataggcaccgttttctggatg

SEQ ID NO: 36567 - DNA, 30 bp, Homo sapiens
acctgctgttatcctcttcagggcagactt

SEQ ID NO: 36568 - DNA, 30 bp, Homo sapiens
tcggagttcttgggcttctgagcattcttt

SEQ ID NO: 36569 - DNA, 30 bp, Homo sapiens
aggatgtgctactttgtctctaagtttcaa

SEQ ID NO: 36570 - DNA, 30 bp, Homo sapiens
gcaaatactgacccatttttcagcttcaac

SEQ ID NO: 36571 - DNA, 30 bp, Homo sapiens
tgttcctcagggtgtacacaacagggttga

SEQ ID NO: 36572 - DNA, 30 bp, Homo sapiens
gaatgtgctactttgtctctcagtttcaac

SEQ ID NO: 36573 - DNA, 30 bp, Homo sapiens
agaaggtcttcttcatggcgaccttcagct

SEQ ID NO: 36574 - DNA, 30 bp, Homo sapiens
ctgaggaatagagtgtgctgaggaaggtcc

SEQ ID NO: 36575 - DNA, 30 bp, Homo sapiens
actgaaaatgattgggctgaggaagggggt

SEQ ID NO: 36576 - DNA, 30 bp, Homo sapiens
tccttaggctgaaaatgattgggctaagga

SEQ ID NO: 36577 - DNA, 30 bp, Homo sapiens
gtttggtgaagcaagtcttcttcatggcga

SEQ ID NO: 36578 - DNA, 30 bp, Homo sapiens
aacagccctgcacagagcatctttgacctc

SEQ ID NO: 36579 - DNA, 30 bp, Homo sapiens
caacctctcttcattaaggagacagagttt

SEQ ID NO: 36580 - DNA, 30 bp, Homo sapiens
agagaggctttctgcccaaagctctgagca

SEQ ID NO: 36581 - DNA, 30 bp, Homo sapiens
actctgcatagggcatcctttacctccttg

SEQ ID NO: 36582 - DNA, 30 bp, Homo sapiens
gttcttcgtagggctgatttgaattcctta

SEQ ID NO: 36583 - DNA, 30 bp, Homo sapiens
tcctggcttgaggagtagttggactgaggc

SEQ ID NO: 36584 - DNA, 30 bp, Homo sapiens
caccaagtgtcgcagggccctcctcacgtc

SEQ ID NO: 36585 - DNA, 30 bp, Homo sapiens
agttggcgtcagaggctgctttacggataa

SEQ ID NO: 36586 - DNA, 30 bp, Homo sapiens
ttgcccaacacttttctgatagcaagttgg

SEQ ID NO: 36587 - DNA, 30 bp, Homo sapiens
gtagactctcggaagctgctgcacaaaagc

SEQ ID NO: 36588 - DNA, 30 bp, Homo sapiens
cacaggcattccaagaactcttttcaatgc

SEQ ID NO: 36589 - DNA, 30 bp, Homo sapiens
ggcatctttcagttccttgttcctcaaact

SEQ ID NO: 36590 - DNA, 30 bp, Homo sapiens
tgttctgggaaaggcagttcctggtaagaa

SEQ ID NO: 36591 - DNA, 30 bp, Homo sapiens
tcctcaggctgaatatgatggggctgagga

SEQ ID NO: 36592 - DNA, 30 bp, Homo sapiens
cccagcaatctccctctgaaagcattcctc

SEQ ID NO: 36593 - DNA, 30 bp, Homo sapiens
tgcctgatgcacctccttgttcctcatggt

SEQ ID NO: 36594 - DNA, 30 bp, Homo sapiens
actatatatcacagggttaagcagtggggt

SEQ ID NO: 36595 - DNA, 30 bp, Homo sapiens
aactttcctcagggctgcctttatctcctt

SEQ ID NO: 36596 - DNA, 30 bp, Homo sapiens
actttcctcagggctgcctttatctcctta

SEQ ID NO: 36597 - DNA, 30 bp, Homo sapiens
attatgttggaactccccagaactttcctc

SEQ ID NO: 36598 - DNA, 30 bp, Homo sapiens
aacaggacatttctcagagcgagtttcatg

SEQ ID NO: 36599 - DNA, 30 bp, Homo sapiens
cccaggactctctttagagcatctttcatg

SEQ ID NO: 36600 - DNA, 30 bp, Homo sapiens
ctctggataattctcattccacagaagaca

SEQ ID NO: 36601 - DNA, 30 bp, Homo sapiens
ttccttctcatgacctttctaacagcttct

SEQ ID NO: 36602 - DNA, 30 bp, Homo sapiens
ccaccttttcattgctctattaaaggcccc

SEQ ID NO: 36603 - DNA, 30 bp, Homo sapiens
gatcactctacccaaggcccccttcacttc

SEQ ID NO: 36604 - DNA, 30 bp, Homo sapiens
tagtggtgttgctgccagtctttaaacaac

SEQ ID NO: 36605 - DNA, 30 bp, Homo sapiens
ctgagggctgctttgacctccttgtttctc

SEQ ID NO: 36606 - DNA, 30 bp, Homo sapiens
gttcagtaggtgttttactgcctctttcac

SEQ ID NO: 36607 - DNA, 30 bp, Homo sapiens
gcatgggtgtcactaccccataaaacagag

SEQ ID NO: 36608 - DNA, 30 bp, Homo sapiens
atgggggtcacaaccccataaaacatggaa

SEQ ID NO: 36609 - DNA, 30 bp, Homo sapiens
tcacatccttgtttctaagactgtagatta

SEQ ID NO: 36610 - DNA, 30 bp, Homo sapiens
catccttgtttcgcagactatagatgagag

SEQ ID NO: 36611 - DNA, 30 bp, Homo sapiens
gttcggtaggtgttttactgcctctttcac

SEQ ID NO: 36612 - DNA, 30 bp, Homo sapiens
ctcaggactttctttacagcctctttgacc

SEQ ID NO: 36613 - DNA, 30 bp, Homo sapiens
tcacctctttgttccgtagactatagatga

SEQ ID NO: 36614 - DNA, 30 bp, Homo sapiens
taattcctgcctgcatctccctattctgga

SEQ ID NO: 36615 - DNA, 30 bp, Homo sapiens
tgcccgtttaacatctttttttctcaggct

SEQ ID NO: 36616 - DNA, 30 bp, Homo sapiens
ggcccgactcctgccccacaccttcctggc

SEQ ID NO: 36617 - DNA, 30 bp, Homo sapiens
atcaacatccccagagccacctttatggcc

SEQ ID NO: 36618 - DNA, 30 bp, Homo sapiens
gggaggcattatggaataaaaaccagaaag

SEQ ID NO: 36619 - DNA, 30 bp, Homo sapiens
acatggctgttttaatctccttattcctaa

SEQ ID NO: 36620 - DNA, 30 bp, Homo sapiens
acagcatcttcctcagtgctgccttcatgg

SEQ ID NO: 36621 - DNA, 30 bp, Homo sapiens
cgcagggcagccttcatgtcccgatttctc

SEQ ID NO: 36622 - DNA, 30 bp, Homo sapiens
tgtagggctgccttcatatcccaatttctc

SEQ ID NO: 36623 - DNA, 30 bp, Homo sapiens
cccattcaagcagcctgcagagtgcaccct

SEQ ID NO: 36624 - DNA, 30 bp, Homo sapiens
ttcatatccctgttccttagggtatagatg

SEQ ID NO: 36625 - DNA, 30 bp, Homo sapiens
gccccatgcatgtccttgttcctcaggctg

SEQ ID NO: 36626 - DNA, 30 bp, Homo sapiens
aaagggtctccataggactcttcccggagc

SEQ ID NO: 36627 - DNA, 30 bp, Homo sapiens
ctcagggctcccttcatgtctctgttcctc

SEQ ID NO: 36628 - DNA, 30 bp, Homo sapiens
acaaatgaccctttccagggctcccttcat

SEQ ID NO: 36629 - DNA, 30 bp, Homo sapiens
cccagggttccccctcatgtctctgttcct

SEQ ID NO: 36630 - DNA, 30 bp, Homo sapiens
tgccaactacttttttcagagcccctttca

SEQ ID NO: 36631 - DNA, 30 bp, Homo sapiens
ccagattaactttctcagggaagactttat

SEQ ID NO: 36632 - DNA, 30 bp, Homo sapiens
ctctgttcccagctagactctgaactcctc

SEQ ID NO: 36633 - DNA, 30 bp, Homo sapiens
cgcctgacctactcaagagttttcttaggg

SEQ ID NO: 36634 - DNA, 30 bp, Homo sapiens
ccaagggcctctttcatgtccctgttccta

SEQ ID NO: 36635 - DNA, 30 bp, Homo sapiens
tgaagagtctctccagggctccctttatgt

SEQ ID NO: 36636 - DNA, 30 bp, Homo sapiens
cccaatgagaagggctcggagtgccccctg

SEQ ID NO: 36637 - DNA, 30 bp, Homo sapiens
catcaactttgccaaaccctgcttcatgtc

SEQ ID NO: 36638 - DNA, 30 bp, Homo sapiens
ttcatgtctttgtttcttaaactgtagata

SEQ ID NO: 36639 - DNA, 30 bp, Homo sapiens
gctgtagatgaaagggttcagcatgggtgt

SEQ ID NO: 36640 - DNA, 30 bp, Homo sapiens
atttcttcaaacccctcttcatatctttgt

SEQ ID NO: 36641 - DNA, 30 bp, Homo sapiens
ctcaggccctgtttcaggtctttgtttctc

SEQ ID NO: 36642 - DNA, 30 bp, Homo sapiens
tcctgagagcccctttcaggtctctgttcc

SEQ ID NO: 36643 - DNA, 30 bp, Homo sapiens
actgaagagcctctttagggcccccttcat

SEQ ID NO: 36644 - DNA, 30 bp, Homo sapiens
acaaaaagtttacccaaagcctccttcatg

SEQ ID NO: 36645 - DNA, 30 bp, Homo sapiens
catgaagcctcccttgacatccccattcct

SEQ ID NO: 36646 - DNA, 30 bp, Homo sapiens
ctcagggcacctttcatatccttattcctc

SEQ ID NO: 36647 - DNA, 30 bp, Homo sapiens
caaaggactctctttagagcccctttcacc

SEQ ID NO: 36648 - DNA, 30 bp, Homo sapiens
cttcctcagtgccctcctcagggcgccctt

SEQ ID NO: 36649 - DNA, 30 bp, Homo sapiens
caccgttctcatggacctcttcctctggag

SEQ ID NO: 36650 - DNA, 30 bp, Homo sapiens
tagagtaccttggacttccttgttcctaag

SEQ ID NO: 36651 - DNA, 30 bp, Homo sapiens
ccagtgctctcctcagggcacccttgacct

SEQ ID NO: 36652 - DNA, 30 bp, Homo sapiens
cactcttttcagggcacccttgacctctgc

SEQ ID NO: 36653 - DNA, 30 bp, Homo sapiens
ctactcccagcactctcttcaaagtattct

SEQ ID NO: 36654 - DNA, 30 bp, Homo sapiens
ttgcagtcgttgaatgcactgggtgataac

SEQ ID NO: 36655 - DNA, 30 bp, Homo sapiens
agcgtggagtgtgctggcagcatgtatttt

SEQ ID NO: 36656 - DNA, 30 bp, Homo sapiens
gtatgtattttcccaggaccctcctcaagg

SEQ ID NO: 36657 - DNA, 30 bp, Homo sapiens
tcccaacagtctcctcactgcccccgtcac

SEQ ID NO: 36658 - DNA, 30 bp, Homo sapiens
ccttgaagggttgttttacctgttggttcc

SEQ ID NO: 36659 - DNA, 30 bp, Homo sapiens
acagcctgggtcttgagacatgattttggt

SEQ ID NO: 36660 - DNA, 30 bp, Homo sapiens
agcctccagatcctggccagaagtctcctc

SEQ ID NO: 36661 - DNA, 30 bp, Homo sapiens
gtaaggtaagtaagcactgtgtctttagca

SEQ ID NO: 36662 - DNA, 30 bp, Homo sapiens
tgaaggcctccttcatatctttatttctaa

SEQ ID NO: 36663 - DNA, 30 bp, Homo sapiens
ttttaaagccttcctttacctccttgttcc

SEQ ID NO: 36664 - DNA, 30 bp, Homo sapiens
tctcttcctttccccagcaacctcctcagt

SEQ ID NO: 36665 - DNA, 30 bp, Homo sapiens
tgcctgcagagccacagcagttctctaata

SEQ ID NO: 36666 - DNA, 30 bp, Homo sapiens
ggctactttcctcagagctgccttcacatc

SEQ ID NO: 36667 - DNA, 30 bp, Homo sapiens
agagaagcactttctcccaactagtttcct

SEQ ID NO: 36668 - DNA, 30 bp, Homo sapiens
ttgatgttaacccagagaatttccataata

SEQ ID NO: 36669 - DNA, 30 bp, Homo sapiens
ttggatgttaacccagagaatttctctaat

SEQ ID NO: 36670 - DNA, 30 bp, Homo sapiens
gcctttgctagaactttctttaatgcccct

SEQ ID NO: 36671 - DNA, 30 bp, Homo sapiens
agaagtttcctcagagcctctttcatatcc

SEQ ID NO: 36672 - DNA, 30 bp, Homo sapiens
ggctttgtccagcagcactacccagtatca

SEQ ID NO: 36673 - DNA, 30 bp, Homo sapiens
ttccctggagtctctttccttccctagtaa

SEQ ID NO: 36674 - DNA, 30 bp, Homo sapiens
gctttgtgtgagccccatttccttccccag

SEQ ID NO: 36675 - DNA, 30 bp, Homo sapiens
cacatcccccattcccaccccattagtctc

SEQ ID NO: 36676 - DNA, 30 bp, Homo sapiens
ctcccaccccaatagtctcttcgctgcccc

SEQ ID NO: 36677 - DNA, 30 bp, Homo sapiens
ccattagtctcttcactgcccctcttacaa

SEQ ID NO: 36678 - DNA, 30 bp, Homo sapiens
atttcttcatagcatctttgacttccttgt

SEQ ID NO: 36679 - DNA, 30 bp, Homo sapiens
ttcaggaaagagaatatcccaaacactctc

SEQ ID NO: 36680 - DNA, 30 bp, Homo sapiens
gtcagggcccccatcacctccttgtttctc

SEQ ID NO: 36681 - DNA, 30 bp, Homo sapiens
gcagattctctgactcactcgtgtcagggc

SEQ ID NO: 36682 - DNA, 30 bp, Homo sapiens; identical to SEQ ID NO: 36680

SEQ ID NO: 36683 - DNA, 30 bp, Homo sapiens
gtcagggcccccatcacctccttgttcctc

SEQ ID NO: 36684 - DNA, 30 bp, Homo sapiens
atcttcatgaatgctctagtcacctccttg

SEQ ID NO: 36685 - DNA, 30 bp, Homo sapiens
ttgccctttcctaagatcttcatgaatgct

SEQ ID NO: 36686 - DNA, 30 bp, Homo sapiens
gtagtgccctgaacacttctttgttgcgga

SEQ ID NO: 36687 - DNA, 30 bp, Homo sapiens
ttgccctttcctaacactttcctgagtgct

SEQ ID NO: 36688 - DNA, 30 bp, Homo sapiens
ctgagtgaagccttttggtctcagcagtct

SEQ ID NO: 36689 - DNA, 30 bp, Homo sapiens
gacaccctttgaggacccttgaacctcccc

SEQ ID NO: 36690 - DNA, 30 bp, Homo sapiens
tgacatccttattcctgaaactgtaaatga

SEQ ID NO: 36691 - DNA, 30 bp, Homo sapiens
taaatgcccctatgacgtccttgtttctga

SEQ ID NO: 36692 - DNA, 30 bp, Homo sapiens
ggcctcattttgctggtgttttaggtttac

SEQ ID NO: 36693 - DNA, 30 bp, Homo sapiens
ctgatcacagtcgccaccctgatgctctgg

SEQ ID NO: 36694 - DNA, 30 bp, Homo sapiens
ctgaggacacacacctccccacaaccttct

SEQ ID NO: 36695 - DNA, 30 bp, Homo sapiens
tgacatccttattcctaagactatagatta

SEQ ID NO: 36696 - DNA, 30 bp, Homo sapiens
agccctggtgacatctttgttgcggagact

SEQ ID NO: 36697 - DNA, 30 bp, Homo sapiens
ctttttgaaaggcaggttccactgttaaca

SEQ ID NO: 36698 - DNA, 30 bp, Homo sapiens
ctctcttcaaggcacccatcacatccctgt

SEQ ID NO: 36699 - DNA, 30 bp, Homo sapiens
accgacccatacaccttgtcagggctccct

SEQ ID NO: 36700 - DNA, 30 bp, Homo sapiens
ctgcagcggtccagccccttcctcagtgcc

SEQ ID NO: 36701 - DNA, 30 bp, Homo sapiens
agcgggttgagacttggagtgatgacggtg

SEQ ID NO: 36702 - DNA, 30 bp, Homo sapiens
ctagctctctcttccccagaagcaaccttc

SEQ ID NO: 36703 - DNA, 30 bp, Homo sapiens
gttgaggctccccagcccctttctcccacc

SEQ ID NO: 36704 - DNA, 30 bp, Homo sapiens
gtccctgcccctccatagtactttccacag

SEQ ID NO: 36705 - DNA, 30 bp, Homo sapiens
tccagctctgctaagcactttgaccaaagc

SEQ ID NO: 36706 - DNA, 30 bp, Homo sapiens
accgcctccctgtgagcatcctccagatgg

SEQ ID NO: 36707 - DNA, 30 bp, Homo sapiens
aggtcagtgatctcctccccaaaaatattt

SEQ ID NO: 36708 - DNA, 30 bp, Homo sapiens
aagtagctgacacagagcgccctgaacatc

SEQ ID NO: 36709 - DNA, 30 bp, Homo sapiens
cccagctaagcttacttttttactccaaag

SEQ ID NO: 36710 - DNA, 30 bp, Homo sapiens
atttgttgccttagaactaggaataaatat

SEQ ID NO: 36711 - DNA, 30 bp, Homo sapiens
cttcttcatagcacttgtcatctcagaatt

SEQ ID NO: 36712 - DNA, 30 bp, Homo sapiens
atgaggacggacactcctcctataataaat

SEQ ID NO: 36713 - DNA, 30 bp, Homo sapiens
ctggattctcctttttgctccacaatcttc

SEQ ID NO: 36714 - DNA, 30 bp, Homo sapiens
cataactttctcatggcatttttcacttct

SEQ ID NO: 36715 - DNA, 30 bp, Homo sapiens
cttccttattgcactttttacctcagcatt

SEQ ID NO: 36716 - DNA, 30 bp, Homo sapiens
tcaaggtgtagattaaggggtttaacatag

SEQ ID NO: 36717 - DNA, 30 bp, Homo sapiens
tcagtctgttccatattctcctcatggcct

SEQ ID NO: 36718 - DNA, 30 bp, Homo sapiens
cttcctcatggcacttttcacttctgtatt

SEQ ID NO: 36719 - DNA, 30 bp, Homo sapiens
aaagagctttctcatggcattttttacctc

SEQ ID NO: 36720 - DNA, 30 bp, Homo sapiens
cagtggggaaggaggttagaggtcttagat

SEQ ID NO: 36721 - DNA, 30 bp, Homo sapiens
atgtcctttctactacacaatttcctgatg

SEQ ID NO: 36722 - DNA, 30 bp, Homo sapiens
attatttggctccagagctgcttcatggca

SEQ ID NO: 36723 - DNA, 30 bp, Homo sapiens
caaagcctcccatttcatccagagtttctt

SEQ ID NO: 36724 - DNA, 30 bp, Homo sapiens
aaattactaggcacttgcctaatctcctca

SEQ ID NO: 36725 - DNA, 30 bp, Homo sapiens
tcatggctgacttcatctcatggttcctca

SEQ ID NO: 36726 - DNA, 30 bp, Homo sapiens
cagaaggcacgagtcttctcttcagtcttc

SEQ ID NO: 36727 - DNA, 30 bp, Homo sapiens
ggtgtctccctaatcttctcactgctgcct

SEQ ID NO: 36728 - DNA, 30 bp, Homo sapiens
tccaggggaccaatagggtcctttttcctc

SEQ ID NO: 36729 - DNA, 30 bp, Homo sapiens
ttttctgctctcggaaggcccaagtctcct

SEQ ID NO: 36730 - DNA, 30 bp, Homo sapiens
tgattgtcctagccgtctcttcagtttcct

SEQ ID NO: 36731 - DNA, 30 bp, Homo sapiens
taacttgtttaaggcactcttcatttcttc

SEQ ID NO: 36732 - DNA, 30 bp, Homo sapiens
ctgcttcatggcactttttacctcctcatt

SEQ ID NO: 36733 - DNA, 30 bp, Homo sapiens
tgccactttcatgtctttgttcctgaatgt

SEQ ID NO: 36734 - DNA, 30 bp, Homo sapiens
tcatgtctttgttcctcagtgtgtatataa

SEQ ID NO: 36735 - DNA, 30 bp, Homo sapiens
acatgggtggaccaaagaacaaaaggacca

SEQ ID NO: 36736 - DNA, 30 bp, Homo sapiens
gtaaatcactagctgtttgcatactctctt

SEQ ID NO: 36737 - DNA, 30 bp, Homo sapiens
ttctcagccgtcttattgccgtcttcatgt

SEQ ID NO: 36738 - DNA, 30 bp, Homo sapiens
aacgggagtgataactgcatcaaagatggc

SEQ ID NO: 36739 - DNA, 30 bp, Homo sapiens
tttttccaggagttcacatgacggtttctc

SEQ ID NO: 36740 - DNA, 30 bp, Homo sapiens
atctgctgaagggccagacgtagataaaga

SEQ ID NO: 36741 - DNA, 30 bp, Homo sapiens
ggttttgcagtttcttcatagctgctttca

SEQ ID NO: 36742 - DNA, 30 bp, Homo sapiens
actaggcttcagataccgactcttcagttt

SEQ ID NO: 36743 - DNA, 30 bp, Homo sapiens
tcatggatatcttcatttctttgtttctca

SEQ ID NO: 36744 - DNA, 30 bp, Homo sapiens
ggctatctttacttcttgattcctcaaagt

SEQ ID NO: 36745 - DNA, 30 bp, Homo sapiens
tcatggaatacttgacatctttattcctaa

SEQ ID NO: 36746 - DNA, 30 bp, Homo sapiens
cctcaggtaatggttcacaattttccttac

SEQ ID NO: 36747 - DNA, 30 bp, Homo sapiens
tattggaaccgtaattttcttatggcctct

SEQ ID NO: 36748 - DNA, 30 bp, Homo sapiens
tcctcatggctgcctttacttccttgtttc

SEQ ID NO: 36749 - DNA, 30 bp, Homo sapiens; identical to SEQ ID NO: 36748

SEQ ID NO: 36750 - DNA, 30 bp, Homo sapiens
tcatggaagctttcacttcctggttgcgaa

SEQ ID NO: 36751 - DNA, 30 bp, Homo sapiens
gacagactacatgtcgactcaataacctct

SEQ ID NO: 36752 - DNA, 30 bp, Homo sapiens
tcatggaagctttcacctcctggttgcgaa

SEQ ID NO: 36753 - DNA, 30 bp, Homo sapiens
tttcctcatggcgttcttcatctctgtgtt

SEQ ID NO: 36754 - DNA, 30 bp, Homo sapiens
ttttccaagtaagcccatttctgacccaga

SEQ ID NO: 36755 - DNA, 30 bp, Homo sapiens
acatggttttatcctcagcttcttcatagc

SEQ ID NO: 36756 - DNA, 30 bp, Homo sapiens
agctcctcttgaccctaaacagcttcctca

SEQ ID NO: 36757 - DNA, 30 bp, Homo sapiens
agcctccaagaaaacatttctgccccacag

SEQ ID NO: 36758 - DNA, 30 bp, Homo sapiens
ataaatctcctcatggcatttttcacttca

SEQ ID NO: 36759 - DNA, 30 bp, Homo sapiens
ccacagcctcttcatggccttcctcatttc

SEQ ID NO: 36760 - DNA, 30 bp, Homo sapiens
cggaggtacaagtaggagaacatttgccat

SEQ ID NO: 36761 - DNA, 30 bp, Homo sapiens
cagtggaggtacaagtaggagaacatttgc

SEQ ID NO: 36762 - DNA, 30 bp, Homo sapiens
acattaagcaacttccccaagatcttctcc

SEQ ID NO: 36763 - DNA, 30 bp, Homo sapiens
tttagataaaaggcggataatgccatattg

SEQ ID NO: 36764 - DNA, 30 bp, Homo sapiens
tctgcccagaaaataggcgaataatgcttc

SEQ ID NO: 36765 - DNA, 30 bp, Homo sapiens
ctatgggtagtaaaaaggtgaagaatggca

SEQ ID NO: 36766 - DNA, 30 bp, Homo sapiens
tgaatctgcttagttttaatgctatagata

SEQ ID NO: 36767 - DNA, 30 bp, Homo sapiens
tgtgagaacatacagaggacccttgaacag

SEQ ID NO: 36768 - DNA, 30 bp, Homo sapiens
gctctgaagcgtgtgtggccacatggaaaa

SEQ ID NO: 36769 - DNA, 30 bp, Homo sapiens
acagcctgcaagtccttgtcacagctgatc

SEQ ID NO: 36770 - DNA, 30 bp, Homo sapiens
ttgcggatttgttttgtttttacactgtcg

SEQ ID NO: 36771 - DNA, 30 bp, Homo sapiens
cacaggagggattagcagaaagacattggc

SEQ ID NO: 36772 - DNA, 30 bp, Homo sapiens
aaaaacacctaagtgactttataaactgaa

SEQ ID NO: 36773 - DNA, 30 bp, Homo sapiens
tcccggatctgtttggtcttcacactgtag

SEQ ID NO: 36774 - DNA, 30 bp, Homo sapiens
caatggggtttagcacaggcgggagcagta

SEQ ID NO: 36775 - DNA, 30 bp, Homo sapiens
gcctgggatttatggaagaacttgagaatc

SEQ ID NO: 36776 - DNA, 30 bp, Homo sapiens
atgcggaaaatggctcggcggatttccttt

SEQ ID NO: 36777 - DNA, 30 bp, Homo sapiens
caatggcaccatggatctccttggtcttaa

SEQ ID NO: 36778 - DNA, 30 bp, Homo sapiens
ccttaggacaaacttgtggagaattcctag

SEQ ID NO: 36779 - DNA, 30 bp, Homo sapiens
tactggcctttttaagacctaggaacttga

SEQ ID NO: 36780 - DNA, 30 bp, Homo sapiens
tggatctgcttgttctttacactgtaaatg

SEQ ID NO: 36781 - DNA, 30 bp, Homo sapiens
accttcctgggctgcaacctgttgagtatt

SEQ ID NO: 36782 - DNA, 30 bp, Homo sapiens
ttcccctaagacccctcacattaaaacccc

SEQ ID NO: 36783 - DNA, 30 bp, Homo sapiens
ttctggtatgaatctgttgggtcttgacac

SEQ ID NO: 36784 - DNA, 30 bp, Homo sapiens
gaatgcgaatctgtgtggtctttgcaccat

SEQ ID NO: 36785 - DNA, 30 bp, Homo sapiens
gcttggtcttcactccatagacaatagggt

SEQ ID NO: 36786 - DNA, 30 bp, Homo sapiens
ggggaggtacagcaccaagtcttgatgtca

SEQ ID NO: 36787 - DNA, 30 bp, Homo sapiens
gttcctggatttgcttggttttgatcccat

SEQ ID NO: 36788 - DNA, 30 bp, Homo sapiens
ccagtattggcttagtcctcactccataaa

SEQ ID NO: 36789 - DNA, 30 bp, Homo sapiens
cccaggtgaagcagttttagaagtcgactc

SEQ ID NO: 36790 - DNA, 30 bp, Homo sapiens
gtttggttctgacaccataaattacagagt

SEQ ID NO: 36791 - DNA, 30 bp, Homo sapiens
atgtattaggtactcttccttttccattcc

SEQ ID NO: 36792 - DNA, 30 bp, Homo sapiens
gcttggtcctgactccataaatgacagggt

SEQ ID NO: 36793 - DNA, 30 bp, Homo sapiens
cactgtctccctaatatgtttggttctgac

SEQ ID NO: 36794 - DNA, 30 bp, Homo sapiens
cactctctctcgaatctgctttgtcctgac

SEQ ID NO: 36795 - DNA, 30 bp, Homo sapiens
ctctgatctgcttggtcttcactccgtaaa

SEQ ID NO: 36796 - DNA, 30 bp, Homo sapiens
ttggagtggtcaaagaggaagtgcatcaga

SEQ ID NO: 36797 - DNA, 30 bp, Homo sapiens
cccaggttggaatggtcaaagaggacatgc

SEQ ID NO: 36798 - DNA, 30 bp, Homo sapiens
gtttggtcctcaccccataaatgatggggt

SEQ ID NO: 36799 - DNA, 30 bp, Homo sapiens
acatgttctttctctggaatagactgagca

SEQ ID NO: 36800 - DNA, 30 bp, Homo sapiens
acatatcctttcttgggaatactcccaaga

SEQ ID NO: 36801 - DNA, 30 bp, Homo sapiens
gtgtaaacactctgagcactcgctggcgga

SEQ ID NO: 36802 - DNA, 30 bp, Homo sapiens
tatttggagaaggctctctcggatctgctt

SEQ ID NO: 36803 - DNA, 30 bp, Homo sapiens
ccttaagaaagaacctaatgacactttctc

SEQ ID NO: 36804 - DNA, 30 bp, Homo sapiens
tgaatctgcttggtcttgactccataaaca

SEQ ID NO: 36805 - DNA, 30 bp, Homo sapiens
tgtaggatttggtatccttagaacctgaaa

SEQ ID NO: 36806 - DNA, 30 bp, Homo sapiens
cccttatcaccctggaagaactttatgaca

SEQ ID NO: 36807 - DNA, 30 bp, Homo sapiens
catccttggataaccctgtccccgatctgt

SEQ ID NO: 36808 - DNA, 30 bp, Homo sapiens
tgaaggtttccaggagtcggtctctgatct

SEQ ID NO: 36809 - DNA, 30 bp, Homo sapiens
gataggagagaaaagcaaaatcactcgatc

SEQ ID NO: 36810 - DNA, 30 bp, Homo sapiens
tctctgcagtaacttctgaattccctgttt

SEQ ID NO: 36811 - DNA, 30 bp, Homo sapiens
cttcaacaacctctgcattccctgcttaat

SEQ ID NO: 36812 - DNA, 30 bp, Homo sapiens
cagcaggttttggattccctgcttgatctc

SEQ ID NO: 36813 - DNA, 30 bp, Homo sapiens
cagcaggttctggattccctgcttgatctc

SEQ ID NO: 36814 - DNA, 30 bp, Homo sapiens
ttttggaaggctgccctaagttctttggtc

SEQ ID NO: 36815 - DNA, 30 bp, Homo sapiens
acttggacacgtcctgacccagtccaagca

SEQ ID NO: 36816 - DNA, 30 bp, Homo sapiens
caacaccttccacagggcatccttgatctc

SEQ ID NO: 36817 - DNA, 30 bp, Homo sapiens
tgagaaatcccggggtccctttccatggct

SEQ ID NO: 36818 - DNA, 30 bp, Homo sapiens
tcttggtcttcagctaagccagatgcagga

SEQ ID NO: 36819 - DNA, 30 bp, Homo sapiens
tcatattttcctgggaattattagaatgag

SEQ ID NO: 36820 - DNA, 30 bp, Homo sapiens
tgtaggaatcactaccacattaaacacaga

SEQ ID NO: 36821 - DNA, 30 bp, Homo sapiens
ttaaggcatctttaatttctttgttcctca

SEQ ID NO: 36822 - DNA, 30 bp, Homo sapiens
gatcttctttagggccttttttacatcctt

SEQ ID NO: 36823 - DNA, 30 bp, Homo sapiens
tccgcaaactgtagatcaagggatttaaca

SEQ ID NO: 36824 - DNA, 30 bp, Homo sapiens
ccttatcagtgtctagggaatagctagtgg

SEQ ID NO: 36825 - DNA, 30 bp, Homo sapiens
ttttcctaccccaaacctttattaaagctt

SEQ ID NO: 36826 - DNA, 30 bp, Homo sapiens
gaggcctttgccttccctacagtcttttta

SEQ ID NO: 36827 - DNA, 30 bp, Homo sapiens
caacaaccttcatgaatgcattcttcacgt

SEQ ID NO: 36828 - DNA, 30 bp, Homo sapiens
ttctggacttctctgttcctcaggctgtag

SEQ ID NO: 36829 - DNA, 30 bp, Homo sapiens
agcacttttcacttctttgttcctaaggct

SEQ ID NO: 36830 - DNA, 30 bp, Homo sapiens
tacagacaattttgccttctcaacaacttt

SEQ ID NO: 36831 - DNA, 30 bp, Homo sapiens
ccctggacagtggaatcggctccaggtctg

SEQ ID NO: 36832 - DNA, 30 bp, Homo sapiens
gctgtagatcaatgggttcagcattggaat

SEQ ID NO: 36833 - DNA, 30 bp, Homo sapiens
agcatccttcacgtctttattccttaggct

SEQ ID NO: 36834 - DNA, 30 bp, Homo sapiens
atcaggggattcaacaaggggatcaccacg

SEQ ID NO: 36835 - DNA, 30 bp, Homo sapiens
tctcggtgactgtatccttgacatctttat

SEQ ID NO: 36836 - DNA, 30 bp, Homo sapiens
ttacttccttactcctgaggctgtagatca

SEQ ID NO: 36837 - DNA, 30 bp, Homo sapiens
gataggatttaacaaaggaatgatgacagt

SEQ ID NO: 36838 - DNA, 30 bp, Homo sapiens
tcttggtcatctgcttgtggagatgcaggg

SEQ ID NO: 36839 - DNA, 30 bp, Homo sapiens
tcatgggatttaataaaggaactatgacag

SEQ ID NO: 36840 - DNA, 30 bp, Homo sapiens
cactggaatgaaaatggtgtagaacactga

SEQ ID NO: 36841 - DNA, 30 bp, Homo sapiens
tcactgcctcctttacgtccttgtttctca

SEQ ID NO: 36842 - DNA, 30 bp, Homo sapiens
cttcaagcaaatttggtctaacgtacatga

SEQ ID NO: 36843 - DNA, 30 bp, Homo sapiens
tcttcaagcaaatttggtctaatgtatagg

SEQ ID NO: 36844 - DNA, 30 bp, Homo sapiens
gggatgacatttgtttcagaatgtgacaaa

SEQ ID NO: 36845 - DNA, 30 bp, Homo sapiens
gtgtatctttatctccttcttcagatggtc

SEQ ID NO: 36846 - DNA, 30 bp, Homo sapiens
gagtgaattttggagcccatcacttttctg

SEQ ID NO: 36847 - DNA, 30 bp, Homo sapiens
acttttctgagagctttgttcacatcctta

SEQ ID NO: 36848 - DNA, 30 bp, Homo sapiens
atcatttgttgcatggcaaggattacatct

SEQ ID NO: 36849 - DNA, 30 bp, Homo sapiens
gtatggcaaggattacatctctgttccgta

SEQ ID NO: 36850 - DNA, 30 bp, Homo sapiens
tcacatctttattcctcagactgtagatca

SEQ ID NO: 36851 - DNA, 30 bp, Homo sapiens
tcatggcctttttcacatccttgttcctca

SEQ ID NO: 36852 - DNA, 30 bp, Homo sapiens
ctgtggtataaaatacagctaccattttac

SEQ ID NO: 36853 - DNA, 30 bp, Homo sapiens
atatgtcttggtgattgctttgttgactgc

SEQ ID NO: 36854 - DNA, 30 bp, Homo sapiens
taatctccttgttcctgaggctgtagatca

SEQ ID NO: 36855 - DNA, 30 bp, Homo sapiens
tccaaggctttctttgaggcatctttcact

SEQ ID NO: 36856 - DNA, 30 bp, Homo sapiens
ttacatctttgttccgcaaactgtagatga

SEQ ID NO: 36857 - DNA, 30 bp, Homo sapiens
actgtagatgacgggattcagcaagggaat

SEQ ID NO: 36858 - DNA, 30 bp, Homo sapiens
actatagatgatgggattcaacttgggaat

SEQ ID NO: 36859 - DNA, 30 bp, Homo sapiens
aagaggaaattggtggctgccacttgctcc

SEQ ID NO: 36860 - DNA, 30 bp, Homo sapiens
tcacatccttgttcctcaggctataaatca

SEQ ID NO: 36861 - DNA, 30 bp, Homo sapiens
atacatttctgctagctttcttggggtcag

SEQ ID NO: 36862 - DNA, 30 bp, Homo sapiens
aatatgccagtttcttcagagcttccttga

SEQ ID NO: 36863 - DNA, 30 bp, Homo sapiens
cccaaggcctttttcaaggcgtccttaaat

SEQ ID NO: 36864 - DNA, 30 bp, Homo sapiens
atttggagatgaagttccagaagactagaa

SEQ ID NO: 36865 - DNA, 30 bp, Homo sapiens
catgttaatgaaagcttgcttgacttgctg

SEQ ID NO: 36866 - DNA, 30 bp, Homo sapiens
tcaaggtgtaaatgaaggggttcaacaagg

SEQ ID NO: 36867 - DNA, 30 bp, Homo sapiens
tgaaggcttgttttacttgctggtttctca

SEQ ID NO: 36868 - DNA, 30 bp, Homo sapiens
aagcttgtttcacttgctgatttcttaaag

SEQ ID NO: 36869 - DNA, 30 bp, Homo sapiens
agacttctttcacctgctggtttctgagag

SEQ ID NO: 36870 - DNA, 30 bp, Homo sapiens
gggcctgtttcacctgctggtttcttaagg

SEQ ID NO: 36871 - DNA, 30 bp, Homo sapiens
cttttgcagatggcttgatatagatgaaga

SEQ ID NO: 36872 - DNA, 30 bp, Homo sapiens
tgatggctttatgtagataaacatacaact

SEQ ID NO: 36873 - DNA, 30 bp, Homo sapiens
tgggggcaacagaagtgctgagcagagcta

SEQ ID NO: 36874 - DNA, 30 bp, Homo sapiens
tcttgaaggcttgcttcacttgcttatttc

SEQ ID NO: 36875 - DNA, 30 bp, Homo sapiens
atgcttgtttcacctgctggtttcttagag

SEQ ID NO: 36876 - DNA, 30 bp, Homo sapiens
catttcttcagcagagtctctcttacttcc

SEQ ID NO: 36877 - DNA, 30 bp, Homo sapiens
cactggagctttacagaatagacacatggt

SEQ ID NO: 36878 - DNA, 30 bp, Homo sapiens
ccctggtcttacggaaaaaaatatcttagc

SEQ ID NO: 36879 - DNA, 30 bp, Homo sapiens
ggcttgttcaacactttttgaagacagaac

SEQ ID NO: 36880 - DNA, 30 bp, Homo sapiens
ccaaccagccctcttctgatagtggaaaag

SEQ ID NO: 36881 - DNA, 30 bp, Homo sapiens
ccttctcattcctcaagctgtagataaaag

SEQ ID NO: 36882 - DNA, 30 bp, Homo sapiens
tctctttagctgcctcctcacagcctcctt

SEQ ID NO: 36883 - DNA, 30 bp, Homo sapiens
ttctggaagatggtcctcttgatagcttta

SEQ ID NO: 36884 - DNA, 30 bp, Homo sapiens
catccctaggatagtgacatctgcccatca

SEQ ID NO: 36885 - DNA, 30 bp, Homo sapiens
gctcccttcacttccttgttcctaagactg

SEQ ID NO: 36886 - DNA, 30 bp, Homo sapiens
aacgcctgccactaccttcctaaacatgtc

SEQ ID NO: 36887 - DNA, 30 bp, Homo sapiens
acttgtgaccctcagtttcatcacagcagt

SEQ ID NO: 36888 - DNA, 30 bp, Homo sapiens
aaaggcctttcagcctctgcatctgcccct

SEQ ID NO: 36889 - DNA, 30 bp, Homo sapiens
ctttgggcaagtcattgcctttcttaaggc

SEQ ID NO: 36890 - DNA, 30 bp, Homo sapiens
ttccctggggcccacttcctctgcaatgta

SEQ ID NO: 36891 - DNA, 30 bp, Homo sapiens
actgtagatgaaggggttcagcatgggggt

SEQ ID NO: 36892 - DNA, 30 bp, Homo sapiens
aaggacattttcagagccctctttatgtct

SEQ ID NO: 36893 - DNA, 30 bp, Homo sapiens
catgggcacttcttgaaaaattgccctttc

SEQ ID NO: 36894 - DNA, 30 bp, Homo sapiens
gtgatgtcaccattaaaaaatgttgcccta

SEQ ID NO: 36895 - DNA, 30 bp, Homo sapiens
tttgagagacgttgccctgaggaggagtct

SEQ ID NO: 36896 - DNA, 30 bp, Homo sapiens
caaacaagaggctgccctgctgaggagact

SEQ ID NO: 36897 - DNA, 30 bp, Homo sapiens
agtcggccctgctgaggagtctttccaggg

SEQ ID NO: 36898 - DNA, 30 bp, Homo sapiens
agcctgcacagggcactttgaatgtccttg

SEQ ID NO: 36899 - DNA, 30 bp, Homo sapiens
agctttcttcatctccttatttctcaggct

SEQ ID NO: 36900 - DNA, 30 bp, Homo sapiens
tccaaagcaaatggcacaccacagaagaga

SEQ ID NO: 36901 - DNA, 30 bp, Homo sapiens
agccttcaacatgtccttgtttctcaggct

SEQ ID NO: 36902 - DNA, 30 bp, Homo sapiens
agcgttttctgcacggcagcctttacttcc

SEQ ID NO: 36903 - DNA, 30 bp, Homo sapiens
gttctcctcagggcaactttgacatccttg

SEQ ID NO: 36904 - DNA, 30 bp, Homo sapiens
tgcaactttgacatccttgttcctcaaact

SEQ ID NO: 36905 - DNA, 30 bp, Homo sapiens
cccagggcaagtttatcatccttattcctc

SEQ ID NO: 36906 - DNA, 30 bp, Homo sapiens
ctcaggctataaattaatgggttgagcatg

SEQ ID NO: 36907 - DNA, 30 bp, Homo sapiens
aagaccttccttaatgctttcttcacatcc

SEQ ID NO: 36908 - DNA, 30 bp, Homo sapiens
cctagtcatcttcttcagtgcatttttcac

SEQ ID NO: 36909 - DNA, 30 bp, Homo sapiens
actatatatcaagggattcaacatgagaat

SEQ ID NO: 36910 - DNA, 30 bp, Homo sapiens
ttcagggaaacatggacatctttattcctc

SEQ ID NO: 36911 - DNA, 30 bp, Homo sapiens
tgggggttcagcatgggcacaatagtagta

SEQ ID NO: 36912 - DNA, 30 bp, Homo sapiens
cgttttcttcagggcaacgtggacatcttt

SEQ ID NO: 36913 - DNA, 30 bp, Homo sapiens
gtcctgtcttctctgcatgactctaatgag

SEQ ID NO: 36914 - DNA, 30 bp, Homo sapiens
actgtagatgagtggattcagcatgggaat

SEQ ID NO: 36915 - DNA, 30 bp, Homo sapiens
tcctcaggctgtagatcaagggattcagca

SEQ ID NO: 36916 - DNA, 30 bp, Homo sapiens
gctgtagatcaagggattcagcataggaat

SEQ ID NO: 36917 - DNA, 30 bp, Homo sapiens
gctgtagatcaacggattcagcataggaat

SEQ ID NO: 36918 - DNA, 30 bp, Homo sapiens
ccttcgtagggcatattttacatctttgtt

SEQ ID NO: 36919 - DNA, 30 bp, Homo sapiens
cgtttcttaagctgtaaatcaaagggttaa

SEQ ID NO: 36920 - DNA, 30 bp, Homo sapiens
gcgccgcgcgcagcgcggagcatgcgcagg

SEQ ID NO: 36921 - DNA, 30 bp, Homo sapiens
aatatggtgactgccagcatgtgagagcta

SEQ ID NO: 36922 - DNA, 30 bp, Homo sapiens
tattctggaggctatagattaagggattca

SEQ ID NO: 36923 - DNA, 30 bp, Homo sapiens
tctcggagggcctctttgactttgtcattc

SEQ ID NO: 36924 - DNA, 30 bp, Homo sapiens
tagttgacagcagcgtttcaccccatcccg

SEQ ID NO: 36925 - DNA, 30 bp, Homo sapiens
tgaaggcctctttgatatctttgtttctca

SEQ ID NO: 36926 - DNA, 30 bp, Homo sapiens
tcacatccttattccttaggctgtagatca

SEQ ID NO: 36927 - DNA, 30 bp, Homo sapiens
gtctcctagcgacctttctgaaggcgtctt

SEQ ID NO: 36928 - DNA, 30 bp, Homo sapiens
ggacatctttgttcctcagagagtaaatca

SEQ ID NO: 36929 - DNA, 30 bp, Homo sapiens
acttggctctattgagaatttttctcaggg

SEQ ID NO: 36930 - DNA, 30 bp, Homo sapiens
agggtcttctagcaggctttgatttgctca

SEQ ID NO: 36931 - DNA, 30 bp, Homo sapiens
catagtggctgccgggcgtcagggggtggt

SEQ ID NO: 36932 - DNA, 30 bp, Homo sapiens
acaagacctgcaggctgcgctcatgcccgt

SEQ ID NO: 36933 - DNA, 30 bp, Homo sapiens
caagggggcatctgatagatgcccgtgaac

SEQ ID NO: 36934 - DNA, 30 bp, Homo sapiens
gctccccctgcaggcgattcagttcctcta

SEQ ID NO: 36935 - DNA, 30 bp, Homo sapiens
caaaatgaaagtccggaaccttctgcacta

SEQ ID NO: 36936 - DNA, 30 bp, Homo sapiens
tactcgtctttcagcgcatacagcacatca

SEQ ID NO: 36937 - DNA, 30 bp, Homo sapiens
cttcttccttttccaagaaatcagtcaatg

SEQ ID NO: 36938 - DNA, 30 bp, Homo sapiens
catgttagtcttgccacatggtcagtcttc

SEQ ID NO: 36939 - DNA, 30 bp, Homo sapiens
tagtgaggatgttgcccactgcctcacatc

SEQ ID NO: 36940 - DNA, 30 bp, Homo sapiens
aatagctctgatgaagtctagagacactgt

SEQ ID NO: 36941 - DNA, 30 bp, Homo sapiens
tgaatgctctttagtattaactttagtatc

SEQ ID NO: 36942 - DNA, 30 bp, Homo sapiens
gagcactggcagcattttccaaaatttttc

SEQ ID NO: 36943 - DNA, 30 bp, Homo sapiens
aggattccccctcctcctgtttcctctcct

SEQ ID NO: 36944 - DNA, 30 bp, Homo sapiens
atccgaacaccatgtagttgtggcattttg

SEQ ID NO: 36945 - DNA, 30 bp, Homo sapiens
gtatttgttgatgccaaagacacgaacccc

SEQ ID NO: 36946 - DNA, 30 bp, Homo sapiens
atccggactccgtggagctggggcagcttg

SEQ ID NO: 36947 - DNA, 30 bp, Homo sapiens
tccaggtcccctgtgccctccccacctgga

SEQ ID NO: 36948 - DNA, 30 bp, Homo sapiens
cagaaaatgtccgggcatgagctccagtcc

SEQ ID NO: 36949 - DNA, 30 bp, Homo sapiens
tgttggggcacatatgccagtcttgcttct

SEQ ID NO: 36950 - DNA, 30 bp, Homo sapiens
cagtgtgctttccagaggggattgaagtat

SEQ ID NO: 36951 - DNA, 30 bp, Homo sapiens
tgctggttgtgttgttggaattattttcca

SEQ ID NO: 36952 - DNA, 30 bp, Homo sapiens
agctgccagagtaaatccagtcctgtgctc

SEQ ID NO: 36953 - DNA, 30 bp, Homo sapiens
gtagatatctgggcagtcggagaaattccg

SEQ ID NO: 36954 - DNA, 30 bp, Homo sapiens
cagtggccactcgaggaagtccagcctcgt

SEQ ID NO: 36955 - DNA, 30 bp, Homo sapiens
gacaggatggtccagtttggaaaaaccaag

SEQ ID NO: 36956 - DNA, 30 bp, Homo sapiens
ttgaggatgtggttaatgaacagctgacac

SEQ ID NO: 36957 - DNA, 30 bp, Homo sapiens
taccaaagaacagggctgtctactttgcta

SEQ ID NO: 36958 - DNA, 30 bp, Homo sapiens
gcacggccccatccatgttcccatagcctg

SEQ ID NO: 36959 - DNA, 30 bp, Homo sapiens
aggaggaaaatgatgaagtagtctttttgt

SEQ ID NO: 36960 - DNA, 30 bp, Homo sapiens
taatgcttggcagcaccaagacgtttcagt

SEQ ID NO: 36961 - DNA, 30 bp, Homo sapiens
caggggcggataccagcaggagcgcggttc

SEQ ID NO: 36962 - DNA, 30 bp, Homo sapiens
tcctggatctgagggaggaggggctgggtc

SEQ ID NO: 36963 - DNA, 30 bp, Homo sapiens
acaaaactcaaagttctcaaaagggtatac

SEQ ID NO: 36964 - DNA, 30 bp, Homo sapiens
tcatggcgagcaaatcgtcccctttgctgg

SEQ ID NO: 36965 - DNA, 30 bp, Homo sapiens
atgtgggacattttcttgggaatatacaag

SEQ ID NO: 36966 - DNA, 30 bp, Homo sapiens
tccaggtcacctctacttcatctgtccgat

SEQ ID NO: 36967 - DNA, 30 bp, Homo sapiens
aagaggacattttggttcatagcggatgcc

SEQ ID NO: 36968 - DNA, 30 bp, Homo sapiens
gggtggcttcctggtctccttccttagcag

SEQ ID NO: 36969 - DNA, 30 bp, Homo sapiens
tcctcctcctctttcaacaaacaaatgctt

SEQ ID NO: 36970 - DNA, 30 bp, Homo sapiens
taccggggcagctgtcccctggtcatgagt

SEQ ID NO: 36971 - DNA, 30 bp, Homo sapiens
acctggatctaaaagggtaattgaggagag

SEQ ID NO: 36972 - DNA, 30 bp, Homo sapiens
cagtggtgactgtttgttagggttgcagtt

SEQ ID NO: 36973 - DNA, 30 bp, Homo sapiens
tagtggccacggtgggctgtgacaactcta

SEQ ID NO: 36974 - DNA, 30 bp, Homo sapiens
cctgtgagtgtagcgtcttgtggacagcga

SEQ ID NO: 36975 - DNA, 30 bp, Homo sapiens
ccgcggggtgtgagtcaggctgtgccgccg

SEQ ID NO: 36976 - DNA, 30 bp, Homo sapiens
cagatcacagtttcgcctgaacactttgcc

SEQ ID NO: 36977 - DNA, 30 bp, Homo sapiens
ctgaggaaataaaagttgtttggaaaaatc

SEQ ID NO: 36978 - DNA, 30 bp, Homo sapiens
agatagcccggcagtttcattctcatgaat

SEQ ID NO: 36979 - DNA, 30 bp, Homo sapiens
aacagaagaaggaatctattgagttttggg

SEQ ID NO: 36980 - DNA, 30 bp, Homo sapiens
ggccaagaaagctactggcctctgatgccc

SEQ ID NO: 36981 - DNA, 30 bp, Homo sapiens
cctcggcattgcttaatgttcgaactgcat

SEQ ID NO: 36982 - DNA, 30 bp, Homo sapiens
gtttgggcagaatgagtttgcgtttctttt

SEQ ID NO: 36983 - DNA, 30 bp, Homo sapiens
ctctggaatttgaaagccggtttctaccaa

SEQ ID NO: 36984 - DNA, 30 bp, Homo sapiens
ctgaggtgagtaatctgtcagcagggacac

SEQ ID NO: 36985 - DNA, 30 bp, Homo sapiens
accacaggagcttggccattagaaccagca

SEQ ID NO: 36986 - DNA, 30 bp, Homo sapiens
tgccccaaggagctttttgaccatgtagcc

SEQ ID NO: 36987 - DNA, 30 bp, Homo sapiens
ccgaggattttcttgaccaggtagccaggc

SEQ ID NO: 36988 - DNA, 30 bp, Homo sapiens
gcaggcacagtcggtgggctcctgcactgt

SEQ ID NO: 36989 - DNA, 30 bp, Homo sapiens
cactggcacgtacagtctatgggttcctgg

SEQ ID NO: 36990 - DNA, 30 bp, Homo sapiens
gtttcctctgggtacaaaaggaacccagta

SEQ ID NO: 36991 - DNA, 30 bp, Homo sapiens
aagagggaggcagctgcgtgcattcgatag

SEQ ID NO: 36992 - DNA, 30 bp, Homo sapiens
gacagcacgtagacctccagcaggctggac

SEQ ID NO: 36993 - DNA, 30 bp, Homo sapiens
gcccccaggtagacctccaccaggcctccc

SEQ ID NO: 36994 - DNA, 30 bp, Homo sapiens
tgggaacttccttggtagcttcctggtaca

SEQ ID NO: 36995 - DNA, 30 bp, Homo sapiens
agtcctcctgatagggaacgtggaagccca

SEQ ID NO: 36996 - DNA, 30 bp, Homo sapiens
ttgcggcggagggaggcgatgctggtgccc

SEQ ID NO: 36997 - DNA, 30 bp, Homo sapiens
tagaggatatcgtagtgtccaggccggtag

SEQ ID NO: 36998 - DNA, 30 bp, Homo sapiens
taaaggatgttgtagtgggatgttttatag

SEQ ID NO: 36999 - DNA, 30 bp, Homo sapiens
atttggcaagttcttcgtcgcgtttccttt

SEQ ID NO: 37000 - DNA, 30 bp, Homo sapiens
gagcggcgaaggtcttcaccaaggtgacct

SEQ ID NO: 37001 - DNA, 30 bp, Homo sapiens
agtgtgctgtcccctatggccatctcccat

SEQ ID NO: 37002 - DNA, 30 bp, Homo sapiens
tgtctagttccatcacaattttactaacat

SEQ ID NO: 37003 - DNA, 30 bp, Homo sapiens
actcttgtctgggggcgggtctctgtgcac

SEQ ID NO: 37004 - DNA, 30 bp, Homo sapiens
tacaggagacgcgggagcacgcccccggcg

SEQ ID NO: 37005 - DNA, 30 bp, Homo sapiens
gtgtaaccgaattataatgttctcctaagc

SEQ ID NO: 37006 - DNA, 30 bp, Homo sapiens
agggccgggccccgcgcgcctcgcgccgcc

SEQ ID NO: 37007 - DNA, 30 bp, Homo sapiens
taagggggggtctccacaatccacctcccc

SEQ ID NO: 37008 - DNA, 30 bp, Homo sapiens
cagaacctgtgcaccaggagctccccatcc

SEQ ID NO: 37009 - DNA, 30 bp, Homo sapiens
gactggtctcctcacacactctgacgggga

SEQ ID NO: 37010 - DNA, 30 bp, Homo sapiens
acctggaaccgccatgaggcttggtcctta

SEQ ID NO: 37011 - DNA, 30 bp, Homo sapiens
acctggaatttccacgaggatgtctgatct

SEQ ID NO: 37012 - DNA, 30 bp, Homo sapiens
aactggtccaagaacttgaggtaggcctga

SEQ ID NO: 37013 - DNA, 30 bp, Homo sapiens
ccaaatccttcgtaaacacgcagatgacca

SEQ ID NO: 37014 - DNA, 30 bp, Homo sapiens
acattgattcatcctctgatatggagatgt

SEQ ID NO: 37015 - DNA, 30 bp, Homo sapiens
cagagttttctgggatttctttttttagag

SEQ ID NO: 37016 - DNA, 30 bp, Homo sapiens
cacaggtgggggctgccctgcagcagggaa

SEQ ID NO: 37017 - DNA, 30 bp, Homo sapiens
ttcctctcctcctcctcactcaggctggta

SEQ ID NO: 37018 - DNA, 30 bp, Homo sapiens
caggctgcgcggtgcagggcgcggtgctgt

SEQ ID NO: 37019 - DNA, 30 bp, Homo sapiens
gtgtcgtgccagggatactttgactttggt

SEQ ID NO: 37020 - DNA, 30 bp, Homo sapiens
cattggcatgagttttggtgaaactgcaaa

SEQ ID NO: 37021 - DNA, 30 bp, Homo sapiens
agggtgccacctgctgcatgggcctgaggt

SEQ ID NO: 37022 - DNA, 30 bp, Homo sapiens
gccctgggaggagccttccttttccagaga

SEQ ID NO: 37023 - DNA, 30 bp, Homo sapiens
tactttgcatctcactgttgagcagacagc

SEQ ID NO: 37024 - DNA, 30 bp, Homo sapiens
cacctggtgtgcagccggatctccatcctg

SEQ ID NO: 37025 - DNA, 30 bp, Homo sapiens
aagcggcccctccacagattccggggcggg

SEQ ID NO: 37026 - DNA, 30 bp, Homo sapiens
accaccacttctcaaagcaaatgtgttctt

SEQ ID NO: 37027 - DNA, 30 bp, Homo sapiens
tcttggataaagaaatcttccttcttagaa

SEQ ID NO: 37028 - DNA, 30 bp, Homo sapiens
atacaaagtgttgcattagtaccaccaaaa

SEQ ID NO: 37029 - DNA, 30 bp, Homo sapiens
agctgggcaaatcctatcagtttaccatca

SEQ ID NO: 37030 - DNA, 30 bp, Homo sapiens
cgctgggagaaggtggcttccgcgtcgcag

SEQ ID NO: 37031 - DNA, 30 bp, Homo sapiens
ccgtggatggctgggagcagctcctctggc

SEQ ID NO: 37032 - DNA, 30 bp, Homo sapiens
gttctcctgcaggcccagggtggagctggt

SEQ ID NO: 37033 - DNA, 30 bp, Homo sapiens
ctttggggtctgtgggtgtggaggcttggg

SEQ ID NO: 37034 - DNA, 30 bp, Homo sapiens
taatggtgggaatcaggctgaacttcccgg

SEQ ID NO: 37035 - DNA, 30 bp, Homo sapiens
tagtggcctatggagaaggcccccgaatcg

SEQ ID NO: 37036 - DNA, 30 bp, Homo sapiens
cactggtccagctcactagcaagaccctgc

SEQ ID NO: 37037 - DNA, 30 bp, Homo sapiens
atttctctggggtgatgtcaaatttccctg

SEQ ID NO: 37038 - DNA, 30 bp, Homo sapiens
gggctccaggagctgtgggcacacagatcc

SEQ ID NO: 37039 - DNA, 30 bp, Homo sapiens
tacaggctcccggaatgggttggcaagtgg

SEQ ID NO: 37040 - DNA, 30 bp, Homo sapiens
caagggtggaattctacccccaatcctcca

SEQ ID NO: 37041 - DNA, 30 bp, Homo sapiens
gtaaggactcttgaagccactgtactgccc

SEQ ID NO: 37042 - DNA, 30 bp, Homo sapiens
cacaggcttgtatctccattctgcttgaac

SEQ ID NO: 37043 - DNA, 30 bp, Homo sapiens
attgatgaaccactctccttgctcatgagg

SEQ ID NO: 37044 - DNA, 30 bp, Homo sapiens
cattggctcagctcacgggactggggctct

SEQ ID NO: 37045 - DNA, 30 bp, Homo sapiens
atttgggtcaccaccatcctgttctttttt

SEQ ID NO: 37046 - DNA, 30 bp, Homo sapiens
ctaaggttatgttgtctgtctgactgctat

SEQ ID NO: 37047 - DNA, 30 bp, Homo sapiens
taatggaatgtgcaatttcttacataagat

SEQ ID NO: 37048 - DNA, 30 bp, Homo sapiens
gccgaatgtccttagtgttctcgctaccag

SEQ ID NO: 37049 - DNA, 30 bp, Homo sapiens
tacaatctatctgccctaggagtagagcag

SEQ ID NO: 37050 - DNA, 30 bp, Homo sapiens
ctctgccatttggctgtgagtttctgtagg

SEQ ID NO: 37051 - DNA, 30 bp, Homo sapiens
ctctggaggccgggcctggtggctccctcc

SEQ ID NO: 37052 - DNA, 30 bp, Homo sapiens
ccttgggcttcgattcactgcctgagagag

SEQ ID NO: 37053 - DNA, 30 bp, Homo sapiens
catctgcctgcaccctgtcccgctcgagct

SEQ ID NO: 37054 - DNA, 30 bp, Homo sapiens
cccaggggacaaggaaggttccttaatggc

SEQ ID NO: 37055 - DNA, 30 bp, Homo sapiens
ctgttcttgatccagaattgcaatcacttc

SEQ ID NO: 37056 - DNA, 30 bp, Homo sapiens
acagctcctcccgaacccgaggtgcccttc

SEQ ID NO: 37057 - DNA, 30 bp, Homo sapiens
catgcgagttcaggctctggctcagcctcg

SEQ ID NO: 37058 - DNA, 30 bp, Homo sapiens
ctgacaacgtacaaggtcttcgaaattctt

SEQ ID NO: 37059 - DNA, 30 bp, Homo sapiens
acaaggtctcaagaactcctgtcctcgttc

SEQ ID NO: 37060 - DNA, 30 bp, Homo sapiens
ttcagggctggagctgcagggtctgcggaa

SEQ ID NO: 37061 - DNA, 30 bp, Homo sapiens
ccctggtaacaacctctcccttgcctctga

SEQ ID NO: 37062 - DNA, 30 bp, Homo sapiens
tgtctggctcctctgcttcttccaggtcct

SEQ ID NO: 37063 - DNA, 30 bp, Homo sapiens
gagttccacgcgcgcatcgcggtaggcccg

SEQ ID NO: 37064 - DNA, 30 bp, Homo sapiens
cagtccccagcttcattttcttctaatgtt

SEQ ID NO: 37065 - DNA, 30 bp, Homo sapiens
cagaggtcagaaagctggtagcgtcgtaca

SEQ ID NO: 37066 - DNA, 30 bp, Homo sapiens
cggtggcactgttaactgctttctgggcag

SEQ ID NO: 37067 - DNA, 30 bp, Homo sapiens
cttcggctgctccatagcctggtgtgcctg

SEQ ID NO: 37068 - DNA, 30 bp, Homo sapiens
gcaaggtggcctcctcgtcggtgtcttcct

SEQ ID NO: 37069 - DNA, 30 bp, Homo sapiens
gcactgttaactgctttctgggtagcctct

SEQ ID NO: 37070 - DNA, 30 bp, Homo sapiens
aagaggtagcagcagcaacagcgcccacct

SEQ ID NO: 37071 - DNA, 30 bp, Homo sapiens
gtctctgggccaaggcaatgctaagaggtt

SEQ ID NO: 37072 - DNA, 30 bp, Homo sapiens
gcctggcctggcccagggtgacatgcaggg

SEQ ID NO: 37073 - DNA, 30 bp, Homo sapiens
tgtcgctctagcccggcccctgtagacgcg

SEQ ID NO: 37074 - DNA, 30 bp, Homo sapiens
atacggtgaaaaccatggtgagaattttcc

SEQ ID NO: 37075 - DNA, 30 bp, Homo sapiens
aatcgggtcttccctttaatacggtgaaaa

SEQ ID NO: 37076 - DNA, 30 bp, Homo sapiens
cgtaggttgggaccacgtacttaatgttga

SEQ ID NO: 37077 - DNA, 30 bp, Homo sapiens
cagccagtaacagctttcctgagttccatg

SEQ ID NO: 37078 - DNA, 30 bp, Homo sapiens
atatggagcagtatgttggaattttagatt

SEQ ID NO: 37079 - DNA, 30 bp, Homo sapiens
aggtggccttgctgccactgaagagtccca

SEQ ID NO: 37080 - DNA, 30 bp, Homo sapiens
agaaggtggccttggagtgtccgaagatgc

SEQ ID NO: 37081 - DNA, 30 bp, Homo sapiens
gatagcctccacgtagttggcagggtagag

SEQ ID NO: 37082 - DNA, 30 bp, Homo sapiens
cactggatcgcctccacataatttgccggg

SEQ ID NO: 37083 - DNA, 30 bp, Homo sapiens
cactccacgtagttggcagggtacaggcca

SEQ ID NO: 37084 - DNA, 30 bp, Homo sapiens
tccaccatttgaagggaaagggcttcctgc

SEQ ID NO: 37085 - DNA, 30 bp, Homo sapiens
cttgaaggtgaagggcttcctgcggacgtt

SEQ ID NO: 37086 - DNA, 30 bp, Homo sapiens
tccaccacttgaaagagaagggctttctgc

SEQ ID NO: 37087 - DNA, 30 bp, Homo sapiens
tccaccacttgaaggagaagggctttctgc

SEQ ID NO: 37088 - DNA, 30 bp, Homo sapiens
tccaccatttgaaggcaaagggcacccggc

SEQ ID NO: 37089 - DNA, 30 bp, Homo sapiens
gtttcaagtccagcaagtaccataggtgcc

SEQ ID NO: 37090 - DNA, 30 bp, Homo sapiens
aaacggcacggctcttccatctgtttcaag

SEQ ID NO: 37091 - DNA, 30 bp, Homo sapiens
cactggaatcagaagctgcagcttcactgc

SEQ ID NO: 37092 - DNA, 30 bp, Homo sapiens
gaaaagtgctttgctgctcacaataatggt

SEQ ID NO: 37093 - DNA, 30 bp, Homo sapiens
caacggcactcccacacttttactgtttga

SEQ ID NO: 37094 - DNA, 30 bp, Homo sapiens
aggcaatggtggtttgtttctcctcaggtg

SEQ ID NO: 37095 - DNA, 30 bp, Homo sapiens
tccatctggacttttctttcatggtaatcc

SEQ ID NO: 37096 - DNA, 30 bp, Homo sapiens
tgtaggatttcctcagtccatctggacttt

SEQ ID NO: 37097 - DNA, 30 bp, Homo sapiens
gctgccttgtgttgataagttgtacaatgg

SEQ ID NO: 37098 - DNA, 30 bp, Homo sapiens
gtgcgggctccagcaggggagcaccttggc

SEQ ID NO: 37099 - DNA, 30 bp, Homo sapiens
tacaggctggacagatggtggggggcccct

SEQ ID NO: 37100 - DNA, 30 bp, Homo sapiens
gcctggtaatatctctgccttgctgcaagt

SEQ ID NO: 37101 - DNA, 30 bp, Homo sapiens
gtgttttcacctcctctggatttggcaggc

SEQ ID NO: 37102 - DNA, 30 bp, Homo sapiens
tccagcactttagtgagatcaaaagtgggc

SEQ ID NO: 37103 - DNA, 30 bp, Homo sapiens
tctggtattttaacaggctccagatttggc

SEQ ID NO: 37104 - DNA, 30 bp, Homo sapiens
tctttagtcttagcatgcttaggattaggt

SEQ ID NO: 37105 - DNA, 30 bp, Homo sapiens
tccagcactttagtgggatcaaaagtgggc

SEQ ID NO: 37106 - DNA, 30 bp, Homo sapiens
ccgagggaagagactactcccggaggatcg

SEQ ID NO: 37107 - DNA, 30 bp, Homo sapiens
caaaggattccaatttcactgttaatggaa

SEQ ID NO: 37108 - DNA, 30 bp, Homo sapiens
tcaaggaaatccatgtgttcaaaatgcttg

SEQ ID NO: 37109 - DNA, 30 bp, Homo sapiens
ctctgggtccatctcatcatcaatatcatc

SEQ ID NO: 37110 - DNA, 30 bp, Homo sapiens
ttcaccccaggaacaaactcctttgcattt

SEQ ID NO: 37111 - DNA, 30 bp, Homo sapiens
tcctggaataaactccttggcatctgggtt

SEQ ID NO: 37112 - DNA, 30 bp, Homo sapiens
tagctgcagcaatcagtggagtgaggctgg

SEQ ID NO: 37113 - DNA, 30 bp, Homo sapiens
tcctcttcttggttgatatcaggccacttt

SEQ ID NO: 37114 - DNA, 30 bp, Homo sapiens
taacggttactcttcattgcttctttagct

SEQ ID NO: 37115 - DNA, 30 bp, Homo sapiens
tagcggctgctgttcttaattgcttccttt

SEQ ID NO: 37116 - DNA, 30 bp, Homo sapiens
atctggtgcggttctggcgcatgaggggca

SEQ ID NO: 37117 - DNA, 30 bp, Homo sapiens
ttgtctcatgagggggacgatgcaagacgg

SEQ ID NO: 37118 - DNA, 30 bp, Homo sapiens
agcaggtggaggtctgctttcggtagagct

SEQ ID NO: 37119 - DNA, 30 bp, Homo sapiens
tggaggtctgctttcggtagagctggatca

SEQ ID NO: 37120 - DNA, 30 bp, Homo sapiens
ttttgtccagccagcaaatgagagtctgta

SEQ ID NO: 37121 - DNA, 30 bp, Homo sapiens
acagcaagtcctcgggggcagagggctcga

SEQ ID NO: 37122 - DNA, 30 bp, Homo sapiens
tacaggtcctcactttctaccaaggcagta

SEQ ID NO: 37123 - DNA, 30 bp, Homo sapiens
tggcagtacaggacacaatccctgcttcat

SEQ ID NO: 37124 - DNA, 30 bp, Homo sapiens
cacatgatggagcagcatttacaacggtgc

SEQ ID NO: 37125 - DNA, 30 bp, Homo sapiens
ttttgggtacctggggctggctctgtagct

SEQ ID NO: 37126 - DNA, 30 bp, Homo sapiens
tcctggttggcatagatccctgcttcccag

SEQ ID NO: 37127 - DNA, 30 bp, Homo sapiens
aacactggcacgtcttttgcttagggccac

SEQ ID NO: 37128 - DNA, 30 bp, Homo sapiens
ttcccagctttgccattctcatccttaaag

SEQ ID NO: 37129 - DNA, 30 bp, Homo sapiens
aggaggaggaaggtgcgagcgcaggcagag

SEQ ID NO: 37130 - DNA, 30 bp, Homo sapiens
gtatggggcatctgccctttttctctgtcc

SEQ ID NO: 37131 - DNA, 30 bp, Homo sapiens
tttaaaaggcagcaccttggtgaaggcagt

SEQ ID NO: 37132 - DNA, 30 bp, Homo sapiens
ctgaggagaagacagctgcattcttgggac

SEQ ID NO: 37133 - DNA, 30 bp, Homo sapiens
gcagctgcaatcagttcttgaaaagtattt

SEQ ID NO: 37134 - DNA, 30 bp, Homo sapiens
gtgccccaacggctccaaaataaccctcat

SEQ ID NO: 37135 - DNA, 30 bp, Homo sapiens
cacgggatcttcaacagctcaaggagtgct

SEQ ID NO: 37136 - DNA, 30 bp, Homo sapiens
caaatttgtacgctccacctccagtggcac

SEQ ID NO: 37137 - DNA, 30 bp, Homo sapiens
aagtgcaccaactgctccaaagtaaccctc

SEQ ID NO: 37138 - DNA, 30 bp, Homo sapiens
actcggctgggacctcgtacttgaagatga

SEQ ID NO: 37139 - DNA, 30 bp, Homo sapiens
taggtgctggccgagcgcggggcgggcagg

SEQ ID NO: 37140 - DNA, 30 bp, Homo sapiens
gtctctgtcgggcattcttctctccattat

SEQ ID NO: 37141 - DNA, 30 bp, Homo sapiens
tctcggctcgtcgaaggtggcgatgaggat

SEQ ID NO: 37142 - DNA, 30 bp, Homo sapiens
aaactccacagtactcacgaccgttctcgg

SEQ ID NO: 37143 - DNA, 30 bp, Homo sapiens
agttggtgaggtgtttgggttttgagggtt

SEQ ID NO: 37144 - DNA, 30 bp, Homo sapiens
cacttgggtgagacacagaagtacttcttc

SEQ ID NO: 37145 - DNA, 30 bp, Homo sapiens
tagagcctgggcctgggctgctgcacctgc

SEQ ID NO: 37146 - DNA, 30 bp, Homo sapiens
tgaaatctgtcagaagaaatgagggtccca

SEQ ID NO: 37147 - DNA, 30 bp, Homo sapiens
atcttttcaggacagcagctcttacaggta

SEQ ID NO: 37148 - DNA, 30 bp, Homo sapiens
cagaggtctgagaggggcgcgtccctcttg

SEQ ID NO: 37149 - DNA, 30 bp, Homo sapiens
tctgctgaggctcacgggcagactgtcccg

SEQ ID NO: 37150 - DNA, 30 bp, Homo sapiens
tgccagatgggctgagcgtgaggctggaaa

SEQ ID NO: 37151 - DNA, 30 bp, Homo sapiens
agtaggctttctcataccgttaagacttct

SEQ ID NO: 37152 - DNA, 30 bp, Homo sapiens
atttggataaagctggcaagttcttgctac

SEQ ID NO: 37153 - DNA, 30 bp, Homo sapiens
tgcagggagagcagggatatcagaaaggtc

SEQ ID NO: 37154 - DNA, 30 bp, Homo sapiens
tataggattagatatgtttgttgctgagtt

SEQ ID NO: 37155 - DNA, 30 bp, Homo sapiens
ttaagggtcagtcgaatggaatttttgatg

SEQ ID NO: 37156 - DNA, 30 bp, Homo sapiens
ccatggctgtatccccggaggtctttccgg

SEQ ID NO: 37157 - DNA, 30 bp, Homo sapiens
caaaggcccccatgtattcttaacagaaaa

SEQ ID NO: 37158 - DNA, 30 bp, Homo sapiens
ccttggggtcccggcaggtgcactcatcca

SEQ ID NO: 37159 - DNA, 30 bp, Homo sapiens
ctttctccaaggatttgtagtattctgtca

SEQ ID NO: 37160 - DNA, 30 bp, Homo sapiens
tccagggacctgtaataatctgtcaggacc

SEQ ID NO: 37161 - DNA, 30 bp, Homo sapiens
acaaggcttgctatgtctgtactgcatgac

SEQ ID NO: 37162 - DNA, 30 bp, Homo sapiens
tcccggggacaggcgtggtgggcagcccag

SEQ ID NO: 37163 - DNA, 30 bp, Homo sapiens
cagagcagctgagaaataaattatgttgct

SEQ ID NO: 37164 - DNA, 30 bp, Homo sapiens
tgttgtttggcctgggtacccccctccagt

SEQ ID NO: 37165 - DNA, 30 bp, Homo sapiens
gcctggacacgcatgcatctcccctctcag

SEQ ID NO: 37166 - DNA, 30 bp, Homo sapiens
cacttggtcttctgatcaagtttgcgctgt

SEQ ID NO: 37167 - DNA, 30 bp, Homo sapiens
gaatctttcttggtcagtctggccttgact

SEQ ID NO: 37168 - DNA, 30 bp, Homo sapiens
tttaggaacttcctgattaccagccccagg

SEQ ID NO: 37169 - DNA, 30 bp, Homo sapiens
agaagggcctccctttctcaggagtctgaa

SEQ ID NO: 37170 - DNA, 30 bp, Homo sapiens
ctcgggcttcagtttggcaaggctgaacat

SEQ ID NO: 37171 - DNA, 30 bp, Homo sapiens
atacggctgcagtcatggggttcttctgcc

SEQ ID NO: 37172 - DNA, 30 bp, Homo sapiens
cagaggctgaagccactaccatctcctcga

SEQ ID NO: 37173 - DNA, 30 bp, Homo sapiens
ttgagctgcttgctatggctgctaagctca

SEQ ID NO: 37174 - DNA, 30 bp, Homo sapiens
ccgcgggcccgtgctcctccacgccgcctg

SEQ ID NO: 37175 - DNA, 30 bp, Homo sapiens
gtccctgtcctttgccctgaatggtcagcg

SEQ ID NO: 37176 - DNA, 30 bp, Homo sapiens
cttgagccgccacctccttgccattcaggg

SEQ ID NO: 37177 - DNA, 30 bp, Homo sapiens
ccttttttggggccattagtccttatttca

SEQ ID NO: 37178 - DNA, 30 bp, Homo sapiens
gatggtccatatcttcctgtggcaacttta

SEQ ID NO: 37179 - DNA, 30 bp, Homo sapiens
cagagggttgttgtagtttccccaggaccc

SEQ ID NO: 37180 - DNA, 30 bp, Homo sapiens
gtcaggaacttcaaagagtgtggcagggct

SEQ ID NO: 37181 - DNA, 30 bp, Homo sapiens
taccacagggaggtcttaaaattgaatttc

SEQ ID NO: 37182 - DNA, 30 bp, Homo sapiens
gtctggggagcggcccgggagcccagaggg

SEQ ID NO: 37183 - DNA, 30 bp, Homo sapiens
ctcaggatagatttggttggcatcaaaaac

SEQ ID NO: 37184 - DNA, 30 bp, Homo sapiens
tgtcggctgctgaacagggagcccaaggcc

SEQ ID NO: 37185 - DNA, 30 bp, Homo sapiens
gcttggtagtcataaaatgccacaaataaa

SEQ ID NO: 37186 - DNA, 30 bp, Homo sapiens
atagctttggagatcgtgtattgtttgtca

SEQ ID NO: 37187 - DNA, 30 bp, Homo sapiens
gtgttggaaagcagaggagttgatgacact

SEQ ID NO: 37188 - DNA, 30 bp, Homo sapiens
ctgaaggaaattaaactgaacctttaaaag

SEQ ID NO: 37189 - DNA, 30 bp, Homo sapiens
cagaggtggacctccagcaggtagcgcagg

SEQ ID NO: 37190 - DNA, 30 bp, Homo sapiens
ctgtaatggaggactctatgaagaggggac

SEQ ID NO: 37191 - DNA, 30 bp, Homo sapiens
cagtttgtgtaaacctgagttccgatcaca

SEQ ID NO: 37192 - DNA, 30 bp, Homo sapiens
accagtagcagtttgattaccaattactcg

SEQ ID NO: 37193 - DNA, 30 bp, Homo sapiens
gcgaatcccctccaaggatgctgtgcaaag

SEQ ID NO: 37194 - DNA, 30 bp, Homo sapiens
tccacagagtagccccaatgatgaggcatt

SEQ ID NO: 37195 - DNA, 30 bp, Homo sapiens
gcctggccagaaatcaacttgtccttggca

SEQ ID NO: 37196 - DNA, 30 bp, Homo sapiens
tgcaaggagtcttaattttgaacatgtcac

SEQ ID NO: 37197 - DNA, 30 bp, Homo sapiens
gtcctcataatggtcagtcacgtccatgtt

SEQ ID NO: 37198 - DNA, 30 bp, Homo sapiens
cactggggtcagtaaatccatgactccatc

SEQ ID NO: 37199 - DNA, 30 bp, Homo sapiens
actccacgttacggtacttggtgaagaggt

SEQ ID NO: 37200 - DNA, 30 bp, Homo sapiens
cactccacgttcttgtacttggtgaacagg

SEQ ID NO: 37201 - DNA, 30 bp, Homo sapiens
attcggggctccatggggcgtcctgtccct

SEQ ID NO: 37202 - DNA, 30 bp, Homo sapiens
gcacggcttatttgagtcacgttgctctgc

SEQ ID NO: 37203 - DNA, 30 bp, Homo sapiens
cagagagagaaccgagtatggatcactgat

SEQ ID NO: 37204 - DNA, 30 bp, Homo sapiens
agctggtcagcagacggggatccccgggat

SEQ ID NO: 37205 - DNA, 30 bp, Homo sapiens
cacaggtcatggctcctgcagcacctgaag

SEQ ID NO: 37206 - DNA, 30 bp, Homo sapiens
ctcagggaggttgcagtagttactatgatc

SEQ ID NO: 37207 - DNA, 30 bp, Homo sapiens
cctgagatcaaatgtcatgtctctgcagaa

SEQ ID NO: 37208 - DNA, 30 bp, Homo sapiens
aacaggcctcttttggaggactcctcttcc

SEQ ID NO: 37209 - DNA, 30 bp, Homo sapiens
ttaaggttacagtccctctctggtgtttta

SEQ ID NO: 37210 - DNA, 30 bp, Homo sapiens
aatcggccgtcatctgcagctgctcctctg

SEQ ID NO: 37211 - DNA, 30 bp, Homo sapiens
agttcagtttctgccggtcaacatagcgag

SEQ ID NO: 37212 - DNA, 30 bp, Homo sapiens
tccaggcaaactccatcctggcctccagct

SEQ ID NO: 37213 - DNA, 30 bp, Homo sapiens
ttcccttcaggccccatgggctgctggtca

SEQ ID NO: 37214 - DNA, 30 bp, Homo sapiens
aatcggatcctgatgtgagcatttctggcc

SEQ ID NO: 37215 - DNA, 30 bp, Homo sapiens
tagccaacaggccactgggtaaaggccctg

SEQ ID NO: 37216 - DNA, 30 bp, Homo sapiens
acctggtcagctgacccacaactttcaaaa

SEQ ID NO: 37217 - DNA, 30 bp, Homo sapiens
aggaggtcgaggccgggatgggcagtccgt

SEQ ID NO: 37218 - DNA, 30 bp, Homo sapiens
ttcagagaagcctaaaaacccagaccaata

SEQ ID NO: 37219 - DNA, 30 bp, Homo sapiens
ctcgttgtaggccgtgtactgggggtggct

SEQ ID NO: 37220 - DNA, 30 bp, Homo sapiens
agacggggacgatgtggaggccgaagctgt

SEQ ID NO: 37221 - DNA, 30 bp, Homo sapiens
tagtggcggtcataggcagcggcagcagcg

SEQ ID NO: 37222 - DNA, 30 bp, Homo sapiens
cttcctcttctccactgcttttgtcgaacg

SEQ ID NO: 37223 - DNA, 30 bp, Homo sapiens
atctggcttgagataatgaaaggcacctga

SEQ ID NO: 37224 - DNA, 30 bp, Homo sapiens
atgcgaggaaactccggagaccagggcctt

SEQ ID NO: 37225 - DNA, 30 bp, Homo sapiens
ccctccaagtcacccagcaagtgcgccgcc

SEQ ID NO: 37226 - DNA, 30 bp, Homo sapiens
aaaaagtccaaggcttactttgtccatact

SEQ ID NO: 37227 - DNA, 30 bp, Homo sapiens
aaaaggatttgaaaccaagcgatatctggc

SEQ ID NO: 37228 - DNA, 30 bp, Homo sapiens
tccaagccatacagtagtgggcagccaggc

SEQ ID NO: 37229 - DNA, 30 bp, Homo sapiens
gtgtttggtgcccgcctggctccaagggtc

SEQ ID NO: 37230 - DNA, 30 bp, Homo sapiens
tgacggtcataggcagtggcggctgcaggt

SEQ ID NO: 37231 - DNA, 30 bp, Homo sapiens
ttgagacatatcaggttcacttccgggaac

SEQ ID NO: 37232 - DNA, 30 bp, Homo sapiens
tgactggtcaagccaatcactgtagtgcga

SEQ ID NO: 37233 - DNA, 30 bp, Homo sapiens
agtaggcctggccagtttccacaggcagga

SEQ ID NO: 37234 - DNA, 30 bp, Homo sapiens
atctggctggacttcaatttttccatctgt

SEQ ID NO: 37235 - DNA, 30 bp, Homo sapiens
gccaggcctcgctgtaggaggagtaggggg

SEQ ID NO: 37236 - DNA, 30 bp, Homo sapiens
agatggtcaaaggccgtggcagtggtgggc

SEQ ID NO: 37237 - DNA, 30 bp, Homo sapiens
agagcgcggaagccgtgacagaatgactac

SEQ ID NO: 37238 - DNA, 30 bp, Homo sapiens
ctcgaacacttgcaaggagttttactatct

SEQ ID NO: 37239 - DNA, 30 bp, Homo sapiens
acaaggcctgtccgtccagattcttcttgg

SEQ ID NO: 37240 - DNA, 30 bp, Homo sapiens
tttgagtgagcactccagtcagaacgaact

SEQ ID NO: 37241 - DNA, 30 bp, Homo sapiens
agactgcctctcccctcataggcggactcc

SEQ ID NO: 37242 - DNA, 30 bp, Homo sapiens
ggtctcatcgaagtccacgccaccagctgg

SEQ ID NO: 37243 - DNA, 30 bp, Homo sapiens
gggtctgtgcaagtagcaccgtggtacttg

SEQ ID NO: 37244 - DNA, 30 bp, Homo sapiens
atagctttttcaccacttttgttgatttct

SEQ ID NO: 37245 - DNA, 30 bp, Homo sapiens
cttcaacaatgtgtgcagcagaaggacgat

SEQ ID NO: 37246 - DNA, 30 bp, Homo sapiens
ggctgtcagtgtgccctctaaaacaacagc

SEQ ID NO: 37247 - DNA, 30 bp, Homo sapiens
agaaggaacactagcttcgaattaggcaaa

SEQ ID NO: 37248 - DNA, 30 bp, Homo sapiens
cctagggtctgagttaactgcaaagtcaat

SEQ ID NO: 37249 - DNA, 30 bp, Homo sapiens
ttgagggtgtcccggagcatcaaatctcga

SEQ ID NO: 37250 - DNA, 30 bp, Homo sapiens
cgttggaagtcggaagtgatagtgggcttg

SEQ ID NO: 37251 - DNA, 30 bp, Homo sapiens
ctgtatcctcctgtctggctgataacatgg

SEQ ID NO: 37252 - DNA, 30 bp, Homo sapiens
agttggaggtatcagagtgaacactgccag

SEQ ID NO: 37253 - DNA, 30 bp, Homo sapiens
agttggaggtatcagagtgaacactccctg

SEQ ID NO: 37254 - DNA, 30 bp, Homo sapiens
ctgtagcctcccgtctgattgataacatga

SEQ ID NO: 37255 - DNA, 30 bp, Homo sapiens
tagaggtatccgagtgcacacttcctgggc

SEQ ID NO: 37256 - DNA, 30 bp, Homo sapiens
gccagggtctccagcaggtgaggcagttgc

SEQ ID NO: 37257 - DNA, 30 bp, Homo sapiens
ccccggtggtggtggtggtggctatggctg

SEQ ID NO: 37258 - DNA, 30 bp, Homo sapiens
tccaggatgaggtcgtcaccttccagtgtc

SEQ ID NO: 37259 - DNA, 30 bp, Homo sapiens
tcatggacactgctacttgttcgatgaagc

SEQ ID NO: 37260 - DNA, 30 bp, Homo sapiens
atctgtagttggcaagctggagaaccagga

SEQ ID NO: 37261 - DNA, 30 bp, Homo sapiens
tcacatcttttttggtcagttcaccacagt

SEQ ID NO: 37262 - DNA, 30 bp, Homo sapiens
gcccttctcagaggaaagcctggcattgat

SEQ ID NO: 37263 - DNA, 30 bp, Homo sapiens
gccacccgtctccgaggaaagcctgacatt

SEQ ID NO: 37264 - DNA, 30 bp, Homo sapiens
tcccggtgacctcggacgtcagcctggcgt

SEQ ID NO: 37265 - DNA, 30 bp, Homo sapiens
agtagggggagaatttctgccgctcagcct

SEQ ID NO: 37266 - DNA, 30 bp, Homo sapiens
tccagggcactgtaccaagaaactgaatgc

SEQ ID NO: 37267 - DNA, 30 bp, Homo sapiens
ttccagctccacgagcagatccccttctcc

SEQ ID NO: 37268 - DNA, 30 bp, Homo sapiens
acgttgtaccttcttgctggccaagacatc

SEQ ID NO: 37269 - DNA, 30 bp, Homo sapiens
ctcccacacctcggtccagatggctccgtg

SEQ ID NO: 37270 - DNA, 30 bp, Homo sapiens
cacaggtagatctcgcgcttggccgtctgg

SEQ ID NO: 37271 - DNA, 30 bp, Homo sapiens
agctccttcctctccagagtgctgtgaagg

SEQ ID NO: 37272 - DNA, 30 bp, Homo sapiens
tagaggaggctttctgatggaggagatgag

SEQ ID NO: 37273 - DNA, 30 bp, Homo sapiens
taatgggggaatcacctctggacggtctgg

SEQ ID NO: 37274 - DNA, 30 bp, Homo sapiens
aagaggaagtaagcacagtctttcctgcca

SEQ ID NO: 37275 - DNA, 30 bp, Homo sapiens; identical to SEQ ID NO: 37273

SEQ ID NO: 37276 - DNA, 30 bp, Homo sapiens
cacaggtacctcgaaggttgtcactggata

SEQ ID NO: 37277 - DNA, 30 bp, Homo sapiens
cacaggcacctgctgctgctgctgctgcct

SEQ ID NO: 37278 - DNA, 30 bp, Homo sapiens
cactaggctctctaatttcaacctttggtt

SEQ ID NO: 37279 - DNA, 30 bp, Homo sapiens
cattggtatatggaggttgttccaggggcc

SEQ ID NO: 37280 - DNA, 30 bp, Homo sapiens
gttttgttcagatgtgatttccatatttgt

SEQ ID NO: 37281 - DNA, 30 bp, Homo sapiens
gagtttgctcctggcgacttcttttggttt

SEQ ID NO: 37282 - DNA, 30 bp, Homo sapiens
cacagggtcgtttccccggcagtcttgcaa

SEQ ID NO: 37283 - DNA, 30 bp, Homo sapiens
ctctggcggacatcttgaagcagtttgtta

SEQ ID NO: 37284 - DNA, 30 bp, Homo sapiens
gacgcttcacaccaggggactctttgttgc

SEQ ID NO: 37285 - DNA, 30 bp, Homo sapiens
gctttctctctcgcatatgcaagtcaattt

SEQ ID NO: 37286 - DNA, 30 bp, Homo sapiens
gtatggatgtagacgcatctgtttgctgta

SEQ ID NO: 37287 - DNA, 30 bp, Homo sapiens
tacaggtaaacttctcttctagtgagagta

SEQ ID NO: 37288 - DNA, 30 bp, Homo sapiens
ccctgggatatttaaatatatttgggatac

SEQ ID NO: 37289 - DNA, 30 bp, Homo sapiens
cttcggggacaggtacctgccaggagggga

SEQ ID NO: 37290 - DNA, 30 bp, Homo sapiens
tactggttgactgggcacttgtatgcagta

SEQ ID NO: 37291 - DNA, 30 bp, Homo sapiens
cttaggactctcagtagcacctcctgcttg

SEQ ID NO: 37292 - DNA, 30 bp, Homo sapiens
ctcgaaagttggacttacattaccagaaag

SEQ ID NO: 37293 - DNA, 30 bp, Homo sapiens
ttcctagagtggtcccctccaatagactga

SEQ ID NO: 37294 - DNA, 30 bp, Homo sapiens
gataggtggaatctgtagaaaactcacctg

SEQ ID NO: 37295 - DNA, 30 bp, Homo sapiens
gggaggatttaaacaatcttctcgagacag

SEQ ID NO: 37296 - DNA, 30 bp, Homo sapiens
tcaagcattctgagtcctcctccctctggc

SEQ ID NO: 37297 - DNA, 30 bp, Homo sapiens
agctggatttgaagattgaagttccatatc

SEQ ID NO: 37298 - DNA, 30 bp, Homo sapiens
ctacgtattctgattctgagagctgtttct

SEQ ID NO: 37299 - DNA, 30 bp, Homo sapiens
gagtggaaacattgaggaatgaaaaacaaa

SEQ ID NO: 37300 - DNA, 30 bp, Homo sapiens
caaaggattcctcagttgtctgcagctgat

SEQ ID NO: 37301 - DNA, 30 bp, Homo sapiens
agatggatgttaatattagaaaactcacgt

SEQ ID NO: 37302 - DNA, 30 bp, Homo sapiens
tctccgccttacccatcataataggacaag

SEQ ID NO: 37303 - DNA, 30 bp, Homo sapiens
tagaggatggaccctgaggaaggctgggac

SEQ ID NO: 37304 - DNA, 30 bp, Homo sapiens
tcaactgatcccagatcaggaggaaggcag

SEQ ID NO: 37305 - DNA, 30 bp, Homo sapiens
ccctgggagtaatcgataatatctttcaag

SEQ ID NO: 37306 - DNA, 30 bp, Homo sapiens
cattgacattagcgtgatcccctttcctat

SEQ ID NO: 37307 - DNA, 30 bp, Homo sapiens
cactggtcactgttgtcagtcgtgctgttc

SEQ ID NO: 37308 - DNA, 30 bp, Homo sapiens
cacaggatattgggggatgtgtaacaaatg

SEQ ID NO: 37309 - DNA, 30 bp, Homo sapiens
acctggtcatggccctctaatctctgagac

SEQ ID NO: 37310 - DNA, 30 bp, Homo sapiens
ctatttcggaaggtggaattttcttcaccc

SEQ ID NO: 37311 - DNA, 30 bp, Homo sapiens
ctatttcgaaaggtggagttttcttcacta

SEQ ID NO: 37312 - DNA, 30 bp, Homo sapiens
tattctgaaatgggggattttcttcgactt

SEQ ID NO: 37313 - DNA, 30 bp, Homo sapiens
gttattggggaaggtagaatttccttgtat

SEQ ID NO: 37314 - DNA, 30 bp, Homo sapiens
tattcctaccagtgtcatgaacttgaaaat

SEQ ID NO: 37315 - DNA, 30 bp, Homo sapiens
agagtcctggcttacaatatttgggaatat

SEQ ID NO: 37316 - DNA, 30 bp, Homo sapiens
ggagagaagttggggataatcggcttcagg

SEQ ID NO: 37317 - DNA, 30 bp, Homo sapiens
aactgggatttgcctcgctaaccctctctg

SEQ ID NO: 37318 - DNA, 30 bp, Homo sapiens
tatttctgaacttggggttttccttaactt

SEQ ID NO: 37319 - DNA, 30 bp, Homo sapiens
ctattccggaaggcagcagttttccctatt

SEQ ID NO: 37320 - DNA, 30 bp, Homo sapiens
gaacgggaagctattccgagaggtgggggt

SEQ ID NO: 37321 - DNA, 30 bp, Homo sapiens
tattctgaaatgggcgattttcttccactt

SEQ ID NO: 37322 - DNA, 30 bp, Homo sapiens
ccattcctaaagttagagttttgttccatt

SEQ ID NO: 37323 - DNA, 30 bp, Homo sapiens
ctattggggagagtagaattttcctctatt

SEQ ID NO: 37324 - DNA, 30 bp, Homo sapiens
ctggggtgctgatagaaaaccctttttctc

SEQ ID NO: 37325 - DNA, 30 bp, Homo sapiens
tcatgccgcaaacttcaaagtaaaaaccaa

SEQ ID NO: 37326 - DNA, 30 bp, Homo sapiens
aacaggctcaaaaaacatctccttaaaaga

SEQ ID NO: 37327 - DNA, 30 bp, Homo sapiens
ttaacccatgactgtctttagaaaataccg

SEQ ID NO: 37328 - DNA, 30 bp, Homo sapiens
aaaacgtttcttctctttcttcttcgagta

SEQ ID NO: 37329 - DNA, 30 bp, Homo sapiens
tacttcttctccttcttgcccgacttcttc

SEQ ID NO: 37330 - DNA, 30 bp, Homo sapiens
gtaggttggaatctcctttcatttcaagta

SEQ ID NO: 37331 - DNA, 30 bp, Homo sapiens
gattagggtctccttttgtttcaagtaaat

SEQ ID NO: 37332 - DNA, 30 bp, Homo sapiens
ctcgccgttcttctttgtttgcatctacct

SEQ ID NO: 37333 - DNA, 30 bp, Homo sapiens
taggcggaaagaaactcacctgaagttgcc

SEQ ID NO: 37334 - DNA, 30 bp, Homo sapiens
ggaaataaaggaagggctgggctcacctga

SEQ ID NO: 37335 - DNA, 30 bp, Homo sapiens
catgatcagcttcattcttatattcatgaa

SEQ ID NO: 37336 - DNA, 30 bp, Homo sapiens
ccaaaggggtgtcttctataggaaacttgg

SEQ ID NO: 37337 - DNA, 30 bp, Homo sapiens
agaagggtcataagcgattttgtgatcttc

SEQ ID NO: 37338 - DNA, 30 bp, Homo sapiens
aaatagtatctgaggcaaaagggaccccag

SEQ ID NO: 37339 - DNA, 30 bp, Homo sapiens
ttagaaggcatttctggattgtcattactt

SEQ ID NO: 37340 - DNA, 30 bp, Homo sapiens
gggaagtcaattcactggaattacaaagtg

SEQ ID NO: 37341 - DNA, 30 bp, Homo sapiens
ctcaggatgggaagtcgactcgctggaatt

SEQ ID NO: 37342 - DNA, 30 bp, Homo sapiens
tcagagtctcaggatgtgaagtcaaatcct

SEQ ID NO: 37343 - DNA, 30 bp, Homo sapiens
cgctgggagttaaaatgctagccagtagca

SEQ ID NO: 37344 - DNA, 30 bp, Homo sapiens
cacaaaggcactaactttgatctaggaagg

SEQ ID NO: 37345 - DNA, 30 bp, Homo sapiens
gagaggccagtactctctaggacatggcct

SEQ ID NO: 37346 - DNA, 30 bp, Homo sapiens
tggtttcgcgcaaacggtccaatgatcccg

SEQ ID NO: 37347 - DNA, 30 bp, Homo sapiens
tacccaggccatgtccccgaatgggcagga

SEQ ID NO: 37348 - DNA, 30 bp, Homo sapiens
attgaggccttggctcaggattggctgggg

SEQ ID NO: 37349 - DNA, 30 bp, Homo sapiens
tacaagctggtggtgtatcaattcgttctt

SEQ ID NO: 37350 - DNA, 30 bp, Homo sapiens
cctcctcttctctttcacactgtattgtaa

SEQ ID NO: 37351 - DNA, 30 bp, Homo sapiens
gttaaggggggcacgggagcgccgttgaca

SEQ ID NO: 37352 - DNA, 30 bp, Homo sapiens
acagcaagtccatcttgggtctgtagtgca

SEQ ID NO: 37353 - DNA, 30 bp, Homo sapiens
catagggtatgactgatacaaagggccatc

SEQ ID NO: 37354 - DNA, 30 bp, Homo sapiens
gaccataatgaaggacaagcagaccatcct

SEQ ID NO: 37355 - DNA, 30 bp, Homo sapiens
tgcagtaccggaccggtctcatcagcacaa

SEQ ID NO: 37356 - DNA, 30 bp, Homo sapiens
tcggggctccgtgtactttcaacacaccgt

SEQ ID NO: 37357 - DNA, 30 bp, Homo sapiens
ccgtggacaggggaggaaatgggttctgct

SEQ ID NO: 37358 - DNA, 30 bp, Homo sapiens
aagtggggtgaggctcgcggctaggaccct

SEQ ID NO: 37359 - DNA, 30 bp, Homo sapiens
tacatctggcttattctttgcttcaaggca

SEQ ID NO: 37360 - DNA, 30 bp, Homo sapiens
agatggttggaggttgtggagaaagctttt

SEQ ID NO: 37361 - DNA, 30 bp, Homo sapiens
tccagggcctcaagctcagccaacacctct

SEQ ID NO: 37362 - DNA, 30 bp, Homo sapiens
caaaggacatgcttttctctttgcttttcc

SEQ ID NO: 37363 - DNA, 30 bp, Homo sapiens
gcacggcagcttcggcagcagctatggcag

SEQ ID NO: 37364 - DNA, 30 bp, Homo sapiens
agtaggactgaccaaaagtttgtgccagtt

SEQ ID NO: 37365 - DNA, 30 bp, Homo sapiens
actaggagtaagttctgagtttgatgctat

SEQ ID NO: 37366 - DNA, 30 bp, Homo sapiens
ttgaggtggccttcgttttcactctcattc

SEQ ID NO: 37367 - DNA, 30 bp, Homo sapiens
ctctgggctcccaccgtttcaggttctttt

SEQ ID NO: 37368 - DNA, 30 bp, Homo sapiens
ccactgcttttctttatctgttaaaggcac

SEQ ID NO: 37369 - DNA, 30 bp, Homo sapiens
acctggaccactgcttttctttatctgtta

SEQ ID NO: 37370 - DNA, 30 bp, Homo sapiens
gggaggggcagcttcatgattttttctctc

SEQ ID NO: 37371 - DNA, 30 bp, Homo sapiens
atctggcagagggaggctcaggaccttctg

SEQ ID NO: 37372 - DNA, 30 bp, Homo sapiens
atccttcttcatcctcgatcttgggagcca

SEQ ID NO: 37373 - DNA, 30 bp, Homo sapiens
ttgaaggagtttggtccagctgatgttggt

SEQ ID NO: 37374 - DNA, 30 bp, Homo sapiens
gcttctggttatcagaaaacccatgctttc

SEQ ID NO: 37375 - DNA, 30 bp, Homo sapiens
gggtggcaggatttctttgaagtagaatct

SEQ ID NO: 37376 - DNA, 30 bp, Homo sapiens
gttctagtaccccagtttcaattacagtca

SEQ ID NO: 37377 - DNA, 30 bp, Homo sapiens
actgctcgtctgacacactttgctgcgagg

SEQ ID NO: 37378 - DNA, 30 bp, Homo sapiens
gtcatgcaaactcattgacgatttttgcag

SEQ ID NO: 37379 - DNA, 30 bp, Homo sapiens
tactggtgttccagcaggggctgggctgcc

SEQ ID NO: 37380 - DNA, 30 bp, Homo sapiens
cccaggggaggttctgctgcttgtaccgta

SEQ ID NO: 37381 - DNA, 30 bp, Homo sapiens
tcctgggacgcagcagcccgcacaggttga

SEQ ID NO: 37382 - DNA, 30 bp, Homo sapiens
gcttctgattcttggtcttgaacatcatga

SEQ ID NO: 37383 - DNA, 30 bp, Homo sapiens
caggggcagaaggggaataagggtgacgtg

SEQ ID NO: 37384 - DNA, 30 bp, Homo sapiens
cagggggcttgtgtcgggggctgggggctg

SEQ ID NO: 37385 - DNA, 30 bp, Homo sapiens
aggactgagacccagccttcttcttctgga

SEQ ID NO: 37386 - DNA, 30 bp, Homo sapiens
aggagctgggatcctttttccttttctgaa

SEQ ID NO: 37387 - DNA, 30 bp, Homo sapiens
tcagaatgtccaccagagcttgaagcagcc

SEQ ID NO: 37388 - DNA, 30 bp, Homo sapiens
gggtggcaagaggcggcgtgcaggcacctg

SEQ ID NO: 37389 - DNA, 30 bp, Homo sapiens
ttaaggatgcttttcaggcttctctccacg

SEQ ID NO: 37390 - DNA, 30 bp, Homo sapiens
agctggcagccagacctggggtttggtggg

SEQ ID NO: 37391 - DNA, 30 bp, Homo sapiens
cgttggcacagattgttctttttcacaagc

SEQ ID NO: 37392 - DNA, 30 bp, Homo sapiens
tactggtagtaggagtaactctcgtcatca

SEQ ID NO: 37393 - DNA, 30 bp, Homo sapiens
gtgtggaaacgaacctctcttctgtggtca

SEQ ID NO: 37394 - DNA, 30 bp, Homo sapiens
tccaggttcccttgcttctccgggttgcgg

SEQ ID NO: 37395 - DNA, 30 bp, Homo sapiens
ctcttgttcaatctgccaccggaacacgtg

SEQ ID NO: 37396 - DNA, 30 bp, Homo sapiens
acccggccaggaggcacgtgcggcagcaga

SEQ ID NO: 37397 - DNA, 30 bp, Homo sapiens
tacacattccagggccacccaatggtccac

SEQ ID NO: 37398 - DNA, 30 bp, Homo sapiens
tcccgtgcggtacgtctaggtgctgatgag

SEQ ID NO: 37399 - DNA, 30 bp, Homo sapiens
cactggagctcctgggaggcctgcgccagg

SEQ ID NO: 37400 - DNA, 30 bp, Homo sapiens
acttgatgaggtctctctgattctgagctt

SEQ ID NO: 37401 - DNA, 30 bp, Homo sapiens
cggcccagttaatgagccaggacggaattt

SEQ ID NO: 37402 - DNA, 30 bp, Homo sapiens
gacaggctcttgccatgtctttcaagaagt

SEQ ID NO: 37403 - DNA, 30 bp, Homo sapiens
tgatcaatcatgtctgtgtgcccgttccag

SEQ ID NO: 37404 - DNA, 30 bp, Homo sapiens
cagttcagtcttgaccttgtgcatcaaatc

SEQ ID NO: 37405 - DNA, 30 bp, Homo sapiens
tgatatcataggctgcagccttgtgcctgg

SEQ ID NO: 37406 - DNA, 30 bp, Homo sapiens
cttttcatcctcatccccctcgctcatgct

SEQ ID NO: 37407 - DNA, 30 bp, Homo sapiens
agaagtctctgcacctcgcccaactcttca

SEQ ID NO: 37408 - DNA, 30 bp, Homo sapiens
tagaagtcaccatcgcgctcccccaggggc

SEQ ID NO: 37409 - DNA, 30 bp, Homo sapiens
ttcagggagagtgactgcattcgttttcct

SEQ ID NO: 37410 - DNA, 30 bp, Homo sapiens
tttcaggtagtaacccatattcatttagga

SEQ ID NO: 37411 - DNA, 30 bp, Homo sapiens
cagaggggccaagagcagtgtccatcctca

SEQ ID NO: 37412 - DNA, 30 bp, Homo sapiens
ttttgaaggtctgaagtattaagttggttt

SEQ ID NO: 37413 - DNA, 30 bp, Homo sapiens
gtcctctagcactgagctcttggcctccac

SEQ ID NO: 37414 - DNA, 30 bp, Homo sapiens
ttgttgtggtgacaggtctttttgttgtgt

SEQ ID NO: 37415 - DNA, 30 bp, Homo sapiens
ctccctataatctctgagtaatcttccttt

SEQ ID NO: 37416 - DNA, 30 bp, Homo sapiens
cggtgtatctgttacatcctgcttccacac

SEQ ID NO: 37417 - DNA, 30 bp, Homo sapiens
aatgaatgaagtcctgaaactgcttaccca

SEQ ID NO: 37418 - DNA, 30 bp, Homo sapiens
gagtctgatgatttgggggccagcaactct

SEQ ID NO: 37419 - DNA, 30 bp, Homo sapiens
ctctggtttaagacgacctccatctccttc

SEQ ID NO: 37420 - DNA, 30 bp, Homo sapiens
cacttagttgtccatatcttgccatctgta

SEQ ID NO: 37421 - DNA, 30 bp, Homo sapiens
agtcactggattaaagggagtccacgtgcc

SEQ ID NO: 37422 - DNA, 30 bp, Homo sapiens
ccatggacaggtactgttcgtacgacacct

SEQ ID NO: 37423 - DNA, 30 bp, Homo sapiens
ggagagtatctttgtattgacactgtttga

SEQ ID NO: 37424 - DNA, 30 bp, Homo sapiens
ctgtggatagtaagactgctgtgggggctg

SEQ ID NO: 37425 - DNA, 30 bp, Homo sapiens
tgtcgttgctggggagcgggggaaggaccc

SEQ ID NO: 37426 - DNA, 30 bp, Homo sapiens
cgctatcctcactgtgacacgtggcagagt

SEQ ID NO: 37427 - DNA, 30 bp, Homo sapiens
cttttctggggttttcttccaaatcagtct

SEQ ID NO: 37428 - DNA, 30 bp, Homo sapiens
tcaccctcggaatcgctgtccctcttcatg

SEQ ID NO: 37429 - DNA, 30 bp, Homo sapiens
gagccacggatggggatgaaatccaggttg

SEQ ID NO: 37430 - DNA, 30 bp, Homo sapiens
ttccttggctaccataacactggcagggga

SEQ ID NO: 37431 - DNA, 30 bp, Homo sapiens
tgtaggcgctcctttcactaggtcaaggtc

SEQ ID NO: 37432 - DNA, 30 bp, Homo sapiens
cagagggatgggaaacactaggtaaggcct

SEQ ID NO: 37433 - DNA, 30 bp, Homo sapiens
tttaggatgccagtaaagatgggtattagc

SEQ ID NO: 37434 - DNA, 30 bp, Homo sapiens
aactggttcttgcttcttgtgcagctaact

SEQ ID NO: 37435 - DNA, 30 bp, Homo sapiens
aatgtgtctcatcatgtttttcttcagcat

SEQ ID NO: 37436 - DNA, 30 bp, Homo sapiens
tcccattctggttgtgttcatcttcggcag

SEQ ID NO: 37437 - DNA, 30 bp, Homo sapiens
ttagagtgatccttcttgtctgtcttattt

SEQ ID NO: 37438 - DNA, 30 bp, Homo sapiens
atgtgagatgttctgaatctttttcatttt

SEQ ID NO: 37439 - DNA, 30 bp, Homo sapiens
tcaaggctgcagcagccattgatgggggcc

SEQ ID NO: 37440 - DNA, 30 bp, Homo sapiens
cactggtctggcttttgggttggtatctcc

SEQ ID NO: 37441 - DNA, 30 bp, Homo sapiens
catctgcctcttcaattacctgaatctcat

SEQ ID NO: 37442 - DNA, 30 bp, Homo sapiens
ggtagggtctccacctgaccccccgccacc

SEQ ID NO: 37443 - DNA, 30 bp, Homo sapiens
ccacgggggacttgtcttctgttgcaatgt

SEQ ID NO: 37444 - DNA, 30 bp, Homo sapiens
gtcctctggttgtcgaggggtaagtcccca

SEQ ID NO: 37445 - DNA, 30 bp, Homo sapiens
gtcaggagaacgatcatctatgacacaggc

SEQ ID NO: 37446 - DNA, 30 bp, Homo sapiens
tgtccctctgggccagggcctcagtgtatt

SEQ ID NO: 37447 - DNA, 30 bp, Homo sapiens
acaaggctggagtacatggcagagccctta

SEQ ID NO: 37448 - DNA, 30 bp, Homo sapiens
cctcaatactgtcagtgaactcagtgcttg

SEQ ID NO: 37449 - DNA, 30 bp, Homo sapiens
cagataggtagctgcacaaaagggggacag

SEQ ID NO: 37450 - DNA, 30 bp, Homo sapiens
agttccgcttggcctggccgctttccccat

SEQ ID NO: 37451 - DNA, 30 bp, Homo sapiens
tactggatgcagcaggacttggatgtagtt

SEQ ID NO: 37452 - DNA, 30 bp, Homo sapiens
ctcttgtagcaaatagccacaggcagaacc

SEQ ID NO: 37453 - DNA, 30 bp, Homo sapiens
cacaggatacagcaggttgaagacttgggt

SEQ ID NO: 37454 - DNA, 30 bp, Homo sapiens
cctgaatcttcagcagctttttcggctcct

SEQ ID NO: 37455 - DNA, 30 bp, Homo sapiens
atctgggactcgggtgctgcctctatcaag

SEQ ID NO: 37456 - DNA, 30 bp, Homo sapiens
aggcggaatttttccatttgttctgtcgaa

SEQ ID NO: 37457 - DNA, 30 bp, Homo sapiens
tattgggccagctcgtgcagctccaggtgg

SEQ ID NO: 37458 - DNA, 30 bp, Homo sapiens
ctgagcgagctcatgcaattccaggtggct

SEQ ID NO: 37459 - DNA, 30 bp, Homo sapiens
ctgaggtaataactgtgagttcaactcaaa

SEQ ID NO: 37460 - DNA, 30 bp, Homo sapiens
taggggctgtcgccttcctgctcctcgctc

SEQ ID NO: 37461 - DNA, 30 bp, Homo sapiens
attcaggaggtggtcggaggttccgcagct

SEQ ID NO: 37462 - DNA, 30 bp, Homo sapiens
ggctggcagatgtgcaaaggctgtgcaaaa

SEQ ID NO: 37463 - DNA, 30 bp, Homo sapiens
agatggaagcctcaaacttttgcactttag

SEQ ID NO: 37464 - DNA, 30 bp, Homo sapiens
ctgtttttcacatctctgcttctctctctg

SEQ ID NO: 37465 - DNA, 30 bp, Homo sapiens
tccaatagacgtttgtgaacgtcctgctgt

SEQ ID NO: 37466 - DNA, 30 bp, Homo sapiens
cctcttcccgataatccggattcaggcttg

SEQ ID NO: 37467 - DNA, 30 bp, Homo sapiens
tttacctgactccctaggccttcccgtgtc

SEQ ID NO: 37468 - DNA, 30 bp, Homo sapiens
ggctccaagggtctccttcagtgccgtctt

SEQ ID NO: 37469 - DNA, 30 bp, Homo sapiens
gtgctccctctgcacacacagtcacactcc

SEQ ID NO: 37470 - DNA, 30 bp, Homo sapiens
tcgaggtggtcttgagctgcagatacaatc

SEQ ID NO: 37471 - DNA, 30 bp, Homo sapiens
tacaggaagctgtcttccaccaggtctgaa

SEQ ID NO: 37472 - DNA, 30 bp, Homo sapiens
ggaaggccagaaagcagtggtctgcctgcc

SEQ ID NO: 37473 - DNA, 30 bp, Homo sapiens
tacaggaagctatcctctgcttccgcccga

SEQ ID NO: 37474 - DNA, 30 bp, Homo sapiens
caggaaaactcaacagtggtagctactgtg

SEQ ID NO: 37475 - DNA, 30 bp, Homo sapiens
attggcaccacgaacttcaaaaggtgggtc

SEQ ID NO: 37476 - DNA, 30 bp, Homo sapiens
actgacggacttaaacttgatccatggatt

SEQ ID NO: 37477 - DNA, 30 bp, Homo sapiens
ctgaggtatagagttgtcctctagaatctt

SEQ ID NO: 37478 - DNA, 30 bp, Homo sapiens
agtcggataggattctctaggtttgcttta

SEQ ID NO: 37479 - DNA, 30 bp, Homo sapiens
ccttggaccccatagtggagttggccggtg

SEQ ID NO: 37480 - DNA, 30 bp, Homo sapiens
gtgccttcttcttcttcttgggtttttctt

SEQ ID NO: 37481 - DNA, 30 bp, Homo sapiens
aagctcttccttggtcctgctcagttttgt

SEQ ID NO: 37482 - DNA, 30 bp, Homo sapiens
ttttccctagtctttcatggtctccctccc

SEQ ID NO: 37483 - DNA, 30 bp, Homo sapiens
gtcatcaagctccacatcactgaggtcaat

SEQ ID NO: 37484 - DNA, 30 bp, Homo sapiens
tgctatctttaaatgcaatttgtactaatc

SEQ ID NO: 37485 - DNA, 30 bp, Homo sapiens
cactggaggtccctttggcttagccaccac

SEQ ID NO: 37486 - DNA, 30 bp, Homo sapiens
ctgcggaacgtcgtcatgtctttgggttct

SEQ ID NO: 37487 - DNA, 30 bp, Homo sapiens
gctgacgcggtacgtggacgtgttcttggg

SEQ ID NO: 37488 - DNA, 30 bp, Homo sapiens
agcagcccggccctgggccccagcaccgcc

SEQ ID NO: 37489 - DNA, 30 bp, Homo sapiens
ccctgggttcactgctgggattgctccaat

SEQ ID NO: 37490 - DNA, 30 bp, Homo sapiens
cacatggccacttcttttgccaggttcttt

SEQ ID NO: 37491 - DNA, 30 bp, Homo sapiens
acttggggaacacagtgaccacttcataac

SEQ ID NO: 37492 - DNA, 30 bp, Homo sapiens
agctgagggtggcaggtgcggagtagcgct

SEQ ID NO: 37493 - DNA, 30 bp, Homo sapiens
gcttggctggatgggtctcctggtcttcct

SEQ ID NO: 37494 - DNA, 30 bp, Homo sapiens
agtcggcacaggtgtagcagccggggtggc

SEQ ID NO: 37495 - DNA, 30 bp, Homo sapiens
ctttgggatacagagtgaccgtgtcatagc

SEQ ID NO: 37496 - DNA, 30 bp, Homo sapiens
cagacgagttccaccttggcattggggtac

SEQ ID NO: 37497 - DNA, 30 bp, Homo sapiens
tcactgcacatgaagcactcgggatggtag

SEQ ID NO: 37498 - DNA, 30 bp, Homo sapiens
cacaggggcttgtccttcttggagaaaaag

SEQ ID NO: 37499 - DNA, 30 bp, Homo sapiens
gccaggcacggtggctcacgcctgtaatct

SEQ ID NO: 37500 - DNA, 30 bp, Homo sapiens
tcatggtgccagtcacgtaattttgtgtat

SEQ ID NO: 37501 - DNA, 30 bp, Homo sapiens
tggagaaaaaggtctgaccttccaaacttt

SEQ ID NO: 37502 - DNA, 30 bp, Homo sapiens
agaaggcatggctcttgcagagaggcctgt

SEQ ID NO: 37503 - DNA, 30 bp, Homo sapiens
tacgactgcacgttgagcacgtgggcagag

SEQ ID NO: 37504 - DNA, 30 bp, Homo sapiens
tcttggttttgatacgcccctacaacatga

SEQ ID NO: 37505 - DNA, 30 bp, Homo sapiens
ttgtaatatgcaccgattgattctgagtta

SEQ ID NO: 37506 - DNA, 30 bp, Homo sapiens
cactgcacagcggcgtccgggtggctctgg

SEQ ID NO: 37507 - DNA, 30 bp, Homo sapiens
gataatacgtcctgttaggcaagggtttcc

SEQ ID NO: 37508 - DNA, 30 bp, Homo sapiens
cgacatttttcgcataaccacaacgatgat

SEQ ID NO: 37509 - DNA, 30 bp, Homo sapiens
taagtcactcagctccatgtcatcctttcg

SEQ ID NO: 37510 - DNA, 30 bp, Homo sapiens
aagatgaccttgagagctttaagctcatcc

SEQ ID NO: 37511 - DNA, 30 bp, Homo sapiens
tgctggtgctgcctttttggctaaatcttg

SEQ ID NO: 37512 - DNA, 30 bp, Homo sapiens
aacaggttgggctaattaataactccaact

SEQ ID NO: 37513 - DNA, 30 bp, Homo sapiens
ccttttagcacttcgccgccgtacatttac

SEQ ID NO: 37514 - DNA, 30 bp, Homo sapiens
tccaggcaaactgaaccgtcgcatgatcat

SEQ ID NO: 37515 - DNA, 30 bp, Homo sapiens
ttctggggatggtcgaagtttactgatctc

SEQ ID NO: 37516 - DNA, 30 bp, Homo sapiens
ccgagggaggaaagctctccagggcctcca

SEQ ID NO: 37517 - DNA, 30 bp, Homo sapiens
atcgtggttcctgcggccgccgaggcgcga

SEQ ID NO: 37518 - DNA, 30 bp, Homo sapiens
aggtggcgcctgctcccctgtgctccctgg

SEQ ID NO: 37519 - DNA, 30 bp, Homo sapiens
ccagcaggtcggatggtgatggacggggac

SEQ ID NO: 37520 - DNA, 30 bp, Homo sapiens
ctccggtccttctacctgtgagtggtcatc

SEQ ID NO: 37521 - DNA, 30 bp, Homo sapiens
cagcaccgtggcctggacgacgatctctgg

SEQ ID NO: 37522 - DNA, 30 bp, Homo sapiens
acccctctgtcaagtctgcgatgctctcca

SEQ ID NO: 37523 - DNA, 30 bp, Homo sapiens
taagcattcggatcttcctgagaccgagtc

SEQ ID NO: 37524 - DNA, 30 bp, Homo sapiens
tttttggcgatgataattgtagggaaagaa

SEQ ID NO: 37525 - DNA, 30 bp, Homo sapiens
ttctgggacagacttcataatattccaggc

SEQ ID NO: 37526 - DNA, 30 bp, Homo sapiens
ccgaggccagagcccagtcctctgcagccc

SEQ ID NO: 37527 - DNA, 30 bp, Homo sapiens
acacggtggtgactgagagaagagggttgt

SEQ ID NO: 37528 - DNA, 30 bp, Homo sapiens
tccaggaatttgagactagcctgggcaaca

SEQ ID NO: 37529 - DNA, 30 bp, Homo sapiens
catgggatgcgtggggagggtgcgggctta

SEQ ID NO: 37530 - DNA, 30 bp, Homo sapiens
aacagggtgaaacccccatctctttctcta

SEQ ID NO: 37531 - DNA, 30 bp, Homo sapiens
actcggatgggccaaataagtcatctgata

SEQ ID NO: 37532 - DNA, 30 bp, Homo sapiens
tttgataccagttgggctttaccctcttca

SEQ ID NO: 37533 - DNA, 30 bp, Homo sapiens
gtgaggctgtactgtgggcccgttcttttg

SEQ ID NO: 37534 - DNA, 30 bp, Homo sapiens
catcggggtgctgcggaccttgccttcctc

SEQ ID NO: 37535 - DNA, 30 bp, Homo sapiens
gataggaaggaattgtatactctagtgccg

SEQ ID NO: 37536 - DNA, 30 bp, Homo sapiens
cagtggtcaccgacaagaaggcattatgga

SEQ ID NO: 37537 - DNA, 30 bp, Homo sapiens
cttcggtgggggagccaatttgatgatctc

SEQ ID NO: 37538 - DNA, 30 bp, Homo sapiens
taacggtgctgcagaattttcacaatacaa

SEQ ID NO: 37539 - DNA, 30 bp, Homo sapiens
gcagcgccagggcctggcccatcgaggact

SEQ ID NO: 37540 - DNA, 30 bp, Homo sapiens
caacggtcctggcgtcgaagtggaggtgat

SEQ ID NO: 37541 - DNA, 30 bp, Homo sapiens
acttcccagacagctgctcgtacagtttgg

SEQ ID NO: 37542 - DNA, 30 bp, Homo sapiens
agcaggcagctatctccgcctggtttttgt

SEQ ID NO: 37543 - DNA, 30 bp, Homo sapiens
tcaagggagccttccgttctagagtatctg

SEQ ID NO: 37544 - DNA, 30 bp, Homo sapiens
taaaggtctccttcatctttttgacaacag

SEQ ID NO: 37545 - DNA, 30 bp, Homo sapiens
agctgtcatggtgacgaagtcctcgaagct

SEQ ID NO: 37546 - DNA, 30 bp, Homo sapiens
acagcggggccggggagtttcccgccggcg

SEQ ID NO: 37547 - DNA, 30 bp, Homo sapiens
tacagggtactgtaagatggaggcggcggc

SEQ ID NO: 37548 - DNA, 30 bp, Homo sapiens
gccagtgtgggtattctggtgtctggcgag

SEQ ID NO: 37549 - DNA, 30 bp, Homo sapiens
tagaggtccttgaaaaataagtctgatgta

SEQ ID NO: 37550 - DNA, 30 bp, Homo sapiens
aattggaccttggaaaattaatttgatgca

SEQ ID NO: 37551 - DNA, 30 bp, Homo sapiens
ccagcgggccctggaaaatgaggcggacgc

SEQ ID NO: 37552 - DNA, 30 bp, Homo sapiens
cagaactggaatcaccctcttggtcagaaa

SEQ ID NO: 37553 - DNA, 30 bp, Homo sapiens
gtcaggctctgtgggaggtggtggcttctc

SEQ ID NO: 37554 - DNA, 30 bp, Homo sapiens
ttgtgggacccggaggctttctgccggtag

SEQ ID NO: 37555 - DNA, 30 bp, Homo sapiens
cagcggtgaagggctcttcgtataggagag

SEQ ID NO: 37556 - DNA, 30 bp, Homo sapiens
caggaacttctttggagtaactttcgcctt

SEQ ID NO: 37557 - DNA, 30 bp, Homo sapiens
acttggggccagagaagggggtaaaggcct

SEQ ID NO: 37558 - DNA, 30 bp, Homo sapiens
agctggtgcagtttcctgctgtaggtaagg

SEQ ID NO: 37559 - DNA, 30 bp, Homo sapiens
attcaagggggatccattttcgtcttcttt

SEQ ID NO: 37560 - DNA, 30 bp, Homo sapiens
cctgaccacaggatgtggccgcaccatcag

SEQ ID NO: 37561 - DNA, 30 bp, Homo sapiens
agctggggctggggctgtggctgcggcgcc

SEQ ID NO: 37562 - DNA, 30 bp, Homo sapiens
taggcagatgtgtagaagtacctgggcttg

SEQ ID NO: 37563 - DNA, 30 bp, Homo sapiens
ctccggccttgccttcttggccttcttctc

SEQ ID NO: 37564 - DNA, 30 bp, Homo sapiens
gagttctgctgggcgtcgcgaaggagcttc

SEQ ID NO: 37565 - DNA, 30 bp, Homo sapiens
cacaggaattgacaaatcaaaggaattgag

SEQ ID NO: 37566 - DNA, 30 bp, Homo sapiens
tccaggtcgaaacattgttccactttgatt

SEQ ID NO: 37567 - DNA, 30 bp, Homo sapiens
cagcggtagtgccgaaggtagatgagcttc

SEQ ID NO: 37568 - DNA, 30 bp, Homo sapiens
taacgggtcttcagcttcatctgaggatat

SEQ ID NO: 37569 - DNA, 30 bp, Homo sapiens
gccagggatagattagggtgagaatagaca

SEQ ID NO: 37570 - DNA, 30 bp, Homo sapiens
cagggggtagtggcctcggcctggccgccg

SEQ ID NO: 37571 - DNA, 30 bp, Homo sapiens
cagttctcaggggagtagagtttaatcaga

SEQ ID NO: 37572 - DNA, 30 bp, Homo sapiens
ttcccaatggaatcaggtgcaactggaacc

SEQ ID NO: 37573 - DNA, 30 bp, Homo sapiens
tcccgctcactctcgttgctggcgccctcg

SEQ ID NO: 37574 - DNA, 30 bp, Homo sapiens
gccaggtgggcaagtaatccatgagcggcc

SEQ ID NO: 37575 - DNA, 30 bp, Homo sapiens
caagggtgtcctgggaggaacgctggtggc

SEQ ID NO: 37576 - DNA, 30 bp, Homo sapiens
cactggcaccatctctccagccagctcttt

SEQ ID NO: 37577 - DNA, 30 bp, Homo sapiens
ttcagtggctgcagactgtgtacttctgtg

SEQ ID NO: 37578 - DNA, 30 bp, Homo sapiens
gtcacggatgcggagctggtagaggcgaga

SEQ ID NO: 37579 - DNA, 30 bp, Homo sapiens
gctgaggggtactaaaagcttcatacacat

SEQ ID NO: 37580 - DNA, 30 bp, Homo sapiens
cactggggcaggccaaacatagttaggagg

SEQ ID NO: 37581 - DNA, 30 bp, Homo sapiens
tgaaagctcttaagaggacatccaggtcac

SEQ ID NO: 37582 - DNA, 30 bp, Homo sapiens
agcaggcagcaaacttgcgctggatgcgct

SEQ ID NO: 37583 - DNA, 30 bp, Homo sapiens
agcaggaatagtaagacaagcagggtcata

SEQ ID NO: 37584 - DNA, 30 bp, Homo sapiens
tgcaggtccaagcaaattttccttccattc

SEQ ID NO: 37585 - DNA, 30 bp, Homo sapiens
aaattttcctcccattcttcagcgtggcta

SEQ ID NO: 37586 - DNA, 30 bp, Homo sapiens
agcagctcccttccagggtccagtttcggg

SEQ ID NO: 37587 - DNA, 30 bp, Homo sapiens
caaaggtacaggaagggaaaagagaagagg

SEQ ID NO: 37588 - DNA, 30 bp, Homo sapiens
gagaccaacactccagctgagctggcctta

SEQ ID NO: 37589 - DNA, 30 bp, Homo sapiens
ctctggattctaaggcgtcaatttcttctt

SEQ ID NO: 37590 - DNA, 30 bp, Homo sapiens
cagtagcctgagctgcccccagggctgtga

SEQ ID NO: 37591 - DNA, 30 bp, Homo sapiens
gccaggagcccctgcctttgctgcctgggc

SEQ ID NO: 37592 - DNA, 30 bp, Homo sapiens
tagtgggctgggacagtatccagggcttcc

SEQ ID NO: 37593 - DNA, 30 bp, Homo sapiens
gcaaggcaacatgagggacgctgcggaggg

SEQ ID NO: 37594 - DNA, 30 bp, Homo sapiens
agtcggccccttcttgcatgtcctgggcac

SEQ ID NO: 37595 - DNA, 30 bp, Homo sapiens
tgtttcctggaggagtcagcgctgctccgg

SEQ ID NO: 37596 - DNA, 30 bp, Homo sapiens
caaaggttgtccaggcagctgcgtgggcac

SEQ ID NO: 37597 - DNA, 30 bp, Homo sapiens
cactggtgagcaggcaccgtgacaagggct

SEQ ID NO: 37598 - DNA, 30 bp, Homo sapiens
aagcccttgtccatgctcagggtgcggcgg

SEQ ID NO: 37599 - DNA, 30 bp, Homo sapiens
agacggcagcttccccggaccgcttccggg

SEQ ID NO: 37600 - DNA, 30 bp, Homo sapiens
tccagggctgcacatgttccagctggcctg

SEQ ID NO: 37601 - DNA, 30 bp, Homo sapiens
tactgggaacgccgaaggtgggaggccatt

SEQ ID NO: 37602 - DNA, 30 bp, Homo sapiens
ctcaggtataaagcgagttcatatgctttc

SEQ ID NO: 37603 - DNA, 30 bp, Homo sapiens
tctctcaagtattttgccattgagtatgcc

SEQ ID NO: 37604 - DNA, 30 bp, Homo sapiens
aggcgccctgcatgcgcagcccgcgtatga

SEQ ID NO: 37605 - DNA, 30 bp, Homo sapiens
ctctctgtggcttccacacagatgctagga

SEQ ID NO: 37606 - DNA, 30 bp, Homo sapiens
ccacgggggccaggccgacctggttgtttg

SEQ ID NO: 37607 - DNA, 30 bp, Homo sapiens
cacaggggccaggccgacctggttgtttgc

SEQ ID NO: 37608 - DNA, 30 bp, Homo sapiens
cttcttggccttgccctgggcagccacagc

SEQ ID NO: 37609 - DNA, 30 bp, Homo sapiens
acttggccttgccctgggcagccacagcct

SEQ ID NO: 37610 - DNA, 30 bp, Homo sapiens
ggatcgagtgatcttgtcgggaggcatgaa

SEQ ID NO: 37611 - DNA, 30 bp, Homo sapiens
aagcacaaaatccccagcggacaacagcgg

SEQ ID NO: 37612 - DNA, 30 bp, Homo sapiens
gcatggaagcctatataaatgtgctgaccc

SEQ ID NO: 37613 - DNA, 30 bp, Homo sapiens
ctcaggctgagaggttatgagcagctcctt

SEQ ID NO: 37614 - DNA, 30 bp, Homo sapiens
aatacatgttgtgccgaaagtagacagcca

SEQ ID NO: 37615 - DNA, 30 bp, Homo sapiens
taacacacccaccccctgcacacacacact

SEQ ID NO: 37616 - DNA, 30 bp, Homo sapiens
tgaacttgtcctctgattccttcagcaggt

SEQ ID NO: 37617 - DNA, 30 bp, Homo sapiens
tctgacagatgagcattgtgttccaagtag

SEQ ID NO: 37618 - DNA, 30 bp, Homo sapiens
caccggatgtggtactccctgaagcatttg

SEQ ID NO: 37619 - DNA, 30 bp, Homo sapiens
attcagtgtgatattcaacggaacacttca

SEQ ID NO: 37620 - DNA, 30 bp, Homo sapiens
aagcggaacatcacattcggcacaaaaata

SEQ ID NO: 37621 - DNA, 30 bp, Homo sapiens
cagtgggtcggagaggcatcctccaagccc

SEQ ID NO: 37622 - DNA, 30 bp, Homo sapiens
gctcccgaatgatgctgacttctggggggt

SEQ ID NO: 37623 - DNA, 30 bp, Homo sapiens
aggcggcagtggcaaagcctactctgttgt

SEQ ID NO: 37624 - DNA, 30 bp, Homo sapiens
acgaggatgacacggtgccaccatggcctg

SEQ ID NO: 37625 - DNA, 30 bp, Homo sapiens
ctccggggaacagcatcgccgcacaggtgg

SEQ ID NO: 37626 - DNA, 30 bp, Homo sapiens
tattcagaggcagggtccacagtgagtgac

SEQ ID NO: 37627 - DNA, 30 bp, Homo sapiens
ccttggttttccagctttgatggagatcta

SEQ ID NO: 37628 - DNA, 30 bp, Homo sapiens
cccaggaaggactttaccttccaggagctc

SEQ ID NO: 37629 - DNA, 30 bp, Homo sapiens
ctccaggaaggattttaccttccagaagct

SEQ ID NO: 37630 - DNA, 30 bp, Homo sapiens
acaaagtggaatgcttctcgaagggcacgg

SEQ ID NO: 37631 - DNA, 30 bp, Homo sapiens
cagggggagcggtagtgtggccaattctgg

SEQ ID NO: 37632 - DNA, 30 bp, Homo sapiens
tattggaggtctgtggctggcagggtcctt

SEQ ID NO: 37633 - DNA, 30 bp, Homo sapiens
gtgcttgaaatgaggccaggtgctgatgat

SEQ ID NO: 37634 - DNA, 30 bp, Homo sapiens
atgaggccaggtgctgatgatgttgtacaa

SEQ ID NO: 37635 - DNA, 30 bp, Homo sapiens
cagtgggtgcagtgcgtcccgtcctctcct

SEQ ID NO: 37636 - DNA, 30 bp, Homo sapiens
ctgtggctggaaaaaatgttcttcaatagc

SEQ ID NO: 37637 - DNA, 30 bp, Homo sapiens
aacagaacgccagatcagtccattcttact

SEQ ID NO: 37638 - DNA, 30 bp, Homo sapiens
cggcactgtatgttcattagcagttcctgg

SEQ ID NO: 37639 - DNA, 30 bp, Homo sapiens
ggttggggcctttctccaattcctccagcc

SEQ ID NO: 37640 - DNA, 30 bp, Homo sapiens
gcaaggtgatctgcactttcttacttgtga

SEQ ID NO: 37641 - DNA, 30 bp, Homo sapiens
cagtgggtcccctccggccagttctctcat

SEQ ID NO: 37642 - DNA, 30 bp, Homo sapiens
agggcaggcaaaaggtcggctatgctgtca

SEQ ID NO: 37643 - DNA, 30 bp, Homo sapiens
gtgtttgtggcaatagttgattttgccctc

SEQ ID NO: 37644 - DNA, 30 bp, Homo sapiens
ccagctggtccgcgttgtacggcttcccca

SEQ ID NO: 37645 - DNA, 30 bp, Homo sapiens
gcccagccccaggcagaatccggcatatcc

SEQ ID NO: 37646 - DNA, 30 bp, Homo sapiens
acgagcagaaaagcagagcagggaattctt

SEQ ID NO: 37647 - DNA, 30 bp, Homo sapiens
cagttccctttggctggaaggaccatggtt

SEQ ID NO: 37648 - DNA, 30 bp, Homo sapiens
ctgccaatatcttgggtaattgtgcagcaa

SEQ ID NO: 37649 - DNA, 30 bp, Homo sapiens
actctcatcttttggttcttcctcatctga

SEQ ID NO: 37650 - DNA, 30 bp, Homo sapiens
caccagccgccatcactgcccgccagcgcc

SEQ ID NO: 37651 - DNA, 30 bp, Homo sapiens
aagaagttcttgatcagtggagtcaccatc

SEQ ID NO: 37652 - DNA, 30 bp, Homo sapiens
ggtcggtgaaaccttgttaagtgtctactc

SEQ ID NO: 37653 - DNA, 30 bp, Homo sapiens
aaactgtcgactctcttcatgaacttccat

SEQ ID NO: 37654 - DNA, 30 bp, Homo sapiens
ctgtggaatcttgtcaagtgcttgcttgat

SEQ ID NO: 37655 - DNA, 30 bp, Homo sapiens
cgatggtagcgtgtaaaatgtttgctctct

SEQ ID NO: 37656 - DNA, 30 bp, Homo sapiens
cctccaacttggcttctgcatgtccttcct

SEQ ID NO: 37657 - DNA, 30 bp, Homo sapiens
cactggggcagctggaggagcacggactgc

SEQ ID NO: 37658 - DNA, 30 bp, Homo sapiens
atgaggctgtcacttcccctggtgaaactt

SEQ ID NO: 37659 - DNA, 30 bp, Homo sapiens
taggtctccttgaggacatttatcttggcg

SEQ ID NO: 37660 - DNA, 30 bp, Homo sapiens
gagtccttgagcatgctgatgcgggcgtag

SEQ ID NO: 37661 - DNA, 30 bp, Homo sapiens
aagattccttcagagagttgatgcgtgcac

SEQ ID NO: 37662 - DNA, 30 bp, Homo sapiens
agctggttgttggtgaatgtgatgcctggt

SEQ ID NO: 37663 - DNA, 30 bp, Homo sapiens
taccagagtcggcaggagtccatgcctctg

SEQ ID NO: 37664 - DNA, 30 bp, Homo sapiens
gagtggggggcacttttagggatgtctgtg

SEQ ID NO: 37665 - DNA, 30 bp, Homo sapiens
cctccccactcaaccaggtactgcacagag

SEQ ID NO: 37666 - DNA, 30 bp, Homo sapiens
ttgctgtttttcccccttctgcccactttc

SEQ ID NO: 37667 - DNA, 30 bp, Homo sapiens
gacagggatgatattgatgtagaacttgac

SEQ ID NO: 37668 - DNA, 30 bp, Homo sapiens
ctgtggttgccatcttgttcctgctctctt

SEQ ID NO: 37669 - DNA, 30 bp, Homo sapiens
gaacagagttggagcgcagcacagggccct

SEQ ID NO: 37670 - DNA, 30 bp, Homo sapiens
caacccaaggctgagcagcactcacctgac

SEQ ID NO: 37671 - DNA, 30 bp, Homo sapiens
tccaggaacagcttccgggagcccgtccgc

SEQ ID NO: 37672 - DNA, 30 bp, Homo sapiens
tgaagggtatctgacaagattttcattgtc

SEQ ID NO: 37673 - DNA, 30 bp, Homo sapiens
gtaaggggtggtcccttcccactccaccag

SEQ ID NO: 37674 - DNA, 30 bp, Homo sapiens
tcctggccaaggacagtggcagaggcgcta

SEQ ID NO: 37675 - DNA, 30 bp, Homo sapiens
ctatggggatgtggcaccaggccacacttc

SEQ ID NO: 37676 - DNA, 30 bp, Homo sapiens
taaaggagtagtttcccgttccgatgaatt

SEQ ID NO: 37677 - DNA, 30 bp, Homo sapiens
cagagggcgatctgctgcaccttgcccagg

SEQ ID NO: 37678 - DNA, 30 bp, Homo sapiens
tcaattaggagctgttttatgtggcgttta

SEQ ID NO: 37679 - DNA, 30 bp, Homo sapiens
catacctgctccagcattggagctgtttca

SEQ ID NO: 37680 - DNA, 30 bp, Homo sapiens
ccctggttacagttcgctgtgcagctctgg

SEQ ID NO: 37681 - DNA, 30 bp, Homo sapiens
ttgtggccctgggggtgctggacggtgggg

SEQ ID NO: 37682 - DNA, 30 bp, Homo sapiens
gggctctccagatttgggaggcccccctaa

SEQ ID NO: 37683 - DNA, 30 bp, Homo sapiens
tatcctgggggcttcaggtgaatggctgcg

SEQ ID NO: 37684 - DNA, 30 bp, Homo sapiens
atgtggttttttgcaaaacccacactgctt

SEQ ID NO: 37685 - DNA, 30 bp, Homo sapiens
gtgtggtccctatctttgtggtacctatcc

SEQ ID NO: 37686 - DNA, 30 bp, Homo sapiens
acctcttcttgaagccgtattttttgcgtt

SEQ ID NO: 37687 - DNA, 30 bp, Homo sapiens
ttccattaagttgctgctgagttagttgtt

SEQ ID NO: 37688 - DNA, 30 bp, Homo sapiens
ttaatctcctgaagtacagttttaatatca

SEQ ID NO: 37689 - DNA, 30 bp, Homo sapiens
acttggattttttgcagctgttagtgattc

SEQ ID NO: 37690 - DNA, 30 bp, Homo sapiens
cggatgggcgtctcttctcttcaacttggg

SEQ ID NO: 37691 - DNA, 30 bp, Homo sapiens
tcagttaatgagagcttcattttcttcacc

SEQ ID NO: 37692 - DNA, 30 bp, Homo sapiens
ctgtggattttcaggatacggccgagtctc

SEQ ID NO: 37693 - DNA, 30 bp, Homo sapiens
aagtggaactggaaggcttcagtcacatgc

SEQ ID NO: 37694 - DNA, 30 bp, Homo sapiens
tccaggtcagctgggcaattctctcaggct

SEQ ID NO: 37695 - DNA, 30 bp, Homo sapiens
ctagaagttccaaaagttaaagaggtgtct

SEQ ID NO: 37696 - DNA, 30 bp, Homo sapiens
ttgcatggcacagatgctgtggggcaggaa

SEQ ID NO: 37697 - DNA, 30 bp, Homo sapiens
tgcatctggcagcccgaattgggcaacaat

SEQ ID NO: 37698 - DNA, 30 bp, Homo sapiens
tagctaatcagacacgggtcatcattgttt

SEQ ID NO: 37699 - DNA, 30 bp, Homo sapiens
agtagtcctcctcggccagggagaggagca

SEQ ID NO: 37700 - DNA, 30 bp, Homo sapiens
gctttccaatccactgcttccttatccagt

SEQ ID NO: 37701 - DNA, 30 bp, Homo sapiens
ccagcacaagcacggcctcatcctcagtta

SEQ ID NO: 37702 - DNA, 30 bp, Homo sapiens
caggcagagttggaggtgctgcggagaagc

SEQ ID NO: 37703 - DNA, 30 bp, Homo sapiens
caacggagcgaggatccgcgcgcacgggaa

SEQ ID NO: 37704 - DNA, 30 bp, Homo sapiens
ggccgaacaccgcagtggggggaagatgcg

SEQ ID NO: 37705 - DNA, 30 bp, Homo sapiens
gcccctgtgacaatgacatccatccagata

SEQ ID NO: 37706 - DNA, 30 bp, Homo sapiens
gcccccgtaactataacatccatccagatc

SEQ ID NO: 37707 - DNA, 30 bp, Homo sapiens
cagggggcgtggttttcgtcagcggcggtc

SEQ ID NO: 37708 - DNA, 30 bp, Homo sapiens
tagtggcgtgtcgtaataatctggcagctg

SEQ ID NO: 37709 - DNA, 30 bp, Homo sapiens
ctccgggggctcggtccgatcctcttcatg

SEQ ID NO: 37710 - DNA, 30 bp, Homo sapiens
tgcaggtggaggcgcacatctgcagccgtt

SEQ ID NO: 37711 - DNA, 30 bp, Homo sapiens
gaccaaactacaacagaatattccataggc

SEQ ID NO: 37712 - DNA, 30 bp, Homo sapiens
gattggtcttcagggcggggccgggcttcc

SEQ ID NO: 37713 - DNA, 30 bp, Homo sapiens
cagaacatactgctcttcactaaggcggct

SEQ ID NO: 37714 - DNA, 30 bp, Homo sapiens
ttagcccaggtgacctcgtagtcggggtac

SEQ ID NO: 37715 - DNA, 30 bp, Homo sapiens
tgctgggcaggaccataggccttgatggtg

SEQ ID NO: 37716 - DNA, 30 bp, Homo sapiens
ccctcggccccctgcgtgggcggctcctcc

SEQ ID NO: 37717 - DNA, 30 bp, Homo sapiens
caatggaatatcatatacaaaaacaggtaa

SEQ ID NO: 37718 - DNA, 30 bp, Homo sapiens
acagcagaaaggataactactcttgtgata

SEQ ID NO: 37719 - DNA, 30 bp, Homo sapiens
cacaacaaatgaaagcaatcgaaagtgtca

SEQ ID NO: 37720 - DNA, 30 bp, Homo sapiens
aacaccttcagaagtcctgtccacatgacg

SEQ ID NO: 37721 - DNA, 30 bp, Homo sapiens
aagtcactgataacaccagaaacagctgac

SEQ ID NO: 37722 - DNA, 30 bp, Homo sapiens
acaagtcgagctcgaaacatccaaatatcc

SEQ ID NO: 37723 - DNA, 30 bp, Homo sapiens
acccgggaggggcgagggctcctgccctgc

SEQ ID NO: 37724 - DNA, 30 bp, Homo sapiens
ggtgtacagttggggaaagggcagttcagc

SEQ ID NO: 37725 - DNA, 30 bp, Homo sapiens
tagcggcccacgctgatgttgcaggtcttg

SEQ ID NO: 37726 - DNA, 30 bp, Homo sapiens
tacaggttttgcagctgggatctttctttg

SEQ ID NO: 37727 - DNA, 30 bp, Homo sapiens
ggctggagcctcagcgtttcacaacttctc

SEQ ID NO: 37728 - DNA, 30 bp, Homo sapiens
caggtagtttgacgtaactcctggaaaaca

SEQ ID NO: 37729 - DNA, 30 bp, Homo sapiens
cagaagattccagccaacaccagaggaggc

SEQ ID NO: 37730 - DNA, 30 bp, Homo sapiens
cgcaagagccttcacagcacttcttgattc

SEQ ID NO: 37731 - DNA, 30 bp, Homo sapiens
tgaaaagaagggcttccggctctgaaagct

SEQ ID NO: 37732 - DNA, 30 bp, Homo sapiens
accaggaggaaaaaaatggcttcctgcaat

SEQ ID NO: 37733 - DNA, 30 bp, Homo sapiens
cagtaggggatgtcattctgatagtactgg

SEQ ID NO: 37734 - DNA, 30 bp, Homo sapiens
cgttggtgaggtactggaagccgtcataga

SEQ ID NO: 37735 - DNA, 30 bp, Homo sapiens
caccggttcaactggaaggctggagccccc

SEQ ID NO: 37736 - DNA, 30 bp, Homo sapiens
accaggggaatccggttcaactggaaggct

SEQ ID NO: 37737 - DNA, 30 bp, Homo sapiens
agatggatgccgtgtccgtgctgctcctgt

SEQ ID NO: 37738 - DNA, 30 bp, Homo sapiens
catgggagctggtggtggtgacagacgtac

SEQ ID NO: 37739 - DNA, 30 bp, Homo sapiens
gtccaatgagatgatgtcaggaatgttact

SEQ ID NO: 37740 - DNA, 30 bp, Homo sapiens
aaatctgatgacatgcttgatattggcgta

SEQ ID NO: 37741 - DNA, 30 bp, Homo sapiens
ggttgggctgctttgtgtttctgacataaa

SEQ ID NO: 37742 - DNA, 30 bp, Homo sapiens
cacaggacaaatccaggtgggctttttctc

SEQ ID NO: 37743 - DNA, 30 bp, Homo sapiens
tccagggaaatgatgtctgaccgacagcca

SEQ ID NO: 37744 - DNA, 30 bp, Homo sapiens
agcaggccggcaccaggcccttctggaagg

SEQ ID NO: 37745 - DNA, 30 bp, Homo sapiens
ctcaggtgcttcttttttagtaaagagtgt

SEQ ID NO: 37746 - DNA, 30 bp, Homo sapiens
acagggccaaaggggtttggaggtctcatg

SEQ ID NO: 37747 - DNA, 30 bp, Homo sapiens
tccacccttgtccaagggcccagcagcccc

SEQ ID NO: 37748 - DNA, 30 bp, Homo sapiens
catcggattccaattcctgggaaacctctt

SEQ ID NO: 37749 - DNA, 30 bp, Homo sapiens
gcctgggcaggctctgggggctgtggagcc

SEQ ID NO: 37750 - DNA, 30 bp, Homo sapiens
ccttctcacgagtccacttgatcatggtct

SEQ ID NO: 37751 - DNA, 30 bp, Homo sapiens
gatcattgtctctggtgagcgatataggaa

SEQ ID NO: 37752 - DNA, 30 bp, Homo sapiens
caatgtccccaaacactatttatcccctga

SEQ ID NO: 37753 - DNA, 30 bp, Homo sapiens
cagaggattgggtccatgttctcctggtct

SEQ ID NO: 37754 - DNA, 30 bp, Homo sapiens
tacaggcttaggtaggccacacggttccga

SEQ ID NO: 37755 - DNA, 30 bp, Homo sapiens
acctggtttcagatatctcattattctcac

SEQ ID NO: 37756 - DNA, 30 bp, Homo sapiens
cgaccctctggcaagtgagtgtggaagaaa

SEQ ID NO: 37757 - DNA, 30 bp, Homo sapiens
gatctttggcatactgttcaaatactggtt

SEQ ID NO: 37758 - DNA, 30 bp, Homo sapiens
ctgaggaacctggacaagtcttccttgatt

SEQ ID NO: 37759 - DNA, 30 bp, Homo sapiens
cccctgcagggtacatggagagatctataa

SEQ ID NO: 37760 - DNA, 30 bp, Homo sapiens
tatccagagtggtgaaataacaaggccagc

SEQ ID NO: 37761 - DNA, 30 bp, Homo sapiens
cagcctttctgcgcagtgcctgtgggacgc

SEQ ID NO: 37762 - DNA, 30 bp, Homo sapiens
gtctggtttgatccattgccgtgaagaata

SEQ ID NO: 37763 - DNA, 30 bp, Homo sapiens
ccttggtaacagtcgcaggaacctagcttt

SEQ ID NO: 37764 - DNA, 30 bp, Homo sapiens
gtctggtaaacgaaaggcagcctgaaataa

SEQ ID NO: 37765 - DNA, 30 bp, Homo sapiens
cccaggagatgacagtgggacttccagctc

SEQ ID NO: 37766 - DNA, 30 bp, Homo sapiens
catgggcttgttgatgtggctttctggtgt

SEQ ID NO: 37767 - DNA, 30 bp, Homo sapiens
atcccagaataaagcccccaggaggatgcc

SEQ ID NO: 37768 - DNA, 30 bp, Homo sapiens
cagaggaagctcagtgagttgattctcatg

SEQ ID NO: 37769 - DNA, 30 bp, Homo sapiens
caggggttcttctttgtaatgggaaataat

SEQ ID NO: 37770 - DNA, 30 bp, Homo sapiens
atgaagtgacttttgggtttgccacatagt

SEQ ID NO: 37771 - DNA, 30 bp, Homo sapiens
tgctgggccagaaatagctgcctgaaccag

SEQ ID NO: 37772 - DNA, 30 bp, Homo sapiens
atttggtttacttcactaatagaaatatct

SEQ ID NO: 37773 - DNA, 30 bp, Homo sapiens
tccagggaacatccgcaaataaaccccgtg

SEQ ID NO: 37774 - DNA, 30 bp, Homo sapiens
gtcctgcttgtcccctctctgcctccaggg

SEQ ID NO: 37775 - DNA, 30 bp, Homo sapiens
aggcttcctgggggccgtcctgggcctcgg

SEQ ID NO: 37776 - DNA, 30 bp, Homo sapiens
cagtctgtcttctcaggctttctccaggac

SEQ ID NO: 37777 - DNA, 30 bp, Homo sapiens
gagtggggggacacctcgggcgcgccggat

SEQ ID NO: 37778 - DNA, 30 bp, Homo sapiens
tgagcacgagcatggcctctgtgccatcct

SEQ ID NO: 37779 - DNA, 30 bp, Homo sapiens
catgtccaaggcaggaagttgcaatgtagg

SEQ ID NO: 37780 - DNA, 30 bp, Homo sapiens
ataaggcccacaaggtactgctgtgtaatg

SEQ ID NO: 37781 - DNA, 30 bp, Homo sapiens
cacaggattgtaatgagcagagtcacagaa

SEQ ID NO: 37782 - DNA, 30 bp, Homo sapiens
cttcttgcttcttactttgacgtgtcatcc

SEQ ID NO: 37783 - DNA, 30 bp, Homo sapiens
gctccacaatgtgaagactgaggtggtccc

SEQ ID NO: 37784 - DNA, 30 bp, Homo sapiens
caagaaggcaccggcagaagcggcatggcc

SEQ ID NO: 37785 - DNA, 30 bp, Homo sapiens
caaaggcattgtgatgattagcgtggattt

SEQ ID NO: 37786 - DNA, 30 bp, Homo sapiens
ttgtggttctgttgttccctcagaaacact

SEQ ID NO: 37787 - DNA, 30 bp, Homo sapiens
ctctgggatatagaatgctttggcactggt

SEQ ID NO: 37788 - DNA, 30 bp, Homo sapiens
ctctgggtggaacaggtggaggaggatgga

SEQ ID NO: 37789 - DNA, 30 bp, Homo sapiens
tcagctgataccatttaaccgtctctttgc

SEQ ID NO: 37790 - DNA, 30 bp, Homo sapiens
acaaggtgccatgacttcgagatcccaggg

SEQ ID NO: 37791 - DNA, 30 bp, Homo sapiens
ttctttatcgagtgggacactacagagtcg

SEQ ID NO: 37792 - DNA, 30 bp, Homo sapiens
ctgcagcaaaaagagcatggacactctcat

SEQ ID NO: 37793 - DNA, 30 bp, Homo sapiens
gtgtggaagatccaatccatttttgttgtc

SEQ ID NO: 37794 - DNA, 30 bp, Homo sapiens
tgtgtgggccatccagttcactttagtagt

SEQ ID NO: 37795 - DNA, 30 bp, Homo sapiens
ctgcctgttgtctttggacacgttgtgggc

SEQ ID NO: 37796 - DNA, 30 bp, Homo sapiens
ttgatgccaagaacaagatgtagaaaccaa

SEQ ID NO: 37797 - DNA, 30 bp, Homo sapiens
gttcccaggtcctttttctccttggagttc

SEQ ID NO: 37798 - DNA, 30 bp, Homo sapiens
cccaggagtcccggcctggcccataagggg

SEQ ID NO: 37799 - DNA, 30 bp, Homo sapiens
ctgtgcatatactgggtaggctagtgtgac

SEQ ID NO: 37800 - DNA, 30 bp, Homo sapiens
cagcgggcggcaggcggcgggccggggccc

SEQ ID NO: 37801 - DNA, 30 bp, Homo sapiens
tatctgcaaagcgagggcatctgtgcatga

SEQ ID NO: 37802 - DNA, 30 bp, Homo sapiens
cttcacaatcccatctctagaagcagttac

SEQ ID NO: 37803 - DNA, 30 bp, Homo sapiens
tagggcagagctccactgaaagtcatgatg

SEQ ID NO: 37804 - DNA, 30 bp, Homo sapiens
cactggacaataccagagaatgtgttgatg

SEQ ID NO: 37805 - DNA, 30 bp, Homo sapiens
cctgtccagtggtctggtaccattaggaaa

SEQ ID NO: 37806 - DNA, 30 bp, Homo sapiens
acctttttggtcagcagggtgagggggcac

SEQ ID NO: 37807 - DNA, 30 bp, Homo sapiens
attctcatatggctcctctgtgttttggaa

SEQ ID NO: 37808 - DNA, 30 bp, Homo sapiens
agacagagtacagggtctcgttctgggggc

SEQ ID NO: 37809 - DNA, 30 bp, Homo sapiens
gcttggcgccctgctacctttccttctcct

SEQ ID NO: 37810 - DNA, 30 bp, Homo sapiens
tgctgggccccggcgacaggctgtggaggt

SEQ ID NO: 37811 - DNA, 30 bp, Homo sapiens
gcaaggaccaggccaaaggggcagggcctc

SEQ ID NO: 37812 - DNA, 30 bp, Homo sapiens
aagctctcgctgctggacgtggtgctggcc

SEQ ID NO: 37813 - DNA, 30 bp, Homo sapiens
tcatgaatgagagagacgatgtcaccactc

SEQ ID NO: 37814 - DNA, 30 bp, Homo sapiens
cacggggaagcatagacatccttgagtatg

SEQ ID NO: 37815 - DNA, 30 bp, Homo sapiens
ctcagtgcggaggatgatgtggatgccgga

SEQ ID NO: 37816 - DNA, 30 bp, Homo sapiens
tttgtcttaaccggtgggtctgtaaacaca

SEQ ID NO: 37817 - DNA, 30 bp, Homo sapiens
taaggggtggtttgtaaatatgataccaat

SEQ ID NO: 37818 - DNA, 30 bp, Homo sapiens
cacagggctgccctccatgagcagaggagg

SEQ ID NO: 37819 - DNA, 30 bp, Homo sapiens
cagggggagtgagtgcactctatatgatgg

SEQ ID NO: 37820 - DNA, 30 bp, Homo sapiens
atttggaatctttcttcttcttctttttca

SEQ ID NO: 37821 - DNA, 30 bp, Homo sapiens
ccctggaactggaacctggggcttgttctt

SEQ ID NO: 37822 - DNA, 30 bp, Homo sapiens
gtttttgatggggattacagcagcatcatc

SEQ ID NO: 37823 - DNA, 30 bp, Homo sapiens
atgtggccaataaagtccaaaaagcgcttt

SEQ ID NO: 37824 - DNA, 30 bp, Homo sapiens
gtcaggatgttggacataaactcgttgaag

SEQ ID NO: 37825 - DNA, 30 bp, Homo sapiens
tgttggtaataaaatccaggaatcgcttag

SEQ ID NO: 37826 - DNA, 30 bp, Homo sapiens
ttctggacagggtggctgaccttcatacag

SEQ ID NO: 37827 - DNA, 30 bp, Homo sapiens
ttctggataactgactcttatggctcccca

SEQ ID NO: 37828 - DNA, 30 bp, Homo sapiens
taatgggtgaactctgactctgcaacttca

SEQ ID NO: 37829 - DNA, 30 bp, Homo sapiens
gtgtggatagtgctcattgacgtataagga

SEQ ID NO: 37830 - DNA, 30 bp, Homo sapiens
cttccagagtgttgggctcagcggtcaagt

SEQ ID NO: 37831 - DNA, 30 bp, Homo sapiens
cgtccgaggcctggctggcaggtgcgccct

SEQ ID NO: 37832 - DNA, 30 bp, Homo sapiens
cggaggccgggggggcctgggcgctatagt

SEQ ID NO: 37833 - DNA, 30 bp, Homo sapiens
gcccttctggaaaacaactgacgtcagaca

SEQ ID NO: 37834 - DNA, 30 bp, Homo sapiens
actccgtgtgcgcctccacccactggcaga

SEQ ID NO: 37835 - DNA, 30 bp, Homo sapiens
caaaggtgggctttgcccaggcttgggaaa

SEQ ID NO: 37836 - DNA, 30 bp, Homo sapiens
gttcccaatctttgatttccaggttttggc

SEQ ID NO: 37837 - DNA, 30 bp, Homo sapiens
gcgagtcaggaagaaggacttgaggctgcg

SEQ ID NO: 37838 - DNA, 30 bp, Homo sapiens
cccagggcttccccaaagcggattttctgt

SEQ ID NO: 37839 - DNA, 30 bp, Homo sapiens
tgtaggagcccttgctgtgccttgggctgt

SEQ ID NO: 37840 - DNA, 30 bp, Homo sapiens
ctgtggggtaacctgatggaccctatggtc

SEQ ID NO: 37841 - DNA, 30 bp, Homo sapiens
cactgggtccttttgtctcatttcatccag

SEQ ID NO: 37842 - DNA, 30 bp, Homo sapiens
tgcctcgaacggaacccctcttacgcattg

SEQ ID NO: 37843 - DNA, 30 bp, Homo sapiens
cactggctgcgcttgttcccctcacttgac

SEQ ID NO: 37844 - DNA, 30 bp, Homo sapiens
acatggcttatctgaagagtgcatgccggg

SEQ ID NO: 37845 - DNA, 30 bp, Homo sapiens
cacaggggaggaatgctgattgcaaacttt

SEQ ID NO: 37846 - DNA, 30 bp, Homo sapiens
tcctcgctgtccagcttcaggctgatgctc

SEQ ID NO: 37847 - DNA, 30 bp, Homo sapiens
acttggggcccgcggctgcccccggctcca

SEQ ID NO: 37848 - DNA, 30 bp, Homo sapiens
agggcaccgactcgaacttggggggcccac

SEQ ID NO: 37849 - DNA, 30 bp, Homo sapiens
cattggatgatccaggatgggtccttggca

SEQ ID NO: 37850 - DNA, 30 bp, Homo sapiens
tactggcacgcgttgaggcccgaggccggg

SEQ ID NO: 37851 - DNA, 30 bp, Homo sapiens
acacgggccggtccactgcatactggcaag

SEQ ID NO: 37852 - DNA, 30 bp, Homo sapiens
atacgggcctttccacggcgtactggcacg

SEQ ID NO: 37853 - DNA, 30 bp, Homo sapiens
tactggccagttgtaatagatgtggcacag

SEQ ID NO: 37854 - DNA, 30 bp, Homo sapiens
tagaggtagtaaaggcggtttgacagtgac

SEQ ID NO: 37855 - DNA, 30 bp, Homo sapiens
cacaggaagaacaggttctcgcacagctgg

SEQ ID NO: 37856 - DNA, 30 bp, Homo sapiens
caaaggtaaaagagacgagttgacaaggaa

SEQ ID NO: 37857 - DNA, 30 bp, Homo sapiens
cacaggtagaagagatggttggctaattcc

SEQ ID NO: 37858 - DNA, 30 bp, Homo sapiens
gagtgggggagggaacatgcagcggcacac

SEQ ID NO: 37859 - DNA, 30 bp, Homo sapiens
tgaaggtggggcatcaggatcaggctcaga

SEQ ID NO: 37860 - DNA, 30 bp, Homo sapiens
acagaacactgaaagcacccataaactgtc

SEQ ID NO: 37861 - DNA, 30 bp, Homo sapiens
tgctggggtggaccttgttcttggcccgaa

SEQ ID NO: 37862 - DNA, 30 bp, Homo sapiens
aagtccttgatgtctgctggctcagcagct

SEQ ID NO: 37863 - DNA, 30 bp, Homo sapiens
cacctagcgtgagatacatgggcagcagga

SEQ ID NO: 37864 - DNA, 30 bp, Homo sapiens
ccttgggcaaagcttgtgctggtcgagagt

SEQ ID NO: 37865 - DNA, 30 bp, Homo sapiens
gctgtcgtggctgcttgctcagatgaggtt

SEQ ID NO: 37866 - DNA, 30 bp, Homo sapiens
acgtggacattagaactcccatttccacct

SEQ ID NO: 37867 - DNA, 30 bp, Homo sapiens
caacgttggaatctcaccacgggagagtct

SEQ ID NO: 37868 - DNA, 30 bp, Homo sapiens
tcaccacttgatttagcttcaaattgatgt

SEQ ID NO: 37869 - DNA, 30 bp, Homo sapiens
ttgtggtgccatctcgaaattcttcttgag

SEQ ID NO: 37870 - DNA, 30 bp, Homo sapiens
cagaggccttcacatatgtggtcttgttgg

SEQ ID NO: 37871 - DNA, 30 bp, Homo sapiens
tcttcccgttgatgtttctggtcttcagcc

SEQ ID NO: 37872 - DNA, 30 bp, Homo sapiens
cagtggttactgcgttgaagaaggatgcag

SEQ ID NO: 37873 - DNA, 30 bp, Homo sapiens
cacagttgctcctgaatagtttccgggtgt

SEQ ID NO: 37874 - DNA, 30 bp, Homo sapiens
gccacattcttccaaccagacagctaatta

SEQ ID NO: 37875 - DNA, 30 bp, Homo sapiens
ccctgggcttccccactttgttctgtagaa

SEQ ID NO: 37876 - DNA, 30 bp, Homo sapiens
cggagagagcctccagtttgaggggcaaat

SEQ ID NO: 37877 - DNA, 30 bp, Homo sapiens
tttcctgtccctggcacagggttttctgct

SEQ ID NO: 37878 - DNA, 30 bp, Homo sapiens
acgaggtggtcccatcgctgctctggggct

SEQ ID NO: 37879 - DNA, 30 bp, Homo sapiens
tgatgttggtgtagccggagccaggtcgcc

SEQ ID NO: 37880 - DNA, 30 bp, Homo sapiens
cggcacaggaacaacacgcatggtgttggt

SEQ ID NO: 37881 - DNA, 30 bp, Homo sapiens
tccagggcatccctgggtgtgcacctgctc

SEQ ID NO: 37882 - DNA, 30 bp, Homo sapiens
ggttgggtctagggtgtcctcaaacaggct

SEQ ID NO: 37883 - DNA, 30 bp, Homo sapiens
ccccggccacgaagtcgaagtccaggaagg

SEQ ID NO: 37884 - DNA, 30 bp, Homo sapiens
cctcttccgaaagtatccttggttctcgag

SEQ ID NO: 37885 - DNA, 30 bp, Homo sapiens
gggttccaggaatcgctctgacacaaagtc

SEQ ID NO: 37886 - DNA, 30 bp, Homo sapiens
aagtagcgcaggtccgcagggccacacagg

SEQ ID NO: 37887 - DNA, 30 bp, Homo sapiens
ctgcagggagtcactgttctccaagaccag

SEQ ID NO: 37888 - DNA, 30 bp, Homo sapiens
tactccagggagtcactgtgttccaagccc

SEQ ID NO: 37889 - DNA, 30 bp, Homo sapiens
aatcgggaggtgaagttcctgaggctgttg

SEQ ID NO: 37890 - DNA, 30 bp, Homo sapiens
tctttaagggagtggtaggctttggcagtc

SEQ ID NO: 37891 - DNA, 30 bp, Homo sapiens
tatgggcccaggaagtcctccttccgatag

SEQ ID NO: 37892 - DNA, 30 bp, Homo sapiens
agtctggggaccctgggtactgttctgctc

SEQ ID NO: 37893 - DNA, 30 bp, Homo sapiens
catacctatgagctccttgttgcgaacatc

SEQ ID NO: 37894 - DNA, 30 bp, Homo sapiens
cacaggctatcttcaggtcacaggaaacag

SEQ ID NO: 37895 - DNA, 30 bp, Homo sapiens
acttgggcgagtccggctcacataggaact

SEQ ID NO: 37896 - DNA, 30 bp, Homo sapiens
atgcggctcgttggctgtccagatatggtt

SEQ ID NO: 37897 - DNA, 30 bp, Homo sapiens
aactcttccttctcctcctctgcacagatg

SEQ ID NO: 37898 - DNA, 30 bp, Homo sapiens
ccaaggagcacacgtttcagataggccagg

SEQ ID NO: 37899 - DNA, 30 bp, Homo sapiens
ataaggctcatggctgccaagcccattcct

SEQ ID NO: 37900 - DNA, 30 bp, Homo sapiens
tcttggtgtccaggttcttgtgtgccttgt

SEQ ID NO: 37901 - DNA, 30 bp, Homo sapiens
acgaggggtgctccctctgcagtgtttatt

SEQ ID NO: 37902 - DNA, 30 bp, Homo sapiens
cttttttgcagggtgggggcagctgtcctg

SEQ ID NO: 37903 - DNA, 30 bp, Homo sapiens
cttaggacagtggagggccttgaggtttta

SEQ ID NO: 37904 - DNA, 30 bp, Homo sapiens
cccaggggtctgcccccggcagtggggccg

SEQ ID NO: 37905 - DNA, 30 bp, Homo sapiens
gcacagcttgttgggataatgggcatattt

SEQ ID NO: 37906 - DNA, 30 bp, Homo sapiens
gggaggggcggggggcgctggggattggtg

SEQ ID NO: 37907 - DNA, 30 bp, Homo sapiens
cactggctccaggacttctgctgcctgtcg

SEQ ID NO: 37908 - DNA, 30 bp, Homo sapiens
ctttgggtttacttagaaactccttgttga

SEQ ID NO: 37909 - DNA, 30 bp, Homo sapiens
tacccggccacgttcatcaactctctaagg

SEQ ID NO: 37910 - DNA, 30 bp, Homo sapiens
agcaacttcgggcactatccttcgggtagt

SEQ ID NO: 37911 - DNA, 30 bp, Homo sapiens
gtctgtgcccttggaggcctcgcctctaga

SEQ ID NO: 37912 - DNA, 30 bp, Homo sapiens
aggagggacactggcccttcaggcgcttct

SEQ ID NO: 37913 - DNA, 30 bp, Homo sapiens
ccctctcccgagcctggtgccggtccagag

SEQ ID NO: 37914 - DNA, 30 bp, Homo sapiens
agcagaggatgttgggaaagtattggtact

SEQ ID NO: 37915 - DNA, 30 bp, Homo sapiens
gggtgagagcagcagctggatgagcttctg

SEQ ID NO: 37916 - DNA, 30 bp, Homo sapiens
gagttctgtaacatgatgtgttgattggtt

SEQ ID NO: 37917 - DNA, 30 bp, Homo sapiens
tgcaggatagtaaggattccgaaaccctgc

SEQ ID NO: 37918 - DNA, 30 bp, Homo sapiens
aattgagcattcaaccaaaccatctggaca

SEQ ID NO: 37919 - DNA, 30 bp, Homo sapiens
tttaggataaatctacagcattcacttact

SEQ ID NO: 37920 - DNA, 30 bp, Homo sapiens
acatggacccaatcatatcatctgtgtgaa

SEQ ID NO: 37921 - DNA, 30 bp, Homo sapiens
gtgaggagtgagggtgtccaggttgagtga

SEQ ID NO: 37922 - DNA, 30 bp, Homo sapiens
gttgatatctctcttgatttggcaaagagt

SEQ ID NO: 37923 - DNA, 30 bp, Homo sapiens
accagggtgtccttagtcattgggactgca

SEQ ID NO: 37924 - DNA, 30 bp, Homo sapiens
aggtcgggagcggggctgaagggtcccggg

SEQ ID NO: 37925 - DNA, 30 bp, Homo sapiens
ggaaggaagtcgagaggacagggctggttc

SEQ ID NO: 37926 - DNA, 30 bp, Homo sapiens
gaaaagcttgatggaaacgtgggagggtgg

SEQ ID NO: 37927 - DNA, 30 bp, Homo sapiens
atgaggcaggatggcagagccagtgccagc

SEQ ID NO: 37928 - DNA, 30 bp, Homo sapiens
tactggaatgcttgatggaaacgaggcagg

SEQ ID NO: 37929 - DNA, 30 bp, Homo sapiens
cacggtcgcatgttgtcacgaatccagtct

SEQ ID NO: 37930 - DNA, 30 bp, Homo sapiens
cagagggccaggccattctcttccttggtg

SEQ ID NO: 37931 - DNA, 30 bp, Homo sapiens
agcatggtggtctcagggcagtagtacttt

SEQ ID NO: 37932 - DNA, 30 bp, Homo sapiens
cagaggagagtgcctccccacagtctggca

SEQ ID NO: 37933 - DNA, 30 bp, Homo sapiens
tagagggccacagtgcgcaggctcattgga

SEQ ID NO: 37934 - DNA, 30 bp, Homo sapiens
ctctggcatgccctgatgtagagttttgtt

SEQ ID NO: 37935 - DNA, 30 bp, Homo sapiens
aaaccttgacaggcgcgaacttccagaggt

SEQ ID NO: 37936 - DNA, 30 bp, Homo sapiens
gagagcttgagggttggggggagtaaagtt

SEQ ID NO: 37937 - DNA, 30 bp, Homo sapiens
cagaggagtatcaaattcttttcctgggat

SEQ ID NO: 37938 - DNA, 30 bp, Homo sapiens
cagaggcggctctcctgggcatctgccttt

SEQ ID NO: 37939 - DNA, 30 bp, Homo sapiens
tccaggtttgcctttggggaggtggcaggc

SEQ ID NO: 37940 - DNA, 30 bp, Homo sapiens
cagagctgcgtgttctcctcctggctctcc

SEQ ID NO: 37941 - DNA, 30 bp, Homo sapiens
tgctggtctgcggtccatctcggcttccaa

SEQ ID NO: 37942 - DNA, 30 bp, Homo sapiens
ttttggagtttcatactactgttgctggtc

SEQ ID NO: 37943 - DNA, 30 bp, Homo sapiens
tagtcctggagggagatcttcacaaagagg

SEQ ID NO: 37944 - DNA, 30 bp, Homo sapiens
ggagcgctggatgcggatttggatgaagag

SEQ ID NO: 37945 - DNA, 30 bp, Homo sapiens
caggactcatccccctccaggccttcctgg

SEQ ID NO: 37946 - DNA, 30 bp, Homo sapiens
tgtcggtaatccattgtgtcactggaggac

SEQ ID NO: 37947 - DNA, 30 bp, Homo sapiens
tagaggcggttgtctccattgacccgagtc

SEQ ID NO: 37948 - DNA, 30 bp, Homo sapiens
gttgcatttctcctggtacagctggagctg

SEQ ID NO: 37949 - DNA, 30 bp, Homo sapiens
gcttggctcagtctgcaaaacagaattatc

SEQ ID NO: 37950 - DNA, 30 bp, Homo sapiens
tacaggcagcgacaaagctcccagaaggtt

SEQ ID NO: 37951 - DNA, 30 bp, Homo sapiens
cgatggtttccaggctgcacagtgggggga

SEQ ID NO: 37952 - DNA, 30 bp, Homo sapiens
ctcctccagcttttgagcaaacaaggcact

SEQ ID NO: 37953 - DNA, 30 bp, Homo sapiens
cagaggcggagcaggaccaggttttcagca

SEQ ID NO: 37954 - DNA, 30 bp, Homo sapiens
ctcctcactactttccttctcctctatggc

SEQ ID NO: 37955 - DNA, 30 bp, Homo sapiens
tctccagtttcatcgtttgctttttcgggt

SEQ ID NO: 37956 - DNA, 30 bp, Homo sapiens
agcaccacagcagcttctgattgagcgcga

SEQ ID NO: 37957 - DNA, 30 bp, Homo sapiens
ggatcttctgctgaatctcaaaggataaac

SEQ ID NO: 37958 - DNA, 30 bp, Homo sapiens
gcttctttcctgactcagcagggatggccc

SEQ ID NO: 37959 - DNA, 30 bp, Homo sapiens
tgttggcttctccttcatcaaagacatagt

SEQ ID NO: 37960 - DNA, 30 bp, Homo sapiens
agcaggctcaaggctctcacccattctgga

SEQ ID NO: 37961 - DNA, 30 bp, Homo sapiens
ctccatgggcactatggcctctttggtccc

SEQ ID NO: 37962 - DNA, 30 bp, Homo sapiens
ttctagggggatcatgccctccttgctacc

SEQ ID NO: 37963 - DNA, 30 bp, Homo sapiens
agcaggcggcaggcgttgcccacgctgtca

SEQ ID NO: 37964 - DNA, 30 bp, Homo sapiens
cagccctgccaaacgcagtcctggcccgga

SEQ ID NO: 37965 - DNA, 30 bp, Homo sapiens
tccggggatcctttccgcctgtgtcgtctg

SEQ ID NO: 37966 - DNA, 30 bp, Homo sapiens
gtttggctttcgctggaggtgccgcaagtt

SEQ ID NO: 37967 - DNA, 30 bp, Homo sapiens
gccacggcagactcagggccccccagggag

SEQ ID NO: 37968 - DNA, 30 bp, Homo sapiens
gttcgggaggccatctggatggctctgatc

SEQ ID NO: 37969 - DNA, 30 bp, Homo sapiens
actcggctcgctcagccttgctgctggcct

SEQ ID NO: 37970 - DNA, 30 bp, Homo sapiens
agaaggcacgtttgcgtgagagcccacata

SEQ ID NO: 37971 - DNA, 30 bp, Homo sapiens
ctttggaagctggttctcttggagagacag

SEQ ID NO: 37972 - DNA, 30 bp, Homo sapiens
acgtcactgaccggaaggctcgcatcgtcc

SEQ ID NO: 37973 - DNA, 30 bp, Homo sapiens
cacatcagaggtccgtatgttttcatcatc

SEQ ID NO: 37974 - DNA, 30 bp, Homo sapiens
agaaggatggaagagtatcttctgattcag

SEQ ID NO: 37975 - DNA, 30 bp, Homo sapiens
tagccagggcttgggagaggctgagaaccc

SEQ ID NO: 37976 - DNA, 30 bp, Homo sapiens
agctggattgtagcagagtgactcgcagag

SEQ ID NO: 37977 - DNA, 30 bp, Homo sapiens
gtgagctgcggctgagtggatggaactggc

SEQ ID NO: 37978 - DNA, 30 bp, Homo sapiens
agtaggcaaatctgtgctctgccgccggtg

SEQ ID NO: 37979 - DNA, 30 bp, Homo sapiens
tggtatagctgctgtcggcgccccgtgggg

SEQ ID NO: 37980 - DNA, 30 bp, Homo sapiens
taacatactgagccaagatctccagggagc

SEQ ID NO: 37981 - DNA, 30 bp, Homo sapiens
cacgggtcagtcactgcctgggctgccacc

SEQ ID NO: 37982 - DNA, 30 bp, Homo sapiens
taccacctcatcagattccagcccgtggac

SEQ ID NO: 37983 - DNA, 30 bp, Homo sapiens
tgcaggccactctgcacccgcctgattctg

SEQ ID NO: 37984 - DNA, 30 bp, Homo sapiens
aaacccctcgaactacccagccatggtgtt

SEQ ID NO: 37985 - DNA, 30 bp, Homo sapiens
tgttggatttcttagggctgtctggatatc

SEQ ID NO: 37986 - DNA, 30 bp, Homo sapiens
acacccacattcctacacttagggctgtct

SEQ ID NO: 37987 - DNA, 30 bp, Homo sapiens
agcagggcgaccacatgagcgagcccagcg

SEQ ID NO: 37988 - DNA, 30 bp, Homo sapiens
ggccatgcccgtggctgctcctgccagcat

SEQ ID NO: 37989 - DNA, 30 bp, Homo sapiens
gaagacccaaaatagagaccctaaggccat

SEQ ID NO: 37990 - DNA, 30 bp, Homo sapiens
actttccaccccgggagagtgccgaggggg

SEQ ID NO: 37991 - DNA, 30 bp, Homo sapiens
ctgtggaaggcagaccaggccacccccgag

SEQ ID NO: 37992 - DNA, 30 bp, Homo sapiens
tcactgctatcatcatcgtcatcatcatca

SEQ ID NO: 37993 - DNA, 30 bp, Homo sapiens
gcaaagctgcttgaactgagacactgaaat

SEQ ID NO: 37994 - DNA, 30 bp, Homo sapiens
gtttctgagagctccacccgctcgaagcac

SEQ ID NO: 37995 - DNA, 30 bp, Homo sapiens
atgtggaagggggcatcaggagccccctgg

SEQ ID NO: 37996 - DNA, 30 bp, Homo sapiens
gtctggacttccaggtcaagttctgagggt

SEQ ID NO: 37997 - DNA, 30 bp, Homo sapiens
gagttcaaggcctggaacttctctctaagg

SEQ ID NO: 37998 - DNA, 30 bp, Homo sapiens
ggcccctacccagggcctgccctgacacac

SEQ ID NO: 37999 - DNA, 30 bp, Homo sapiens
gcctggcgtgtgcggctcagcagcacagca

SEQ ID NO: 38000 - DNA, 30 bp, Homo sapiens
agcagggtggtcctgattcggtagagctgg

SEQ ID NO: 38001 - DNA, 30 bp, Homo sapiens
gaatgatgtggggcccccgcatcctctgca

SEQ ID NO: 38002 - DNA, 30 bp, Homo sapiens
tttcagaggattctgcgggcaatgtgaata

SEQ ID NO: 38003 - DNA, 30 bp, Homo sapiens
cgttggccccttggtagcacaggaaacaga

SEQ ID NO: 38004 - DNA, 30 bp, Homo sapiens
gtaaggtggggcctttggtcggtctgctgc

SEQ ID NO: 38005 - DNA, 30 bp, Homo sapiens
gctgccccaagcagccagactgtccctggg

SEQ ID NO: 38006 - DNA, 30 bp, Homo sapiens
cccaggcccgcgcctgcctccacccgcttg

SEQ ID NO: 38007 - DNA, 30 bp, Homo sapiens
agccactcagctggaacctggcctcctcgg

SEQ ID NO: 38008 - DNA, 30 bp, Homo sapiens
agcaggaggtggagtgaggctggcaggctg

SEQ ID NO: 38009 - DNA, 30 bp, Homo sapiens
tcctggtacttgcgccggcgggcacagcgg

SEQ ID NO: 38010 - DNA, 30 bp, Homo sapiens
caccaggggtctcgggaggctcggccgcgg

SEQ ID NO: 38011 - DNA, 30 bp, Homo sapiens
ttctggtaggacagctcgaacatggtgcaa

SEQ ID NO: 38012 - DNA, 30 bp, Homo sapiens
gatccactgcacaagccccccactggcctc

SEQ ID NO: 38013 - DNA, 30 bp, Homo sapiens
catcaggctcttccggtactgactgtgcgg

SEQ ID NO: 38014 - DNA, 30 bp, Homo sapiens
ggtgcacttctcctgtagagggtcaccagc

SEQ ID NO: 38015 - DNA, 30 bp, Homo sapiens
accagcaccatcattagtcataattttaca

SEQ ID NO: 38016 - DNA, 30 bp, Homo sapiens
tgtggcttctgtgagagcaagatagttgat

SEQ ID NO: 38017 - DNA, 30 bp, Homo sapiens
ccctggctcctttctgctggctctttttaa

SEQ ID NO: 38018 - DNA, 30 bp, Homo sapiens
agaagagaagtgtgctggtgagaaaagcaa

SEQ ID NO: 38019 - DNA, 30 bp, Homo sapiens
tctgtggggagaagtggaactccatttttg

SEQ ID NO: 38020 - DNA, 30 bp, Homo sapiens
gattatggaggacttcctgttttcagccat

SEQ ID NO: 38021 - DNA, 30 bp, Homo sapiens
ttctggctttttcaatgctttcaaaagtga

SEQ ID NO: 38022 - DNA, 30 bp, Homo sapiens
agctggctgtaatgcgtgcggcccaggatg

SEQ ID NO: 38023 - DNA, 30 bp, Homo sapiens
cgctgggtctcctggctgctcttgtccatc

SEQ ID NO: 38024 - DNA, 30 bp, Homo sapiens
acttcttctcctccggggctttctcagtga

SEQ ID NO: 38025 - DNA, 30 bp, Homo sapiens
cagcgggcaaggcgaagggccctaccagcc

SEQ ID NO: 38026 - DNA, 30 bp, Homo sapiens
gctcgggcatcagggtgtgcttgaccgggc

SEQ ID NO: 38027 - DNA, 30 bp, Homo sapiens
aggaggccttgagacggttgctggccgagc

SEQ ID NO: 38028 - DNA, 30 bp, Homo sapiens
ttcagggcatattccattcgattttttaat

SEQ ID NO: 38029 - DNA, 30 bp, Homo sapiens
ggctgggctgcggtcccggagcaggcgcag

SEQ ID NO: 38030 - DNA, 30 bp, Homo sapiens
tgtttgaccatttggtgaggtataactgat

SEQ ID NO: 38031 - DNA, 30 bp, Homo sapiens
atgcggagggcgtggtgaaggtgctgtccg

SEQ ID NO: 38032 - DNA, 30 bp, Homo sapiens
gccatctgactggtggccgcattgctgcct

SEQ ID NO: 38033 - DNA, 30 bp, Homo sapiens
ggttgatagaggaagaaaaatagctatatc

SEQ ID NO: 38034 - DNA, 30 bp, Homo sapiens
agggatcgacgaaggagactgcgatgtagc

SEQ ID NO: 38035 - DNA, 30 bp, Homo sapiens
tgcaaatgtgtgagtctcccaggatgcatg

SEQ ID NO: 38036 - DNA, 30 bp, Homo sapiens
caggggtcgacaaaggacaccatgatgtag

SEQ ID NO: 38037 - DNA, 30 bp, Homo sapiens
acttggtgcctcggcccatgagtttaagga

SEQ ID NO: 38038 - DNA, 30 bp, Homo sapiens
caccgggccatctgcggggtcagtgggggc

SEQ ID NO: 38039 - DNA, 30 bp, Homo sapiens
ccacctccagcggggccttcacgtctgctg

SEQ ID NO: 38040 - DNA, 30 bp, Homo sapiens
tcttggcatgatgttttctctttttattaa

SEQ ID NO: 38041 - DNA, 30 bp, Homo sapiens
aaggctggtgattgctcggatagtgattcc

SEQ ID NO: 38042 - DNA, 30 bp, Homo sapiens
aggaggaggagtgcgggtatccatagtggt

SEQ ID NO: 38043 - DNA, 30 bp, Homo sapiens
tcatgttgtggtgattgttcctgtcaataa

SEQ ID NO: 38044 - DNA, 30 bp, Homo sapiens
acaagggcaggatggcagcacagagccgcc

SEQ ID NO: 38045 - DNA, 30 bp, Homo sapiens
gtgaggctgggactcgcagactaacgtagg

SEQ ID NO: 38046 - DNA, 30 bp, Homo sapiens
tgttggccagaggaggatagtgctgtctgt

SEQ ID NO: 38047 - DNA, 30 bp, Homo sapiens
taccgggccttcggtgatcccctccagagg

SEQ ID NO: 38048 - DNA, 30 bp, Homo sapiens
agggaagcagcggtagaagaaatctgggcg

SEQ ID NO: 38049 - DNA, 30 bp, Homo sapiens
tctaggttaaattcaatgatgtgaaaacaa

SEQ ID NO: 38050 - DNA, 30 bp, Homo sapiens
cccaggcttctgtgcagtggaaagtacaag

SEQ ID NO: 38051 - DNA, 30 bp, Homo sapiens
acttggcagtgttggtgcatttgagcagat

SEQ ID NO: 38052 - DNA, 30 bp, Homo sapiens
taaagggtccttgccagtgatgcttgtagt

SEQ ID NO: 38053 - DNA, 30 bp, Homo sapiens
taaaaagaggaccggagcattatggggtga

SEQ ID NO: 38054 - DNA, 30 bp, Homo sapiens
accaggcagagatgagcatctggcaggtgc

SEQ ID NO: 38055 - DNA, 30 bp, Homo sapiens
cttcggtcatggacgcagagtgattctgtg

SEQ ID NO: 38056 - DNA, 30 bp, Homo sapiens
aggtggccacggcgggcgcagttctgcgac

SEQ ID NO: 38057 - DNA, 30 bp, Homo sapiens
agcaggtggtcacggctggcaaacaggtaa

SEQ ID NO: 38058 - DNA, 30 bp, Homo sapiens
tagtcggggaagcggcgcgcctgcatcttg

SEQ ID NO: 38059 - DNA, 30 bp, Homo sapiens
aagcccgtgtgggggaggttcctttgtaga

SEQ ID NO: 38060 - DNA, 30 bp, Homo sapiens
cgaaggcagtgatgtggttcttttccaaag

SEQ ID NO: 38061 - DNA, 30 bp, Homo sapiens
gactggatgagtttcttctgtggctgtgtc

SEQ ID NO: 38062 - DNA, 30 bp, Homo sapiens
cccattaagcatgcaaacaccgtcataacc

SEQ ID NO: 38063 - DNA, 30 bp, Homo sapiens
cccatcaaacatgcaaacacagtcatgacc

SEQ ID NO: 38064 - DNA, 30 bp, Homo sapiens
ccacactcctgatttttgttcctggctgcc

SEQ ID NO: 38065 - DNA, 30 bp, Homo sapiens
atcacggctttcattttaacatcaaggtct

SEQ ID NO: 38066 - DNA, 30 bp, Homo sapiens
aactggtgacggcagagggcccagcgcctc

SEQ ID NO: 38067 - DNA, 30 bp, Homo sapiens
ttgtggtggagatctttcaaaatacatgaa

SEQ ID NO: 38068 - DNA, 30 bp, Homo sapiens
agtgaatgttcaaagaacataaaatcaaag

SEQ ID NO: 38069 - DNA, 30 bp, Homo sapiens
ctgtggacggtgtgggggcagtggacgccc

SEQ ID NO: 38070 - DNA, 30 bp, Homo sapiens
tgcagggggcctctgggactccaggatctt

SEQ ID NO: 38071 - DNA, 30 bp, Homo sapiens
tgaagccctccttctcatggcccgagggct

SEQ ID NO: 38072 - DNA, 30 bp, Homo sapiens
ttctctccaactggttcaacttcagcatag

SEQ ID NO: 38073 - DNA, 30 bp, Homo sapiens
ctcagggccatcgtgtccaccacctgctcc

SEQ ID NO: 38074 - DNA, 30 bp, Homo sapiens
agctctcaatggacatggcattaatgagct

SEQ ID NO: 38075 - DNA, 30 bp, Homo sapiens
tagctgtcgctggacacgaggctgatgatc

SEQ ID NO: 38076 - DNA, 30 bp, Homo sapiens
atgagggttatgacttgttctagtttgtag

SEQ ID NO: 38077 - DNA, 30 bp, Homo sapiens
tacatttaggaagcaacaaagcagaggctg

SEQ ID NO: 38078 - DNA, 30 bp, Homo sapiens
agctggagaacaggagttccagagtcactg

SEQ ID NO: 38079 - DNA, 30 bp, Homo sapiens
gatctgtgaccttgttttccacagcagctg

SEQ ID NO: 38080 - DNA, 30 bp, Homo sapiens
cagaggtcagtgaccttgttctccagtgca

SEQ ID NO: 38081 - DNA, 30 bp, Homo sapiens
cacaggtcagtcactttgttttccaccagg

SEQ ID NO: 38082 - DNA, 30 bp, Homo sapiens
ctcgttctctttctagtttatttagaatct

SEQ ID NO: 38083 - DNA, 30 bp, Homo sapiens
tgtagcactcgtagatgttgtcctccatca

SEQ ID NO: 38084 - DNA, 30 bp, Homo sapiens
agtttgtgcaggtgagaaactggctcctgg

SEQ ID NO: 38085 - DNA, 30 bp, Homo sapiens
tgattccttccagtaactctggtttaaaaa

SEQ ID NO: 38086 - DNA, 30 bp, Homo sapiens
cacaggtcatctcccttcacagtaggccag

SEQ ID NO: 38087 - DNA, 30 bp, Homo sapiens
acaaggtcggtagactcttcccagcataca

SEQ ID NO: 38088 - DNA, 30 bp, Homo sapiens
gcccactgaggagggggctgttctcaccaa

SEQ ID NO: 38089 - DNA, 30 bp, Homo sapiens
gagagggtgtcctttctgtttatccttctc

SEQ ID NO: 38090 - DNA, 30 bp, Homo sapiens
ctcaggctccctcagcacagcaaccagctc

SEQ ID NO: 38091 - DNA, 30 bp, Homo sapiens
gcacagcaaccagctccctctgttctctgt

SEQ ID NO: 38092 - DNA, 30 bp, Homo sapiens
tcctgggctccaggggatccgggtagggga

SEQ ID NO: 38093 - DNA, 30 bp, Homo sapiens
tgccctcctgcttggacacaaaggctgcac

SEQ ID NO: 38094 - DNA, 30 bp, Homo sapiens
atgaggaacccgggcagtggggcatcccga

SEQ ID NO: 38095 - DNA, 30 bp, Homo sapiens
cagaggcctgcttgacgggcgcctgggact

SEQ ID NO: 38096 - DNA, 30 bp, Homo sapiens
cactggaaaattccccaggcgcaaggcaag

SEQ ID NO: 38097 - DNA, 30 bp, Homo sapiens
gggtgggggtagccccaggagaacccactt

SEQ ID NO: 38098 - DNA, 30 bp, Homo sapiens
agctctgctgggaggccctctctgccaagc

SEQ ID NO: 38099 - DNA, 30 bp, Homo sapiens
ccctgggagtgctggcagcctctgggctgg

SEQ ID NO: 38100 - DNA, 30 bp, Homo sapiens
tgcagggcctgtaagagcatgggctggagg

SEQ ID NO: 38101 - DNA, 30 bp, Homo sapiens
ctgcctccccggcgccactggccacgtggt

SEQ ID NO: 38102 - DNA, 30 bp, Homo sapiens
cacgcctcatgagctgtctctgggaagaaa

SEQ ID NO: 38103 - DNA, 30 bp, Homo sapiens
taggagaacagcagttcacagatcctgcgc

SEQ ID NO: 38104 - DNA, 30 bp, Homo sapiens
cctttctttgtcttctatgacattgacatt

SEQ ID NO: 38105 - DNA, 30 bp, Homo sapiens
catagattctggtgcacaccacgcccttca

SEQ ID NO: 38106 - DNA, 30 bp, Homo sapiens
aaccacacatttgacttgagtttgattcag

SEQ ID NO: 38107 - DNA, 30 bp, Homo sapiens
cctccactgctttctgtttggtttggtttg

SEQ ID NO: 38108 - DNA, 30 bp, Homo sapiens
taccggaagagccggtacgtcctgggcagg

SEQ ID NO: 38109 - DNA, 30 bp, Homo sapiens
catgttactgcgtatctgtttaaaatctgg

SEQ ID NO: 38110 - DNA, 30 bp, Homo sapiens
tgatgccactgcagtccagcctgtgtgaca

SEQ ID NO: 38111 - DNA, 30 bp, Homo sapiens
gataggttaaatgatgaaaaaatgggcgac

SEQ ID NO: 38112 - DNA, 30 bp, Homo sapiens
tcaggaccaagcccaaagcaatatatttgt

SEQ ID NO: 38113 - DNA, 30 bp, Homo sapiens
cccaggttggcgatgtgtctcatggttggc

SEQ ID NO: 38114 - DNA, 30 bp, Homo sapiens
gtctggagcggataaattctatcaggttct

SEQ ID NO: 38115 - DNA, 30 bp, Homo sapiens
ggggggctggccagcacggaggcctgagtg

SEQ ID NO: 38116 - DNA, 30 bp, Homo sapiens
tcgggacttagacttgtgtttgcggcttgc

SEQ ID NO: 38117 - DNA, 30 bp, Homo sapiens
agtcaaactggttcactggccccactgcaa

SEQ ID NO: 38118 - DNA, 30 bp, Homo sapiens
cgtttacgacggggaggggttgttgatctt

SEQ ID NO: 38119 - DNA, 30 bp, Homo sapiens
cattcctcagcgtttacgacggggaggggt

SEQ ID NO: 38120 - DNA, 30 bp, Homo sapiens
tgccacattctgttgaagtttgaatcccct

SEQ ID NO: 38121 - DNA, 30 bp, Homo sapiens
gtctgcaccccagacccaacatcaggggac

SEQ ID NO: 38122 - DNA, 30 bp, Homo sapiens
agccggcggagctcttccaggagctgggcc

SEQ ID NO: 38123 - DNA, 30 bp, Homo sapiens
cctcggagaactggcagtacagccgcccca

SEQ ID NO: 38124 - DNA, 30 bp, Homo sapiens
cttccaaggatgaacgcgagaagggcccag

SEQ ID NO: 38125 - DNA, 30 bp, Homo sapiens
acacggtgtgagggtgagcagaacttcctc

SEQ ID NO: 38126 - DNA, 30 bp, Homo sapiens
agcagggcgtgagggtgagcagcgtgtctt

SEQ ID NO: 38127 - DNA, 30 bp, Homo sapiens
acaagggtaaagagattgcaagacgttttc

SEQ ID NO: 38128 - DNA, 30 bp, Homo sapiens
gcatggtttcaggttctggagaatattagg

SEQ ID NO: 38129 - DNA, 30 bp, Homo sapiens
tccaggcctaactgcagaagggtggcctca

SEQ ID NO: 38130 - DNA, 30 bp, Homo sapiens
tgattccagcggccatagccatctcgttcc

SEQ ID NO: 38131 - DNA, 30 bp, Homo sapiens
gtctgggcttctctttcccctccttccaat

SEQ ID NO: 38132 - DNA, 30 bp, Homo sapiens
acttggccttggacttgggatggctcttgt

SEQ ID NO: 38133 - DNA, 30 bp, Homo sapiens
tttcccagggcttgggatggctcatggccc

SEQ ID NO: 38134 - DNA, 30 bp, Homo sapiens
tagttatcacattcctccaggacgggcttg

SEQ ID NO: 38135 - DNA, 30 bp, Homo sapiens
tgccctgggaggacttgggctggccctcgt

SEQ ID NO: 38136 - DNA, 30 bp, Homo sapiens
caaacctttctggattcattggtggcacgc

SEQ ID NO: 38137 - DNA, 30 bp, Homo sapiens
gtatgggtggtcccccagatcaaacctttc

SEQ ID NO: 38138 - DNA, 30 bp, Homo sapiens
tagcggcatttagggggcagcctccggccc

SEQ ID NO: 38139 - DNA, 30 bp, Homo sapiens
cagcccaaccttctgagcccaggcgaagaa

SEQ ID NO: 38140 - DNA, 30 bp, Homo sapiens
acgccttttgtctttcctgtctgattttcg

SEQ ID NO: 38141 - DNA, 30 bp, Homo sapiens
ctatccttgtccgtgtcacattctctatgg

SEQ ID NO: 38142 - DNA, 30 bp, Homo sapiens
ctcgaatattgccataaaccttggaaggag

SEQ ID NO: 38143 - DNA, 30 bp, Homo sapiens
acacattaccattctggtgcagggtgcgcc

SEQ ID NO: 38144 - DNA, 30 bp, Homo sapiens
aactggctttgtcagggagtggaatgctgg

SEQ ID NO: 38145 - DNA, 30 bp, Homo sapiens
gcttggttttttggatcccgaatgtcttgg

SEQ ID NO: 38146 - DNA, 30 bp, Homo sapiens
cccagggccccgatcacgggccgggcctcg

SEQ ID NO: 38147 - DNA, 30 bp, Homo sapiens
aactgggaaaggtggagagcccctcagcac

SEQ ID NO: 38148 - DNA, 30 bp, Homo sapiens
tgatacaaagattccattttcctcttgctt

SEQ ID NO: 38149 - DNA, 30 bp, Homo sapiens
caggcctggtgggtgggcccgagctcctct

SEQ ID NO: 38150 - DNA, 30 bp, Homo sapiens
gcatctgtggctgagccgggcggctcctgg

SEQ ID NO: 38151 - DNA, 30 bp, Homo sapiens
cccgtcctggtcagaggagccctcagacag

SEQ ID NO: 38152 - DNA, 30 bp, Homo sapiens
caactgcagctgatccagcttttcatttcg

SEQ ID NO: 38153 - DNA, 30 bp, Homo sapiens
ttcctccccgcggtgggtcatgggccccaa

SEQ ID NO: 38154 - DNA, 30 bp, Homo sapiens
ccacggttgtagctggcgactgaagcactt

SEQ ID NO: 38155 - DNA, 30 bp, Homo sapiens
gctccctgttttggttggaattttcaacag

SEQ ID NO: 38156 - DNA, 30 bp, Homo sapiens
aacagggacccagtggcttggtggtttggg

SEQ ID NO: 38157 - DNA, 30 bp, Homo sapiens
catggtgttgctctctgcatgattagctgc

SEQ ID NO: 38158 - DNA, 30 bp, Homo sapiens
tcaaagtcagtcgctgctccaagattgaaa

SEQ ID NO: 38159 - DNA, 30 bp, Homo sapiens
gactgggtgtgagctgatctggttccaagt

SEQ ID NO: 38160 - DNA, 30 bp, Homo sapiens
cctcctcctccttttccttccccaagcggc

SEQ ID NO: 38161 - DNA, 30 bp, Homo sapiens
aactagaatgtttgggacgtggcagggcag

SEQ ID NO: 38162 - DNA, 30 bp, Homo sapiens
tagaggtgtgtgtcttcctcctcatccagg

SEQ ID NO: 38163 - DNA, 30 bp, Homo sapiens
cacaggtgcgtgtcctcctcgaacacgtcc

SEQ ID NO: 38164 - DNA, 30 bp, Homo sapiens
tgaacttacacaagtgtatttgtcttctgt

SEQ ID NO: 38165 - DNA, 30 bp, Homo sapiens
acctggtggtatatattcgtagtcatcata

SEQ ID NO: 38166 - DNA, 30 bp, Homo sapiens
ccttgggaagagtaaggtaacacaggagtg

SEQ ID NO: 38167 - DNA, 30 bp, Homo sapiens
gcttagggggcctgtccatgccgaagaaag

SEQ ID NO: 38168 - DNA, 30 bp, Homo sapiens
cagtaggtgatcttccagtgggtgggttgc

SEQ ID NO: 38169 - DNA, 30 bp, Homo sapiens
acgaggaggcaaacagtatggaaatgacca

SEQ ID NO: 38170 - DNA, 30 bp, Homo sapiens
agttgctctcagccatgctttcggtgtcac

SEQ ID NO: 38171 - DNA, 30 bp, Homo sapiens
aacaggtgatgtcatccatctgcaaatggt

SEQ ID NO: 38172 - DNA, 30 bp, Homo sapiens
gatctaggtcagcttcttcaaagccataga

SEQ ID NO: 38173 - DNA, 30 bp, Homo sapiens
ggatttcacggcacaaccagcgaagagttt

SEQ ID NO: 38174 - DNA, 30 bp, Homo sapiens
atcctgacgacctgcacagcaatgcatggg

SEQ ID NO: 38175 - DNA, 30 bp, Homo sapiens
tcgctccggtccttgggttcccggtatttc

SEQ ID NO: 38176 - DNA, 30 bp, Homo sapiens
accaggcctcaggtccagggggtccgaagc

SEQ ID NO: 38177 - DNA, 30 bp, Homo sapiens
caggggcccagccccaggcctcccaggtca

SEQ ID NO: 38178 - DNA, 30 bp, Homo sapiens
ctctggaagaagccagtaatggacacctgt

SEQ ID NO: 38179 - DNA, 30 bp, Homo sapiens
cataggggatagagatgccagagactgcac

SEQ ID NO: 38180 - DNA, 30 bp, Homo sapiens
taagggcaggaggtcttacgtggtgcctca

SEQ ID NO: 38181 - DNA, 30 bp, Homo sapiens
agtgaaggcctgagggtggtgtcttctcat

SEQ ID NO: 38182 - DNA, 30 bp, Homo sapiens
caaagcttgattttgaattctgtgggctgc

SEQ ID NO: 38183 - DNA, 30 bp, Homo sapiens
taatggcccagctgtgggttcttctgcagc

SEQ ID NO: 38184 - DNA, 30 bp, Homo sapiens
attcggtatttgtcgtagtgaaaggatcat

SEQ ID NO: 38185 - DNA, 30 bp, Homo sapiens
cagaggcattcggtatttgtcgtagtgaaa

SEQ ID NO: 38186 - DNA, 30 bp, Homo sapiens
cattctgttcttcttcttccagcctttctt

SEQ ID NO: 38187 - DNA, 30 bp, Homo sapiens
aagcaaattcatccacagcttctattgcat

SEQ ID NO: 38188 - DNA, 30 bp, Homo sapiens
tccaggctggcttcgtttttccaaggagcc

SEQ ID NO: 38189 - DNA, 30 bp, Homo sapiens
ttgtggtgtctctgcttctcagatgtatta

SEQ ID NO: 38190 - DNA, 30 bp, Homo sapiens
taatggcttaaaaaatgattccaatgtttg

SEQ ID NO: 38191 - DNA, 30 bp, Homo sapiens
tcatggctcatcttgtgagcatcatagcgg

SEQ ID NO: 38192 - DNA, 30 bp, Homo sapiens
agcttcacaagtttgtcttccagccttctt

SEQ ID NO: 38193 - DNA, 30 bp, Homo sapiens
tggaaatctgatcctgctctcttccactct

SEQ ID NO: 38194 - DNA, 30 bp, Homo sapiens
gtttggttttattttctttgatgttgagta

SEQ ID NO: 38195 - DNA, 30 bp, Homo sapiens
ccgctcagcaggttctcggtaggggaggcc

SEQ ID NO: 38196 - DNA, 30 bp, Homo sapiens
atgaggctggcactgagggctcccacctca

SEQ ID NO: 38197 - DNA, 30 bp, Homo sapiens
ctctggaggaaggtactcaaggcccaggtg

SEQ ID NO: 38198 - DNA, 30 bp, Homo sapiens
tgaaggcgaaaaatgcaggggtgggggctg

SEQ ID NO: 38199 - DNA, 30 bp, Homo sapiens
gctctccccagctggcgcctattttcactt

SEQ ID NO: 38200 - DNA, 30 bp, Homo sapiens
cagaggctgcttgagctcgaacaggcctgt

SEQ ID NO: 38201 - DNA, 30 bp, Homo sapiens
cagctacaaaataccgaaaaacataaggca

SEQ ID NO: 38202 - DNA, 30 bp, Homo sapiens
atccactcgccttggcctcccaaagtgctg

SEQ ID NO: 38203 - DNA, 30 bp, Homo sapiens
gaaccgcatctagttcatccaagaagcgcc

SEQ ID NO: 38204 - DNA, 30 bp, Homo sapiens
cgccggttggaccgcttttcgtacttgtcc

SEQ ID NO: 38205 - DNA, 30 bp, Homo sapiens
atgtggattcatttctgcttgctttttgat

SEQ ID NO: 38206 - DNA, 30 bp, Homo sapiens
ctttgccaggcggtctgaggtctgggctgg

SEQ ID NO: 38207 - DNA, 30 bp, Homo sapiens
gttctcctcgtcactgtcatccgggctgat

SEQ ID NO: 38208 - DNA, 30 bp, Homo sapiens
tcgcggtgcaatactcatagacataagttc

SEQ ID NO: 38209 - DNA, 30 bp, Homo sapiens
ttatggttagcacatcactctggatctcgt

SEQ ID NO: 38210 - DNA, 30 bp, Homo sapiens
gtctggatatcatcaagaatctgctgcagc

SEQ ID NO: 38211 - DNA, 30 bp, Homo sapiens
agccggtaggtgatgtacctgccagccgtc

SEQ ID NO: 38212 - DNA, 30 bp, Homo sapiens
ctgtggcagctgcaagcttagaagattttc

SEQ ID NO: 38213 - DNA, 30 bp, Homo sapiens
gaaacaatgggtggcttgatgagacctgct

SEQ ID NO: 38214 - DNA, 30 bp, Homo sapiens
tccgggagagagagatgccaggcaggcagg

SEQ ID NO: 38215 - DNA, 30 bp, Homo sapiens
tggcaatgagcagaggatctgtctccccct

SEQ ID NO: 38216 - DNA, 30 bp, Homo sapiens
taatcgtccatcagggagccaatagcaaaa

SEQ ID NO: 38217 - DNA, 30 bp, Homo sapiens
cccaggcagggaccttgatccttggcccag

SEQ ID NO: 38218 - DNA, 30 bp, Homo sapiens
gcgaggttcagaaggctagcttcttcatca

SEQ ID NO: 38219 - DNA, 30 bp, Homo sapiens
agaaggctagcttcttcatcaggagataaa

SEQ ID NO: 38220 - DNA, 30 bp, Homo sapiens
tgaaagattcactctcacaatgcagtcgag

SEQ ID NO: 38221 - DNA, 30 bp, Homo sapiens
catcgaaaatatcctcaaacaggatgcccg

SEQ ID NO: 38222 - DNA, 30 bp, Homo sapiens
actcggtccagcggtggccgcagtgtgggg

SEQ ID NO: 38223 - DNA, 30 bp, Homo sapiens
ctcaattccttcctgcttgtcttttatggc

SEQ ID NO: 38224 - DNA, 30 bp, Homo sapiens
gtccggaagcgctcctccagcagggacagc

SEQ ID NO: 38225 - DNA, 30 bp, Homo sapiens
tctctgcatctgattggatccctagatttt

SEQ ID NO: 38226 - DNA, 30 bp, Homo sapiens
gaacacccagaaggagggaacctcaaagag

SEQ ID NO: 38227 - DNA, 30 bp, Homo sapiens
gtcatcttcatcccttacttctcggtatct

SEQ ID NO: 38228 - DNA, 30 bp, Homo sapiens
acaagggggatgtggaattcatttgtgtcg

SEQ ID NO: 38229 - DNA, 30 bp, Homo sapiens
tcattgtacttggacagttttaacctgggg

SEQ ID NO: 38230 - DNA, 30 bp, Homo sapiens
tcatggtgcactcaatgtaagactccagca

SEQ ID NO: 38231 - DNA, 30 bp, Homo sapiens
taccggtgtttgtgatccaagagggattca

SEQ ID NO: 38232 - DNA, 30 bp, Homo sapiens
ttaaggtaccacatgccaccatagcttaca

SEQ ID NO: 38233 - DNA, 30 bp, Homo sapiens
tgtcatgtaaatacagttagatggtgaaat

SEQ ID NO: 38234 - DNA, 30 bp, Homo sapiens
aggttgcctcatccatgttgtcatcactgt

SEQ ID NO: 38235 - DNA, 30 bp, Homo sapiens
ccatattgtcatcactgtcaccaccaaagt

SEQ ID NO: 38236 - DNA, 30 bp, Homo sapiens
agggcctgaaggacttcacccctggcaagg

SEQ ID NO: 38237 - DNA, 30 bp, Homo sapiens
tccctccagcggtgtccacactgagcattg

SEQ ID NO: 38238 - DNA, 30 bp, Homo sapiens
agtaggtggaacgcttcacctgctccaggt

SEQ ID NO: 38239 - DNA, 30 bp, Homo sapiens
tcctggtgggaaaggaagatgcctgtcctc

SEQ ID NO: 38240 - DNA, 30 bp, Homo sapiens
ttgcgggtgtgctgccttcgggcctgcagt

SEQ ID NO: 38241 - DNA, 30 bp, Homo sapiens
caaaggggccagcagactgggtgacctcga

SEQ ID NO: 38242 - DNA, 30 bp, Homo sapiens
cttcgggaatgccctttctcccgattcttt

SEQ ID NO: 38243 - DNA, 30 bp, Homo sapiens
ctcgcccttcttgtaggcgttcttgatgat

SEQ ID NO: 38244 - DNA, 30 bp, Homo sapiens
ttctggggctcctggggctccctcctcctt

SEQ ID NO: 38245 - DNA, 30 bp, Homo sapiens
tatccagctttggaaatctggacaaagaga

SEQ ID NO: 38246 - DNA, 30 bp, Homo sapiens
catctgcaaagggtcccaggaggatcttgt

SEQ ID NO: 38247 - DNA, 30 bp, Homo sapiens
acatcatggcatctctaagtgtatccaaga

SEQ ID NO: 38248 - DNA, 30 bp, Homo sapiens
tcaagtgtggctctcccatgacttcgcttt

SEQ ID NO: 38249 - DNA, 30 bp, Homo sapiens
tgtctttccagcgaagggccttgagttcat

SEQ ID NO: 38250 - DNA, 30 bp, Homo sapiens
aagtcccatgagtccagccaccttagtcct

SEQ ID NO: 38251 - DNA, 30 bp, Homo sapiens
acgtggaccactggctcacgacacgaggct

SEQ ID NO: 38252 - DNA, 30 bp, Homo sapiens
aagtggaagacatccactgtgaactggagt

SEQ ID NO: 38253 - DNA, 30 bp, Homo sapiens
agcagtttccctttgtacacagaggcaact

SEQ ID NO: 38254 - DNA, 30 bp, Homo sapiens
ctgtggtataaagtgcctatgagcagcttc

SEQ ID NO: 38255 - DNA, 30 bp, Homo sapiens
agaattttcccatggtacacagaagccaca

SEQ ID NO: 38256 - DNA, 30 bp, Homo sapiens
tagcaatcctcgcaaatcgatactgcagag

SEQ ID NO: 38257 - DNA, 30 bp, Homo sapiens
aatgccatgaaaggaaagaccaagtcttga

SEQ ID NO: 38258 - DNA, 30 bp, Homo sapiens
cacaggtcaatcgttcccttcgctttgaac

SEQ ID NO: 38259 - DNA, 30 bp, Homo sapiens
cttctgcagcctcctcacctgactcctcct

SEQ ID NO: 38260 - DNA, 30 bp, Homo sapiens
agactcggatgtggatggctgagttgttgc

SEQ ID NO: 38261 - DNA, 30 bp, Homo sapiens
agttcaggcgtgtgggttggagccaaaggg

SEQ ID NO: 38262 - DNA, 30 bp, Homo sapiens
gccaccttccctgaaaagccaaactggtgg

SEQ ID NO: 38263 - DNA, 30 bp, Homo sapiens
gtctggaattctgaaaatgttgtgtcaggg

SEQ ID NO: 38264 - DNA, 30 bp, Homo sapiens
gctccacacgtccagggagtagcggccctt

SEQ ID NO: 38265 - DNA, 30 bp, Homo sapiens
cctatgagacggtagaagatccagcatcca

SEQ ID NO: 38266 - DNA, 30 bp, Homo sapiens
cttaatcgtcttctagatccttgaactttt

SEQ ID NO: 38267 - DNA, 30 bp, Homo sapiens
ctgtggtgtcaaaaatctgatagcaaattt

SEQ ID NO: 38268 - DNA, 30 bp, Homo sapiens
tagtggctatttttgagttctagtaagtgt

SEQ ID NO: 38269 - DNA, 30 bp, Homo sapiens
tactggttttcgttaatgcttcttcattca

SEQ ID NO: 38270 - DNA, 30 bp, Homo sapiens
tccagaaattagcatggcaatttcttcctg

SEQ ID NO: 38271 - DNA, 30 bp, Homo sapiens
acaagcatttgcggtggacaatggaggggc

SEQ ID NO: 38272 - DNA, 30 bp, Homo sapiens
tggaggggcctgactcatcatactcctgct

SEQ ID NO: 38273 - DNA, 30 bp, Homo sapiens
ctatctgcttttcttcatgaatcagaatct

SEQ ID NO: 38274 - DNA, 30 bp, Homo sapiens
tttctctctgcctccggttgcaaaaccaaa

SEQ ID NO: 38275 - DNA, 30 bp, Homo sapiens
agccttccacagagagagtgtggttaagcg

SEQ ID NO: 38276 - DNA, 30 bp, Homo sapiens
cactgtgccttggaggcggtggtggtggtg

SEQ ID NO: 38277 - DNA, 30 bp, Homo sapiens
aggctggtaaggggcagggttccaccagag

SEQ ID NO: 38278 - DNA, 30 bp, Homo sapiens
taccccgtgctggggttcaggcctgacaag

SEQ ID NO: 38279 - DNA, 30 bp, Homo sapiens
aagccgatagccgagtggctgccttgaggg

SEQ ID NO: 38280 - DNA, 30 bp, Homo sapiens
cagtggaggtaggtggaatgattccatcgg

SEQ ID NO: 38281 - DNA, 30 bp, Homo sapiens
agccgggcagtgtgtggtggtggtggtggt

SEQ ID NO: 38282 - DNA, 30 bp, Homo sapiens
cactggacgggcgtctgcaccccgtggtgt

SEQ ID NO: 38283 - DNA, 30 bp, Homo sapiens
ccgtggtgaggcggcggcgtgtcggcgctc

SEQ ID NO: 38284 - DNA, 30 bp, Homo sapiens
agagatcatggcaagatgtgtctgttttca

SEQ ID NO: 38285 - DNA, 30 bp, Homo sapiens
cagtaagtggcagagaatttcatccgcttc

SEQ ID NO: 38286 - DNA, 30 bp, Homo sapiens
tgccggcggaatatttcattcttttctgtt

SEQ ID NO: 38287 - DNA, 30 bp, Homo sapiens
cagtggacagccgaatacttcattcgtttc

SEQ ID NO: 38288 - DNA, 30 bp, Homo sapiens
tttgaatgcatgggagagcccagagtggtg

SEQ ID NO: 38289 - DNA, 30 bp, Homo sapiens
aatctgaggaggcccagagtggtggctggg

SEQ ID NO: 38290 - DNA, 30 bp, Homo sapiens
taagggatctgaaagacgttcagcttgctg

SEQ ID NO: 38291 - DNA, 30 bp, Homo sapiens
tagaggaggaggcgtttgtgaaaggcttag

SEQ ID NO: 38292 - DNA, 30 bp, Homo sapiens
agtctgttaagggctccaaagggactgccg

SEQ ID NO: 38293 - DNA, 30 bp, Homo sapiens
agtaaagcagcatttacaagttcatggcta

SEQ ID NO: 38294 - DNA, 30 bp, Homo sapiens
ctgttggtactgtgcaggcagattcacagg

SEQ ID NO: 38295 - DNA, 30 bp, Homo sapiens
ccaaggaagtgccacacttgctcttcttca

SEQ ID NO: 38296 - DNA, 30 bp, Homo sapiens
tcttccctgggcggccccggccccggcctc

SEQ ID NO: 38297 - DNA, 30 bp, Homo sapiens
agcaggtcgctgactgccagctggacagag

SEQ ID NO: 38298 - DNA, 30 bp, Homo sapiens
agatctcctgcagtagcgggtgcagcgcag

SEQ ID NO: 38299 - DNA, 30 bp, Homo sapiens
cacagaatgatggccgcaatgaatagggcc

SEQ ID NO: 38300 - DNA, 30 bp, Homo sapiens
gtacatgtccttgtagatctcctggagcag

SEQ ID NO: 38301 - DNA, 30 bp, Homo sapiens
agatctcctgcaggagcgggtgaagactca

SEQ ID NO: 38302 - DNA, 30 bp, Homo sapiens
acctgggcggttgatttgtctgttgtcttt

SEQ ID NO: 38303 - DNA, 30 bp, Homo sapiens
caagcttctctgagcttctttcagtaaact

SEQ ID NO: 38304 - DNA, 30 bp, Homo sapiens
tgcaggctctgctgggcctctttcagtaag

SEQ ID NO: 38305 - DNA, 30 bp, Homo sapiens
accattctaattctacaggatattttccag

SEQ ID NO: 38306 - DNA, 30 bp, Homo sapiens
atctgggtccaggcagattttcctcccatc

SEQ ID NO: 38307 - DNA, 30 bp, Homo sapiens
gccaggactctccagctgtggtgtttctaa

SEQ ID NO: 38308 - DNA, 30 bp, Homo sapiens
caactctgctggaagccactgtgctggaag

SEQ ID NO: 38309 - DNA, 30 bp, Homo sapiens
caactcgggttccccagctgagatccgtgg

SEQ ID NO: 38310 - DNA, 30 bp, Homo sapiens
cctgtcttcactgtgctggctggaataagc

SEQ ID NO: 38311 - DNA, 30 bp, Homo sapiens
aaagctgtgtgtcgagactgaagattatcc

SEQ ID NO: 38312 - DNA, 30 bp, Homo sapiens
tgctggaggcctggggaggttccgagtgct

SEQ ID NO: 38313 - DNA, 30 bp, Homo sapiens
ggacgggggcccagcgctggctgtgctgga

SEQ ID NO: 38314 - DNA, 30 bp, Homo sapiens
gcagacagatcttttattctcacatttgaa

SEQ ID NO: 38315 - DNA, 30 bp, Homo sapiens
agcagacagatcttttattctcacatttga

SEQ ID NO: 38316 - DNA, 30 bp, Homo sapiens
ccaaggttggtgacatcaggtttcatcaag

SEQ ID NO: 38317 - DNA, 30 bp, Homo sapiens
acctggactgctgcagccactgtctttagc

SEQ ID NO: 38318 - DNA, 30 bp, Homo sapiens
tgtagcagaatccaacctctgtgttcctga

SEQ ID NO: 38319 - DNA, 30 bp, Homo sapiens
acataccgtccatctgcatcttctttggct

SEQ ID NO: 38320 - DNA, 30 bp, Homo sapiens
cagtggagttgtctaacctctgcagtcttg

SEQ ID NO: 38321 - DNA, 30 bp, Homo sapiens
cagaggttgtggttaacctaaatccagctg

SEQ ID NO: 38322 - DNA, 30 bp, Homo sapiens
agcaggaataggtccggaccgaaacgccgt

SEQ ID NO: 38323 - DNA, 30 bp, Homo sapiens
tcccggaaggcggagagcatgtgtccgtag

SEQ ID NO: 38324 - DNA, 30 bp, Homo sapiens
tgctggcactgggggaacgggcagcaaaat

SEQ ID NO: 38325 - DNA, 30 bp, Homo sapiens
ctgtggtccacgggcctaaggcacttgagc

SEQ ID NO: 38326 - DNA, 30 bp, Homo sapiens
acctggtccagcccatccagttcaggggca

SEQ ID NO: 38327 - DNA, 30 bp, Homo sapiens
atcagagttgggggcaggcaggcgagagtc

SEQ ID NO: 38328 - DNA, 30 bp, Homo sapiens
ttctggctttacatccttgcgtgagttgca

SEQ ID NO: 38329 - DNA, 30 bp, Homo sapiens
gagtggaagtatcatactctgcaatgaaat

SEQ ID NO: 38330 - DNA, 30 bp, Homo sapiens
ctttggtttttgatgctattgctttagagc

SEQ ID NO: 38331 - DNA, 30 bp, Homo sapiens
gcgctccatggcctccacaatattcatgcc

SEQ ID NO: 38332 - DNA, 30 bp, Homo sapiens
caatggtgatcttcttgctggtcttgctat

SEQ ID NO: 38333 - DNA, 30 bp, Homo sapiens
tccttggcgatggcaaagggcttctccacc

SEQ ID NO: 38334 - DNA, 30 bp, Homo sapiens
agcgatctcaaccacaaaaggcgttttcac

SEQ ID NO: 38335 - DNA, 30 bp, Homo sapiens
ctttatctttctgtgcctttatcttttgtt

SEQ ID NO: 38336 - DNA, 30 bp, Homo sapiens
tccaggacctcggctggctggtaattgctg

SEQ ID NO: 38337 - DNA, 30 bp, Homo sapiens
agatggtgtggctctcaaccttttggcttt

SEQ ID NO: 38338 - DNA, 30 bp, Homo sapiens
cacacgtactccccacagtcggcgatgatc

SEQ ID NO: 38339 - DNA, 30 bp, Homo sapiens
aactggccacagtctgtgatgacaatcttc

SEQ ID NO: 38340 - DNA, 30 bp, Homo sapiens
ttgtcttcatctgttccagggcttgattca

SEQ ID NO: 38341 - DNA, 30 bp, Homo sapiens
actgcgagatcaccacaggtagcttgggct

SEQ ID NO: 38342 - DNA, 30 bp, Homo sapiens
agaagggtatgccttaatgatcttcacgtc

SEQ ID NO: 38343 - DNA, 30 bp, Homo sapiens
accaggagctgaagtccccaaaaccccgac

SEQ ID NO: 38344 - DNA, 30 bp, Homo sapiens
gctgaagtccccaaaaccccgactgggctt

SEQ ID NO: 38345 - DNA, 30 bp, Homo sapiens
tagtggtcatcaggcagcctgctgctacca

SEQ ID NO: 38346 - DNA, 30 bp, Homo sapiens
aaatgggttggcatgaatagttatgtcctt

SEQ ID NO: 38347 - DNA, 30 bp, Homo sapiens
cttcggtctctctttttactcctttctctt

SEQ ID NO: 38348 - DNA, 30 bp, Homo sapiens
cttgtatccagccattctgtactattcgat

SEQ ID NO: 38349 - DNA, 30 bp, Homo sapiens
tcagtaattctacacatatgtattggtctt

SEQ ID NO: 38350 - DNA, 30 bp, Homo sapiens
ggacctcctgggcctgcagatcaatctcct

SEQ ID NO: 38351 - DNA, 30 bp, Homo sapiens
tgaggtattaggaacaactgcactagaagg

SEQ ID NO: 38352 - DNA, 30 bp, Homo sapiens
tctgcccagataccaagaccgccagctcct

SEQ ID NO: 38353 - DNA, 30 bp, Homo sapiens
caccccctggtgggaggctggggatgttct

SEQ ID NO: 38354 - DNA, 30 bp, Homo sapiens
tctactctgcattccaggtacttgtccaac

SEQ ID NO: 38355 - DNA, 30 bp, Homo sapiens
atctttgtccctgcatcttcattagagctg

SEQ ID NO: 38356 - DNA, 30 bp, Homo sapiens
actttctctatgtggattcagtctactata

SEQ ID NO: 38357 - DNA, 30 bp, Homo sapiens
ccatgggtcttctagatctccagcaccccc

SEQ ID NO: 38358 - DNA, 30 bp, Homo sapiens
ttgatgaagtaaaggatttccaattttctt

SEQ ID NO: 38359 - DNA, 30 bp, Homo sapiens
aagatctgggcatggaatatcatgagtctt

SEQ ID NO: 38360 - DNA, 30 bp, Homo sapiens
agcttcttggtggagcctgggtctcaggtt

SEQ ID NO: 38361 - DNA, 30 bp, Homo sapiens
gcttggccttcttcttcttgtcgctgttgc

SEQ ID NO: 38362 - DNA, 30 bp, Homo sapiens
cccagtcggtcattagatatccgccatcct

SEQ ID NO: 38363 - DNA, 30 bp, Homo sapiens
aggagtaactgcctggccctcccaggggga

SEQ ID NO: 38364 - DNA, 30 bp, Homo sapiens
gtccactggaggcaaagcttctgctgaatg

SEQ ID NO: 38365 - DNA, 30 bp, Homo sapiens
tgactgttatattgtcagggcagcctctgt

SEQ ID NO: 38366 - DNA, 30 bp, Homo sapiens
cagtggtcactgctctcttggccctgactg

SEQ ID NO: 38367 - DNA, 30 bp, Homo sapiens
tgtccaaggctgagcccaaatgcgtggggt

SEQ ID NO: 38368 - DNA, 30 bp, Homo sapiens
gccaggaaacacacactggaatccaccgat

SEQ ID NO: 38369 - DNA, 30 bp, Homo sapiens
gttaggttctgtgcccaggacactgactgc

SEQ ID NO: 38370 - DNA, 30 bp, Homo sapiens
tcttggctttggcggaattgcggggtgggg

SEQ ID NO: 38371 - DNA, 30 bp, Homo sapiens
cttcggcggattagctgttcgaggtggagt

SEQ ID NO: 38372 - DNA, 30 bp, Homo sapiens
ccttggaggcgttacaggtctcgtggcatt

SEQ ID NO: 38373 - DNA, 30 bp, Homo sapiens
ggacgggttcaggcctgatgcaacccttgg

SEQ ID NO: 38374 - DNA, 30 bp, Homo sapiens
ggcagggggggcccattgacacccgggtgg

SEQ ID NO: 38375 - DNA, 30 bp, Homo sapiens
cattggccctggagggggctgggaagggtc

SEQ ID NO: 38376 - DNA, 30 bp, Homo sapiens
tttcatcctttagcctctggttgtctgctt

SEQ ID NO: 38377 - DNA, 30 bp, Homo sapiens
aattcccccataccctcccaaactgcacct

SEQ ID NO: 38378 - DNA, 30 bp, Homo sapiens
acttggacagtttgctgatgactctgatga

SEQ ID NO: 38379 - DNA, 30 bp, Homo sapiens
aaaaggccagaagagaactgcctccttctc

SEQ ID NO: 38380 - DNA, 30 bp, Homo sapiens
tcctgggtgtccgaggactcgatggactcc

SEQ ID NO: 38381 - DNA, 30 bp, Homo sapiens
cacttggagagtttgctgatgacgcggatc

SEQ ID NO: 38382 - DNA, 30 bp, Homo sapiens
tgtcggggtttgatccgtggatacagcccc

SEQ ID NO: 38383 - DNA, 30 bp, Homo sapiens
agactttactcctttgaggcttcaccctgg

SEQ ID NO: 38384 - DNA, 30 bp, Homo sapiens
caggggtgagcagtccgggcccggtcctgg

SEQ ID NO: 38385 - DNA, 30 bp, Homo sapiens
ctgcggagggctcagtttcctcatgcctct

SEQ ID NO: 38386 - DNA, 30 bp, Homo sapiens
ggcaggcctggcagtgctgaggctgctaaa

SEQ ID NO: 38387 - DNA, 30 bp, Homo sapiens
ctgaggccggctgagtctccggagtttctt

SEQ ID NO: 38388 - DNA, 30 bp, Homo sapiens
ctcccactgaggtccagggcagccgctgca

SEQ ID NO: 38389 - DNA, 30 bp, Homo sapiens
caacattgcttgagaacattaagtcctttg

SEQ ID NO: 38390 - DNA, 30 bp, Homo sapiens
atgagcaggcagcacggcctcctctccacg

SEQ ID NO: 38391 - DNA, 30 bp, Homo sapiens
atacggcaacagccatgcaccttctcctcc

SEQ ID NO: 38392 - DNA, 30 bp, Homo sapiens
ttttcgtcatcttccacgattgctttgggt

SEQ ID NO: 38393 - DNA, 30 bp, Homo sapiens
cgccggcaggactcatccacaatcagggcc

SEQ ID NO: 38394 - DNA, 30 bp, Homo sapiens
tggctcccttggaatccagtggtggtatat

SEQ ID NO: 38395 - DNA, 30 bp, Homo sapiens
tgccaggctcagagggggaagggcgctgag

SEQ ID NO: 38396 - DNA, 30 bp, Homo sapiens
gctcctctctttcattggtgccttcttctt

SEQ ID NO: 38397 - DNA, 30 bp, Homo sapiens
taatggtcccgctgctcctctctttcattg

SEQ ID NO: 38398 - DNA, 30 bp, Homo sapiens
acttggagtagatccttgatttgattcttc

SEQ ID NO: 38399 - DNA, 30 bp, Homo sapiens
tggacatctttagtgtgtcaatctcttctc

SEQ ID NO: 38400 - DNA, 30 bp, Homo sapiens
ctactgagctgccgccactgtcctccgtgg

SEQ ID NO: 38401 - DNA, 30 bp, Homo sapiens
tcgtggtccctttgaagagctccaccagct

SEQ ID NO: 38402 - DNA, 30 bp, Homo sapiens
taagggtcgcatgactgggtttgcagtcca

SEQ ID NO: 38403 - DNA, 30 bp, Homo sapiens
cagcggctgctgtgaggtgtgttctggtag

SEQ ID NO: 38404 - DNA, 30 bp, Homo sapiens
gcctcagtgtccggtgcatgaggaaggtgt

SEQ ID NO: 38405 - DNA, 30 bp, Homo sapiens
agatggtcatgtctggcccaggcccaggtg

SEQ ID NO: 38406 - DNA, 30 bp, Homo sapiens
tacttagggcatgatgtatgagaggacagt

SEQ ID NO: 38407 - DNA, 30 bp, Homo sapiens
gcccggattcctgactggcttccagaagca

SEQ ID NO: 38408 - DNA, 30 bp, Homo sapiens
tcccaggatagccaggacaatgacaaaacg

SEQ ID NO: 38409 - DNA, 30 bp, Homo sapiens
agtagggccctagcttttcatatcctaagt

SEQ ID NO: 38410 - DNA, 30 bp, Homo sapiens
tctccattctcccccagctctgccactctg

SEQ ID NO: 38411 - DNA, 30 bp, Homo sapiens
aagtggatccagctctcttcgcactccccg

SEQ ID NO: 38412 - DNA, 30 bp, Homo sapiens
aagtggatccagccctgcggctccggagct

SEQ ID NO: 38413 - DNA, 30 bp, Homo sapiens
agaaccaagccagagagaggcacagcgcaa

SEQ ID NO: 38414 - DNA, 30 bp, Homo sapiens
cgcagggcgcgcgtagcgcagcgtgtagtt

SEQ ID NO: 38415 - DNA, 30 bp, Homo sapiens
gatttggacaccaatatcagtctgtccctg

SEQ ID NO: 38416 - DNA, 30 bp, Homo sapiens
catgcagaagttggttgtcaacggctatga

SEQ ID NO: 38417 - DNA, 30 bp, Homo sapiens
gaacgtggcatcgatctgccgcacggaggg

SEQ ID NO: 38418 - DNA, 30 bp, Homo sapiens
agtacgtgaggctgtcctgcacattgttct

SEQ ID NO: 38419 - DNA, 30 bp, Homo sapiens
gtgtgggcttcttgcctggccaagcctctt

SEQ ID NO: 38420 - DNA, 30 bp, Homo sapiens
ccctcggctgtagttgacgtcatcttttct

SEQ ID NO: 38421 - DNA, 30 bp, Homo sapiens
tgtttgcaagtttccttccagttctgagat

SEQ ID NO: 38422 - DNA, 30 bp, Homo sapiens
gtctggggtacgacgagtaacatgtggctc

SEQ ID NO: 38423 - DNA, 30 bp, Homo sapiens
aacatgaggctcaccacgacgaggcgctgg

SEQ ID NO: 38424 - DNA, 30 bp, Homo sapiens
gggcaaagtatttgacgtccacatcctggt

SEQ ID NO: 38425 - DNA, 30 bp, Homo sapiens
tatgccaatgcaagaacacttatagcttcc

SEQ ID NO: 38426 - DNA, 30 bp, Homo sapiens
ctttgggagaaatgcactagctctgcaatt

SEQ ID NO: 38427 - DNA, 30 bp, Homo sapiens
ccttggggtgccaggctgtgtgaaggattt

SEQ ID NO: 38428 - DNA, 30 bp, Homo sapiens
agttaaccttgtcctggaatatatataggt

SEQ ID NO: 38429 - DNA, 30 bp, Homo sapiens
gcatgtcagagtttaccttgtcctggaaga

SEQ ID NO: 38430 - DNA, 30 bp, Homo sapiens
tcctggaatatgtacaagttattggtggca

SEQ ID NO: 38431 - DNA, 30 bp, Homo sapiens
attgaagctttccacatttctctggaaggc

SEQ ID NO: 38432 - DNA, 30 bp, Homo sapiens
cagcggctccaggtcctcgtccccgcatgc

SEQ ID NO: 38433 - DNA, 30 bp, Homo sapiens
tcaaggtctgcagagttttcactgtcattt

SEQ ID NO: 38434 - DNA, 30 bp, Homo sapiens
gtaaggtcatcgaaaagcttgccattcatt

SEQ ID NO: 38435 - DNA, 30 bp, Homo sapiens
cactggcggccacctggggtgtaagccgct

SEQ ID NO: 38436 - DNA, 30 bp, Homo sapiens
gattggctttggctagattttctattttaa

SEQ ID NO: 38437 - DNA, 30 bp, Homo sapiens
tagcggccgtcctgggaggccagctcatcg

SEQ ID NO: 38438 - DNA, 30 bp, Homo sapiens
tcctggctggcagttaggaactcttccgcc

SEQ ID NO: 38439 - DNA, 30 bp, Homo sapiens
cgtctaagacctctctttaactccagatcc

SEQ ID NO: 38440 - DNA, 30 bp, Homo sapiens
ctgtccgtgccgttagtctctgaggtgaga

SEQ ID NO: 38441 - DNA, 30 bp, Homo sapiens
cactgggcagtatggttgcccgtcccgtgg

SEQ ID NO: 38442 - DNA, 30 bp, Homo sapiens
gacaggaactaaaaaacagaaggaattccc

SEQ ID NO: 38443 - DNA, 30 bp, Homo sapiens
gaatgggctttcttcccttggtcgctcctg

SEQ ID NO: 38444 - DNA, 30 bp, Homo sapiens
tctttttgtggatatctaggccacctacaa

SEQ ID NO: 38445 - DNA, 30 bp, Homo sapiens
atgaggaccagcttcttgtggatctccagg

SEQ ID NO: 38446 - DNA, 30 bp, Homo sapiens
cacaggaagtagtcggccacgggcttcttg

SEQ ID NO: 38447 - DNA, 30 bp, Homo sapiens
agtaggttgaggacgctgtgctcatggcat

SEQ ID NO: 38448 - DNA, 30 bp, Homo sapiens
gttcatcggtgacttctgtggcttcgtcat

SEQ ID NO: 38449 - DNA, 30 bp, Homo sapiens
agtttgggaagttgaggcaggtggatcact

SEQ ID NO: 38450 - DNA, 30 bp, Homo sapiens
cttcatcctcatcatcatcttcatcatcat

SEQ ID NO: 38451 - DNA, 30 bp, Homo sapiens
acgaggtcttttcctgggggacgattcttc

SEQ ID NO: 38452 - DNA, 30 bp, Homo sapiens
atgaggtttcttcttgggggatgtttcatc

SEQ ID NO: 38453 - DNA, 30 bp, Homo sapiens
gtcttatcaggatttgggtttttctcttgt

SEQ ID NO: 38454 - DNA, 30 bp, Homo sapiens
ctctggacaaacatatgtgagatccatact

SEQ ID NO: 38455 - DNA, 30 bp, Homo sapiens
gtggttgtgtatctttacttccactgctct

SEQ ID NO: 38456 - DNA, 30 bp, Homo sapiens
atcattcctagctgcagcagcgtgttggca

SEQ ID NO: 38457 - DNA, 30 bp, Homo sapiens
acgtggtctgaacacagtcttggctggtga

SEQ ID NO: 38458 - DNA, 30 bp, Homo sapiens
caaaggaaatatggcgttgtcgttctggga

SEQ ID NO: 38459 - DNA, 30 bp, Homo sapiens
gatgcaggcccttccggggcagagccattg

SEQ ID NO: 38460 - DNA, 30 bp, Homo sapiens
aaggcagctccttctggcggggcatctgtc

SEQ ID NO: 38461 - DNA, 30 bp, Homo sapiens
cactgggccatttaaggcagctccttctgg

SEQ ID NO: 38462 - DNA, 30 bp, Homo sapiens
atacagggccattcactgaagtgtcacctg

SEQ ID NO: 38463 - DNA, 30 bp, Homo sapiens
tcctgggagtgctggaatctccacaccact

SEQ ID NO: 38464 - DNA, 30 bp, Homo sapiens
ctgaggttcttctgggcctgtttcaacaat

SEQ ID NO: 38465 - DNA, 30 bp, Homo sapiens
ccaaggaatggtatgatgtgggcataaaac

SEQ ID NO: 38466 - DNA, 30 bp, Homo sapiens
gagagccaaggttcaatgcaggtctcataa

SEQ ID NO: 38467 - DNA, 30 bp, Homo sapiens
ttgaaagaaggacggtgatgtcatctggct

SEQ ID NO: 38468 - DNA, 30 bp, Homo sapiens
catagggcttatctgttttgggattgactt

SEQ ID NO: 38469 - DNA, 30 bp, Homo sapiens
cagcgggctgagctccctggggacagcagc

SEQ ID NO: 38470 - DNA, 30 bp, Homo sapiens
gcttggttcgggaggcctctgcattggccc

SEQ ID NO: 38471 - DNA, 30 bp, Homo sapiens
agcaggaagtaggccgtcttgaaggcgtca

SEQ ID NO: 38472 - DNA, 30 bp, Homo sapiens
cagagggccttggtgccagtggggtgcacg

SEQ ID NO: 38473 - DNA, 30 bp, Homo sapiens
agctggggaggaggggctcaagctccgagg

SEQ ID NO: 38474 - DNA, 30 bp, Homo sapiens
cagaggactccccaaagtgacaatctgact

SEQ ID NO: 38475 - DNA, 30 bp, Homo sapiens
gtcaggtagcagcctttgaaatttgtcagg

SEQ ID NO: 38476 - DNA, 30 bp, Homo sapiens
catgctaatttcacttatctgaaagaatat

SEQ ID NO: 38477 - DNA, 30 bp, Homo sapiens
catggccaatgcaaacagcagaaatgaagt

SEQ ID NO: 38478 - DNA, 30 bp, Homo sapiens
ttcagcctttatagcggtcttccggtagcg

SEQ ID NO: 38479 - DNA, 30 bp, Homo sapiens
gaaaggatacacagcgatgtaaggagtggc

SEQ ID NO: 38480 - DNA, 30 bp, Homo sapiens
ctatgatccacttctgcagggcaaggatga

SEQ ID NO: 38481 - DNA, 30 bp, Homo sapiens
tcggcctcccgaaattccagaattacaggc

SEQ ID NO: 38482 - DNA, 30 bp, Homo sapiens
tccaggagaacctgcgggcaggctttcatc

SEQ ID NO: 38483 - DNA, 30 bp, Homo sapiens
agaaggtccagggcggttgcagcagctcaa

SEQ ID NO: 38484 - DNA, 30 bp, Homo sapiens
atccagcctcctgctcttgtcccagtgcct

SEQ ID NO: 38485 - DNA, 30 bp, Homo sapiens
tgcaggagcttcagcgactgtaagagggcc

SEQ ID NO: 38486 - DNA, 30 bp, Homo sapiens
cccagggggagtggttggttttccagggga

SEQ ID NO: 38487 - DNA, 30 bp, Homo sapiens
taattaggcatgaaacaggggcacaggatg

SEQ ID NO: 38488 - DNA, 30 bp, Homo sapiens
cagcaaagatggagctccagttcctcagac

SEQ ID NO: 38489 - DNA, 30 bp, Homo sapiens
gagcaaagatggaagtccactttctcagat

SEQ ID NO: 38490 - DNA, 30 bp, Homo sapiens
tgacagcaggcattcaacagacagtgactg

SEQ ID NO: 38491 - DNA, 30 bp, Homo sapiens
agatggaagtccactttctcagatggccat

SEQ ID NO: 38492 - DNA, 30 bp, Homo sapiens
taggcaggccttccccacaagcaaaaattg

SEQ ID NO: 38493 - DNA, 30 bp, Homo sapiens
taggcaggccttccccgcaagcaaaaattg

SEQ ID NO: 38494 - DNA, 30 bp, Homo sapiens
tacctccaggtcgtaaagtgacctgttgcc

SEQ ID NO: 38495 - DNA, 30 bp, Homo sapiens
ccacaagcaaaaattgaactccagttgctc

SEQ ID NO: 38496 - DNA, 30 bp, Homo sapiens
tccaggtcataaaatgacctgttgccacag

SEQ ID NO: 38497 - DNA, 30 bp, Homo sapiens; identical to SEQ ID NO: 38496

SEQ ID NO: 38498 - DNA, 30 bp, Homo sapiens
cagaggcagtgactgggctccaggtcatag

SEQ ID NO: 38499 - DNA, 30 bp, Homo sapiens
tactgggggtggtagatgtggtcttggtct

SEQ ID NO: 38500 - DNA, 30 bp, Homo sapiens
cactggggaggtctggaaggtctgccccct

SEQ ID NO: 38501 - DNA, 30 bp, Homo sapiens
tactggggaggctgtccctggggaggtctg

SEQ ID NO: 38502 - DNA, 30 bp, Homo sapiens
gggaggctgttgtccctgggcaggtctggg

SEQ ID NO: 38503 - DNA, 30 bp, Homo sapiens
atttggaagcctttgaaagttctcgcactc

SEQ ID NO: 38504 - DNA, 30 bp, Homo sapiens
gactggatgttggttgaattgaggattcca

SEQ ID NO: 38505 - DNA, 30 bp, Homo sapiens
atccatatttggcttgggtctgacggcggc

SEQ ID NO: 38506 - DNA, 30 bp, Homo sapiens
taaaggtccacccttgccctgagcttcaca

SEQ ID NO: 38507 - DNA, 30 bp, Homo sapiens
ctgtcatagaaatctctgatccaattcttc

SEQ ID NO: 38508 - DNA, 30 bp, Homo sapiens
gttcaactgtttcttgtttgacctttacag

SEQ ID NO: 38509 - DNA, 30 bp, Homo sapiens
gtttggtgatatgcacttcgctgcttccgt

SEQ ID NO: 38510 - DNA, 30 bp, Homo sapiens
atgtcggggtaaaactccgtcccgtggtcc

SEQ ID NO: 38511 - DNA, 30 bp, Homo sapiens
acacagcccactgcgtactctgccctccga

SEQ ID NO: 38512 - DNA, 30 bp, Homo sapiens
ccatggccggcaggtggtgcgcggcggcgg

SEQ ID NO: 38513 - DNA, 30 bp, Homo sapiens
cgcccccaacctcggggtcgctctggtcgt

SEQ ID NO: 38514 - DNA, 30 bp, Homo sapiens
atgtgggagtagaatgtttcttgatctgag

SEQ ID NO: 38515 - DNA, 30 bp, Homo sapiens
gcacctggggctgggccgcctgctgtgggg

SEQ ID NO: 38516 - DNA, 30 bp, Homo sapiens
cagaggtggttgatggggtgaaatgctcca

SEQ ID NO: 38517 - DNA, 30 bp, Homo sapiens
gaatggtccctggaactgggctgcagctgg

SEQ ID NO: 38518 - DNA, 30 bp, Homo sapiens
tccaggtcacttcaggtgctgtcagggagc

SEQ ID NO: 38519 - DNA, 30 bp, Homo sapiens
tacaggaagttcctgaagtccttcagctcc

SEQ ID NO: 38520 - DNA, 30 bp, Homo sapiens
aatacacagcactgttaatcctacagtctt

SEQ ID NO: 38521 - DNA, 30 bp, Homo sapiens
tagctgtcagctacaccatggatattgtcc

SEQ ID NO: 38522 - DNA, 30 bp, Homo sapiens
tccaggcctcgcttctggctgaaggccttg

SEQ ID NO: 38523 - DNA, 30 bp, Homo sapiens
cgattgattctgggctctcagttattggct

SEQ ID NO: 38524 - DNA, 30 bp, Homo sapiens
tttgatctcttgacctttggttttgtcatt

SEQ ID NO: 38525 - DNA, 30 bp, Homo sapiens
caattatgcgaggtcatgtgcctggagagg

SEQ ID NO: 38526 - DNA, 30 bp, Homo sapiens
tgcagacgtagggcttctcccctgtgtgtg

SEQ ID NO: 38527 - DNA, 30 bp, Homo sapiens
gcttggagaaatattctttgctcttttgga

SEQ ID NO: 38528 - DNA, 30 bp, Homo sapiens
taattgtgtttggagaaatattccttgctg

SEQ ID NO: 38529 - DNA, 30 bp, Homo sapiens
gaaagtactctttggaagcagctggacttg

SEQ ID NO: 38530 - DNA, 30 bp, Homo sapiens
agctggatctgggattattgtttcactacc

SEQ ID NO: 38531 - DNA, 30 bp, Homo sapiens
agctgtgagatgatattgggtgccaggctg

SEQ ID NO: 38532 - DNA, 30 bp, Homo sapiens
ggctggggtgtgtagcggaggtatttcttg

SEQ ID NO: 38533 - DNA, 30 bp, Homo sapiens
taaaggaaacctggaaaggcactctggagc

SEQ ID NO: 38534 - DNA, 30 bp, Homo sapiens
acacagcaggagcaggagccacacaggaac

SEQ ID NO: 38535 - DNA, 30 bp, Homo sapiens
tcttggtggccgccttgctggcgaggtcct

SEQ ID NO: 38536 - DNA, 30 bp, Homo sapiens
tgttcctttagcagcatctccatgattcta

SEQ ID NO: 38537 - DNA, 30 bp, Homo sapiens
tagctcacagcgctttcagagtgttcaatt

SEQ ID NO: 38538 - DNA, 30 bp, Homo sapiens
cattggagtccttatggttcctcttgctga

SEQ ID NO: 38539 - DNA, 30 bp, Homo sapiens
tgaccacggactgcaggaggcggaagcaca

SEQ ID NO: 38540 - DNA, 30 bp, Homo sapiens
gacgttcaggcaccgcgcgatgaacgcaaa

SEQ ID NO: 38541 - DNA, 30 bp, Homo sapiens
ttcaggtatttcttaagatcctcgaaaaca

SEQ ID NO: 38542 - DNA, 30 bp, Homo sapiens
cagaggtccccatccaccggcggctggcag

SEQ ID NO: 38543 - DNA, 30 bp, Homo sapiens
gacaggggccctctctgctaagagcatttc

SEQ ID NO: 38544 - DNA, 30 bp, Homo sapiens
agctgggggaggtggctcgcacagcttgta

SEQ ID NO: 38545 - DNA, 30 bp, Homo sapiens
acacggccccactccggtttcctggaggct

SEQ ID NO: 38546 - DNA, 30 bp, Homo sapiens
cagtaggaacagatgaaaggaagtcttctg

SEQ ID NO: 38547 - DNA, 30 bp, Homo sapiens
agaaggagcagacgaagggcagttgcttgt

SEQ ID NO: 38548 - DNA, 30 bp, Homo sapiens
ctttggataaggtctgcccagaacgagtag

SEQ ID NO: 38549 - DNA, 30 bp, Homo sapiens
ctgtggaggtccttgtgggcggcccccttg

SEQ ID NO: 38550 - DNA, 30 bp, Homo sapiens
tgtccctttttcttcttggattttgttgtc

SEQ ID NO: 38551 - DNA, 30 bp, Homo sapiens
gtgcaactgtcctctgccacctaatgtgga

SEQ ID NO: 38552 - DNA, 30 bp, Homo sapiens
agccacgatgcagttcttgtctcgggcctg

SEQ ID NO: 38553 - DNA, 30 bp, Homo sapiens
gcacatggtgcagtgcgtcttagaggcgtt

SEQ ID NO: 38554 - DNA, 30 bp, Homo sapiens
cgggatttatccagattttcaagaaaatgt

SEQ ID NO: 38555 - DNA, 30 bp, Homo sapiens
actgcaattggctatcctttaagaaatcct

SEQ ID NO: 38556 - DNA, 30 bp, Homo sapiens
atatccatttccagagaggaatttaaagag

SEQ ID NO: 38557 - DNA, 30 bp, Homo sapiens
cgttgttcacgtctactcctttgttgctct

SEQ ID NO: 38558 - DNA, 30 bp, Homo sapiens
cactgttataactgagaagactgttctctg

SEQ ID NO: 38559 - DNA, 30 bp, Homo sapiens
tccaggtcttggagttaggtcaacaggaga

SEQ ID NO: 38560 - DNA, 30 bp, Homo sapiens
caacgggctaaagtagtaatcagactggca

SEQ ID NO: 38561 - DNA, 30 bp, Homo sapiens
atatgggcttgtataacaaggtggtgacgt

SEQ ID NO: 38562 - DNA, 30 bp, Homo sapiens
aaatgggcttgtatagcagagtagtaacat

SEQ ID NO: 38563 - DNA, 30 bp, Homo sapiens
aaactcagaaaactccttgccacacttctc

SEQ ID NO: 38564 - DNA, 30 bp, Homo sapiens
gaatgggggatagccagctgccatttcata

SEQ ID NO: 38565 - DNA, 30 bp, Homo sapiens
tgctggtatctccagagcctctaaactttg

SEQ ID NO: 38566 - DNA, 30 bp, Homo sapiens
cagggcttcttctctccacctgtgagcacc

SEQ ID NO: 38567 - DNA, 30 bp, Homo sapiens
gtttggcacctgctggtgtgaggatcaggg

SEQ ID NO: 38568 - DNA, 30 bp, Homo sapiens
ccgagggcatcgatgccagcagggctgagc

SEQ ID NO: 38569 - DNA, 30 bp, Homo sapiens
tgctggatgtttcgtttgaggatgtctgag

SEQ ID NO: 38570 - DNA, 30 bp, Homo sapiens
cccaggggaatgctcctccttgagatgatg

SEQ ID NO: 38571 - DNA, 30 bp, Homo sapiens
agacggtgagggagatgaagctgttgtaac

SEQ ID NO: 38572 - DNA, 30 bp, Homo sapiens
gttgcccagatccacgctggagccaaacat

SEQ ID NO: 38573 - DNA, 30 bp, Homo sapiens
gcccgaggttgcccagatccacgctggagc

SEQ ID NO: 38574 - DNA, 30 bp, Homo sapiens
cagtgggttcaacaatatccatgttcgttc

SEQ ID NO: 38575 - DNA, 30 bp, Homo sapiens
agatggggtgcacaaactgggggttgacat

SEQ ID NO: 38576 - DNA, 30 bp, Homo sapiens
cttcgggttttaaaaattcagagttaacaa

SEQ ID NO: 38577 - DNA, 30 bp, Homo sapiens
aattcattttggtccaagttcatgatgaag

SEQ ID NO: 38578 - DNA, 30 bp, Homo sapiens
tcttccaggaggtgctcgaatttggggttc

SEQ ID NO: 38579 - DNA, 30 bp, Homo sapiens
atcaggtcttcaccaaagtaggagaaacct

SEQ ID NO: 38580 - DNA, 30 bp, Homo sapiens
ccgcgggggcagagctggaatgctggggtg

SEQ ID NO: 38581 - DNA, 30 bp, Homo sapiens
tgacgggcacaggcactgggctggtggggc

SEQ ID NO: 38582 - DNA, 30 bp, Homo sapiens
ttctggagacacataggaaaagtttctaaa

SEQ ID NO: 38583 - DNA, 30 bp, Homo sapiens
aagaggattgatatactcaaaaccttcaaa

SEQ ID NO: 38584 - DNA, 30 bp, Homo sapiens
tcggccggaacggtgggtcaatctccttcc

SEQ ID NO: 38585 - DNA, 30 bp, Homo sapiens
catcccggggttcatgaaggaaaagttcct

SEQ ID NO: 38586 - DNA, 30 bp, Homo sapiens
agagctcgtcatggtcgtcttcggtgggtg

SEQ ID NO: 38587 - DNA, 30 bp, Homo sapiens
accgactcctcggtggacagcaataatggg

SEQ ID NO: 38588 - DNA, 30 bp, Homo sapiens
cagaggatgctgacacgctcaccgagggct

SEQ ID NO: 38589 - DNA, 30 bp, Homo sapiens
agaacactgatgcgctccgccagcccctgc

SEQ ID NO: 38590 - DNA, 30 bp, Homo sapiens
catctggattaggagccataatgaagtgct

SEQ ID NO: 38591 - DNA, 30 bp, Homo sapiens
atccagggctcccatccttcccaggttctg

SEQ ID NO: 38592 - DNA, 30 bp, Homo sapiens
ctgagttgtcatcaggtggtggttcatcgt

SEQ ID NO: 38593 - DNA, 30 bp, Homo sapiens
ctgatagctcatctggaggcattccctttt

SEQ ID NO: 38594 - DNA, 30 bp, Homo sapiens
tacacgtcgaaccagtggtcccccatgcag

SEQ ID NO: 38595 - DNA, 30 bp, Homo sapiens
cacaggagataccggagccatgacagactg

SEQ ID NO: 38596 - DNA, 30 bp, Homo sapiens
cgccgggctgccctgctctctgcaggtgcc

SEQ ID NO: 38597 - DNA, 30 bp, Homo sapiens
gcggcacgggcgcggctgtgtcccagtcat

SEQ ID NO: 38598 - DNA, 30 bp, Homo sapiens
ttgtggatgattcggcacttcaggagcttg

SEQ ID NO: 38599 - DNA, 30 bp, Homo sapiens
tgggacgacatagcaccgccttccaggggg

SEQ ID NO: 38600 - DNA, 30 bp, Homo sapiens
tgacggtcatattctggccatggggggcta

SEQ ID NO: 38601 - DNA, 30 bp, Homo sapiens
tcccgggcttcttgggcttgccgctgttct

SEQ ID NO: 38602 - DNA, 30 bp, Homo sapiens
tactggactgtggtcaatgttgcctttgtg

SEQ ID NO: 38603 - DNA, 30 bp, Homo sapiens
caaggggtcacctccaacagatgagcatca

SEQ ID NO: 38604 - DNA, 30 bp, Homo sapiens
gaaaggagtgtgtaaaacatgcgggatcca

SEQ ID NO: 38605 - DNA, 30 bp, Homo sapiens
tcgcggtctgtacctggggcggcagcacct

SEQ ID NO: 38606 - DNA, 30 bp, Homo sapiens
gcatgttctcttcctggttctgcagcctct

SEQ ID NO: 38607 - DNA, 30 bp, Homo sapiens
acttggtgtttcgggcgactttttcttaat

SEQ ID NO: 38608 - DNA, 30 bp, Homo sapiens
gcaggagcgatgctgccgcctgtggatccg

SEQ ID NO: 38609 - DNA, 30 bp, Homo sapiens
tgcagggcaaggcgggggcgcaggcagacc

SEQ ID NO: 38610 - DNA, 30 bp, Homo sapiens
aggagggtgtccgcttgggctcggggctct

SEQ ID NO: 38611 - DNA, 30 bp, Homo sapiens
cgcatccggtagtcggtggagcaggacagc

SEQ ID NO: 38612 - DNA, 30 bp, Homo sapiens
ctgaggttgaactcgtacgcgttgtcccag

SEQ ID NO: 38613 - DNA, 30 bp, Homo sapiens
aagatatgcacactgctttccaaataaagc

SEQ ID NO: 38614 - DNA, 30 bp, Homo sapiens
agatggggaagactttttctccaacttttt

SEQ ID NO: 38615 - DNA, 30 bp, Homo sapiens
agtaggaagatgggccaggagagatgaagg

SEQ ID NO: 38616 - DNA, 30 bp, Homo sapiens
cactggagaccataagtttgagttgaatta

SEQ ID NO: 38617 - DNA, 30 bp, Homo sapiens
tagaggccaatggtatatgagcggcctgtg

SEQ ID NO: 38618 - DNA, 30 bp, Homo sapiens
ccatggcaaagtctttggtcttctcctcct

SEQ ID NO: 38619 - DNA, 30 bp, Homo sapiens
ctctgggacagctgccttgtgtccagtctc

SEQ ID NO: 38620 - DNA, 30 bp, Homo sapiens
gtctggggtatctgcatgcctgaactccat

SEQ ID NO: 38621 - DNA, 30 bp, Homo sapiens
ctactgtgaaatcgaggtctcgcacatttt

SEQ ID NO: 38622 - DNA, 30 bp, Homo sapiens
ccatttcaacctggatgggattatctaaaa

SEQ ID NO: 38623 - DNA, 30 bp, Homo sapiens
gccagatcaaagccagaaggcagaggagca

SEQ ID NO: 38624 - DNA, 30 bp, Homo sapiens
cccactatcaggaagatgaggaaagagatc

SEQ ID NO: 38625 - DNA, 30 bp, Homo sapiens
cagcgggaacaatgaacccttgccgggctg

SEQ ID NO: 38626 - DNA, 30 bp, Homo sapiens
tcttctggggggcttccttgtctctgatgt

SEQ ID NO: 38627 - DNA, 30 bp, Homo sapiens
ctgaggttggggtttgatcctgggggagat

SEQ ID NO: 38628 - DNA, 30 bp, Homo sapiens
acctgtgcacaggaagatgcctacagccac

SEQ ID NO: 38629 - DNA, 30 bp, Homo sapiens
ggcagggcgatggaagaggttgccagttcg

SEQ ID NO: 38630 - DNA, 30 bp, Homo sapiens
tagtggggtatccttcggcatcctggcagc

SEQ ID NO: 38631 - DNA, 30 bp, Homo sapiens
ccatggagcagcggtacctgccgtccggga

SEQ ID NO: 38632 - DNA, 30 bp, Homo sapiens
ttttgggctaaacaaataaatcggttaaat

SEQ ID NO: 38633 - DNA, 30 bp, Homo sapiens
cttcggtggcaggcatcccaattgtcttga

SEQ ID NO: 38634 - DNA, 30 bp, Homo sapiens
acagtccacctcttctgtggtgggcacccc

SEQ ID NO: 38635 - DNA, 30 bp, Homo sapiens
tgatgggtttttcatgggtatagtttcaac

SEQ ID NO: 38636 - DNA, 30 bp, Homo sapiens
agcttcagggaggtaacccgggggatgtgg

SEQ ID NO: 38637 - DNA, 30 bp, Homo sapiens
ttccaggacttggatggctcaaggctgagg

SEQ ID NO: 38638 - DNA, 30 bp, Homo sapiens
tcaaattggaggctctgctggagaggacag

SEQ ID NO: 38639 - DNA, 30 bp, Homo sapiens
tgatggacatgagtgagctctaatatcatt

SEQ ID NO: 38640 - DNA, 30 bp, Homo sapiens
actctgggacaggcttggttgcaaagaaaa

SEQ ID NO: 38641 - DNA, 30 bp, Homo sapiens
cgaactctccctgagcagccccagcttccg

SEQ ID NO: 38642 - DNA, 30 bp, Homo sapiens
tccagggaatctccttcccttcttagcagc

SEQ ID NO: 38643 - DNA, 30 bp, Homo sapiens
tgtaggcagttcggggatttgaaaatctca

SEQ ID NO: 38644 - DNA, 30 bp, Homo sapiens
tactggggatagctggaagatttgaatatc

SEQ ID NO: 38645 - DNA, 30 bp, Homo sapiens
tgagtacctggagaccttggtgacaaggac

SEQ ID NO: 38646 - DNA, 30 bp, Homo sapiens
atttggatgggtctgtaggaaagtgtttct

SEQ ID NO: 38647 - DNA, 30 bp, Homo sapiens
tacaggctgtagaacttgaggcttctgtcc

SEQ ID NO: 38648 - DNA, 30 bp, Homo sapiens
tcaccatctccctttgtgttagatgtctgt

SEQ ID NO: 38649 - DNA, 30 bp, Homo sapiens
cagtggactctaacacagattcactcagcg

SEQ ID NO: 38650 - DNA, 30 bp, Homo sapiens
gggattatgtaagagtcccaccactcaatt

SEQ ID NO: 38651 - DNA, 30 bp, Homo sapiens
catgcgctctgtcgtgacaggaaggacatc

SEQ ID NO: 38652 - DNA, 30 bp, Homo sapiens
aggtggacataaggccactcttctcgccct

SEQ ID NO: 38653 - DNA, 30 bp, Homo sapiens
ctcattccctctccggctcttcttgtggct

SEQ ID NO: 38654 - DNA, 30 bp, Homo sapiens
ctttggctccttcgacgatcatgtttgtct

SEQ ID NO: 38655 - DNA, 30 bp, Homo sapiens
aggttggagggggaggataatattgtccat

SEQ ID NO: 38656 - DNA, 30 bp, Homo sapiens
cgtaggtcccaaactcgaccaaatgcatcc

SEQ ID NO: 38657 - DNA, 30 bp, Homo sapiens
acagcttgaaggtcctgtcatatgagcaag

SEQ ID NO: 38658 - DNA, 30 bp, Homo sapiens
gctccaaaagggttcttctgcgcttttcca

SEQ ID NO: 38659 - DNA, 30 bp, Homo sapiens
cactggtgatcatccagctgctgtaggagt

SEQ ID NO: 38660 - DNA, 30 bp, Homo sapiens
tgaaggcgtgctgtagggcctggttgatgc

SEQ ID NO: 38661 - DNA, 30 bp, Homo sapiens
agaaggtgttcttgatgcggccggccacca

SEQ ID NO: 38662 - DNA, 30 bp, Homo sapiens
tacaggtcctcccgatccgcagagtaaacc

SEQ ID NO: 38663 - DNA, 30 bp, Homo sapiens
ctgtgggcagaagacttgtccagctcactg

SEQ ID NO: 38664 - DNA, 30 bp, Homo sapiens
gccagcctctggggcctggcctgcgtctgc

SEQ ID NO: 38665 - DNA, 30 bp, Homo sapiens
aataggtaagaaacggattctccattgtga

SEQ ID NO: 38666 - DNA, 30 bp, Homo sapiens
aacaggtaggaaacagattccccattatga

SEQ ID NO: 38667 - DNA, 30 bp, Homo sapiens
tagcgggacatggctgaacaggtaggacac

SEQ ID NO: 38668 - DNA, 30 bp, Homo sapiens
tgatgtttcggaaaaggtaggccatggact

SEQ ID NO: 38669 - DNA, 30 bp, Homo sapiens
tttctgaaaaggtaggacatggactcccca

SEQ ID NO: 38670 - DNA, 30 bp, Homo sapiens
aagtggcagagttggagttgggcttctagg

SEQ ID NO: 38671 - DNA, 30 bp, Homo sapiens
cagcggctgtgggcctgtgcttgggccagc

SEQ ID NO: 38672 - DNA, 30 bp, Homo sapiens
tgctggaagaggaggaggaagaggaggaat

SEQ ID NO: 38673 - DNA, 30 bp, Homo sapiens
tccagtggggctgctcccgatctactgttt

SEQ ID NO: 38674 - DNA, 30 bp, Homo sapiens
gattgttcctgctcctcttccttggcaaag

SEQ ID NO: 38675 - DNA, 30 bp, Homo sapiens
tcgtgggggtcaccaggaaagcctgcctcc

SEQ ID NO: 38676 - DNA, 30 bp, Homo sapiens
actttgatgaccgtccttcctcgtgatcat

SEQ ID NO: 38677 - DNA, 30 bp, Homo sapiens
tagtggttgacttcctcaagatcgtcttct

SEQ ID NO: 38678 - DNA, 30 bp, Homo sapiens
ctcaggtgccgccgtgagtccagggccccc

SEQ ID NO: 38679 - DNA, 30 bp, Homo sapiens
tacagtctcatgggtggaaaagaccaggct

SEQ ID NO: 38680 - DNA, 30 bp, Homo sapiens
tgtcggtgaggaacactgggaccccttgca

SEQ ID NO: 38681 - DNA, 30 bp, Homo sapiens
atgcggggtggctcccaggtcctccctggg

SEQ ID NO: 38682 - DNA, 30 bp, Homo sapiens
tcctggaacagtcgtctgcgggccttgcac

SEQ ID NO: 38683 - DNA, 30 bp, Homo sapiens
gcctggaacaggcgtctccgggccttgcac

SEQ ID NO: 38684 - DNA, 30 bp, Homo sapiens
tcctggaacaggcgtcttcggaccttgcac

SEQ ID NO: 38685 - DNA, 30 bp, Homo sapiens
gagacatctccgtgccctgctgggaggcct

SEQ ID NO: 38686 - DNA, 30 bp, Homo sapiens
gctccacccggtggtgacggcgaggacggc

SEQ ID NO: 38687 - DNA, 30 bp, Homo sapiens
caagagagggagaagggtgaggttctgggg

SEQ ID NO: 38688 - DNA, 30 bp, Homo sapiens
atccggcccgtccaggaactcattggcgtg

SEQ ID NO: 38689 - DNA, 30 bp, Homo sapiens
gtgaggggggatccgtggatggagttggga

SEQ ID NO: 38690 - DNA, 30 bp, Homo sapiens
cataggaggctctcggcatcatagtagtct

SEQ ID NO: 38691 - DNA, 30 bp, Homo sapiens
cagaggaggtccattgacgcctggatggta

SEQ ID NO: 38692 - DNA, 30 bp, Homo sapiens
ttttggagaatgagctccagagaaactggc

SEQ ID NO: 38693 - DNA, 30 bp, Homo sapiens
gagaggagggagaagcagagaccgagcagc

SEQ ID NO: 38694 - DNA, 30 bp, Homo sapiens
gctgtgctctctgttgggtgatgcaggagc

SEQ ID NO: 38695 - DNA, 30 bp, Homo sapiens
cattgggaggccgaggcaggaagattgcat

SEQ ID NO: 38696 - DNA, 30 bp, Homo sapiens
cctcggcgccctgggggctctgcaggccac

SEQ ID NO: 38697 - DNA, 30 bp, Homo sapiens
cagtggaaggtctccacctccaccacggtc

SEQ ID NO: 38698 - DNA, 30 bp, Homo sapiens
aattctagattaccagagtggttgctcctg

SEQ ID NO: 38699 - DNA, 30 bp, Homo sapiens
gagtggttgctcctggggatgtcttgctgg

SEQ ID NO: 38700 - DNA, 30 bp, Homo sapiens
acgacactctgccggcccccagagccctcc

SEQ ID NO: 38701 - DNA, 30 bp, Homo sapiens
ccttgggccggaccctggagtgccgcctgg

SEQ ID NO: 38702 - DNA, 30 bp, Homo sapiens
ctgagggaagcacagttcagctccgagccc

SEQ ID NO: 38703 - DNA, 30 bp, Homo sapiens
tatacggctgtagtcctcccgaacaagggg

SEQ ID NO: 38704 - DNA, 30 bp, Homo sapiens
gccaggggatgagcacttctcctggacttt

SEQ ID NO: 38705 - DNA, 30 bp, Homo sapiens
acactgtcctgggtggcaggcgctgtttat

SEQ ID NO: 38706 - DNA, 30 bp, Homo sapiens
accaggtcaccaggggcaggaaaatttcta

SEQ ID NO: 38707 - DNA, 30 bp, Homo sapiens
cagcggggtgggggcaacccaggctccttg

SEQ ID NO: 38708 - DNA, 30 bp, Homo sapiens
tctcctccactttgacagcccgaggcttga

SEQ ID NO: 38709 - DNA, 30 bp, Homo sapiens
ctgaggtttgattggtccagttctaacagg

SEQ ID NO: 38710 - DNA, 30 bp, Homo sapiens
tgatggtggtgaccacaggcaccataggaa

SEQ ID NO: 38711 - DNA, 30 bp, Homo sapiens
cacaggttgctcaggtagtcacccagcttt

SEQ ID NO: 38712 - DNA, 30 bp, Homo sapiens
gtgaggcctcctgaggctggtgtagggggg

SEQ ID NO: 38713 - DNA, 30 bp, Homo sapiens
acttgtcagcgccagggttggcggccacta

SEQ ID NO: 38714 - DNA, 30 bp, Homo sapiens
agatgggagagacatagattttttaaatac

SEQ ID NO: 38715 - DNA, 30 bp, Homo sapiens
agttctcgtggtgctgcgcggcgatgatga

SEQ ID NO: 38716 - DNA, 30 bp, Homo sapiens
ccatggggctcaccatgacagcataagcga

SEQ ID NO: 38717 - DNA, 30 bp, Homo sapiens
ttgatgacgcaggaggcgatgatgatgagg

SEQ ID NO: 38718 - DNA, 30 bp, Homo sapiens
acttatacactgtgggagaggagagggaag

SEQ ID NO: 38719 - DNA, 30 bp, Homo sapiens
cgatggtatcactggaggcgctgcgggatt

SEQ ID NO: 38720 - DNA, 30 bp, Homo sapiens
attccccaccctccgcccccatacatcccc

SEQ ID NO: 38721 - DNA, 30 bp, Homo sapiens
cacaggtctatggtgtcgctgcccacgctc

SEQ ID NO: 38722 - DNA, 30 bp, Homo sapiens
cactggccctgcccccggtccccagcgagg

SEQ ID NO: 38723 - DNA, 30 bp, Homo sapiens
ttgactgttggcacctggttcctctgtaaa

SEQ ID NO: 38724 - DNA, 30 bp, Homo sapiens
gaatccgttatgaagcccctcgtgtaaaca

SEQ ID NO: 38725 - DNA, 30 bp, Homo sapiens
cgtaggcacctggctgtggtgcaggctgaa

SEQ ID NO: 38726 - DNA, 30 bp, Homo sapiens
tattggcagctatggtgttcttaatccatt

SEQ ID NO: 38727 - DNA, 30 bp, Homo sapiens
ccaaggtacaaaggctgagactttggtata

SEQ ID NO: 38728 - DNA, 30 bp, Homo sapiens
atctggctctcctttgccagcttgagccag

SEQ ID NO: 38729 - DNA, 30 bp, Homo sapiens
tgttggcagctatggtgtccttaatccagt

SEQ ID NO: 38730 - DNA, 30 bp, Homo sapiens
gaccggccccaggagtgggagagcccagag

SEQ ID NO: 38731 - DNA, 30 bp, Homo sapiens
cgccttgggcattgccagcacaaaccatgt

SEQ ID NO: 38732 - DNA, 30 bp, Homo sapiens
gagcgcgcggcggccccagagccctggctc

SEQ ID NO: 38733 - DNA, 30 bp, Homo sapiens
cctacaatccaggtagtttcctttaatcca

SEQ ID NO: 38734 - DNA, 30 bp, Homo sapiens
ttctggccgcccaacctcgctggctggaac

SEQ ID NO: 38735 - DNA, 30 bp, Homo sapiens
tgttggcagcgatggtgtccttaatccagt

SEQ ID NO: 38736 - DNA, 30 bp, Homo sapiens
tccaggggctatatgtggccacactggtgt

SEQ ID NO: 38737 - DNA, 30 bp, Homo sapiens
gcacaattggcatcgttcccgtgaatccag

SEQ ID NO: 38738 - DNA, 30 bp, Homo sapiens
agctctggatcaggagagtcagcaggagca

SEQ ID NO: 38739 - DNA, 30 bp, Homo sapiens
cagtgttctcaatccaggatacatatttgt

SEQ ID NO: 38740 - DNA, 30 bp, Homo sapiens
agcactgaccagccagccagcatggccatt

SEQ ID NO: 38741 - DNA, 30 bp, Homo sapiens
gcagggcaaggagcagcaacagctgggagg

SEQ ID NO: 38742 - DNA, 30 bp, Homo sapiens
gcgaccacagccgatgccccagctcacaat

SEQ ID NO: 38743 - DNA, 30 bp, Homo sapiens
atctggggctgcagcagccagcacaggaac

SEQ ID NO: 38744 - DNA, 30 bp, Homo sapiens
tcctcccgcctctcccacacccctcttatg

SEQ ID NO: 38745 - DNA, 30 bp, Homo sapiens
gttagcagtggctctcctgtgagttctctg

SEQ ID NO: 38746 - DNA, 30 bp, Homo sapiens
ccctgggactaaatctccatgcattctctt

SEQ ID NO: 38747 - DNA, 30 bp, Homo sapiens
cagagggcagcaaggaggctgaggggcagt

SEQ ID NO: 38748 - DNA, 30 bp, Homo sapiens
cagcagctggttggttggcttatgttggcc

SEQ ID NO: 38749 - DNA, 30 bp, Homo sapiens
cgaaggaaaccaagatgatttcttcgggct

SEQ ID NO: 38750 - DNA, 30 bp, Homo sapiens
acatgggacaggggacagagcaggagccag

SEQ ID NO: 38751 - DNA, 30 bp, Homo sapiens
gaaaggtgtgagacccaggcggctttgttt

SEQ ID NO: 38752 - DNA, 30 bp, Homo sapiens
gcctggcggggggtacctgagggttgagtg

SEQ ID NO: 38753 - DNA, 30 bp, Homo sapiens
aggcggcttctcctgggggcctggtggtcc

SEQ ID NO: 38754 - DNA, 30 bp, Homo sapiens
ttttggattacattttcaatccagggtata

SEQ ID NO: 38755 - DNA, 30 bp, Homo sapiens
cagtgctcgctgagccatggggagaggagg

SEQ ID NO: 38756 - DNA, 30 bp, Homo sapiens
cttctggatgttctcttcaccaacaaactg

SEQ ID NO: 38757 - DNA, 30 bp, Homo sapiens
tcattgatgacgcatatgtgattcagatct

SEQ ID NO: 38758 - DNA, 30 bp, Homo sapiens
cagaggttggggggtgtggtacttataact

SEQ ID NO: 38759 - DNA, 30 bp, Homo sapiens
caggggcggcccttggcctccacacggcgc

SEQ ID NO: 38760 - DNA, 30 bp, Homo sapiens
tcttggacagggaggctgtggtagactgtg

SEQ ID NO: 38761 - DNA, 30 bp, Homo sapiens
aaggcttttctttcagcttcaagtcaatat

SEQ ID NO: 38762 - DNA, 30 bp, Homo sapiens
cctgagccccctccatcctggccgggcctg

SEQ ID NO: 38763 - DNA, 30 bp, Homo sapiens
acgtggccacagatgtccccaagtgccctg

SEQ ID NO: 38764 - DNA, 30 bp, Homo sapiens
agttccacacatggcgtttgcaatgctcga

SEQ ID NO: 38765 - DNA, 30 bp, Homo sapiens
gcgtggaggtgcatctctttccatacatgc

SEQ ID NO: 38766 - DNA, 30 bp, Homo sapiens
tctgaacgtcttcaattgtgacagcattat

SEQ ID NO: 38767 - DNA, 30 bp, Homo sapiens
taccgggccctcctgagtgcctgtcccctg

SEQ ID NO: 38768 - DNA, 30 bp, Homo sapiens
cccactgcctgcccctggccgaggctctga

SEQ ID NO: 38769 - DNA, 30 bp, Homo sapiens
atcaggcccagtggcatcctttgtggtttt

SEQ ID NO: 38770 - DNA, 30 bp, Homo sapiens
ttcaggtcggtgatccttcctctctgacac

SEQ ID NO: 38771 - DNA, 30 bp, Homo sapiens
ttgcggttccgcttagggatgatcttccgg

SEQ ID NO: 38772 - DNA, 30 bp, Homo sapiens
ctgtggcaaagtagaaaacaagcccaaagg

SEQ ID NO: 38773 - DNA, 30 bp, Homo sapiens
gatgtagagctgatgggaggccagggtgtc

SEQ ID NO: 38774 - DNA, 30 bp, Homo sapiens
cagggggtgcccaggggtatggtgaaggag

SEQ ID NO: 38775 - DNA, 30 bp, Homo sapiens
atttggagctttccttgccagtggctgagt

SEQ ID NO: 38776 - DNA, 30 bp, Homo sapiens
aaaaccctattgccaacgatgctgggatcc

SEQ ID NO: 38777 - DNA, 30 bp, Homo sapiens
tatagggcttcagagacttcgactgtcatg

SEQ ID NO: 38778 - DNA, 30 bp, Homo sapiens
cgttggattattgaaagcaaaagttcctaa

SEQ ID NO: 38779 - DNA, 30 bp, Homo sapiens
tgttggattaaggagaggaagaagtcctat

SEQ ID NO: 38780 - DNA, 30 bp, Homo sapiens
taatggattaaggccaggaagatgtcctgt

SEQ ID NO: 38781 - DNA, 30 bp, Homo sapiens; identical to SEQ ID NO: 38775

SEQ ID NO: 38782 - DNA, 30 bp, Homo sapiens
tattggattaaggagaggaagacgtcctat

SEQ ID NO: 38783 - DNA, 30 bp, Homo sapiens
ggcagggaccagagactttgactatcatgg

SEQ ID NO: 38784 - DNA, 30 bp, Homo sapiens
agaaggatttcttgaaaccaggtgtttgga

SEQ ID NO: 38785 - DNA, 30 bp, Homo sapiens; identical to SEQ ID NO: 38775

SEQ ID NO: 38786 - DNA, 30 bp, Homo sapiens
aaatccctattgccaaggatactgggatcc

SEQ ID NO: 38787 - DNA, 30 bp, Homo sapiens
cagtggctgagttacgaacagagcaagcat

SEQ ID NO: 38788 - DNA, 30 bp, Homo sapiens
gtcaggtctccatggcagggaccagagact

SEQ ID NO: 38789 - DNA, 30 bp, Homo sapiens
gttcctcttgcttgcgttttcgatctgctg

SEQ ID NO: 38790 - DNA, 30 bp, Homo sapiens
gagatatttcagtctctctctcttcactgg

SEQ ID NO: 38791 - DNA, 30 bp, Homo sapiens
tattgctgctggtagcgcaggttgagctcc

SEQ ID NO: 38792 - DNA, 30 bp, Homo sapiens
cagtggcgattctactatccttaagtttct

SEQ ID NO: 38793 - DNA, 30 bp, Homo sapiens
gttcatcagccttttctgcaggttcatcag

SEQ ID NO: 38794 - DNA, 30 bp, Homo sapiens
agagatacaagacgagacacaggcagtggt

SEQ ID NO: 38795 - DNA, 30 bp, Homo sapiens
cttcagttggagtaagcctcctaaatccag

SEQ ID NO: 38796 - DNA, 30 bp, Homo sapiens
catatttctctgcttcttctcttatatctt

SEQ ID NO: 38797 - DNA, 30 bp, Homo sapiens
catgtggccttccatcccccgtaatttcca

SEQ ID NO: 38798 - DNA, 30 bp, Homo sapiens
ctttggcttcttcttcctcatgttttttga

SEQ ID NO: 38799 - DNA, 30 bp, Homo sapiens
taacctcttcaagttcttcctttgtgaaca

SEQ ID NO: 38800 - DNA, 30 bp, Homo sapiens
acaaggtgagcatcaatctctgcttctgta

SEQ ID NO: 38801 - DNA, 30 bp, Homo sapiens
gacagcaagttcaatgtttttgccacctga

SEQ ID NO: 38802 - DNA, 30 bp, Homo sapiens
gactggacaacttctagcaaagcttttatt

SEQ ID NO: 38803 - DNA, 30 bp, Homo sapiens
ttaaggaaacagtttcctccctgatgccct

SEQ ID NO: 38804 - DNA, 30 bp, Homo sapiens
ccatagcctgcacagtttcctccactagct

SEQ ID NO: 38805 - DNA, 30 bp, Homo sapiens
cagtccctgctggcatcctggagtctcctg

SEQ ID NO: 38806 - DNA, 30 bp, Homo sapiens
gtttggggaaggaaatgttatccaggtcat

SEQ ID NO: 38807 - DNA, 30 bp, Homo sapiens
attcgggccttcagtgtcctggtggtgatt

SEQ ID NO: 38808 - DNA, 30 bp, Homo sapiens
agttggtctctgtagacaatggtccctcta

SEQ ID NO: 38809 - DNA, 30 bp, Homo sapiens
cagggggtagagccactatacttctcatgt

SEQ ID NO: 38810 - DNA, 30 bp, Homo sapiens
actgtccacgtagtagaggccttgccatgt

SEQ ID NO: 38811 - DNA, 30 bp, Homo sapiens
cactggagccatcccgctccatggccaaag

SEQ ID NO: 38812 - DNA, 30 bp, Homo sapiens
aggcgggtggtaaagtggcaacggcgaatt

SEQ ID NO: 38813 - DNA, 30 bp, Homo sapiens
aggaagtgtccattgtttggactgtttctt

SEQ ID NO: 38814 - DNA, 30 bp, Homo sapiens
ttgattggcttcccggtactggtgcagcag

SEQ ID NO: 38815 - DNA, 30 bp, Homo sapiens
atgactcgatggtccacaccggcagctgta

SEQ ID NO: 38816 - DNA, 30 bp, Homo sapiens
ctcaggggtgccttcctgtttcttataaag

SEQ ID NO: 38817 - DNA, 30 bp, Homo sapiens
acgaggagtagcactgaatttggcataaga

SEQ ID NO: 38818 - DNA, 30 bp, Homo sapiens
tctcatcccttcttcaatgtcagtaggtgc

SEQ ID NO: 38819 - DNA, 30 bp, Homo sapiens
gcgtagtattgtaggttggctttcttcttg

SEQ ID NO: 38820 - DNA, 30 bp, Homo sapiens
caggggtctgggagtgtgacgttgtaatct

SEQ ID NO: 38821 - DNA, 30 bp, Homo sapiens
cgtccttcttgatgacagtcttgtatgctt

SEQ ID NO: 38822 - DNA, 30 bp, Homo sapiens
ccttggctactgccatctcaaagtcctcct

SEQ ID NO: 38823 - DNA, 30 bp, Homo sapiens
tagactccagcttcttagaatcagccactt

SEQ ID NO: 38824 - DNA, 30 bp, Homo sapiens
tgggggttctggctcttgttcctcctcctc

SEQ ID NO: 38825 - DNA, 30 bp, Homo sapiens
ctgctgcccggtgcattgctgtagcctcat

SEQ ID NO: 38826 - DNA, 30 bp, Homo sapiens
accattctcttgagtattaaacccaggcca

SEQ ID NO: 38827 - DNA, 30 bp, Homo sapiens
tcagtttcttggctttgttgtagagggaat

SEQ ID NO: 38828 - DNA, 30 bp, Homo sapiens
tagagggaatccactactttgctcatgttc

SEQ ID NO: 38829 - DNA, 30 bp, Homo sapiens
tggctatgagatgcgtagttttgttaacca

SEQ ID NO: 38830 - DNA, 30 bp, Homo sapiens
gtgaggatgtcatgggcctggtgctccacc

SEQ ID NO: 38831 - DNA, 30 bp, Homo sapiens
tagctgctaaacactggacaatatttgagg

SEQ ID NO: 38832 - DNA, 30 bp, Homo sapiens
cgaaggataacaaaaccttccagaatgggg

SEQ ID NO: 38833 - DNA, 30 bp, Homo sapiens
caagggaagctgtcatcatcatcttctgcc

SEQ ID NO: 38834 - DNA, 30 bp, Homo sapiens
tcttgtccttcttgccgtccttggtggcct

SEQ ID NO: 38835 - DNA, 30 bp, Homo sapiens
actgctgtcgtggaaacaggtttcacatag

SEQ ID NO: 38836 - DNA, 30 bp, Homo sapiens
atcaggtctgttggtttctactatttcatt

SEQ ID NO: 38837 - DNA, 30 bp, Homo sapiens
cctctttcctatcctttttgctctcttctt

SEQ ID NO: 38838 - DNA, 30 bp, Homo sapiens
tgccgggcatactcgatgacctgtttggcc

SEQ ID NO: 38839 - DNA, 30 bp, Homo sapiens
cagaggaataatgttgcagcccagcagtcc

SEQ ID NO: 38840 - DNA, 30 bp, Homo sapiens
gtttctcccctgggcttcttgagcttctcg

SEQ ID NO: 38841 - DNA, 30 bp, Homo sapiens
acccctagcctgcagggtcagggagtgggt

SEQ ID NO: 38842 - DNA, 30 bp, Homo sapiens
cacataagcattgcggatctccatgaccat

SEQ ID NO: 38843 - DNA, 30 bp, Homo sapiens
agatggcttttcttcaccctttgggttgac

SEQ ID NO: 38844 - DNA, 30 bp, Homo sapiens
tacagagtctctgcattgctgctccggggc

SEQ ID NO: 38845 - DNA, 30 bp, Homo sapiens
gatcggtgagaacaagcagttggtcatcag

SEQ ID NO: 38846 - DNA, 30 bp, Homo sapiens
tctgtcaggcctcgggccgggtgggctggt

SEQ ID NO: 38847 - DNA, 30 bp, Homo sapiens
cacaggtacatgtcatcgtagcccggcggg

SEQ ID NO: 38848 - DNA, 30 bp, Homo sapiens
gggtgggctggtcccaatgggtccaaaggg

SEQ ID NO: 38849 - DNA, 30 bp, Homo sapiens
cctcgggctgagtgactacgtacccgggtg

SEQ ID NO: 38850 - DNA, 30 bp, Homo sapiens
ctttggggaatattcttaaccaaacccttc

SEQ ID NO: 38851 - DNA, 30 bp, Homo sapiens
cagggggaagaccactgccaaagagtaatc

SEQ ID NO: 38852 - DNA, 30 bp, Homo sapiens
caccacacctggcacacccggatcacctcc

SEQ ID NO: 38853 - DNA, 30 bp, Homo sapiens
aagagtgggccccacctggctggccatgca

SEQ ID NO: 38854 - DNA, 30 bp, Homo sapiens
tttcggggaaagcctccatctcttccttga

SEQ ID NO: 38855 - DNA, 30 bp, Homo sapiens
tcaaggagctgagaccaaaaggagaatggg

SEQ ID NO: 38856 - DNA, 30 bp, Homo sapiens
tctgtactcttcccggggtgggtctaggtc

SEQ ID NO: 38857 - DNA, 30 bp, Homo sapiens
aagttgcccccttgacttcctctaccaaag

SEQ ID NO: 38858 - DNA, 30 bp, Homo sapiens
ctcccagcagctctacaaaatcagtgatat

SEQ ID NO: 38859 - DNA, 30 bp, Homo sapiens
gccaccacagccgcaggcagccgccgagag

SEQ ID NO: 38860 - DNA, 30 bp, Homo sapiens
aggtcctgggactgccactttcctgggggg

SEQ ID NO: 38861 - DNA, 30 bp, Homo sapiens
gctcaatggcctcttctcgattctgcaaca

SEQ ID NO: 38862 - DNA, 30 bp, Homo sapiens
agcttctccaggtaggaaccagggacgaag

SEQ ID NO: 38863 - DNA, 30 bp, Homo sapiens
agtaattgggatcatctggtgagcttttag

SEQ ID NO: 38864 - DNA, 30 bp, Homo sapiens
ttgagggaattgccagggatctggttgaat

SEQ ID NO: 38865 - DNA, 30 bp, Homo sapiens
atttcctgtatgcactggcaaacctggctt

SEQ ID NO: 38866 - DNA, 30 bp, Homo sapiens
agatggtggacttggagaaggagacccgca

SEQ ID NO: 38867 - DNA, 30 bp, Homo sapiens
tgatggttttctccaaggttataattatga

SEQ ID NO: 38868 - DNA, 30 bp, Homo sapiens
ctgaggtggtgattttctccaaggtcatgg

SEQ ID NO: 38869 - DNA, 30 bp, Homo sapiens
atatctcgtgggaacagaagagaaactgca

SEQ ID NO: 38870 - DNA, 30 bp, Homo sapiens
acctgcccccaagggcacatccgtcatcag

SEQ ID NO: 38871 - DNA, 30 bp, Homo sapiens
aacagggactggctgagtggctggaaggtg

SEQ ID NO: 38872 - DNA, 30 bp, Homo sapiens
cactggtgtcactgtcgctgtcactgctgc

SEQ ID NO: 38873 - DNA, 30 bp, Homo sapiens
agttggagctgcttccccggggcctctcct

SEQ ID NO: 38874 - DNA, 30 bp, Homo sapiens
cctcgggcctaagcccgcctccctgtggag

SEQ ID NO: 38875 - DNA, 30 bp, Homo sapiens
cagtggctggacctggtcccctggaactga

SEQ ID NO: 38876 - DNA, 30 bp, Homo sapiens
acacgggtactatcgatatctaccatttct

SEQ ID NO: 38877 - DNA, 30 bp, Homo sapiens
ccccgggaagaaatgatttcatttgatgaa

SEQ ID NO: 38878 - DNA, 30 bp, Homo sapiens
cagtggagatgcccatggcgaagaacggga

SEQ ID NO: 38879 - DNA, 30 bp, Homo sapiens
atactgtggtgacgtgatccgggttctctt

SEQ ID NO: 38880 - DNA, 30 bp, Homo sapiens
ggcagctccagcctgcagaggaggaggcag

SEQ ID NO: 38881 - DNA, 30 bp, Homo sapiens
ccattggtgacttttgacttggaatgccga

SEQ ID NO: 38882 - DNA, 30 bp, Homo sapiens
cagtttggagttggtgctccctcgccctcg

SEQ ID NO: 38883 - DNA, 30 bp, Homo sapiens
ctctggatcagagtcagtggtgtcagaata

SEQ ID NO: 38884 - DNA, 30 bp, Homo sapiens
tatttgaaagttagccattgcttagggttc

SEQ ID NO: 38885 - DNA, 30 bp, Homo sapiens
aaatggtggttcgttttctatgttgttgaa

SEQ ID NO: 38886 - DNA, 30 bp, Homo sapiens
ctactcccaggtgtcttggcggggactcca

SEQ ID NO: 38887 - DNA, 30 bp, Homo sapiens
gactggattccatgttagtggaattgctgc

SEQ ID NO: 38888 - DNA, 30 bp, Homo sapiens
tcgaggtgctgctcagcgcccggttcaggg

SEQ ID NO: 38889 - DNA, 30 bp, Homo sapiens
gttccgtcatgcacttatcggtttggggca

SEQ ID NO: 38890 - DNA, 30 bp, Homo sapiens
aagtggctgaggccgctgtgccgggagctg

SEQ ID NO: 38891 - DNA, 30 bp, Homo sapiens
aggtcagcctgtttactggcatctgactgt

SEQ ID NO: 38892 - DNA, 30 bp, Homo sapiens
tcctggcaaaactttcgaagaaggatcttt

SEQ ID NO: 38893 - DNA, 30 bp, Homo sapiens
ggtcgctccacatcaaggttgaggaacact

SEQ ID NO: 38894 - DNA, 30 bp, Homo sapiens
agcaggtaaacccaaggatccaagatctgg

SEQ ID NO: 38895 - DNA, 30 bp, Homo sapiens
ctgtccatcattagagcagctggagacagc

SEQ ID NO: 38896 - DNA, 30 bp, Homo sapiens
ttctggtgtacacattaatgctgctcacga

SEQ ID NO: 38897 - DNA, 30 bp, Homo sapiens
cactgggaaatgtgacttgcagggagctcc

SEQ ID NO: 38898 - DNA, 30 bp, Homo sapiens
cacaggtggcgggccgcttcccagaggatc

SEQ ID NO: 38899 - DNA, 30 bp, Homo sapiens
cgctggggaggcctcggtgatggccctctc

SEQ ID NO: 38900 - DNA, 30 bp, Homo sapiens
tccagatctggcattttttcatcatcactg

SEQ ID NO: 38901 - DNA, 30 bp, Homo sapiens
catccatggcaggtggaggtctcttggtgc

SEQ ID NO: 38902 - DNA, 30 bp, Homo sapiens
attccaatgttggccattgtaacctatgta

SEQ ID NO: 38903 - DNA, 30 bp, Homo sapiens
aactggtgactcagaaatagcagcaacctt

SEQ ID NO: 38904 - DNA, 30 bp, Homo sapiens
tagtccatctccatcgacatgagcctgcgg

SEQ ID NO: 38905 - DNA, 30 bp, Homo sapiens
cagagggagcaggcgacgctggcttctgct

SEQ ID NO: 38906 - DNA, 30 bp, Homo sapiens
catgggcggatgcggtagcggacgggcacg

SEQ ID NO: 38907 - DNA, 30 bp, Homo sapiens
tcagcaagtccttcagagctttttggcggg

SEQ ID NO: 38908 - DNA, 30 bp, Homo sapiens
attatctcctttcagcattcccataaatgc

SEQ ID NO: 38909 - DNA, 30 bp, Homo sapiens
ttacctcctgtcatcatggactggaatgca

SEQ ID NO: 38910 - DNA, 30 bp, Homo sapiens
agagctctgtggatggtcgctccacagcag

SEQ ID NO: 38911 - DNA, 30 bp, Homo sapiens
ctgtgggattgatatcatctagtccggagc

SEQ ID NO: 38912 - DNA, 30 bp, Homo sapiens
caagacttttttcatggctctcaaccaaga

SEQ ID NO: 38913 - DNA, 30 bp, Homo sapiens
cacatgactgtctcccactcttcctgtagc

SEQ ID NO: 38914 - DNA, 30 bp, Homo sapiens
ccagcagcttgtgcatgtacgagttcagcc

SEQ ID NO: 38915 - DNA, 30 bp, Homo sapiens
agagaacatcctcagtttctccttggcatc

SEQ ID NO: 38916 - DNA, 30 bp, Homo sapiens
atcgagctccagcgacgttgtggaggtgtc

SEQ ID NO: 38917 - DNA, 30 bp, Homo sapiens
accgtgaatcgagctccagcgacgttgtgg

SEQ ID NO: 38918 - DNA, 30 bp, Homo sapiens
tgcaggacactgagtatggagtggtgagcg

SEQ ID NO: 38919 - DNA, 30 bp, Homo sapiens
gtgtggtctcgtctgcccaagcattttcag

SEQ ID NO: 38920 - DNA, 30 bp, Homo sapiens
ctctgcaggtgggtgggccagattggccag

SEQ ID NO: 38921 - DNA, 30 bp, Homo sapiens
ggtcgggttctcgtagctggtgaagctgga

SEQ ID NO: 38922 - DNA, 30 bp, Homo sapiens
cacggcttgctgtccacggtgctgtctccc

SEQ ID NO: 38923 - DNA, 30 bp, Homo sapiens
cgtcggtcttctgcttcttggtatcgacat

SEQ ID NO: 38924 - DNA, 30 bp, Homo sapiens
taccggaggaagaatgaggctggtagggga

SEQ ID NO: 38925 - DNA, 30 bp, Homo sapiens
tcttctcctgtttcttgccttcctttttct

SEQ ID NO: 38926 - DNA, 30 bp, Homo sapiens
ttgctgttgctcctgctccaggttccgctg

SEQ ID NO: 38927 - DNA, 30 bp, Homo sapiens
ctgtgactcctggaggggcccagcccgggg

SEQ ID NO: 38928 - DNA, 30 bp, Homo sapiens
cgttggaatctttgaaacgcagccgcattt

SEQ ID NO: 38929 - DNA, 30 bp, Homo sapiens
agcttcattggttagggaagagaagaattc

SEQ ID NO: 38930 - DNA, 30 bp, Homo sapiens
actgaacacagcaatgcccattggtatctc

SEQ ID NO: 38931 - DNA, 30 bp, Homo sapiens
gcccaccttcctccccgctggggccatgcc

SEQ ID NO: 38932 - DNA, 30 bp, Homo sapiens
tagcccgacgtgacaggatggatgggcagc

SEQ ID NO: 38933 - DNA, 30 bp, Homo sapiens
tagaggccaggcttagggccatcttttgtc

SEQ ID NO: 38934 - DNA, 30 bp, Homo sapiens
agctggccaggcctgatgtggatgtatgac

SEQ ID NO: 38935 - DNA, 30 bp, Homo sapiens
ctttgttgcccgtgcagtaatctgcttgtg

SEQ ID NO: 38936 - DNA, 30 bp, Homo sapiens
aacaggaacctgtagcagaggtaagcgccg

SEQ ID NO: 38937 - DNA, 30 bp, Homo sapiens
atcaggcccacgttttcatagactctagca

SEQ ID NO: 38938 - DNA, 30 bp, Homo sapiens
gtgcaccacgaccggccctgcatccatgat

SEQ ID NO: 38939 - DNA, 30 bp, Homo sapiens
tgaaggtggatctcttggtcctttgggttt

SEQ ID NO: 38940 - DNA, 30 bp, Homo sapiens
ctgaggctgctgtttttgctcttcttctgc

SEQ ID NO: 38941 - DNA, 30 bp, Homo sapiens
gtctggagttttggaggaactggatgagga

SEQ ID NO: 38942 - DNA, 30 bp, Homo sapiens
acccgggtccactcagcaggcgggtcccgg

SEQ ID NO: 38943 - DNA, 30 bp, Homo sapiens
tcttggcctttttctttttcgttcattctc

SEQ ID NO: 38944 - DNA, 30 bp, Homo sapiens
aacaaaagcgccaaccaaaatgactgacat

SEQ ID NO: 38945 - DNA, 30 bp, Homo sapiens
tttttccaagaggaacgcgtgttgaatcat

SEQ ID NO: 38946 - DNA, 30 bp, Homo sapiens
tcagaagtttccgaagaacttcaagcacaa

SEQ ID NO: 38947 - DNA, 30 bp, Homo sapiens
gttgaactcaccaggcagattcttaagttc

SEQ ID NO: 38948 - DNA, 30 bp, Homo sapiens
tttgaaccatgccagaacgttgttctctca

SEQ ID NO: 38949 - DNA, 30 bp, Homo sapiens
cactggaaagttccttcgtttgaaccatgc

SEQ ID NO: 38950 - DNA, 30 bp, Homo sapiens
gcctggagcttttcaggaactggatgagga

SEQ ID NO: 38951 - DNA, 30 bp, Homo sapiens
tggtggtggattccttggtcctttgggttt

SEQ ID NO: 38952 - DNA, 30 bp, Homo sapiens
caggtcttgttgagtgtccagagtggatcc

SEQ ID NO: 38953 - DNA, 30 bp, Homo sapiens
atttggactaaaccttcttcatacacacga

SEQ ID NO: 38954 - DNA, 30 bp, Homo sapiens
acatggctgtttccatagtaataagaaccc

SEQ ID NO: 38955 - DNA, 30 bp, Homo sapiens
ttctggggactggtgggacagctgcttttc

SEQ ID NO: 38956 - DNA, 30 bp, Homo sapiens
tcttgttcttagtgtgcaggttctcataca

SEQ ID NO: 38957 - DNA, 30 bp, Homo sapiens
acttcctcttgagggaacccttgctcttct

SEQ ID NO: 38958 - DNA, 30 bp, Homo sapiens
caggggctgggttcctcaggcagctggcct

SEQ ID NO: 38959 - DNA, 30 bp, Homo sapiens
ccacggccagcaggttttggccagaggata

SEQ ID NO: 38960 - DNA, 30 bp, Homo sapiens
acttgaagttggcataatctgagaatgcat

SEQ ID NO: 38961 - DNA, 30 bp, Homo sapiens
gactggatctctgtgatactctggattcac

SEQ ID NO: 38962 - DNA, 30 bp, Homo sapiens
tgtgcctgtgagcgtattgccaagggagat

SEQ ID NO: 38963 - DNA, 30 bp, Homo sapiens
tttaaagctggacttgcaggaccattgaca

SEQ ID NO: 38964 - DNA, 30 bp, Homo sapiens
cagtgcggtgacatggaggccctggccccc

SEQ ID NO: 38965 - DNA, 30 bp, Homo sapiens
tagtggtcaaagctgcccaggtactctagt

SEQ ID NO: 38966 - DNA, 30 bp, Homo sapiens
tttgcaccatatgtggtctctgaagtcgta

SEQ ID NO: 38967 - DNA, 30 bp, Homo sapiens
tagtggtcaaagctgccgaggtactccagg

SEQ ID NO: 38968 - DNA, 30 bp, Homo sapiens
acactagggactccatgctctcagcagggt

SEQ ID NO: 38969 - DNA, 30 bp, Homo sapiens
acttgtgggcctggatggcggccacgttct

SEQ ID NO: 38970 - DNA, 30 bp, Homo sapiens
ctattgcaaactgtccgagatgccccttca

SEQ ID NO: 38971 - DNA, 30 bp, Homo sapiens
cattggtctttccaaatgtggtcacgggcg

SEQ ID NO: 38972 - DNA, 30 bp, Homo sapiens
aagtggatcattgggcaatcttggactaaa

SEQ ID NO: 38973 - DNA, 30 bp, Homo sapiens
taagatgattccaggtactccaaagctaca

SEQ ID NO: 38974 - DNA, 30 bp, Homo sapiens
gccagaattcaagtattccagggccacctc

SEQ ID NO: 38975 - DNA, 30 bp, Homo sapiens
cactggggcagggccttgaggatggcattc

SEQ ID NO: 38976 - DNA, 30 bp, Homo sapiens
cactggggaagggccttgaggatggcgttc

SEQ ID NO: 38977 - DNA, 30 bp, Homo sapiens
cagttgcacacactgatggataaaaatgta

SEQ ID NO: 38978 - DNA, 30 bp, Homo sapiens
caagctcaacatcaccttccatggcgtcca

SEQ ID NO: 38979 - DNA, 30 bp, Homo sapiens
cactggacagtctctgctgaaagtctgctc

SEQ ID NO: 38980 - DNA, 30 bp, Homo sapiens
tagtggtcaaagcttccgaggtactccagt

SEQ ID NO: 38981 - DNA, 30 bp, Homo sapiens
aaaaggagcttaaatattccagtgccacct

SEQ ID NO: 38982 - DNA, 30 bp, Homo sapiens
tatcttgactccagcccctccaagtactcc

SEQ ID NO: 38983 - DNA, 30 bp, Homo sapiens
atcaggcaatgctgcaccattactgtccag

SEQ ID NO: 38984 - DNA, 30 bp, Homo sapiens
ggtcggtggctcgatccagcaacagaggca

SEQ ID NO: 38985 - DNA, 30 bp, Homo sapiens
gtgagggcccctggcttcgctcacggatgt

SEQ ID NO: 38986 - DNA, 30 bp, Homo sapiens
aactgtggcgaatctctcgtaattgacgtc

SEQ ID NO: 38987 - DNA, 30 bp, Homo sapiens
agtaaagttttaggtgaccagtgactttgt

SEQ ID NO: 38988 - DNA, 30 bp, Homo sapiens
aatcggaacttcttcaaatactggcccact

SEQ ID NO: 38989 - DNA, 30 bp, Homo sapiens
ggaagaactttctggaggttgtcccagata

SEQ ID NO: 38990 - DNA, 30 bp, Homo sapiens
aacaggtggcaattcaacatccagggtcga

SEQ ID NO: 38991 - DNA, 30 bp, Homo sapiens
aacaggccatatttttttctgatttcatca

SEQ ID NO: 38992 - DNA, 30 bp, Homo sapiens
aacagggaatagaaggtcaccagtctgcaa

SEQ ID NO: 38993 - DNA, 30 bp, Homo sapiens
tcgacagaatgcttgaaggagactgcaaac

SEQ ID NO: 38994 - DNA, 30 bp, Homo sapiens
atgtggctggatctctgtgactccccaccc

SEQ ID NO: 38995 - DNA, 30 bp, Homo sapiens
aggtgcagttggccccctgcacaaatccgc

SEQ ID NO: 38996 - DNA, 30 bp, Homo sapiens
agaaggaggagcgctgagaagggatcccgg

SEQ ID NO: 38997 - DNA, 30 bp, Homo sapiens
cactcataggagggcaaaccaaacagctcg

SEQ ID NO: 38998 - DNA, 30 bp, Homo sapiens
gagaggtcactgttatcaaaacgctcctgg

SEQ ID NO: 38999 - DNA, 30 bp, Homo sapiens
atgataccattaggggggccacagatgggc

SEQ ID NO: 39000 - DNA, 30 bp, Homo sapiens
tggtggtcctccaataggtcctaggtccgg

SEQ ID NO: 39001 - DNA, 30 bp, Homo sapiens
atgtgctcagtttttcaagtagaatttcta

SEQ ID NO: 39002 - DNA, 30 bp, Homo sapiens
cttcctcaccctgcagtagcagggtggcag

SEQ ID NO: 39003 - DNA, 30 bp, Homo sapiens
caatcctcatccacctcctcaccctctgac

SEQ ID NO: 39004 - DNA, 30 bp, Homo sapiens
tcgaggcattcttgttcttcaccactggcc

SEQ ID NO: 39005 - DNA, 30 bp, Homo sapiens
ttggggtaatttgtgagcttcaggaaaatt

SEQ ID NO: 39006 - DNA, 30 bp, Homo sapiens
tcagtgtctccgtccccttcactgccttcc

SEQ ID NO: 39007 - DNA, 30 bp, Homo sapiens
agcaggtggccagtcaacatctacagactc

SEQ ID NO: 39008 - DNA, 30 bp, Homo sapiens
tcgttggtgtctccaaattagtattctctt

SEQ ID NO: 39009 - DNA, 30 bp, Homo sapiens
gccaggttgtattcagctgcgtctggttct

SEQ ID NO: 39010 - DNA, 30 bp, Homo sapiens
gacaaacggtagcatagcatgaagcatcaa

SEQ ID NO: 39011 - DNA, 30 bp, Homo sapiens
ccgtggctcccgaactgtggcccctgcagg

SEQ ID NO: 39012 - DNA, 30 bp, Homo sapiens
gagtggagaattcgtcaaccccaattttgc

SEQ ID NO: 39013 - DNA, 30 bp, Homo sapiens
gccctctgtctgtggatcctgggaagagct

SEQ ID NO: 39014 - DNA, 30 bp, Homo sapiens
ttacggcagctctggtgatgctcactcgag

SEQ ID NO: 39015 - DNA, 30 bp, Homo sapiens
ctaagggtccttccatggccctgggccccc

SEQ ID NO: 39016 - DNA, 30 bp, Homo sapiens
ccatgggtgtatctgagctcctgctgccaa

SEQ ID NO: 39017 - DNA, 30 bp, Homo sapiens
tctcttcttctgagtctctgcctcctcctc

SEQ ID NO: 39018 - DNA, 30 bp, Homo sapiens
ctgaatccacagtggtctgtcagacactgt

SEQ ID NO: 39019 - DNA, 30 bp, Homo sapiens
cttcgggggtcagctgcttggcagccttag

SEQ ID NO: 39020 - DNA, 30 bp, Homo sapiens
gactggggcttgggtgccatcttgccactc

SEQ ID NO: 39021 - DNA, 30 bp, Homo sapiens
acgtttcaaactgggttaagagctccctga

SEQ ID NO: 39022 - DNA, 30 bp, Homo sapiens
cgtcggtgaccccagacgatgtcccccacg

SEQ ID NO: 39023 - DNA, 30 bp, Homo sapiens
tgtctgtctcgaaggggaccaggtggtaat

SEQ ID NO: 39024 - DNA, 30 bp, Homo sapiens
gcttttcctccgccctcttctgtaagcaga

SEQ ID NO: 39025 - DNA, 30 bp, Homo sapiens
ctctggggaatcacttggcattcctcggtc

SEQ ID NO: 39026 - DNA, 30 bp, Homo sapiens
cttcggagcactgtgatcacaggttttggc

SEQ ID NO: 39027 - DNA, 30 bp, Homo sapiens
cacaggttttggctttcctcaaagttcctt

SEQ ID NO: 39028 - DNA, 30 bp, Homo sapiens
tgacggggacgtgagaggtgagctggcccc

SEQ ID NO: 39029 - DNA, 30 bp, Homo sapiens
cagatccatggtgggactgagctcttgtca

SEQ ID NO: 39030 - DNA, 30 bp, Homo sapiens
ccaaggaggccaggtaggcataccagaaca

SEQ ID NO: 39031 - DNA, 30 bp, Homo sapiens
aattggagggacggctcttgttatagacga

SEQ ID NO: 39032 - DNA, 30 bp, Homo sapiens
gcctggtgatggcccaagccctctgccctc

SEQ ID NO: 39033 - DNA, 30 bp, Homo sapiens
agaagagcttgaggaagcagttctgacagt

SEQ ID NO: 39034 - DNA, 30 bp, Homo sapiens
aaaatgcagcaacacctgaactcttctaaa

SEQ ID NO: 39035 - DNA, 30 bp, Homo sapiens
agaatccttccctgtgacatgcatcataat

SEQ ID NO: 39036 - DNA, 30 bp, Homo sapiens
ctccgctccaggtcctccaccaggtaggac

SEQ ID NO: 39037 - DNA, 30 bp, Homo sapiens
ccgctggggccaggctgcgggggagcagct

SEQ ID NO: 39038 - DNA, 30 bp, Homo sapiens
ggaaggagcccgtgccagctgatactggag

SEQ ID NO: 39039 - DNA, 30 bp, Homo sapiens
cagccatggactgcagctcccaggagggcc

SEQ ID NO: 39040 - DNA, 30 bp, Homo sapiens
tccttcttgcctcccagggccaggcttctt

SEQ ID NO: 39041 - DNA, 30 bp, Homo sapiens
tactttctgctgagctccttggcccggcag

SEQ ID NO: 39042 - DNA, 30 bp, Homo sapiens
cgcagcccgctgcagccgtgcggcctcctc

SEQ ID NO: 39043 - DNA, 30 bp, Homo sapiens
cagatgcgtttgattcatcttttcaaagac

SEQ ID NO: 39044 - DNA, 30 bp, Homo sapiens
tcccgggggatgttggggggcgggatctgc

SEQ ID NO: 39045 - DNA, 30 bp, Homo sapiens
tccagatgttttgggcatattctttaattg

SEQ ID NO: 39046 - DNA, 30 bp, Homo sapiens
agatggcctcatccggggctggcaggcgct

SEQ ID NO: 39047 - DNA, 30 bp, Homo sapiens
gcagatggaccaaaagtttctctagtacgc

SEQ ID NO: 39048 - DNA, 30 bp, Homo sapiens
gttagcagccaccagctgccccatgccctc

SEQ ID NO: 39049 - DNA, 30 bp, Homo sapiens
tgaaggaactgctggatggggttgttggtg

SEQ ID NO: 39050 - DNA, 30 bp, Homo sapiens
ggatggcggttggtggaagtgtcagaagaa

SEQ ID NO: 39051 - DNA, 30 bp, Homo sapiens
cagaggcctaactccaagtcctctaactcc

SEQ ID NO: 39052 - DNA, 30 bp, Homo sapiens
aagacagctcccatcattcgtccattttgc

SEQ ID NO: 39053 - DNA, 30 bp, Homo sapiens
ttgaggtccctaaaggccacatgtgctgca

SEQ ID NO: 39054 - DNA, 30 bp, Homo sapiens
cacaggtctgggccctccgaccgcgacctg

SEQ ID NO: 39055 - DNA, 30 bp, Homo sapiens
acatttccatgctctgtatctgtgctgcag

SEQ ID NO: 39056 - DNA, 30 bp, Homo sapiens
cacacctttcctgggtcttccttcagtgtg

SEQ ID NO: 39057 - DNA, 30 bp, Homo sapiens
aatatgctggggtgagttccgtccttcctt

SEQ ID NO: 39058 - DNA, 30 bp, Homo sapiens
ccatggggagaagaacttacctaatacacc

SEQ ID NO: 39059 - DNA, 30 bp, Homo sapiens
tgccggtggcggctcggtctgcggtcacaa

SEQ ID NO: 39060 - DNA, 30 bp, Homo sapiens
caatgggctgaaatatcaggcatgactggc

SEQ ID NO: 39061 - DNA, 30 bp, Homo sapiens
cgttgggaaagccatacctaatacaccact

SEQ ID NO: 39062 - DNA, 30 bp, Homo sapiens
caaagacttgtaggattttgtttagattgt

SEQ ID NO: 39063 - DNA, 30 bp, Homo sapiens
cccaggtattcagccaggaacacagcgaga

SEQ ID NO: 39064 - DNA, 30 bp, Homo sapiens
tagtggattttgggcactggagccacctct

SEQ ID NO: 39065 - DNA, 30 bp, Homo sapiens
accgaagcggaagctgaagccgcctttctt

SEQ ID NO: 39066 - DNA, 30 bp, Homo sapiens
gtctaaaggagaattctcagccagttcaga

SEQ ID NO: 39067 - DNA, 30 bp, Homo sapiens
cattggccactgcgatggcctcctgaattt

SEQ ID NO: 39068 - DNA, 30 bp, Homo sapiens
gaaatctgggcgctctgtggccgagagggc

SEQ ID NO: 39069 - DNA, 30 bp, Homo sapiens
ggctactgtaagaagctgctggtcacaaaa

SEQ ID NO: 39070 - DNA, 30 bp, Homo sapiens
gtcctaaatcttcattttttttctgcaccg

SEQ ID NO: 39071 - DNA, 30 bp, Homo sapiens
gccggcacatgtggggtggtgtttgtgggg

SEQ ID NO: 39072 - DNA, 30 bp, Homo sapiens
tgcagggtggccagcatggcccttcagggc

SEQ ID NO: 39073 - DNA, 30 bp, Homo sapiens
acacggccgggtggtggtgcttgaccttcc

SEQ ID NO: 39074 - DNA, 30 bp, Homo sapiens
cagcccagtgtgattcccacagaggccaga

SEQ ID NO: 39075 - DNA, 30 bp, Homo sapiens
ctgtggatgagctctttcaactgtgccagt

SEQ ID NO: 39076 - DNA, 30 bp, Homo sapiens
gggcggcagcggaccccggacagcaggccg

SEQ ID NO: 39077 - DNA, 30 bp, Homo sapiens
gactggtctctgccttcccagatgtcttcc

SEQ ID NO: 39078 - DNA, 30 bp, Homo sapiens
aaatggaggggaatgtggctaagacggtgt

SEQ ID NO: 39079 - DNA, 30 bp, Homo sapiens
tattgggagctggctcgctccaggatcctc

SEQ ID NO: 39080 - DNA, 30 bp, Homo sapiens
gctgtgctgctccaggtaggcggacaggag

SEQ ID NO: 39081 - DNA, 30 bp, Homo sapiens
gaacttgttggatttcagccccttgaagca

SEQ ID NO: 39082 - DNA, 30 bp, Homo sapiens
tgtcacgcctcctccactgctgatatctac

SEQ ID NO: 39083 - DNA, 30 bp, Homo sapiens
atgttctgacagcactgcacctttggcttg

SEQ ID NO: 39084 - DNA, 30 bp, Homo sapiens
tgtaggaactgccctgagatgacgtagatc

SEQ ID NO: 39085 - DNA, 30 bp, Homo sapiens
cacaggttctggcagcactgcagcttgttg

SEQ ID NO: 39086 - DNA, 30 bp, Homo sapiens
tttttgccaacctgagtcgggatgcggagg

SEQ ID NO: 39087 - DNA, 30 bp, Homo sapiens
ttcctggatggttcatacggcactctgaga

SEQ ID NO: 39088 - DNA, 30 bp, Homo sapiens
cttgacctccaggatggacgggttggtctc

SEQ ID NO: 39089 - DNA, 30 bp, Homo sapiens
tgtttgatctcgaggatggagggattgtgg

SEQ ID NO: 39090 - DNA, 30 bp, Homo sapiens
atttgggggggcccggggggatctgcagca

SEQ ID NO: 39091 - DNA, 30 bp, Homo sapiens
catcggacatgtggtcttggtggaggcagt

SEQ ID NO: 39092 - DNA, 30 bp, Homo sapiens
cccagggagcacttgttggtgttcttcttg

SEQ ID NO: 39093 - DNA, 30 bp, Homo sapiens
ccttctctctggggttggggttcactggtt

SEQ ID NO: 39094 - DNA, 30 bp, Homo sapiens
agcaggttttcgaagagttcgctgggccct

SEQ ID NO: 39095 - DNA, 30 bp, Homo sapiens
tgcaggcacttgtttcatagaagtccatgc

SEQ ID NO: 39096 - DNA, 30 bp, Homo sapiens
tagtgggcgcagcatttggcctgcctcgcg

SEQ ID NO: 39097 - DNA, 30 bp, Homo sapiens
cacaggctcctcctccttggccttcttccc

SEQ ID NO: 39098 - DNA, 30 bp, Homo sapiens
gtttataacacagagcaataaccaccacag

SEQ ID NO: 39099 - DNA, 30 bp, Homo sapiens
cagtgggtcttttcacttggaccctgggcc

SEQ ID NO: 39100 - DNA, 30 bp, Homo sapiens
cctgactgcttgactggagtgctctgaatt

SEQ ID NO: 39101 - DNA, 30 bp, Homo sapiens
tagcaacagccaccgccagccggctttaca

SEQ ID NO: 39102 - DNA, 30 bp, Homo sapiens
atctggtcctcttgggtggcttatgactgg

SEQ ID NO: 39103 - DNA, 30 bp, Homo sapiens
gaacagcaccctccaccactggtctgggct

SEQ ID NO: 39104 - DNA, 30 bp, Homo sapiens
ctttggctctgaaggctgtcttcggagttt

SEQ ID NO: 39105 - DNA, 30 bp, Homo sapiens
aaaaggatttctgtttttcttggtcctttg

SEQ ID NO: 39106 - DNA, 30 bp, Homo sapiens
agtaggggtttggcttctggcccagatcca

SEQ ID NO: 39107 - DNA, 30 bp, Homo sapiens
cagaggctgatgcaacaggccctcttctcc

SEQ ID NO: 39108 - DNA, 30 bp, Homo sapiens
caagggcggcagcaggaggcccctcgaccc

SEQ ID NO: 39109 - DNA, 30 bp, Homo sapiens
gcccctttctccttttcttcacttaactga

SEQ ID NO: 39110 - DNA, 30 bp, Homo sapiens
ctctggtggcttttccccatccaagtttcc

SEQ ID NO: 39111 - DNA, 30 bp, Homo sapiens
tagaggtggtatgttgattttcttcttccg

SEQ ID NO: 39112 - DNA, 30 bp, Homo sapiens
tctaggagggttaacagtccttgacatagg

SEQ ID NO: 39113 - DNA, 30 bp, Homo sapiens
actgttctatttctgctttgtttaatttga

SEQ ID NO: 39114 - DNA, 30 bp, Homo sapiens
agcaggaccagctggaggacttggtttgta

SEQ ID NO: 39115 - DNA, 30 bp, Homo sapiens
ccagcctgctgtcctccctgattgcctgca

SEQ ID NO: 39116 - DNA, 30 bp, Homo sapiens
agttggaccctatgtcacgagagttccgct

SEQ ID NO: 39117 - DNA, 30 bp, Homo sapiens
tccaggtaagggtgaggatacattgttcac

SEQ ID NO: 39118 - DNA, 30 bp, Homo sapiens
caccggcggctggcttgcatggttggcttc

SEQ ID NO: 39119 - DNA, 30 bp, Homo sapiens
cactgggatttgttctctgctctcaaggtc

SEQ ID NO: 39120 - DNA, 30 bp, Homo sapiens
gacaggaagttttactgttagcttcctgtg

SEQ ID NO: 39121 - DNA, 30 bp, Homo sapiens
cgtcattgcaggctttggttcaggcttcag

SEQ ID NO: 39122 - DNA, 30 bp, Homo sapiens
ctctggaggaatgagggtggcacagtgccc

SEQ ID NO: 39123 - DNA, 30 bp, Homo sapiens
catgggcaacatgtgggcttcttcttgctg

SEQ ID NO: 39124 - DNA, 30 bp, Homo sapiens
atagcccccctgccagccccatctctgcac

SEQ ID NO: 39125 - DNA, 30 bp, Homo sapiens
tagcagcagcccaggctggagggcctcttg

SEQ ID NO: 39126 - DNA, 30 bp, Homo sapiens
cgtgtgtgtgcagggagcggaggccttcca

SEQ ID NO: 39127 - DNA, 30 bp, Homo sapiens
tgaaggagcagcagctggagcgcttcttct

SEQ ID NO: 39128 - DNA, 30 bp, Homo sapiens
aggatttggcacagccagagcagctggcaa

SEQ ID NO: 39129 - DNA, 30 bp, Homo sapiens
tcctgggctttactgcttcctcagaagaat

SEQ ID NO: 39130 - DNA, 30 bp, Homo sapiens
tgatttgacaacctcttctgaagagtgaac

SEQ ID NO: 39131 - DNA, 30 bp, Homo sapiens
agcaggcgcagtcctggtgcggtggcacct

SEQ ID NO: 39132 - DNA, 30 bp, Homo sapiens
atgagcagttctgctgcagcagcggtgggg

SEQ ID NO: 39133 - DNA, 30 bp, Homo sapiens
agcaggcacagttgggctgcggtggaggag

SEQ ID NO: 39134 - DNA, 30 bp, Homo sapiens
tgctgggctggggggctggagcatccccca

SEQ ID NO: 39135 - DNA, 30 bp, Homo sapiens
agaaggaagtatctgatgaaaaggcacctg

SEQ ID NO: 39136 - DNA, 30 bp, Homo sapiens
cttcaatgaggtgtaaggctagaccatatt

SEQ ID NO: 39137 - DNA, 30 bp, Homo sapiens
gcctcctgggggaagaagccgagcttggcc

SEQ ID NO: 39138 - DNA, 30 bp, Homo sapiens
tgaaataacccagctttgccaatgacatct

SEQ ID NO: 39139 - DNA, 30 bp, Homo sapiens
tgaatgtatcgaatgtatgtaaaaaagtta

SEQ ID NO: 39140 - DNA, 30 bp, Homo sapiens
ttctggtgcagtttttgggggggctctggg

SEQ ID NO: 39141 - DNA, 30 bp, Homo sapiens
taggagatcttgcagttactccgcgagcag

SEQ ID NO: 39142 - DNA, 30 bp, Homo sapiens
tcctcgaaggattccagttcgatttcaacc

SEQ ID NO: 39143 - DNA, 30 bp, Homo sapiens
cactggcatgggcctgagtgctgcttcctg

SEQ ID NO: 39144 - DNA, 30 bp, Homo sapiens
tagctgtgggccgtgaccccatgctgtgct

SEQ ID NO: 39145 - DNA, 30 bp, Homo sapiens
cagcacccgcagccccagccttctccgatg

SEQ ID NO: 39146 - DNA, 30 bp, Homo sapiens
ctcttgggcggcctcttgggggccaccttc

SEQ ID NO: 39147 - DNA, 30 bp, Homo sapiens
aaccacactcctgagcgttcggggcctgtg

SEQ ID NO: 39148 - DNA, 30 bp, Homo sapiens
acacggctgaggggccacggcctgggcact

SEQ ID NO: 39149 - DNA, 30 bp, Homo sapiens
tcctggttggttgtgtgggttcggtaaggt

SEQ ID NO: 39150 - DNA, 30 bp, Homo sapiens
cagttgctacaacactggctcttgttctgc

SEQ ID NO: 39151 - DNA, 30 bp, Homo sapiens
cactggctccggctggctgggttgttctcc

SEQ ID NO: 39152 - DNA, 30 bp, Homo sapiens
agcaggaacagcctccttcactgactggtt

SEQ ID NO: 39153 - DNA, 30 bp, Homo sapiens
agcaggagcagccgccctcgctggccgggg

SEQ ID NO: 39154 - DNA, 30 bp, Homo sapiens
cgagacaggcagcaatgatgaattgcaaaa

SEQ ID NO: 39155 - DNA, 30 bp, Homo sapiens
ccaactccatatcagaatgacttccaccgc

SEQ ID NO: 39156 - DNA, 30 bp, Homo sapiens
gactggtctggcgagagcttgatggattct

SEQ ID NO: 39157 - DNA, 30 bp, Homo sapiens
agaagaacacatcggaaaaagctgctcctc

SEQ ID NO: 39158 - DNA, 30 bp, Homo sapiens
aactggtcttctttgatcggttttctgtta

SEQ ID NO: 39159 - DNA, 30 bp, Homo sapiens
gctaggcttgggctttcggtgaagattgac

SEQ ID NO: 39160 - DNA, 30 bp, Homo sapiens
ctttggagccactgttcaagtcaatggtgt

SEQ ID NO: 39161 - DNA, 30 bp, Homo sapiens
acacgggttccatctgcagctcctccccgt

SEQ ID NO: 39162 - DNA, 30 bp, Homo sapiens
ggatgggatcctttttcatttcattttcta

SEQ ID NO: 39163 - DNA, 30 bp, Homo sapiens
ctcaggaagctggttaatgtctgtcagttt

SEQ ID NO: 39164 - DNA, 30 bp, Homo sapiens
aggtgtccttgatgtccctgacgtccgtga

SEQ ID NO: 39165 - DNA, 30 bp, Homo sapiens
cagtcacaatacaatcgtcatagatttccc

SEQ ID NO: 39166 - DNA, 30 bp, Homo sapiens
aaccccggttgctgtctttatggagctcag

SEQ ID NO: 39167 - DNA, 30 bp, Homo sapiens
ccttgggtggctgggtgaccggtgctggct

SEQ ID NO: 39168 - DNA, 30 bp, Homo sapiens
ggtcttcctgttgcagctgactctctcgca

SEQ ID NO: 39169 - DNA, 30 bp, Homo sapiens
taaacttgaggttgcagtggtggaggaagt

SEQ ID NO: 39170 - DNA, 30 bp, Homo sapiens
aggtgaggacgctgctaactgaaggcagca

SEQ ID NO: 39171 - DNA, 30 bp, Homo sapiens
ctcaggctgaacattcactctctgaagcac

SEQ ID NO: 39172 - DNA, 30 bp, Homo sapiens
tcatgggaaactcgttccaaggccacatag

SEQ ID NO: 39173 - DNA, 30 bp, Homo sapiens
agctgtggggagaggccacctcctctgatg

SEQ ID NO: 39174 - DNA, 30 bp, Homo sapiens
ctgatggggtctcgatgctgctgctctgtt

SEQ ID NO: 39175 - DNA, 30 bp, Homo sapiens
ccaaatcttttccgatcaggaaagcctgga

SEQ ID NO: 39176 - DNA, 30 bp, Homo sapiens
tagagctcctcgtagtcgccacccccaggg

SEQ ID NO: 39177 - DNA, 30 bp, Homo sapiens
gggaatggagcagctgagcagtggggagct

SEQ ID NO: 39178 - DNA, 30 bp, Homo sapiens
agcaggcattttctcttcctcttcttcacg

SEQ ID NO: 39179 - DNA, 30 bp, Homo sapiens
gaggaggctgcaggcgcgcttctgctgccg

SEQ ID NO: 39180 - DNA, 30 bp, Homo sapiens
agacggtgcacttcttccccggcttcttca

SEQ ID NO: 39181 - DNA, 30 bp, Homo sapiens
caaacactgtcttcaggccccgctgggtca

SEQ ID NO: 39182 - DNA, 30 bp, Homo sapiens
cattggagaagcaaaaaagttgccttgtcg

SEQ ID NO: 39183 - DNA, 30 bp, Homo sapiens
caatggtcacctgccacactcgcaccaggt

SEQ ID NO: 39184 - DNA, 30 bp, Homo sapiens
ttcaggaacttcttcatcagggcagcagta

SEQ ID NO: 39185 - DNA, 30 bp, Homo sapiens
actctcgtagtcttctattattatgttttc

SEQ ID NO: 39186 - DNA, 30 bp, Homo sapiens
acgcttgtttcttggttcaatctcagcact

SEQ ID NO: 39187 - DNA, 30 bp, Homo sapiens
tccaggtgttgcgatgatgtcactgtacgg

SEQ ID NO: 39188 - DNA, 30 bp, Homo sapiens
tagctataatatctgcatagggagcactct

SEQ ID NO: 39189 - DNA, 30 bp, Homo sapiens
ctcaggaggaagttggcagccaagttctca

SEQ ID NO: 39190 - DNA, 30 bp, Homo sapiens
ttcaggaaatcctaatgcctttaacctttc

SEQ ID NO: 39191 - DNA, 30 bp, Homo sapiens
gagctaacactgcatttcacaatctctgag

SEQ ID NO: 39192 - DNA, 30 bp, Homo sapiens
ctttggcatctcccactccatctgcattaa

SEQ ID NO: 39193 - DNA, 30 bp, Homo sapiens
gacagggagagtcgtagattttgcagattc

SEQ ID NO: 39194 - DNA, 30 bp, Homo sapiens
tagtggcatttggatgcaaaggtttaactc

SEQ ID NO: 39195 - DNA, 30 bp, Homo sapiens
ttttcttgacaaaccaatcctgattggcct

SEQ ID NO: 39196 - DNA, 30 bp, Homo sapiens
ctcaggaggctgaggtgggaggatttctgg

SEQ ID NO: 39197 - DNA, 30 bp, Homo sapiens
cactggatgctcatccaaagtctctgttct

SEQ ID NO: 39198 - DNA, 30 bp, Homo sapiens
tcttggccttgaagaaccaggccttcctcc

SEQ ID NO: 39199 - DNA, 30 bp, Homo sapiens
cttcctccttgatggtgtagacaaatgagg

SEQ ID NO: 39200 - DNA, 30 bp, Homo sapiens
cataggcttgaagaaccaggccttcctcct

SEQ ID NO: 39201 - DNA, 30 bp, Homo sapiens
agaaccaggccttcctccttgatggtgtag

SEQ ID NO: 39202 - DNA, 30 bp, Homo sapiens
caaaggccttgaagaaccaggccttcctcc

SEQ ID NO: 39203 - DNA, 30 bp, Homo sapiens
tctctgttctgattccagttgcccagtttg

SEQ ID NO: 39204 - DNA, 30 bp, Homo sapiens
acctggtgcaccacaaatttctgttgtttt

SEQ ID NO: 39205 - DNA, 30 bp, Homo sapiens
ctctgggtctcgtgaccgtttccgggtgct

SEQ ID NO: 39206 - DNA, 30 bp, Homo sapiens
aatgtggcactctgctctgaggtcccccag

SEQ ID NO: 39207 - DNA, 30 bp, Homo sapiens
tgacggcgtggagactcgaacctgctgctt

SEQ ID NO: 39208 - DNA, 30 bp, Homo sapiens
agatggatcatatttccttttcttcatgtc

SEQ ID NO: 39209 - DNA, 30 bp, Homo sapiens
tacagtttccaagtgcattcccaaaactcc

SEQ ID NO: 39210 - DNA, 30 bp, Homo sapiens
gcttgagtggttatattctgaaaaatgaat

SEQ ID NO: 39211 - DNA, 30 bp, Homo sapiens
cagcggaggccccgctgctcctcatgagaa

SEQ ID NO: 39212 - DNA, 30 bp, Homo sapiens
tatttcccagtgacctctatcacatcatcg

SEQ ID NO: 39213 - DNA, 30 bp, Homo sapiens
ccctcactgtcttccgccagcacagggctg

SEQ ID NO: 39214 - DNA, 30 bp, Homo sapiens
tattccactccaaactcaggctgtcttggc

SEQ ID NO: 39215 - DNA, 30 bp, Homo sapiens
ttcatgtcctcttcactgtcacttgctctt

SEQ ID NO: 39216 - DNA, 30 bp, Homo sapiens
aattctttcctgcagcacacattattcatg

SEQ ID NO: 39217 - DNA, 30 bp, Homo sapiens
tagagagggggcgtgcggaaatggatcttc

SEQ ID NO: 39218 - DNA, 30 bp, Homo sapiens
cttcttattcctgggctttagctcttcggc

SEQ ID NO: 39219 - DNA, 30 bp, Homo sapiens
taagacgtcctcaagggccagagaccagcc

SEQ ID NO: 39220 - DNA, 30 bp, Homo sapiens
cagttacctgtcggttctggcattgcctcc

SEQ ID NO: 39221 - DNA, 30 bp, Homo sapiens
aggtggatcttctgcctgtcggttctggca

SEQ ID NO: 39222 - DNA, 30 bp, Homo sapiens
agatatggagacctgtagtggctccgaata

SEQ ID NO: 39223 - DNA, 30 bp, Homo sapiens
aggatgaagcaggggaggatgatgaggagg

SEQ ID NO: 39224 - DNA, 30 bp, Homo sapiens
gacaggcagcctcggggacgtggtcagcgt

SEQ ID NO: 39225 - DNA, 30 bp, Homo sapiens
aatcttggctttccagagagtcctctatgc

SEQ ID NO: 39226 - DNA, 30 bp, Homo sapiens
ggcaggagtcaagatttttccagaaccttt

SEQ ID NO: 39227 - DNA, 30 bp, Homo sapiens
tcgctggcacacgggtagtggtaggtgtgg

SEQ ID NO: 39228 - DNA, 30 bp, Homo sapiens
acatggtaaggatttgcttcagtactttct

SEQ ID NO: 39229 - DNA, 30 bp, Homo sapiens
gttgttttttgattgggagcatgtgtattt

SEQ ID NO: 39230 - DNA, 30 bp, Homo sapiens
tcttggctaaacttttcctcttcttttttc

SEQ ID NO: 39231 - DNA, 30 bp, Homo sapiens
ccacgttggcccgggtcttcgctgacgtct

SEQ ID NO: 39232 - DNA, 30 bp, Homo sapiens
agatggacgtctccttcctatccctgctgg

SEQ ID NO: 39233 - DNA, 30 bp, Homo sapiens
gatttattggctgagccagaggaacgacgc

SEQ ID NO: 39234 - DNA, 30 bp, Homo sapiens
agatggtaaatggtggtagggagctggaga

SEQ ID NO: 39235 - DNA, 30 bp, Homo sapiens
cgctgagggagtagctgggagagggagaaa

SEQ ID NO: 39236 - DNA, 30 bp, Homo sapiens
tcctggaaaagtgaagtataaaactctggc

SEQ ID NO: 39237 - DNA, 30 bp, Homo sapiens
gaagatgcccttggcaatcttgagtccttt

SEQ ID NO: 39238 - DNA, 30 bp, Homo sapiens
cacagggccctgcctccttccccgcaccgc

SEQ ID NO: 39239 - DNA, 30 bp, Homo sapiens
tgcaggtacctgaggcctgttgcttttaca

SEQ ID NO: 39240 - DNA, 30 bp, Homo sapiens
acatggctgcaagatcttccttggaagaga

SEQ ID NO: 39241 - DNA, 30 bp, Homo sapiens
gtttgttactttggcaggctgcactcaaat

SEQ ID NO: 39242 - DNA, 30 bp, Homo sapiens
catccgcgtctgtgtcctggctgtgttcca

SEQ ID NO: 39243 - DNA, 30 bp, Homo sapiens
tcttcatcgaagtcctcctctatcccatct

SEQ ID NO: 39244 - DNA, 30 bp, Homo sapiens
tacacaatgccctcagtgcgcttgctctgc

SEQ ID NO: 39245 - DNA, 30 bp, Homo sapiens
aggcctgggcctcactgtctttactcctcc

SEQ ID NO: 39246 - DNA, 30 bp, Homo sapiens
cagcagcgtgtcggtgcgtttgctgcgcca

SEQ ID NO: 39247 - DNA, 30 bp, Homo sapiens
cacaggtcatcatcctcatccgggagagca

SEQ ID NO: 39248 - DNA, 30 bp, Homo sapiens
catcctccttggtctcctccttcaccgaga

SEQ ID NO: 39249 - DNA, 30 bp, Homo sapiens
ctctggcaaaggagcaagaacccaggcctg

SEQ ID NO: 39250 - DNA, 30 bp, Homo sapiens
gcatggttcagtgttgccatcactgcgcaa

SEQ ID NO: 39251 - DNA, 30 bp, Homo sapiens
ctttgggagaaccaaatgattcaatctttt

SEQ ID NO: 39252 - DNA, 30 bp, Homo sapiens
tgtgctcccggtcgtctgcccgtccccttc

SEQ ID NO: 39253 - DNA, 30 bp, Homo sapiens
aacaggcaaccgactgtctgtgagtccaac

SEQ ID NO: 39254 - DNA, 30 bp, Homo sapiens
tctcatcacagctttcgcagttcaattgtt

SEQ ID NO: 39255 - DNA, 30 bp, Homo sapiens
ccatggtgtgataaaactgaattgaaaaat

SEQ ID NO: 39256 - DNA, 30 bp, Homo sapiens
aggcttcctgctgttcatcatcaagttgtg

SEQ ID NO: 39257 - DNA, 30 bp, Homo sapiens
ctgtggcaaatgcgcaggatccaattcctg

SEQ ID NO: 39258 - DNA, 30 bp, Homo sapiens
acagcgtctgcagcagactgtggcgggcga

SEQ ID NO: 39259 - DNA, 30 bp, Homo sapiens
gtctggtactggggcagcctcagcaaggcc

SEQ ID NO: 39260 - DNA, 30 bp, Homo sapiens
tactggggaccaaagatgttaggatcgtga

SEQ ID NO: 39261 - DNA, 30 bp, Homo sapiens
ctatctgctgcttgccagagaggacccagg

SEQ ID NO: 39262 - DNA, 30 bp, Homo sapiens
tacgggggctgattgaaggtaagcaagaga

SEQ ID NO: 39263 - DNA, 30 bp, Homo sapiens
gcagcagacatgatttctttttaggcttct

SEQ ID NO: 39264 - DNA, 30 bp, Homo sapiens
cccaggcactggagtttttctgttaatttg

SEQ ID NO: 39265 - DNA, 30 bp, Homo sapiens
ggggcatgtgctgctcagatgcttccagct

SEQ ID NO: 39266 - DNA, 30 bp, Homo sapiens
cagagctggcatggctgagcttgtcaaagc

SEQ ID NO: 39267 - DNA, 30 bp, Homo sapiens
taagtctctgctctgtgagagaggcctgct

SEQ ID NO: 39268 - DNA, 30 bp, Homo sapiens
gcatgggtcatctttgtcaggctgagcagc

SEQ ID NO: 39269 - DNA, 30 bp, Homo sapiens
cagaggatcacgcaggccgagcagcagccc

SEQ ID NO: 39270 - DNA, 30 bp, Homo sapiens
ctccggcagggatgaatagttcatttgcct

SEQ ID NO: 39271 - DNA, 30 bp, Homo sapiens
tcttctcttcccggtctgtttttctccttg

SEQ ID NO: 39272 - DNA, 30 bp, Homo sapiens
acagcagaaacttgttcatcttcatcctcc

SEQ ID NO: 39273 - DNA, 30 bp, Homo sapiens
catggctccagctctcgggagaggcgggag

SEQ ID NO: 39274 - DNA, 30 bp, Homo sapiens
acgaggctctaatctgtgtgacatctgtga

SEQ ID NO: 39275 - DNA, 30 bp, Homo sapiens
ccgaggctcgatcctgtgtgagagctcaaa

SEQ ID NO: 39276 - DNA, 30 bp, Homo sapiens
tttagacttgaatcgcgtatagaagcagtt

SEQ ID NO: 39277 - DNA, 30 bp, Homo sapiens
atctggaagtcttctctgttttatgacacc

SEQ ID NO: 39278 - DNA, 30 bp, Homo sapiens
tttaggatggaatggctgcaaattatgcct

SEQ ID NO: 39279 - DNA, 30 bp, Homo sapiens
ctgtacttgaagtgacagttttataaactg

SEQ ID NO: 39280 - DNA, 30 bp, Homo sapiens
gcttgtaggagagctcgaagaggaggttct

SEQ ID NO: 39281 - DNA, 30 bp, Homo sapiens
gagtgcctcgtttccaggcttcagagaata

SEQ ID NO: 39282 - DNA, 30 bp, Homo sapiens
ctctggagagcttggtgttctggtctcttt

SEQ ID NO: 39283 - DNA, 30 bp, Homo sapiens
cttgaccctgtcttggctgcttcaggggcg

SEQ ID NO: 39284 - DNA, 30 bp, Homo sapiens
gccaggcttcatggatgagcggcggcagtt

SEQ ID NO: 39285 - DNA, 30 bp, Homo sapiens
cacggggagtgggtggccgggctgcttctg

SEQ ID NO: 39286 - DNA, 30 bp, Homo sapiens
gagtggtgactgactgaccccactgttttc

SEQ ID NO: 39287 - DNA, 30 bp, Homo sapiens
ttgccctggcccccaggaacctcatcctcg

SEQ ID NO: 39288 - DNA, 30 bp, Homo sapiens
tcagttccggaggcttcttctggtgtctgt

SEQ ID NO: 39289 - DNA, 30 bp, Homo sapiens
gcctcacactagtgagctgtgccaagtagt

SEQ ID NO: 39290 - DNA, 30 bp, Homo sapiens
ggcagggccttggagaaggcgaactgtcca

SEQ ID NO: 39291 - DNA, 30 bp, Homo sapiens
ttttggtatctcctaatcgcaaaagagcat

SEQ ID NO: 39292 - DNA, 30 bp, Homo sapiens
gacaggttttattcccaggatatcaaaccc

SEQ ID NO: 39293 - DNA, 30 bp, Homo sapiens
agtttcattccattggctaggacagaacgg

SEQ ID NO: 39294 - DNA, 30 bp, Homo sapiens
tacaggtgttattccaagaagtttcattcc

SEQ ID NO: 39295 - DNA, 30 bp, Homo sapiens
cattggtttttgtatactggttttgttttt

SEQ ID NO: 39296 - DNA, 30 bp, Homo sapiens
aattggattttccttgctcccatattttgc

SEQ ID NO: 39297 - DNA, 30 bp, Homo sapiens
aaatggaatgagtggaggtctcggactgct

SEQ ID NO: 39298 - DNA, 30 bp, Homo sapiens
gtctgcagctccaggaggcagttgggctct

SEQ ID NO: 39299 - DNA, 30 bp, Homo sapiens
taggggccaagggggcccagggccgccttc

SEQ ID NO: 39300 - DNA, 30 bp, Homo sapiens
agcagctgctgtttttgaattcaccattct

SEQ ID NO: 39301 - DNA, 30 bp, Homo sapiens
cgtaggaatggataatggtttcgaagacct

SEQ ID NO: 39302 - DNA, 30 bp, Homo sapiens
aggtggtgtctccattgaggcagggtgctt

SEQ ID NO: 39303 - DNA, 30 bp, Homo sapiens
ttgccgcagatgaccaggggcacgtccacg

SEQ ID NO: 39304 - DNA, 30 bp, Homo sapiens
tgatgacgcagcgctccttgtccttggcct

SEQ ID NO: 39305 - DNA, 30 bp, Homo sapiens
cactggatggtgcacttgtccctctcacgg

SEQ ID NO: 39306 - DNA, 30 bp, Homo sapiens
ctgtggtgactttttggaattggtcccggt

SEQ ID NO: 39307 - DNA, 30 bp, Homo sapiens
caggctctgttcagaagggtggtcctgagg

SEQ ID NO: 39308 - DNA, 30 bp, Homo sapiens
aagaggctcgaccttaaagacttccatctg

SEQ ID NO: 39309 - DNA, 30 bp, Homo sapiens
ctctgggctctcactttcgtaagaagccaa

SEQ ID NO: 39310 - DNA, 30 bp, Homo sapiens
aggtggggagttttggttctattcggagag

SEQ ID NO: 39311 - DNA, 30 bp, Homo sapiens
agcagggagtcgaggttcaatttttagtga

SEQ ID NO: 39312 - DNA, 30 bp, Homo sapiens
agcagatctttggctcccaatgagcaaagg

SEQ ID NO: 39313 - DNA, 30 bp, Homo sapiens
tccatttgagctaagacatgattgcttttt

SEQ ID NO: 39314 - DNA, 30 bp, Homo sapiens
cctccaccgtctgtacctcctcctcacgga

SEQ ID NO: 39315 - DNA, 30 bp, Homo sapiens
catcctgtctggtctcttctccttcatcct

SEQ ID NO: 39316 - DNA, 30 bp, Homo sapiens
gcttggaggatgcagttgatggtgggtcca

SEQ ID NO: 39317 - DNA, 30 bp, Homo sapiens
acgtggccacgggaggcccatggcgataat

SEQ ID NO: 39318 - DNA, 30 bp, Homo sapiens
atgaggctgcagcgcgcgggatgcagcgcc

SEQ ID NO: 39319 - DNA, 30 bp, Homo sapiens
tgatggcgcagcggttgcggcgcagcgcgc

SEQ ID NO: 39320 - DNA, 30 bp, Homo sapiens
tgcagagggggctttgactttgggagacag

SEQ ID NO: 39321 - DNA, 30 bp, Homo sapiens
agacggaggtgacagtcctcactttggcag

SEQ ID NO: 39322 - DNA, 30 bp, Homo sapiens
aagatcttgaagcccttcaggagagtcagg

SEQ ID NO: 39323 - DNA, 30 bp, Homo sapiens
ccaagggggcaggcgtgcagggcctcttgg

SEQ ID NO: 39324 - DNA, 30 bp, Homo sapiens
cacaagggattcgcacatgggcaaggagtc

SEQ ID NO: 39325 - DNA, 30 bp, Homo sapiens
tgctggggtctcggctatctcctccagcct

SEQ ID NO: 39326 - DNA, 30 bp, Homo sapiens
taatcaggcttccacacctcacggagggct

SEQ ID NO: 39327 - DNA, 30 bp, Homo sapiens
acttggcctccaccagctgctccaggcgct

SEQ ID NO: 39328 - DNA, 30 bp, Homo sapiens
acccaggtttgccctgggattctcttaagg

SEQ ID NO: 39329 - DNA, 30 bp, Homo sapiens
ggatggagaaggcatcccacttgtccgtcc

SEQ ID NO: 39330 - DNA, 30 bp, Homo sapiens
atgaggaaaatgcgagcattcttttcagaa

SEQ ID NO: 39331 - DNA, 30 bp, Homo sapiens
gcctggggctgggctgccagaggacaccac

SEQ ID NO: 39332 - DNA, 30 bp, Homo sapiens
catgggggccactgagtgccaggagggccc

SEQ ID NO: 39333 - DNA, 30 bp, Homo sapiens
gcttggagtggggctgggccaggtcctcac

SEQ ID NO: 39334 - DNA, 30 bp, Homo sapiens
tcaatgtctgcatgtgaggcctctatttca

SEQ ID NO: 39335 - DNA, 30 bp, Homo sapiens
ttcaggattaaaaccagatgagataggatt

SEQ ID NO: 39336 - DNA, 30 bp, Homo sapiens
ctcctactgttgtttcggagtcctgactgt

SEQ ID NO: 39337 - DNA, 30 bp, Homo sapiens
agaaaatcctcttccgcttcaggtaggagt

SEQ ID NO: 39338 - DNA, 30 bp, Homo sapiens
aatatgctcctgtgccctgagaatgctggt

SEQ ID NO: 39339 - DNA, 30 bp, Homo sapiens
tagagggcctgccacggcttcccgatggcc

SEQ ID NO: 39340 - DNA, 30 bp, Homo sapiens
atggggtcttgctgtgtcacccaggctggt

SEQ ID NO: 39341 - DNA, 30 bp, Homo sapiens
ttctcttccttgtttgaggtatccatgcta

SEQ ID NO: 39342 - DNA, 30 bp, Homo sapiens
tacggctttcactctgtaaaactttgtccc

SEQ ID NO: 39343 - DNA, 30 bp, Homo sapiens
tgaaggctgatctgtggtggaattttttcc

SEQ ID NO: 39344 - DNA, 30 bp, Homo sapiens
atccgggtggggagcggctttggcggtggg

SEQ ID NO: 39345 - DNA, 30 bp, Homo sapiens
tccttctggatccacgcttccttcagggtc

SEQ ID NO: 39346 - DNA, 30 bp, Homo sapiens
aagggctggctgagttccgcctgcacttta

SEQ ID NO: 39347 - DNA, 30 bp, Homo sapiens
gcactttacccttcgctgatccttccagag

SEQ ID NO: 39348 - DNA, 30 bp, Homo sapiens
ggccggcctgcttgcttcttcttggatttg

SEQ ID NO: 39349 - DNA, 30 bp, Homo sapiens
cgctggttcagttcgacttataacatatgt

SEQ ID NO: 39350 - DNA, 30 bp, Homo sapiens
ccacttcagtgcctgcatgtttcttatgct

SEQ ID NO: 39351 - DNA, 30 bp, Homo sapiens
ccctccagttcggatgtcgtgacatctgac

SEQ ID NO: 39352 - DNA, 30 bp, Homo sapiens
ttttggagaaaatattgcgttgtaaggctg

SEQ ID NO: 39353 - DNA, 30 bp, Homo sapiens
cccaggggctgctgttgggggagggactgt

SEQ ID NO: 39354 - DNA, 30 bp, Homo sapiens
tgctggtactttcagcaaagactttacaac

SEQ ID NO: 39355 - DNA, 30 bp, Homo sapiens
ctccgggtcgcctgggagaggcgggagacc

SEQ ID NO: 39356 - DNA, 30 bp, Homo sapiens
cagtggcagttctgacagcttgggtggcaa

SEQ ID NO: 39357 - DNA, 30 bp, Homo sapiens
gcccctgccacaccaggcccccgagccctt

SEQ ID NO: 39358 - DNA, 30 bp, Homo sapiens
actccctgcttgctccgcagctgtggccat

SEQ ID NO: 39359 - DNA, 30 bp, Homo sapiens
agcagaggcctggaagtgtgcagcttagct

SEQ ID NO: 39360 - DNA, 30 bp, Homo sapiens
cctcggtatatactagcctgcaatgaagaa

SEQ ID NO: 39361 - DNA, 30 bp, Homo sapiens
ccgtaggtgggggctggagcaagtgcgtgg

SEQ ID NO: 39362 - DNA, 30 bp, Homo sapiens
agtagggggcaaatcggctgtagccacctc

SEQ ID NO: 39363 - DNA, 30 bp, Homo sapiens
ctgtaggtcgccgcgggcccgatggtgtga

SEQ ID NO: 39364 - DNA, 30 bp, Homo sapiens
aagcggaaggtcttttttgtaagggtaaga

SEQ ID NO: 39365 - DNA, 30 bp, Homo sapiens
caccttaccttagaagggctgccattgaac

SEQ ID NO: 39366 - DNA, 30 bp, Homo sapiens
gtcgtttcagtaaaacgtcatcattttctt

SEQ ID NO: 39367 - DNA, 30 bp, Homo sapiens
cagtgggaaccacggtcattagctacatct

SEQ ID NO: 39368 - DNA, 30 bp, Homo sapiens
tcattagctacatcttggagacggcgtaat

SEQ ID NO: 39369 - DNA, 30 bp, Homo sapiens
cactgggcctcgttgaagcgggtcaccatt

SEQ ID NO: 39370 - DNA, 30 bp, Homo sapiens
ttttggctacattcgttgcctctgttgttg

SEQ ID NO: 39371 - DNA, 30 bp, Homo sapiens
ggcctgtcatttaagtcaatgacagcagct

SEQ ID NO: 39372 - DNA, 30 bp, Homo sapiens
aactggcctatcatttagatctttaatagc

SEQ ID NO: 39373 - DNA, 30 bp, Homo sapiens
atgcggcgctggtagccagagtgcatctga

SEQ ID NO: 39374 - DNA, 30 bp, Homo sapiens
agctggggctgcaacacagaacatcaccac

SEQ ID NO: 39375 - DNA, 30 bp, Homo sapiens
accacgtcacactcgatgacgcgtccgcgg

SEQ ID NO: 39376 - DNA, 30 bp, Homo sapiens
taacagggtcagcgccaagttttctctctt

SEQ ID NO: 39377 - DNA, 30 bp, Homo sapiens
cttcatccgctgttcaaccagttttgcacg

SEQ ID NO: 39378 - DNA, 30 bp, Homo sapiens
gttcttcttctagcttgcccaatgtcctta

SEQ ID NO: 39379 - DNA, 30 bp, Homo sapiens
ccaagaccctgaatttgtccaaattgtaga

SEQ ID NO: 39380 - DNA, 30 bp, Homo sapiens
tcttcgagatttccatgctgttctagaata

SEQ ID NO: 39381 - DNA, 30 bp, Homo sapiens
cacagctgaagggtctgctcctcgctgtcg

SEQ ID NO: 39382 - DNA, 30 bp, Homo sapiens
gaagcgtggcacgattccgctgtcctctgg

SEQ ID NO: 39383 - DNA, 30 bp, Homo sapiens
taggggctgctgtgttttccagcatgagct

SEQ ID NO: 39384 - DNA, 30 bp, Homo sapiens
aagaggctggagagctggaaacactgggag

SEQ ID NO: 39385 - DNA, 30 bp, Homo sapiens
attcggtctgtctgcagctgctgaggctgg

SEQ ID NO: 39386 - DNA, 30 bp, Homo sapiens
ctggggtgaactatgagccataaccttaga

SEQ ID NO: 39387 - DNA, 30 bp, Homo sapiens
acgagattcattgtcctcttcttcttcatc

SEQ ID NO: 39388 - DNA, 30 bp, Homo sapiens
gcgagactcatattcatcttcatcttcatc

SEQ ID NO: 39389 - DNA, 30 bp, Homo sapiens
gctcctctttgcaagaggtgctcctttaga

SEQ ID NO: 39390 - DNA, 30 bp, Homo sapiens
gagtagcggtcataaccaccctggtttctg

SEQ ID NO: 39391 - DNA, 30 bp, Homo sapiens
atcagggccacatttatgtgggacaaatct

SEQ ID NO: 39392 - DNA, 30 bp, Homo sapiens
ttcttctgtcctttcttcttcgttttaagg

SEQ ID NO: 39393 - DNA, 30 bp, Homo sapiens
actgcatcctgtcaggctgcagctgcggcg

SEQ ID NO: 39394 - DNA, 30 bp, Homo sapiens
tggaggctccgcggcttggcgcccagatat

SEQ ID NO: 39395 - DNA, 30 bp, Homo sapiens
tcgtctacttggaaccagtagctgtgttgc

SEQ ID NO: 39396 - DNA, 30 bp, Homo sapiens
ccgatcggcatactgctcccgctcataccg

SEQ ID NO: 39397 - DNA, 30 bp, Homo sapiens
tcctggactccaaaattaaattgcagttct

SEQ ID NO: 39398 - DNA, 30 bp, Homo sapiens
tgatggcctccactgcatcctctgcccgct

SEQ ID NO: 39399 - DNA, 30 bp, Homo sapiens
atttctgtagtgctacctgtagcacatgat

SEQ ID NO: 39400 - DNA, 30 bp, Homo sapiens
gcacatgatatgagagaagtcgcttggaga

SEQ ID NO: 39401 - DNA, 30 bp, Homo sapiens
ctcaggcccagcttcttcttttccttctgc

SEQ ID NO: 39402 - DNA, 30 bp, Homo sapiens
aacaggtaagtgtcagaagaagatcctata

SEQ ID NO: 39403 - DNA, 30 bp, Homo sapiens
tggaagcagagtttttcagaagagatgaag

SEQ ID NO: 39404 - DNA, 30 bp, Homo sapiens
taactttaagtctcaccccattcagaatct

SEQ ID NO: 39405 - DNA, 30 bp, Homo sapiens
gaaaggacccaaatgaagtaatgtaaactg

SEQ ID NO: 39406 - DNA, 30 bp, Homo sapiens
gattggagatacatagccgctgtccaacat

SEQ ID NO: 39407 - DNA, 30 bp, Homo sapiens
tcttctacacaggtccaggctgaagagatt

SEQ ID NO: 39408 - DNA, 30 bp, Homo sapiens
tatgtctggtagacgtcggggatggggacc

SEQ ID NO: 39409 - DNA, 30 bp, Homo sapiens
ttctggcttgtcctctggaggctttggcac

SEQ ID NO: 39410 - DNA, 30 bp, Homo sapiens
aactctgtgttgtcaaggcccctgatggcc

SEQ ID NO: 39411 - DNA, 30 bp, Homo sapiens
accgggctcggtccacatactgctcccgtt

SEQ ID NO: 39412 - DNA, 30 bp, Homo sapiens
cagtgaaccgggcaaacatggctttccgga

SEQ ID NO: 39413 - DNA, 30 bp, Homo sapiens
tctcggtaagtctcgttggactgtcttttg

SEQ ID NO: 39414 - DNA, 30 bp, Homo sapiens
tccatctctactactgtctcttctgttatc

SEQ ID NO: 39415 - DNA, 30 bp, Homo sapiens
agcgacgtctccggtctggacttctgctgc

SEQ ID NO: 39416 - DNA, 30 bp, Homo sapiens
gctgttgaccacttgcctcctcaacaggaa

SEQ ID NO: 39417 - DNA, 30 bp, Homo sapiens
aactggaaagaatagaccccatgctctgag

SEQ ID NO: 39418 - DNA, 30 bp, Homo sapiens
tgcaggtgcatgttcgttggatgtgtccac

SEQ ID NO: 39419 - DNA, 30 bp, Homo sapiens
tgttggtaagaatatgcaggtgcatgttcg

SEQ ID NO: 39420 - DNA, 30 bp, Homo sapiens
ccataatgagcaaaatcaccaaccataact

SEQ ID NO: 39421 - DNA, 30 bp, Homo sapiens
caacggtcactgggattcgaagactcccgc

SEQ ID NO: 39422 - DNA, 30 bp, Homo sapiens
cctctatcagatcggcttcctccagggcca

SEQ ID NO: 39423 - DNA, 30 bp, Homo sapiens
tagtatctgctccggccttcccccctctcg

SEQ ID NO: 39424 - DNA, 30 bp, Homo sapiens
gcgtggcaggtgcttccaccataagacatc

SEQ ID NO: 39425 - DNA, 30 bp, Homo sapiens
tcagatcgactctccccaccatctactata

SEQ ID NO: 39426 - DNA, 30 bp, Homo sapiens
tgcaccttcttgaatacttgcttgcagacc

SEQ ID NO: 39427 - DNA, 30 bp, Homo sapiens
aagaggaaaagccagtttcactcatgcact

SEQ ID NO: 39428 - DNA, 30 bp, Homo sapiens
acttgcggtcatctatgcctgtcagatcct

SEQ ID NO: 39429 - DNA, 30 bp, Homo sapiens
acctggtcaccacaggtcagctccaggtac

SEQ ID NO: 39430 - DNA, 30 bp, Homo sapiens
tacaggtggtcctgcaggcctgggctccgc

SEQ ID NO: 39431 - DNA, 30 bp, Homo sapiens
tggacgatcagcctgtactgcctggccagg

SEQ ID NO: 39432 - DNA, 30 bp, Homo sapiens
caaactgcacagtgtagtttcggaaggtgc

SEQ ID NO: 39433 - DNA, 30 bp, Homo sapiens
atctgaccttcctgaagacctgctcgcaca

SEQ ID NO: 39434 - DNA, 30 bp, Homo sapiens
ctctggaatgtctgtttgcacacttgacct

SEQ ID NO: 39435 - DNA, 30 bp, Homo sapiens
ctgtggctgtagatgatgtgacactggttg

SEQ ID NO: 39436 - DNA, 30 bp, Homo sapiens
cgtcggcgcgcaccaggctcatggggattg

SEQ ID NO: 39437 - DNA, 30 bp, Homo sapiens
gtctggatgaagaggtggaagttggtgcgc

SEQ ID NO: 39438 - DNA, 30 bp, Homo sapiens
tgctggtctgcagtaggttggtatgttaca

SEQ ID NO: 39439 - DNA, 30 bp, Homo sapiens
tgacgggacttccagccctgagaagtagcc

SEQ ID NO: 39440 - DNA, 30 bp, Homo sapiens
caggctggcactatcaggagacggagcgct

SEQ ID NO: 39441 - DNA, 30 bp, Homo sapiens
ttgctgggtggtgtcagaggaagggtacca

SEQ ID NO: 39442 - DNA, 30 bp, Homo sapiens
ttctgcttggccagggtgtgcttcagctcc

SEQ ID NO: 39443 - DNA, 30 bp, Homo sapiens
ctctgttgtccaatggacacacctgtcgtg

SEQ ID NO: 39444 - DNA, 30 bp, Homo sapiens
ctctgggagtcattattatcccctcctccc

SEQ ID NO: 39445 - DNA, 30 bp, Homo sapiens
taatggtataaccaagatgcagcagcagaa

SEQ ID NO: 39446 - DNA, 30 bp, Homo sapiens
agctgttaaccatcttcccatttgcaacag

SEQ ID NO: 39447 - DNA, 30 bp, Homo sapiens
tcctcttctctaggcacttcaagtggggaa

SEQ ID NO: 39448 - DNA, 30 bp, Homo sapiens
cagctgaggtggatcggcgtgtactccggc

SEQ ID NO: 39449 - DNA, 30 bp, Homo sapiens
tgcaggtggtgccaagaggcaggcatgctc

SEQ ID NO: 39450 - DNA, 30 bp, Homo sapiens
agttggacacggagggtggcaggccaggac

SEQ ID NO: 39451 - DNA, 30 bp, Homo sapiens
agcgcgcaatcaaaggtctggggctcattc

SEQ ID NO: 39452 - DNA, 30 bp, Homo sapiens
ctgcggtcggagggtcggggcgcctcgtct

SEQ ID NO: 39453 - DNA, 30 bp, Homo sapiens
taaaggctccacatttactggctttagcaa

SEQ ID NO: 39454 - DNA, 30 bp, Homo sapiens
acaggaggcgccacgagacggcgggagtgg

SEQ ID NO: 39455 - DNA, 30 bp, Homo sapiens
catcatatctgactgcagcagagaatagcg

SEQ ID NO: 39456 - DNA, 30 bp, Homo sapiens
cagtggacgtaccctctggacacggatgcc

SEQ ID NO: 39457 - DNA, 30 bp, Homo sapiens
ctgcttgctttgctgataaagttcttcagg

SEQ ID NO: 39458 - DNA, 30 bp, Homo sapiens
tgcaggagaagtgggtgaggtgcgggagga

SEQ ID NO: 39459 - DNA, 30 bp, Homo sapiens
tgctggcccccgctggacacagataagacc

SEQ ID NO: 39460 - DNA, 30 bp, Homo sapiens
cagaggagtgggcctgttgtcttggcgctg

SEQ ID NO: 39461 - DNA, 30 bp, Homo sapiens
acttggccagggtcaccatgtggtccacgc

SEQ ID NO: 39462 - DNA, 30 bp, Homo sapiens
ctgtggccatgtatcgtttaacactgcaca

SEQ ID NO: 39463 - DNA, 30 bp, Homo sapiens
cagagggttcgggggttgtattctggcagt

SEQ ID NO: 39464 - DNA, 30 bp, Homo sapiens
ctccacagcatacacgtaggtgttccacgg

SEQ ID NO: 39465 - DNA, 30 bp, Homo sapiens
cacaggggagcctctgagtcccctgcccgc

SEQ ID NO: 39466 - DNA, 30 bp, Homo sapiens
aaattctacgtcctccagcttgagcagtat

SEQ ID NO: 39467 - DNA, 30 bp, Homo sapiens
ttgagggtcttgctaaggttggagaaacca

SEQ ID NO: 39468 - DNA, 30 bp, Homo sapiens
aattggtagcttggcttccgacaaacatgt

SEQ ID NO: 39469 - DNA, 30 bp, Homo sapiens
tctgtggcttcactggtgagaaacaagtcc

SEQ ID NO: 39470 - DNA, 30 bp, Homo sapiens
tcgtggtgccgggtcaggtcctcgccatag

SEQ ID NO: 39471 - DNA, 30 bp, Homo sapiens
aggaggcagatgcatatctgacatccagaa

SEQ ID NO: 39472 - DNA, 30 bp, Homo sapiens
gtgagggtgctgggggctccagaggggttc

SEQ ID NO: 39473 - DNA, 30 bp, Homo sapiens
agcagggcgaataagaggtggtggaggctg

SEQ ID NO: 39474 - DNA, 30 bp, Homo sapiens
acaaacacacctcctcttcttcatcagtgc

SEQ ID NO: 39475 - DNA, 30 bp, Homo sapiens
agtgatggtggctgttgaccaccaaccgtg

SEQ ID NO: 39476 - DNA, 30 bp, Homo sapiens
tcctggacaggagtgtcatcctccggcttg

SEQ ID NO: 39477 - DNA, 30 bp, Homo sapiens
ctttttgaggctcaaactggatcagtcgca

SEQ ID NO: 39478 - DNA, 30 bp, Homo sapiens
agtcggctttgggcgcccggaattcgggca

SEQ ID NO: 39479 - DNA, 30 bp, Homo sapiens
ggtaggttccatattctgtgtgagaacact

SEQ ID NO: 39480 - DNA, 30 bp, Homo sapiens
cctaggaaccgatacatgcacacaactgct

SEQ ID NO: 39481 - DNA, 30 bp, Homo sapiens
agtctattgggaggcccagcaggtcacaac

SEQ ID NO: 39482 - DNA, 30 bp, Homo sapiens
actcccaccggattcctagaagctcacagc

SEQ ID NO: 39483 - DNA, 30 bp, Homo sapiens
atctggggaggggctgctccctcacagagg

SEQ ID NO: 39484 - DNA, 30 bp, Homo sapiens
ttagcaggccaaccatcacttcactgatat

SEQ ID NO: 39485 - DNA, 30 bp, Homo sapiens
ccttggccgggcttggagagacccagtaca

SEQ ID NO: 39486 - DNA, 30 bp, Homo sapiens
gcttgggcaggcttgggaaggacccaggtg

SEQ ID NO: 39487 - DNA, 30 bp, Homo sapiens
tcttggccgcacccgcgttgggaggcagcc

SEQ ID NO: 39488 - DNA, 30 bp, Homo sapiens
tcaaggatgatcaagacagtcttacctaga

SEQ ID NO: 39489 - DNA, 30 bp, Homo sapiens
ttctggcagcctgaactcttcctcctccaa

SEQ ID NO: 39490 - DNA, 30 bp, Homo sapiens
ataaggaatgataatggtccttgatgatcc

SEQ ID NO: 39491 - DNA, 30 bp, Homo sapiens
cgaatctgtcgcagagtcttgtacttatca

SEQ ID NO: 39492 - DNA, 30 bp, Homo sapiens
ctttggcaagagcgcatctggaacaatgca

SEQ ID NO: 39493 - DNA, 30 bp, Homo sapiens
agctttttcagttccttttctacctcttcc

SEQ ID NO: 39494 - DNA, 30 bp, Homo sapiens
cagtggaatctgggccccggctggatcagg

SEQ ID NO: 39495 - DNA, 30 bp, Homo sapiens
ggttcctcattggataagattgagtataat

SEQ ID NO: 39496 - DNA, 30 bp, Homo sapiens
caagtgcaaggcaaggcccaagctgagggg

SEQ ID NO: 39497 - DNA, 30 bp, Homo sapiens
tctaggtgaagaaaatggattccaggatgt

SEQ ID NO: 39498 - DNA, 30 bp, Homo sapiens
tgctgaagcatgtttgcagccttcttctgg

SEQ ID NO: 39499 - DNA, 30 bp, Homo sapiens
cagcgggccacctgcaggagctcttccgtg

SEQ ID NO: 39500 - DNA, 30 bp, Homo sapiens
ctctgggggccacacaggccatgccagtca

SEQ ID NO: 39501 - DNA, 30 bp, Homo sapiens
gcctggacacaacctgactacaccaagcag

SEQ ID NO: 39502 - DNA, 30 bp, Homo sapiens
ttcttcacagaaggtcaccagggcatcaaa

SEQ ID NO: 39503 - DNA, 30 bp, Homo sapiens
aggcggtgcctgagctgctagcgctctcag

SEQ ID NO: 39504 - DNA, 30 bp, Homo sapiens
acgtggtttcggtggccgaggatgaggtac

SEQ ID NO: 39505 - DNA, 30 bp, Homo sapiens
ccagaggtcttcttcttgggccgggtcttc

SEQ ID NO: 39506 - DNA, 30 bp, Homo sapiens
tgcggcctttggtggttttcacagatttca

SEQ ID NO: 39507 - DNA, 30 bp, Homo sapiens
taggggcttctctcggggccgggctggcgc

SEQ ID NO: 39508 - DNA, 30 bp, Homo sapiens
ctgtccacgtctgagggcacagtctttttc

SEQ ID NO: 39509 - DNA, 30 bp, Homo sapiens
accatcagcaggagtcaggagggtggggcc

SEQ ID NO: 39510 - DNA, 30 bp, Homo sapiens
aaattcacggtagctttcttcgcttcttta

SEQ ID NO: 39511 - DNA, 30 bp, Homo sapiens
agcaggccaggtgtttcaggcaccagtagt

SEQ ID NO: 39512 - DNA, 30 bp, Homo sapiens
tacgggccaggacctgcaagacgttcctgg

SEQ ID NO: 39513 - DNA, 30 bp, Homo sapiens
gtttttgaacttgcagacaaaggagaactt

SEQ ID NO: 39514 - DNA, 30 bp, Homo sapiens
catgaagtcaggcttgcacagtagccagca

SEQ ID NO: 39515 - DNA, 30 bp, Homo sapiens
catagggtaacctcacattacagttataat

SEQ ID NO: 39516 - DNA, 30 bp, Homo sapiens
tccttgaacttgcagacatagggtaacttt

SEQ ID NO: 39517 - DNA, 30 bp, Homo sapiens
tatccgtatgtgcttgtagcccatctaggg

SEQ ID NO: 39518 - DNA, 30 bp, Homo sapiens
ggtcggtacttgcacaggaagtgttggcgc

SEQ ID NO: 39519 - DNA, 30 bp, Homo sapiens
ctgtttggattagtactgtttgatggtccc

SEQ ID NO: 39520 - DNA, 30 bp, Homo sapiens
taggagctgatctgactcagcagggctgag

SEQ ID NO: 39521 - DNA, 30 bp, Homo sapiens
acgtggcttcaggccccggggataggaggc

SEQ ID NO: 39522 - DNA, 30 bp, Homo sapiens
cgttctctcttcacaggtgttgccggcacc

SEQ ID NO: 39523 - DNA, 30 bp, Homo sapiens
tccctgtggtagagacacctggtgatcaga

SEQ ID NO: 39524 - DNA, 30 bp, Homo sapiens
tgaccttcgtcttctgttgtagaaatgtct

SEQ ID NO: 39525 - DNA, 30 bp, Homo sapiens
agatgaccaggttgctctcacttagccgga

SEQ ID NO: 39526 - DNA, 30 bp, Homo sapiens
gcacggccagattgtggcaggacttggagc

SEQ ID NO: 39527 - DNA, 30 bp, Homo sapiens
gagaggtcgtgacacgacctggagcgctgc

SEQ ID NO: 39528 - DNA, 30 bp, Homo sapiens
cagcgggccaaggcgaagccaatgcggttg

SEQ ID NO: 39529 - DNA, 30 bp, Homo sapiens
ttccgcgcctcggcaggcgggggtgggggc

SEQ ID NO: 39530 - DNA, 30 bp, Homo sapiens
cagagaatgctgatataaaccttgcccacc

SEQ ID NO: 39531 - DNA, 30 bp, Homo sapiens
cagacatcgtgcttcttctggtgggccagg

SEQ ID NO: 39532 - DNA, 30 bp, Homo sapiens
tataggtgagagaatggtcgaagttgttcc

SEQ ID NO: 39533 - DNA, 30 bp, Homo sapiens
gaccggacgaagttgttccaattggttttc

SEQ ID NO: 39534 - DNA, 30 bp, Homo sapiens
agctggcgaaggccttgccggcatcctcct

SEQ ID NO: 39535 - DNA, 30 bp, Homo sapiens
ttggtaggtggccaccatgcatgtgggggt

SEQ ID NO: 39536 - DNA, 30 bp, Homo sapiens
tactgattttggtgagcatcttgttaatgg

SEQ ID NO: 39537 - DNA, 30 bp, Homo sapiens
atttagatccactgggacgtctcttttctt

SEQ ID NO: 39538 - DNA, 30 bp, Homo sapiens
cacagggttgcggcccacagtaggaagtgg

SEQ ID NO: 39539 - DNA, 30 bp, Homo sapiens
cttgagctgcttcttcaagatagtacacat

SEQ ID NO: 39540 - DNA, 30 bp, Homo sapiens
attttgccgctgagggtgaaagcatccagt

SEQ ID NO: 39541 - DNA, 30 bp, Homo sapiens
ggaagggagggctcgagggaggggggcatt

SEQ ID NO: 39542 - DNA, 30 bp, Homo sapiens
ggctgcacacgacagcagcgcgctccggtc

SEQ ID NO: 39543 - DNA, 30 bp, Homo sapiens
caggtcaggtggcagcagcgggcagtggtc

SEQ ID NO: 39544 - DNA, 30 bp, Homo sapiens
agcagatttgaaaggaaacctgaagacttc

SEQ ID NO: 39545 - DNA, 30 bp, Homo sapiens
ccacggcctgagcttcttggtctgactgta

SEQ ID NO: 39546 - DNA, 30 bp, Homo sapiens
cagtggctcctagaactggcagggtccagc

SEQ ID NO: 39547 - DNA, 30 bp, Homo sapiens
gcccggatcctagaatcaagattcttaagg

SEQ ID NO: 39548 - DNA, 30 bp, Homo sapiens
acctggacattgtcaagaataaagtcaaat

SEQ ID NO: 39549 - DNA, 30 bp, Homo sapiens
tgccggagatatggtgccttggacaattct

SEQ ID NO: 39550 - DNA, 30 bp, Homo sapiens
actcggcagattccgcatcaaacctaaggt

SEQ ID NO: 39551 - DNA, 30 bp, Homo sapiens
gcttggtcttggcgtcttctcgaaccttcc

SEQ ID NO: 39552 - DNA, 30 bp, Homo sapiens
tcacggtcttctcattttccccattttcta

SEQ ID NO: 39553 - DNA, 30 bp, Homo sapiens
cagtggtctggagcagtcagcagggggcgc

SEQ ID NO: 39554 - DNA, 30 bp, Homo sapiens
cacgaacacaggcctgggccagcgctttct

SEQ ID NO: 39555 - DNA, 30 bp, Homo sapiens
ccttttctgggctccttatctttttctggt

SEQ ID NO: 39556 - DNA, 30 bp, Homo sapiens
aactggccaccggggccattgtcttctgac

SEQ ID NO: 39557 - DNA, 30 bp, Homo sapiens
aatatgtcacagcttcttgattcctcctta

SEQ ID NO: 39558 - DNA, 30 bp, Homo sapiens
aatccatcctccatgaacttcttataaagt

SEQ ID NO: 39559 - DNA, 30 bp, Homo sapiens
caaaggctgatgagttgcaaatgttcatca

SEQ ID NO: 39560 - DNA, 30 bp, Homo sapiens
caacaatcaggtctctggtgacttgaaatg

SEQ ID NO: 39561 - DNA, 30 bp, Homo sapiens
cagtggcataaaaatcagagtcacacttaa

SEQ ID NO: 39562 - DNA, 30 bp, Homo sapiens
gaccggaagacatgcacagctcggattaca

SEQ ID NO: 39563 - DNA, 30 bp, Homo sapiens
ctcaggtagccaacaatggccacattgagg

SEQ ID NO: 39564 - DNA, 30 bp, Homo sapiens
gagaggtcgtcgctgcccgggagctccgcg

SEQ ID NO: 39565 - DNA, 30 bp, Homo sapiens
gagaggtcggggcgccctgtttctgcctgg

SEQ ID NO: 39566 - DNA, 30 bp, Homo sapiens
atttggcctccccaggatggactggagcat

SEQ ID NO: 39567 - DNA, 30 bp, Homo sapiens
atttggcctccccaggacggactggagcat

SEQ ID NO: 39568 - DNA, 30 bp, Homo sapiens; identical to SEQ ID NO: 39567

SEQ ID NO: 39569 - DNA, 30 bp, Homo sapiens
gaagaaactggggcactggcagtggatgga

SEQ ID NO: 39570 - DNA, 30 bp, Homo sapiens
catgggcagatggtcaggacgttgccactc

SEQ ID NO: 39571 - DNA, 30 bp, Homo sapiens
gtctgggcacacctaactgagtcctgagga

SEQ ID NO: 39572 - DNA, 30 bp, Homo sapiens
caagctctctgacttcctcagcatccccgt

SEQ ID NO: 39573 - DNA, 30 bp, Homo sapiens
tcactccatcttcctgatcaaactgtccgt

SEQ ID NO: 39574 - DNA, 30 bp, Homo sapiens
ataccaattctagcaccttaattgtaccct

SEQ ID NO: 39575 - DNA, 30 bp, Homo sapiens
tatagatgtggaccatcttctctgttaagg

SEQ ID NO: 39576 - DNA, 30 bp, Homo sapiens
agctggagggcagcgcctgcacgaagaggc

SEQ ID NO: 39577 - DNA, 30 bp, Homo sapiens
tgcagggagtggttggggtcactgcgctcc

SEQ ID NO: 39578 - DNA, 30 bp, Homo sapiens
aattggaaaagatgttgattctgacctcga

SEQ ID NO: 39579 - DNA, 30 bp, Homo sapiens
tccctcctggctctgaggctgacttggtta

SEQ ID NO: 39580 - DNA, 30 bp, Homo sapiens
tgtaggtatttcctgtagcgctgcactgtc

SEQ ID NO: 39581 - DNA, 30 bp, Homo sapiens
ctgtagaggcctctccgttgatgtaagcaa

SEQ ID NO: 39582 - DNA, 30 bp, Homo sapiens
catgggggtgttgcttttgggtctttatgc

SEQ ID NO: 39583 - DNA, 30 bp, Homo sapiens
gctgctgttcccatgaacacagtgttgata

SEQ ID NO: 39584 - DNA, 30 bp, Homo sapiens
tttcaacagtaggatggtccttgctttcta

SEQ ID NO: 39585 - DNA, 30 bp, Homo sapiens
tttagggttatgagggcttcttgtcccata

SEQ ID NO: 39586 - DNA, 30 bp, Homo sapiens
ctcagggtcagcgggcaccaggttgctctg

SEQ ID NO: 39587 - DNA, 30 bp, Homo sapiens
cattgatgttcctggaaactgctgttgtct

SEQ ID NO: 39588 - DNA, 30 bp, Homo sapiens
tgaaggcttctagctcttttgtgtctccta

SEQ ID NO: 39589 - DNA, 30 bp, Homo sapiens
cagagggtgattttgctgtgtctgttactc

SEQ ID NO: 39590 - DNA, 30 bp, Homo sapiens
cagaacagtgcccgtgcaatcttcctccct

SEQ ID NO: 39591 - DNA, 30 bp, Homo sapiens
gcttggggagacagacagagtgttccgggt

SEQ ID NO: 39592 - DNA, 30 bp, Homo sapiens
tacgggttttcgggctccagctggcaggac

SEQ ID NO: 39593 - DNA, 30 bp, Homo sapiens
tgactcacaaaagtcccatggcctgatcct

SEQ ID NO: 39594 - DNA, 30 bp, Homo sapiens
cacagggagcagggccaggagcgggacgag

SEQ ID NO: 39595 - DNA, 30 bp, Homo sapiens
caaaaacacgataaggatcaagcaggtgag

SEQ ID NO: 39596 - DNA, 30 bp, Homo sapiens
cccgcataggagtagggagcaattcctttg

SEQ ID NO: 39597 - DNA, 30 bp, Homo sapiens
agatggttatggtgctggtgctggggcctg

SEQ ID NO: 39598 - DNA, 30 bp, Homo sapiens
gcaaccgcagcaagttttcccttttcttca

SEQ ID NO: 39599 - DNA, 30 bp, Homo sapiens
gaacgggaagcattttcttcctcatcttga

SEQ ID NO: 39600 - DNA, 30 bp, Homo sapiens
tcttggctctcgccctttcagtgccacaaa

SEQ ID NO: 39601 - DNA, 30 bp, Homo sapiens
gaacgggaaggattttcttcctcatcttga

SEQ ID NO: 39602 - DNA, 30 bp, Homo sapiens
acttggttcggtccttctccctcttctgcg

SEQ ID NO: 39603 - DNA, 30 bp, Homo sapiens
actttaggctattagcctgcaggtcattta

SEQ ID NO: 39604 - DNA, 30 bp, Homo sapiens
atcaggcaaatcttcttcctcttcctcggt

SEQ ID NO: 39605 - DNA, 30 bp, Homo sapiens
ggccaccccatctccacccccagggccaca

SEQ ID NO: 39606 - DNA, 30 bp, Homo sapiens
acctggaggtacctggtctggaaggtcctg

SEQ ID NO: 39607 - DNA, 30 bp, Homo sapiens
cgaaggtggcgtggtgagcgctggtcttgg

SEQ ID NO: 39608 - DNA, 30 bp, Homo sapiens
tgttggactgcatagttttcaaaagttttt

SEQ ID NO: 39609 - DNA, 30 bp, Homo sapiens
cagagggctgagtcggtggtggagttcaag

SEQ ID NO: 39610 - DNA, 30 bp, Homo sapiens
gtgagggctcgtccaggctgcagctggaca

SEQ ID NO: 39611 - DNA, 30 bp, Homo sapiens
gtactttcaacaaatgacttataaatttga

SEQ ID NO: 39612 - DNA, 30 bp, Homo sapiens
ggcaacatctgattgtacatcttggaattc

SEQ ID NO: 39613 - DNA, 30 bp, Homo sapiens
cctcggaggaggactgtgatggcccctgca

SEQ ID NO: 39614 - DNA, 30 bp, Homo sapiens
ctgtggtgatttgtggctttttacacaagt

SEQ ID NO: 39615 - DNA, 30 bp, Homo sapiens
aggactgaagcaagtccttatagacagcag

SEQ ID NO: 39616 - DNA, 30 bp, Homo sapiens
aaaaaagggagccattttttatgatttgga

SEQ ID NO: 39617 - DNA, 30 bp, Homo sapiens
ctaaggcttctatatactttgagtagcacc

SEQ ID NO: 39618 - DNA, 30 bp, Homo sapiens
aagcgggggactcatcttcttctggttaat

SEQ ID NO: 39619 - DNA, 30 bp, Homo sapiens
agagtctgtcctggtgaggtaaagcttcta

SEQ ID NO: 39620 - DNA, 30 bp, Homo sapiens
ctgagggaccagggaagcacagtctgctga

SEQ ID NO: 39621 - DNA, 30 bp, Homo sapiens
caaagcaggttattgtaggctctagcatgt

SEQ ID NO: 39622 - DNA, 30 bp, Homo sapiens
tattgaaatggcttgtgtacagagcacaca

SEQ ID NO: 39623 - DNA, 30 bp, Homo sapiens
aaaactcagagcgcacaaagcgaggcagag

SEQ ID NO: 39624 - DNA, 30 bp, Homo sapiens
agcgagtggagtgttggaatacaacttctt

SEQ ID NO: 39625 - DNA, 30 bp, Homo sapiens
aggaggactgcatcaggcccgtgaggcgct

SEQ ID NO: 39626 - DNA, 30 bp, Homo sapiens
agtaagactgagcaaggcttgttaacctct

SEQ ID NO: 39627 - DNA, 30 bp, Homo sapiens
tgctggccctcagtgttggtgtacagtttt

SEQ ID NO: 39628 - DNA, 30 bp, Homo sapiens
agcttgagatgagacaacacagcccaaaga

SEQ ID NO: 39629 - DNA, 30 bp, Homo sapiens
aaaaggtttttcatttctctcatgtctttc

SEQ ID NO: 39630 - DNA, 30 bp, Homo sapiens
ctctggctttgggacagcagatctaagtac

SEQ ID NO: 39631 - DNA, 30 bp, Homo sapiens
ttttggagttggctcctgcggtccagcttg

SEQ ID NO: 39632 - DNA, 30 bp, Homo sapiens
tacaggctctcccaggggcagatgacctcc

SEQ ID NO: 39633 - DNA, 30 bp, Homo sapiens
gctcagcttcgccacgcacacggctagggc

SEQ ID NO: 39634 - DNA, 30 bp, Homo sapiens
acgggatgcagctgcatggcagataccacg

SEQ ID NO: 39635 - DNA, 30 bp, Homo sapiens
cttagggaccttccaataaacagaatcatc

SEQ ID NO: 39636 - DNA, 30 bp, Homo sapiens
cactggctatcgaatctgtgaagccgctgt

SEQ ID NO: 39637 - DNA, 30 bp, Homo sapiens
gcatggggaccctggaggactccttggagc

SEQ ID NO: 39638 - DNA, 30 bp, Homo sapiens
gggaggcccaggaccctcggagtgggcagg

SEQ ID NO: 39639 - DNA, 30 bp, Homo sapiens
cagtggagctgagcgtccagttcgtacttc

SEQ ID NO: 39640 - DNA, 30 bp, Homo sapiens
acctggtccagctcatacttctcgcagaag

SEQ ID NO: 39641 - DNA, 30 bp, Homo sapiens
agggcggtggggggatgtgggcgcccagca

SEQ ID NO: 39642 - DNA, 30 bp, Homo sapiens
tgctggagataggaaaatgttgaaaaacac

SEQ ID NO: 39643 - DNA, 30 bp, Homo sapiens
caggggggaggcggcagctttaagtccagc

SEQ ID NO: 39644 - DNA, 30 bp, Homo sapiens
tgtctgcctcctccaccctcagaggtctct

SEQ ID NO: 39645 - DNA, 30 bp, Homo sapiens
gaggtgctttccatattttgagatttagga

SEQ ID NO: 39646 - DNA, 30 bp, Homo sapiens
atgaggaaacttccagaaaacttggtcatc

SEQ ID NO: 39647 - DNA, 30 bp, Homo sapiens
gtaccaagggtaccgaggaagccatgggta

SEQ ID NO: 39648 - DNA, 30 bp, Homo sapiens
cgatggccaagctgagttccccaatgctga

SEQ ID NO: 39649 - DNA, 30 bp, Homo sapiens
agagtggcagagaaaggattcaactccatt

SEQ ID NO: 39650 - DNA, 30 bp, Homo sapiens
tgcaggcaacagtgagaggaagttgtcttg

SEQ ID NO: 39651 - DNA, 30 bp, Homo sapiens
atgaagacttgccttgtgaagctgccccgt

SEQ ID NO: 39652 - DNA, 30 bp, Homo sapiens
agatggcagcgacgctcttgcccataggaa

SEQ ID NO: 39653 - DNA, 30 bp, Homo sapiens
acaaggaattggcttctgctcagcttccct

SEQ ID NO: 39654 - DNA, 30 bp, Homo sapiens
ggccggggccacctggctcgtctccgtctt

SEQ ID NO: 39655 - DNA, 30 bp, Homo sapiens
acaaggcacccagattttttcttcccacgt

SEQ ID NO: 39656 - DNA, 30 bp, Homo sapiens
caccggctcctgggtgtggtagtgggcgcc

SEQ ID NO: 39657 - DNA, 30 bp, Homo sapiens
ttgtgtgctcatcattccgaagatccttct

SEQ ID NO: 39658 - DNA, 30 bp, Homo sapiens
tagcaccttgcagcagttgatgcagccgtt

SEQ ID NO: 39659 - DNA, 30 bp, Homo sapiens
caggccactgctggagatgaattccagaag

SEQ ID NO: 39660 - DNA, 30 bp, Homo sapiens
ccgaggaggaagatggggatgaggaggagg

SEQ ID NO: 39661 - DNA, 30 bp, Homo sapiens
tacattactaagcaacgacatttccgggag

SEQ ID NO: 39662 - DNA, 30 bp, Homo sapiens
gaatgggacagcccctccgacgcttgttct

SEQ ID NO: 39663 - DNA, 30 bp, Homo sapiens
aggtcaccacgcaaaagccctgggtaatcc

SEQ ID NO: 39664 - DNA, 30 bp, Homo sapiens
agcaggcagagccggcgcttcttctgccgt

SEQ ID NO: 39665 - DNA, 30 bp, Homo sapiens
aagaggatgcaggaccgcccacgcttgatc

SEQ ID NO: 39666 - DNA, 30 bp, Homo sapiens
tgatggagaagagcctccttctgtttcgtc

SEQ ID NO: 39667 - DNA, 30 bp, Homo sapiens
ataattgaacagcagctgtgaccctcagaa

SEQ ID NO: 39668 - DNA, 30 bp, Homo sapiens
ttctgggttaaagctgaacattccacatag

SEQ ID NO: 39669 - DNA, 30 bp, Homo sapiens
ctgcaaaaacagtagcaccaaaacttgctc

SEQ ID NO: 39670 - DNA, 30 bp, Homo sapiens
cactggctcttcaccaggaccctgtagagt

SEQ ID NO: 39671 - DNA, 30 bp, Homo sapiens
accaggacttggagaggtttttcattttat

SEQ ID NO: 39672 - DNA, 30 bp, Homo sapiens
cagcggcagcgggagagggtgcgcacacct

SEQ ID NO: 39673 - DNA, 30 bp, Homo sapiens
cgatgtagacacagtcgtctgggtcagcac

SEQ ID NO: 39674 - DNA, 30 bp, Homo sapiens
gacattggggaatgtgaaagaaggcacgat

SEQ ID NO: 39675 - DNA, 30 bp, Homo sapiens
cggccaccctgggtgcttcaaggatgaggg

SEQ ID NO: 39676 - DNA, 30 bp, Homo sapiens
actgtctgagttgagaaggctgaaagggga

SEQ ID NO: 39677 - DNA, 30 bp, Homo sapiens
gtctctgagtctggagggccgggctgctta

SEQ ID NO: 39678 - DNA, 30 bp, Homo sapiens
cactgggctttttgctcattagccagctgc

SEQ ID NO: 39679 - DNA, 30 bp, Homo sapiens
tagcggctgctggtgttaaactgctggtga

SEQ ID NO: 39680 - DNA, 30 bp, Homo sapiens
tatcgacttcctgtattaaattgtgtgaaa

SEQ ID NO: 39681 - DNA, 30 bp, Homo sapiens
ctgaaaaggttcttcctcctctgcttgggc

SEQ ID NO: 39682 - DNA, 30 bp, Homo sapiens
acaagtgacatgaagtctacattaccagtt

SEQ ID NO: 39683 - DNA, 30 bp, Homo sapiens
accattaggtcccactctgttgattaattt

SEQ ID NO: 39684 - DNA, 30 bp, Homo sapiens
ccctgggggttacgcttcctcagcatgctg

SEQ ID NO: 39685 - DNA, 30 bp, Homo sapiens
gtcagggtccgagtcagggtccgaggagag

SEQ ID NO: 39686 - DNA, 30 bp, Homo sapiens
tcctggtgcaggtccttcacatctgctctc

SEQ ID NO: 39687 - DNA, 30 bp, Homo sapiens
agctggtctcttcgatgacagagtactggt

SEQ ID NO: 39688 - DNA, 30 bp, Homo sapiens
tataggttgctttggtggtgttgccaacac

SEQ ID NO: 39689 - DNA, 30 bp, Homo sapiens
tatagtgatgccgttgtcagtggtccttgg

SEQ ID NO: 39690 - DNA, 30 bp, Homo sapiens
aacttagtttctcgtgcatttcaaatagtt

SEQ ID NO: 39691 - DNA, 30 bp, Homo sapiens
tgttgggaagtcttggatccgtgaagtagt

SEQ ID NO: 39692 - DNA, 30 bp, Homo sapiens
ctctggggcggctgaggcccccagacaaag

SEQ ID NO: 39693 - DNA, 30 bp, Homo sapiens
gacaggctgcagtgtggggtcatctattat

SEQ ID NO: 39694 - DNA, 30 bp, Homo sapiens
tgcagggcttcctgtccttgctctgtgtaa

SEQ ID NO: 39695 - DNA, 30 bp, Homo sapiens
tgttcctgccagcatttttggcactagtaa

SEQ ID NO: 39696 - DNA, 30 bp, Homo sapiens
tttttcagcagtttcttgcctttggaaagc

SEQ ID NO: 39697 - DNA, 30 bp, Homo sapiens
ttgcctttgagcgcattggcgtatcttgag

SEQ ID NO: 39698 - DNA, 30 bp, Homo sapiens
tgccaagttcagagcctttcaggaagtcgt

SEQ ID NO: 39699 - DNA, 30 bp, Homo sapiens
tgcctttgagcgcattggcgtatcttgaga

SEQ ID NO: 39700 - DNA, 30 bp, Homo sapiens
tcagagcctttcaggaagtcgtccaccgag

SEQ ID NO: 39701 - DNA, 30 bp, Homo sapiens
ccatggagggacatgtgatccagcaggtgg

SEQ ID NO: 39702 - DNA, 30 bp, Homo sapiens
gttaatgttgtagccaggttcgggcagcat

SEQ ID NO: 39703 - DNA, 30 bp, Homo sapiens
gtttgatttcattggctagcagctggttca

SEQ ID NO: 39704 - DNA, 30 bp, Homo sapiens
tacagggaggcccagttgaactttccagag

SEQ ID NO: 39705 - DNA, 30 bp, Homo sapiens
ctcactggcacttgtgggagctgtcttccc

SEQ ID NO: 39706 - DNA, 30 bp, Homo sapiens
agacacgcggcctccgcagcgcgcacagaa

SEQ ID NO: 39707 - DNA, 30 bp, Homo sapiens
agaaggtccagttgaactttccagagatga

SEQ ID NO: 39708 - DNA, 30 bp, Homo sapiens
gagcatgaggggctggtggcactctccagg

SEQ ID NO: 39709 - DNA, 30 bp, Homo sapiens
cgcagggccccacggtgctctcgagggaca

SEQ ID NO: 39710 - DNA, 30 bp, Homo sapiens
ctgcccggcttccctctgcctctggttccc

SEQ ID NO: 39711 - DNA, 30 bp, Homo sapiens
aggaggtggtgaggtcttcttccccgttct

SEQ ID NO: 39712 - DNA, 30 bp, Homo sapiens
cacaggaagttgggctcccgcaccaccagg

SEQ ID NO: 39713 - DNA, 30 bp, Homo sapiens
ctttggatccttggtgggagcatagcacag

SEQ ID NO: 39714 - DNA, 30 bp, Homo sapiens
gttgtcactggtccctgtcacagtctcttc

SEQ ID NO: 39715 - DNA, 30 bp, Homo sapiens
ttaggccaatttgtcctcaaattaagtaga

SEQ ID NO: 39716 - DNA, 30 bp, Homo sapiens
ttcgtcttggctgtcttctcctttcttttt

SEQ ID NO: 39717 - DNA, 30 bp, Homo sapiens
gaaaggcctgaattctctatttaatgacga

SEQ ID NO: 39718 - DNA, 30 bp, Homo sapiens
aagctggctgcttccaaacttgatttgata

SEQ ID NO: 39719 - DNA, 30 bp, Homo sapiens
attcttctgaacgtgatcttcattcatttt

SEQ ID NO: 39720 - DNA, 30 bp, Homo sapiens
tagaggcatcttagtgagcagcagcccctt

SEQ ID NO: 39721 - DNA, 30 bp, Homo sapiens
ggataataccaggctttccttttcctcatc

SEQ ID NO: 39722 - DNA, 30 bp, Homo sapiens
ttctggctgacgtaaatcaagctgctcaga

SEQ ID NO: 39723 - DNA, 30 bp, Homo sapiens
gtatttccgggtaaggctgaagacccattt

SEQ ID NO: 39724 - DNA, 30 bp, Homo sapiens
atgattataccaaccctgtggcctgctcca

SEQ ID NO: 39725 - DNA, 30 bp, Homo sapiens
aggtcttgcttcgccgcaggagcgtggcgg

SEQ ID NO: 39726 - DNA, 30 bp, Homo sapiens
tgctggccatgctgccaggcccaaagatgc

SEQ ID NO: 39727 - DNA, 30 bp, Homo sapiens
ctgtggcaacttcagttccatgacgacctc

SEQ ID NO: 39728 - DNA, 30 bp, Homo sapiens
actctttatactgctctttatgtggttcta

SEQ ID NO: 39729 - DNA, 30 bp, Homo sapiens
gtgatctccgtccaagaggcagcaccattt

SEQ ID NO: 39730 - DNA, 30 bp, Homo sapiens
tcctggcaaaagacttctctttgttctgag

SEQ ID NO: 39731 - DNA, 30 bp, Homo sapiens
acttctcttcttcatcctcctgctcttcat

SEQ ID NO: 39732 - DNA, 30 bp, Homo sapiens
tttcatcttcgctatcagaatcttcataaa

SEQ ID NO: 39733 - DNA, 30 bp, Homo sapiens
agcagggatgcgtagtgtcctggctcgggt

SEQ ID NO: 39734 - DNA, 30 bp, Homo sapiens
atttggatgaggagcacttgccaccccttg

SEQ ID NO: 39735 - DNA, 30 bp, Homo sapiens
gaatggtgattttagcctcttccatacact

SEQ ID NO: 39736 - DNA, 30 bp, Homo sapiens
agcttcttccacaggctgtcttttctcttc

SEQ ID NO: 39737 - DNA, 30 bp, Homo sapiens
gaattcttcccttccaaactctttcagtgt

SEQ ID NO: 39738 - DNA, 30 bp, Homo sapiens
agggggctttggtttctgggtggccccacc

SEQ ID NO: 39739 - DNA, 30 bp, Homo sapiens
agaaggctgtgttctcagcttgggcctggg

SEQ ID NO: 39740 - DNA, 30 bp, Homo sapiens
caaagctcatctgtcttttttgttggaaat

SEQ ID NO: 39741 - DNA, 30 bp, Homo sapiens
gctaagactgctctgcgacaaataggacag

SEQ ID NO: 39742 - DNA, 30 bp, Homo sapiens
ggtacaaccaattaggcaacatttctcaaa

SEQ ID NO: 39743 - DNA, 30 bp, Homo sapiens
aactctcgggtgaagcagcttcctgttctc

SEQ ID NO: 39744 - DNA, 30 bp, Homo sapiens
acatggcaacatttattagccaatgcactg

SEQ ID NO: 39745 - DNA, 30 bp, Homo sapiens
caaaggctactgatttcacttttgctacac

SEQ ID NO: 39746 - DNA, 30 bp, Homo sapiens
atccgggaaggtatctctctttattaattg

SEQ ID NO: 39747 - DNA, 30 bp, Homo sapiens
ctgtgtgtgctggatagtccttggctttca

SEQ ID NO: 39748 - DNA, 30 bp, Homo sapiens
agctgcttctgtttctcttcacctgtttat

SEQ ID NO: 39749 - DNA, 30 bp, Homo sapiens
tggtaacagtaggaagcaataaagccaaat

SEQ ID NO: 39750 - DNA, 30 bp, Homo sapiens
cttccaggtccttctggatagccaaatcct

SEQ ID NO: 39751 - DNA, 30 bp, Homo sapiens
ctttagattctcaaggtgttccatattaac

SEQ ID NO: 39752 - DNA, 30 bp, Homo sapiens
taaatcttctacctccagttcccacatact

SEQ ID NO: 39753 - DNA, 30 bp, Homo sapiens
tggtaatgaggatgacaatcatccactcca

SEQ ID NO: 39754 - DNA, 30 bp, Homo sapiens
tcctggactttgttccattggacagtaggg

SEQ ID NO: 39755 - DNA, 30 bp, Homo sapiens
tgccgggttctgctccatgggacagtaggg

SEQ ID NO: 39756 - DNA, 30 bp, Homo sapiens
gtagagtcctccacagaagcatcaaagtgg

SEQ ID NO: 39757 - DNA, 30 bp, Homo sapiens
ggtaactggcgcttcatgtcattacaggtt

SEQ ID NO: 39758 - DNA, 30 bp, Homo sapiens
actaaccagctcatcagagaatgacctgtc

SEQ ID NO: 39759 - DNA, 30 bp, Homo sapiens
aaactatctggcctcaagtcatcacaagtg

SEQ ID NO: 39760 - DNA, 30 bp, Homo sapiens
tagagaccagcgatacctattggatcagct

SEQ ID NO: 39761 - DNA, 30 bp, Homo sapiens
tccaggtgaactggaaccaccggatactgt

SEQ ID NO: 39762 - DNA, 30 bp, Homo sapiens
agatggtggtatccaggtgaactggaacca

SEQ ID NO: 39763 - DNA, 30 bp, Homo sapiens
tagaggtgcccgcttcttcctccctagtac

SEQ ID NO: 39764 - DNA, 30 bp, Homo sapiens
aagtgcacaggcacctgtgggttaccctca

SEQ ID NO: 39765 - DNA, 30 bp, Homo sapiens
tgtaggggggatcgctcttctgaggggggt

SEQ ID NO: 39766 - DNA, 30 bp, Homo sapiens
taaaggactctgtccaagtgtacaggaacc

SEQ ID NO: 39767 - DNA, 30 bp, Homo sapiens
gcacaggaacaagtgggtaccctgggtcac

SEQ ID NO: 39768 - DNA, 30 bp, Homo sapiens
tcactgaggaaacttctgtgttcaggtggc

SEQ ID NO: 39769 - DNA, 30 bp, Homo sapiens
gtttagctccttctctggctaatctgtcag

SEQ ID NO: 39770 - DNA, 30 bp, Homo sapiens
tagaggctggttgctgactccaggccgcgt

SEQ ID NO: 39771 - DNA, 30 bp, Homo sapiens
cttgccccttttctgtctttgtgctgccat

SEQ ID NO: 39772 - DNA, 30 bp, Homo sapiens
ttgtcaactttagccaaagccttctgagct

SEQ ID NO: 39773 - DNA, 30 bp, Homo sapiens
cctcgggcacctgtgcgtgaatcgctgccg

SEQ ID NO: 39774 - DNA, 30 bp, Homo sapiens
cgcaccatgtattccttgcgcttattgagc

SEQ ID NO: 39775 - DNA, 30 bp, Homo sapiens
gcacccagggctggccaacccactggcccc

SEQ ID NO: 39776 - DNA, 30 bp, Homo sapiens
gcttggtctttttaggtgggggatagaaga

SEQ ID NO: 39777 - DNA, 30 bp, Homo sapiens
cacataatggaacagcttttggccttttcc

SEQ ID NO: 39778 - DNA, 30 bp, Homo sapiens
acatgaggttgcagcttttggctcgatcct

SEQ ID NO: 39779 - DNA, 30 bp, Homo sapiens
gtaagtccgtagcaactgccgagagttctg

SEQ ID NO: 39780 - DNA, 30 bp, Homo sapiens
acttggtgtggacgactgaggtgctgaaca

SEQ ID NO: 39781 - DNA, 30 bp, Homo sapiens
acaagggctggtgttgtgcatatggctgct

SEQ ID NO: 39782 - DNA, 30 bp, Homo sapiens
agatgccatcttttgtgtcttccacaagct

SEQ ID NO: 39783 - DNA, 30 bp, Homo sapiens
cataggatgaaagcagtgctgcatcaactg

SEQ ID NO: 39784 - DNA, 30 bp, Homo sapiens
acttggcagctgggcctcaatgtccactct

SEQ ID NO: 39785 - DNA, 30 bp, Homo sapiens
tcctggagaaggggctctcggtccccttcc

SEQ ID NO: 39786 - DNA, 30 bp, Homo sapiens
taatgggaattgcatcctcatcggggtctt

SEQ ID NO: 39787 - DNA, 30 bp, Homo sapiens
gcagcctgaagcttttgcagtttcgccatc

SEQ ID NO: 39788 - DNA, 30 bp, Homo sapiens
cactggtcgatgatggagcgctgcaacacc

SEQ ID NO: 39789 - DNA, 30 bp, Homo sapiens
catcggtcatgtagctgactgtcattgcta

SEQ ID NO: 39790 - DNA, 30 bp, Homo sapiens
ctttgcagtagggacacgtttgcttctttc

SEQ ID NO: 39791 - DNA, 30 bp, Homo sapiens
tccaggcccaggatgtagttgatgccttgg

SEQ ID NO: 39792 - DNA, 30 bp, Homo sapiens
catccaatagaatcccaatgttctgcgtgg

SEQ ID NO: 39793 - DNA, 30 bp, Homo sapiens
ctgaggaggtagtactcgtattggctccct

SEQ ID NO: 39794 - DNA, 30 bp, Homo sapiens
gaccggtctaagactcttcggataagagct

SEQ ID NO: 39795 - DNA, 30 bp, Homo sapiens
ttgtggcgttctcgttgctgggcgagctgg

SEQ ID NO: 39796 - DNA, 30 bp, Homo sapiens
attaggagtttcgtcttcttcaaaggttgg

SEQ ID NO: 39797 - DNA, 30 bp, Homo sapiens
caccattaggctgcaactggaccacgacat

SEQ ID NO: 39798 - DNA, 30 bp, Homo sapiens
tctcggagtgagctccccatcctgaggaag

SEQ ID NO: 39799 - DNA, 30 bp, Homo sapiens
ctgtggctctgatgatcatgtagcagagtg

SEQ ID NO: 39800 - DNA, 30 bp, Homo sapiens
aggtgaaggatgaacatcttccactactga

SEQ ID NO: 39801 - DNA, 30 bp, Homo sapiens
taaaggttggatggatggcccactgagcaa

SEQ ID NO: 39802 - DNA, 30 bp, Homo sapiens
tgtaagccatacagccagaaggcagggtac

SEQ ID NO: 39803 - DNA, 30 bp, Homo sapiens
gtttggtattgggtttcttcatctagctga

SEQ ID NO: 39804 - DNA, 30 bp, Homo sapiens
tgctgaatcactccatttctttctctttga

SEQ ID NO: 39805 - DNA, 30 bp, Homo sapiens
cttcccaaatatcgtcgtcaacatccacag

SEQ ID NO: 39806 - DNA, 30 bp, Homo sapiens
ctgtggggctggcctgcctcatcagccatg

SEQ ID NO: 39807 - DNA, 30 bp, Homo sapiens
agagccaatactcaattccggggagtgata

SEQ ID NO: 39808 - DNA, 30 bp, Homo sapiens
aggtgggtaacgggtcgtcgtcacctttac

SEQ ID NO: 39809 - DNA, 30 bp, Homo sapiens
tccgatgccagatcacagatgcccgggagt

SEQ ID NO: 39810 - DNA, 30 bp, Homo sapiens
ttgtggatgggtcgtgctttttcttcttgc

SEQ ID NO: 39811 - DNA, 30 bp, Homo sapiens
ggctgattcaacaggatgtgcttcatcttt

SEQ ID NO: 39812 - DNA, 30 bp, Homo sapiens
atcaggccttctagatctgacactgacact

SEQ ID NO: 39813 - DNA, 30 bp, Homo sapiens
acatgggacatgtcctatgggctaaaagcc

SEQ ID NO: 39814 - DNA, 30 bp, Homo sapiens
agatgggtcctccatgccgagagtcactcc

SEQ ID NO: 39815 - DNA, 30 bp, Homo sapiens
tcctggtcagtggaaagttctacatcagac

SEQ ID NO: 39816 - DNA, 30 bp, Homo sapiens
tacaaggtatgttggccctgggctccccca

SEQ ID NO: 39817 - DNA, 30 bp, Homo sapiens
tccaaactcagctatgtctggtcgtcccaa

SEQ ID NO: 39818 - DNA, 30 bp, Homo sapiens
cagccacaggatatcacagtgaagcgctta

SEQ ID NO: 39819 - DNA, 30 bp, Homo sapiens
caaagggccccacacacagggcctcgtctc

SEQ ID NO: 39820 - DNA, 30 bp, Homo sapiens
gctgtcggctcccagttgtgtctcaatgtc

SEQ ID NO: 39821 - DNA, 30 bp, Homo sapiens
agttctcagagagagacagggccagagcag

SEQ ID NO: 39822 - DNA, 30 bp, Homo sapiens
accaggataacaggggaagagggaggggac

SEQ ID NO: 39823 - DNA, 30 bp, Homo sapiens
tttgtgcatctctgaaacatctgaaaaaca

SEQ ID NO: 39824 - DNA, 30 bp, Homo sapiens
acttggccccggccatgttgctggaccgta

SEQ ID NO: 39825 - DNA, 30 bp, Homo sapiens
ttctaccaacggcatatgaactggatgctg

SEQ ID NO: 39826 - DNA, 30 bp, Homo sapiens
ggttatcacttctcgatacataatagagat

SEQ ID NO: 39827 - DNA, 30 bp, Homo sapiens
aaccaaaggatggaaacacagtctagtaac

SEQ ID NO: 39828 - DNA, 30 bp, Homo sapiens
ccagccctagtgaatagttaatgccttgaa

SEQ ID NO: 39829 - DNA, 30 bp, Homo sapiens
ttctggaagggcttctacattcatgtgcca

SEQ ID NO: 39830 - DNA, 30 bp, Homo sapiens
acccagttcactgaataaatatatatgatc

SEQ ID NO: 39831 - DNA, 30 bp, Homo sapiens
tctgtagccatctttcacgccttcgttgtt

SEQ ID NO: 39832 - DNA, 30 bp, Homo sapiens
gcttggtaggggccattttgcagagttgga

SEQ ID NO: 39833 - DNA, 30 bp, Homo sapiens
cacgtgtacatggctccatggaggttctcc

SEQ ID NO: 39834 - DNA, 30 bp, Homo sapiens
aggaggtgccatacagtctagaaattcatg

SEQ ID NO: 39835 - DNA, 30 bp, Homo sapiens
accccaaaggaactgcttggtccaaaagat

SEQ ID NO: 39836 - DNA, 30 bp, Homo sapiens
atcaggagccagaacatgatcaccagggcc

SEQ ID NO: 39837 - DNA, 30 bp, Homo sapiens
caatggaagagatgtggctgtgtttctgct

SEQ ID NO: 39838 - DNA, 30 bp, Homo sapiens
agcaggcggagacagtgagaaagacaaact

SEQ ID NO: 39839 - DNA, 30 bp, Homo sapiens
tctgatgtgagtggttgttatttgtttctt

SEQ ID NO: 39840 - DNA, 30 bp, Homo sapiens
catactctggcttctccaccttctggcttc

SEQ ID NO: 39841 - DNA, 30 bp, Homo sapiens
gcatggatcatgctaaacctgtcctgtggg

SEQ ID NO: 39842 - DNA, 30 bp, Homo sapiens
tgtaggtgcgtaataaagttccatgggttt

SEQ ID NO: 39843 - DNA, 30 bp, Homo sapiens
gcagcattacacttgggacatttgcgctgg

SEQ ID NO: 39844 - DNA, 30 bp, Homo sapiens
agtcgggtgttccctccatgtggggacatc

SEQ ID NO: 39845 - DNA, 30 bp, Homo sapiens
tgatggagcaggcggacagtgggttccgca

SEQ ID NO: 39846 - DNA, 30 bp, Homo sapiens
gccttccagaactgaacgctaggaggagca

SEQ ID NO: 39847 - DNA, 30 bp, Homo sapiens
ctgcgggaaaactccaccctgcgtttgtga

SEQ ID NO: 39848 - DNA, 30 bp, Homo sapiens
aaattggcaaagaggaaacacaacagacac

SEQ ID NO: 39849 - DNA, 30 bp, Homo sapiens
ttctctcccactgggtaatcccatatgcct

SEQ ID NO: 39850 - DNA, 30 bp, Homo sapiens
cagcacagcagctgttttccacactgagac

SEQ ID NO: 39851 - DNA, 30 bp, Homo sapiens
cccttggcgagggaggagggtgcccacttc

SEQ ID NO: 39852 - DNA, 30 bp, Homo sapiens
agttggacaaaagggacaagtgtcatttgt

SEQ ID NO: 39853 - DNA, 30 bp, Homo sapiens
catcggagtagcggttccccaggacgttga

SEQ ID NO: 39854 - DNA, 30 bp, Homo sapiens
gaagcgatgccgcggctgggggccaaagtg

SEQ ID NO: 39855 - DNA, 30 bp, Homo sapiens
cacaggctgtggagccaaatgttgggtttg

SEQ ID NO: 39856 - DNA, 30 bp, Homo sapiens
catacctgtccgtgatcgttttctctgttt

SEQ ID NO: 39857 - DNA, 30 bp, Homo sapiens
ggctggcactggaaaggctgctctggattt

SEQ ID NO: 39858 - DNA, 30 bp, Homo sapiens
cgcaggtctccgggcgctgtgatcgtgttg

SEQ ID NO: 39859 - DNA, 30 bp, Homo sapiens
tcctcaccagcagcacccagggcaggatgg

SEQ ID NO: 39860 - DNA, 30 bp, Homo sapiens
ttatcagtcagaggcccgaggggggaggcg

SEQ ID NO: 39861 - DNA, 30 bp, Homo sapiens
cctcggggctgcctaggggtgggcagcaga

SEQ ID NO: 39862 - DNA, 30 bp, Homo sapiens
agcctcctcgcgccccgtggccacggggcc

SEQ ID NO: 39863 - DNA, 30 bp, Homo sapiens
cccaggaaggggcccctgagggggtccacg

SEQ ID NO: 39864 - DNA, 30 bp, Homo sapiens
aggaaccatccttagattccaggcccaggg

SEQ ID NO: 39865 - DNA, 30 bp, Homo sapiens
cagaggtagacattgagggtctgcaggatg

SEQ ID NO: 39866 - DNA, 30 bp, Homo sapiens
ctgcgggggatactctgtcccaagggtacc

SEQ ID NO: 39867 - DNA, 30 bp, Homo sapiens
gccccgagacatgggtcttcgaaacatgcg

SEQ ID NO: 39868 - DNA, 30 bp, Homo sapiens
agcaggagcggcagagaggacaggcatgga

SEQ ID NO: 39869 - DNA, 30 bp, Homo sapiens
agctggtttccagtcttgtgtctttttttc

SEQ ID NO: 39870 - DNA, 30 bp, Homo sapiens
gcacggctcgcaccacatactgccggcaga

SEQ ID NO: 39871 - DNA, 30 bp, Homo sapiens
gcacttctgaagcatcagctcggcaaattg

SEQ ID NO: 39872 - DNA, 30 bp, Homo sapiens
cgctggtacaatgcggagcggagcacgagg

SEQ ID NO: 39873 - DNA, 30 bp, Homo sapiens
gtgtggcaggcagattggtcgaccggcaga

SEQ ID NO: 39874 - DNA, 30 bp, Homo sapiens
ttgtggttgatctttttcctacaagttggg

SEQ ID NO: 39875 - DNA, 30 bp, Homo sapiens
cgatggaagtcgtgggcaccaaaggccgcg

SEQ ID NO: 39876 - DNA, 30 bp, Homo sapiens
catgcgcaaatatcatgacaaggcctggct

SEQ ID NO: 39877 - DNA, 30 bp, Homo sapiens
cacacagctcctcgagttcctcctctgagc

SEQ ID NO: 39878 - DNA, 30 bp, Homo sapiens
tcagcctccctgggcacctcggaggcgtcg

SEQ ID NO: 39879 - DNA, 30 bp, Homo sapiens
aaagaagaagatggcgagaaacaggaagag

SEQ ID NO: 39880 - DNA, 30 bp, Homo sapiens
ccattgtttgctatgttagaccctaaaaca

SEQ ID NO: 39881 - DNA, 30 bp, Homo sapiens
atctggcaaagcagctctccaagtttggtt

SEQ ID NO: 39882 - DNA, 30 bp, Homo sapiens
ctttggaccacccagtcctgctggcagaga

SEQ ID NO: 39883 - DNA, 30 bp, Homo sapiens
cacagggacatgcagcagttgtggaaggaa

SEQ ID NO: 39884 - DNA, 30 bp, Homo sapiens
tgagaacaattcgtcgttctttcacttctg

SEQ ID NO: 39885 - DNA, 30 bp, Homo sapiens
gagcagcggagtcacggctagagagaatcc

SEQ ID NO: 39886 - DNA, 30 bp, Homo sapiens
aagtggctccatccttccatttgtttatat

SEQ ID NO: 39887 - DNA, 30 bp, Homo sapiens
acacctggaagtgtgcggacgtggcgccgt

SEQ ID NO: 39888 - DNA, 30 bp, Homo sapiens
acacctgcactttcatcaatcttctccagc

SEQ ID NO: 39889 - DNA, 30 bp, Homo sapiens
taaagggcgtggtcttttgggaggtggtgg

SEQ ID NO: 39890 - DNA, 30 bp, Homo sapiens
gagatgaccctcagggatggcttgtccttc

SEQ ID NO: 39891 - DNA, 30 bp, Homo sapiens
cacatagggcagaagtgatgcagccatcaa

SEQ ID NO: 39892 - DNA, 30 bp, Homo sapiens
agatgggaaatccaatcgccatcatccagg

SEQ ID NO: 39893 - DNA, 30 bp, Homo sapiens
cagaggataaactgcatggcaggtctggga

SEQ ID NO: 39894 - DNA, 30 bp, Homo sapiens
caaaggcaaacaccaagtaaatacttgtag

SEQ ID NO: 39895 - DNA, 30 bp, Homo sapiens
ttaggatcttgttttggtctagcagatcga

SEQ ID NO: 39896 - DNA, 30 bp, Homo sapiens
actgcccttgggtgccacgatctgctggac

SEQ ID NO: 39897 - DNA, 30 bp, Homo sapiens
gagagatggcactgctgggggcctcgtccc

SEQ ID NO: 39898 - DNA, 30 bp, Homo sapiens
tatcgggaggagttggagctggagcggctc

SEQ ID NO: 39899 - DNA, 30 bp, Homo sapiens
agctgggtggggtataagttacaggggcga

SEQ ID NO: 39900 - DNA, 30 bp, Homo sapiens
tcatatcctccaagtacctgcatttctgca

SEQ ID NO: 39901 - DNA, 30 bp, Homo sapiens
aactgtccttgactgttggagcccatatat

SEQ ID NO: 39902 - DNA, 30 bp, Homo sapiens
tcttggttcctctcggcgtttctgtcctgg

SEQ ID NO: 39903 - DNA, 30 bp, Homo sapiens
tacaggagaagcaccagccttgggcatacg

SEQ ID NO: 39904 - DNA, 30 bp, Homo sapiens
tccggaaagactgatttgcagtggatcttg

SEQ ID NO: 39905 - DNA, 30 bp, Homo sapiens
acttggccgtctaatagactggttttgctg

SEQ ID NO: 39906 - DNA, 30 bp, Homo sapiens
agaagggtctgtagctccagtagctggaga

SEQ ID NO: 39907 - DNA, 30 bp, Homo sapiens
ggcctcagatagatcctccttgggaggtgc

SEQ ID NO: 39908 - DNA, 30 bp, Homo sapiens
catcggatgcccatcccaatggccatgaat

SEQ ID NO: 39909 - DNA, 30 bp, Homo sapiens
gaaccctggggttttgggtaaagtcattca

SEQ ID NO: 39910 - DNA, 30 bp, Homo sapiens
aaaccctggggttttgggtaaagtcattca

SEQ ID NO: 39911 - DNA, 30 bp, Homo sapiens
atgccgttcttcctggcgtctatattttcc

SEQ ID NO: 39912 - DNA, 30 bp, Homo sapiens
atattggcgtctcctagtaaagatgcttgc

SEQ ID NO: 39913 - DNA, 30 bp, Homo sapiens
cgctgggatgtcacacagatcagacttaaa

SEQ ID NO: 39914 - DNA, 30 bp, Homo sapiens
gctgtcgccgctgcggtgtggacgcagatg

SEQ ID NO: 39915 - DNA, 30 bp, Homo sapiens
aagcttccagctggacttgggcctcgtcca

SEQ ID NO: 39916 - DNA, 30 bp, Homo sapiens
aatttgcattgctggctcaaattctgaagt

SEQ ID NO: 39917 - DNA, 30 bp, Homo sapiens
catttgcagccggtggcacagtcaggatta

SEQ ID NO: 39918 - DNA, 30 bp, Homo sapiens
cacttggacagccccacaggtgactcggtt

SEQ ID NO: 39919 - DNA, 30 bp, Homo sapiens
tccatatccactgtgagtgagacaggcata

SEQ ID NO: 39920 - DNA, 30 bp, Homo sapiens
acttggcaaatatctaagaggcaagcttga

SEQ ID NO: 39921 - DNA, 30 bp, Homo sapiens
ccgtctgccctgcccactgcctcagtgggg

SEQ ID NO: 39922 - DNA, 30 bp, Homo sapiens
gccgtctccttgctttcagatacaaacatc

SEQ ID NO: 39923 - DNA, 30 bp, Homo sapiens
cactctgagtcagaaccctcatttgacttg

SEQ ID NO: 39924 - DNA, 30 bp, Homo sapiens
acatcaatgcacttctcctgatgctcatga

SEQ ID NO: 39925 - DNA, 30 bp, Homo sapiens
attctgcatctgtggatttaaaatggtcat

SEQ ID NO: 39926 - DNA, 30 bp, Homo sapiens
taaaggataaaactgagggaagtcatggat

SEQ ID NO: 39927 - DNA, 30 bp, Homo sapiens
ccacagtgggatagatgtggccctcaacgg

SEQ ID NO: 39928 - DNA, 30 bp, Homo sapiens
tgatggactgctcttggttgatcagctcct

SEQ ID NO: 39929 - DNA, 30 bp, Homo sapiens
cacaggccttggttgatcagctcctgttga

SEQ ID NO: 39930 - DNA, 30 bp, Homo sapiens
cacaggtccctcttaccacagagtgggtcc

SEQ ID NO: 39931 - DNA, 30 bp, Homo sapiens
tagaggatcacagcccaagtatcacaggca

SEQ ID NO: 39932 - DNA, 30 bp, Homo sapiens
tctctgataccccattttggagcactgttg

SEQ ID NO: 39933 - DNA, 30 bp, Homo sapiens
tgatggttagactttcaaggtcttcatttt

SEQ ID NO: 39934 - DNA, 30 bp, Homo sapiens
tatcttttcttgagttcttcgacagaacta

SEQ ID NO: 39935 - DNA, 30 bp, Homo sapiens
ccgtgaaacttaatgatcttccaaagggct

SEQ ID NO: 39936 - DNA, 30 bp, Homo sapiens
cacatttatggacagtgtcaggacctactc

SEQ ID NO: 39937 - DNA, 30 bp, Homo sapiens
aagagaacgtttctgagcagcttctgagca

SEQ ID NO: 39938 - DNA, 30 bp, Homo sapiens
gtcaggacctactccaccatcgacctctat

SEQ ID NO: 39939 - DNA, 30 bp, Homo sapiens
aaggtgacagggatgttaatctccacttca

SEQ ID NO: 39940 - DNA, 30 bp, Homo sapiens
atctggggtcttcactcctcataatagcac

SEQ ID NO: 39941 - DNA, 30 bp, Homo sapiens
tcccggggcttatggacccattcatactct

SEQ ID NO: 39942 - DNA, 30 bp, Homo sapiens
tgcaggtcgcttcttcaaccccttcatttt

SEQ ID NO: 39943 - DNA, 30 bp, Homo sapiens
ctttttggaacctgatggcccgttttttaa

SEQ ID NO: 39944 - DNA, 30 bp, Homo sapiens
tggtgggatattctgatgattctgactcat

SEQ ID NO: 39945 - DNA, 30 bp, Homo sapiens
aaatagcatggaggacagcagctgcttgaa

SEQ ID NO: 39946 - DNA, 30 bp, Homo sapiens
gcttgcgggcatgctgtttaagtaaaatgt

SEQ ID NO: 39947 - DNA, 30 bp, Homo sapiens
agtcatctctgtattgcttgtagacagact

SEQ ID NO: 39948 - DNA, 30 bp, Homo sapiens
caaagtaaaaggcctgcacatagcatgcca

SEQ ID NO: 39949 - DNA, 30 bp, Homo sapiens
cacttgacacgtggttctcattctgtagct

SEQ ID NO: 39950 - DNA, 30 bp, Homo sapiens
cccaggcagctggaggggcctgctggagct

SEQ ID NO: 39951 - DNA, 30 bp, Homo sapiens
gaaaggcttctccctcatgttcactgagcc

SEQ ID NO: 39952 - DNA, 30 bp, Homo sapiens
gagcagggctgagttgtcaacctgtttctg

SEQ ID NO: 39953 - DNA, 30 bp, Homo sapiens
acttggccaatgtgaaccctggccacagtg

SEQ ID NO: 39954 - DNA, 30 bp, Homo sapiens
tgagtgcagggcccgccacttgtccagagg

SEQ ID NO: 39955 - DNA, 30 bp, Homo sapiens
tataggcgctggggcttgcccatggtgctc

SEQ ID NO: 39956 - DNA, 30 bp, Homo sapiens
tgagtgcagaacccgccacttgtccaaggg

SEQ ID NO: 39957 - DNA, 30 bp, Homo sapiens
gccaggaaggatgatcccatcatacttctg

SEQ ID NO: 39958 - DNA, 30 bp, Homo sapiens
ggctgggcattccacagcaccactgttgat

SEQ ID NO: 39959 - DNA, 30 bp, Homo sapiens
ctgcggcttccttggctctttttgcccgta

SEQ ID NO: 39960 - DNA, 30 bp, Homo sapiens
gtccgtgggtcttgaggacctctgtgtatt

SEQ ID NO: 39961 - DNA, 30 bp, Homo sapiens
atgctttcttgccagatgcctttggagcag

SEQ ID NO: 39962 - DNA, 30 bp, Homo sapiens
cagaggttgcagtgagccgtgattgcccca

SEQ ID NO: 39963 - DNA, 30 bp, Homo sapiens
cggtggagctggagagtattgcgccttctc

SEQ ID NO: 39964 - DNA, 30 bp, Homo sapiens
ccgtaaggatcatctcaatgtggcagggag

SEQ ID NO: 39965 - DNA, 30 bp, Homo sapiens
acgactaacgaagggggaaaccagagggta

SEQ ID NO: 39966 - DNA, 30 bp, Homo sapiens
cctcggctggcccgtcggcctctggcacgc

SEQ ID NO: 39967 - DNA, 30 bp, Homo sapiens
agaaggtgttgggcctcttggtggtgaagc

SEQ ID NO: 39968 - DNA, 30 bp, Homo sapiens
tcttggtctcttcctccttggataaagtct

SEQ ID NO: 39969 - DNA, 30 bp, Homo sapiens
cttcctcctcttcttcgtcctggttaatct

SEQ ID NO: 39970 - DNA, 30 bp, Homo sapiens
gtagtggcaccaccatcaggctcagcagta

SEQ ID NO: 39971 - DNA, 30 bp, Homo sapiens
cattggatgcaatccggggccacaagtctg

SEQ ID NO: 39972 - DNA, 30 bp, Homo sapiens
catcgtaatcaggagccagtcgaacatatg

SEQ ID NO: 39973 - DNA, 30 bp, Homo sapiens
tagcgttttccaccaactcggggagctgaa

SEQ ID NO: 39974 - DNA, 30 bp, Homo sapiens
tcttctcaatggtttcttccttgtatttgc

SEQ ID NO: 39975 - DNA, 30 bp, Homo sapiens
tcttttccaacttgtcgagacttggctttg

SEQ ID NO: 39976 - DNA, 30 bp, Homo sapiens
tttctggaagaaccacttgttcttgcctgt

SEQ ID NO: 39977 - DNA, 30 bp, Homo sapiens
accaggacacaggcccccccaacactctta

SEQ ID NO: 39978 - DNA, 30 bp, Homo sapiens
cactccacaagccgccccctaggccaatgc

SEQ ID NO: 39979 - DNA, 30 bp, Homo sapiens
tcttggtggggcgggtccgcttcctcttca

SEQ ID NO: 39980 - DNA, 30 bp, Homo sapiens
acccgggaaaggggccgctctctggcccaa

SEQ ID NO: 39981 - DNA, 30 bp, Homo sapiens
ttgtgggcacagtcaagcaggttttgcaca

SEQ ID NO: 39982 - DNA, 30 bp, Homo sapiens
aatgaccaccacgacacctttgccgtcggc

SEQ ID NO: 39983 - DNA, 30 bp, Homo sapiens
tgtaggggcctgggtacgtttgggagcctg

SEQ ID NO: 39984 - DNA, 30 bp, Homo sapiens
tcctttgcaattcggtctttcttcagtggt

SEQ ID NO: 39985 - DNA, 30 bp, Homo sapiens
tgttctggcatgcttctaatgatgtcagag

SEQ ID NO: 39986 - DNA, 30 bp, Homo sapiens
tacgttttctggacagccgcacacggattc

SEQ ID NO: 39987 - DNA, 30 bp, Homo sapiens
tatgggctcttggcgactgtaacactgttt

SEQ ID NO: 39988 - DNA, 30 bp, Homo sapiens
cattttcttcactgcgcagcctggcattgg

SEQ ID NO: 39989 - DNA, 30 bp, Homo sapiens
acactttcacaacgattttctgctcctcga

SEQ ID NO: 39990 - DNA, 30 bp, Homo sapiens
aggccttgaccgcgtacttccgcagcgggt

SEQ ID NO: 39991 - DNA, 30 bp, Homo sapiens
ggggtacagcatcactcggattctgtgtcc

SEQ ID NO: 39992 - DNA, 30 bp, Homo sapiens
tcttggcagcagctttcctcatggcggcca

SEQ ID NO: 39993 - DNA, 30 bp, Homo sapiens
aactgggaaacgtcaaatagtaactaccac

SEQ ID NO: 39994 - DNA, 30 bp, Homo sapiens
tccggaaaatcggcttagtttgcccaccat

SEQ ID NO: 39995 - DNA, 30 bp, Homo sapiens
acttggccctttctcttcttatctcctccc

SEQ ID NO: 39996 - DNA, 30 bp, Homo sapiens
tcttgggtttaggtgttgttccttcacgga

SEQ ID NO: 39997 - DNA, 30 bp, Homo sapiens
tactggtctttcaactccttcagtcttctg

SEQ ID NO: 39998 - DNA, 30 bp, Homo sapiens
accggggggcagggactgcttcagtttctc

SEQ ID NO: 39999 - DNA, 30 bp, Homo sapiens
ttcatccgaatccactggggaatgggacga

SEQ ID NO: 40000 - DNA, 30 bp, Homo sapiens
tggttcttctccaatgcctccttttggagt

SEQ ID NO: 40001 - DNA, 30 bp, Homo sapiens
agtctcccgaggtctccggcgtttccttct

SEQ ID NO: 40002 - DNA, 30 bp, Homo sapiens
tagtaggtttcttctctgcaggcttctttt

SEQ ID NO: 40003 - DNA, 30 bp, Homo sapiens
cagaggaccaacatgggcattttgtttatg

SEQ ID NO: 40004 - DNA, 30 bp, Homo sapiens
cctgagctctgaggaagcttgccttctttt

SEQ ID NO: 40005 - DNA, 30 bp, Homo sapiens
gtcagagcaaacacagatcgcaggtagccc

SEQ ID NO: 40006 - DNA, 30 bp, Homo sapiens
tcgtggagaagacaatttgaagggccacag

SEQ ID NO: 40007 - DNA, 30 bp, Homo sapiens
ccttttcgagcttggcgatacgagccacag

SEQ ID NO: 40008 - DNA, 30 bp, Homo sapiens
tgacggatgagctgattgatgcgttcaccc

SEQ ID NO: 40009 - DNA, 30 bp, Homo sapiens
cagtcttggttccccggagacgtccagtcc

SEQ ID NO: 40010 - DNA, 30 bp, Homo sapiens
gaacagttcctttttcagagacatagatac

SEQ ID NO: 40011 - DNA, 30 bp, Homo sapiens
cccatatcctcgtccgactcctccgactct

SEQ ID NO: 40012 - DNA, 30 bp, Homo sapiens
cccatgtcatcatcagactcctcggattct

SEQ ID NO: 40013 - DNA, 30 bp, Homo sapiens
cccatgtcatcatctgactcttcagactcc

SEQ ID NO: 40014 - DNA, 30 bp, Homo sapiens
tacagggcatccaggatgtggtcgatcttg

SEQ ID NO: 40015 - DNA, 30 bp, Homo sapiens
gggccagcatccgattgccagccagaaacg

SEQ ID NO: 40016 - DNA, 30 bp, Homo sapiens
tactgctctgctctgcagcgatcctcttga

SEQ ID NO: 40017 - DNA, 30 bp, Homo sapiens
ttctggaaccataactttaacccagccttc

SEQ ID NO: 40018 - DNA, 30 bp, Homo sapiens
cactggttactggaaccctgagtctgcatt

SEQ ID NO: 40019 - DNA, 30 bp, Homo sapiens
ggaaggcggtctgaaatggagtgggctgtg

SEQ ID NO: 40020 - DNA, 30 bp, Homo sapiens
gatcctcgtccgcaacccctggctcgggtt

SEQ ID NO: 40021 - DNA, 30 bp, Homo sapiens
gatcgggtgtctcgagcccttcttcgggaa

SEQ ID NO: 40022 - DNA, 30 bp, Homo sapiens
tcttgggagtatgatctctctgatgagaga

SEQ ID NO: 40023 - DNA, 30 bp, Homo sapiens
cacttggctttcttggaagctggaagacaa

SEQ ID NO: 40024 - DNA, 30 bp, Homo sapiens
gaccgtcagcaagctttctcttaggttttg

SEQ ID NO: 40025 - DNA, 30 bp, Homo sapiens
cagccatctgaagccaatagtcctgattat

SEQ ID NO: 40026 - DNA, 30 bp, Homo sapiens
atcttcactgtagatgtctcccgcaaaggg

SEQ ID NO: 40027 - DNA, 30 bp, Homo sapiens
tatgctctttctctgcaagggcttcctttt

SEQ ID NO: 40028 - DNA, 30 bp, Homo sapiens
tagtcagttgaaaacaggtccccagcagag

SEQ ID NO: 40029 - DNA, 30 bp, Homo sapiens
acgtggtggaaatggtggaggccaggactt

SEQ ID NO: 40030 - DNA, 30 bp, Homo sapiens
gtacctgggagggaagaatgggcgttttgg

SEQ ID NO: 40031 - DNA, 30 bp, Homo sapiens
agtagggccccacgaccaccgcctccacct

SEQ ID NO: 40032 - DNA, 30 bp, Homo sapiens
cccaggatggctgcgcccacgtccttggag

SEQ ID NO: 40033 - DNA, 30 bp, Homo sapiens
ccacgaccaaatccgcctctaaactggaat

SEQ ID NO: 40034 - DNA, 30 bp, Homo sapiens
aacttctggaactgcttcttggtgccggca

SEQ ID NO: 40035 - DNA, 30 bp, Homo sapiens
ccttggcctgagactccttgccatagtcct

SEQ ID NO: 40036 - DNA, 30 bp, Homo sapiens
accagggcagaggctgtagatgattcatat

SEQ ID NO: 40037 - DNA, 30 bp, Homo sapiens
agacggcgaccacggcgaccccccttcctg

SEQ ID NO: 40038 - DNA, 30 bp, Homo sapiens
cttgagagggatgaagcgggaggagtgggt

SEQ ID NO: 40039 - DNA, 30 bp, Homo sapiens
aaaagaatcccaggattttccctcctgtgt

SEQ ID NO: 40040 - DNA, 30 bp, Homo sapiens
tatcggtaggatttctggtagcgagcgcgg

SEQ ID NO: 40041 - DNA, 30 bp, Homo sapiens
ccgaggcgttttgaaattcatcccaactgt

SEQ ID NO: 40042 - DNA, 30 bp, Homo sapiens
ccacggtgcggccacggcggccagtggtct

SEQ ID NO: 40043 - DNA, 30 bp, Homo sapiens
gcatggtttgttctaatgcttcttgttggc

SEQ ID NO: 40044 - DNA, 30 bp, Homo sapiens
gtccggcgattctgtccagatctctttgtc

SEQ ID NO: 40045 - DNA, 30 bp, Homo sapiens
tgccgaagtattcctgctggaacttctgga

SEQ ID NO: 40046 - DNA, 30 bp, Homo sapiens
ctggagcctgagtccgctgcacggagactc

SEQ ID NO: 40047 - DNA, 30 bp, Homo sapiens
caatggtgacttccacctcaactcctggct

SEQ ID NO: 40048 - DNA, 30 bp, Homo sapiens
aaaaggacatgtccccggggattcgaatac

SEQ ID NO: 40049 - DNA, 30 bp, Homo sapiens
gccttggccaatcggagaatggaatcatct

SEQ ID NO: 40050 - DNA, 30 bp, Homo sapiens
tgcctttgtatagggccaaaagagaaacat

SEQ ID NO: 40051 - DNA, 30 bp, Homo sapiens
ctccttcggctttttgccagcaccaacatt

SEQ ID NO: 40052 - DNA, 30 bp, Homo sapiens
tagtggcccagaccagagaggcaggaaggt

SEQ ID NO: 40053 - DNA, 30 bp, Homo sapiens
ccaacattggcctttgcagtccccctgact

SEQ ID NO: 40054 - DNA, 30 bp, Homo sapiens
catgcatcttcaccagcagctggagcatct

SEQ ID NO: 40055 - DNA, 30 bp, Homo sapiens
ccttgggcacgcatcgggcacagttagtgc

SEQ ID NO: 40056 - DNA, 30 bp, Homo sapiens
tcctgggcatttcacatccatgaagtagga

SEQ ID NO: 40057 - DNA, 30 bp, Homo sapiens
tgaaggaacatccttctgtaagccttgctt

SEQ ID NO: 40058 - DNA, 30 bp, Homo sapiens
ttctggtttgttgaaacagtaagtcagaca

SEQ ID NO: 40059 - DNA, 30 bp, Homo sapiens
gtgagtctggcctttcctcctgtaggctgg

SEQ ID NO: 40060 - DNA, 30 bp, Homo sapiens
ctccgggcttctcgctctgactccaaaagg

SEQ ID NO: 40061 - DNA, 30 bp, Homo sapiens
tgcaggctggcattggcattggtgactctg

SEQ ID NO: 40062 - DNA, 30 bp, Homo sapiens
tccttcgcgtactgacggaaacactggcgg

SEQ ID NO: 40063 - DNA, 30 bp, Homo sapiens
tatgctgtggggactggctggggcatggca

SEQ ID NO: 40064 - DNA, 30 bp, Homo sapiens
ggctggggcatggcaggcggctctggcttc

SEQ ID NO: 40065 - DNA, 30 bp, Homo sapiens
gctcgttcaactttagcacctgtctcgtcc

SEQ ID NO: 40066 - DNA, 30 bp, Homo sapiens
tctcgggtcatgatttccatcatcttcttc

SEQ ID NO: 40067 - DNA, 30 bp, Homo sapiens
cacccactgctctgtttggccgccagtctt

SEQ ID NO: 40068 - DNA, 30 bp, Homo sapiens
ctctgtttggtggccagcctcttatctctc

SEQ ID NO: 40069 - DNA, 30 bp, Homo sapiens
ctctgtttggcagccagcctcttgtctctc

SEQ ID NO: 40070 - DNA, 30 bp, Homo sapiens
cagcggttggacttggccacacgctccagc

SEQ ID NO: 40071 - DNA, 30 bp, Homo sapiens
gagaggaaagtctgcgtctcttcgcaattt

SEQ ID NO: 40072 - DNA, 30 bp, Homo sapiens
cacagggtggtggatggcaacttcctcact

SEQ ID NO: 40073 - DNA, 30 bp, Homo sapiens
acagccgcgtggacgtgagtctcttcatgc

SEQ ID NO: 40074 - DNA, 30 bp, Homo sapiens
cacagggctgttgaggtgatttttttaata

SEQ ID NO: 40075 - DNA, 30 bp, Homo sapiens
aggaggggggcagggggccgttggctcggc

SEQ ID NO: 40076 - DNA, 30 bp, Homo sapiens
ctcaggtttcagatccctgtgcaccactcc

SEQ ID NO: 40077 - DNA, 30 bp, Homo sapiens
ctactgagtccgagaactggaagagggtct

SEQ ID NO: 40078 - DNA, 30 bp, Homo sapiens
tacaggccagttgatgttcgctttttcatg

SEQ ID NO: 40079 - DNA, 30 bp, Homo sapiens
aatcttcgaggtgatcggatttttggttca

SEQ ID NO: 40080 - DNA, 30 bp, Homo sapiens
cgcaggtgctctggccgtttggagatcatg

SEQ ID NO: 40081 - DNA, 30 bp, Homo sapiens
gccctggacgcccacggcccctcttggact

SEQ ID NO: 40082 - DNA, 30 bp, Homo sapiens
ccacaggggtaaaaaatggatgagatttga

SEQ ID NO: 40083 - DNA, 30 bp, Homo sapiens
taccccaccagcttgctccattggatggta

SEQ ID NO: 40084 - DNA, 30 bp, Homo sapiens
ccgtgagcttcttatagacaccagaaaaag

SEQ ID NO: 40085 - DNA, 30 bp, Homo sapiens
tgcgggccttgattttcctaagatagaact

SEQ ID NO: 40086 - DNA, 30 bp, Homo sapiens
cctcgtcgtctccagccccagccccaccct

SEQ ID NO: 40087 - DNA, 30 bp, Homo sapiens
ttgcggacccttcgaacagacgccgtgggt

SEQ ID NO: 40088 - DNA, 30 bp, Homo sapiens
caggctgagcgctccagtcttcagtaggga

SEQ ID NO: 40089 - DNA, 30 bp, Homo sapiens
tgatggttctgctcgtcttcatgggtttgc

SEQ ID NO: 40090 - DNA, 30 bp, Homo sapiens
tctgacacgcttctccaccgagtacacgga

SEQ ID NO: 40091 - DNA, 30 bp, Homo sapiens
gtccggttccagcgtccactccgacagcca

SEQ ID NO: 40092 - DNA, 30 bp, Homo sapiens
ctttggagacaggatcgcctgcgtacagcc

SEQ ID NO: 40093 - DNA, 30 bp, Homo sapiens
gtccttttgccagtcatcctgtgcccaggc

SEQ ID NO: 40094 - DNA, 30 bp, Homo sapiens
aagcggagccccaggcactgtagggtcctg

SEQ ID NO: 40095 - DNA, 30 bp, Homo sapiens
tccaggacctgtcagtggctgcagctggac

SEQ ID NO: 40096 - DNA, 30 bp, Homo sapiens
agctggcagcagaaatcgctggcccaggac

SEQ ID NO: 40097 - DNA, 30 bp, Homo sapiens
cacttggcttcattgttctcattttgatcc

SEQ ID NO: 40098 - DNA, 30 bp, Homo sapiens
gaaccgagaggtcgtggcaggacttggatt

SEQ ID NO: 40099 - DNA, 30 bp, Homo sapiens
ataaggagactgtgcttggggccatccact

SEQ ID NO: 40100 - DNA, 30 bp, Homo sapiens
ctttggtccatccactctttccagcttttc

SEQ ID NO: 40101 - DNA, 30 bp, Homo sapiens
agatggcgtttcgtggcgtgccattgtgtg

SEQ ID NO: 40102 - DNA, 30 bp, Homo sapiens
gcagcactctaggggtcccattaggggtgg

SEQ ID NO: 40103 - DNA, 30 bp, Homo sapiens
tacaggaggacgcaggggcagcccccgccc

SEQ ID NO: 40104 - DNA, 30 bp, Homo sapiens
tgttggttctggtgaaggaggacattcctg

SEQ ID NO: 40105 - DNA, 30 bp, Homo sapiens
cagaggtgccctcctttgagctgctgccgt

SEQ ID NO: 40106 - DNA, 30 bp, Homo sapiens
ccacgagctgggaggcgccatcagctgtgg

SEQ ID NO: 40107 - DNA, 30 bp, Homo sapiens
gccaatgggttttgagatacatccatgggt

SEQ ID NO: 40108 - DNA, 30 bp, Homo sapiens
gatccacacatcagacattcatctctattc

SEQ ID NO: 40109 - DNA, 30 bp, Homo sapiens
ccaaggtaaaagaattctctgttggacttg

SEQ ID NO: 40110 - DNA, 30 bp, Homo sapiens
tgaagacgttatctgtggtttctgccataa

SEQ ID NO: 40111 - DNA, 30 bp, Homo sapiens
cagaggggactgggttgcatgtacaacacg

SEQ ID NO: 40112 - DNA, 30 bp, Homo sapiens
cagaaagagcctgacccaggggcatcttgg

SEQ ID NO: 40113 - DNA, 30 bp, Homo sapiens
gcatggaaaccctgttcctgaaggtacagc

SEQ ID NO: 40114 - DNA, 30 bp, Homo sapiens
cactccctgcgtttcttcttcttctccggc

SEQ ID NO: 40115 - DNA, 30 bp, Homo sapiens
ggtcgacgatcctttctgcggtttttgtgt

SEQ ID NO: 40116 - DNA, 30 bp, Homo sapiens
ttctggtctgctgtcatctggcccatcact

SEQ ID NO: 40117 - DNA, 30 bp, Homo sapiens
aagaaatccatagccctgggccttctcctt

SEQ ID NO: 40118 - DNA, 30 bp, Homo sapiens
cttgcctgcatttcgtcgcctctttcgact

SEQ ID NO: 40119 - DNA, 30 bp, Homo sapiens
gtacggtcggaatttgcgctgggcccgcag

SEQ ID NO: 40120 - DNA, 30 bp, Homo sapiens
cttgtagagacatggctgaagctgcaggcc

SEQ ID NO: 40121 - DNA, 30 bp, Homo sapiens
agctgggggtacagggaccctgcggagtgg

SEQ ID NO: 40122 - DNA, 30 bp, Homo sapiens
ctttcctcctgggcgctgtcctccttttct

SEQ ID NO: 40123 - DNA, 30 bp, Homo sapiens
gctccatccggatggcaatgcggacgtgcc

SEQ ID NO: 40124 - DNA, 30 bp, Homo sapiens
tcctggcacaggggagggggttctctgctg

SEQ ID NO: 40125 - DNA, 30 bp, Homo sapiens
taccaatccagcttcagatcagccttactc

SEQ ID NO: 40126 - DNA, 30 bp, Homo sapiens
aagtggttgaatgttcttgcagattgtgtt

SEQ ID NO: 40127 - DNA, 30 bp, Homo sapiens
tccagggcacaattcttcctttaaatcttt

SEQ ID NO: 40128 - DNA, 30 bp, Homo sapiens
tgtaggaactacgatgttttttgcgagcaa

SEQ ID NO: 40129 - DNA, 30 bp, Homo sapiens
cttctggtgctcctgcctcctgcccaccac

SEQ ID NO: 40130 - DNA, 30 bp, Homo sapiens
ttcaggagcactctctggggggttgggaag

SEQ ID NO: 40131 - DNA, 30 bp, Homo sapiens
gactggggtactttgggttttttgggccat

SEQ ID NO: 40132 - DNA, 30 bp, Homo sapiens
ccacatcctcttgtaactgctgtaccattt

SEQ ID NO: 40133 - DNA, 30 bp, Homo sapiens
tcctggaggtctgactgtctagtttcttct

SEQ ID NO: 40134 - DNA, 30 bp, Homo sapiens
tgatggtcttgctggatggggacacggtca

SEQ ID NO: 40135 - DNA, 30 bp, Homo sapiens
tgatggcgatccgggctgcccgctgtaagg

SEQ ID NO: 40136 - DNA, 30 bp, Homo sapiens
tatgacaattcttcctcccctaaggacttc

SEQ ID NO: 40137 - DNA, 30 bp, Homo sapiens
cttcatcttcctcagattcttcattctcag

SEQ ID NO: 40138 - DNA, 30 bp, Homo sapiens
gagaaggcatatgctccaggccaaaggttg

SEQ ID NO: 40139 - DNA, 30 bp, Homo sapiens
tcatctgtctcctcgccctcctcctcctcc

SEQ ID NO: 40140 - DNA, 30 bp, Homo sapiens
ggctggctcccattctatagcatgaagggc

SEQ ID NO: 40141 - DNA, 30 bp, Homo sapiens
tatagcatgaagggcaagtccatgttcttc

SEQ ID NO: 40142 - DNA, 30 bp, Homo sapiens
ggcaggccctgcagatgtgagtggccccac

SEQ ID NO: 40143 - DNA, 30 bp, Homo sapiens
tattggttagctctgtctgtagctaggaag

SEQ ID NO: 40144 - DNA, 30 bp, Homo sapiens
agtgtacagtgctgactgataccgatttct

SEQ ID NO: 40145 - DNA, 30 bp, Homo sapiens
tgcaggccgggctggcgcggcctcacgtcc

SEQ ID NO: 40146 - DNA, 30 bp, Homo sapiens
tactgccagtgtgtccaacactagcccatc

SEQ ID NO: 40147 - DNA, 30 bp, Homo sapiens
ggcaggtctccagctgcaaggcacaatcca

SEQ ID NO: 40148 - DNA, 30 bp, Homo sapiens
cacaggactgcccattagtctttcttgtcg

SEQ ID NO: 40149 - DNA, 30 bp, Homo sapiens
ctcgcattgaagatgtgaaacccaaaccca

SEQ ID NO: 40150 - DNA, 30 bp, Homo sapiens
tccatatggactttttttctgatctatttt

SEQ ID NO: 40151 - DNA, 30 bp, Homo sapiens
ctgttcttggctgccaggggtttccggctg

SEQ ID NO: 40152 - DNA, 30 bp, Homo sapiens
taggggccgctgccgcttccactgccactc

SEQ ID NO: 40153 - DNA, 30 bp, Homo sapiens
ggaagggtgggagcagggacctggggagta

SEQ ID NO: 40154 - DNA, 30 bp, Homo sapiens
ccttggcattcaataatataagtatcttta

SEQ ID NO: 40155 - DNA, 30 bp, Homo sapiens
atcacagcaattggtctcagtttaatggct

SEQ ID NO: 40156 - DNA, 30 bp, Homo sapiens
tagaggccccactcagatgctgcaggcccg

SEQ ID NO: 40157 - DNA, 30 bp, Homo sapiens
cactggggctctggccagaagacctgcatg

SEQ ID NO: 40158 - DNA, 30 bp, Homo sapiens
tcgttttttgtagtcttccaagttcagaga

SEQ ID NO: 40159 - DNA, 30 bp, Homo sapiens
agtaggacgtgtgggtgacccagtgggcag

SEQ ID NO: 40160 - DNA, 30 bp, Homo sapiens
agttggttttcttctctctagaatcaaggc

SEQ ID NO: 40161 - DNA, 30 bp, Homo sapiens
cactggtgactggagccaagtgcgaggttg

SEQ ID NO: 40162 - DNA, 30 bp, Homo sapiens
gccatgatctagggtccagaatgtctttga

SEQ ID NO: 40163 - DNA, 30 bp, Homo sapiens
tcaccacatcagtatcaaacacattagctc

SEQ ID NO: 40164 - DNA, 30 bp, Homo sapiens
tcgaggttagcatcttcgtcctcatcaggc

SEQ ID NO: 40165 - DNA, 30 bp, Homo sapiens
cccaggagaaagtggtggctctcctggggt

SEQ ID NO: 40166 - DNA, 30 bp, Homo sapiens
tactggcaggcctggatgtttcccgcctgc

SEQ ID NO: 40167 - DNA, 30 bp, Homo sapiens
tactggtgagctgtgttatttgtcgttgcc

SEQ ID NO: 40168 - DNA, 30 bp, Homo sapiens
attcggccacgagcagctcggtggcccccc

SEQ ID NO: 40169 - DNA, 30 bp, Homo sapiens
gctcgggcaggcagggctggcgctggacta

SEQ ID NO: 40170 - DNA, 30 bp, Homo sapiens
atgtggcaggaacacaagaggtctctgggg

SEQ ID NO: 40171 - DNA, 30 bp, Homo sapiens
tctgttggtgagatgcggtggatggcgatg

SEQ ID NO: 40172 - DNA, 30 bp, Homo sapiens
tagaagtcctcgtcctcctcccatccaaag

SEQ ID NO: 40173 - DNA, 30 bp, Homo sapiens
caagaacacaagaggtttctgggggtgggg

SEQ ID NO: 40174 - DNA, 30 bp, Homo sapiens
tgttggtatgggccttctgatgatggcctg

SEQ ID NO: 40175 - DNA, 30 bp, Homo sapiens
agcgcctgggattttagcctgaatctttgc

SEQ ID NO: 40176 - DNA, 30 bp, Homo sapiens
attcggctttggctttggatccggagactg

SEQ ID NO: 40177 - DNA, 30 bp, Homo sapiens
ttttggcgattccagggagttttgcttgga

SEQ ID NO: 40178 - DNA, 30 bp, Homo sapiens
tagtacaagtaacgacgttataactattaa

SEQ ID NO: 40179 - DNA, 30 bp, Homo sapiens
taaagggaaaggatgggagaaaacaccaaa

SEQ ID NO: 40180 - DNA, 30 bp, Homo sapiens
tccagggatttttgcttggattttagccat

SEQ ID NO: 40181 - DNA, 30 bp, Homo sapiens
gcgtgtcctctttccaccttcaggaaggct

SEQ ID NO: 40182 - DNA, 30 bp, Homo sapiens
agcagggcccaagcactgtccacagcacca

SEQ ID NO: 40183 - DNA, 30 bp, Homo sapiens
cagcggagagtgaccgccagccccagtgtc

SEQ ID NO: 40184 - DNA, 30 bp, Homo sapiens
cagaggtggtggggcaccaggagcaggagg

SEQ ID NO: 40185 - DNA, 30 bp, Homo sapiens
atacggagctacggaaagagaactgcaggt

SEQ ID NO: 40186 - DNA, 30 bp, Homo sapiens
aaagaaggcaggactgaggaaggagaactg

SEQ ID NO: 40187 - DNA, 30 bp, Homo sapiens
taacaatgagaatgacacaacagcagaaaa

SEQ ID NO: 40188 - DNA, 30 bp, Homo sapiens
cagtggatctgggtctcgactgggccctaa

SEQ ID NO: 40189 - DNA, 30 bp, Homo sapiens
ctgcgggtagatcccggggttcagccgaca

SEQ ID NO: 40190 - DNA, 30 bp, Homo sapiens
ttaaggagctgcacgaggttttcaagacat

SEQ ID NO: 40191 - DNA, 30 bp, Homo sapiens
aggtggcctccaggacggcggcttccaggg

SEQ ID NO: 40192 - DNA, 30 bp, Homo sapiens
cagaggccacactttccagaagttttctcc

SEQ ID NO: 40193 - DNA, 30 bp, Homo sapiens
ctcaggggcatcatgttgctgcagaggcca

SEQ ID NO: 40194 - DNA, 30 bp, Homo sapiens
aggaggccgtggaggagcagcgctgcagga

SEQ ID NO: 40195 - DNA, 30 bp, Homo sapiens
tgtactggtcctgcgtgtcactgctggcac

SEQ ID NO: 40196 - DNA, 30 bp, Homo sapiens
gacaggaatcacaaacccgtactggttttg

SEQ ID NO: 40197 - DNA, 30 bp, Homo sapiens
gattagtcttctcttccaagcgactgttta

SEQ ID NO: 40198 - DNA, 30 bp, Homo sapiens
gatgttttgggatcagtttatttgctgcac

SEQ ID NO: 40199 - DNA, 30 bp, Homo sapiens
tgatgggctggtagaatattgcttcatcag

SEQ ID NO: 40200 - DNA, 30 bp, Homo sapiens
acctgggcttctcttccctgggcgcagggt

SEQ ID NO: 40201 - DNA, 30 bp, Homo sapiens
aaaaggcatctttgatgtttttgagctggc

SEQ ID NO: 40202 - DNA, 30 bp, Homo sapiens
atttggctctgagcttccgatgggacccca

SEQ ID NO: 40203 - DNA, 30 bp, Homo sapiens
agctggggctcagtgctgggctgccctcgg

SEQ ID NO: 40204 - DNA, 30 bp, Homo sapiens
gcctggacttgtcatctctgttgtaggact

SEQ ID NO: 40205 - DNA, 30 bp, Homo sapiens
catctccagggtgctgtgtcttcctcctgc

SEQ ID NO: 40206 - DNA, 30 bp, Homo sapiens
agtagggcctccacacggcctcctccaggc

SEQ ID NO: 40207 - DNA, 30 bp, Homo sapiens
gcgaggggttgtctctatggtggaaggggt

SEQ ID NO: 40208 - DNA, 30 bp, Homo sapiens
atatggtcgccaaacagattcatccattct

SEQ ID NO: 40209 - DNA, 30 bp, Homo sapiens
agtagggccgccacacggcctcatccatgc

SEQ ID NO: 40210 - DNA, 30 bp, Homo sapiens
acaagggaggtataccccacaggcaccaga

SEQ ID NO: 40211 - DNA, 30 bp, Homo sapiens
ttttggctgcttccaggggttggacttgga

SEQ ID NO: 40212 - DNA, 30 bp, Homo sapiens
catgggacctgtttcatttcctgtggagta

SEQ ID NO: 40213 - DNA, 30 bp, Homo sapiens
tgctggtcagccaggattttggcggaggac

SEQ ID NO: 40214 - DNA, 30 bp, Homo sapiens
ggccggggtcagcagctgcactgagtacct

SEQ ID NO: 40215 - DNA, 30 bp, Homo sapiens
caggaggtgtccatggtctcgcctttgagt

SEQ ID NO: 40216 - DNA, 30 bp, Homo sapiens
gtcagctgagtcactctctgggtcagcagg

SEQ ID NO: 40217 - DNA, 30 bp, Homo sapiens
tccatagtcaccatgagcctcaaggagtaa

SEQ ID NO: 40218 - DNA, 30 bp, Homo sapiens
acaccaaagaacatctggaaaacatcccca

SEQ ID NO: 40219 - DNA, 30 bp, Homo sapiens
gagtccacatctactttggaggttttctga

SEQ ID NO: 40220 - DNA, 30 bp, Homo sapiens
caagtacaaattcggagaaaagcttcttaa

SEQ ID NO: 40221 - DNA, 30 bp, Homo sapiens
ttgaggttgtttctgtctccctgtagtaaa

SEQ ID NO: 40222 - DNA, 30 bp, Homo sapiens
agccagttttgcttaaatgcttcacaacat

SEQ ID NO: 40223 - DNA, 30 bp, Homo sapiens
aataggaattgagtctcgttgattgagaaa

SEQ ID NO: 40224 - DNA, 30 bp, Homo sapiens
gtttcagggaagaggagtcctctatccaca

SEQ ID NO: 40225 - DNA, 30 bp, Homo sapiens
agtaggcagagctgctgggcagcaggtcgt

SEQ ID NO: 40226 - DNA, 30 bp, Homo sapiens
tgtccctctgtccaggttggtgagcagggt

SEQ ID NO: 40227 - DNA, 30 bp, Homo sapiens
tcatttggtgcggcgcctccagcatctcca

SEQ ID NO: 40228 - DNA, 30 bp, Homo sapiens
tgatggggagcctcaagcatctccatgagg

SEQ ID NO: 40229 - DNA, 30 bp, Homo sapiens
cagcggggtctccaacatctccatgaggaa

SEQ ID NO: 40230 - DNA, 30 bp, Homo sapiens
ctttggcgtggaggaacgggaggagccctt

SEQ ID NO: 40231 - DNA, 30 bp, Homo sapiens
cgtaggcccccagggctgcatgaaactctg

SEQ ID NO: 40232 - DNA, 30 bp, Homo sapiens
agctggtcctcatactgcttacggaaacaa

SEQ ID NO: 40233 - DNA, 30 bp, Homo sapiens
agctggtcttcatactgtttccggaagcaa

SEQ ID NO: 40234 - DNA, 30 bp, Homo sapiens
caccggctgggaagaaatcccaacaccttt

SEQ ID NO: 40235 - DNA, 30 bp, Homo sapiens
agaaattgttacaggccactgtgagagcag

SEQ ID NO: 40236 - DNA, 30 bp, Homo sapiens
tctttcccttctgcttcatgtgtactacaa

SEQ ID NO: 40237 - DNA, 30 bp, Homo sapiens
gtccgcttctgggaagggacagccttgagg

SEQ ID NO: 40238 - DNA, 30 bp, Homo sapiens
ctttgtgggtgtggtaatgggcagccttca

SEQ ID NO: 40239 - DNA, 30 bp, Homo sapiens
cttcaggtctttcttcttcctgatttcctt

SEQ ID NO: 40240 - DNA, 30 bp, Homo sapiens
ccccggacaggcctctccagcttcacactc

SEQ ID NO: 40241 - DNA, 30 bp, Homo sapiens
tcatggatgagtttggcgatggggccggtg

SEQ ID NO: 40242 - DNA, 30 bp, Homo sapiens
ggtcggtctgggcagccctggaagaagtca

SEQ ID NO: 40243 - DNA, 30 bp, Homo sapiens
tactgggagcaggggggctctgaggggcag

SEQ ID NO: 40244 - DNA, 30 bp, Homo sapiens
tcctgggctgcttatctgggaagccttcaa

SEQ ID NO: 40245 - DNA, 30 bp, Homo sapiens
cacttgttgtcctctagaaagaagtcgttg

SEQ ID NO: 40246 - DNA, 30 bp, Homo sapiens
agggcttcattgtagatcaaagccaaggcc

SEQ ID NO: 40247 - DNA, 30 bp, Homo sapiens
cactggctgcccccggaacagggcgctgct

SEQ ID NO: 40248 - DNA, 30 bp, Homo sapiens
cacttccacagggtcacccacataggcaca

SEQ ID NO: 40249 - DNA, 30 bp, Homo sapiens
cactggcttcccccggaacagggtgccact

SEQ ID NO: 40250 - DNA, 30 bp, Homo sapiens
ttgtggctttcttcatggctttttttgtgg

SEQ ID NO: 40251 - DNA, 30 bp, Homo sapiens
tagggggtgccctccccgaggcctggctta

SEQ ID NO: 40252 - DNA, 30 bp, Homo sapiens
tcgtggcaggcagtagtaaccatggcaaca

SEQ ID NO: 40253 - DNA, 30 bp, Homo sapiens
ccattcttgtccagttcttgaaagagatca

SEQ ID NO: 40254 - DNA, 30 bp, Homo sapiens
ttctcaaagtacttgtgacaggcagacgtg

SEQ ID NO: 40255 - DNA, 30 bp, Homo sapiens
gtctgggagacgctggaaccgatggtggct

SEQ ID NO: 40256 - DNA, 30 bp, Homo sapiens
tgaccacgaattcattaaaatccacttcgt

SEQ ID NO: 40257 - DNA, 30 bp, Homo sapiens
gacataatggtctctgggttgtccccttcg

SEQ ID NO: 40258 - DNA, 30 bp, Homo sapiens
gaccaccgtgttgccctccagaaacgtggg

SEQ ID NO: 40259 - DNA, 30 bp, Homo sapiens
ctgaagtgctgcgttcttgtccatgatgca

SEQ ID NO: 40260 - DNA, 30 bp, Homo sapiens
cgctggagatgctggacaggggctcccgca

SEQ ID NO: 40261 - DNA, 30 bp, Homo sapiens
agccggttctgataccagagtccgggcggc

SEQ ID NO: 40262 - DNA, 30 bp, Homo sapiens
ctcaggcaggccagcaggtcggaagtgatt

SEQ ID NO: 40263 - DNA, 30 bp, Homo sapiens
cacccccaggtccccttttggcagcatcat

SEQ ID NO: 40264 - DNA, 30 bp, Homo sapiens
cttaggcaggccgtcaggtctgaagcggtc

SEQ ID NO: 40265 - DNA, 30 bp, Homo sapiens
acttgggaagtttttttccaagtcatcagc

SEQ ID NO: 40266 - DNA, 30 bp, Homo sapiens
caggctggggacccaggtctgtccgtgccc

SEQ ID NO: 40267 - DNA, 30 bp, Homo sapiens
gtctgggagcatcgacaaaatctttgccat

SEQ ID NO: 40268 - DNA, 30 bp, Homo sapiens
ccctcatagcaacctcagaagtgaacctgt

SEQ ID NO: 40269 - DNA, 30 bp, Homo sapiens
tgaaggaaggggacagggaatacaggtggg

SEQ ID NO: 40270 - DNA, 30 bp, Homo sapiens
acttggggccaaggcactccacaatcccat

SEQ ID NO: 40271 - DNA, 30 bp, Homo sapiens
caatttcctgtgccaaaatccctccaacca

SEQ ID NO: 40272 - DNA, 30 bp, Homo sapiens
tagcggcgagtgaagcgggcatcgctgggc

SEQ ID NO: 40273 - DNA, 30 bp, Homo sapiens
tagcggcgggtgaagtgggggtacgggggg

SEQ ID NO: 40274 - DNA, 30 bp, Homo sapiens
ctcagcttctcctgcatctttcagattatg

SEQ ID NO: 40275 - DNA, 30 bp, Homo sapiens
agatggcagtgggaatctatttctttaagc

SEQ ID NO: 40276 - DNA, 30 bp, Homo sapiens
tgtcctccacgaagcgggtgaagcggaagt

SEQ ID NO: 40277 - DNA, 30 bp, Homo sapiens
catgggatcgtggggtcatcttttcgggga

SEQ ID NO: 40278 - DNA, 30 bp, Homo sapiens
tgatgggcttctcaggcactgccttgggtg

SEQ ID NO: 40279 - DNA, 30 bp, Homo sapiens
tccttgttatcctcgataaaccgcgtgaat

SEQ ID NO: 40280 - DNA, 30 bp, Homo sapiens
gctgaccgcaatcttgttttcttccaggaa

SEQ ID NO: 40281 - DNA, 30 bp, Homo sapiens
aagccatcggggtcatcatcctcaaagtgg

SEQ ID NO: 40282 - DNA, 30 bp, Homo sapiens
cgaaggaagcttggctgagcagctgcaggc

SEQ ID NO: 40283 - DNA, 30 bp, Homo sapiens
cacagaggctgggaagggtcgggggcccct

SEQ ID NO: 40284 - DNA, 30 bp, Homo sapiens
ctcctgtctgtcctaatagtaaggtggtct

SEQ ID NO: 40285 - DNA, 30 bp, Homo sapiens
agctggagcacctgttgtaagatgtgctgc

SEQ ID NO: 40286 - DNA, 30 bp, Homo sapiens
cagaggttttacatgatattcgtagatttt

SEQ ID NO: 40287 - DNA, 30 bp, Homo sapiens
gctcttcttggcctcctgctctcggcgccg

SEQ ID NO: 40288 - DNA, 30 bp, Homo sapiens
tggttcagtgcaaggtaattcctcattctc

SEQ ID NO: 40289 - DNA, 30 bp, Homo sapiens
gagtgggtgctgaaatcctacttcgttttc

SEQ ID NO: 40290 - DNA, 30 bp, Homo sapiens
agatggtggaggtccggtcaaccccgtctc

SEQ ID NO: 40291 - DNA, 30 bp, Homo sapiens
agatggtggaggttttgtctgtcccatcac

SEQ ID NO: 40292 - DNA, 30 bp, Homo sapiens
cagagatccctcgacgggccacccaaggcg

SEQ ID NO: 40293 - DNA, 30 bp, Homo sapiens
cttcggccaattcattaagtactctaggat

SEQ ID NO: 40294 - DNA, 30 bp, Homo sapiens
tcaattcctttaggaattattgtatcctgg

SEQ ID NO: 40295 - DNA, 30 bp, Homo sapiens
ccttgctctcctactctgctgatatgctct

SEQ ID NO: 40296 - DNA, 30 bp, Homo sapiens
acgcatagaagcactaaaaagatacttaca

SEQ ID NO: 40297 - DNA, 30 bp, Homo sapiens
caatggaaaatcccaggtaaaaagacacct

SEQ ID NO: 40298 - DNA, 30 bp, Homo sapiens
cagagggccttcaatggaaaatcctaggta

SEQ ID NO: 40299 - DNA, 30 bp, Homo sapiens
cattgggtcatctttaaaaagctggactct

SEQ ID NO: 40300 - DNA, 30 bp, Homo sapiens
tacaggaaccttatcccagctccaaactgg

SEQ ID NO: 40301 - DNA, 30 bp, Homo sapiens
acttggctctgtgataataatcttatgtac

SEQ ID NO: 40302 - DNA, 30 bp, Homo sapiens
gcttcaatttggacacttttttgacagtcc

SEQ ID NO: 40303 - DNA, 30 bp, Homo sapiens
tgaaggaggtggtgcccgatttggaggggt

SEQ ID NO: 40304 - DNA, 30 bp, Homo sapiens
caatgggtgtctggggtctgtgggagagag

SEQ ID NO: 40305 - DNA, 30 bp, Homo sapiens
gaacaccactatcaaccttgagatctgatt

SEQ ID NO: 40306 - DNA, 30 bp, Homo sapiens
gcttggccttcttcacaatggtgcccacag

SEQ ID NO: 40307 - DNA, 30 bp, Homo sapiens
tcaagctgcttgccaccctccgatttctgg

SEQ ID NO: 40308 - DNA, 30 bp, Homo sapiens
acacgggtagggcctcttggccccttggtg

SEQ ID NO: 40309 - DNA, 30 bp, Homo sapiens
tgaaggtggaatccagaggtcccccgtcct

SEQ ID NO: 40310 - DNA, 30 bp, Homo sapiens
cagcggaaaccctcgccgtaaccttgcctc

SEQ ID NO: 40311 - DNA, 30 bp, Homo sapiens
cagcggaagccttctccgtaaccttgtctt

SEQ ID NO: 40312 - DNA, 30 bp, Homo sapiens
tcctggtaccaccatatcctgatgcagttc

SEQ ID NO: 40313 - DNA, 30 bp, Homo sapiens
gtagattcccttcaccctcttgttgttggg

SEQ ID NO: 40314 - DNA, 30 bp, Homo sapiens
ggttggacccatgggtgcagcaccctccaa

SEQ ID NO: 40315 - DNA, 30 bp, Homo sapiens
gcgctctgctcttttcctcttctttgcctc

SEQ ID NO: 40316 - DNA, 30 bp, Homo sapiens
tgttctgcagcctgttttctagggtgacgt

SEQ ID NO: 40317 - DNA, 30 bp, Homo sapiens
agcaggctggccaggcagcccaggcttccg

SEQ ID NO: 40318 - DNA, 30 bp, Homo sapiens
acttggtgatggtgttcgcgttcatgctct

SEQ ID NO: 40319 - DNA, 30 bp, Homo sapiens
cactttctcagaaacagcttggcaaaatcg

SEQ ID NO: 40320 - DNA, 30 bp, Homo sapiens
tacatggcctcagggcctggcggcagtttg

SEQ ID NO: 40321 - DNA, 30 bp, Homo sapiens
caaggtgccccggccagggagaggccttgc

SEQ ID NO: 40322 - DNA, 30 bp, Homo sapiens
cccagggaaataggctgaagacgcagaggg

SEQ ID NO: 40323 - DNA, 30 bp, Homo sapiens
tcctctgttgccatttttagcaagtactcc

SEQ ID NO: 40324 - DNA, 30 bp, Homo sapiens
aactttctcgttgcctctccttgaaagcag

SEQ ID NO: 40325 - DNA, 30 bp, Homo sapiens
actgacagctcttcttctagtttcactgaa

SEQ ID NO: 40326 - DNA, 30 bp, Homo sapiens
ggcaggtgctgccttgcttttgtcagcatt

SEQ ID NO: 40327 - DNA, 30 bp, Homo sapiens
tgatggctatcttggtaagcttgtgtgaca

SEQ ID NO: 40328 - DNA, 30 bp, Homo sapiens
tgttgggcataccactgctgtctctgcttt

SEQ ID NO: 40329 - DNA, 30 bp, Homo sapiens
ccctctggttggggttttctgaatcatcta

SEQ ID NO: 40330 - DNA, 30 bp, Homo sapiens
ctgcaggaataatcttgcggaagaatttat

SEQ ID NO: 40331 - DNA, 30 bp, Homo sapiens
tagaggcaacaagagattggagctagaagt

SEQ ID NO: 40332 - DNA, 30 bp, Homo sapiens
tccctgccaggggtctcaactgtaactcgc

SEQ ID NO: 40333 - DNA, 30 bp, Homo sapiens
aacctttgcctttagtttccttttttatta

SEQ ID NO: 40334 - DNA, 30 bp, Homo sapiens
gacaggcagctctggatccggtccacccac

SEQ ID NO: 40335 - DNA, 30 bp, Homo sapiens
ctctggatcttgtccatccattgctgggca

SEQ ID NO: 40336 - DNA, 30 bp, Homo sapiens
cgatggccgtggccagcaccacctgccctt

SEQ ID NO: 40337 - DNA, 30 bp, Homo sapiens
ctcctcttccaccgctcccactgcctccgc

SEQ ID NO: 40338 - DNA, 30 bp, Homo sapiens
cagggagctcccccatctgtccccgtcctc

SEQ ID NO: 40339 - DNA, 30 bp, Homo sapiens
agttggtgatgctctgagggtgatgctgtt

SEQ ID NO: 40340 - DNA, 30 bp, Homo sapiens
gagaggagcctgggcgccggggaagggtgg

SEQ ID NO: 40341 - DNA, 30 bp, Homo sapiens
tagggcatgatgttggcgacgctcctccac

SEQ ID NO: 40342 - DNA, 30 bp, Homo sapiens
cactggtctactcgccgaacttttttccaa

SEQ ID NO: 40343 - DNA, 30 bp, Homo sapiens
cctgaatggctgctgcgctttccctctgtc

SEQ ID NO: 40344 - DNA, 30 bp, Homo sapiens
gagagggggcaggggcaggcccgggccacc

SEQ ID NO: 40345 - DNA, 30 bp, Homo sapiens
ttttcttttggctccccttccgtgaatatt

SEQ ID NO: 40346 - DNA, 30 bp, Homo sapiens
acgaggagcctctgctgctgagccagaatc

SEQ ID NO: 40347 - DNA, 30 bp, Homo sapiens
agtttctgtgctttctaccactggttcact

SEQ ID NO: 40348 - DNA, 30 bp, Homo sapiens
gaatggatgctaattccaaaatgtgcttct

SEQ ID NO: 40349 - DNA, 30 bp, Homo sapiens
aaagcattctgagctgcactagatgctgca

SEQ ID NO: 40350 - DNA, 30 bp, Homo sapiens
ccctggaaggctccttgggcagcagatgaa

SEQ ID NO: 40351 - DNA, 30 bp, Homo sapiens
cacggggcccggaaggcattttcagcagcc

SEQ ID NO: 40352 - DNA, 30 bp, Homo sapiens
cgatgcggcgaggggccacacacggcgggg

SEQ ID NO: 40353 - DNA, 30 bp, Homo sapiens
cattggagtacgtgtaattgggggtggcgg

SEQ ID NO: 40354 - DNA, 30 bp, Homo sapiens
agccagtgatgcgcacatccgtgcggcggc

SEQ ID NO: 40355 - DNA, 30 bp, Homo sapiens
tctccagcacagagggcacatacaccaggc

SEQ ID NO: 40356 - DNA, 30 bp, Homo sapiens
cccaggcctgctgaggaaatctgttagcca

SEQ ID NO: 40357 - DNA, 30 bp, Homo sapiens
cagtagaagctctggcttcctggtggacct

SEQ ID NO: 40358 - DNA, 30 bp, Homo sapiens
aggatggtgacattgcgaaggatttctcca

SEQ ID NO: 40359 - DNA, 30 bp, Homo sapiens
cgctggcatcttcggcatgtccacagtttg

SEQ ID NO: 40360 - DNA, 30 bp, Homo sapiens
ctgtggggctggggggctgtccgctgggag

SEQ ID NO: 40361 - DNA, 30 bp, Homo sapiens
gttttgcttcctgcagcacagagcccttgg

SEQ ID NO: 40362 - DNA, 30 bp, Homo sapiens
atgaggggtgctctttcatccgctgttccc

SEQ ID NO: 40363 - DNA, 30 bp, Homo sapiens
ttctggtggcctggagatgggtacaacatt

SEQ ID NO: 40364 - DNA, 30 bp, Homo sapiens
taggctggaggtgcgcgggatggcgaatgg

SEQ ID NO: 40365 - DNA, 30 bp, Homo sapiens
tacagggtgggtgcgcccgccctgcccagc

SEQ ID NO: 40366 - DNA, 30 bp, Homo sapiens
ttgttgagtctgtcaatcaactttgttttg

SEQ ID NO: 40367 - DNA, 30 bp, Homo sapiens
ttgtagtttccatctccggttcttttaatc

SEQ ID NO: 40368 - DNA, 30 bp, Homo sapiens
tcctggccttccgggcctcgatcatcggct

SEQ ID NO: 40369 - DNA, 30 bp, Homo sapiens
gaatacctccagggacacagaaagagcacg

SEQ ID NO: 40370 - DNA, 30 bp, Homo sapiens
actatcacccgcttgtagattttccaaagg

SEQ ID NO: 40371 - DNA, 30 bp, Homo sapiens
cccaccacaaaaacaatggcctcttggaat

SEQ ID NO: 40372 - DNA, 30 bp, Homo sapiens
ccaaggtctggatgcagtcggtcagttgca

SEQ ID NO: 40373 - DNA, 30 bp, Homo sapiens
ctctcttagcaatatgctcccttccctttt

SEQ ID NO: 40374 - DNA, 30 bp, Homo sapiens
tgatggcctcggcttcttccttgtcaagga

SEQ ID NO: 40375 - DNA, 30 bp, Homo sapiens
ctctggatccttatcctcatctgaaaaatg

SEQ ID NO: 40376 - DNA, 30 bp, Homo sapiens
ctttgggctattttttccatgagcttaatg

SEQ ID NO: 40377 - DNA, 30 bp, Homo sapiens
aggcaccgtcctgactgcccagcacttgca

SEQ ID NO: 40378 - DNA, 30 bp, Homo sapiens
tatccacgcatttcttcacttccatcttgg

SEQ ID NO: 40379 - DNA, 30 bp, Homo sapiens
cttccgcaatgaggcttcgtttctgaaggg

SEQ ID NO: 40380 - DNA, 30 bp, Homo sapiens
ctttttcaatgagagtcgtttcttaaaaga

SEQ ID NO: 40381 - DNA, 30 bp, Homo sapiens
gctgtcgtacactgtatgcatcatcagtcc

SEQ ID NO: 40382 - DNA, 30 bp, Homo sapiens
cattgctcagagtttcatccgtttggttaa

SEQ ID NO: 40383 - DNA, 30 bp, Homo sapiens
agaaggctgcttctatgcaatcgttgctct

SEQ ID NO: 40384 - DNA, 30 bp, Homo sapiens
gtcagggcccccagcagggccttcagggcc

SEQ ID NO: 40385 - DNA, 30 bp, Homo sapiens
gtttcttcacagcttcagaagcctctggtc

SEQ ID NO: 40386 - DNA, 30 bp, Homo sapiens
tatgggttgattttcagcccaagacacaaa

SEQ ID NO: 40387 - DNA, 30 bp, Homo sapiens
tgcaggcattttctctgccatgtgcttctg

SEQ ID NO: 40388 - DNA, 30 bp, Homo sapiens
gaatggcatgaacccgggaggcggagcttg

SEQ ID NO: 40389 - DNA, 30 bp, Homo sapiens
ttcaggctcaatgtagcttgggatggaaac

SEQ ID NO: 40390 - DNA, 30 bp, Homo sapiens
taccacttgctggaatcccagcccaggaac

SEQ ID NO: 40391 - DNA, 30 bp, Homo sapiens
atccgggaggcggagcttgcagtgagccga

SEQ ID NO: 40392 - DNA, 30 bp, Homo sapiens
tcatcagggaggctgcttttcttctctgca

SEQ ID NO: 40393 - DNA, 30 bp, Homo sapiens
aatatttcagctgcccatttagttctccta

SEQ ID NO: 40394 - DNA, 30 bp, Homo sapiens
gcctggtcctccagctgcgccacggcctgc

SEQ ID NO: 40395 - DNA, 30 bp, Homo sapiens
aatgtggtaggagagcttgagtgcaggccc

SEQ ID NO: 40396 - DNA, 30 bp, Homo sapiens
ttaagtcggtcaatgtagtagcatagcttc

SEQ ID NO: 40397 - DNA, 30 bp, Homo sapiens
tgctggccccagcttcagccccatatactt

SEQ ID NO: 40398 - DNA, 30 bp, Homo sapiens
atgtggtagcagagtttcagtgcaggtccc

SEQ ID NO: 40399 - DNA, 30 bp, Homo sapiens
ggcaatcagctccatactggtggcttcatc

SEQ ID NO: 40400 - DNA, 30 bp, Homo sapiens
cagtggaccttgcccttggccaccccaaag

SEQ ID NO: 40401 - DNA, 30 bp, Homo sapiens
gctttttcatctttgccttcttgctcatgt

SEQ ID NO: 40402 - DNA, 30 bp, Homo sapiens
cccgagaaacacatcggattattatcccgg

SEQ ID NO: 40403 - DNA, 30 bp, Homo sapiens
ggacgcccgtgcagttctctttgctttcag

SEQ ID NO: 40404 - DNA, 30 bp, Homo sapiens
tatctttccctttgtcttccttttctgatt

SEQ ID NO: 40405 - DNA, 30 bp, Homo sapiens
acttggcgccatcatccgggttgccttcac

SEQ ID NO: 40406 - DNA, 30 bp, Homo sapiens
gtctggttttgttacactatcataggaagg

SEQ ID NO: 40407 - DNA, 30 bp, Homo sapiens
cactggtaccgcagagttctccttgttctc

SEQ ID NO: 40408 - DNA, 30 bp, Homo sapiens
agacaagagactccttgacacctgggcgca

SEQ ID NO: 40409 - DNA, 30 bp, Homo sapiens
agaccagggtggccagccctggttgagagg

SEQ ID NO: 40410 - DNA, 30 bp, Homo sapiens
tgaaggtggtttctcctctgccttggagcc

SEQ ID NO: 40411 - DNA, 30 bp, Homo sapiens
cgatggactcacggtccctgtccggagaag

SEQ ID NO: 40412 - DNA, 30 bp, Homo sapiens
atctggctttgaataggtgacttttcctta

SEQ ID NO: 40413 - DNA, 30 bp, Homo sapiens
acacttggattctctgacctctttttgtct

SEQ ID NO: 40414 - DNA, 30 bp, Homo sapiens
tgtctttccctttgtcttccttttctgttc

SEQ ID NO: 40415 - DNA, 30 bp, Homo sapiens
ccaaggggagatcaggtggttcctcctcat

SEQ ID NO: 40416 - DNA, 30 bp, Homo sapiens
cagggcccccccagaggacaggtggaggaa

SEQ ID NO: 40417 - DNA, 30 bp, Homo sapiens
agatggcatcaccctcactgtcagactcga

SEQ ID NO: 40418 - DNA, 30 bp, Homo sapiens
tctcaaggggctggggcccagcccagctct

SEQ ID NO: 40419 - DNA, 30 bp, Homo sapiens
agctcatccagcatctgggtatctgtgagc

SEQ ID NO: 40420 - DNA, 30 bp, Homo sapiens
gtatggcctcatgtgtgtggcaattgaagc

SEQ ID NO: 40421 - DNA, 30 bp, Homo sapiens
gacaggacactgcggaaagccgccatgtgc

SEQ ID NO: 40422 - DNA, 30 bp, Homo sapiens
ctgcatctactcttgcagagagatcttcaa

SEQ ID NO: 40423 - DNA, 30 bp, Homo sapiens
gcctggctgaagctgaagattttgtaactt

SEQ ID NO: 40424 - DNA, 30 bp, Homo sapiens
agcaggaatgtcctcctgtagcgcctagtg

SEQ ID NO: 40425 - DNA, 30 bp, Homo sapiens
gccaggaagtctgagtcagccattgtgatt

SEQ ID NO: 40426 - DNA, 30 bp, Homo sapiens
ctttgaaaaccctttccagcttccagctaa

SEQ ID NO: 40427 - DNA, 30 bp, Homo sapiens
tattcttgctgagtcaccagtctcatcatc

SEQ ID NO: 40428 - DNA, 30 bp, Homo sapiens
ctttggtccaaagaaaacgtcttttgggca

SEQ ID NO: 40429 - DNA, 30 bp, Homo sapiens
aggagggcacagggcccaggccacggcgcc

SEQ ID NO: 40430 - DNA, 30 bp, Homo sapiens
caacacagtcatagaaaaggtcccccactt

SEQ ID NO: 40431 - DNA, 30 bp, Homo sapiens
ctccctgggggatacctgatctctctccat

SEQ ID NO: 40432 - DNA, 30 bp, Homo sapiens
gcctggctctccctcttcacgaaggcctgg

SEQ ID NO: 40433 - DNA, 30 bp, Homo sapiens
caagatgcttgttttgaaggattgattcca

SEQ ID NO: 40434 - DNA, 30 bp, Homo sapiens
taggcctgcacagggctgagctgtggcggc

SEQ ID NO: 40435 - DNA, 30 bp, Homo sapiens
agctggccgggccggcgggggtcggcgggg

SEQ ID NO: 40436 - DNA, 30 bp, Homo sapiens
atctgggccgcaaggttccttctgcagcag

SEQ ID NO: 40437 - DNA, 30 bp, Homo sapiens
agatgatgctggtcctgcaggtgccctggc

SEQ ID NO: 40438 - DNA, 30 bp, Homo sapiens
tatttgtagggccgcaggaaccgagacact

SEQ ID NO: 40439 - DNA, 30 bp, Homo sapiens
gtaaggtctcaaaaacctggacactttgga

SEQ ID NO: 40440 - DNA, 30 bp, Homo sapiens
tgtagggcctcaggaagctggaaactttgg

SEQ ID NO: 40441 - DNA, 30 bp, Homo sapiens
aactgcgaatcgctgtctttctgtcgcggt

SEQ ID NO: 40442 - DNA, 30 bp, Homo sapiens
ttccgggctcccagcttcatggggcccttg

SEQ ID NO: 40443 - DNA, 30 bp, Homo sapiens
tattggtcatagtagttggtggctgtgcaa

SEQ ID NO: 40444 - DNA, 30 bp, Homo sapiens
attatcttcccagttcagctccccttcttc

SEQ ID NO: 40445 - DNA, 30 bp, Homo sapiens
gtttttctcggaaggaacgcttattttttg

SEQ ID NO: 40446 - DNA, 30 bp, Homo sapiens
caggcatagaattcctcctgtttggtgggc

SEQ ID NO: 40447 - DNA, 30 bp, Homo sapiens
agtaggtgccttctgataagcagcactgga

SEQ ID NO: 40448 - DNA, 30 bp, Homo sapiens
ggcatagaactcctcctgcttgtcaggctt

SEQ ID NO: 40449 - DNA, 30 bp, Homo sapiens
cattggtgggggctttcttgtagatgggtt

SEQ ID NO: 40450 - DNA, 30 bp, Homo sapiens
ctcaggaatggtgtggtccattaggctttt

SEQ ID NO: 40451 - DNA, 30 bp, Homo sapiens
atctgggatggagtggtccatggtgtggtg

SEQ ID NO: 40452 - DNA, 30 bp, Homo sapiens
gagtcttcctcctcgtctttaacttcagaa

SEQ ID NO: 40453 - DNA, 30 bp, Homo sapiens
cagcaatcagattgtggcatgctgggtaac

SEQ ID NO: 40454 - DNA, 30 bp, Homo sapiens
caaaggcttggcaaataaagccgggtcaat

SEQ ID NO: 40455 - DNA, 30 bp, Homo sapiens
gcatggtgggcttctgccttcaacaactca

SEQ ID NO: 40456 - DNA, 30 bp, Homo sapiens
cagagggctccacactaggcttgatgaaga

SEQ ID NO: 40457 - DNA, 30 bp, Homo sapiens
catggggtccatgtagctctgcgggcgagc

SEQ ID NO: 40458 - DNA, 30 bp, Homo sapiens
gcacgctgcgcgcgtagtccaccagcttgc

SEQ ID NO: 40459 - DNA, 30 bp, Homo sapiens
agtaggagcgaatggctggcgggacggtgg

SEQ ID NO: 40460 - DNA, 30 bp, Homo sapiens
accgtccgtcggggcgggtctccggtgccc

SEQ ID NO: 40461 - DNA, 30 bp, Homo sapiens
acgtggcttttcaaagaggtactcaagatc

SEQ ID NO: 40462 - DNA, 30 bp, Homo sapiens
gggttttgtggcttcttgcatcagctcctg

SEQ ID NO: 40463 - DNA, 30 bp, Homo sapiens
cgttcccaatctccatatcgggtaggttct

SEQ ID NO: 40464 - DNA, 30 bp, Homo sapiens
tataggttgccatcattttcttgatctctg

SEQ ID NO: 40465 - DNA, 30 bp, Homo sapiens
acatggctgccagccccatagaggacaaca

SEQ ID NO: 40466 - DNA, 30 bp, Homo sapiens
cccaggctggagataagaatgacaaacaga

SEQ ID NO: 40467 - DNA, 30 bp, Homo sapiens
acttgggaggctgaggcaggagaatcgctt

SEQ ID NO: 40468 - DNA, 30 bp, Homo sapiens
gcatggcaacagctttgcagatgcccacat

SEQ ID NO: 40469 - DNA, 30 bp, Homo sapiens
cgaaggaggagaagccggtgagcggagttc

SEQ ID NO: 40470 - DNA, 30 bp, Homo sapiens
taccaggacgctgacccacggggagccaca

SEQ ID NO: 40471 - DNA, 30 bp, Homo sapiens
atgggagcccgggagcctggggccaggctg

SEQ ID NO: 40472 - DNA, 30 bp, Homo sapiens
attgcatgaaggatgcccaaatagtcagct

SEQ ID NO: 40473 - DNA, 30 bp, Homo sapiens
tagtgggatcgtaagcctgaatttcgaatt

SEQ ID NO: 40474 - DNA, 30 bp, Homo sapiens
taggctacaatttcctttaaggcagcccct

SEQ ID NO: 40475 - DNA, 30 bp, Homo sapiens
cagtgacagaatcacagaagaaggcagcca

SEQ ID NO: 40476 - DNA, 30 bp, Homo sapiens
tagacactgtccgctggccttggaaggtac

SEQ ID NO: 40477 - DNA, 30 bp, Homo sapiens
acttgggcaacctatttgtcatgcccagct

SEQ ID NO: 40478 - DNA, 30 bp, Homo sapiens
agacctggcccaggtgggttttcaaagcct

SEQ ID NO: 40479 - DNA, 30 bp, Homo sapiens
tgacgacaatggccaaggcatagatgaggt

SEQ ID NO: 40480 - DNA, 30 bp, Homo sapiens
ctccactgaactgttctcctgataaaatcc

SEQ ID NO: 40481 - DNA, 30 bp, Homo sapiens
acagaccagtatctactccaaacatccagt

SEQ ID NO: 40482 - DNA, 30 bp, Homo sapiens
cgaataaacccagcaaaaagagaactgcat

SEQ ID NO: 40483 - DNA, 30 bp, Homo sapiens
acagccaaaagagcatacctcttgctcttc

SEQ ID NO: 40484 - DNA, 30 bp, Homo sapiens
tgctggccctctgtcactgatgctgatacg

SEQ ID NO: 40485 - DNA, 30 bp, Homo sapiens
gtctggtcagctgaccactccccggcccac

SEQ ID NO: 40486 - DNA, 30 bp, Homo sapiens
acctggagatcatggagctggagtgggact

SEQ ID NO: 40487 - DNA, 30 bp, Homo sapiens
gagtgggactggctggaggaggtggtggcg

SEQ ID NO: 40488 - DNA, 30 bp, Homo sapiens
ttcggggtgcctgcccccagctgtttcatc

SEQ ID NO: 40489 - DNA, 30 bp, Homo sapiens
atccatggaggaagaggaacctcacaggca

SEQ ID NO: 40490 - DNA, 30 bp, Homo sapiens
agacaggggtgagctccttatcatatttct

SEQ ID NO: 40491 - DNA, 30 bp, Homo sapiens
tggaggcaggtgaggctcccatcctcaggc

SEQ ID NO: 40492 - DNA, 30 bp, Homo sapiens
tgttggggagggtctcatcgccttgagact

SEQ ID NO: 40493 - DNA, 30 bp, Homo sapiens
tatctggagaccagggagctgctatgagac

SEQ ID NO: 40494 - DNA, 30 bp, Homo sapiens
atttctccatcttctccatgaaggtttggt

SEQ ID NO: 40495 - DNA, 30 bp, Homo sapiens
accaggctgtaggtgttgtaaaacctcagg

SEQ ID NO: 40496 - DNA, 30 bp, Homo sapiens
tcagcaccaggtgcttcctctggccaatcc

SEQ ID NO: 40497 - DNA, 30 bp, Homo sapiens
gcatggctgggtgggatagcgacgctgagc

SEQ ID NO: 40498 - DNA, 30 bp, Homo sapiens
aatcgggagccttgccctgggcttgcctta

SEQ ID NO: 40499 - DNA, 30 bp, Homo sapiens
gaatcggacatacactattaacatgatgaa

SEQ ID NO: 40500 - DNA, 30 bp, Homo sapiens
actccacagtcagactgcttctcctgaagc

SEQ ID NO: 40501 - DNA, 30 bp, Homo sapiens
acgaggtttggtccaaccagcagaaccagc

SEQ ID NO: 40502 - DNA, 30 bp, Homo sapiens
cactggacacagcaagtttcttcaagtgat

SEQ ID NO: 40503 - DNA, 30 bp, Homo sapiens
aacaggcactggagacagccagcttcttca

SEQ ID NO: 40504 - DNA, 30 bp, Homo sapiens
tgctggggctgttctggactaatgttcatt

SEQ ID NO: 40505 - DNA, 30 bp, Homo sapiens
tcatggcaatttccaggcaggtaataagag

SEQ ID NO: 40506 - DNA, 30 bp, Homo sapiens
aacaggaattcataatatgataatgcagat

SEQ ID NO: 40507 - DNA, 30 bp, Homo sapiens
gtccggtcttcaatcaaatgctgaaaaaat

SEQ ID NO: 40508 - DNA, 30 bp, Homo sapiens
ctccttgtgcatatgacagagaaagtccac

SEQ ID NO: 40509 - DNA, 30 bp, Homo sapiens
gaacacaacaaaggaaatccacataagaag

SEQ ID NO: 40510 - DNA, 30 bp, Homo sapiens
agacacccagcttattggcctgggtgagaa

SEQ ID NO: 40511 - DNA, 30 bp, Homo sapiens
gcttatgagcgatgatgaggacagccttca

SEQ ID NO: 40512 - DNA, 30 bp, Homo sapiens
agcagggcccccatgctgccaacctcgctt

SEQ ID NO: 40513 - DNA, 30 bp, Homo sapiens
ccaccaacttcggcctgttctttaacaaat

SEQ ID NO: 40514 - DNA, 30 bp, Homo sapiens
cccttccaccttcttaacttcacttttggt

SEQ ID NO: 40515 - DNA, 30 bp, Homo sapiens
tactggaacagggccaactttgagcccagg

SEQ ID NO: 40516 - DNA, 30 bp, Homo sapiens
gctgttgccatggcaatcttctggaattct

SEQ ID NO: 40517 - DNA, 30 bp, Homo sapiens
ttttcctcttcctcatcctcttcacaatcc

SEQ ID NO: 40518 - DNA, 30 bp, Homo sapiens
cttcttcctcaaagctatcttcaaagccct

SEQ ID NO: 40519 - DNA, 30 bp, Homo sapiens
ccaaggattcttctagctccagggtacatc

SEQ ID NO: 40520 - DNA, 30 bp, Homo sapiens
tgctggacttctgctgcccaggactggcct

SEQ ID NO: 40521 - DNA, 30 bp, Homo sapiens
tatgggtctgcggcatatggaaacaagggt

SEQ ID NO: 40522 - DNA, 30 bp, Homo sapiens
attctcaggtaagggattaagaggccgaga

SEQ ID NO: 40523 - DNA, 30 bp, Homo sapiens
gaagatccatttaatgaattctgaagactt

SEQ ID NO: 40524 - DNA, 30 bp, Homo sapiens
actgtggtggctgctgctctggtggcccct

SEQ ID NO: 40525 - DNA, 30 bp, Homo sapiens
ccatgtgggctattagattgcccccaagag

SEQ ID NO: 40526 - DNA, 30 bp, Homo sapiens
ccatggtgatttctaagcaacaaaatcagc

SEQ ID NO: 40527 - DNA, 30 bp, Homo sapiens
acgtggctccgggttattagttactgtggg

SEQ ID NO: 40528 - DNA, 30 bp, Homo sapiens
ttttggtagcttccatctgattcaaggctt

SEQ ID NO: 40529 - DNA, 30 bp, Homo sapiens
gtcagagctacaatcgcccccagggtagcg

SEQ ID NO: 40530 - DNA, 30 bp, Homo sapiens
acttcaagaatagctcctgcatacagcttt

SEQ ID NO: 40531 - DNA, 30 bp, Homo sapiens
ccattccctccccgccgttcgccagcttct

SEQ ID NO: 40532 - DNA, 30 bp, Homo sapiens
caatctgagtttggtttcctcaatgagaag

SEQ ID NO: 40533 - DNA, 30 bp, Homo sapiens
ccaccagccattggagggggactagggcca

SEQ ID NO: 40534 - DNA, 30 bp, Homo sapiens
tacaggtcagcgtggtccgaagtttcctct

SEQ ID NO: 40535 - DNA, 30 bp, Homo sapiens
caggactggtcatccagggccccccacagc

SEQ ID NO: 40536 - DNA, 30 bp, Homo sapiens
gagcgggggcttactgctgtaggagcgctg

SEQ ID NO: 40537 - DNA, 30 bp, Homo sapiens
tgctggcatatctcggttctctgggtgacc

SEQ ID NO: 40538 - DNA, 30 bp, Homo sapiens
ccgccagatgacgggcctctgcgtccaggt

SEQ ID NO: 40539 - DNA, 30 bp, Homo sapiens
cgatggtgtgggattgaatccatatgcaca

SEQ ID NO: 40540 - DNA, 30 bp, Homo sapiens
tgtccagcgcgaagttctcgctggaggagg

SEQ ID NO: 40541 - DNA, 30 bp, Homo sapiens
tcagaaacccacccatcctgatgcctctct

SEQ ID NO: 40542 - DNA, 30 bp, Homo sapiens
atatgggtcattcatacttctcttggattt

SEQ ID NO: 40543 - DNA, 30 bp, Homo sapiens
ggactcgggtcaaatgcagcgtttgtaaaa

SEQ ID NO: 40544 - DNA, 30 bp, Homo sapiens
taagggaggaagctgtgcagggtgaggtca

SEQ ID NO: 40545 - DNA, 30 bp, Homo sapiens
cattgtcatcatcccaattatcctcccaga

SEQ ID NO: 40546 - DNA, 30 bp, Homo sapiens
tgctggggccagattgtagaggtcacccga

SEQ ID NO: 40547 - DNA, 30 bp, Homo sapiens
tcctgggtgccctctcaaattcgtgggtcc

SEQ ID NO: 40548 - DNA, 30 bp, Homo sapiens
cgttgcgctgcgcggcccccgctcagcgcg

SEQ ID NO: 40549 - DNA, 30 bp, Homo sapiens
gtttctacttttccgactattgatgagggc

SEQ ID NO: 40550 - DNA, 30 bp, Homo sapiens
tctagggagctcatccaggtctctgtgatg

SEQ ID NO: 40551 - DNA, 30 bp, Homo sapiens
caggagtccagcgtgtgcctgggcaggcgg

SEQ ID NO: 40552 - DNA, 30 bp, Homo sapiens
gtgtccggagggtggtgccggcggttccgg

SEQ ID NO: 40553 - DNA, 30 bp, Homo sapiens
tacgtggcctccacctcccggggcgtccga

SEQ ID NO: 40554 - DNA, 30 bp, Homo sapiens
tgcctaggcagttgttgtcagcgtccacat

SEQ ID NO: 40555 - DNA, 30 bp, Homo sapiens
agtcacggatctccgagccaaggcggaccc

SEQ ID NO: 40556 - DNA, 30 bp, Homo sapiens
acatggcttctcccctgttggtacaaaaga

SEQ ID NO: 40557 - DNA, 30 bp, Homo sapiens
atactgatgactcctcggggttggagtcgg

SEQ ID NO: 40558 - DNA, 30 bp, Homo sapiens
tctccatctgcgtctgagtcagcgaacttc

SEQ ID NO: 40559 - DNA, 30 bp, Homo sapiens
tacagggtgtccttgctacagctttcccac

SEQ ID NO: 40560 - DNA, 30 bp, Homo sapiens
agatggatgtttcatcacatgtggctagag

SEQ ID NO: 40561 - DNA, 30 bp, Homo sapiens
gctgcgtgtgcttccttttttccaggatgc

SEQ ID NO: 40562 - DNA, 30 bp, Homo sapiens
ccaaggagagtggggaggctgattcacaag

SEQ ID NO: 40563 - DNA, 30 bp, Homo sapiens
gagatgtgggttgaagtatttgtttctttc

SEQ ID NO: 40564 - DNA, 30 bp, Homo sapiens
tgttggggaagcaccgttgtccaggtgagg

SEQ ID NO: 40565 - DNA, 30 bp, Homo sapiens
cattgggcttcatggatgtggaaaggggag

SEQ ID NO: 40566 - DNA, 30 bp, Homo sapiens
tagggcacggggggcgcagtcctgtccgcc

SEQ ID NO: 40567 - DNA, 30 bp, Homo sapiens
aaaagttgaaacggccgccgttcgggacgg

SEQ ID NO: 40568 - DNA, 30 bp, Homo sapiens
ttgcatggttgtaggcttcaatctcttcca

SEQ ID NO: 40569 - DNA, 30 bp, Homo sapiens
atgtggaccatctggttggactctccagac

SEQ ID NO: 40570 - DNA, 30 bp, Homo sapiens
agatggggtttgaggaacaaaggaaggctt

SEQ ID NO: 40571 - DNA, 30 bp, Homo sapiens
tagtggaccagcaagccaagagtgagtgtg

SEQ ID NO: 40572 - DNA, 30 bp, Homo sapiens
gacgatcactgtcatcttcctgctctataa

SEQ ID NO: 40573 - DNA, 30 bp, Homo sapiens
tattggatttctgtcttcattatattgttg

SEQ ID NO: 40574 - DNA, 30 bp, Homo sapiens
tttcggtggaggatctcccagaccatccgc

SEQ ID NO: 40575 - DNA, 30 bp, Homo sapiens
tgaaggatttcccacaccatcttcttccgg

SEQ ID NO: 40576 - DNA, 30 bp, Homo sapiens
agatctgccgacgaagtttgggcatgtcct

SEQ ID NO: 40577 - DNA, 30 bp, Homo sapiens
agccggcactcacatagctccttgtaaatc

SEQ ID NO: 40578 - DNA, 30 bp, Homo sapiens
cctaaaggtgcttctgttgagtaagtgtcc

SEQ ID NO: 40579 - DNA, 30 bp, Homo sapiens
tttagacagtgcaggtcctcattggtaaca

SEQ ID NO: 40580 - DNA, 30 bp, Homo sapiens
gttgctgtaaatgaagtttcaagatgagct

SEQ ID NO: 40581 - DNA, 30 bp, Homo sapiens
ttcaggctgagtatcagatattaaaagaga

SEQ ID NO: 40582 - DNA, 30 bp, Homo sapiens
gtgtggtaatgagatctttccattctcccc

SEQ ID NO: 40583 - DNA, 30 bp, Homo sapiens
aggtggccccgggtgtgggattcacatttt

SEQ ID NO: 40584 - DNA, 30 bp, Homo sapiens
gctaggctcagaggaggcatttgaactgtc

SEQ ID NO: 40585 - DNA, 30 bp, Homo sapiens
tcctggtatgtgtcaagaagtacattatct

SEQ ID NO: 40586 - DNA, 30 bp, Homo sapiens
cagagggcgtctgactgctcgccctgggcc

SEQ ID NO: 40587 - DNA, 30 bp, Homo sapiens
ctctggcttatgtattgaccttgtacttga

SEQ ID NO: 40588 - DNA, 30 bp, Homo sapiens
tcttggtgaagtctcttaaggtgctcaaat

SEQ ID NO: 40589 - DNA, 30 bp, Homo sapiens
acttcttacggtccttgtccttcctcaggt

SEQ ID NO: 40590 - DNA, 30 bp, Homo sapiens
ccttcctcaggttgctgcctgttgccagaa

SEQ ID NO: 40591 - DNA, 30 bp, Homo sapiens
ctttcttggtttgctgggccccagattgct

SEQ ID NO: 40592 - DNA, 30 bp, Homo sapiens
tcatgggcccccctgcagaccttgaaggtc

SEQ ID NO: 40593 - DNA, 30 bp, Homo sapiens
cttcggaggcagctttcattttataaaaat

SEQ ID NO: 40594 - DNA, 30 bp, Homo sapiens
acgtggtgcccgagagccccgccatcgcca

SEQ ID NO: 40595 - DNA, 30 bp, Homo sapiens
catgggttactgtcgtggctttcctctgtg

SEQ ID NO: 40596 - DNA, 30 bp, Homo sapiens
ttcagcagtggggcagggggtggctggcac

SEQ ID NO: 40597 - DNA, 30 bp, Homo sapiens
ctttctctcggataagcttctcagtttctg

SEQ ID NO: 40598 - DNA, 30 bp, Homo sapiens
tagtggcagccctgcccctggtgctcttgg

SEQ ID NO: 40599 - DNA, 30 bp, Homo sapiens
cactggtcctgcatctgctgcttcatcctc

SEQ ID NO: 40600 - DNA, 30 bp, Homo sapiens
tctcggcgtccggggtgggcagcggcagga

SEQ ID NO: 40601 - DNA, 30 bp, Homo sapiens
ccatggattatttttcttctctttgtctct

SEQ ID NO: 40602 - DNA, 30 bp, Homo sapiens
gcctgggagccctgggactggagcagctca

SEQ ID NO: 40603 - DNA, 30 bp, Homo sapiens
ttgctttctcatcctcgaactgacgacgtt

SEQ ID NO: 40604 - DNA, 30 bp, Homo sapiens
gggaatagtgacactgtaaatggaagacca

SEQ ID NO: 40605 - DNA, 30 bp, Homo sapiens
ccttcctcaggggctgctgcgaggtggcgt

SEQ ID NO: 40606 - DNA, 30 bp, Homo sapiens
cagaggaatccttccctccacgtcgcatcc

SEQ ID NO: 40607 - DNA, 30 bp, Homo sapiens
ctccggggcttctggctccttctcctccat

SEQ ID NO: 40608 - DNA, 30 bp, Homo sapiens
tcaaggtctttggctaaagcttcacgaatg

SEQ ID NO: 40609 - DNA, 30 bp, Homo sapiens
aagccagagctgggaatgcctctgggtcat

SEQ ID NO: 40610 - DNA, 30 bp, Homo sapiens
gcttttcttgcatgatctcagagtccctct

SEQ ID NO: 40611 - DNA, 30 bp, Homo sapiens
tccaacagcaaaagtcctcataaaaagaag

SEQ ID NO: 40612 - DNA, 30 bp, Homo sapiens
cacccccgggagtggcccagggggagagag

SEQ ID NO: 40613 - DNA, 30 bp, Homo sapiens
tttctggaccagtcagattggctttgggtt

SEQ ID NO: 40614 - DNA, 30 bp, Homo sapiens
agctgggctgggagcatgtgtgtgcactgt

SEQ ID NO: 40615 - DNA, 30 bp, Homo sapiens
aagtggtgccacgagtgtccaaacatacag

SEQ ID NO: 40616 - DNA, 30 bp, Homo sapiens
ctgaagtcgcggttgcgcaggaggagtggg

SEQ ID NO: 40617 - DNA, 30 bp, Homo sapiens
gactggtgaggacaagtggagccacaaggg

SEQ ID NO: 40618 - DNA, 30 bp, Homo sapiens
gactggaggatatttgttatctggggatat

SEQ ID NO: 40619 - DNA, 30 bp, Homo sapiens
tcccgggtggggcagcagaggggagcgacc

SEQ ID NO: 40620 - DNA, 30 bp, Homo sapiens
ggtgacggtcatcatcacatacagggaagc

SEQ ID NO: 40621 - DNA, 30 bp, Homo sapiens
accagggtcctacagacgccttctcttcgg

SEQ ID NO: 40622 - DNA, 30 bp, Homo sapiens
atcgttcagagggccacatgcacgcattag

SEQ ID NO: 40623 - DNA, 30 bp, Homo sapiens
ttttgggtgggattcaccacttttcccatg

SEQ ID NO: 40624 - DNA, 30 bp, Homo sapiens
tataggagagtcggattcaccaccctgccc

SEQ ID NO: 40625 - DNA, 30 bp, Homo sapiens
aactgggttgacaacttttcccaggaagag

SEQ ID NO: 40626 - DNA, 30 bp, Homo sapiens
cccaggaagagcacggaaggtattttctcg

SEQ ID NO: 40627 - DNA, 30 bp, Homo sapiens
atttttgggtgggattcaccacttttccaa

SEQ ID NO: 40628 - DNA, 30 bp, Homo sapiens
gcttgggattggtgactttgctcatgaaga

SEQ ID NO: 40629 - DNA, 30 bp, Homo sapiens
tcgtggggtcgacgaccttgcccagaaaga

SEQ ID NO: 40630 - DNA, 30 bp, Homo sapiens
caggggcggttcactttgccaaggaagagg

SEQ ID NO: 40631 - DNA, 30 bp, Homo sapiens
cactgggttcataaccctcgccaggaaaag

SEQ ID NO: 40632 - DNA, 30 bp, Homo sapiens
tacgcttccgttgggttcacaactttccct

SEQ ID NO: 40633 - DNA, 30 bp, Homo sapiens
taggatttagtgggattttccactttccct

SEQ ID NO: 40634 - DNA, 30 bp, Homo sapiens
aaggggaagaaaatctccccaagaatagga

SEQ ID NO: 40635 - DNA, 30 bp, Homo sapiens
tagggggagcataatcttccataaaaaaga

SEQ ID NO: 40636 - DNA, 30 bp, Homo sapiens
gagaggcaagcttgccacagaataggatcg

SEQ ID NO: 40637 - DNA, 30 bp, Homo sapiens
taaggagagcagaccctgccataaaagaga

SEQ ID NO: 40638 - DNA, 30 bp, Homo sapiens
aagaggatgctgttggattcattgtgcctg

SEQ ID NO: 40639 - DNA, 30 bp, Homo sapiens
gtgaggaaaatctgccgaaaaataaaatgc

SEQ ID NO: 40640 - DNA, 30 bp, Homo sapiens
tacggggatgagaatctgccatagaagagg

SEQ ID NO: 40641 - DNA, 30 bp, Homo sapiens
atggggatgagaatctgccatagaagagga

SEQ ID NO: 40642 - DNA, 30 bp, Homo sapiens
gctgcaggatccgtgctcctggcacctcta

SEQ ID NO: 40643 - DNA, 30 bp, Homo sapiens
ggagaggaaaagcggccgcagaagagaatc

SEQ ID NO: 40644 - DNA, 30 bp, Homo sapiens
aacaaataggaatgggtggtcagctctaaa

SEQ ID NO: 40645 - DNA, 30 bp, Homo sapiens
tacggagaagagaacctgccacagaacaag

SEQ ID NO: 40646 - DNA, 30 bp, Homo sapiens
cataactctcctccagctttaatcacggcg

SEQ ID NO: 40647 - DNA, 30 bp, Homo sapiens
tgtcatcgggaagcagaatgaccatgctca

SEQ ID NO: 40648 - DNA, 30 bp, Homo sapiens
cgaggtccgtgttgtcatcgggaagcagaa

SEQ ID NO: 40649 - DNA, 30 bp, Homo sapiens
atggcgatgagaacctgccacagaacagaa

SEQ ID NO: 40650 - DNA, 30 bp, Homo sapiens
aaggcctgttggccttgaaagtcaccctgt

SEQ ID NO: 40651 - DNA, 30 bp, Homo sapiens
ggacctgctggggttggccactcttcccat

SEQ ID NO: 40652 - DNA, 30 bp, Homo sapiens
acttggcccatgaaaaggactgttcctgtg

SEQ ID NO: 40653 - DNA, 30 bp, Homo sapiens
ggattatgtcggatgaaaaacagaaaaggt

SEQ ID NO: 40654 - DNA, 30 bp, Homo sapiens
tagtggacaaatgagcccttgttgctagag

SEQ ID NO: 40655 - DNA, 30 bp, Homo sapiens
ccctggggtccagaatcttgccaatgaaga

SEQ ID NO: 40656 - DNA, 30 bp, Homo sapiens
acttggggctgccaaactgggggtaatcct

SEQ ID NO: 40657 - DNA, 30 bp, Homo sapiens
ccctggggtcatatactcgccccatgaaga

SEQ ID NO: 40658 - DNA, 30 bp, Homo sapiens
aactcgtctcgcatcttgtcacccttaggc

SEQ ID NO: 40659 - DNA, 30 bp, Homo sapiens
gtgttcattgtttcaggatgcatgactcgt

SEQ ID NO: 40660 - DNA, 30 bp, Homo sapiens
atctcctgggtgtcaggatttgtcactctt

SEQ ID NO: 40661 - DNA, 30 bp, Homo sapiens
ccctggccccggcggtcgctccagtgcctg

SEQ ID NO: 40662 - DNA, 30 bp, Homo sapiens
aagcacctccatgatgtggtccagctctgt

SEQ ID NO: 40663 - DNA, 30 bp, Homo sapiens
aatgatttccatgatgtgatccagttcatt

SEQ ID NO: 40664 - DNA, 30 bp, Homo sapiens
ctgcagcacagtttgttacttggtggtgaa

SEQ ID NO: 40665 - DNA, 30 bp, Homo sapiens
tgcatcacataggaatccttgtatccttgt

SEQ ID NO: 40666 - DNA, 30 bp, Homo sapiens
gatgaaaggtttgaaaaagtggacctctga

SEQ ID NO: 40667 - DNA, 30 bp, Homo sapiens
tagcgggtaatggctctcagagcataaagg

SEQ ID NO: 40668 - DNA, 30 bp, Homo sapiens
tagcgggtgatggcacggagggcgtacagc

SEQ ID NO: 40669 - DNA, 30 bp, Homo sapiens
ttatggcacgaagagcataaagaagttcag

SEQ ID NO: 40670 - DNA, 30 bp, Homo sapiens
ctgtggtcaccatttcaggatgtctcagct

SEQ ID NO: 40671 - DNA, 30 bp, Homo sapiens
tagggaaggacctcgctctcactccctcgg

SEQ ID NO: 40672 - DNA, 30 bp, Homo sapiens
ctgcaggttcactgtgaaaaggaagagtga

SEQ ID NO: 40673 - DNA, 30 bp, Homo sapiens
cagtttagggagccccggcagctctctgtg

SEQ ID NO: 40674 - DNA, 30 bp, Homo sapiens
ttgagggtcccccggcagttctcggagcca

SEQ ID NO: 40675 - DNA, 30 bp, Homo sapiens
ctttgggtttgtaaacagccccaaacttct

SEQ ID NO: 40676 - DNA, 30 bp, Homo sapiens
ctccagcagtgctgtctgaagaagatcctt

SEQ ID NO: 40677 - DNA, 30 bp, Homo sapiens
cagaggcgacagcaagagcgaaggaatctt

SEQ ID NO: 40678 - DNA, 30 bp, Homo sapiens
tgcagggtctcggcagatgccctgagaatc

SEQ ID NO: 40679 - DNA, 30 bp, Homo sapiens
tcttgagacataaacacaagcatgaggatt

SEQ ID NO: 40680 - DNA, 30 bp, Homo sapiens
gaaagtcccgtctgagtcttgactcctgac

SEQ ID NO: 40681 - DNA, 30 bp, Homo sapiens
cgaacctgtaaggcttgctgttccctccag

SEQ ID NO: 40682 - DNA, 30 bp, Homo sapiens
gagtgaacagtcacacggcttactgggtaa

SEQ ID NO: 40683 - DNA, 30 bp, Homo sapiens
acttttgctgggtggcctggaaggccttca

SEQ ID NO: 40684 - DNA, 30 bp, Homo sapiens
ccttgggctgcactataaagaggaatgcca

SEQ ID NO: 40685 - DNA, 30 bp, Homo sapiens
ttgatgtccctaagtgcgacaagaacaaca

SEQ ID NO: 40686 - DNA, 30 bp, Homo sapiens
gatgccttcttaccattggaacaattgttg

SEQ ID NO: 40687 - DNA, 30 bp, Homo sapiens
tttgtcatagctgtaggcaatgtttggaag

SEQ ID NO: 40688 - DNA, 30 bp, Homo sapiens
aagaagacgtcctctgcattcaatggcccc

SEQ ID NO: 40689 - DNA, 30 bp, Homo sapiens
cctccaaaattgtagagaagaacagtacca

SEQ ID NO: 40690 - DNA, 30 bp, Homo sapiens
attggcagaagatttccttctcaggcacag

SEQ ID NO: 40691 - DNA, 30 bp, Homo sapiens
cagaggtaaagctagccaaccactgtcttc

SEQ ID NO: 40692 - DNA, 30 bp, Homo sapiens
agttggtttattcctgtagcgtaaaaatcc

SEQ ID NO: 40693 - DNA, 30 bp, Homo sapiens
tcctcctctccttcctccccttcatcatca

SEQ ID NO: 40694 - DNA, 30 bp, Homo sapiens
gctccagtgtcctcttgtcccacctagagt

SEQ ID NO: 40695 - DNA, 30 bp, Homo sapiens
tagatggagacttcatattctctcgtctct

SEQ ID NO: 40696 - DNA, 30 bp, Homo sapiens
caaaggaaagagatccagtctcgtaagttg

SEQ ID NO: 40697 - DNA, 30 bp, Homo sapiens
ctctggtttcccctgtctcgtaaatggggt

SEQ ID NO: 40698 - DNA, 30 bp, Homo sapiens
agatggaaacttcatactcccgcgtatccc

SEQ ID NO: 40699 - DNA, 30 bp, Homo sapiens
catcctgtccaccaggggcgttgctgaggc

SEQ ID NO: 40700 - DNA, 30 bp, Homo sapiens
caatgggcgcggaaagtcctcactctcatg

SEQ ID NO: 40701 - DNA, 30 bp, Homo sapiens
agaagggtccatgggaggcggaggaggagg

SEQ ID NO: 40702 - DNA, 30 bp, Homo sapiens
tggtggaggcggtgggggagctggaggcat

SEQ ID NO: 40703 - DNA, 30 bp, Homo sapiens
gcctctctccttgagggccaggtggatgac

SEQ ID NO: 40704 - DNA, 30 bp, Homo sapiens
agttggttgggggagggggaggtatgttcc

SEQ ID NO: 40705 - DNA, 30 bp, Homo sapiens
cttttcagatcctcgtatgtcttcttattc

SEQ ID NO: 40706 - DNA, 30 bp, Homo sapiens
tcctgggaaccaatgtagatggagttgtaa

SEQ ID NO: 40707 - DNA, 30 bp, Homo sapiens
gcaaaaggatcaagacgctctggggaaatt

SEQ ID NO: 40708 - DNA, 30 bp, Homo sapiens
atttcttgctgcccccacggctgtcctggg

SEQ ID NO: 40709 - DNA, 30 bp, Homo sapiens
agaaggcgtagcgggtccggatatcctcga

SEQ ID NO: 40710 - DNA, 30 bp, Homo sapiens
gagagggcctcgaagtgggcctcgaggggg

SEQ ID NO: 40711 - DNA, 30 bp, Homo sapiens
cctcgggcttgtcggctggcggtccacaag

SEQ ID NO: 40712 - DNA, 30 bp, Homo sapiens
ttctccttgagaagcttcaactgttcctcc

SEQ ID NO: 40713 - DNA, 30 bp, Homo sapiens
cacagggcctgccgcagggcctggatgcgg

SEQ ID NO: 40714 - DNA, 30 bp, Homo sapiens
cagttggcaaactgctcataaaaagcaaac

SEQ ID NO: 40715 - DNA, 30 bp, Homo sapiens
agttggcgtactgggcgtagaaagccactt

SEQ ID NO: 40716 - DNA, 30 bp, Homo sapiens
ctctggggctcctggggagcctcgcccccc

SEQ ID NO: 40717 - DNA, 30 bp, Homo sapiens
tactcttctctccctctaccatatcctgct

SEQ ID NO: 40718 - DNA, 30 bp, Homo sapiens
tggtctatcaattgagtaaggcttagtttc

SEQ ID NO: 40719 - DNA, 30 bp, Homo sapiens
acacggactgaaaggtggggcactcatggt

SEQ ID NO: 40720 - DNA, 30 bp, Homo sapiens
ttgcggatgctgcgggagatgcgcttgaac

SEQ ID NO: 40721 - DNA, 30 bp, Homo sapiens
tttcgggtttgttctcttctgggcactcct

SEQ ID NO: 40722 - DNA, 30 bp, Homo sapiens
cagtggggctctgccgccccgtagaagaaa

SEQ ID NO: 40723 - DNA, 30 bp, Homo sapiens
caggaagcgctggtttgcaggtttttggaa

SEQ ID NO: 40724 - DNA, 30 bp, Homo sapiens
atatgggatgtacgacaggctataccaggt

SEQ ID NO: 40725 - DNA, 30 bp, Homo sapiens
aaatggtatgaaggaaaggctgtaccacgt

SEQ ID NO: 40726 - DNA, 30 bp, Homo sapiens
acacgggcagcaccttggcgaggccggcgc

SEQ ID NO: 40727 - DNA, 30 bp, Homo sapiens
acatggtgttgagatcttgcatggtggagg

SEQ ID NO: 40728 - DNA, 30 bp, Homo sapiens
atgaactcctgctttgtgacagcgtcgtgg

SEQ ID NO: 40729 - DNA, 30 bp, Homo sapiens
gctgtataaattctgtgttgacgtagacct

SEQ ID NO: 40730 - DNA, 30 bp, Homo sapiens
aagtgggacttttccttaatgtattggata

SEQ ID NO: 40731 - DNA, 30 bp, Homo sapiens
agaactcacagatggtcagtcgggagtaca

SEQ ID NO: 40732 - DNA, 30 bp, Homo sapiens
caaaggtcggggctgtggatacactggaga

SEQ ID NO: 40733 - DNA, 30 bp, Homo sapiens
tgtagtagagcggcacctcgccacacaggg

SEQ ID NO: 40734 - DNA, 30 bp, Homo sapiens
gacgcttttctccacaagccctgtcattcc

SEQ ID NO: 40735 - DNA, 30 bp, Homo sapiens
ttgaagtacacgcgtcgcaattcaggatgg

SEQ ID NO: 40736 - DNA, 30 bp, Homo sapiens
aacccatgccaggggctgccatgagaatcc

SEQ ID NO: 40737 - DNA, 30 bp, Homo sapiens
actcggcctccaagcttgtcacagacatgg

SEQ ID NO: 40738 - DNA, 30 bp, Homo sapiens
acttggccttgatagtgtcttggagcttcg

SEQ ID NO: 40739 - DNA, 30 bp, Homo sapiens
caaagccccttgttgtagtagaccacttca

SEQ ID NO: 40740 - DNA, 30 bp, Homo sapiens
cccctctgtgataaaagatttctgtttctt

SEQ ID NO: 40741 - DNA, 30 bp, Homo sapiens
gttgtacaccactgtccggctgctcgtggc

SEQ ID NO: 40742 - DNA, 30 bp, Homo sapiens
tggagacagcccctcctctttgaatcgccc

SEQ ID NO: 40743 - DNA, 30 bp, Homo sapiens
aattgggatgtttcaatctctgacatttgc

SEQ ID NO: 40744 - DNA, 30 bp, Homo sapiens
ctccagctccccgtaccgcatcaggaccac

SEQ ID NO: 40745 - DNA, 30 bp, Homo sapiens
atgaggggcacctgggcgctgtccacgcgg

SEQ ID NO: 40746 - DNA, 30 bp, Homo sapiens
caggggttgtctgagatttggcagcccatg

SEQ ID NO: 40747 - DNA, 30 bp, Homo sapiens
ttatgggaagggttggcctgttgaagctgt

SEQ ID NO: 40748 - DNA, 30 bp, Homo sapiens
cagaggcagacacttgtgtttatctgacaa

SEQ ID NO: 40749 - DNA, 30 bp, Homo sapiens
gtctgctgttggggaatctgagtctgatgt

SEQ ID NO: 40750 - DNA, 30 bp, Homo sapiens
cagaggcagatgtggctgtgctcctggcac

SEQ ID NO: 40751 - DNA, 30 bp, Homo sapiens
cacaggcagatgttgctactggactgacaa

SEQ ID NO: 40752 - DNA, 30 bp, Homo sapiens
tcttgggttccttacaagccaccacgtatc

SEQ ID NO: 40753 - DNA, 30 bp, Homo sapiens
gcaaaccttttcttgatgagtgaaaatcga

SEQ ID NO: 40754 - DNA, 30 bp, Homo sapiens
cagaggaaagagtccgtgggaggcgcatag

SEQ ID NO: 40755 - DNA, 30 bp, Homo sapiens
tgtcatcatcctctggcgcataagaaaatc

SEQ ID NO: 40756 - DNA, 30 bp, Homo sapiens
aatgcatcatctgcctccaatacactggca

SEQ ID NO: 40757 - DNA, 30 bp, Homo sapiens
agcagggatagggtagagcaagaaggactc

SEQ ID NO: 40758 - DNA, 30 bp, Homo sapiens
agccggctgtatttaacttgcctactgagg

SEQ ID NO: 40759 - DNA, 30 bp, Homo sapiens
gtcgatttctcattgtcttcaccaatcttc

SEQ ID NO: 40760 - DNA, 30 bp, Homo sapiens
agttcacgctggctgtgcacctacgtttag

SEQ ID NO: 40761 - DNA, 30 bp, Homo sapiens
gcagatgtgggtttcaagtttacatttcct

SEQ ID NO: 40762 - DNA, 30 bp, Homo sapiens
tcttctgcttgtccgttctgaagatagatc

SEQ ID NO: 40763 - DNA, 30 bp, Homo sapiens
cagtggggttttggagaaccattcatctgg

SEQ ID NO: 40764 - DNA, 30 bp, Homo sapiens
cataggtaatataccgataaggaagttcaa

SEQ ID NO: 40765 - DNA, 30 bp, Homo sapiens
aacctgtgaagcatcggcacaaaggttgta

SEQ ID NO: 40766 - DNA, 30 bp, Homo sapiens
cagcttacttcacctctctgagcctcattc

SEQ ID NO: 40767 - DNA, 30 bp, Homo sapiens
ttgtggaggggctggcactggggagagagc

SEQ ID NO: 40768 - DNA, 30 bp, Homo sapiens
gcacacaggagctgccctcggaagggccga

SEQ ID NO: 40769 - DNA, 30 bp, Homo sapiens
acttgttctcaatcagagtctgcaccttgt

SEQ ID NO: 40770 - DNA, 30 bp, Homo sapiens
acgtggttttcagggaagtaccattgaaaa

SEQ ID NO: 40771 - DNA, 30 bp, Homo sapiens
cacttgttctctatgagcatctgcaccttg

SEQ ID NO: 40772 - DNA, 30 bp, Homo sapiens
aaggaagggcagaaccttggacctgaatac

SEQ ID NO: 40773 - DNA, 30 bp, Homo sapiens
cacatcccagctgaagaggtggtgcttcac

SEQ ID NO: 40774 - DNA, 30 bp, Homo sapiens
ggtcgtcgttgctggcgctgggcgtccgac

SEQ ID NO: 40775 - DNA, 30 bp, Homo sapiens
ctccggatgtgatttctcagttgctctata

SEQ ID NO: 40776 - DNA, 30 bp, Homo sapiens
gaagggcatgagggtgcaggaggcatcggg

SEQ ID NO: 40777 - DNA, 30 bp, Homo sapiens
catgggaggtggtcggttacacagtcactc

SEQ ID NO: 40778 - DNA, 30 bp, Homo sapiens
cgaaggagtactggttgttaatggccctgg

SEQ ID NO: 40779 - DNA, 30 bp, Homo sapiens
agaaggagtactggttctccacggcgcgcg

SEQ ID NO: 40780 - DNA, 30 bp, Homo sapiens
gagaggtgtgtactgattgtctatggcccg

SEQ ID NO: 40781 - DNA, 30 bp, Homo sapiens
ttcaggcagacatcaggatcttctcttatc

SEQ ID NO: 40782 - DNA, 30 bp, Homo sapiens
aatcgctgttactgttcacaaatgtttcca

SEQ ID NO: 40783 - DNA, 30 bp, Homo sapiens
actgaggaggcccaaggggaagccatgcct

SEQ ID NO: 40784 - DNA, 30 bp, Homo sapiens
cagcggtcaggctccaggcgctgcgacagg

SEQ ID NO: 40785 - DNA, 30 bp, Homo sapiens
cgctggagcggacagcaggttccagcttgt

SEQ ID NO: 40786 - DNA, 30 bp, Homo sapiens
tccaggtagtcaggcagctggtcctgctga

SEQ ID NO: 40787 - DNA, 30 bp, Homo sapiens
gtctggtgggctgtccctctgtccgcaggg

SEQ ID NO: 40788 - DNA, 30 bp, Homo sapiens
agcccaggccctgcagctctgcctcggact

SEQ ID NO: 40789 - DNA, 30 bp, Homo sapiens
gcccacaagtagatgtgagaggatcctttg

SEQ ID NO: 40790 - DNA, 30 bp, Homo sapiens
gaatttgtgcttcctgtacgtgaagaagag

SEQ ID NO: 40791 - DNA, 30 bp, Homo sapiens
aatcttcgtcttctccaggctcttctcctt

SEQ ID NO: 40792 - DNA, 30 bp, Homo sapiens
aaccaggtggggctgtcaagcctaagaagg

SEQ ID NO: 40793 - DNA, 30 bp, Homo sapiens
atgccaaccgtggtttcaggcctaaaaatg

SEQ ID NO: 40794 - DNA, 30 bp, Homo sapiens
atgctgggggtagacagacgggccggcggg

SEQ ID NO: 40795 - DNA, 30 bp, Homo sapiens
ttacaaaaaacatgtcggcaagagaagaat

SEQ ID NO: 40796 - DNA, 30 bp, Homo sapiens
agttggtctctgaggcaaggctcctggggc

SEQ ID NO: 40797 - DNA, 30 bp, Homo sapiens
cctaggcccagtgtagccgtaggggtgccg

SEQ ID NO: 40798 - DNA, 30 bp, Homo sapiens
caaatcacgaagtcgtcctggtccgcaggg

SEQ ID NO: 40799 - DNA, 30 bp, Homo sapiens
cttccctttgagcactgtagggagagctgc

SEQ ID NO: 40800 - DNA, 30 bp, Homo sapiens
tacaggctgacgctgcgctggtgccgaccc

SEQ ID NO: 40801 - DNA, 30 bp, Homo sapiens
gctgatctgtagaaactgtatgtagttttt

SEQ ID NO: 40802 - DNA, 30 bp, Homo sapiens
agtaggtctgcgtctgcgtgtggatgacgc

SEQ ID NO: 40803 - DNA, 30 bp, Homo sapiens
ctgcggcaggggcacaagcacctccacgta

SEQ ID NO: 40804 - DNA, 30 bp, Homo sapiens
taatggggcagggcaaccagaatttccaca

SEQ ID NO: 40805 - DNA, 30 bp, Homo sapiens
aattaatggggaagaatcccgattctccgt

SEQ ID NO: 40806 - DNA, 30 bp, Homo sapiens
tctccttggttttctggctcaaagtcatag

SEQ ID NO: 40807 - DNA, 30 bp, Homo sapiens
aattggcaccttgcccttctggtttcccct

SEQ ID NO: 40808 - DNA, 30 bp, Homo sapiens
agtaggtgacagggaccttgcccttcttgt

SEQ ID NO: 40809 - DNA, 30 bp, Homo sapiens
tagctgagcagttccaagtaggtgacaggg

SEQ ID NO: 40810 - DNA, 30 bp, Homo sapiens
ccggattttcttctcttcatccaactcaga

SEQ ID NO: 40811 - DNA, 30 bp, Homo sapiens
tcaaggtagttggaaggcacccagcctttg

SEQ ID NO: 40812 - DNA, 30 bp, Homo sapiens
ccatggaagctgccacgtgcttcccaagtg

SEQ ID NO: 40813 - DNA, 30 bp, Homo sapiens
agttggaaggaatccacccttcccaggaag

SEQ ID NO: 40814 - DNA, 30 bp, Homo sapiens
atgttttccacaaagcttcctgggaaaagg

SEQ ID NO: 40815 - DNA, 30 bp, Homo sapiens
tgctgggaaacacggtctgcgtgcctgagg

SEQ ID NO: 40816 - DNA, 30 bp, Homo sapiens
gcccgggaagaggcctgtgcggccgttccg

SEQ ID NO: 40817 - DNA, 30 bp, Homo sapiens
gcgagggtggctgggggccaaccagggggc

SEQ ID NO: 40818 - DNA, 30 bp, Homo sapiens
cagagggccaggccaccaccactcagccac

SEQ ID NO: 40819 - DNA, 30 bp, Homo sapiens
ggctggaaaaatgccagtttgacctcgaag

SEQ ID NO: 40820 - DNA, 30 bp, Homo sapiens
cctctccaggaagaatttgagagcccggtc

SEQ ID NO: 40821 - DNA, 30 bp, Homo sapiens
ctgtccagcagctgtttcaaagccctttct

SEQ ID NO: 40822 - DNA, 30 bp, Homo sapiens
agctgcctgagcgcgcgctcgatgttcatg

SEQ ID NO: 40823 - DNA, 30 bp, Homo sapiens
gcaagggggtcccaagtgcagggcctctgg

SEQ ID NO: 40824 - DNA, 30 bp, Homo sapiens
cacagggtcctcacagccacgggatagagg

SEQ ID NO: 40825 - DNA, 30 bp, Homo sapiens
taatgggaagcgtcagtgccattgcctggg

SEQ ID NO: 40826 - DNA, 30 bp, Homo sapiens
aggcaaaaagaggtggaagagtcttctctt

SEQ ID NO: 40827 - DNA, 30 bp, Homo sapiens
cacaggttgctgtagacacagttcgctgcc

SEQ ID NO: 40828 - DNA, 30 bp, Homo sapiens
agaccacgccacgcaggtgcagctcactct

SEQ ID NO: 40829 - DNA, 30 bp, Homo sapiens
cactgcttcctctccactggctgctggaga

SEQ ID NO: 40830 - DNA, 30 bp, Homo sapiens
tgctggattattatcttttctcactggttg

SEQ ID NO: 40831 - DNA, 30 bp, Homo sapiens
ctacctttcccattccacttgaactggttc

SEQ ID NO: 40832 - DNA, 30 bp, Homo sapiens
tgacgtttgcttctatcttattattattca

SEQ ID NO: 40833 - DNA, 30 bp, Homo sapiens
cagggggtctgcgtgaccacggggtacagc

SEQ ID NO: 40834 - DNA, 30 bp, Homo sapiens
cactgggtagagtaaagtcatgtgttctgc

SEQ ID NO: 40835 - DNA, 30 bp, Homo sapiens
ccctggctgctcctgcaaaggctttggaaa

SEQ ID NO: 40836 - DNA, 30 bp, Homo sapiens
gtccggatggccacagggtagagcagggac

SEQ ID NO: 40837 - DNA, 30 bp, Homo sapiens
accaggtagctggcctctttgcacagccgg

SEQ ID NO: 40838 - DNA, 30 bp, Homo sapiens
gacaggaatagatatgcatttagtcatgag

SEQ ID NO: 40839 - DNA, 30 bp, Homo sapiens
agctggacttgaccgccatgcccagcgggt

SEQ ID NO: 40840 - DNA, 30 bp, Homo sapiens
cgctgggtacatcttctgttcactgttggt

SEQ ID NO: 40841 - DNA, 30 bp, Homo sapiens
aactggaactgaagtctggacagctcttcc

SEQ ID NO: 40842 - DNA, 30 bp, Homo sapiens
gctcccgggtaagagggctgtggtggcata

SEQ ID NO: 40843 - DNA, 30 bp, Homo sapiens
cagagggccgccttcggggcatccatgtag

SEQ ID NO: 40844 - DNA, 30 bp, Homo sapiens
acgcacacacacaacataaccaagtggcag

SEQ ID NO: 40845 - DNA, 30 bp, Homo sapiens
tgctggtggacaggagccctgctcacctgt

SEQ ID NO: 40846 - DNA, 30 bp, Homo sapiens
acacggtcacttcggtcttgctggctgtgt

SEQ ID NO: 40847 - DNA, 30 bp, Homo sapiens
acagtcacctcgttcttgctggccgtgcgc

SEQ ID NO: 40848 - DNA, 30 bp, Homo sapiens
cacacggtgacctcggtcttgctattggtc

SEQ ID NO: 40849 - DNA, 30 bp, Homo sapiens
tgttggtgatgaagtatggctgtgggggtg

SEQ ID NO: 40850 - DNA, 30 bp, Homo sapiens
tccaggtttgaagtccgacactccactctc

SEQ ID NO: 40851 - DNA, 30 bp, Homo sapiens
aaaaggaagtttcattgagcttcatcttgg

SEQ ID NO: 40852 - DNA, 30 bp, Homo sapiens
gaagtcaggcaggccaggcagagggaagag

SEQ ID NO: 40853 - DNA, 30 bp, Homo sapiens
atgctcatcaaaaccaggcatggggaaggc

SEQ ID NO: 40854 - DNA, 30 bp, Homo sapiens
ccatggcacgatatggaccctgcatcttta

SEQ ID NO: 40855 - DNA, 30 bp, Homo sapiens
cccagggcctccgcgtgcttccgcgccttg

SEQ ID NO: 40856 - DNA, 30 bp, Homo sapiens
tactccagcccgggcgacaagagcaaaact

SEQ ID NO: 40857 - DNA, 30 bp, Homo sapiens
cccagggctgcggcgtgctttttggctttc

SEQ ID NO: 40858 - DNA, 30 bp, Homo sapiens
ttctggttgaggtgtctccggagcatgacc

SEQ ID NO: 40859 - DNA, 30 bp, Homo sapiens
cggtgcaccctccctatggcctgaagctca

SEQ ID NO: 40860 - DNA, 30 bp, Homo sapiens
ctttggtaaataggtctgccaggtcagcca

SEQ ID NO: 40861 - DNA, 30 bp, Homo sapiens
ctctcctgaatattgctgcggtttacagca

SEQ ID NO: 40862 - DNA, 30 bp, Homo sapiens
gtaaggagaagagggaagggcggctgaact

SEQ ID NO: 40863 - DNA, 30 bp, Homo sapiens
tttcgggctgaaggctgtccaataagcact

SEQ ID NO: 40864 - DNA, 30 bp, Homo sapiens
gagaggttaatgttgggaaaataccactga

SEQ ID NO: 40865 - DNA, 30 bp, Homo sapiens
cccaggagtagactctccctgagacatttg

SEQ ID NO: 40866 - DNA, 30 bp, Homo sapiens
agttggagctgtctgtctctctcacgtttt

SEQ ID NO: 40867 - DNA, 30 bp, Homo sapiens
aacttgtgcatccttccaatttacggggcc

SEQ ID NO: 40868 - DNA, 30 bp, Homo sapiens
tactgggaggccagtattccttttagttca

SEQ ID NO: 40869 - DNA, 30 bp, Homo sapiens
gtgtggtcagatcaatacgtaatatcatgt

SEQ ID NO: 40870 - DNA, 30 bp, Homo sapiens
tccaggaccctggtctgtaatgaaagcaat

SEQ ID NO: 40871 - DNA, 30 bp, Homo sapiens
acatggaaatagttacattgatgcctaaat

SEQ ID NO: 40872 - DNA, 30 bp, Homo sapiens
ttcccattatctgcaaaaagatgtgctatg

SEQ ID NO: 40873 - DNA, 30 bp, Homo sapiens
atttcagcttctgaggggaggacctctgtc

SEQ ID NO: 40874 - DNA, 30 bp, Homo sapiens
gacagggatctggtctctccgaaccacatc

SEQ ID NO: 40875 - DNA, 30 bp, Homo sapiens
agaagacatagatcttgtcccgctgcacag

SEQ ID NO: 40876 - DNA, 30 bp, Homo sapiens
ccttggacaccaggcagtagaagtctgtgc

SEQ ID NO: 40877 - DNA, 30 bp, Homo sapiens
cccaggggtggggcacaggttgaggtctca

SEQ ID NO: 40878 - DNA, 30 bp, Homo sapiens
cattggaacttgacttctgcataatccgcc

SEQ ID NO: 40879 - DNA, 30 bp, Homo sapiens
cactttggaaccatccctgacatctccctc

SEQ ID NO: 40880 - DNA, 30 bp, Homo sapiens
acttggggatgttgatctcggagtactcat

SEQ ID NO: 40881 - DNA, 30 bp, Homo sapiens
gccaggcctctcagccctgctctgctgggg

SEQ ID NO: 40882 - DNA, 30 bp, Homo sapiens
ggtgagcacatggtggctggtgggctccgg

SEQ ID NO: 40883 - DNA, 30 bp, Homo sapiens
cagcgtctgcagcctccatgcccaatgctg

SEQ ID NO: 40884 - DNA, 30 bp, Homo sapiens
ttgcttgtcttgatctccgagtactccgtg

SEQ ID NO: 40885 - DNA, 30 bp, Homo sapiens
agcagggtggtctgaaactatgcctgtctg

SEQ ID NO: 40886 - DNA, 30 bp, Homo sapiens
tgtcggtgacctttggttcctgaggttgca

SEQ ID NO: 40887 - DNA, 30 bp, Homo sapiens
gtctggaactggtgctgatgaccctgaaga

SEQ ID NO: 40888 - DNA, 30 bp, Homo sapiens
acttggggatcttgatctctgagtactcat

SEQ ID NO: 40889 - DNA, 30 bp, Homo sapiens
acgttcacagagagctggtcatatttataa

SEQ ID NO: 40890 - DNA, 30 bp, Homo sapiens
acttctttgctggaggggttgtgattcctc

SEQ ID NO: 40891 - DNA, 30 bp, Homo sapiens
ctgtggatcttgatctccgagtactcggtg

SEQ ID NO: 40892 - DNA, 30 bp, Homo sapiens
cagatgaggaagaaccagtgaaagaaatct

SEQ ID NO: 40893 - DNA, 30 bp, Homo sapiens
agctggctcgtttatcttgcttttccaata

SEQ ID NO: 40894 - DNA, 30 bp, Homo sapiens
ccctgggtagaagacctcacttttggtggt

SEQ ID NO: 40895 - DNA, 30 bp, Homo sapiens
ggcctggctggtcaagggtcctgggtagaa

SEQ ID NO: 40896 - DNA, 30 bp, Homo sapiens
caagggtcctggccaaagaggtaggtggtg

SEQ ID NO: 40897 - DNA, 30 bp, Homo sapiens
accaggcccgtgtactaccgtctccctcgg

SEQ ID NO: 40898 - DNA, 30 bp, Homo sapiens
ctgcaccaggacaaacgtgcctagggagca

SEQ ID NO: 40899 - DNA, 30 bp, Homo sapiens
accaggacatacccgttgtgttgtggatcc

SEQ ID NO: 40900 - DNA, 30 bp, Homo sapiens
tgctccatgctgaaggagacttcggggtgc

SEQ ID NO: 40901 - DNA, 30 bp, Homo sapiens
gcttgggaagcagtgtccattgagttttcc

SEQ ID NO: 40902 - DNA, 30 bp, Homo sapiens
ctcagctccttcagcaagctgttgacagag

SEQ ID NO: 40903 - DNA, 30 bp, Homo sapiens
cgttggttattataacagatgttcccttgt

SEQ ID NO: 40904 - DNA, 30 bp, Homo sapiens
ttagaagcagaaagagggcaagtttgccca

SEQ ID NO: 40905 - DNA, 30 bp, Homo sapiens
cgttggtgatgatgaccgaggcgcccaggt

SEQ ID NO: 40906 - DNA, 30 bp, Homo sapiens
ggagccgctccagcccttttgaaagggctc

SEQ ID NO: 40907 - DNA, 30 bp, Homo sapiens
taaggggctttgaatactgtgccgtatttg

SEQ ID NO: 40908 - DNA, 30 bp, Homo sapiens
gcgaggccgggcggcggctgtactgcacgc

SEQ ID NO: 40909 - DNA, 30 bp, Homo sapiens
ctgagtggagatgggcagaggctctggccc

SEQ ID NO: 40910 - DNA, 30 bp, Homo sapiens
gccaggtcggcggtgggtgagcccagctgc

SEQ ID NO: 40911 - DNA, 30 bp, Homo sapiens
ctcatgtctatggtgttgaagacccattct

SEQ ID NO: 40912 - DNA, 30 bp, Homo sapiens
cgatggtggtgaaaaaccattctgtgaatt

SEQ ID NO: 40913 - DNA, 30 bp, Homo sapiens
cagagctccttcttctccctgcagaagatc

SEQ ID NO: 40914 - DNA, 30 bp, Homo sapiens
cacttcctcgggacctggacgctggcgtac

SEQ ID NO: 40915 - DNA, 30 bp, Homo sapiens
gtttccagcagatgtagatggcagagacac

SEQ ID NO: 40916 - DNA, 30 bp, Homo sapiens
gcttccagtagacatagatgacagagacac

SEQ ID NO: 40917 - DNA, 30 bp, Homo sapiens
actcttgacccttgctccatgctaaggtgt

SEQ ID NO: 40918 - DNA, 30 bp, Homo sapiens
agtcccagcagccggaggcagcagcagggt

SEQ ID NO: 40919 - DNA, 30 bp, Homo sapiens
ccaggggacgtagatggggcccaggaggac

SEQ ID NO: 40920 - DNA, 30 bp, Homo sapiens
tcacagatatagcttcattaattgcctctt

SEQ ID NO: 40921 - DNA, 30 bp, Homo sapiens
cactggggtttctccctctctgttgtcctg

SEQ ID NO: 40922 - DNA, 30 bp, Homo sapiens
gccaggccacgtccctgcaaggaggtaccc

SEQ ID NO: 40923 - DNA, 30 bp, Homo sapiens
tgtctggtccatcaagcttcccagtttccc

SEQ ID NO: 40924 - DNA, 30 bp, Homo sapiens
gcatgggtctatcaaaggcagcaactctcc

SEQ ID NO: 40925 - DNA, 30 bp, Homo sapiens
gggtggtctccgtgttaaattcagccactg

SEQ ID NO: 40926 - DNA, 30 bp, Homo sapiens
gcaagggcttcaggaagagtcgttccacag

SEQ ID NO: 40927 - DNA, 30 bp, Homo sapiens
catgacctcgtcaacgtagccatggatgcg

SEQ ID NO: 40928 - DNA, 30 bp, Homo sapiens
cagctggggaccgccttggccttcaccctt

SEQ ID NO: 40929 - DNA, 30 bp, Homo sapiens
tgtgcgttttgtgcagcccctgccaaacca

SEQ ID NO: 40930 - DNA, 30 bp, Homo sapiens
cagctggctgcaggctggctgttggcatag

SEQ ID NO: 40931 - DNA, 30 bp, Homo sapiens
gtctcgaacatggcacagctggtgcacagc

SEQ ID NO: 40932 - DNA, 30 bp, Homo sapiens
taggaccccaagtccaccagactggaggtg

SEQ ID NO: 40933 - DNA, 30 bp, Homo sapiens
cccaggtccacgaggttggctgacatgggg

SEQ ID NO: 40934 - DNA, 30 bp, Homo sapiens
cgctggaggttaccgagaggatggaggtgc

SEQ ID NO: 40935 - DNA, 30 bp, Homo sapiens
agctggacagtctggagcttggcaagctct

SEQ ID NO: 40936 - DNA, 30 bp, Homo sapiens
ccaagggctcctccacaggcaccgactgga

SEQ ID NO: 40937 - DNA, 30 bp, Homo sapiens
cgctggacgtgatggagatggctgaagtgg

SEQ ID NO: 40938 - DNA, 30 bp, Homo sapiens
cctcggacctctgatagcctccggcagtgt

SEQ ID NO: 40939 - DNA, 30 bp, Homo sapiens
tccaggtctgtttgcttctgtagtttttgt

SEQ ID NO: 40940 - DNA, 30 bp, Homo sapiens
ctgtttgcttctgtagtttttgtatcatat

SEQ ID NO: 40941 - DNA, 30 bp, Homo sapiens
tgtattgaatgtaatccagatcagactcag

SEQ ID NO: 40942 - DNA, 30 bp, Homo sapiens
cactggaatttctggagaatatcttctgga

SEQ ID NO: 40943 - DNA, 30 bp, Homo sapiens
tctcggatgttctgtccatgtttaaggaac

SEQ ID NO: 40944 - DNA, 30 bp, Homo sapiens
caaaggcagtggtgagatactcctttggaa

SEQ ID NO: 40945 - DNA, 30 bp, Homo sapiens
tgtaggctttaggcaccaagccaatggctc

SEQ ID NO: 40946 - DNA, 30 bp, Homo sapiens
ccgcagcgccctcgctgcccgcagcctcgg

SEQ ID NO: 40947 - DNA, 30 bp, Homo sapiens
tttgtgactaggtggaagaggtattgcaga

SEQ ID NO: 40948 - DNA, 30 bp, Homo sapiens
cctgtctgagttcatcttggagttcttgcc

SEQ ID NO: 40949 - DNA, 30 bp, Homo sapiens
cactgggtgtagaggctggccgcaaatacg

SEQ ID NO: 40950 - DNA, 30 bp, Homo sapiens
tagaggctggcagcaaacacaatatctctc

SEQ ID NO: 40951 - DNA, 30 bp, Homo sapiens
tgaaggagcagttgccagtgcagtggcggg

SEQ ID NO: 40952 - DNA, 30 bp, Homo sapiens
atctcctccagaagcatcagagtctgtgat

SEQ ID NO: 40953 - DNA, 30 bp, Homo sapiens
ttttctttcctgatcaaacttgctgcatag

SEQ ID NO: 40954 - DNA, 30 bp, Homo sapiens
acctgggcttcctcctcttcagtaaagtca

SEQ ID NO: 40955 - DNA, 30 bp, Homo sapiens
cactggttctctttgcgtacctgggcttcc

SEQ ID NO: 40956 - DNA, 30 bp, Homo sapiens
tgttggcaaaatagcttatggctggacttg

SEQ ID NO: 40957 - DNA, 30 bp, Homo sapiens
agtcggcatttgatgccccatatctcctgg

SEQ ID NO: 40958 - DNA, 30 bp, Homo sapiens
agtaaggtggtgatgagaagaatgagctct

SEQ ID NO: 40959 - DNA, 30 bp, Homo sapiens
agggcacccatctgcaaacccagaccttct

SEQ ID NO: 40960 - DNA, 30 bp, Homo sapiens
aacaggagggagctgtccagctctttccag

SEQ ID NO: 40961 - DNA, 30 bp, Homo sapiens
catcatccaaagagacagcctcgtcattca

SEQ ID NO: 40962 - DNA, 30 bp, Homo sapiens
ctccaatttccatccctcagagtgctgagt

SEQ ID NO: 40963 - DNA, 30 bp, Homo sapiens
ttccaactgtcatctttcatgctaccatag

SEQ ID NO: 40964 - DNA, 30 bp, Homo sapiens
tgatggaatttgtttcctggacagactctg

SEQ ID NO: 40965 - DNA, 30 bp, Homo sapiens
ctctggaagtgtcacactagcatagactgt

SEQ ID NO: 40966 - DNA, 30 bp, Homo sapiens
tcaagggcagttgccctggaaaaagtgggt

SEQ ID NO: 40967 - DNA, 30 bp, Homo sapiens
ccttggtgtgtctggcatcgtgagcagtga

SEQ ID NO: 40968 - DNA, 30 bp, Homo sapiens
tggcagatcctgcacaagggggttctctgt

SEQ ID NO: 40969 - DNA, 30 bp, Homo sapiens
gcaagaagatgagcaatcccttggccagga

SEQ ID NO: 40970 - DNA, 30 bp, Homo sapiens
ggcagggctggagccaggctttgcctcctt

SEQ ID NO: 40971 - DNA, 30 bp, Homo sapiens
taggacactttcatctgtctcaaagtcagc

SEQ ID NO: 40972 - DNA, 30 bp, Homo sapiens
tcatggctgagaagtctctcaagggttcag

SEQ ID NO: 40973 - DNA, 30 bp, Homo sapiens
gcaaggggagcagtcctcccctttgtaggt

SEQ ID NO: 40974 - DNA, 30 bp, Homo sapiens
gtcaggttgaaatcctccatttgccttata

SEQ ID NO: 40975 - DNA, 30 bp, Homo sapiens
ggaactgggaacaggctgctgtagatgaag

SEQ ID NO: 40976 - DNA, 30 bp, Homo sapiens
gagcggtttccatcattattatattttctg

SEQ ID NO: 40977 - DNA, 30 bp, Homo sapiens
cacatggctactgtaaaaggagccacagaa

SEQ ID NO: 40978 - DNA, 30 bp, Homo sapiens
tattcacatgaagtgatgtggccaactggc

SEQ ID NO: 40979 - DNA, 30 bp, Homo sapiens
ttccaccaactgccttggttaaaatcactg

SEQ ID NO: 40980 - DNA, 30 bp, Homo sapiens
tgtcggccttgtcagcttcactcccttctg

SEQ ID NO: 40981 - DNA, 30 bp, Homo sapiens
cttctggattattcaagttagccagtggcc

SEQ ID NO: 40982 - DNA, 30 bp, Homo sapiens
tgtaggatacagttatttctggcttcagtg

SEQ ID NO: 40983 - DNA, 30 bp, Homo sapiens
aacttccaaaggctgaattaaatattgcag

SEQ ID NO: 40984 - DNA, 30 bp, Homo sapiens
cagaggtctcccctttctggtcctcttcaa

SEQ ID NO: 40985 - DNA, 30 bp, Homo sapiens
ccacgggtggcttcttctgtcagcaggcct

SEQ ID NO: 40986 - DNA, 30 bp, Homo sapiens
ccatggtgttcagaagatagagttcaggct

SEQ ID NO: 40987 - DNA, 30 bp, Homo sapiens
actagtaagacaggtgggaggttctttgtg

SEQ ID NO: 40988 - DNA, 30 bp, Homo sapiens
aactaggaggattggtggtaggtccttaga

SEQ ID NO: 40989 - DNA, 30 bp, Homo sapiens
tactggcagtaaaaggtgagcacgttttcc

SEQ ID NO: 40990 - DNA, 30 bp, Homo sapiens
agatggtgatgacttcacggccaccaccgc

SEQ ID NO: 40991 - DNA, 30 bp, Homo sapiens
agatggtgatgacctcgcggccgccgccgc

SEQ ID NO: 40992 - DNA, 30 bp, Homo sapiens
ccccggacaagtaggactcgctctagtccc

SEQ ID NO: 40993 - DNA, 30 bp, Homo sapiens
agatggtgatcacctcccggccgccacccc

SEQ ID NO: 40994 - DNA, 30 bp, Homo sapiens
gtgaggcatcagctgctcccggttcacgag

SEQ ID NO: 40995 - DNA, 30 bp, Homo sapiens
tccccagggtaatagcgtcccagactcgag

SEQ ID NO: 40996 - DNA, 30 bp, Homo sapiens
ggcaggggatgcgagtttgactcgaggccg

SEQ ID NO: 40997 - DNA, 30 bp, Homo sapiens
tgcaggtgactggagtgaccccatgaacca

SEQ ID NO: 40998 - DNA, 30 bp, Homo sapiens
agcaggagcccacgaagggtaagtgtagag

SEQ ID NO: 40999 - DNA, 30 bp, Homo sapiens
taggggcttggtgtggtggtgttggccagg

SEQ ID NO: 41000 - DNA, 30 bp, Homo sapiens
cagagggtccgaaatgtgtcattggccaag

SEQ ID NO: 41001 - DNA, 30 bp, Homo sapiens
cccatgctgggtaagtgtccaggtggaaga

SEQ ID NO: 41002 - DNA, 30 bp, Homo sapiens
tctcaatatgtgtcacattagcccagtcag

SEQ ID NO: 41003 - DNA, 30 bp, Homo sapiens
caaagggctttccaccattcttttcttggc

SEQ ID NO: 41004 - DNA, 30 bp, Homo sapiens
cgtaggcctgatactttgttatgattgatg

SEQ ID NO: 41005 - DNA, 30 bp, Homo sapiens
catctgtttctgtgaattggcccctgacat

SEQ ID NO: 41006 - DNA, 30 bp, Homo sapiens
tcttggtctctagtttgatcatgttcccct

SEQ ID NO: 41007 - DNA, 30 bp, Homo sapiens
cagcccctgtccctgctgaaacggctgtgg

SEQ ID NO: 41008 - DNA, 30 bp, Homo sapiens
tgctggtgggcacgccattggctcttgatc

SEQ ID NO: 41009 - DNA, 30 bp, Homo sapiens
catagggctgtctcccaaagatcaatactt

SEQ ID NO: 41010 - DNA, 30 bp, Homo sapiens
gactggactttcctcctccttgggccctcc

SEQ ID NO: 41011 - DNA, 30 bp, Homo sapiens
gaacttgacagcagagagttctggttttcc

SEQ ID NO: 41012 - DNA, 30 bp, Homo sapiens
gagtggagccagggcctcctggggacagca

SEQ ID NO: 41013 - DNA, 30 bp, Homo sapiens
gtgaggctgtagccaggcactgctgtagcc

SEQ ID NO: 41014 - DNA, 30 bp, Homo sapiens
ccagcccctccttgggtaggggaactttag

SEQ ID NO: 41015 - DNA, 30 bp, Homo sapiens
atgtattttcttctggattgttctataatt

SEQ ID NO: 41016 - DNA, 30 bp, Homo sapiens
gattggttcctcagggttgggggagcccgg

SEQ ID NO: 41017 - DNA, 30 bp, Homo sapiens
agacacttgtttccggggtgtgaaccacct

SEQ ID NO: 41018 - DNA, 30 bp, Homo sapiens
ttcggccaatggtacaaaaaaaaaggaaac

SEQ ID NO: 41019 - DNA, 30 bp, Homo sapiens
ggtagggctattccagcccagagccgtttg

SEQ ID NO: 41020 - DNA, 30 bp, Homo sapiens
taccggctccatttgcacgtgaactctgtg

SEQ ID NO: 41021 - DNA, 30 bp, Homo sapiens
ctctggtcttctgccttgcattttcctcct

SEQ ID NO: 41022 - DNA, 30 bp, Homo sapiens
actcggcagccagcctcggcctcgcctcta

SEQ ID NO: 41023 - DNA, 30 bp, Homo sapiens
agctggcttggggagttgcttgttgcatgt

SEQ ID NO: 41024 - DNA, 30 bp, Homo sapiens
cctgaatttctgctgtagcaactataaggt

SEQ ID NO: 41025 - DNA, 30 bp, Homo sapiens
acttgaagatgttcaataaactggcccaac

SEQ ID NO: 41026 - DNA, 30 bp, Homo sapiens
cagaggcgggtaagggtcctctctttggcc

SEQ ID NO: 41027 - DNA, 30 bp, Homo sapiens
tcttggacatctgcttctccaaatatgagg

SEQ ID NO: 41028 - DNA, 30 bp, Homo sapiens
cagaggtgggtgaatgtctgctctttagcc

SEQ ID NO: 41029 - DNA, 30 bp, Homo sapiens
gtgtctgtgtccatggtgatcattgagagc

SEQ ID NO: 41030 - DNA, 30 bp, Homo sapiens
agctatgtgagtcttgtacttctccttgta

SEQ ID NO: 41031 - DNA, 30 bp, Homo sapiens
tcccggacagggggtgggggcctggggggc

SEQ ID NO: 41032 - DNA, 30 bp, Homo sapiens
ttctggtaggatgtcagctcttcctcatca

SEQ ID NO: 41033 - DNA, 30 bp, Homo sapiens
tagaggtcctcatgggtagagctcaggtcc

SEQ ID NO: 41034 - DNA, 30 bp, Homo sapiens
tcatggtcaggctcctcatcactgtcctcc

SEQ ID NO: 41035 - DNA, 30 bp, Homo sapiens
cactgtcctcccccagaggaaattccttcg

SEQ ID NO: 41036 - DNA, 30 bp, Homo sapiens
ggatatgactggatattattctgagtgtac

SEQ ID NO: 41037 - DNA, 30 bp, Homo sapiens
ctgcgggtgtagtagtagttgtagtcgtcc

SEQ ID NO: 41038 - DNA, 30 bp, Homo sapiens
attaggcaagagagtagttcgttcctcctc

SEQ ID NO: 41039 - DNA, 30 bp, Homo sapiens
cactggttcacattctgaacaccgtcgctt

SEQ ID NO: 41040 - DNA, 30 bp, Homo sapiens
ggatggacacacttcagaaggacagacagg

SEQ ID NO: 41041 - DNA, 30 bp, Homo sapiens
cactggccaggaaaaccacagcgatgagtg

SEQ ID NO: 41042 - DNA, 30 bp, Homo sapiens
ctctgggtgagacacatctggattctcact

SEQ ID NO: 41043 - DNA, 30 bp, Homo sapiens
aactgtgaggtctgggtgaatgagatggtg

SEQ ID NO: 41044 - DNA, 30 bp, Homo sapiens
ttctcacgtttccaaggttcttcctcaaca

SEQ ID NO: 41045 - DNA, 30 bp, Homo sapiens
cccgggcagccagatgccccagagaaacaa

SEQ ID NO: 41046 - DNA, 30 bp, Homo sapiens
cgatgggtttctcagtttcattgtcctgtg

SEQ ID NO: 41047 - DNA, 30 bp, Homo sapiens
cacagaaccgactccttggattccagttct

SEQ ID NO: 41048 - DNA, 30 bp, Homo sapiens
cagaggcgaccgtggcatcccctgcgggcc

SEQ ID NO: 41049 - DNA, 30 bp, Homo sapiens
aatgatgcccaccagcctcataatagcctc

SEQ ID NO: 41050 - DNA, 30 bp, Homo sapiens
acatagcactctcgttgcctccccgtcccc

SEQ ID NO: 41051 - DNA, 30 bp, Homo sapiens
cattggtctccagctcactgatctggatgg

SEQ ID NO: 41052 - DNA, 30 bp, Homo sapiens
cagccaggaccctttggtccgttcctccaa

SEQ ID NO: 41053 - DNA, 30 bp, Homo sapiens
cctgctccacttgaacggggacgtggtggg

SEQ ID NO: 41054 - DNA, 30 bp, Homo sapiens
ctgaggatgacatatctgaagattgccatg

SEQ ID NO: 41055 - DNA, 30 bp, Homo sapiens
ggaaggatcccatacatgagaagagccatg

SEQ ID NO: 41056 - DNA, 30 bp, Homo sapiens
ccgagggttctgaggtttggaccttaaggt

SEQ ID NO: 41057 - DNA, 30 bp, Homo sapiens
gttctcggcgtccttcatggtctctggcaa

SEQ ID NO: 41058 - DNA, 30 bp, Homo sapiens
ccttgatggtgtcaggcaaaggcagattct

SEQ ID NO: 41059 - DNA, 30 bp, Homo sapiens
gcgaggtactttccacagtgacggcctctt

SEQ ID NO: 41060 - DNA, 30 bp, Homo sapiens
gtgtggattttaggacagagttccccagcg

SEQ ID NO: 41061 - DNA, 30 bp, Homo sapiens
caaaggccactcccgggctggaagttcttc

SEQ ID NO: 41062 - DNA, 30 bp, Homo sapiens
acatcatcagatgatgtttccttagtcttc

SEQ ID NO: 41063 - DNA, 30 bp, Homo sapiens
cctcactctcactccctaaagagctctcct

SEQ ID NO: 41064 - DNA, 30 bp, Homo sapiens
ccagaatccctgggggtaatcgcttccgtt

SEQ ID NO: 41065 - DNA, 30 bp, Homo sapiens
cagagggcagggttgggggtggcaagcagc

SEQ ID NO: 41066 - DNA, 30 bp, Homo sapiens
caccggactttgtccttcctctggggcata

SEQ ID NO: 41067 - DNA, 30 bp, Homo sapiens
ctgcggagggggtgctagtcccaaggggtg

SEQ ID NO: 41068 - DNA, 30 bp, Homo sapiens
caatggaatgtctagtttctgaacttggag

SEQ ID NO: 41069 - DNA, 30 bp, Homo sapiens
ctctggaattttgaactcaggatctgtttc

SEQ ID NO: 41070 - DNA, 30 bp, Homo sapiens
tacatggccttcatgccgttggccgtggca

SEQ ID NO: 41071 - DNA, 30 bp, Homo sapiens
gagcagcatgagcaggaaggggcagatgat

SEQ ID NO: 41072 - DNA, 30 bp, Homo sapiens
cctggatggtgttaggaagaggtagatccc

SEQ ID NO: 41073 - DNA, 30 bp, Homo sapiens
aataggtactatggacatcatggctcagga

SEQ ID NO: 41074 - DNA, 30 bp, Homo sapiens
gcacagagctcctctgaggggcagctaggc

SEQ ID NO: 41075 - DNA, 30 bp, Homo sapiens
caaaggtgagagcgggaaactggggttttc

SEQ ID NO: 41076 - DNA, 30 bp, Homo sapiens
gctcgggggtgtggccggcccagtaggagt

SEQ ID NO: 41077 - DNA, 30 bp, Homo sapiens
gattttcttctgtctccattgagtctcttg

SEQ ID NO: 41078 - DNA, 30 bp, Homo sapiens
agaaggctgtgcttttaaggattgtgggcc

SEQ ID NO: 41079 - DNA, 30 bp, Homo sapiens
agtccattcttctcttgtgctgaggcctgc

SEQ ID NO: 41080 - DNA, 30 bp, Homo sapiens
tagttctggacctgcttcatgggcatctct

SEQ ID NO: 41081 - DNA, 30 bp, Homo sapiens
agctggagcccaggcctggtccgtgaggct

SEQ ID NO: 41082 - DNA, 30 bp, Homo sapiens
aactgcgtcacttccactctcggatcctct

SEQ ID NO: 41083 - DNA, 30 bp, Homo sapiens
ccttggtgcacacagatgcagtttctgtat

SEQ ID NO: 41084 - DNA, 30 bp, Homo sapiens
ccgtggcctgggagtcttcatctgaactcc

SEQ ID NO: 41085 - DNA, 30 bp, Homo sapiens
ttctgggacctaaacccttctctgctagat

SEQ ID NO: 41086 - DNA, 30 bp, Homo sapiens
gtgaatagcaccatgctgaaacatttcaca

SEQ ID NO: 41087 - DNA, 30 bp, Homo sapiens
tacaggacaggatatgattcgatcttctaa

SEQ ID NO: 41088 - DNA, 30 bp, Homo sapiens
agatggagacggggcatgtaagaattctgt

SEQ ID NO: 41089 - DNA, 30 bp, Homo sapiens
cagtggtccccgcacatgggcaggttcaca

SEQ ID NO: 41090 - DNA, 30 bp, Homo sapiens
tcccggcacatcggcaagttgacgaaggta

SEQ ID NO: 41091 - DNA, 30 bp, Homo sapiens
cagccccttattttattatttccaataatt

SEQ ID NO: 41092 - DNA, 30 bp, Homo sapiens
tccacactttgttgagcagcttcaccactt

SEQ ID NO: 41093 - DNA, 30 bp, Homo sapiens
ggatggcactttgatgccaaagtttttgcg

SEQ ID NO: 41094 - DNA, 30 bp, Homo sapiens
acttgggtgagcaacagccaggctgcaccc

SEQ ID NO: 41095 - DNA, 30 bp, Homo sapiens
cagccactgaggaagagacgcttgtaggcc

SEQ ID NO: 41096 - DNA, 30 bp, Homo sapiens
gagtggctgccactgctgcctttggctgaa

SEQ ID NO: 41097 - DNA, 30 bp, Homo sapiens
tatgggcctccaccaatagcctttgaggta

SEQ ID NO: 41098 - DNA, 30 bp, Homo sapiens
tagctgctcgtatgtaataaaaaaaatgat

SEQ ID NO: 41099 - DNA, 30 bp, Homo sapiens
aactggttcatcatcaacttcctgctatat

SEQ ID NO: 41100 - DNA, 30 bp, Homo sapiens
tagagtccttttcgaattccatggtgtcca

SEQ ID NO: 41101 - DNA, 30 bp, Homo sapiens
cttgagagggaatacagcgaatgtaattaa

SEQ ID NO: 41102 - DNA, 30 bp, Homo sapiens
ttccggcagaacagttcctaattgcattcg

SEQ ID NO: 41103 - DNA, 30 bp, Homo sapiens
tgttggtgtgcacgcttcagccccataact

SEQ ID NO: 41104 - DNA, 30 bp, Homo sapiens
ccaataaaatagaccccttgagcaatccca

SEQ ID NO: 41105 - DNA, 30 bp, Homo sapiens
cgctggctggctgtcctgttcatgcagtgg

SEQ ID NO: 41106 - DNA, 30 bp, Homo sapiens
gtattcgtaggccacaaacagtgccccatt

SEQ ID NO: 41107 - DNA, 30 bp, Homo sapiens
aagttgggggtggcccaattaaggaacttc

SEQ ID NO: 41108 - DNA, 30 bp, Homo sapiens
ctcttgaagccatgaataggtgtattcata

SEQ ID NO: 41109 - DNA, 30 bp, Homo sapiens
aataggtgtattcataaaccagcagcatca

SEQ ID NO: 41110 - DNA, 30 bp, Homo sapiens
gcctgggggtcctgcagcagccccagcagg

SEQ ID NO: 41111 - DNA, 30 bp, Homo sapiens
acctggacgtgacccccaaggcctgcttca

SEQ ID NO: 41112 - DNA, 30 bp, Homo sapiens
aactgatgcctacagcagggagcaccttca

SEQ ID NO: 41113 - DNA, 30 bp, Homo sapiens
caccgcgactgcacgcccagggtgatcttc

SEQ ID NO: 41114 - DNA, 30 bp, Homo sapiens
tccaacagcaagctgtgcgttcggtcataa

SEQ ID NO: 41115 - DNA, 30 bp, Homo sapiens
cattggatggccttgtgagatccgaccaga

SEQ ID NO: 41116 - DNA, 30 bp, Homo sapiens
ccttgaacagcctgaatcaagcagtcagtc

SEQ ID NO: 41117 - DNA, 30 bp, Homo sapiens
caccattgaccaaggggtcattctcagcca

SEQ ID NO: 41118 - DNA, 30 bp, Homo sapiens
ctccactcttcttgccttttagtgattagg

SEQ ID NO: 41119 - DNA, 30 bp, Homo sapiens
tctgatagactccacagctcgcagcatccc

SEQ ID NO: 41120 - DNA, 30 bp, Homo sapiens
cacaggctggagggctgcgccagggcaggc

SEQ ID NO: 41121 - DNA, 30 bp, Homo sapiens
cttcttcttcagagactctggcatctcggg

SEQ ID NO: 41122 - DNA, 30 bp, Homo sapiens
tcttcaactgctcgtatgtcacaaagaaaa

SEQ ID NO: 41123 - DNA, 30 bp, Homo sapiens
tacctaccaccaatatcaatatgaaagaat

SEQ ID NO: 41124 - DNA, 30 bp, Homo sapiens
tcatcatacgtcttctaactgtgtcaaagg

SEQ ID NO: 41125 - DNA, 30 bp, Homo sapiens
aggtaatacagcaggctggagtcactctaa

SEQ ID NO: 41126 - DNA, 30 bp, Homo sapiens
actgagtacggtcttctaacaggtacacaa

SEQ ID NO: 41127 - DNA, 30 bp, Homo sapiens
tgctgggcccgcccagccagtttccgaagc

SEQ ID NO: 41128 - DNA, 30 bp, Homo sapiens
gactgggttcccaggagaatcgggctgcac

SEQ ID NO: 41129 - DNA, 30 bp, Homo sapiens
tagagggagcgcagctggtcccagaagaag

SEQ ID NO: 41130 - DNA, 30 bp, Homo sapiens
agtaggtaaaccaccaattcataggtggcc

SEQ ID NO: 41131 - DNA, 30 bp, Homo sapiens
gtatggagctcgattttccagctggcgctt

SEQ ID NO: 41132 - DNA, 30 bp, Homo sapiens
ttcaggcccatcttggccatcatctcttca

SEQ ID NO: 41133 - DNA, 30 bp, Homo sapiens
cagccgcccagaagccggtcctggttcagc

SEQ ID NO: 41134 - DNA, 30 bp, Homo sapiens
caaaagcaccgcccatgcctctcagcacat

SEQ ID NO: 41135 - DNA, 30 bp, Homo sapiens
aacattttgtttctggaaaaaagcctttcc

SEQ ID NO: 41136 - DNA, 30 bp, Homo sapiens
tgcccagggttttcttcatggcttcgtaca

SEQ ID NO: 41137 - DNA, 30 bp, Homo sapiens
tggggttgatgagggtctgggagatggcca

SEQ ID NO: 41138 - DNA, 30 bp, Homo sapiens
gctctgcaggtgccgcagcaggatctgcat

SEQ ID NO: 41139 - DNA, 30 bp, Homo sapiens
cttcggttttctcgttttgaagaacttctt

SEQ ID NO: 41140 - DNA, 30 bp, Homo sapiens
tctcgagtccaccagctcaggtcggaggct

SEQ ID NO: 41141 - DNA, 30 bp, Homo sapiens
cagcggaggagatattcgtagctgaggaag

SEQ ID NO: 41142 - DNA, 30 bp, Homo sapiens
actccttcctcctgccttatggtattgata

SEQ ID NO: 41143 - DNA, 30 bp, Homo sapiens
atgtgagcagaccccgggcgagcctcagca

SEQ ID NO: 41144 - DNA, 30 bp, Homo sapiens
ctgagaaagcaagccggcatcctggaggag

SEQ ID NO: 41145 - DNA, 30 bp, Homo sapiens
gcgtggtccccgcggatagcctgcagcgac

SEQ ID NO: 41146 - DNA, 30 bp, Homo sapiens
atgaggcccagggaacactgtagtcatcct

SEQ ID NO: 41147 - DNA, 30 bp, Homo sapiens
atgcctctgagaacattggaccatgcaccc

SEQ ID NO: 41148 - DNA, 30 bp, Homo sapiens
gagatgagggaccgatggtaattcagatgg

SEQ ID NO: 41149 - DNA, 30 bp, Homo sapiens
tcctggagtgcgacttcctctgcaggaagt

SEQ ID NO: 41150 - DNA, 30 bp, Homo sapiens
gatcaccttcttgagctcgtcgtacaggac

SEQ ID NO: 41151 - DNA, 30 bp, Homo sapiens
tacagatgggcatcggtggcctccagctcc

SEQ ID NO: 41152 - DNA, 30 bp, Homo sapiens
cttccagaagttcctgcgagtcactcctct

SEQ ID NO: 41153 - DNA, 30 bp, Homo sapiens
ttgccgcagcccagtgcctcctggctcccg

SEQ ID NO: 41154 - DNA, 30 bp, Homo sapiens
tatgccttgagcagggcaaccttttggtcc

SEQ ID NO: 41155 - DNA, 30 bp, Homo sapiens
cattgggaacacatactcctttctgatttt

SEQ ID NO: 41156 - DNA, 30 bp, Homo sapiens
atacccgattacgtaatcctccatttgtat

SEQ ID NO: 41157 - DNA, 30 bp, Homo sapiens
cctggacatcaagttcttcttccgtcagct

SEQ ID NO: 41158 - DNA, 30 bp, Homo sapiens
ctcaggagtggcaggagtggcattgggctc

SEQ ID NO: 41159 - DNA, 30 bp, Homo sapiens
cggtctccatcttctggtcatctctgtatg

SEQ ID NO: 41160 - DNA, 30 bp, Homo sapiens
cagagttttcactccaacagaatcaataaa

SEQ ID NO: 41161 - DNA, 30 bp, Homo sapiens
gtctggtgaccgaaacagggctgtcgggga

SEQ ID NO: 41162 - DNA, 30 bp, Homo sapiens
ctgtggtcactgagtttgctcaaattctta

SEQ ID NO: 41163 - DNA, 30 bp, Homo sapiens
gagcggtggcattgttggaagatccaagtt

SEQ ID NO: 41164 - DNA, 30 bp, Homo sapiens
catcttcattgctgttgccctctggtgagt

SEQ ID NO: 41165 - DNA, 30 bp, Homo sapiens
cacagggcggtcagggtctctgcgtgaaac

SEQ ID NO: 41166 - DNA, 30 bp, Homo sapiens
gtccgtgacagcctgacaccatctgacacc

SEQ ID NO: 41167 - DNA, 30 bp, Homo sapiens
cagagggcgaaggcgcccgagcagatgcga

SEQ ID NO: 41168 - DNA, 30 bp, Homo sapiens
ttcagggttttagcacttatggcattatag

SEQ ID NO: 41169 - DNA, 30 bp, Homo sapiens
cgaaggtttcctgccaggagggcgctgtac

SEQ ID NO: 41170 - DNA, 30 bp, Homo sapiens
ctgcctggatgcggctgtaggcctcttggt

SEQ ID NO: 41171 - DNA, 30 bp, Homo sapiens
tccaggttccctcacacacagcctggtaca

SEQ ID NO: 41172 - DNA, 30 bp, Homo sapiens
tcagtagaacataagactttttcaagttat

SEQ ID NO: 41173 - DNA, 30 bp, Homo sapiens
gccaggagttcaagaccagcctggtcaaca

SEQ ID NO: 41174 - DNA, 30 bp, Homo sapiens
tgtgcacagatcgtgtggttgtaaaaccga

SEQ ID NO: 41175 - DNA, 30 bp, Homo sapiens
ggctgggactcggcaggtgtacttttgaat

SEQ ID NO: 41176 - DNA, 30 bp, Homo sapiens
tccaggtgatctgagggaggtactgattcg

SEQ ID NO: 41177 - DNA, 30 bp, Homo sapiens
gcacagacggtattgttgtagaatccacag

SEQ ID NO: 41178 - DNA, 30 bp, Homo sapiens
gcagttaaaggtcgatggattcaacaatgt

SEQ ID NO: 41179 - DNA, 30 bp, Homo sapiens
gcccggaacaggaaggagaaaacagccccc

SEQ ID NO: 41180 - DNA, 30 bp, Homo sapiens
gaaacggcaaagagcagcatgaaggtgatg

SEQ ID NO: 41181 - DNA, 30 bp, Homo sapiens
cagagcagcgccttgaagaggaaggagagg

SEQ ID NO: 41182 - DNA, 30 bp, Homo sapiens
tagatgaggtgcaccaggagggtagagcag

SEQ ID NO: 41183 - DNA, 30 bp, Homo sapiens
cctggcatactccagcctggacagcagcag

SEQ ID NO: 41184 - DNA, 30 bp, Homo sapiens
cagaggcctgcgaggatggaaccattggcg

SEQ ID NO: 41185 - DNA, 30 bp, Homo sapiens
acttgggaatcagcccccaggggatggaac

SEQ ID NO: 41186 - DNA, 30 bp, Homo sapiens
aggaggccgcagagatctcgatgcggctgt

SEQ ID NO: 41187 - DNA, 30 bp, Homo sapiens
atgaggaatgcaggagggagtgaggaccag

SEQ ID NO: 41188 - DNA, 30 bp, Homo sapiens
gactggataacctccaggctcctccacgtg

SEQ ID NO: 41189 - DNA, 30 bp, Homo sapiens
ggtctctggagaaagctgcctggattggcc

SEQ ID NO: 41190 - DNA, 30 bp, Homo sapiens
cagaagcatcattgtcagaaagatgatagt

SEQ ID NO: 41191 - DNA, 30 bp, Homo sapiens
cattggtggtggtctccttagcaggctcga

SEQ ID NO: 41192 - DNA, 30 bp, Homo sapiens
cctaggaatttcatttctacagcagctttt

SEQ ID NO: 41193 - DNA, 30 bp, Homo sapiens; identical to SEQ ID NO: 41191

SEQ ID NO: 41194 - DNA, 30 bp, Homo sapiens
agtcgttctcatctggccctaaatactcaa

SEQ ID NO: 41195 - DNA, 30 bp, Homo sapiens
tccaggaaccgctggcaggctttcttccag

SEQ ID NO: 41196 - DNA, 30 bp, Homo sapiens
tgacaggtggaagctctttcagttcctcct

SEQ ID NO: 41197 - DNA, 30 bp, Homo sapiens
atgttggctcgggacaggatgggcccccca

SEQ ID NO: 41198 - DNA, 30 bp, Homo sapiens
gcaagaaggaccttctccccgtgcggaaga

SEQ ID NO: 41199 - DNA, 30 bp, Homo sapiens
ggcaggagaggctgtgggaggcccagcatc

SEQ ID NO: 41200 - DNA, 30 bp, Homo sapiens
aaaaggacactgaagatgcagaaagcggag

SEQ ID NO: 41201 - DNA, 30 bp, Homo sapiens
aaaatgggctgtgatttgttccagagtctt

SEQ ID NO: 41202 - DNA, 30 bp, Homo sapiens
gtgacagctgagtcgattttctcttctggt

SEQ ID NO: 41203 - DNA, 30 bp, Homo sapiens
ttcaggttgtttgtttggcatgtttttaat

SEQ ID NO: 41204 - DNA, 30 bp, Homo sapiens
cattggtcctcctgagttttgttaagactt

SEQ ID NO: 41205 - DNA, 30 bp, Homo sapiens
ctgaggggccctggcatgcctgacagtcct

SEQ ID NO: 41206 - DNA, 30 bp, Homo sapiens
gcttgggggggttcctggcagcgcaggcac

SEQ ID NO: 41207 - DNA, 30 bp, Homo sapiens
tgatggtgtcattgtattccagcctaagcg

SEQ ID NO: 41208 - DNA, 30 bp, Homo sapiens
cttgcctgtaactctgaagctgaatagtac

SEQ ID NO: 41209 - DNA, 30 bp, Homo sapiens
agtttcctaggatcatttaactttttgtct

SEQ ID NO: 41210 - DNA, 30 bp, Homo sapiens
tggtccacaaagagtgaggccaaaaaacca

SEQ ID NO: 41211 - DNA, 30 bp, Homo sapiens
ttgcagtatttcatggattccatttgtttt

SEQ ID NO: 41212 - DNA, 30 bp, Homo sapiens
tcttggttgtccaattctattattagttcc

SEQ ID NO: 41213 - DNA, 30 bp, Homo sapiens
agcatcagcatcaggtgctactattaattt

SEQ ID NO: 41214 - DNA, 30 bp, Homo sapiens
cacaggggtcttcacagaaaaggcagtcgg

SEQ ID NO: 41215 - DNA, 30 bp, Homo sapiens
ctacatgtcgaacttcaggatttcgttttt

SEQ ID NO: 41216 - DNA, 30 bp, Homo sapiens
caatggcaatgctctgtgatatccactacc

SEQ ID NO: 41217 - DNA, 30 bp, Homo sapiens
aagctgtgctgagaagtgggtaagctaggt

SEQ ID NO: 41218 - DNA, 30 bp, Homo sapiens
tcctccgcgttggttcggtaggcttcgatg

SEQ ID NO: 41219 - DNA, 30 bp, Homo sapiens
gcatttccacgaagatgatccttcatcctg

SEQ ID NO: 41220 - DNA, 30 bp, Homo sapiens
caggggcagtgaggaacagagctgtcttcc

SEQ ID NO: 41221 - DNA, 30 bp, Homo sapiens
tagaggcgggtggcattgtggtgagcaggc

SEQ ID NO: 41222 - DNA, 30 bp, Homo sapiens
acaaggccgtgcattcggtctttgagtccg

SEQ ID NO: 41223 - DNA, 30 bp, Homo sapiens
acaactgctgggaggccaagatctcagggt

SEQ ID NO: 41224 - DNA, 30 bp, Homo sapiens
actctctcctttgaagctgtttctccttgt

SEQ ID NO: 41225 - DNA, 30 bp, Homo sapiens
gtttggtcccagctgggccaagggcaagaa

SEQ ID NO: 41226 - DNA, 30 bp, Homo sapiens
cttcaccagcactgactttggcagaaaggg

SEQ ID NO: 41227 - DNA, 30 bp, Homo sapiens
ccttggtgagcaactttggcagaaagggct

SEQ ID NO: 41228 - DNA, 30 bp, Homo sapiens
acctgggagaaaagaccatctcccaaaccc

SEQ ID NO: 41229 - DNA, 30 bp, Homo sapiens
ggatggctccaaggaaaaagacacaagctg

SEQ ID NO: 41230 - DNA, 30 bp, Homo sapiens
tgcaggtttgggatcataaccatacaaaaa

SEQ ID NO: 41231 - DNA, 30 bp, Homo sapiens
tagcggctgccatagtacaggcgcatggcc

SEQ ID NO: 41232 - DNA, 30 bp, Homo sapiens
agatctcggatcctttcttgcctaggtgcg

SEQ ID NO: 41233 - DNA, 30 bp, Homo sapiens
tcttgggtttggtaagtctttctagttctt

SEQ ID NO: 41234 - DNA, 30 bp, Homo sapiens
tagtgggatgtcttcttagctcctttccca

SEQ ID NO: 41235 - DNA, 30 bp, Homo sapiens
aaccttctgcacaggagactcaacaggcac

SEQ ID NO: 41236 - DNA, 30 bp, Homo sapiens
tccttgactttcttgcttccactgatttgt

SEQ ID NO: 41237 - DNA, 30 bp, Homo sapiens
ttcttcttgctgtccttctgaggctcactt

SEQ ID NO: 41238 - DNA, 30 bp, Homo sapiens
ccatggcgctcttctcgctgtctttggggc

SEQ ID NO: 41239 - DNA, 30 bp, Homo sapiens
ccctgggccacaaagtactcctcctcctca

SEQ ID NO: 41240 - DNA, 30 bp, Homo sapiens
cccttaatgtccagcttgttattagcctct

SEQ ID NO: 41241 - DNA, 30 bp, Homo sapiens
agatgttttcttcacccacaggtttaggtt

SEQ ID NO: 41242 - DNA, 30 bp, Homo sapiens
caaggactgggtaactcctcgttttctatc

SEQ ID NO: 41243 - DNA, 30 bp, Homo sapiens
tagcggttcaaactgtacgagtttgggtag

SEQ ID NO: 41244 - DNA, 30 bp, Homo sapiens
tactgggcctgaaagtcaccggggagattt

SEQ ID NO: 41245 - DNA, 30 bp, Homo sapiens
caggacgcaggaagcatggggcagggcagc

SEQ ID NO: 41246 - DNA, 30 bp, Homo sapiens
gcctggggtcctgtggaagcagcggctcca

SEQ ID NO: 41247 - DNA, 30 bp, Homo sapiens
taaggacgttgtgccagtttactcctactt

SEQ ID NO: 41248 - DNA, 30 bp, Homo sapiens
acttctgcagtcctctgctgaatggaccag

SEQ ID NO: 41249 - DNA, 30 bp, Homo sapiens
tgctgggctggtccctccgccacagccccc

SEQ ID NO: 41250 - DNA, 30 bp, Homo sapiens
tcctggccctgcccagcgctcctcattcga

SEQ ID NO: 41251 - DNA, 30 bp, Homo sapiens
gccacacgaacatgaggctcctcttcggtc

SEQ ID NO: 41252 - DNA, 30 bp, Homo sapiens
acaagacagcagagtgggtctcctggaggt

SEQ ID NO: 41253 - DNA, 30 bp, Homo sapiens
tagcgggcgaaggaagggcgggctcttctg

SEQ ID NO: 41254 - DNA, 30 bp, Homo sapiens
gcaaatgccactcctatgatggaatcagcg

SEQ ID NO: 41255 - DNA, 30 bp, Homo sapiens
tttcggtttgtactcagaacaagtgagaaa

SEQ ID NO: 41256 - DNA, 30 bp, Homo sapiens
taagccagtggtatagacactgtcccattg

SEQ ID NO: 41257 - DNA, 30 bp, Homo sapiens
agttttcagtatggattcttgttctttcac

SEQ ID NO: 41258 - DNA, 30 bp, Homo sapiens
tcctgagaaacactgtgcatagaaatgaga

SEQ ID NO: 41259 - DNA, 30 bp, Homo sapiens
attgtctcttcgctgtatagttccattatc

SEQ ID NO: 41260 - DNA, 30 bp, Homo sapiens
agctggcatcattgatgggagtgcgggtgc

SEQ ID NO: 41261 - DNA, 30 bp, Homo sapiens
atttggaactttggtaccatttacgaatgg

SEQ ID NO: 41262 - DNA, 30 bp, Homo sapiens
tcctggtagtcctgctttcttaaattcctc

SEQ ID NO: 41263 - DNA, 30 bp, Homo sapiens
ccctccctgtcctctcacagctgaggttct

SEQ ID NO: 41264 - DNA, 30 bp, Homo sapiens
ccttccctgtcctctcacagatgaggttcc

SEQ ID NO: 41265 - DNA, 30 bp, Homo sapiens
ccttcccttccctctcacagctgaggttcc

SEQ ID NO: 41266 - DNA, 30 bp, Homo sapiens
ctgtgcgcacaaacaggtccaccactaact

SEQ ID NO: 41267 - DNA, 30 bp, Homo sapiens
atgaaggcacaggtggaattgatgaagatg

SEQ ID NO: 41268 - DNA, 30 bp, Homo sapiens
cacaggatctgaacaatgaactggtagatc

SEQ ID NO: 41269 - DNA, 30 bp, Homo sapiens
aaaagtggtggagttggaaaaggggtgaga

SEQ ID NO: 41270 - DNA, 30 bp, Homo sapiens
ctgtggagttggccatggaatggctgatgg

SEQ ID NO: 41271 - DNA, 30 bp, Homo sapiens
acaactttgggagtaggataaataatttct

SEQ ID NO: 41272 - DNA, 30 bp, Homo sapiens
tagctgaccctgggcagctcagctccttgt

SEQ ID NO: 41273 - DNA, 30 bp, Homo sapiens
tggtgggttaggaccatactagagccgctg

SEQ ID NO: 41274 - DNA, 30 bp, Homo sapiens
gcctctgctcagggacaccttccaggccaa

SEQ ID NO: 41275 - DNA, 30 bp, Homo sapiens
actccctcaatatgtgagcctgtctcctta

SEQ ID NO: 41276 - DNA, 30 bp, Homo sapiens
ctcaggtggctggcagtgttgagagacgcc

SEQ ID NO: 41277 - DNA, 30 bp, Homo sapiens
tcttggacactcggcccatcttggtgcgga

SEQ ID NO: 41278 - DNA, 30 bp, Homo sapiens
tccagagaacacaagattataagttccttg

SEQ ID NO: 41279 - DNA, 30 bp, Homo sapiens
cagtggccttcgtcactactcgatgagcag

SEQ ID NO: 41280 - DNA, 30 bp, Homo sapiens
ctctggaggcccaggcgcctgtctaagctg

SEQ ID NO: 41281 - DNA, 30 bp, Homo sapiens
taaaggggagcaagggagataaaacggtaa

SEQ ID NO: 41282 - DNA, 30 bp, Homo sapiens
ctgaggtatttgtgagagagaaattgtcag

SEQ ID NO: 41283 - DNA, 30 bp, Homo sapiens
taatggccacctccaggtgcattgtgtacc

SEQ ID NO: 41284 - DNA, 30 bp, Homo sapiens
tagtggtttcctccatgccggctggtccct

SEQ ID NO: 41285 - DNA, 30 bp, Homo sapiens
gcttggaatttggaggatcataaatccagt

SEQ ID NO: 41286 - DNA, 30 bp, Homo sapiens
cagtgtccagacatgcggctctggcctgtg

SEQ ID NO: 41287 - DNA, 30 bp, Homo sapiens
atgagcaaaacgaatgccccaagctttttc

SEQ ID NO: 41288 - DNA, 30 bp, Homo sapiens
ggttgggaagtgcaagatcaaggtgtggac

SEQ ID NO: 41289 - DNA, 30 bp, Homo sapiens
gatccacaaagatggcgttggctgtggtct

SEQ ID NO: 41290 - DNA, 30 bp, Homo sapiens
gaatggccccatagctctaagagatgggtt

SEQ ID NO: 41291 - DNA, 30 bp, Homo sapiens
agaacatctcccagaccgctgccgccgtgc

SEQ ID NO: 41292 - DNA, 30 bp, Homo sapiens
ccaaaatgatgatgaaaacgtggaagatta

SEQ ID NO: 41293 - DNA, 30 bp, Homo sapiens
agatttggatgaagagcaggccagtgagca

SEQ ID NO: 41294 - DNA, 30 bp, Homo sapiens
aactggatgtcaaacacaattttatcttca

SEQ ID NO: 41295 - DNA, 30 bp, Homo sapiens
cccaggccaacgtccagtgacatcatcact

SEQ ID NO: 41296 - DNA, 30 bp, Homo sapiens
agcaggagagaaagccaacctaggatcaat

SEQ ID NO: 41297 - DNA, 30 bp, Homo sapiens
agagcgagaacagcaccattaccacgatgc

SEQ ID NO: 41298 - DNA, 30 bp, Homo sapiens
ccaaggcgatgtagagaaagccgccagagg

SEQ ID NO: 41299 - DNA, 30 bp, Homo sapiens
ccaatctggatctgtcctgaatacatggtg

SEQ ID NO: 41300 - DNA, 30 bp, Homo sapiens
actcgggaggcttagacaggataatcgctt

SEQ ID NO: 41301 - DNA, 30 bp, Homo sapiens
acaaggcaataaaggccatgaaggcaaaac

SEQ ID NO: 41302 - DNA, 30 bp, Homo sapiens
taggccaggcccaccccctcccttttgatg

SEQ ID NO: 41303 - DNA, 30 bp, Homo sapiens
accacttgaggaagaccatcccggccagga

SEQ ID NO: 41304 - DNA, 30 bp, Homo sapiens
agaaggtgatgtcatcctcgtacagggaca

SEQ ID NO: 41305 - DNA, 30 bp, Homo sapiens
cagccctcagtggtcacgggcagtagccgc

SEQ ID NO: 41306 - DNA, 30 bp, Homo sapiens
cccaaaagcatcccagcattctgtaaaaag

SEQ ID NO: 41307 - DNA, 30 bp, Homo sapiens
caaccagagcaacatacatgaataagccag

SEQ ID NO: 41308 - DNA, 30 bp, Homo sapiens
actcaaggtgggcaatcagcaccatcatga

SEQ ID NO: 41309 - DNA, 30 bp, Homo sapiens
ctctggaaacatatctgccagagaaatata

SEQ ID NO: 41310 - DNA, 30 bp, Homo sapiens
cgatttctcctgcatacaaggtaatgagta

SEQ ID NO: 41311 - DNA, 30 bp, Homo sapiens
tcagtcctaagtatgtcaccatggacataa

SEQ ID NO: 41312 - DNA, 30 bp, Homo sapiens
tgctggtgtcctactgacaggatgagaggg

SEQ ID NO: 41313 - DNA, 30 bp, Homo sapiens
acgaggtatacagtatgttcagtacactgg

SEQ ID NO: 41314 - DNA, 30 bp, Homo sapiens
cgtaggggaagcggagcagcagcccttcgt

SEQ ID NO: 41315 - DNA, 30 bp, Homo sapiens
taacttcttttgcatcaggaccgcaagcaa

SEQ ID NO: 41316 - DNA, 30 bp, Homo sapiens
tagtccccgacatccgtgtctcggtcccct

SEQ ID NO: 41317 - DNA, 30 bp, Homo sapiens
tctccatctcgatctccaataagccaaaga

SEQ ID NO: 41318 - DNA, 30 bp, Homo sapiens
tagggaggtccagatgccagttctgagatg

SEQ ID NO: 41319 - DNA, 30 bp, Homo sapiens
tgaagggttgtatgaggccccatcctgggg

SEQ ID NO: 41320 - DNA, 30 bp, Homo sapiens
atgcggtcacctcagagccgctaagcacct

SEQ ID NO: 41321 - DNA, 30 bp, Homo sapiens
cacgaaggcctcctggttggacgagccgtt

SEQ ID NO: 41322 - DNA, 30 bp, Homo sapiens
cagagggactttctttccaagtacggcatt

SEQ ID NO: 41323 - DNA, 30 bp, Homo sapiens
ttaccagcttctttcattgctttcctactg

SEQ ID NO: 41324 - DNA, 30 bp, Homo sapiens
gctttagctctctggaatcagcgacgcctc

SEQ ID NO: 41325 - DNA, 30 bp, Homo sapiens
ggactccgctgccttcttgttggtcttgtt

SEQ ID NO: 41326 - DNA, 30 bp, Homo sapiens
caatggcctggagttctgttccctcctcat

SEQ ID NO: 41327 - DNA, 30 bp, Homo sapiens
cttgttgtccgggggcgcctcgttcttctt

SEQ ID NO: 41328 - DNA, 30 bp, Homo sapiens
ttgtggattttcctcctggaaaatcttcag

SEQ ID NO: 41329 - DNA, 30 bp, Homo sapiens
ttctggggaactagttgcttcttgatcaga

SEQ ID NO: 41330 - DNA, 30 bp, Homo sapiens
agcaggaggggccggtgctcctcgtctgca

SEQ ID NO: 41331 - DNA, 30 bp, Homo sapiens
tttcttcctcgcggtggtactcagtaatga

SEQ ID NO: 41332 - DNA, 30 bp, Homo sapiens
atctaacaaagagagcgacaaagcaacagc

SEQ ID NO: 41333 - DNA, 30 bp, Homo sapiens
tatagggatccccgcggtacacaatctggc

SEQ ID NO: 41334 - DNA, 30 bp, Homo sapiens
atttggccaagtcgctcttgtcaaatacta

SEQ ID NO: 41335 - DNA, 30 bp, Homo sapiens
ccacggactctgtctccaccggtccctgca

SEQ ID NO: 41336 - DNA, 30 bp, Homo sapiens
cccaggccccccggaccagcctcctcccag

SEQ ID NO: 41337 - DNA, 30 bp, Homo sapiens
ttgtggaaaagaaaattttttttctaaaat

SEQ ID NO: 41338 - DNA, 30 bp, Homo sapiens
caggggctctggggaaactgctggaactcg

SEQ ID NO: 41339 - DNA, 30 bp, Homo sapiens
atatggtgacaatgggacttgtttataggc

SEQ ID NO: 41340 - DNA, 30 bp, Homo sapiens
aacaggctctgtctgaagcatcttcactgg

SEQ ID NO: 41341 - DNA, 30 bp, Homo sapiens
tgaagcatcttcactggattcttcttgtat

SEQ ID NO: 41342 - DNA, 30 bp, Homo sapiens
cactgaattctgacatagaatctcactaaa

SEQ ID NO: 41343 - DNA, 30 bp, Homo sapiens
gcctggtggctaggatcctgaccgtgagcc

SEQ ID NO: 41344 - DNA, 30 bp, Homo sapiens
accttgacctcttgactttgttgccctggc

SEQ ID NO: 41345 - DNA, 30 bp, Homo sapiens
acacaggcatggccacttcgtcgtattcat

SEQ ID NO: 41346 - DNA, 30 bp, Homo sapiens
ggaaggggagcttttggaaggaaagcttga

SEQ ID NO: 41347 - DNA, 30 bp, Homo sapiens
cttttgagttatcggcagtaatcagaaggt

SEQ ID NO: 41348 - DNA, 30 bp, Homo sapiens
aaggcctgtgctcagcgtccatgacatcca

SEQ ID NO: 41349 - DNA, 30 bp, Homo sapiens
ttgtcattaagatgggttctgccatctcca

SEQ ID NO: 41350 - DNA, 30 bp, Homo sapiens
cacaggcatgggcatctcattgtactcgtc

SEQ ID NO: 41351 - DNA, 30 bp, Homo sapiens
cactggcatgtgcagctcattgtactcatc

SEQ ID NO: 41352 - DNA, 30 bp, Homo sapiens
tcaaggaatgttggtgatctttctctgtca

SEQ ID NO: 41353 - DNA, 30 bp, Homo sapiens
ctcctccagaaataatcattgtcttcaggt

SEQ ID NO: 41354 - DNA, 30 bp, Homo sapiens
aactggaagatctttttctggcaatgcagt

SEQ ID NO: 41355 - DNA, 30 bp, Homo sapiens
atttctttcttggttcatcttcaaaactta

SEQ ID NO: 41356 - DNA, 30 bp, Homo sapiens
cacttagaagtccctcctaaacctgtggtc

SEQ ID NO: 41357 - DNA, 30 bp, Homo sapiens
ttttgggaggccgaggcaggcagatcacga

SEQ ID NO: 41358 - DNA, 30 bp, Homo sapiens
ttcatactgagagctttccaaactgtagtt

SEQ ID NO: 41359 - DNA, 30 bp, Homo sapiens
ctttggctgatacatcagctctgaatcttc

SEQ ID NO: 41360 - DNA, 30 bp, Homo sapiens
tagaggcaccaggaggcagaggtgagaagg

SEQ ID NO: 41361 - DNA, 30 bp, Homo sapiens
gtttgcaggagccagtagttcctgtcttgc

SEQ ID NO: 41362 - DNA, 30 bp, Homo sapiens
taggctttgaggttcaagtccaggtctgga

SEQ ID NO: 41363 - DNA, 30 bp, Homo sapiens
tagctctcagtttctggtacatccggaagg

SEQ ID NO: 41364 - DNA, 30 bp, Homo sapiens
caggggccacaggggtctacacagtccttt

SEQ ID NO: 41365 - DNA, 30 bp, Homo sapiens
cacaggggtctgcacagtcctttctgctgt

SEQ ID NO: 41366 - DNA, 30 bp, Homo sapiens
taggctggacagtgcagattgcagaagtcc

SEQ ID NO: 41367 - DNA, 30 bp, Homo sapiens
gcatggcaaaagacagccacggtcaccagg

SEQ ID NO: 41368 - DNA, 30 bp, Homo sapiens
agtaggcataaaagaatatgttgacacaca

SEQ ID NO: 41369 - DNA, 30 bp, Homo sapiens
taagcaaaatagccccagataaagatggcg

SEQ ID NO: 41370 - DNA, 30 bp, Homo sapiens
aaatgggtagtctcaaatgccatattgttg

SEQ ID NO: 41371 - DNA, 30 bp, Homo sapiens
cagaggaacacggccactgccatcatgagc

SEQ ID NO: 41372 - DNA, 30 bp, Homo sapiens
gaacacacagcaaaaagtccaatatttagt

SEQ ID NO: 41373 - DNA, 30 bp, Homo sapiens
ataaagaccaccacagccaggaggaggatg

SEQ ID NO: 41374 - DNA, 30 bp, Homo sapiens
cagaggtttgtctcctgctggtctcgacca

SEQ ID NO: 41375 - DNA, 30 bp, Homo sapiens
cacagggaggtctcctggaggatgcaggtg

SEQ ID NO: 41376 - DNA, 30 bp, Homo sapiens
cccttctggactggaatcaacatcaaggaa

SEQ ID NO: 41377 - DNA, 30 bp, Homo sapiens
gctcttgccactctgatctgagttcaattc

SEQ ID NO: 41378 - DNA, 30 bp, Homo sapiens
cagaggaagatgttgatggccagcaaaagg

SEQ ID NO: 41379 - DNA, 30 bp, Homo sapiens
tagatgtaggcctccttgctggtggagctg

SEQ ID NO: 41380 - DNA, 30 bp, Homo sapiens
actcccaaaactccatgacaggggaggtgg

SEQ ID NO: 41381 - DNA, 30 bp, Homo sapiens
agaagtgcgtctccttctctgtgatggctg

SEQ ID NO: 41382 - DNA, 30 bp, Homo sapiens
aaatgggtctccttctccccggctatcagt

SEQ ID NO: 41383 - DNA, 30 bp, Homo sapiens
agcagtgagactctagctctgtgagtctga

SEQ ID NO: 41384 - DNA, 30 bp, Homo sapiens
cagaggggccgtaagtgcaggagatggaag

SEQ ID NO: 41385 - DNA, 30 bp, Homo sapiens
ttctgctgccactaacagtaggtatttcat

SEQ ID NO: 41386 - DNA, 30 bp, Homo sapiens
tacaaatcagattctggcatatctggcata

SEQ ID NO: 41387 - DNA, 30 bp, Homo sapiens
gagagggatgaatccagaaatggtgattag

SEQ ID NO: 41388 - DNA, 30 bp, Homo sapiens
gaacctctttactgggtgttagctggtgac

SEQ ID NO: 41389 - DNA, 30 bp, Homo sapiens
ctcaggggtgctggccagcaggtagccgct

SEQ ID NO: 41390 - DNA, 30 bp, Homo sapiens
gtccgggcgcatgtccgtgtctgggcgcgt

SEQ ID NO: 41391 - DNA, 30 bp, Homo sapiens
cagtacttcaggtccccgttcatggaggct

SEQ ID NO: 41392 - DNA, 30 bp, Homo sapiens
agatggccagccagtgttgcaactggaact

SEQ ID NO: 41393 - DNA, 30 bp, Homo sapiens
agcaggatatctggcaagagttggtagctc

SEQ ID NO: 41394 - DNA, 30 bp, Homo sapiens
ccacggggtctgcgtctcccctcttgaggc

SEQ ID NO: 41395 - DNA, 30 bp, Homo sapiens
acaccttgagccagtggcggagcgtgaact

SEQ ID NO: 41396 - DNA, 30 bp, Homo sapiens
aagcggatgtccccacaaggaatttctgtt

SEQ ID NO: 41397 - DNA, 30 bp, Homo sapiens
tccaaatccttcactggcagtttgagtccc

SEQ ID NO: 41398 - DNA, 30 bp, Homo sapiens
tcatggtctccacaatgatgtgggtcggtt

SEQ ID NO: 41399 - DNA, 30 bp, Homo sapiens
tcccagaactcgatgacaggggaggtgaag

SEQ ID NO: 41400 - DNA, 30 bp, Homo sapiens
atcatcgactcctcctcctctgcaatctca

SEQ ID NO: 41401 - DNA, 30 bp, Homo sapiens
cgacgaccttgctgctctcggacactgggg

SEQ ID NO: 41402 - DNA, 30 bp, Homo sapiens
atccgggagtcctggaggcggctggagcca

SEQ ID NO: 41403 - DNA, 30 bp, Homo sapiens
cactggtccaagttgccgtcaggagtcctt

SEQ ID NO: 41404 - DNA, 30 bp, Homo sapiens
tcgagggcttgtctgtggcaggcagcaggg

SEQ ID NO: 41405 - DNA, 30 bp, Homo sapiens
gggtttcttgtcccatataataaagagata

SEQ ID NO: 41406 - DNA, 30 bp, Homo sapiens
acacatcagggaggcaaatattaaatagta

SEQ ID NO: 41407 - DNA, 30 bp, Homo sapiens
ctctggagagtaatctaactcatcatttgc

SEQ ID NO: 41408 - DNA, 30 bp, Homo sapiens
tcttgggtgatggtcatttgcttgaatggc

SEQ ID NO: 41409 - DNA, 30 bp, Homo sapiens
gagtggacatagagagtgccgggatcaagg

SEQ ID NO: 41410 - DNA, 30 bp, Homo sapiens
atatggccagggtcctgtgctggtgcctgg

SEQ ID NO: 41411 - DNA, 30 bp, Homo sapiens
tatgtctcctgggggaccacctgcatgagc

SEQ ID NO: 41412 - DNA, 30 bp, Homo sapiens
gtcagttttcctctcatcctttttttcttc

SEQ ID NO: 41413 - DNA, 30 bp, Homo sapiens
gtctgaatccaggtcgtgggggctgtcata

SEQ ID NO: 41414 - DNA, 30 bp, Homo sapiens
gcttgggcatctctcctccatcttccaaat

SEQ ID NO: 41415 - DNA, 30 bp, Homo sapiens
ggctggggctgccccgccacgtccttgtcc

SEQ ID NO: 41416 - DNA, 30 bp, Homo sapiens
ctcagggtcttcctccggtgggaccacttc

SEQ ID NO: 41417 - DNA, 30 bp, Homo sapiens
gaagccttttatgtggcagtaggcctccag

SEQ ID NO: 41418 - DNA, 30 bp, Homo sapiens
aagccccggatgtggcagtacgcctccagg

SEQ ID NO: 41419 - DNA, 30 bp, Homo sapiens
gatgtagcaataggcctctagtgtggcaaa

SEQ ID NO: 41420 - DNA, 30 bp, Homo sapiens
ttcaggtgaatcactccaaattcagtgagg

SEQ ID NO: 41421 - DNA, 30 bp, Homo sapiens
ccttggggaagaacggttctccctccccag

SEQ ID NO: 41422 - DNA, 30 bp, Homo sapiens
aatcgggctttccggcttccaggttccgat

SEQ ID NO: 41423 - DNA, 30 bp, Homo sapiens
gggagggcggcggggggccgctcctcgggg

SEQ ID NO: 41424 - DNA, 30 bp, Homo sapiens
cagaggttgctgaagagttcgtttttcttg

SEQ ID NO: 41425 - DNA, 30 bp, Homo sapiens
ccagtccatctgtggcgcgcgcttgttgac

SEQ ID NO: 41426 - DNA, 30 bp, Homo sapiens
ctatgggacctgtgatggtccctgccgtgt

SEQ ID NO: 41427 - DNA, 30 bp, Homo sapiens
agccggctgcctctgttgaactggatgcac

SEQ ID NO: 41428 - DNA, 30 bp, Homo sapiens
tccagggatgagatgctctggttccaaccc

SEQ ID NO: 41429 - DNA, 30 bp, Homo sapiens
ggctggaccatgtctcgtattatctaacaa

SEQ ID NO: 41430 - DNA, 30 bp, Homo sapiens
tccaggggaaacactaggcgggtgccccgg

SEQ ID NO: 41431 - DNA, 30 bp, Homo sapiens
cgtcgtcctcggagccggaggggccctggc

SEQ ID NO: 41432 - DNA, 30 bp, Homo sapiens
gtttgctcaagcttgagttcatagcctccc

SEQ ID NO: 41433 - DNA, 30 bp, Homo sapiens
ccttggtgtactcgcacttcttggctacct

SEQ ID NO: 41434 - DNA, 30 bp, Homo sapiens
tttaggccccagaatgcccataagtagagc

SEQ ID NO: 41435 - DNA, 30 bp, Homo sapiens
aacttgcacagaagtctctccttgaacttc

SEQ ID NO: 41436 - DNA, 30 bp, Homo sapiens
gcctggggcccagtaaaccaataagcagac

SEQ ID NO: 41437 - DNA, 30 bp, Homo sapiens
gtttattctaggggactccttacagttgaa

SEQ ID NO: 41438 - DNA, 30 bp, Homo sapiens
tgttcaaagaccgtgttgactgaggccatg

SEQ ID NO: 41439 - DNA, 30 bp, Homo sapiens
ccgtggacttttggtatatatctttgcact

SEQ ID NO: 41440 - DNA, 30 bp, Homo sapiens
cagaagggacaaaatgtttatttttattta

SEQ ID NO: 41441 - DNA, 30 bp, Homo sapiens
agaaggtacaaaatgttcaccattatttaa

SEQ ID NO: 41442 - DNA, 30 bp, Homo sapiens
ccatgggattttttccttacaacaaaaata

SEQ ID NO: 41443 - DNA, 30 bp, Homo sapiens
ggaatcttgtagacaccattgttctttctc

SEQ ID NO: 41444 - DNA, 30 bp, Homo sapiens
gcctggccagtagttgggttgtagcagatg

SEQ ID NO: 41445 - DNA, 30 bp, Homo sapiens
atgaggcctgccgccttctgcacgttgtac

SEQ ID NO: 41446 - DNA, 30 bp, Homo sapiens
actcgggaatcctctggcttcttccctggc

SEQ ID NO: 41447 - DNA, 30 bp, Homo sapiens
gcttctcacaaaggagtcttctgaaggtga

SEQ ID NO: 41448 - DNA, 30 bp, Homo sapiens
tttcacaccactcatggtcttccaggttat

SEQ ID NO: 41449 - DNA, 30 bp, Homo sapiens
ctctggagctggctatctgtggcactgtca

SEQ ID NO: 41450 - DNA, 30 bp, Homo sapiens
tgatggaggtggtttatacaaaaagattgc

SEQ ID NO: 41451 - DNA, 30 bp, Homo sapiens
tagattggagtaggaatgtatgctgagtgt

SEQ ID NO: 41452 - DNA, 30 bp, Homo sapiens
aggagggcggctccaaggcagcggggctct

SEQ ID NO: 41453 - DNA, 30 bp, Homo sapiens
acaagtcagtttcttcttttttcttaactt

SEQ ID NO: 41454 - DNA, 30 bp, Homo sapiens
ctgaccgacacatcatttccaatgttatca

SEQ ID NO: 41455 - DNA, 30 bp, Homo sapiens
atacccttgcccccgcgacccggccccttc

SEQ ID NO: 41456 - DNA, 30 bp, Homo sapiens
aagaatctggtacccagaagtcatgaagct

SEQ ID NO: 41457 - DNA, 30 bp, Homo sapiens
agtaggccgacagttctggattatttcctg

SEQ ID NO: 41458 - DNA, 30 bp, Homo sapiens
taatggccaccccacggaaaaatatacagg

SEQ ID NO: 41459 - DNA, 30 bp, Homo sapiens
ggtgagccttcgacaagatttaaacatctt

SEQ ID NO: 41460 - DNA, 30 bp, Homo sapiens
ctttcattgtttgagctgttgtccaatagt

SEQ ID NO: 41461 - DNA, 30 bp, Homo sapiens
ccctggaagccagacagatcagaatattgg

SEQ ID NO: 41462 - DNA, 30 bp, Homo sapiens
ttcataaagcaggtagaggtgtttaatggc

SEQ ID NO: 41463 - DNA, 30 bp, Homo sapiens
cactggctggcagatgtttttcttgctgaa

SEQ ID NO: 41464 - DNA, 30 bp, Homo sapiens
acacagaagccttcagaatatacagatgtc

SEQ ID NO: 41465 - DNA, 30 bp, Homo sapiens
cacaggacacagcaggtgcaggacacaggc

SEQ ID NO: 41466 - DNA, 30 bp, Homo sapiens
gtagtgcattccgaagtccttcttctgaag

SEQ ID NO: 41467 - DNA, 30 bp, Homo sapiens
ttttggccttctagtgtgaacctttactcc

SEQ ID NO: 41468 - DNA, 30 bp, Homo sapiens
cagagggcacagccacacttggtgggcttt

SEQ ID NO: 41469 - DNA, 30 bp, Homo sapiens
acagccgcacttcaccactttctcaacctc

SEQ ID NO: 41470 - DNA, 30 bp, Homo sapiens
gcgaggcagccgcactctaagtgtctctcc

SEQ ID NO: 41471 - DNA, 30 bp, Homo sapiens
tcatacactctgtgggccccatctgcgttg

SEQ ID NO: 41472 - DNA, 30 bp, Homo sapiens
acagctgactgattgcagtttgtttttcca

SEQ ID NO: 41473 - DNA, 30 bp, Homo sapiens
tgttgtcttctccaggacttcgaggtaatc

SEQ ID NO: 41474 - DNA, 30 bp, Homo sapiens
tcttgttcaaagctgtttgctcctcaagga

SEQ ID NO: 41475 - DNA, 30 bp, Homo sapiens
acgtggtctgtttttccagcacttcgaggt

SEQ ID NO: 41476 - DNA, 30 bp, Homo sapiens
atgtttgctgctccaggacttctaaatagt

SEQ ID NO: 41477 - DNA, 30 bp, Homo sapiens
atccggtggaatgcaagctgggaataggat

SEQ ID NO: 41478 - DNA, 30 bp, Homo sapiens
ctctggccagacctggcacgtacagcacga

SEQ ID NO: 41479 - DNA, 30 bp, Homo sapiens
ttttggctttaagtccaaccataattgggc

SEQ ID NO: 41480 - DNA, 30 bp, Homo sapiens
tggaccgaaacaccaaaacaggaaagccag

SEQ ID NO: 41481 - DNA, 30 bp, Homo sapiens
ccctggcaaacacttggcagcccttgggag

SEQ ID NO: 41482 - DNA, 30 bp, Homo sapiens
catgcccatgcaacacttcaagtcacgctt

SEQ ID NO: 41483 - DNA, 30 bp, Homo sapiens
tcgcggaggtccacccttaaatggcttaaa

SEQ ID NO: 41484 - DNA, 30 bp, Homo sapiens
ccaaggaaagaggccatggggtcatctggc

SEQ ID NO: 41485 - DNA, 30 bp, Homo sapiens
tgcagaggtctcggaagcagcagaagatca

SEQ ID NO: 41486 - DNA, 30 bp, Homo sapiens
agcaggtctgtccagtgtgcctcttctaat

SEQ ID NO: 41487 - DNA, 30 bp, Homo sapiens
cagttccgctccaccttcttcttgccccga

SEQ ID NO: 41488 - DNA, 30 bp, Homo sapiens
taatggcctctttcgtatttctttcttttc

SEQ ID NO: 41489 - DNA, 30 bp, Homo sapiens
cactggagggggccgtgcagatgtatctca

SEQ ID NO: 41490 - DNA, 30 bp, Homo sapiens
tgaaggggatcccatctgagttaatacttt

SEQ ID NO: 41491 - DNA, 30 bp, Homo sapiens
cactggaacagcggatgcttggggagccca

SEQ ID NO: 41492 - DNA, 30 bp, Homo sapiens
tctaaaggttgtgggtctgcaatcggcatg

SEQ ID NO: 41493 - DNA, 30 bp, Homo sapiens
cagaggggagcccatctgagtaaggacttt

SEQ ID NO: 41494 - DNA, 30 bp, Homo sapiens
atctggggttgttgaggaggatctccagcc

SEQ ID NO: 41495 - DNA, 30 bp, Homo sapiens
taccggctgttgaagatgacctctagccag

SEQ ID NO: 41496 - DNA, 30 bp, Homo sapiens
accagggcaggcaggggagaggctgagggg

SEQ ID NO: 41497 - DNA, 30 bp, Homo sapiens
atgtggagagcccatctgagtcagaacttt

SEQ ID NO: 41498 - DNA, 30 bp, Homo sapiens
tctcgctgcccttggccaagtcactctcca

SEQ ID NO: 41499 - DNA, 30 bp, Homo sapiens
ttgtgtgctgagagtctgacctgatgagct

SEQ ID NO: 41500 - DNA, 30 bp, Homo sapiens
tgtcattggccagtagattgcactgatgga

SEQ ID NO: 41501 - DNA, 30 bp, Homo sapiens
ctgaggactgagagtctgatttgctgcctg

SEQ ID NO: 41502 - DNA, 30 bp, Homo sapiens
gagttttagttgcccgtttcttcttttctg

SEQ ID NO: 41503 - DNA, 30 bp, Homo sapiens
tgacatccttctttccagagctctcagtag

SEQ ID NO: 41504 - DNA, 30 bp, Homo sapiens
cacttccttctgactgttcacgttcatcct

SEQ ID NO: 41505 - DNA, 30 bp, Homo sapiens
gagcggtcctcctcttgttcctcctcactg

SEQ ID NO: 41506 - DNA, 30 bp, Homo sapiens
ccatcaggtgcgccatccattttacgtttc

SEQ ID NO: 41507 - DNA, 30 bp, Homo sapiens
tgctggcatactcccttcatcaccttcatc

SEQ ID NO: 41508 - DNA, 30 bp, Homo sapiens
tacaggggagacgtaaagctgtcccagtta

SEQ ID NO: 41509 - DNA, 30 bp, Homo sapiens
accaggccggggccgtgttggcaagacgcc

SEQ ID NO: 41510 - DNA, 30 bp, Homo sapiens
taaggagcagctgaggctggcgggccagga

SEQ ID NO: 41511 - DNA, 30 bp, Homo sapiens
ctgtggaggtggcacaggggtgaccgtgcc

SEQ ID NO: 41512 - DNA, 30 bp, Homo sapiens
gtattccggattcccagggcttgctctaat

SEQ ID NO: 41513 - DNA, 30 bp, Homo sapiens
gtcaggcgaattcccagcacctgttccagt

SEQ ID NO: 41514 - DNA, 30 bp, Homo sapiens
tgttgcgcacaaccagcgactgctccagct

SEQ ID NO: 41515 - DNA, 30 bp, Homo sapiens
tgttggtggctcctccactgttgcactgtt

SEQ ID NO: 41516 - DNA, 30 bp, Homo sapiens
cattggggttggggttggcatctgggtact

SEQ ID NO: 41517 - DNA, 30 bp, Homo sapiens
tagcgggactctccgtgtctcttgctgctt

SEQ ID NO: 41518 - DNA, 30 bp, Homo sapiens
gtgctcctttgggtggttttgccttggatt

SEQ ID NO: 41519 - DNA, 30 bp, Homo sapiens
aaccatgtgtggtatcatcttctacaaagt

SEQ ID NO: 41520 - DNA, 30 bp, Homo sapiens
agtaaaggggagtgggcttgtagtggtgaa

SEQ ID NO: 41521 - DNA, 30 bp, Homo sapiens
cctttggaaagcctttaaattccatgtgtt

SEQ ID NO: 41522 - DNA, 30 bp, Homo sapiens
gtcatcatcttcttcttgagtcacaggtct

SEQ ID NO: 41523 - DNA, 30 bp, Homo sapiens
atacatctgttttggttataatcctatttt

SEQ ID NO: 41524 - DNA, 30 bp, Homo sapiens
agatggtatcaactcttcgagggatgactt

SEQ ID NO: 41525 - DNA, 30 bp, Homo sapiens
acaaggcttccacttccaaattcaagaaag

SEQ ID NO: 41526 - DNA, 30 bp, Homo sapiens
atttggtgtttcactgtattgatgacctca

SEQ ID NO: 41527 - DNA, 30 bp, Homo sapiens
actcggtgatggtggggcgcgtggccacgt

SEQ ID NO: 41528 - DNA, 30 bp, Homo sapiens
gcttggcctggactcattttgtgggctatg

SEQ ID NO: 41529 - DNA, 30 bp, Homo sapiens
gcatggggtggctggtccctggagattcct

SEQ ID NO: 41530 - DNA, 30 bp, Homo sapiens
gaacaaaaatgtcatgttcctcaagtagag

SEQ ID NO: 41531 - DNA, 30 bp, Homo sapiens
acacccaggctgtccaaccttcatacagct

SEQ ID NO: 41532 - DNA, 30 bp, Homo sapiens
gcaagtagattgatattttctcctggtaac

SEQ ID NO: 41533 - DNA, 30 bp, Homo sapiens; identical to SEQ ID NO: 25083

SEQ ID NO: 41534 - DNA, 30 bp, Homo sapiens
actgattctggtacacagtataccttaatg

SEQ ID NO: 41535 - DNA, 30 bp, Homo sapiens
aaaaagtacgaaaacccatcaggtgtggcg

SEQ ID NO: 41536 - DNA, 30 bp, Homo sapiens
tccttccactgcttgtagaagtccagaaca

SEQ ID NO: 41537 - DNA, 30 bp, Homo sapiens
gcccacctgggcccacgtgaggaaggctgg

SEQ ID NO: 41538 - DNA, 30 bp, Homo sapiens
gtgtggagggttcatggtgccttgtccccg

SEQ ID NO: 41539 - DNA, 30 bp, Homo sapiens
tttcgtctcttccaaaatggacgacgtcgt

SEQ ID NO: 41540 - DNA, 30 bp, Homo sapiens
gaaccccacggagcaccttgtagctcatta

SEQ ID NO: 41541 - DNA, 30 bp, Homo sapiens
gccagcaggcggctgtactctgccagagca

SEQ ID NO: 41542 - DNA, 30 bp, Homo sapiens
gtgaggtagcccaggatgaagatgatccag

SEQ ID NO: 41543 - DNA, 30 bp, Homo sapiens
tgcaggtggacgttgagaatcaccgaggcc

SEQ ID NO: 41544 - DNA, 30 bp, Homo sapiens
atcggatgttgaggatcaccgagcccgcga

SEQ ID NO: 41545 - DNA, 30 bp, Homo sapiens
taggccaatacggccacaccagaagccact

SEQ ID NO: 41546 - DNA, 30 bp, Homo sapiens
gggtaccagtgcaagagatgcggaaatggg

SEQ ID NO: 41547 - DNA, 30 bp, Homo sapiens
agcctccagtttttgttgttttgcctccaa

SEQ ID NO: 41548 - DNA, 30 bp, Homo sapiens
acgaggcacatgttcgtccctgccccaaag

SEQ ID NO: 41549 - DNA, 30 bp, Homo sapiens
tcattgatgtctgcatttttccacagaacg

SEQ ID NO: 41550 - DNA, 30 bp, Homo sapiens
cacaggaggagctggtggatcttgtccatt

SEQ ID NO: 41551 - DNA, 30 bp, Homo sapiens
gagaggtgatttttctgaagaatcccaaac

SEQ ID NO: 41552 - DNA, 30 bp, Homo sapiens
taaaaccaggaacaaaaaaagcacgcacac

SEQ ID NO: 41553 - DNA, 30 bp, Homo sapiens
cagtttcacgttttctgatgttgtccatca

SEQ ID NO: 41554 - DNA, 30 bp, Homo sapiens
agagttgcacactgtcagcttggttttgtg

SEQ ID NO: 41555 - DNA, 30 bp, Homo sapiens
tctggcacctgactttggtcctcttctgcg

SEQ ID NO: 41556 - DNA, 30 bp, Homo sapiens
ttttggaaaatcaactgaatcatgaaaacc

SEQ ID NO: 41557 - DNA, 30 bp, Homo sapiens
tccagtcttcagaaaccccttgtatcctgc

SEQ ID NO: 41558 - DNA, 30 bp, Homo sapiens
tcctggatgacttcaaacgtagaaagtttc

SEQ ID NO: 41559 - DNA, 30 bp, Homo sapiens
tccagggccaagttatccactcccttgggt

SEQ ID NO: 41560 - DNA, 30 bp, Homo sapiens
ttagagaaatctctagcaacccctccccac

SEQ ID NO: 41561 - DNA, 30 bp, Homo sapiens
tcatggtctccgggctctttttcctccaga

SEQ ID NO: 41562 - DNA, 30 bp, Homo sapiens
ctctggctgagtgtggagaggggatttctg

SEQ ID NO: 41563 - DNA, 30 bp, Homo sapiens
atgggaatcagggcaactatcaaatttaaa

SEQ ID NO: 41564 - DNA, 30 bp, Homo sapiens
atggttctgtaccagggccaccagtccatg

SEQ ID NO: 41565 - DNA, 30 bp, Homo sapiens
gagtgggaaggggaagagcggagaaaaacg

SEQ ID NO: 41566 - DNA, 30 bp, Homo sapiens
gtctgggtatttcttccttagctgtcgtct

SEQ ID NO: 41567 - DNA, 30 bp, Homo sapiens
caaaggtgtctaccagccgcccccatccca

SEQ ID NO: 41568 - DNA, 30 bp, Homo sapiens
cagctcctcctccagcgtcccctgcgggct

SEQ ID NO: 41569 - DNA, 30 bp, Homo sapiens
agcaggcacaaatgcctgtaatgctgagaa

SEQ ID NO: 41570 - DNA, 30 bp, Homo sapiens
caccggcttctactgcttccacaacaggca

SEQ ID NO: 41571 - DNA, 30 bp, Homo sapiens
gtaaggggtaagtacagataaagggagtct

SEQ ID NO: 41572 - DNA, 30 bp, Homo sapiens
tacaccggccgcgtcttccagggcgcgcgg

SEQ ID NO: 41573 - DNA, 30 bp, Homo sapiens
cgttggagaacttcatgtagccaccatctg

SEQ ID NO: 41574 - DNA, 30 bp, Homo sapiens
ttctctgatactgtctttctgaggcttttc

SEQ ID NO: 41575 - DNA, 30 bp, Homo sapiens
gcgagggggagcccgaggaagccctgcttg

SEQ ID NO: 41576 - DNA, 30 bp, Homo sapiens
cacccgcttcacactgagtgttttctgtgg

SEQ ID NO: 41577 - DNA, 30 bp, Homo sapiens
cacagggcgatgaagattcgaaagtatctg

SEQ ID NO: 41578 - DNA, 30 bp, Homo sapiens
tgctagatggaaaggcaatctgcttgagtt

SEQ ID NO: 41579 - DNA, 30 bp, Homo sapiens
atttggatgttttccgcctcatataactgt

SEQ ID NO: 41580 - DNA, 30 bp, Homo sapiens
tttctgtccccacttccataaaagacactt

SEQ ID NO: 41581 - DNA, 30 bp, Homo sapiens
cagtggactggatcaactacaagaatggtg

SEQ ID NO: 41582 - DNA, 30 bp, Homo sapiens
ctttcctttgggagcacccggccaatggaa

SEQ ID NO: 41583 - DNA, 30 bp, Homo sapiens
cattctctggtacagggaagagccatcctt

SEQ ID NO: 41584 - DNA, 30 bp, Homo sapiens
tgatagccactcatgtaccatgaaattaac

SEQ ID NO: 41585 - DNA, 30 bp, Homo sapiens
tagaggtatcttgatattgtgtcataggtt

SEQ ID NO: 41586 - DNA, 30 bp, Homo sapiens
ctgcatccatgagttctgtgtccatcaggt

SEQ ID NO: 41587 - DNA, 30 bp, Homo sapiens
acgaggcgtccttctttgctaacacccagg

SEQ ID NO: 41588 - DNA, 30 bp, Homo sapiens
atccttgtttccttggctgtctattagacg

SEQ ID NO: 41589 - DNA, 30 bp, Homo sapiens
ggtcccctgctggaagaggtctcggtacat

SEQ ID NO: 41590 - DNA, 30 bp, Homo sapiens
cacgggaacaaaaattcatattgagagaga

SEQ ID NO: 41591 - DNA, 30 bp, Homo sapiens
caaaacagtggccttggccacaggctctgg

SEQ ID NO: 41592 - DNA, 30 bp, Homo sapiens
atttggtacacacggtaacctgcaaggatg

SEQ ID NO: 41593 - DNA, 30 bp, Homo sapiens
cctgctgccccaggagtagggctggctgag

SEQ ID NO: 41594 - DNA, 30 bp, Homo sapiens
cctcccccgaagacaccatcagtcgcatgg

SEQ ID NO: 41595 - DNA, 30 bp, Homo sapiens
gggctggtgcagcttcccccgctcggtcag

SEQ ID NO: 41596 - DNA, 30 bp, Homo sapiens
cataggaaatattatcaagattcataattg

SEQ ID NO: 41597 - DNA, 30 bp, Homo sapiens
ctgaggctcagtggtcaggggaaggtggat

SEQ ID NO: 41598 - DNA, 30 bp, Homo sapiens
cacaggcccagcagggccatcagcagcagc

SEQ ID NO: 41599 - DNA, 30 bp, Homo sapiens
actgttcagctttggggacatattttagtt

SEQ ID NO: 41600 - DNA, 30 bp, Homo sapiens
tgcaggagtagggagggcaggatcagttgg

SEQ ID NO: 41601 - DNA, 30 bp, Homo sapiens
ggttgaggagggggtggtggaaatatccct

SEQ ID NO: 41602 - DNA, 30 bp, Homo sapiens
agtgtaaaatacccacaattccaagtatga

SEQ ID NO: 41603 - DNA, 30 bp, Homo sapiens
ttttggtttttaccagccccttctggacca

SEQ ID NO: 41604 - DNA, 30 bp, Homo sapiens
cgcaggcgcagttcgtggcgtcgcaggtgg

SEQ ID NO: 41605 - DNA, 30 bp, Homo sapiens
cacttcttcttggtcttcaccagtcctttc

SEQ ID NO: 41606 - DNA, 30 bp, Homo sapiens
cgcaggtggttgtacagcgactggacgtag

SEQ ID NO: 41607 - DNA, 30 bp, Homo sapiens
ctttaggagtccatcttcactgtaggtagc

SEQ ID NO: 41608 - DNA, 30 bp, Homo sapiens
agctgggatgaaaagccaggtcttctgact

SEQ ID NO: 41609 - DNA, 30 bp, Homo sapiens
cagtggcagcagccccagctcattcaatct

SEQ ID NO: 41610 - DNA, 30 bp, Homo sapiens
caaacccgcaggtctcctccacggctgtca

SEQ ID NO: 41611 - DNA, 30 bp, Homo sapiens
caaatccacatgtttcttcaatggctgtta

SEQ ID NO: 41612 - DNA, 30 bp, Homo sapiens
tgcttcttgtggaacagagctggggatggc

SEQ ID NO: 41613 - DNA, 30 bp, Homo sapiens
cagtggctttcaatttcctgtttgatctca

SEQ ID NO: 41614 - DNA, 30 bp, Homo sapiens
ggatgctctgatgttggcgtcgcattcttc

SEQ ID NO: 41615 - DNA, 30 bp, Homo sapiens
aatgcaggccctacaggggtgggtggtaag

SEQ ID NO: 41616 - DNA, 30 bp, Homo sapiens
gctctgcatcttctggctctccttcctcct

SEQ ID NO: 41617 - DNA, 30 bp, Homo sapiens
cagcggggacatcctgagcagccggactct

SEQ ID NO: 41618 - DNA, 30 bp, Homo sapiens
tcctcatgtttgtgcaggagagacattctg

SEQ ID NO: 41619 - DNA, 30 bp, Homo sapiens
caggggcccgggcagcagccagactcctca

SEQ ID NO: 41620 - DNA, 30 bp, Homo sapiens
ctctggcattggcaatatcaatacgatctc

SEQ ID NO: 41621 - DNA, 30 bp, Homo sapiens
cccagcatctttgttgcacgttggttggcc

SEQ ID NO: 41622 - DNA, 30 bp, Homo sapiens
ctttggttgtcagccggtcaagaatgtcat

SEQ ID NO: 41623 - DNA, 30 bp, Homo sapiens
ggtcagcctcttcatccgcctgttgtgctt

SEQ ID NO: 41624 - DNA, 30 bp, Homo sapiens
taggaaagtctctgtctccacaaagctcct

SEQ ID NO: 41625 - DNA, 30 bp, Homo sapiens
tgttaagatccgctaatgggtcctttgctg

SEQ ID NO: 41626 - DNA, 30 bp, Homo sapiens
tcttggatgcagtgaactctgttccactca

SEQ ID NO: 41627 - DNA, 30 bp, Homo sapiens
acctggcaggggtggctgcccgacccagaa

SEQ ID NO: 41628 - DNA, 30 bp, Homo sapiens
tcaacataaggataagcaaggaattccccc

SEQ ID NO: 41629 - DNA, 30 bp, Homo sapiens
gcctccgcttccgggtgtgcctggcatgcc

SEQ ID NO: 41630 - DNA, 30 bp, Homo sapiens
tagcggagaactggccgcagcaggtggtca

SEQ ID NO: 41631 - DNA, 30 bp, Homo sapiens
cctcctcttccgtcacatgactctttgtgc

SEQ ID NO: 41632 - DNA, 30 bp, Homo sapiens
gcctggggagccaggggggtaaattcccga

SEQ ID NO: 41633 - DNA, 30 bp, Homo sapiens
ccaactggtcctttttgacaaagccagtgg

SEQ ID NO: 41634 - DNA, 30 bp, Homo sapiens
aaggcatttcataagcctcattgtcaggat

SEQ ID NO: 41635 - DNA, 30 bp, Homo sapiens
ctctggctcagcaatgtgctttatgctgta

SEQ ID NO: 41636 - DNA, 30 bp, Homo sapiens
tctttcctttgctagcggagctggcagggt

SEQ ID NO: 41637 - DNA, 30 bp, Homo sapiens
cgcctctggctcatactcctgatattcctc

SEQ ID NO: 41638 - DNA, 30 bp, Homo sapiens
acatgggggggatggggactctccatgcca

SEQ ID NO: 41639 - DNA, 30 bp, Homo sapiens
agtctcccccactctgggcctcctctgcca

SEQ ID NO: 41640 - DNA, 30 bp, Homo sapiens
cctcctgttggggggcagatggcctcaagt

SEQ ID NO: 41641 - DNA, 30 bp, Homo sapiens
tagcggctgtagccaaattcgtctgcatca

SEQ ID NO: 41642 - DNA, 30 bp, Homo sapiens
gatttctccagtgtctgactcttactttgt

SEQ ID NO: 41643 - DNA, 30 bp, Homo sapiens
caggggagggcttctctggcctcctcagct

SEQ ID NO: 41644 - DNA, 30 bp, Homo sapiens
cctcctcatcctcgtcatctttcctgtcta

SEQ ID NO: 41645 - DNA, 30 bp, Homo sapiens
ccgtggacttccgggccgttgggagtcatc

SEQ ID NO: 41646 - DNA, 30 bp, Homo sapiens
cagagctgggagccgccgcccgctgggctg

SEQ ID NO: 41647 - DNA, 30 bp, Homo sapiens
acatggcaacagctggctgggctggatgcg

SEQ ID NO: 41648 - DNA, 30 bp, Homo sapiens
tgaatttgtactcctggtcacatcccatgt

SEQ ID NO: 41649 - DNA, 30 bp, Homo sapiens
ctttttgatgaaggaaacctcgtctcgatt

SEQ ID NO: 41650 - DNA, 30 bp, Homo sapiens
caaaggtctgttgaatccaccttttcgatt

SEQ ID NO: 41651 - DNA, 30 bp, Homo sapiens
cttgcctctttccttcttctccctcccctt

SEQ ID NO: 41652 - DNA, 30 bp, Homo sapiens
tacagtctcttgtcactcgatgctgagata

SEQ ID NO: 41653 - DNA, 30 bp, Homo sapiens
tttccttcttctcgactcacagtttttatc

SEQ ID NO: 41654 - DNA, 30 bp, Homo sapiens
cactccggcgcagcctccatcaaataccca

SEQ ID NO: 41655 - DNA, 30 bp, Homo sapiens
tcttggcaaaggagatcttcatggcgttgt

SEQ ID NO: 41656 - DNA, 30 bp, Homo sapiens
tgtgactgtgtcttcttccatctcttcttc

SEQ ID NO: 41657 - DNA, 30 bp, Homo sapiens
ccttggtgggcgcattcccgggggaggggg

SEQ ID NO: 41658 - DNA, 30 bp, Homo sapiens
agaaggcctcgcatcccagggggaggaggc

SEQ ID NO: 41659 - DNA, 30 bp, Homo sapiens
gcatgggacggtgtgatcttaaatccctgt

SEQ ID NO: 41660 - DNA, 30 bp, Homo sapiens
ctgtctggtcgagtcattccgggccgagtg

SEQ ID NO: 41661 - DNA, 30 bp, Homo sapiens
cctaggaccccctcttcctctgccacggcc

SEQ ID NO: 41662 - DNA, 30 bp, Homo sapiens
cttgccggcgatgagcgggttccgcaggac

SEQ ID NO: 41663 - DNA, 30 bp, Homo sapiens
cccattccacgtcctcttcctcttgcggcc

SEQ ID NO: 41664 - DNA, 30 bp, Homo sapiens
agcatgatccgacccagttgttttcttgac

SEQ ID NO: 41665 - DNA, 30 bp, Homo sapiens
cttcttcctcttcttccacacctctgatat

SEQ ID NO: 41666 - DNA, 30 bp, Homo sapiens
cttggaggtctttatgcttaataatttgct

SEQ ID NO: 41667 - DNA, 30 bp, Homo sapiens
cttctaacatgatgatactatttcctcgta

SEQ ID NO: 41668 - DNA, 30 bp, Homo sapiens
tcttggtggacgcattcctgggggaggtgg

SEQ ID NO: 41669 - DNA, 30 bp, Homo sapiens
gcccgaggcgggtgactttggccgacagga

SEQ ID NO: 41670 - DNA, 30 bp, Homo sapiens
agcccagtcttgtaatcttagctgacagga

SEQ ID NO: 41671 - DNA, 30 bp, Homo sapiens
cgagtgactttggccgataaaaacgtgtgc

SEQ ID NO: 41672 - DNA, 30 bp, Homo sapiens
cacattacctttgttgcagcatcaaagcag

SEQ ID NO: 41673 - DNA, 30 bp, Homo sapiens
tcgtggtagcagagctggcagcagtagaag

SEQ ID NO: 41674 - DNA, 30 bp, Homo sapiens
gctgctgtacatgtattttctggcaagact

SEQ ID NO: 41675 - DNA, 30 bp, Homo sapiens
gaaaggatctctctgtattttggcttggtt

SEQ ID NO: 41676 - DNA, 30 bp, Homo sapiens
caatggactgctgaatggattggatctgct

SEQ ID NO: 41677 - DNA, 30 bp, Homo sapiens
atgaggcatccagggtggtctgggctatgg

SEQ ID NO: 41678 - DNA, 30 bp, Homo sapiens
tcttggtgtctcagctaagaatgcctgcct

SEQ ID NO: 41679 - DNA, 30 bp, Homo sapiens
ccttcctcctcttcttgccttcatgctcgt

SEQ ID NO: 41680 - DNA, 30 bp, Homo sapiens
ctttggagagacctgtgcctattccttcct

SEQ ID NO: 41681 - DNA, 30 bp, Homo sapiens
ggagatggcctttgcctcaggaaggaaggc

SEQ ID NO: 41682 - DNA, 30 bp, Homo sapiens
gaacaggtagctgaggtaggcggagagaaa

SEQ ID NO: 41683 - DNA, 30 bp, Homo sapiens
gagctgtatttactttacatccatgtgaac

SEQ ID NO: 41684 - DNA, 30 bp, Homo sapiens
ctgtttctaactgaccagggtccaaaggca

SEQ ID NO: 41685 - DNA, 30 bp, Homo sapiens
tactggcgcaccttccccgggacgtagttc

SEQ ID NO: 41686 - DNA, 30 bp, Homo sapiens
cagtgggtgcccagcaattcttgctatctc

SEQ ID NO: 41687 - DNA, 30 bp, Homo sapiens
ctgcaaagaaggcgcttgagtagtttgaag

SEQ ID NO: 41688 - DNA, 30 bp, Homo sapiens
ccatcatcggatcctctgaaactaggatct

SEQ ID NO: 41689 - DNA, 30 bp, Homo sapiens
ccaaggttttgttaaacaaaacagggttcc

SEQ ID NO: 41690 - DNA, 30 bp, Homo sapiens
tgtcacagaggtaacttccttttgtacctt

SEQ ID NO: 41691 - DNA, 30 bp, Homo sapiens
tagggtgggagttgagacaggtgcaggcgc

SEQ ID NO: 41692 - DNA, 30 bp, Homo sapiens
ctgctacttctatctctgatacagcatttt

SEQ ID NO: 41693 - DNA, 30 bp, Homo sapiens
ctccaatgccctcgaaggcgaaattgccgt

SEQ ID NO: 41694 - DNA, 30 bp, Homo sapiens
caaaggtactctttgaaccttcgagaaaga

SEQ ID NO: 41695 - DNA, 30 bp, Homo sapiens
ttctgggtaactttttggaaaaatattatt

SEQ ID NO: 41696 - DNA, 30 bp, Homo sapiens
cgtccacgtctctgctcgcttcctcacctg

SEQ ID NO: 41697 - DNA, 30 bp, Homo sapiens
agttttccctgagcttctaagttggcttca

SEQ ID NO: 41698 - DNA, 30 bp, Homo sapiens
acatggcatgctcagctggatcgctgttgc

SEQ ID NO: 41699 - DNA, 30 bp, Homo sapiens
aagaggagacacccatcctcttagagttgc

SEQ ID NO: 41700 - DNA, 30 bp, Homo sapiens
cagaggcactgagatccaagaattccagga

SEQ ID NO: 41701 - DNA, 30 bp, Homo sapiens
caatggctttggcttcaggtaggaatgctt

SEQ ID NO: 41702 - DNA, 30 bp, Homo sapiens
gtgtggcgtcaggagccggagccacaaact

SEQ ID NO: 41703 - DNA, 30 bp, Homo sapiens
caaaggaaaacagctggtgattgatagaac

SEQ ID NO: 41704 - DNA, 30 bp, Homo sapiens
cagtgcaggtattctcgcacagtgagctcc

SEQ ID NO: 41705 - DNA, 30 bp, Homo sapiens
cctccttgatgagcaattctttgagactgg

SEQ ID NO: 41706 - DNA, 30 bp, Homo sapiens
cattgggccccggaattgccgctgcaggtt

SEQ ID NO: 41707 - DNA, 30 bp, Homo sapiens
catcggtggcagaggagcagggtgacaggc

SEQ ID NO: 41708 - DNA, 30 bp, Homo sapiens
acctgggctgtagatgagggtaaaatatcc

SEQ ID NO: 41709 - DNA, 30 bp, Homo sapiens
ctcaggacacagttcaattagcagcagttc

SEQ ID NO: 41710 - DNA, 30 bp, Homo sapiens
ttctccacttgagctcgcagaacaccctct

SEQ ID NO: 41711 - DNA, 30 bp, Homo sapiens
aggtggccacatctctctgctgtgacctcg

SEQ ID NO: 41712 - DNA, 30 bp, Homo sapiens
cagaggtcaccgctctggggctccacgttg

SEQ ID NO: 41713 - DNA, 30 bp, Homo sapiens
cagaggatgaccagcgaccttgtttataaa

SEQ ID NO: 41714 - DNA, 30 bp, Homo sapiens
ccacggtctccgccatttcgctgtagctgc

SEQ ID NO: 41715 - DNA, 30 bp, Homo sapiens
acttggcctcttgtttctcctgcagtagtg

SEQ ID NO: 41716 - DNA, 30 bp, Homo sapiens
tgttcccaaaaacgcagtcatctttagcta

SEQ ID NO: 41717 - DNA, 30 bp, Homo sapiens
tttagggcaacaagggtgttccggagaatc

SEQ ID NO: 41718 - DNA, 30 bp, Homo sapiens
cagaggttgtcatacatgcgcagggtcttc

SEQ ID NO: 41719 - DNA, 30 bp, Homo sapiens
cattggtccaaacttgaattccctttttgc

SEQ ID NO: 41720 - DNA, 30 bp, Homo sapiens
aaaagggagacattgttcctggcatgtttt

SEQ ID NO: 41721 - DNA, 30 bp, Homo sapiens
aacactgccaggcagttctgcagcaactgt

SEQ ID NO: 41722 - DNA, 30 bp, Homo sapiens
tgaaggttggtctgtgatgtaaggaatgac

SEQ ID NO: 41723 - DNA, 30 bp, Homo sapiens
gtgaggacacaggccgtcctccggcgggga

SEQ ID NO: 41724 - DNA, 30 bp, Homo sapiens
tcactggaaagcggctgagggcctgcctca

SEQ ID NO: 41725 - DNA, 30 bp, Homo sapiens
tccaggaacgtggccggacataatccaaaa

SEQ ID NO: 41726 - DNA, 30 bp, Homo sapiens
ggtatggcaggaccaagatcgaggtgtcac

SEQ ID NO: 41727 - DNA, 30 bp, Homo sapiens
tttgagcggcggctccaggtcctcaggccc

SEQ ID NO: 41728 - DNA, 30 bp, Homo sapiens
aaatctggaaggggaaggagctcaggtagt

SEQ ID NO: 41729 - DNA, 30 bp, Homo sapiens
agatggcaccggtacatttgttaatggtga

SEQ ID NO: 41730 - DNA, 30 bp, Homo sapiens
aaagcggggcatcgtactggtccaggaact

SEQ ID NO: 41731 - DNA, 30 bp, Homo sapiens
ttctggtgcatcaatcctgagtactctaac

SEQ ID NO: 41732 - DNA, 30 bp, Homo sapiens
gactggttctcgttccaaccagcgaactct

SEQ ID NO: 41733 - DNA, 30 bp, Homo sapiens
ttttgtttggcaaaggcagtttctgaatta

SEQ ID NO: 41734 - DNA, 30 bp, Homo sapiens
tacgtggagggttccacctcttgcttctgt

SEQ ID NO: 41735 - DNA, 30 bp, Homo sapiens
tattgggcgatcccaattacaccacaagcc

SEQ ID NO: 41736 - DNA, 30 bp, Homo sapiens
tcgaggcactccttctacaatgaggtagac

SEQ ID NO: 41737 - DNA, 30 bp, Homo sapiens
catcaatccccagcagtggaataaggcctg

SEQ ID NO: 41738 - DNA, 30 bp, Homo sapiens
aggcggccttgcactcgctctcgcgccgcc

SEQ ID NO: 41739 - DNA, 30 bp, Homo sapiens
tattggcgggggctggggaggggccaggat

SEQ ID NO: 41740 - DNA, 30 bp, Homo sapiens
cgctgggggggagtgccctctcctccccac

SEQ ID NO: 41741 - DNA, 30 bp, Homo sapiens
cctcggcgccgcggtcgtccgcagacttgg

SEQ ID NO: 41742 - DNA, 30 bp, Homo sapiens
acgcggggggaccagccctgaacccagggc

SEQ ID NO: 41743 - DNA, 30 bp, Homo sapiens
agcaggcaaagaagtcagggaagatgctct

SEQ ID NO: 41744 - DNA, 30 bp, Homo sapiens
ttgaatgaagaagagagatctttttgtttt

SEQ ID NO: 41745 - DNA, 30 bp, Homo sapiens
gtctggcccaacccagaagtgcagtgccga

SEQ ID NO: 41746 - DNA, 30 bp, Homo sapiens
gtaagggctccatttctcaataccctaaag

SEQ ID NO: 41747 - DNA, 30 bp, Homo sapiens
aggtggaggtgcaggctttaggtttggtgg

SEQ ID NO: 41748 - DNA, 30 bp, Homo sapiens
aaatctagagctatagagccttgaagcaaa

SEQ ID NO: 41749 - DNA, 30 bp, Homo sapiens
gcctggaaaagtaccaaactgctttgtcct

SEQ ID NO: 41750 - DNA, 30 bp, Homo sapiens
gacgtagtttccggggaaagtaccaaagaa

SEQ ID NO: 41751 - DNA, 30 bp, Homo sapiens
acaccggggcaacgtaatttccagggaacg

SEQ ID NO: 41752 - DNA, 30 bp, Homo sapiens
agctgggattccaccttctcatctataagc

SEQ ID NO: 41753 - DNA, 30 bp, Homo sapiens
ctgctatgcacatcactgtaacacatgctt

SEQ ID NO: 41754 - DNA, 30 bp, Homo sapiens
ctatggaaatacttccttttaaacttgtag

SEQ ID NO: 41755 - DNA, 30 bp, Homo sapiens
attgcatactgtgccccagcagatccccgc

SEQ ID NO: 41756 - DNA, 30 bp, Homo sapiens
accaggtagctgtgcatctctcgggagttg

SEQ ID NO: 41757 - DNA, 30 bp, Homo sapiens
ttggggatctcctttgtgctttcgctgttt

SEQ ID NO: 41758 - DNA, 30 bp, Homo sapiens
ttctggtcactggggtcacacttgagcatg

SEQ ID NO: 41759 - DNA, 30 bp, Homo sapiens
ccatggggacgtcatctgaaaatccagtta

SEQ ID NO: 41760 - DNA, 30 bp, Homo sapiens
aagaggtcctcatctgagtcatcatgataa

SEQ ID NO: 41761 - DNA, 30 bp, Homo sapiens
gaatgggcattctccaacagtggtggtcca

SEQ ID NO: 41762 - DNA, 30 bp, Homo sapiens
ttggggagtttctgcattttctagcaaagg

SEQ ID NO: 41763 - DNA, 30 bp, Homo sapiens
agtaggcgttctccagctcggcctggttgg

SEQ ID NO: 41764 - DNA, 30 bp, Homo sapiens
tgctggatttgctggctcttttccgctctc

SEQ ID NO: 41765 - DNA, 30 bp, Homo sapiens
ggttgttggaggcaaactgggcactagacc

SEQ ID NO: 41766 - DNA, 30 bp, Homo sapiens
cagtcactatactcttctctttcccttgga

SEQ ID NO: 41767 - DNA, 30 bp, Homo sapiens
acattggactttggtctcaatgtgaagggc

SEQ ID NO: 41768 - DNA, 30 bp, Homo sapiens
caacggtcctggaatgaggggaacagatgg

SEQ ID NO: 41769 - DNA, 30 bp, Homo sapiens
gtcaggggcaccgtgccgttcacgcccgcg

SEQ ID NO: 41770 - DNA, 30 bp, Homo sapiens
tagggccgggacagtgtcgtatatactggc

SEQ ID NO: 41771 - DNA, 30 bp, Homo sapiens
aatatgtgaacaccaggtcggagaagttcg

SEQ ID NO: 41772 - DNA, 30 bp, Homo sapiens
agtaggtgaaaaccaggtctgcgatgctag

SEQ ID NO: 41773 - DNA, 30 bp, Homo sapiens
actccccatcgctcttctcttcgccctccg

SEQ ID NO: 41774 - DNA, 30 bp, Homo sapiens
acatggccgtagcgtgggctgacgaataag

SEQ ID NO: 41775 - DNA, 30 bp, Homo sapiens
tagaggtgggttaggggcatgggggcacca

SEQ ID NO: 41776 - DNA, 30 bp, Homo sapiens
acacgtcaggatagttgcagtaatataccg

SEQ ID NO: 41777 - DNA, 30 bp, Homo sapiens
agccggagatgcacgcgctgtaatagaccg

SEQ ID NO: 41778 - DNA, 30 bp, Homo sapiens
catgtgtgagaggggcagtgtgccgttaat

SEQ ID NO: 41779 - DNA, 30 bp, Homo sapiens
gcgcggcagcgtaggccgcggggtaggggt

SEQ ID NO: 41780 - DNA, 30 bp, Homo sapiens
atgtgggtcagcggcaccgttccgttgact

SEQ ID NO: 41781 - DNA, 30 bp, Homo sapiens
tgttttgggtacctgtcttcataataacta

SEQ ID NO: 41782 - DNA, 30 bp, Homo sapiens
gcactttttcttcttcctcctcatcactgt

SEQ ID NO: 41783 - DNA, 30 bp, Homo sapiens
agtaggtgaaaaccaggttggagatgctgg

SEQ ID NO: 41784 - DNA, 30 bp, Homo sapiens
cagttggcttgtcctgcaatatggttttca

SEQ ID NO: 41785 - DNA, 30 bp, Homo sapiens
agttggcactgacagcctccggggcttcat

SEQ ID NO: 41786 - DNA, 30 bp, Homo sapiens
acgtggccgtggcatcagccaggacggaga

SEQ ID NO: 41787 - DNA, 30 bp, Homo sapiens
gggcctggtcagggtggtgtacaccggctg

SEQ ID NO: 41788 - DNA, 30 bp, Homo sapiens
caaggtcgagtgagctgtgtgtagacgggt

SEQ ID NO: 41789 - DNA, 30 bp, Homo sapiens
ccactgatattaatggactgcagatctgcc

SEQ ID NO: 41790 - DNA, 30 bp, Homo sapiens
cttgttcatcctcttcatcttcttcctctt

SEQ ID NO: 41791 - DNA, 30 bp, Homo sapiens
ttcttgtgcttggtggttctggcagaaatt

SEQ ID NO: 41792 - DNA, 30 bp, Homo sapiens
cttctttacctgaccctcttcttagggatg

SEQ ID NO: 41793 - DNA, 30 bp, Homo sapiens
cttgaattcccagtctggtgaatttatctt

SEQ ID NO: 41794 - DNA, 30 bp, Homo sapiens
accgccgtcattggcttcatgaaaaccgag

SEQ ID NO: 41795 - DNA, 30 bp, Homo sapiens
gtcattccttcacaacgtatattccgtttc

SEQ ID NO: 41796 - DNA, 30 bp, Homo sapiens
aattgttcccatttgtttcctgaatagcaa

SEQ ID NO: 41797 - DNA, 30 bp, Homo sapiens
cagtgtaccagtatgtgctaggctctcttc

SEQ ID NO: 41798 - DNA, 30 bp, Homo sapiens
aactgttcccatttgtttcctgaatagcaa

SEQ ID NO: 41799 - DNA, 30 bp, Homo sapiens
aagttcttcgtgaccaggtgggtcttgtaa

SEQ ID NO: 41800 - DNA, 30 bp, Homo sapiens
tctcatttccagaaactgtgacaagctgta

SEQ ID NO: 41801 - DNA, 30 bp, Homo sapiens
tggttgaaacattgggagttgctggattcg

SEQ ID NO: 41802 - DNA, 30 bp, Homo sapiens
cacaggtcccgcgcgtcctcccgcttaacc

SEQ ID NO: 41803 - DNA, 30 bp, Homo sapiens
agttggagggagccacgctgccctcggcct

SEQ ID NO: 41804 - DNA, 30 bp, Homo sapiens
cagatctccagcaagttgctctgctcaggg

SEQ ID NO: 41805 - DNA, 30 bp, Homo sapiens
tctaggccgttgcggtgcccgggctcgggg

SEQ ID NO: 41806 - DNA, 30 bp, Homo sapiens
gctgcttccttgcctcccgcggaggccgcc

SEQ ID NO: 41807 - DNA, 30 bp, Homo sapiens
ctctggctatgtgtccccggaaggcagctt

SEQ ID NO: 41808 - DNA, 30 bp, Homo sapiens
agctctcctaagccccatcctgtgggtcaa

SEQ ID NO: 41809 - DNA, 30 bp, Homo sapiens
accaggcatttctgttggtaattggtcaag

SEQ ID NO: 41810 - DNA, 30 bp, Homo sapiens
agcctcgtagtccaaagcagctgcgttgaa

SEQ ID NO: 41811 - DNA, 30 bp, Homo sapiens
tagaagtcacagccatccacccattcagtg

SEQ ID NO: 41812 - DNA, 30 bp, Homo sapiens
cagtggaacagagtaatacaatcaaaccca

SEQ ID NO: 41813 - DNA, 30 bp, Homo sapiens
gagccattcagataaatcatggccagaaca

SEQ ID NO: 41814 - DNA, 30 bp, Homo sapiens
cagtaccatcgaaagaacatccacgccaac

SEQ ID NO: 41815 - DNA, 30 bp, Homo sapiens
tgactgccttggctcctcctctgtgcgctg

SEQ ID NO: 41816 - DNA, 30 bp, Homo sapiens
gcggcaacttctcggagtgggcgatccatt

SEQ ID NO: 41817 - DNA, 30 bp, Homo sapiens
accaggaggcctccagggtggttttgaaca

SEQ ID NO: 41818 - DNA, 30 bp, Homo sapiens
tttagggcctgtatatcttctaaagtaaaa

SEQ ID NO: 41819 - DNA, 30 bp, Homo sapiens
ccacagcgttgtctgtgctgctggcctgtc

SEQ ID NO: 41820 - DNA, 30 bp, Homo sapiens
cggtggaacatcccctggcccatctaggcc

SEQ ID NO: 41821 - DNA, 30 bp, Homo sapiens
tctgccatccatctctggtttctcttttcc

SEQ ID NO: 41822 - DNA, 30 bp, Homo sapiens
cttctcctgcagtcaacaacttttaaatct

SEQ ID NO: 41823 - DNA, 30 bp, Homo sapiens
gcataatctgggtgtagacatctggaacat

SEQ ID NO: 41824 - DNA, 30 bp, Homo sapiens
tcgaactgtgccgtcagagcctccagaaaa

SEQ ID NO: 41825 - DNA, 30 bp, Homo sapiens
gtgtggaggaataaattgtagaagttctct

SEQ ID NO: 41826 - DNA, 30 bp, Homo sapiens
tgcactgccctctgccccctctgaggttcg

SEQ ID NO: 41827 - DNA, 30 bp, Homo sapiens
atccctgtagttctttgcatcccctcacca

SEQ ID NO: 41828 - DNA, 30 bp, Homo sapiens
tctgcagaagtgtatctgaatatccagggg

SEQ ID NO: 41829 - DNA, 30 bp, Homo sapiens
aagtgcacaaacttgcaactctggaaagaa

SEQ ID NO: 41830 - DNA, 30 bp, Homo sapiens
aggaggttggcggcaactcttccccactct

SEQ ID NO: 41831 - DNA, 30 bp, Homo sapiens
caccagcctctgtcctcttgagttaccgtt

SEQ ID NO: 41832 - DNA, 30 bp, Homo sapiens
agaaaggagtcattctcccccctccaccac

SEQ ID NO: 41833 - DNA, 30 bp, Homo sapiens
atcacttgccacactatcaagtgactcctt

SEQ ID NO: 41834 - DNA, 30 bp, Homo sapiens
tcccagacttccagcctccaaatgaacatt

SEQ ID NO: 41835 - DNA, 30 bp, Homo sapiens
gtgtggagggtgaagcattgtagaaaattt

SEQ ID NO: 41836 - DNA, 30 bp, Homo sapiens
cctccatttggtcggggttgattctgttct

SEQ ID NO: 41837 - DNA, 30 bp, Homo sapiens
tgcaggtatttcaaccattatttccatgaa

SEQ ID NO: 41838 - DNA, 30 bp, Homo sapiens
caccctcctgtgaagatccttcagatgagt

SEQ ID NO: 41839 - DNA, 30 bp, Homo sapiens
cactgtcctgtgaagatccttcagataagc

SEQ ID NO: 41840 - DNA, 30 bp, Homo sapiens
atcctgtggagatcctgcagatatgtctag

SEQ ID NO: 41841 - DNA, 30 bp, Homo sapiens
gactggtcattctcgagttgatttgaatgt

SEQ ID NO: 41842 - DNA, 30 bp, Homo sapiens
cagccggcccactcatccagggcgatgtac

SEQ ID NO: 41843 - DNA, 30 bp, Homo sapiens
ctccaggcagaacaacaaaccatccaaaca

SEQ ID NO: 41844 - DNA, 30 bp, Homo sapiens
cagtggccccactccttcagggtgatgtgc

SEQ ID NO: 41845 - DNA, 30 bp, Homo sapiens
ttacttccttcgtctgctcatccttctccc

SEQ ID NO: 41846 - DNA, 30 bp, Homo sapiens
acagtggtatctccaaagtccttgttccaa

SEQ ID NO: 41847 - DNA, 30 bp, Homo sapiens
cagttttcaatgttcgtaaatctgaaactg

SEQ ID NO: 41848 - DNA, 30 bp, Homo sapiens
tgttggagtatactgtagagagggacctga

SEQ ID NO: 41849 - DNA, 30 bp, Homo sapiens
ttccggaagggggtgagcctgttgaaggtg

SEQ ID NO: 41850 - DNA, 30 bp, Homo sapiens
ctgaacagtttgaagtcgcttcatttttgt

SEQ ID NO: 41851 - DNA, 30 bp, Homo sapiens
tacaatctgtccagcttttgaatataattt

SEQ ID NO: 41852 - DNA, 30 bp, Homo sapiens
cttattggagaaggactccgacttcgagac

SEQ ID NO: 41853 - DNA, 30 bp, Homo sapiens
ctgaggaggagggtctcatactgaagtcct

SEQ ID NO: 41854 - DNA, 30 bp, Homo sapiens
tatctgtacacgagatgggagagctgggtg

SEQ ID NO: 41855 - DNA, 30 bp, Homo sapiens
cgcagggatcagtgatgggcactgagcagg

SEQ ID NO: 41856 - DNA, 30 bp, Homo sapiens
cagtgggttcgagctggcacagagctgagc

SEQ ID NO: 41857 - DNA, 30 bp, Homo sapiens
gcctggaaagttttttgttcagaaacagac

SEQ ID NO: 41858 - DNA, 30 bp, Homo sapiens
gggtgttgtcttctggaatatcatccaaca

SEQ ID NO: 41859 - DNA, 30 bp, Homo sapiens
ccctgggatgctggtggctgcgggcctgac

SEQ ID NO: 41860 - DNA, 30 bp, Homo sapiens
acaagcaggagccaggaggctggccccttt

SEQ ID NO: 41861 - DNA, 30 bp, Homo sapiens
ggccgggccccggggctgttgtagagcaga

SEQ ID NO: 41862 - DNA, 30 bp, Homo sapiens
agtaggcagctcctagagcccccagagcca

SEQ ID NO: 41863 - DNA, 30 bp, Homo sapiens
cagataccttcccaaagaagacagtgcctt

SEQ ID NO: 41864 - DNA, 30 bp, Homo sapiens
cagtggtgatggtggctggaggcactgggt

SEQ ID NO: 41865 - DNA, 30 bp, Homo sapiens
tgttgggacgactctggttcttgagagtgg

SEQ ID NO: 41866 - DNA, 30 bp, Homo sapiens
tggggggaaattttcctccctgtaaatgct

SEQ ID NO: 41867 - DNA, 30 bp, Homo sapiens
atatggaaagatttaatatgggcttcatat

SEQ ID NO: 41868 - DNA, 30 bp, Homo sapiens
aggaggcaagacacctctgtgcagacatca

SEQ ID NO: 41869 - DNA, 30 bp, Homo sapiens
ctctgggattgtgggggctgacagcttaaa

SEQ ID NO: 41870 - DNA, 30 bp, Homo sapiens
aagctgccggcggcgggtgcttggctgtcc

SEQ ID NO: 41871 - DNA, 30 bp, Homo sapiens
tactggggttcctgtgccgccggtaggggc

SEQ ID NO: 41872 - DNA, 30 bp, Homo sapiens
gataggtttcatagcagagtaataagaatg

SEQ ID NO: 41873 - DNA, 30 bp, Homo sapiens
gagcaaggagactcagcttgatccaggagc

SEQ ID NO: 41874 - DNA, 30 bp, Homo sapiens
agtaggcttcaccgccaatttgcctaaggt

SEQ ID NO: 41875 - DNA, 30 bp, Homo sapiens
gtagtctatggtttctttgtccttcttgtt

SEQ ID NO: 41876 - DNA, 30 bp, Homo sapiens
tcattggccaaagcctttgctatcattgtt

SEQ ID NO: 41877 - DNA, 30 bp, Homo sapiens
ctcaggaattctaggtgtcacagtgctcaa

SEQ ID NO: 41878 - DNA, 30 bp, Homo sapiens
cattttttcagctccttgtatttaccctgt

SEQ ID NO: 41879 - DNA, 30 bp, Homo sapiens
acgttagaaaatccttctttcttaaataag

SEQ ID NO: 41880 - DNA, 30 bp, Homo sapiens
tatgtgaagcagaactacaggcctttttgt

SEQ ID NO: 41881 - DNA, 30 bp, Homo sapiens
cagagggtagcttggtctttcaatgatata

SEQ ID NO: 41882 - DNA, 30 bp, Homo sapiens
ggcagtcctcaatgctcatttccatgattt

SEQ ID NO: 41883 - DNA, 30 bp, Homo sapiens
atatgggtgaaacaggacacttctcctgtt

SEQ ID NO: 41884 - DNA, 30 bp, Homo sapiens
tccgagctaagctccaaggatccagaaata

SEQ ID NO: 41885 - DNA, 30 bp, Homo sapiens
gattggtcaaacacagaatgtaaaacttgg

SEQ ID NO: 41886 - DNA, 30 bp, Homo sapiens
gaacatgggcttgccgtcatcgtgcgccag

SEQ ID NO: 41887 - DNA, 30 bp, Homo sapiens
cactggggttcagggaagcctcgggggttc

SEQ ID NO: 41888 - DNA, 30 bp, Homo sapiens
accaggcgaagaggggcttgccgtcctcct

SEQ ID NO: 41889 - DNA, 30 bp, Homo sapiens
tcttggaaagtccaaagcaccagaaaggtg

SEQ ID NO: 41890 - DNA, 30 bp, Homo sapiens
gagaggtcctgggtttgcgctgggggagcc

SEQ ID NO: 41891 - DNA, 30 bp, Homo sapiens
acgtcacagccgggactgagagaactgctg

SEQ ID NO: 41892 - DNA, 30 bp, Homo sapiens
aaatggctccccaaaaaggatactgccttt

SEQ ID NO: 41893 - DNA, 30 bp, Homo sapiens
taccactcggtgtccaccagactccagagg

SEQ ID NO: 41894 - DNA, 30 bp, Homo sapiens
ccgtcacagatgtgaaactgcaggcctggc

SEQ ID NO: 41895 - DNA, 30 bp, Homo sapiens
cagtaaaagctttccgaacattggcaagaa

SEQ ID NO: 41896 - DNA, 30 bp, Homo sapiens
gtttcttgtcgtctgtgcttgattcttgaa

SEQ ID NO: 41897 - DNA, 30 bp, Homo sapiens
tcatggagcctggatatttcaggctcatat

SEQ ID NO: 41898 - DNA, 30 bp, Homo sapiens
cctgtcacaagaggtagaattccagcattt

SEQ ID NO: 41899 - DNA, 30 bp, Homo sapiens
agatggggtgcacgaactggtagacgaggc

SEQ ID NO: 41900 - DNA, 30 bp, Homo sapiens
ttgagggcactgggtctctggagtagattt

SEQ ID NO: 41901 - DNA, 30 bp, Homo sapiens
cctttgcaatcagtttagtctttcttaaag

SEQ ID NO: 41902 - DNA, 30 bp, Homo sapiens
cattcttcacttcctgtaaaccactccata

SEQ ID NO: 41903 - DNA, 30 bp, Homo sapiens
gaaccagtataagcttgagaaggatcacct

SEQ ID NO: 41904 - DNA, 30 bp, Homo sapiens
cccagggcgtgccggaggctttgggaagat

SEQ ID NO: 41905 - DNA, 30 bp, Homo sapiens
actcctctggggaaacccaagccctgcagc

SEQ ID NO: 41906 - DNA, 30 bp, Homo sapiens
actcctcccgggaaacccaagccctgccgc

SEQ ID NO: 41907 - DNA, 30 bp, Homo sapiens
cctccagggaaacccaagccctgcagcgca

SEQ ID NO: 41908 - DNA, 30 bp, Homo sapiens
actcctccggggaaacccaagccctgcagc

SEQ ID NO: 41909 - DNA, 30 bp, Homo sapiens
atgagggtgcgatctcgggcccacacccag

SEQ ID NO: 41910 - DNA, 30 bp, Homo sapiens
actgcatcacactctgccagtcgggccggt

SEQ ID NO: 41911 - DNA, 30 bp, Homo sapiens
tgctggtgaccaccctgccgtggccctgca

SEQ ID NO: 41912 - DNA, 30 bp, Homo sapiens
cccagggagggaggggcggctctgctggtg

SEQ ID NO: 41913 - DNA, 30 bp, Homo sapiens
catacagcatcacgttctgccagtcgggtc

SEQ ID NO: 41914 - DNA, 30 bp, Homo sapiens
accgctgcttacgctccgcctgctggagcc

SEQ ID NO: 41915 - DNA, 30 bp, Homo sapiens
tctccagttctgtaagttgttctcttgagg

SEQ ID NO: 41916 - DNA, 30 bp, Homo sapiens
tatgtcttgaaggtgatctctctccatcac

SEQ ID NO: 41917 - DNA, 30 bp, Homo sapiens
acctccaagcgggcctcgcactgccgagca

SEQ ID NO: 41918 - DNA, 30 bp, Homo sapiens
taggggccgccagggtaggagcgcagcagc

SEQ ID NO: 41919 - DNA, 30 bp, Homo sapiens
acctcccagttagggaacggtacacccaat

SEQ ID NO: 41920 - DNA, 30 bp, Homo sapiens
tctcggtctggctcctgtgcagagagggcc

SEQ ID NO: 41921 - DNA, 30 bp, Homo sapiens
acacggaggcaatgacaatcatgaggtggg

SEQ ID NO: 41922 - DNA, 30 bp, Homo sapiens
accctgctaggcttcttggggtcctggctc

SEQ ID NO: 41923 - DNA, 30 bp, Homo sapiens
ctctggtggaacacatttaatatctaaata

SEQ ID NO: 41924 - DNA, 30 bp, Homo sapiens
agcatgtcctttagacagcaacctgtctga

SEQ ID NO: 41925 - DNA, 30 bp, Homo sapiens
tcctggctgatgccaaggctgcctttctgc

SEQ ID NO: 41926 - DNA, 30 bp, Homo sapiens
tacttgggccaagtcggctcttcgcctcca

SEQ ID NO: 41927 - DNA, 30 bp, Homo sapiens
aaaaggcaaccccagcagagcgaatgaccc

SEQ ID NO: 41928 - DNA, 30 bp, Homo sapiens
catttcccagagtttttatgtgtctctgtg

SEQ ID NO: 41929 - DNA, 30 bp, Homo sapiens
ataagggctcttctggcggtggcatctgct

SEQ ID NO: 41930 - DNA, 30 bp, Homo sapiens
ccccgggcagccaggaggcccagtgagcag

SEQ ID NO: 41931 - DNA, 30 bp, Homo sapiens
tatcccagttccaagagccagtcaaagaga

SEQ ID NO: 41932 - DNA, 30 bp, Homo sapiens
cagtggggcgggtggcgccgctcggccagg

SEQ ID NO: 41933 - DNA, 30 bp, Homo sapiens
agcaggaactggtacaggcgcagcttcttg

SEQ ID NO: 41934 - DNA, 30 bp, Homo sapiens
gcccggcggactgcaggcagcagcgcgctg

SEQ ID NO: 41935 - DNA, 30 bp, Homo sapiens
tcatggtaattggcatatgtataattataa

SEQ ID NO: 41936 - DNA, 30 bp, Homo sapiens
ttcttcattctgtttctcaatctttgctct

SEQ ID NO: 41937 - DNA, 30 bp, Homo sapiens
gtgttctgcagaggcccctcctgcactcag

SEQ ID NO: 41938 - DNA, 30 bp, Homo sapiens
tctgttccaatctcccgttgccacacatgt

SEQ ID NO: 41939 - DNA, 30 bp, Homo sapiens
gcaaacctcagcagggaggaaatgctgcgc

SEQ ID NO: 41940 - DNA, 30 bp, Homo sapiens
caccaccaccaccaccacccttgcagccac

SEQ ID NO: 41941 - DNA, 30 bp, Homo sapiens
cggagggcttggcttctacttgatgaatga

SEQ ID NO: 41942 - DNA, 30 bp, Homo sapiens
gtttggtttccacttggtgaatgaccatgc

SEQ ID NO: 41943 - DNA, 30 bp, Homo sapiens
gaatgaccatgccagttctcttggagccat

SEQ ID NO: 41944 - DNA, 30 bp, Homo sapiens
ctcttggacccgtcatctttggcatgctcc

SEQ ID NO: 41945 - DNA, 30 bp, Homo sapiens
gcaaggcccagatttttgaatgaggataga

SEQ ID NO: 41946 - DNA, 30 bp, Homo sapiens
gtgtggccatttgaggcacaaacaggtgct

SEQ ID NO: 41947 - DNA, 30 bp, Homo sapiens
tcatggtaaaacctgattcttccatgagat

SEQ ID NO: 41948 - DNA, 30 bp, Homo sapiens
ctgctctcagaaaatgtgtgttaacaaatc

SEQ ID NO: 41949 - DNA, 30 bp, Homo sapiens
cattggcataagtggacatgtcactgccac

SEQ ID NO: 41950 - DNA, 30 bp, Homo sapiens
agcagggtccatttcgaatgattttaatat

SEQ ID NO: 41951 - DNA, 30 bp, Homo sapiens
ttcatgatctggatgtcctgtttggttttt

SEQ ID NO: 41952 - DNA, 30 bp, Homo sapiens
ctgcggtggttcctggggtgctgctctcct

SEQ ID NO: 41953 - DNA, 30 bp, Homo sapiens
cattatttgagggcttgctacttgatttct

SEQ ID NO: 41954 - DNA, 30 bp, Homo sapiens
tccaggatgctttaggctaatctttccacc

SEQ ID NO: 41955 - DNA, 30 bp, Homo sapiens
tgaagaaactgaactcttccattacttttc

SEQ ID NO: 41956 - DNA, 30 bp, Homo sapiens
tgtaggtaacctggtcactgccacaaatag

SEQ ID NO: 41957 - DNA, 30 bp, Homo sapiens
gatccacaaattggatcatacatatgatga

SEQ ID NO: 41958 - DNA, 30 bp, Homo sapiens
cagaggggccgcgtggtgtggttatagacc

SEQ ID NO: 41959 - DNA, 30 bp, Homo sapiens
cacaggacatatgtgttcttcaccagctgc

SEQ ID NO: 41960 - DNA, 30 bp, Homo sapiens
aaagttgttgctgttgcctccgcagcctcc

SEQ ID NO: 41961 - DNA, 30 bp, Homo sapiens
cacaggctacttcacgttctattttaagct

SEQ ID NO: 41962 - DNA, 30 bp, Homo sapiens
tgaagggcagtactccgaggggcctggcga

SEQ ID NO: 41963 - DNA, 30 bp, Homo sapiens
tcctggtgttagggatgtagagggattggg

SEQ ID NO: 41964 - DNA, 30 bp, Homo sapiens
taaggggcagccccgtctcccccttcgggc

SEQ ID NO: 41965 - DNA, 30 bp, Homo sapiens
agatgagcacactggccacgggcacgcggg

SEQ ID NO: 41966 - DNA, 30 bp, Homo sapiens
cagactttcacagatgcgggcggcatcgcc

SEQ ID NO: 41967 - DNA, 30 bp, Homo sapiens
ggctcctctgtagaggcgccagcgcccgaa

SEQ ID NO: 41968 - DNA, 30 bp, Homo sapiens
ctctggaaagataatctgatgataggaaag

SEQ ID NO: 41969 - DNA, 30 bp, Homo sapiens
tctagggaagggacactcagagccagcttc

SEQ ID NO: 41970 - DNA, 30 bp, Homo sapiens
gtacccgacctcatcctctttgtcatcatc

SEQ ID NO: 41971 - DNA, 30 bp, Homo sapiens
gtgtggcctgcgttgtactgggtgggtcgg

SEQ ID NO: 41972 - DNA, 30 bp, Homo sapiens
gtagcccccgtcgtcagcctcgcctgcctc

SEQ ID NO: 41973 - DNA, 30 bp, Homo sapiens
tcatcatcatccccttcatcttcatcatca

SEQ ID NO: 41974 - DNA, 30 bp, Homo sapiens
tgtctctggaagcagtagcaccactcatta

SEQ ID NO: 41975 - DNA, 30 bp, Homo sapiens
taacaaggatgaacattgcatgctctgatc

SEQ ID NO: 41976 - DNA, 30 bp, Homo sapiens
atcagggacgcactcagcctcttcttcgag

SEQ ID NO: 41977 - DNA, 30 bp, Homo sapiens
ttcaggcgtttgcgtgggggtcccagaaaa

SEQ ID NO: 41978 - DNA, 30 bp, Homo sapiens
gcgtggaatgccaaactgtggacactgtgc

SEQ ID NO: 41979 - DNA, 30 bp, Homo sapiens
tgccgggcacccgcctggatgaggccaggc

SEQ ID NO: 41980 - DNA, 30 bp, Homo sapiens
aagatgcactatctaattcatgagaaatac

SEQ ID NO: 41981 - DNA, 30 bp, Homo sapiens
tgccggtggtttgggtaccttctgtttcca

SEQ ID NO: 41982 - DNA, 30 bp, Homo sapiens
atcacagggttttcttcatttgttgcacaa

SEQ ID NO: 41983 - DNA, 30 bp, Homo sapiens
ggccgaggcgccaggctgggttaccgggga

SEQ ID NO: 41984 - DNA, 30 bp, Homo sapiens
aactggtattcaccgcaaagccgctgcccg

SEQ ID NO: 41985 - DNA, 30 bp, Homo sapiens
cacaagggagcctgggtcgacatgctcttt

SEQ ID NO: 41986 - DNA, 30 bp, Homo sapiens
tacttccaggaatcgggagctgctggactt

SEQ ID NO: 41987 - DNA, 30 bp, Homo sapiens
acgtgggctccagacttgaactcgtccttt

SEQ ID NO: 41988 - DNA, 30 bp, Homo sapiens
catccagcagctttatgtttcccaccacag

SEQ ID NO: 41989 - DNA, 30 bp, Homo sapiens
acgcggccgctttgtgcttcccgccacagc

SEQ ID NO: 41990 - DNA, 30 bp, Homo sapiens
cgcgcagcctcctcgtggcgacccccgcag

SEQ ID NO: 41991 - DNA, 30 bp, Homo sapiens
taactggaacattccatcagcttgcagtgc

SEQ ID NO: 41992 - DNA, 30 bp, Homo sapiens
tacttctgcttggtcttctgctgggctggt

SEQ ID NO: 41993 - DNA, 30 bp, Homo sapiens
cttcggtggatactttggctggcagggtgg

SEQ ID NO: 41994 - DNA, 30 bp, Homo sapiens
tcttgggtggacactttggctggcagggtg

SEQ ID NO: 41995 - DNA, 30 bp, Homo sapiens
tcttgggtggatacttctgctggcagggtg

SEQ ID NO: 41996 - DNA, 30 bp, Homo sapiens
tacttctgcttggtcttctgctgagctggg

SEQ ID NO: 41997 - DNA, 30 bp, Homo sapiens
atcttgggcaggaggagatgtgagaggagg

SEQ ID NO: 41998 - DNA, 30 bp, Homo sapiens
tcaaggcaccagtccaagtgctcattaatc

SEQ ID NO: 41999 - DNA, 30 bp, Homo sapiens
ttctctgcggccaatactggttcctttcct

SEQ ID NO: 42000 - DNA, 30 bp, Homo sapiens
tgatggtttaccctgaccccgggaggggca

SEQ ID NO: 42001 - DNA, 30 bp, Homo sapiens
taggggggacagtgggaactttgcagcaaa

SEQ ID NO: 42002 - DNA, 30 bp, Homo sapiens
tcctgggccttggggaagggtgcactacca

SEQ ID NO: 42003 - DNA, 30 bp, Homo sapiens
gaaaggcttgtcgggcctgctggtcttggc

SEQ ID NO: 42004 - DNA, 30 bp, Homo sapiens
ccactcaaggggtgcagatctactttgact

SEQ ID NO: 42005 - DNA, 30 bp, Homo sapiens
tagaggccctcgggcacctcaagccctgaa

SEQ ID NO: 42006 - DNA, 30 bp, Homo sapiens
tggaggcgtatgataaaactcactgaactg

SEQ ID NO: 42007 - DNA, 30 bp, Homo sapiens
cactggtagaggaggtaggccttgagggaa

SEQ ID NO: 42008 - DNA, 30 bp, Homo sapiens
cactggtagagcaggtagcgcttcatggca

SEQ ID NO: 42009 - DNA, 30 bp, Homo sapiens
gtccggcggcagcgcttcctctggcagggc

SEQ ID NO: 42010 - DNA, 30 bp, Homo sapiens
cactggtactgcagatagtttttgagagac

SEQ ID NO: 42011 - DNA, 30 bp, Homo sapiens
agtaggaattggtgaagccaacgtagtcat

SEQ ID NO: 42012 - DNA, 30 bp, Homo sapiens
gagcgggtgaactccacgtagtcgaacgcg

SEQ ID NO: 42013 - DNA, 30 bp, Homo sapiens
agtaggggtgagagggctctggctgcagtg

SEQ ID NO: 42014 - DNA, 30 bp, Homo sapiens
acttctttttggggaagaagctgaatctct

SEQ ID NO: 42015 - DNA, 30 bp, Homo sapiens
ccatggctggtcactggctgtccgtctgct

SEQ ID NO: 42016 - DNA, 30 bp, Homo sapiens
aggctgaaccgcttctctttgtctttctct

SEQ ID NO: 42017 - DNA, 30 bp, Homo sapiens
ttgctgcggagcacaacaggcccctcagcc

SEQ ID NO: 42018 - DNA, 30 bp, Homo sapiens
agaagggggctgtcaatgggctgggggtgg

SEQ ID NO: 42019 - DNA, 30 bp, Homo sapiens
cccgctggccctgcgatctccgccttccct

SEQ ID NO: 42020 - DNA, 30 bp, Homo sapiens
tagacatccaggccgggcatccttggtcgt

SEQ ID NO: 42021 - DNA, 30 bp, Homo sapiens
agcaggacggcctgggctacctccttgatg

SEQ ID NO: 42022 - DNA, 30 bp, Homo sapiens
aattggtccatactgacaccatttggtaac

SEQ ID NO: 42023 - DNA, 30 bp, Homo sapiens
aatcctctgggtccacaagtccccacgcca

SEQ ID NO: 42024 - DNA, 30 bp, Homo sapiens
caaagggcctgtccagtagaggtaccaacc

SEQ ID NO: 42025 - DNA, 30 bp, Homo sapiens
ctcaggacgtgctgacttcttgtgccggga

SEQ ID NO: 42026 - DNA, 30 bp, Homo sapiens
tgtgctggggcatgaagacgtatcctgtgt

SEQ ID NO: 42027 - DNA, 30 bp, Homo sapiens
tgaaggggcacgtcctttggcggtggtaga

SEQ ID NO: 42028 - DNA, 30 bp, Homo sapiens
cggtggcccaatacatgcttttttccctct

SEQ ID NO: 42029 - DNA, 30 bp, Homo sapiens
cagcttcttggcccttcgacgttgcatttc

SEQ ID NO: 42030 - DNA, 30 bp, Homo sapiens
aagcagactgtcttccaggaatctggtttg

SEQ ID NO: 42031 - DNA, 30 bp, Homo sapiens
ttttcccctaagagcttttcttgcaacatg

SEQ ID NO: 42032 - DNA, 30 bp, Homo sapiens
ctgagaagggctcgaggttttgtaatccaa

SEQ ID NO: 42033 - DNA, 30 bp, Homo sapiens
tgaaacaacttgcgcagaaacgctggtcct

SEQ ID NO: 42034 - DNA, 30 bp, Homo sapiens
caacggcgggggatgctttgaatactggat

SEQ ID NO: 42035 - DNA, 30 bp, Homo sapiens
tgctggaagcctggtatggtatggttcttc

SEQ ID NO: 42036 - DNA, 30 bp, Homo sapiens
aatcggcctgcccacagacacaagaggaga

SEQ ID NO: 42037 - DNA, 30 bp, Homo sapiens
atgaggtccagagtaatcctagatcggggg

SEQ ID NO: 42038 - DNA, 30 bp, Homo sapiens
tagaggttctccccgggctggtactggggc

SEQ ID NO: 42039 - DNA, 30 bp, Homo sapiens
cacgtcttggccttgcggcctctgtgacta

SEQ ID NO: 42040 - DNA, 30 bp, Homo sapiens
agaaggagatggaagaattccttgccccaa

SEQ ID NO: 42041 - DNA, 30 bp, Homo sapiens
cggaggtaccactcatgatgctcttttgct

SEQ ID NO: 42042 - DNA, 30 bp, Homo sapiens
gccaggacccctaggaagacttcatactga

SEQ ID NO: 42043 - DNA, 30 bp, Homo sapiens
atttggggtagtcctcaaacatcttgaggt

SEQ ID NO: 42044 - DNA, 30 bp, Homo sapiens
cttcgggtaagagacaaatttgcttttgta

SEQ ID NO: 42045 - DNA, 30 bp, Homo sapiens
agctggaagtgacagtggtcccaccgccca

SEQ ID NO: 42046 - DNA, 30 bp, Homo sapiens
aggaggcggcaatggcagtgccaccaccca

SEQ ID NO: 42047 - DNA, 30 bp, Homo sapiens
ctgcttctgttttggtagagaggttttctt

SEQ ID NO: 42048 - DNA, 30 bp, Homo sapiens
atctggttctttattgtgctctttctcctc

SEQ ID NO: 42049 - DNA, 30 bp, Homo sapiens
ttctggagaattcagaactattaggtgtag

SEQ ID NO: 42050 - DNA, 30 bp, Homo sapiens
tcttggtgctgtgggcggtgtccaggttca

SEQ ID NO: 42051 - DNA, 30 bp, Homo sapiens
gcttgcttcccatgaaggatgaagaggcag

SEQ ID NO: 42052 - DNA, 30 bp, Homo sapiens
tgttggaccctggggaggtggggcaggtcc

SEQ ID NO: 42053 - DNA, 30 bp, Homo sapiens
gacagtacaagacttgtcagtagactgtgg

SEQ ID NO: 42054 - DNA, 30 bp, Homo sapiens
tgtactgatgggggatgagtccgtcgatgc

SEQ ID NO: 42055 - DNA, 30 bp, Homo sapiens
cactccctcactgtgaaataaaactgctct

SEQ ID NO: 42056 - DNA, 30 bp, Homo sapiens
cactcccttactgtgaaataaaactgctct

SEQ ID NO: 42057 - DNA, 30 bp, Homo sapiens
acatggtgcccgacttgtccgctgagctgt

SEQ ID NO: 42058 - DNA, 30 bp, Homo sapiens
ctaatccatgttgacccaagtcctggctgt

SEQ ID NO: 42059 - DNA, 30 bp, Homo sapiens
tgagcagtatcccgtcttcgaaagctgtct

SEQ ID NO: 42060 - DNA, 30 bp, Homo sapiens
caacaatgatgggactctccctccccctga

SEQ ID NO: 42061 - DNA, 30 bp, Homo sapiens
agtgcttcctgtagcgattttttggtgttt

SEQ ID NO: 42062 - DNA, 30 bp, Homo sapiens
ttcagggccttgcgggcaaactcgggcagc

SEQ ID NO: 42063 - DNA, 30 bp, Homo sapiens
caggggtggcatctgtggatggcgtgcagc

SEQ ID NO: 42064 - DNA, 30 bp, Homo sapiens
actgtgctgctgttgctgctgttgttgctg

SEQ ID NO: 42065 - DNA, 30 bp, Homo sapiens
ccttttttacttccctctccttgttgaaga

SEQ ID NO: 42066 - DNA, 30 bp, Homo sapiens
aaccagaagttaggcttagtgtataatgtg

SEQ ID NO: 42067 - DNA, 30 bp, Homo sapiens
ttcctcctcccacgacttcggcacctagag

SEQ ID NO: 42068 - DNA, 30 bp, Homo sapiens
acaaggcagaggctcccatcttcctgtttg

SEQ ID NO: 42069 - DNA, 30 bp, Homo sapiens
atgcctttcatgttgccagcagcaccctgt

SEQ ID NO: 42070 - DNA, 30 bp, Homo sapiens
tagctcctgaatccaaagatgcccttgatg

SEQ ID NO: 42071 - DNA, 30 bp, Homo sapiens
accttttccacctttcttctttttctgttg

SEQ ID NO: 42072 - DNA, 30 bp, Homo sapiens
aggaggctgaagcaagaggaccgcttgagc

SEQ ID NO: 42073 - DNA, 30 bp, Homo sapiens
actcagtttccatggtaacattgcgggctt

SEQ ID NO: 42074 - DNA, 30 bp, Homo sapiens
ccaagggtgccggagacactcggcggcagt

SEQ ID NO: 42075 - DNA, 30 bp, Homo sapiens
gcttggtgatgtgtcgcagttctccataca

SEQ ID NO: 42076 - DNA, 30 bp, Homo sapiens
atgccgaaggcattcgccagctgaggctcg

SEQ ID NO: 42077 - DNA, 30 bp, Homo sapiens
taggggttgagccaggggtgctggaggcag

SEQ ID NO: 42078 - DNA, 30 bp, Homo sapiens
taagccttcatgagggcagccaccacagcc

SEQ ID NO: 42079 - DNA, 30 bp, Homo sapiens
aggcaattttagccagccatttctccaagt

SEQ ID NO: 42080 - DNA, 30 bp, Homo sapiens
tacaggtctggctcatttcggcttgtagga

SEQ ID NO: 42081 - DNA, 30 bp, Homo sapiens
gcaccatactgaaggagtagagtgggattc

SEQ ID NO: 42082 - DNA, 30 bp, Homo sapiens
gctcccgacgctgggtcaactcctgattgc

SEQ ID NO: 42083 - DNA, 30 bp, Homo sapiens
agctggcctttcagcctgcttcacccaagt

SEQ ID NO: 42084 - DNA, 30 bp, Homo sapiens
agaaggatcttctctcttgttcctgatgat

SEQ ID NO: 42085 - DNA, 30 bp, Homo sapiens
aagactgtggggacacttgggccttcctca

SEQ ID NO: 42086 - DNA, 30 bp, Homo sapiens
ggagcggtgtctcatgggccgagggctagg

SEQ ID NO: 42087 - DNA, 30 bp, Homo sapiens
ctctcagagctgctccggctgtggtagctg

SEQ ID NO: 42088 - DNA, 30 bp, Homo sapiens
ctccggctgtggtagctgggactgggggtc

SEQ ID NO: 42089 - DNA, 30 bp, Homo sapiens
tgctggagtagctgtctgctgagctgtagc

SEQ ID NO: 42090 - DNA, 30 bp, Homo sapiens
gcttggaagaagatgatgaagacctttccc

SEQ ID NO: 42091 - DNA, 30 bp, Homo sapiens
ctggggcatccaggtcccgatattccacaa

SEQ ID NO: 42092 - DNA, 30 bp, Homo sapiens
tatccaattctggtcaaagaaaagaatacg

SEQ ID NO: 42093 - DNA, 30 bp, Homo sapiens
tgacggggagaatagcgtggtgatcctctg

SEQ ID NO: 42094 - DNA, 30 bp, Homo sapiens
ccgtggtcttccagtcggtctatttctagg

SEQ ID NO: 42095 - DNA, 30 bp, Homo sapiens
cagtggccactggacttaggactagtccaa

SEQ ID NO: 42096 - DNA, 30 bp, Homo sapiens
tactgggtattccagctgcagtttggtcta

SEQ ID NO: 42097 - DNA, 30 bp, Homo sapiens
cttcttcatgatgatcatccccattcactt

SEQ ID NO: 42098 - DNA, 30 bp, Homo sapiens
atctggaatgtgaccgaaaatgagaatgct

SEQ ID NO: 42099 - DNA, 30 bp, Homo sapiens
cttcctcttcaggagacttggggggactct

SEQ ID NO: 42100 - DNA, 30 bp, Homo sapiens
atttgacctagatcgactacgagacctaga

SEQ ID NO: 42101 - DNA, 30 bp, Homo sapiens
aggaccttgagtgggacctagatctagatc

SEQ ID NO: 42102 - DNA, 30 bp, Homo sapiens
tcaactgatctggaccttgatcgggaccgg

SEQ ID NO: 42103 - DNA, 30 bp, Homo sapiens
ctctggaactcgacctggaccttgatcttg

SEQ ID NO: 42104 - DNA, 30 bp, Homo sapiens
tttcaggacttgcacttctgcgaggacttc

SEQ ID NO: 42105 - DNA, 30 bp, Homo sapiens
tcttcaggagacttggggggcctcttggat

SEQ ID NO: 42106 - DNA, 30 bp, Homo sapiens
agtagggcctgaaaggagagaagtagtgtg

SEQ ID NO: 42107 - DNA, 30 bp, Homo sapiens
cagagggagagagcaggaaacagacttctg

SEQ ID NO: 42108 - DNA, 30 bp, Homo sapiens
gctttgtccagtggctgtagcggtcccgtt

SEQ ID NO: 42109 - DNA, 30 bp, Homo sapiens
tgctggtaatttccatactgtccctggtca

SEQ ID NO: 42110 - DNA, 30 bp, Homo sapiens
ctgctggtaatttccatactggccctgttc

SEQ ID NO: 42111 - DNA, 30 bp, Homo sapiens
ggttggactggcatctgcaatggtagccaa

SEQ ID NO: 42112 - DNA, 30 bp, Homo sapiens
ccattttctgttttctgttgtttggatgca

SEQ ID NO: 42113 - DNA, 30 bp, Homo sapiens
tactccttctctttcgtctggtcactcaga

SEQ ID NO: 42114 - DNA, 30 bp, Homo sapiens
gctaggggagtacttggaaatactgtccat

SEQ ID NO: 42115 - DNA, 30 bp, Homo sapiens
gcttggagaataattgtcgttctgaaagga

SEQ ID NO: 42116 - DNA, 30 bp, Homo sapiens
cacacgctcatggtcatccctggcgagtag

SEQ ID NO: 42117 - DNA, 30 bp, Homo sapiens
tgaaggctggcacaggacactggcatcctc

SEQ ID NO: 42118 - DNA, 30 bp, Homo sapiens
ctcaggggtctttcttcttcctctggggta

SEQ ID NO: 42119 - DNA, 30 bp, Homo sapiens
gggaggcgctgcaaccctggcagtccttga

SEQ ID NO: 42120 - DNA, 30 bp, Homo sapiens
ttcaggtcatttgtacataataaacaaaat

SEQ ID NO: 42121 - DNA, 30 bp, Homo sapiens
acaatttcccgtctgatttccccaacaata

SEQ ID NO: 42122 - DNA, 30 bp, Homo sapiens
caacagcaagtatcttctaaagcacaaata

SEQ ID NO: 42123 - DNA, 30 bp, Homo sapiens
cgaagggctctttaagttttctggggcggg

SEQ ID NO: 42124 - DNA, 30 bp, Homo sapiens
gaaagaaccctcaggtccctggagatggga

SEQ ID NO: 42125 - DNA, 30 bp, Homo sapiens
cattcttccaccaatagtacatcacagtgt

SEQ ID NO: 42126 - DNA, 30 bp, Homo sapiens
acatggtattatagaaggggttggttgtcc

SEQ ID NO: 42127 - DNA, 30 bp, Homo sapiens
cctcctctccactgtcatgcacgctggcct

SEQ ID NO: 42128 - DNA, 30 bp, Homo sapiens
gactgtctcttttcattggcggtgttactg

SEQ ID NO: 42129 - DNA, 30 bp, Homo sapiens
cgccgctacttttctggtctggggctgtag

SEQ ID NO: 42130 - DNA, 30 bp, Homo sapiens
tgggggccttcggaagccgtgagggagcat

SEQ ID NO: 42131 - DNA, 30 bp, Homo sapiens
ctggcaggagctgcactggcagctgtggat

SEQ ID NO: 42132 - DNA, 30 bp, Homo sapiens
gatctcttctgtgcccgtttcctgggcaac

SEQ ID NO: 42133 - DNA, 30 bp, Homo sapiens
tgctggagtaccacaatagcagggggatgc

SEQ ID NO: 42134 - DNA, 30 bp, Homo sapiens
atttggagccagtagacaggagggcgatga

SEQ ID NO: 42135 - DNA, 30 bp, Homo sapiens
ggcctggatgtggctcttcgcactgaaggc

SEQ ID NO: 42136 - DNA, 30 bp, Homo sapiens
catcggatcctgacgctgagtcctctgagc

SEQ ID NO: 42137 - DNA, 30 bp, Homo sapiens
tgcaggctgcgcagggcctccgcacatgcg

SEQ ID NO: 42138 - DNA, 30 bp, Homo sapiens
gaaattcttgcagccagctttgcgttctcg

SEQ ID NO: 42139 - DNA, 30 bp, Homo sapiens
atccgggacgtgcaggtgccattacggaag

SEQ ID NO: 42140 - DNA, 30 bp, Homo sapiens
tactggtttggaggtctccattgaggaggg

SEQ ID NO: 42141 - DNA, 30 bp, Homo sapiens
tacaggtagctgatgcgcatcgtgctggac

SEQ ID NO: 42142 - DNA, 30 bp, Homo sapiens
agaaggtggtggtcctggtgagggggatgc

SEQ ID NO: 42143 - DNA, 30 bp, Homo sapiens
tgctggtctgcataagcccgttggctgcgg

SEQ ID NO: 42144 - DNA, 30 bp, Homo sapiens
agacggtgtgcagaaaggtgcggccactct

SEQ ID NO: 42145 - DNA, 30 bp, Homo sapiens
cgatggtacagccacagcaataccgctcag

SEQ ID NO: 42146 - DNA, 30 bp, Homo sapiens
ggtcactgatctcttcataaatcaccagct

SEQ ID NO: 42147 - DNA, 30 bp, Homo sapiens
gttttctctcacgcagtctgtgggtccagg

SEQ ID NO: 42148 - DNA, 30 bp, Homo sapiens
tcaaggagcatccactatagcaaccttcct

SEQ ID NO: 42149 - DNA, 30 bp, Homo sapiens
ctcaggatcgctgatctcttcataaatcac

SEQ ID NO: 42150 - DNA, 30 bp, Homo sapiens
gctgctttctctcacgcagtctgtgggtcc

SEQ ID NO: 42151 - DNA, 30 bp, Homo sapiens
ccgaggggagttactcgtcatcttcctcag

SEQ ID NO: 42152 - DNA, 30 bp, Homo sapiens
ctgagggtcgctgatctcttcataaatcac

SEQ ID NO: 42153 - DNA, 30 bp, Homo sapiens
ttcagggtcgctgatctcttcataaatcac

SEQ ID NO: 42154 - DNA, 30 bp, Homo sapiens
atttggctgacaatttactgatgagattca

SEQ ID NO: 42155 - DNA, 30 bp, Homo sapiens
taccccagtgttctctttgatccagtcccg

SEQ ID NO: 42156 - DNA, 30 bp, Homo sapiens
accaggcttttccctcctagcagataccaa

SEQ ID NO: 42157 - DNA, 30 bp, Homo sapiens
acatggatacccttcactgcctgtttgata

SEQ ID NO: 42158 - DNA, 30 bp, Homo sapiens
cattgggctgttggtggaatccagttcctt

SEQ ID NO: 42159 - DNA, 30 bp, Homo sapiens
ggccggtttcacaatatggagtgtcctttc

SEQ ID NO: 42160 - DNA, 30 bp, Homo sapiens
taaaggacttcatctaccttcatgtcgttt

SEQ ID NO: 42161 - DNA, 30 bp, Homo sapiens
gaagatccggattttattgatggaggccaa

SEQ ID NO: 42162 - DNA, 30 bp, Homo sapiens
cagttgccccggtagacttcgatcttgctg

SEQ ID NO: 42163 - DNA, 30 bp, Homo sapiens
cacaatgtcatagtcgtcaattcgtgaccc

SEQ ID NO: 42164 - DNA, 30 bp, Homo sapiens
cagatgccactgcttagatcagtgatgacg

SEQ ID NO: 42165 - DNA, 30 bp, Homo sapiens
tagtgggcctcttcctgcatggcaagtgaa

SEQ ID NO: 42166 - DNA, 30 bp, Homo sapiens
tccgcagaaactctttctctcgctggatat

SEQ ID NO: 42167 - DNA, 30 bp, Homo sapiens
cagaaggacgtgaggttcttgatagctccc

SEQ ID NO: 42168 - DNA, 30 bp, Homo sapiens
acctggccaggcccagaactccctccccaa

SEQ ID NO: 42169 - DNA, 30 bp, Homo sapiens
ctgagatctttcaccactccctctttgacc

SEQ ID NO: 42170 - DNA, 30 bp, Homo sapiens
acgaggtttttttctataatgtccttcaaa

SEQ ID NO: 42171 - DNA, 30 bp, Homo sapiens
ttgtggagaaacttcattttgttgcccaaa

SEQ ID NO: 42172 - DNA, 30 bp, Homo sapiens
gaatggtccggaagccaggcagtgtggctt

SEQ ID NO: 42173 - DNA, 30 bp, Homo sapiens
gtgtggaatgactggacttggtgcagggca

SEQ ID NO: 42174 - DNA, 30 bp, Homo sapiens
atatggccaatttttacaaatgagccaatg

SEQ ID NO: 42175 - DNA, 30 bp, Homo sapiens
cagttcttggctttggcagttccgggacca

SEQ ID NO: 42176 - DNA, 30 bp, Homo sapiens
cgctggtacagctgaaggatgccggccttg

SEQ ID NO: 42177 - DNA, 30 bp, Homo sapiens
tggaaggaagtgagcttctatttttctgaa

SEQ ID NO: 42178 - DNA, 30 bp, Homo sapiens
gtttggatgtgtaaatattatcctgtgctt

SEQ ID NO: 42179 - DNA, 30 bp, Homo sapiens
gcatggtcactctgtccttcccagtttcct

SEQ ID NO: 42180 - DNA, 30 bp, Homo sapiens
cagtttccttcttaaaaactccatcacagt

SEQ ID NO: 42181 - DNA, 30 bp, Homo sapiens
tccaggacggatgggcgaacacgatgggcc

SEQ ID NO: 42182 - DNA, 30 bp, Homo sapiens
gattgggatcccttgtggtccgccactccg

SEQ ID NO: 42183 - DNA, 30 bp, Homo sapiens
cacaggtttattctcaggatgatttatagc

SEQ ID NO: 42184 - DNA, 30 bp, Homo sapiens
acagagctccagtgcaattgtcattgtaaa

SEQ ID NO: 42185 - DNA, 30 bp, Homo sapiens
caaggccctgattggctgggagacactcca

SEQ ID NO: 42186 - DNA, 30 bp, Homo sapiens
agttttccaggaggtggggaggtcacccca

SEQ ID NO: 42187 - DNA, 30 bp, Homo sapiens
tccaggaggggtgggagaaggtgatgccat

SEQ ID NO: 42188 - DNA, 30 bp, Homo sapiens
ttttggaaatgttgagattgaggtgccgga

SEQ ID NO: 42189 - DNA, 30 bp, Homo sapiens
tagctggtgccacagactggatgggaggat

SEQ ID NO: 42190 - DNA, 30 bp, Homo sapiens
gatcatacttacagctttagcaaaaatacc

SEQ ID NO: 42191 - DNA, 30 bp, Homo sapiens
ctcaaacctaggtcttctgacttcaaatcc

SEQ ID NO: 42192 - DNA, 30 bp, Homo sapiens
aagtgggctggagtgaggtatcttcacatg

SEQ ID NO: 42193 - DNA, 30 bp, Homo sapiens
tacgtggccccatcgcactggccgacagtc

SEQ ID NO: 42194 - DNA, 30 bp, Homo sapiens
gcttggtgagcccttccccatgcattcggt

SEQ ID NO: 42195 - DNA, 30 bp, Homo sapiens
gtcagttttagagctcctctattatgtagc

SEQ ID NO: 42196 - DNA, 30 bp, Homo sapiens
cacattcactgtctaacagaatgccagaat

SEQ ID NO: 42197 - DNA, 30 bp, Homo sapiens
gcagcagctgcaggtgcccgtgtgcacgcg

SEQ ID NO: 42198 - DNA, 30 bp, Homo sapiens
atgtgaagttggaggatctggctgtattct

SEQ ID NO: 42199 - DNA, 30 bp, Homo sapiens
cacttgactgtgaggatcctctgggtgtca

SEQ ID NO: 42200 - DNA, 30 bp, Homo sapiens
cagtgtcctcaaggggtcattgccctcaag

SEQ ID NO: 42201 - DNA, 30 bp, Homo sapiens
agggggatgaggcctttcttttttccactg

SEQ ID NO: 42202 - DNA, 30 bp, Homo sapiens
agatctcagtcagggcgtcgactggcacca

SEQ ID NO: 42203 - DNA, 30 bp, Homo sapiens
gaaagtcggtgggaaacagccccaccttgc

SEQ ID NO: 42204 - DNA, 30 bp, Homo sapiens
cataggcattccaaatcctgaatcatcttc

SEQ ID NO: 42205 - DNA, 30 bp, Homo sapiens
atcaggcttcagttctgttctctctcgtct

SEQ ID NO: 42206 - DNA, 30 bp, Homo sapiens
tatccagctctgtagaatctaagaggtcca

SEQ ID NO: 42207 - DNA, 30 bp, Homo sapiens
gcagagccttctgagaatatggttgctgtg

SEQ ID NO: 42208 - DNA, 30 bp, Homo sapiens
tgatggtaatttgtgtgctgctgtgcaact

SEQ ID NO: 42209 - DNA, 30 bp, Homo sapiens
tgtgtggatgaaatcctttctggcgacagg

SEQ ID NO: 42210 - DNA, 30 bp, Homo sapiens
cgaaggtctgtgatggtcactgctctgtcc

SEQ ID NO: 42211 - DNA, 30 bp, Homo sapiens
ctccttggtgtgtggatgaaagcccttttt

SEQ ID NO: 42212 - DNA, 30 bp, Homo sapiens
catactgggttcttgaccagtgttttcatc

SEQ ID NO: 42213 - DNA, 30 bp, Homo sapiens
cagtgctccagtgcccgcctcttctccagc

SEQ ID NO: 42214 - DNA, 30 bp, Homo sapiens
acctggcttcagaggcagggtgggactcca

SEQ ID NO: 42215 - DNA, 30 bp, Homo sapiens
gcgaggtgtcgtcgtcgctgccctcgccgc

SEQ ID NO: 42216 - DNA, 30 bp, Homo sapiens
cgaggcagttgctgcgtagatatctcagtg

SEQ ID NO: 42217 - DNA, 30 bp, Homo sapiens
acactgatagatatggagaaaggtctcact

SEQ ID NO: 42218 - DNA, 30 bp, Homo sapiens
gcaatgaggggctggaaagagtttctaatc

SEQ ID NO: 42219 - DNA, 30 bp, Homo sapiens
gcccgggcccccagctcgctgatgcgctgt

SEQ ID NO: 42220 - DNA, 30 bp, Homo sapiens
tttcttcagcttcttcagatcctgcttcgg

SEQ ID NO: 42221 - DNA, 30 bp, Homo sapiens
gataaaagcccttctttatagcccacagta

SEQ ID NO: 42222 - DNA, 30 bp, Homo sapiens
aagttggttaaagtgcttgccatggctgta

SEQ ID NO: 42223 - DNA, 30 bp, Homo sapiens
tcatggaattgcttcactgctttctgaagg

SEQ ID NO: 42224 - DNA, 30 bp, Homo sapiens
cttgatggagttctgtgtgcctttattcca

SEQ ID NO: 42225 - DNA, 30 bp, Homo sapiens
aagcatactcaatccgagcagggccacagc

SEQ ID NO: 42226 - DNA, 30 bp, Homo sapiens
ctcagggcccgctgcctgcagggtggggaa

SEQ ID NO: 42227 - DNA, 30 bp, Homo sapiens
ccaaggaaggaagccagtctggctataacc

SEQ ID NO: 42228 - DNA, 30 bp, Homo sapiens
cctttagggccatcaagttccattggctct

SEQ ID NO: 42229 - DNA, 30 bp, Homo sapiens
atccgagacacctcgtcaaactcctcagga

SEQ ID NO: 42230 - DNA, 30 bp, Homo sapiens
agtcagaaggcatcaagggtccatcagtgt

SEQ ID NO: 42231 - DNA, 30 bp, Homo sapiens
ttcaggtatggggcagcgctacctgggtca

SEQ ID NO: 42232 - DNA, 30 bp, Homo sapiens
acatgggggaggtagcgcactccgaggtca

SEQ ID NO: 42233 - DNA, 30 bp, Homo sapiens
attcagcagaataaggagacttcattgcag

SEQ ID NO: 42234 - DNA, 30 bp, Homo sapiens
gagagggagcctctggcagaggtgaaaaga

SEQ ID NO: 42235 - DNA, 30 bp, Homo sapiens
gtgcgggatccactgactgtccattggccg

SEQ ID NO: 42236 - DNA, 30 bp, Homo sapiens
aactggggttggcccttaggtccatgtggg

SEQ ID NO: 42237 - DNA, 30 bp, Homo sapiens
gtatggttgtgggtatagtggttgttctgg

SEQ ID NO: 42238 - DNA, 30 bp, Homo sapiens
cctgttcttggcatctctgtactttgttgg

SEQ ID NO: 42239 - DNA, 30 bp, Homo sapiens
agacggccgagtttgatttcttgcagtcct

SEQ ID NO: 42240 - DNA, 30 bp, Homo sapiens
agccttgaatccttgctaaatattccagtt

SEQ ID NO: 42241 - DNA, 30 bp, Homo sapiens
ccatgcgtgaaccactttatcctcatggcc

SEQ ID NO: 42242 - DNA, 30 bp, Homo sapiens
tatgcactctcatgggatgtgcgtttgatg

SEQ ID NO: 42243 - DNA, 30 bp, Homo sapiens
ctccggatatcagaatactcagactgttcg

SEQ ID NO: 42244 - DNA, 30 bp, Homo sapiens
catgtctaatcttcagtatcttcttcctca

SEQ ID NO: 42245 - DNA, 30 bp, Homo sapiens
tgaagggctggctgctgataaaatgaagta

SEQ ID NO: 42246 - DNA, 30 bp, Homo sapiens
acaaggtcaggaagttgatcctaccatgta

SEQ ID NO: 42247 - DNA, 30 bp, Homo sapiens
ctccggggagacatgaggaattgttcctcc

SEQ ID NO: 42248 - DNA, 30 bp, Homo sapiens
ccagctcagtctgggtatctgcaaagctgc

SEQ ID NO: 42249 - DNA, 30 bp, Homo sapiens
cagtctgggtatctgcaaagctgcaaaaga

SEQ ID NO: 42250 - DNA, 30 bp, Homo sapiens
acgtggctcgtcttctcggccagggcgtgg

SEQ ID NO: 42251 - DNA, 30 bp, Homo sapiens
caaatcctcttgatgaccatatggggtgga

SEQ ID NO: 42252 - DNA, 30 bp, Homo sapiens
ccagccctggcggatccttgtaagggtgtt

SEQ ID NO: 42253 - DNA, 30 bp, Homo sapiens
tacacttggcatgaggtcgcctgactctca

SEQ ID NO: 42254 - DNA, 30 bp, Homo sapiens
agaaggttgcaaactttcaggaaaaattgt

SEQ ID NO: 42255 - DNA, 30 bp, Homo sapiens
tacttcttaagaggcttcttaaagattttg

SEQ ID NO: 42256 - DNA, 30 bp, Homo sapiens
atgtggagggaggactccgaatcggaatgg

SEQ ID NO: 42257 - DNA, 30 bp, Homo sapiens
tgacaaaggtcatgtgggatgctgcttatt

SEQ ID NO: 42258 - DNA, 30 bp, Homo sapiens
ccaaggtgaatacattgcttttcagcagag

SEQ ID NO: 42259 - DNA, 30 bp, Homo sapiens
tgcaatcagacccacatccatcagcttctg

SEQ ID NO: 42260 - DNA, 30 bp, Homo sapiens
aactgtaggggaagaacttggcggccttgc

SEQ ID NO: 42261 - DNA, 30 bp, Homo sapiens
tgctgcttgcaggccgacagccggcggatc

SEQ ID NO: 42262 - DNA, 30 bp, Homo sapiens
catcggtcaagggccagcgcctcttggatc

SEQ ID NO: 42263 - DNA, 30 bp, Homo sapiens
atttgggtagtatgttggccaggagctggg

SEQ ID NO: 42264 - DNA, 30 bp, Homo sapiens
tcctggaatttcttgtagcaaaggttcctc

SEQ ID NO: 42265 - DNA, 30 bp, Homo sapiens
gattgggtaatgagtcatcgaaacgaaatc

SEQ ID NO: 42266 - DNA, 30 bp, Homo sapiens
ctctggcaggcggaggagggttcctgaagt

SEQ ID NO: 42267 - DNA, 30 bp, Homo sapiens
cagtgggatgaagttcctccaccacttaga

SEQ ID NO: 42268 - DNA, 30 bp, Homo sapiens
cagcgggtggatgtcaggtggtttctgttg

SEQ ID NO: 42269 - DNA, 30 bp, Homo sapiens
tatctgtgatgccgggacaggcggcttcag

SEQ ID NO: 42270 - DNA, 30 bp, Homo sapiens
tttctttgcatccatcgcatccagaatggg

SEQ ID NO: 42271 - DNA, 30 bp, Homo sapiens
cttgtcttctccatacatttatccaagttc

SEQ ID NO: 42272 - DNA, 30 bp, Homo sapiens
tcaccttgtgggtctttggtttgttccaag

SEQ ID NO: 42273 - DNA, 30 bp, Homo sapiens
tatgaaactttcgaggtctgaaaagtctca

SEQ ID NO: 42274 - DNA, 30 bp, Homo sapiens
cagtgggacttgtaggagagccaggtatca

SEQ ID NO: 42275 - DNA, 30 bp, Homo sapiens
ccacgggtgcaggtgtgggtgaggaggttg

SEQ ID NO: 42276 - DNA, 30 bp, Homo sapiens
ccttcgccactcacggcaacacccatgtca

SEQ ID NO: 42277 - DNA, 30 bp, Homo sapiens
ccccctcactcctccgtccagaggcagcct

SEQ ID NO: 42278 - DNA, 30 bp, Homo sapiens
tagccgctcccggccgaggggcaaatgggg

SEQ ID NO: 42279 - DNA, 30 bp, Homo sapiens
tggaagtagcaatgccacgggcagcaaact

SEQ ID NO: 42280 - DNA, 30 bp, Homo sapiens
cttgatgggccacagaacacacccccagct

SEQ ID NO: 42281 - DNA, 30 bp, Homo sapiens
ggcagaggttgcagttgacttgaacccagg

SEQ ID NO: 42282 - DNA, 30 bp, Homo sapiens
gacagggcgccggatttagcagggtacttg

SEQ ID NO: 42283 - DNA, 30 bp, Homo sapiens
acctggtccattctggtttcaagttcaaag

SEQ ID NO: 42284 - DNA, 30 bp, Homo sapiens
ctatgggctggcctcaggaggtgaatgagt

SEQ ID NO: 42285 - DNA, 30 bp, Homo sapiens
ggaaggtattgccccccttgcagtcaggcc

SEQ ID NO: 42286 - DNA, 30 bp, Homo sapiens
tttcatgtaggtggggatagagccacgttg

SEQ ID NO: 42287 - DNA, 30 bp, Homo sapiens
cagcttcacttcatcaggaatctccgaccc

SEQ ID NO: 42288 - DNA, 30 bp, Homo sapiens
cttcttagcctctatggcatccaggatggg

SEQ ID NO: 42289 - DNA, 30 bp, Homo sapiens
agcaggtttccctggcaattttggatacat

SEQ ID NO: 42290 - DNA, 30 bp, Homo sapiens
cgcaggtagcgctgcgccaggatggccgtg

SEQ ID NO: 42291 - DNA, 30 bp, Homo sapiens
ccccagacgtggtgcaccccagctgggggc

SEQ ID NO: 42292 - DNA, 30 bp, Homo sapiens
gaaataaagggccttgccaaggctgcacag

SEQ ID NO: 42293 - DNA, 30 bp, Homo sapiens
agcagggtctttggattctttgttcttccg

SEQ ID NO: 42294 - DNA, 30 bp, Homo sapiens
agttcaacctggagttccttgttcctgcgc

SEQ ID NO: 42295 - DNA, 30 bp, Homo sapiens
ctctgaagctccagaaattgagactctata

SEQ ID NO: 42296 - DNA, 30 bp, Homo sapiens
gcaaggggccaggcagcagctttgggatgg

SEQ ID NO: 42297 - DNA, 30 bp, Homo sapiens
agcaggcggttccttctcttgcagccgttc

SEQ ID NO: 42298 - DNA, 30 bp, Homo sapiens
acctggaggcctcttccttcagctccttgt

SEQ ID NO: 42299 - DNA, 30 bp, Homo sapiens
gcttggttgtaggacatgtctgactccacg

SEQ ID NO: 42300 - DNA, 30 bp, Homo sapiens
gtggtggtgatgccagctacttgagaagct

SEQ ID NO: 42301 - DNA, 30 bp, Homo sapiens
tgctgacaatgtcactctggtcctccagga

SEQ ID NO: 42302 - DNA, 30 bp, Homo sapiens
agatggctgtgttttgcccctatgattcct

SEQ ID NO: 42303 - DNA, 30 bp, Homo sapiens
tttccacacgctccacctttattccccagg

SEQ ID NO: 42304 - DNA, 30 bp, Homo sapiens
aagaggaaatctgagaaagattcttggtgc

SEQ ID NO: 42305 - DNA, 30 bp, Homo sapiens
tcaaggccctgaggacagcctccagcttca

SEQ ID NO: 42306 - DNA, 30 bp, Homo sapiens
actcatcttgactcgatcaagttcctcatc

SEQ ID NO: 42307 - DNA, 30 bp, Homo sapiens
gctttatttggaagcttcttgtggttatca

SEQ ID NO: 42308 - DNA, 30 bp, Homo sapiens
gagttatgcagtcaccaattttatctgggt

SEQ ID NO: 42309 - DNA, 30 bp, Homo sapiens
tgcatcaccaatggcttttgcaaatacata

SEQ ID NO: 42310 - DNA, 30 bp, Homo sapiens
acgaaccctggtatctccctgcttatcata

SEQ ID NO: 42311 - DNA, 30 bp, Homo sapiens
ttctgatagatgatgccagtggaacttcca

SEQ ID NO: 42312 - DNA, 30 bp, Homo sapiens
accaggcgaacatagtaagcatggctaaaa

SEQ ID NO: 42313 - DNA, 30 bp, Homo sapiens
tagcggtagtaaggaattagatgtgagtgg

SEQ ID NO: 42314 - DNA, 30 bp, Homo sapiens
taatgtttcatcaaacgctccaaaagtgat

SEQ ID NO: 42315 - DNA, 30 bp, Homo sapiens
atgtcatggaagctggcatcaggcgacttt

SEQ ID NO: 42316 - DNA, 30 bp, Homo sapiens
agttggaaggtttctgtagcttctcagctt

SEQ ID NO: 42317 - DNA, 30 bp, Homo sapiens
agaaccgggatccatttcttgtcctcgttg

SEQ ID NO: 42318 - DNA, 30 bp, Homo sapiens
caccaatgagatttcctttctttttctcct

SEQ ID NO: 42319 - DNA, 30 bp, Homo sapiens
tagcggggagatgggcagatgggggatcca

SEQ ID NO: 42320 - DNA, 30 bp, Homo sapiens
agaaggggcctgtgtcgtggcgcttgggtc

SEQ ID NO: 42321 - DNA, 30 bp, Homo sapiens
tgttgggaatctttgaactgttgagcgaaa

SEQ ID NO: 42322 - DNA, 30 bp, Homo sapiens
tcttggcccattttggctatggtcggagac

SEQ ID NO: 42323 - DNA, 30 bp, Homo sapiens
gggctgggcaccattggcacccaacagggc

SEQ ID NO: 42324 - DNA, 30 bp, Homo sapiens
tccaggctctgactagtctcaactctgtga

SEQ ID NO: 42325 - DNA, 30 bp, Homo sapiens
aacgggaaaggatgcttcctgctttacttg

SEQ ID NO: 42326 - DNA, 30 bp, Homo sapiens
cgtccacctccagctcttccaggtttgtta

SEQ ID NO: 42327 - DNA, 30 bp, Homo sapiens
cctcctgagcaccctctgctctcccgaagc

SEQ ID NO: 42328 - DNA, 30 bp, Homo sapiens
aggagggtgctggcactgggccgttggagg

SEQ ID NO: 42329 - DNA, 30 bp, Homo sapiens
aattcccagtatgagtctttttcatcagga

SEQ ID NO: 42330 - DNA, 30 bp, Homo sapiens
tgatggccttttctcaggatcttgttgcaa

SEQ ID NO: 42331 - DNA, 30 bp, Homo sapiens
catcaggagctgaaggaaagatgcaatctg

SEQ ID NO: 42332 - DNA, 30 bp, Homo sapiens
gtggggaacaggatatgttggaaatttcat

SEQ ID NO: 42333 - DNA, 30 bp, Homo sapiens
agcaggtggccaaggaagctgatagtcaat

SEQ ID NO: 42334 - DNA, 30 bp, Homo sapiens
tgcagcagctcttcccaggaaatgggcttg

SEQ ID NO: 42335 - DNA, 30 bp, Homo sapiens
ttctggagcagctcctcccaacagatgggc

SEQ ID NO: 42336 - DNA, 30 bp, Homo sapiens
ctttgggaagactcaccattcccgtaagcc

SEQ ID NO: 42337 - DNA, 30 bp, Homo sapiens
cgtcagctccagcactggctatatagcatt

SEQ ID NO: 42338 - DNA, 30 bp, Homo sapiens
ctagctatatatgcttttgacgagtggaaa

SEQ ID NO: 42339 - DNA, 30 bp, Homo sapiens
ccttggccagggcatcagcgccagcactgg

SEQ ID NO: 42340 - DNA, 30 bp, Homo sapiens
tagcggctcagtctcttatcctgtttttct

SEQ ID NO: 42341 - DNA, 30 bp, Homo sapiens
caagcctcgattatccaggtcctttacctt

SEQ ID NO: 42342 - DNA, 30 bp, Homo sapiens
ttttggtagtcttctttgacaaatacttct

SEQ ID NO: 42343 - DNA, 30 bp, Homo sapiens
tagtcctccacccagccattctcagagatg

SEQ ID NO: 42344 - DNA, 30 bp, Homo sapiens
ctgtgggatgccctgctccttgtagccttg

SEQ ID NO: 42345 - DNA, 30 bp, Homo sapiens
cacggggagagggtaccacctacaacctgc

SEQ ID NO: 42346 - DNA, 30 bp, Homo sapiens
ctttggccaacttcctgaggaccccgtcca

SEQ ID NO: 42347 - DNA, 30 bp, Homo sapiens
acgaggagaagcacccccactagcacggcg

SEQ ID NO: 42348 - DNA, 30 bp, Homo sapiens
acttgaggcagggacagcagaagcagcaga

SEQ ID NO: 42349 - DNA, 30 bp, Homo sapiens
accaggatacacatcttcttgcgagatttt

SEQ ID NO: 42350 - DNA, 30 bp, Homo sapiens
atcgagacttcacgccaacgaggacaacaa

SEQ ID NO: 42351 - DNA, 30 bp, Homo sapiens
gtttggctgggaagatctggacagctggaa

SEQ ID NO: 42352 - DNA, 30 bp, Homo sapiens
tagctgtcgtaccagtcgaggaagagcaag

SEQ ID NO: 42353 - DNA, 30 bp, Homo sapiens
acacagtactctgcaaggatttcttttttt

SEQ ID NO: 42354 - DNA, 30 bp, Homo sapiens
cgccttgctctggtacttgacggccttctt

SEQ ID NO: 42355 - DNA, 30 bp, Homo sapiens
acagtggaggcgatgacgatgcccaggatc

SEQ ID NO: 42356 - DNA, 30 bp, Homo sapiens
agcccagcgtccccccaatggatgacgcca

SEQ ID NO: 42357 - DNA, 30 bp, Homo sapiens
tcacccttcttgccttgctctgatatttga

SEQ ID NO: 42358 - DNA, 30 bp, Homo sapiens
tttgccaactgacaagccaataattagagc

SEQ ID NO: 42359 - DNA, 30 bp, Homo sapiens
aaatggctcttgggatatggttgctatgac

SEQ ID NO: 42360 - DNA, 30 bp, Homo sapiens
ccaaggatcacaagcaaaacaattacacaa

SEQ ID NO: 42361 - DNA, 30 bp, Homo sapiens
caacggaaagtccaataatcaatgctaaaa

SEQ ID NO: 42362 - DNA, 30 bp, Homo sapiens
acaagggtggccacaccagtctggagtgaa

SEQ ID NO: 42363 - DNA, 30 bp, Homo sapiens
actgtgacgccaatgatgactgctaggagg

SEQ ID NO: 42364 - DNA, 30 bp, Homo sapiens
acgttctcgtcgatcctggggacaaggccg

SEQ ID NO: 42365 - DNA, 30 bp, Homo sapiens
gcaaggaagaccacaaagatgatgaagaag

SEQ ID NO: 42366 - DNA, 30 bp, Homo sapiens
cagcactaagaagaggatgagcacaaccaa

SEQ ID NO: 42367 - DNA, 30 bp, Homo sapiens
atcaacatgcaggaatcctttttctgataa

SEQ ID NO: 42368 - DNA, 30 bp, Homo sapiens
cagtggttcaatccccatatgatgagactg

SEQ ID NO: 42369 - DNA, 30 bp, Homo sapiens
agttggtcggccagactgcaacaaccacga

SEQ ID NO: 42370 - DNA, 30 bp, Homo sapiens
gtttctgtggggtgaggatgtgtgtggatc

SEQ ID NO: 42371 - DNA, 30 bp, Homo sapiens
tgttggagcctgatcctcaaaagataccct

SEQ ID NO: 42372 - DNA, 30 bp, Homo sapiens
ggcagggcaatgtcctccagcttcttgtcc

SEQ ID NO: 42373 - DNA, 30 bp, Homo sapiens
gtttattcagcatctttatatcatccaaca

SEQ ID NO: 42374 - DNA, 30 bp, Homo sapiens
acttttctggttggggagttctctagagca

SEQ ID NO: 42375 - DNA, 30 bp, Homo sapiens
aactggtaccacttcttatctttgtatttc

SEQ ID NO: 42376 - DNA, 30 bp, Homo sapiens
cactggtcatcatgcctgcagttttctctt

SEQ ID NO: 42377 - DNA, 30 bp, Homo sapiens
tcatggcaagcttgtgcgcagtttctgcaa

SEQ ID NO: 42378 - DNA, 30 bp, Homo sapiens
aagaggctctccactctgatgccggccaca

SEQ ID NO: 42379 - DNA, 30 bp, Homo sapiens
tgtgcagtcgccacttgcatggttccaaaa

SEQ ID NO: 42380 - DNA, 30 bp, Homo sapiens
gagcggatccatgatgtttgtgatggaatc

SEQ ID NO: 42381 - DNA, 30 bp, Homo sapiens
atgaggtaggctatgatggcggcacaactg

SEQ ID NO: 42382 - DNA, 30 bp, Homo sapiens
agctggctccattgttctggatttaaagaa

SEQ ID NO: 42383 - DNA, 30 bp, Homo sapiens
tattggcaactgaaatttcacatccacatg

SEQ ID NO: 42384 - DNA, 30 bp, Homo sapiens
agatcgtggttcccagctgtgcaggagaca

SEQ ID NO: 42385 - DNA, 30 bp, Homo sapiens
tcttggccacactggccacagccttcttgg

SEQ ID NO: 42386 - DNA, 30 bp, Homo sapiens
ttttggtgggcgacgttctcttggatacca

SEQ ID NO: 42387 - DNA, 30 bp, Homo sapiens
acttttctctgaatgaaagtaggagttcat

SEQ ID NO: 42388 - DNA, 30 bp, Homo sapiens
actgctgtaacaccaaatgttcccacggtg

SEQ ID NO: 42389 - DNA, 30 bp, Homo sapiens
cgccggcggatcacgaagagcccgcgctga

SEQ ID NO: 42390 - DNA, 30 bp, Homo sapiens
tccatgagccgcgtaaggatgctcctcagt

SEQ ID NO: 42391 - DNA, 30 bp, Homo sapiens
tagtgtagcggactgtcgaacaccacgtca

SEQ ID NO: 42392 - DNA, 30 bp, Homo sapiens
tgttggtccaccactccagcgctgagcagc

SEQ ID NO: 42393 - DNA, 30 bp, Homo sapiens
gtaaggccgtctgggattgttcagggggtt

SEQ ID NO: 42394 - DNA, 30 bp, Homo sapiens
tgtgtctgtacatctgcatcatcctctgtc

SEQ ID NO: 42395 - DNA, 30 bp, Homo sapiens
catatcatcaggaggattgatttcaacttt

SEQ ID NO: 42396 - DNA, 30 bp, Homo sapiens
catccatcccataactgtcctctgtgtagg

SEQ ID NO: 42397 - DNA, 30 bp, Homo sapiens
cagccttcccacagttgtcccagtgatttg

SEQ ID NO: 42398 - DNA, 30 bp, Homo sapiens
cacagctcagagcggaagctgaggctgcag

SEQ ID NO: 42399 - DNA, 30 bp, Homo sapiens
gtgcggaattgaagtgcagttttggacatt

SEQ ID NO: 42400 - DNA, 30 bp, Homo sapiens
agaagtttatggaggttccttccatctttc

SEQ ID NO: 42401 - DNA, 30 bp, Homo sapiens
gttagggtgcttcctgccatcttcttctgg

SEQ ID NO: 42402 - DNA, 30 bp, Homo sapiens
agatctccaggcagaagttcagtgtggacc

SEQ ID NO: 42403 - DNA, 30 bp, Homo sapiens
tagaactggaagtggaaagttagtctggta

SEQ ID NO: 42404 - DNA, 30 bp, Homo sapiens
tagatctcagttcgaaacttcagtgtagat

SEQ ID NO: 42405 - DNA, 30 bp, Homo sapiens
ccatgggaacagctctcgaggaagatctgc

SEQ ID NO: 42406 - DNA, 30 bp, Homo sapiens
tcgtgggtgcggggtctcagaggcctggcc

SEQ ID NO: 42407 - DNA, 30 bp, Homo sapiens
agacggtgaagatgtccttccacagcccaa

SEQ ID NO: 42408 - DNA, 30 bp, Homo sapiens
ccctggcaatatgattcatacttcaacttt

SEQ ID NO: 42409 - DNA, 30 bp, Homo sapiens
tagtgggcaggcggtcggctgcacagcgga

SEQ ID NO: 42410 - DNA, 30 bp, Homo sapiens
ccctggcggccggcctgcgtctgcagcaca

SEQ ID NO: 42411 - DNA, 30 bp, Homo sapiens
acagaaacacctggcccccagccatcgtca

SEQ ID NO: 42412 - DNA, 30 bp, Homo sapiens
gtttgttcctgataaacttcaatcacatct

SEQ ID NO: 42413 - DNA, 30 bp, Homo sapiens
cagtagacacctcccgtctgctgttggaac

SEQ ID NO: 42414 - DNA, 30 bp, Homo sapiens
agaaactgtgccctgccaggctgctctccg

SEQ ID NO: 42415 - DNA, 30 bp, Homo sapiens
gacaggttcgccatgaactctgaaccgata

SEQ ID NO: 42416 - DNA, 30 bp, Homo sapiens
caaatagtgcagacactgagacttacagaa

SEQ ID NO: 42417 - DNA, 30 bp, Homo sapiens
tagtgggcgggctccccatgcactctgaag

SEQ ID NO: 42418 - DNA, 30 bp, Homo sapiens
gcctggtgtgccatggaccctgaatcgata

SEQ ID NO: 42419 - DNA, 30 bp, Homo sapiens
taggggttctggtgaggctgctctctgggc

SEQ ID NO: 42420 - DNA, 30 bp, Homo sapiens
catggggagacatagacatggacacgatgc

SEQ ID NO: 42421 - DNA, 30 bp, Homo sapiens
tttcttggggggtgcagagctgtgtctgga

SEQ ID NO: 42422 - DNA, 30 bp, Homo sapiens
ggttggcgtgcctctcttcattttactttt

SEQ ID NO: 42423 - DNA, 30 bp, Homo sapiens
tgccgatgatgatgtagctgagctgtttgt

SEQ ID NO: 42424 - DNA, 30 bp, Homo sapiens
ttcctctgatctaccaactggctccctact

SEQ ID NO: 42425 - DNA, 30 bp, Homo sapiens
ggagctggaggggttggcttgcctcccttc

SEQ ID NO: 42426 - DNA, 30 bp, Homo sapiens
agcaggctagaaaagccatcccattcctgc

SEQ ID NO: 42427 - DNA, 30 bp, Homo sapiens
aacttcatggaattcagcagcagtttctgt

SEQ ID NO: 42428 - DNA, 30 bp, Homo sapiens
ctctggatttgtaggccactcctcgacttt

SEQ ID NO: 42429 - DNA, 30 bp, Homo sapiens
tccaggagcttccccaggaagcggaggttg

SEQ ID NO: 42430 - DNA, 30 bp, Homo sapiens
accgatccatctcgtccaggagtggggtgg

SEQ ID NO: 42431 - DNA, 30 bp, Homo sapiens
cctcttcttgcagcgctggttgaaaacagg

SEQ ID NO: 42432 - DNA, 30 bp, Homo sapiens
atcaggttccttcttctttcttctcgtccc

SEQ ID NO: 42433 - DNA, 30 bp, Homo sapiens
accaggtgtcccacgtaggaatttcttaaa

SEQ ID NO: 42434 - DNA, 30 bp, Homo sapiens
acctggctgtttacaggagctgaagctctt

SEQ ID NO: 42435 - DNA, 30 bp, Homo sapiens
cttcttcttctcatccatggagacaccccc

SEQ ID NO: 42436 - DNA, 30 bp, Homo sapiens
gccaggcaggtactgtttgggggagctctc

SEQ ID NO: 42437 - DNA, 30 bp, Homo sapiens
ttctggacaatctcatcaaaaacttcaagt

SEQ ID NO: 42438 - DNA, 30 bp, Homo sapiens
accaggcctgcgcgctccaggtcctgcggc

SEQ ID NO: 42439 - DNA, 30 bp, Homo sapiens
gcccgggcggctcccgcggctccgtgcagg

SEQ ID NO: 42440 - DNA, 30 bp, Homo sapiens
agaaggagaggaatgtgagaatgatcacaa

SEQ ID NO: 42441 - DNA, 30 bp, Homo sapiens
gccagggaacccagtccaacacccgccatc

SEQ ID NO: 42442 - DNA, 30 bp, Homo sapiens
agggctgtgcaccccagacgtgcgtgttgc

SEQ ID NO: 42443 - DNA, 30 bp, Homo sapiens
cctagggcatatgctgcgggctgttgtggc

SEQ ID NO: 42444 - DNA, 30 bp, Homo sapiens
tagggatcttcttccattagaggaatctca

SEQ ID NO: 42445 - DNA, 30 bp, Homo sapiens
tggtggtgctagttgaggaacaggtaggtg

SEQ ID NO: 42446 - DNA, 30 bp, Homo sapiens
ccttctccatctcgatctgctggtggtagt

SEQ ID NO: 42447 - DNA, 30 bp, Homo sapiens
tgcttctttcaacagtggaatatcatctgt

SEQ ID NO: 42448 - DNA, 30 bp, Homo sapiens
aagaggtatttgcggcaggactcagtccca

SEQ ID NO: 42449 - DNA, 30 bp, Homo sapiens
ttgaggtaacctctgcaagtcacagctcca

SEQ ID NO: 42450 - DNA, 30 bp, Homo sapiens
agacactatctgtttccaaagctttctctt

SEQ ID NO: 42451 - DNA, 30 bp, Homo sapiens
cactgcagcacctgcccccgggtctcaggc

SEQ ID NO: 42452 - DNA, 30 bp, Homo sapiens
atcaggacctgttctcgagtctctggcagt

SEQ ID NO: 42453 - DNA, 30 bp, Homo sapiens
acatcagaacctgggttcgtgtgtcaggca

SEQ ID NO: 42454 - DNA, 30 bp, Homo sapiens
agccggggcaacatggcaagactctgcgtc

SEQ ID NO: 42455 - DNA, 30 bp, Homo sapiens
tctccaggaggctgcatctgtttacagaac

SEQ ID NO: 42456 - DNA, 30 bp, Homo sapiens
tcctggaacagttatgtcccgtccaagaag

SEQ ID NO: 42457 - DNA, 30 bp, Homo sapiens
cagaacaggccttttgctttcttcaggttc

SEQ ID NO: 42458 - DNA, 30 bp, Homo sapiens
gtccaccttctggtgggggcccggatgtag

SEQ ID NO: 42459 - DNA, 30 bp, Homo sapiens
tccaccttctggtgggggcccggatgtagc

SEQ ID NO: 42460 - DNA, 30 bp, Homo sapiens
agccagagttcgacctggtaacacctgcac

SEQ ID NO: 42461 - DNA, 30 bp, Homo sapiens
ctttggtttcgatggggagagtgaatgcag

SEQ ID NO: 42462 - DNA, 30 bp, Homo sapiens
ccgtggtctttttctctttccagttcttct

SEQ ID NO: 42463 - DNA, 30 bp, Homo sapiens
cagtcattcatgtccagcccaaactctgga

SEQ ID NO: 42464 - DNA, 30 bp, Homo sapiens
ggctggcctccagagcttgaacccttgcct

SEQ ID NO: 42465 - DNA, 30 bp, Homo sapiens
gttgagcatgtcttcacaccatcccctgtt

SEQ ID NO: 42466 - DNA, 30 bp, Homo sapiens
cccagttttcatctcgtttttcagattctg

SEQ ID NO: 42467 - DNA, 30 bp, Homo sapiens
aggcggtgcggcggagcgaatgcagggcaa

SEQ ID NO: 42468 - DNA, 30 bp, Homo sapiens
tgtcactggtctacctggtctgggagccac

SEQ ID NO: 42469 - DNA, 30 bp, Homo sapiens
tagagggcgtcaggggcagccaccggcggc

SEQ ID NO: 42470 - DNA, 30 bp, Homo sapiens
ctgttggtctgtacttctgaagcagtggcc

SEQ ID NO: 42471 - DNA, 30 bp, Homo sapiens
gcctttgcttggtctcatgcagcagctctt

SEQ ID NO: 42472 - DNA, 30 bp, Homo sapiens
gtagagcgcggagatagcgttggaccagtc

SEQ ID NO: 42473 - DNA, 30 bp, Homo sapiens
tagcaattacagcccaacggtcctcccgca

SEQ ID NO: 42474 - DNA, 30 bp, Homo sapiens
gaagcctgtcttgcagcactttcatatctt

SEQ ID NO: 42475 - DNA, 30 bp, Homo sapiens
cacttgcagatcacagaaagattgcagatc

SEQ ID NO: 42476 - DNA, 30 bp, Homo sapiens
acttgctatctcttgctgctgagtttccat

SEQ ID NO: 42477 - DNA, 30 bp, Homo sapiens
cagaggcacacgttgatttgcttggagagc

SEQ ID NO: 42478 - DNA, 30 bp, Homo sapiens
tagactcaactgtctgcattgtcaaatatg

SEQ ID NO: 42479 - DNA, 30 bp, Homo sapiens
ctccggctatatttgtctcgtttttcaatc

SEQ ID NO: 42480 - DNA, 30 bp, Homo sapiens
catagtagtaattgcgcagccgcagttcca

SEQ ID NO: 42481 - DNA, 30 bp, Homo sapiens
cagctgttccccttggcctcgggttccctg

SEQ ID NO: 42482 - DNA, 30 bp, Homo sapiens
taaggctgggcctgggcggggctggctttg

SEQ ID NO: 42483 - DNA, 30 bp, Homo sapiens
agtcggagaagaggctggcgaaagacttcc

SEQ ID NO: 42484 - DNA, 30 bp, Homo sapiens
ttttggccctactgcaatgccattacagtc

SEQ ID NO: 42485 - DNA, 30 bp, Homo sapiens
aagaggctggcaaaggacttcctcaagctc

SEQ ID NO: 42486 - DNA, 30 bp, Homo sapiens
aacaggctggcaaaagacttcctcaggttg

SEQ ID NO: 42487 - DNA, 30 bp, Homo sapiens
ggctggggctggcctagctgaggccccagc

SEQ ID NO: 42488 - DNA, 30 bp, Homo sapiens
gactgtgtctccattccacctgcctgagaa

SEQ ID NO: 42489 - DNA, 30 bp, Homo sapiens
tccgggttacagatttggccatatatttct

SEQ ID NO: 42490 - DNA, 30 bp, Homo sapiens
ttgcccaaaagtatcctgataaaactcctg

SEQ ID NO: 42491 - DNA, 30 bp, Homo sapiens
aacaggtcaggaccggcctcgacccctttt

SEQ ID NO: 42492 - DNA, 30 bp, Homo sapiens
cacaggtggttgttcttggagaggtaggcg

SEQ ID NO: 42493 - DNA, 30 bp, Homo sapiens
ccgttctgggacatgtaagctgccagagcc

SEQ ID NO: 42494 - DNA, 30 bp, Homo sapiens
gaaagggaggaatcggagccaccttttgtg

SEQ ID NO: 42495 - DNA, 30 bp, Homo sapiens
gagtggaggagggccattcgtgtatctgag

SEQ ID NO: 42496 - DNA, 30 bp, Homo sapiens
atgtggggggtggcccattggtgtacctca

SEQ ID NO: 42497 - DNA, 30 bp, Homo sapiens
aggtgggtggtgggccattgtagcgcagca

SEQ ID NO: 42498 - DNA, 30 bp, Homo sapiens
ctgggggaagaccattgacatagctgagca

SEQ ID NO: 42499 - DNA, 30 bp, Homo sapiens
acgcgggtttgttggacccaaggggggaag

SEQ ID NO: 42500 - DNA, 30 bp, Homo sapiens
tagtggtctgcggtgtttcggaactcgccg

SEQ ID NO: 42501 - DNA, 30 bp, Homo sapiens
gactggtagccctggggctcggtgtcgaag

SEQ ID NO: 42502 - DNA, 30 bp, Homo sapiens
gctgtgccgaggcagggaacagtgtgctgt

SEQ ID NO: 42503 - DNA, 30 bp, Homo sapiens
agtacacagggggcggctggtagccctcgg

SEQ ID NO: 42504 - DNA, 30 bp, Homo sapiens
ttctggatgaagtcgtccacgccagccttg

SEQ ID NO: 42505 - DNA, 30 bp, Homo sapiens
agtaggcgggcacctggtaccctttggggc

SEQ ID NO: 42506 - DNA, 30 bp, Homo sapiens
agccggggggactttggagcggtcagacag

SEQ ID NO: 42507 - DNA, 30 bp, Homo sapiens
accctgatggttgctcctgttgcggttgtg

SEQ ID NO: 42508 - DNA, 30 bp, Homo sapiens
gtgtgggtgaagccttagaggccaaggtcg

SEQ ID NO: 42509 - DNA, 30 bp, Homo sapiens
cagtgggtcaaacacctgcagtgctgtcct

SEQ ID NO: 42510 - DNA, 30 bp, Homo sapiens
tctcatgaaagcccaggctgctaccatggt

SEQ ID NO: 42511 - DNA, 30 bp, Homo sapiens
cccatcattctcctcctcctcattgtctag

SEQ ID NO: 42512 - DNA, 30 bp, Homo sapiens
agaaggaaggcttccacacctgagcctcga

SEQ ID NO: 42513 - DNA, 30 bp, Homo sapiens
aggtggtgcaggaggcctcggcggggaggc

SEQ ID NO: 42514 - DNA, 30 bp, Homo sapiens
ccttgggtgtgggttgtagttgtaatcagc

SEQ ID NO: 42515 - DNA, 30 bp, Homo sapiens
gaaaggtaggctgggaagtaggtccttatg

SEQ ID NO: 42516 - DNA, 30 bp, Homo sapiens
cagatggtttccacacctgaattgtgacac

SEQ ID NO: 42517 - DNA, 30 bp, Homo sapiens
catcggttggtttactagagtaactataag

SEQ ID NO: 42518 - DNA, 30 bp, Homo sapiens
cactggtgccctgccccaggcctccacaca

SEQ ID NO: 42519 - DNA, 30 bp, Homo sapiens
aagtggggccagtaggctgttggccaaact

SEQ ID NO: 42520 - DNA, 30 bp, Homo sapiens
agcaggtcaggcaggacgaggccaggaggc

SEQ ID NO: 42521 - DNA, 30 bp, Homo sapiens
tacatctgattggagaaggaggtgggtgca

SEQ ID NO: 42522 - DNA, 30 bp, Homo sapiens
ggaggtggaatacctccttggctatgaggg

SEQ ID NO: 42523 - DNA, 30 bp, Homo sapiens
ctccctgctcagctgcactctcctggctgg

SEQ ID NO: 42524 - DNA, 30 bp, Homo sapiens
cattggatttaggggctgagttgaggggta

SEQ ID NO: 42525 - DNA, 30 bp, Homo sapiens
aacaggctcccctgagctggctacatagca

SEQ ID NO: 42526 - DNA, 30 bp, Homo sapiens
cttcttgacggccagcatggcatcaacttc

SEQ ID NO: 42527 - DNA, 30 bp, Homo sapiens
gtgtggaaggtggtttaggagaagggcagg

SEQ ID NO: 42528 - DNA, 30 bp, Homo sapiens
acttggccacaggcttgcgggggctctcgc

SEQ ID NO: 42529 - DNA, 30 bp, Homo sapiens
cgccggacagcgtgccacatggacacgggc

SEQ ID NO: 42530 - DNA, 30 bp, Homo sapiens
tacaggtgcagctggtgccacatggcaatc

SEQ ID NO: 42531 - DNA, 30 bp, Homo sapiens
acatacttgctgtccttttgactctttcat

SEQ ID NO: 42532 - DNA, 30 bp, Homo sapiens
atccggatgtcagatgaaacagaaacagtt

SEQ ID NO: 42533 - DNA, 30 bp, Homo sapiens
ccgtggtgcggcagagcgcatgccagcgct

SEQ ID NO: 42534 - DNA, 30 bp, Homo sapiens
attccagcaaagtgtgccatctgcagatct

SEQ ID NO: 42535 - DNA, 30 bp, Homo sapiens
ggtcacctccagggaggcaggagacacgcg

SEQ ID NO: 42536 - DNA, 30 bp, Homo sapiens
cccaggagtgcatccacctcctcctcaggc

SEQ ID NO: 42537 - DNA, 30 bp, Homo sapiens
actcggagttctctttctctgatagtcctt

SEQ ID NO: 42538 - DNA, 30 bp, Homo sapiens
cagagcacgtgccacttggcaatttgtctc

SEQ ID NO: 42539 - DNA, 30 bp, Homo sapiens
cgcaggcagcagcctcactcggtccggggg

SEQ ID NO: 42540 - DNA, 30 bp, Homo sapiens
ccgagggtttccctctttgaaggatttctt

SEQ ID NO: 42541 - DNA, 30 bp, Homo sapiens
caggccttcagctggtgccactgggccacg

SEQ ID NO: 42542 - DNA, 30 bp, Homo sapiens
gagtggggcaagggcaggcgcaggcgaagg

SEQ ID NO: 42543 - DNA, 30 bp, Homo sapiens
gggaatgccagtgtgcaatgggcttccgag

SEQ ID NO: 42544 - DNA, 30 bp, Homo sapiens
tcctgggggccaggttggttctgaggggta

SEQ ID NO: 42545 - DNA, 30 bp, Homo sapiens
atttggaaatcttggcaatcaaaagcattc

SEQ ID NO: 42546 - DNA, 30 bp, Homo sapiens
tgcaggacaagagtcatgtctgtccataga

SEQ ID NO: 42547 - DNA, 30 bp, Homo sapiens
ttctgcttggccattgaggaacggagctgc

SEQ ID NO: 42548 - DNA, 30 bp, Homo sapiens
agagcctacattttcccatgctggaacgaa

SEQ ID NO: 42549 - DNA, 30 bp, Homo sapiens
cagtgggcaacaggagactccagcttctgc

SEQ ID NO: 42550 - DNA, 30 bp, Homo sapiens
gacccatcaggacccaaaggctgtctgatc

SEQ ID NO: 42551 - DNA, 30 bp, Homo sapiens
cagaggaggcgggtccagagggtgaaacag

SEQ ID NO: 42552 - DNA, 30 bp, Homo sapiens
acatggaaggtggcgacacaggtgtccatg

SEQ ID NO: 42553 - DNA, 30 bp, Homo sapiens
ttttggaaaattttaccaaacagcatcatc

SEQ ID NO: 42554 - DNA, 30 bp, Homo sapiens
aaaatgtacttcagtgctctgcgaaaccag

SEQ ID NO: 42555 - DNA, 30 bp, Homo sapiens
ctgcggtgagaagaccttctggctcagtgt

SEQ ID NO: 42556 - DNA, 30 bp, Homo sapiens
caggggttataaagcccataaaggcatcaa

SEQ ID NO: 42557 - DNA, 30 bp, Homo sapiens
ccaaggataaaatagagcataaatcaaagg

SEQ ID NO: 42558 - DNA, 30 bp, Homo sapiens
gaccttgccgcttacaataagttttattgc

SEQ ID NO: 42559 - DNA, 30 bp, Homo sapiens
taccctggggtcaggctgcccaggaggttt

SEQ ID NO: 42560 - DNA, 30 bp, Homo sapiens
ggtgctgtcaccacgctctgctcgccatgg

SEQ ID NO: 42561 - DNA, 30 bp, Homo sapiens
ccttggcatctcacactgttcacagcgaat

SEQ ID NO: 42562 - DNA, 30 bp, Homo sapiens
ccgtggcatctcgcactgctcacagcgatt

SEQ ID NO: 42563 - DNA, 30 bp, Homo sapiens
gtccaacaaaggaatctgttttatgtcttt

SEQ ID NO: 42564 - DNA, 30 bp, Homo sapiens
agagcctttaacagggccacttgtttttca

SEQ ID NO: 42565 - DNA, 30 bp, Homo sapiens
tcccgtttgcccattaatccaaagaactgc

SEQ ID NO: 42566 - DNA, 30 bp, Homo sapiens
ctgctctcgggggatacttgaggatgccaa

SEQ ID NO: 42567 - DNA, 30 bp, Homo sapiens
tgcaggactgctgcttgacactgagagtcc

SEQ ID NO: 42568 - DNA, 30 bp, Homo sapiens
ccttgggcctcatcctctctgccttctgtg

SEQ ID NO: 42569 - DNA, 30 bp, Homo sapiens
tttgcaatcagctcatcacagatttttgtc

SEQ ID NO: 42570 - DNA, 30 bp, Homo sapiens
ctgcttctgaggatgaaaacgcatgattta

SEQ ID NO: 42571 - DNA, 30 bp, Homo sapiens
ttttggcaatcagttcgtcacaaatcttgg

SEQ ID NO: 42572 - DNA, 30 bp, Homo sapiens
tcttggagatgaggtcgtcgcagatcctgg

SEQ ID NO: 42573 - DNA, 30 bp, Homo sapiens
tcgtggttgctgagagcctgaatgagatgt

SEQ ID NO: 42574 - DNA, 30 bp, Homo sapiens
agagcacattggaggagaagctgaagctct

SEQ ID NO: 42575 - DNA, 30 bp, Homo sapiens
ctgtcattgaggcagcagtagatgatgggg

SEQ ID NO: 42576 - DNA, 30 bp, Homo sapiens
tgggggcaagcaaaccatacccaaaccata

SEQ ID NO: 42577 - DNA, 30 bp, Homo sapiens
aggtatagggtgagcttatgaaacttgaag

SEQ ID NO: 42578 - DNA, 30 bp, Homo sapiens
agctcggttcctttctcaactcccccagtt

SEQ ID NO: 42579 - DNA, 30 bp, Homo sapiens
ccttggctgccaagcgctggcggtgaactt

SEQ ID NO: 42580 - DNA, 30 bp, Homo sapiens
tcaaggctcaaaaaccacctacatgcatgg

SEQ ID NO: 42581 - DNA, 30 bp, Homo sapiens
cctttagtgatgtatccttctctgatgagg

SEQ ID NO: 42582 - DNA, 30 bp, Homo sapiens
ccctggagatccagccgctttctgtgagga

SEQ ID NO: 42583 - DNA, 30 bp, Homo sapiens
agcaggtcgtgcttcttggtgcggttgtgg

SEQ ID NO: 42584 - DNA, 30 bp, Homo sapiens
cagcagcttcaggatgctctcacgctcctt

SEQ ID NO: 42585 - DNA, 30 bp, Homo sapiens
tcatcagagtccaagtcactgtccccagca

SEQ ID NO: 42586 - DNA, 30 bp, Homo sapiens
gtgcggcttcttcacattgatgccatactc

SEQ ID NO: 42587 - DNA, 30 bp, Homo sapiens
tatgtttgggttgtagtggtggcatttctc

SEQ ID NO: 42588 - DNA, 30 bp, Homo sapiens
aacggcttccctcatatgtttgggttgtag

SEQ ID NO: 42589 - DNA, 30 bp, Homo sapiens
tcttggttgttttccggatcaatgccattc

SEQ ID NO: 42590 - DNA, 30 bp, Homo sapiens
ccctggcaaacttccttgggtcctttcgaa

SEQ ID NO: 42591 - DNA, 30 bp, Homo sapiens
ggtcggttgcgctgatcatttctgtagtcg

SEQ ID NO: 42592 - DNA, 30 bp, Homo sapiens
gatttggtgatcttgctttaaaatataccg

SEQ ID NO: 42593 - DNA, 30 bp, Homo sapiens
tcttggatcttgatttctttctttttacac

SEQ ID NO: 42594 - DNA, 30 bp, Homo sapiens
aagcccattcgaggcttcttccggaggggc

SEQ ID NO: 42595 - DNA, 30 bp, Homo sapiens
acattttcaggcctctctgtccagtatttt

SEQ ID NO: 42596 - DNA, 30 bp, Homo sapiens
ccatccttgtgttctcctgaagcatgctga

SEQ ID NO: 42597 - DNA, 30 bp, Homo sapiens
cagtctgaaagggaaggagaacgaatagac

SEQ ID NO: 42598 - DNA, 30 bp, Homo sapiens
cagtgggctcgatgcttcctcttcttgtgc

SEQ ID NO: 42599 - DNA, 30 bp, Homo sapiens
ttaaggaatgctttgtagagcagcagtgaa

SEQ ID NO: 42600 - DNA, 30 bp, Homo sapiens
agaagggccaggtatagagctcgagaatac

SEQ ID NO: 42601 - DNA, 30 bp, Homo sapiens
gctagaaccaggtttcttcgagtaaaatga

SEQ ID NO: 42602 - DNA, 30 bp, Homo sapiens
accagaagaaggttacaggccatgaactgc

SEQ ID NO: 42603 - DNA, 30 bp, Homo sapiens
cctccagaatatcacaagccaaatggatgc

SEQ ID NO: 42604 - DNA, 30 bp, Homo sapiens
agcaggctgaggggagccggagttgggctg

SEQ ID NO: 42605 - DNA, 30 bp, Homo sapiens
gagcggcaagtacagcgagtagtccgagag

SEQ ID NO: 42606 - DNA, 30 bp, Homo sapiens
gcaaagagctgagttgctccttttctcggt

SEQ ID NO: 42607 - DNA, 30 bp, Homo sapiens
ttcttcagaaaacgctgcaactgttcctgt

SEQ ID NO: 42608 - DNA, 30 bp, Homo sapiens
gagagggacttcttcctgcggatcttgggc

SEQ ID NO: 42609 - DNA, 30 bp, Homo sapiens
tgatggattaatcagaacattctgaactgc

SEQ ID NO: 42610 - DNA, 30 bp, Homo sapiens
cagtgggtttgcttcattggctgtgttctg

SEQ ID NO: 42611 - DNA, 30 bp, Homo sapiens
tgttcaggtccttctgggcttcaaatgaca

SEQ ID NO: 42612 - DNA, 30 bp, Homo sapiens
agaccggctggctacatcgtcgcacgagac

SEQ ID NO: 42613 - DNA, 30 bp, Homo sapiens
taactgatgatctgccgaggtcgtccgtag

SEQ ID NO: 42614 - DNA, 30 bp, Homo sapiens
cagaggatctggcgtggcatcccgtagcca

SEQ ID NO: 42615 - DNA, 30 bp, Homo sapiens
tgatctgcctgggcatcccgtaccctgtca

SEQ ID NO: 42616 - DNA, 30 bp, Homo sapiens
gacagggatcccaaactccaggccaaaagc

SEQ ID NO: 42617 - DNA, 30 bp, Homo sapiens
accgagggccggctccatcggcggcaggca

SEQ ID NO: 42618 - DNA, 30 bp, Homo sapiens
taaggaatgtggtggcttggaccaggtgaa

SEQ ID NO: 42619 - DNA, 30 bp, Homo sapiens
tctgcattgaacattcgttctgtcagcatc

SEQ ID NO: 42620 - DNA, 30 bp, Homo sapiens
ccaccctttccacattttgtgcagttttag

SEQ ID NO: 42621 - DNA, 30 bp, Homo sapiens
tgcaggtcagccagagctgccacgaattgc

SEQ ID NO: 42622 - DNA, 30 bp, Homo sapiens
gtgaggtggctcctgtgggcttcattacta

SEQ ID NO: 42623 - DNA, 30 bp, Homo sapiens
gaacggtctctttggtttgataggggatgt

SEQ ID NO: 42624 - DNA, 30 bp, Homo sapiens
cataggttctggtctcccagtgggagaggt

SEQ ID NO: 42625 - DNA, 30 bp, Homo sapiens
gcatggtggcacacgcctgtaatcccagct

SEQ ID NO: 42626 - DNA, 30 bp, Homo sapiens
tgaaggtcacgtggccgtccgcatctacca

SEQ ID NO: 42627 - DNA, 30 bp, Homo sapiens
ggcaggaccatgatcttcttctccagcttc

SEQ ID NO: 42628 - DNA, 30 bp, Homo sapiens
ctttggtagtttttctcttgctattcctga

SEQ ID NO: 42629 - DNA, 30 bp, Homo sapiens
cgaaggaaatcccccctggatgtaatggat

SEQ ID NO: 42630 - DNA, 30 bp, Homo sapiens
cattggatatttgtgaagtgacactcgtgc

SEQ ID NO: 42631 - DNA, 30 bp, Homo sapiens
tccaggggggcagggcccgggactggcggg

SEQ ID NO: 42632 - DNA, 30 bp, Homo sapiens
gaatagaagtgggaagaaccattgaggatg

SEQ ID NO: 42633 - DNA, 30 bp, Homo sapiens
cttaggaaaatctaatgtaaccaaattccc

SEQ ID NO: 42634 - DNA, 30 bp, Homo sapiens
tgaagggcagccagctcctcttcaatcttc

SEQ ID NO: 42635 - DNA, 30 bp, Homo sapiens
ttctggagcatctgcaggagcctgcaccat

SEQ ID NO: 42636 - DNA, 30 bp, Homo sapiens
tagagctgggcaagcttctgcagcttgccc

SEQ ID NO: 42637 - DNA, 30 bp, Homo sapiens
tccatcagccgctgctgaaccaggcgggaa

SEQ ID NO: 42638 - DNA, 30 bp, Homo sapiens
cgcactgcacatctagggcactagtagcct

SEQ ID NO: 42639 - DNA, 30 bp, Homo sapiens
gttaggatatagtgccaggttttaacccag

SEQ ID NO: 42640 - DNA, 30 bp, Homo sapiens
aggtggacaggtagacagcagcccagccca

SEQ ID NO: 42641 - DNA, 30 bp, Homo sapiens
agctgggctggcttacacgcgctgtgcggt

SEQ ID NO: 42642 - DNA, 30 bp, Homo sapiens
attcggtttccacaaattgtgaacctgtct

SEQ ID NO: 42643 - DNA, 30 bp, Homo sapiens
gcttggtatctccgtgcgagagcagctgct

SEQ ID NO: 42644 - DNA, 30 bp, Homo sapiens
atgatcttgaggtactgcagggcacggcgg

SEQ ID NO: 42645 - DNA, 30 bp, Homo sapiens
ccagaagacttagaatccatgcttgagcca

SEQ ID NO: 42646 - DNA, 30 bp, Homo sapiens
ctctggtttgaaggcctctgattcacctgg

SEQ ID NO: 42647 - DNA, 30 bp, Homo sapiens
cagcagaaagccgttcttctaagcagacag

SEQ ID NO: 42648 - DNA, 30 bp, Homo sapiens
tgctgcggaactctttgagctgctgtagcc

SEQ ID NO: 42649 - DNA, 30 bp, Homo sapiens
tgttctgtagctccaccagtcgctgcacag

SEQ ID NO: 42650 - DNA, 30 bp, Homo sapiens
aaaaggcctcctcagcattgagtgtccgtg

SEQ ID NO: 42651 - DNA, 30 bp, Homo sapiens
aggtggagccgcagcgcctcgtgtagtcct

SEQ ID NO: 42652 - DNA, 30 bp, Homo sapiens
tcatggtgtagccctggatcatgctgttga

SEQ ID NO: 42653 - DNA, 30 bp, Homo sapiens
atttcctgtgttcccgtcattctggccttg

SEQ ID NO: 42654 - DNA, 30 bp, Homo sapiens
ctgtggaggaggaacttttttgcattttgt

SEQ ID NO: 42655 - DNA, 30 bp, Homo sapiens
ctcacagcacttcaattgctgcagtaccct

SEQ ID NO: 42656 - DNA, 30 bp, Homo sapiens
ccttagctgccaccaaaagaaaggcctgtc

SEQ ID NO: 42657 - DNA, 30 bp, Homo sapiens
ctgagggctccccatctttgaacatgtacc

SEQ ID NO: 42658 - DNA, 30 bp, Homo sapiens
actttccctttagaatccttttcaacgtag

SEQ ID NO: 42659 - DNA, 30 bp, Homo sapiens
aactgaaagaaaggtctgttttagcttcct

SEQ ID NO: 42660 - DNA, 30 bp, Homo sapiens
gactggttctgtccttttgcccagcaagtc

SEQ ID NO: 42661 - DNA, 30 bp, Homo sapiens
ccttggatccaggcttcagatgaccagact

SEQ ID NO: 42662 - DNA, 30 bp, Homo sapiens
ttgtgaatctatggagacgaaggcttctgt

SEQ ID NO: 42663 - DNA, 30 bp, Homo sapiens
tgaaggcttctctcctttcacccagtacct

SEQ ID NO: 42664 - DNA, 30 bp, Homo sapiens
gtccgggaatctgccttgtggtcggctctt

SEQ ID NO: 42665 - DNA, 30 bp, Homo sapiens
ttttgggtaaagatgaagtcgaagctgaag

SEQ ID NO: 42666 - DNA, 30 bp, Homo sapiens
tcctggagagtaaagggtggcaaaaatcag

SEQ ID NO: 42667 - DNA, 30 bp, Homo sapiens
acagagtctgcccttttaggtaaagaggaa

SEQ ID NO: 42668 - DNA, 30 bp, Homo sapiens
agaagccccttgccaacaacaggagctgcg

SEQ ID NO: 42669 - DNA, 30 bp, Homo sapiens
atgccacagtagcctcacagctgtctgttg

SEQ ID NO: 42670 - DNA, 30 bp, Homo sapiens
acccagtacctcatttgccaaaaaactgaa

SEQ ID NO: 42671 - DNA, 30 bp, Homo sapiens
atcaggatgaacgggtgggctgaagaacag

SEQ ID NO: 42672 - DNA, 30 bp, Homo sapiens
acccagtacctcacatgccacaaaactgaa

SEQ ID NO: 42673 - DNA, 30 bp, Homo sapiens
catgggccccagcatctccgagcacacact

SEQ ID NO: 42674 - DNA, 30 bp, Homo sapiens
tcttggttctccaaattaggatgaatgagt

SEQ ID NO: 42675 - DNA, 30 bp, Homo sapiens
ccttgaggaacgacgactcttcagcacagc

SEQ ID NO: 42676 - DNA, 30 bp, Homo sapiens
cacctttagagatgcatgtcttaatttatt

SEQ ID NO: 42677 - DNA, 30 bp, Homo sapiens
ccaaggggtagagaattgctgcaatctctc

SEQ ID NO: 42678 - DNA, 30 bp, Homo sapiens
aaaaggctttcttcttctaaggaaacactt

SEQ ID NO: 42679 - DNA, 30 bp, Homo sapiens
cactgggctctccaggcggcacaccccacc

SEQ ID NO: 42680 - DNA, 30 bp, Homo sapiens
tatcacactcctcctggctgccttcagcac

SEQ ID NO: 42681 - DNA, 30 bp, Homo sapiens
cagtggatcctcatctctcactgctgacat

SEQ ID NO: 42682 - DNA, 30 bp, Homo sapiens
tagaggcgactggtgttctcacgcaaggca

SEQ ID NO: 42683 - DNA, 30 bp, Homo sapiens
tgtcggagcttaggaaacagttttaatgca

SEQ ID NO: 42684 - DNA, 30 bp, Homo sapiens
cacctgggcaatatattctgctgtttttct

SEQ ID NO: 42685 - DNA, 30 bp, Homo sapiens
aaacacctgctggtcatagtcaggagggaa

SEQ ID NO: 42686 - DNA, 30 bp, Homo sapiens
gcatggactgctgcacggccttctgcagcg

SEQ ID NO: 42687 - DNA, 30 bp, Homo sapiens
cccaggctggaggtggttgtggagctgctc

SEQ ID NO: 42688 - DNA, 30 bp, Homo sapiens
agctctctgccctcggcttcgatgtcttct

SEQ ID NO: 42689 - DNA, 30 bp, Homo sapiens
ccgtgggctcgggctgcgtgcactcaggct

SEQ ID NO: 42690 - DNA, 30 bp, Homo sapiens
agtaggtgtcctcactctcttgggacgtca

SEQ ID NO: 42691 - DNA, 30 bp, Homo sapiens
tgccgggcctcggctgagggcctgtcccca

SEQ ID NO: 42692 - DNA, 30 bp, Homo sapiens
agaagcgggtgtccaggaaggaggtggagc

SEQ ID NO: 42693 - DNA, 30 bp, Homo sapiens
agatggcttgggccccggcgaggcggacct

SEQ ID NO: 42694 - DNA, 30 bp, Homo sapiens
agcaggactactgttcttgtctccttcttt

SEQ ID NO: 42695 - DNA, 30 bp, Homo sapiens
tactttgagtcttggagctccttggctttc

SEQ ID NO: 42696 - DNA, 30 bp, Homo sapiens
tgtcggagggacggacttcccttctccatt

SEQ ID NO: 42697 - DNA, 30 bp, Homo sapiens
tgcaggtgttaatctgcagacatctgagga

SEQ ID NO: 42698 - DNA, 30 bp, Homo sapiens
agtgggcccagcaggcctcccagatccgca

SEQ ID NO: 42699 - DNA, 30 bp, Homo sapiens
tatctgcggaagccgaagccgtcctgcggc

SEQ ID NO: 42700 - DNA, 30 bp, Homo sapiens
agtcggcgccctcgtcctcctcctcgggca

SEQ ID NO: 42701 - DNA, 30 bp, Homo sapiens
atgtcacctccatcaggttcactgctcgga

SEQ ID NO: 42702 - DNA, 30 bp, Homo sapiens
caggcttccccctccacctcgtcctcgctg

SEQ ID NO: 42703 - DNA, 30 bp, Homo sapiens
cttaggggcccattccagggcacttttcac

SEQ ID NO: 42704 - DNA, 30 bp, Homo sapiens
cagaggaagaaatcctttaatgtctgagga

SEQ ID NO: 42705 - DNA, 30 bp, Homo sapiens
gattgggggcgtcggcaaaagcaaacttga

SEQ ID NO: 42706 - DNA, 30 bp, Homo sapiens
tatcggcggtagtgatttggggcatcggca

SEQ ID NO: 42707 - DNA, 30 bp, Homo sapiens
ctttcatgatctgctgttttatggctttag

SEQ ID NO: 42708 - DNA, 30 bp, Homo sapiens
cactgggtgtcagggtcctggaagccccag

SEQ ID NO: 42709 - DNA, 30 bp, Homo sapiens
caagatgcggctgtggcctcagccccctcc

SEQ ID NO: 42710 - DNA, 30 bp, Homo sapiens
tttgggaaggacttgtgcagcacctgctcc

SEQ ID NO: 42711 - DNA, 30 bp, Homo sapiens
agagacacccatgcctgtgaatatgggcac

SEQ ID NO: 42712 - DNA, 30 bp, Homo sapiens
tatcctgccacatctccctctccgagatgg

SEQ ID NO: 42713 - DNA, 30 bp, Homo sapiens
caggtatcctcctcctcgtcactgaccagc

SEQ ID NO: 42714 - DNA, 30 bp, Homo sapiens
agccggactttctccaagtggtaggcgcgt

SEQ ID NO: 42715 - DNA, 30 bp, Homo sapiens
agctctgcctgaaatcataatggcggaacc

SEQ ID NO: 42716 - DNA, 30 bp, Homo sapiens
tttccaccgccgggtttgctgaagctccta

SEQ ID NO: 42717 - DNA, 30 bp, Homo sapiens
gatgaggggtttgacatctgtgacgagccc

SEQ ID NO: 42718 - DNA, 30 bp, Homo sapiens
gtctctcagcagcactgttcggtagttttg

SEQ ID NO: 42719 - DNA, 30 bp, Homo sapiens
cccctctacgtccaggtccgttgggaggcg

SEQ ID NO: 42720 - DNA, 30 bp, Homo sapiens
gctttcttgttagtttcttcatagaggccc

SEQ ID NO: 42721 - DNA, 30 bp, Homo sapiens
tgtactcctcatatgccaggaggatgtgga

SEQ ID NO: 42722 - DNA, 30 bp, Homo sapiens
acgtccaggtcggttgggaggcggggcatg

SEQ ID NO: 42723 - DNA, 30 bp, Homo sapiens
ggtgggagcacacggctgttcgtccctagc

SEQ ID NO: 42724 - DNA, 30 bp, Homo sapiens
ttggctttgttgttagggttgcagtttagg

SEQ ID NO: 42725 - DNA, 30 bp, Homo sapiens
tccaggggactcacaatggtgaagccagag

SEQ ID NO: 42726 - DNA, 30 bp, Homo sapiens
gcatggccatgaatgccaagtaaagatgtg

SEQ ID NO: 42727 - DNA, 30 bp, Homo sapiens
gaatggaccggggtcccacagtgtttgtgc

SEQ ID NO: 42728 - DNA, 30 bp, Homo sapiens
tggtggctcatttcaaaagttttgagattg

SEQ ID NO: 42729 - DNA, 30 bp, Homo sapiens
tcttggttctagaccttaactgagaaattc

SEQ ID NO: 42730 - DNA, 30 bp, Homo sapiens
taacacattgtccttggattcttactagtg

SEQ ID NO: 42731 - DNA, 30 bp, Homo sapiens
cagccggacatggccgagatttcatagtca

SEQ ID NO: 42732 - DNA, 30 bp, Homo sapiens
agccggaaactccaggctgctcatggtcac

SEQ ID NO: 42733 - DNA, 30 bp, Homo sapiens
tattggattgaaaaaaaaaatttaaacatg

SEQ ID NO: 42734 - DNA, 30 bp, Homo sapiens
ctaaacgtgcttctttatattcctcagctt

SEQ ID NO: 42735 - DNA, 30 bp, Homo sapiens
cgtagtcctcctccgggaagtcccccaccg

SEQ ID NO: 42736 - DNA, 30 bp, Homo sapiens
cactggatatttcgctcctcttcaggaaga

SEQ ID NO: 42737 - DNA, 30 bp, Homo sapiens
ccagctgcttgtttggagcctgctgcaggg

SEQ ID NO: 42738 - DNA, 30 bp, Homo sapiens
agcaggcaccaggctggggcaccagctggg

SEQ ID NO: 42739 - DNA, 30 bp, Homo sapiens
cactaatagacaatctccattttccacaga

SEQ ID NO: 42740 - DNA, 30 bp, Homo sapiens
ctaatgccaaaggaatgcaatgcccgagag

SEQ ID NO: 42741 - DNA, 30 bp, Homo sapiens
ggatggtgaggaggcctgttggctttattt

SEQ ID NO: 42742 - DNA, 30 bp, Homo sapiens
cgaaggccaccatccatggttaaagagcca

SEQ ID NO: 42743 - DNA, 30 bp, Homo sapiens
atcttgctgttctccaggtgggagtcaatg

SEQ ID NO: 42744 - DNA, 30 bp, Homo sapiens
gacgcgctggcacccactttgtctcctcgg

SEQ ID NO: 42745 - DNA, 30 bp, Homo sapiens
cgaaggtctaatacacaaactgaaccatct

SEQ ID NO: 42746 - DNA, 30 bp, Homo sapiens
gacgcgctggcgcccactttatctcctcgg

SEQ ID NO: 42747 - DNA, 30 bp, Homo sapiens
ttcagggcacccaggctcttcagggtctct

SEQ ID NO: 42748 - DNA, 30 bp, Homo sapiens
agggcagtgcgcctttatgggtttcccagg

SEQ ID NO: 42749 - DNA, 30 bp, Homo sapiens
cgtcgtcttcctgaatccctttagaatagg

SEQ ID NO: 42750 - DNA, 30 bp, Homo sapiens
ttcaaacacaaatgggtaaatctgttccac

SEQ ID NO: 42751 - DNA, 30 bp, Homo sapiens
ctttggcacctgtcaacacaacttttccag

SEQ ID NO: 42752 - DNA, 30 bp, Homo sapiens
tgtgcgagtagaagccatagtagccgctaa

SEQ ID NO: 42753 - DNA, 30 bp, Homo sapiens
tgatggagacttcaagtgctgcaggtgagt

SEQ ID NO: 42754 - DNA, 30 bp, Homo sapiens
acttggccagctcctcagccaccgctttgc

SEQ ID NO: 42755 - DNA, 30 bp, Homo sapiens
agtgtccttgcagtgtggtggtctcaggga

SEQ ID NO: 42756 - DNA, 30 bp, Homo sapiens
tatctggggcaatagtcgtaggagccgggc

SEQ ID NO: 42757 - DNA, 30 bp, Homo sapiens
agacggtcacctgcggtcctcccagccacc

SEQ ID NO: 42758 - DNA, 30 bp, Homo sapiens
cactgggagtcctggccaggccccaggcac

SEQ ID NO: 42759 - DNA, 30 bp, Homo sapiens
aaccatgtgcacggacatctgggaggagga

SEQ ID NO: 42760 - DNA, 30 bp, Homo sapiens
gtgcagatacttgagatgatgacagagtta

SEQ ID NO: 42761 - DNA, 30 bp, Homo sapiens
taaccatccagtgaggaaggagaatggtgc

SEQ ID NO: 42762 - DNA, 30 bp, Homo sapiens
acttgggcgactcccggcctggggagaggg

SEQ ID NO: 42763 - DNA, 30 bp, Homo sapiens
aatgtcagtgagcctggaggaatcccggaa

SEQ ID NO: 42764 - DNA, 30 bp, Homo sapiens
cagaggaatggcgtagtccttgaatggcag

SEQ ID NO: 42765 - DNA, 30 bp, Homo sapiens
gcttccttatcaaaaggagaaggggcccca

SEQ ID NO: 42766 - DNA, 30 bp, Homo sapiens
ccaaaagaaacttgactgtcgtcattcact

SEQ ID NO: 42767 - DNA, 30 bp, Homo sapiens
tacggggacgcgctgcgggacctgtccggc

SEQ ID NO: 42768 - DNA, 30 bp, Homo sapiens
gtccagttctccacagtccccattcctgaa

SEQ ID NO: 42769 - DNA, 30 bp, Homo sapiens
ctctggcaccatgccaactccgtgcacaga

SEQ ID NO: 42770 - DNA, 30 bp, Homo sapiens
acatgggtttggagcccacatccagatagc

SEQ ID NO: 42771 - DNA, 30 bp, Homo sapiens
ttctggacagagccttccctgttggaggtt

SEQ ID NO: 42772 - DNA, 30 bp, Homo sapiens
gcagcccggagcgctgcgtgagctggggct

SEQ ID NO: 42773 - DNA, 30 bp, Homo sapiens
cagcgggatacgatcttgatatagacacca

SEQ ID NO: 42774 - DNA, 30 bp, Homo sapiens
cagcggtacctttcagggttgaaggtctcc

SEQ ID NO: 42775 - DNA, 30 bp, Homo sapiens
agatggatttaatttgtgccacctgataac

SEQ ID NO: 42776 - DNA, 30 bp, Homo sapiens
atctgtgtgaggaggtacaatttcataata

SEQ ID NO: 42777 - DNA, 30 bp, Homo sapiens
gtggggcatctgtgtgaggaggtacaattt

SEQ ID NO: 42778 - DNA, 30 bp, Homo sapiens
ctcccagaatttctgctcagtacctgtaga

SEQ ID NO: 42779 - DNA, 30 bp, Homo sapiens
cttcctggcacggaggtacacttgcatggg

SEQ ID NO: 42780 - DNA, 30 bp, Homo sapiens
ttccaattccaaggaatacaaaggtctcca

SEQ ID NO: 42781 - DNA, 30 bp, Homo sapiens
ataaggaaaaatcactagggcattgaaaac

SEQ ID NO: 42782 - DNA, 30 bp, Homo sapiens
cagcctctctgtgcttcctgggacatggag

SEQ ID NO: 42783 - DNA, 30 bp, Homo sapiens
caacagaacttccatcgatttccacattca

SEQ ID NO: 42784 - DNA, 30 bp, Homo sapiens
gtttccacactcgttgcagacaacaaaggt

SEQ ID NO: 42785 - DNA, 30 bp, Homo sapiens
attgccacattcattgcataagacaaaggt

SEQ ID NO: 42786 - DNA, 30 bp, Homo sapiens
aataggataaggacggctccgttttgcctt

SEQ ID NO: 42787 - DNA, 30 bp, Homo sapiens
taaaggtatgggatatcgtgtaagcccctc

SEQ ID NO: 42788 - DNA, 30 bp, Homo sapiens
ataaggaatgtcttcaatgtcccttcgtgg

SEQ ID NO: 42789 - DNA, 30 bp, Homo sapiens
ttctggcccctacctccgcccctcactccc

SEQ ID NO: 42790 - DNA, 30 bp, Homo sapiens
actcccctgacaccccgttgtccccttggg

SEQ ID NO: 42791 - DNA, 30 bp, Homo sapiens
aatgcctatggttagaatgcagagccctaa

SEQ ID NO: 42792 - DNA, 30 bp, Homo sapiens
gcacacaggataaggacggctgcgtgaatg

SEQ ID NO: 42793 - DNA, 30 bp, Homo sapiens
ggatggtttcgattaaccttccaacgcatc

SEQ ID NO: 42794 - DNA, 30 bp, Homo sapiens
cacccacttgctatggtaccactgctcccc

SEQ ID NO: 42795 - DNA, 30 bp, Homo sapiens
ttgtgggtctgtacaaacgtgccgactggc

SEQ ID NO: 42796 - DNA, 30 bp, Homo sapiens
tcgtgggctccgatgctgtgggaggtgggg

SEQ ID NO: 42797 - DNA, 30 bp, Homo sapiens
ccttagtctgttttccttgtcccgtttctt

SEQ ID NO: 42798 - DNA, 30 bp, Homo sapiens
gggttggtagtttcactaagcccaggatgg

SEQ ID NO: 42799 - DNA, 30 bp, Homo sapiens
ccgtggccctcgaaggggggccacccccct

SEQ ID NO: 42800 - DNA, 30 bp, Homo sapiens
gtctgaatgccagcccggcaccctgggcat

SEQ ID NO: 42801 - DNA, 30 bp, Homo sapiens
cacccccgctccgactgctctgtgctgagg

SEQ ID NO: 42802 - DNA, 30 bp, Homo sapiens
catctccacagtctcaccttgtgcttaggg

SEQ ID NO: 42803 - DNA, 30 bp, Homo sapiens
acgcggtggttccacataagcggctcgcgg

SEQ ID NO: 42804 - DNA, 30 bp, Homo sapiens
atagattggggttgtaagggaatgagcaag

SEQ ID NO: 42805 - DNA, 30 bp, Homo sapiens
agctggtgagagtggtgtggtggaaaggag

SEQ ID NO: 42806 - DNA, 30 bp, Homo sapiens
gctgtgagtctgttggagtgttgtcatgat

SEQ ID NO: 42807 - DNA, 30 bp, Homo sapiens
ccccctccccctcagcgtcgtcctcgtgcg

SEQ ID NO: 42808 - DNA, 30 bp, Homo sapiens
acatgtgcccggcggggttgtgggcttcgc

SEQ ID NO: 42809 - DNA, 30 bp, Homo sapiens
ggggttgtgggcttcgctcaggcctgggtg

SEQ ID NO: 42810 - DNA, 30 bp, Homo sapiens
tacatctgtcccatgtgattcgatgcgtct

SEQ ID NO: 42811 - DNA, 30 bp, Homo sapiens
gcactgtcatcggaaggaacggggctgggg

SEQ ID NO: 42812 - DNA, 30 bp, Homo sapiens
caatccgtctgctggttgaggccaaagcga

SEQ ID NO: 42813 - DNA, 30 bp, Homo sapiens
agctgggctagaggaagaagacatggacag

SEQ ID NO: 42814 - DNA, 30 bp, Homo sapiens
aggaatagtgaagagagttatctgtggtgg

SEQ ID NO: 42815 - DNA, 30 bp, Homo sapiens
tagtgggcagacttggtgaccagggaaaga

SEQ ID NO: 42816 - DNA, 30 bp, Homo sapiens
gaagagggtgggctgaggcagctgccttca

SEQ ID NO: 42817 - DNA, 30 bp, Homo sapiens
cagtgcccgacacttctttggagtatttgc

SEQ ID NO: 42818 - DNA, 30 bp, Homo sapiens
cagcggctggggctgggtcccggccaggga

SEQ ID NO: 42819 - DNA, 30 bp, Homo sapiens
cagttattctgttgatcaaggccaaagcgc

SEQ ID NO: 42820 - DNA, 30 bp, Homo sapiens
ctttcctggatgtatttcaggaatgctgtg

SEQ ID NO: 42821 - DNA, 30 bp, Homo sapiens
acttgatctccatcgaggggctgctctgta

SEQ ID NO: 42822 - DNA, 30 bp, Homo sapiens
gggcggtattgagatctctgctcttggatg

SEQ ID NO: 42823 - DNA, 30 bp, Homo sapiens
tttgtagtaccagcctctctctctgagggt

SEQ ID NO: 42824 - DNA, 30 bp, Homo sapiens
aatttttggatgtccgtaaggcttaggccg

SEQ ID NO: 42825 - DNA, 30 bp, Homo sapiens
tgatggaatatttccgcagtttcagaaact

SEQ ID NO: 42826 - DNA, 30 bp, Homo sapiens
tcatctgtggcagcgaaggtgaagggactc

SEQ ID NO: 42827 - DNA, 30 bp, Homo sapiens
tcacggagctgagtgggtgtgcaacatgaa

SEQ ID NO: 42828 - DNA, 30 bp, Homo sapiens
ctccggctgatatgttaggaccagctgctc

SEQ ID NO: 42829 - DNA, 30 bp, Homo sapiens
aacctccaagttttctccattgcggacaac

SEQ ID NO: 42830 - DNA, 30 bp, Homo sapiens
aaccagcctcagctcaatggtttctccatc

SEQ ID NO: 42831 - DNA, 30 bp, Homo sapiens
tcctggtcctgggcagaggtcacagctgcc

SEQ ID NO: 42832 - DNA, 30 bp, Homo sapiens
ggacggtgactcagaatctttggttgaggc

SEQ ID NO: 42833 - DNA, 30 bp, Homo sapiens
tgaacagcatcttcataacttccatgttta

SEQ ID NO: 42834 - DNA, 30 bp, Homo sapiens
cgtctctctgcacagggagttggccttcca

SEQ ID NO: 42835 - DNA, 30 bp, Homo sapiens
cagggccccatgtcctgtctggagggagcg

SEQ ID NO: 42836 - DNA, 30 bp, Homo sapiens
ttgtttccagtgcctgggctggggaaatga

SEQ ID NO: 42837 - DNA, 30 bp, Homo sapiens
gatcggacgaggatcttactcaggattgca

SEQ ID NO: 42838 - DNA, 30 bp, Homo sapiens
atgaggcacctgcaacctcggcttttcttg

SEQ ID NO: 42839 - DNA, 30 bp, Homo sapiens
ccatggcttcctcattgaagagcagctttc

SEQ ID NO: 42840 - DNA, 30 bp, Homo sapiens
gttaggctccacatctgtttcttgtgcttg

SEQ ID NO: 42841 - DNA, 30 bp, Homo sapiens
acaaaagaactgatggtcttcccaacccag

SEQ ID NO: 42842 - DNA, 30 bp, Homo sapiens
gagttctcagggccattggcagttatggtt

SEQ ID NO: 42843 - DNA, 30 bp, Homo sapiens
ccagtgccacgtaggattctgcttcgtgtt

SEQ ID NO: 42844 - DNA, 30 bp, Homo sapiens
cagaggcatctgcttccaataagtatgctc

SEQ ID NO: 42845 - DNA, 30 bp, Homo sapiens
gctgctacaacgcagaataaaattcatgaa

SEQ ID NO: 42846 - DNA, 30 bp, Homo sapiens
cactcgcagtagagcccgtggaccgtggcc

SEQ ID NO: 42847 - DNA, 30 bp, Homo sapiens
taaagggcagcctggcattgatggctggtg

SEQ ID NO: 42848 - DNA, 30 bp, Homo sapiens
tttcctggtaaccttgaaaattaacttaca

SEQ ID NO: 42849 - DNA, 30 bp, Homo sapiens
tataggctttgcatattctggtccaggggt

SEQ ID NO: 42850 - DNA, 30 bp, Homo sapiens
agtaagaggcacaggataaggatgggagag

SEQ ID NO: 42851 - DNA, 30 bp, Homo sapiens
gcatggctttcttcttcctgttcttgtgtt

SEQ ID NO: 42852 - DNA, 30 bp, Homo sapiens
agcataaaagtggtagtacgtgcagacggt

SEQ ID NO: 42853 - DNA, 30 bp, Homo sapiens
agtaggagctatcacagtattctgctgtat

SEQ ID NO: 42854 - DNA, 30 bp, Homo sapiens
aggagggcacccacatgttcccatgcgtat

SEQ ID NO: 42855 - DNA, 30 bp, Homo sapiens
gattctcaggagggcacccacatgttccca

SEQ ID NO: 42856 - DNA, 30 bp, Homo sapiens
tgatcactaggaaatctaccacagtccagt

SEQ ID NO: 42857 - DNA, 30 bp, Homo sapiens
ataagggtttacctccaagagatgctgttt

SEQ ID NO: 42858 - DNA, 30 bp, Homo sapiens
tcaaagcaccagtgattttccctttgagga

SEQ ID NO: 42859 - DNA, 30 bp, Homo sapiens
cagcagcctgctgcagacaccccaagggca

SEQ ID NO: 42860 - DNA, 30 bp, Homo sapiens
gctctcaaaggatcaggatttaaaaactgc

SEQ ID NO: 42861 - DNA, 30 bp, Homo sapiens
atgaggtgaatctttagaataagttgcgag

SEQ ID NO: 42862 - DNA, 30 bp, Homo sapiens
agttccgagcccggggtggttggtaaaact

SEQ ID NO: 42863 - DNA, 30 bp, Homo sapiens
tgcttccatccttttcacactggggtacca

SEQ ID NO: 42864 - DNA, 30 bp, Homo sapiens
cctccaaaccccttttctcaggtggactct

SEQ ID NO: 42865 - DNA, 30 bp, Homo sapiens
atcggtgtctggcaacgatgtgtccactaa

SEQ ID NO: 42866 - DNA, 30 bp, Homo sapiens
acaaccagtttgtggagctggtagagaaag

SEQ ID NO: 42867 - DNA, 30 bp, Homo sapiens
tcaaggttatcatcaccagacatggaagca

SEQ ID NO: 42868 - DNA, 30 bp, Homo sapiens
cactccgcctcctccgggctatctgtcagg

SEQ ID NO: 42869 - DNA, 30 bp, Homo sapiens
tgccgcgcgcaggctccacctggagctgtt

SEQ ID NO: 42870 - DNA, 30 bp, Homo sapiens
agagtagagtttcttgtgtatccctgtttg

SEQ ID NO: 42871 - DNA, 30 bp, Homo sapiens
cagtccctgaccaggcggtaaatgtgatgc

SEQ ID NO: 42872 - DNA, 30 bp, Homo sapiens
tctttgacgagcttgtagacatggtgctgg

SEQ ID NO: 42873 - DNA, 30 bp, Homo sapiens
tgtagatgtggtgctgagccccgtgctcac

SEQ ID NO: 42874 - DNA, 30 bp, Homo sapiens
agaaggccttccctctggtttctcctgcca

SEQ ID NO: 42875 - DNA, 30 bp, Homo sapiens
cagcagacggggccatgggcctctggtggg

SEQ ID NO: 42876 - DNA, 30 bp, Homo sapiens
gatgacctcccactcgtcctccaggtcctc

SEQ ID NO: 42877 - DNA, 30 bp, Homo sapiens
aacttctgcttacctggacaggtggctcaa

SEQ ID NO: 42878 - DNA, 30 bp, Homo sapiens
agcaggaaggggatgatgggcatgcgcagg

SEQ ID NO: 42879 - DNA, 30 bp, Homo sapiens
aagacatctggatactcatcagaagtgtaa

SEQ ID NO: 42880 - DNA, 30 bp, Homo sapiens
ttgaagttccattgaagaattagaggctct

SEQ ID NO: 42881 - DNA, 30 bp, Homo sapiens
acacggcacaaatccccaacatcatgatga

SEQ ID NO: 42882 - DNA, 30 bp, Homo sapiens
gcgtccaggtggcgggatccagatgagacc

SEQ ID NO: 42883 - DNA, 30 bp, Homo sapiens
tgcaggttcatcccgcaggatggtaaggac

SEQ ID NO: 42884 - DNA, 30 bp, Homo sapiens
cagggggagctctttggaaggaggagagcc

SEQ ID NO: 42885 - DNA, 30 bp, Homo sapiens
acaagggcccgtatttggtctcatacttgg

SEQ ID NO: 42886 - DNA, 30 bp, Homo sapiens
ccgaggatccgccttcagtatagaatcgaa

SEQ ID NO: 42887 - DNA, 30 bp, Homo sapiens
ccgcttcttcagcagaacagtcaattcctg

SEQ ID NO: 42888 - DNA, 30 bp, Homo sapiens
atcagggcggaggcccccagcccagacccc

SEQ ID NO: 42889 - DNA, 30 bp, Homo sapiens
ccagctggcagcttttgagtggactcaggg

SEQ ID NO: 42890 - DNA, 30 bp, Homo sapiens
cagaagccgaccagccggagggtgttgggg

SEQ ID NO: 42891 - DNA, 30 bp, Homo sapiens
cactggtagccagccagctgcaggatggtg

SEQ ID NO: 42892 - DNA, 30 bp, Homo sapiens
gtgtggcccaccaggcgcggggtgcagggg

SEQ ID NO: 42893 - DNA, 30 bp, Homo sapiens
acgcgggtgggaggagcctgttcttgagtc

SEQ ID NO: 42894 - DNA, 30 bp, Homo sapiens
tactggctgccgccccgctcctgcttgtac

SEQ ID NO: 42895 - DNA, 30 bp, Homo sapiens
gcctatttcgctctgtctcataaagtgaat

SEQ ID NO: 42896 - DNA, 30 bp, Homo sapiens
tcccatctcattctgtcttaaaaactggat

SEQ ID NO: 42897 - DNA, 30 bp, Homo sapiens
gccgatctcgctctgccgcaggaactggat

SEQ ID NO: 42898 - DNA, 30 bp, Homo sapiens
ctccggcccatctcgctctgtctcatgaag

SEQ ID NO: 42899 - DNA, 30 bp, Homo sapiens
acgtctcccacggcaagctgcagggtggag

SEQ ID NO: 42900 - DNA, 30 bp, Homo sapiens
gccagggggtcaggtagttgacacgactgt

SEQ ID NO: 42901 - DNA, 30 bp, Homo sapiens
ttcaggaacgcgaaagctgacggctctgag

SEQ ID NO: 42902 - DNA, 30 bp, Homo sapiens
gtttggtcagcttgtggtatttgtgagcaa

SEQ ID NO: 42903 - DNA, 30 bp, Homo sapiens
atcctgaggttccaggaatgaagtcatgta

SEQ ID NO: 42904 - DNA, 30 bp, Homo sapiens
ctgaggaaatcagttttagtttcttcatgg

SEQ ID NO: 42905 - DNA, 30 bp, Homo sapiens
cttttcatggtccgccagcgatccttaatc

SEQ ID NO: 42906 - DNA, 30 bp, Homo sapiens
agctacattctgagcaccaaattttttgac

SEQ ID NO: 42907 - DNA, 30 bp, Homo sapiens
gtccaggatggtcttgaagtctgagggcag

SEQ ID NO: 42908 - DNA, 30 bp, Homo sapiens
aagacatcctcttcttacattccactgaac

SEQ ID NO: 42909 - DNA, 30 bp, Homo sapiens
cagtggcagagggccatggtttccatgtta

SEQ ID NO: 42910 - DNA, 30 bp, Homo sapiens
cccaggcagctgcaggctgggtgtgggtgg

SEQ ID NO: 42911 - DNA, 30 bp, Homo sapiens
cacccatcctgctttccctgggtttgcagg

SEQ ID NO: 42912 - DNA, 30 bp, Homo sapiens
ccagccaaagttatttttggtggtcctgga

SEQ ID NO: 42913 - DNA, 30 bp, Homo sapiens
aaattcctccaggatcatctgctctgccag

SEQ ID NO: 42914 - DNA, 30 bp, Homo sapiens
aaagtctggtggtggtgggggtgcctgggt

SEQ ID NO: 42915 - DNA, 30 bp, Homo sapiens
gacccaatggttatagggccccgcaacgtg

SEQ ID NO: 42916 - DNA, 30 bp, Homo sapiens
gacccgagtgaaggcatatggagatgtagt

SEQ ID NO: 42917 - DNA, 30 bp, Homo sapiens
gtctcagtacatttctggcacttacctaca

SEQ ID NO: 42918 - DNA, 30 bp, Homo sapiens
tccagcggctgtaggggccagtgaccttcg

SEQ ID NO: 42919 - DNA, 30 bp, Homo sapiens
caatacactgtagccagtgcactgggccct

SEQ ID NO: 42920 - DNA, 30 bp, Homo sapiens
caatggcagcagtagctgtaacccccaaac

SEQ ID NO: 42921 - DNA, 30 bp, Homo sapiens
ctgacttgctccagtagccatgttcatgaa

SEQ ID NO: 42922 - DNA, 30 bp, Homo sapiens
tcgcaggaactctcttttttgtattagaaa

SEQ ID NO: 42923 - DNA, 30 bp, Homo sapiens
atgaggtttttgcagccagattcccttccc

SEQ ID NO: 42924 - DNA, 30 bp, Homo sapiens
cagaggccccccagttgaaaggcatctgag

SEQ ID NO: 42925 - DNA, 30 bp, Homo sapiens
cgctgggtcaacgctgccattctcaactgg

SEQ ID NO: 42926 - DNA, 30 bp, Homo sapiens
agtctgacaagtcactctgatccagcacga

SEQ ID NO: 42927 - DNA, 30 bp, Homo sapiens
tcctggatgaaaggattcttggtgccatgg

SEQ ID NO: 42928 - DNA, 30 bp, Homo sapiens
tatgaaggaaagaagcttggccagtgtgag

SEQ ID NO: 42929 - DNA, 30 bp, Homo sapiens
atggctgatcagcagcctccacaggtgggt

SEQ ID NO: 42930 - DNA, 30 bp, Homo sapiens
ggaagggggtgacctcgaggcctcgaaagt

SEQ ID NO: 42931 - DNA, 30 bp, Homo sapiens
tgaaggtactctttgacttgagaggaagta

SEQ ID NO: 42932 - DNA, 30 bp, Homo sapiens
gactgggtagaatggcctctttgatgaagg

SEQ ID NO: 42933 - DNA, 30 bp, Homo sapiens
ccttctcaggggcagtgggctcccagagcc

SEQ ID NO: 42934 - DNA, 30 bp, Homo sapiens
aaggtccatctgctggaggcccagagtcct

SEQ ID NO: 42935 - DNA, 30 bp, Homo sapiens
tttcttcggcttctgttattgtccctgtta

SEQ ID NO: 42936 - DNA, 30 bp, Homo sapiens
tttcactgccatggaatgatttgccttctc

SEQ ID NO: 42937 - DNA, 30 bp, Homo sapiens
atggggagcttgcattttctgtgccacttt

SEQ ID NO: 42938 - DNA, 30 bp, Homo sapiens
acttggagctcttggatttgctgttttctc

SEQ ID NO: 42939 - DNA, 30 bp, Homo sapiens
gcttggaggtgatgaatcggaactgctggt

SEQ ID NO: 42940 - DNA, 30 bp, Homo sapiens
ctcagtctgggactttggggcaggcacagc

SEQ ID NO: 42941 - DNA, 30 bp, Homo sapiens
atccagcagtcccactgcagcgtatatacc

SEQ ID NO: 42942 - DNA, 30 bp, Homo sapiens
tgtcaacagtgaaccttactttgggcttct

SEQ ID NO: 42943 - DNA, 30 bp, Homo sapiens
gcaaggaggggtgcattagttctcaggcct

SEQ ID NO: 42944 - DNA, 30 bp, Homo sapiens
tactggtaaaatggcatcaagggtccccac

SEQ ID NO: 42945 - DNA, 30 bp, Homo sapiens
tgaaggaaaaggcttggcattgaagctatg

SEQ ID NO: 42946 - DNA, 30 bp, Homo sapiens
gaagccatgggaaatcacagtgctttggta

SEQ ID NO: 42947 - DNA, 30 bp, Homo sapiens
agttggggtcagcctgggcctggcgtgggg

SEQ ID NO: 42948 - DNA, 30 bp, Homo sapiens
tgctggctggggcacaggtacatagggggc

SEQ ID NO: 42949 - DNA, 30 bp, Homo sapiens
tagctgggggaactcgaagtacagtcagac

SEQ ID NO: 42950 - DNA, 30 bp, Homo sapiens
aacgtgaaggagcaggccataccacctcag

SEQ ID NO: 42951 - DNA, 30 bp, Homo sapiens
agtgaggcatggctggaatggccagtgctc

SEQ ID NO: 42952 - DNA, 30 bp, Homo sapiens
attgagaatagagtgatccataaacctggt

SEQ ID NO: 42953 - DNA, 30 bp, Homo sapiens
ctcccagatcttgtatatcactgatgctgt

SEQ ID NO: 42954 - DNA, 30 bp, Homo sapiens
ctgcctccttcttcctttgccagtaaaaga

SEQ ID NO: 42955 - DNA, 30 bp, Homo sapiens
cagtgaaagatagcatcttggcagcttcaa

SEQ ID NO: 42956 - DNA, 30 bp, Homo sapiens
tgcaggcttccaggagtgatgaggtggagc

SEQ ID NO: 42957 - DNA, 30 bp, Homo sapiens
caccatattttcgttgtttctttattgtgc

SEQ ID NO: 42958 - DNA, 30 bp, Homo sapiens
tttctgtgcttctcctctttgtcactgctt

SEQ ID NO: 42959 - DNA, 30 bp, Homo sapiens
tttctcctccttgtcgccagttttactacc

SEQ ID NO: 42960 - DNA, 30 bp, Homo sapiens
tttctccattttctccagggttttgttaga

SEQ ID NO: 42961 - DNA, 30 bp, Homo sapiens
ttcacggcagcctctgaagttttccgcagg

SEQ ID NO: 42962 - DNA, 30 bp, Homo sapiens
gcttggcatccttctccgaagccttggttt

SEQ ID NO: 42963 - DNA, 30 bp, Homo sapiens
cccccgacggctcctcccggctctggtcca

SEQ ID NO: 42964 - DNA, 30 bp, Homo sapiens
atggcagtatttccttcggaactgaaatac

SEQ ID NO: 42965 - DNA, 30 bp, Homo sapiens
agatggagagctggcggggccgaagagtag

SEQ ID NO: 42966 - DNA, 30 bp, Homo sapiens
tccagggtttcatcatacagccatttataa

SEQ ID NO: 42967 - DNA, 30 bp, Homo sapiens
tgttggcccctgcttgtaaatctggctgat

SEQ ID NO: 42968 - DNA, 30 bp, Homo sapiens
ttcaggatgatgtggtagccatcattgctc

SEQ ID NO: 42969 - DNA, 30 bp, Homo sapiens
cattctcgttgaagtcatcgtcctcctcgt

SEQ ID NO: 42970 - DNA, 30 bp, Homo sapiens
gggaggaggaatcctcctcatcatcttcct

SEQ ID NO: 42971 - DNA, 30 bp, Homo sapiens
cattctcactgaggtcgtcatcgttgttgt

SEQ ID NO: 42972 - DNA, 30 bp, Homo sapiens
caggactcctcttccatgctgaagctgctg

SEQ ID NO: 42973 - DNA, 30 bp, Homo sapiens
tccatgctgaagctgctccggcggctgctg

SEQ ID NO: 42974 - DNA, 30 bp, Homo sapiens
tctgagctaaagctacttctcctactgctt

SEQ ID NO: 42975 - DNA, 30 bp, Homo sapiens
attaggatagaagcaccaggggaccccacg

SEQ ID NO: 42976 - DNA, 30 bp, Homo sapiens
taatggcagtcttccacagacttcgggaag

SEQ ID NO: 42977 - DNA, 30 bp, Homo sapiens
agaaggtgcattctgcttcctgcaggggct

SEQ ID NO: 42978 - DNA, 30 bp, Homo sapiens
tatcgataaccaggtccaggttgggtatag

SEQ ID NO: 42979 - DNA, 30 bp, Homo sapiens
acttggccatgtcgatcaggctctgcagtg

SEQ ID NO: 42980 - DNA, 30 bp, Homo sapiens
ctagaaagaacatggatgcatgaatgcaga

SEQ ID NO: 42981 - DNA, 30 bp, Homo sapiens
ctttggatgaaaccttttttacatgccctc

SEQ ID NO: 42982 - DNA, 30 bp, Homo sapiens
tgctaacaaagttattgtcattccctccac

SEQ ID NO: 42983 - DNA, 30 bp, Homo sapiens
tttccggattctactggcaaagcgaagctt

SEQ ID NO: 42984 - DNA, 30 bp, Homo sapiens
cagaggctgggctggccagggtcgggtagg

SEQ ID NO: 42985 - DNA, 30 bp, Homo sapiens
atccccgctaagcgcattggctgccccttg

SEQ ID NO: 42986 - DNA, 30 bp, Homo sapiens
cgtcaccagagagggcatttgcagctccct

SEQ ID NO: 42987 - DNA, 30 bp, Homo sapiens
tgtaggtcttagagcctggttcctggaggc

SEQ ID NO: 42988 - DNA, 30 bp, Homo sapiens
gaaagggttctaatgccttttccacattct

SEQ ID NO: 42989 - DNA, 30 bp, Homo sapiens
aagcggttcttcccttcaggagggcgctgg

SEQ ID NO: 42990 - DNA, 30 bp, Homo sapiens
ctgcacttgcaggagcgcacgatcatgttg

SEQ ID NO: 42991 - DNA, 30 bp, Homo sapiens
agcttcaggaagcagggctggcagtagggc

SEQ ID NO: 42992 - DNA, 30 bp, Homo sapiens
gaatggttagaggttctaaatcttgggaca

SEQ ID NO: 42993 - DNA, 30 bp, Homo sapiens
caccggaagcagtaattggtgtccaaagcc

SEQ ID NO: 42994 - DNA, 30 bp, Homo sapiens
tgttggagagctgctccactttgggggtcc

SEQ ID NO: 42995 - DNA, 30 bp, Homo sapiens
aaaacgctgatgcttgtttgaagatctcaa

SEQ ID NO: 42996 - DNA, 30 bp, Homo sapiens
tgttgactgagttgcgataatgttttctta

SEQ ID NO: 42997 - DNA, 30 bp, Homo sapiens
atttggtagtgtttagggagccgtcttcag

SEQ ID NO: 42998 - DNA, 30 bp, Homo sapiens
tgctgctggagcaaggcgtgctctgcgtgc

SEQ ID NO: 42999 - DNA, 30 bp, Homo sapiens
tgggacctcctgggctggggaccgctgggc

SEQ ID NO: 43000 - DNA, 30 bp, Homo sapiens
ccgttctctctgctgctgcctctggcatct

SEQ ID NO: 43001 - DNA, 30 bp, Homo sapiens
gccaggactggatgagctggggtttgtgtg

SEQ ID NO: 43002 - DNA, 30 bp, Homo sapiens
gctccatctctgcagcccgtttgagtgcaa

SEQ ID NO: 43003 - DNA, 30 bp, Homo sapiens
tactggggattttcagagactaaagggatg

SEQ ID NO: 43004 - DNA, 30 bp, Homo sapiens
gctcggcagccctttgtactgctgcatcga

SEQ ID NO: 43005 - DNA, 30 bp, Homo sapiens
ttccggtgagcttctggctaggggccgact

SEQ ID NO: 43006 - DNA, 30 bp, Homo sapiens
cgagatgccatagggatggtctctcctaag

SEQ ID NO: 43007 - DNA, 30 bp, Homo sapiens
aggcggggccaatgatgacattccggaagc

SEQ ID NO: 43008 - DNA, 30 bp, Homo sapiens
tccaggaacacagggctttaccagagaaag

SEQ ID NO: 43009 - DNA, 30 bp, Homo sapiens
attcggctacatcgatggacaacatggcct

SEQ ID NO: 43010 - DNA, 30 bp, Homo sapiens
acttggtgatgagaacaatcttctgagcat

SEQ ID NO: 43011 - DNA, 30 bp, Homo sapiens
acccttaatgtccttaaacttgttgcttct

SEQ ID NO: 43012 - DNA, 30 bp, Homo sapiens
acttggcagtggccacatggacgatcacaa

SEQ ID NO: 43013 - DNA, 30 bp, Homo sapiens
aactggactgaggccctctcctgaggctcc

SEQ ID NO: 43014 - DNA, 30 bp, Homo sapiens
ccacagtgacgaagatgtccttgtagcctt

SEQ ID NO: 43015 - DNA, 30 bp, Homo sapiens
cattggtgacgttcatctttttccagagga

SEQ ID NO: 43016 - DNA, 30 bp, Homo sapiens
gttggtagtcactggcctttggccgccggg

SEQ ID NO: 43017 - DNA, 30 bp, Homo sapiens
cagaggaatataccattctgttaggacttg

SEQ ID NO: 43018 - DNA, 30 bp, Homo sapiens
caatatcagcatttcttggaagaaaataaa

SEQ ID NO: 43019 - DNA, 30 bp, Homo sapiens
cagaggctggtcttcgaattaggtcaccaa

SEQ ID NO: 43020 - DNA, 30 bp, Homo sapiens
caatggcactcagcgcatgggcaagggtgt

SEQ ID NO: 43021 - DNA, 30 bp, Homo sapiens
ctgttcttggaagagttaactgcctcgatt

SEQ ID NO: 43022 - DNA, 30 bp, Homo sapiens
atacagtggactcgcccatacattggaaat

SEQ ID NO: 43023 - DNA, 30 bp, Homo sapiens
atgtgttcctttccaccacagcagcaggcc

SEQ ID NO: 43024 - DNA, 30 bp, Homo sapiens
tctgatacgtcgtctttctctttctggaag

SEQ ID NO: 43025 - DNA, 30 bp, Homo sapiens
cagccatataagacaaatcactctgttcac

SEQ ID NO: 43026 - DNA, 30 bp, Homo sapiens
cacattccgtgcttcttgcggatgacagcc

SEQ ID NO: 43027 - DNA, 30 bp, Homo sapiens
tttcggaattatctgtaggaagctctgact

SEQ ID NO: 43028 - DNA, 30 bp, Homo sapiens
gaagactgcttaaggcagttggtaacatgt

SEQ ID NO: 43029 - DNA, 30 bp, Homo sapiens
ctctggcccaagtctggcctggagtccctg

SEQ ID NO: 43030 - DNA, 30 bp, Homo sapiens
ctcctcactcaaccacaaggcttcacgtga

SEQ ID NO: 43031 - DNA, 30 bp, Homo sapiens
tacggggtcaccttcttgtaggtgacgtga

SEQ ID NO: 43032 - DNA, 30 bp, Homo sapiens
ttcctgctttagctgccttataagagcttc

SEQ ID NO: 43033 - DNA, 30 bp, Homo sapiens
ctatgctctcctgacaacagtcccaacaga

SEQ ID NO: 43034 - DNA, 30 bp, Homo sapiens
aggccatgctgctgctcagctgcatggcaa

SEQ ID NO: 43035 - DNA, 30 bp, Homo sapiens
gcactggggatccgagtgtccaggagctcc

SEQ ID NO: 43036 - DNA, 30 bp, Homo sapiens
ttacttagcaaatgcctgaatttactactg

SEQ ID NO: 43037 - DNA, 30 bp, Homo sapiens
agagtctctgcggcgtccgctcggtccgca

SEQ ID NO: 43038 - DNA, 30 bp, Homo sapiens
tctaccaccagcataggttttatcatagat

SEQ ID NO: 43039 - DNA, 30 bp, Homo sapiens
cgcccgccagcgtaggtttggtcatagata

SEQ ID NO: 43040 - DNA, 30 bp, Homo sapiens
cacacccttccctggagcagctgcctccgg

SEQ ID NO: 43041 - DNA, 30 bp, Homo sapiens
ttctgggtttgaaactcttggaagtcctca

SEQ ID NO: 43042 - DNA, 30 bp, Homo sapiens
tagaggccaggcctgggttgatcacacttt

SEQ ID NO: 43043 - DNA, 30 bp, Homo sapiens
accgtgtaggatgtagataggtcattaatc

SEQ ID NO: 43044 - DNA, 30 bp, Homo sapiens
tcctttgagaacactgtgctttcaaagcag

SEQ ID NO: 43045 - DNA, 30 bp, Homo sapiens
agtatagggtcttctcatcaacactctgaa

SEQ ID NO: 43046 - DNA, 30 bp, Homo sapiens
tactggggagactcttcttccaactgcagc

SEQ ID NO: 43047 - DNA, 30 bp, Homo sapiens
cactggtccttggtgacatcactgagccca

SEQ ID NO: 43048 - DNA, 30 bp, Homo sapiens
ccacggttgctcctttctttctcttcatcc

SEQ ID NO: 43049 - DNA, 30 bp, Homo sapiens
agatggttttctgaaattgctcaagtattt

SEQ ID NO: 43050 - DNA, 30 bp, Homo sapiens
tagcgggcctgtggcccttcctgtgggcag

SEQ ID NO: 43051 - DNA, 30 bp, Homo sapiens
ctctggatgttccttccagaaagcatcccc

SEQ ID NO: 43052 - DNA, 30 bp, Homo sapiens
gactcttcaagacattcatatcagctgcac

SEQ ID NO: 43053 - DNA, 30 bp, Homo sapiens
tactgggaggtgttgagggcatgactcctc

SEQ ID NO: 43054 - DNA, 30 bp, Homo sapiens
caggggtcaggccagcagccaggacagctt

SEQ ID NO: 43055 - DNA, 30 bp, Homo sapiens
cagccaccacctctgaccatggctgtccct

SEQ ID NO: 43056 - DNA, 30 bp, Homo sapiens
ctcaggtgttgcatgaactccctcttgatc

SEQ ID NO: 43057 - DNA, 30 bp, Homo sapiens
ccgaggacttatgatgtttcttctcttcct

SEQ ID NO: 43058 - DNA, 30 bp, Homo sapiens
aagaatcattaggaagcccaaacagcttca

SEQ ID NO: 43059 - DNA, 30 bp, Homo sapiens
cgatggctgaagaatccctgaggatggttg

SEQ ID NO: 43060 - DNA, 30 bp, Homo sapiens
agaaggacagggagaaggctcggtaaccca

SEQ ID NO: 43061 - DNA, 30 bp, Homo sapiens
tatggcttaggatctgtttccatgcttgct

SEQ ID NO: 43062 - DNA, 30 bp, Homo sapiens
cagacctgcggctcgggctcgcagcccccg

SEQ ID NO: 43063 - DNA, 30 bp, Homo sapiens
ccttcctgagacagattctgggagtgggtg

SEQ ID NO: 43064 - DNA, 30 bp, Homo sapiens
agcagggggtggagctggaccacaggggtg

SEQ ID NO: 43065 - DNA, 30 bp, Homo sapiens
cctcaaagacctcgaggaagagtgggggga

SEQ ID NO: 43066 - DNA, 30 bp, Homo sapiens
gagaggctgcattgcctgccaggtcctcgc

SEQ ID NO: 43067 - DNA, 30 bp, Homo sapiens
actcggttgtgggctgtatattgtccttct

SEQ ID NO: 43068 - DNA, 30 bp, Homo sapiens
acacttccaagaacaaaggggggaagagtt

SEQ ID NO: 43069 - DNA, 30 bp, Homo sapiens
ttgtcccgtcatttcctggtatttccttgt

SEQ ID NO: 43070 - DNA, 30 bp, Homo sapiens
tctccacgctaagtgtacttgtggtttcat

SEQ ID NO: 43071 - DNA, 30 bp, Homo sapiens
cccaggaagcccgtctgcctgttggccaca

SEQ ID NO: 43072 - DNA, 30 bp, Homo sapiens
cataggctaaggttaaaggtttcagtcggt

SEQ ID NO: 43073 - DNA, 30 bp, Homo sapiens
cgtaggctaaggtcagaggcttctgttggg

SEQ ID NO: 43074 - DNA, 30 bp, Homo sapiens
gcccaggcagtggtcaggatcttcagtctc

SEQ ID NO: 43075 - DNA, 30 bp, Homo sapiens
gcttggctggtgctgtctcctgtgcaggca

SEQ ID NO: 43076 - DNA, 30 bp, Homo sapiens
ctgtggcttgacttgcaagttcaggtttgg

SEQ ID NO: 43077 - DNA, 30 bp, Homo sapiens
gtgcatttgcagtctaggtcctggtgacaa

SEQ ID NO: 43078 - DNA, 30 bp, Homo sapiens
acagtccagaagagtgcgacttcttatatt

SEQ ID NO: 43079 - DNA, 30 bp, Homo sapiens
caatggcaatttggccattctttagcagct

SEQ ID NO: 43080 - DNA, 30 bp, Homo sapiens
gtctgctttccatccaaagtgtttcataat

SEQ ID NO: 43081 - DNA, 30 bp, Homo sapiens
agttcctctttctccgtcttgttctgaagg

SEQ ID NO: 43082 - DNA, 30 bp, Homo sapiens
cacagggacatgaaatccgtggcctggagg

SEQ ID NO: 43083 - DNA, 30 bp, Homo sapiens
agggttgtcctctttgctagatgggtcata

SEQ ID NO: 43084 - DNA, 30 bp, Homo sapiens
acttggttccttttcctccaggctcaaaac

SEQ ID NO: 43085 - DNA, 30 bp, Homo sapiens
gccagggcaattctgtccattcttcagaga

SEQ ID NO: 43086 - DNA, 30 bp, Homo sapiens
gaacaaatgaatatcctttatctggaaaga

SEQ ID NO: 43087 - DNA, 30 bp, Homo sapiens
cactgggtttcataccctgccactcgatac

SEQ ID NO: 43088 - DNA, 30 bp, Homo sapiens
acatggaaatgatcttgcattgcaacagtt

SEQ ID NO: 43089 - DNA, 30 bp, Homo sapiens
acttctcactgagctcacccatttgttgaa

SEQ ID NO: 43090 - DNA, 30 bp, Homo sapiens
ttccttttcttctccaatacacctacactc

SEQ ID NO: 43091 - DNA, 30 bp, Homo sapiens
ccccaagccttccctctcaagttgagttta

SEQ ID NO: 43092 - DNA, 30 bp, Homo sapiens
cactgtgtttggtaacttgccataccatat

SEQ ID NO: 43093 - DNA, 30 bp, Homo sapiens
tcctggagggggcaaagtcttcacgcctaa

SEQ ID NO: 43094 - DNA, 30 bp, Homo sapiens
ctctctgtttcataaaaacactcctcactg

SEQ ID NO: 43095 - DNA, 30 bp, Homo sapiens
gcgtcttgtcctcgggcgcctgggaccctc

SEQ ID NO: 43096 - DNA, 30 bp, Homo sapiens
ctttcttcctctaaggcattgatggtttgg

SEQ ID NO: 43097 - DNA, 30 bp, Homo sapiens
gccaggttcccatgagcttcttccgtgtat

SEQ ID NO: 43098 - DNA, 30 bp, Homo sapiens
cagctgtggcatcaatgcccgcgtaagtga

SEQ ID NO: 43099 - DNA, 30 bp, Homo sapiens
ctgtcggagaactgctttgggaggagcaga

SEQ ID NO: 43100 - DNA, 30 bp, Homo sapiens
accagggggaggctgcccctgggagatgcc

SEQ ID NO: 43101 - DNA, 30 bp, Homo sapiens
cgagtttcagtcagtccatttagatgatcc

SEQ ID NO: 43102 - DNA, 30 bp, Homo sapiens
cttcggtgagtcgtactctttttgctggtg

SEQ ID NO: 43103 - DNA, 30 bp, Homo sapiens
cctccttaataccaatttatcagacagaag

SEQ ID NO: 43104 - DNA, 30 bp, Homo sapiens
cataggcagcaaagccgctccacctcctcc

SEQ ID NO: 43105 - DNA, 30 bp, Homo sapiens
attttgatggtaaagggagttcagttcctg

SEQ ID NO: 43106 - DNA, 30 bp, Homo sapiens
cacacaccgtcataggggcctgctggggta

SEQ ID NO: 43107 - DNA, 30 bp, Homo sapiens
tggaggaaatctgtaattttggaatcaata

SEQ ID NO: 43108 - DNA, 30 bp, Homo sapiens
gttgaaggcccactgaaggagtccttaata

SEQ ID NO: 43109 - DNA, 30 bp, Homo sapiens
tctgtgaagaagctgcagttacccaggctt

SEQ ID NO: 43110 - DNA, 30 bp, Homo sapiens
tagagggtaaaaaggccgtcttcgtcttcc

SEQ ID NO: 43111 - DNA, 30 bp, Homo sapiens
catcctcaatctggtatcgtttcttctttt

SEQ ID NO: 43112 - DNA, 30 bp, Homo sapiens
tgcaggcccagagctctgctgcaccctctt

SEQ ID NO: 43113 - DNA, 30 bp, Homo sapiens
agtttctcttcctcggatttggctgcattg

SEQ ID NO: 43114 - DNA, 30 bp, Homo sapiens
acatgttggctcgttcccgctgcagccgcg

SEQ ID NO: 43115 - DNA, 30 bp, Homo sapiens
gatattgtcgatagtctccaaaaggtgagg

SEQ ID NO: 43116 - DNA, 30 bp, Homo sapiens
cagtggtactgctgatagctggggtagcct

SEQ ID NO: 43117 - DNA, 30 bp, Homo sapiens
tcctgggttctctttcacttgcgcatacac

SEQ ID NO: 43118 - DNA, 30 bp, Homo sapiens
caccggaggtaataatcaatcgcagcagag

SEQ ID NO: 43119 - DNA, 30 bp, Homo sapiens
tgttggagcaaggagcctttcatgtgctcc

SEQ ID NO: 43120 - DNA, 30 bp, Homo sapiens
agcagcacacagaacggggaatccaaagcc

SEQ ID NO: 43121 - DNA, 30 bp, Homo sapiens
tctcggggcctccgcctgcaccagcgagtg

SEQ ID NO: 43122 - DNA, 30 bp, Homo sapiens
gctcggtgctggaggccgagatgtccagga

SEQ ID NO: 43123 - DNA, 30 bp, Homo sapiens
gtttggagcgaggccacaagcggctggtga

SEQ ID NO: 43124 - DNA, 30 bp, Homo sapiens
aggatgcaagaggacgccggtgagctccaa

SEQ ID NO: 43125 - DNA, 30 bp, Homo sapiens
gaaaggctttctgagaaaactggcttggat

SEQ ID NO: 43126 - DNA, 30 bp, Homo sapiens
cacaggaacccaacaaagttcagtcatctg

SEQ ID NO: 43127 - DNA, 30 bp, Homo sapiens
gccctcctttctgtacaatctgggcaaacc

SEQ ID NO: 43128 - DNA, 30 bp, Homo sapiens
tcgtggttggccaaggagtcctgctttggc

SEQ ID NO: 43129 - DNA, 30 bp, Homo sapiens
tctaggaaggtttagcagtgcttcaatttt

SEQ ID NO: 43130 - DNA, 30 bp, Homo sapiens
atctgggaccgcagggactgccaggtgcac

SEQ ID NO: 43131 - DNA, 30 bp, Homo sapiens
tatgggtcctcgatgtcgagaaactcctgc

SEQ ID NO: 43132 - DNA, 30 bp, Homo sapiens
caggggtctgtggcattgatgatgctttta

SEQ ID NO: 43133 - DNA, 30 bp, Homo sapiens
tagggctgaacgatgtcaacaaactccttc

SEQ ID NO: 43134 - DNA, 30 bp, Homo sapiens
agttggccccaagctgcgataatcaacttt

SEQ ID NO: 43135 - DNA, 30 bp, Homo sapiens
tgatgacccatgtcctccatgcccacgcgg

SEQ ID NO: 43136 - DNA, 30 bp, Homo sapiens
cacaggaagaaacaggtatggcaccgtggc

SEQ ID NO: 43137 - DNA, 30 bp, Homo sapiens
actccttttgctctgtggcaggcaagtcaa

SEQ ID NO: 43138 - DNA, 30 bp, Homo sapiens
aagagtcataaaggtcactggtgacactgc

SEQ ID NO: 43139 - DNA, 30 bp, Homo sapiens
gtgtttcctcttcatttaaagtattggcaa

SEQ ID NO: 43140 - DNA, 30 bp, Homo sapiens
tcatgaagttcatcctcaaaaaggagaact

SEQ ID NO: 43141 - DNA, 30 bp, Homo sapiens
tgctgggttaggatcaattctttctggaaa

SEQ ID NO: 43142 - DNA, 30 bp, Homo sapiens
ccccttctccctcctgtagtagcttacaac

SEQ ID NO: 43143 - DNA, 30 bp, Homo sapiens
atcagggcccctgccatcgacgtagtacat

SEQ ID NO: 43144 - DNA, 30 bp, Homo sapiens
ttgagcaggttgccctgctcctgggcctgg

SEQ ID NO: 43145 - DNA, 30 bp, Homo sapiens
agataatttggatctccgggaagacacttg

SEQ ID NO: 43146 - DNA, 30 bp, Homo sapiens
tcccggtatcgggcagactggccatagtaa

SEQ ID NO: 43147 - DNA, 30 bp, Homo sapiens
cacaggtcagtggccggaccccagtcatag

SEQ ID NO: 43148 - DNA, 30 bp, Homo sapiens
agttggcagggctgcattgcagaatctgct

SEQ ID NO: 43149 - DNA, 30 bp, Homo sapiens
tatgggcaatgcttccgattctctggagtt

SEQ ID NO: 43150 - DNA, 30 bp, Homo sapiens
caggggctgccatggggaaaaggctgcctt

SEQ ID NO: 43151 - DNA, 30 bp, Homo sapiens
caagggcagatcaccaggccgcctccttcc

SEQ ID NO: 43152 - DNA, 30 bp, Homo sapiens
cagtggggtccccaactctaaggtgaagag

SEQ ID NO: 43153 - DNA, 30 bp, Homo sapiens
ctctgcaagacctccaagatggcccggagg

SEQ ID NO: 43154 - DNA, 30 bp, Homo sapiens
agtcgggtgtgtcctcccttttgtccacag

SEQ ID NO: 43155 - DNA, 30 bp, Homo sapiens
taggccttggtgatgaggcccctcacagct

SEQ ID NO: 43156 - DNA, 30 bp, Homo sapiens
tcacggccactatgatatgtctggcactaa

SEQ ID NO: 43157 - DNA, 30 bp, Homo sapiens
gtctggtactgattccaaacatatccagca

SEQ ID NO: 43158 - DNA, 30 bp, Homo sapiens
actcagtcaagaacttgtctttgtgttgct

SEQ ID NO: 43159 - DNA, 30 bp, Homo sapiens
ttcaggctgagagtcgaactgttgctggtg

SEQ ID NO: 43160 - DNA, 30 bp, Homo sapiens
tcatcgtccgggacttcccggagcccttcg

SEQ ID NO: 43161 - DNA, 30 bp, Homo sapiens
ctccagctcctggatgcagaactgctcctg

SEQ ID NO: 43162 - DNA, 30 bp, Homo sapiens
tgtcccccgagccagtgactatgtacttat

SEQ ID NO: 43163 - DNA, 30 bp, Homo sapiens
catacacggtggccttcttgtcccccgagc

SEQ ID NO: 43164 - DNA, 30 bp, Homo sapiens
ctcaggactgaggacgactccttggacgca

SEQ ID NO: 43165 - DNA, 30 bp, Homo sapiens
aaactgtggccttcttgtcaccagagcctg

SEQ ID NO: 43166 - DNA, 30 bp, Homo sapiens
tatccccagagccagtgacaatgtatttgt

SEQ ID NO: 43167 - DNA, 30 bp, Homo sapiens
agtaggtgatctggtacacggaggcgtgct

SEQ ID NO: 43168 - DNA, 30 bp, Homo sapiens
tgtaggggatgctgtcagcccagccatgtg

SEQ ID NO: 43169 - DNA, 30 bp, Homo sapiens
cagaggttgatgcaatagcagctccagcag

SEQ ID NO: 43170 - DNA, 30 bp, Homo sapiens
cccctggggtcacagaaactctccagatgc

SEQ ID NO: 43171 - DNA, 30 bp, Homo sapiens
atctggatatcttatgcttttgtatcttat

SEQ ID NO: 43172 - DNA, 30 bp, Homo sapiens
tgcagggcatcctggaacttggtgctggtg

SEQ ID NO: 43173 - DNA, 30 bp, Homo sapiens
tgaaggcagaaacttgtactgctgctgccg

SEQ ID NO: 43174 - DNA, 30 bp, Homo sapiens
gccctcatcttccctcagctcggtgggtaa

SEQ ID NO: 43175 - DNA, 30 bp, Homo sapiens
aattggaattcactggcggtaaagtcctgg

SEQ ID NO: 43176 - DNA, 30 bp, Homo sapiens
gttagcccaaaaaaggccacgtttgctctt

SEQ ID NO: 43177 - DNA, 30 bp, Homo sapiens
gactcttcatttaactctgtgaatgtctgc

SEQ ID NO: 43178 - DNA, 30 bp, Homo sapiens
actttatcgcagctctcagatttacccaaa

SEQ ID NO: 43179 - DNA, 30 bp, Homo sapiens
cgttctttctgaactggccagttcaagatg

SEQ ID NO: 43180 - DNA, 30 bp, Homo sapiens
cagatagatgttgcttcctgccaattgcat

SEQ ID NO: 43181 - DNA, 30 bp, Homo sapiens
agatggttgctacagtttgcaacggaatgt

SEQ ID NO: 43182 - DNA, 30 bp, Homo sapiens
agagcccacgtttgcttttctccttgggcc

SEQ ID NO: 43183 - DNA, 30 bp, Homo sapiens
ccttgaacacctgactataggccacatgat

SEQ ID NO: 43184 - DNA, 30 bp, Homo sapiens
ttctcagagtttgccaaaacaagccttctg

SEQ ID NO: 43185 - DNA, 30 bp, Homo sapiens
attcggccgtgggtccctggcagaagttcc

SEQ ID NO: 43186 - DNA, 30 bp, Homo sapiens
ctttgtccgccggttctggaaccaggtttt

SEQ ID NO: 43187 - DNA, 30 bp, Homo sapiens
cgcaggccgacgccaccgacgtgacgctag

SEQ ID NO: 43188 - DNA, 30 bp, Homo sapiens
ccgaggcgagcccggacactgaagccactt

SEQ ID NO: 43189 - DNA, 30 bp, Homo sapiens
accagggaggtgacagcgggaaccttggaa

SEQ ID NO: 43190 - DNA, 30 bp, Homo sapiens
gtctggttccatagtaatctataatgtaac

SEQ ID NO: 43191 - DNA, 30 bp, Homo sapiens
gctgccatcacttggcatcagccctccagt

SEQ ID NO: 43192 - DNA, 30 bp, Homo sapiens
tgctggtccaacatagccaactccaatgag

SEQ ID NO: 43193 - DNA, 30 bp, Homo sapiens
gtgagctgaacatgaagccccacctgggcc

SEQ ID NO: 43194 - DNA, 30 bp, Homo sapiens
atgcctccaagcactccatttattacttga

SEQ ID NO: 43195 - DNA, 30 bp, Homo sapiens
agtatcttggatagttgcatgactactctg

SEQ ID NO: 43196 - DNA, 30 bp, Homo sapiens
acttctcgcagaggctgcagaaaaggccca

SEQ ID NO: 43197 - DNA, 30 bp, Homo sapiens
taaaggggaagtttgtttataattcgtacc

SEQ ID NO: 43198 - DNA, 30 bp, Homo sapiens
agacagccaaggaaaccgatgactatctga

SEQ ID NO: 43199 - DNA, 30 bp, Homo sapiens
aaacgggtccatctcccccacagcagccac

SEQ ID NO: 43200 - DNA, 30 bp, Homo sapiens
gtgaggtgtgtcctgttttttcctgcaatc

SEQ ID NO: 43201 - DNA, 30 bp, Homo sapiens
tttcttctgcctttgtttttatgaagaact

SEQ ID NO: 43202 - DNA, 30 bp, Homo sapiens
tccaggaacatccaggaaccactaagccat

SEQ ID NO: 43203 - DNA, 30 bp, Homo sapiens
tgccttgctggagagtgctttctgtgatga

SEQ ID NO: 43204 - DNA, 30 bp, Homo sapiens
ttgtggagggctagggggtcggagggtggt

SEQ ID NO: 43205 - DNA, 30 bp, Homo sapiens
cagtagatgtagggcatgatgcggtaaggc

SEQ ID NO: 43206 - DNA, 30 bp, Homo sapiens
caaaggcgttctctctccagctggctgctc

SEQ ID NO: 43207 - DNA, 30 bp, Homo sapiens
ttgaggttaacatagatataccggatgaac

SEQ ID NO: 43208 - DNA, 30 bp, Homo sapiens
agtaatagccatggaataaagggaggatac

SEQ ID NO: 43209 - DNA, 30 bp, Homo sapiens
gcatgcaaagaagccaattgttcctgtaaa

SEQ ID NO: 43210 - DNA, 30 bp, Homo sapiens
attatccccaaggctgtgctaaataccgcc

SEQ ID NO: 43211 - DNA, 30 bp, Homo sapiens
agtctatcttcacagcagcatagatcttgc

SEQ ID NO: 43212 - DNA, 30 bp, Homo sapiens
cagtcatttcctcatctgaatcacttgatt

SEQ ID NO: 43213 - DNA, 30 bp, Homo sapiens
ttcttaattccacctgtggccaagggcccc

SEQ ID NO: 43214 - DNA, 30 bp, Homo sapiens
ggccccttccccgcggccttcgcttttagc

SEQ ID NO: 43215 - DNA, 30 bp, Homo sapiens
ttgcgatcccccatcagctgcagcacaaag

SEQ ID NO: 43216 - DNA, 30 bp, Homo sapiens
caccaggagcacaattcccaggacacagaa

SEQ ID NO: 43217 - DNA, 30 bp, Homo sapiens
tccaaatttgctgaaatccttcttagattg

SEQ ID NO: 43218 - DNA, 30 bp, Homo sapiens
accgtaacaggtgcaggaatagattgatga

SEQ ID NO: 43219 - DNA, 30 bp, Homo sapiens
cattcatggccaggatcatcatgagttttc

SEQ ID NO: 43220 - DNA, 30 bp, Homo sapiens
tactggcgaccagcagctgcagctgctcgt

SEQ ID NO: 43221 - DNA, 30 bp, Homo sapiens
cagtggggaggtctctgagcactctttcca

SEQ ID NO: 43222 - DNA, 30 bp, Homo sapiens
ccacggtcagctcctgccccgacttggcct

SEQ ID NO: 43223 - DNA, 30 bp, Homo sapiens
agccggtttggtggaggtcagcgccacagc

SEQ ID NO: 43224 - DNA, 30 bp, Homo sapiens
ccttggattaccttcttgaactgatcttct

SEQ ID NO: 43225 - DNA, 30 bp, Homo sapiens
aggcatcctgttcatctgtgagcagggcag

SEQ ID NO: 43226 - DNA, 30 bp, Homo sapiens
gtccctttgggcttctgttagtttctggat

SEQ ID NO: 43227 - DNA, 30 bp, Homo sapiens
acgcggctgggcctcaaggcagagttttgg

SEQ ID NO: 43228 - DNA, 30 bp, Homo sapiens
cgctggggaagcggaatctgcgggcggagg

SEQ ID NO: 43229 - DNA, 30 bp, Homo sapiens
tctaggggatgaaaagaaccgttccacata

SEQ ID NO: 43230 - DNA, 30 bp, Homo sapiens
agctgggcagcaacacgtgctccaggaggt

SEQ ID NO: 43231 - DNA, 30 bp, Homo sapiens
tcttggtattatcatcctttctatggcaca

SEQ ID NO: 43232 - DNA, 30 bp, Homo sapiens
agaaggaggtggtgggccaagaaatccacc

SEQ ID NO: 43233 - DNA, 30 bp, Homo sapiens
aaatgggggaagtaaaccctgatgtggaca

SEQ ID NO: 43234 - DNA, 30 bp, Homo sapiens
atcaggatttctttgttccccttgctttcc

SEQ ID NO: 43235 - DNA, 30 bp, Homo sapiens
cagaggctggaccgtctctccggtctgggc

SEQ ID NO: 43236 - DNA, 30 bp, Homo sapiens
tctccgagccatcagaggctggaccgtctc

SEQ ID NO: 43237 - DNA, 30 bp, Homo sapiens
ccgtgctggggccctgggtcttgcaggcac

SEQ ID NO: 43238 - DNA, 30 bp, Homo sapiens
cccagggtctggcccaggccaccactgccc

SEQ ID NO: 43239 - DNA, 30 bp, Homo sapiens
aaaaggaggaggcccattttttactgaata

SEQ ID NO: 43240 - DNA, 30 bp, Homo sapiens
gtggggtaacatgtcctctgtctcaagtgt

SEQ ID NO: 43241 - DNA, 30 bp, Homo sapiens
aagagctgtctgctggagagcatacacacg

SEQ ID NO: 43242 - DNA, 30 bp, Homo sapiens
acgtgggcaccgggcgcttgtcctggaaga

SEQ ID NO: 43243 - DNA, 30 bp, Homo sapiens
agaagcgtcgcaggtagaagacctgccagg

SEQ ID NO: 43244 - DNA, 30 bp, Homo sapiens
ctccggacttcaaaaaatctcttcaggtag

SEQ ID NO: 43245 - DNA, 30 bp, Homo sapiens
cactggaacccttagtggtggcgttggtgt

SEQ ID NO: 43246 - DNA, 30 bp, Homo sapiens
gagtggactgccctgctgatgggtcgtttt

SEQ ID NO: 43247 - DNA, 30 bp, Homo sapiens
aggagggtgccagtcgtcccagtccctcgg

SEQ ID NO: 43248 - DNA, 30 bp, Homo sapiens
acaaggagatatgcacttgccctttggtaa

SEQ ID NO: 43249 - DNA, 30 bp, Homo sapiens
actttgggaggctgcggcagtggattgcct

SEQ ID NO: 43250 - DNA, 30 bp, Homo sapiens
tcttggcctcaaagaagctcttgaggtgac

SEQ ID NO: 43251 - DNA, 30 bp, Homo sapiens
atcttcaaacagactcttcagcatataaac

SEQ ID NO: 43252 - DNA, 30 bp, Homo sapiens
tttgcttagtctggacttgatgctgttgat

SEQ ID NO: 43253 - DNA, 30 bp, Homo sapiens
tcttggcttctttgtatctgtagttgttgg

SEQ ID NO: 43254 - DNA, 30 bp, Homo sapiens
cgagttgtggtggttcttttatctgagaaa

SEQ ID NO: 43255 - DNA, 30 bp, Homo sapiens
agctggtgtagtagatgtggaagtagagag

SEQ ID NO: 43256 - DNA, 30 bp, Homo sapiens
tcttggcttcaaagaagctcttgaggtgcc

SEQ ID NO: 43257 - DNA, 30 bp, Homo sapiens
tggatgacgtatctgaagtaaaatgaccta

SEQ ID NO: 43258 - DNA, 30 bp, Homo sapiens
tccatctccagatcctgatcctgcatctgt

SEQ ID NO: 43259 - DNA, 30 bp, Homo sapiens
agattaacctcgtggacgctcttgttgtat

SEQ ID NO: 43260 - DNA, 30 bp, Homo sapiens
gatgcagaggaccaccacacagatgacagc

SEQ ID NO: 43261 - DNA, 30 bp, Homo sapiens
gagctgtttgactctcccgtctcttggctt

SEQ ID NO: 43262 - DNA, 30 bp, Homo sapiens
cagtggccaggatgacagcagttccgaaga

SEQ ID NO: 43263 - DNA, 30 bp, Homo sapiens
taatgggccccgccccccacgcccgccaaa

SEQ ID NO: 43264 - DNA, 30 bp, Homo sapiens
aggtgggtctggtgcttctgtggggaggga

SEQ ID NO: 43265 - DNA, 30 bp, Homo sapiens
gagcttggtctcgctgaggatgatattggc

SEQ ID NO: 43266 - DNA, 30 bp, Homo sapiens
tctaatccctgcaccccggccccacagccc

SEQ ID NO: 43267 - DNA, 30 bp, Homo sapiens
tggtgggtgaggggtcagctggtggggcac

SEQ ID NO: 43268 - DNA, 30 bp, Homo sapiens
ttgtggctgaagtacatttaaatattcaga

SEQ ID NO: 43269 - DNA, 30 bp, Homo sapiens
ctgtggaatttcctccacaatccacatagt

SEQ ID NO: 43270 - DNA, 30 bp, Homo sapiens
agaagggtttctttttcagcccaaagacgg

SEQ ID NO: 43271 - DNA, 30 bp, Homo sapiens
aacagtgtttcttgacagaaggggttaaca

SEQ ID NO: 43272 - DNA, 30 bp, Homo sapiens
cactcctcctccacactgcgggcccccttg

SEQ ID NO: 43273 - DNA, 30 bp, Homo sapiens
accagggcggccagtgctatcgtgttgtgc

SEQ ID NO: 43274 - DNA, 30 bp, Homo sapiens
atacgggtagcccaaagcggtgcttctttt

SEQ ID NO: 43275 - DNA, 30 bp, Homo sapiens
atatggcctggtcctgcctccgtctcaggc

SEQ ID NO: 43276 - DNA, 30 bp, Homo sapiens
cgattcgctgactgtcacgttctccagcct

SEQ ID NO: 43277 - DNA, 30 bp, Homo sapiens
cgtcgggggagctgcctcgaaggtgattag

SEQ ID NO: 43278 - DNA, 30 bp, Homo sapiens
ggcaggaaaagtcagggtggattccagtga

SEQ ID NO: 43279 - DNA, 30 bp, Homo sapiens
acgaggaagataattccatagttaaaccat

SEQ ID NO: 43280 - DNA, 30 bp, Homo sapiens
cgtaggtgtacttttagaagtcgttgggtc

SEQ ID NO: 43281 - DNA, 30 bp, Homo sapiens
cactggggtggacactgctgcaagcacagg

SEQ ID NO: 43282 - DNA, 30 bp, Homo sapiens
gggcccacagcgcccataaaacccaaggga

SEQ ID NO: 43283 - DNA, 30 bp, Homo sapiens
tccttcttgctcccgtgccgctgactgtga

SEQ ID NO: 43284 - DNA, 30 bp, Homo sapiens
ttcttctggagcttggcatgcacgactttg

SEQ ID NO: 43285 - DNA, 30 bp, Homo sapiens
gcgtgggcgaggacatgtgggggcgcccag

SEQ ID NO: 43286 - DNA, 30 bp, Homo sapiens
cacgtgtccagggggtcacgcgtgggcgag

SEQ ID NO: 43287 - DNA, 30 bp, Homo sapiens
attctgagaggccacagccagggtgttgac

SEQ ID NO: 43288 - DNA, 30 bp, Homo sapiens
gcctcttcttgagtaatacattttgcatcc

SEQ ID NO: 43289 - DNA, 30 bp, Homo sapiens
gatgaggctggcaatgctggatgtggtctc

SEQ ID NO: 43290 - DNA, 30 bp, Homo sapiens
gccaggttcagataactgaagggcctttat

SEQ ID NO: 43291 - DNA, 30 bp, Homo sapiens
agcagcgtctgaacaggaagtttgagaata

SEQ ID NO: 43292 - DNA, 30 bp, Homo sapiens
caatggattaaaacccttccttttggtggc

SEQ ID NO: 43293 - DNA, 30 bp, Homo sapiens
agcagggggtggctggaactggttgatgac

SEQ ID NO: 43294 - DNA, 30 bp, Homo sapiens
agtgtgataaacatgacaacccccataaac

SEQ ID NO: 43295 - DNA, 30 bp, Homo sapiens
cagcgcacggtgcacacatccaggatgcag

SEQ ID NO: 43296 - DNA, 30 bp, Homo sapiens
tgcaggcctccagctccagatgtcaaaggc

SEQ ID NO: 43297 - DNA, 30 bp, Homo sapiens
acacggtgtaagttttgacagacttataga

SEQ ID NO: 43298 - DNA, 30 bp, Homo sapiens
ccaagggtccgagcttcttcttccaatcgt

SEQ ID NO: 43299 - DNA, 30 bp, Homo sapiens
gtaactcgagtctctagacagtgggaaatt

SEQ ID NO: 43300 - DNA, 30 bp, Homo sapiens
ccccggatcctctccatgtagttgcgaagc

SEQ ID NO: 43301 - DNA, 30 bp, Homo sapiens
agtctctaaagtcctgtgaatcccccagcc

SEQ ID NO: 43302 - DNA, 30 bp, Homo sapiens
ctttgagtttctccagatagtttctaagtt

SEQ ID NO: 43303 - DNA, 30 bp, Homo sapiens
catgtagttgtgcagctctttgcagtcccc

SEQ ID NO: 43304 - DNA, 30 bp, Homo sapiens
tgcaggtccgggggtgcagtgggccgcgtg

SEQ ID NO: 43305 - DNA, 30 bp, Homo sapiens
agtagggcaggtagaagaactggaagcccc

SEQ ID NO: 43306 - DNA, 30 bp, Homo sapiens
ctgtgggcaactctggtgttacagttgtgt

SEQ ID NO: 43307 - DNA, 30 bp, Homo sapiens
tgtttcagctgccgttcctcactccgcctg

SEQ ID NO: 43308 - DNA, 30 bp, Homo sapiens
aactccaacgtcggttgtcatgcggacatc

SEQ ID NO: 43309 - DNA, 30 bp, Homo sapiens
aacttgcatgaactccttgcgcagccacaa

SEQ ID NO: 43310 - DNA, 30 bp, Homo sapiens
taagggggtgcccagttgtcctcataaaaa

SEQ ID NO: 43311 - DNA, 30 bp, Homo sapiens
gcagctctcaagcttgctctcagccctctc

SEQ ID NO: 43312 - DNA, 30 bp, Homo sapiens
ggtgtggggagggtcggcctggggtcaggg

SEQ ID NO: 43313 - DNA, 30 bp, Homo sapiens
tgctgggcgtggcttgcgggggctcggaag

SEQ ID NO: 43314 - DNA, 30 bp, Homo sapiens
aagatgatgcaaaatgcaagtatcattaat

SEQ ID NO: 43315 - DNA, 30 bp, Homo sapiens
cagaggtctcgaagggggccagggggccgg

SEQ ID NO: 43316 - DNA, 30 bp, Homo sapiens
agtgcacattgacaacggcgacatacaggg

SEQ ID NO: 43317 - DNA, 30 bp, Homo sapiens
ctcaggatcatcatgaggcttaaacctgca

SEQ ID NO: 43318 - DNA, 30 bp, Homo sapiens
ggagggtaaggcaggagaatcgcttgaacc

SEQ ID NO: 43319 - DNA, 30 bp, Homo sapiens
ctttggcggccatcagcaaactggcacctg

SEQ ID NO: 43320 - DNA, 30 bp, Homo sapiens
taatggggtctgttgaacatactaactcca

SEQ ID NO: 43321 - DNA, 30 bp, Homo sapiens
atcatagcgatgctctcgggggcacagttg

SEQ ID NO: 43322 - DNA, 30 bp, Homo sapiens
acagctggaccggcagggagatgggggagg

SEQ ID NO: 43323 - DNA, 30 bp, Homo sapiens
acctggtcagtctgatattcagaagcttct

SEQ ID NO: 43324 - DNA, 30 bp, Homo sapiens
ccatccccctggcagccgctgtctccgtgg

SEQ ID NO: 43325 - DNA, 30 bp, Homo sapiens
gtgaggtctctacgcaggagccgtggcggt

SEQ ID NO: 43326 - DNA, 30 bp, Homo sapiens
cttccttcaaggtaggtaaacattcaaagt

SEQ ID NO: 43327 - DNA, 30 bp, Homo sapiens
gaaaggagtaaggtagcctttctttgcgta

SEQ ID NO: 43328 - DNA, 30 bp, Homo sapiens
acacagttctggccaatgagatgaaggcaa

SEQ ID NO: 43329 - DNA, 30 bp, Homo sapiens
tgggggaagcacttcctggacttgatccaa

SEQ ID NO: 43330 - DNA, 30 bp, Homo sapiens
acttggtcgccacccccgaagtgacggccg

SEQ ID NO: 43331 - DNA, 30 bp, Homo sapiens
cagtggccttccaatattatgacccccagc

SEQ ID NO: 43332 - DNA, 30 bp, Homo sapiens
tcctggtaaagcccctcgaattctgcagac

SEQ ID NO: 43333 - DNA, 30 bp, Homo sapiens
actcgggtggcggccgacccgcctcatcag

SEQ ID NO: 43334 - DNA, 30 bp, Homo sapiens
aagtgctggtggaagtagaggccgaaaagg

SEQ ID NO: 43335 - DNA, 30 bp, Homo sapiens
tcagatactggtgatagaaaagcccaaaaa

SEQ ID NO: 43336 - DNA, 30 bp, Homo sapiens
acatgggttatttcacaagctttctcagtt

SEQ ID NO: 43337 - DNA, 30 bp, Homo sapiens
aggtttcaggtgctgcaggttttacatggc

SEQ ID NO: 43338 - DNA, 30 bp, Homo sapiens
cactcaaacatctcgtagtgacgtgtctgc

SEQ ID NO: 43339 - DNA, 30 bp, Homo sapiens
ggctggaagccggagcaaatccagcagata

SEQ ID NO: 43340 - DNA, 30 bp, Homo sapiens
gtctattttcttggctggaagccggagcaa

SEQ ID NO: 43341 - DNA, 30 bp, Homo sapiens
aaacgatgcctcctatgattgtcacagttc

SEQ ID NO: 43342 - DNA, 30 bp, Homo sapiens
gtctggcacagtagaacagggattaacaag

SEQ ID NO: 43343 - DNA, 30 bp, Homo sapiens
cactgggttcaggtctccaacaggttcttc

SEQ ID NO: 43344 - DNA, 30 bp, Homo sapiens
cttagggaaagtcaagaaatgaaacaaatg

SEQ ID NO: 43345 - DNA, 30 bp, Homo sapiens
cctgtgtccagcacagtaggaagaaaccaa

SEQ ID NO: 43346 - DNA, 30 bp, Homo sapiens
ccgtggaggtttctacttcttggatggggt

SEQ ID NO: 43347 - DNA, 30 bp, Homo sapiens
ccttctcatgtctcctctgtttgcagagag

SEQ ID NO: 43348 - DNA, 30 bp, Homo sapiens
aaaggagaccaccaagacgcaaaatgtctg

SEQ ID NO: 43349 - DNA, 30 bp, Homo sapiens
agtgtagcgaggatccttgaaaaggagatg

SEQ ID NO: 43350 - DNA, 30 bp, Homo sapiens
cggtggggaaggctcagaagatagaggcaa

SEQ ID NO: 43351 - DNA, 30 bp, Homo sapiens
gtaacctcttccttttcctcctgccgcagg

SEQ ID NO: 43352 - DNA, 30 bp, Homo sapiens
gtgcggagagggaggggcttttccattcca

SEQ ID NO: 43353 - DNA, 30 bp, Homo sapiens
gcgagggagagagtatatttcttcataagg

SEQ ID NO: 43354 - DNA, 30 bp, Homo sapiens
agcagggggcagggaggagctgggactgtg

SEQ ID NO: 43355 - DNA, 30 bp, Homo sapiens
acttccaacatttccttctggtctcttttc

SEQ ID NO: 43356 - DNA, 30 bp, Homo sapiens
cacaggacaatggcagtggaggtctgctcc

SEQ ID NO: 43357 - DNA, 30 bp, Homo sapiens
aggagcggcccggattgagcatccccctcc

SEQ ID NO: 43358 - DNA, 30 bp, Homo sapiens
ccgtggagtctctgccagactttagctgtg

SEQ ID NO: 43359 - DNA, 30 bp, Homo sapiens
tctcgggtctggatttagggtagttggtcc

SEQ ID NO: 43360 - DNA, 30 bp, Homo sapiens
catgtccagcacccttggagggctcctggc

SEQ ID NO: 43361 - DNA, 30 bp, Homo sapiens
tgacagcgctcttctcctcttggaaggagg

SEQ ID NO: 43362 - DNA, 30 bp, Homo sapiens
gaatgggaaaggcgtgacccaacgagagca

SEQ ID NO: 43363 - DNA, 30 bp, Homo sapiens
agtcttctttccttctccttttcttttcct

SEQ ID NO: 43364 - DNA, 30 bp, Homo sapiens
tgtacttggcccggatggcctggccgttct

SEQ ID NO: 43365 - DNA, 30 bp, Homo sapiens
aacaaccagaaatagtaatccagctagcaa

SEQ ID NO: 43366 - DNA, 30 bp, Homo sapiens
cactgcgcagtttccgaccaccatggacag

SEQ ID NO: 43367 - DNA, 30 bp, Homo sapiens
ctcagggagaatgggtactgaggatgccac

SEQ ID NO: 43368 - DNA, 30 bp, Homo sapiens
tagcccggactccactggtctgtgcccgcc

SEQ ID NO: 43369 - DNA, 30 bp, Homo sapiens
attcatcatcagagctgagcaggagagtct

SEQ ID NO: 43370 - DNA, 30 bp, Homo sapiens
ccacggatttatctgaaggttcttttttct

SEQ ID NO: 43371 - DNA, 30 bp, Homo sapiens
ccagtggatgatcttgtccagtcttaaggc

SEQ ID NO: 43372 - DNA, 30 bp, Homo sapiens
atctggcatttcgatatttaatttgggagg

SEQ ID NO: 43373 - DNA, 30 bp, Homo sapiens
atctggcatatcaatatttaacttgggagg

SEQ ID NO: 43374 - DNA, 30 bp, Homo sapiens
acacctgtgtgaaacgctctctgtccagga

SEQ ID NO: 43375 - DNA, 30 bp, Homo sapiens
cagagggatggaatcttgggtgagtgttga

SEQ ID NO: 43376 - DNA, 30 bp, Homo sapiens
gcttctcgcccgtcaggccctggatgaggt

SEQ ID NO: 43377 - DNA, 30 bp, Homo sapiens
ccctgggccaaaaaccccaagcagcagttg

SEQ ID NO: 43378 - DNA, 30 bp, Homo sapiens
atcctcctcttcctcgccctctgtctcctc

SEQ ID NO: 43379 - DNA, 30 bp, Homo sapiens
ggttggcagaagcccgttagcgcgcagctc

SEQ ID NO: 43380 - DNA, 30 bp, Homo sapiens
acgttctacttggctgacagcccaggtctg

SEQ ID NO: 43381 - DNA, 30 bp, Homo sapiens
aatatcagctgtggtcctccattgctcatg

SEQ ID NO: 43382 - DNA, 30 bp, Homo sapiens
cactggggggcctgagcaggctgtcagagg

SEQ ID NO: 43383 - DNA, 30 bp, Homo sapiens
acagttctcccagctcgccttccattgccc

SEQ ID NO: 43384 - DNA, 30 bp, Homo sapiens
tccaggtctcttctgcggacagtggtggct

SEQ ID NO: 43385 - DNA, 30 bp, Homo sapiens
ttcagaagttcccctctttaggttgttact

SEQ ID NO: 43386 - DNA, 30 bp, Homo sapiens
acccgggcccccaagtcccctcctcctccc

SEQ ID NO: 43387 - DNA, 30 bp, Homo sapiens
ctttccagttcttcttctacccctatggca

SEQ ID NO: 43388 - DNA, 30 bp, Homo sapiens
cttcggggccggaacctccgtgggcccgtt

SEQ ID NO: 43389 - DNA, 30 bp, Homo sapiens
cgcaggctctggtacagaaacaccgaggtg

SEQ ID NO: 43390 - DNA, 30 bp, Homo sapiens
accaccacagtcctgactttggtaaatttt

SEQ ID NO: 43391 - DNA, 30 bp, Homo sapiens
gacaggcgcggatcatgagcagctgcagga

SEQ ID NO: 43392 - DNA, 30 bp, Homo sapiens
gcatggtgactccacgtagtcattgtccag

SEQ ID NO: 43393 - DNA, 30 bp, Homo sapiens
tagaggctccttatttccagggcaaggcca

SEQ ID NO: 43394 - DNA, 30 bp, Homo sapiens
atgtggctcgttgcctgacctcttctttta

SEQ ID NO: 43395 - DNA, 30 bp, Homo sapiens
aggtggggagcctaaagggccaaaacatgg

SEQ ID NO: 43396 - DNA, 30 bp, Homo sapiens
catctgccgccgctcctgtcggcgctgccg

SEQ ID NO: 43397 - DNA, 30 bp, Homo sapiens
agaccaagattaactctcccaagcattcct

SEQ ID NO: 43398 - DNA, 30 bp, Homo sapiens
actcaggtggtaggggcgggggtggtggcg

SEQ ID NO: 43399 - DNA, 30 bp, Homo sapiens
tctcggtggcactggagaagatgatggtcc

SEQ ID NO: 43400 - DNA, 30 bp, Homo sapiens
agcagggagttgcatgtttatgtgtccatt

SEQ ID NO: 43401 - DNA, 30 bp, Homo sapiens
ccttgggctcatctggagtcagcttcatca

SEQ ID NO: 43402 - DNA, 30 bp, Homo sapiens
tgctgggatatcagggcaagtgcccagtcc

SEQ ID NO: 43403 - DNA, 30 bp, Homo sapiens
cgatggtctcgtggtcccacctgccttgta

SEQ ID NO: 43404 - DNA, 30 bp, Homo sapiens
gaaagcagccaaggtgagcacctcaagtaa

SEQ ID NO: 43405 - DNA, 30 bp, Homo sapiens
tgagcacctcaagtaaaagctctgagccac

SEQ ID NO: 43406 - DNA, 30 bp, Homo sapiens
acctctgcctctcaaagtactgggattcca

SEQ ID NO: 43407 - DNA, 30 bp, Homo sapiens
ctgcctctcaaagtactgggattccaggtg

SEQ ID NO: 43408 - DNA, 30 bp, Homo sapiens
tgctgggggctgagcttggcactggagaca

SEQ ID NO: 43409 - DNA, 30 bp, Homo sapiens
agtaggagtgcagtggtttggcatagatcg

SEQ ID NO: 43410 - DNA, 30 bp, Homo sapiens
gagccgggttctagaccagtgggactcccg

SEQ ID NO: 43411 - DNA, 30 bp, Homo sapiens
agttggccaagaggaccgcatttccttgtt

SEQ ID NO: 43412 - DNA, 30 bp, Homo sapiens
gtgtggagtccttccccatgctccctggtc

SEQ ID NO: 43413 - DNA, 30 bp, Homo sapiens
caccggaggttaaagaccaggctgacggtg

SEQ ID NO: 43414 - DNA, 30 bp, Homo sapiens
ctccggtaggcacccacagtattgtcaaag

SEQ ID NO: 43415 - DNA, 30 bp, Homo sapiens
cacagagcccaggttacgtgacgtgtttgg

SEQ ID NO: 43416 - DNA, 30 bp, Homo sapiens
tctccttttgtactgagctcggttctcctc

SEQ ID NO: 43417 - DNA, 30 bp, Homo sapiens
acaacacgttggaaattaggtcctggtaca

SEQ ID NO: 43418 - DNA, 30 bp, Homo sapiens
cagtcagtcttgacatggccgttggccagg

SEQ ID NO: 43419 - DNA, 30 bp, Homo sapiens
gtctggaatgtcatcataggagtaaccacg

SEQ ID NO: 43420 - DNA, 30 bp, Homo sapiens
gtcaggtgatgacacctgtgttcctcttcc

SEQ ID NO: 43421 - DNA, 30 bp, Homo sapiens
taggataagtgctccttacacaagtctccc

SEQ ID NO: 43422 - DNA, 30 bp, Homo sapiens
aggaagttcatagggcttggtttgcttatg

SEQ ID NO: 43423 - DNA, 30 bp, Homo sapiens
gaagtgaactgcacaagaaatgccgatgat

SEQ ID NO: 43424 - DNA, 30 bp, Homo sapiens
caaagggtagactgttgcccctgggtctta

SEQ ID NO: 43425 - DNA, 30 bp, Homo sapiens
cccccacccctgcaaatcggaggggctctc

SEQ ID NO: 43426 - DNA, 30 bp, Homo sapiens
cactggcaaaagggtcgaccagcgggatgc

SEQ ID NO: 43427 - DNA, 30 bp, Homo sapiens
ttctggttaggtaattgaagtaaatgtaag

SEQ ID NO: 43428 - DNA, 30 bp, Homo sapiens
aagaggctttgatttctttctctttatcag

SEQ ID NO: 43429 - DNA, 30 bp, Homo sapiens
tcgctgcccgcgcccgccgccccgggcccg

SEQ ID NO: 43430 - DNA, 30 bp, Homo sapiens
attgatccaaatcctgagtgtcgcctgggt

SEQ ID NO: 43431 - DNA, 30 bp, Homo sapiens
cacaggtgccgcgggctggggtggccattg

SEQ ID NO: 43432 - DNA, 30 bp, Homo sapiens
tgagaaaaccagcaaggcctctccaagcgc

SEQ ID NO: 43433 - DNA, 30 bp, Homo sapiens
atttggatttcaatgtttcctcccactcaa

SEQ ID NO: 43434 - DNA, 30 bp, Homo sapiens
cttcccacatcatggaagtacaggtttgca

SEQ ID NO: 43435 - DNA, 30 bp, Homo sapiens
gcagcccaccaatgtgatgtcaaggggaat

SEQ ID NO: 43436 - DNA, 30 bp, Homo sapiens
caacctactgaagatttcagatcttcagaa

SEQ ID NO: 43437 - DNA, 30 bp, Homo sapiens
tagaggagactgggatgaaagttgtaccgg

SEQ ID NO: 43438 - DNA, 30 bp, Homo sapiens
aataggtagtgcttggcgaagagaaagaag

SEQ ID NO: 43439 - DNA, 30 bp, Homo sapiens
cgggacaaaattcaggattgctctgacgca

SEQ ID NO: 43440 - DNA, 30 bp, Homo sapiens
tccaggctggactgagaggagctgggcttg

SEQ ID NO: 43441 - DNA, 30 bp, Homo sapiens
acacagtcccgaggtgggggaggccctcag

SEQ ID NO: 43442 - DNA, 30 bp, Homo sapiens
aagcttccacactgttgaattatgtgcctg

SEQ ID NO: 43443 - DNA, 30 bp, Homo sapiens
ctcatcactgctcacgctggacactcgata

SEQ ID NO: 43444 - DNA, 30 bp, Homo sapiens
ctggtgaggaggccgccgggctccgggtcc

SEQ ID NO: 43445 - DNA, 30 bp, Homo sapiens
acacggccatgggcagtccaccatagtgct

SEQ ID NO: 43446 - DNA, 30 bp, Homo sapiens
caaatgcctggtggcgattgcaaataactg

SEQ ID NO: 43447 - DNA, 30 bp, Homo sapiens
cactcttggcctcgcctctgggcgtcctct

SEQ ID NO: 43448 - DNA, 30 bp, Homo sapiens
gggtggaaggagagcagcacgtgtctgttc

SEQ ID NO: 43449 - DNA, 30 bp, Homo sapiens
agatggtgagagacgctatcccaaagaaga

SEQ ID NO: 43450 - DNA, 30 bp, Homo sapiens
gccaggcaagccaatacccattgcacagga

SEQ ID NO: 43451 - DNA, 30 bp, Homo sapiens
acaaggactctcccacatgaatcagccagg

SEQ ID NO: 43452 - DNA, 30 bp, Homo sapiens
tagggactgtaaggtggtggcttttcaaaa

SEQ ID NO: 43453 - DNA, 30 bp, Homo sapiens
cgtaggggggtggcttctcccccgggggaa

SEQ ID NO: 43454 - DNA, 30 bp, Homo sapiens
ccaaggcaagccagcccaagagtagcaggg

SEQ ID NO: 43455 - DNA, 30 bp, Homo sapiens
cagagcagcaggaagaggactccaaagccc

SEQ ID NO: 43456 - DNA, 30 bp, Homo sapiens
ccgcttgctggtgctggtgtggcagcagat

SEQ ID NO: 43457 - DNA, 30 bp, Homo sapiens
ctccgagggcgcctccgttggggccatgga

SEQ ID NO: 43458 - DNA, 30 bp, Homo sapiens
gtgtggtgggagtcgtcggaggtgactggg

SEQ ID NO: 43459 - DNA, 30 bp, Homo sapiens
tctcagactttgcagttcttttcttaggtg

SEQ ID NO: 43460 - DNA, 30 bp, Homo sapiens
tagccctgttccgactccccaggcctcagt

SEQ ID NO: 43461 - DNA, 30 bp, Homo sapiens
cagtggtgctcctcccggtactcgatggcc

SEQ ID NO: 43462 - DNA, 30 bp, Homo sapiens
aagggcactttgtttacaacagcagaccca

SEQ ID NO: 43463 - DNA, 30 bp, Homo sapiens
gcctggaatatagtaagtaataaatagtag

SEQ ID NO: 43464 - DNA, 30 bp, Homo sapiens
ctcagggaccctgtgcagcttttgctcttt

SEQ ID NO: 43465 - DNA, 30 bp, Homo sapiens
acatcaatacgaactccatgttttgaagac

SEQ ID NO: 43466 - DNA, 30 bp, Homo sapiens
gccaggaacgggcagcaccctgtgcctagg

SEQ ID NO: 43467 - DNA, 30 bp, Homo sapiens
tgctgtggcgaaagacaggctgccttgccc

SEQ ID NO: 43468 - DNA, 30 bp, Homo sapiens
agagaggggtgagcctctcatcctctgtca

SEQ ID NO: 43469 - DNA, 30 bp, Homo sapiens
ctctgggagtttcttgctctggcaaaactg

SEQ ID NO: 43470 - DNA, 30 bp, Homo sapiens
catcggcagcaagtctccacctggagcaca

SEQ ID NO: 43471 - DNA, 30 bp, Homo sapiens
gactgggaatggctgacgagtcatggactg

SEQ ID NO: 43472 - DNA, 30 bp, Homo sapiens
agaaggaaggagatggatccaacagcgatg

SEQ ID NO: 43473 - DNA, 30 bp, Homo sapiens
cgtcgtcgtcctggtcctggtagcgaatgt

SEQ ID NO: 43474 - DNA, 30 bp, Homo sapiens
ggaaggaaaaacttgtagaagtagagggtg

SEQ ID NO: 43475 - DNA, 30 bp, Homo sapiens
taaaggcaatgctctggagacaaagtcttc

SEQ ID NO: 43476 - DNA, 30 bp, Homo sapiens
ctttgccctgaggggccttctcatataagg

SEQ ID NO: 43477 - DNA, 30 bp, Homo sapiens
tccaggattccttgaatgtacttagagtct

SEQ ID NO: 43478 - DNA, 30 bp, Homo sapiens
cccagggatgggtgatgctgttgatgtgaa

SEQ ID NO: 43479 - DNA, 30 bp, Homo sapiens
aatccgccttcttggccttcttcttcctgg

SEQ ID NO: 43480 - DNA, 30 bp, Homo sapiens
taccggctttgaggccaatgacccaacgcc

SEQ ID NO: 43481 - DNA, 30 bp, Homo sapiens
gttcataactgttgagtgggtaggagtatg

SEQ ID NO: 43482 - DNA, 30 bp, Homo sapiens
aaacggtggtccaggtctctctgggggcta

SEQ ID NO: 43483 - DNA, 30 bp, Homo sapiens
tcagtcttcctgaaccctgtcagcctaaac

SEQ ID NO: 43484 - DNA, 30 bp, Homo sapiens
catgtgtcttttctactgtgtatatgatta

SEQ ID NO: 43485 - DNA, 30 bp, Homo sapiens
ggctggcagaatagaaagaacagccaagat

SEQ ID NO: 43486 - DNA, 30 bp, Homo sapiens
gccttggcatcatccatatctctgggaacc

SEQ ID NO: 43487 - DNA, 30 bp, Homo sapiens
gtgtggaaggggcttccaggtgggtgggag

SEQ ID NO: 43488 - DNA, 30 bp, Homo sapiens
ttttggctggcacccgtgtccgagcaacaa

SEQ ID NO: 43489 - DNA, 30 bp, Homo sapiens
ttcagggtcccactccaggtcggagttgat

SEQ ID NO: 43490 - DNA, 30 bp, Homo sapiens
ctcaggtgtgctgtcctcacagagtcctgg

SEQ ID NO: 43491 - DNA, 30 bp, Homo sapiens
tctgaggagcagagcctcttaagtctagat

SEQ ID NO: 43492 - DNA, 30 bp, Homo sapiens
ctgagccactcaagagggcggtctggtaag

SEQ ID NO: 43493 - DNA, 30 bp, Homo sapiens
ttcaggcaataaaggatggcacccccaaac

SEQ ID NO: 43494 - DNA, 30 bp, Homo sapiens
ccatggacttgagtaactgcagaggagcac

SEQ ID NO: 43495 - DNA, 30 bp, Homo sapiens
gtcttcagtgcggccaaacttaaaaaccag

SEQ ID NO: 43496 - DNA, 30 bp, Homo sapiens
ctcttcggttcttccaaatttgtagatcag

SEQ ID NO: 43497 - DNA, 30 bp, Homo sapiens
agctgggaacatagtaccttgaggcagcct

SEQ ID NO: 43498 - DNA, 30 bp, Homo sapiens
agtcgggcggccgggtgtcgggggccttct

SEQ ID NO: 43499 - DNA, 30 bp, Homo sapiens
caaggggcaccagggctacaaggtggtagt

SEQ ID NO: 43500 - DNA, 30 bp, Homo sapiens
gtcaactattcgagtcgactccttctctgt

SEQ ID NO: 43501 - DNA, 30 bp, Homo sapiens
cagcggacgcagttgcgcatgaagtcgaca

SEQ ID NO: 43502 - DNA, 30 bp, Homo sapiens
cagagggtcagaggctcagagctggtgcag

SEQ ID NO: 43503 - DNA, 30 bp, Homo sapiens
gacattcatcacatccaaaacaacacaact

SEQ ID NO: 43504 - DNA, 30 bp, Homo sapiens
gcttttgtgtgaattctgaacacggtccca

SEQ ID NO: 43505 - DNA, 30 bp, Homo sapiens
tttcttcaggggctggtaaacagaggcatt

SEQ ID NO: 43506 - DNA, 30 bp, Homo sapiens
tgtaggtagaggccctgcttcttcatgatc

SEQ ID NO: 43507 - DNA, 30 bp, Homo sapiens
aagcaggctagtttgaaaggcagtattgtt

SEQ ID NO: 43508 - DNA, 30 bp, Homo sapiens
gcttggtcaggtccagcttcagcttgtagg

SEQ ID NO: 43509 - DNA, 30 bp, Homo sapiens
tctgttaaagccccagccagcaaggcccat

SEQ ID NO: 43510 - DNA, 30 bp, Homo sapiens
acttcctccccgtgcagtctgaaccaggcc

SEQ ID NO: 43511 - DNA, 30 bp, Homo sapiens
ggagctcaggtggctttttaactgcaccat

SEQ ID NO: 43512 - DNA, 30 bp, Homo sapiens
gcctcctggggggcagcagccacactgccc

SEQ ID NO: 43513 - DNA, 30 bp, Homo sapiens
tactggtgaatctcattctctatgaggctg

SEQ ID NO: 43514 - DNA, 30 bp, Homo sapiens
cagtggtactggttctggccctccagttcc

SEQ ID NO: 43515 - DNA, 30 bp, Homo sapiens
ccagaaaatgttagggtcctcttgttgtag

SEQ ID NO: 43516 - DNA, 30 bp, Homo sapiens
tttcatcttcttcacctcctccaaagaaaa

SEQ ID NO: 43517 - DNA, 30 bp, Homo sapiens
atgttttggatgccaaattcttttgtccta

SEQ ID NO: 43518 - DNA, 30 bp, Homo sapiens
tcctggtattctttggtgcttatcaatcaa

SEQ ID NO: 43519 - DNA, 30 bp, Homo sapiens
agtgatctaaatccttctcgaatattttgt

SEQ ID NO: 43520 - DNA, 30 bp, Homo sapiens
cagcacacatgaatggcaacacaaaggtga

SEQ ID NO: 43521 - DNA, 30 bp, Homo sapiens
ctcttatgtcctttttctggaaaactactt

SEQ ID NO: 43522 - DNA, 30 bp, Homo sapiens
ctcttcactggtttcttccatatacaaaat

SEQ ID NO: 43523 - DNA, 30 bp, Homo sapiens
agatggcgtatttaagaatcgaacatatcc

SEQ ID NO: 43524 - DNA, 30 bp, Homo sapiens
acaggcagtggttttgaaatagctggcaag

SEQ ID NO: 43525 - DNA, 30 bp, Homo sapiens
aacaggccggtggctgtaagagatgacagg

SEQ ID NO: 43526 - DNA, 30 bp, Homo sapiens
ccaaggacagttccagagtgttttcattcg

SEQ ID NO: 43527 - DNA, 30 bp, Homo sapiens
ctctggagggtgtggctagtctctgagacc

SEQ ID NO: 43528 - DNA, 30 bp, Homo sapiens
cccaggggcggggcctgtagtcggaggccg

SEQ ID NO: 43529 - DNA, 30 bp, Homo sapiens
acctggtgaaggccgcgatggcaaccacct

SEQ ID NO: 43530 - DNA, 30 bp, Homo sapiens
gtccactcttgcaccgggcctgcctgcctg

SEQ ID NO: 43531 - DNA, 30 bp, Homo sapiens
accatgaaggcaacaggtctccagcttcag

SEQ ID NO: 43532 - DNA, 30 bp, Homo sapiens
tgcaggcccccccttagcgcacagaggaca

SEQ ID NO: 43533 - DNA, 30 bp, Homo sapiens
aagagggggccgaactctgggactggggtg

SEQ ID NO: 43534 - DNA, 30 bp, Homo sapiens
agttggccttggtcagtctgtagtgttcca

SEQ ID NO: 43535 - DNA, 30 bp, Homo sapiens
cagtcagtcttgggcaccgggctcctgagg

SEQ ID NO: 43536 - DNA, 30 bp, Homo sapiens
tccattttggacctttcaaagtgtgtgatc

SEQ ID NO: 43537 - DNA, 30 bp, Homo sapiens
gtttttctcctaaaagaggcagtcgatgca

SEQ ID NO: 43538 - DNA, 30 bp, Homo sapiens
cagatctggtcatgatttcctcatctgaat

SEQ ID NO: 43539 - DNA, 30 bp, Homo sapiens
tagatgttcaggattgagatgtgggtcgtg

SEQ ID NO: 43540 - DNA, 30 bp, Homo sapiens
cctttcctgatgtgggaacggcctgggacc

SEQ ID NO: 43541 - DNA, 30 bp, Homo sapiens
cgcagagttgctcgtcctcgtcggggcgcc

SEQ ID NO: 43542 - DNA, 30 bp, Homo sapiens
ctctgggtggaagtcccctttatttggatt

SEQ ID NO: 43543 - DNA, 30 bp, Homo sapiens
gatcgttcttgcagatctgatagtggcagg

SEQ ID NO: 43544 - DNA, 30 bp, Homo sapiens
cagctggcacagatgctgctgacagtggcc

SEQ ID NO: 43545 - DNA, 30 bp, Homo sapiens
tgaaggcacagacattcccaaaccctcgga

SEQ ID NO: 43546 - DNA, 30 bp, Homo sapiens
tagctgagcatcttgtgccgatcgaagact

SEQ ID NO: 43547 - DNA, 30 bp, Homo sapiens
ggttcacagtgagggctgtaggggcaacta

SEQ ID NO: 43548 - DNA, 30 bp, Homo sapiens
gcagatacgtagcacctactataggtcagg

SEQ ID NO: 43549 - DNA, 30 bp, Homo sapiens
gtgagggctgtaggggcaacttctgggcta

SEQ ID NO: 43550 - DNA, 30 bp, Homo sapiens
gggcgggtctcgggaggcaaggtaggcagc

SEQ ID NO: 43551 - DNA, 30 bp, Homo sapiens
agaaggccgggttgtcaatgcccctctgat

SEQ ID NO: 43552 - DNA, 30 bp, Homo sapiens
agaagggagagttcatgcccagcttagttt

SEQ ID NO: 43553 - DNA, 30 bp, Homo sapiens
tttgcttggaggtggtgggactccaccagg

SEQ ID NO: 43554 - DNA, 30 bp, Homo sapiens
taaggggctgactggttcccctccaaggga

SEQ ID NO: 43555 - DNA, 30 bp, Homo sapiens
aacctagcccacacccctttgcccaccctc

SEQ ID NO: 43556 - DNA, 30 bp, Homo sapiens
tgcaggaagccttcagggcctgggaggcct

SEQ ID NO: 43557 - DNA, 30 bp, Homo sapiens
gttgaggtaaacgtagaaaacaaacagccc

SEQ ID NO: 43558 - DNA, 30 bp, Homo sapiens
tagctgaggacaacatgccggtcaaagaca

SEQ ID NO: 43559 - DNA, 30 bp, Homo sapiens
ctgctttttctccatacatctgcagaatag

SEQ ID NO: 43560 - DNA, 30 bp, Homo sapiens
tcttctcatcctcctctactttgatggcca

SEQ ID NO: 43561 - DNA, 30 bp, Homo sapiens
tctccgttttcagagatgactttgcaatac

SEQ ID NO: 43562 - DNA, 30 bp, Homo sapiens
cacaatgtcagaaagatcacaacacatgca

SEQ ID NO: 43563 - DNA, 30 bp, Homo sapiens
ccactttggggaacccttttggcctcggct

SEQ ID NO: 43564 - DNA, 30 bp, Homo sapiens
gggtggggtcctgttgaggtctcctgggat

SEQ ID NO: 43565 - DNA, 30 bp, Homo sapiens
agtaggagccatttcctttggagtcaggac

SEQ ID NO: 43566 - DNA, 30 bp, Homo sapiens
tgttcaatacttgtcccagagacgaagtga

SEQ ID NO: 43567 - DNA, 30 bp, Homo sapiens
gccccaagaggcgagcagtgtttaatacat

SEQ ID NO: 43568 - DNA, 30 bp, Homo sapiens
ctccggcacttgggaatgatgggcccagtc

SEQ ID NO: 43569 - DNA, 30 bp, Homo sapiens
cttcggtctgcttcaactctcttcttacga

SEQ ID NO: 43570 - DNA, 30 bp, Homo sapiens
tactggtgatctccttcaactcgtctctta

SEQ ID NO: 43571 - DNA, 30 bp, Homo sapiens
tgctggcgacgtagttcattgtttcgggtc

SEQ ID NO: 43572 - DNA, 30 bp, Homo sapiens
aataatgttccacctttaaagggagtggaa

SEQ ID NO: 43573 - DNA, 30 bp, Homo sapiens
agttggattttctagggtcaacatgaagaa

SEQ ID NO: 43574 - DNA, 30 bp, Homo sapiens
cagggagaccgctgcaggatgagctctgtg

SEQ ID NO: 43575 - DNA, 30 bp, Homo sapiens
tttgaagcaatccagtttcggtaataagtc

SEQ ID NO: 43576 - DNA, 30 bp, Homo sapiens
tcttggatgtaatccaattgcgataagaag

SEQ ID NO: 43577 - DNA, 30 bp, Homo sapiens
ttgttgcctaatccagtcaaggtaggctgt

SEQ ID NO: 43578 - DNA, 30 bp, Homo sapiens
ccgcaaggccgtaactctagtataaacacc

SEQ ID NO: 43579 - DNA, 30 bp, Homo sapiens
tacataccagtctttgaggcaatccaatct

SEQ ID NO: 43580 - DNA, 30 bp, Homo sapiens
atctggccacgtaaaatatttatagtaagt

SEQ ID NO: 43581 - DNA, 30 bp, Homo sapiens
tgctgtaaatccagggaagaacttctgtca

SEQ ID NO: 43582 - DNA, 30 bp, Homo sapiens
ggcttcagtttccctaattataaaacagaa

SEQ ID NO: 43583 - DNA, 30 bp, Homo sapiens
ggtaaaccttgagaccctggcatacactcc

SEQ ID NO: 43584 - DNA, 30 bp, Homo sapiens
ttgtcgataaatccagtccgtgaataccat

SEQ ID NO: 43585 - DNA, 30 bp, Homo sapiens
caggtttttaggtctctctccatctgctcg

SEQ ID NO: 43586 - DNA, 30 bp, Homo sapiens
gaaacaaaggaagagctgcagaaccacata

SEQ ID NO: 43587 - DNA, 30 bp, Homo sapiens
agacattgtagatccagttgagataggctg

SEQ ID NO: 43588 - DNA, 30 bp, Homo sapiens
cagaggagggagtcctgagcagtgtcatgg

SEQ ID NO: 43589 - DNA, 30 bp, Homo sapiens
gtcaccacttgctggatccagctgatcaca

SEQ ID NO: 43590 - DNA, 30 bp, Homo sapiens
tccagggaacaaagtttgacacccttgtgt

SEQ ID NO: 43591 - DNA, 30 bp, Homo sapiens
tcctggatgtgctgtcctatccagcctctc

SEQ ID NO: 43592 - DNA, 30 bp, Homo sapiens
gcaaaccggagaatttggcagtccgattgg

SEQ ID NO: 43593 - DNA, 30 bp, Homo sapiens
tgctggatagtttcctttgagggaagagta

SEQ ID NO: 43594 - DNA, 30 bp, Homo sapiens
agcaggcgccgccccagccctctctgattg

SEQ ID NO: 43595 - DNA, 30 bp, Homo sapiens
gcttggtgatgtgcctgaggtcccagctac

SEQ ID NO: 43596 - DNA, 30 bp, Homo sapiens; identical to SEQ ID NO: 43593

SEQ ID NO: 43597 - DNA, 30 bp, Homo sapiens
ccacttcttccaccccacttcttccttcac

SEQ ID NO: 43598 - DNA, 30 bp, Homo sapiens
accaggtttgtcagacatggctgcggagga

SEQ ID NO: 43599 - DNA, 30 bp, Homo sapiens
atttggcaagattttccttcagcagtttgc

SEQ ID NO: 43600 - DNA, 30 bp, Homo sapiens
ttttccatgatgttccacagtttgcggaga

SEQ ID NO: 43601 - DNA, 30 bp, Homo sapiens
acaagggggagggaaaaggacagagaggca

SEQ ID NO: 43602 - DNA, 30 bp, Homo sapiens
acacttgaaatcttactggttgggaatatt

SEQ ID NO: 43603 - DNA, 30 bp, Homo sapiens
ttctccttagttcctgatgccgtggggtca

SEQ ID NO: 43604 - DNA, 30 bp, Homo sapiens
tacgggcggtacatggcaaaggccaggaga

SEQ ID NO: 43605 - DNA, 30 bp, Homo sapiens
aatagccccagaagcaagagcctagggccc

SEQ ID NO: 43606 - DNA, 30 bp, Homo sapiens
cgtccatacatcccaaatactaggaagctg

SEQ ID NO: 43607 - DNA, 30 bp, Homo sapiens
tgatggacccagagagcgttgtcttatggc

SEQ ID NO: 43608 - DNA, 30 bp, Homo sapiens
ctgtggccgccgcattgcctccttgccacc

SEQ ID NO: 43609 - DNA, 30 bp, Homo sapiens
tgttttccccatctgacactgtggtggggg

SEQ ID NO: 43610 - DNA, 30 bp, Homo sapiens
gaaccacttcttctgaggcagaaaagaagt

SEQ ID NO: 43611 - DNA, 30 bp, Homo sapiens
gctcctgcactgtaggcactacagatcctc

SEQ ID NO: 43612 - DNA, 30 bp, Homo sapiens
agctggcatctcttttagtgtcacatactc

SEQ ID NO: 43613 - DNA, 30 bp, Homo sapiens
tcagcatgctgacttttacgctgcctcaag

SEQ ID NO: 43614 - DNA, 30 bp, Homo sapiens
tgcgcctgccttcaagatttctgaagttgc

SEQ ID NO: 43615 - DNA, 30 bp, Homo sapiens
cacagggcaatgatcccaaagtagacctgc

SEQ ID NO: 43616 - DNA, 30 bp, Homo sapiens
cgatgggtagactggtggccgagctgccgg

SEQ ID NO: 43617 - DNA, 30 bp, Homo sapiens
taagggaaaataggggccgggagggctcct

SEQ ID NO: 43618 - DNA, 30 bp, Homo sapiens
agccatacatctgcttgaactgaaagcatt

SEQ ID NO: 43619 - DNA, 30 bp, Homo sapiens
ctggatttggatacaggatccattgcaaca

SEQ ID NO: 43620 - DNA, 30 bp, Homo sapiens
aaaaggattatacaaggcagccaaaaattc

SEQ ID NO: 43621 - DNA, 30 bp, Homo sapiens
cagaggctgccctcgtccagcatccggccc

SEQ ID NO: 43622 - DNA, 30 bp, Homo sapiens
gtctagcagcttcctgagtccgtcacagat

SEQ ID NO: 43623 - DNA, 30 bp, Homo sapiens
taaaggactttctcatctagcaacttattg

SEQ ID NO: 43624 - DNA, 30 bp, Homo sapiens
ccaaggacacggcagagcctgtgccatctt

SEQ ID NO: 43625 - DNA, 30 bp, Homo sapiens
acatggcagagtctgcattaccttctagat

SEQ ID NO: 43626 - DNA, 30 bp, Homo sapiens
cgatggtgcatgagaggtaatgagaagagg

SEQ ID NO: 43627 - DNA, 30 bp, Homo sapiens
cacaggcaggacgtagcagagcctgcctca

SEQ ID NO: 43628 - DNA, 30 bp, Homo sapiens
ccttggccccgccttgctcctgcaccggcc

SEQ ID NO: 43629 - DNA, 30 bp, Homo sapiens
ctccacttaggcggccacaagcctcattga

SEQ ID NO: 43630 - DNA, 30 bp, Homo sapiens
tgaaggaacctgatggtcttctttagactc

SEQ ID NO: 43631 - DNA, 30 bp, Homo sapiens
cactggatcagcgccacagctgggcagccc

SEQ ID NO: 43632 - DNA, 30 bp, Homo sapiens
tatgcacctgggcccccctcctgggcaggc

SEQ ID NO: 43633 - DNA, 30 bp, Homo sapiens
tattgttgctcagggccggccgtcttggtg

SEQ ID NO: 43634 - DNA, 30 bp, Homo sapiens
cagtggtttgggctcctccccgtgaatgag

SEQ ID NO: 43635 - DNA, 30 bp, Homo sapiens
tccagggtcccattgggagagaaggtcccc

SEQ ID NO: 43636 - DNA, 30 bp, Homo sapiens
cactcaaagcagctggcaggctcttgcaat

SEQ ID NO: 43637 - DNA, 30 bp, Homo sapiens
cacaggtctcccagccgccccttctcctct

SEQ ID NO: 43638 - DNA, 30 bp, Homo sapiens
taagaccccaccccatcagggccagcaagg

SEQ ID NO: 43639 - DNA, 30 bp, Homo sapiens
gggacgtctgagtggctgggtggatgacag

SEQ ID NO: 43640 - DNA, 30 bp, Homo sapiens
cacagggaacccagtcgctgccttacctgg

SEQ ID NO: 43641 - DNA, 30 bp, Homo sapiens
ctgagaagactgggcgcgggcgggagggcg

SEQ ID NO: 43642 - DNA, 30 bp, Homo sapiens
taactgggcttcatcccagcatcaggcact

SEQ ID NO: 43643 - DNA, 30 bp, Homo sapiens
agcaggtcaggaagatggctataaacagag

SEQ ID NO: 43644 - DNA, 30 bp, Homo sapiens
acgtggggcaggacacgcagccatcgccat

SEQ ID NO: 43645 - DNA, 30 bp, Homo sapiens
cacgggccgcgctgcaggcggctgcgcaag

SEQ ID NO: 43646 - DNA, 30 bp, Homo sapiens
cagatcttggccagggtggagtgggcgtcg

SEQ ID NO: 43647 - DNA, 30 bp, Homo sapiens
cacagggaggaagcgctcacggacgctccg

SEQ ID NO: 43648 - DNA, 30 bp, Homo sapiens
tttccagaggcagctgtgggcaaggggtct

SEQ ID NO: 43649 - DNA, 30 bp, Homo sapiens
cacagttcacatcctccttcttcttcttct

SEQ ID NO: 43650 - DNA, 30 bp, Homo sapiens
ttgcggcccagagccttttcattcttggag

SEQ ID NO: 43651 - DNA, 30 bp, Homo sapiens
agatggcagcaatgaccctgtctgctgccc

SEQ ID NO: 43652 - DNA, 30 bp, Homo sapiens
aaaaaggccccaaaaaaactggcttcatgg

SEQ ID NO: 43653 - DNA, 30 bp, Homo sapiens
agtatgttgcatcctgatccggatccagta

SEQ ID NO: 43654 - DNA, 30 bp, Homo sapiens
agtgaacctggaagagtccgaagtaggtga

SEQ ID NO: 43655 - DNA, 30 bp, Homo sapiens
aaggttccatgtggagagaggttaagtttc

SEQ ID NO: 43656 - DNA, 30 bp, Homo sapiens
cccaggaaggttccatgtggagagaggtta

SEQ ID NO: 43657 - DNA, 30 bp, Homo sapiens
agtgatatttgtgcattttctcttggtatt

SEQ ID NO: 43658 - DNA, 30 bp, Homo sapiens
caccatgaaagccccgaagtaagaccgggt

SEQ ID NO: 43659 - DNA, 30 bp, Homo sapiens
atagtaagaaggctccaaagaaggttttat

SEQ ID NO: 43660 - DNA, 30 bp, Homo sapiens
aattggggatttgctagtaaaatgataccc

SEQ ID NO: 43661 - DNA, 30 bp, Homo sapiens
caaaggacacagaattcaccaggattttga

SEQ ID NO: 43662 - DNA, 30 bp, Homo sapiens
aagaggaaaggtgcttgtatctatgtactg

SEQ ID NO: 43663 - DNA, 30 bp, Homo sapiens
tcaaggcagcagtgtcccttcccagagtcc

SEQ ID NO: 43664 - DNA, 30 bp, Homo sapiens
cctcggtgaagggagtccggctgggatttc

SEQ ID NO: 43665 - DNA, 30 bp, Homo sapiens
catcatggaatttctgttgagggtcatgaa

SEQ ID NO: 43666 - DNA, 30 bp, Homo sapiens
acttgggagctctgatttggatttcgaacc

SEQ ID NO: 43667 - DNA, 30 bp, Homo sapiens
agctggctctgcaagatgaaggtggagcca

SEQ ID NO: 43668 - DNA, 30 bp, Homo sapiens
ctgaggcccctcacggtcattttttggaga

SEQ ID NO: 43669 - DNA, 30 bp, Homo sapiens
tcttggcaatctgagatcagctggctctgg

SEQ ID NO: 43670 - DNA, 30 bp, Homo sapiens
cactggcagcactcagccacatgcctgagg

SEQ ID NO: 43671 - DNA, 30 bp, Homo sapiens
ctgaggataaactgggtgctcccgttgctt

SEQ ID NO: 43672 - DNA, 30 bp, Homo sapiens
ggatggactttctttactgaggataaacca

SEQ ID NO: 43673 - DNA, 30 bp, Homo sapiens
gcctggccaggacatagcggctggcagctg

SEQ ID NO: 43674 - DNA, 30 bp, Homo sapiens
cccaggagcccagaaggtggcagccggcct

SEQ ID NO: 43675 - DNA, 30 bp, Homo sapiens
ctgcggctgttgcggtctgggaaggggctt

SEQ ID NO: 43676 - DNA, 30 bp, Homo sapiens
tcttcttcagtttcagggcttgaagccagt

SEQ ID NO: 43677 - DNA, 30 bp, Homo sapiens
accataccttcaggcctcataatctggtaa

SEQ ID NO: 43678 - DNA, 30 bp, Homo sapiens
agaccctccccagcatgcgggccacccacc

SEQ ID NO: 43679 - DNA, 30 bp, Homo sapiens
gaacgttcgcagccttcctctcagcgtccg

SEQ ID NO: 43680 - DNA, 30 bp, Homo sapiens
ccttcatgaactccaggaactcatcatagt

SEQ ID NO: 43681 - DNA, 30 bp, Homo sapiens
tgcacgccctccatcatcttcaggaactcg

SEQ ID NO: 43682 - DNA, 30 bp, Homo sapiens
ttgtgaggtcggagacttggcggcatcaaa

SEQ ID NO: 43683 - DNA, 30 bp, Homo sapiens
actcggactcaaacatcttcttccggccct

SEQ ID NO: 43684 - DNA, 30 bp, Homo sapiens
ttgcggccctccattccactcagtgcatcg

SEQ ID NO: 43685 - DNA, 30 bp, Homo sapiens
agctgctactatttcggcaagaatgaaaat

SEQ ID NO: 43686 - DNA, 30 bp, Homo sapiens
ttccagcggcctccaacgcggcccttccct

SEQ ID NO: 43687 - DNA, 30 bp, Homo sapiens
gcccggtgactttagccttcccgcgggtct

SEQ ID NO: 43688 - DNA, 30 bp, Homo sapiens
tacttccagcgcccgccgactttgcccttg

SEQ ID NO: 43689 - DNA, 30 bp, Homo sapiens
ttcgtcacaactggcatttgatccacattc

SEQ ID NO: 43690 - DNA, 30 bp, Homo sapiens
agttggatttccatcctgagctccgcgtct

SEQ ID NO: 43691 - DNA, 30 bp, Homo sapiens
aaagctgcaagacgctcttttaagggaaga

SEQ ID NO: 43692 - DNA, 30 bp, Homo sapiens
ccccatagaaagccgccagcctctccttga

SEQ ID NO: 43693 - DNA, 30 bp, Homo sapiens
acctggtgaagtctcgcaaggcccagcaaa

SEQ ID NO: 43694 - DNA, 30 bp, Homo sapiens
gtaaggactgccgttttctccctgccatga

SEQ ID NO: 43695 - DNA, 30 bp, Homo sapiens
gcacgggcacgccgtccgtggagaagatca

SEQ ID NO: 43696 - DNA, 30 bp, Homo sapiens
acatggactctccacccccacccaggtggt

SEQ ID NO: 43697 - DNA, 30 bp, Homo sapiens
ctcctcccagaaggtcaccaggtagtaaag

SEQ ID NO: 43698 - DNA, 30 bp, Homo sapiens
tacagggactccccgctgagcaggtcccca

SEQ ID NO: 43699 - DNA, 30 bp, Homo sapiens
ttttggccggcattcagcatgaccttggag

SEQ ID NO: 43700 - DNA, 30 bp, Homo sapiens
ttttctctggcccagtagaactttggtgat

SEQ ID NO: 43701 - DNA, 30 bp, Homo sapiens
ctttggggaaccaatcatgacctttgatac

SEQ ID NO: 43702 - DNA, 30 bp, Homo sapiens
catcctttctgcgtcctgcagcagagcagt

SEQ ID NO: 43703 - DNA, 30 bp, Homo sapiens
cccgctggggagcgaaagtttcttggtctc

SEQ ID NO: 43704 - DNA, 30 bp, Homo sapiens
caggctggaattgctggttagaatactgca

SEQ ID NO: 43705 - DNA, 30 bp, Homo sapiens
agttggccagcaccacgggctggaactgct

SEQ ID NO: 43706 - DNA, 30 bp, Homo sapiens
gtgagcttcatcttctgattgtgggctttg

SEQ ID NO: 43707 - DNA, 30 bp, Homo sapiens
ttaacagattctgacccatctgtgcaaaga

SEQ ID NO: 43708 - DNA, 30 bp, Homo sapiens
gaaaagggtatgagctgccagttgtcttgc

SEQ ID NO: 43709 - DNA, 30 bp, Homo sapiens
gaatggaatcggaaggcgctccaccacctc

SEQ ID NO: 43710 - DNA, 30 bp, Homo sapiens
ccatctgcagcagggagttgatggcggcat

SEQ ID NO: 43711 - DNA, 30 bp, Homo sapiens
ataaggcaaacagcatgtcatcatctttct

SEQ ID NO: 43712 - DNA, 30 bp, Homo sapiens
ttttgagctcctttgtgctggtgagcatca

SEQ ID NO: 43713 - DNA, 30 bp, Homo sapiens
gagtggccctaggcatccggggactgggac

SEQ ID NO: 43714 - DNA, 30 bp, Homo sapiens
cacagggcgaagagggcatcctctgaccgc

SEQ ID NO: 43715 - DNA, 30 bp, Homo sapiens
catcttcagccaagctctgagcacttacaa

SEQ ID NO: 43716 - DNA, 30 bp, Homo sapiens
agcagtcctgttcattcatgtctgcctcaa

SEQ ID NO: 43717 - DNA, 30 bp, Homo sapiens
agtgagggtagagcccctggcattcctcct

SEQ ID NO: 43718 - DNA, 30 bp, Homo sapiens
tgtaggttctgcttcacttcctgccgcaac

SEQ ID NO: 43719 - DNA, 30 bp, Homo sapiens
cgatggtgaggccaaagccacactgaaact

SEQ ID NO: 43720 - DNA, 30 bp, Homo sapiens
cccacagtgatgctgaagccacaatggaat

SEQ ID NO: 43721 - DNA, 30 bp, Homo sapiens
agatgagaaagttccgtatggaggagatca

SEQ ID NO: 43722 - DNA, 30 bp, Homo sapiens
atatgcccgtcgccttcaacgcgcaccctc

SEQ ID NO: 43723 - DNA, 30 bp, Homo sapiens
tgaccccttagagttaaggggtgcccgtcg

SEQ ID NO: 43724 - DNA, 30 bp, Homo sapiens
gctgaggtgccatgaggtcaatgtcactca

SEQ ID NO: 43725 - DNA, 30 bp, Homo sapiens
tccccaaagtaggctcaaaacagttggttc

SEQ ID NO: 43726 - DNA, 30 bp, Homo sapiens
tgttggtggttttaatccgtatttctttgc

SEQ ID NO: 43727 - DNA, 30 bp, Homo sapiens
cagaggcgccgaaagaagagcttggagccg

SEQ ID NO: 43728 - DNA, 30 bp, Homo sapiens
caatggcccaggcaaacttctcccgctggg

SEQ ID NO: 43729 - DNA, 30 bp, Homo sapiens
ccatggcgagagcccaggcgaacctctccc

SEQ ID NO: 43730 - DNA, 30 bp, Homo sapiens
tccaggtactttataggtttctttgcccgt

SEQ ID NO: 43731 - DNA, 30 bp, Homo sapiens
ccgaccggttcgtggcagagaaggtggctc

SEQ ID NO: 43732 - DNA, 30 bp, Homo sapiens
ctgaggacaaaagggacgggtgtgtccagg

SEQ ID NO: 43733 - DNA, 30 bp, Homo sapiens
agtaggcggccagggctgacatcttgtcct

SEQ ID NO: 43734 - DNA, 30 bp, Homo sapiens
agagtccagcctggtgcaaggcaggggttg

SEQ ID NO: 43735 - DNA, 30 bp, Homo sapiens
ctttccagcccacttcatattctcttttaa

SEQ ID NO: 43736 - DNA, 30 bp, Homo sapiens
tctaggtcgtttgattttatttttttctgt

SEQ ID NO: 43737 - DNA, 30 bp, Homo sapiens
ccgtggcgatggcaattgccttgatggctc

SEQ ID NO: 43738 - DNA, 30 bp, Homo sapiens
tgcagcctttatctgagaaaactctctcct

SEQ ID NO: 43739 - DNA, 30 bp, Homo sapiens
ttcagggcattttcaggttgcacaggcaga

SEQ ID NO: 43740 - DNA, 30 bp, Homo sapiens
aaaaggcacccctgttcttctatgctactc

SEQ ID NO: 43741 - DNA, 30 bp, Homo sapiens
ttaaggttttatctgttctggtcaagatta

SEQ ID NO: 43742 - DNA, 30 bp, Homo sapiens
atgagggaagtgcagagtcgatacaaacag

SEQ ID NO: 43743 - DNA, 30 bp, Homo sapiens
cagtggaaatccagccgcgactgcacagtc

SEQ ID NO: 43744 - DNA, 30 bp, Homo sapiens
ttgcggtaagacactccgtcaacctgctcg

SEQ ID NO: 43745 - DNA, 30 bp, Homo sapiens
cagaggaagaaggcgattcgggaggccacg

SEQ ID NO: 43746 - DNA, 30 bp, Homo sapiens
cccttggctccaggcccagctgggccagct

SEQ ID NO: 43747 - DNA, 30 bp, Homo sapiens
accaggcggaatgacaatgtcatctctgag

SEQ ID NO: 43748 - DNA, 30 bp, Homo sapiens
tgacaggaagtagttaatcctctgggaaat

SEQ ID NO: 43749 - DNA, 30 bp, Homo sapiens
tacaggaggttcaccgtggccaccacctgc

SEQ ID NO: 43750 - DNA, 30 bp, Homo sapiens
gtaaggtacagtgctttgtccctctgcatg

SEQ ID NO: 43751 - DNA, 30 bp, Homo sapiens
gtgaggtagagcgatttgtccctggggagc

SEQ ID NO: 43752 - DNA, 30 bp, Homo sapiens
ataatacttgagtctgtgtctgagactgta

SEQ ID NO: 43753 - DNA, 30 bp, Homo sapiens
cccaggccaagaatacatccctgcagtgct

SEQ ID NO: 43754 - DNA, 30 bp, Homo sapiens
atcaggaagtaacaccatcgtaagtcaagt

SEQ ID NO: 43755 - DNA, 30 bp, Homo sapiens
gtcaggcccttctgtcttgaacatgagttt

SEQ ID NO: 43756 - DNA, 30 bp, Homo sapiens
gtctggtcctgaagggtgaaatattctcca

SEQ ID NO: 43757 - DNA, 30 bp, Homo sapiens
agttgctgaggaccaagatccagacgagac

SEQ ID NO: 43758 - DNA, 30 bp, Homo sapiens
tctgtccaatgctctgaactggggacagtc

SEQ ID NO: 43759 - DNA, 30 bp, Homo sapiens
caacggtgcttttttctgatcatagctgag

SEQ ID NO: 43760 - DNA, 30 bp, Homo sapiens
ctctccccaacaatgaggcactggatcacc

SEQ ID NO: 43761 - DNA, 30 bp, Homo sapiens
tcctttgtcttggtttaattcttgggtaca

SEQ ID NO: 43762 - DNA, 30 bp, Homo sapiens
tcttgggtcttcggccgacttggtaatagt

SEQ ID NO: 43763 - DNA, 30 bp, Homo sapiens
tctcggaggcagccccagagcctgacagat

SEQ ID NO: 43764 - DNA, 30 bp, Homo sapiens
gccaggagaggggcccttcctcagggtcca

SEQ ID NO: 43765 - DNA, 30 bp, Homo sapiens
ctccgagctctcgccttccgggccgctgtc

SEQ ID NO: 43766 - DNA, 30 bp, Homo sapiens
cactggggcagttccaggacgatcttgcct

SEQ ID NO: 43767 - DNA, 30 bp, Homo sapiens
tatgggcctcctggatttcggtcactgggt

SEQ ID NO: 43768 - DNA, 30 bp, Homo sapiens
cgcgggcagggctgatgaacaacccagcca

SEQ ID NO: 43769 - DNA, 30 bp, Homo sapiens
tcctggccctgggactacttgggctatgta

SEQ ID NO: 43770 - DNA, 30 bp, Homo sapiens
aactggcgctggcacggctggtagatgaag

SEQ ID NO: 43771 - DNA, 30 bp, Homo sapiens
ccatggacctctttcttcctctcaggcgca

SEQ ID NO: 43772 - DNA, 30 bp, Homo sapiens
cgcggaggcagtgagaggccaccggccctt

SEQ ID NO: 43773 - DNA, 30 bp, Homo sapiens
attcctccccttcagctgatggcgcgatct

SEQ ID NO: 43774 - DNA, 30 bp, Homo sapiens
ccatcaggaatggttgtaggagtgagggcg

SEQ ID NO: 43775 - DNA, 30 bp, Homo sapiens
cctctttgatgcgctgttgcttattgcggc

SEQ ID NO: 43776 - DNA, 30 bp, Homo sapiens
tatgggtacactgatcggtttgggggcttg

SEQ ID NO: 43777 - DNA, 30 bp, Homo sapiens
aatgctgcaatctgtgggatacggaggtgg

SEQ ID NO: 43778 - DNA, 30 bp, Homo sapiens
cagtggatctcggcctccgtgaactcctcc

SEQ ID NO: 43779 - DNA, 30 bp, Homo sapiens
tggtcaggttctgcaggtggtaaatgctct

SEQ ID NO: 43780 - DNA, 30 bp, Homo sapiens
cccaggtcctgacgaggctggggtcggcgt

SEQ ID NO: 43781 - DNA, 30 bp, Homo sapiens
tagaactgaggttcgttaatctggggtccg

SEQ ID NO: 43782 - DNA, 30 bp, Homo sapiens
agagccccgagcccggggaggtggcgcggg

SEQ ID NO: 43783 - DNA, 30 bp, Homo sapiens
taacggtctgggagcgctggcggctgcctg

SEQ ID NO: 43784 - DNA, 30 bp, Homo sapiens
cagccacaggtgcgggtgctggctcagcct

SEQ ID NO: 43785 - DNA, 30 bp, Homo sapiens
cacaggctctcctgtgtcttttctggaaga

SEQ ID NO: 43786 - DNA, 30 bp, Homo sapiens
ttttggtgatgactgagccaacagacgaaa

SEQ ID NO: 43787 - DNA, 30 bp, Homo sapiens
ttcttgctgatggccgttccaacgttgctg

SEQ ID NO: 43788 - DNA, 30 bp, Homo sapiens
ccttggtccgccgggagcctcctgccaagc

SEQ ID NO: 43789 - DNA, 30 bp, Homo sapiens
gaatggcgaatggagtaactcatgtctccg

SEQ ID NO: 43790 - DNA, 30 bp, Homo sapiens
gaaaggtgcgggatccgacaggggcttgtc

SEQ ID NO: 43791 - DNA, 30 bp, Homo sapiens
ccctggctggctgctccgctgaacagagct

SEQ ID NO: 43792 - DNA, 30 bp, Homo sapiens
tttagggtttccttcaaaagatctgagtgt

SEQ ID NO: 43793 - DNA, 30 bp, Homo sapiens
tcttcacgcctccaagcttcctgcagatga

SEQ ID NO: 43794 - DNA, 30 bp, Homo sapiens
tcttttgccccctgagactttggacttgat

SEQ ID NO: 43795 - DNA, 30 bp, Homo sapiens
cccaccggcttgaccttcgcgatgaagagc

SEQ ID NO: 43796 - DNA, 30 bp, Homo sapiens
ttccgggtggggtttccagagccagaggag

SEQ ID NO: 43797 - DNA, 30 bp, Homo sapiens
ggcaggtgttcctcccttaccttggcctgt

SEQ ID NO: 43798 - DNA, 30 bp, Homo sapiens
tccaggtctgccagagtgggtgcattagga

SEQ ID NO: 43799 - DNA, 30 bp, Homo sapiens
gctccggattcctgttcttcctcttggatt

SEQ ID NO: 43800 - DNA, 30 bp, Homo sapiens
aagcaccctcgcttggaacggccttcagat

SEQ ID NO: 43801 - DNA, 30 bp, Homo sapiens
ctgaggaatgattgcgacactgttgttccc

SEQ ID NO: 43802 - DNA, 30 bp, Homo sapiens
ttgtggccagtccccatgccttggcctgtg

SEQ ID NO: 43803 - DNA, 30 bp, Homo sapiens
actcggcttcctgctgaccttagcaagggc

SEQ ID NO: 43804 - DNA, 30 bp, Homo sapiens
tattggttcattttgtttaaagcatcacac

SEQ ID NO: 43805 - DNA, 30 bp, Homo sapiens
gtttggcattgatgatgtccacgaattcgg

SEQ ID NO: 43806 - DNA, 30 bp, Homo sapiens
tgatggccatggtccagaggagtgggtggt

SEQ ID NO: 43807 - DNA, 30 bp, Homo sapiens
ggacgggattatccttggctatccaggtgg

SEQ ID NO: 43808 - DNA, 30 bp, Homo sapiens
gcgtggtccagctcctcgctgatggctttg

SEQ ID NO: 43809 - DNA, 30 bp, Homo sapiens
tcagggccagctttagttcattagtgaggc

SEQ ID NO: 43810 - DNA, 30 bp, Homo sapiens
acatggaagtcatatcgttgagagcgtggt

SEQ ID NO: 43811 - DNA, 30 bp, Homo sapiens
aagtctgatccagcatctgatgcatactaa

SEQ ID NO: 43812 - DNA, 30 bp, Homo sapiens
cagagggaggtgatgtcattgagtgcgttg

SEQ ID NO: 43813 - DNA, 30 bp, Homo sapiens
cacaggttgttgagttccagcagggtctgg

SEQ ID NO: 43814 - DNA, 30 bp, Homo sapiens
gcgtggtccagctcctcgctaatggccttg

SEQ ID NO: 43815 - DNA, 30 bp, Homo sapiens
agtcacacagatcatgcagcgttagcttca

SEQ ID NO: 43816 - DNA, 30 bp, Homo sapiens
ttcaggtcaagcagggtctggtccagcatc

SEQ ID NO: 43817 - DNA, 30 bp, Homo sapiens
tctgatgtaagcccacgttctcttctttgg

SEQ ID NO: 43818 - DNA, 30 bp, Homo sapiens
tgtttagttggatcataagaaagaacacac

SEQ ID NO: 43819 - DNA, 30 bp, Homo sapiens
aatttcagcatgtggaacataaaatggtgg

SEQ ID NO: 43820 - DNA, 30 bp, Homo sapiens
cagagggctctcggcagcctgtgagtatcc

SEQ ID NO: 43821 - DNA, 30 bp, Homo sapiens
caggggttgagtagagtcttcagcaaagct

SEQ ID NO: 43822 - DNA, 30 bp, Homo sapiens
gggaggatacatgatggggagccagttttc

SEQ ID NO: 43823 - DNA, 30 bp, Homo sapiens
cagggcctggcgagcctctgtgcctgccgt

SEQ ID NO: 43824 - DNA, 30 bp, Homo sapiens
tacttggtcttcttatcgtaggtgccagaa

SEQ ID NO: 43825 - DNA, 30 bp, Homo sapiens
ttcttcaccttggcatcgtaggtgcctgca

SEQ ID NO: 43826 - DNA, 30 bp, Homo sapiens
tttattcctcctctccctcccattgcatgg

SEQ ID NO: 43827 - DNA, 30 bp, Homo sapiens
tccaggtaggccaccccgccggcagagtcg

SEQ ID NO: 43828 - DNA, 30 bp, Homo sapiens
ggcattgatggccttccagcgctcgctgtc

SEQ ID NO: 43829 - DNA, 30 bp, Homo sapiens
ctcccacgggcaagggaatagccaagtttg

SEQ ID NO: 43830 - DNA, 30 bp, Homo sapiens
ttgcccctggtcatggagtagcccagtttc

SEQ ID NO: 43831 - DNA, 30 bp, Homo sapiens
gaccttctacttgagatattaggtattctt

SEQ ID NO: 43832 - DNA, 30 bp, Homo sapiens
tacagggctggctcgctgcggaagtccgag

SEQ ID NO: 43833 - DNA, 30 bp, Homo sapiens
ataacctggggcctgagtgattttcattca

SEQ ID NO: 43834 - DNA, 30 bp, Homo sapiens
ttttggggacatagtggtggatccagtcca

SEQ ID NO: 43835 - DNA, 30 bp, Homo sapiens
accttgcagaccaggggccctccagagtca

SEQ ID NO: 43836 - DNA, 30 bp, Homo sapiens
gtcaggggcggggaagggagtaccatccgc

SEQ ID NO: 43837 - DNA, 30 bp, Homo sapiens
gttaggtgggttggcatatgggtcatatcc

SEQ ID NO: 43838 - DNA, 30 bp, Homo sapiens
aagtgggaggaggtgctgttctggttcacc

SEQ ID NO: 43839 - DNA, 30 bp, Homo sapiens
tcacggtagtccaatagagcaaccatgcca

SEQ ID NO: 43840 - DNA, 30 bp, Homo sapiens
taaagatgtattccccaattcaatctgggc

SEQ ID NO: 43841 - DNA, 30 bp, Homo sapiens
aatcggatccagctacaacatcactggaag

SEQ ID NO: 43842 - DNA, 30 bp, Homo sapiens
agtatctccacagcaaattctggtggataa

SEQ ID NO: 43843 - DNA, 30 bp, Homo sapiens
cagtggaatcgagtggagaatttgggagat

SEQ ID NO: 43844 - DNA, 30 bp, Homo sapiens
atcatatcctctatcatagtaagaatctcg

SEQ ID NO: 43845 - DNA, 30 bp, Homo sapiens
atctggaacgtgatctgtatcctccacgac

SEQ ID NO: 43846 - DNA, 30 bp, Homo sapiens
tgtgccgggcctcggtcaccctctgcaggc

SEQ ID NO: 43847 - DNA, 30 bp, Homo sapiens
ctcggtcaccctctgcaggcagtactgcgc

SEQ ID NO: 43848 - DNA, 30 bp, Homo sapiens
gcaaagaagaagcctttgtcagggaactcc

SEQ ID NO: 43849 - DNA, 30 bp, Homo sapiens
tacaggaggggtgtctctgtttggaaagcc

SEQ ID NO: 43850 - DNA, 30 bp, Homo sapiens
aggagggcccaaggctatgcagcaggaagc

SEQ ID NO: 43851 - DNA, 30 bp, Homo sapiens
gccaggccgccattgggatcggtcaggccc

SEQ ID NO: 43852 - DNA, 30 bp, Homo sapiens
taagtgctggtctccacaatgcacttgagg

SEQ ID NO: 43853 - DNA, 30 bp, Homo sapiens
gtcaggtccacaatggccttgatgaagatg

SEQ ID NO: 43854 - DNA, 30 bp, Homo sapiens
gatcgggcagatccgaagtatccactatga

SEQ ID NO: 43855 - DNA, 30 bp, Homo sapiens
tgttggccttcacagcacagatcttgtctt

SEQ ID NO: 43856 - DNA, 30 bp, Homo sapiens
acaagggaaccacctgaagggtgggcagag

SEQ ID NO: 43857 - DNA, 30 bp, Homo sapiens
cttgaagctgtaaggattgattttgaagca

SEQ ID NO: 43858 - DNA, 30 bp, Homo sapiens
gccaggaacactgccagtgctgcagcaatc

SEQ ID NO: 43859 - DNA, 30 bp, Homo sapiens
ctgaggatcttccggggcagttcaacagca

SEQ ID NO: 43860 - DNA, 30 bp, Homo sapiens
tccaggtcagttaagtccacggccactttc

SEQ ID NO: 43861 - DNA, 30 bp, Homo sapiens
catcagtacttcgtggctgaaaaccctccc

SEQ ID NO: 43862 - DNA, 30 bp, Homo sapiens
cagtgctatccacagcccctgagaagagtc

SEQ ID NO: 43863 - DNA, 30 bp, Homo sapiens
ctcctcctcttcctcttctgcatccccagc

SEQ ID NO: 43864 - DNA, 30 bp, Homo sapiens
cacaggaaggtgtccagcttggcctggaag

SEQ ID NO: 43865 - DNA, 30 bp, Homo sapiens
cagaggaactcaaaccagcagcgcgggtgg

SEQ ID NO: 43866 - DNA, 30 bp, Homo sapiens
cgtaagctagtttgtttggagagcttagca

SEQ ID NO: 43867 - DNA, 30 bp, Homo sapiens
cagacgagcggaagctacagacagagaacc

SEQ ID NO: 43868 - DNA, 30 bp, Homo sapiens
atctcctctcagctcaacggggcatatggc

SEQ ID NO: 43869 - DNA, 30 bp, Homo sapiens
tcctccttcaggacacccattttgggtgag

SEQ ID NO: 43870 - DNA, 30 bp, Homo sapiens
agagtctgctacatttgaagttaatgttcc

SEQ ID NO: 43871 - DNA, 30 bp, Homo sapiens
tggcggacagtctactctatttgaagtttc

SEQ ID NO: 43872 - DNA, 30 bp, Homo sapiens
ggagacttgagtttcttagtccgtggggag

SEQ ID NO: 43873 - DNA, 30 bp, Homo sapiens
ttccgagaacgccttctaggccgaagctca

SEQ ID NO: 43874 - DNA, 30 bp, Homo sapiens
tccagggccttgacaagcagctcattcaag

SEQ ID NO: 43875 - DNA, 30 bp, Homo sapiens
gcccgggcggagaagaagggcagagagcga

SEQ ID NO: 43876 - DNA, 30 bp, Homo sapiens
tccaggacgtggtcatcttggctggggatg

SEQ ID NO: 43877 - DNA, 30 bp, Homo sapiens
tagaggtatcatccatgagtcgaccctgtg

SEQ ID NO: 43878 - DNA, 30 bp, Homo sapiens
ctgtggcttgacaaaaatactggtaggtat

SEQ ID NO: 43879 - DNA, 30 bp, Homo sapiens
ttgaggcactgtgtgttgaagctgtccccc

SEQ ID NO: 43880 - DNA, 30 bp, Homo sapiens
gctttccactttaatggcagaagataccac

SEQ ID NO: 43881 - DNA, 30 bp, Homo sapiens
aataggagaattgggttcataaaatggatt

SEQ ID NO: 43882 - DNA, 30 bp, Homo sapiens
tcatcatcgacgtcaccatgttatcaaagg

SEQ ID NO: 43883 - DNA, 30 bp, Homo sapiens
cagctggaagattgtcctcaatccgcctga

SEQ ID NO: 43884 - DNA, 30 bp, Homo sapiens
tctgtcacactgtcaccttttagtctgtct

SEQ ID NO: 43885 - DNA, 30 bp, Homo sapiens
gagtggaacatggaggccagcataagcttc

SEQ ID NO: 43886 - DNA, 30 bp, Homo sapiens
acccaggtccaaaagttccagccttctctg

SEQ ID NO: 43887 - DNA, 30 bp, Homo sapiens
atctgctagaaccacaaacttgatccgagt

SEQ ID NO: 43888 - DNA, 30 bp, Homo sapiens
cagcggccctccagggcccggtctcgagcg

SEQ ID NO: 43889 - DNA, 30 bp, Homo sapiens
tttcggaatcaccacctggaacttacagac

SEQ ID NO: 43890 - DNA, 30 bp, Homo sapiens
cccagggtatagagggcgccgcgcaggagg

SEQ ID NO: 43891 - DNA, 30 bp, Homo sapiens
tttgataagccacctctgattaagccacac

SEQ ID NO: 43892 - DNA, 30 bp, Homo sapiens
atcagggcaggcatggaattctgctgactt

SEQ ID NO: 43893 - DNA, 30 bp, Homo sapiens
cctccagggcacacacgtgcacactgggca

SEQ ID NO: 43894 - DNA, 30 bp, Homo sapiens
agtttataggttctctcttagcacggatca

SEQ ID NO: 43895 - DNA, 30 bp, Homo sapiens
ccaaggagatttgctatttctttaggagtg

SEQ ID NO: 43896 - DNA, 30 bp, Homo sapiens
agtaggcgataacgctgtttcactgttatc

SEQ ID NO: 43897 - DNA, 30 bp, Homo sapiens
tccactgtcttggttgttttctcttccttc

SEQ ID NO: 43898 - DNA, 30 bp, Homo sapiens
agggcaggtgatgccggagtgggtctggaa

SEQ ID NO: 43899 - DNA, 30 bp, Homo sapiens
ttctcttagaacctccggcagcctcctgct

SEQ ID NO: 43900 - DNA, 30 bp, Homo sapiens
tcagtatcttcgtcaccatcatcatcttct

SEQ ID NO: 43901 - DNA, 30 bp, Homo sapiens
tgcttctgtcctggagaatttgcttgacca

SEQ ID NO: 43902 - DNA, 30 bp, Homo sapiens
ccatggcaggaggctgagcaggaggctggg

SEQ ID NO: 43903 - DNA, 30 bp, Homo sapiens
gccaggagaatgacaatgttgaacaccgga

SEQ ID NO: 43904 - DNA, 30 bp, Homo sapiens
gtacaaatgacctcagcgtgacagcaaaca

SEQ ID NO: 43905 - DNA, 30 bp, Homo sapiens
agcacacagactgggaaacaaagggctcag

SEQ ID NO: 43906 - DNA, 30 bp, Homo sapiens
cgtgtctctcagccctggcagagtttggag

SEQ ID NO: 43907 - DNA, 30 bp, Homo sapiens
accagtccctgcttccagggtccaggagaa

SEQ ID NO: 43908 - DNA, 30 bp, Homo sapiens
agctggatggagtctgattgttaggtggat

SEQ ID NO: 43909 - DNA, 30 bp, Homo sapiens
acgtggtggaccactgaggagggattcttg

SEQ ID NO: 43910 - DNA, 30 bp, Homo sapiens
atcaagtagacttccacatagggctctggt

SEQ ID NO: 43911 - DNA, 30 bp, Homo sapiens
atcaggcccttggccaggaggagtccacat

SEQ ID NO: 43912 - DNA, 30 bp, Homo sapiens
agcaagactgaatcttgatcatccaagaga

SEQ ID NO: 43913 - DNA, 30 bp, Homo sapiens
ccccaggtgtggccagggatagtccataca

SEQ ID NO: 43914 - DNA, 30 bp, Homo sapiens
ggctggggtcatcaggcggcaagtacatgg

SEQ ID NO: 43915 - DNA, 30 bp, Homo sapiens
tccaggggctctctgacccaggctgcccgc

SEQ ID NO: 43916 - DNA, 30 bp, Homo sapiens
cattggaaaagctcgtcttggtaaagcatt

SEQ ID NO: 43917 - DNA, 30 bp, Homo sapiens
aagccaagcaggtgtcatcaaaagacactt

SEQ ID NO: 43918 - DNA, 30 bp, Homo sapiens
ccatggcccatgaactccagtccttcaata

SEQ ID NO: 43919 - DNA, 30 bp, Homo sapiens
agaaggaactaatgtcactgtcctcctggt

SEQ ID NO: 43920 - DNA, 30 bp, Homo sapiens
gaaagggtccaagttctcttccatgttgac

SEQ ID NO: 43921 - DNA, 30 bp, Homo sapiens
catacagaaccacttctctgtctccctcct

SEQ ID NO: 43922 - DNA, 30 bp, Homo sapiens
agtcggcaaatcgctgcaggagacggtcct

SEQ ID NO: 43923 - DNA, 30 bp, Homo sapiens
tatgcagctacttctgtgccaagcacggat

SEQ ID NO: 43924 - DNA, 30 bp, Homo sapiens
caggagctcagggagaaactggaccctcgg

SEQ ID NO: 43925 - DNA, 30 bp, Homo sapiens
cactggggagccagggtgtccccggaccca

SEQ ID NO: 43926 - DNA, 30 bp, Homo sapiens
tgttcagtaccaccaaagtaaaattcttga

SEQ ID NO: 43927 - DNA, 30 bp, Homo sapiens
gggcagccgggggatgctgatggccccctc

SEQ ID NO: 43928 - DNA, 30 bp, Homo sapiens
cagcctttcagcgtaaggcaggaacctttt

SEQ ID NO: 43929 - DNA, 30 bp, Homo sapiens
ccaaggacggtgctggcttctcgggttcct

SEQ ID NO: 43930 - DNA, 30 bp, Homo sapiens
cataggtgcctgccccgaagatctccacct

SEQ ID NO: 43931 - DNA, 30 bp, Homo sapiens
acgaggtcaggagatcgagaccatcctggc

SEQ ID NO: 43932 - DNA, 30 bp, Homo sapiens
acccacatggtcactgtggagatgaccatc

SEQ ID NO: 43933 - DNA, 30 bp, Homo sapiens
tacgaaggcacagtgaatagccagtgaccg

SEQ ID NO: 43934 - DNA, 30 bp, Homo sapiens
tctgcaaccacaacatgaccatctgaagtt

SEQ ID NO: 43935 - DNA, 30 bp, Homo sapiens
tcccgggcagtatctgccatcccagccact

SEQ ID NO: 43936 - DNA, 30 bp, Homo sapiens
atagtcagtggatccttgtgatccaatatt

SEQ ID NO: 43937 - DNA, 30 bp, Homo sapiens
gctcggtgggcacacagtcatggggactag

SEQ ID NO: 43938 - DNA, 30 bp, Homo sapiens
ctctgtgactacctctttcccagtatattg

SEQ ID NO: 43939 - DNA, 30 bp, Homo sapiens
ctccagcagctacaagttgccgtgagagcc

SEQ ID NO: 43940 - DNA, 30 bp, Homo sapiens
cataatttatggagactgagtagttcagtg

SEQ ID NO: 43941 - DNA, 30 bp, Homo sapiens
ttgaggcgtttcttccggggctgtacaaag

SEQ ID NO: 43942 - DNA, 30 bp, Homo sapiens
tacttgggggagcagatggagagtgtggca

SEQ ID NO: 43943 - DNA, 30 bp, Homo sapiens
agcaggaggcgtgttcctggccacttgagc

SEQ ID NO: 43944 - DNA, 30 bp, Homo sapiens
caaggggaggtctccatggaatgaccatga

SEQ ID NO: 43945 - DNA, 30 bp, Homo sapiens
caggggccatcaccagggccaccagacagc

SEQ ID NO: 43946 - DNA, 30 bp, Homo sapiens
catggggcttcgttggacccaatcccgttg

SEQ ID NO: 43947 - DNA, 30 bp, Homo sapiens
tactggaggtagcgataggctttaaagcag

SEQ ID NO: 43948 - DNA, 30 bp, Homo sapiens
tgaaggaacctcacaaaaccaagcccggat

SEQ ID NO: 43949 - DNA, 30 bp, Homo sapiens
atggggtggaatatcttctcagatggtagc

SEQ ID NO: 43950 - DNA, 30 bp, Homo sapiens
tttaggcgttttctgcggggctgtataaag

SEQ ID NO: 43951 - DNA, 30 bp, Homo sapiens
tcctggccacccatacgcaccatttcatga

SEQ ID NO: 43952 - DNA, 30 bp, Homo sapiens
cagccatccagttcttccttgacactgatg

SEQ ID NO: 43953 - DNA, 30 bp, Homo sapiens
tgaagggtacagattccacagatgcaagca

SEQ ID NO: 43954 - DNA, 30 bp, Homo sapiens
accaggcggagccgggcgcgcggaggcccc

SEQ ID NO: 43955 - DNA, 30 bp, Homo sapiens
tcttggtattccagatattttgctgtgatg

SEQ ID NO: 43956 - DNA, 30 bp, Homo sapiens
ttcagggcctatttgttcaccatcaggaaa

SEQ ID NO: 43957 - DNA, 30 bp, Homo sapiens
tcacctgggggaggcagaaacaaaggagaa

SEQ ID NO: 43958 - DNA, 30 bp, Homo sapiens
actcccaatctgttgggggcctgatggtaa

SEQ ID NO: 43959 - DNA, 30 bp, Homo sapiens
ttcctatcagtcactggtggaatgactaaa

SEQ ID NO: 43960 - DNA, 30 bp, Homo sapiens
ctgagggggctgaagaagcaattcactgac

SEQ ID NO: 43961 - DNA, 30 bp, Homo sapiens
caagggcagagcttgatgcgggtgcccttg

SEQ ID NO: 43962 - DNA, 30 bp, Homo sapiens
ttctggccggtctgttggacagacatagta

SEQ ID NO: 43963 - DNA, 30 bp, Homo sapiens
ttctggagggcagactggatattcttcagc

SEQ ID NO: 43964 - DNA, 30 bp, Homo sapiens
catctgtggccagtgtaaaagaaaggcctg

SEQ ID NO: 43965 - DNA, 30 bp, Homo sapiens
tgtgtcctcttcttcactggcaccactggg

SEQ ID NO: 43966 - DNA, 30 bp, Homo sapiens
agagagccacagtcctaagtagactcctcg

SEQ ID NO: 43967 - DNA, 30 bp, Homo sapiens
gcttggcgaagcccccaatggtgactttcc

SEQ ID NO: 43968 - DNA, 30 bp, Homo sapiens
gagtagctggaattgtaggcacgcaccacc

SEQ ID NO: 43969 - DNA, 30 bp, Homo sapiens
cttcagcacggatatgcaggacttcttgag

SEQ ID NO: 43970 - DNA, 30 bp, Homo sapiens
atgggccctgccctgagcgctagattcaga

SEQ ID NO: 43971 - DNA, 30 bp, Homo sapiens
aggaggtgagaaagagcaattagggatggt

SEQ ID NO: 43972 - DNA, 30 bp, Homo sapiens
cagaggtgaacacagcaaaagataggcctg

SEQ ID NO: 43973 - DNA, 30 bp, Homo sapiens
tagcgtcggacatctgtcagctctctaaac

SEQ ID NO: 43974 - DNA, 30 bp, Homo sapiens
tcttggaaggagaatcataaatcttaaaac

SEQ ID NO: 43975 - DNA, 30 bp, Homo sapiens
gcttggtgagcacagagtcatggggactcc

SEQ ID NO: 43976 - DNA, 30 bp, Homo sapiens
agcttggtgggctgctcggggctgaggggg

SEQ ID NO: 43977 - DNA, 30 bp, Homo sapiens
gataggcctgagaggaggtgagaaggagca

SEQ ID NO: 43978 - DNA, 30 bp, Homo sapiens
actcctgcaccacctcctccaaaggcagca

SEQ ID NO: 43979 - DNA, 30 bp, Homo sapiens
tcagcctcttgcgagctgatgttttttaag

SEQ ID NO: 43980 - DNA, 30 bp, Homo sapiens
tgtgaatgctttcttgctctatctgaagta

SEQ ID NO: 43981 - DNA, 30 bp, Homo sapiens
ccacctcctccaaaggcagcacgctgtgct

SEQ ID NO: 43982 - DNA, 30 bp, Homo sapiens
tcatgggatggacaaactggtactcctgca

SEQ ID NO: 43983 - DNA, 30 bp, Homo sapiens
ggcccatccggccgctcttcctccggcccc

SEQ ID NO: 43984 - DNA, 30 bp, Homo sapiens
gcgctaggcagattactaactcctgagaag

SEQ ID NO: 43985 - DNA, 30 bp, Homo sapiens
accaggaaaaggagaagatatggcgagctg

SEQ ID NO: 43986 - DNA, 30 bp, Homo sapiens
taactgtccggagaacggacccgaaagatg

SEQ ID NO: 43987 - DNA, 30 bp, Homo sapiens
agcaggatctaaatgatccctggatgccca

SEQ ID NO: 43988 - DNA, 30 bp, Homo sapiens
gagaggcttcagaaaaccatattaaagtga

SEQ ID NO: 43989 - DNA, 30 bp, Homo sapiens
cgcagggtcataggaattacacagttgcaa

SEQ ID NO: 43990 - DNA, 30 bp, Homo sapiens
tggtgggcatagagtcatgggagctggaca

SEQ ID NO: 43991 - DNA, 30 bp, Homo sapiens
gttcggaatctgttccagtatagaaataag

SEQ ID NO: 43992 - DNA, 30 bp, Homo sapiens
cagaggcagaagaatcgcttgatcccggga

SEQ ID NO: 43993 - DNA, 30 bp, Homo sapiens
atgcggacggtgttgatccgcagcggctga

SEQ ID NO: 43994 - DNA, 30 bp, Homo sapiens
tactggtgtccttcttccttcccttctgtg

SEQ ID NO: 43995 - DNA, 30 bp, Homo sapiens
caaaagaaaggcctcagaggggaagagaag

SEQ ID NO: 43996 - DNA, 30 bp, Homo sapiens
tcctggggccccagagggaacacagcccct

SEQ ID NO: 43997 - DNA, 30 bp, Homo sapiens
agatgctgttggccaggcgaaatgacattc

SEQ ID NO: 43998 - DNA, 30 bp, Homo sapiens
agctttggccgccccaggttagtcggcact

SEQ ID NO: 43999 - DNA, 30 bp, Homo sapiens
catccagggagcagatggccagaggagcag

SEQ ID NO: 44000 - DNA, 30 bp, Homo sapiens
caatggttctttattctctccaccatcatt

SEQ ID NO: 44001 - DNA, 30 bp, Homo sapiens
taatgtcccacggggggcctgcgggtgcct

SEQ ID NO: 44002 - DNA, 30 bp, Homo sapiens
aaggccagattcgcaagtaggtgcccgtgg

SEQ ID NO: 44003 - DNA, 30 bp, Homo sapiens
acgaggattcgattgttgccaaagtccacc

SEQ ID NO: 44004 - DNA, 30 bp, Homo sapiens
cctcggcgccttcgggacccacgagcagca

SEQ ID NO: 44005 - DNA, 30 bp, Homo sapiens
acctggaggccatggagtggaacttccaga

SEQ ID NO: 44006 - DNA, 30 bp, Homo sapiens
caaatgaaaggtctgagaggaaaatagaag

SEQ ID NO: 44007 - DNA, 30 bp, Homo sapiens
gtttggtggacggctgcccatacaccctgt

SEQ ID NO: 44008 - DNA, 30 bp, Homo sapiens
gctattgatgctctgctggagtagaagtcg

SEQ ID NO: 44009 - DNA, 30 bp, Homo sapiens
tagatgccacgcagttctcgctctgaggga

SEQ ID NO: 44010 - DNA, 30 bp, Homo sapiens
agacgtggctgttcagtgagcagatggtga

SEQ ID NO: 44011 - DNA, 30 bp, Homo sapiens
agaaggaccatgttgtaagatggtgaggga

SEQ ID NO: 44012 - DNA, 30 bp, Homo sapiens
tctaggcagaagcctgctctgcagaaagtt

SEQ ID NO: 44013 - DNA, 30 bp, Homo sapiens
tttgagacctgcaggcggggtgaccttggg

SEQ ID NO: 44014 - DNA, 30 bp, Homo sapiens
ctcagccaggctgttgcgcatcgactcctt

SEQ ID NO: 44015 - DNA, 30 bp, Homo sapiens
cacaggtctcagccgaagccacggggtcag

SEQ ID NO: 44016 - DNA, 30 bp, Homo sapiens
actcggaggtaggaggtgggcacgtagccc

SEQ ID NO: 44017 - DNA, 30 bp, Homo sapiens
cactgttgtcaggtaacgctggcaaaggtg

SEQ ID NO: 44018 - DNA, 30 bp, Homo sapiens
tacctgcagctccttggggagcttcatctg

SEQ ID NO: 44019 - DNA, 30 bp, Homo sapiens
agatggaacgactgctgcccttctcttgct

SEQ ID NO: 44020 - DNA, 30 bp, Homo sapiens
ccagagacagggcctggaggaacccctcta

SEQ ID NO: 44021 - DNA, 30 bp, Homo sapiens
acgcggatggcatctgatggctcggtgccc

SEQ ID NO: 44022 - DNA, 30 bp, Homo sapiens
ctttgctccttgatggatcttggaatccaa

SEQ ID NO: 44023 - DNA, 30 bp, Homo sapiens
cagtggtgacggtggctgagagctcctgga

SEQ ID NO: 44024 - DNA, 30 bp, Homo sapiens
tcttggtccagatcagggtcaacatccgtg

SEQ ID NO: 44025 - DNA, 30 bp, Homo sapiens
cctccgtcttctgcttcttggctactattc

SEQ ID NO: 44026 - DNA, 30 bp, Homo sapiens
accaggggccgagttttatcatcgtcaccg

SEQ ID NO: 44027 - DNA, 30 bp, Homo sapiens
ccctggggatcccttctctttaggttcttt

SEQ ID NO: 44028 - DNA, 30 bp, Homo sapiens
gaccctagagacaccaaggaccccacaggg

SEQ ID NO: 44029 - DNA, 30 bp, Homo sapiens
gcctggcccagcggcagccccaggtccagg

SEQ ID NO: 44030 - DNA, 30 bp, Homo sapiens
gtgtggcagagagttcactgtagattcagt

SEQ ID NO: 44031 - DNA, 30 bp, Homo sapiens
attccactgagttccgaagaatatagcctt

SEQ ID NO: 44032 - DNA, 30 bp, Homo sapiens
tgttttctcttgggaacgaattgcagagcc

SEQ ID NO: 44033 - DNA, 30 bp, Homo sapiens
ttccagcagtaaacagtcccaagccatgaa

SEQ ID NO: 44034 - DNA, 30 bp, Homo sapiens
agcaggccaagccatgaactgtgttgtagt

SEQ ID NO: 44035 - DNA, 30 bp, Homo sapiens
ttagccataatgaatgacaaaccagcatcc

SEQ ID NO: 44036 - DNA, 30 bp, Homo sapiens
gggtggatttttcttccttggcaattcttt

SEQ ID NO: 44037 - DNA, 30 bp, Homo sapiens
cactcagcagcatgttggggatcccgcggc

SEQ ID NO: 44038 - DNA, 30 bp, Homo sapiens
gtgcgggaggcaggtggcccgggaagcaag

SEQ ID NO: 44039 - DNA, 30 bp, Homo sapiens
gccaactgaaggacaggggcagcattccag

SEQ ID NO: 44040 - DNA, 30 bp, Homo sapiens
agcagttgtttctggtgatgaagaatgatt

SEQ ID NO: 44041 - DNA, 30 bp, Homo sapiens
tctgcagccacttgcttctgctttgtcatt

SEQ ID NO: 44042 - DNA, 30 bp, Homo sapiens
tagatggggctctgcagaggctgtgggggg

SEQ ID NO: 44043 - DNA, 30 bp, Homo sapiens
atgaggggaaggtcccagtttcttgtaggg

SEQ ID NO: 44044 - DNA, 30 bp, Homo sapiens
aagaggagcaccagctcacaatgtggggtg

SEQ ID NO: 44045 - DNA, 30 bp, Homo sapiens
cctcggggtggtccggggtggccgcagctc

SEQ ID NO: 44046 - DNA, 30 bp, Homo sapiens
tctgccttttaagaggtggatcttcatgat

SEQ ID NO: 44047 - DNA, 30 bp, Homo sapiens
ctctgggcattttcgttttttagctgcagg

SEQ ID NO: 44048 - DNA, 30 bp, Homo sapiens
agcctggggtcttggtggcgaaggtcaggt

SEQ ID NO: 44049 - DNA, 30 bp, Homo sapiens
ttgtggtttgaccttcctcaacttgacaag

SEQ ID NO: 44050 - DNA, 30 bp, Homo sapiens
gcaagggactcaggcctggaccatcttctg

SEQ ID NO: 44051 - DNA, 30 bp, Homo sapiens
cagtggccatcccagctctgcgctggccct

SEQ ID NO: 44052 - DNA, 30 bp, Homo sapiens
tacatcatggcagggatctctgaagacact

SEQ ID NO: 44053 - DNA, 30 bp, Homo sapiens
ctgcggggaggcggggccgcggggcgggct

SEQ ID NO: 44054 - DNA, 30 bp, Homo sapiens
tttttccactgttctcgcaactgttgtaat

SEQ ID NO: 44055 - DNA, 30 bp, Homo sapiens
catgacaccctcagctgattggccataact

SEQ ID NO: 44056 - DNA, 30 bp, Homo sapiens
tagccatacgagaagccacaggcaccaaga

SEQ ID NO: 44057 - DNA, 30 bp, Homo sapiens
ccatggcacctgtctgggcagggggcccag

SEQ ID NO: 44058 - DNA, 30 bp, Homo sapiens
ccctggggggcagcagaaccaactggaatg

SEQ ID NO: 44059 - DNA, 30 bp, Homo sapiens
ctccagtatcaaagccgcacatatccaaca

SEQ ID NO: 44060 - DNA, 30 bp, Homo sapiens
caatggtgaaaccatttgatgtcattccac

SEQ ID NO: 44061 - DNA, 30 bp, Homo sapiens
agatggtgtgtttttgccttgactgctctc

SEQ ID NO: 44062 - DNA, 30 bp, Homo sapiens
gccaagtaaatcccttatttcatttcggaa

SEQ ID NO: 44063 - DNA, 30 bp, Homo sapiens
tgctgggattcagtttctcactaagtttat

SEQ ID NO: 44064 - DNA, 30 bp, Homo sapiens
tcgtgggtgactgtgtctgggaggtttaga

SEQ ID NO: 44065 - DNA, 30 bp, Homo sapiens
tgaagtccctgtctatgtccatgtagggct

SEQ ID NO: 44066 - DNA, 30 bp, Homo sapiens
tagaggcgagttgtaacttgttcttcctgt

SEQ ID NO: 44067 - DNA, 30 bp, Homo sapiens
ctaacatagcctgatctatatcaaatatta

SEQ ID NO: 44068 - DNA, 30 bp, Homo sapiens
gatttggttccatggataatttctctccaa

SEQ ID NO: 44069 - DNA, 30 bp, Homo sapiens
ttcaccctcaggtggtctttgtttaagttc

SEQ ID NO: 44070 - DNA, 30 bp, Homo sapiens
cagtggtgtccagtttccaagcctcatggc

SEQ ID NO: 44071 - DNA, 30 bp, Homo sapiens
ctgtggaagctttctctttcttaacctttt

SEQ ID NO: 44072 - DNA, 30 bp, Homo sapiens
actcagcggctgccttctggaggagggtct

SEQ ID NO: 44073 - DNA, 30 bp, Homo sapiens
cgccttcttctgagtatttatgcccaaagg

SEQ ID NO: 44074 - DNA, 30 bp, Homo sapiens
ctttggaaagccgatgttctggacagtctc

SEQ ID NO: 44075 - DNA, 30 bp, Homo sapiens
caggtcagggggtggcggcccacctggggg

SEQ ID NO: 44076 - DNA, 30 bp, Homo sapiens
ccgagggaggctggccagccccgggttgtt

SEQ ID NO: 44077 - DNA, 30 bp, Homo sapiens
ctggggaatttctacccgtctcccttgctg

SEQ ID NO: 44078 - DNA, 30 bp, Homo sapiens
tggtggaatttccaggctgaagattcaaat

SEQ ID NO: 44079 - DNA, 30 bp, Homo sapiens
gtctaaatcgatgcctcatttcctctgagg

SEQ ID NO: 44080 - DNA, 30 bp, Homo sapiens
gtgcattgttcctatgcaggcccctctgga

SEQ ID NO: 44081 - DNA, 30 bp, Homo sapiens
cctttctctggagctgtgcttggggctact

SEQ ID NO: 44082 - DNA, 30 bp, Homo sapiens
ttctccccggaagcggcaggactcttgaag

SEQ ID NO: 44083 - DNA, 30 bp, Homo sapiens
agttggactggaggagctggacgggcacat

SEQ ID NO: 44084 - DNA, 30 bp, Homo sapiens
ccgaggtttccgggaattcctcgacttctt

SEQ ID NO: 44085 - DNA, 30 bp, Homo sapiens
gagcggggcgtcatcagtcctccacttgcg

SEQ ID NO: 44086 - DNA, 30 bp, Homo sapiens
ctccatccccctcactaaggttcagtccaa

SEQ ID NO: 44087 - DNA, 30 bp, Homo sapiens
tctccccgtcctccagacccctgttgatta

SEQ ID NO: 44088 - DNA, 30 bp, Homo sapiens
gccaggggtgccaggcggggtccatgcggc

SEQ ID NO: 44089 - DNA, 30 bp, Homo sapiens
cattagactcaggttttgattttttaagtg

SEQ ID NO: 44090 - DNA, 30 bp, Homo sapiens
acccctctccagccccaaggtagagctcgg

SEQ ID NO: 44091 - DNA, 30 bp, Homo sapiens
cccaggagccagttgtgtcacagatgcctg

SEQ ID NO: 44092 - DNA, 30 bp, Homo sapiens
ggcaggtgatttaacaatggattaggagat

SEQ ID NO: 44093 - DNA, 30 bp, Homo sapiens
ctgtgttcatgatgagtctcattgtagtcc

SEQ ID NO: 44094 - DNA, 30 bp, Homo sapiens
acaaactcggtgaagtcctccaccgaggag

SEQ ID NO: 44095 - DNA, 30 bp, Homo sapiens
atgcggttggtcctgagccctgcgatgctg

SEQ ID NO: 44096 - DNA, 30 bp, Homo sapiens
ctgtggtatactaactgctggaatactctg

SEQ ID NO: 44097 - DNA, 30 bp, Homo sapiens
attcggctgctgtggaggttgcgttggctg

SEQ ID NO: 44098 - DNA, 30 bp, Homo sapiens
acaccgcagaaccaccaggggcctcgggca

SEQ ID NO: 44099 - DNA, 30 bp, Homo sapiens
agacggagggcccattgggcgcagggggcc

SEQ ID NO: 44100 - DNA, 30 bp, Homo sapiens
acatggatgtcatcttctaagagaaatatt

SEQ ID NO: 44101 - DNA, 30 bp, Homo sapiens
gtctggcagcataaatccatcagtaagttt

SEQ ID NO: 44102 - DNA, 30 bp, Homo sapiens
ggtctggcagcataaatccatcagtaagtt

SEQ ID NO: 44103 - DNA, 30 bp, Homo sapiens
agatctcccttatcctgttatggctgaggg

SEQ ID NO: 44104 - DNA, 30 bp, Homo sapiens
agcaggcagaggttgcagtgatccaagatc

SEQ ID NO: 44105 - DNA, 30 bp, Homo sapiens
tcgtgaagaaacccatcgactcagaatcac

SEQ ID NO: 44106 - DNA, 30 bp, Homo sapiens
tgcaggctggcccattgcagggaggtgtag

SEQ ID NO: 44107 - DNA, 30 bp, Homo sapiens
ttattgagacctcctgagacttaaacccat

SEQ ID NO: 44108 - DNA, 30 bp, Homo sapiens
atcctggggcaacgtgaagtccctgaagct

SEQ ID NO: 44109 - DNA, 30 bp, Homo sapiens
aagaggaggtgttctgcaagaagttggatt

SEQ ID NO: 44110 - DNA, 30 bp, Homo sapiens
cagtttctgctgcctcttcaccttctccac

SEQ ID NO: 44111 - DNA, 30 bp, Homo sapiens
tttagggtctgacaatgcatcatggttcca

SEQ ID NO: 44112 - DNA, 30 bp, Homo sapiens
tagaggtcactgagaccggcagtctttctt

SEQ ID NO: 44113 - DNA, 30 bp, Homo sapiens
cctcggtcaggagatcgatggtgagcacgt

SEQ ID NO: 44114 - DNA, 30 bp, Homo sapiens
ctccgggtccaggctggggttgtagtgcct

SEQ ID NO: 44115 - DNA, 30 bp, Homo sapiens
gaccgtggcctttttgataatccactgcgg

SEQ ID NO: 44116 - DNA, 30 bp, Homo sapiens
agataagacttctgaggtttggtacagtag

SEQ ID NO: 44117 - DNA, 30 bp, Homo sapiens
ttctttggggttagatgggagttttcaatc

SEQ ID NO: 44118 - DNA, 30 bp, Homo sapiens
tgatggcatactggagcgtggggccttctg

SEQ ID NO: 44119 - DNA, 30 bp, Homo sapiens
cagtcacatagatcaggtggtcctcgggag

SEQ ID NO: 44120 - DNA, 30 bp, Homo sapiens
ctgttacaaactgtgaatggtgttcgggtg

SEQ ID NO: 44121 - DNA, 30 bp, Homo sapiens
agaaggtggtcttccggagatttcccgtgt

SEQ ID NO: 44122 - DNA, 30 bp, Homo sapiens
attgttcaggggctgagcccccctgttttg

SEQ ID NO: 44123 - DNA, 30 bp, Homo sapiens
agatggtggggcccctggcagcagaatccc

SEQ ID NO: 44124 - DNA, 30 bp, Homo sapiens
tccttgtaattgtgacacttgttccagaca

SEQ ID NO: 44125 - DNA, 30 bp, Homo sapiens
atttttcaacacaagctgctgccgtctcct

SEQ ID NO: 44126 - DNA, 30 bp, Homo sapiens
cattgatgaaggtggagatgtggaggggtc

SEQ ID NO: 44127 - DNA, 30 bp, Homo sapiens
caggggcagccacaagcagctgggggtctc

SEQ ID NO: 44128 - DNA, 30 bp, Homo sapiens
cagaggtggcgatgatgatgatgatgacaa

SEQ ID NO: 44129 - DNA, 30 bp, Homo sapiens
ttttggaatttctgaccctctgactttcaa

SEQ ID NO: 44130 - DNA, 30 bp, Homo sapiens
ttgcaggctctggctctcgaggtcccacac

SEQ ID NO: 44131 - DNA, 30 bp, Homo sapiens
acatggacacaatcatggcagccagctcga

SEQ ID NO: 44132 - DNA, 30 bp, Homo sapiens
ccccgggcgggcttggcagcgggcggggcg

SEQ ID NO: 44133 - DNA, 30 bp, Homo sapiens
gtaaaaatgccgctggagcctctggtgcaa

SEQ ID NO: 44134 - DNA, 30 bp, Homo sapiens
tctcaaagtgtgtattaaagctgtttgcca

SEQ ID NO: 44135 - DNA, 30 bp, Homo sapiens
actaggattcgcgcgggggtctttctggtt

SEQ ID NO: 44136 - DNA, 30 bp, Homo sapiens
aagtgatggccggccttcactgcctcgatg

SEQ ID NO: 44137 - DNA, 30 bp, Homo sapiens
aattggggtagcacaagcagcatcccgtgc

SEQ ID NO: 44138 - DNA, 30 bp, Homo sapiens
gttcaagaccagcctgcgcaacatagcgag

SEQ ID NO: 44139 - DNA, 30 bp, Homo sapiens
ttgataaacagcagcaaagtggcaagaatt

SEQ ID NO: 44140 - DNA, 30 bp, Homo sapiens
cccaggccaaagaaaacatgtcggctgggt

SEQ ID NO: 44141 - DNA, 30 bp, Homo sapiens
aagactcccgccaccacaatcaggttgtcc

SEQ ID NO: 44142 - DNA, 30 bp, Homo sapiens
tactggatgccccggaagaggcacatggca

SEQ ID NO: 44143 - DNA, 30 bp, Homo sapiens
gcatggattatattcttgatgtttttgaag

SEQ ID NO: 44144 - DNA, 30 bp, Homo sapiens
cagaggaccatgctgaatatcatgccaaag

SEQ ID NO: 44145 - DNA, 30 bp, Homo sapiens
cataggttccgccagtgatgaggagctcgt

SEQ ID NO: 44146 - DNA, 30 bp, Homo sapiens
gaaaggcactggggttggctctaggatcct

SEQ ID NO: 44147 - DNA, 30 bp, Homo sapiens
ctcagggcacccactgagcccaccgcgact

SEQ ID NO: 44148 - DNA, 30 bp, Homo sapiens
ccatgggtcagcccggtgctgctggttgta

SEQ ID NO: 44149 - DNA, 30 bp, Homo sapiens
cgcagtaggtgtctgccttgaccacttggc

SEQ ID NO: 44150 - DNA, 30 bp, Homo sapiens
cgccctgacagcttcgatatcgctaaccaa

SEQ ID NO: 44151 - DNA, 30 bp, Homo sapiens
tactggttatttgttatggcacgagagagg

SEQ ID NO: 44152 - DNA, 30 bp, Homo sapiens
caaaggaaattcctgcaacgactcccattt

SEQ ID NO: 44153 - DNA, 30 bp, Homo sapiens
accatctcatactgattggccgtgatgaac

SEQ ID NO: 44154 - DNA, 30 bp, Homo sapiens
atctggcaatacaggaccatagaaaacacc

SEQ ID NO: 44155 - DNA, 30 bp, Homo sapiens
catgcgtcgtacttcttaccagtccggtgg

SEQ ID NO: 44156 - DNA, 30 bp, Homo sapiens
cgtgtcctcagccgcaggaccctggagagg

SEQ ID NO: 44157 - DNA, 30 bp, Homo sapiens
ctctggcagccgccgtcccccacgccagcc

SEQ ID NO: 44158 - DNA, 30 bp, Homo sapiens
tcactcttctccgtgggctgaggctggtgc

SEQ ID NO: 44159 - DNA, 30 bp, Homo sapiens
agcactggactcttctcctcctcgttctct

SEQ ID NO: 44160 - DNA, 30 bp, Homo sapiens
cacaggtccttacataggatctgtcagggg

SEQ ID NO: 44161 - DNA, 30 bp, Homo sapiens
gtctctgttccctcttcaggtggcttcatc

SEQ ID NO: 44162 - DNA, 30 bp, Homo sapiens
gactggaacccaaagggcctggggatctct

SEQ ID NO: 44163 - DNA, 30 bp, Homo sapiens
atccggttttccccctcttccccggattgg

SEQ ID NO: 44164 - DNA, 30 bp, Homo sapiens
gactggaacctgaaggatctggcgctctcc

SEQ ID NO: 44165 - DNA, 30 bp, Homo sapiens
agttggattggctcaccccaggctgagtag

SEQ ID NO: 44166 - DNA, 30 bp, Homo sapiens
cactggaacccaaagggcctggggatctcc

SEQ ID NO: 44167 - DNA, 30 bp, Homo sapiens
ctccatgcccccttgaggcactgttgaaga

SEQ ID NO: 44168 - DNA, 30 bp, Homo sapiens
ccctgaactcaaatgggatgggataaggag

SEQ ID NO: 44169 - DNA, 30 bp, Homo sapiens
catttttttctccggacaatggtccagcca

SEQ ID NO: 44170 - DNA, 30 bp, Homo sapiens
gtctctctgccgtttcttgattcctttcca

SEQ ID NO: 44171 - DNA, 30 bp, Homo sapiens
cagacctcagcacctgggtcctcggggctg

SEQ ID NO: 44172 - DNA, 30 bp, Homo sapiens
cactgggcccgcgtctctggaggctgttgg

SEQ ID NO: 44173 - DNA, 30 bp, Homo sapiens
ctcagctccggagatgtgatggtctttggc

SEQ ID NO: 44174 - DNA, 30 bp, Homo sapiens
ccatggatgccaactaacttcttcaattga

SEQ ID NO: 44175 - DNA, 30 bp, Homo sapiens
gcaaggattggtgctgtttagtggtgttgt

SEQ ID NO: 44176 - DNA, 30 bp, Homo sapiens
agccggagtccccggcgcgcagccagcagt

SEQ ID NO: 44177 - DNA, 30 bp, Homo sapiens
cagactttccctgggacacacggctctctg

SEQ ID NO: 44178 - DNA, 30 bp, Homo sapiens
ttccgggcctgctcgtagttgtcagtgaac

SEQ ID NO: 44179 - DNA, 30 bp, Homo sapiens
cacctcccagctagcagccacacctccccg

SEQ ID NO: 44180 - DNA, 30 bp, Homo sapiens
taactctctttctccaaccattctctatag

SEQ ID NO: 44181 - DNA, 30 bp, Homo sapiens
cactggcccatcctcatcagcatcaggccc

SEQ ID NO: 44182 - DNA, 30 bp, Homo sapiens
atttggatggttttacttcattgtacttct

SEQ ID NO: 44183 - DNA, 30 bp, Homo sapiens
atctggccccagcccggccctccgcgcctc

SEQ ID NO: 44184 - DNA, 30 bp, Homo sapiens
tgctgagtttactggctggcttactcttcc

SEQ ID NO: 44185 - DNA, 30 bp, Homo sapiens
agccggtagaggaatcctgtttgatctgga

SEQ ID NO: 44186 - DNA, 30 bp, Homo sapiens
tctaggccatgaagctttctcagttgagca

SEQ ID NO: 44187 - DNA, 30 bp, Homo sapiens
acgtggagaagagtctgtgtttagcacctc

SEQ ID NO: 44188 - DNA, 30 bp, Homo sapiens
ccgtggtcaggatcatcaataccactgtct

SEQ ID NO: 44189 - DNA, 30 bp, Homo sapiens
ttctggaacctctgttttgatatcctcccc

SEQ ID NO: 44190 - DNA, 30 bp, Homo sapiens
catctttaaaagtctcatccaaagccaaag

SEQ ID NO: 44191 - DNA, 30 bp, Homo sapiens
agacagcttcatagtaggtgaggtcctgat

SEQ ID NO: 44192 - DNA, 30 bp, Homo sapiens
cttcttcagcattaagtgacactggatggt

SEQ ID NO: 44193 - DNA, 30 bp, Homo sapiens
tcctggtcttccagtctagtagcccttgtg

SEQ ID NO: 44194 - DNA, 30 bp, Homo sapiens
caaaggtctacttttctttgacagctcagc

SEQ ID NO: 44195 - DNA, 30 bp, Homo sapiens
tagggcctcagggaccttcgggccttttcc

SEQ ID NO: 44196 - DNA, 30 bp, Homo sapiens
gcacgggccttatcaagtatatcctttctg

SEQ ID NO: 44197 - DNA, 30 bp, Homo sapiens
aatgagacagcccggcggtcccgcggcgcg

SEQ ID NO: 44198 - DNA, 30 bp, Homo sapiens
acctggaattccagcactttgggaggtcga

SEQ ID NO: 44199 - DNA, 30 bp, Homo sapiens
tctgctgttgtgccgggccgggccttcccc

SEQ ID NO: 44200 - DNA, 30 bp, Homo sapiens
tttctccattttggacaagccatttgcaaa

SEQ ID NO: 44201 - DNA, 30 bp, Homo sapiens
tccatgggtctcctctggcggctcctgctg

SEQ ID NO: 44202 - DNA, 30 bp, Homo sapiens
ccatctcatttcctgtttttttcgtttctc

SEQ ID NO: 44203 - DNA, 30 bp, Homo sapiens
agttggttttcctcagttctctgatgatac

SEQ ID NO: 44204 - DNA, 30 bp, Homo sapiens
agacgggaaatcgttattcaccagattgtg

SEQ ID NO: 44205 - DNA, 30 bp, Homo sapiens
cttctcagtaaatggagcacttctcgaagg

SEQ ID NO: 44206 - DNA, 30 bp, Homo sapiens
agatggacactctgttttctttggcccatt

SEQ ID NO: 44207 - DNA, 30 bp, Homo sapiens
cttaggtcttggagctctgtcactaaggtg

SEQ ID NO: 44208 - DNA, 30 bp, Homo sapiens
agaagggaaaaatcttcctggagacaggaa

SEQ ID NO: 44209 - DNA, 30 bp, Homo sapiens
gagttcttccaaacgttctgagttttgaga

SEQ ID NO: 44210 - DNA, 30 bp, Homo sapiens
agagcaggaaggcagctcctgattctgact

SEQ ID NO: 44211 - DNA, 30 bp, Homo sapiens
tcgaggggttgttcaataacagcaggtatg

SEQ ID NO: 44212 - DNA, 30 bp, Homo sapiens
ctcatatgtgactgtattctttccaacatg

SEQ ID NO: 44213 - DNA, 30 bp, Homo sapiens
catctggcctgagacagatgctggagccca

SEQ ID NO: 44214 - DNA, 30 bp, Homo sapiens
tccaggatttaagtctaagaccttcttgaa

SEQ ID NO: 44215 - DNA, 30 bp, Homo sapiens
catcgggctttgataaaaacagagccatct

SEQ ID NO: 44216 - DNA, 30 bp, Homo sapiens
gcctgaggatgcctccctccggattctggc

SEQ ID NO: 44217 - DNA, 30 bp, Homo sapiens
cagcggctgtcacgggggcggcgcagctgc

SEQ ID NO: 44218 - DNA, 30 bp, Homo sapiens
ctcttgtatctccatgagttttggcattgt

SEQ ID NO: 44219 - DNA, 30 bp, Homo sapiens
atgaggtggacggtagctgccttgcggatg

SEQ ID NO: 44220 - DNA, 30 bp, Homo sapiens
acaaggacactgatgagaccatggatctgc

SEQ ID NO: 44221 - DNA, 30 bp, Homo sapiens
cagtgggagcacgatgtgggacccaccgaa

SEQ ID NO: 44222 - DNA, 30 bp, Homo sapiens
ctgaggaaggttttctccagaggtgaagag

SEQ ID NO: 44223 - DNA, 30 bp, Homo sapiens
ctgaggaaccaattccctcagagaggccag

SEQ ID NO: 44224 - DNA, 30 bp, Homo sapiens
ttgggggaaaaaagatgcctttttccaaca

SEQ ID NO: 44225 - DNA, 30 bp, Homo sapiens
atctggtacacctttctcccccggagaaaa

SEQ ID NO: 44226 - DNA, 30 bp, Homo sapiens
ctgtggtcgcgatgccactgtggcaacagc

SEQ ID NO: 44227 - DNA, 30 bp, Homo sapiens
gcttggttatagtcagccatagcttcctca

SEQ ID NO: 44228 - DNA, 30 bp, Homo sapiens
ctctggggatgatggagaagggcagtacag

SEQ ID NO: 44229 - DNA, 30 bp, Homo sapiens
cagagcacgcgggggatgatggtgaagggc

SEQ ID NO: 44230 - DNA, 30 bp, Homo sapiens
acatggtctggaaatgctgcttcagacttc

SEQ ID NO: 44231 - DNA, 30 bp, Homo sapiens
tacatggcttctttttctctctgggagcat

SEQ ID NO: 44232 - DNA, 30 bp, Homo sapiens
ccaattacatcccgagtctgggacccagcc

SEQ ID NO: 44233 - DNA, 30 bp, Homo sapiens
atgcccaggtagagctgcttctcttttcta

SEQ ID NO: 44234 - DNA, 30 bp, Homo sapiens
atgatccaccggccttggcctcccaaagta

SEQ ID NO: 44235 - DNA, 30 bp, Homo sapiens
aaaaggactctgaggtcagccaaggtgagc

SEQ ID NO: 44236 - DNA, 30 bp, Homo sapiens
gcagctggagcacgttggtcgtgtaggggt

SEQ ID NO: 44237 - DNA, 30 bp, Homo sapiens
tagggtgcgccttcagaaacctgctgcact

SEQ ID NO: 44238 - DNA, 30 bp, Homo sapiens
gttaggagaattcagaccaacaagttggcc

SEQ ID NO: 44239 - DNA, 30 bp, Homo sapiens
tgaaggcagctggctgggtctgaggttgct

SEQ ID NO: 44240 - DNA, 30 bp, Homo sapiens
tccaggtggtgaggaccgctctccccgagt

SEQ ID NO: 44241 - DNA, 30 bp, Homo sapiens
gggcctcgcgttctcaggctcctcgcgttc

SEQ ID NO: 44242 - DNA, 30 bp, Homo sapiens
gactggagggcacagtggacgcaccttgag

SEQ ID NO: 44243 - DNA, 30 bp, Homo sapiens
ggacagggtatgtctgggatgggagagctt

SEQ ID NO: 44244 - DNA, 30 bp, Homo sapiens
cgaagccagagagccctcttgaggccggtc

SEQ ID NO: 44245 - DNA, 30 bp, Homo sapiens
acaaggcaggtaacgtggcagccaccgggc

SEQ ID NO: 44246 - DNA, 30 bp, Homo sapiens
tcttggattattcttttgacatttaatcca

SEQ ID NO: 44247 - DNA, 30 bp, Homo sapiens
gctcttgctgtggaccctggggtacacggc

SEQ ID NO: 44248 - DNA, 30 bp, Homo sapiens
tatgggctcacagccaggagggagtcactg

SEQ ID NO: 44249 - DNA, 30 bp, Homo sapiens
caaaggctgcagggttaaggctgctctgga

SEQ ID NO: 44250 - DNA, 30 bp, Homo sapiens
acatcctttttggccagagatcaggcaatg

SEQ ID NO: 44251 - DNA, 30 bp, Homo sapiens
agatggccatatctggatgtaaacaaaaca

SEQ ID NO: 44252 - DNA, 30 bp, Homo sapiens
cctccgggcggcggacgcagcgcgccctct

SEQ ID NO: 44253 - DNA, 30 bp, Homo sapiens
aactggaagctttcttctgaacttgaaggg

SEQ ID NO: 44254 - DNA, 30 bp, Homo sapiens
ctgatttgtttgtagctacacacctatact

SEQ ID NO: 44255 - DNA, 30 bp, Homo sapiens
aaatggatcgaatatgtatattcacagtgg

SEQ ID NO: 44256 - DNA, 30 bp, Homo sapiens
ctgacaaatgtcctccatggagaattcttc

SEQ ID NO: 44257 - DNA, 30 bp, Homo sapiens
agcaggagtacagctgtgacttcacagctc

SEQ ID NO: 44258 - DNA, 30 bp, Homo sapiens
ttccttgggattggtgacgacagccgtggt

SEQ ID NO: 44259 - DNA, 30 bp, Homo sapiens
tagtggggtctcctccggcagccagggaag

SEQ ID NO: 44260 - DNA, 30 bp, Homo sapiens
cacaaagcgcttggattcctgagggttgaa

SEQ ID NO: 44261 - DNA, 30 bp, Homo sapiens
ggctggaaactgattcccgtagtgcctcag

SEQ ID NO: 44262 - DNA, 30 bp, Homo sapiens
tagtggctgccgctggagtcagggcgaggc

SEQ ID NO: 44263 - DNA, 30 bp, Homo sapiens
ctcgcacgccagcttgctgtcgaagctgga

SEQ ID NO: 44264 - DNA, 30 bp, Homo sapiens
cttcttcctcaccctctccttcaacagaat

SEQ ID NO: 44265 - DNA, 30 bp, Homo sapiens
tcctctccgtcagcactatctgctccaacc

SEQ ID NO: 44266 - DNA, 30 bp, Homo sapiens
agtattcttcaccttcttcagcctcggctt

SEQ ID NO: 44267 - DNA, 30 bp, Homo sapiens
agtattcttcgccttcttcagcctcagctt

SEQ ID NO: 44268 - DNA, 30 bp, Homo sapiens
tcctcgtcctcataggagtcgatgcccacc

SEQ ID NO: 44269 - DNA, 30 bp, Homo sapiens
cttcattttcttcttcaaacgaatcagtcc

SEQ ID NO: 44270 - DNA, 30 bp, Homo sapiens
aaactttgcgccacttcctcatagtccctc

SEQ ID NO: 44271 - DNA, 30 bp, Homo sapiens
gcctcctcttcggcctcctcaccgaaatcc

SEQ ID NO: 44272 - DNA, 30 bp, Homo sapiens
tcttctggctccatttctgcctcctccgtg

SEQ ID NO: 44273 - DNA, 30 bp, Homo sapiens
cctcgccctcctcctcctcgaactcccctt

SEQ ID NO: 44274 - DNA, 30 bp, Homo sapiens
acttggggccctgggcctccgactcctcct

SEQ ID NO: 44275 - DNA, 30 bp, Homo sapiens
ccacctcctcctccgcctcctcctcgaact

SEQ ID NO: 44276 - DNA, 30 bp, Homo sapiens
cctcctcagcctcctcctcgaactcgccct

SEQ ID NO: 44277 - DNA, 30 bp, Homo sapiens
atccatcgatctcctcttcctcatcctcaa

SEQ ID NO: 44278 - DNA, 30 bp, Homo sapiens
tctcctcagttcccctgtgcagatgggcaa

SEQ ID NO: 44279 - DNA, 30 bp, Homo sapiens
cctcctcggcatactcctcatcctcctcct

SEQ ID NO: 44280 - DNA, 30 bp, Homo sapiens
aactggcaacaacctgctctaatgacgtga

SEQ ID NO: 44281 - DNA, 30 bp, Homo sapiens
gtctgggtaaatcctgcacaggcatgtttt

SEQ ID NO: 44282 - DNA, 30 bp, Homo sapiens
tcctgggtgccccaggagatgtagtctggc

SEQ ID NO: 44283 - DNA, 30 bp, Homo sapiens
tcctgggtgccccaggaaatgtagtctggc

SEQ ID NO: 44284 - DNA, 30 bp, Homo sapiens
gtgcggtgactgcgaccctgggtgcaggag

SEQ ID NO: 44285 - DNA, 30 bp, Homo sapiens
gtgtgggagctgcgccgccccctggtaccc

SEQ ID NO: 44286 - DNA, 30 bp, Homo sapiens
tataggcacatctcaacctcaatttcacgc

SEQ ID NO: 44287 - DNA, 30 bp, Homo sapiens
aaacgagttctgaaacaaagcgagtgccag

SEQ ID NO: 44288 - DNA, 30 bp, Homo sapiens
gttccaccagcctgggtatagtatttgtta

SEQ ID NO: 44289 - DNA, 30 bp, Homo sapiens
gaaaggatcctctacagacggctttgttta

SEQ ID NO: 44290 - DNA, 30 bp, Homo sapiens
ttttgggaggtcaaggtgggcggattgctt

SEQ ID NO: 44291 - DNA, 30 bp, Homo sapiens
cagccatgagtgacaacgctagagattcca

SEQ ID NO: 44292 - DNA, 30 bp, Homo sapiens
gcgtcctggtagtagttgttgaagttgatg

SEQ ID NO: 44293 - DNA, 30 bp, Homo sapiens
gatattcttctcctcctcagtcatggccag

SEQ ID NO: 44294 - DNA, 30 bp, Homo sapiens
actcggatgacaggcatgggcttcgggcta

SEQ ID NO: 44295 - DNA, 30 bp, Homo sapiens
cgcaggccagcttcccgtcgaaactggaga

SEQ ID NO: 44296 - DNA, 30 bp, Homo sapiens
aactggacaagcagatgctgaaggcctgga

SEQ ID NO: 44297 - DNA, 30 bp, Homo sapiens
catgcttatctgatgtggtgcaggaacaac

SEQ ID NO: 44298 - DNA, 30 bp, Homo sapiens
tactgtcaaagctagaaagaccgatgccaa

SEQ ID NO: 44299 - DNA, 30 bp, Homo sapiens
atccgtccaaactgcatcacctggtaaatc

SEQ ID NO: 44300 - DNA, 30 bp, Homo sapiens
ttgaggcgctgagtcacgttggccagggca

SEQ ID NO: 44301 - DNA, 30 bp, Homo sapiens
gccagggcccagagggctccgagtcccggg

SEQ ID NO: 44302 - DNA, 30 bp, Homo sapiens
tagaggatcacagggaaatccacgtggatg

SEQ ID NO: 44303 - DNA, 30 bp, Homo sapiens
tacttggaacgaaatattgaaagtagaaaa

SEQ ID NO: 44304 - DNA, 30 bp, Homo sapiens
cagcaccagacggagccccaagcttgcacc

SEQ ID NO: 44305 - DNA, 30 bp, Homo sapiens
ttgagggaggaaaacctgtaagaaatgatg

SEQ ID NO: 44306 - DNA, 30 bp, Homo sapiens
gctggtgaatctccagcccctcgaggccag

SEQ ID NO: 44307 - DNA, 30 bp, Homo sapiens
tatgaagtagccatgctggttaaatgcttt

SEQ ID NO: 44308 - DNA, 30 bp, Homo sapiens
tactctgaaggagaagagtgcactaaaagc

SEQ ID NO: 44309 - DNA, 30 bp, Homo sapiens
gccagatgaaattttggcccgggctcacca

SEQ ID NO: 44310 - DNA, 30 bp, Homo sapiens
actttactgtgaaggagaagagtgcactaa

SEQ ID NO: 44311 - DNA, 30 bp, Homo sapiens
cgctgggcccctaattagtcttcgaattcc

SEQ ID NO: 44312 - DNA, 30 bp, Homo sapiens
agctgtcatccccattttcacccgggccgc

SEQ ID NO: 44313 - DNA, 30 bp, Homo sapiens
tagtgggacgcggacatggaccaggccccc

SEQ ID NO: 44314 - DNA, 30 bp, Homo sapiens
tagtgggaggcggacatggaccacgcgccc

SEQ ID NO: 44315 - DNA, 30 bp, Homo sapiens
aggtggggtaaattcggcctcttcactgtg

SEQ ID NO: 44316 - DNA, 30 bp, Homo sapiens
taaaggccactcactttggctgagccaaaa

SEQ ID NO: 44317 - DNA, 30 bp, Homo sapiens
ctttgaacgcttggaggtgtctggctggtc

SEQ ID NO: 44318 - DNA, 30 bp, Homo sapiens
tcaatacattctggaccaatgcactcgcag

SEQ ID NO: 44319 - DNA, 30 bp, Homo sapiens
accaggtttccgcaatctctgtgacagccc

SEQ ID NO: 44320 - DNA, 30 bp, Homo sapiens
ccctggcggaggtgggctcttgaggcccag

SEQ ID NO: 44321 - DNA, 30 bp, Homo sapiens
agattggtgtcagccacgttgcgcggctgg

SEQ ID NO: 44322 - DNA, 30 bp, Homo sapiens
cgatggccggagcagagcctgtggacgggg

SEQ ID NO: 44323 - DNA, 30 bp, Homo sapiens
tattggctccagaaaattcacccacctttt

SEQ ID NO: 44324 - DNA, 30 bp, Homo sapiens
agcttcttcaggaaggcctccaactgatcc

SEQ ID NO: 44325 - DNA, 30 bp, Homo sapiens
ctccttattcctttcagacaccagtgtggc

SEQ ID NO: 44326 - DNA, 30 bp, Homo sapiens
agcctttcctgagcttccttcatcccctga

SEQ ID NO: 44327 - DNA, 30 bp, Homo sapiens
gttcctgctcttgtcctggaattagccacc

SEQ ID NO: 44328 - DNA, 30 bp, Homo sapiens
cattctcctgcacatctgtttctttcatac

SEQ ID NO: 44329 - DNA, 30 bp, Homo sapiens
accaggttggcctgaagacactcagattct

SEQ ID NO: 44330 - DNA, 30 bp, Homo sapiens
gggcgccgcaaagttcatccaccttttctt

SEQ ID NO: 44331 - DNA, 30 bp, Homo sapiens
gttcgtctttcgcttggctcaggacaaagc

SEQ ID NO: 44332 - DNA, 30 bp, Homo sapiens
tgcttaagcaaagtcctgaaattagctctg

SEQ ID NO: 44333 - DNA, 30 bp, Homo sapiens
catttccatcatctgcaagacacaggttgc

SEQ ID NO: 44334 - DNA, 30 bp, Homo sapiens
atagttttcttttccagctttgtgaagttt

SEQ ID NO: 44335 - DNA, 30 bp, Homo sapiens
ttgaggatgcagggatccacctcagtataa

SEQ ID NO: 44336 - DNA, 30 bp, Homo sapiens
tagtggctttctccttttttgccaactact

SEQ ID NO: 44337 - DNA, 30 bp, Homo sapiens
tagcggtacttggtggagtagtccttgggg

SEQ ID NO: 44338 - DNA, 30 bp, Homo sapiens
tcctggagtgactccctcctcttatcagca

SEQ ID NO: 44339 - DNA, 30 bp, Homo sapiens
ctttggacaataagcttccccctcattgct

SEQ ID NO: 44340 - DNA, 30 bp, Homo sapiens
cagccagcctggaggatgcttgccccagag

SEQ ID NO: 44341 - DNA, 30 bp, Homo sapiens
cagtctcttctctggttttttccagcatgt

SEQ ID NO: 44342 - DNA, 30 bp, Homo sapiens
gcagcctgtcaccgtggggtccaggcctga

SEQ ID NO: 44343 - DNA, 30 bp, Homo sapiens
cagcctttctgagtgatgtctagtcctgac

SEQ ID NO: 44344 - DNA, 30 bp, Homo sapiens
caaacatcatcctttctcatggctggctct

SEQ ID NO: 44345 - DNA, 30 bp, Homo sapiens
cacacgctgaacactgaaggggcctggcct

SEQ ID NO: 44346 - DNA, 30 bp, Homo sapiens
ctgcggcggcagaacgagctctgcgaaggg

SEQ ID NO: 44347 - DNA, 30 bp, Homo sapiens
taatagttggatgcggattgtacccttcaa

SEQ ID NO: 44348 - DNA, 30 bp, Homo sapiens
ggaaggacgaccgcacgggcaccggcaccc

SEQ ID NO: 44349 - DNA, 30 bp, Homo sapiens
ctgtggtaatcctctttctccatgaggagt

SEQ ID NO: 44350 - DNA, 30 bp, Homo sapiens
gtgtggcagtagcccttgctgcagcagcaa

SEQ ID NO: 44351 - DNA, 30 bp, Homo sapiens
atacggcctctgtgtgttgaggtcgctgta

SEQ ID NO: 44352 - DNA, 30 bp, Homo sapiens
actgattaggattctggagtttttcatatt

SEQ ID NO: 44353 - DNA, 30 bp, Homo sapiens
agcttgctccgcggggcctctgccaggggc

SEQ ID NO: 44354 - DNA, 30 bp, Homo sapiens
tattgtcccgggtgttgctggtgattatgc

SEQ ID NO: 44355 - DNA, 30 bp, Homo sapiens
ccttgggatcaaagcttctttcattggcac

SEQ ID NO: 44356 - DNA, 30 bp, Homo sapiens
ttcagggaagatggtaacattgattcctag

SEQ ID NO: 44357 - DNA, 30 bp, Homo sapiens
tgtaggctttgtcttgaatgtgtaggacca

SEQ ID NO: 44358 - DNA, 30 bp, Homo sapiens
tctttcacgatctctcgaccgcctcctgtc

SEQ ID NO: 44359 - DNA, 30 bp, Homo sapiens
gcccgggagcctgggaaggatggggcagga

SEQ ID NO: 44360 - DNA, 30 bp, Homo sapiens
aagcggccatgccagtgatcaggggaacac

SEQ ID NO: 44361 - DNA, 30 bp, Homo sapiens
ccagaagtcccggcggtgataagagtcggg

SEQ ID NO: 44362 - DNA, 30 bp, Homo sapiens
gtgtggagatctggactgggatctggactt

SEQ ID NO: 44363 - DNA, 30 bp, Homo sapiens
ccgcatttgtatgatctggagcagagcctc

SEQ ID NO: 44364 - DNA, 30 bp, Homo sapiens
ttcaccagctcatgaactccattctcatcg

SEQ ID NO: 44365 - DNA, 30 bp, Homo sapiens
gctgcggctccctggcctggtcttcatcca

SEQ ID NO: 44366 - DNA, 30 bp, Homo sapiens
cagcggatggtgtatcggacatagggaacc

SEQ ID NO: 44367 - DNA, 30 bp, Homo sapiens
gttctatacgtgacctctttgcactgagat

SEQ ID NO: 44368 - DNA, 30 bp, Homo sapiens
ctgtggggtggtgacatcagcaaccgccag

SEQ ID NO: 44369 - DNA, 30 bp, Homo sapiens
atgaggtcttccaagctttcaccagaatct

SEQ ID NO: 44370 - DNA, 30 bp, Homo sapiens
tatttgaccttcttcttgggacgcaggttg

SEQ ID NO: 44371 - DNA, 30 bp, Homo sapiens
gcgtggtggtggtggcgcacactggtaatt

SEQ ID NO: 44372 - DNA, 30 bp, Homo sapiens
tactggaggtcccggcaaatcttcatctcc

SEQ ID NO: 44373 - DNA, 30 bp, Homo sapiens
cacagctcatagtgcagaggtgggaaggca

SEQ ID NO: 44374 - DNA, 30 bp, Homo sapiens
acgtgcgatttagtgtctggaagattctag

SEQ ID NO: 44375 - DNA, 30 bp, Homo sapiens
agcaggaagttggtggcgacattgaggtca

SEQ ID NO: 44376 - DNA, 30 bp, Homo sapiens
tctctctgcctccatggcagggtgggccct

SEQ ID NO: 44377 - DNA, 30 bp, Homo sapiens
ctctggccgtccatggccgccatggctttc

SEQ ID NO: 44378 - DNA, 30 bp, Homo sapiens
agctggctcctgcccgagccatgaggtctt

SEQ ID NO: 44379 - DNA, 30 bp, Homo sapiens
cactgggcacaggccaccagctcctccagg

SEQ ID NO: 44380 - DNA, 30 bp, Homo sapiens
gtatggagagttgccgtaggcaggtttgga

SEQ ID NO: 44381 - DNA, 30 bp, Homo sapiens
agttggccccccagctgtagctgttgtagg

SEQ ID NO: 44382 - DNA, 30 bp, Homo sapiens
tggtcatcgacgaaattgaggatgtcctgg

SEQ ID NO: 44383 - DNA, 30 bp, Homo sapiens
tagctctcagccgtccagaaatgcttgtaa

SEQ ID NO: 44384 - DNA, 30 bp, Homo sapiens
atccagttcctccagttaaatgctgcgttc

SEQ ID NO: 44385 - DNA, 30 bp, Homo sapiens
cccattttccttcctctttattttcttcac

SEQ ID NO: 44386 - DNA, 30 bp, Homo sapiens
gcaaggtctctctccagttgaagcccccag

SEQ ID NO: 44387 - DNA, 30 bp, Homo sapiens
ctcaggcgcaggaccaggtgcagggtcgac

SEQ ID NO: 44388 - DNA, 30 bp, Homo sapiens
ctcaagcgcaggaccaagtgcagagtggac

SEQ ID NO: 44389 - DNA, 30 bp, Homo sapiens
aatacaataacatgccaggaagagtaagtt

SEQ ID NO: 44390 - DNA, 30 bp, Homo sapiens
ttgttctactattgcagaaacacgcttttc

SEQ ID NO: 44391 - DNA, 30 bp, Homo sapiens
ttgttcaacaatggccgaaactcttttctc

SEQ ID NO: 44392 - DNA, 30 bp, Homo sapiens
tcctggctggtgacctgctttgagtaggtt

SEQ ID NO: 44393 - DNA, 30 bp, Homo sapiens
caagggactatcaatgttgggtttgttcca

SEQ ID NO: 44394 - DNA, 30 bp, Homo sapiens
tcttgcatgtctgttgtatttttctttgtc

SEQ ID NO: 44395 - DNA, 30 bp, Homo sapiens
ccgagctattctgttgtacttttctctatc

SEQ ID NO: 44396 - DNA, 30 bp, Homo sapiens
acatggcatacttctgagtccattcccgag

SEQ ID NO: 44397 - DNA, 30 bp, Homo sapiens
acatagcgtatttctctgtccactctcttg

SEQ ID NO: 44398 - DNA, 30 bp, Homo sapiens
tcttgctagtctgttgtacttctctctgtc

SEQ ID NO: 44399 - DNA, 30 bp, Homo sapiens
gtctggccattctgtcatgttctgctctgt

SEQ ID NO: 44400 - DNA, 30 bp, Homo sapiens
atgtggcgtaccgcttggtccactgtctgg

SEQ ID NO: 44401 - DNA, 30 bp, Homo sapiens
atctggcataacgtttgatgtagtcatcca

SEQ ID NO: 44402 - DNA, 30 bp, Homo sapiens
tcttggctttttcttacacagcgggcaact

SEQ ID NO: 44403 - DNA, 30 bp, Homo sapiens
gacttctggacgatctgcttggcaatctta

SEQ ID NO: 44404 - DNA, 30 bp, Homo sapiens
tcctgggcctcatcttcggaaaagtcagac

SEQ ID NO: 44405 - DNA, 30 bp, Homo sapiens
atgagggcgcaaacttcttggcttgtgctc

SEQ ID NO: 44406 - DNA, 30 bp, Homo sapiens
cgtcggaatataagagctgccaatgccaaa

SEQ ID NO: 44407 - DNA, 30 bp, Homo sapiens
tcctgcgcgatgctcctcagcacgtacttg

SEQ ID NO: 44408 - DNA, 30 bp, Homo sapiens
ttactcagaagcaattctgttgcagtctct

SEQ ID NO: 44409 - DNA, 30 bp, Homo sapiens
cacaggtcgcttttccccatatttctttgt

SEQ ID NO: 44410 - DNA, 30 bp, Homo sapiens
aggagggccggtccactccgaatcggaggg

SEQ ID NO: 44411 - DNA, 30 bp, Homo sapiens
ttcaggcagcgctcaaagtaggtggagccg

SEQ ID NO: 44412 - DNA, 30 bp, Homo sapiens
ccatgctctagctgtttcaatggcttgggc

SEQ ID NO: 44413 - DNA, 30 bp, Homo sapiens
tgcactccggcatgcctgcctctagcaggg

SEQ ID NO: 44414 - DNA, 30 bp, Homo sapiens
tcttttgggggtgtgtaccagccgtttttt

SEQ ID NO: 44415 - DNA, 30 bp, Homo sapiens
tcctttggaggggtgtaccagccatttttc

SEQ ID NO: 44416 - DNA, 30 bp, Homo sapiens
cgaactgttctccttagtatcttctagacg

SEQ ID NO: 44417 - DNA, 30 bp, Homo sapiens
cgtcggacacgggcggggtgacccaaccat

SEQ ID NO: 44418 - DNA, 30 bp, Homo sapiens
tcccagaatcatcatcatcataacagtcgg

SEQ ID NO: 44419 - DNA, 30 bp, Homo sapiens
acagccgccgcagcgcccgcttcttgtccg

SEQ ID NO: 44420 - DNA, 30 bp, Homo sapiens
atcaggatgaaatttcttttctatgcctac

SEQ ID NO: 44421 - DNA, 30 bp, Homo sapiens
tttctgatgctgtagatccattttcttcca

SEQ ID NO: 44422 - DNA, 30 bp, Homo sapiens
cttcgggcggctgagggagtttcatatttt

SEQ ID NO: 44423 - DNA, 30 bp, Homo sapiens
gactgggaactctcacaaatcaggaaggtc

SEQ ID NO: 44424 - DNA, 30 bp, Homo sapiens
ttctggtggctgtggaagcttcatattttc

SEQ ID NO: 44425 - DNA, 30 bp, Homo sapiens
agctggaaagcatgctaataatgctaagac

SEQ ID NO: 44426 - DNA, 30 bp, Homo sapiens
ctcaggctcccatgaaggtctgtctctgtc

SEQ ID NO: 44427 - DNA, 30 bp, Homo sapiens
cctttggcatacgtgatggccttcaacaat

SEQ ID NO: 44428 - DNA, 30 bp, Homo sapiens
gcgagacaactgccagtcataccagcttct

SEQ ID NO: 44429 - DNA, 30 bp, Homo sapiens
ttcatgctgatggcgtagcgcagcttctcg

SEQ ID NO: 44430 - DNA, 30 bp, Homo sapiens
cagcggcacattcaatcgcatagagaagtt

SEQ ID NO: 44431 - DNA, 30 bp, Homo sapiens
aggaattcacacggcgaagggatgaaggca

SEQ ID NO: 44432 - DNA, 30 bp, Homo sapiens
gttgtttcctctctgcaagccaccgttgga

SEQ ID NO: 44433 - DNA, 30 bp, Homo sapiens
ctgaatctgctctttcagttctggcactgg

SEQ ID NO: 44434 - DNA, 30 bp, Homo sapiens
ccccagcacagtgtctttgattgcatccac

SEQ ID NO: 44435 - DNA, 30 bp, Homo sapiens
cagtggctagatgaggactggatggcgtag

SEQ ID NO: 44436 - DNA, 30 bp, Homo sapiens
aaattttgggcagactgcctgctggtgcca

SEQ ID NO: 44437 - DNA, 30 bp, Homo sapiens
atgaggactcctgtgtagagaaaggagcca

SEQ ID NO: 44438 - DNA, 30 bp, Homo sapiens
tacaggattacacaacaattactctctcca

SEQ ID NO: 44439 - DNA, 30 bp, Homo sapiens
atttggagaagcccttctccattgtctcag

SEQ ID NO: 44440 - DNA, 30 bp, Homo sapiens
tactgatcagctgctgcctcctccttctcc

SEQ ID NO: 44441 - DNA, 30 bp, Homo sapiens
tcatcccatcgtggatttcatagtccccca

SEQ ID NO: 44442 - DNA, 30 bp, Homo sapiens
catggggctcctccagcaaagatgagctcc

SEQ ID NO: 44443 - DNA, 30 bp, Homo sapiens
ttctttgagagatatctttcccaatatttg

SEQ ID NO: 44444 - DNA, 30 bp, Homo sapiens
ccgtggtacagcaggccctttcccgtgaag

SEQ ID NO: 44445 - DNA, 30 bp, Homo sapiens
ccgtggtaatttagtgtcccctttactttg

SEQ ID NO: 44446 - DNA, 30 bp, Homo sapiens
aagtggacccgcagcacgtcttggctagca

SEQ ID NO: 44447 - DNA, 30 bp, Homo sapiens
cccaggcagggtcggcacaggaggtggccg

SEQ ID NO: 44448 - DNA, 30 bp, Homo sapiens
cggtgggaccctgtctgtaaacctgattaa

SEQ ID NO: 44449 - DNA, 30 bp, Homo sapiens
tgatggctgggagcccagtaacctttcaat

SEQ ID NO: 44450 - DNA, 30 bp, Homo sapiens
ggctgggagcccagcagcctttcaatggct

SEQ ID NO: 44451 - DNA, 30 bp, Homo sapiens
actgtctcagcttctccacagcagcatcca

SEQ ID NO: 44452 - DNA, 30 bp, Homo sapiens
agctgggagcccagcagtctctcgatagct

SEQ ID NO: 44453 - DNA, 30 bp, Homo sapiens
cactaagcagatcagaaatctgtgtctgct

SEQ ID NO: 44454 - DNA, 30 bp, Homo sapiens
caaatggagcttccgataccgctcacgaga

SEQ ID NO: 44455 - DNA, 30 bp, Homo sapiens
cagaggtgagccactgcgcccagcagagat

SEQ ID NO: 44456 - DNA, 30 bp, Homo sapiens
aatgccaaccagtgtctgattggcttcctg

SEQ ID NO: 44457 - DNA, 30 bp, Homo sapiens
gtaatgtggaccccatcttttattgatgtg

SEQ ID NO: 44458 - DNA, 30 bp, Homo sapiens
caggggactgagttcaacaggtccttcagg

SEQ ID NO: 44459 - DNA, 30 bp, Homo sapiens
gagtgggacgtaaagtcgagaaatgcaagt

SEQ ID NO: 44460 - DNA, 30 bp, Homo sapiens
tagctgcagtaatactgcatcccatccact

SEQ ID NO: 44461 - DNA, 30 bp, Homo sapiens
agtcctggggtggtgggggctggttgatga

SEQ ID NO: 44462 - DNA, 30 bp, Homo sapiens
cactggtgttgggttctgcacaggttggct

SEQ ID NO: 44463 - DNA, 30 bp, Homo sapiens
agttggagtcagagtctgaggagtcccctg

SEQ ID NO: 44464 - DNA, 30 bp, Homo sapiens
ctgcagtctgaagagttactgctttcttcc

SEQ ID NO: 44465 - DNA, 30 bp, Homo sapiens
ctctttgcatccctccttttcctaggcatg

SEQ ID NO: 44466 - DNA, 30 bp, Homo sapiens
agctgggacatttcttggccacaatgagaa

SEQ ID NO: 44467 - DNA, 30 bp, Homo sapiens
ttccccatcttccagtgagatgcccagcac

SEQ ID NO: 44468 - DNA, 30 bp, Homo sapiens
tattgggggctgggactgggtccaggacag

SEQ ID NO: 44469 - DNA, 30 bp, Homo sapiens
tgagtgtctcatctagcaacctgaggacag

SEQ ID NO: 44470 - DNA, 30 bp, Homo sapiens
gtcaggctttcatctgttagctctttattc

SEQ ID NO: 44471 - DNA, 30 bp, Homo sapiens
cttaacagactccagaaattgagcatttgt

SEQ ID NO: 44472 - DNA, 30 bp, Homo sapiens
gagtggaatttccattccaagtgttgtttt

SEQ ID NO: 44473 - DNA, 30 bp, Homo sapiens
cgatggctgacaggagctcgggtttcagga

SEQ ID NO: 44474 - DNA, 30 bp, Homo sapiens
caaagacagtctcttgaggacaaaggcctg

SEQ ID NO: 44475 - DNA, 30 bp, Homo sapiens
agttggtctgctccttctcctccaggatga

SEQ ID NO: 44476 - DNA, 30 bp, Homo sapiens
agagagccacggcagagaagcggacttctc

SEQ ID NO: 44477 - DNA, 30 bp, Homo sapiens
ccatggttaattggaaatggcttccgccca

SEQ ID NO: 44478 - DNA, 30 bp, Homo sapiens
ctttctttgcgttctgtttttcttttgcct

SEQ ID NO: 44479 - DNA, 30 bp, Homo sapiens
agtgtcttctcaaagtgtttctcaaacttt

SEQ ID NO: 44480 - DNA, 30 bp, Homo sapiens
tgctggtgttctgctaaagtctttaacaat

SEQ ID NO: 44481 - DNA, 30 bp, Homo sapiens
cagtggggtctgctgctggactccaaatgt

SEQ ID NO: 44482 - DNA, 30 bp, Homo sapiens
agaatgtcctggatgtgctgcacgatcagg

SEQ ID NO: 44483 - DNA, 30 bp, Homo sapiens
atgcggcctgctgctggactccgatgcctg

SEQ ID NO: 44484 - DNA, 30 bp, Homo sapiens
tgtaggccacttcctcctcgtcactgccat

SEQ ID NO: 44485 - DNA, 30 bp, Homo sapiens
aagatggtctgcaaagaggtgaaagtcagg

SEQ ID NO: 44486 - DNA, 30 bp, Homo sapiens
cttgcccaccgagtcgaatatgatgcggtt

SEQ ID NO: 44487 - DNA, 30 bp, Homo sapiens
cacaggcttcctgtgttcgggcctttgtgc

SEQ ID NO: 44488 - DNA, 30 bp, Homo sapiens
cttcttcctcccaatttgcgccatcaggtg

SEQ ID NO: 44489 - DNA, 30 bp, Homo sapiens
tctgccttgactttgacagttctcgtttca

SEQ ID NO: 44490 - DNA, 30 bp, Homo sapiens
agaagggagcctctcgggaagtgcaggcag

SEQ ID NO: 44491 - DNA, 30 bp, Homo sapiens
acatctggactttcatcagggcccgtttca

SEQ ID NO: 44492 - DNA, 30 bp, Homo sapiens
gtagaaggctgtggggccctcctgggccac

SEQ ID NO: 44493 - DNA, 30 bp, Homo sapiens
cactccagcctgggtaacagagcgagactc

SEQ ID NO: 44494 - DNA, 30 bp, Homo sapiens
ggacagctgcacttgagaggtatgactcac

SEQ ID NO: 44495 - DNA, 30 bp, Homo sapiens
tcttctccttgctcgccaataacccatact

SEQ ID NO: 44496 - DNA, 30 bp, Homo sapiens
ctgtggattgaggatgcactgctttggagt

SEQ ID NO: 44497 - DNA, 30 bp, Homo sapiens
cattggttgcatttctctttgtgttggatg

SEQ ID NO: 44498 - DNA, 30 bp, Homo sapiens
ttgattggggaggggctgggctctacccct

SEQ ID NO: 44499 - DNA, 30 bp, Homo sapiens
ttacgcaatgactgtccttctccagagaaa

SEQ ID NO: 44500 - DNA, 30 bp, Homo sapiens
cagatgatttcctagatttgagaacaaggt

SEQ ID NO: 44501 - DNA, 30 bp, Homo sapiens
ggaagggcaaataaaatcttcccttacaca

SEQ ID NO: 44502 - DNA, 30 bp, Homo sapiens
cgatctctaggaataatccgcagttctgaa

SEQ ID NO: 44503 - DNA, 30 bp, Homo sapiens
tccaaggtgcgctgctgctgttgggagcta

SEQ ID NO: 44504 - DNA, 30 bp, Homo sapiens
ctgaggaagacataagttatagtatgcatc

SEQ ID NO: 44505 - DNA, 30 bp, Homo sapiens
ctgtacccccacagcgtaatctgtagcgac

SEQ ID NO: 44506 - DNA, 30 bp, Homo sapiens
tttaggtttcttgttaggtggatcttgaag

SEQ ID NO: 44507 - DNA, 30 bp, Homo sapiens
cggcttggttcttttgtcttctctttgtac

SEQ ID NO: 44508 - DNA, 30 bp, Homo sapiens
attctgggacaattctggcagcagctttta

SEQ ID NO: 44509 - DNA, 30 bp, Homo sapiens
tgcgaaggtttccagacacaatcttgttct

SEQ ID NO: 44510 - DNA, 30 bp, Homo sapiens
caatgggtcttggatttgtgggctttctta

SEQ ID NO: 44511 - DNA, 30 bp, Homo sapiens
atatagccgttgtcacacagaccagcaaga

SEQ ID NO: 44512 - DNA, 30 bp, Homo sapiens
cacaggccagcaggaacccaatcacatcta

SEQ ID NO: 44513 - DNA, 30 bp, Homo sapiens
ctagcaaacttccagaaacaaaacagacaa

SEQ ID NO: 44514 - DNA, 30 bp, Homo sapiens
ttcccttttctagcaaacttccagaaacaa

SEQ ID NO: 44515 - DNA, 30 bp, Homo sapiens
ttggcaagctttcggaaacaaaacaggcaa

SEQ ID NO: 44516 - DNA, 30 bp, Homo sapiens; identical to SEQ ID NO: 44515

SEQ ID NO: 44517 - DNA, 30 bp, Homo sapiens
caagggctgttgcaattacgttggcccttt

SEQ ID NO: 44518 - DNA, 30 bp, Homo sapiens
gtacagccgagtattgagtcctaaagtatc

SEQ ID NO: 44519 - DNA, 30 bp, Homo sapiens
ctttcctgttctaacaaacttccagacaca

SEQ ID NO: 44520 - DNA, 30 bp, Homo sapiens
gtagagccgagtattgagacctaaggtatc

SEQ ID NO: 44521 - DNA, 30 bp, Homo sapiens
agaccagcaggaacccaatcacatccaaag

SEQ ID NO: 44522 - DNA, 30 bp, Homo sapiens
gtcttcttcaccttcctggccccacgcagc

SEQ ID NO: 44523 - DNA, 30 bp, Homo sapiens
cagtggttcaggatacactccagaggagaa

SEQ ID NO: 44524 - DNA, 30 bp, Homo sapiens
gtctccttcacctttctggccccacgcagc

SEQ ID NO: 44525 - DNA, 30 bp, Homo sapiens
ttgaggattccattgtggtaatgtccatta

SEQ ID NO: 44526 - DNA, 30 bp, Homo sapiens
ttgtaggcactcagcgggtagaatgtagcc

SEQ ID NO: 44527 - DNA, 30 bp, Homo sapiens
cattcagcagtcttagcactggagtgggaa

SEQ ID NO: 44528 - DNA, 30 bp, Homo sapiens
caccggccattgccgtagccggggaagagc

SEQ ID NO: 44529 - DNA, 30 bp, Homo sapiens
agaaggggttatatttcctaatctcctgaa

SEQ ID NO: 44530 - DNA, 30 bp, Homo sapiens
attcaactgtcatcttctttatatgatgaa

SEQ ID NO: 44531 - DNA, 30 bp, Homo sapiens
cttaggaaggcagttggaaaatcctttcca

SEQ ID NO: 44532 - DNA, 30 bp, Homo sapiens
ctgtagccagggaagaaaaggtcaagtaga

SEQ ID NO: 44533 - DNA, 30 bp, Homo sapiens
tcctctgccagctttggtccgtgtccgact

SEQ ID NO: 44534 - DNA, 30 bp, Homo sapiens
tggctgaacaagtttgctttcccaccaaca

SEQ ID NO: 44535 - DNA, 30 bp, Homo sapiens
ctgccagctagaatgaagcagaggaagatg

SEQ ID NO: 44536 - DNA, 30 bp, Homo sapiens
atgccagggaggatgaagcaggggaggatg

SEQ ID NO: 44537 - DNA, 30 bp, Homo sapiens
gccagggaggatgaagcagaggatgatgag

SEQ ID NO: 44538 - DNA, 30 bp, Homo sapiens
agcagcgccgagagtctccgctcaatgcac

SEQ ID NO: 44539 - DNA, 30 bp, Homo sapiens
acacggttgcggtgctatggcagagcgccg

SEQ ID NO: 44540 - DNA, 30 bp, Homo sapiens
tgaagggtgcaagagctacgaacagattcc

SEQ ID NO: 44541 - DNA, 30 bp, Homo sapiens
cagaagcttctgctcctttgggtcctcctt

SEQ ID NO: 44542 - DNA, 30 bp, Homo sapiens
gcccaacggcttggaggatttccagggcca

SEQ ID NO: 44543 - DNA, 30 bp, Homo sapiens
ccgtgataagttttcgctgccatcatagga

SEQ ID NO: 44544 - DNA, 30 bp, Homo sapiens
gtcagggtcaaggtggccgagagaagcaga

SEQ ID NO: 44545 - DNA, 30 bp, Homo sapiens
attcgtagaacacctggtagctgaagttgt

SEQ ID NO: 44546 - DNA, 30 bp, Homo sapiens
ctactcaaatacgcttcccaagcagctttt

SEQ ID NO: 44547 - DNA, 30 bp, Homo sapiens
tgtaggaatagtctgctttattgtgcatca

SEQ ID NO: 44548 - DNA, 30 bp, Homo sapiens
aggcggaggaaggcaggcgtgaactggtag

SEQ ID NO: 44549 - DNA, 30 bp, Homo sapiens
cttccccactcccagaagaccctgcccgcg

SEQ ID NO: 44550 - DNA, 30 bp, Homo sapiens
tactggcctccattataggcataatcagcc

SEQ ID NO: 44551 - DNA, 30 bp, Homo sapiens
taaggcgcaggcgcggcaccgccctcctcg

SEQ ID NO: 44552 - DNA, 30 bp, Homo sapiens
ctccgtggaacgagactctgatttgagttt

SEQ ID NO: 44553 - DNA, 30 bp, Homo sapiens
catcactggtcctctgagagagtattctaa

SEQ ID NO: 44554 - DNA, 30 bp, Homo sapiens
tgccggccgcaaggcatgctgggaggcctg

SEQ ID NO: 44555 - DNA, 30 bp, Homo sapiens
cactctccatcttggttgggttggataagc

SEQ ID NO: 44556 - DNA, 30 bp, Homo sapiens
cactggtttaatgaaaccataatccatgca

SEQ ID NO: 44557 - DNA, 30 bp, Homo sapiens
cagtgccagggaaagcccgtagagcagaat

SEQ ID NO: 44558 - DNA, 30 bp, Homo sapiens
cactcagcctccgacactgtgaagaggcca

SEQ ID NO: 44559 - DNA, 30 bp, Homo sapiens
cgtcggtggccacagccaccagcatctcac

SEQ ID NO: 44560 - DNA, 30 bp, Homo sapiens
tgctgctaaggacaccaccgtttcatgtct

SEQ ID NO: 44561 - DNA, 30 bp, Homo sapiens
tccaggccctggttatcccgggcgcccccg

SEQ ID NO: 44562 - DNA, 30 bp, Homo sapiens
tgcctgctgtagttgaagtcggcttcatca

SEQ ID NO: 44563 - DNA, 30 bp, Homo sapiens
tagaggataaaattgagaggctgcttccga

SEQ ID NO: 44564 - DNA, 30 bp, Homo sapiens
tccccagctcagtgggagtaaaggtgaact

SEQ ID NO: 44565 - DNA, 30 bp, Homo sapiens
gcctggttgacctgtcctggagcgtggggt

SEQ ID NO: 44566 - DNA, 30 bp, Homo sapiens
actgctcctccggcccgtctcccccctgcg

SEQ ID NO: 44567 - DNA, 30 bp, Homo sapiens
tccatgtccagctcctcgccctccggcggg

SEQ ID NO: 44568 - DNA, 30 bp, Homo sapiens
agtcaatgggcttcttgccagacttctgca

SEQ ID NO: 44569 - DNA, 30 bp, Homo sapiens
gactggagggtgtgggcccggccaggctgg

SEQ ID NO: 44570 - DNA, 30 bp, Homo sapiens
tgcaggggctggcccttgcagtaggggcac

SEQ ID NO: 44571 - DNA, 30 bp, Homo sapiens
aggcggtggaggaaggtcctgtgtgcaccc

SEQ ID NO: 44572 - DNA, 30 bp, Homo sapiens
actctttcacgatggtggggctgtagttgg

SEQ ID NO: 44573 - DNA, 30 bp, Homo sapiens
aatactgggacagccccgtcaccccgccat

SEQ ID NO: 44574 - DNA, 30 bp, Homo sapiens
accagtcttaaagattagatctgcattagg

SEQ ID NO: 44575 - DNA, 30 bp, Homo sapiens
ccctcttctcaggaccagtccccgaacctt

SEQ ID NO: 44576 - DNA, 30 bp, Homo sapiens
tcctggtaaggaataagttctccttcccag

SEQ ID NO: 44577 - DNA, 30 bp, Homo sapiens
cccgcaaacgtttcttttctaactctctcc

SEQ ID NO: 44578 - DNA, 30 bp, Homo sapiens
agctctcttgtcttcgcctccatctccccc

SEQ ID NO: 44579 - DNA, 30 bp, Homo sapiens
cagtagctggaactataggcacgcaccacc

SEQ ID NO: 44580 - DNA, 30 bp, Homo sapiens
ggtcggcggcgaagaactcgaagtagtcgt

SEQ ID NO: 44581 - DNA, 30 bp, Homo sapiens
ctccttcttttctatggctaataccacttt

SEQ ID NO: 44582 - DNA, 30 bp, Homo sapiens
gagcatggtgtagaaatacatggctatcag

SEQ ID NO: 44583 - DNA, 30 bp, Homo sapiens
caggatggcaaacccaaaccacgagatacc

SEQ ID NO: 44584 - DNA, 30 bp, Homo sapiens
gaacatggtacccaggagaacccaaaaagt

SEQ ID NO: 44585 - DNA, 30 bp, Homo sapiens
tacttgcgggagcccagtgccagggcaatg

SEQ ID NO: 44586 - DNA, 30 bp, Homo sapiens
tcttggagcttgctggaatacacctcagcc

SEQ ID NO: 44587 - DNA, 30 bp, Homo sapiens
taggggctgaggctggggagggggtccagg

SEQ ID NO: 44588 - DNA, 30 bp, Homo sapiens
ccccatctcccccagccccatgcaaagagg

SEQ ID NO: 44589 - DNA, 30 bp, Homo sapiens
aggaagccccctcggcaggagtgctgaacg

SEQ ID NO: 44590 - DNA, 30 bp, Homo sapiens
tcagtttcttcttgatgaagtagctcacca

SEQ ID NO: 44591 - DNA, 30 bp, Homo sapiens
cgccgtctgatgaagttggagattaggagc

SEQ ID NO: 44592 - DNA, 30 bp, Homo sapiens
tgtgtaggtgcaacaggatgaacttcagta

SEQ ID NO: 44593 - DNA, 30 bp, Homo sapiens
tactgcctcatgctgaactcaccatgagga

SEQ ID NO: 44594 - DNA, 30 bp, Homo sapiens
aaagtccctcgtcgttgtaagtcggagaat

SEQ ID NO: 44595 - DNA, 30 bp, Homo sapiens
gatcctcctcaggacccttgggggcaaact

SEQ ID NO: 44596 - DNA, 30 bp, Homo sapiens
cgccggcgccgccttcgccgccaaccatcc

SEQ ID NO: 44597 - DNA, 30 bp, Homo sapiens
catgctgactaaacatacttcaaacacagc

SEQ ID NO: 44598 - DNA, 30 bp, Homo sapiens
atccgggcacggagcaggtttcagtgaggt

SEQ ID NO: 44599 - DNA, 30 bp, Homo sapiens
ctctctgatactgtccctcctaaaatccat

SEQ ID NO: 44600 - DNA, 30 bp, Homo sapiens
tcaaggtagaaattttcctttgcctagttt

SEQ ID NO: 44601 - DNA, 30 bp, Homo sapiens
tcagatacggttcaaggtagaaattttcct

SEQ ID NO: 44602 - DNA, 30 bp, Homo sapiens
tagaagcgcagccagaacatgccgctacgg

SEQ ID NO: 44603 - DNA, 30 bp, Homo sapiens
tttccacttgctgccattgacttctggcca

SEQ ID NO: 44604 - DNA, 30 bp, Homo sapiens
atcaccatatcgtcactggtgaactcatac

SEQ ID NO: 44605 - DNA, 30 bp, Homo sapiens
tcccgggcctttacacatttctccaactgc

SEQ ID NO: 44606 - DNA, 30 bp, Homo sapiens
caatggtcctttgcatgcaagaagtcaaag

SEQ ID NO: 44607 - DNA, 30 bp, Homo sapiens
gcaccatggcttacgcctgtaatcccagca

SEQ ID NO: 44608 - DNA, 30 bp, Homo sapiens
gcgcggaggaggtcggccaggcgcaggctg

SEQ ID NO: 44609 - DNA, 30 bp, Homo sapiens
ctgaggctgcgctggcggcgtccttgcaga

SEQ ID NO: 44610 - DNA, 30 bp, Homo sapiens
gccgtatatcttttctctccttcatgtttg

SEQ ID NO: 44611 - DNA, 30 bp, Homo sapiens
caccagctcaatgagctgctggatgttttt

SEQ ID NO: 44612 - DNA, 30 bp, Homo sapiens
tagaggtacttatacacaacctttgagggc

SEQ ID NO: 44613 - DNA, 30 bp, Homo sapiens
ctttctgttgcaatctggcagctttaaact

SEQ ID NO: 44614 - DNA, 30 bp, Homo sapiens
gaggggcgaggtttcttgaatagccaacta

SEQ ID NO: 44615 - DNA, 30 bp, Homo sapiens
ggatggaggagtactcccatgtccccagct

SEQ ID NO: 44616 - DNA, 30 bp, Homo sapiens
gccgccgtgcagagtggagatgaagaggac

SEQ ID NO: 44617 - DNA, 30 bp, Homo sapiens
ttgtggaggaggaaactgaggcacacgcat

SEQ ID NO: 44618 - DNA, 30 bp, Homo sapiens
gagctgcagggcctgctggagcacccgctc

SEQ ID NO: 44619 - DNA, 30 bp, Homo sapiens
caaaggcgcccacatgttctgggtccatgt

SEQ ID NO: 44620 - DNA, 30 bp, Homo sapiens
cacaggtttctccttctgtatccaggccaa

SEQ ID NO: 44621 - DNA, 30 bp, Homo sapiens
ccatggggctggagagccttcctgatgcca

SEQ ID NO: 44622 - DNA, 30 bp, Homo sapiens
caaaggcatcgagaagaacttgttcccaga

SEQ ID NO: 44623 - DNA, 30 bp, Homo sapiens
ctttgggttgggcttctggcatgggcttct

SEQ ID NO: 44624 - DNA, 30 bp, Homo sapiens
tcctggctcctgacgcagagctcctaaatc

SEQ ID NO: 44625 - DNA, 30 bp, Homo sapiens
tttaggcatgattcgaatgaagaggatcat

SEQ ID NO: 44626 - DNA, 30 bp, Homo sapiens
atccgtggtgccgcaactgagctcgaagca

SEQ ID NO: 44627 - DNA, 30 bp, Homo sapiens
tgccgggtgccctcgcccaccatctccagg

SEQ ID NO: 44628 - DNA, 30 bp, Homo sapiens
atatggcttatgttatgggcaggtctgttt

SEQ ID NO: 44629 - DNA, 30 bp, Homo sapiens
agaaggtcagctcatcgtcatactcctttg

SEQ ID NO: 44630 - DNA, 30 bp, Homo sapiens
taacggtgaatttggtttccccttttggac

SEQ ID NO: 44631 - DNA, 30 bp, Homo sapiens
gggccggcgggcgctccatcgcctgccgcc

SEQ ID NO: 44632 - DNA, 30 bp, Homo sapiens
aagtctgtattgactgggtgagtggagctg

SEQ ID NO: 44633 - DNA, 30 bp, Homo sapiens
tacaggtgggtgtctgtgaatgtggtgcgt

SEQ ID NO: 44634 - DNA, 30 bp, Homo sapiens
gaaaggtgtccccaagctggggaggcggga

SEQ ID NO: 44635 - DNA, 30 bp, Homo sapiens
atgttgctttcacagctggagtttttttgg

SEQ ID NO: 44636 - DNA, 30 bp, Homo sapiens
gccaggatcttcactttcatcatcctcatc

SEQ ID NO: 44637 - DNA, 30 bp, Homo sapiens
agtaggagatgtagaaggggaaagagaatt

SEQ ID NO: 44638 - DNA, 30 bp, Homo sapiens
agcaggtccactcggcggtaatacaggagg

SEQ ID NO: 44639 - DNA, 30 bp, Homo sapiens
actcagagctgggtggggagctgcaggcag

SEQ ID NO: 44640 - DNA, 30 bp, Homo sapiens
cagtcccgagactgatagaaaaggatgtaa

SEQ ID NO: 44641 - DNA, 30 bp, Homo sapiens
ctgcggtaaaagtacatgtagcccaggtct

SEQ ID NO: 44642 - DNA, 30 bp, Homo sapiens
tttcaactctgcgaggcccatagagtagaa

SEQ ID NO: 44643 - DNA, 30 bp, Homo sapiens
cagtggcagctgaagcacctttagtttctc

SEQ ID NO: 44644 - DNA, 30 bp, Homo sapiens
tagtggctttttaggagtagaaggacccct

SEQ ID NO: 44645 - DNA, 30 bp, Homo sapiens
agaagtccagagttatcaatgggtccagga

SEQ ID NO: 44646 - DNA, 30 bp, Homo sapiens
gtgctattggctcttgaccttccatcaatg

SEQ ID NO: 44647 - DNA, 30 bp, Homo sapiens
cccttttgattccatttcaaaatcttgtgg

SEQ ID NO: 44648 - DNA, 30 bp, Homo sapiens
ggctctcctggtcctcccttgcagagaagc

SEQ ID NO: 44649 - DNA, 30 bp, Homo sapiens
gtgtcggggtcgtcgaagagagttttagca

SEQ ID NO: 44650 - DNA, 30 bp, Homo sapiens
gtctaaggtgctttcctgagtggctctttc

SEQ ID NO: 44651 - DNA, 30 bp, Homo sapiens
agaccactggcacacaagcagagccctctt

SEQ ID NO: 44652 - DNA, 30 bp, Homo sapiens
cggcggtgacctcggcatcatccattttat

SEQ ID NO: 44653 - DNA, 30 bp, Homo sapiens
gctcttggttctctgcctcttgacacactc

SEQ ID NO: 44654 - DNA, 30 bp, Homo sapiens
ggatctcctggtcctcccttgcagagaagc

SEQ ID NO: 44655 - DNA, 30 bp, Homo sapiens
gttgctcgcctgtcggtgtcttctgcgcca

SEQ ID NO: 44656 - DNA, 30 bp, Homo sapiens
ctttggatctcctggtgctcccttgcagag

SEQ ID NO: 44657 - DNA, 30 bp, Homo sapiens
gcactccatcttcatgtaaaccagaagata

SEQ ID NO: 44658 - DNA, 30 bp, Homo sapiens
aatccacctcctccatgttgctgtaggtgg

SEQ ID NO: 44659 - DNA, 30 bp, Homo sapiens
actctgggataccagaggatagaacacgtt

SEQ ID NO: 44660 - DNA, 30 bp, Homo sapiens
attcgggagggcgggctggccagttcgtag

SEQ ID NO: 44661 - DNA, 30 bp, Homo sapiens
acacggcccgcgtctcggcttcgatcttct

SEQ ID NO: 44662 - DNA, 30 bp, Homo sapiens
cacaggcaccggggtggctcctgcatcagt

SEQ ID NO: 44663 - DNA, 30 bp, Homo sapiens
tccaggaactgtttgtgatagaacagcaag

SEQ ID NO: 44664 - DNA, 30 bp, Homo sapiens
gggatcaacatcatcaaggtcacttctcaa

SEQ ID NO: 44665 - DNA, 30 bp, Homo sapiens
agcaggagttcgactgagggacaacatgat

SEQ ID NO: 44666 - DNA, 30 bp, Homo sapiens
gaagggtctcctctacctccttgctattaa

SEQ ID NO: 44667 - DNA, 30 bp, Homo sapiens
agtaggcttgtgtgttcatttctttcactt

SEQ ID NO: 44668 - DNA, 30 bp, Homo sapiens
cgaaggagaggatcgcagtacatctgttca

SEQ ID NO: 44669 - DNA, 30 bp, Homo sapiens
attgactccatgacagctgcaaatcggcta

SEQ ID NO: 44670 - DNA, 30 bp, Homo sapiens
agcaggtctgtacaaagagtcaccttcgta

SEQ ID NO: 44671 - DNA, 30 bp, Homo sapiens
cagctttggcctggtgttccacgtagaaaa

SEQ ID NO: 44672 - DNA, 30 bp, Homo sapiens
tcctggctctggtgctgcatcctggaaagg

SEQ ID NO: 44673 - DNA, 30 bp, Homo sapiens
ctgaggtttttgagaaggccgtgcagaggt

SEQ ID NO: 44674 - DNA, 30 bp, Homo sapiens
caatttggcaagtatgacaaatgtacagat

SEQ ID NO: 44675 - DNA, 30 bp, Homo sapiens
atctggatcaacatgaacaaccggaggtcg

SEQ ID NO: 44676 - DNA, 30 bp, Homo sapiens
gcttggtttcctttgccagatatccttgtg

SEQ ID NO: 44677 - DNA, 30 bp, Homo sapiens
ctgtggaagtcaccaccattgccacctgca

SEQ ID NO: 44678 - DNA, 30 bp, Homo sapiens
cagcggcgatagctgaggctggcagccttt

SEQ ID NO: 44679 - DNA, 30 bp, Homo sapiens
gggtagtcttccccacttccgtgctaagtg

SEQ ID NO: 44680 - DNA, 30 bp, Homo sapiens
gttctttctgtagaggtgggtctccattta

SEQ ID NO: 44681 - DNA, 30 bp, Homo sapiens
gtattaaatcctcctccaccccctccacca

SEQ ID NO: 44682 - DNA, 30 bp, Homo sapiens
agccccctgctggttggtttcatcattatc

SEQ ID NO: 44683 - DNA, 30 bp, Homo sapiens
acctggaggtcttgtaattcataccatttg

SEQ ID NO: 44684 - DNA, 30 bp, Homo sapiens
atcccagccactcgggaggctggggcagaa

SEQ ID NO: 44685 - DNA, 30 bp, Homo sapiens
agttggtgtccatgctgcaagcctcatcat

SEQ ID NO: 44686 - DNA, 30 bp, Homo sapiens
acgtggatggagagagaagtttccggggct

SEQ ID NO: 44687 - DNA, 30 bp, Homo sapiens
ccatactcaaagagacgacacctgtcatcc

SEQ ID NO: 44688 - DNA, 30 bp, Homo sapiens
aaagctggactccggtaaggttttctttcg

SEQ ID NO: 44689 - DNA, 30 bp, Homo sapiens
ctaaggatttcattagacgaggtatcagcg

SEQ ID NO: 44690 - DNA, 30 bp, Homo sapiens
aagtagcagagcagaatggtgctaaatcga

SEQ ID NO: 44691 - DNA, 30 bp, Homo sapiens
tctaggttgatgaatattttctatagtaac

SEQ ID NO: 44692 - DNA, 30 bp, Homo sapiens
ttctggaaccacctgtaagtaagtgtcact

SEQ ID NO: 44693 - DNA, 30 bp, Homo sapiens
tctgacaaagctgattaaaaagaactttag

SEQ ID NO: 44694 - DNA, 30 bp, Homo sapiens
tactggagaataatctgcaaaccaacctct

SEQ ID NO: 44695 - DNA, 30 bp, Homo sapiens
gccgtgacttttcacaatagtgatataatg

SEQ ID NO: 44696 - DNA, 30 bp, Homo sapiens
acgaggtgagtatgttacacgatgtccagt

SEQ ID NO: 44697 - DNA, 30 bp, Homo sapiens
aacccttcttctggcatacaaacttgcatg

SEQ ID NO: 44698 - DNA, 30 bp, Homo sapiens
ccagcaggtaacctttggtacagctcctta

SEQ ID NO: 44699 - DNA, 30 bp, Homo sapiens
caggaaaatgtctgtggtctgccttcatca

SEQ ID NO: 44700 - DNA, 30 bp, Homo sapiens
tccgtgtcccccaccccacagagtaaagcg

SEQ ID NO: 44701 - DNA, 30 bp, Homo sapiens
agctggccactctctggtagaagtagatgt

SEQ ID NO: 44702 - DNA, 30 bp, Homo sapiens
gcctgggtgactgaattcttgcagaaagca

SEQ ID NO: 44703 - DNA, 30 bp, Homo sapiens
actgtagagtaagtcctcaatggtagcctt

SEQ ID NO: 44704 - DNA, 30 bp, Homo sapiens
ctctctggaaaagagagcttgggcctctga

SEQ ID NO: 44705 - DNA, 30 bp, Homo sapiens
ttcttccagcagagggtgctgttgttatag

SEQ ID NO: 44706 - DNA, 30 bp, Homo sapiens
ccattgactgtgctgcaggactctagccct

SEQ ID NO: 44707 - DNA, 30 bp, Homo sapiens
tgcttgtgtctgccatctttttgccatcaa

SEQ ID NO: 44708 - DNA, 30 bp, Homo sapiens
tcttggatggaaagcccgtcccgattcctg

SEQ ID NO: 44709 - DNA, 30 bp, Homo sapiens
ttatggattttaatggccttttcaaggtaa

SEQ ID NO: 44710 - DNA, 30 bp, Homo sapiens
atgtggctacatcagttactcgtggtccca

SEQ ID NO: 44711 - DNA, 30 bp, Homo sapiens
ccttggtttgaggtggggatacttcttcac

SEQ ID NO: 44712 - DNA, 30 bp, Homo sapiens
tctgaggtgaggatacttcttcattgcctt

SEQ ID NO: 44713 - DNA, 30 bp, Homo sapiens
ctgaggaggaaaaaaactcatcgaaaatat

SEQ ID NO: 44714 - DNA, 30 bp, Homo sapiens
acttttcatcatcctgttcttcatcgtcga

SEQ ID NO: 44715 - DNA, 30 bp, Homo sapiens
cactggcacgggtccctgaggacccctcgc

SEQ ID NO: 44716 - DNA, 30 bp, Homo sapiens
ctttcttcaccttcactttctgagttttat

SEQ ID NO: 44717 - DNA, 30 bp, Homo sapiens
gtgtggtgattcgttttggattcctctgta

SEQ ID NO: 44718 - DNA, 30 bp, Homo sapiens; identical to SEQ ID NO: 44717

SEQ ID NO: 44719 - DNA, 30 bp, Homo sapiens
gatgtgtgttccaacacagaagtgccttcc

SEQ ID NO: 44720 - DNA, 30 bp, Homo sapiens
catcagggccttgcccttttcattccccaa

SEQ ID NO: 44721 - DNA, 30 bp, Homo sapiens
ttgctaaatctttcaggctatggctttttt

SEQ ID NO: 44722 - DNA, 30 bp, Homo sapiens
gcattctgcttctcagaaagtacttttggg

SEQ ID NO: 44723 - DNA, 30 bp, Homo sapiens
cgaatgccagataattcaccactataacgt

SEQ ID NO: 44724 - DNA, 30 bp, Homo sapiens
tggtgggagctgagcaatgatgtcatccag

SEQ ID NO: 44725 - DNA, 30 bp, Homo sapiens
tgatgcatagcatgtttagctacaaatgcc

SEQ ID NO: 44726 - DNA, 30 bp, Homo sapiens
gcctgctgggaacatttgggcagcaagatg

SEQ ID NO: 44727 - DNA, 30 bp, Homo sapiens
gcaatcaggagtctcacgtttcttgtatgg

SEQ ID NO: 44728 - DNA, 30 bp, Homo sapiens
acagcataggacgtctcagaatccttctcc

SEQ ID NO: 44729 - DNA, 30 bp, Homo sapiens
cgccggggccctgggaccctcgggcgcagg

SEQ ID NO: 44730 - DNA, 30 bp, Homo sapiens
gcatggtggctcacacctgtaatcccagca

SEQ ID NO: 44731 - DNA, 30 bp, Homo sapiens
ttttgtactgttcgagcaccacaaaatttt

SEQ ID NO: 44732 - DNA, 30 bp, Homo sapiens
tccaggaaagatgcaccatgggtactggtg

SEQ ID NO: 44733 - DNA, 30 bp, Homo sapiens
aaatgctacagtaatgagctggttcatcat

SEQ ID NO: 44734 - DNA, 30 bp, Homo sapiens
tatcggaactcctgcgcggccggcggaagc

SEQ ID NO: 44735 - DNA, 30 bp, Homo sapiens
aactggtttgaaaacttctcgtgcttcttc

SEQ ID NO: 44736 - DNA, 30 bp, Homo sapiens
ctgtggcgagtccgtcctttctttattctg

SEQ ID NO: 44737 - DNA, 30 bp, Homo sapiens
caatggtgaggcttctctgggaaattctgc

SEQ ID NO: 44738 - DNA, 30 bp, Homo sapiens
cagaggacaaccctccggtccaggtggtcc

SEQ ID NO: 44739 - DNA, 30 bp, Homo sapiens
tgatggcacagatggctcccagcatgatca

SEQ ID NO: 44740 - DNA, 30 bp, Homo sapiens
ccatgggcaccgatactcttctcctcccaa

SEQ ID NO: 44741 - DNA, 30 bp, Homo sapiens
tgatggcgcaaatcactcccaagatgatca

SEQ ID NO: 44742 - DNA, 30 bp, Homo sapiens
cgatgatgatgatgatgaagataaccagaa

SEQ ID NO: 44743 - DNA, 30 bp, Homo sapiens
tgatggcttttattttgcatccacgccacc

SEQ ID NO: 44744 - DNA, 30 bp, Homo sapiens
cccaggccctgaggcaatgcctgcatcctg

SEQ ID NO: 44745 - DNA, 30 bp, Homo sapiens
tcttcacacagcttggccatgtaaatccac

SEQ ID NO: 44746 - DNA, 30 bp, Homo sapiens
cacaggaataaactggtagataagacaaag

SEQ ID NO: 44747 - DNA, 30 bp, Homo sapiens
agaaggcaccagtggcaaagagcacaatga

SEQ ID NO: 44748 - DNA, 30 bp, Homo sapiens
cgaaggacaaatttgtgagatttggggtct

SEQ ID NO: 44749 - DNA, 30 bp, Homo sapiens
ctgaggtctcagactgcagcctcatgacaa

SEQ ID NO: 44750 - DNA, 30 bp, Homo sapiens
aagaggactggtgacattatctctgaagga

SEQ ID NO: 44751 - DNA, 30 bp, Homo sapiens
acgtggctcaacgtatgtgacttctaagga

SEQ ID NO: 44752 - DNA, 30 bp, Homo sapiens
acaaggcaatcttcccaataattacaccaa

SEQ ID NO: 44753 - DNA, 30 bp, Homo sapiens
ttctggaatagggcgatggcctcatccacc

SEQ ID NO: 44754 - DNA, 30 bp, Homo sapiens
ctccgggctccctggggctggaggctcatc

SEQ ID NO: 44755 - DNA, 30 bp, Homo sapiens
cagacccggatctggtacccgttaaggtct

SEQ ID NO: 44756 - DNA, 30 bp, Homo sapiens
attcggatttgatagcccacttcattcaga

SEQ ID NO: 44757 - DNA, 30 bp, Homo sapiens
tgtagggctttgcgtggaggggtgactgga

SEQ ID NO: 44758 - DNA, 30 bp, Homo sapiens
ttcctcagctcctggacgaaggcttcaatg

SEQ ID NO: 44759 - DNA, 30 bp, Homo sapiens
ttctccttctctggccctggaaccaggagg

SEQ ID NO: 44760 - DNA, 30 bp, Homo sapiens
tactggataaagggcatccgctccttgttc

SEQ ID NO: 44761 - DNA, 30 bp, Homo sapiens
cgtagttggcagggaaccagccaacccggc

SEQ ID NO: 44762 - DNA, 30 bp, Homo sapiens
cactggatgccctcctcttctacgtacgtt

SEQ ID NO: 44763 - DNA, 30 bp, Homo sapiens
ccacatatgtggatggaaaccagcccaccc

SEQ ID NO: 44764 - DNA, 30 bp, Homo sapiens
cttttttctcggccccttctttattgttgg

SEQ ID NO: 44765 - DNA, 30 bp, Homo sapiens
tataggggctgccaccctctgcccccggag

SEQ ID NO: 44766 - DNA, 30 bp, Homo sapiens
tgctggcgctgcccactttccgttctagcc

SEQ ID NO: 44767 - DNA, 30 bp, Homo sapiens
tcttggtagagtcatccttgtttcttcttt

SEQ ID NO: 44768 - DNA, 30 bp, Homo sapiens
catgttggcttttcttgcaaagtaaattat

SEQ ID NO: 44769 - DNA, 30 bp, Homo sapiens
ctcctgccacctccggctccaacgatgatc

SEQ ID NO: 44770 - DNA, 30 bp, Homo sapiens
tactggtaccagggagtctttctaacccag

SEQ ID NO: 44771 - DNA, 30 bp, Homo sapiens
agccatacaggtcatcatcattgtcttctg

SEQ ID NO: 44772 - DNA, 30 bp, Homo sapiens
gctcagttgtgttagtcatctcagcatctt

SEQ ID NO: 44773 - DNA, 30 bp, Homo sapiens
cgatggaaatttctcaaaatattttttctc

SEQ ID NO: 44774 - DNA, 30 bp, Homo sapiens
agtcggtgctctcggagacaggggaaaagc

SEQ ID NO: 44775 - DNA, 30 bp, Homo sapiens
acacactcggtagttcttccatctcgctct

SEQ ID NO: 44776 - DNA, 30 bp, Homo sapiens
gataggggagtagatgggcgccccttactc

SEQ ID NO: 44777 - DNA, 30 bp, Homo sapiens
ctagaccaagcttgtggccaccagcattga

SEQ ID NO: 44778 - DNA, 30 bp, Homo sapiens
actccagggcgagcccaaccttgtggcctc

SEQ ID NO: 44779 - DNA, 30 bp, Homo sapiens
taagcttccagttcaaatcccaagccaacc

SEQ ID NO: 44780 - DNA, 30 bp, Homo sapiens
caggagatctcattgccaaacacttcgagc

SEQ ID NO: 44781 - DNA, 30 bp, Homo sapiens
tgcaggaacatttacacgtctgcggatctt

SEQ ID NO: 44782 - DNA, 30 bp, Homo sapiens
tcctggtgagagatctgcaagtacgttcgt

SEQ ID NO: 44783 - DNA, 30 bp, Homo sapiens
caccgcctcggcttgtcacatttttcttgt

SEQ ID NO: 44784 - DNA, 30 bp, Homo sapiens
ttccggcacctgcaggtgtctgggttgagc

SEQ ID NO: 44785 - DNA, 30 bp, Homo sapiens
ccttggcaacggaggaagctgcggcgtcgg

SEQ ID NO: 44786 - DNA, 30 bp, Homo sapiens
tgaagggacacaacgacacacttcttcact

SEQ ID NO: 44787 - DNA, 30 bp, Homo sapiens
tttcggctgtggggcccctgggcagccctt

SEQ ID NO: 44788 - DNA, 30 bp, Homo sapiens
caaaatgcatcccccgtctgtggcatagca

SEQ ID NO: 44789 - DNA, 30 bp, Homo sapiens
gatcagccaggagatctgccttggtaattg

SEQ ID NO: 44790 - DNA, 30 bp, Homo sapiens
gatatgtggttacttctctactttcccttt

SEQ ID NO: 44791 - DNA, 30 bp, Homo sapiens
acatgtccccaagctcaactttcgcaccat

SEQ ID NO: 44792 - DNA, 30 bp, Homo sapiens
cggtgatgtaggcaaagcttggggcaagaa

SEQ ID NO: 44793 - DNA, 30 bp, Homo sapiens
taattccatgcggactttaccccatgatca

SEQ ID NO: 44794 - DNA, 30 bp, Homo sapiens
caccaccaaaagtctgttcctgcatggtgg

SEQ ID NO: 44795 - DNA, 30 bp, Homo sapiens
ctgcctttctgcctctgaagctttaaatcc

SEQ ID NO: 44796 - DNA, 30 bp, Homo sapiens
cacgggcgccggagcagcacgtgctcgatg

SEQ ID NO: 44797 - DNA, 30 bp, Homo sapiens
tgcaggtatcgatgtgggtggccccagtgg

SEQ ID NO: 44798 - DNA, 30 bp, Homo sapiens
ctcaggagggatgcaccacagagggaataa

SEQ ID NO: 44799 - DNA, 30 bp, Homo sapiens
tcgaatcccacgctgggcactatgtctact

SEQ ID NO: 44800 - DNA, 30 bp, Homo sapiens
ccacggtgattccttactcttgtcttgatg

SEQ ID NO: 44801 - DNA, 30 bp, Homo sapiens
aggagaccacagagggggagtgactgtggc

SEQ ID NO: 44802 - DNA, 30 bp, Homo sapiens
cgttgatgtgcaatgcgctcctgtgtcagc

SEQ ID NO: 44803 - DNA, 30 bp, Homo sapiens
tgttggcaaaaacaggctgtccattaacat

SEQ ID NO: 44804 - DNA, 30 bp, Homo sapiens
tcgaggcagagcagagaaggcagctggagt

SEQ ID NO: 44805 - DNA, 30 bp, Homo sapiens
tgctttttctcctgccgctgcctccacgtg

SEQ ID NO: 44806 - DNA, 30 bp, Homo sapiens
catctctagtttcaaccgtcttaatcagaa

SEQ ID NO: 44807 - DNA, 30 bp, Homo sapiens
agtcgggagattctccctcactgctcctct

SEQ ID NO: 44808 - DNA, 30 bp, Homo sapiens
ctgctgatcctttatctaccttactcctgt

SEQ ID NO: 44809 - DNA, 30 bp, Homo sapiens
accagggagacttcggcttggaagctggag

SEQ ID NO: 44810 - DNA, 30 bp, Homo sapiens
ccgaggtctccgtttgcaggaaggactggg

SEQ ID NO: 44811 - DNA, 30 bp, Homo sapiens
ccactgcctccactaacaaactttcctctt

SEQ ID NO: 44812 - DNA, 30 bp, Homo sapiens
ttgtttgcatgggcaatggaagaggcagca

SEQ ID NO: 44813 - DNA, 30 bp, Homo sapiens
ccagtggagcttgaccggttaagatgttaa

SEQ ID NO: 44814 - DNA, 30 bp, Homo sapiens
ccgaggctgtgagttgaactctgtacaaat

SEQ ID NO: 44815 - DNA, 30 bp, Homo sapiens
agccttgccctggggttcttggaccttccg

SEQ ID NO: 44816 - DNA, 30 bp, Homo sapiens
aacaggatccaggccaggtagacagaacca

SEQ ID NO: 44817 - DNA, 30 bp, Homo sapiens
gttagggtggagtctgtcgggcgtcagtcc

SEQ ID NO: 44818 - DNA, 30 bp, Homo sapiens
gcttgggttgcagctgccgcttccaggcct

SEQ ID NO: 44819 - DNA, 30 bp, Homo sapiens
gaagcactgtgtctaccaatgtctatggag

SEQ ID NO: 44820 - DNA, 30 bp, Homo sapiens
tgccttcacgccactgtcgtgagccttcat

SEQ ID NO: 44821 - DNA, 30 bp, Homo sapiens
ctgtggtcccaaacactgcaggctggaggt

SEQ ID NO: 44822 - DNA, 30 bp, Homo sapiens
aactgcggcagcagaataagcgcgcgtcgt

SEQ ID NO: 44823 - DNA, 30 bp, Homo sapiens
gggatcctcgacccctgcgccccaccttcc

SEQ ID NO: 44824 - DNA, 30 bp, Homo sapiens
acgttcccgcgcgcgcagtgcagcctgatc

SEQ ID NO: 44825 - DNA, 30 bp, Homo sapiens
agttcaaccgctgctggattcgtttggcat

SEQ ID NO: 44826 - DNA, 30 bp, Homo sapiens
attaggaaagagtgttttccttgtcctgca

SEQ ID NO: 44827 - DNA, 30 bp, Homo sapiens
gcctggatctgctggggtcacggcacatga

SEQ ID NO: 44828 - DNA, 30 bp, Homo sapiens
cttaggaaactgtggattccttccacagca

SEQ ID NO: 44829 - DNA, 30 bp, Homo sapiens
aaaacaaaacctgtatacactggggtcaca

SEQ ID NO: 44830 - DNA, 30 bp, Homo sapiens
cattggcgattaaatttcaacatgagcttt

SEQ ID NO: 44831 - DNA, 30 bp, Homo sapiens
gtgaggcctgatgaagcatttgatgcccag

SEQ ID NO: 44832 - DNA, 30 bp, Homo sapiens
tgagctgtaaagtgagtcctttgtgtacca

SEQ ID NO: 44833 - DNA, 30 bp, Homo sapiens
atgtgcatgctggtgttgtgggtatttgca

SEQ ID NO: 44834 - DNA, 30 bp, Homo sapiens
cactggaatttcccagatccctgccctaag

SEQ ID NO: 44835 - DNA, 30 bp, Homo sapiens
tacttggccttcactacctgttcgtacggg

SEQ ID NO: 44836 - DNA, 30 bp, Homo sapiens
gcagcccacgagaccgttcctggaagtgaa

SEQ ID NO: 44837 - DNA, 30 bp, Homo sapiens
caagggacacgtgtcctggctgcagtgggt

SEQ ID NO: 44838 - DNA, 30 bp, Homo sapiens
gggactaaagccgtagccaacagagcagta

SEQ ID NO: 44839 - DNA, 30 bp, Homo sapiens
tcctggagtgcatgagtaggtcgcgttgca

SEQ ID NO: 44840 - DNA, 30 bp, Homo sapiens
cctgtagaattgaattttctgtaacatttg

SEQ ID NO: 44841 - DNA, 30 bp, Homo sapiens
cagaggctcggagaaggttctcttgcttct

SEQ ID NO: 44842 - DNA, 30 bp, Homo sapiens
ccatccctcaacctgtacggtctgataact

SEQ ID NO: 44843 - DNA, 30 bp, Homo sapiens
cctcagggctttatttttcaccatggtaaa

SEQ ID NO: 44844 - DNA, 30 bp, Homo sapiens
ttgaaagtcaccgttgcctttgtgcaataa

SEQ ID NO: 44845 - DNA, 30 bp, Homo sapiens
aggaggttgaggtgggaggatcatttgagg

SEQ ID NO: 44846 - DNA, 30 bp, Homo sapiens
agatggcaattggggtctgagaagtctcac

SEQ ID NO: 44847 - DNA, 30 bp, Homo sapiens
gattcctgtctgtcataaggacgaatgatg

SEQ ID NO: 44848 - DNA, 30 bp, Homo sapiens
ccagctgctctcggttttcgctgagtctta

SEQ ID NO: 44849 - DNA, 30 bp, Homo sapiens
ttcttctgggcttgtgccctggcccgttga

SEQ ID NO: 44850 - DNA, 30 bp, Homo sapiens
tacagccaactgagctgctcctcctcgtag

SEQ ID NO: 44851 - DNA, 30 bp, Homo sapiens
tagaagaacttgacgcctcggccatcgctg

SEQ ID NO: 44852 - DNA, 30 bp, Homo sapiens
actggtgcaccatccattatttcatatttg

SEQ ID NO: 44853 - DNA, 30 bp, Homo sapiens
ttcaggctgttcggcagatgcctgtgattc

SEQ ID NO: 44854 - DNA, 30 bp, Homo sapiens
gcctgcagttgttgtcagacagctggctgg

SEQ ID NO: 44855 - DNA, 30 bp, Homo sapiens
catctgacgccgacatgccgctcagggtct

SEQ ID NO: 44856 - DNA, 30 bp, Homo sapiens
tgcaggaagcggttgaaggcgttgtaggct

SEQ ID NO: 44857 - DNA, 30 bp, Homo sapiens
agctgatacacataggtgaccactgtagaa

SEQ ID NO: 44858 - DNA, 30 bp, Homo sapiens
caacagagcaagatttgaatgcaccctctg

SEQ ID NO: 44859 - DNA, 30 bp, Homo sapiens
gaaaggtttttccatcagagcctctatcca

SEQ ID NO: 44860 - DNA, 30 bp, Homo sapiens
tcatggcctccataaggcgagcgctgtttg

SEQ ID NO: 44861 - DNA, 30 bp, Homo sapiens
taaattggcccctcggattctggtgattcc

SEQ ID NO: 44862 - DNA, 30 bp, Homo sapiens
actgagtcatcacggcaaagatggcccatc

SEQ ID NO: 44863 - DNA, 30 bp, Homo sapiens
aattggctgtgcattgctatcgcctgctga

SEQ ID NO: 44864 - DNA, 30 bp, Homo sapiens
cactggaggatgaaacccggctggtgtgga

SEQ ID NO: 44865 - DNA, 30 bp, Homo sapiens
cccaggccaggcaggccccggcggtggtgg

SEQ ID NO: 44866 - DNA, 30 bp, Homo sapiens
taccggtgggggggctctggctgcgagggc

SEQ ID NO: 44867 - DNA, 30 bp, Homo sapiens
agctgggtttacctctttggaacagaagta

SEQ ID NO: 44868 - DNA, 30 bp, Homo sapiens
ttgcacttcctggtccacggttcttagcac

SEQ ID NO: 44869 - DNA, 30 bp, Homo sapiens
acctggagatgagttctaacaaccagcaca

SEQ ID NO: 44870 - DNA, 30 bp, Homo sapiens
catcttctgctcgctgaccttgatgtgact

SEQ ID NO: 44871 - DNA, 30 bp, Homo sapiens
gtcctctgagaatttcttcactttcaggag

SEQ ID NO: 44872 - DNA, 30 bp, Homo sapiens
tgaccaaaatcttctgtaaacttctttaat

SEQ ID NO: 44873 - DNA, 30 bp, Homo sapiens
catagttccacataaccaagaacaacttga

SEQ ID NO: 44874 - DNA, 30 bp, Homo sapiens
cccaggcaaacattcaccagattggtcagc

SEQ ID NO: 44875 - DNA, 30 bp, Homo sapiens
cgcgctcgcagatgacctcaaccacactgg

SEQ ID NO: 44876 - DNA, 30 bp, Homo sapiens
agttgggcttatgcttcttgagctccacca

SEQ ID NO: 44877 - DNA, 30 bp, Homo sapiens
cacctgttctgctcccaccatgctaattgg

SEQ ID NO: 44878 - DNA, 30 bp, Homo sapiens
ttgcggatgcgtgacgactcttgctctggt

SEQ ID NO: 44879 - DNA, 30 bp, Homo sapiens
ctgctcccaaatttcggccatatttaggtc

SEQ ID NO: 44880 - DNA, 30 bp, Homo sapiens
gcaaggctcggggcccagagccagggaggg

SEQ ID NO: 44881 - DNA, 30 bp, Homo sapiens
gaacagggacttttgggggccgcctcatat

SEQ ID NO: 44882 - DNA, 30 bp, Homo sapiens
tcacaggtggaggaatgagctgcagctgga

SEQ ID NO: 44883 - DNA, 30 bp, Homo sapiens
acttggccaggcctccccggggcagcagct

SEQ ID NO: 44884 - DNA, 30 bp, Homo sapiens
ttctggactctctttctggttcttgaacgg

SEQ ID NO: 44885 - DNA, 30 bp, Homo sapiens
agtttctcctctttctgcactttccatgtt

SEQ ID NO: 44886 - DNA, 30 bp, Homo sapiens
aactgggaaattgtaggccaaagtccagtt

SEQ ID NO: 44887 - DNA, 30 bp, Homo sapiens
tgttgggaaggcaatttgtccatggcagaa

SEQ ID NO: 44888 - DNA, 30 bp, Homo sapiens
agggcaccatcgggaggccaatggggtcat

SEQ ID NO: 44889 - DNA, 30 bp, Homo sapiens
cagccatctaccagggtcaggccgtcatag

SEQ ID NO: 44890 - DNA, 30 bp, Homo sapiens
tatgccttaaccactcccttttcatcttca

SEQ ID NO: 44891 - DNA, 30 bp, Homo sapiens
gactggcctgtcttcttcttgaacaatgtc

SEQ ID NO: 44892 - DNA, 30 bp, Homo sapiens
acagagacaactgaactggggtctgtgctt

SEQ ID NO: 44893 - DNA, 30 bp, Homo sapiens
catagggagcttggacttggtggtcgtcac

SEQ ID NO: 44894 - DNA, 30 bp, Homo sapiens
caccgaaggtcactacccccatatgtctcc

SEQ ID NO: 44895 - DNA, 30 bp, Homo sapiens
cagtggccagaaactcataatccagaggaa

SEQ ID NO: 44896 - DNA, 30 bp, Homo sapiens
acctggctgcttcgtagacatgctcttgtt

SEQ ID NO: 44897 - DNA, 30 bp, Homo sapiens
atctggcaaattccagggcaaagccagtga

SEQ ID NO: 44898 - DNA, 30 bp, Homo sapiens
aagaggccgttcttgcactgcaccggcccc

SEQ ID NO: 44899 - DNA, 30 bp, Homo sapiens
agtttggagagtcagggacagggtccaggg

SEQ ID NO: 44900 - DNA, 30 bp, Homo sapiens
ttctggatgtcgcactgcagaagtaataca

SEQ ID NO: 44901 - DNA, 30 bp, Homo sapiens
attcatgagatcctgggggctcctgggtgg

SEQ ID NO: 44902 - DNA, 30 bp, Homo sapiens
ctgtggagcgtttgtgagtggtaaaataaa

SEQ ID NO: 44903 - DNA, 30 bp, Homo sapiens
acaaagccacaaacaagaagcaggacagaa

SEQ ID NO: 44904 - DNA, 30 bp, Homo sapiens
cagtgggtgcagggtggtgcttggagttta

SEQ ID NO: 44905 - DNA, 30 bp, Homo sapiens
agcaggcgcaggaacttatgcagagctaac

SEQ ID NO: 44906 - DNA, 30 bp, Homo sapiens
ggttggctggtagtcacagactggatcatg

SEQ ID NO: 44907 - DNA, 30 bp, Homo sapiens
aagaggatctgggcgtagacagtgctggtg

SEQ ID NO: 44908 - DNA, 30 bp, Homo sapiens
tgcaggaaggaggccatggttaagtctgcg

SEQ ID NO: 44909 - DNA, 30 bp, Homo sapiens
caatctcctcagttgtgctttctttgagtt

SEQ ID NO: 44910 - DNA, 30 bp, Homo sapiens
ccacggggtctggggagcctgtgtgtctcc

SEQ ID NO: 44911 - DNA, 30 bp, Homo sapiens
agaagggactgctgattggctcactgaatg

SEQ ID NO: 44912 - DNA, 30 bp, Homo sapiens
tgaaggtcatcaggcaccaccacggggtct

SEQ ID NO: 44913 - DNA, 30 bp, Homo sapiens
atgtggctcccaccttccctggctggggcc

SEQ ID NO: 44914 - DNA, 30 bp, Homo sapiens
ccatgtcctccagctgcggtggactgagcc

SEQ ID NO: 44915 - DNA, 30 bp, Homo sapiens
gtcagtaacttgagagccttttgtagattc

SEQ ID NO: 44916 - DNA, 30 bp, Homo sapiens
atcaggtaagggctgagaggcagaagtgcc

SEQ ID NO: 44917 - DNA, 30 bp, Homo sapiens
atcaggatggtgatgaccacgatgatccct

SEQ ID NO: 44918 - DNA, 30 bp, Homo sapiens
caacatccctgtcagaatcctggagctttt

SEQ ID NO: 44919 - DNA, 30 bp, Homo sapiens
caatggctgcgaaagaatttgtagtaaacc

SEQ ID NO: 44920 - DNA, 30 bp, Homo sapiens
agatggccaggagctgggcagcccagccag

SEQ ID NO: 44921 - DNA, 30 bp, Homo sapiens
tacggctcacggctggcggtccccggggtc

SEQ ID NO: 44922 - DNA, 30 bp, Homo sapiens
caggggcgtctcaagaatcggttctcgcag

SEQ ID NO: 44923 - DNA, 30 bp, Homo sapiens
ctttggttctgcatcatttttcttctggag

SEQ ID NO: 44924 - DNA, 30 bp, Homo sapiens
agtgtctcagggacgctcctcagccctttg

SEQ ID NO: 44925 - DNA, 30 bp, Homo sapiens
tgtgtttctgtctgttgatcctaacttctt

SEQ ID NO: 44926 - DNA, 30 bp, Homo sapiens
aaaaggcaaagatagcaggatccacagatg

SEQ ID NO: 44927 - DNA, 30 bp, Homo sapiens
gccgcagaagcacaaacagctggcgggcag

SEQ ID NO: 44928 - DNA, 30 bp, Homo sapiens
cacgttcgctgggctgtagcacagcaggtg

SEQ ID NO: 44929 - DNA, 30 bp, Homo sapiens
ggccaggcctagcagaagcagcacccctcc

SEQ ID NO: 44930 - DNA, 30 bp, Homo sapiens
tcctttgccagctgcacactggtaggcttt

SEQ ID NO: 44931 - DNA, 30 bp, Homo sapiens
acatggtggaggtgaagatctgttgtaaaa

SEQ ID NO: 44932 - DNA, 30 bp, Homo sapiens
ttcatgtctcgtgcacatggcctgccgctc

SEQ ID NO: 44933 - DNA, 30 bp, Homo sapiens
cagtctgcttgccttggcattcacgtttcg

SEQ ID NO: 44934 - DNA, 30 bp, Homo sapiens
gtttggaccttaaattcctccaagattttg

SEQ ID NO: 44935 - DNA, 30 bp, Homo sapiens
tacatggtggactcttccccccgagaagcc

SEQ ID NO: 44936 - DNA, 30 bp, Homo sapiens
tattcagtgcggcaggaacacacattggga

SEQ ID NO: 44937 - DNA, 30 bp, Homo sapiens
ttgctgcacttcctgggggagcatttgcac

SEQ ID NO: 44938 - DNA, 30 bp, Homo sapiens
tgaaggaattctgattttttagcttttcaa

SEQ ID NO: 44939 - DNA, 30 bp, Homo sapiens
ttctggccagttgttccaacagcacaagtg

SEQ ID NO: 44940 - DNA, 30 bp, Homo sapiens
cgaaggacagcttccggggagtcatgaact

SEQ ID NO: 44941 - DNA, 30 bp, Homo sapiens
aatttcttcacctcctggcacacagtgtat

SEQ ID NO: 44942 - DNA, 30 bp, Homo sapiens
cactggaaagaactccccatacttcttgtt

SEQ ID NO: 44943 - DNA, 30 bp, Homo sapiens
agtcatcccattcatcatcttcatcttcat

SEQ ID NO: 44944 - DNA, 30 bp, Homo sapiens
gacaggatggtggcaacatcgttttcaatg

SEQ ID NO: 44945 - DNA, 30 bp, Homo sapiens
aatcggaccagtcgtcctcatcaaattcag

SEQ ID NO: 44946 - DNA, 30 bp, Homo sapiens
ccctgcgcagctgaaaacctgaattctgct

SEQ ID NO: 44947 - DNA, 30 bp, Homo sapiens
agtcggaccagtcgttctcgtcgaactctg

SEQ ID NO: 44948 - DNA, 30 bp, Homo sapiens
acgattcccagtcgtcctcgtcctcctctg

SEQ ID NO: 44949 - DNA, 30 bp, Homo sapiens
tactggcctccaaaggcattcaggggatca

SEQ ID NO: 44950 - DNA, 30 bp, Homo sapiens
atcaggcactggagcatctggcctctcaag

SEQ ID NO: 44951 - DNA, 30 bp, Homo sapiens
aacaggatcagcagacacagtgctgtcaga

SEQ ID NO: 44952 - DNA, 30 bp, Homo sapiens
tgggtagctttgtgtaccgaacataatcct

SEQ ID NO: 44953 - DNA, 30 bp, Homo sapiens
catcatcatcctcaaaatcttcttcatcat

SEQ ID NO: 44954 - DNA, 30 bp, Homo sapiens
tatgggatgtccccttcactggaagacagc

SEQ ID NO: 44955 - DNA, 30 bp, Homo sapiens
atctctttcatgaaagcctcatagacatca

SEQ ID NO: 44956 - DNA, 30 bp, Homo sapiens
agctgggggagctgctgctctgggagttgg

SEQ ID NO: 44957 - DNA, 30 bp, Homo sapiens
tactgggtcttcttatcttccggtgggtag

SEQ ID NO: 44958 - DNA, 30 bp, Homo sapiens
aagaggaggcagagggaagagaagcctcgt

SEQ ID NO: 44959 - DNA, 30 bp, Homo sapiens
tgccttaaatttctagattttccattttca

SEQ ID NO: 44960 - DNA, 30 bp, Homo sapiens
taacgggataaagccctcactgtcagcaga

SEQ ID NO: 44961 - DNA, 30 bp, Homo sapiens
catctacatggttacaacagccagtggtat

SEQ ID NO: 44962 - DNA, 30 bp, Homo sapiens
gtgcggagaaaacccagtcgccagactgca

SEQ ID NO: 44963 - DNA, 30 bp, Homo sapiens
gactggggtcatatcccacaacttaataac

SEQ ID NO: 44964 - DNA, 30 bp, Homo sapiens
ttctgaacctctctcatgctgtaagttata

SEQ ID NO: 44965 - DNA, 30 bp, Homo sapiens
catctgcagaccagcagaatattctccccc

SEQ ID NO: 44966 - DNA, 30 bp, Homo sapiens
ctcctgcttaaatgcaaaagctgatagttt

SEQ ID NO: 44967 - DNA, 30 bp, Homo sapiens
gtgtggtggcacatgccagtggtcccagct

SEQ ID NO: 44968 - DNA, 30 bp, Homo sapiens
ctctgccgtcttctctcagttctccgtctt

SEQ ID NO: 44969 - DNA, 30 bp, Homo sapiens
agtaggtgattgtccactccttgacagagg

SEQ ID NO: 44970 - DNA, 30 bp, Homo sapiens
caatgggttcttccttgggggactcaagct

SEQ ID NO: 44971 - DNA, 30 bp, Homo sapiens
acatgggaagtggtaggtgaatatctgtag

SEQ ID NO: 44972 - DNA, 30 bp, Homo sapiens
ttctgctcccgcctccagacgatgaccatg

SEQ ID NO: 44973 - DNA, 30 bp, Homo sapiens
cctaaaggtgagaatggattcacctttgcc

SEQ ID NO: 44974 - DNA, 30 bp, Homo sapiens
acttggccggccgcgtgatgaagcgcgtgg

SEQ ID NO: 44975 - DNA, 30 bp, Homo sapiens
acagttcctcctccgttcgcaggtactggg

SEQ ID NO: 44976 - DNA, 30 bp, Homo sapiens
tcccggcccacattgaagcagaggcggtcg

SEQ ID NO: 44977 - DNA, 30 bp, Homo sapiens
taccaggccttccccatgtgcaaataaatc

SEQ ID NO: 44978 - DNA, 30 bp, Homo sapiens
acctggagaactggcctggcttggggatga

SEQ ID NO: 44979 - DNA, 30 bp, Homo sapiens
ttctggtcttggagaacaccttgcatcctg

SEQ ID NO: 44980 - DNA, 30 bp, Homo sapiens
caagctcaggaagcaaacggaatgtggcag

SEQ ID NO: 44981 - DNA, 30 bp, Homo sapiens
caggagtactcgcagaggtggccgcagcct

SEQ ID NO: 44982 - DNA, 30 bp, Homo sapiens
cttcatgtcccctccccaggagcaggtggc

SEQ ID NO: 44983 - DNA, 30 bp, Homo sapiens
actatccatgctactgcattcctcttcaat

SEQ ID NO: 44984 - DNA, 30 bp, Homo sapiens
agctggagtttaccatccaaggtagctgtg

SEQ ID NO: 44985 - DNA, 30 bp, Homo sapiens
cagagaaaaaaggggaaaaaaatgttctca

SEQ ID NO: 44986 - DNA, 30 bp, Homo sapiens
ttttcctcttcctcttcttctcttccaagt

SEQ ID NO: 44987 - DNA, 30 bp, Homo sapiens
aatgctgccacttcctgcagttccagccct

SEQ ID NO: 44988 - DNA, 30 bp, Homo sapiens
ccttccaccaccccgtgaagctcctcgcct

SEQ ID NO: 44989 - DNA, 30 bp, Homo sapiens
caaaatgcggcagacagtacatctctaaca

SEQ ID NO: 44990 - DNA, 30 bp, Homo sapiens
gacagaaaggaagtaacaacggcagtgatg

SEQ ID NO: 44991 - DNA, 30 bp, Homo sapiens
aggccgccacctctgctgccaggcagtcca

SEQ ID NO: 44992 - DNA, 30 bp, Homo sapiens
tcccactggactatggcataaggggcagaa

SEQ ID NO: 44993 - DNA, 30 bp, Homo sapiens
ttcttccacctgggatgacaaatttgttat

SEQ ID NO: 44994 - DNA, 30 bp, Homo sapiens
caatggcttgccggtcaaacccacaggtga

SEQ ID NO: 44995 - DNA, 30 bp, Homo sapiens
ttgagggtccctgggtgatttggacgtgcg

SEQ ID NO: 44996 - DNA, 30 bp, Homo sapiens
ccccggtctcatcttcttggcatgcccgtc

SEQ ID NO: 44997 - DNA, 30 bp, Homo sapiens
gcaaggtataagtcaccattctcctctaat

SEQ ID NO: 44998 - DNA, 30 bp, Homo sapiens
cattttcttcatcttttccttcggcatcct

SEQ ID NO: 44999 - DNA, 30 bp, Homo sapiens
aagtcagcagagagaagaacttctgtgtta

SEQ ID NO: 45000 - DNA, 30 bp, Homo sapiens
tcaaggtacacgtcgaaagcctctctgttg

SEQ ID NO: 45001 - DNA, 30 bp, Homo sapiens
catcggtcatctctagaaactgcgcgtaga

SEQ ID NO: 45002 - DNA, 30 bp, Homo sapiens
tccagggcagatggccgggcccccgtgggc

SEQ ID NO: 45003 - DNA, 30 bp, Homo sapiens
gtaagtccagagggtgacagttctatctgc

SEQ ID NO: 45004 - DNA, 30 bp, Homo sapiens
acgtggacttctgacggtaatggagggtga

SEQ ID NO: 45005 - DNA, 30 bp, Homo sapiens
ccttgggaaacaggtttttctcatcaaata

SEQ ID NO: 45006 - DNA, 30 bp, Homo sapiens
cagaggcgatgatgttttctgttgggtgac

SEQ ID NO: 45007 - DNA, 30 bp, Homo sapiens
agccagttcactttttctccatgttcaata

SEQ ID NO: 45008 - DNA, 30 bp, Homo sapiens
agcaaatcccacttagaaattccccaagta

SEQ ID NO: 45009 - DNA, 30 bp, Homo sapiens
ctccggatctccgcaaggtcatagccagtc

SEQ ID NO: 45010 - DNA, 30 bp, Homo sapiens
acagcaaaggagttgcctcaatgtagccac

SEQ ID NO: 45011 - DNA, 30 bp, Homo sapiens
gtcactgtcatccccagtctcctccttttc

SEQ ID NO: 45012 - DNA, 30 bp, Homo sapiens
agacaatgatgcagaacagcaaggagaatt

SEQ ID NO: 45013 - DNA, 30 bp, Homo sapiens
cctcggagtaggctctgtgggagacaccgc

SEQ ID NO: 45014 - DNA, 30 bp, Homo sapiens
agcaggcagtggcacccacacccggtggga

SEQ ID NO: 45015 - DNA, 30 bp, Homo sapiens
atgaggttttctgtaggatgacaagctgct

SEQ ID NO: 45016 - DNA, 30 bp, Homo sapiens
tcataccagttgtaaacctcaagcccctga

SEQ ID NO: 45017 - DNA, 30 bp, Homo sapiens
acttgtgcagttttccctctggccacaggg

SEQ ID NO: 45018 - DNA, 30 bp, Homo sapiens
catctccaacagacacaatttttgaaccat

SEQ ID NO: 45019 - DNA, 30 bp, Homo sapiens
gtgcccccgtgccttcctccgcacggcctg

SEQ ID NO: 45020 - DNA, 30 bp, Homo sapiens
tgtatgaccccttctctgtgactttgatta

SEQ ID NO: 45021 - DNA, 30 bp, Homo sapiens
ttgggtatagctgggaagaaggaagaagcc

SEQ ID NO: 45022 - DNA, 30 bp, Homo sapiens
tcctggccggaatcttctgaaatggttaag

SEQ ID NO: 45023 - DNA, 30 bp, Homo sapiens
tgatggggataatattggtgcctggctccc

SEQ ID NO: 45024 - DNA, 30 bp, Homo sapiens
aagcggtgctccttcccgtcatgggccatg

SEQ ID NO: 45025 - DNA, 30 bp, Homo sapiens
tggctcattctttgcttcctcatcatcaga

SEQ ID NO: 45026 - DNA, 30 bp, Homo sapiens
tcaaggcttgcaaatgaaaatatgatattc

SEQ ID NO: 45027 - DNA, 30 bp, Homo sapiens
aagacaccttgcaggggcagacctttgcta

SEQ ID NO: 45028 - DNA, 30 bp, Homo sapiens
cagcggggggcacaaaggtccacccagtcc

SEQ ID NO: 45029 - DNA, 30 bp, Homo sapiens
caggggctggtggacccaggccgcttcttc

SEQ ID NO: 45030 - DNA, 30 bp, Homo sapiens
taaagggcagctatccagctgtagtctatt

SEQ ID NO: 45031 - DNA, 30 bp, Homo sapiens
cgctggaattacctccagccaaaatatacc

SEQ ID NO: 45032 - DNA, 30 bp, Homo sapiens
tactcagtaacacttgcaggtccaggggct

SEQ ID NO: 45033 - DNA, 30 bp, Homo sapiens
ccatgggattctttattgaccagcagcaag

SEQ ID NO: 45034 - DNA, 30 bp, Homo sapiens
acttggatccaagcaaagtatccattatat

SEQ ID NO: 45035 - DNA, 30 bp, Homo sapiens
gccaggaggcggataaccccgttgtctgag

SEQ ID NO: 45036 - DNA, 30 bp, Homo sapiens
caatggtgggcaaccaaaaggccatgttgg

SEQ ID NO: 45037 - DNA, 30 bp, Homo sapiens
ccatcctctgcctcataggcctcctctcgc

SEQ ID NO: 45038 - DNA, 30 bp, Homo sapiens
ccatgggggcgtcatgggctgaggattctg

SEQ ID NO: 45039 - DNA, 30 bp, Homo sapiens
taaaagggaaaagggggcggtccccagggc

SEQ ID NO: 45040 - DNA, 30 bp, Homo sapiens
cagggatggggagggaggacaggagccacc

SEQ ID NO: 45041 - DNA, 30 bp, Homo sapiens
ggccggctgcaggggcgcggcggcgcagcc

SEQ ID NO: 45042 - DNA, 30 bp, Homo sapiens
tagagagtgggagcaacggtgtgtgtcagt

SEQ ID NO: 45043 - DNA, 30 bp, Homo sapiens
ttccccttggcggcggtgagttctcccttt

SEQ ID NO: 45044 - DNA, 30 bp, Homo sapiens
cgttggtgcacagaggatgctattttcata

SEQ ID NO: 45045 - DNA, 30 bp, Homo sapiens
cagaggccggggacctcccacacaaggatc

SEQ ID NO: 45046 - DNA, 30 bp, Homo sapiens
ttatgggccaggagggtggtcagcttgatc

SEQ ID NO: 45047 - DNA, 30 bp, Homo sapiens
cagaggtgaaggccgccggcgcctccagct

SEQ ID NO: 45048 - DNA, 30 bp, Homo sapiens
gtttggtcaaatgaactacagacgcagaga

SEQ ID NO: 45049 - DNA, 30 bp, Homo sapiens
ttcttgaagttctctctctggagcgacaag

SEQ ID NO: 45050 - DNA, 30 bp, Homo sapiens
aaaaggaagatgaagaacaatacccatttc

SEQ ID NO: 45051 - DNA, 30 bp, Homo sapiens
agctgtaggtgtcagggtccgcgtccgctg

SEQ ID NO: 45052 - DNA, 30 bp, Homo sapiens
atctattgatggccattttcagagtcctat

SEQ ID NO: 45053 - DNA, 30 bp, Homo sapiens
agctgggccggcactgcacctggccctcag

SEQ ID NO: 45054 - DNA, 30 bp, Homo sapiens
cgatgtgtaaattcggatagtgtgtagacg

SEQ ID NO: 45055 - DNA, 30 bp, Homo sapiens
gagcggttcattttctttccaataagtcga

SEQ ID NO: 45056 - DNA, 30 bp, Homo sapiens
atgcagaggctcacgctctcctgaggtaaa

SEQ ID NO: 45057 - DNA, 30 bp, Homo sapiens
tccaggttctgccacattctttgagtcacc

SEQ ID NO: 45058 - DNA, 30 bp, Homo sapiens
cacaggatgctcatgcaaacattcccacag

SEQ ID NO: 45059 - DNA, 30 bp, Homo sapiens
cttgtcacggtatcctccctgggcctgcag

SEQ ID NO: 45060 - DNA, 30 bp, Homo sapiens
cataggatgctcatacaaatgttcccacag

SEQ ID NO: 45061 - DNA, 30 bp, Homo sapiens
cactggtttcgacgtttatccagcagatgt

SEQ ID NO: 45062 - DNA, 30 bp, Homo sapiens
ctgaggacacctggtagaggaggagcctgg

SEQ ID NO: 45063 - DNA, 30 bp, Homo sapiens
agttggcaggcatgatgacttctgagccct

SEQ ID NO: 45064 - DNA, 30 bp, Homo sapiens
cacaggacaccttcccacagccattgcggc

SEQ ID NO: 45065 - DNA, 30 bp, Homo sapiens
caccgggatctctaattcggaatcagacct

SEQ ID NO: 45066 - DNA, 30 bp, Homo sapiens
gcaggatcccggcaatcccgcccgcaggcg

SEQ ID NO: 45067 - DNA, 30 bp, Homo sapiens
ttatggtataaagtaaggctgacctttctg

SEQ ID NO: 45068 - DNA, 30 bp, Homo sapiens
atttcagtccacaatgtgagcagcactttt

SEQ ID NO: 45069 - DNA, 30 bp, Homo sapiens
gtctggggtccatacatttcagtccacaat

SEQ ID NO: 45070 - DNA, 30 bp, Homo sapiens
taggggtttagcattgatttaaggggctct

SEQ ID NO: 45071 - DNA, 30 bp, Homo sapiens
tcctggaagcggttgagcagctcgcaggcc

SEQ ID NO: 45072 - DNA, 30 bp, Homo sapiens
aactccttgaggacgtcacaggtcttcttg

SEQ ID NO: 45073 - DNA, 30 bp, Homo sapiens
gccgccgacaggaatgggaagaaaaagaag

SEQ ID NO: 45074 - DNA, 30 bp, Homo sapiens
catcccactggccagggtcctgctcatcac

SEQ ID NO: 45075 - DNA, 30 bp, Homo sapiens
gagcatcacattgaactcagtgaccagaaa

SEQ ID NO: 45076 - DNA, 30 bp, Homo sapiens
gtaattggattcaggtggatcccgccgctc

SEQ ID NO: 45077 - DNA, 30 bp, Homo sapiens
cctcgggatgggagggagtggtggagcacc

SEQ ID NO: 45078 - DNA, 30 bp, Homo sapiens
gaatgggtggcagaggtggggctccacggg

SEQ ID NO: 45079 - DNA, 30 bp, Homo sapiens
atgtcatcagagctctgcccgactgcttcc

SEQ ID NO: 45080 - DNA, 30 bp, Homo sapiens
tgatttccacggcacaagattataggagga

SEQ ID NO: 45081 - DNA, 30 bp, Homo sapiens
aatcatgggcgggtgctcgctgtcctcatc

SEQ ID NO: 45082 - DNA, 30 bp, Homo sapiens
gtccatgcaaactccacagtacttgggttg

SEQ ID NO: 45083 - DNA, 30 bp, Homo sapiens
tagttggcaatttctgagaagtcagggtag

SEQ ID NO: 45084 - DNA, 30 bp, Homo sapiens
tattggtgttctgcatggtggacccaagct

SEQ ID NO: 45085 - DNA, 30 bp, Homo sapiens
agaaggcactgttttgtggactgcgacccc

SEQ ID NO: 45086 - DNA, 30 bp, Homo sapiens
tccaggttctctgcagtttctctgacacac

SEQ ID NO: 45087 - DNA, 30 bp, Homo sapiens
ccgccgctgtctgtgcctgcggggcctggg

SEQ ID NO: 45088 - DNA, 30 bp, Homo sapiens
gctgcgttgtcattgatgaaggaatatttc

SEQ ID NO: 45089 - DNA, 30 bp, Homo sapiens
actcctgggcctccttgcgggtcaacttgt

SEQ ID NO: 45090 - DNA, 30 bp, Homo sapiens
aagtggtccgcaggttggagcctggggggt

SEQ ID NO: 45091 - DNA, 30 bp, Homo sapiens
gtcaggcttctcactctcaggatctggtgt

SEQ ID NO: 45092 - DNA, 30 bp, Homo sapiens
agcgaacagggtctgaagccgcaaaggaag

SEQ ID NO: 45093 - DNA, 30 bp, Homo sapiens
accaggagggattgtggcaggattctgcac

SEQ ID NO: 45094 - DNA, 30 bp, Homo sapiens
aacatccccggcgaatgtcacccccttgct

SEQ ID NO: 45095 - DNA, 30 bp, Homo sapiens
agacactcgtgcagtacgcgcgtgtgcgtg

SEQ ID NO: 45096 - DNA, 30 bp, Homo sapiens
acttgcagacgctgacccactcggtgatgc

SEQ ID NO: 45097 - DNA, 30 bp, Homo sapiens
cttacacacattcacccactctgtaacctt

SEQ ID NO: 45098 - DNA, 30 bp, Homo sapiens
ttgcagacatagcgctccacggtacgctca

SEQ ID NO: 45099 - DNA, 30 bp, Homo sapiens
gtgtggacatcagtcatgctttcacacctc

SEQ ID NO: 45100 - DNA, 30 bp, Homo sapiens
tagcggttgtccagtcagcgttcttggggg

SEQ ID NO: 45101 - DNA, 30 bp, Homo sapiens
gtttggtccagccactctgccttcttgggg

SEQ ID NO: 45102 - DNA, 30 bp, Homo sapiens
ttgcaggtgtgcacgtcgtagatgcgaata

SEQ ID NO: 45103 - DNA, 30 bp, Homo sapiens
tgcaggtgtgcacgtcgtagacgcgcgtgc

SEQ ID NO: 45104 - DNA, 30 bp, Homo sapiens
catcggcacgtgtgcaactccacgagccgc

SEQ ID NO: 45105 - DNA, 30 bp, Homo sapiens
acttgcacacaaactggtccacgatctccg

SEQ ID NO: 45106 - DNA, 30 bp, Homo sapiens
tatttacagatgtactggtccacgatctcc

SEQ ID NO: 45107 - DNA, 30 bp, Homo sapiens
cacaggcagaggctgagctccttgcgcaca

SEQ ID NO: 45108 - DNA, 30 bp, Homo sapiens
gctcgctgcacgtgttgcacttgacatagc

SEQ ID NO: 45109 - DNA, 30 bp, Homo sapiens
ttgcaggtgaagacctcggtgcgctcgctg

SEQ ID NO: 45110 - DNA, 30 bp, Homo sapiens
cccagggactgggcactgcctggggagcgt

SEQ ID NO: 45111 - DNA, 30 bp, Homo sapiens
cacaggctgctcttcagaagtctgaacaga

SEQ ID NO: 45112 - DNA, 30 bp, Homo sapiens
gggttttctcccgggtttgtgcgcagcgcc

SEQ ID NO: 45113 - DNA, 30 bp, Homo sapiens
tgcaggtgtagacctcctcacgctgcgtgc

SEQ ID NO: 45114 - DNA, 30 bp, Homo sapiens
tactcaggcagctgagacgggagaatcgct

SEQ ID NO: 45115 - DNA, 30 bp, Homo sapiens
gcttgcaggtgtacacaagctcctcctgca

SEQ ID NO: 45116 - DNA, 30 bp, Homo sapiens
tatatcagctcacccacacctccctccgtt

SEQ ID NO: 45117 - DNA, 30 bp, Homo sapiens
gtgtggccgcccagctgtctgcaggctgtg

SEQ ID NO: 45118 - DNA, 30 bp, Homo sapiens
cagctgaacggatgaagcacaatagcgaca

SEQ ID NO: 45119 - DNA, 30 bp, Homo sapiens
ttgtggagagacatttgaaatgttgcttca

SEQ ID NO: 45120 - DNA, 30 bp, Homo sapiens
taactaaaaagacctccccttttcgttttg

SEQ ID NO: 45121 - DNA, 30 bp, Homo sapiens
ctgcttgaagaaatctacccccctcaactc

SEQ ID NO: 45122 - DNA, 30 bp, Homo sapiens
gcttggaaggaatcggcagctcctgaactt

SEQ ID NO: 45123 - DNA, 30 bp, Homo sapiens
tgtgaggaactctttcattttcttggggat

SEQ ID NO: 45124 - DNA, 30 bp, Homo sapiens
atctgggcacatactccctgggcagccccg

SEQ ID NO: 45125 - DNA, 30 bp, Homo sapiens
tcttgggtagtagtcatcggggacacccgt

SEQ ID NO: 45126 - DNA, 30 bp, Homo sapiens
aaagcgccagctggagtttggtcatgtttc

SEQ ID NO: 45127 - DNA, 30 bp, Homo sapiens
catttacacttgagtccaagccattctgaa

SEQ ID NO: 45128 - DNA, 30 bp, Homo sapiens
agaaggggaatttttcggaggtggccactt

SEQ ID NO: 45129 - DNA, 30 bp, Homo sapiens
aggcgtaaacttccaggcactcagttcatt

SEQ ID NO: 45130 - DNA, 30 bp, Homo sapiens
gacaggcagcaatgatgaattgcaaaacgt

SEQ ID NO: 45131 - DNA, 30 bp, Homo sapiens
cagagctcagtgacgtgcacagtgggtgag

SEQ ID NO: 45132 - DNA, 30 bp, Homo sapiens
agctgggatattcatccgaggccgggtgaa

SEQ ID NO: 45133 - DNA, 30 bp, Homo sapiens
agctggcagggatgggatgcttatctttgc

SEQ ID NO: 45134 - DNA, 30 bp, Homo sapiens
gacgtcgtcggctgggagaggaggtatgtt

SEQ ID NO: 45135 - DNA, 30 bp, Homo sapiens
agccggactggctgccaagccgttcttgga

SEQ ID NO: 45136 - DNA, 30 bp, Homo sapiens
tggcggagggtggtattttgttttccattc

SEQ ID NO: 45137 - DNA, 30 bp, Homo sapiens
ccctctgtctcttctattgcaaaaagaagt

SEQ ID NO: 45138 - DNA, 30 bp, Homo sapiens
caaagccctcggtctcctcaatggcataca

SEQ ID NO: 45139 - DNA, 30 bp, Homo sapiens
ccctggaggaaggggccgctcccaggtggt

SEQ ID NO: 45140 - DNA, 30 bp, Homo sapiens
gccaggttagaaagggctcacttttgttca

SEQ ID NO: 45141 - DNA, 30 bp, Homo sapiens
ttcaggctcccaaacactgcggctggcacg

SEQ ID NO: 45142 - DNA, 30 bp, Homo sapiens
gatgaagctaaccaccggcatttctcctga

SEQ ID NO: 45143 - DNA, 30 bp, Homo sapiens
tctggcattttacagtgttcctctttaggt

SEQ ID NO: 45144 - DNA, 30 bp, Homo sapiens
cgccggaacccaaatccagatttatccccg

SEQ ID NO: 45145 - DNA, 30 bp, Homo sapiens
aacctgtgatttcccttcacctgcttctgg

SEQ ID NO: 45146 - DNA, 30 bp, Homo sapiens
ccctggtcatcaggaccatttccacattca

SEQ ID NO: 45147 - DNA, 30 bp, Homo sapiens
ctgtggtttcccttcccctccttctggcat

SEQ ID NO: 45148 - DNA, 30 bp, Homo sapiens
acactaatcagctggggaaagagttcattg

SEQ ID NO: 45149 - DNA, 30 bp, Homo sapiens
gcttggctgatgacgtccccactgacagag

SEQ ID NO: 45150 - DNA, 30 bp, Homo sapiens
agagtcacagctgtattggtcgattgctgg

SEQ ID NO: 45151 - DNA, 30 bp, Homo sapiens
gtcagggtcacagctgtattggtcgattgc

SEQ ID NO: 45152 - DNA, 30 bp, Homo sapiens
agtagaaggaggcgccctcataggcgaagg

SEQ ID NO: 45153 - DNA, 30 bp, Homo sapiens
cagaccagggtttgcagttttctgggacac

SEQ ID NO: 45154 - DNA, 30 bp, Homo sapiens
agtgtcaccaccaccacggatacgatggga

SEQ ID NO: 45155 - DNA, 30 bp, Homo sapiens
acatgggacacttgtcaactgcttcagcac

SEQ ID NO: 45156 - DNA, 30 bp, Homo sapiens
tgggggctgctgggatccggggatcacttc

SEQ ID NO: 45157 - DNA, 30 bp, Homo sapiens
cactgggcagctggctgggagtagctgcag

SEQ ID NO: 45158 - DNA, 30 bp, Homo sapiens
actaggcactccattggataaactgtcttt

SEQ ID NO: 45159 - DNA, 30 bp, Homo sapiens
tgagttgttctgactgcacctccactctgg

SEQ ID NO: 45160 - DNA, 30 bp, Homo sapiens
aagcagagcagagatcttcagcattcaaga

SEQ ID NO: 45161 - DNA, 30 bp, Homo sapiens
ctattgcaggagtgacagtaattcctcagc

SEQ ID NO: 45162 - DNA, 30 bp, Homo sapiens
gctcctgaataagggcatcatctttgtact

SEQ ID NO: 45163 - DNA, 30 bp, Homo sapiens
actcggctcttgcttcatctgttccctgca

SEQ ID NO: 45164 - DNA, 30 bp, Homo sapiens
tagaggagtggtccgtctcgatatcgaatg

SEQ ID NO: 45165 - DNA, 30 bp, Homo sapiens
ctgtggtctcatactccagcagctcctggg

SEQ ID NO: 45166 - DNA, 30 bp, Homo sapiens
ccttcactggcgaagcagcctcatccttag

SEQ ID NO: 45167 - DNA, 30 bp, Homo sapiens
gtttgggtgaaaactcccataataaacaat

SEQ ID NO: 45168 - DNA, 30 bp, Homo sapiens
ttcagtctcaaagggtggctctgagttctc

SEQ ID NO: 45169 - DNA, 30 bp, Homo sapiens
ttacccaccatgctggaattattttttgtg

SEQ ID NO: 45170 - DNA, 30 bp, Homo sapiens
atagtacaagtcttacggtacatgtcatct

SEQ ID NO: 45171 - DNA, 30 bp, Homo sapiens
aaatgggaacaggtgggaagctgctgcttt

SEQ ID NO: 45172 - DNA, 30 bp, Homo sapiens
gagagcttcctggcggccctgtttctgcaa

SEQ ID NO: 45173 - DNA, 30 bp, Homo sapiens
gggaggtatttattaatgctgtttggagat

SEQ ID NO: 45174 - DNA, 30 bp, Homo sapiens
gacactccagccaaggatggcaagggtgga

SEQ ID NO: 45175 - DNA, 30 bp, Homo sapiens
gcctggctgcatatctgttcaatgtcattc

SEQ ID NO: 45176 - DNA, 30 bp, Homo sapiens
tactcgggaagctggtagaaagactgcttg

SEQ ID NO: 45177 - DNA, 30 bp, Homo sapiens
atgtggattaaagatgccagggacagacat

SEQ ID NO: 45178 - DNA, 30 bp, Homo sapiens
tctgcttccgatccagcgtaggaggagtgc

SEQ ID NO: 45179 - DNA, 30 bp, Homo sapiens
agatggtggccaggccacccccatcattgt

SEQ ID NO: 45180 - DNA, 30 bp, Homo sapiens
gcttcacagtgccagggggcaggctgtcgt

SEQ ID NO: 45181 - DNA, 30 bp, Homo sapiens
aagtggaattcttcattgagtcgttgactt

SEQ ID NO: 45182 - DNA, 30 bp, Homo sapiens
ggctttgctctctggaagaacacctttaag

SEQ ID NO: 45183 - DNA, 30 bp, Homo sapiens
tgtcacgagccttggattgagaagcgaggc

SEQ ID NO: 45184 - DNA, 30 bp, Homo sapiens
tgagtgctgtaaagggctgcaaacgtcacc

SEQ ID NO: 45185 - DNA, 30 bp, Homo sapiens
ttgcggcaccaccccatagagctggtgagg

SEQ ID NO: 45186 - DNA, 30 bp, Homo sapiens
cttcaccagttgctgccatgccttacagag

SEQ ID NO: 45187 - DNA, 30 bp, Homo sapiens
cagtgggactgggtcccaggtgtccctcgc

SEQ ID NO: 45188 - DNA, 30 bp, Homo sapiens
ttctgggctgctgtttctcagagtttctaa

SEQ ID NO: 45189 - DNA, 30 bp, Homo sapiens
acacggcctctttctctgaagtctccttct

SEQ ID NO: 45190 - DNA, 30 bp, Homo sapiens
caccaccttcttcaaatacagctgctgtgt

SEQ ID NO: 45191 - DNA, 30 bp, Homo sapiens
tcctggaagtgcttggtgagggcttccagc

SEQ ID NO: 45192 - DNA, 30 bp, Homo sapiens
agaaggtttagaaacaccaaaattaacagc

SEQ ID NO: 45193 - DNA, 30 bp, Homo sapiens
tcttcgtcatgtaatatgttcttttatatt

SEQ ID NO: 45194 - DNA, 30 bp, Homo sapiens
gtatcttcctgagggtggtggcaaagggta

SEQ ID NO: 45195 - DNA, 30 bp, Homo sapiens
gagtcactggctgtgggctcctggcagaac

SEQ ID NO: 45196 - DNA, 30 bp, Homo sapiens
gccgttctgtccactggtgcaggacagcac

SEQ ID NO: 45197 - DNA, 30 bp, Homo sapiens
cctccgggatgggagtgttgcagttcccgt

SEQ ID NO: 45198 - DNA, 30 bp, Homo sapiens
actcgggtgtcctccagtgtagttccacat

SEQ ID NO: 45199 - DNA, 30 bp, Homo sapiens
cactccggaggcccccgggtctgagacaag

SEQ ID NO: 45200 - DNA, 30 bp, Homo sapiens
gtaaagcacaatcagtaggtggttaggaac

SEQ ID NO: 45201 - DNA, 30 bp, Homo sapiens
agccggccatcaggtttgactgcccccagc

SEQ ID NO: 45202 - DNA, 30 bp, Homo sapiens
tacctgagtcgcccgtctgctttgacaggc

SEQ ID NO: 45203 - DNA, 30 bp, Homo sapiens
tgtttaactaaactggctgtctgttccaaa

SEQ ID NO: 45204 - DNA, 30 bp, Homo sapiens
agttggaaggtgcctctggcggccaggcgg

SEQ ID NO: 45205 - DNA, 30 bp, Homo sapiens
aatgatgaggcttctcctctgggtgaagat

SEQ ID NO: 45206 - DNA, 30 bp, Homo sapiens
gcctcttttaaactaggcccacttctctgt

SEQ ID NO: 45207 - DNA, 30 bp, Homo sapiens
tggtggcagccaaaacagactccatgtcat

SEQ ID NO: 45208 - DNA, 30 bp, Homo sapiens
tttcagcgatttacaggaaatggagcccag

SEQ ID NO: 45209 - DNA, 30 bp, Homo sapiens
tgttggtgatttatgctgactccgccttct

SEQ ID NO: 45210 - DNA, 30 bp, Homo sapiens
gctccctccgaagaggccccgggtcagggg

SEQ ID NO: 45211 - DNA, 30 bp, Homo sapiens
ttacagtcaggacgtcattgtaatcttcat

SEQ ID NO: 45212 - DNA, 30 bp, Homo sapiens
cctgctcagcctcgggagcggacgaattct

SEQ ID NO: 45213 - DNA, 30 bp, Homo sapiens
tccaggatggtggtggtggggtccccactg

SEQ ID NO: 45214 - DNA, 30 bp, Homo sapiens
tgctgggtgggtggagcagggttctcagtt

SEQ ID NO: 45215 - DNA, 30 bp, Homo sapiens
agtagggagggttccaggaagggttccaga

SEQ ID NO: 45216 - DNA, 30 bp, Homo sapiens
cactggtcctcattcaatattcccatgtgt

SEQ ID NO: 45217 - DNA, 30 bp, Homo sapiens
agatggggtttggtgtaggcacgagggacg

SEQ ID NO: 45218 - DNA, 30 bp, Homo sapiens
gctctgcaatctcaaagcttgtttttttct

SEQ ID NO: 45219 - DNA, 30 bp, Homo sapiens
tggtactgtggctctgtagcagtgaagtag

SEQ ID NO: 45220 - DNA, 30 bp, Homo sapiens
caccggaccaggtggaaagtcagccagtat

SEQ ID NO: 45221 - DNA, 30 bp, Homo sapiens
gtccggatctcgtgatccgaccgcctcggc

SEQ ID NO: 45222 - DNA, 30 bp, Homo sapiens
accaggtggaaggtgagccagtacatgagc

SEQ ID NO: 45223 - DNA, 30 bp, Homo sapiens
tagctggacttggctgcagcaactgtttgg

SEQ ID NO: 45224 - DNA, 30 bp, Homo sapiens
taggagggggccagggactgcggcaaggta

SEQ ID NO: 45225 - DNA, 30 bp, Homo sapiens
tgcagggtcaccgcaacagctttggctgtg

SEQ ID NO: 45226 - DNA, 30 bp, Homo sapiens
aacaatgaagcagcactgtaggcagcccaa

SEQ ID NO: 45227 - DNA, 30 bp, Homo sapiens
aacaaagcgcaaggatatgctactaaaagt

SEQ ID NO: 45228 - DNA, 30 bp, Homo sapiens
ctgaggagtaaaggtgagaatcatccaact

SEQ ID NO: 45229 - DNA, 30 bp, Homo sapiens
agtatggcacaagggtaggcaacaagaagc

SEQ ID NO: 45230 - DNA, 30 bp, Homo sapiens
cgcagtcggtgcccgtgtatcccggcaggc

SEQ ID NO: 45231 - DNA, 30 bp, Homo sapiens
tgatggcacagcatgagttttgtttccggg

SEQ ID NO: 45232 - DNA, 30 bp, Homo sapiens
gccaggtgaccactttcatctgtgatcttc

SEQ ID NO: 45233 - DNA, 30 bp, Homo sapiens
ttttcccctcaagaacaatttgaatctctt

SEQ ID NO: 45234 - DNA, 30 bp, Homo sapiens
agttggtatggcctgtctccttggcatgtt

SEQ ID NO: 45235 - DNA, 30 bp, Homo sapiens
caaagggaagggtcagtttaagataagttt

SEQ ID NO: 45236 - DNA, 30 bp, Homo sapiens
agtcccagccattgtccttgatcatgtgtg

SEQ ID NO: 45237 - DNA, 30 bp, Homo sapiens
cgttgtctttgatcatgtggttgagttcaa

SEQ ID NO: 45238 - DNA, 30 bp, Homo sapiens
agtcccagccgttgtccttcaccatgtgtg

SEQ ID NO: 45239 - DNA, 30 bp, Homo sapiens
agccctcactctctcgaactagagcacgtt

SEQ ID NO: 45240 - DNA, 30 bp, Homo sapiens
cacaggtaggacgcatgtgaggggagcagt

SEQ ID NO: 45241 - DNA, 30 bp, Homo sapiens
tcccctcggtctctgtctcgatcacataat

SEQ ID NO: 45242 - DNA, 30 bp, Homo sapiens
ccaagggaagacgttcccataactggagca

SEQ ID NO: 45243 - DNA, 30 bp, Homo sapiens
ttgtttgtttcgactctgccgttccttgcg

SEQ ID NO: 45244 - DNA, 30 bp, Homo sapiens
atttcccacgaccttgacgttcctttttaa

SEQ ID NO: 45245 - DNA, 30 bp, Homo sapiens
gcatggcttcctcctcttcttgacgctttt

SEQ ID NO: 45246 - DNA, 30 bp, Homo sapiens
ccagcgtctccttcgtctccctggttttcc

SEQ ID NO: 45247 - DNA, 30 bp, Homo sapiens
cctgcagcgcttctttattctgctcttcac

SEQ ID NO: 45248 - DNA, 30 bp, Homo sapiens
ttgttgccttcgccgccatcgtcgtcctgc

SEQ ID NO: 45249 - DNA, 30 bp, Homo sapiens
cctgcttcttcatcctgctggtcgctcgtc

SEQ ID NO: 45250 - DNA, 30 bp, Homo sapiens
ctgccgcatcacattcttctcctgcactgt

SEQ ID NO: 45251 - DNA, 30 bp, Homo sapiens
aattttcccctccttctcctgcttcagctt

SEQ ID NO: 45252 - DNA, 30 bp, Homo sapiens
cactggttgtttttggccttagcatgtgtt

SEQ ID NO: 45253 - DNA, 30 bp, Homo sapiens
atttcctctgtagcatcttcaggttccatc

SEQ ID NO: 45254 - DNA, 30 bp, Homo sapiens
tctctagcaccatcagccatgtgccgcagt

SEQ ID NO: 45255 - DNA, 30 bp, Homo sapiens
cacgggttgtttttggtcttcacatgcgtt

SEQ ID NO: 45256 - DNA, 30 bp, Homo sapiens
tacagtctaggccgcctgccatggggtgca

SEQ ID NO: 45257 - DNA, 30 bp, Homo sapiens
gtgaggtaattcaactacaatttttccagt

SEQ ID NO: 45258 - DNA, 30 bp, Homo sapiens
aacaggcacagtccagaacagtatctgtgt

SEQ ID NO: 45259 - DNA, 30 bp, Homo sapiens
cacaggcagcctcagccttctgtgtgctgc

SEQ ID NO: 45260 - DNA, 30 bp, Homo sapiens
cacaggacaggcgtttgcctttgcatctac

SEQ ID NO: 45261 - DNA, 30 bp, Homo sapiens
cacaggagaatctcttgtctttgcagcgac

SEQ ID NO: 45262 - DNA, 30 bp, Homo sapiens
ttgcggctgacacgacacctgcgacacccg

SEQ ID NO: 45263 - DNA, 30 bp, Homo sapiens
tagtgtgatgacatgttgcttgttgagaaa

SEQ ID NO: 45264 - DNA, 30 bp, Homo sapiens
tacaggaagctgctgtccctaatgccaaag

SEQ ID NO: 45265 - DNA, 30 bp, Homo sapiens
tgcaggcagctctttctcccgctggcatgc

SEQ ID NO: 45266 - DNA, 30 bp, Homo sapiens
tacaggaggacctttgtgatgacgcagccg

SEQ ID NO: 45267 - DNA, 30 bp, Homo sapiens
tgagcctggattggccaaggctaccgttct

SEQ ID NO: 45268 - DNA, 30 bp, Homo sapiens
atgaggtgcagcatcaagtcttttcctata

SEQ ID NO: 45269 - DNA, 30 bp, Homo sapiens
ctcaggatcccagctcagaaccaacgtaga

SEQ ID NO: 45270 - DNA, 30 bp, Homo sapiens
agaaggctcctgtggggggtaagacagata

SEQ ID NO: 45271 - DNA, 30 bp, Homo sapiens
acgaggaactttttttgaaatagccacacg

SEQ ID NO: 45272 - DNA, 30 bp, Homo sapiens
ctcaggggataatgtatatttaaactgttt

SEQ ID NO: 45273 - DNA, 30 bp, Homo sapiens
tccccaccagctcccctcgtgtgaggcttc

SEQ ID NO: 45274 - DNA, 30 bp, Homo sapiens
cctttgcccccacccagaggatccggtggc

SEQ ID NO: 45275 - DNA, 30 bp, Homo sapiens
cacaggtttagaaggccctatttcaccact

SEQ ID NO: 45276 - DNA, 30 bp, Homo sapiens
gcttggcattataatgtgatctcatatctt

SEQ ID NO: 45277 - DNA, 30 bp, Homo sapiens
tcatcccatcgagagggatcattctgatct

SEQ ID NO: 45278 - DNA, 30 bp, Homo sapiens
gaaatatgtgctacctctactttaacagtt

SEQ ID NO: 45279 - DNA, 30 bp, Homo sapiens
tagcggatgaggacgttaatctcggccaca

SEQ ID NO: 45280 - DNA, 30 bp, Homo sapiens
gctacaggctatcgtctccagctgctgttc

SEQ ID NO: 45281 - DNA, 30 bp, Homo sapiens
acacatagcacaggtagaggtacgtcttct

SEQ ID NO: 45282 - DNA, 30 bp, Homo sapiens
cactcggcaggcgggggacattcaggagct

SEQ ID NO: 45283 - DNA, 30 bp, Homo sapiens
ttcttgagagctatcttctaaggtccagtc

SEQ ID NO: 45284 - DNA, 30 bp, Homo sapiens
agacggtttcttgttcctttttgatggaag

SEQ ID NO: 45285 - DNA, 30 bp, Homo sapiens
gacacatgcatcctcatgtggtcgttgaac

SEQ ID NO: 45286 - DNA, 30 bp, Homo sapiens
actaaatgcagtcttgaatgtcctgtggca

SEQ ID NO: 45287 - DNA, 30 bp, Homo sapiens
cagtttgctcctccacctccaccgaagccc

SEQ ID NO: 45288 - DNA, 30 bp, Homo sapiens
tcctggccaagtggcgttggctggggcacg

SEQ ID NO: 45289 - DNA, 30 bp, Homo sapiens
tctgcaacacactgcaatcagctttgaaaa

SEQ ID NO: 45290 - DNA, 30 bp, Homo sapiens
actaggatagtatccacattttcttgtgtg

SEQ ID NO: 45291 - DNA, 30 bp, Homo sapiens
ccctggctcaggccgtccagagagcagcac

SEQ ID NO: 45292 - DNA, 30 bp, Homo sapiens
caattcacacaagtactatcatttcttaag

SEQ ID NO: 45293 - DNA, 30 bp, Homo sapiens
atgttagtttttggggccaatacaaaatct

SEQ ID NO: 45294 - DNA, 30 bp, Homo sapiens
caggtggtggaggaagaaggacaacaggga

SEQ ID NO: 45295 - DNA, 30 bp, Homo sapiens
ctctggtattataaattcaaactcagtact

SEQ ID NO: 45296 - DNA, 30 bp, Homo sapiens
taatcgggagcatcagacactgtgtgaatt

SEQ ID NO: 45297 - DNA, 30 bp, Homo sapiens
accaccaaagcagttctaaatccacaactc

SEQ ID NO: 45298 - DNA, 30 bp, Homo sapiens
aacttcactgcttgttggccgagccacctt

SEQ ID NO: 45299 - DNA, 30 bp, Homo sapiens
gtctggcccagtggtggacacagagccctg

SEQ ID NO: 45300 - DNA, 30 bp, Homo sapiens
caaaggacaacattttccacaccggtttgt

SEQ ID NO: 45301 - DNA, 30 bp, Homo sapiens
caactgtccgggttcttatccgcctctttg

SEQ ID NO: 45302 - DNA, 30 bp, Homo sapiens
atcgcccttctgggttctctcaacccctgc

SEQ ID NO: 45303 - DNA, 30 bp, Homo sapiens
atttggcctcaccacagatcagcgtcactg

SEQ ID NO: 45304 - DNA, 30 bp, Homo sapiens
gtgctatcaaggcccagtaatgttccaaga

SEQ ID NO: 45305 - DNA, 30 bp, Homo sapiens
agaagggacttgacgaggccacagtgaaac

SEQ ID NO: 45306 - DNA, 30 bp, Homo sapiens
ttgtattctgctcagcctttgcagcttcgt

SEQ ID NO: 45307 - DNA, 30 bp, Homo sapiens
tttaggcgatgcatctttagcgagtaagcc

SEQ ID NO: 45308 - DNA, 30 bp, Homo sapiens
ctttggagtggtactgtgaaatgacaggca

SEQ ID NO: 45309 - DNA, 30 bp, Homo sapiens
ctggtcatttcatccacagcttgactgttg

SEQ ID NO: 45310 - DNA, 30 bp, Homo sapiens
gggcgcagggtgcgccgccaggtggcgctc

SEQ ID NO: 45311 - DNA, 30 bp, Homo sapiens
agagccaggcgaagtccttgtcagggcctc

SEQ ID NO: 45312 - DNA, 30 bp, Homo sapiens
tgttggcgttcatcctcccgccggggctgg

SEQ ID NO: 45313 - DNA, 30 bp, Homo sapiens
cctcggggacagcagctgtgatgatgaggg

SEQ ID NO: 45314 - DNA, 30 bp, Homo sapiens
cactggtctaactcgttttcattctgcagc

SEQ ID NO: 45315 - DNA, 30 bp, Homo sapiens
tgctgggaagattgctgctctgccagcgca

SEQ ID NO: 45316 - DNA, 30 bp, Homo sapiens
gagatcaggcctagatagtttttcaccact

SEQ ID NO: 45317 - DNA, 30 bp, Homo sapiens
gtccggctgtgaagttaccgtcggtggcgg

SEQ ID NO: 45318 - DNA, 30 bp, Homo sapiens
taagaggactccatggcaccttcagcctgg

SEQ ID NO: 45319 - DNA, 30 bp, Homo sapiens
tagttgttggcttcggacatggaggccacg

SEQ ID NO: 45320 - DNA, 30 bp, Homo sapiens
tgttgggcttaatttctttttcttcttctt

SEQ ID NO: 45321 - DNA, 30 bp, Homo sapiens
atctggaatccttatctccattgttcgaaa

SEQ ID NO: 45322 - DNA, 30 bp, Homo sapiens
tctcggtctgataagttaggctgaatttgt

SEQ ID NO: 45323 - DNA, 30 bp, Homo sapiens
tctcttcattatagacctgcattgctgaat

SEQ ID NO: 45324 - DNA, 30 bp, Homo sapiens
ggtgcttggacaatgaaaattcttctcccc

SEQ ID NO: 45325 - DNA, 30 bp, Homo sapiens
cagtgggcagtggcccagccctggcccttg

SEQ ID NO: 45326 - DNA, 30 bp, Homo sapiens
tcacagcaaaatttggcccattctacaggg

SEQ ID NO: 45327 - DNA, 30 bp, Homo sapiens
ctgagttttgctccagaagcagggtccata

SEQ ID NO: 45328 - DNA, 30 bp, Homo sapiens
gctcttctgaggaggttcagccttggctga

SEQ ID NO: 45329 - DNA, 30 bp, Homo sapiens
actctgctcctggggagtataattttctgt

SEQ ID NO: 45330 - DNA, 30 bp, Homo sapiens
tgtggctcttcaatggagccgctggaacct

SEQ ID NO: 45331 - DNA, 30 bp, Homo sapiens
cagtgtggcatggccgtgatgcgcatgctc

SEQ ID NO: 45332 - DNA, 30 bp, Homo sapiens
agaaggtcatcttcatctttcccaggatcc

SEQ ID NO: 45333 - DNA, 30 bp, Homo sapiens
cactggggtgctgggacttgtaggagagga

SEQ ID NO: 45334 - DNA, 30 bp, Homo sapiens
cttagcaacaatcaaggctgccagttgctg

SEQ ID NO: 45335 - DNA, 30 bp, Homo sapiens
agctgggatttctccactaaaatggctgcg

SEQ ID NO: 45336 - DNA, 30 bp, Homo sapiens
gggcttgcccaggggcgcccccgcgctctg

SEQ ID NO: 45337 - DNA, 30 bp, Homo sapiens
tgttggatactggactgtgaaagtttatta

SEQ ID NO: 45338 - DNA, 30 bp, Homo sapiens
aactttttagaaatcccaactcttagcata

SEQ ID NO: 45339 - DNA, 30 bp, Homo sapiens
tcaaggcatgtcgtggtgggacattaatgg

SEQ ID NO: 45340 - DNA, 30 bp, Homo sapiens
cctctccagtgaaaagattttcatcaacag

SEQ ID NO: 45341 - DNA, 30 bp, Homo sapiens
ctttcccggggatcttggcccgcttgcgtg

SEQ ID NO: 45342 - DNA, 30 bp, Homo sapiens
agacgtggtttgatgtgcagaggcttccct

SEQ ID NO: 45343 - DNA, 30 bp, Homo sapiens
tactggcaaaagggggaggccgtggggtcg

SEQ ID NO: 45344 - DNA, 30 bp, Homo sapiens
agttggatcaaaagttttaaaaacctcttt

SEQ ID NO: 45345 - DNA, 30 bp, Homo sapiens
tcattatcatttgggccaattaagtgatct

SEQ ID NO: 45346 - DNA, 30 bp, Homo sapiens
tccccagtggtggcggtggcagcagcagca

SEQ ID NO: 45347 - DNA, 30 bp, Homo sapiens
attcttgtgtttcaggagtcagtggagcat

SEQ ID NO: 45348 - DNA, 30 bp, Homo sapiens
ctctggccctctcttcatctgctgcacata

SEQ ID NO: 45349 - DNA, 30 bp, Homo sapiens
cgcaggctttgtcttcagtatattcaatca

SEQ ID NO: 45350 - DNA, 30 bp, Homo sapiens
gagcagggacagaagccagaggaccagctt

SEQ ID NO: 45351 - DNA, 30 bp, Homo sapiens
gccgaaatattcggaatactttccttgatt

SEQ ID NO: 45352 - DNA, 30 bp, Homo sapiens
tccgtttcggctttttggggttccgggacc

SEQ ID NO: 45353 - DNA, 30 bp, Homo sapiens
cattggtttctccaatgctgataaacacga

SEQ ID NO: 45354 - DNA, 30 bp, Homo sapiens
tgctggtgctactgctactggaagagctgg

SEQ ID NO: 45355 - DNA, 30 bp, Homo sapiens
cgtttcctcttggtgggtggggacaacgct

SEQ ID NO: 45356 - DNA, 30 bp, Homo sapiens
cagtggctcagagaagtcattgtattcgcc

SEQ ID NO: 45357 - DNA, 30 bp, Homo sapiens
cactgggacattccttggctagatgtcggg

SEQ ID NO: 45358 - DNA, 30 bp, Homo sapiens
tttctgctggaggggcgtatttcaacctaa

SEQ ID NO: 45359 - DNA, 30 bp, Homo sapiens
gcttcttcttgtgcttcttcttctttttct

SEQ ID NO: 45360 - DNA, 30 bp, Homo sapiens
cctacactctttatactctcactccttgtg

SEQ ID NO: 45361 - DNA, 30 bp, Homo sapiens
cagccacacttcttgcaggtagtgttcaag

SEQ ID NO: 45362 - DNA, 30 bp, Homo sapiens
ctgtggctcagaagcatcactgtgttctcc

SEQ ID NO: 45363 - DNA, 30 bp, Homo sapiens
tatcattagaaggggggaggggaggtgcgt

SEQ ID NO: 45364 - DNA, 30 bp, Homo sapiens
gccagggacaggagccctggggcccatcaa

SEQ ID NO: 45365 - DNA, 30 bp, Homo sapiens
actgcacgcgacggcagtagtagcccagga

SEQ ID NO: 45366 - DNA, 30 bp, Homo sapiens
gcccggccacgccggttagctgagctgcca

SEQ ID NO: 45367 - DNA, 30 bp, Homo sapiens
aatccagcatctggaagcttggaaaaaact

SEQ ID NO: 45368 - DNA, 30 bp, Homo sapiens
tattgatgggctctttccctccttttcttt

SEQ ID NO: 45369 - DNA, 30 bp, Homo sapiens
tgattcctgctgggtcctcttcgctgaggc

SEQ ID NO: 45370 - DNA, 30 bp, Homo sapiens
acctctcctttttcttctgcttgcccctct

SEQ ID NO: 45371 - DNA, 30 bp, Homo sapiens
ttcagaggcctttttgtttttctgctggtt

SEQ ID NO: 45372 - DNA, 30 bp, Homo sapiens
tttaggtacatccaaaatttcttcatagtc

SEQ ID NO: 45373 - DNA, 30 bp, Homo sapiens
cactgaaatatgtgcttttctttatccttg

SEQ ID NO: 45374 - DNA, 30 bp, Homo sapiens
caggggttcccggtgtctgggctcttcttt

SEQ ID NO: 45375 - DNA, 30 bp, Homo sapiens
acttcccaaacagcgccacggggaagtcct

SEQ ID NO: 45376 - DNA, 30 bp, Homo sapiens
tacattctccagcttttaattttatcccat

SEQ ID NO: 45377 - DNA, 30 bp, Homo sapiens
tacctctcagtttgtttgctagccgagtca

SEQ ID NO: 45378 - DNA, 30 bp, Homo sapiens
taagccagaccagcctcccggccgcccggc

SEQ ID NO: 45379 - DNA, 30 bp, Homo sapiens
aaacggcgggcgcacgcgcctgccgcgcca

SEQ ID NO: 45380 - DNA, 30 bp, Homo sapiens
tcatgggctctgttgtttcttgttgcagcc

SEQ ID NO: 45381 - DNA, 30 bp, Homo sapiens
cagcccagagggtctcccaggaccctgagg

SEQ ID NO: 45382 - DNA, 30 bp, Homo sapiens
cctcggtcgaaggggttgctggggcgctgg

SEQ ID NO: 45383 - DNA, 30 bp, Homo sapiens
acagctgggctgctgccctcttcctcctcc

SEQ ID NO: 45384 - DNA, 30 bp, Homo sapiens
ccctggctgggtgaaagaccatggtgtact

SEQ ID NO: 45385 - DNA, 30 bp, Homo sapiens
acacggagctgagcttcaccaggccgcgca

SEQ ID NO: 45386 - DNA, 30 bp, Homo sapiens
ccacagcaagagatgatgagccttctggat

SEQ ID NO: 45387 - DNA, 30 bp, Homo sapiens
tgagatacttgctgagctgcctctctagct

SEQ ID NO: 45388 - DNA, 30 bp, Homo sapiens
cacactgccatcacagaggctgagtgagca

SEQ ID NO: 45389 - DNA, 30 bp, Homo sapiens
agctggtacccagatcctgatatttggtca

SEQ ID NO: 45390 - DNA, 30 bp, Homo sapiens
caggggtggcctcctaccatgctggcatca

SEQ ID NO: 45391 - DNA, 30 bp, Homo sapiens
cacgccccgggggtcccttccctgctttgt

SEQ ID NO: 45392 - DNA, 30 bp, Homo sapiens
ttaatgcaggattgctcataccagctttgc

SEQ ID NO: 45393 - DNA, 30 bp, Homo sapiens
ttgacgatgccttcttcagctccattctcc

SEQ ID NO: 45394 - DNA, 30 bp, Homo sapiens
acatggttatttgtccctgatttgacgatg

SEQ ID NO: 45395 - DNA, 30 bp, Homo sapiens
gattggcaaagtggtagggaactcgcagtg

SEQ ID NO: 45396 - DNA, 30 bp, Homo sapiens
gcttggagctctcacttccgacattgaaca

SEQ ID NO: 45397 - DNA, 30 bp, Homo sapiens
cctcggcagggtggtggaatgcacgtgtgc

SEQ ID NO: 45398 - DNA, 30 bp, Homo sapiens
tccacgatgagcccgcagaggagccggcgc

SEQ ID NO: 45399 - DNA, 30 bp, Homo sapiens
aggaggtacacgttgcctgcaaatcactgt

SEQ ID NO: 45400 - DNA, 30 bp, Homo sapiens
aggaggctgtgtgtcccacatctgctgtgg

SEQ ID NO: 45401 - DNA, 30 bp, Homo sapiens
cagagtcctcgtcctttgtctcctctgatg

SEQ ID NO: 45402 - DNA, 30 bp, Homo sapiens
gaccacatactggtacgggtctgccttccc

SEQ ID NO: 45403 - DNA, 30 bp, Homo sapiens
atgacatggaaaggcaggtagaaagatctc

SEQ ID NO: 45404 - DNA, 30 bp, Homo sapiens
tctcataggtggtaccaccaacccctgaca

SEQ ID NO: 45405 - DNA, 30 bp, Homo sapiens
ctctggggcttgatctgtttcagcatcaca

SEQ ID NO: 45406 - DNA, 30 bp, Homo sapiens
actgagaactccgggccaccttttctgggt

SEQ ID NO: 45407 - DNA, 30 bp, Homo sapiens
accgagatctcgtaggtggtcccacccacg

SEQ ID NO: 45408 - DNA, 30 bp, Homo sapiens
agggccccgagaggctggggaaaagactgg

SEQ ID NO: 45409 - DNA, 30 bp, Homo sapiens
ctgtggtggctctgggggctctggaggtgg

SEQ ID NO: 45410 - DNA, 30 bp, Homo sapiens
ttttgtcctaagctgcttgcttgactttca

SEQ ID NO: 45411 - DNA, 30 bp, Homo sapiens
tccatattgtcttcctcgtggtctgatttg

SEQ ID NO: 45412 - DNA, 30 bp, Homo sapiens
tctagacgtgtccatgttctcctctttaaa

SEQ ID NO: 45413 - DNA, 30 bp, Homo sapiens
tagagaagcggcaaagtctatggcctttcc

SEQ ID NO: 45414 - DNA, 30 bp, Homo sapiens
tagcaatccaggtttccaaagtatgatcca

SEQ ID NO: 45415 - DNA, 30 bp, Homo sapiens
tttgatggtggggcgactcccgtgtctgca

SEQ ID NO: 45416 - DNA, 30 bp, Homo sapiens
cacaggctgcagttggacggcttcgagctg

SEQ ID NO: 45417 - DNA, 30 bp, Homo sapiens
ggagcacccctccccgatgcgctggcagga

SEQ ID NO: 45418 - DNA, 30 bp, Homo sapiens
cacaggatttgcctcgtgcaagtatctcct

SEQ ID NO: 45419 - DNA, 30 bp, Homo sapiens
caactggattctcttttctgatttttgctg

SEQ ID NO: 45420 - DNA, 30 bp, Homo sapiens
ttttggatcttttcaccaacaactactgga

SEQ ID NO: 45421 - DNA, 30 bp, Homo sapiens
gagttcctgggccggctgctccacagcctg

SEQ ID NO: 45422 - DNA, 30 bp, Homo sapiens
tcttggcacttggaaactagttttctcagg

SEQ ID NO: 45423 - DNA, 30 bp, Homo sapiens
ttttgggttggagtccgtgtgaggtaatct

SEQ ID NO: 45424 - DNA, 30 bp, Homo sapiens
ctacactggtcagaccactgtccttggggc

SEQ ID NO: 45425 - DNA, 30 bp, Homo sapiens
cactgaacatatccattcggatgctattga

SEQ ID NO: 45426 - DNA, 30 bp, Homo sapiens
tgtgaactctctgatggacactgagtcggg

SEQ ID NO: 45427 - DNA, 30 bp, Homo sapiens
gtaaggtgtgaatgctgtctaaaggccttc

SEQ ID NO: 45428 - DNA, 30 bp, Homo sapiens
gtatgagttctttgatgtcgtgtaaggttt

SEQ ID NO: 45429 - DNA, 30 bp, Homo sapiens
tgatgggagggaggatggattccagagaaa

SEQ ID NO: 45430 - DNA, 30 bp, Homo sapiens
atttggaactcccagagttcaattttcttt

SEQ ID NO: 45431 - DNA, 30 bp, Homo sapiens
agtgaacactttgatgtcggaggaggtgag

SEQ ID NO: 45432 - DNA, 30 bp, Homo sapiens
cacattccttacagtcatagggcttttcac

SEQ ID NO: 45433 - DNA, 30 bp, Homo sapiens
agatggggagtcgccggggggctgccacgg

SEQ ID NO: 45434 - DNA, 30 bp, Homo sapiens
agatggaaagtctgctgaagatgggcaggc

SEQ ID NO: 45435 - DNA, 30 bp, Homo sapiens
tcgtcggagatggagaggcggctgaagatt

SEQ ID NO: 45436 - DNA, 30 bp, Homo sapiens
gtgtgggatcgctgatgtataacaagctgt

SEQ ID NO: 45437 - DNA, 30 bp, Homo sapiens
cagggcttcttccgagggtggcgtttctga

SEQ ID NO: 45438 - DNA, 30 bp, Homo sapiens
tgttcattcttgttcgtatttgcatgcgtt

SEQ ID NO: 45439 - DNA, 30 bp, Homo sapiens
ttgttttgtctcctttgcaggccttctctc

SEQ ID NO: 45440 - DNA, 30 bp, Homo sapiens
acagaggcatcctcatcctgcccccatcca

SEQ ID NO: 45441 - DNA, 30 bp, Homo sapiens
agtcggcgggacagagcaaagctggatggg

SEQ ID NO: 45442 - DNA, 30 bp, Homo sapiens
tagaggtcttggctgggctctaggggagcc

SEQ ID NO: 45443 - DNA, 30 bp, Homo sapiens
ttcggaaggcgttcctcctgtgtatttcat

SEQ ID NO: 45444 - DNA, 30 bp, Homo sapiens
tgaaggtatttcttaaatgtgttttgcagt

SEQ ID NO: 45445 - DNA, 30 bp, Homo sapiens
taaaggccttcttacattccttacattcat

SEQ ID NO: 45446 - DNA, 30 bp, Homo sapiens
tgatgggagttgctttcctcaccataccag

SEQ ID NO: 45447 - DNA, 30 bp, Homo sapiens
ctcacaactttccaaggctcttttccttgc

SEQ ID NO: 45448 - DNA, 30 bp, Homo sapiens
ctcaggattctttcttggaagtttctgtct

SEQ ID NO: 45449 - DNA, 30 bp, Homo sapiens
tccttacaagaatagggtttttctccagta

SEQ ID NO: 45450 - DNA, 30 bp, Homo sapiens
aggtccggcagagtctgaatcttcaatcag

SEQ ID NO: 45451 - DNA, 30 bp, Homo sapiens
ggaaggcctggcggctgtgctcggccgcgg

SEQ ID NO: 45452 - DNA, 30 bp, Homo sapiens
aggaggggcccacgcggatgtgagggttca

SEQ ID NO: 45453 - DNA, 30 bp, Homo sapiens
gctcggcggcgtgcgaggagcagtaatact

SEQ ID NO: 45454 - DNA, 30 bp, Homo sapiens
aactggatatcacatagccggcaatatttc

SEQ ID NO: 45455 - DNA, 30 bp, Homo sapiens
agcttcaaatccatcaactccatcactatc

SEQ ID NO: 45456 - DNA, 30 bp, Homo sapiens
accaggcagggtcccataagatggagcaga

SEQ ID NO: 45457 - DNA, 30 bp, Homo sapiens
tccgccccgccggccccgcttcttctcccc

SEQ ID NO: 45458 - DNA, 30 bp, Homo sapiens
agagctcgcagagcacgctgcgccatggaa

SEQ ID NO: 45459 - DNA, 30 bp, Homo sapiens
ggcaggccaacttctttatgatgtcgcatt

SEQ ID NO: 45460 - DNA, 30 bp, Homo sapiens
tctttatggtgtctcattatgtgctggttc

SEQ ID NO: 45461 - DNA, 30 bp, Homo sapiens
taaaggtcaccgggctttttattgcagttg

SEQ ID NO: 45462 - DNA, 30 bp, Homo sapiens
tggaggtcccaccatggatcacaggtatca

SEQ ID NO: 45463 - DNA, 30 bp, Homo sapiens
acaacagacaccacaaaatactttcccaca

SEQ ID NO: 45464 - DNA, 30 bp, Homo sapiens
tcttggcctgcacgtggaggagagtaggca

SEQ ID NO: 45465 - DNA, 30 bp, Homo sapiens
tactggtcccgagattcatagaggagcttg

SEQ ID NO: 45466 - DNA, 30 bp, Homo sapiens
tcctggagcctgggccatgggcaccccggg

SEQ ID NO: 45467 - DNA, 30 bp, Homo sapiens
tcaaggtctggttacacgaggcacacacaa

SEQ ID NO: 45468 - DNA, 30 bp, Homo sapiens
cggtgggagctccggcaagggtctgagcag

SEQ ID NO: 45469 - DNA, 30 bp, Homo sapiens
gcagttccacatgaattttagaacaccttt

SEQ ID NO: 45470 - DNA, 30 bp, Homo sapiens
tggggatgctgaacatgagggccggctcgt

SEQ ID NO: 45471 - DNA, 30 bp, Homo sapiens
cacaggccggccttgtcgctgtagaagggc

SEQ ID NO: 45472 - DNA, 30 bp, Homo sapiens
caacggggccctcactaagctggcaggccc

SEQ ID NO: 45473 - DNA, 30 bp, Homo sapiens
tgcaggccaatggcatcgatgagagaacca

SEQ ID NO: 45474 - DNA, 30 bp, Homo sapiens
tagcgacccacgggtgagtttgctgagtat

SEQ ID NO: 45475 - DNA, 30 bp, Homo sapiens
tgaatggggtccagggacactccacatctg

SEQ ID NO: 45476 - DNA, 30 bp, Homo sapiens
ttgtgggtgtctgccttcctctgctcctgc

SEQ ID NO: 45477 - DNA, 30 bp, Homo sapiens
ctgtggttcatactggtttgcatgttgcaa

SEQ ID NO: 45478 - DNA, 30 bp, Homo sapiens
cacatgtcgtggaggttcccaagtgtcact

SEQ ID NO: 45479 - DNA, 30 bp, Homo sapiens
ccgagggatacactcacctcagctatcaac

SEQ ID NO: 45480 - DNA, 30 bp, Homo sapiens
taggcctggccagcctctgcagggacgcag

SEQ ID NO: 45481 - DNA, 30 bp, Homo sapiens
tggggactcgatgtgtcaaagggctctgag

SEQ ID NO: 45482 - DNA, 30 bp, Homo sapiens
ctgtggccggctgtgtggtggactgcggag

SEQ ID NO: 45483 - DNA, 30 bp, Homo sapiens
acacgtaccattcattgaagttggaggaga

SEQ ID NO: 45484 - DNA, 30 bp, Homo sapiens
gttcggcattaaccctgcatttaggatagg

SEQ ID NO: 45485 - DNA, 30 bp, Homo sapiens
acgtaccattcgttaaaattaggaggaagt

SEQ ID NO: 45486 - DNA, 30 bp, Homo sapiens
ccgccgccgaggaggccacctgggacttgt

SEQ ID NO: 45487 - DNA, 30 bp, Homo sapiens
aacttcagggttcccgtaaatttcctcatc

SEQ ID NO: 45488 - DNA, 30 bp, Homo sapiens
ggctggagcattggctaaaggaattcccac

SEQ ID NO: 45489 - DNA, 30 bp, Homo sapiens
gtgaggtatgagggtcggccgaaacatttc

SEQ ID NO: 45490 - DNA, 30 bp, Homo sapiens
atctggagtgaattcttttctggtgcctaa

SEQ ID NO: 45491 - DNA, 30 bp, Homo sapiens
tttgctgccatcagctggccagcagagggt

SEQ ID NO: 45492 - DNA, 30 bp, Homo sapiens
cacacaacttttcaggaacgcgccaaatgc

SEQ ID NO: 45493 - DNA, 30 bp, Homo sapiens
ttcatcagtctttcccttatgtgggttctc

SEQ ID NO: 45494 - DNA, 30 bp, Homo sapiens
gataggatgtttttccctacatggcttctc

SEQ ID NO: 45495 - DNA, 30 bp, Homo sapiens
atggcttctctgatgttgaacaaggtatga

SEQ ID NO: 45496 - DNA, 30 bp, Homo sapiens
ttaaggtatttatgggatctgtcctctcat

SEQ ID NO: 45497 - DNA, 30 bp, Homo sapiens
gaggccatgctatggtgattttctggcatc

SEQ ID NO: 45498 - DNA, 30 bp, Homo sapiens
tgcaggacctgatgtcgagcaagacttttg

SEQ ID NO: 45499 - DNA, 30 bp, Homo sapiens
gaaactgaccaagccagacctgaggacttc

SEQ ID NO: 45500 - DNA, 30 bp, Homo sapiens
cgcttatggattcagatttttcaccactgt

SEQ ID NO: 45501 - DNA, 30 bp, Homo sapiens
atagactcatcccaaagcatttcctcttct

SEQ ID NO: 45502 - DNA, 30 bp, Homo sapiens
taactcttcttggtggaaccaaagccagag

SEQ ID NO: 45503 - DNA, 30 bp, Homo sapiens
ttctccatctcattcctgtaccgctgttca

SEQ ID NO: 45504 - DNA, 30 bp, Homo sapiens
agatgggcatgatactgttctattgagttt

SEQ ID NO: 45505 - DNA, 30 bp, Homo sapiens
cactggactctgggctgcagaggccacccc

SEQ ID NO: 45506 - DNA, 30 bp, Homo sapiens
ttgttctcaaatagagacaggaggtcatcg

SEQ ID NO: 45507 - DNA, 30 bp, Homo sapiens
agcaggtcgtcattgttgttcgtagggagg

SEQ ID NO: 45508 - DNA, 30 bp, Homo sapiens
cagtggaggatgagaataatgccacattga

SEQ ID NO: 45509 - DNA, 30 bp, Homo sapiens
cctgctcaacagccattagggctgggccag

SEQ ID NO: 45510 - DNA, 30 bp, Homo sapiens
ccaaggtgtttcggtccagtgaagtagacg

SEQ ID NO: 45511 - DNA, 30 bp, Homo sapiens
gtattccaaggcaaaggtaatagatgctgt

SEQ ID NO: 45512 - DNA, 30 bp, Homo sapiens
tccaggtcttcctccccaggacgacccagt

SEQ ID NO: 45513 - DNA, 30 bp, Homo sapiens
cctcggccccaccttcttgtacgcccccaa

SEQ ID NO: 45514 - DNA, 30 bp, Homo sapiens
atttggctttggcaagttcttcatgtacct

SEQ ID NO: 45515 - DNA, 30 bp, Homo sapiens
tactggaagaatgacattagccttctttgt

SEQ ID NO: 45516 - DNA, 30 bp, Homo sapiens
tttgcacccattttcatttttcagttgatt

SEQ ID NO: 45517 - DNA, 30 bp, Homo sapiens
cacgtgcattatgtagatgaaagagtacat

SEQ ID NO: 45518 - DNA, 30 bp, Homo sapiens
cttagggcagggccagaacccaacagattt

SEQ ID NO: 45519 - DNA, 30 bp, Homo sapiens
atttggctctgtcaccctgggctgccagga

SEQ ID NO: 45520 - DNA, 30 bp, Homo sapiens
ttccggcggcaggtgcgcttgtgctccgcg

SEQ ID NO: 45521 - DNA, 30 bp, Homo sapiens
gcttcttcttggtctgagaaatcagttgct

SEQ ID NO: 45522 - DNA, 30 bp, Homo sapiens
taatgggatggtcttcagttgaaatgagac

SEQ ID NO: 45523 - DNA, 30 bp, Homo sapiens
cgccggcgggccccccgcccaggtttcttt

SEQ ID NO: 45524 - DNA, 30 bp, Homo sapiens
atcgctctggctcaagctcatgctggaagg

SEQ ID NO: 45525 - DNA, 30 bp, Homo sapiens
attcaggacaaaaccagtccccctctggtt

SEQ ID NO: 45526 - DNA, 30 bp, Homo sapiens
agaaggtgtccagccgagactctttcggga

SEQ ID NO: 45527 - DNA, 30 bp, Homo sapiens
tagaggtattaacaagcgctgtcccacatt

SEQ ID NO: 45528 - DNA, 30 bp, Homo sapiens
gactggttaaagtctttaccacattcttcc

SEQ ID NO: 45529 - DNA, 30 bp, Homo sapiens
gcctcctgccaaagcactggctacgcccgg

SEQ ID NO: 45530 - DNA, 30 bp, Homo sapiens
tggatcctttcctagcagtgaaaaaagcat

SEQ ID NO: 45531 - DNA, 30 bp, Homo sapiens
tcacatttgtagggtttctctccagtatga

SEQ ID NO: 45532 - DNA, 30 bp, Homo sapiens
tgaagggtagtccttaccatagtcttcgct

SEQ ID NO: 45533 - DNA, 30 bp, Homo sapiens
attcacagggcttctcatctttgtgagtct

SEQ ID NO: 45534 - DNA, 30 bp, Homo sapiens
agggttgaagatcggttaaaggctttgcca

SEQ ID NO: 45535 - DNA, 30 bp, Homo sapiens
cacatctattacattcatattgcctctcct

SEQ ID NO: 45536 - DNA, 30 bp, Homo sapiens
gcacggaaggttttcccacattccttacat

SEQ ID NO: 45537 - DNA, 30 bp, Homo sapiens
ggtactagcacgactaaaggctttgccaca

SEQ ID NO: 45538 - DNA, 30 bp, Homo sapiens
tgatggtggccacgtggttgagttctgatc

SEQ ID NO: 45539 - DNA, 30 bp, Homo sapiens
ctctggtcttcccctttgtttcctatggaa

SEQ ID NO: 45540 - DNA, 30 bp, Homo sapiens
tctctgccttttctgcttcagaatccactg

SEQ ID NO: 45541 - DNA, 30 bp, Homo sapiens
agatggctgaagagtttcccacactggcta

SEQ ID NO: 45542 - DNA, 30 bp, Homo sapiens
gagagagtataaggaatccgaaggttgccc

SEQ ID NO: 45543 - DNA, 30 bp, Homo sapiens
gcctgcctgcagtgtgaactttctggtgcc

SEQ ID NO: 45544 - DNA, 30 bp, Homo sapiens
tgagttctctggtgcttggtaagggaggag

SEQ ID NO: 45545 - DNA, 30 bp, Homo sapiens
cagagggagaaaccaggaagcaagcatgga

SEQ ID NO: 45546 - DNA, 30 bp, Homo sapiens
taaaggctttcccacatgcatttataaggt

SEQ ID NO: 45547 - DNA, 30 bp, Homo sapiens
tcctcacatttgtatggttcctctccagta

SEQ ID NO: 45548 - DNA, 30 bp, Homo sapiens
tgagtcctttcatgcagtcgaaagtgactg

SEQ ID NO: 45549 - DNA, 30 bp, Homo sapiens
cactggtgttcagtaaggaatgagtggtaa

SEQ ID NO: 45550 - DNA, 30 bp, Homo sapiens
gtcaggaaatcgagaccatcctggccaaca

SEQ ID NO: 45551 - DNA, 30 bp, Homo sapiens
taaaggctttgtcacaatctttacatttgt

SEQ ID NO: 45552 - DNA, 30 bp, Homo sapiens
tggtggctcatgactaatcccagctacttg

SEQ ID NO: 45553 - DNA, 30 bp, Homo sapiens
agatggaagaattcttatgttgagttaggt

SEQ ID NO: 45554 - DNA, 30 bp, Homo sapiens
ctcaggtccagtgtggggagcggcaggagc

SEQ ID NO: 45555 - DNA, 30 bp, Homo sapiens
ccctggcgtttctccttgttggattctaga

SEQ ID NO: 45556 - DNA, 30 bp, Homo sapiens
ttctggctgaaagctttcccacattcactg

SEQ ID NO: 45557 - DNA, 30 bp, Homo sapiens
tgaatcttctcatgtctctgaagcaggtac

SEQ ID NO: 45558 - DNA, 30 bp, Homo sapiens
gtctggccagttgtggcatcaggtgaagat

SEQ ID NO: 45559 - DNA, 30 bp, Homo sapiens
ggctggagttatggctaaaggatttcccac

SEQ ID NO: 45560 - DNA, 30 bp, Homo sapiens
tcaagcgcctcttgtagcgtctcccacaat

SEQ ID NO: 45561 - DNA, 30 bp, Homo sapiens
gagaggctttcttcattgtacaacgccagg

SEQ ID NO: 45562 - DNA, 30 bp, Homo sapiens
ccctggtgtgaatcaactggtgtttgatca

SEQ ID NO: 45563 - DNA, 30 bp, Homo sapiens
gtaaggtttctctccggtatgcattctgtg

SEQ ID NO: 45564 - DNA, 30 bp, Homo sapiens
cgcttatcacacacccccatgaaagtggca

SEQ ID NO: 45565 - DNA, 30 bp, Homo sapiens
tgtgaattctctggtgttgactaaggtttg

SEQ ID NO: 45566 - DNA, 30 bp, Homo sapiens
tcttggggtaggagctgatgaccagacttg

SEQ ID NO: 45567 - DNA, 30 bp, Homo sapiens
ttctggtgctgaatgagatgagaattttgg

SEQ ID NO: 45568 - DNA, 30 bp, Homo sapiens
agtccccatggtgaagtcggtgatgctggt

SEQ ID NO: 45569 - DNA, 30 bp, Homo sapiens
cttgcatggaagttcatctgtggccatatt

SEQ ID NO: 45570 - DNA, 30 bp, Homo sapiens
cagaaccatgagatacattgatggagataa

SEQ ID NO: 45571 - DNA, 30 bp, Homo sapiens
gcttggtaaagcctttcacagaataactgc

SEQ ID NO: 45572 - DNA, 30 bp, Homo sapiens
gaaagggcttctttcctaagtgggatcttt

SEQ ID NO: 45573 - DNA, 30 bp, Homo sapiens
tgaatacatgtaaagggtttctctccagta

SEQ ID NO: 45574 - DNA, 30 bp, Homo sapiens
ttaccacactattgggtttctctccattat

SEQ ID NO: 45575 - DNA, 30 bp, Homo sapiens
actttgacttccgagtgtggcctcttccat

SEQ ID NO: 45576 - DNA, 30 bp, Homo sapiens
gccaggatgcagtctctgatgtttgttgag

SEQ ID NO: 45577 - DNA, 30 bp, Homo sapiens
gtgaatggtgtcacggtgaatgaagatctg

SEQ ID NO: 45578 - DNA, 30 bp, Homo sapiens
tgtgtgcaatttctgatgctgaataagaga

SEQ ID NO: 45579 - DNA, 30 bp, Homo sapiens
gggaggccaaaacgacaaatgtccagcaca

SEQ ID NO: 45580 - DNA, 30 bp, Homo sapiens
gtcaggtgtgagaactgggtgaaggctttg

SEQ ID NO: 45581 - DNA, 30 bp, Homo sapiens
cagtctattccctgtttggcgtaacgccgt

SEQ ID NO: 45582 - DNA, 30 bp, Homo sapiens
aactggcacgaataaaggctttgccacatt

SEQ ID NO: 45583 - DNA, 30 bp, Homo sapiens
tttcgggtcttacaggctgagtgggttttc

SEQ ID NO: 45584 - DNA, 30 bp, Homo sapiens
taggaggtcttttctgagtgggtcctctga

SEQ ID NO: 45585 - DNA, 30 bp, Homo sapiens
aggtgggagcgggtgggggtgtggccagag

SEQ ID NO: 45586 - DNA, 30 bp, Homo sapiens
tgcgacattacaggaggtctcattcccatc

SEQ ID NO: 45587 - DNA, 30 bp, Homo sapiens
tgaaggctttgccacattcttcacatttgt

SEQ ID NO: 45588 - DNA, 30 bp, Homo sapiens
tctcggaaactaatcttagtgacagaacga

SEQ ID NO: 45589 - DNA, 30 bp, Homo sapiens
tgagaccagtcagtatattgtagctttttc

SEQ ID NO: 45590 - DNA, 30 bp, Homo sapiens
tgcagggactctgatgtgtgctgaagtttg

SEQ ID NO: 45591 - DNA, 30 bp, Homo sapiens
tgaactctctggtgttgaatgaggacagat

SEQ ID NO: 45592 - DNA, 30 bp, Homo sapiens
aagcaggccattgggccttccgggctccag

SEQ ID NO: 45593 - DNA, 30 bp, Homo sapiens
ccacgggctgggccatcttggcgtgcaggc

SEQ ID NO: 45594 - DNA, 30 bp, Homo sapiens
gcatggactctttgatgaattcgaagagct

SEQ ID NO: 45595 - DNA, 30 bp, Homo sapiens
tgaaggctttactacattccttacatttga

SEQ ID NO: 45596 - DNA, 30 bp, Homo sapiens
tgttagataagtgttgatatgacacaggcc

SEQ ID NO: 45597 - DNA, 30 bp, Homo sapiens
accgttcttgcccccccagccctgcctctc

SEQ ID NO: 45598 - DNA, 30 bp, Homo sapiens
acagacttccttcctgtaccagctttccaa

SEQ ID NO: 45599 - DNA, 30 bp, Homo sapiens
ctccagatttcaatggcttttctccactgt

SEQ ID NO: 45600 - DNA, 30 bp, Homo sapiens
cgaaggcttgaggcctgactaaagcacata

SEQ ID NO: 45601 - DNA, 30 bp, Homo sapiens
gtagcgcttcccacagtcctcacatttaga

SEQ ID NO: 45602 - DNA, 30 bp, Homo sapiens
tggattctctgatgttcttaccacccctat

SEQ ID NO: 45603 - DNA, 30 bp, Homo sapiens
gccaggtcatagagcaaaagagcttttaca

SEQ ID NO: 45604 - DNA, 30 bp, Homo sapiens
tggactttctgatgatatgtaagacgtgaa

SEQ ID NO: 45605 - DNA, 30 bp, Homo sapiens
tgcactctttggtggttccgcagacctgag

SEQ ID NO: 45606 - DNA, 30 bp, Homo sapiens
ctatggacactctgatgctgactgagctgg

SEQ ID NO: 45607 - DNA, 30 bp, Homo sapiens
caatgggaaggctcttttctggcatgaact

SEQ ID NO: 45608 - DNA, 30 bp, Homo sapiens
tggactctctgatgaatctgaagacaacga

SEQ ID NO: 45609 - DNA, 30 bp, Homo sapiens
agaacttcctccctctgacaactctctgat

SEQ ID NO: 45610 - DNA, 30 bp, Homo sapiens
agtgtggactctctgatggtagatgagatg

SEQ ID NO: 45611 - DNA, 30 bp, Homo sapiens
acgtgggtgagggcctgccactcgccggcg

SEQ ID NO: 45612 - DNA, 30 bp, Homo sapiens
gcgaggatctttcttgtgaacccgctggtg

SEQ ID NO: 45613 - DNA, 30 bp, Homo sapiens
ggaatggagctcccaggatgcccacttgag

SEQ ID NO: 45614 - DNA, 30 bp, Homo sapiens
ctgaacgcattcataaggtttctccccagt

SEQ ID NO: 45615 - DNA, 30 bp, Homo sapiens
ccgaggagctgaaacctgagtgttttgttg

SEQ ID NO: 45616 - DNA, 30 bp, Homo sapiens
tgtgaattctctgatgtttggtgagcactg

SEQ ID NO: 45617 - DNA, 30 bp, Homo sapiens
aaatggtcatcttcattttcctggctgctc

SEQ ID NO: 45618 - DNA, 30 bp, Homo sapiens
ctttgtgtgtgtcttctgatgtgcagtgag

SEQ ID NO: 45619 - DNA, 30 bp, Homo sapiens
ttctggtgctggattaggtggccatgctgg

SEQ ID NO: 45620 - DNA, 30 bp, Homo sapiens
agcaggtttctctccaacacgagtctgctg

SEQ ID NO: 45621 - DNA, 30 bp, Homo sapiens
tgtagggttttcgttcaatatgaattttct

SEQ ID NO: 45622 - DNA, 30 bp, Homo sapiens
ggttcatccaccatctcatgtcgcttcata

SEQ ID NO: 45623 - DNA, 30 bp, Homo sapiens
gtgaggtgcgaggaccgattaaaggctttg

SEQ ID NO: 45624 - DNA, 30 bp, Homo sapiens
tcccttgtgaacgttctgatgttttaggag

SEQ ID NO: 45625 - DNA, 30 bp, Homo sapiens
gaccggttaaaggctttgccacattcttca

SEQ ID NO: 45626 - DNA, 30 bp, Homo sapiens
tatacgaagccctgaattccaacagaagga

SEQ ID NO: 45627 - DNA, 30 bp, Homo sapiens
tcactacactgataaggtttttcaccagta

SEQ ID NO: 45628 - DNA, 30 bp, Homo sapiens
tgagttctctgatgactcataagacgggaa

SEQ ID NO: 45629 - DNA, 30 bp, Homo sapiens
ttgtggggtttctctttggtatggttgatc

SEQ ID NO: 45630 - DNA, 30 bp, Homo sapiens
gctgacagtctctcatccgcatgccttctt

SEQ ID NO: 45631 - DNA, 30 bp, Homo sapiens
atgaggtatgacctagagttaaaggctttg

SEQ ID NO: 45632 - DNA, 30 bp, Homo sapiens
aaaaggctttcccacattcagtgcacttac

SEQ ID NO: 45633 - DNA, 30 bp, Homo sapiens
tttaggtttgtatggtttctctccagtatg

SEQ ID NO: 45634 - DNA, 30 bp, Homo sapiens
atgaggtaggctgtttcttctttcgctttg

SEQ ID NO: 45635 - DNA, 30 bp, Homo sapiens
cagagggcccacggaaggccgcaggcgtag

SEQ ID NO: 45636 - DNA, 30 bp, Homo sapiens
aggtgggttcgggcttcaccgcctggccct

SEQ ID NO: 45637 - DNA, 30 bp, Homo sapiens
aactggttcaaaatactgctttgtttcaaa

SEQ ID NO: 45638 - DNA, 30 bp, Homo sapiens
tgaagtctatgatggtatacaaggtttgac

SEQ ID NO: 45639 - DNA, 30 bp, Homo sapiens
tgcaagggagtctggaatctctagtgttca

SEQ ID NO: 45640 - DNA, 30 bp, Homo sapiens
gagtgatggttcagagtcagatgtgctcac

SEQ ID NO: 45641 - DNA, 30 bp, Homo sapiens
gtgggttcagaagttgaggtacttttggaa

SEQ ID NO: 45642 - DNA, 30 bp, Homo sapiens
aagccagcaagttatttctgttttccttcc

SEQ ID NO: 45643 - DNA, 30 bp, Homo sapiens
aagctgcagagatgactttctgtaaattgt

SEQ ID NO: 45644 - DNA, 30 bp, Homo sapiens
tccaggtctactgttgcctctgttgtgcta

SEQ ID NO: 45645 - DNA, 30 bp, Homo sapiens
ctgtaactctggctggtgggtgtctttact

SEQ ID NO: 45646 - DNA, 30 bp, Homo sapiens
tctcgctcaggaggcggcgggagctgccgt

SEQ ID NO: 45647 - DNA, 30 bp, Homo sapiens
cgtagggccgctccttggtgtggctggaaa

SEQ ID NO: 45648 - DNA, 30 bp, Homo sapiens
gaaaggcttccccacattcgttatatttgt

SEQ ID NO: 45649 - DNA, 30 bp, Homo sapiens
gtagcgcttcccacagtcctcacatttgga

SEQ ID NO: 45650 - DNA, 30 bp, Homo sapiens
agaaggtcctttccacgctcacagtgtgtg

SEQ ID NO: 45651 - DNA, 30 bp, Homo sapiens
tcattacatctaaagggtttctctccggta

SEQ ID NO: 45652 - DNA, 30 bp, Homo sapiens
tgaacacgttgatgctgaataaggtttgta

SEQ ID NO: 45653 - DNA, 30 bp, Homo sapiens
cctgtggctttacctatactgatatctttc

SEQ ID NO: 45654 - DNA, 30 bp, Homo sapiens
cgccggccgcctcagggtgcttctgccgca

SEQ ID NO: 45655 - DNA, 30 bp, Homo sapiens
aagaggcgccatatcagtgcaaagattgtg

SEQ ID NO: 45656 - DNA, 30 bp, Homo sapiens
agaaggtgtcaggaggttccacactcgcca

SEQ ID NO: 45657 - DNA, 30 bp, Homo sapiens
acgtggactctctgatatttaactcggtcg

SEQ ID NO: 45658 - DNA, 30 bp, Homo sapiens
taaaggtcttcccacattttttgcatttaa

SEQ ID NO: 45659 - DNA, 30 bp, Homo sapiens
tgtgaattctctggtgtacagttagttgtg

SEQ ID NO: 45660 - DNA, 30 bp, Homo sapiens
gacatttgttgcattcatattttttcttca

SEQ ID NO: 45661 - DNA, 30 bp, Homo sapiens
taaagggccaccaaaactgttgcactcgtg

SEQ ID NO: 45662 - DNA, 30 bp, Homo sapiens
cactggtcaaaatactgactactgaggtct

SEQ ID NO: 45663 - DNA, 30 bp, Homo sapiens
cacaggacgccctcccggtaggcgcccgag

SEQ ID NO: 45664 - DNA, 30 bp, Homo sapiens
cactggagccttttccacacggatgacaca

SEQ ID NO: 45665 - DNA, 30 bp, Homo sapiens
gtgtggtcctggatggcaccaactgtagtt

SEQ ID NO: 45666 - DNA, 30 bp, Homo sapiens
ggcaggcaggcggctacctggtaggcgccc

SEQ ID NO: 45667 - DNA, 30 bp, Homo sapiens
caaagggtgagcctctgtgagcagcttcgc

SEQ ID NO: 45668 - DNA, 30 bp, Homo sapiens
ccacagactccaggttcctgtagttctccc

SEQ ID NO: 45669 - DNA, 30 bp, Homo sapiens
actaaagaccttgccacactgatgacattt

SEQ ID NO: 45670 - DNA, 30 bp, Homo sapiens
caagacatctgtgaggcttctgacgcatgg

SEQ ID NO: 45671 - DNA, 30 bp, Homo sapiens
acctccgctggctgcgagacggcggctggg

SEQ ID NO: 45672 - DNA, 30 bp, Homo sapiens
accttcgctggcttcaggactgggcttggc

SEQ ID NO: 45673 - DNA, 30 bp, Homo sapiens
acccccaccaccaccactgtgattgtccat

SEQ ID NO: 45674 - DNA, 30 bp, Homo sapiens
aacagggaagtcagcaggttcttcctttgc

SEQ ID NO: 45675 - DNA, 30 bp, Homo sapiens
tgtttccatgggttgctctcccaggtgtgc

SEQ ID NO: 45676 - DNA, 30 bp, Homo sapiens
gttctcttgttcctcatagtgagcatagcc

SEQ ID NO: 45677 - DNA, 30 bp, Homo sapiens
ttgtggatcctctgatgttctcggagatgg

SEQ ID NO: 45678 - DNA, 30 bp, Homo sapiens
gggtggccctttcacatcaatggacaggat

SEQ ID NO: 45679 - DNA, 30 bp, Homo sapiens
gtatggatgagacatggataaaggcaggct

SEQ ID NO: 45680 - DNA, 30 bp, Homo sapiens
aggtgggcactctggaagaaggaatttcta

SEQ ID NO: 45681 - DNA, 30 bp, Homo sapiens
ttgtgggatttctgatgtaaaagaaagttt

SEQ ID NO: 45682 - DNA, 30 bp, Homo sapiens
catcggccagggtgatgacgtcgtactcga

SEQ ID NO: 45683 - DNA, 30 bp, Homo sapiens
ccacactccctgtacaaaaacgcttctcac

SEQ ID NO: 45684 - DNA, 30 bp, Homo sapiens
ttcaggatgtcatcagggctttctccacag

SEQ ID NO: 45685 - DNA, 30 bp, Homo sapiens
tgtgttctctgatgtacaatgagatttgac

SEQ ID NO: 45686 - DNA, 30 bp, Homo sapiens
acatggagaagtcctcccggaggtgaatcc

SEQ ID NO: 45687 - DNA, 30 bp, Homo sapiens
actcggaggcctggatgtagacgggcacag

SEQ ID NO: 45688 - DNA, 30 bp, Homo sapiens
ggatggtctcgatctcctgacccaatgaga

SEQ ID NO: 45689 - DNA, 30 bp, Homo sapiens
agtgtgtcctctggtgtctgatgagatttg

SEQ ID NO: 45690 - DNA, 30 bp, Homo sapiens
cgcagagtttcttaccattatgacttttct

SEQ ID NO: 45691 - DNA, 30 bp, Homo sapiens
gtcttccaaggtggttgagtctttctgaat

SEQ ID NO: 45692 - DNA, 30 bp, Homo sapiens
catttgtgcagaggcaggaggaaggaagaa

SEQ ID NO: 45693 - DNA, 30 bp, Homo sapiens
gcccggaccaatgagaggctgtctgtggcc

SEQ ID NO: 45694 - DNA, 30 bp, Homo sapiens
tggttgagtctttctgaatgggttgccttt

SEQ ID NO: 45695 - DNA, 30 bp, Homo sapiens
tgaattctgtgatggcttgcaaggtttgaa

SEQ ID NO: 45696 - DNA, 30 bp, Homo sapiens
ctatggtgtcgcatgaggtgtgagttggaa

SEQ ID NO: 45697 - DNA, 30 bp, Homo sapiens
ggaaggcacaaccacattcactgcattcac

SEQ ID NO: 45698 - DNA, 30 bp, Homo sapiens
ctatggttgaaaagtttcccacatgtatta

SEQ ID NO: 45699 - DNA, 30 bp, Homo sapiens
aatcggcttttaaggagtcctcttcaatgt

SEQ ID NO: 45700 - DNA, 30 bp, Homo sapiens
cataggctttatctcctttaaaaaatctct

SEQ ID NO: 45701 - DNA, 30 bp, Homo sapiens
gccatcaggccccagcagtgccccttgctc

SEQ ID NO: 45702 - DNA, 30 bp, Homo sapiens
caccgggatgccgggggactccgtcctctg

SEQ ID NO: 45703 - DNA, 30 bp, Homo sapiens
tgttggcttttttttagccattttgggcct

SEQ ID NO: 45704 - DNA, 30 bp, Homo sapiens
attccaggtcattttggcacaccaggcgag

SEQ ID NO: 45705 - DNA, 30 bp, Homo sapiens
tgaaggcaagccccaaggaaagcatatgac

SEQ ID NO: 45706 - DNA, 30 bp, Homo sapiens
agatacctaaaagcactgcttgtttttcca

SEQ ID NO: 45707 - DNA, 30 bp, Homo sapiens
tactgtcggagtggcgccccagtcaggttg

SEQ ID NO: 45708 - DNA, 30 bp, Homo sapiens
caaaggtctggagcctctaaaacatgattc

SEQ ID NO: 45709 - DNA, 30 bp, Homo sapiens
gtgtggtggctcacatctgtaattccagca

SEQ ID NO: 45710 - DNA, 30 bp, Homo sapiens
gtaatttccctcgtttactacatttatagg

SEQ ID NO: 45711 - DNA, 30 bp, Homo sapiens
tgactctggcttggaaatttttcctctaat

SEQ ID NO: 45712 - DNA, 30 bp, Homo sapiens
ccgtggtttctaccttgtgagttttctgat

SEQ ID NO: 45713 - DNA, 30 bp, Homo sapiens
tgacgaatgagatccgagccactactaaaa

SEQ ID NO: 45714 - DNA, 30 bp, Homo sapiens
agctggccaggtgctccacctggatggtgc

SEQ ID NO: 45715 - DNA, 30 bp, Homo sapiens
gtacggggagaagaggatgggtccgtgcgc

SEQ ID NO: 45716 - DNA, 30 bp, Homo sapiens
gtacggagcaaagaggatggaggcaggagt

SEQ ID NO: 45717 - DNA, 30 bp, Homo sapiens
ataaggggcaaggacgataggtcctgtggc

SEQ ID NO: 45718 - DNA, 30 bp, Homo sapiens
cacaggagtgtgggcggtccgaatgggtcc

SEQ ID NO: 45719 - DNA, 30 bp, Homo sapiens
agaaggcttttccacagtcattacatttgt

SEQ ID NO: 45720 - DNA, 30 bp, Homo sapiens
tcccggaatccttctgcgcactctctctgc

SEQ ID NO: 45721 - DNA, 30 bp, Homo sapiens
cgcccagccgacagcactttattttgatga

SEQ ID NO: 45722 - DNA, 30 bp, Homo sapiens
agcgctggcaggccttcttccaccggcagg

SEQ ID NO: 45723 - DNA, 30 bp, Homo sapiens
taaaggctttgccacagtcatgacacttgt

SEQ ID NO: 45724 - DNA, 30 bp, Homo sapiens
gtgtggtgagcagagggcccccacaccttc

SEQ ID NO: 45725 - DNA, 30 bp, Homo sapiens
gaaagtgacctggggcacttcagcctagtc

SEQ ID NO: 45726 - DNA, 30 bp, Homo sapiens
ggatggtggctggcaaagtgttgatggcaa

SEQ ID NO: 45727 - DNA, 30 bp, Homo sapiens
tgatggcgcataaggaccgatctgtgcctg

SEQ ID NO: 45728 - DNA, 30 bp, Homo sapiens
ccactcccttccccataccactggttggtc

SEQ ID NO: 45729 - DNA, 30 bp, Homo sapiens
ccatggtgaaatctttgatgttgactaagt

SEQ ID NO: 45730 - DNA, 30 bp, Homo sapiens
ctttgggcttcagaggcactcgacgcgttc

SEQ ID NO: 45731 - DNA, 30 bp, Homo sapiens
tcctggagttcgctgctttctctttggctc

SEQ ID NO: 45732 - DNA, 30 bp, Homo sapiens
ccagcatgcaggtaagcgaggtccgggttt

SEQ ID NO: 45733 - DNA, 30 bp, Homo sapiens
tccacctccaccacctctgcccaggcgccg

SEQ ID NO: 45734 - DNA, 30 bp, Homo sapiens
cactggctttatagcgtttttctccactat

SEQ ID NO: 45735 - DNA, 30 bp, Homo sapiens
gaattcgggaggtagaggttgcagtgagcc

SEQ ID NO: 45736 - DNA, 30 bp, Homo sapiens
tgactgcatggtcaccaggtgatgtgtcac

SEQ ID NO: 45737 - DNA, 30 bp, Homo sapiens
aggaggctgaggcaggagaatcgcttgaac

SEQ ID NO: 45738 - DNA, 30 bp, Homo sapiens
cgcacctgagggcgcgtcggagccgccctg

SEQ ID NO: 45739 - DNA, 30 bp, Homo sapiens
cactggaagctccccctctgacagcagcgg

SEQ ID NO: 45740 - DNA, 30 bp, Homo sapiens
gtttgggcgcacactaaaggacttcccaca

SEQ ID NO: 45741 - DNA, 30 bp, Homo sapiens
tgtagggttttccacatttgctgctgtcac

SEQ ID NO: 45742 - DNA, 30 bp, Homo sapiens
ataaggcctttctcctgtgtgaactctgat

SEQ ID NO: 45743 - DNA, 30 bp, Homo sapiens
cgaaggagagaagagcttcgatgaaatgat

SEQ ID NO: 45744 - DNA, 30 bp, Homo sapiens
gtgtgcatatttagatgaatgatgttcaat

SEQ ID NO: 45745 - DNA, 30 bp, Homo sapiens
gagagtaacggagctccagcagtatgaatt

SEQ ID NO: 45746 - DNA, 30 bp, Homo sapiens
gtatttctgctccatgatccataacaccca

SEQ ID NO: 45747 - DNA, 30 bp, Homo sapiens
ctaaagtcaatcccacattccttatattca

SEQ ID NO: 45748 - DNA, 30 bp, Homo sapiens
ctgtgcgtgctggctcatcgtgtggttctg

SEQ ID NO: 45749 - DNA, 30 bp, Homo sapiens
tagaggctggagggcttctctttggcatgc

SEQ ID NO: 45750 - DNA, 30 bp, Homo sapiens
gaacggggatgactgtaagctttcccgcat

SEQ ID NO: 45751 - DNA, 30 bp, Homo sapiens
cctcaccccgggcatgcagcatgaagtgcc

SEQ ID NO: 45752 - DNA, 30 bp, Homo sapiens
tgctgggattacaggcatgagccaccacac

SEQ ID NO: 45753 - DNA, 30 bp, Homo sapiens
ttcaggtttgtagagtttctctccagtatg

SEQ ID NO: 45754 - DNA, 30 bp, Homo sapiens
tgtagggtttctctccagtatgaattactt

SEQ ID NO: 45755 - DNA, 30 bp, Homo sapiens
taaaggctttcccacattcttgacatttgt

SEQ ID NO: 45756 - DNA, 30 bp, Homo sapiens
tgagttcgctgatgtacaatgagatttctc

SEQ ID NO: 45757 - DNA, 30 bp, Homo sapiens
tatggggtgtctatgcagtgagcccttcca

SEQ ID NO: 45758 - DNA, 30 bp, Homo sapiens
gaaactcttctcacattcggtacattcata

SEQ ID NO: 45759 - DNA, 30 bp, Homo sapiens
cactggaaagttcgatcactccctggttgg

SEQ ID NO: 45760 - DNA, 30 bp, Homo sapiens
tgcattcttatgtgtttgtgtcctttcatg

SEQ ID NO: 45761 - DNA, 30 bp, Homo sapiens
agtgtgtccttttatgtctattaaaggaac

SEQ ID NO: 45762 - DNA, 30 bp, Homo sapiens
atgaattcgaaggttctgggcagatccgaa

SEQ ID NO: 45763 - DNA, 30 bp, Homo sapiens
ctgtgggtcctttcatgtttatgaaaggca

SEQ ID NO: 45764 - DNA, 30 bp, Homo sapiens
attcatatgggttctctccagtgtgagttt

SEQ ID NO: 45765 - DNA, 30 bp, Homo sapiens
ccaagggccagggcgggaaggggcctccac

SEQ ID NO: 45766 - DNA, 30 bp, Homo sapiens
taatctctaatatggtttttcatatgccga

SEQ ID NO: 45767 - DNA, 30 bp, Homo sapiens
gcgcggagtcagttcctgggggccacaaga

SEQ ID NO: 45768 - DNA, 30 bp, Homo sapiens
ctccggccggtggcccttgcggtggatgac

SEQ ID NO: 45769 - DNA, 30 bp, Homo sapiens
aagtgagtgacctggtgcataataaggccg

SEQ ID NO: 45770 - DNA, 30 bp, Homo sapiens
tgaatcctctgatgaaggaaagtccttgtc

SEQ ID NO: 45771 - DNA, 30 bp, Homo sapiens
gcgttctggagagtctcccttctttctata

SEQ ID NO: 45772 - DNA, 30 bp, Homo sapiens
gacttcttctaatagcttcttctaattcca

SEQ ID NO: 45773 - DNA, 30 bp, Homo sapiens
acgaggtcaagagatcgagaccaccctggc

SEQ ID NO: 45774 - DNA, 30 bp, Homo sapiens
tgatgtctctgatgctgaatgaggtttgca

SEQ ID NO: 45775 - DNA, 30 bp, Homo sapiens
caatggtagggtttcttccactatgaatcc

SEQ ID NO: 45776 - DNA, 30 bp, Homo sapiens
ggatggggagggaggagaggaaacctgact

SEQ ID NO: 45777 - DNA, 30 bp, Homo sapiens
ttttggcctctgcattctccaggagagatt

SEQ ID NO: 45778 - DNA, 30 bp, Homo sapiens
gagcgggggcggcgccacctcggggggagc

SEQ ID NO: 45779 - DNA, 30 bp, Homo sapiens
catttagcagccccagaactttccgatttt

SEQ ID NO: 45780 - DNA, 30 bp, Homo sapiens
tgaagcctatgatggtatacaagggatgac

SEQ ID NO: 45781 - DNA, 30 bp, Homo sapiens
actcggaagcatctttctttaaagggattt

SEQ ID NO: 45782 - DNA, 30 bp, Homo sapiens
tggtggtatgggagggcagaggagagaata

SEQ ID NO: 45783 - DNA, 30 bp, Homo sapiens
tgacttctttgatgacaaattaaggataac

SEQ ID NO: 45784 - DNA, 30 bp, Homo sapiens
tacaggcagtattgctgcttgttgtgtaca

SEQ ID NO: 45785 - DNA, 30 bp, Homo sapiens
tacaggcagagggcaccaccaggttcacct

SEQ ID NO: 45786 - DNA, 30 bp, Homo sapiens
aaaagcttgctcacattcttcacatttgta

SEQ ID NO: 45787 - DNA, 30 bp, Homo sapiens
cattccagtcctgttgctgcctcctgcttg

SEQ ID NO: 45788 - DNA, 30 bp, Homo sapiens
ttgtgctaggtatgaaatgcgactaaaggc

SEQ ID NO: 45789 - DNA, 30 bp, Homo sapiens
agaacatctgcatcttttttactgctccat

SEQ ID NO: 45790 - DNA, 30 bp, Homo sapiens
tgtctaatgaggcctgaattacttttaaat

SEQ ID NO: 45791 - DNA, 30 bp, Homo sapiens
ccttggtcaccttctgagtccccacaccat

SEQ ID NO: 45792 - DNA, 30 bp, Homo sapiens
taactacatttcatggctctttctttatta

SEQ ID NO: 45793 - DNA, 30 bp, Homo sapiens
tcttggtttctgtccaatatgaattctctt

SEQ ID NO: 45794 - DNA, 30 bp, Homo sapiens
agctgtgagaagtcatgtgccgggagaggt

SEQ ID NO: 45795 - DNA, 30 bp, Homo sapiens
gtgcacgtgcaaagactttgagtaactgaa

SEQ ID NO: 45796 - DNA, 30 bp, Homo sapiens
aactggaacgaatgaaggctttcccacatt

SEQ ID NO: 45797 - DNA, 30 bp, Homo sapiens
gactggttaaaagctttgccacattcttca

SEQ ID NO: 45798 - DNA, 30 bp, Homo sapiens
aaacggtgaaaccccgtctctactgggggt

SEQ ID NO: 45799 - DNA, 30 bp, Homo sapiens
aaaagctttgccacatgcttcacatttgta

SEQ ID NO: 45800 - DNA, 30 bp, Homo sapiens
agtaggagttcagagcctgcttggaacggc

SEQ ID NO: 45801 - DNA, 30 bp, Homo sapiens
cgactcagagtctacactgtggctatttct

SEQ ID NO: 45802 - DNA, 30 bp, Homo sapiens
gcgcggcccccgtgccgcttctggtgctcg

SEQ ID NO: 45803 - DNA, 30 bp, Homo sapiens
ctttggcaccggggcctccaggagccaccg

SEQ ID NO: 45804 - DNA, 30 bp, Homo sapiens
tgcgtccggcggtgggcgctgaagtgcgag

SEQ ID NO: 45805 - DNA, 30 bp, Homo sapiens
tgaagcctctgatgtcgaagaagtgctgaa

SEQ ID NO: 45806 - DNA, 30 bp, Homo sapiens
tgaagtttctgatgtctgaaaaggactgaa

SEQ ID NO: 45807 - DNA, 30 bp, Homo sapiens
ctgataccccagcgccgaggcggtggtcag

SEQ ID NO: 45808 - DNA, 30 bp, Homo sapiens
tcttcactatgcagggtttctgtctaatat

SEQ ID NO: 45809 - DNA, 30 bp, Homo sapiens
aatttgtgtttagagctgtattgtggtcct

SEQ ID NO: 45810 - DNA, 30 bp, Homo sapiens
tccctgaattttctggtataagcttagggt

SEQ ID NO: 45811 - DNA, 30 bp, Homo sapiens
gtttggttttcttcttgttgcttttaaatc

SEQ ID NO: 45812 - DNA, 30 bp, Homo sapiens
tccttcctcgtttatgattagtctttgggg

SEQ ID NO: 45813 - DNA, 30 bp, Homo sapiens
ttcaggcgccttgctgactcccaccttccg

SEQ ID NO: 45814 - DNA, 30 bp, Homo sapiens
gtgtggacagcccggctgccagcagtcccc

SEQ ID NO: 45815 - DNA, 30 bp, Homo sapiens
tgacttctctgatgtttaataagggatgca

SEQ ID NO: 45816 - DNA, 30 bp, Homo sapiens
ggttccctttctcagaggcactgtctggac

SEQ ID NO: 45817 - DNA, 30 bp, Homo sapiens
aacagggcgcccgcctgccctctgtgtcct

SEQ ID NO: 45818 - DNA, 30 bp, Homo sapiens
ccgagtagcttccattaaatgtctctgccc

SEQ ID NO: 45819 - DNA, 30 bp, Homo sapiens
ccttggaggaaagaacatcccaatctctag

SEQ ID NO: 45820 - DNA, 30 bp, Homo sapiens
acctggtatgaattatttgatgttgagtaa

SEQ ID NO: 45821 - DNA, 30 bp, Homo sapiens
tgttgggtcattgtatgattctgcagctct

SEQ ID NO: 45822 - DNA, 30 bp, Homo sapiens
ggccggctcccctttcccctctgtctcctc

SEQ ID NO: 45823 - DNA, 30 bp, Homo sapiens
cacattctccacacttgcaaggtttctctc

SEQ ID NO: 45824 - DNA, 30 bp, Homo sapiens
cgaaggccgtgtccaactgcaagagcccgc

SEQ ID NO: 45825 - DNA, 30 bp, Homo sapiens
ctaagggctgagacacagctaaaattattc

SEQ ID NO: 45826 - DNA, 30 bp, Homo sapiens
gcaaggtcagaattgtgactgaagacctta

SEQ ID NO: 45827 - DNA, 30 bp, Homo sapiens
taaattttcggttggcaagtaagatgccca

SEQ ID NO: 45828 - DNA, 30 bp, Homo sapiens
aagaggccagagctttggctaaaggatttt

SEQ ID NO: 45829 - DNA, 30 bp, Homo sapiens
tctcggctgagctcatccttttggatttga

SEQ ID NO: 45830 - DNA, 30 bp, Homo sapiens
ggatggaatttttactaaagaccttgccac

SEQ ID NO: 45831 - DNA, 30 bp, Homo sapiens
ccgcggcagcctctgctcaggcggccaacg

SEQ ID NO: 45832 - DNA, 30 bp, Homo sapiens
aagtctggcctcttgatacatccagaattt

SEQ ID NO: 45833 - DNA, 30 bp, Homo sapiens
tttgctgtgctacttgcaagtccgttaaag

SEQ ID NO: 45834 - DNA, 30 bp, Homo sapiens
tacataccttacactcatagggtttctcac

SEQ ID NO: 45835 - DNA, 30 bp, Homo sapiens
tgcagggggccgatgtcagctcccagctcc

SEQ ID NO: 45836 - DNA, 30 bp, Homo sapiens
accacagattttcttcagtggtgatattca

SEQ ID NO: 45837 - DNA, 30 bp, Homo sapiens
atggtggacatgcctgtaatcccagctact

SEQ ID NO: 45838 - DNA, 30 bp, Homo sapiens
gtttctctccagtatgtgtccgccgatgca

SEQ ID NO: 45839 - DNA, 30 bp, Homo sapiens
cggggggcctcctgctctgccctgcacagg

SEQ ID NO: 45840 - DNA, 30 bp, Homo sapiens
ttctggccctgtaccgtctctgctttttgc

SEQ ID NO: 45841 - DNA, 30 bp, Homo sapiens
atgaggtcaggagatcgagaccatcctggc

SEQ ID NO: 45842 - DNA, 30 bp, Homo sapiens
tgaattctgtgatgtcgagtaagttctgaa

SEQ ID NO: 45843 - DNA, 30 bp, Homo sapiens
ccagtgtggactttctgatgtctgagaagt

SEQ ID NO: 45844 - DNA, 30 bp, Homo sapiens
ggttggagttttagctaaagaattccccac

SEQ ID NO: 45845 - DNA, 30 bp, Homo sapiens
ggtgcctgacaagggaatatcttttgttga

SEQ ID NO: 45846 - DNA, 30 bp, Homo sapiens
gtatggaccctttggtgctgcagaaggtgt

SEQ ID NO: 45847 - DNA, 30 bp, Homo sapiens
gcccttcctcatccctagctctccccaacc

SEQ ID NO: 45848 - DNA, 30 bp, Homo sapiens
ttcagtgtgaactctccgatgtcgaatgag

SEQ ID NO: 45849 - DNA, 30 bp, Homo sapiens
ttttgtgaactctctgatgatgacgaagtg

SEQ ID NO: 45850 - DNA, 30 bp, Homo sapiens
agatgtctgttctggtagaacgctttccca

SEQ ID NO: 45851 - DNA, 30 bp, Homo sapiens
taaaggcaacaccatatttacaactttgat

SEQ ID NO: 45852 - DNA, 30 bp, Homo sapiens
tacttagatgtacaggatttctttcctgtg

SEQ ID NO: 45853 - DNA, 30 bp, Homo sapiens
atgcattctcgtatgcacagaaaggtagga

SEQ ID NO: 45854 - DNA, 30 bp, Homo sapiens
gataggagttacttgtgaaggatttcccac

SEQ ID NO: 45855 - DNA, 30 bp, Homo sapiens
atgaggaattactaaaggtttgcccacatt

SEQ ID NO: 45856 - DNA, 30 bp, Homo sapiens
tcatggagtttctggccattgtggattcgc

SEQ ID NO: 45857 - DNA, 30 bp, Homo sapiens
caaaggctttcccacactggtcacattcaa

SEQ ID NO: 45858 - DNA, 30 bp, Homo sapiens
aaatggtaacactcatatccttgcattcat

SEQ ID NO: 45859 - DNA, 30 bp, Homo sapiens
tccactgtgagttttcaaatgtttactacg

SEQ ID NO: 45860 - DNA, 30 bp, Homo sapiens
agtcttttcatgtctttgacatacactggg

SEQ ID NO: 45861 - DNA, 30 bp, Homo sapiens
cacaggtattcgaaggttgtgtgataaatg

SEQ ID NO: 45862 - DNA, 30 bp, Homo sapiens
ataaatgcctgcccacactctctacattcg

SEQ ID NO: 45863 - DNA, 30 bp, Homo sapiens
tccctatattcatagggtttctcactagta

SEQ ID NO: 45864 - DNA, 30 bp, Homo sapiens
tgagttctttgatggacaatgaggtttctc

SEQ ID NO: 45865 - DNA, 30 bp, Homo sapiens
tgacctctcttatgtatagaaagggatgct

SEQ ID NO: 45866 - DNA, 30 bp, Homo sapiens
ccaaagggcttcccacactccttacactcg

SEQ ID NO: 45867 - DNA, 30 bp, Homo sapiens
acaaggtgcgacttttggctgaaagccttg

SEQ ID NO: 45868 - DNA, 30 bp, Homo sapiens
cactggttttagaaagaatgacttggcaac

SEQ ID NO: 45869 - DNA, 30 bp, Homo sapiens
tataggacttggtgattgactgggttgggt

SEQ ID NO: 45870 - DNA, 30 bp, Homo sapiens
cactggacacatgtatagggtttctcacca

SEQ ID NO: 45871 - DNA, 30 bp, Homo sapiens
agacggaaaatgaagagatgaagggcattt

SEQ ID NO: 45872 - DNA, 30 bp, Homo sapiens
aattctctgatgggctttaagggctgaacc

SEQ ID NO: 45873 - DNA, 30 bp, Homo sapiens
atctggaccccctcagcctcggccagaggg

SEQ ID NO: 45874 - DNA, 30 bp, Homo sapiens
tgtgctccacctggtggtggctgcgttgat

SEQ ID NO: 45875 - DNA, 30 bp, Homo sapiens
ccccgggcatgccgaatgtagtgttgatgc

SEQ ID NO: 45876 - DNA, 30 bp, Homo sapiens
tcacttcatttgtgaggcttattctctgtt

SEQ ID NO: 45877 - DNA, 30 bp, Homo sapiens
gcaaggcttgattgatgaatcaatcaagtg

SEQ ID NO: 45878 - DNA, 30 bp, Homo sapiens
aggaggccaggccccccagcccgcgcaggt

SEQ ID NO: 45879 - DNA, 30 bp, Homo sapiens
tagtggaggcgcacgtgctgcgccagctcc

SEQ ID NO: 45880 - DNA, 30 bp, Homo sapiens
catggatgcttccaccgcgtgtgtttctgc

SEQ ID NO: 45881 - DNA, 30 bp, Homo sapiens
ctaatgggctttccccattacttccattca

SEQ ID NO: 45882 - DNA, 30 bp, Homo sapiens
tacaggtcttggcaactgatttgatgtgga

SEQ ID NO: 45883 - DNA, 30 bp, Homo sapiens
ctcaggatgggctctctcatcctccactct

SEQ ID NO: 45884 - DNA, 30 bp, Homo sapiens
catgtgccctgtcctcctgacgcctttctg

SEQ ID NO: 45885 - DNA, 30 bp, Homo sapiens
gcgtggctgctctgatggacgctgaacact

SEQ ID NO: 45886 - DNA, 30 bp, Homo sapiens
caaaggatctcccacattcactgcactcat

SEQ ID NO: 45887 - DNA, 30 bp, Homo sapiens
tccagtatgaactctctgatggcgacggaa

SEQ ID NO: 45888 - DNA, 30 bp, Homo sapiens
cccaggctggtcttgaactccttcctgtcc

SEQ ID NO: 45889 - DNA, 30 bp, Homo sapiens
tctctgcacacataaggcttatcccccgtg

SEQ ID NO: 45890 - DNA, 30 bp, Homo sapiens
acacctgaggggacagtgtgtggctgtcct

SEQ ID NO: 45891 - DNA, 30 bp, Homo sapiens
caggtagaggtatccatctcagggacctca

SEQ ID NO: 45892 - DNA, 30 bp, Homo sapiens
gtctgatgagatctgagctgccctggaagg

SEQ ID NO: 45893 - DNA, 30 bp, Homo sapiens
cagtatgaattcgcttgtgtacagtaaggg

SEQ ID NO: 45894 - DNA, 30 bp, Homo sapiens
ctaaggttaaaaaatttactaaaggctttc

SEQ ID NO: 45895 - DNA, 30 bp, Homo sapiens
acacggtacatttaaaaggttccgctagca

SEQ ID NO: 45896 - DNA, 30 bp, Homo sapiens
tcctggcgatggcttgcagggaggggaagt

SEQ ID NO: 45897 - DNA, 30 bp, Homo sapiens
cgatggtgagtgaacgatgaactgtggctg

SEQ ID NO: 45898 - DNA, 30 bp, Homo sapiens
accatgaactgcctgatggtgaataagtgt

SEQ ID NO: 45899 - DNA, 30 bp, Homo sapiens
tgaaggtggtcccacactcattgcatccat

SEQ ID NO: 45900 - DNA, 30 bp, Homo sapiens
ctctggtgttgaagtagggctgagtgacca

SEQ ID NO: 45901 - DNA, 30 bp, Homo sapiens
ggatggatctaagcctaaaggaccttctgc

SEQ ID NO: 45902 - DNA, 30 bp, Homo sapiens
aacattccagatgcagatgcctgggcagcc

SEQ ID NO: 45903 - DNA, 30 bp, Homo sapiens
ggggggtgggtagagtgagggagttgagcc

SEQ ID NO: 45904 - DNA, 30 bp, Homo sapiens
gtaaggtacgcagtgaattctctccagcat

SEQ ID NO: 45905 - DNA, 30 bp, Homo sapiens
cacattcattacacttgtaaggtttctctg

SEQ ID NO: 45906 - DNA, 30 bp, Homo sapiens
ttctggcaacaggctggctcacaatggcta

SEQ ID NO: 45907 - DNA, 30 bp, Homo sapiens
ataaggaaggagctgtgactctccattaca

SEQ ID NO: 45908 - DNA, 30 bp, Homo sapiens
aattctcctgtgtttaacaaggatagacaa

SEQ ID NO: 45909 - DNA, 30 bp, Homo sapiens
ctgagggaaaacaaccgcccaaaggctttg

SEQ ID NO: 45910 - DNA, 30 bp, Homo sapiens
tgttggatttcagaaacatgagtttattca

SEQ ID NO: 45911 - DNA, 30 bp, Homo sapiens
tacagggagtgagacaaaggattcgggctc

SEQ ID NO: 45912 - DNA, 30 bp, Homo sapiens
gcttggacaggtgtcttctgagtgtgtagt

SEQ ID NO: 45913 - DNA, 30 bp, Homo sapiens
atgaggagtgagaagaaggggtgagaataa

SEQ ID NO: 45914 - DNA, 30 bp, Homo sapiens
ctcaactgatccacctcgaagtatcagatt

SEQ ID NO: 45915 - DNA, 30 bp, Homo sapiens
acttggacccgaaagtgcatctgcttggtg

SEQ ID NO: 45916 - DNA, 30 bp, Homo sapiens
tgttcccccttatctacagacctctcaccc

SEQ ID NO: 45917 - DNA, 30 bp, Homo sapiens
tgaaggcttttccacattcattacatttat

SEQ ID NO: 45918 - DNA, 30 bp, Homo sapiens
ccttggcctttcgaagtgttggagctacag

SEQ ID NO: 45919 - DNA, 30 bp, Homo sapiens; identical to SEQ ID NO: 45587

SEQ ID NO: 45920 - DNA, 30 bp, Homo sapiens
ctttggctctcactgtgaacttgaaggaag

SEQ ID NO: 45921 - DNA, 30 bp, Homo sapiens
aactgggacaactgaagcgttagggttagg

SEQ ID NO: 45922 - DNA, 30 bp, Homo sapiens
aacgtgtgcaccagctggactgcgggtaga

SEQ ID NO: 45923 - DNA, 30 bp, Homo sapiens
cacagggagacacctgggtggcagctccta

SEQ ID NO: 45924 - DNA, 30 bp, Homo sapiens
atatggattctgatgcccagtaaagtatac

SEQ ID NO: 45925 - DNA, 30 bp, Homo sapiens
cacctagagcttctttcttcagcctcattc

SEQ ID NO: 45926 - DNA, 30 bp, Homo sapiens
gactggaaggtgacttattaattccctttc

SEQ ID NO: 45927 - DNA, 30 bp, Homo sapiens
tcccagctgttccggggactttgtccctgg

SEQ ID NO: 45928 - DNA, 30 bp, Homo sapiens
cttcggccattagtagagaaaatgaagttt

SEQ ID NO: 45929 - DNA, 30 bp, Homo sapiens
taccgtctatgtcttctctggtgtgaatga

SEQ ID NO: 45930 - DNA, 30 bp, Homo sapiens
cagagggagaagctgaggtctgcaggccac

SEQ ID NO: 45931 - DNA, 30 bp, Homo sapiens
cagaggaggaagggatgggctccttcttgc

SEQ ID NO: 45932 - DNA, 30 bp, Homo sapiens
caccattgccacagttaccatattaacagg

SEQ ID NO: 45933 - DNA, 30 bp, Homo sapiens
gccaggtgccgcagaaagttgtcctcactc

SEQ ID NO: 45934 - DNA, 30 bp, Homo sapiens
aggtgggcttgtgatccgggtggcttttga

SEQ ID NO: 45935 - DNA, 30 bp, Homo sapiens
agtgtctgacatttcttttgtgcaagatga

SEQ ID NO: 45936 - DNA, 30 bp, Homo sapiens
gactggagttcttttcccatacatcacaat

SEQ ID NO: 45937 - DNA, 30 bp, Homo sapiens
aaaaggagtttccgagcagggacgagcaat

SEQ ID NO: 45938 - DNA, 30 bp, Homo sapiens
ggacttcccaaatccattacatgctagggt

SEQ ID NO: 45939 - DNA, 30 bp, Homo sapiens
tatgtttcctctggtgttgaataagctgtg

SEQ ID NO: 45940 - DNA, 30 bp, Homo sapiens
cattggtgttttgtagccaagagaattcct

SEQ ID NO: 45941 - DNA, 30 bp, Homo sapiens
gaggtcacatttccataattctccagcatc

SEQ ID NO: 45942 - DNA, 30 bp, Homo sapiens
agaaggtgagagatctgacagttatagggt

SEQ ID NO: 45943 - DNA, 30 bp, Homo sapiens
gtgtggactctctggtggatgcagaggctc

SEQ ID NO: 45944 - DNA, 30 bp, Homo sapiens
cagagcgtggcagggcccaggaggctgggg

SEQ ID NO: 45945 - DNA, 30 bp, Homo sapiens
cacattggttacatttgtaaggtttgtctc

SEQ ID NO: 45946 - DNA, 30 bp, Homo sapiens
atcagggatgaactccgactatatgccttc

SEQ ID NO: 45947 - DNA, 30 bp, Homo sapiens
ggccggcccctcttcaggcattcctagcaa

SEQ ID NO: 45948 - DNA, 30 bp, Homo sapiens
ccttggcctcccaaagtgctgggattatag

SEQ ID NO: 45949 - DNA, 30 bp, Homo sapiens
ataagctctttcatgctttcgaagggaact

SEQ ID NO: 45950 - DNA, 30 bp, Homo sapiens
tgaaccctctggtgcagaacaagtgtctgt

SEQ ID NO: 45951 - DNA, 30 bp, Homo sapiens
ccctggcttttcctgttcagccggcccctc

SEQ ID NO: 45952 - DNA, 30 bp, Homo sapiens
tgacttctctgatgtttaatgagagttgac

SEQ ID NO: 45953 - DNA, 30 bp, Homo sapiens
ctgtagtttctctccagtatgtattttttt

SEQ ID NO: 45954 - DNA, 30 bp, Homo sapiens
tgaattctcttgtgtctagtaaggcttgag

SEQ ID NO: 45955 - DNA, 30 bp, Homo sapiens
ctttggaataaagcattaccatgtatatta

SEQ ID NO: 45956 - DNA, 30 bp, Homo sapiens
gattggtaaaaaccttttccacattcttta

SEQ ID NO: 45957 - DNA, 30 bp, Homo sapiens
cagtatgaatcctcttatgagtattaagag

SEQ ID NO: 45958 - DNA, 30 bp, Homo sapiens
gtgaggaccggttaaaagctttgccacatt

SEQ ID NO: 45959 - DNA, 30 bp, Homo sapiens
gcctggcaaagtggattatttctgtaatcc

SEQ ID NO: 45960 - DNA, 30 bp, Homo sapiens
aggtttgaggactggttaaaagctttgcca

SEQ ID NO: 45961 - DNA, 30 bp, Homo sapiens
taaaggcttttccacattcttcacagttgt

SEQ ID NO: 45962 - DNA, 30 bp, Homo sapiens
ccatcaccaggggagtcccggcactgctca

SEQ ID NO: 45963 - DNA, 30 bp, Homo sapiens
ctgttacattcatagggcttctctcctgta

SEQ ID NO: 45964 - DNA, 30 bp, Homo sapiens
cagccccctgccgagccctgatgaacgcca

SEQ ID NO: 45965 - DNA, 30 bp, Homo sapiens
agccgcactcctcgaagatgtctgggtagt

SEQ ID NO: 45966 - DNA, 30 bp, Homo sapiens
taatgggcgttgcccctctgactggagccc

SEQ ID NO: 45967 - DNA, 30 bp, Homo sapiens
tcctgatactcataggccttgtgtccaatg

SEQ ID NO: 45968 - DNA, 30 bp, Homo sapiens
agctggaatctttcccagcctgttcgccca

SEQ ID NO: 45969 - DNA, 30 bp, Homo sapiens
ctgaggaagcagggttggagcctgaggaga

SEQ ID NO: 45970 - DNA, 30 bp, Homo sapiens
cgatggtcgacgactggaccggttctgtgg

SEQ ID NO: 45971 - DNA, 30 bp, Homo sapiens
gagtggttaaaggctttgccacattcctca

SEQ ID NO: 45972 - DNA, 30 bp, Homo sapiens
cactcggcgccatgcacccgccggtgctgg

SEQ ID NO: 45973 - DNA, 30 bp, Homo sapiens
acacaggtgcagcttctggtgctgcgcgag

SEQ ID NO: 45974 - DNA, 30 bp, Homo sapiens
aaagtaggcaggacaaacaaaggctttccc

SEQ ID NO: 45975 - DNA, 30 bp, Homo sapiens
atatggctgacgttcccctccttctgtcct

SEQ ID NO: 45976 - DNA, 30 bp, Homo sapiens
gctacgattaaaagctttgccacagtcatt

SEQ ID NO: 45977 - DNA, 30 bp, Homo sapiens
aatgaatcttctgatggcgaatcaggtgcg

SEQ ID NO: 45978 - DNA, 30 bp, Homo sapiens
tagctgaatgctttcccacaatccttacat

SEQ ID NO: 45979 - DNA, 30 bp, Homo sapiens
tgaagtctatgatgacgttcaaggtttgat

SEQ ID NO: 45980 - DNA, 30 bp, Homo sapiens
tactggtatcccagcgccgaggctgaagct

SEQ ID NO: 45981 - DNA, 30 bp, Homo sapiens
tcgaggaacctctggcaggccttcttccag

SEQ ID NO: 45982 - DNA, 30 bp, Homo sapiens
ctaaggtcggaagacagactgaaggccttc

SEQ ID NO: 45983 - DNA, 30 bp, Homo sapiens; identical to SEQ ID NO: 45982

SEQ ID NO: 45984 - DNA, 30 bp, Homo sapiens
tgaaggccttcccacatagaagacaagcat

SEQ ID NO: 45985 - DNA, 30 bp, Homo sapiens
gcctgaacatcagctaattctggaggaagt

SEQ ID NO: 45986 - DNA, 30 bp, Homo sapiens
cacctccccgtgcctgtgagtcctctgatg

SEQ ID NO: 45987 - DNA, 30 bp, Homo sapiens
ctttggtatgaattctcttatgtttagtaa

SEQ ID NO: 45988 - DNA, 30 bp, Homo sapiens
aacgggaacacttgaaggctttaccacatt

SEQ ID NO: 45989 - DNA, 30 bp, Homo sapiens
cgcaggtggcgcgtcaggttcgtgttgcgg

SEQ ID NO: 45990 - DNA, 30 bp, Homo sapiens
agtaggccatctctttcatggcctgttcag

SEQ ID NO: 45991 - DNA, 30 bp, Homo sapiens
ttgtggtgcctcataatatgctgatttttt

SEQ ID NO: 45992 - DNA, 30 bp, Homo sapiens
tgaaggactgtggcgaacagtttgctcaca

SEQ ID NO: 45993 - DNA, 30 bp, Homo sapiens
ctcgcgatctgctcacctagtcctctcaaa

SEQ ID NO: 45994 - DNA, 30 bp, Homo sapiens
tgaatcctcttatgagtatttagagttgag

SEQ ID NO: 45995 - DNA, 30 bp, Homo sapiens
tactggtgatgtgaaatttggaaaaataaa

SEQ ID NO: 45996 - DNA, 30 bp, Homo sapiens
tcagctacgtcagatttctctcctatatgg

SEQ ID NO: 45997 - DNA, 30 bp, Homo sapiens
ggagctccaccaggctcctgtggcaaatac

SEQ ID NO: 45998 - DNA, 30 bp, Homo sapiens
gtatgagttctcttatgttgaggaaggttg

SEQ ID NO: 45999 - DNA, 30 bp, Homo sapiens
ctttcccactctttccttaagtttaaattc

SEQ ID NO: 46000 - DNA, 30 bp, Homo sapiens
taaaggttttgccacagtctccacacgtgt

SEQ ID NO: 46001 - DNA, 30 bp, Homo sapiens
gattggctaaaacctttaccacattgttta

SEQ ID NO: 46002 - DNA, 30 bp, Homo sapiens
tactggcatctgtaatcccagcactttggg

SEQ ID NO: 46003 - DNA, 30 bp, Homo sapiens
tgagtatttgactactgtctcatgtctctt

SEQ ID NO: 46004 - DNA, 30 bp, Homo sapiens
tcgtcacacttgtaaggtttctctccagta

SEQ ID NO: 46005 - DNA, 30 bp, Homo sapiens
acctgggggttcatccaccatctcatctcg

SEQ ID NO: 46006 - DNA, 30 bp, Homo sapiens
taaaggctttgccacattctttgcacttgt

SEQ ID NO: 46007 - DNA, 30 bp, Homo sapiens
gtgaggattggttgaagtctttaccacatt

SEQ ID NO: 46008 - DNA, 30 bp, Homo sapiens
tgtagggtttctctccagtatgaattgttt

SEQ ID NO: 46009 - DNA, 30 bp, Homo sapiens
aaggtgtgagaaccgcctaaaggctttacc

SEQ ID NO: 46010 - DNA, 30 bp, Homo sapiens
taaaggctttgccacatcctttacatttgg

SEQ ID NO: 46011 - DNA, 30 bp, Homo sapiens
cagttgaggagcagttaaaggttctgccac

SEQ ID NO: 46012 - DNA, 30 bp, Homo sapiens
cgatgctttgccacattcttcacatttgta

SEQ ID NO: 46013 - DNA, 30 bp, Homo sapiens
tacctgggtgtttggctactgcctcctgtc

SEQ ID NO: 46014 - DNA, 30 bp, Homo sapiens
gtgtagtaagggtagaggggcacttaaagc

SEQ ID NO: 46015 - DNA, 30 bp, Homo sapiens
tcgaggtttgctccccagggagaaattcct

SEQ ID NO: 46016 - DNA, 30 bp, Homo sapiens
gagaaaactgcccgtcggaagtcttggact

SEQ ID NO: 46017 - DNA, 30 bp, Homo sapiens
catcggtgggtcccaggacgctgaggccac

SEQ ID NO: 46018 - DNA, 30 bp, Homo sapiens
gcccaggagacccggcggccacagggtcgg

SEQ ID NO: 46019 - DNA, 30 bp, Homo sapiens
cccacattcctggaatatctctggatacag

SEQ ID NO: 46020 - DNA, 30 bp, Homo sapiens
aggcctttttccagtatgaattatctgatg

SEQ ID NO: 46021 - DNA, 30 bp, Homo sapiens
acccgggccctccttcgtagtgtgaacact

SEQ ID NO: 46022 - DNA, 30 bp, Homo sapiens
cacaggtggagtttctggtgtctaagaagg

SEQ ID NO: 46023 - DNA, 30 bp, Homo sapiens
actcaggcaagacgtgctcaggtgtcactg

SEQ ID NO: 46024 - DNA, 30 bp, Homo sapiens
tttaggtttggggagcacaaacaatgctgg

SEQ ID NO: 46025 - DNA, 30 bp, Homo sapiens
gtttggagacactagacatgcttcccttct

SEQ ID NO: 46026 - DNA, 30 bp, Homo sapiens
tccgacactgttgtctccagggtcacagcc

SEQ ID NO: 46027 - DNA, 30 bp, Homo sapiens
gtaaggtttgacttctgactaaaggtcttg

SEQ ID NO: 46028 - DNA, 30 bp, Homo sapiens
ctcaggagatcaagatgaatttcaacaaca

SEQ ID NO: 46029 - DNA, 30 bp, Homo sapiens
cgcattcttaggtgtgtttgaaaacttata

SEQ ID NO: 46030 - DNA, 30 bp, Homo sapiens
cccacactcctggaatatctccgggtacag

SEQ ID NO: 46031 - DNA, 30 bp, Homo sapiens
tgaagtctatgatggtatgtaagggatgac

SEQ ID NO: 46032 - DNA, 30 bp, Homo sapiens
gtaaggactctctcatgaacacttctctga

SEQ ID NO: 46033 - DNA, 30 bp, Homo sapiens
cagcgccggcccgccgcgtgggtccgctgg

SEQ ID NO: 46034 - DNA, 30 bp, Homo sapiens
tgtgttctcacatgtgcttgaagcgatgcg

SEQ ID NO: 46035 - DNA, 30 bp, Homo sapiens
ctaaggcaaccactttcccttgtggtcgtt

SEQ ID NO: 46036 - DNA, 30 bp, Homo sapiens
cactccgggcaacgctcggtggcagtggcg

SEQ ID NO: 46037 - DNA, 30 bp, Homo sapiens
taaggcctttctccagtgtgaattttccag

SEQ ID NO: 46038 - DNA, 30 bp, Homo sapiens
tgaatccttcgatgtttaacaagactggag

SEQ ID NO: 46039 - DNA, 30 bp, Homo sapiens
gttcgggcgccacttgtggctgtcggttcg

SEQ ID NO: 46040 - DNA, 30 bp, Homo sapiens
tgacggaagctcttgttacatttactacag

SEQ ID NO: 46041 - DNA, 30 bp, Homo sapiens
gcgcgcctcctccttggggctgcacgcagg

SEQ ID NO: 46042 - DNA, 30 bp, Homo sapiens
tgaactcgttgatgtttaatgaggtttccc

SEQ ID NO: 46043 - DNA, 30 bp, Homo sapiens
gtcagggtaaaatagcaaaaccctatctct

SEQ ID NO: 46044 - DNA, 30 bp, Homo sapiens
gtgtgggtccgcaggtggtacttgagcgac

SEQ ID NO: 46045 - DNA, 30 bp, Homo sapiens
tgatggttaaggcatgaggaattcttaaaa

SEQ ID NO: 46046 - DNA, 30 bp, Homo sapiens
cataggatttccaggctacaatacactaaa

SEQ ID NO: 46047 - DNA, 30 bp, Homo sapiens
cacctgtgtgaatgttcttatggcgattaa

SEQ ID NO: 46048 - DNA, 30 bp, Homo sapiens
tgaaggctgtcccacatttcttacattcaa

SEQ ID NO: 46049 - DNA, 30 bp, Homo sapiens
tgaaggccttcttgcattactgacattcat

SEQ ID NO: 46050 - DNA, 30 bp, Homo sapiens
ccctgggtgggctttctgatgttctctaag

SEQ ID NO: 46051 - DNA, 30 bp, Homo sapiens
cagccctcctccttccggctgggccagggc

SEQ ID NO: 46052 - DNA, 30 bp, Homo sapiens
tactggtcggcctccaccttcaccttcgcg

SEQ ID NO: 46053 - DNA, 30 bp, Homo sapiens
cccacactcttgaaatatatctggaaagtg

SEQ ID NO: 46054 - DNA, 30 bp, Homo sapiens
ctccaatcggcctctatcattgcaaacagt

SEQ ID NO: 46055 - DNA, 30 bp, Homo sapiens
acagacgggggtgctgcccaggctggaggg

SEQ ID NO: 46056 - DNA, 30 bp, Homo sapiens
taccggccctccccaccgcggcactcgggg

SEQ ID NO: 46057 - DNA, 30 bp, Homo sapiens
cacagggcttttcgccagtgtgtgcccttt

SEQ ID NO: 46058 - DNA, 30 bp, Homo sapiens
tgagtgccctggtgcttaataaagcttgtg

SEQ ID NO: 46059 - DNA, 30 bp, Homo sapiens
cagtggtattgcagcatcaaactggaaata

SEQ ID NO: 46060 - DNA, 30 bp, Homo sapiens
atgaggaacacgaggtgagagtgaagaatg

SEQ ID NO: 46061 - DNA, 30 bp, Homo sapiens
tactctccggcgtggagtctctgatgtcta

SEQ ID NO: 46062 - DNA, 30 bp, Homo sapiens
gtctgtccattcacagagatttgcactatt

SEQ ID NO: 46063 - DNA, 30 bp, Homo sapiens
tgaaggcttttccacattgcttacattcaa

SEQ ID NO: 46064 - DNA, 30 bp, Homo sapiens
gaacctccccagggtgggtacttggatgaa

SEQ ID NO: 46065 - DNA, 30 bp, Homo sapiens
ggcattcttccgagcatgaattttctgatg

SEQ ID NO: 46066 - DNA, 30 bp, Homo sapiens
ttccttacatccatacgggttctctccagt

SEQ ID NO: 46067 - DNA, 30 bp, Homo sapiens
atgtggattctctgatgtcaaataacatgg

SEQ ID NO: 46068 - DNA, 30 bp, Homo sapiens
caaaggttttttcctccagagtggatctta

SEQ ID NO: 46069 - DNA, 30 bp, Homo sapiens
atcttgtacttcggcctttggttttgtttc

SEQ ID NO: 46070 - DNA, 30 bp, Homo sapiens
gagaggttgcaaagggatgacagtagggtg

SEQ ID NO: 46071 - DNA, 30 bp, Homo sapiens
ttaaggcctctttcacttcatttagctgtt

SEQ ID NO: 46072 - DNA, 30 bp, Homo sapiens
accatgaattgcctgatggtgaataagtgt

SEQ ID NO: 46073 - DNA, 30 bp, Homo sapiens
ttctgggtgaacccctttccacagtcgctg

SEQ ID NO: 46074 - DNA, 30 bp, Homo sapiens
atatggcttttctccagtgtgaactctggt

SEQ ID NO: 46075 - DNA, 30 bp, Homo sapiens
acccatggattgcttgatggtgaataagtg

SEQ ID NO: 46076 - DNA, 30 bp, Homo sapiens
cattggaaagatttttctctcatgtgtact

SEQ ID NO: 46077 - DNA, 30 bp, Homo sapiens
caaaggccatcttgcccagaagctggctgt

SEQ ID NO: 46078 - DNA, 30 bp, Homo sapiens
agtccttttatgtctatgcaaggaacggag

SEQ ID NO: 46079 - DNA, 30 bp, Homo sapiens
ggtggggacagtgtggcatttcttatgctc

SEQ ID NO: 46080 - DNA, 30 bp, Homo sapiens
ttgagcccaccggtggggacagtgtggcat

SEQ ID NO: 46081 - DNA, 30 bp, Homo sapiens
tgaattccctcatggcgaatgaggtcagag

SEQ ID NO: 46082 - DNA, 30 bp, Homo sapiens
tgaaatctctgatgacgtacaagatatgaa

SEQ ID NO: 46083 - DNA, 30 bp, Homo sapiens
aacaatgcccctttcaccctccaatcctga

SEQ ID NO: 46084 - DNA, 30 bp, Homo sapiens
tgctggtgtcactgaactctactcgagttt

SEQ ID NO: 46085 - DNA, 30 bp, Homo sapiens
tgctggtccacgcgggtttctgccagggca

SEQ ID NO: 46086 - DNA, 30 bp, Homo sapiens
agttaggagaacatctaaaggcttttccac

SEQ ID NO: 46087 - DNA, 30 bp, Homo sapiens
gcgcggcgcggcccccgtgccgcttccggt

SEQ ID NO: 46088 - DNA, 30 bp, Homo sapiens
tagcgggcccatccgcaggcacgcccctct

SEQ ID NO: 46089 - DNA, 30 bp, Homo sapiens
tcaatgcatcgataaggcttctctcctgta

SEQ ID NO: 46090 - DNA, 30 bp, Homo sapiens
cagaggttaggacaacatctaacggccttt

SEQ ID NO: 46091 - DNA, 30 bp, Homo sapiens
acatggcgctgacgtctgttcaccctctcg

SEQ ID NO: 46092 - DNA, 30 bp, Homo sapiens
tgtcgggccaggttggacctccggctggag

SEQ ID NO: 46093 - DNA, 30 bp, Homo sapiens
tgagcccttttatgtctacgaaaggaacca

SEQ ID NO: 46094 - DNA, 30 bp, Homo sapiens
tgacggaaggttttgccacactcattacac

SEQ ID NO: 46095 - DNA, 30 bp, Homo sapiens
tgagttcgtgtgtgaacgttaaggtatgtg

SEQ ID NO: 46096 - DNA, 30 bp, Homo sapiens
tgaattcgcatgtgtaaaataagtcctgtg

SEQ ID NO: 46097 - DNA, 30 bp, Homo sapiens
gagtggataatttataaataaaaaggcttg

SEQ ID NO: 46098 - DNA, 30 bp, Homo sapiens
gactggttaaaggctttgccacattcttca

SEQ ID NO: 46099 - DNA, 30 bp, Homo sapiens
taaaggccttcccacatgtcttacattcat

SEQ ID NO: 46100 - DNA, 30 bp, Homo sapiens
gaagatgaccgagccagacctgagggcttc

SEQ ID NO: 46101 - DNA, 30 bp, Homo sapiens
cagcgccttgtctgcgggcgcagtggctgt

SEQ ID NO: 46102 - DNA, 30 bp, Homo sapiens
actgaagaccttgccacgcttatgacattt

SEQ ID NO: 46103 - DNA, 30 bp, Homo sapiens
ggacatcccgggggcctcctggctggtgtg

SEQ ID NO: 46104 - DNA, 30 bp, Homo sapiens
tcccggccaaggtgcccgcccctgctccag

SEQ ID NO: 46105 - DNA, 30 bp, Homo sapiens
tgagtccttacatgcttttgaaggattgag

SEQ ID NO: 46106 - DNA, 30 bp, Homo sapiens
tatgaattctcatgtgtgtcataagggatg

SEQ ID NO: 46107 - DNA, 30 bp, Homo sapiens
gtacggtttctctccagtatggattctgtg

SEQ ID NO: 46108 - DNA, 30 bp, Homo sapiens
ttagtacattgatagggtctctcccttgta

SEQ ID NO: 46109 - DNA, 30 bp, Homo sapiens
accatggattgcctgatggtgaataagtgt

SEQ ID NO: 46110 - DNA, 30 bp, Homo sapiens
tacagggtttctctctcagtatgaattctc

SEQ ID NO: 46111 - DNA, 30 bp, Homo sapiens
tcttcactatgtaggctttctgtccaatat

SEQ ID NO: 46112 - DNA, 30 bp, Homo sapiens
tcggcctcccaaagtagtgggattacaggt

SEQ ID NO: 46113 - DNA, 30 bp, Homo sapiens
tcatgtttgcagggtttctctccagtataa

SEQ ID NO: 46114 - DNA, 30 bp, Homo sapiens
ttgagggtgaaataaaggctttgccacatt

SEQ ID NO: 46115 - DNA, 30 bp, Homo sapiens
tgtagggtttctctccagtatgaatcatct

SEQ ID NO: 46116 - DNA, 30 bp, Homo sapiens
aaaagctttaccacattcttcacatttgta

SEQ ID NO: 46117 - DNA, 30 bp, Homo sapiens
tcatcccctggatctcctcaaagttcatca

SEQ ID NO: 46118 - DNA, 30 bp, Homo sapiens
ctcctggtgggtccccagacagcgcacagt

SEQ ID NO: 46119 - DNA, 30 bp, Homo sapiens
cagctagggagctcctcaatgagagttctt

SEQ ID NO: 46120 - DNA, 30 bp, Homo sapiens
taagactcctcattctgggatggctccaca

SEQ ID NO: 46121 - DNA, 30 bp, Homo sapiens
tagtggcaggcgcctgtagtcccagctgct

SEQ ID NO: 46122 - DNA, 30 bp, Homo sapiens
gctttacggttttggtaggaagagctgatc

SEQ ID NO: 46123 - DNA, 30 bp, Homo sapiens
ttcttggtagattcactcttcacttggtga

SEQ ID NO: 46124 - DNA, 30 bp, Homo sapiens
tcctggaacttgcagttggtacaggtgtag

SEQ ID NO: 46125 - DNA, 30 bp, Homo sapiens
cgcagggtgttccggacaagatctgttcac

SEQ ID NO: 46126 - DNA, 30 bp, Homo sapiens
tgaagggtgctcagggcaagatctatttac

SEQ ID NO: 46127 - DNA, 30 bp, Homo sapiens
tcccgggctgctgctgtctgctgagtgaga

SEQ ID NO: 46128 - DNA, 30 bp, Homo sapiens
accaggggcctcaggaggggctgaggagac

SEQ ID NO: 46129 - DNA, 30 bp, Homo sapiens
cactgtctgttgctttcccagagcttctgg

SEQ ID NO: 46130 - DNA, 30 bp, Homo sapiens
ctcgtacaggtagtagatgaagcctagagt

SEQ ID NO: 46131 - DNA, 30 bp, Homo sapiens
cacagggtgggaggcagtgcgacacctcct

SEQ ID NO: 46132 - DNA, 30 bp, Homo sapiens
agtaggatactaacaaggctccaaggatta

SEQ ID NO: 46133 - DNA, 30 bp, Homo sapiens
accaggctgctattgcattgaaggcaatga

SEQ ID NO: 46134 - DNA, 30 bp, Homo sapiens
cataggtaaggacggaaacgcaggtctgac

SEQ ID NO: 46135 - DNA, 30 bp, Homo sapiens
gactgggtttcttatgccattcaacactaa

SEQ ID NO: 46136 - DNA, 30 bp, Homo sapiens
ttgcggagccaggcctgcctcatagccctc

SEQ ID NO: 46137 - DNA, 30 bp, Homo sapiens
cttcctctccatcagacagggatgtacacg

SEQ ID NO: 46138 - DNA, 30 bp, Homo sapiens
gaatgggatgatccagatgatgacctgtgg

SEQ ID NO: 46139 - DNA, 30 bp, Homo sapiens
acctggctttcgggtgaccgtgatcttgtt

SEQ ID NO: 46140 - DNA, 30 bp, Homo sapiens
atcgtgtgatgtctgatccatgctttgatg

SEQ ID NO: 46141 - DNA, 30 bp, Homo sapiens
ctcctcctgccacgacttcgggacctagag

SEQ ID NO: 46142 - DNA, 30 bp, Homo sapiens
acatgtggccgtgggccgtgtggagcttct

SEQ ID NO: 46143 - DNA, 30 bp, Homo sapiens
tagtacagcgtctcgcgggcgtgggtgcgc

SEQ ID NO: 46144 - DNA, 30 bp, Homo sapiens
tggatagtctgatgttgagtaagagctgag

SEQ ID NO: 46145 - DNA, 30 bp, Homo sapiens
ctttgtggtttcccagcttcctgctccagc

SEQ ID NO: 46146 - DNA, 30 bp, Homo sapiens
taccattcctttgtggtttcccagcttcct

SEQ ID NO: 46147 - DNA, 30 bp, Homo sapiens
gaaaggccttccacactcatcacattcata

SEQ ID NO: 46148 - DNA, 30 bp, Homo sapiens
cgcctctgggggtgcggggggagcctcgcc

SEQ ID NO: 46149 - DNA, 30 bp, Homo sapiens
ccacactcggggcatttgtagggcttctcc

SEQ ID NO: 46150 - DNA, 30 bp, Homo sapiens
cacagggcagccatgtacgcaggaagctgt

SEQ ID NO: 46151 - DNA, 30 bp, Homo sapiens
aactggtcacctccaccggaagggaagcaa

SEQ ID NO: 46152 - DNA, 30 bp, Homo sapiens
cgacgccttccctcctgcatgggttctccg

SEQ ID NO: 46153 - DNA, 30 bp, Homo sapiens
ccagtgtggactcgctgatgtttggaaaga

SEQ ID NO: 46154 - DNA, 30 bp, Homo sapiens
attgcagcaccgtgatgtggatccgcaagt

SEQ ID NO: 46155 - DNA, 30 bp, Homo sapiens
aggtgggtgactcggctgaaggccttccca

SEQ ID NO: 46156 - DNA, 30 bp, Homo sapiens
cactgggtggactttccgatgctggattag

SEQ ID NO: 46157 - DNA, 30 bp, Homo sapiens
caggtcttcctgtgggggttttgcctcctt

SEQ ID NO: 46158 - DNA, 30 bp, Homo sapiens
ttctggagagaccctgcagtcctgcggttc

SEQ ID NO: 46159 - DNA, 30 bp, Homo sapiens
cagcggctcctggcggtgctgggtcttctg

SEQ ID NO: 46160 - DNA, 30 bp, Homo sapiens
caagccagtttgtctttgtggtgatatctc

SEQ ID NO: 46161 - DNA, 30 bp, Homo sapiens
acttgggagctgactgtgtcagaagctttt

SEQ ID NO: 46162 - DNA, 30 bp, Homo sapiens
ctctggtgtgtgttctctgatgctgcataa

SEQ ID NO: 46163 - DNA, 30 bp, Homo sapiens
tggtctctctccagtgtggattttctgatg

SEQ ID NO: 46164 - DNA, 30 bp, Homo sapiens
tgtgatgagagtactgctttcatgtgtact

SEQ ID NO: 46165 - DNA, 30 bp, Homo sapiens
ttctggtgtggagggaacacttggcagggt

SEQ ID NO: 46166 - DNA, 30 bp, Homo sapiens
ttctggatgtgttttctggtggcgtcttaa

SEQ ID NO: 46167 - DNA, 30 bp, Homo sapiens
cactgggaggtggtttcccggtgtgttttc

SEQ ID NO: 46168 - DNA, 30 bp, Homo sapiens
accagctcagccactgtgtggatcttctga

SEQ ID NO: 46169 - DNA, 30 bp, Homo sapiens
agttggacctgctcataaggcccaatccag

SEQ ID NO: 46170 - DNA, 30 bp, Homo sapiens
cacaggctgtcttgatagatgactacattt

SEQ ID NO: 46171 - DNA, 30 bp, Homo sapiens
agcaggagggaatccctccccttcttcttg

SEQ ID NO: 46172 - DNA, 30 bp, Homo sapiens
accaaaacgctcccgcaccaaaagcatgag

SEQ ID NO: 46173 - DNA, 30 bp, Homo sapiens
cgctctcgcaccagcagcatcaactttttc

SEQ ID NO: 46174 - DNA, 30 bp, Homo sapiens
ctctcccgaaccaacatcatcagtttcttt

SEQ ID NO: 46175 - DNA, 30 bp, Homo sapiens
gacaggtcctcataacctgactcaggtaaa

SEQ ID NO: 46176 - DNA, 30 bp, Homo sapiens
cagggggagaaggtggccatctcgagtgag

SEQ ID NO: 46177 - DNA, 30 bp, Homo sapiens
aaataccagaggccacccaacgccccctcc

SEQ ID NO: 46178 - DNA, 30 bp, Homo sapiens
ctctggggctctcccccagcaatccctgag

SEQ ID NO: 46179 - DNA, 30 bp, Homo sapiens
tcctggcaagtttctcctctagagaaagag

SEQ ID NO: 46180 - DNA, 30 bp, Homo sapiens
acaaggcacgaattaaagcttttacttcac

SEQ ID NO: 46181 - DNA, 30 bp, Homo sapiens
acctggctgcaggtaaccatgttagtaaag

SEQ ID NO: 46182 - DNA, 30 bp, Homo sapiens
agcaggttgtagaccaacagccttgaagga

SEQ ID NO: 46183 - DNA, 30 bp, Homo sapiens
atgagctgccagtcacagtgataagatttc

SEQ ID NO: 46184 - DNA, 30 bp, Homo sapiens
ctgcagatcctgcaggttgatagtgcttcc

SEQ ID NO: 46185 - DNA, 30 bp, Homo sapiens
agaagttgccagtgcctgcactgagctctg

SEQ ID NO: 46186 - DNA, 30 bp, Homo sapiens
agaagggcatttgacacagagtgggcctct

SEQ ID NO: 46187 - DNA, 30 bp, Homo sapiens
gcttggggctgttttttacagggaggtggc

SEQ ID NO: 46188 - DNA, 30 bp, Homo sapiens
gtctgggctctagcagtgtggcacttccga

SEQ ID NO: 46189 - DNA, 30 bp, Homo sapiens
tccagaggcgggtggccttgtttgggtagt

SEQ ID NO: 46190 - DNA, 30 bp, Homo sapiens
catctgtttgctggaaagtagtttgggtca

SEQ ID NO: 46191 - DNA, 70 bp, Artificial Sequence
  Synthetic
gccaagcatttaggtgacactatagtgagagacacatcagagcccgtttcagagctatgctggaaacagc

SEQ ID NO: 46192 - DNA, 70 bp, Artificial Sequence
  Synthetic
gccaagcatttaggtgacactatagtgagggacacatcagagcccgtttcagagctatgctggaaacagc

SEQ ID NO: 46193 - DNA, 70 bp, Artificial Sequence
  Synthetic
gccaagcatttaggtgacactatagcgaccctgtggagctcctgggtttcagagctatgctggaaacagc

SEQ ID NO: 46194 - DNA, 70 bp, Artificial Sequence
  Synthetic
gccaagcatttaggtgacactatagactgcccgaggggatggatagtttcagagctatgctggaaacagc

SEQ ID NO: 46195 - DNA, 70 bp, Artificial Sequence
  Synthetic
gccaagcatttaggtgacactatagagtctatgattactacgagagtttcagagctatgctggaaacagc

SEQ ID NO: 46196 - DNA, 70 bp, Artificial Sequence
  Synthetic
gccaagcatttaggtgacactatagtattctgatccctgtgaatggtttcagagctatgctggaaacagc

SEQ ID NO: 46197 - DNA, 70 bp, Artificial Sequence
  Synthetic
gccaagcatttaggtgacactatagccaaggggtaccggctgctggtttcagagctatgctggaaacagc

SEQ ID NO: 46198 - DNA, 70 bp, Artificial Sequence
  Synthetic
gccaagcatttaggtgacactataggccatgaaaatgtacttgtggtttcagagctatgctggaaacagc

SEQ ID NO: 46199 - DNA, 70 bp, Artificial Sequence
  Synthetic
gccaagcatttaggtgacactataggtgactggggagctgggtccgtttcagagctatgctggaaacagc

SEQ ID NO: 46200 - DNA, 70 bp, Artificial Sequence
  Synthetic
gccaagcatttaggtgacactatagtattcttagaggtgggaatggtttcagagctatgctggaaacagc

SEQ ID NO: 46201 - DNA, 70 bp, Artificial Sequence
  Synthetic
gccaagcatttaggtgacactatagcgggacatccctgagctgcagtttcagagctatgctggaaacagc

SEQ ID NO: 46202 - DNA, 70 bp, Artificial Sequence
  Synthetic
gccaagcatttaggtgacactatagcctgcagctcagggatgtccgtttcagagctatgctggaaacagc

SEQ ID NO: 46203 - DNA, 70 bp, Artificial Sequence
  Synthetic
gccaagcatttaggtgacactatagtcagtatattgagtggctaagtttcagagctatgctggaaacagc

SEQ ID NO: 46204 - DNA, 70 bp, Artificial Sequence
  Synthetic
gccaagcatttaggtgacactatagagatatgtatgtaagttggcgtttcagagctatgctggaaacagc

SEQ ID NO: 46205 - DNA, 70 bp, Artificial Sequence
  Synthetic
gccaagcatttaggtgacactatagtaatgcactcagaattctcagtttcagagctatgctggaaacagc

SEQ ID NO: 46206 - DNA, 70 bp, Artificial Sequence
  Synthetic
gccaagcatttaggtgacactatagctacagcattcacaatcttcgtttcagagctatgctggaaacagc

SEQ ID NO: 46207 - DNA, 70 bp, Artificial Sequence
  Synthetic
gccaagcatttaggtgacactatagaagttgtgctaatacctggagtttcagagctatgctggaaacagc

SEQ ID NO: 46208 - DNA, 70 bp, Artificial Sequence
  Synthetic
gccaagcatttaggtgacactatagagtgcattttaagtcacacagtttcagagctatgctggaaacagc

SEQ ID NO: 46209 - DNA, 70 bp, Artificial Sequence
  Synthetic
gccaagcatttaggtgacactatagagtgctcttcatcagatgaagtttcagagctatgctggaaacagc

SEQ ID NO: 46210 - DNA, 70 bp, Artificial Sequence
  Synthetic
gccaagcatttaggtgacactatagtgctactgggtcacggctacgtttcagagctatgctggaaacagc

SEQ ID NO: 46211 - DNA, 70 bp, Artificial Sequence
  Synthetic
gccaagcatttaggtgacactatagaaggtgcatcttaagaatgagtttcagagctatgctggaaacagc

SEQ ID NO: 46212 - DNA, 70 bp, Artificial Sequence
  Synthetic
gccaagcatttaggtgacactatagcatcaaacatgtctgtgagcgtttcagagctatgctggaaacagc

SEQ ID NO: 46213 - DNA, 70 bp, Artificial Sequence
  Synthetic
gccaagcatttaggtgacactatagcctcttaaggctccatcagcgtttcagagctatgctggaaacagc

SEQ ID NO: 46214 - DNA, 70 bp, Artificial Sequence
  Synthetic
gccaagcatttaggtgacactataggcaggggctgcagccattaagtttcagagctatgctggaaacagc

SEQ ID NO: 46215 - DNA, 70 bp, Artificial Sequence
  Synthetic
gccaagcatttaggtgacactatagaggaacagcggctgctgaacgtttcagagctatgctggaaacagc

SEQ ID NO: 46216 - DNA, 70 bp, Artificial Sequence
  Synthetic
gccaagcatttaggtgacactatagggcatcgagatgggctaactgtttcagagctatgctggaaacagc

SEQ ID NO: 46217 - DNA, 70 bp, Artificial Sequence
  Synthetic
gccaagcatttaggtgacactataggcgtgtgcatttctttattcgtttcagagctatgctggaaacagc

SEQ ID NO: 46218 - DNA, 70 bp, Artificial Sequence
  Synthetic
gccaagcatttaggtgacactatagggggatgtaaagaactgagtgtttcagagctatgctggaaacagc

SEQ ID NO: 46219 - DNA, 70 bp, Artificial Sequence
  Synthetic
gccaagcatttaggtgacactataggggcggacctgggtcagagcgtttcagagctatgctggaaacagc

SEQ ID NO: 46220 - DNA, 70 bp, Artificial Sequence
  Synthetic
gccaagcatttaggtgacactatagcgcagagtgctaaggagtgagtttcagagctatgctggaaacagc

SEQ ID NO: 46221 - DNA, 70 bp, Artificial Sequence
  Synthetic
gccaagcatttaggtgacactatagtattgtctggatttattggggtttcagagctatgctggaaacagc

SEQ ID NO: 46222 - DNA, 70 bp, Artificial Sequence
  Synthetic
gccaagcatttaggtgacactatagtattttttgctctgatggtggtttcagagctatgctggaaacagc

SEQ ID NO: 46223 - DNA, 70 bp, Artificial Sequence
  Synthetic
gccaagcatttaggtgacactatagtgtggaaactttattgtggtgtttcagagctatgctggaaacagc

SEQ ID NO: 46224 - DNA, 70 bp, Artificial Sequence
  Synthetic
gccaagcatttaggtgacactatagacctgaagatccttcattttgtttcagagctatgctggaaacagc

SEQ ID NO: 46225 - DNA, 70 bp, Artificial Sequence
  Synthetic
gccaagcatttaggtgacactatagttggagcgaattaaagcagagtttcagagctatgctggaaacagc

SEQ ID NO: 46226 - DNA, 70 bp, Artificial Sequence
  Synthetic
gccaagcatttaggtgacactataggtgggcgatgtcaatccccggtttcagagctatgctggaaacagc

SEQ ID NO: 46227 - DNA, 70 bp, Artificial Sequence
  Synthetic
gccaagcatttaggtgacactatagtgccgggggtgagagtaaaggtttcagagctatgctggaaacagc

SEQ ID NO: 46228 - DNA, 70 bp, Artificial Sequence
  Synthetic
gccaagcatttaggtgacactatagtattgaggaacaggtgagcggtttcagagctatgctggaaacagc

SEQ ID NO: 46229 - DNA, 70 bp, Artificial Sequence
  Synthetic
gccaagcatttaggtgacactatagagttctcacatcttttctacgtttcagagctatgctggaaacagc

SEQ ID NO: 46230 - DNA, 70 bp, Artificial Sequence
  Synthetic
gccaagcatttaggtgacactatagtcattttaagggtcttcctggtttcagagctatgctggaaacagc

SEQ ID NO: 46231 - DNA, 70 bp, Artificial Sequence
  Synthetic
gccaagcatttaggtgacactatagggaagtgttaagactccatcgtttcagagctatgctggaaacagc

SEQ ID NO: 46232 - DNA, 70 bp, Artificial Sequence
  Synthetic
gccaagcatttaggtgacactatagaaacttctttagtgctcagagtttcagagctatgctggaaacagc

SEQ ID NO: 46233 - DNA, 70 bp, Artificial Sequence
  Synthetic
gccaagcatttaggtgacactatagggcccagctgtccttcaacagtttcagagctatgctggaaacagc

SEQ ID NO: 46234 - DNA, 70 bp, Artificial Sequence
  Synthetic
gccaagcatttaggtgacactatagcgcagaggaggggcgatgaggtttcagagctatgctggaaacagc

SEQ ID NO: 46235 - DNA, 70 bp, Artificial Sequence
  Synthetic
gccaagcatttaggtgacactatagtggagccagtcgacaagcccgtttcagagctatgctggaaacagc

SEQ ID NO: 46236 - DNA, 70 bp, Artificial Sequence
  Synthetic
gccaagcatttaggtgacactatagtttaaacagcacactttggtgtttcagagctatgctggaaacagc

SEQ ID NO: 46237 - DNA, 70 bp, Artificial Sequence
  Synthetic
gccaagcatttaggtgacactatagaaggttcatctgaatgaggggtttcagagctatgctggaaacagc

SEQ ID NO: 46238 - DNA, 70 bp, Artificial Sequence
  Synthetic
gccaagcatttaggtgacactatagggaggctcagagcacagtctgtttcagagctatgctggaaacagc

SEQ ID NO: 46239 - DNA, 70 bp, Artificial Sequence
  Synthetic
gccaagcatttaggtgacactatagtggggttttaaggctcttccgtttcagagctatgctggaaacagc

SEQ ID NO: 46240 - DNA, 70 bp, Artificial Sequence
  Synthetic
gccaagcatttaggtgacactatagagctttaaggctcttcctgcgtttcagagctatgctggaaacagc

SEQ ID NO: 46241 - DNA, 70 bp, Artificial Sequence
  Synthetic
gccaagcatttaggtgacactatagctcatacagtcagagttcacgtttcagagctatgctggaaacagc

SEQ ID NO: 46242 - DNA, 70 bp, Artificial Sequence
  Synthetic
gccaagcatttaggtgacactatagagctgctttcaaaaccaaatgtttcagagctatgctggaaacagc

SEQ ID NO: 46243 - DNA, 70 bp, Artificial Sequence
  Synthetic
gccaagcatttaggtgacactatagtcttgcattgggtcaactgagtttcagagctatgctggaaacagc

SEQ ID NO: 46244 - DNA, 70 bp, Artificial Sequence
  Synthetic
gccaagcatttaggtgacactatagataagttctgtgtcccagccgtttcagagctatgctggaaacagc

SEQ ID NO: 46245 - DNA, 70 bp, Artificial Sequence
  Synthetic
gccaagcatttaggtgacactataggtcagctgttcaagctgcacgtttcagagctatgctggaaacagc

SEQ ID NO: 46246 - DNA, 70 bp, Artificial Sequence
  Synthetic
gccaagcatttaggtgacactatagtaggtcaaaatgaatacctggtttcagagctatgctggaaacagc

SEQ ID NO: 46247 - DNA, 70 bp, Artificial Sequence
  Synthetic
gccaagcatttaggtgacactatagtctgcacaatggaaagataagtttcagagctatgctggaaacagc

SEQ ID NO: 46248 - DNA, 70 bp, Artificial Sequence
  Synthetic
gccaagcatttaggtgacactatagaaacttttgtcaccgttccagtttcagagctatgctggaaacagc

SEQ ID NO: 46249 - DNA, 70 bp, Artificial Sequence
  Synthetic
gccaagcatttaggtgacactataggtcaatagtgtgaaaggctggtttcagagctatgctggaaacagc

SEQ ID NO: 46250 - DNA, 70 bp, Artificial Sequence
  Synthetic
gccaagcatttaggtgacactatagcaccagcacaagtcctgagagtttcagagctatgctggaaacagc

SEQ ID NO: 46251 - DNA, 70 bp, Artificial Sequence
  Synthetic
gccaagcatttaggtgacactatagggatgaagccaccagcgcttgtttcagagctatgctggaaacagc

SEQ ID NO: 46252 - DNA, 70 bp, Artificial Sequence
  Synthetic
gccaagcatttaggtgacactatagggcagtcacaaggcctgatggtttcagagctatgctggaaacagc

SEQ ID NO: 46253 - DNA, 70 bp, Artificial Sequence
  Synthetic
gccaagcatttaggtgacactatagctctggggctcacaccaagcgtttcagagctatgctggaaacagc

SEQ ID NO: 46254 - DNA, 70 bp, Artificial Sequence
  Synthetic
gccaagcatttaggtgacactatagggagtccctgcctcactcgggtttcagagctatgctggaaacagc

SEQ ID NO: 46255 - DNA, 70 bp, Artificial Sequence
  Synthetic
gccaagcatttaggtgacactataggccacttcttcactgagatagtttcagagctatgctggaaacagc

SEQ ID NO: 46256 - DNA, 70 bp, Artificial Sequence
  Synthetic
gccaagcatttaggtgacactatagcagcagaagtcagattgtaggtttcagagctatgctggaaacagc

SEQ ID NO: 46257 - DNA, 70 bp, Artificial Sequence
  Synthetic
gccaagcatttaggtgacactatagtactttatggctaaggaagcgtttcagagctatgctggaaacagc

SEQ ID NO: 46258 - DNA, 70 bp, Artificial Sequence
  Synthetic
gccaagcatttaggtgacactatagcaggcatggccagggctcatgtttcagagctatgctggaaacagc

SEQ ID NO: 46259 - DNA, 70 bp, Artificial Sequence
  Synthetic
gccaagcatttaggtgacactatagtacgggatggccagagatgcgtttcagagctatgctggaaacagc

SEQ ID NO: 46260 - DNA, 70 bp, Artificial Sequence
  Synthetic
gccaagcatttaggtgacactatagtctcgctgtgttgtcctggcgtttcagagctatgctggaaacagc

SEQ ID NO: 46261 - DNA, 70 bp, Artificial Sequence
  Synthetic
gccaagcatttaggtgacactatagtgctgtctcgaaaatagttagtttcagagctatgctggaaacagc

SEQ ID NO: 46262 - DNA, 70 bp, Artificial Sequence
  Synthetic
gccaagcatttaggtgacactataggagaacaaggtcgctgtcaagtttcagagctatgctggaaacagc

SEQ ID NO: 46263 - DNA, 70 bp, Artificial Sequence
  Synthetic
gccaagcatttaggtgacactatagttcaggatggctgtattctggtttcagagctatgctggaaacagc

SEQ ID NO: 46264 - DNA, 70 bp, Artificial Sequence
  Synthetic
gccaagcatttaggtgacactataggtctactttaagacttcaccgtttcagagctatgctggaaacagc

SEQ ID NO: 46265 - DNA, 70 bp, Artificial Sequence
  Synthetic
gccaagcatttaggtgacactatagtgagggtcctggctcagaccgtttcagagctatgctggaaacagc

SEQ ID NO: 46266 - DNA, 70 bp, Artificial Sequence
  Synthetic
gccaagcatttaggtgacactatagtggcaggtcacttgtctgcagtttcagagctatgctggaaacagc

SEQ ID NO: 46267 - DNA, 70 bp, Artificial Sequence
  Synthetic
gccaagcatttaggtgacactatagcttgttggtcatcaccaaaggtttcagagctatgctggaaacagc

SEQ ID NO: 46268 - DNA, 70 bp, Artificial Sequence
  Synthetic
gccaagcatttaggtgacactatagttgttcgcgcagacatgtgagtttcagagctatgctggaaacagc

SEQ ID NO: 46269 - DNA, 70 bp, Artificial Sequence
  Synthetic
gccaagcatttaggtgacactatagccggggacggttgtgtcagggtttcagagctatgctggaaacagc

SEQ ID NO: 46270 - DNA, 70 bp, Artificial Sequence
  Synthetic
gccaagcatttaggtgacactatagattgagtctctgctgcatttgtttcagagctatgctggaaacagc

SEQ ID NO: 46271 - DNA, 70 bp, Artificial Sequence
  Synthetic
gccaagcatttaggtgacactatagaacgagtgcaattggagctcgtttcagagctatgctggaaacagc

SEQ ID NO: 46272 - DNA, 70 bp, Artificial Sequence
  Synthetic
gccaagcatttaggtgacactatagacagaagatacagttgagttgtttcagagctatgctggaaacagc

SEQ ID NO: 46273 - DNA, 70 bp, Artificial Sequence
  Synthetic
gccaagcatttaggtgacactatagcacttcctctgtcagggcacgtttcagagctatgctggaaacagc

SEQ ID NO: 46274 - DNA, 70 bp, Artificial Sequence
  Synthetic
gccaagcatttaggtgacactatagctcacaaggatggcctgagggtttcagagctatgctggaaacagc

SEQ ID NO: 46275 - DNA, 70 bp, Artificial Sequence
  Synthetic
gccaagcatttaggtgacactatagggagctgatgagaatcaaaggtttcagagctatgctggaaacagc

SEQ ID NO: 46276 - DNA, 70 bp, Artificial Sequence
  Synthetic
gccaagcatttaggtgacactatagattcgtggcctatagttgttgtttcagagctatgctggaaacagc

SEQ ID NO: 46277 - DNA, 70 bp, Artificial Sequence
  Synthetic
gccaagcatttaggtgacactatagtgggaaggaaagctcactctgtttcagagctatgctggaaacagc

SEQ ID NO: 46278 - DNA, 70 bp, Artificial Sequence
  Synthetic
gccaagcatttaggtgacactatagggtagagggctcacacgttggtttcagagctatgctggaaacagc

SEQ ID NO: 46279 - DNA, 70 bp, Artificial Sequence
  Synthetic
gccaagcatttaggtgacactataggttcatgatgctcatggcctgtttcagagctatgctggaaacagc

SEQ ID NO: 46280 - DNA, 70 bp, Artificial Sequence
  Synthetic
gccaagcatttaggtgacactatagcctcagcctggtggccctaggtttcagagctatgctggaaacagc

SEQ ID NO: 46281 - DNA, 70 bp, Artificial Sequence
  Synthetic
gccaagcatttaggtgacactatagggtacaaaatccgggcagaggtttcagagctatgctggaaacagc

SEQ ID NO: 46282 - DNA, 70 bp, Artificial Sequence
  Synthetic
gccaagcatttaggtgacactatagatgtactggcgaagaatattgtttcagagctatgctggaaacagc

SEQ ID NO: 46283 - DNA, 70 bp, Artificial Sequence
  Synthetic
gccaagcatttaggtgacactatagatttcaggtaggcaattgtggtttcagagctatgctggaaacagc

SEQ ID NO: 46284 - DNA, 70 bp, Artificial Sequence
  Synthetic
gccaagcatttaggtgacactataggggtcaagtcagagagataggtttcagagctatgctggaaacagc

SEQ ID NO: 46285 - DNA, 70 bp, Artificial Sequence
  Synthetic
gccaagcatttaggtgacactatagtaagggatcatctcattagcgtttcagagctatgctggaaacagc

SEQ ID NO: 46286 - DNA, 70 bp, Artificial Sequence
  Synthetic
gccaagcatttaggtgacactatagaacagaaaccaagtcaagacgtttcagagctatgctggaaacagc

SEQ ID NO: 46287 - DNA, 70 bp, Artificial Sequence
  Synthetic
gccaagcatttaggtgacactatagcagctgtttctgtcctcagagtttcagagctatgctggaaacagc

SEQ ID NO: 46288 - DNA, 70 bp, Artificial Sequence
  Synthetic
gccaagcatttaggtgacactataggtttaatcagcttcctgttggtttcagagctatgctggaaacagc

SEQ ID NO: 46289 - DNA, 70 bp, Artificial Sequence
  Synthetic
gccaagcatttaggtgacactatagtgtctgctttttccctcattgtttcagagctatgctggaaacagc

SEQ ID NO: 46290 - DNA, 70 bp, Artificial Sequence
  Synthetic
gccaagcatttaggtgacactatagagagccgcataatctcaggggtttcagagctatgctggaaacagc

SEQ ID NO: 46291 - DNA, 70 bp, Artificial Sequence
  Synthetic
gccaagcatttaggtgacactatagccattcagtatataccctgagtttcagagctatgctggaaacagc

SEQ ID NO: 46292 - DNA, 70 bp, Artificial Sequence
  Synthetic
gccaagcatttaggtgacactatagttgccagcaactcttagaccgtttcagagctatgctggaaacagc

SEQ ID NO: 46293 - DNA, 70 bp, Artificial Sequence
  Synthetic
gccaagcatttaggtgacactatagcccacggccaggctcagtgcgtttcagagctatgctggaaacagc

SEQ ID NO: 46294 - DNA, 70 bp, Artificial Sequence
  Synthetic
gccaagcatttaggtgacactatagtcccagcatgtggtcagagcgtttcagagctatgctggaaacagc

SEQ ID NO: 46295 - DNA, 70 bp, Artificial Sequence
  Synthetic
gccaagcatttaggtgacactataggagatttcctgagcaagcaggtttcagagctatgctggaaacagc

SEQ ID NO: 46296 - DNA, 70 bp, Artificial Sequence
  Synthetic
gccaagcatttaggtgacactataggagccattctcctgaagaaagtttcagagctatgctggaaacagc

SEQ ID NO: 46297 - DNA, 70 bp, Artificial Sequence
  Synthetic
gccaagcatttaggtgacactataggtgggttagttcaaggtagagtttcagagctatgctggaaacagc

SEQ ID NO: 46298 - DNA, 70 bp, Artificial Sequence
  Synthetic
gccaagcatttaggtgacactataggcagcagtgctgggcttcacgtttcagagctatgctggaaacagc

SEQ ID NO: 46299 - DNA, 70 bp, Artificial Sequence
  Synthetic
gccaagcatttaggtgacactatagactggaagcgatcatacacagtttcagagctatgctggaaacagc

SEQ ID NO: 46300 - DNA, 70 bp, Artificial Sequence
  Synthetic
gccaagcatttaggtgacactataggagtcccagttggtccctaggtttcagagctatgctggaaacagc

SEQ ID NO: 46301 - DNA, 70 bp, Artificial Sequence
  Synthetic
gccaagcatttaggtgacactataggcatataggttacagccgccgtttcagagctatgctggaaacagc

SEQ ID NO: 46302 - DNA, 70 bp, Artificial Sequence
  Synthetic
gccaagcatttaggtgacactatagtgcccagccagcgcgcctaggtttcagagctatgctggaaacagc

SEQ ID NO: 46303 - DNA, 70 bp, Artificial Sequence
  Synthetic
gccaagcatttaggtgacactatagacagtttgtgtcacaggaacgtttcagagctatgctggaaacagc

SEQ ID NO: 46304 - DNA, 70 bp, Artificial Sequence
  Synthetic
gccaagcatttaggtgacactatagagttgttgtcttcaggaattgtttcagagctatgctggaaacagc

SEQ ID NO: 46305 - DNA, 70 bp, Artificial Sequence
  Synthetic
gccaagcatttaggtgacactatagactagttagcgtatttatgggtttcagagctatgctggaaacagc

SEQ ID NO: 46306 - DNA, 70 bp, Artificial Sequence
  Synthetic
gccaagcatttaggtgacactataggtggaggccgacctggagtggtttcagagctatgctggaaacagc

SEQ ID NO: 46307 - DNA, 70 bp, Artificial Sequence
  Synthetic
gccaagcatttaggtgacactataggtgcaagccatggttgagcagtttcagagctatgctggaaacagc

SEQ ID NO: 46308 - DNA, 70 bp, Artificial Sequence
  Synthetic
gccaagcatttaggtgacactatagcatcttcaatgctgtggtgggtttcagagctatgctggaaacagc

SEQ ID NO: 46309 - DNA, 70 bp, Artificial Sequence
  Synthetic
gccaagcatttaggtgacactatagaaaggagatctgcgacactggtttcagagctatgctggaaacagc

SEQ ID NO: 46310 - DNA, 70 bp, Artificial Sequence
  Synthetic
gccaagcatttaggtgacactatagaacaacaagaagctggactggtttcagagctatgctggaaacagc

SEQ ID NO: 46311 - DNA, 70 bp, Artificial Sequence
  Synthetic
gccaagcatttaggtgacactatagagcggctacttcttgtcttcgtttcagagctatgctggaaacagc

SEQ ID NO: 46312 - DNA, 70 bp, Artificial Sequence
  Synthetic
gccaagcatttaggtgacactatagattgattcaacatagttcccgtttcagagctatgctggaaacagc

SEQ ID NO: 46313 - DNA, 70 bp, Artificial Sequence
  Synthetic
gccaagcatttaggtgacactatagatagactcaacgtaattcccgtttcagagctatgctggaaacagc

SEQ ID NO: 46314 - DNA, 70 bp, Artificial Sequence
  Synthetic
gccaagcatttaggtgacactatagagccctgggctgtcagcagcgtttcagagctatgctggaaacagc

SEQ ID NO: 46315 - DNA, 70 bp, Artificial Sequence
  Synthetic
gccaagcatttaggtgacactatagggactacaattcctggaaaagtttcagagctatgctggaaacagc

SEQ ID NO: 46316 - DNA, 70 bp, Artificial Sequence
  Synthetic
gccaagcatttaggtgacactatagaaatcagtgacatagtgcaggtttcagagctatgctggaaacagc

SEQ ID NO: 46317 - DNA, 70 bp, Artificial Sequence
  Synthetic
gccaagcatttaggtgacactatagaaatcagtgatgtggtgcaggtttcagagctatgctggaaacagc

SEQ ID NO: 46318 - DNA, 70 bp, Artificial Sequence
  Synthetic
gccaagcatttaggtgacactatagcaatgttatgcacgtctgatgtttcagagctatgctggaaacagc

SEQ ID NO: 46319 - DNA, 70 bp, Artificial Sequence
  Synthetic
gccaagcatttaggtgacactatagatgtcgttgcgtctccaaaggtttcagagctatgctggaaacagc

SEQ ID NO: 46320 - DNA, 70 bp, Artificial Sequence
  Synthetic
gccaagcatttaggtgacactatagacagctttcactcacgtgaggtttcagagctatgctggaaacagc

SEQ ID NO: 46321 - DNA, 70 bp, Artificial Sequence
  Synthetic
gccaagcatttaggtgacactatagagaaagcccttttgttctgagtttcagagctatgctggaaacagc

SEQ ID NO: 46322 - DNA, 70 bp, Artificial Sequence
  Synthetic
gccaagcatttaggtgacactataggaagcaagcccggctgttctgtttcagagctatgctggaaacagc

SEQ ID NO: 46323 - DNA, 70 bp, Artificial Sequence
  Synthetic
gccaagcatttaggtgacactatagtgtagacaggacccgtttaggtttcagagctatgctggaaacagc

SEQ ID NO: 46324 - DNA, 70 bp, Artificial Sequence
  Synthetic
gccaagcatttaggtgacactatagagcccctggcagccgctcacgtttcagagctatgctggaaacagc

SEQ ID NO: 46325 - DNA, 70 bp, Artificial Sequence
  Synthetic
gccaagcatttaggtgacactatagccctgcctcgggctacacgtgtttcagagctatgctggaaacagc

SEQ ID NO: 46326 - DNA, 70 bp, Artificial Sequence
  Synthetic
gccaagcatttaggtgacactatagaagagggcaaggggaggcttgtttcagagctatgctggaaacagc

SEQ ID NO: 46327 - DNA, 70 bp, Artificial Sequence
  Synthetic
gccaagcatttaggtgacactatagtgagtagcgtaatcacaacagtttcagagctatgctggaaacagc

SEQ ID NO: 46328 - DNA, 70 bp, Artificial Sequence
  Synthetic
gccaagcatttaggtgacactatagccaggagagctgcttctgcagtttcagagctatgctggaaacagc

SEQ ID NO: 46329 - DNA, 70 bp, Artificial Sequence
  Synthetic
gccaagcatttaggtgacactatagagggttttggtgaatattcagtttcagagctatgctggaaacagc

SEQ ID NO: 46330 - DNA, 70 bp, Artificial Sequence
  Synthetic
gccaagcatttaggtgacactatagctgggaggtctgagtgttccgtttcagagctatgctggaaacagc

SEQ ID NO: 46331 - DNA, 70 bp, Artificial Sequence
  Synthetic
gccaagcatttaggtgacactatagcccttgtcagggactcctgagtttcagagctatgctggaaacagc

SEQ ID NO: 46332 - DNA, 70 bp, Artificial Sequence
  Synthetic
gccaagcatttaggtgacactatagcctgctcgtgtccatcggtcgtttcagagctatgctggaaacagc

SEQ ID NO: 46333 - DNA, 70 bp, Artificial Sequence
  Synthetic
gccaagcatttaggtgacactatagtacatcacctcccgggtgtggtttcagagctatgctggaaacagc

SEQ ID NO: 46334 - DNA, 70 bp, Artificial Sequence
  Synthetic
gccaagcatttaggtgacactatagtgggacctcactcagttcccgtttcagagctatgctggaaacagc

SEQ ID NO: 46335 - DNA, 70 bp, Artificial Sequence
  Synthetic
gccaagcatttaggtgacactataggaatgatgacagcaatacctgtttcagagctatgctggaaacagc

SEQ ID NO: 46336 - DNA, 70 bp, Artificial Sequence
  Synthetic
gccaagcatttaggtgacactatagggcaggaagctcttcctacggtttcagagctatgctggaaacagc

SEQ ID NO: 46337 - DNA, 70 bp, Artificial Sequence
  Synthetic
gccaagcatttaggtgacactatagctgggcgggccacggtcagggtttcagagctatgctggaaacagc

SEQ ID NO: 46338 - DNA, 70 bp, Artificial Sequence
  Synthetic
gccaagcatttaggtgacactatagcagccccaaggctctaaatggtttcagagctatgctggaaacagc

SEQ ID NO: 46339 - DNA, 70 bp, Artificial Sequence
  Synthetic
gccaagcatttaggtgacactatagctgacagccaagatataagggtttcagagctatgctggaaacagc

SEQ ID NO: 46340 - DNA, 70 bp, Artificial Sequence
  Synthetic
gccaagcatttaggtgacactataggtgggttctactcctgaagcgtttcagagctatgctggaaacagc

SEQ ID NO: 46341 - DNA, 70 bp, Artificial Sequence
  Synthetic
gccaagcatttaggtgacactatagcctctggacaggacatgctggtttcagagctatgctggaaacagc

SEQ ID NO: 46342 - DNA, 70 bp, Artificial Sequence
  Synthetic
gccaagcatttaggtgacactatagagagttcagccaatctatgggtttcagagctatgctggaaacagc

SEQ ID NO: 46343 - DNA, 70 bp, Artificial Sequence
  Synthetic
gccaagcatttaggtgacactatagtgtacttgtcaatgtgttcagtttcagagctatgctggaaacagc

SEQ ID NO: 46344 - DNA, 70 bp, Artificial Sequence
  Synthetic
gccaagcatttaggtgacactataggtccgccgcgggctcagctcgtttcagagctatgctggaaacagc

SEQ ID NO: 46345 - DNA, 70 bp, Artificial Sequence
  Synthetic
gccaagcatttaggtgacactatagtgcatcgatatgctttgcaagtttcagagctatgctggaaacagc

SEQ ID NO: 46346 - DNA, 70 bp, Artificial Sequence
  Synthetic
gccaagcatttaggtgacactataggggagtattcagaagccaaggtttcagagctatgctggaaacagc

SEQ ID NO: 46347 - DNA, 70 bp, Artificial Sequence
  Synthetic
gccaagcatttaggtgacactataggtcctggaagctcttctcaggtttcagagctatgctggaaacagc

SEQ ID NO: 46348 - DNA, 70 bp, Artificial Sequence
  Synthetic
gccaagcatttaggtgacactataggggcctcgggtcacagcgtggtttcagagctatgctggaaacagc

SEQ ID NO: 46349 - DNA, 70 bp, Artificial Sequence
  Synthetic
gccaagcatttaggtgacactatagagaatttctgtgaatcttgcgtttcagagctatgctggaaacagc

SEQ ID NO: 46350 - DNA, 70 bp, Artificial Sequence
  Synthetic
gccaagcatttaggtgacactatagctccacctggaagagagctagtttcagagctatgctggaaacagc

SEQ ID NO: 46351 - DNA, 70 bp, Artificial Sequence
  Synthetic
gccaagcatttaggtgacactatagctacagcttctgaattagcagtttcagagctatgctggaaacagc

SEQ ID NO: 46352 - DNA, 70 bp, Artificial Sequence
  Synthetic
gccaagcatttaggtgacactatagctgtgcattgggggtgggatgtttcagagctatgctggaaacagc

SEQ ID NO: 46353 - DNA, 70 bp, Artificial Sequence
  Synthetic
gccaagcatttaggtgacactatagacaactcctactctttgtgggtttcagagctatgctggaaacagc

SEQ ID NO: 46354 - DNA, 70 bp, Artificial Sequence
  Synthetic
gccaagcatttaggtgacactatagccactgacagtcacctctttgtttcagagctatgctggaaacagc

SEQ ID NO: 46355 - DNA, 70 bp, Artificial Sequence
  Synthetic
gccaagcatttaggtgacactatagatgctgttcttctaaaccctgtttcagagctatgctggaaacagc

SEQ ID NO: 46356 - DNA, 70 bp, Artificial Sequence
  Synthetic
gccaagcatttaggtgacactatagtcggtcagactggagtgaaggtttcagagctatgctggaaacagc

SEQ ID NO: 46357 - DNA, 70 bp, Artificial Sequence
  Synthetic
gccaagcatttaggtgacactataggccttttattgcacagtggtgtttcagagctatgctggaaacagc

SEQ ID NO: 46358 - DNA, 70 bp, Artificial Sequence
  Synthetic
gccaagcatttaggtgacactatagttttagacagtgtggtcagggtttcagagctatgctggaaacagc

SEQ ID NO: 46359 - DNA, 70 bp, Artificial Sequence
  Synthetic
gccaagcatttaggtgacactataggcagcggcacacaactggcagtttcagagctatgctggaaacagc

SEQ ID NO: 46360 - DNA, 70 bp, Artificial Sequence
  Synthetic
gccaagcatttaggtgacactatagggtctggaactcctgatctggtttcagagctatgctggaaacagc

SEQ ID NO: 46361 - DNA, 70 bp, Artificial Sequence
  Synthetic
gccaagcatttaggtgacactatagagtgaccaacgcaggtgagcgtttcagagctatgctggaaacagc

SEQ ID NO: 46362 - DNA, 70 bp, Artificial Sequence
  Synthetic
gccaagcatttaggtgacactatagggaggatgcaatgagggagtgtttcagagctatgctggaaacagc

SEQ ID NO: 46363 - DNA, 70 bp, Artificial Sequence
  Synthetic
gccaagcatttaggtgacactatagtcctgcgtgacgtctcacatgtttcagagctatgctggaaacagc

SEQ ID NO: 46364 - DNA, 70 bp, Artificial Sequence
  Synthetic
gccaagcatttaggtgacactataggtggagctgagacactcctggtttcagagctatgctggaaacagc

SEQ ID NO: 46365 - DNA, 70 bp, Artificial Sequence
  Synthetic
gccaagcatttaggtgacactatagtctgaacatcatcagtgtttgtttcagagctatgctggaaacagc

SEQ ID NO: 46366 - DNA, 70 bp, Artificial Sequence
  Synthetic
gccaagcatttaggtgacactatagggaaatccggggtgatgacagtttcagagctatgctggaaacagc

SEQ ID NO: 46367 - DNA, 70 bp, Artificial Sequence
  Synthetic
gccaagcatttaggtgacactatagcatcagtcaagatcacgtgagtttcagagctatgctggaaacagc

SEQ ID NO: 46368 - DNA, 70 bp, Artificial Sequence
  Synthetic
gccaagcatttaggtgacactatagaaataatgggccgggcgcgggtttcagagctatgctggaaacagc

SEQ ID NO: 46369 - DNA, 70 bp, Artificial Sequence
  Synthetic
gccaagcatttaggtgacactatagattcatcaatgcttcctgaggtttcagagctatgctggaaacagc

SEQ ID NO: 46370 - DNA, 70 bp, Artificial Sequence
  Synthetic
gccaagcatttaggtgacactataggaggccgtgttcacagccgcgtttcagagctatgctggaaacagc

SEQ ID NO: 46371 - DNA, 70 bp, Artificial Sequence
  Synthetic
gccaagcatttaggtgacactataggggggtcccgccggggtcacgtttcagagctatgctggaaacagc

SEQ ID NO: 46372 - DNA, 70 bp, Artificial Sequence
  Synthetic
gccaagcatttaggtgacactatagcggggtgggcgccgctagctgtttcagagctatgctggaaacagc

SEQ ID NO: 46373 - DNA, 70 bp, Artificial Sequence
  Synthetic
gccaagcatttaggtgacactatagagaactaggatttgcttccagtttcagagctatgctggaaacagc

SEQ ID NO: 46374 - DNA, 70 bp, Artificial Sequence
  Synthetic
gccaagcatttaggtgacactatagaccctaacaaggaggatgtggtttcagagctatgctggaaacagc

SEQ ID NO: 46375 - DNA, 70 bp, Artificial Sequence
  Synthetic
gccaagcatttaggtgacactatagcctctccagggcagatcattgtttcagagctatgctggaaacagc

SEQ ID NO: 46376 - DNA, 70 bp, Artificial Sequence
  Synthetic
gccaagcatttaggtgacactatagaaagtactggttggctctgtgtttcagagctatgctggaaacagc

SEQ ID NO: 46377 - DNA, 70 bp, Artificial Sequence
  Synthetic
gccaagcatttaggtgacactatagtgttacatgctcatgtgttcgtttcagagctatgctggaaacagc

SEQ ID NO: 46378 - DNA, 70 bp, Artificial Sequence
  Synthetic
gccaagcatttaggtgacactatagggcaatgccctggcatttttgtttcagagctatgctggaaacagc

SEQ ID NO: 46379 - DNA, 70 bp, Artificial Sequence
  Synthetic
gccaagcatttaggtgacactatagccaagtgcacgtctcctactgtttcagagctatgctggaaacagc

SEQ ID NO: 46380 - DNA, 70 bp, Artificial Sequence
  Synthetic
gccaagcatttaggtgacactatagtgaaggaactgcaacagtgagtttcagagctatgctggaaacagc

SEQ ID NO: 46381 - DNA, 70 bp, Artificial Sequence
  Synthetic
gccaagcatttaggtgacactatagtctatcacaaatctctcctggtttcagagctatgctggaaacagc

SEQ ID NO: 46382 - DNA, 70 bp, Artificial Sequence
  Synthetic
gccaagcatttaggtgacactatagtggccactgagggcatctaggtttcagagctatgctggaaacagc

SEQ ID NO: 46383 - DNA, 70 bp, Artificial Sequence
  Synthetic
gccaagcatttaggtgacactatagtgtcttgaaggtatccaaatgtttcagagctatgctggaaacagc

SEQ ID NO: 46384 - DNA, 70 bp, Artificial Sequence
  Synthetic
gccaagcatttaggtgacactatagtagagaatcctcctgatgatgtttcagagctatgctggaaacagc

SEQ ID NO: 46385 - DNA, 70 bp, Artificial Sequence
  Synthetic
gccaagcatttaggtgacactatagtgctgttctctcagtttcccgtttcagagctatgctggaaacagc

SEQ ID NO: 46386 - DNA, 70 bp, Artificial Sequence
  Synthetic
gccaagcatttaggtgacactatagttgatgggattgtcccctcggtttcagagctatgctggaaacagc

SEQ ID NO: 46387 - DNA, 70 bp, Artificial Sequence
  Synthetic
gccaagcatttaggtgacactatagatttagggacagctgttttcgtttcagagctatgctggaaacagc

SEQ ID NO: 46388 - DNA, 70 bp, Artificial Sequence
  Synthetic
gccaagcatttaggtgacactataggaaagtttgaatttgctgccgtttcagagctatgctggaaacagc

SEQ ID NO: 46389 - DNA, 70 bp, Artificial Sequence
  Synthetic
gccaagcatttaggtgacactataggaggagggagtctagggctggtttcagagctatgctggaaacagc

SEQ ID NO: 46390 - DNA, 70 bp, Artificial Sequence
  Synthetic
gccaagcatttaggtgacactatagacagcttgctctctgagaccgtttcagagctatgctggaaacagc

SEQ ID NO: 46391 - DNA, 70 bp, Artificial Sequence
  Synthetic
gccaagcatttaggtgacactatagggtgttcttagggctccacagtttcagagctatgctggaaacagc

SEQ ID NO: 46392 - DNA, 70 bp, Artificial Sequence
  Synthetic
gccaagcatttaggtgacactatagccttgtgacacttcagagctgtttcagagctatgctggaaacagc

SEQ ID NO: 46393 - DNA, 70 bp, Artificial Sequence
  Synthetic
gccaagcatttaggtgacactataggaagtcaccaaccaatactcgtttcagagctatgctggaaacagc

SEQ ID NO: 46394 - DNA, 70 bp, Artificial Sequence
  Synthetic
gccaagcatttaggtgacactataggagtccagaacaaagtcagggtttcagagctatgctggaaacagc

SEQ ID NO: 46395 - DNA, 70 bp, Artificial Sequence
  Synthetic
gccaagcatttaggtgacactatagtctgaaatcgaagctctagtgtttcagagctatgctggaaacagc

SEQ ID NO: 46396 - DNA, 70 bp, Artificial Sequence
  Synthetic
gccaagcatttaggtgacactataggctgggagccaagctctaacgtttcagagctatgctggaaacagc

SEQ ID NO: 46397 - DNA, 70 bp, Artificial Sequence
  Synthetic
gccaagcatttaggtgacactatagagggcacgaacctgcctcaggtttcagagctatgctggaaacagc

SEQ ID NO: 46398 - DNA, 70 bp, Artificial Sequence
  Synthetic
gccaagcatttaggtgacactatagcttaggcagctcacagctctgtttcagagctatgctggaaacagc

SEQ ID NO: 46399 - DNA, 70 bp, Artificial Sequence
  Synthetic
gccaagcatttaggtgacactatagggctgagtggttgtcaggcggtttcagagctatgctggaaacagc

SEQ ID NO: 46400 - DNA, 70 bp, Artificial Sequence
  Synthetic
gccaagcatttaggtgacactataggccctggtttctggctcacagtttcagagctatgctggaaacagc

SEQ ID NO: 46401 - DNA, 70 bp, Artificial Sequence
  Synthetic
gccaagcatttaggtgacactatagagtcatgggagttcagggccgtttcagagctatgctggaaacagc

SEQ ID NO: 46402 - DNA, 70 bp, Artificial Sequence
  Synthetic
gccaagcatttaggtgacactatagcaaactcaggtgatggaagtgtttcagagctatgctggaaacagc

SEQ ID NO: 46403 - DNA, 70 bp, Artificial Sequence
  Synthetic
gccaagcatttaggtgacactataggggagacttggtgctaactcgtttcagagctatgctggaaacagc

SEQ ID NO: 46404 - DNA, 70 bp, Artificial Sequence
  Synthetic
gccaagcatttaggtgacactatagagagctgccgccatccctaggtttcagagctatgctggaaacagc

SEQ ID NO: 46405 - DNA, 70 bp, Artificial Sequence
  Synthetic
gccaagcatttaggtgacactataggtctgttcagatgttcccatgtttcagagctatgctggaaacagc

SEQ ID NO: 46406 - DNA, 70 bp, Artificial Sequence
  Synthetic
gccaagcatttaggtgacactatagtactgtcttcagtaccttgagtttcagagctatgctggaaacagc

SEQ ID NO: 46407 - DNA, 70 bp, Artificial Sequence
  Synthetic
gccaagcatttaggtgacactataggagaaccaggtcagatcagggtttcagagctatgctggaaacagc

SEQ ID NO: 46408 - DNA, 70 bp, Artificial Sequence
  Synthetic
gccaagcatttaggtgacactatagctaggccagttcggatgagcgtttcagagctatgctggaaacagc

SEQ ID NO: 46409 - DNA, 70 bp, Artificial Sequence
  Synthetic
gccaagcatttaggtgacactatagacctcttctcccatggaacggtttcagagctatgctggaaacagc

SEQ ID NO: 46410 - DNA, 70 bp, Artificial Sequence
  Synthetic
gccaagcatttaggtgacactatagacagttttggagaagtacaagtttcagagctatgctggaaacagc

SEQ ID NO: 46411 - DNA, 70 bp, Artificial Sequence
  Synthetic
gccaagcatttaggtgacactatagagctccatcaaagcagtcaggtttcagagctatgctggaaacagc

SEQ ID NO: 46412 - DNA, 70 bp, Artificial Sequence
  Synthetic
gccaagcatttaggtgacactatagattcaaacttcgagagcagagtttcagagctatgctggaaacagc

SEQ ID NO: 46413 - DNA, 70 bp, Artificial Sequence
  Synthetic
gccaagcatttaggtgacactatagcacttccacccctcatgaccgtttcagagctatgctggaaacagc

SEQ ID NO: 46414 - DNA, 70 bp, Artificial Sequence
  Synthetic
gccaagcatttaggtgacactatagtgacctctattccactatcagtttcagagctatgctggaaacagc

SEQ ID NO: 46415 - DNA, 70 bp, Artificial Sequence
  Synthetic
gccaagcatttaggtgacactataggcggacattgagcgaatgtagtttcagagctatgctggaaacagc

SEQ ID NO: 46416 - DNA, 70 bp, Artificial Sequence
  Synthetic
gccaagcatttaggtgacactataggacattgaacgaatgtatgggtttcagagctatgctggaaacagc

SEQ ID NO: 46417 - DNA, 70 bp, Artificial Sequence
  Synthetic
gccaagcatttaggtgacactatagtaagtaccttatcctaatccgtttcagagctatgctggaaacagc

SEQ ID NO: 46418 - DNA, 70 bp, Artificial Sequence
  Synthetic
gccaagcatttaggtgacactatagaactttccttgaacttcacagtttcagagctatgctggaaacagc

SEQ ID NO: 46419 - DNA, 70 bp, Artificial Sequence
  Synthetic
gccaagcatttaggtgacactatagggagactggtcagatgtaatgtttcagagctatgctggaaacagc

SEQ ID NO: 46420 - DNA, 70 bp, Artificial Sequence
  Synthetic
gccaagcatttaggtgacactatagcttagatgtctcactgcgcagtttcagagctatgctggaaacagc

SEQ ID NO: 46421 - DNA, 70 bp, Artificial Sequence
  Synthetic
gccaagcatttaggtgacactatagggaaaagcccgtgcgcagtggtttcagagctatgctggaaacagc

SEQ ID NO: 46422 - DNA, 70 bp, Artificial Sequence
  Synthetic
gccaagcatttaggtgacactatagaaagtttatatgggggtaaggtttcagagctatgctggaaacagc

SEQ ID NO: 46423 - DNA, 70 bp, Artificial Sequence
  Synthetic
gccaagcatttaggtgacactatagatgaactgaggaagaaagaagtttcagagctatgctggaaacagc

SEQ ID NO: 46424 - DNA, 70 bp, Artificial Sequence
  Synthetic
gccaagcatttaggtgacactatagttaagagaccaagaatggaggtttcagagctatgctggaaacagc

SEQ ID NO: 46425 - DNA, 70 bp, Artificial Sequence
  Synthetic
gccaagcatttaggtgacactatagagggaactcctccggtgaatgtttcagagctatgctggaaacagc

SEQ ID NO: 46426 - DNA, 70 bp, Artificial Sequence
  Synthetic
gccaagcatttaggtgacactatagagtcaggagtgggggaaatggtttcagagctatgctggaaacagc

SEQ ID NO: 46427 - DNA, 70 bp, Artificial Sequence
  Synthetic
gccaagcatttaggtgacactatagtggagtcttcggaggtctacgtttcagagctatgctggaaacagc

SEQ ID NO: 46428 - DNA, 70 bp, Artificial Sequence
  Synthetic
gccaagcatttaggtgacactataggatgatgttgccaatgcattgtttcagagctatgctggaaacagc

SEQ ID NO: 46429 - DNA, 70 bp, Artificial Sequence
  Synthetic
gccaagcatttaggtgacactatagcaggctgctgctaagtgagcgtttcagagctatgctggaaacagc

SEQ ID NO: 46430 - DNA, 70 bp, Artificial Sequence
  Synthetic
gccaagcatttaggtgacactataggacttgttagagcactaactgtttcagagctatgctggaaacagc

SEQ ID NO: 46431 - DNA, 70 bp, Artificial Sequence
  Synthetic
gccaagcatttaggtgacactatagaaggtcaggatcatgttcacgtttcagagctatgctggaaacagc

SEQ ID NO: 46432 - DNA, 70 bp, Artificial Sequence
  Synthetic
gccaagcatttaggtgacactataggcttcagcatttcttctacggtttcagagctatgctggaaacagc

SEQ ID NO: 46433 - DNA, 70 bp, Artificial Sequence
  Synthetic
gccaagcatttaggtgacactatagagtgtgtctagaagcatttggtttcagagctatgctggaaacagc

SEQ ID NO: 46434 - DNA, 70 bp, Artificial Sequence
  Synthetic
gccaagcatttaggtgacactatagtgttttagaagcatttgcgggtttcagagctatgctggaaacagc

SEQ ID NO: 46435 - DNA, 70 bp, Artificial Sequence
  Synthetic
gccaagcatttaggtgacactatagccaccgcaaatgcttctagggtttcagagctatgctggaaacagc

SEQ ID NO: 46436 - DNA, 70 bp, Artificial Sequence
  Synthetic
gccaagcatttaggtgacactatagcattttctgtgaacgatagggtttcagagctatgctggaaacagc

SEQ ID NO: 46437 - DNA, 70 bp, Artificial Sequence
  Synthetic
gccaagcatttaggtgacactatagaggcatcttagaagcatttggtttcagagctatgctggaaacagc

SEQ ID NO: 46438 - DNA, 70 bp, Artificial Sequence
  Synthetic
gccaagcatttaggtgacactatagccaccgcaaatgcttctaaagtttcagagctatgctggaaacagc

SEQ ID NO: 46439 - DNA, 70 bp, Artificial Sequence
  Synthetic
gccaagcatttaggtgacactataggactttagaagcacttcctggtttcagagctatgctggaaacagc

SEQ ID NO: 46440 - DNA, 70 bp, Artificial Sequence
  Synthetic
gccaagcatttaggtgacactataggaacacatcgtacagcagccgtttcagagctatgctggaaacagc

SEQ ID NO: 46441 - DNA, 70 bp, Artificial Sequence
  Synthetic
gccaagcatttaggtgacactataggcttgggaactctttctcaagtttcagagctatgctggaaacagc

SEQ ID NO: 46442 - DNA, 70 bp, Artificial Sequence
  Synthetic
gccaagcatttaggtgacactataggtggggaggagtgccatcaggtttcagagctatgctggaaacagc

SEQ ID NO: 46443 - DNA, 70 bp, Artificial Sequence
  Synthetic
gccaagcatttaggtgacactatagggcctttcttcctctacagagtttcagagctatgctggaaacagc

SEQ ID NO: 46444 - DNA, 70 bp, Artificial Sequence
  Synthetic
gccaagcatttaggtgacactatagggctcagcacttgctgtagagtttcagagctatgctggaaacagc

SEQ ID NO: 46445 - DNA, 70 bp, Artificial Sequence
  Synthetic
gccaagcatttaggtgacactatagaggagtatggtgagcatatggtttcagagctatgctggaaacagc

SEQ ID NO: 46446 - DNA, 70 bp, Artificial Sequence
  Synthetic
gccaagcatttaggtgacactatagtaccgcaaatgctactgaccgtttcagagctatgctggaaacagc

SEQ ID NO: 46447 - DNA, 70 bp, Artificial Sequence
  Synthetic
gccaagcatttaggtgacactatagggccgggcggggtggattaggtttcagagctatgctggaaacagc

SEQ ID NO: 46448 - DNA, 70 bp, Artificial Sequence
  Synthetic
gccaagcatttaggtgacactataggttctcttccgcactctacggtttcagagctatgctggaaacagc

SEQ ID NO: 46449 - DNA, 70 bp, Artificial Sequence
  Synthetic
gccaagcatttaggtgacactatagacctcagtggttggggtcaagtttcagagctatgctggaaacagc

SEQ ID NO: 46450 - DNA, 70 bp, Artificial Sequence
  Synthetic
gccaagcatttaggtgacactatagtcaggtctctggggcctcacgtttcagagctatgctggaaacagc

SEQ ID NO: 46451 - DNA, 70 bp, Artificial Sequence
  Synthetic
gccaagcatttaggtgacactataggaaaatgctctcttcatcaggtttcagagctatgctggaaacagc

SEQ ID NO: 46452 - DNA, 70 bp, Artificial Sequence
  Synthetic
gccaagcatttaggtgacactataggatgatgtcccgacattagagtttcagagctatgctggaaacagc

SEQ ID NO: 46453 - DNA, 70 bp, Artificial Sequence
  Synthetic
gccaagcatttaggtgacactatagaagttttgcgatgaatagcagtttcagagctatgctggaaacagc

SEQ ID NO: 46454 - DNA, 70 bp, Artificial Sequence
  Synthetic
gccaagcatttaggtgacactataggtccgtgtgctagagaaactgtttcagagctatgctggaaacagc

SEQ ID NO: 46455 - DNA, 70 bp, Artificial Sequence
  Synthetic
gccaagcatttaggtgacactatagtacgacatgactccaaacacgtttcagagctatgctggaaacagc

SEQ ID NO: 46456 - DNA, 70 bp, Artificial Sequence
  Synthetic
gccaagcatttaggtgacactatagctaggacatgactccaaagagtttcagagctatgctggaaacagc

SEQ ID NO: 46457 - DNA, 70 bp, Artificial Sequence
  Synthetic
gccaagcatttaggtgacactatagtgtcgcccaggccagaatgcgtttcagagctatgctggaaacagc

SEQ ID NO: 46458 - DNA, 70 bp, Artificial Sequence
  Synthetic
gccaagcatttaggtgacactatagcaatgaaatggaggtgacaggtttcagagctatgctggaaacagc

SEQ ID NO: 46459 - DNA, 70 bp, Artificial Sequence
  Synthetic
gccaagcatttaggtgacactatagtataccaagcttggctacgcgtttcagagctatgctggaaacagc

SEQ ID NO: 46460 - DNA, 70 bp, Artificial Sequence
  Synthetic
gccaagcatttaggtgacactatagtggaggtggtgctggtgagcgtttcagagctatgctggaaacagc

SEQ ID NO: 46461 - DNA, 70 bp, Artificial Sequence
  Synthetic
gccaagcatttaggtgacactatagattacttatgcctgggaagggtttcagagctatgctggaaacagc

SEQ ID NO: 46462 - DNA, 70 bp, Artificial Sequence
  Synthetic
gccaagcatttaggtgacactataggctgcgtttgtgtggtgaatgtttcagagctatgctggaaacagc

SEQ ID NO: 46463 - DNA, 70 bp, Artificial Sequence
  Synthetic
gccaagcatttaggtgacactatagggacatctgtggttcaaagagtttcagagctatgctggaaacagc

SEQ ID NO: 46464 - DNA, 70 bp, Artificial Sequence
  Synthetic
gccaagcatttaggtgacactatagtgcagagaagatgcttctgagtttcagagctatgctggaaacagc

SEQ ID NO: 46465 - DNA, 70 bp, Artificial Sequence
  Synthetic
gccaagcatttaggtgacactataggcatctttggtgtactatgtgtttcagagctatgctggaaacagc

SEQ ID NO: 46466 - DNA, 70 bp, Artificial Sequence
  Synthetic
gccaagcatttaggtgacactatagagtcagttttcaatttgtcggtttcagagctatgctggaaacagc

SEQ ID NO: 46467 - DNA, 70 bp, Artificial Sequence
  Synthetic
gccaagcatttaggtgacactatagcctctcccagctcagcgtgcgtttcagagctatgctggaaacagc

SEQ ID NO: 46468 - DNA, 70 bp, Artificial Sequence
  Synthetic
gccaagcatttaggtgacactatagtcttaatacgaagagcagttgtttcagagctatgctggaaacagc

SEQ ID NO: 46469 - DNA, 70 bp, Artificial Sequence
  Synthetic
gccaagcatttaggtgacactatagcatagactagattctttggggtttcagagctatgctggaaacagc

SEQ ID NO: 46470 - DNA, 70 bp, Artificial Sequence
  Synthetic
gccaagcatttaggtgacactataggcttagatgcttgactctttgtttcagagctatgctggaaacagc

SEQ ID NO: 46471 - DNA, 70 bp, Artificial Sequence
  Synthetic
gccaagcatttaggtgacactatagctgggctattgaatcactttgtttcagagctatgctggaaacagc

SEQ ID NO: 46472 - DNA, 70 bp, Artificial Sequence
  Synthetic
gccaagcatttaggtgacactatagttccagggctcagctgtcacgtttcagagctatgctggaaacagc

SEQ ID NO: 46473 - DNA, 70 bp, Artificial Sequence
  Synthetic
gccaagcatttaggtgacactatagtgtgtcttgggttaggaagcgtttcagagctatgctggaaacagc

SEQ ID NO: 46474 - DNA, 70 bp, Artificial Sequence
  Synthetic
gccaagcatttaggtgacactataggctttgtcgatgtgtgatttgtttcagagctatgctggaaacagc

SEQ ID NO: 46475 - DNA, 70 bp, Artificial Sequence
  Synthetic
gccaagcatttaggtgacactatagagagtattcaagcttagagagtttcagagctatgctggaaacagc

SEQ ID NO: 46476 - DNA, 70 bp, Artificial Sequence
  Synthetic
gccaagcatttaggtgacactatagattcatcagctccggaagctgtttcagagctatgctggaaacagc

SEQ ID NO: 46477 - DNA, 70 bp, Artificial Sequence
  Synthetic
gccaagcatttaggtgacactatagcagaccactgcactccagcagtttcagagctatgctggaaacagc

SEQ ID NO: 46478 - DNA, 70 bp, Artificial Sequence
  Synthetic
gccaagcatttaggtgacactatagtggaggagtggcgtcttcaggtttcagagctatgctggaaacagc

SEQ ID NO: 46479 - DNA, 70 bp, Artificial Sequence
  Synthetic
gccaagcatttaggtgacactataggcagatgtggctacaaagtggtttcagagctatgctggaaacagc

SEQ ID NO: 46480 - DNA, 70 bp, Artificial Sequence
  Synthetic
gccaagcatttaggtgacactataggcagggagatttcacaatccgtttcagagctatgctggaaacagc

SEQ ID NO: 46481 - DNA, 70 bp, Artificial Sequence
  Synthetic
gccaagcatttaggtgacactatagtttctgaatttgcccaccaggtttcagagctatgctggaaacagc

SEQ ID NO: 46482 - DNA, 70 bp, Artificial Sequence
  Synthetic
gccaagcatttaggtgacactataggggagagacagagagtcatcgtttcagagctatgctggaaacagc

SEQ ID NO: 46483 - DNA, 70 bp, Artificial Sequence
  Synthetic
gccaagcatttaggtgacactatagtatgtaacactctgggcttcgtttcagagctatgctggaaacagc

SEQ ID NO: 46484 - DNA, 70 bp, Artificial Sequence
  Synthetic
gccaagcatttaggtgacactatagccccgagagagttatcaaatgtttcagagctatgctggaaacagc

SEQ ID NO: 46485 - DNA, 70 bp, Artificial Sequence
  Synthetic
gccaagcatttaggtgacactataggggtggcacttaggcccctcgtttcagagctatgctggaaacagc

SEQ ID NO: 46486 - DNA, 70 bp, Artificial Sequence
  Synthetic
gccaagcatttaggtgacactatagggctcagatgagtgtcagtggtttcagagctatgctggaaacagc

SEQ ID NO: 46487 - DNA, 70 bp, Artificial Sequence
  Synthetic
gccaagcatttaggtgacactataggtcggcttctcacttaatatgtttcagagctatgctggaaacagc

SEQ ID NO: 46488 - DNA, 70 bp, Artificial Sequence
  Synthetic
gccaagcatttaggtgacactatagggaacctccggagaggtcaggtttcagagctatgctggaaacagc

SEQ ID NO: 46489 - DNA, 70 bp, Artificial Sequence
  Synthetic
gccaagcatttaggtgacactatagggctggaatcccgcccctaggtttcagagctatgctggaaacagc

SEQ ID NO: 46490 - DNA, 70 bp, Artificial Sequence
  Synthetic
gccaagcatttaggtgacactataggggcaagaccaggtgtgagagtttcagagctatgctggaaacagc

SEQ ID NO: 46491 - DNA, 70 bp, Artificial Sequence
  Synthetic
gccaagcatttaggtgacactatagattctgacgctgcagtttaagtttcagagctatgctggaaacagc

SEQ ID NO: 46492 - DNA, 70 bp, Artificial Sequence
  Synthetic
gccaagcatttaggtgacactatagacagtcacctgtgagtttaagtttcagagctatgctggaaacagc

SEQ ID NO: 46493 - DNA, 70 bp, Artificial Sequence
  Synthetic
gccaagcatttaggtgacactataggtatcagaaagcgatgacgtgtttcagagctatgctggaaacagc

SEQ ID NO: 46494 - DNA, 70 bp, Artificial Sequence
  Synthetic
gccaagcatttaggtgacactatagacagatcacagagggctggagtttcagagctatgctggaaacagc

SEQ ID NO: 46495 - DNA, 70 bp, Artificial Sequence
  Synthetic
gccaagcatttaggtgacactatagagtgaacctaaagggtagtcgtttcagagctatgctggaaacagc

SEQ ID NO: 46496 - DNA, 70 bp, Artificial Sequence
  Synthetic
gccaagcatttaggtgacactatagactattgtgccttcttccttgtttcagagctatgctggaaacagc

SEQ ID NO: 46497 - DNA, 70 bp, Artificial Sequence
  Synthetic
gccaagcatttaggtgacactataggaaactaaggctcattcatcgtttcagagctatgctggaaacagc

SEQ ID NO: 46498 - DNA, 70 bp, Artificial Sequence
  Synthetic
gccaagcatttaggtgacactatagaagtgaaccgacaaagtgccgtttcagagctatgctggaaacagc

SEQ ID NO: 46499 - DNA, 70 bp, Artificial Sequence
  Synthetic
gccaagcatttaggtgacactatagaggaagcggagtttcacatcgtttcagagctatgctggaaacagc

SEQ ID NO: 46500 - DNA, 70 bp, Artificial Sequence
  Synthetic
gccaagcatttaggtgacactatagtactcagttgaattagaccggtttcagagctatgctggaaacagc

SEQ ID NO: 46501 - DNA, 70 bp, Artificial Sequence
  Synthetic
gccaagcatttaggtgacactatagtccagcgcagctgattcagagtttcagagctatgctggaaacagc

SEQ ID NO: 46502 - DNA, 70 bp, Artificial Sequence
  Synthetic
gccaagcatttaggtgacactatagtagctgttgcttcatgctttgtttcagagctatgctggaaacagc

SEQ ID NO: 46503 - DNA, 70 bp, Artificial Sequence
  Synthetic
gccaagcatttaggtgacactatagtttcccctgtgcatgtgcgagtttcagagctatgctggaaacagc

SEQ ID NO: 46504 - DNA, 70 bp, Artificial Sequence
  Synthetic
gccaagcatttaggtgacactatagcaactgaggttggctctagggtttcagagctatgctggaaacagc

SEQ ID NO: 46505 - DNA, 70 bp, Artificial Sequence
  Synthetic
gccaagcatttaggtgacactatagtttcttgacactctttgcttgtttcagagctatgctggaaacagc

SEQ ID NO: 46506 - DNA, 70 bp, Artificial Sequence
  Synthetic
gccaagcatttaggtgacactatagttgggtactgtcctgtgattgtttcagagctatgctggaaacagc

SEQ ID NO: 46507 - DNA, 70 bp, Artificial Sequence
  Synthetic
gccaagcatttaggtgacactatagaagatcctgcctctggtgaggtttcagagctatgctggaaacagc

SEQ ID NO: 46508 - DNA, 70 bp, Artificial Sequence
  Synthetic
gccaagcatttaggtgacactatagcctgcaagtaaagattcaaggtttcagagctatgctggaaacagc

SEQ ID NO: 46509 - DNA, 70 bp, Artificial Sequence
  Synthetic
gccaagcatttaggtgacactatagggccaaccctggtccagctggtttcagagctatgctggaaacagc

SEQ ID NO: 46510 - DNA, 70 bp, Artificial Sequence
  Synthetic
gccaagcatttaggtgacactataggctcccacagcaccctaggggtttcagagctatgctggaaacagc

SEQ ID NO: 46511 - DNA, 70 bp, Artificial Sequence
  Synthetic
gccaagcatttaggtgacactataggtgagggaactatataaagggtttcagagctatgctggaaacagc

SEQ ID NO: 46512 - DNA, 70 bp, Artificial Sequence
  Synthetic
gccaagcatttaggtgacactatagaagcctggaactgattgcgggtttcagagctatgctggaaacagc

SEQ ID NO: 46513 - DNA, 70 bp, Artificial Sequence
  Synthetic
gccaagcatttaggtgacactatagaatggcagaatgcagttaaggtttcagagctatgctggaaacagc

SEQ ID NO: 46514 - DNA, 70 bp, Artificial Sequence
  Synthetic
gccaagcatttaggtgacactataggggtgccgcgcgccccctaggtttcagagctatgctggaaacagc

SEQ ID NO: 46515 - DNA, 70 bp, Artificial Sequence
  Synthetic
gccaagcatttaggtgacactatagcaaaacagattcttcaacccgtttcagagctatgctggaaacagc

SEQ ID NO: 46516 - DNA, 70 bp, Artificial Sequence
  Synthetic
gccaagcatttaggtgacactatagcccaaaggcaaagaaggcaagtttcagagctatgctggaaacagc

SEQ ID NO: 46517 - DNA, 70 bp, Artificial Sequence
  Synthetic
gccaagcatttaggtgacactatagagggaaaggaaggaacctgagtttcagagctatgctggaaacagc

SEQ ID NO: 46518 - DNA, 70 bp, Artificial Sequence
  Synthetic
gccaagcatttaggtgacactatagcagggcacagctcatgtcacgtttcagagctatgctggaaacagc

SEQ ID NO: 46519 - DNA, 70 bp, Artificial Sequence
  Synthetic
gccaagcatttaggtgacactataggtcctgaggccgtgctgagtgtttcagagctatgctggaaacagc

SEQ ID NO: 46520 - DNA, 70 bp, Artificial Sequence
  Synthetic
gccaagcatttaggtgacactatagtctaagtccaacttgtgagtgtttcagagctatgctggaaacagc

SEQ ID NO: 46521 - DNA, 70 bp, Artificial Sequence
  Synthetic
gccaagcatttaggtgacactataggggactgcgtgtcacgagttgtttcagagctatgctggaaacagc

SEQ ID NO: 46522 - DNA, 70 bp, Artificial Sequence
  Synthetic
gccaagcatttaggtgacactatagaatgctgcaagtcatgcacagtttcagagctatgctggaaacagc

SEQ ID NO: 46523 - DNA, 70 bp, Artificial Sequence
  Synthetic
gccaagcatttaggtgacactatagaactcttctgctgcagctttgtttcagagctatgctggaaacagc

SEQ ID NO: 46524 - DNA, 70 bp, Artificial Sequence
  Synthetic
gccaagcatttaggtgacactatagcaaggtaggtggatcgcctggtttcagagctatgctggaaacagc

SEQ ID NO: 46525 - DNA, 70 bp, Artificial Sequence
  Synthetic
gccaagcatttaggtgacactatagatgcggaagaaagagatgctgtttcagagctatgctggaaacagc

SEQ ID NO: 46526 - DNA, 70 bp, Artificial Sequence
  Synthetic
gccaagcatttaggtgacactatagtgtcttcctcacatgactacgtttcagagctatgctggaaacagc

SEQ ID NO: 46527 - DNA, 70 bp, Artificial Sequence
  Synthetic
gccaagcatttaggtgacactatagactttctcatctttctaagggtttcagagctatgctggaaacagc

SEQ ID NO: 46528 - DNA, 70 bp, Artificial Sequence
  Synthetic
gccaagcatttaggtgacactatagctgccctgggaggcagtgatgtttcagagctatgctggaaacagc

SEQ ID NO: 46529 - DNA, 70 bp, Artificial Sequence
  Synthetic
gccaagcatttaggtgacactatagggcggcgcccctgggcgggcgtttcagagctatgctggaaacagc

SEQ ID NO: 46530 - DNA, 70 bp, Artificial Sequence
  Synthetic
gccaagcatttaggtgacactatagaagcattgcttaaacgcagagtttcagagctatgctggaaacagc

SEQ ID NO: 46531 - DNA, 70 bp, Artificial Sequence
  Synthetic
gccaagcatttaggtgacactatagtttctgtgggtcagtgtcctgtttcagagctatgctggaaacagc

SEQ ID NO: 46532 - DNA, 70 bp, Artificial Sequence
  Synthetic
gccaagcatttaggtgacactataggtgcatcctggcgcagtcaggtttcagagctatgctggaaacagc

SEQ ID NO: 46533 - DNA, 70 bp, Artificial Sequence
  Synthetic
gccaagcatttaggtgacactatagcccctgcccccctgaatcacgtttcagagctatgctggaaacagc

SEQ ID NO: 46534 - DNA, 70 bp, Artificial Sequence
  Synthetic
gccaagcatttaggtgacactataggctataaaactcgcacctccgtttcagagctatgctggaaacagc

SEQ ID NO: 46535 - DNA, 70 bp, Artificial Sequence
  Synthetic
gccaagcatttaggtgacactatagctgtgcttttacaacttacggtttcagagctatgctggaaacagc

SEQ ID NO: 46536 - DNA, 70 bp, Artificial Sequence
  Synthetic
gccaagcatttaggtgacactatagtctcgctgctgtggaacttggtttcagagctatgctggaaacagc

SEQ ID NO: 46537 - DNA, 70 bp, Artificial Sequence
  Synthetic
gccaagcatttaggtgacactataggcagctgccgggcctaggaggtttcagagctatgctggaaacagc

SEQ ID NO: 46538 - DNA, 70 bp, Artificial Sequence
  Synthetic
gccaagcatttaggtgacactatagagagggataaacctttggaggtttcagagctatgctggaaacagc

SEQ ID NO: 46539 - DNA, 70 bp, Artificial Sequence
  Synthetic
gccaagcatttaggtgacactatagtgctgccagtcatgtcaagagtttcagagctatgctggaaacagc

SEQ ID NO: 46540 - DNA, 70 bp, Artificial Sequence
  Synthetic
gccaagcatttaggtgacactatagccccaggatccctcctgaaagtttcagagctatgctggaaacagc

SEQ ID NO: 46541 - DNA, 70 bp, Artificial Sequence
  Synthetic
gccaagcatttaggtgacactatagacaagtttattgagctatgcgtttcagagctatgctggaaacagc

SEQ ID NO: 46542 - DNA, 70 bp, Artificial Sequence
  Synthetic
gccaagcatttaggtgacactataggctcctgcaggggctcagccgtttcagagctatgctggaaacagc

SEQ ID NO: 46543 - DNA, 70 bp, Artificial Sequence
  Synthetic
gccaagcatttaggtgacactatagggacaggcccatgctgccccgtttcagagctatgctggaaacagc

SEQ ID NO: 46544 - DNA, 70 bp, Artificial Sequence
  Synthetic
gccaagcatttaggtgacactatagcagagagtggccgcagcagcgtttcagagctatgctggaaacagc

SEQ ID NO: 46545 - DNA, 70 bp, Artificial Sequence
  Synthetic
gccaagcatttaggtgacactataggtcactggagcatactatacgtttcagagctatgctggaaacagc

SEQ ID NO: 46546 - DNA, 70 bp, Artificial Sequence
  Synthetic
gccaagcatttaggtgacactatagaaaggagtaccaggccgccagtttcagagctatgctggaaacagc

SEQ ID NO: 46547 - DNA, 70 bp, Artificial Sequence
  Synthetic
gccaagcatttaggtgacactatagcttggactcatggtacacgtgtttcagagctatgctggaaacagc

SEQ ID NO: 46548 - DNA, 70 bp, Artificial Sequence
  Synthetic
gccaagcatttaggtgacactatagttctcactcacgccctgaccgtttcagagctatgctggaaacagc

SEQ ID NO: 46549 - DNA, 70 bp, Artificial Sequence
  Synthetic
gccaagcatttaggtgacactataggcagtttctactgactctctgtttcagagctatgctggaaacagc

SEQ ID NO: 46550 - DNA, 70 bp, Artificial Sequence
  Synthetic
gccaagcatttaggtgacactatagtatcaccagttcaagtgagagtttcagagctatgctggaaacagc

SEQ ID NO: 46551 - DNA, 70 bp, Artificial Sequence
  Synthetic
gccaagcatttaggtgacactatagatatcgggctgaggaagcaggtttcagagctatgctggaaacagc

SEQ ID NO: 46552 - DNA, 70 bp, Artificial Sequence
  Synthetic
gccaagcatttaggtgacactatagctggctggaccccgacacgtgtttcagagctatgctggaaacagc

SEQ ID NO: 46553 - DNA, 70 bp, Artificial Sequence
  Synthetic
gccaagcatttaggtgacactataggttccctgctccactctgaggtttcagagctatgctggaaacagc

SEQ ID NO: 46554 - DNA, 70 bp, Artificial Sequence
  Synthetic
gccaagcatttaggtgacactatagccagtgtgccccccgtgatggtttcagagctatgctggaaacagc

SEQ ID NO: 46555 - DNA, 70 bp, Artificial Sequence
  Synthetic
gccaagcatttaggtgacactatagtaccagtacctggagacctagtttcagagctatgctggaaacagc

SEQ ID NO: 46556 - DNA, 70 bp, Artificial Sequence
  Synthetic
gccaagcatttaggtgacactatagcagctgggaaggaggcttaggtttcagagctatgctggaaacagc

SEQ ID NO: 46557 - DNA, 70 bp, Artificial Sequence
  Synthetic
gccaagcatttaggtgacactatagtggtctcccaccctgcaacggtttcagagctatgctggaaacagc

SEQ ID NO: 46558 - DNA, 70 bp, Artificial Sequence
  Synthetic
gccaagcatttaggtgacactatagcctgatgagagctaataccggtttcagagctatgctggaaacagc

SEQ ID NO: 46559 - DNA, 70 bp, Artificial Sequence
  Synthetic
gccaagcatttaggtgacactataggtccctttcccagagcaacggtttcagagctatgctggaaacagc

SEQ ID NO: 46560 - DNA, 70 bp, Artificial Sequence
  Synthetic
gccaagcatttaggtgacactatagggtggtggacaactcctgaagtttcagagctatgctggaaacagc

SEQ ID NO: 46561 - DNA, 70 bp, Artificial Sequence
  Synthetic
gccaagcatttaggtgacactatagggcgagtgcaatctcagcctgtttcagagctatgctggaaacagc

SEQ ID NO: 46562 - DNA, 70 bp, Artificial Sequence
  Synthetic
gccaagcatttaggtgacactataggccaacagctgctaactgaggtttcagagctatgctggaaacagc

SEQ ID NO: 46563 - DNA, 70 bp, Artificial Sequence
  Synthetic
gccaagcatttaggtgacactataggggggccccagcagttaacagtttcagagctatgctggaaacagc

SEQ ID NO: 46564 - DNA, 70 bp, Artificial Sequence
  Synthetic
gccaagcatttaggtgacactatagaggggctggggctgaactgagtttcagagctatgctggaaacagc

SEQ ID NO: 46565 - DNA, 70 bp, Artificial Sequence
  Synthetic
gccaagcatttaggtgacactatagtgaagtgagctcatttaaacgtttcagagctatgctggaaacagc

SEQ ID NO: 46566 - DNA, 70 bp, Artificial Sequence
  Synthetic
gccaagcatttaggtgacactataggagcctggagcccaggctgagtttcagagctatgctggaaacagc

SEQ ID NO: 46567 - DNA, 70 bp, Artificial Sequence
  Synthetic
gccaagcatttaggtgacactataggtttcaaagagtgtgtgagggtttcagagctatgctggaaacagc

SEQ ID NO: 46568 - DNA, 70 bp, Artificial Sequence
  Synthetic
gccaagcatttaggtgacactatagagggaagaggtataaacaaagtttcagagctatgctggaaacagc

SEQ ID NO: 46569 - DNA, 70 bp, Artificial Sequence
  Synthetic
gccaagcatttaggtgacactatagggaggggagcatggctcagggtttcagagctatgctggaaacagc

SEQ ID NO: 46570 - DNA, 70 bp, Artificial Sequence
  Synthetic
gccaagcatttaggtgacactatagactcccatcaagctggaggagtttcagagctatgctggaaacagc

SEQ ID NO: 46571 - DNA, 70 bp, Artificial Sequence
  Synthetic
gccaagcatttaggtgacactatagcttcttgctcttcttcagaagtttcagagctatgctggaaacagc

SEQ ID NO: 46572 - DNA, 70 bp, Artificial Sequence
  Synthetic
gccaagcatttaggtgacactatagaggtgggtatgaggactcaggtttcagagctatgctggaaacagc

SEQ ID NO: 46573 - DNA, 70 bp, Artificial Sequence
  Synthetic
gccaagcatttaggtgacactataggacttggaaggagagactaagtttcagagctatgctggaaacagc

SEQ ID NO: 46574 - DNA, 70 bp, Artificial Sequence
  Synthetic
gccaagcatttaggtgacactataggagcaaaaagaaggagaaaggtttcagagctatgctggaaacagc

SEQ ID NO: 46575 - DNA, 70 bp, Artificial Sequence
  Synthetic
gccaagcatttaggtgacactatagttttcagaaaagaaggagtggtttcagagctatgctggaaacagc

SEQ ID NO: 46576 - DNA, 70 bp, Artificial Sequence
  Synthetic
gccaagcatttaggtgacactatagtttttctgtgtgtcaggagcgtttcagagctatgctggaaacagc

SEQ ID NO: 46577 - DNA, 70 bp, Artificial Sequence
  Synthetic
gccaagcatttaggtgacactatagaacgaaactactgtgtagatgtttcagagctatgctggaaacagc

SEQ ID NO: 46578 - DNA, 70 bp, Artificial Sequence
  Synthetic
gccaagcatttaggtgacactatagagcgaaactaccgtctaagggtttcagagctatgctggaaacagc

SEQ ID NO: 46579 - DNA, 70 bp, Artificial Sequence
  Synthetic
gccaagcatttaggtgacactataggcaatgttaggactggattagtttcagagctatgctggaaacagc

SEQ ID NO: 46580 - DNA, 70 bp, Artificial Sequence
  Synthetic
gccaagcatttaggtgacactatagctccagaccgaggtctgagcgtttcagagctatgctggaaacagc

SEQ ID NO: 46581 - DNA, 70 bp, Artificial Sequence
  Synthetic
gccaagcatttaggtgacactataggtggcactcacacctctgtcgtttcagagctatgctggaaacagc

SEQ ID NO: 46582 - DNA, 70 bp, Artificial Sequence
  Synthetic
gccaagcatttaggtgacactatagttgcctctggatgtgcaagagtttcagagctatgctggaaacagc

SEQ ID NO: 46583 - DNA, 70 bp, Artificial Sequence
  Synthetic
gccaagcatttaggtgacactataggacctgtcagccgtgtgagcgtttcagagctatgctggaaacagc

SEQ ID NO: 46584 - DNA, 70 bp, Artificial Sequence
  Synthetic
gccaagcatttaggtgacactatagcatgccatccgcttccaagagtttcagagctatgctggaaacagc

SEQ ID NO: 46585 - DNA, 70 bp, Artificial Sequence
  Synthetic
gccaagcatttaggtgacactatagtgacacctccaaacccagcagtttcagagctatgctggaaacagc

SEQ ID NO: 46586 - DNA, 70 bp, Artificial Sequence
  Synthetic
gccaagcatttaggtgacactatagtattttctcttcacttgtccgtttcagagctatgctggaaacagc

SEQ ID NO: 46587 - DNA, 70 bp, Artificial Sequence
  Synthetic
gccaagcatttaggtgacactatagcatcagagtccggcatatgagtttcagagctatgctggaaacagc

SEQ ID NO: 46588 - DNA, 70 bp, Artificial Sequence
  Synthetic
gccaagcatttaggtgacactatagctgagttagcatgatgttgtgtttcagagctatgctggaaacagc

SEQ ID NO: 46589 - DNA, 70 bp, Artificial Sequence
  Synthetic
gccaagcatttaggtgacactatagtgtgccattgcactccaactgtttcagagctatgctggaaacagc

SEQ ID NO: 46590 - DNA, 70 bp, Artificial Sequence
  Synthetic
gccaagcatttaggtgacactatagagaggctactcaaccctttagtttcagagctatgctggaaacagc

SEQ ID NO: 46591 - DNA, 70 bp, Artificial Sequence
  Synthetic
gccaagcatttaggtgacactataggagaaagcctagttctcaccgtttcagagctatgctggaaacagc

SEQ ID NO: 46592 - DNA, 70 bp, Artificial Sequence
  Synthetic
gccaagcatttaggtgacactatagtggccctcctcagaggacatgtttcagagctatgctggaaacagc

SEQ ID NO: 46593 - DNA, 70 bp, Artificial Sequence
  Synthetic
gccaagcatttaggtgacactatagaaggaggaagcgacactgccgtttcagagctatgctggaaacagc

SEQ ID NO: 46594 - DNA, 70 bp, Artificial Sequence
  Synthetic
gccaagcatttaggtgacactataggcatcactaggcccaaccaagtttcagagctatgctggaaacagc

SEQ ID NO: 46595 - DNA, 70 bp, Artificial Sequence
  Synthetic
gccaagcatttaggtgacactataggttgagcaacgaagaagcacgtttcagagctatgctggaaacagc

SEQ ID NO: 46596 - DNA, 70 bp, Artificial Sequence
  Synthetic
gccaagcatttaggtgacactataggtgggctggaggcctagatggtttcagagctatgctggaaacagc

SEQ ID NO: 46597 - DNA, 70 bp, Artificial Sequence
  Synthetic
gccaagcatttaggtgacactatagctcagaaggacttcaaagcggtttcagagctatgctggaaacagc

SEQ ID NO: 46598 - DNA, 70 bp, Artificial Sequence
  Synthetic
gccaagcatttaggtgacactatagtccgcatctcaagaataggagtttcagagctatgctggaaacagc

SEQ ID NO: 46599 - DNA, 70 bp, Artificial Sequence
  Synthetic
gccaagcatttaggtgacactatagcaacttcacaaatcaaggaggtttcagagctatgctggaaacagc

SEQ ID NO: 46600 - DNA, 70 bp, Artificial Sequence
  Synthetic
gccaagcatttaggtgacactatagaccgtagagcgagtttaagagtttcagagctatgctggaaacagc

SEQ ID NO: 46601 - DNA, 70 bp, Artificial Sequence
  Synthetic
gccaagcatttaggtgacactatagtcccaaacaacacagtagtcgtttcagagctatgctggaaacagc

SEQ ID NO: 46602 - DNA, 70 bp, Artificial Sequence
  Synthetic
gccaagcatttaggtgacactatagaaactttgtgctgtggctgagtttcagagctatgctggaaacagc

SEQ ID NO: 46603 - DNA, 70 bp, Artificial Sequence
  Synthetic
gccaagcatttaggtgacactatagtcaaaactggcccatgctgagtttcagagctatgctggaaacagc

SEQ ID NO: 46604 - DNA, 70 bp, Artificial Sequence
  Synthetic
gccaagcatttaggtgacactatagctctgaaagtgacaatgcaagtttcagagctatgctggaaacagc

SEQ ID NO: 46605 - DNA, 70 bp, Artificial Sequence
  Synthetic
gccaagcatttaggtgacactatagagctggtcaccagtctctgagtttcagagctatgctggaaacagc

SEQ ID NO: 46606 - DNA, 70 bp, Artificial Sequence
  Synthetic
gccaagcatttaggtgacactatagagcacttcaacacttaatcagtttcagagctatgctggaaacagc

SEQ ID NO: 46607 - DNA, 70 bp, Artificial Sequence
  Synthetic
gccaagcatttaggtgacactataggtctgtctgctcaggctatcgtttcagagctatgctggaaacagc

SEQ ID NO: 46608 - DNA, 70 bp, Artificial Sequence
  Synthetic
gccaagcatttaggtgacactatagtagagaaggacaaatgcagcgtttcagagctatgctggaaacagc

SEQ ID NO: 46609 - DNA, 70 bp, Artificial Sequence
  Synthetic
gccaagcatttaggtgacactatagtcgctattcctctggcacacgtttcagagctatgctggaaacagc

SEQ ID NO: 46610 - DNA, 70 bp, Artificial Sequence
  Synthetic
gccaagcatttaggtgacactatagttcaaaaggaccggctcattgtttcagagctatgctggaaacagc

SEQ ID NO: 46611 - DNA, 70 bp, Artificial Sequence
  Synthetic
gccaagcatttaggtgacactatagttgccatggttaccattcaggtttcagagctatgctggaaacagc

SEQ ID NO: 46612 - DNA, 70 bp, Artificial Sequence
  Synthetic
gccaagcatttaggtgacactatagaaaaatgtcccctgttgtttgtttcagagctatgctggaaacagc

SEQ ID NO: 46613 - DNA, 70 bp, Artificial Sequence
  Synthetic
gccaagcatttaggtgacactatagaatggttagtgaggtgctacgtttcagagctatgctggaaacagc

SEQ ID NO: 46614 - DNA, 70 bp, Artificial Sequence
  Synthetic
gccaagcatttaggtgacactataggatttgacctgcttcactctgtttcagagctatgctggaaacagc

SEQ ID NO: 46615 - DNA, 70 bp, Artificial Sequence
  Synthetic
gccaagcatttaggtgacactatagcgtaccgtcctgacgttttggtttcagagctatgctggaaacagc

SEQ ID NO: 46616 - DNA, 70 bp, Artificial Sequence
  Synthetic
gccaagcatttaggtgacactatagattgtttcaaaacgtcaggagtttcagagctatgctggaaacagc

SEQ ID NO: 46617 - DNA, 70 bp, Artificial Sequence
  Synthetic
gccaagcatttaggtgacactatagcctggcatcttcaaaagatggtttcagagctatgctggaaacagc

SEQ ID NO: 46618 - DNA, 70 bp, Artificial Sequence
  Synthetic
gccaagcatttaggtgacactataggcctttgaactgatgcattcgtttcagagctatgctggaaacagc

SEQ ID NO: 46619 - DNA, 70 bp, Artificial Sequence
  Synthetic
gccaagcatttaggtgacactatagcagacagcacatccctaaacgtttcagagctatgctggaaacagc

SEQ ID NO: 46620 - DNA, 70 bp, Artificial Sequence
  Synthetic
gccaagcatttaggtgacactatagactttggatctcaaaacgtcgtttcagagctatgctggaaacagc

SEQ ID NO: 46621 - DNA, 70 bp, Artificial Sequence
  Synthetic
gccaagcatttaggtgacactatagtccccagtcagaagaggatcgtttcagagctatgctggaaacagc

SEQ ID NO: 46622 - DNA, 70 bp, Artificial Sequence
  Synthetic
gccaagcatttaggtgacactatagtcccaggcagcactgctagggtttcagagctatgctggaaacagc

SEQ ID NO: 46623 - DNA, 70 bp, Artificial Sequence
  Synthetic
gccaagcatttaggtgacactatagctctggaggctttcacatgtgtttcagagctatgctggaaacagc

SEQ ID NO: 46624 - DNA, 70 bp, Artificial Sequence
  Synthetic
gccaagcatttaggtgacactatagctgagttagtggtgatcagtgtttcagagctatgctggaaacagc

SEQ ID NO: 46625 - DNA, 70 bp, Artificial Sequence
  Synthetic
gccaagcatttaggtgacactatagcaggtgggaaggctcagagagtttcagagctatgctggaaacagc

SEQ ID NO: 46626 - DNA, 70 bp, Artificial Sequence
  Synthetic
gccaagcatttaggtgacactatagcggcgggggctgcagtgaaggtttcagagctatgctggaaacagc

SEQ ID NO: 46627 - DNA, 70 bp, Artificial Sequence
  Synthetic
gccaagcatttaggtgacactatagagtctccctgctgtcatttcgtttcagagctatgctggaaacagc

SEQ ID NO: 46628 - DNA, 70 bp, Artificial Sequence
  Synthetic
gccaagcatttaggtgacactataggttttcagctcttccatcaggtttcagagctatgctggaaacagc

SEQ ID NO: 46629 - DNA, 70 bp, Artificial Sequence
  Synthetic
gccaagcatttaggtgacactatagaagtgctccccactttctttgtttcagagctatgctggaaacagc

SEQ ID NO: 46630 - DNA, 70 bp, Artificial Sequence
  Synthetic
gccaagcatttaggtgacactatagtgggacaggagggggagcgtgtttcagagctatgctggaaacagc

SEQ ID NO: 46631 - DNA, 70 bp, Artificial Sequence
  Synthetic
gccaagcatttaggtgacactatagtccccgggctgcgactaggtgtttcagagctatgctggaaacagc

SEQ ID NO: 46632 - DNA, 70 bp, Artificial Sequence
  Synthetic
gccaagcatttaggtgacactatagaacctggcacttaggcctgtgtttcagagctatgctggaaacagc

SEQ ID NO: 46633 - DNA, 70 bp, Artificial Sequence
  Synthetic
gccaagcatttaggtgacactatagcacaagccttctgtacttttgtttcagagctatgctggaaacagc

SEQ ID NO: 46634 - DNA, 70 bp, Artificial Sequence
  Synthetic
gccaagcatttaggtgacactatagctgggcgccagtggcttcaagtttcagagctatgctggaaacagc

SEQ ID NO: 46635 - DNA, 70 bp, Artificial Sequence
  Synthetic
gccaagcatttaggtgacactataggaaggcggggtctagtcatcgtttcagagctatgctggaaacagc

SEQ ID NO: 46636 - DNA, 70 bp, Artificial Sequence
  Synthetic
gccaagcatttaggtgacactatagcccctggcccaggatggagcgtttcagagctatgctggaaacagc

SEQ ID NO: 46637 - DNA, 70 bp, Artificial Sequence
  Synthetic
gccaagcatttaggtgacactataggaggcgagagcctagatcatgtttcagagctatgctggaaacagc

SEQ ID NO: 46638 - DNA, 70 bp, Artificial Sequence
  Synthetic
gccaagcatttaggtgacactatagctgccatccctctgattcttgtttcagagctatgctggaaacagc

SEQ ID NO: 46639 - DNA, 70 bp, Artificial Sequence
  Synthetic
gccaagcatttaggtgacactatagggaagtacaccctcactattgtttcagagctatgctggaaacagc

SEQ ID NO: 46640 - DNA, 70 bp, Artificial Sequence
  Synthetic
gccaagcatttaggtgacactatagtgaacatcacgtctccctaagtttcagagctatgctggaaacagc

SEQ ID NO: 46641 - DNA, 70 bp, Artificial Sequence
  Synthetic
gccaagcatttaggtgacactatagatggctttacttctcctctggtttcagagctatgctggaaacagc

SEQ ID NO: 46642 - DNA, 70 bp, Artificial Sequence
  Synthetic
gccaagcatttaggtgacactataggtcttccagaagagttgatggtttcagagctatgctggaaacagc

SEQ ID NO: 46643 - DNA, 70 bp, Artificial Sequence
  Synthetic
gccaagcatttaggtgacactatagaaaatgatgttgaaagggaggtttcagagctatgctggaaacagc

SEQ ID NO: 46644 - DNA, 70 bp, Artificial Sequence
  Synthetic
gccaagcatttaggtgacactatagatcaagcatccatctgactagtttcagagctatgctggaaacagc

SEQ ID NO: 46645 - DNA, 70 bp, Artificial Sequence
  Synthetic
gccaagcatttaggtgacactatagatgatgccaccgtggagaaagtttcagagctatgctggaaacagc

SEQ ID NO: 46646 - DNA, 70 bp, Artificial Sequence
  Synthetic
gccaagcatttaggtgacactataggccaccaggccgacgccaccgtttcagagctatgctggaaacagc

SEQ ID NO: 46647 - DNA, 70 bp, Artificial Sequence
  Synthetic
gccaagcatttaggtgacactatagggaaagacacctgtggggttgtttcagagctatgctggaaacagc

SEQ ID NO: 46648 - DNA, 70 bp, Artificial Sequence
  Synthetic
gccaagcatttaggtgacactataggggaagctggcttcatgtcagtttcagagctatgctggaaacagc

SEQ ID NO: 46649 - DNA, 70 bp, Artificial Sequence
  Synthetic
gccaagcatttaggtgacactatagtgagaacggggaggaagtctgtttcagagctatgctggaaacagc

SEQ ID NO: 46650 - DNA, 70 bp, Artificial Sequence
  Synthetic
gccaagcatttaggtgacactatagctggcgcccgggcagttttagtttcagagctatgctggaaacagc

SEQ ID NO: 46651 - DNA, 70 bp, Artificial Sequence
  Synthetic
gccaagcatttaggtgacactatagctacgggagaccgatatttagtttcagagctatgctggaaacagc

SEQ ID NO: 46652 - DNA, 70 bp, Artificial Sequence
  Synthetic
gccaagcatttaggtgacactataggacaggaagcggatcgtgtggtttcagagctatgctggaaacagc

SEQ ID NO: 46653 - DNA, 70 bp, Artificial Sequence
  Synthetic
gccaagcatttaggtgacactataggcagcgcaggcgggctcaccgtttcagagctatgctggaaacagc

SEQ ID NO: 46654 - DNA, 70 bp, Artificial Sequence
  Synthetic
gccaagcatttaggtgacactataggacggaggagaaggggcttcgtttcagagctatgctggaaacagc

SEQ ID NO: 46655 - DNA, 70 bp, Artificial Sequence
  Synthetic
gccaagcatttaggtgacactataggcctcggaatccaaggtgtagtttcagagctatgctggaaacagc

SEQ ID NO: 46656 - DNA, 70 bp, Artificial Sequence
  Synthetic
gccaagcatttaggtgacactatagataacattgattcacaaggggtttcagagctatgctggaaacagc

SEQ ID NO: 46657 - DNA, 70 bp, Artificial Sequence
  Synthetic
gccaagcatttaggtgacactatagggcttcttggggagtttcttgtttcagagctatgctggaaacagc

SEQ ID NO: 46658 - DNA, 70 bp, Artificial Sequence
  Synthetic
gccaagcatttaggtgacactataggacggcgcgtggctcagtccgtttcagagctatgctggaaacagc

SEQ ID NO: 46659 - DNA, 70 bp, Artificial Sequence
  Synthetic
gccaagcatttaggtgacactatagaccatatgaaagcgtgatgagtttcagagctatgctggaaacagc

SEQ ID NO: 46660 - DNA, 70 bp, Artificial Sequence
  Synthetic
gccaagcatttaggtgacactatagacacagacatatcaaatgcagtttcagagctatgctggaaacagc

SEQ ID NO: 46661 - DNA, 70 bp, Artificial Sequence
  Synthetic
gccaagcatttaggtgacactatagcagtctgtgactaaaacagcgtttcagagctatgctggaaacagc

SEQ ID NO: 46662 - DNA, 70 bp, Artificial Sequence
  Synthetic
gccaagcatttaggtgacactatagtgaggcagccacggaagaaggtttcagagctatgctggaaacagc

SEQ ID NO: 46663 - DNA, 70 bp, Artificial Sequence
  Synthetic
gccaagcatttaggtgacactataggacctacacagtgaactttggtttcagagctatgctggaaacagc

SEQ ID NO: 46664 - DNA, 70 bp, Artificial Sequence
  Synthetic
gccaagcatttaggtgacactatagcaaagatactgccttgctttgtttcagagctatgctggaaacagc

SEQ ID NO: 46665 - DNA, 70 bp, Artificial Sequence
  Synthetic
gccaagcatttaggtgacactatagtgccgcagaagaggttgaaggtttcagagctatgctggaaacagc

SEQ ID NO: 46666 - DNA, 70 bp, Artificial Sequence
  Synthetic
gccaagcatttaggtgacactatagcaggacagaaggaattgagagtttcagagctatgctggaaacagc

SEQ ID NO: 46667 - DNA, 70 bp, Artificial Sequence
  Synthetic
gccaagcatttaggtgacactatagggcgagaagtcggattagcagtttcagagctatgctggaaacagc

SEQ ID NO: 46668 - DNA, 70 bp, Artificial Sequence
  Synthetic
gccaagcatttaggtgacactatagaattgaagaacgggacctaggtttcagagctatgctggaaacagc

SEQ ID NO: 46669 - DNA, 70 bp, Artificial Sequence
  Synthetic
gccaagcatttaggtgacactatagatgggaaatgaagaagacctgtttcagagctatgctggaaacagc

SEQ ID NO: 46670 - DNA, 70 bp, Artificial Sequence
  Synthetic
gccaagcatttaggtgacactatagtcaggcaactgccaaactgtgtttcagagctatgctggaaacagc

SEQ ID NO: 46671 - DNA, 70 bp, Artificial Sequence
  Synthetic
gccaagcatttaggtgacactatagtcctttcttctcccattcctgtttcagagctatgctggaaacagc

SEQ ID NO: 46672 - DNA, 70 bp, Artificial Sequence
  Synthetic
gccaagcatttaggtgacactatagaaaattctagctgcccttaagtttcagagctatgctggaaacagc

SEQ ID NO: 46673 - DNA, 70 bp, Artificial Sequence
  Synthetic
gccaagcatttaggtgacactatagacgagaagctttcactttatgtttcagagctatgctggaaacagc

SEQ ID NO: 46674 - DNA, 70 bp, Artificial Sequence
  Synthetic
gccaagcatttaggtgacactatagggggctccattaaggtgtttgtttcagagctatgctggaaacagc

SEQ ID NO: 46675 - DNA, 70 bp, Artificial Sequence
  Synthetic
gccaagcatttaggtgacactatagcgatgcccacttgttgtagtgtttcagagctatgctggaaacagc

SEQ ID NO: 46676 - DNA, 70 bp, Artificial Sequence
  Synthetic
gccaagcatttaggtgacactatagaacagcgcccacctgtcatagtttcagagctatgctggaaacagc

SEQ ID NO: 46677 - DNA, 70 bp, Artificial Sequence
  Synthetic
gccaagcatttaggtgacactatagaagatatcaacttggcatccgtttcagagctatgctggaaacagc

SEQ ID NO: 46678 - DNA, 70 bp, Artificial Sequence
  Synthetic
gccaagcatttaggtgacactatagcaaaagtggcagttacttctgtttcagagctatgctggaaacagc

SEQ ID NO: 46679 - DNA, 70 bp, Artificial Sequence
  Synthetic
gccaagcatttaggtgacactatagcctccctctgggcctctagtgtttcagagctatgctggaaacagc

SEQ ID NO: 46680 - DNA, 70 bp, Artificial Sequence
  Synthetic
gccaagcatttaggtgacactatagtggcttcagttgccaattttgtttcagagctatgctggaaacagc

SEQ ID NO: 46681 - DNA, 70 bp, Artificial Sequence
  Synthetic
gccaagcatttaggtgacactatagccaagtatcgtcagaactacgtttcagagctatgctggaaacagc

SEQ ID NO: 46682 - DNA, 70 bp, Artificial Sequence
  Synthetic
gccaagcatttaggtgacactatagtcaaaaactcgtgctgctttgtttcagagctatgctggaaacagc

SEQ ID NO: 46683 - DNA, 70 bp, Artificial Sequence
  Synthetic
gccaagcatttaggtgacactatagagctctcaagaaaaagcagagtttcagagctatgctggaaacagc

SEQ ID NO: 46684 - DNA, 70 bp, Artificial Sequence
  Synthetic
gccaagcatttaggtgacactatagtcagccaactgaggaaaaaggtttcagagctatgctggaaacagc

SEQ ID NO: 46685 - DNA, 70 bp, Artificial Sequence
  Synthetic
gccaagcatttaggtgacactatagccggggccatgatgaattaggtttcagagctatgctggaaacagc

SEQ ID NO: 46686 - DNA, 70 bp, Artificial Sequence
  Synthetic
gccaagcatttaggtgacactatagagggtgcccaccatcatctggtttcagagctatgctggaaacagc

SEQ ID NO: 46687 - DNA, 70 bp, Artificial Sequence
  Synthetic
gccaagcatttaggtgacactatagcagatactacacgcactcgtgtttcagagctatgctggaaacagc

SEQ ID NO: 46688 - DNA, 70 bp, Artificial Sequence
  Synthetic
gccaagcatttaggtgacactatagcgccgacgccccggttgcgcgtttcagagctatgctggaaacagc

SEQ ID NO: 46689 - DNA, 70 bp, Artificial Sequence
  Synthetic
gccaagcatttaggtgacactatagcaccaactggtcttctaattgtttcagagctatgctggaaacagc

SEQ ID NO: 46690 - DNA, 70 bp, Artificial Sequence
  Synthetic
gccaagcatttaggtgacactataggccctcttcctgggccttatgtttcagagctatgctggaaacagc

SEQ ID NO: 46691 - DNA, 70 bp, Artificial Sequence
  Synthetic
gccaagcatttaggtgacactatagcagatactacacacacttgtgtttcagagctatgctggaaacagc

SEQ ID NO: 46692 - DNA, 70 bp, Artificial Sequence
  Synthetic
gccaagcatttaggtgacactatagcagatactacacacactcgtgtttcagagctatgctggaaacagc

SEQ ID NO: 46693 - DNA, 70 bp, Artificial Sequence
  Synthetic
gccaagcatttaggtgacactatagtcctgacggggtggacgtcagtttcagagctatgctggaaacagc

SEQ ID NO: 46694 - DNA, 70 bp, Artificial Sequence
  Synthetic
gccaagcatttaggtgacactatagatttcctgccaaagcatattgtttcagagctatgctggaaacagc

SEQ ID NO: 46695 - DNA, 70 bp, Artificial Sequence
  Synthetic
gccaagcatttaggtgacactatagcacagcccaggctcacctacgtttcagagctatgctggaaacagc

SEQ ID NO: 46696 - DNA, 70 bp, Artificial Sequence
  Synthetic
gccaagcatttaggtgacactatagagctagattaactctcccttgtttcagagctatgctggaaacagc

SEQ ID NO: 46697 - DNA, 70 bp, Artificial Sequence
  Synthetic
gccaagcatttaggtgacactatagccaaaatgccagaggacaaggtttcagagctatgctggaaacagc

SEQ ID NO: 46698 - DNA, 70 bp, Artificial Sequence
  Synthetic
gccaagcatttaggtgacactatagaggactccgtgtctttaaaagtttcagagctatgctggaaacagc

SEQ ID NO: 46699 - DNA, 70 bp, Artificial Sequence
  Synthetic
gccaagcatttaggtgacactatagcataaaggcattatcagaccgtttcagagctatgctggaaacagc

SEQ ID NO: 46700 - DNA, 70 bp, Artificial Sequence
  Synthetic
gccaagcatttaggtgacactataggttgtctggggcattgctgggtttcagagctatgctggaaacagc

SEQ ID NO: 46701 - DNA, 70 bp, Artificial Sequence
  Synthetic
gccaagcatttaggtgacactatagagaaaaccaggaggaagagggtttcagagctatgctggaaacagc

SEQ ID NO: 46702 - DNA, 70 bp, Artificial Sequence
  Synthetic
gccaagcatttaggtgacactatagagcccccaacacatgtgactgtttcagagctatgctggaaacagc

SEQ ID NO: 46703 - DNA, 70 bp, Artificial Sequence
  Synthetic
gccaagcatttaggtgacactataggaatcagtcggaggaacctggtttcagagctatgctggaaacagc

SEQ ID NO: 46704 - DNA, 70 bp, Artificial Sequence
  Synthetic
gccaagcatttaggtgacactatagtagtactggagggccttgaggtttcagagctatgctggaaacagc

SEQ ID NO: 46705 - DNA, 70 bp, Artificial Sequence
  Synthetic
gccaagcatttaggtgacactatagttggttgatgagcttcctgtgtttcagagctatgctggaaacagc

SEQ ID NO: 46706 - DNA, 70 bp, Artificial Sequence
  Synthetic
gccaagcatttaggtgacactatagaaaaacacagtgctacaagagtttcagagctatgctggaaacagc

SEQ ID NO: 46707 - DNA, 70 bp, Artificial Sequence
  Synthetic
gccaagcatttaggtgacactatagtaaaagggactttagagtgagtttcagagctatgctggaaacagc

SEQ ID NO: 46708 - DNA, 70 bp, Artificial Sequence
  Synthetic
gccaagcatttaggtgacactataggcttgtcttctgctgctcacgtttcagagctatgctggaaacagc

SEQ ID NO: 46709 - DNA, 70 bp, Artificial Sequence
  Synthetic
gccaagcatttaggtgacactatagaagaatagtagcaattgaccgtttcagagctatgctggaaacagc

SEQ ID NO: 46710 - DNA, 70 bp, Artificial Sequence
  Synthetic
gccaagcatttaggtgacactatagtgaagagcacaagactcagagtttcagagctatgctggaaacagc

SEQ ID NO: 46711 - DNA, 70 bp, Artificial Sequence
  Synthetic
gccaagcatttaggtgacactatagaacaactcacctctcaccctgtttcagagctatgctggaaacagc

SEQ ID NO: 46712 - DNA, 70 bp, Artificial Sequence
  Synthetic
gccaagcatttaggtgacactataggcaccatgtacttcgcttgagtttcagagctatgctggaaacagc

SEQ ID NO: 46713 - DNA, 70 bp, Artificial Sequence
  Synthetic
gccaagcatttaggtgacactatagaacatgtcaagcaaagtacagtttcagagctatgctggaaacagc

SEQ ID NO: 46714 - DNA, 70 bp, Artificial Sequence
  Synthetic
gccaagcatttaggtgacactatagagcgaagtacattgtgcgtagtttcagagctatgctggaaacagc

SEQ ID NO: 46715 - DNA, 70 bp, Artificial Sequence
  Synthetic
gccaagcatttaggtgacactatagaggcaaaatacatcgtgtgcgtttcagagctatgctggaaacagc

SEQ ID NO: 46716 - DNA, 70 bp, Artificial Sequence
  Synthetic
gccaagcatttaggtgacactatagtgaagaagcctgggggcggtgtttcagagctatgctggaaacagc

SEQ ID NO: 46717 - DNA, 70 bp, Artificial Sequence
  Synthetic
gccaagcatttaggtgacactatagcctgccgtggtctgggctacgtttcagagctatgctggaaacagc

SEQ ID NO: 46718 - DNA, 70 bp, Artificial Sequence
  Synthetic
gccaagcatttaggtgacactatagaaactcttggtttccgtagcgtttcagagctatgctggaaacagc

SEQ ID NO: 46719 - DNA, 70 bp, Artificial Sequence
  Synthetic
gccaagcatttaggtgacactatagcttgctgtcagagttgccgtgtttcagagctatgctggaaacagc

SEQ ID NO: 46720 - DNA, 70 bp, Artificial Sequence
  Synthetic
gccaagcatttaggtgacactatagatgctttaatagtaacccacgtttcagagctatgctggaaacagc

SEQ ID NO: 46721 - DNA, 70 bp, Artificial Sequence
  Synthetic
gccaagcatttaggtgacactataggtggaccccaataacatcttgtttcagagctatgctggaaacagc

SEQ ID NO: 46722 - DNA, 70 bp, Artificial Sequence
  Synthetic
gccaagcatttaggtgacactatagacagttagagccgatatcacgtttcagagctatgctggaaacagc

SEQ ID NO: 46723 - DNA, 70 bp, Artificial Sequence
  Synthetic
gccaagcatttaggtgacactatagattgtacacatatgagcctcgtttcagagctatgctggaaacagc

SEQ ID NO: 46724 - DNA, 70 bp, Artificial Sequence
  Synthetic
gccaagcatttaggtgacactatagccctgccccaccccatgagcgtttcagagctatgctggaaacagc

SEQ ID NO: 46725 - DNA, 70 bp, Artificial Sequence
  Synthetic
gccaagcatttaggtgacactatagtccctgcagccgcacctagcgtttcagagctatgctggaaacagc

SEQ ID NO: 46726 - DNA, 70 bp, Artificial Sequence
  Synthetic
gccaagcatttaggtgacactatagaacccgctgagcacagcatggtttcagagctatgctggaaacagc

SEQ ID NO: 46727 - DNA, 70 bp, Artificial Sequence
  Synthetic
gccaagcatttaggtgacactataggatggcagcgggctcaaggtgtttcagagctatgctggaaacagc

SEQ ID NO: 46728 - DNA, 70 bp, Artificial Sequence
  Synthetic
gccaagcatttaggtgacactataggaagcctgcaccatgttttggtttcagagctatgctggaaacagc

SEQ ID NO: 46729 - DNA, 70 bp, Artificial Sequence
  Synthetic
gccaagcatttaggtgacactatagctctcacgtttaagacacaagtttcagagctatgctggaaacagc

SEQ ID NO: 46730 - DNA, 70 bp, Artificial Sequence
  Synthetic
gccaagcatttaggtgacactatagcacatgtaccgggagcgcgggtttcagagctatgctggaaacagc

SEQ ID NO: 46731 - DNA, 70 bp, Artificial Sequence
  Synthetic
gccaagcatttaggtgacactataggtggctggcttcagtaccctgtttcagagctatgctggaaacagc

SEQ ID NO: 46732 - DNA, 70 bp, Artificial Sequence
  Synthetic
gccaagcatttaggtgacactatagtacggtcctgagaagacccagtttcagagctatgctggaaacagc

SEQ ID NO: 46733 - DNA, 70 bp, Artificial Sequence
  Synthetic
gccaagcatttaggtgacactatagggcaggtcacagcttcttctgtttcagagctatgctggaaacagc

SEQ ID NO: 46734 - DNA, 70 bp, Artificial Sequence
  Synthetic
gccaagcatttaggtgacactatagtagctcttctttccatgtgtgtttcagagctatgctggaaacagc

SEQ ID NO: 46735 - DNA, 70 bp, Artificial Sequence
  Synthetic
gccaagcatttaggtgacactatagatcagccgaatttctatggggtttcagagctatgctggaaacagc

SEQ ID NO: 46736 - DNA, 70 bp, Artificial Sequence
  Synthetic
gccaagcatttaggtgacactatagtgacaggaacaggtcttggagtttcagagctatgctggaaacagc

SEQ ID NO: 46737 - DNA, 70 bp, Artificial Sequence
  Synthetic
gccaagcatttaggtgacactataggcagacctggctctcagtaggtttcagagctatgctggaaacagc

SEQ ID NO: 46738 - DNA, 70 bp, Artificial Sequence
  Synthetic
gccaagcatttaggtgacactatagatctgggactcaacaaaaatgtttcagagctatgctggaaacagc

SEQ ID NO: 46739 - DNA, 70 bp, Artificial Sequence
  Synthetic
gccaagcatttaggtgacactatagccttcaagcctaattactacgtttcagagctatgctggaaacagc

SEQ ID NO: 46740 - DNA, 70 bp, Artificial Sequence
  Synthetic
gccaagcatttaggtgacactatagggcacttcagttggcactacgtttcagagctatgctggaaacagc

SEQ ID NO: 46741 - DNA, 70 bp, Artificial Sequence
  Synthetic
gccaagcatttaggtgacactatagatgaggaagaacaagcaagcgtttcagagctatgctggaaacagc

SEQ ID NO: 46742 - DNA, 70 bp, Artificial Sequence
  Synthetic
gccaagcatttaggtgacactatagaagtcccaggacttcagactgtttcagagctatgctggaaacagc

SEQ ID NO: 46743 - DNA, 70 bp, Artificial Sequence
  Synthetic
gccaagcatttaggtgacactatagctgatgtagaatctcttgaggtttcagagctatgctggaaacagc

SEQ ID NO: 46744 - DNA, 70 bp, Artificial Sequence
  Synthetic
gccaagcatttaggtgacactatagtcagtctccaccccaaatgcgtttcagagctatgctggaaacagc

SEQ ID NO: 46745 - DNA, 70 bp, Artificial Sequence
  Synthetic
gccaagcatttaggtgacactatagttccacaaagaaagagtagcgtttcagagctatgctggaaacagc

SEQ ID NO: 46746 - DNA, 70 bp, Artificial Sequence
  Synthetic
gccaagcatttaggtgacactataggggaccaaatgaaggctgaggtttcagagctatgctggaaacagc

SEQ ID NO: 46747 - DNA, 70 bp, Artificial Sequence
  Synthetic
gccaagcatttaggtgacactatagaaaattgggcttggaattacgtttcagagctatgctggaaacagc

SEQ ID NO: 46748 - DNA, 70 bp, Artificial Sequence
  Synthetic
gccaagcatttaggtgacactatagggtggtcactgcgctatggcgtttcagagctatgctggaaacagc

SEQ ID NO: 46749 - DNA, 70 bp, Artificial Sequence
  Synthetic
gccaagcatttaggtgacactatagtatggcgcacgcttattttagtttcagagctatgctggaaacagc

SEQ ID NO: 46750 - DNA, 70 bp, Artificial Sequence
  Synthetic
gccaagcatttaggtgacactatagatcacgttagggggggatgtgtttcagagctatgctggaaacagc

SEQ ID NO: 46751 - DNA, 70 bp, Artificial Sequence
  Synthetic
gccaagcatttaggtgacactatagctgcagctgacccccctaaagtttcagagctatgctggaaacagc

SEQ ID NO: 46752 - DNA, 70 bp, Artificial Sequence
  Synthetic
gccaagcatttaggtgacactataggatcagacacttcaaggtctgtttcagagctatgctggaaacagc

SEQ ID NO: 46753 - DNA, 70 bp, Artificial Sequence
  Synthetic
gccaagcatttaggtgacactatagggctgggtccctgagctagggtttcagagctatgctggaaacagc

SEQ ID NO: 46754 - DNA, 70 bp, Artificial Sequence
  Synthetic
gccaagcatttaggtgacactatagcgagacgcatttcgtactttgtttcagagctatgctggaaacagc

SEQ ID NO: 46755 - DNA, 70 bp, Artificial Sequence
  Synthetic
gccaagcatttaggtgacactatagtctacatcaaactttgcacagtttcagagctatgctggaaacagc

SEQ ID NO: 46756 - DNA, 70 bp, Artificial Sequence
  Synthetic
gccaagcatttaggtgacactatagcaactcagagatagctttctgtttcagagctatgctggaaacagc

SEQ ID NO: 46757 - DNA, 70 bp, Artificial Sequence
  Synthetic
gccaagcatttaggtgacactataggacattgctagcctgccctggtttcagagctatgctggaaacagc

SEQ ID NO: 46758 - DNA, 70 bp, Artificial Sequence
  Synthetic
gccaagcatttaggtgacactatagtgatctcagaggtgacaggagtttcagagctatgctggaaacagc

SEQ ID NO: 46759 - DNA, 70 bp, Artificial Sequence
  Synthetic
gccaagcatttaggtgacactatagggcctgtgctcttggcagaagtttcagagctatgctggaaacagc

SEQ ID NO: 46760 - DNA, 70 bp, Artificial Sequence
  Synthetic
gccaagcatttaggtgacactatagttaaccgaatgccaatagcagtttcagagctatgctggaaacagc

SEQ ID NO: 46761 - DNA, 70 bp, Artificial Sequence
  Synthetic
gccaagcatttaggtgacactatagtgaggcagtctccaccttgagtttcagagctatgctggaaacagc

SEQ ID NO: 46762 - DNA, 70 bp, Artificial Sequence
  Synthetic
gccaagcatttaggtgacactatagatgtcctggcttacggggaagtttcagagctatgctggaaacagc

SEQ ID NO: 46763 - DNA, 70 bp, Artificial Sequence
  Synthetic
gccaagcatttaggtgacactatagatcccagggtggctgaatcagtttcagagctatgctggaaacagc

SEQ ID NO: 46764 - DNA, 70 bp, Artificial Sequence
  Synthetic
gccaagcatttaggtgacactatagtgttcagaacttctcccagcgtttcagagctatgctggaaacagc

SEQ ID NO: 46765 - DNA, 70 bp, Artificial Sequence
  Synthetic
gccaagcatttaggtgacactatagtggagttcatagcaccataagtttcagagctatgctggaaacagc

SEQ ID NO: 46766 - DNA, 70 bp, Artificial Sequence
  Synthetic
gccaagcatttaggtgacactataggctcaaaccatgagcaacaggtttcagagctatgctggaaacagc

SEQ ID NO: 46767 - DNA, 70 bp, Artificial Sequence
  Synthetic
gccaagcatttaggtgacactatagcagttacggcaattcacttagtttcagagctatgctggaaacagc

SEQ ID NO: 46768 - DNA, 70 bp, Artificial Sequence
  Synthetic
gccaagcatttaggtgacactataggcactttggcaaagtcagccgtttcagagctatgctggaaacagc

SEQ ID NO: 46769 - DNA, 70 bp, Artificial Sequence
  Synthetic
gccaagcatttaggtgacactataggggccaagtgctcctgtcaagtttcagagctatgctggaaacagc

SEQ ID NO: 46770 - DNA, 70 bp, Artificial Sequence
  Synthetic
gccaagcatttaggtgacactatagcagtgctgcagcgagtgcccgtttcagagctatgctggaaacagc

SEQ ID NO: 46771 - DNA, 70 bp, Artificial Sequence
  Synthetic
gccaagcatttaggtgacactatagtgcaggggcggacagtgagggtttcagagctatgctggaaacagc

SEQ ID NO: 46772 - DNA, 70 bp, Artificial Sequence
  Synthetic
gccaagcatttaggtgacactatagcccggccatctggggtcagggtttcagagctatgctggaaacagc

SEQ ID NO: 46773 - DNA, 70 bp, Artificial Sequence
  Synthetic
gccaagcatttaggtgacactataggtttgaaatctcctgctgacgtttcagagctatgctggaaacagc

SEQ ID NO: 46774 - DNA, 70 bp, Artificial Sequence
  Synthetic
gccaagcatttaggtgacactatagccatccttggaagtctgcaggtttcagagctatgctggaaacagc

SEQ ID NO: 46775 - DNA, 70 bp, Artificial Sequence
  Synthetic
gccaagcatttaggtgacactataggattgcagctcagatatagtgtttcagagctatgctggaaacagc

SEQ ID NO: 46776 - DNA, 70 bp, Artificial Sequence
  Synthetic
gccaagcatttaggtgacactatagtaatagctcagaagtactctgtttcagagctatgctggaaacagc

SEQ ID NO: 46777 - DNA, 70 bp, Artificial Sequence
  Synthetic
gccaagcatttaggtgacactatagggctccagcgttgctactttgtttcagagctatgctggaaacagc

SEQ ID NO: 46778 - DNA, 70 bp, Artificial Sequence
  Synthetic
gccaagcatttaggtgacactatagcaaagccacatgtaaagactgtttcagagctatgctggaaacagc

SEQ ID NO: 46779 - DNA, 70 bp, Artificial Sequence
  Synthetic
gccaagcatttaggtgacactatagcccggtgatgtcatctttcagtttcagagctatgctggaaacagc

SEQ ID NO: 46780 - DNA, 70 bp, Artificial Sequence
  Synthetic
gccaagcatttaggtgacactatagggccttctgatactaggatggtttcagagctatgctggaaacagc

SEQ ID NO: 46781 - DNA, 70 bp, Artificial Sequence
  Synthetic
gccaagcatttaggtgacactatagtggctttggagaaggctgctgtttcagagctatgctggaaacagc

SEQ ID NO: 46782 - DNA, 70 bp, Artificial Sequence
  Synthetic
gccaagcatttaggtgacactatagaaagcttcagttactccatggtttcagagctatgctggaaacagc

SEQ ID NO: 46783 - DNA, 70 bp, Artificial Sequence
  Synthetic
gccaagcatttaggtgacactataggcagggtcaatatgcttcttgtttcagagctatgctggaaacagc

SEQ ID NO: 46784 - DNA, 70 bp, Artificial Sequence
  Synthetic
gccaagcatttaggtgacactatagagttgaagaaaaacgtcctcgtttcagagctatgctggaaacagc

SEQ ID NO: 46785 - DNA, 70 bp, Artificial Sequence
  Synthetic
gccaagcatttaggtgacactatagtcttgaaatggattgagcaggtttcagagctatgctggaaacagc

SEQ ID NO: 46786 - DNA, 70 bp, Artificial Sequence
  Synthetic
gccaagcatttaggtgacactatagcgaagaccctgttgattttcgtttcagagctatgctggaaacagc

SEQ ID NO: 46787 - DNA, 70 bp, Artificial Sequence
  Synthetic
gccaagcatttaggtgacactatagttcaagtttcactgtgcttcgtttcagagctatgctggaaacagc

SEQ ID NO: 46788 - DNA, 70 bp, Artificial Sequence
  Synthetic
gccaagcatttaggtgacactatagcctggctctgaacccatcaggtttcagagctatgctggaaacagc

SEQ ID NO: 46789 - DNA, 70 bp, Artificial Sequence
  Synthetic
gccaagcatttaggtgacactatagaagtcaatggctctgaactggtttcagagctatgctggaaacagc

SEQ ID NO: 46790 - DNA, 70 bp, Artificial Sequence
  Synthetic
gccaagcatttaggtgacactatagtacttggacctcaatattcagtttcagagctatgctggaaacagc

SEQ ID NO: 46791 - DNA, 70 bp, Artificial Sequence
  Synthetic
gccaagcatttaggtgacactatagaagcacgaaaagaagtaacagtttcagagctatgctggaaacagc

SEQ ID NO: 46792 - DNA, 70 bp, Artificial Sequence
  Synthetic
gccaagcatttaggtgacactatagctaggctatgcatttgcattgtttcagagctatgctggaaacagc

SEQ ID NO: 46793 - DNA, 70 bp, Artificial Sequence
  Synthetic
gccaagcatttaggtgacactatagggaagcagcatgggggtcaagtttcagagctatgctggaaacagc

SEQ ID NO: 46794 - DNA, 70 bp, Artificial Sequence
  Synthetic
gccaagcatttaggtgacactatagagtcagtgacattatgcagcgtttcagagctatgctggaaacagc

SEQ ID NO: 46795 - DNA, 70 bp, Artificial Sequence
  Synthetic
gccaagcatttaggtgacactataggtcgctgtttgattggctctgtttcagagctatgctggaaacagc

SEQ ID NO: 46796 - DNA, 70 bp, Artificial Sequence
  Synthetic
gccaagcatttaggtgacactataggatcacaccccaagcacagggtttcagagctatgctggaaacagc

SEQ ID NO: 46797 - DNA, 70 bp, Artificial Sequence
  Synthetic
gccaagcatttaggtgacactataggcgtcagaagtatcagcagagtttcagagctatgctggaaacagc

SEQ ID NO: 46798 - DNA, 70 bp, Artificial Sequence
  Synthetic
gccaagcatttaggtgacactatagggtgaattcactgtggaaaagtttcagagctatgctggaaacagc

SEQ ID NO: 46799 - DNA, 70 bp, Artificial Sequence
  Synthetic
gccaagcatttaggtgacactatagtcagacacgattgaataagagtttcagagctatgctggaaacagc

SEQ ID NO: 46800 - DNA, 70 bp, Artificial Sequence
  Synthetic
gccaagcatttaggtgacactatagtgcccgtcattacctgttccgtttcagagctatgctggaaacagc

SEQ ID NO: 46801 - DNA, 70 bp, Artificial Sequence
  Synthetic
gccaagcatttaggtgacactataggcagtggggttgccgattacgtttcagagctatgctggaaacagc

SEQ ID NO: 46802 - DNA, 70 bp, Artificial Sequence
  Synthetic
gccaagcatttaggtgacactatagggagtcaaggatcagctcacgtttcagagctatgctggaaacagc

SEQ ID NO: 46803 - DNA, 70 bp, Artificial Sequence
  Synthetic
gccaagcatttaggtgacactatagagaacagctggttaatgaaagtttcagagctatgctggaaacagc

SEQ ID NO: 46804 - DNA, 70 bp, Artificial Sequence
  Synthetic
gccaagcatttaggtgacactatagacaggttaaagttttggggcgtttcagagctatgctggaaacagc

SEQ ID NO: 46805 - DNA, 70 bp, Artificial Sequence
  Synthetic
gccaagcatttaggtgacactataggcaatgacaatgagaacaacgtttcagagctatgctggaaacagc

SEQ ID NO: 46806 - DNA, 70 bp, Artificial Sequence
  Synthetic
gccaagcatttaggtgacactataggggaaatgagcatcattctggtttcagagctatgctggaaacagc

SEQ ID NO: 46807 - DNA, 70 bp, Artificial Sequence
  Synthetic
gccaagcatttaggtgacactatagccgccccgagctcgggtcacgtttcagagctatgctggaaacagc

SEQ ID NO: 46808 - DNA, 70 bp, Artificial Sequence
  Synthetic
gccaagcatttaggtgacactatagtcaactactcaatttcatgcgtttcagagctatgctggaaacagc

SEQ ID NO: 46809 - DNA, 70 bp, Artificial Sequence
  Synthetic
gccaagcatttaggtgacactatagagtgatggtcaacatcacacgtttcagagctatgctggaaacagc

SEQ ID NO: 46810 - DNA, 70 bp, Artificial Sequence
  Synthetic
gccaagcatttaggtgacactatagttatgcgacggtatgggacagtttcagagctatgctggaaacagc

SEQ ID NO: 46811 - DNA, 70 bp, Artificial Sequence
  Synthetic
gccaagcatttaggtgacactatagtatttactctacggcaggttgtttcagagctatgctggaaacagc

SEQ ID NO: 46812 - DNA, 70 bp, Artificial Sequence
  Synthetic
gccaagcatttaggtgacactataggcccccagtgaagtcagaaggtttcagagctatgctggaaacagc

SEQ ID NO: 46813 - DNA, 70 bp, Artificial Sequence
  Synthetic
gccaagcatttaggtgacactatagttgctaaagcacagaggtgggtttcagagctatgctggaaacagc

SEQ ID NO: 46814 - DNA, 70 bp, Artificial Sequence
  Synthetic
gccaagcatttaggtgacactatagaagaagctgtggtctcagtagtttcagagctatgctggaaacagc

SEQ ID NO: 46815 - DNA, 70 bp, Artificial Sequence
  Synthetic
gccaagcatttaggtgacactatagcacagcttcaaaactcttcagtttcagagctatgctggaaacagc

SEQ ID NO: 46816 - DNA, 70 bp, Artificial Sequence
  Synthetic
gccaagcatttaggtgacactatagcccttcaatgcagaatattggtttcagagctatgctggaaacagc

SEQ ID NO: 46817 - DNA, 70 bp, Artificial Sequence
  Synthetic
gccaagcatttaggtgacactatagcccttcgatgcagaatattggtttcagagctatgctggaaacagc

SEQ ID NO: 46818 - DNA, 70 bp, Artificial Sequence
  Synthetic
gccaagcatttaggtgacactatagaggacatagggattttaacagtttcagagctatgctggaaacagc

SEQ ID NO: 46819 - DNA, 70 bp, Artificial Sequence
  Synthetic
gccaagcatttaggtgacactatagatttctgtttaggccatctagtttcagagctatgctggaaacagc

SEQ ID NO: 46820 - DNA, 70 bp, Artificial Sequence
  Synthetic
gccaagcatttaggtgacactatagaatagtggagatttctgtctgtttcagagctatgctggaaacagc

SEQ ID NO: 46821 - DNA, 70 bp, Artificial Sequence
  Synthetic
gccaagcatttaggtgacactatagtcattctccaatgtctctaagtttcagagctatgctggaaacagc

SEQ ID NO: 46822 - DNA, 70 bp, Artificial Sequence
  Synthetic
gccaagcatttaggtgacactatagtgaattccagttgacatcaggtttcagagctatgctggaaacagc

SEQ ID NO: 46823 - DNA, 70 bp, Artificial Sequence
  Synthetic
gccaagcatttaggtgacactatagtcatcatgaaatgggtattcgtttcagagctatgctggaaacagc

SEQ ID NO: 46824 - DNA, 70 bp, Artificial Sequence
  Synthetic
gccaagcatttaggtgacactatagtttcaacatccagcgagggggtttcagagctatgctggaaacagc

SEQ ID NO: 46825 - DNA, 70 bp, Artificial Sequence
  Synthetic
gccaagcatttaggtgacactatagcctttccacatagaatactggtttcagagctatgctggaaacagc

SEQ ID NO: 46826 - DNA, 70 bp, Artificial Sequence
  Synthetic
gccaagcatttaggtgacactatagctgagccatgatgggcctaggtttcagagctatgctggaaacagc

SEQ ID NO: 46827 - DNA, 70 bp, Artificial Sequence
  Synthetic
gccaagcatttaggtgacactatagctgagaaacgatgggcctaggtttcagagctatgctggaaacagc

SEQ ID NO: 46828 - DNA, 70 bp, Artificial Sequence
  Synthetic
gccaagcatttaggtgacactatagatgagcttagatgaagtagtgtttcagagctatgctggaaacagc

SEQ ID NO: 46829 - DNA, 70 bp, Artificial Sequence
  Synthetic
gccaagcatttaggtgacactataggccagcggcacggcctgagggtttcagagctatgctggaaacagc

SEQ ID NO: 46830 - DNA, 70 bp, Artificial Sequence
  Synthetic
gccaagcatttaggtgacactataggcgacttccagaagctgaaggtttcagagctatgctggaaacagc

SEQ ID NO: 46831 - DNA, 70 bp, Artificial Sequence
  Synthetic
gccaagcatttaggtgacactataggtgggcagactgctcactcggtttcagagctatgctggaaacagc

SEQ ID NO: 46832 - DNA, 70 bp, Artificial Sequence
  Synthetic
gccaagcatttaggtgacactatagattgtggcatgctgggtaacgtttcagagctatgctggaaacagc

SEQ ID NO: 46833 - DNA, 70 bp, Artificial Sequence
  Synthetic
gccaagcatttaggtgacactatagcaattttcctactctgcaaggtttcagagctatgctggaaacagc

SEQ ID NO: 46834 - DNA, 70 bp, Artificial Sequence
  Synthetic
gccaagcatttaggtgacactatagctgaaaggctgtactgagccgtttcagagctatgctggaaacagc

SEQ ID NO: 46835 - DNA, 70 bp, Artificial Sequence
  Synthetic
gccaagcatttaggtgacactatagagtggctgaaggaggaatgagtttcagagctatgctggaaacagc

SEQ ID NO: 46836 - DNA, 70 bp, Artificial Sequence
  Synthetic
gccaagcatttaggtgacactataggagcaagttggtatctgctcgtttcagagctatgctggaaacagc

SEQ ID NO: 46837 - DNA, 70 bp, Artificial Sequence
  Synthetic
gccaagcatttaggtgacactataggcagctggcttctcaggcatgtttcagagctatgctggaaacagc

SEQ ID NO: 46838 - DNA, 70 bp, Artificial Sequence
  Synthetic
gccaagcatttaggtgacactataggctgcaagtcaagctgccttgtttcagagctatgctggaaacagc

SEQ ID NO: 46839 - DNA, 70 bp, Artificial Sequence
  Synthetic
gccaagcatttaggtgacactatagaaacaaggacctcggtaatagtttcagagctatgctggaaacagc

SEQ ID NO: 46840 - DNA, 70 bp, Artificial Sequence
  Synthetic
gccaagcatttaggtgacactatagtgaggcacctacaatagtcagtttcagagctatgctggaaacagc

SEQ ID NO: 46841 - DNA, 70 bp, Artificial Sequence
  Synthetic
gccaagcatttaggtgacactatagttgttgctggtgtcgtctacgtttcagagctatgctggaaacagc

SEQ ID NO: 46842 - DNA, 70 bp, Artificial Sequence
  Synthetic
gccaagcatttaggtgacactatagctcaggcatcagtcccccatgtttcagagctatgctggaaacagc

SEQ ID NO: 46843 - DNA, 70 bp, Artificial Sequence
  Synthetic
gccaagcatttaggtgacactatagttttcctggctcttttcagtgtttcagagctatgctggaaacagc

SEQ ID NO: 46844 - DNA, 70 bp, Artificial Sequence
  Synthetic
gccaagcatttaggtgacactatagcggtttccatgaatatacaggtttcagagctatgctggaaacagc

SEQ ID NO: 46845 - DNA, 70 bp, Artificial Sequence
  Synthetic
gccaagcatttaggtgacactatagccccagaagaactcctaagagtttcagagctatgctggaaacagc

SEQ ID NO: 46846 - DNA, 70 bp, Artificial Sequence
  Synthetic
gccaagcatttaggtgacactataggagccccgcctttccttcaggtttcagagctatgctggaaacagc

SEQ ID NO: 46847 - DNA, 70 bp, Artificial Sequence
  Synthetic
gccaagcatttaggtgacactatagtgctcttacgagttcttctggtttcagagctatgctggaaacagc

SEQ ID NO: 46848 - DNA, 70 bp, Artificial Sequence
  Synthetic
gccaagcatttaggtgacactataggacctttcttcagtattcgagtttcagagctatgctggaaacagc

SEQ ID NO: 46849 - DNA, 70 bp, Artificial Sequence
  Synthetic
gccaagcatttaggtgacactatagcaaaaccaagacggtgacacgtttcagagctatgctggaaacagc

SEQ ID NO: 46850 - DNA, 70 bp, Artificial Sequence
  Synthetic
gccaagcatttaggtgacactataggttgggcgagtacgggctgcgtttcagagctatgctggaaacagc

SEQ ID NO: 46851 - DNA, 70 bp, Artificial Sequence
  Synthetic
gccaagcatttaggtgacactataggagcaacccctcctcagtgcgtttcagagctatgctggaaacagc

SEQ ID NO: 46852 - DNA, 70 bp, Artificial Sequence
  Synthetic
gccaagcatttaggtgacactatagtggtgttcatctctgcttacgtttcagagctatgctggaaacagc

SEQ ID NO: 46853 - DNA, 70 bp, Artificial Sequence
  Synthetic
gccaagcatttaggtgacactatagtgtagccgctgtgcttgtcagtttcagagctatgctggaaacagc

SEQ ID NO: 46854 - DNA, 70 bp, Artificial Sequence
  Synthetic
gccaagcatttaggtgacactataggcagtgtgcagctgcagcctgtttcagagctatgctggaaacagc

SEQ ID NO: 46855 - DNA, 70 bp, Artificial Sequence
  Synthetic
gccaagcatttaggtgacactataggaggcgggtgggacgctcacgtttcagagctatgctggaaacagc

SEQ ID NO: 46856 - DNA, 70 bp, Artificial Sequence
  Synthetic
gccaagcatttaggtgacactatagcacataagcccctgggggacgtttcagagctatgctggaaacagc

SEQ ID NO: 46857 - DNA, 70 bp, Artificial Sequence
  Synthetic
gccaagcatttaggtgacactatagtgtgtgttacgggggcttgtgtttcagagctatgctggaaacagc

SEQ ID NO: 46858 - DNA, 70 bp, Artificial Sequence
  Synthetic
gccaagcatttaggtgacactatagaacttgtttctaacggcccagtttcagagctatgctggaaacagc

SEQ ID NO: 46859 - DNA, 70 bp, Artificial Sequence
  Synthetic
gccaagcatttaggtgacactatagaaagaccttcctctggcccagtttcagagctatgctggaaacagc

SEQ ID NO: 46860 - DNA, 70 bp, Artificial Sequence
  Synthetic
gccaagcatttaggtgacactatagagatcagtgtttaacggtgagtttcagagctatgctggaaacagc

SEQ ID NO: 46861 - DNA, 70 bp, Artificial Sequence
  Synthetic
gccaagcatttaggtgacactataggtgtgtggagatgggtgatggtttcagagctatgctggaaacagc

SEQ ID NO: 46862 - DNA, 70 bp, Artificial Sequence
  Synthetic
gccaagcatttaggtgacactatagctctaaccacgcctattaaggtttcagagctatgctggaaacagc

SEQ ID NO: 46863 - DNA, 70 bp, Artificial Sequence
  Synthetic
gccaagcatttaggtgacactatagggcgggcattggaccctagtgtttcagagctatgctggaaacagc

SEQ ID NO: 46864 - DNA, 70 bp, Artificial Sequence
  Synthetic
gccaagcatttaggtgacactataggtatggagtggatactcagtgtttcagagctatgctggaaacagc

SEQ ID NO: 46865 - DNA, 70 bp, Artificial Sequence
  Synthetic
gccaagcatttaggtgacactataggctccgatgggatgagagctgtttcagagctatgctggaaacagc

SEQ ID NO: 46866 - DNA, 70 bp, Artificial Sequence
  Synthetic
gccaagcatttaggtgacactatagaggacattcaaaggtttatggtttcagagctatgctggaaacagc

SEQ ID NO: 46867 - DNA, 70 bp, Artificial Sequence
  Synthetic
gccaagcatttaggtgacactatagcaaggtacaacccagaaacagtttcagagctatgctggaaacagc

SEQ ID NO: 46868 - DNA, 70 bp, Artificial Sequence
  Synthetic
gccaagcatttaggtgacactatagagtgacattcctatcatctggtttcagagctatgctggaaacagc

SEQ ID NO: 46869 - DNA, 70 bp, Artificial Sequence
  Synthetic
gccaagcatttaggtgacactatagctcccccggccgtcctgagggtttcagagctatgctggaaacagc

SEQ ID NO: 46870 - DNA, 70 bp, Artificial Sequence
  Synthetic
gccaagcatttaggtgacactataggctggatcttacataccctggtttcagagctatgctggaaacagc

SEQ ID NO: 46871 - DNA, 70 bp, Artificial Sequence
  Synthetic
gccaagcatttaggtgacactatagatgcagaaaatttttctggcgtttcagagctatgctggaaacagc

SEQ ID NO: 46872 - DNA, 70 bp, Artificial Sequence
  Synthetic
gccaagcatttaggtgacactatagggcaagcttctagtgtctcagtttcagagctatgctggaaacagc

SEQ ID NO: 46873 - DNA, 70 bp, Artificial Sequence
  Synthetic
gccaagcatttaggtgacactatagtcacagggtgaagccagattgtttcagagctatgctggaaacagc

SEQ ID NO: 46874 - DNA, 70 bp, Artificial Sequence
  Synthetic
gccaagcatttaggtgacactatagtttgtcaaacaattcgcccagtttcagagctatgctggaaacagc

SEQ ID NO: 46875 - DNA, 70 bp, Artificial Sequence
  Synthetic
gccaagcatttaggtgacactatagactgggaggcgctgctcaaagtttcagagctatgctggaaacagc

SEQ ID NO: 46876 - DNA, 70 bp, Artificial Sequence
  Synthetic
gccaagcatttaggtgacactatagagaaaaccgcctggtctttggtttcagagctatgctggaaacagc

SEQ ID NO: 46877 - DNA, 70 bp, Artificial Sequence
  Synthetic
gccaagcatttaggtgacactatagccgatatgttaccaaactgcgtttcagagctatgctggaaacagc

SEQ ID NO: 46878 - DNA, 70 bp, Artificial Sequence
  Synthetic
gccaagcatttaggtgacactataggggaaaggggtggacttcaggtttcagagctatgctggaaacagc

SEQ ID NO: 46879 - DNA, 70 bp, Artificial Sequence
  Synthetic
gccaagcatttaggtgacactatagcctggaggcttgagcaaactgtttcagagctatgctggaaacagc

SEQ ID NO: 46880 - DNA, 70 bp, Artificial Sequence
  Synthetic
gccaagcatttaggtgacactatagattatgtgggattccaaaaggtttcagagctatgctggaaacagc

SEQ ID NO: 46881 - DNA, 70 bp, Artificial Sequence
  Synthetic
gccaagcatttaggtgacactatagcagtaggcatcacatatgctgtttcagagctatgctggaaacagc

SEQ ID NO: 46882 - DNA, 70 bp, Artificial Sequence
  Synthetic
gccaagcatttaggtgacactatagcagtgaagagcagaggaaaggtttcagagctatgctggaaacagc

SEQ ID NO: 46883 - DNA, 70 bp, Artificial Sequence
  Synthetic
gccaagcatttaggtgacactatagcaaatcaggaagaaaagtgggtttcagagctatgctggaaacagc

SEQ ID NO: 46884 - DNA, 70 bp, Artificial Sequence
  Synthetic
gccaagcatttaggtgacactatagccattaacttctccttgactgtttcagagctatgctggaaacagc

SEQ ID NO: 46885 - DNA, 70 bp, Artificial Sequence
  Synthetic
gccaagcatttaggtgacactataggaagagcagaaccaacttacgtttcagagctatgctggaaacagc

SEQ ID NO: 46886 - DNA, 70 bp, Artificial Sequence
  Synthetic
gccaagcatttaggtgacactatagtgccaagaatactgagaaacgtttcagagctatgctggaaacagc

SEQ ID NO: 46887 - DNA, 70 bp, Artificial Sequence
  Synthetic
gccaagcatttaggtgacactatagtgcgaccgagctcagggcccgtttcagagctatgctggaaacagc

SEQ ID NO: 46888 - DNA, 70 bp, Artificial Sequence
  Synthetic
gccaagcatttaggtgacactatagagggtagttttgctaggtctgtttcagagctatgctggaaacagc

SEQ ID NO: 46889 - DNA, 70 bp, Artificial Sequence
  Synthetic
gccaagcatttaggtgacactatagtgtcagtccagtgtgcatgggtttcagagctatgctggaaacagc

SEQ ID NO: 46890 - DNA, 70 bp, Artificial Sequence
  Synthetic
gccaagcatttaggtgacactatagatctccaagtctcagctgtcgtttcagagctatgctggaaacagc

SEQ ID NO: 46891 - DNA, 70 bp, Artificial Sequence
  Synthetic
gccaagcatttaggtgacactatagcgaaaagtcagattcacccggtttcagagctatgctggaaacagc

SEQ ID NO: 46892 - DNA, 70 bp, Artificial Sequence
  Synthetic
gccaagcatttaggtgacactatagtcatcattagtaagctcccggtttcagagctatgctggaaacagc

SEQ ID NO: 46893 - DNA, 70 bp, Artificial Sequence
  Synthetic
gccaagcatttaggtgacactatagctcaaagctctgacgtcaccgtttcagagctatgctggaaacagc

SEQ ID NO: 46894 - DNA, 70 bp, Artificial Sequence
  Synthetic
gccaagcatttaggtgacactatagagccaaggaggcggttcacagtttcagagctatgctggaaacagc

SEQ ID NO: 46895 - DNA, 70 bp, Artificial Sequence
  Synthetic
gccaagcatttaggtgacactatagcccgaaaggtgaagatgcgggtttcagagctatgctggaaacagc

SEQ ID NO: 46896 - DNA, 70 bp, Artificial Sequence
  Synthetic
gccaagcatttaggtgacactatagctggcggtcacttgcccagcgtttcagagctatgctggaaacagc

SEQ ID NO: 46897 - DNA, 70 bp, Artificial Sequence
  Synthetic
gccaagcatttaggtgacactatagtctgtagggtcatcgtcctcgtttcagagctatgctggaaacagc

SEQ ID NO: 46898 - DNA, 70 bp, Artificial Sequence
  Synthetic
gccaagcatttaggtgacactataggtagaaagctgggggtcagcgtttcagagctatgctggaaacagc

SEQ ID NO: 46899 - DNA, 70 bp, Artificial Sequence
  Synthetic
gccaagcatttaggtgacactatagctggtgtgtgattcttcaaagtttcagagctatgctggaaacagc

SEQ ID NO: 46900 - DNA, 70 bp, Artificial Sequence
  Synthetic
gccaagcatttaggtgacactatagcggggctttgtgtgtgttaagtttcagagctatgctggaaacagc

SEQ ID NO: 46901 - DNA, 70 bp, Artificial Sequence
  Synthetic
gccaagcatttaggtgacactatagaataaacttgtgtcagtcccgtttcagagctatgctggaaacagc

SEQ ID NO: 46902 - DNA, 70 bp, Artificial Sequence
  Synthetic
gccaagcatttaggtgacactataggagtcactctagggctcagagtttcagagctatgctggaaacagc

SEQ ID NO: 46903 - DNA, 70 bp, Artificial Sequence
  Synthetic
gccaagcatttaggtgacactatagatgctgttctcaatcagcacgtttcagagctatgctggaaacagc

SEQ ID NO: 46904 - DNA, 70 bp, Artificial Sequence
  Synthetic
gccaagcatttaggtgacactatagaaagggtggcgacgcttagagtttcagagctatgctggaaacagc

SEQ ID NO: 46905 - DNA, 70 bp, Artificial Sequence
  Synthetic
gccaagcatttaggtgacactataggtgttcccctgggatttagagtttcagagctatgctggaaacagc

SEQ ID NO: 46906 - DNA, 70 bp, Artificial Sequence
  Synthetic
gccaagcatttaggtgacactatagagactggcagtgtgctcagagtttcagagctatgctggaaacagc

SEQ ID NO: 46907 - DNA, 70 bp, Artificial Sequence
  Synthetic
gccaagcatttaggtgacactatagagttagggaatgagaagtaggtttcagagctatgctggaaacagc

SEQ ID NO: 46908 - DNA, 70 bp, Artificial Sequence
  Synthetic
gccaagcatttaggtgacactatagggtatttgggggtggttagagtttcagagctatgctggaaacagc

SEQ ID NO: 46909 - DNA, 70 bp, Artificial Sequence
  Synthetic
gccaagcatttaggtgacactataggtggggcactcagggagcaggtttcagagctatgctggaaacagc

SEQ ID NO: 46910 - DNA, 70 bp, Artificial Sequence
  Synthetic
gccaagcatttaggtgacactatagttctttgactagaccttcaagtttcagagctatgctggaaacagc

SEQ ID NO: 46911 - DNA, 70 bp, Artificial Sequence
  Synthetic
gccaagcatttaggtgacactatagcgttaggttttcttttcgccgtttcagagctatgctggaaacagc

SEQ ID NO: 46912 - DNA, 70 bp, Artificial Sequence
  Synthetic
gccaagcatttaggtgacactataggctccaaggcccagggcatggtttcagagctatgctggaaacagc

SEQ ID NO: 46913 - DNA, 70 bp, Artificial Sequence
  Synthetic
gccaagcatttaggtgacactatagccctgagcgtcctgttctgagtttcagagctatgctggaaacagc

SEQ ID NO: 46914 - DNA, 70 bp, Artificial Sequence
  Synthetic
gccaagcatttaggtgacactatagacgggacactcagggagcaggtttcagagctatgctggaaacagc

SEQ ID NO: 46915 - DNA, 70 bp, Artificial Sequence
  Synthetic
gccaagcatttaggtgacactatagtcagcgtgagaagcttaactgtttcagagctatgctggaaacagc

SEQ ID NO: 46916 - DNA, 70 bp, Artificial Sequence
  Synthetic
gccaagcatttaggtgacactatagtgtctagagttgaactgtatgtttcagagctatgctggaaacagc

SEQ ID NO: 46917 - DNA, 70 bp, Artificial Sequence
  Synthetic
gccaagcatttaggtgacactatagtccagggagctctggtagccgtttcagagctatgctggaaacagc

SEQ ID NO: 46918 - DNA, 70 bp, Artificial Sequence
  Synthetic
gccaagcatttaggtgacactataggtgcaagatggtagcaagaagtttcagagctatgctggaaacagc

SEQ ID NO: 46919 - DNA, 70 bp, Artificial Sequence
  Synthetic
gccaagcatttaggtgacactatagggcctgactgtggtgctcatgtttcagagctatgctggaaacagc

SEQ ID NO: 46920 - DNA, 70 bp, Artificial Sequence
  Synthetic
gccaagcatttaggtgacactataggcacaccgccaatatttcatgtttcagagctatgctggaaacagc

SEQ ID NO: 46921 - DNA, 70 bp, Artificial Sequence
  Synthetic
gccaagcatttaggtgacactatagtctgaactggaccacgtgatgtttcagagctatgctggaaacagc

SEQ ID NO: 46922 - DNA, 70 bp, Artificial Sequence
  Synthetic
gccaagcatttaggtgacactatagatttcctgggccacatgacagtttcagagctatgctggaaacagc

SEQ ID NO: 46923 - DNA, 70 bp, Artificial Sequence
  Synthetic
gccaagcatttaggtgacactataggatttgctggtctgtttaacgtttcagagctatgctggaaacagc

SEQ ID NO: 46924 - DNA, 70 bp, Artificial Sequence
  Synthetic
gccaagcatttaggtgacactatagggtcctgagatctttatttcgtttcagagctatgctggaaacagc

SEQ ID NO: 46925 - DNA, 70 bp, Artificial Sequence
  Synthetic
gccaagcatttaggtgacactatagtaagctgataaatctcttcggtttcagagctatgctggaaacagc

SEQ ID NO: 46926 - DNA, 70 bp, Artificial Sequence
  Synthetic
gccaagcatttaggtgacactatagttctacgagctgctgatcaagtttcagagctatgctggaaacagc

SEQ ID NO: 46927 - DNA, 70 bp, Artificial Sequence
  Synthetic
gccaagcatttaggtgacactatagcttagagctgtcagggctctgtttcagagctatgctggaaacagc

SEQ ID NO: 46928 - DNA, 70 bp, Artificial Sequence
  Synthetic
gccaagcatttaggtgacactatagcagaccggccagttgtcagtgtttcagagctatgctggaaacagc

SEQ ID NO: 46929 - DNA, 70 bp, Artificial Sequence
  Synthetic
gccaagcatttaggtgacactatagctaggggagaaccacggaacgtttcagagctatgctggaaacagc

SEQ ID NO: 46930 - DNA, 70 bp, Artificial Sequence
  Synthetic
gccaagcatttaggtgacactatagttgctgcttcttagcaaaacgtttcagagctatgctggaaacagc

SEQ ID NO: 46931 - DNA, 70 bp, Artificial Sequence
  Synthetic
gccaagcatttaggtgacactatagcatttgatttaccagttcgggtttcagagctatgctggaaacagc

SEQ ID NO: 46932 - DNA, 70 bp, Artificial Sequence
  Synthetic
gccaagcatttaggtgacactatagctgggcagggcctcgcctgagtttcagagctatgctggaaacagc

SEQ ID NO: 46933 - DNA, 70 bp, Artificial Sequence
  Synthetic
gccaagcatttaggtgacactataggacgcagctaggcagtgacagtttcagagctatgctggaaacagc

SEQ ID NO: 46934 - DNA, 70 bp, Artificial Sequence
  Synthetic
gccaagcatttaggtgacactatagcaagaccaagcgggaggaaggtttcagagctatgctggaaacagc

SEQ ID NO: 46935 - DNA, 70 bp, Artificial Sequence
  Synthetic
gccaagcatttaggtgacactatagcaagaccaagcaggaggaaggtttcagagctatgctggaaacagc

SEQ ID NO: 46936 - DNA, 70 bp, Artificial Sequence
  Synthetic
gccaagcatttaggtgacactatagcttggctaggtttccattcagtttcagagctatgctggaaacagc

SEQ ID NO: 46937 - DNA, 70 bp, Artificial Sequence
  Synthetic
gccaagcatttaggtgacactataggacagtgccaaaaagttgtggtttcagagctatgctggaaacagc

SEQ ID NO: 46938 - DNA, 70 bp, Artificial Sequence
  Synthetic
gccaagcatttaggtgacactatagatgtgagcctgtcctacagagtttcagagctatgctggaaacagc

SEQ ID NO: 46939 - DNA, 70 bp, Artificial Sequence
  Synthetic
gccaagcatttaggtgacactataggaaggcaagggagcgctagggtttcagagctatgctggaaacagc

SEQ ID NO: 46940 - DNA, 70 bp, Artificial Sequence
  Synthetic
gccaagcatttaggtgacactatagccgcgcggcgcaggggtcacgtttcagagctatgctggaaacagc

SEQ ID NO: 46941 - DNA, 70 bp, Artificial Sequence
  Synthetic
gccaagcatttaggtgacactatagaggagctccctcagcccatcgtttcagagctatgctggaaacagc

SEQ ID NO: 46942 - DNA, 70 bp, Artificial Sequence
  Synthetic
gccaagcatttaggtgacactatagtgcatatttacacaggagaagtttcagagctatgctggaaacagc

SEQ ID NO: 46943 - DNA, 70 bp, Artificial Sequence
  Synthetic
gccaagcatttaggtgacactatagacgcccattgtggtgtgagcgtttcagagctatgctggaaacagc

SEQ ID NO: 46944 - DNA, 70 bp, Artificial Sequence
  Synthetic
gccaagcatttaggtgacactatagaattaagtggacgccacaaagtttcagagctatgctggaaacagc

SEQ ID NO: 46945 - DNA, 70 bp, Artificial Sequence
  Synthetic
gccaagcatttaggtgacactatagctgggcagtctaggttgtcagtttcagagctatgctggaaacagc

SEQ ID NO: 46946 - DNA, 70 bp, Artificial Sequence
  Synthetic
gccaagcatttaggtgacactatagcggctcagtgtcaggaataagtttcagagctatgctggaaacagc

SEQ ID NO: 46947 - DNA, 70 bp, Artificial Sequence
  Synthetic
gccaagcatttaggtgacactataggtcaggagtaatgattgtaggtttcagagctatgctggaaacagc

SEQ ID NO: 46948 - DNA, 70 bp, Artificial Sequence
  Synthetic
gccaagcatttaggtgacactatagggccgaggccgaggcctgaggtttcagagctatgctggaaacagc

SEQ ID NO: 46949 - DNA, 70 bp, Artificial Sequence
  Synthetic
gccaagcatttaggtgacactatagacaaactaaagcaagtgacagtttcagagctatgctggaaacagc

SEQ ID NO: 46950 - DNA, 70 bp, Artificial Sequence
  Synthetic
gccaagcatttaggtgacactatagagagcctgatgcagagatgggtttcagagctatgctggaaacagc

SEQ ID NO: 46951 - DNA, 70 bp, Artificial Sequence
  Synthetic
gccaagcatttaggtgacactatagacagggatggcagttagatggtttcagagctatgctggaaacagc

SEQ ID NO: 46952 - DNA, 70 bp, Artificial Sequence
  Synthetic
gccaagcatttaggtgacactatagtggtggagatactgatctgagtttcagagctatgctggaaacagc

SEQ ID NO: 46953 - DNA, 70 bp, Artificial Sequence
  Synthetic
gccaagcatttaggtgacactatagtggcctatcgctatgaaaccgtttcagagctatgctggaaacagc

SEQ ID NO: 46954 - DNA, 70 bp, Artificial Sequence
  Synthetic
gccaagcatttaggtgacactatagttcatggaccaggctcattggtttcagagctatgctggaaacagc

SEQ ID NO: 46955 - DNA, 70 bp, Artificial Sequence
  Synthetic
gccaagcatttaggtgacactatagtgtcaaatgctggacctagtgtttcagagctatgctggaaacagc

SEQ ID NO: 46956 - DNA, 70 bp, Artificial Sequence
  Synthetic
gccaagcatttaggtgacactatagttcacccgacgcttagattagtttcagagctatgctggaaacagc

SEQ ID NO: 46957 - DNA, 70 bp, Artificial Sequence
  Synthetic
gccaagcatttaggtgacactatagctggtccgtcactcagaagcgtttcagagctatgctggaaacagc

SEQ ID NO: 46958 - DNA, 70 bp, Artificial Sequence
  Synthetic
gccaagcatttaggtgacactatagccctgagccagcttcacttggtttcagagctatgctggaaacagc

SEQ ID NO: 46959 - DNA, 70 bp, Artificial Sequence
  Synthetic
gccaagcatttaggtgacactataggccaccacagaatcagcaaagtttcagagctatgctggaaacagc

SEQ ID NO: 46960 - DNA, 70 bp, Artificial Sequence
  Synthetic
gccaagcatttaggtgacactatagaaaattaatggcaactgcacgtttcagagctatgctggaaacagc

SEQ ID NO: 46961 - DNA, 70 bp, Artificial Sequence
  Synthetic
gccaagcatttaggtgacactatagacatactgtgatgtcatttcgtttcagagctatgctggaaacagc

SEQ ID NO: 46962 - DNA, 70 bp, Artificial Sequence
  Synthetic
gccaagcatttaggtgacactatagttctattagtaactctgctggtttcagagctatgctggaaacagc

SEQ ID NO: 46963 - DNA, 70 bp, Artificial Sequence
  Synthetic
gccaagcatttaggtgacactatagggccccccgtccctgggatggtttcagagctatgctggaaacagc

SEQ ID NO: 46964 - DNA, 70 bp, Artificial Sequence
  Synthetic
gccaagcatttaggtgacactatagctcacagcacatgcccgagtgtttcagagctatgctggaaacagc

SEQ ID NO: 46965 - DNA, 70 bp, Artificial Sequence
  Synthetic
gccaagcatttaggtgacactataggctgcttcagttcccagctggtttcagagctatgctggaaacagc

SEQ ID NO: 46966 - DNA, 70 bp, Artificial Sequence
  Synthetic
gccaagcatttaggtgacactatagctggctgttctccaaaaatggtttcagagctatgctggaaacagc

SEQ ID NO: 46967 - DNA, 70 bp, Artificial Sequence
  Synthetic
gccaagcatttaggtgacactatagagacacggtcacatcaccatgtttcagagctatgctggaaacagc

SEQ ID NO: 46968 - DNA, 70 bp, Artificial Sequence
  Synthetic
gccaagcatttaggtgacactatagagttggtggaaccaagtggcgtttcagagctatgctggaaacagc

SEQ ID NO: 46969 - DNA, 70 bp, Artificial Sequence
  Synthetic
gccaagcatttaggtgacactatagccagtagaagagagctccatgtttcagagctatgctggaaacagc

SEQ ID NO: 46970 - DNA, 70 bp, Artificial Sequence
  Synthetic
gccaagcatttaggtgacactatagtcacaaccttcaagaaattcgtttcagagctatgctggaaacagc

SEQ ID NO: 46971 - DNA, 70 bp, Artificial Sequence
  Synthetic
gccaagcatttaggtgacactatagcgacctggctctcgctggaggtttcagagctatgctggaaacagc

SEQ ID NO: 46972 - DNA, 70 bp, Artificial Sequence
  Synthetic
gccaagcatttaggtgacactatagtccaccttgttgcagctcaggtttcagagctatgctggaaacagc

SEQ ID NO: 46973 - DNA, 70 bp, Artificial Sequence
  Synthetic
gccaagcatttaggtgacactatagaggcaggaagccgcagctgagtttcagagctatgctggaaacagc

SEQ ID NO: 46974 - DNA, 70 bp, Artificial Sequence
  Synthetic
gccaagcatttaggtgacactatagagccaagcgtcagtttccaagtttcagagctatgctggaaacagc

SEQ ID NO: 46975 - DNA, 70 bp, Artificial Sequence
  Synthetic
gccaagcatttaggtgacactatagtcagagagatggaaggatctgtttcagagctatgctggaaacagc

SEQ ID NO: 46976 - DNA, 70 bp, Artificial Sequence
  Synthetic
gccaagcatttaggtgacactatagatagggtggttgtttctgccgtttcagagctatgctggaaacagc

SEQ ID NO: 46977 - DNA, 70 bp, Artificial Sequence
  Synthetic
gccaagcatttaggtgacactatagtcaggaccagtggatgatctgtttcagagctatgctggaaacagc

SEQ ID NO: 46978 - DNA, 70 bp, Artificial Sequence
  Synthetic
gccaagcatttaggtgacactatagcaggcagtatcaacctgaaggtttcagagctatgctggaaacagc

SEQ ID NO: 46979 - DNA, 70 bp, Artificial Sequence
  Synthetic
gccaagcatttaggtgacactataggatgtgtcagctgcagttctgtttcagagctatgctggaaacagc

SEQ ID NO: 46980 - DNA, 70 bp, Artificial Sequence
  Synthetic
gccaagcatttaggtgacactatagctagattaggagtctagctcgtttcagagctatgctggaaacagc

SEQ ID NO: 46981 - DNA, 70 bp, Artificial Sequence
  Synthetic
gccaagcatttaggtgacactatagttgataaaccatctctagaggtttcagagctatgctggaaacagc

SEQ ID NO: 46982 - DNA, 70 bp, Artificial Sequence
  Synthetic
gccaagcatttaggtgacactatagaccagtatagtatagcactagtttcagagctatgctggaaacagc

SEQ ID NO: 46983 - DNA, 70 bp, Artificial Sequence
  Synthetic
gccaagcatttaggtgacactatagtggttcggcatgcagtgagggtttcagagctatgctggaaacagc

SEQ ID NO: 46984 - DNA, 70 bp, Artificial Sequence
  Synthetic
gccaagcatttaggtgacactatagggcccgctggttacggacgagtttcagagctatgctggaaacagc

SEQ ID NO: 46985 - DNA, 70 bp, Artificial Sequence
  Synthetic
gccaagcatttaggtgacactataggtgttggaagagatggtgatgtttcagagctatgctggaaacagc

SEQ ID NO: 46986 - DNA, 70 bp, Artificial Sequence
  Synthetic
gccaagcatttaggtgacactataggaagtcaccgccccatgacagtttcagagctatgctggaaacagc

SEQ ID NO: 46987 - DNA, 70 bp, Artificial Sequence
  Synthetic
gccaagcatttaggtgacactatagagtctgaactttgccaataagtttcagagctatgctggaaacagc

SEQ ID NO: 46988 - DNA, 70 bp, Artificial Sequence
  Synthetic
gccaagcatttaggtgacactatagaggtcgaatcatcatagttggtttcagagctatgctggaaacagc

SEQ ID NO: 46989 - DNA, 70 bp, Artificial Sequence
  Synthetic
gccaagcatttaggtgacactatagtgggatgtttagaaatctgcgtttcagagctatgctggaaacagc

SEQ ID NO: 46990 - DNA, 70 bp, Artificial Sequence
  Synthetic
gccaagcatttaggtgacactataggcagtgagaaccagctatacgtttcagagctatgctggaaacagc

SEQ ID NO: 46991 - DNA, 70 bp, Artificial Sequence
  Synthetic
gccaagcatttaggtgacactataggctgctcgttagatgtccaagtttcagagctatgctggaaacagc

SEQ ID NO: 46992 - DNA, 70 bp, Artificial Sequence
  Synthetic
gccaagcatttaggtgacactatagagtgtctctcttcagtcaatgtttcagagctatgctggaaacagc

SEQ ID NO: 46993 - DNA, 70 bp, Artificial Sequence
  Synthetic
gccaagcatttaggtgacactatagaggagggggagctggcttaggtttcagagctatgctggaaacagc

SEQ ID NO: 46994 - DNA, 70 bp, Artificial Sequence
  Synthetic
gccaagcatttaggtgacactatagtcaaagctttctgaatctgtgtttcagagctatgctggaaacagc

SEQ ID NO: 46995 - DNA, 70 bp, Artificial Sequence
  Synthetic
gccaagcatttaggtgacactatagggcccagccaggacgctagggtttcagagctatgctggaaacagc

SEQ ID NO: 46996 - DNA, 70 bp, Artificial Sequence
  Synthetic
gccaagcatttaggtgacactatagcttgacaggtgagttgttttgtttcagagctatgctggaaacagc

SEQ ID NO: 46997 - DNA, 70 bp, Artificial Sequence
  Synthetic
gccaagcatttaggtgacactataggaacacagagtcacagcttcgtttcagagctatgctggaaacagc

SEQ ID NO: 46998 - DNA, 70 bp, Artificial Sequence
  Synthetic
gccaagcatttaggtgacactatagagaagacttcaagccttaaagtttcagagctatgctggaaacagc

SEQ ID NO: 46999 - DNA, 70 bp, Artificial Sequence
  Synthetic
gccaagcatttaggtgacactatagccatccaggcagattcaggcgtttcagagctatgctggaaacagc

SEQ ID NO: 47000 - DNA, 70 bp, Artificial Sequence
  Synthetic
gccaagcatttaggtgacactatagtcctggggatagctcagcccgtttcagagctatgctggaaacagc

SEQ ID NO: 47001 - DNA, 70 bp, Artificial Sequence
  Synthetic
gccaagcatttaggtgacactataggcagagtgtgtggggttcaggtttcagagctatgctggaaacagc

SEQ ID NO: 47002 - DNA, 70 bp, Artificial Sequence
  Synthetic
gccaagcatttaggtgacactatagagcgggccagcctgaaaagggtttcagagctatgctggaaacagc

SEQ ID NO: 47003 - DNA, 70 bp, Artificial Sequence
  Synthetic
gccaagcatttaggtgacactatagagccaaagatgactttgaaggtttcagagctatgctggaaacagc

SEQ ID NO: 47004 - DNA, 70 bp, Artificial Sequence
  Synthetic
gccaagcatttaggtgacactataggagtgacaccgagcagtcaggtttcagagctatgctggaaacagc

SEQ ID NO: 47005 - DNA, 70 bp, Artificial Sequence
  Synthetic
gccaagcatttaggtgacactatagtggacacaccgtggtaaagagtttcagagctatgctggaaacagc

SEQ ID NO: 47006 - DNA, 70 bp, Artificial Sequence
  Synthetic
gccaagcatttaggtgacactatagtgaccgttcgctgttacgaggtttcagagctatgctggaaacagc

SEQ ID NO: 47007 - DNA, 70 bp, Artificial Sequence
  Synthetic
gccaagcatttaggtgacactatagatgttttattagccttctgcgtttcagagctatgctggaaacagc

SEQ ID NO: 47008 - DNA, 70 bp, Artificial Sequence
  Synthetic
gccaagcatttaggtgacactatagccattgtactccagccagccgtttcagagctatgctggaaacagc

SEQ ID NO: 47009 - DNA, 70 bp, Artificial Sequence
  Synthetic
gccaagcatttaggtgacactatagtatgaagagctggtacacgcgtttcagagctatgctggaaacagc

SEQ ID NO: 47010 - DNA, 70 bp, Artificial Sequence
  Synthetic
gccaagcatttaggtgacactatagtgctatgacttaggtcttcagtttcagagctatgctggaaacagc

SEQ ID NO: 47011 - DNA, 70 bp, Artificial Sequence
  Synthetic
gccaagcatttaggtgacactatagcctcttcagatgtttgaactgtttcagagctatgctggaaacagc

SEQ ID NO: 47012 - DNA, 70 bp, Artificial Sequence
  Synthetic
gccaagcatttaggtgacactatagtgatgtactgactctgggtggtttcagagctatgctggaaacagc

SEQ ID NO: 47013 - DNA, 70 bp, Artificial Sequence
  Synthetic
gccaagcatttaggtgacactatagatgagagaggagaatgaatagtttcagagctatgctggaaacagc

SEQ ID NO: 47014 - DNA, 70 bp, Artificial Sequence
  Synthetic
gccaagcatttaggtgacactatagagatgcatgtttccaatatggtttcagagctatgctggaaacagc

SEQ ID NO: 47015 - DNA, 70 bp, Artificial Sequence
  Synthetic
gccaagcatttaggtgacactatagtagtagcttacaagcatcaagtttcagagctatgctggaaacagc

SEQ ID NO: 47016 - DNA, 70 bp, Artificial Sequence
  Synthetic
gccaagcatttaggtgacactatagatttcaaattgtgcgtcatcgtttcagagctatgctggaaacagc

SEQ ID NO: 47017 - DNA, 70 bp, Artificial Sequence
  Synthetic
gccaagcatttaggtgacactatagcacctcaaacctcaagtgacgtttcagagctatgctggaaacagc

SEQ ID NO: 47018 - DNA, 70 bp, Artificial Sequence
  Synthetic
gccaagcatttaggtgacactatagttctaagccaggagccgagagtttcagagctatgctggaaacagc

SEQ ID NO: 47019 - DNA, 70 bp, Artificial Sequence
  Synthetic
gccaagcatttaggtgacactatagaactccccagcactcagcccgtttcagagctatgctggaaacagc

SEQ ID NO: 47020 - DNA, 70 bp, Artificial Sequence
  Synthetic
gccaagcatttaggtgacactatagcccatctctggtttcagaaggtttcagagctatgctggaaacagc

SEQ ID NO: 47021 - DNA, 70 bp, Artificial Sequence
  Synthetic
gccaagcatttaggtgacactataggagcccagcgccaagcctacgtttcagagctatgctggaaacagc

SEQ ID NO: 47022 - DNA, 70 bp, Artificial Sequence
  Synthetic
gccaagcatttaggtgacactatagacgtgcagctgctgcttcacgtttcagagctatgctggaaacagc

SEQ ID NO: 47023 - DNA, 70 bp, Artificial Sequence
  Synthetic
gccaagcatttaggtgacactatagtgcagggccacaggtgtctggtttcagagctatgctggaaacagc

SEQ ID NO: 47024 - DNA, 70 bp, Artificial Sequence
  Synthetic
gccaagcatttaggtgacactatagatggatctagctgtagccctgtttcagagctatgctggaaacagc

SEQ ID NO: 47025 - DNA, 70 bp, Artificial Sequence
  Synthetic
gccaagcatttaggtgacactatagtctcgcatagctacattctggtttcagagctatgctggaaacagc

SEQ ID NO: 47026 - DNA, 70 bp, Artificial Sequence
  Synthetic
gccaagcatttaggtgacactatagaatggttcagatgacaattcgtttcagagctatgctggaaacagc

SEQ ID NO: 47027 - DNA, 70 bp, Artificial Sequence
  Synthetic
gccaagcatttaggtgacactataggtcagcgtctctaggagccggtttcagagctatgctggaaacagc

SEQ ID NO: 47028 - DNA, 70 bp, Artificial Sequence
  Synthetic
gccaagcatttaggtgacactataggccgtcccgcggtgtcatgcgtttcagagctatgctggaaacagc

SEQ ID NO: 47029 - DNA, 70 bp, Artificial Sequence
  Synthetic
gccaagcatttaggtgacactatagggaagtactgactgctatatgtttcagagctatgctggaaacagc

SEQ ID NO: 47030 - DNA, 70 bp, Artificial Sequence
  Synthetic
gccaagcatttaggtgacactataggtgacagctgtaagacttgcgtttcagagctatgctggaaacagc

SEQ ID NO: 47031 - DNA, 70 bp, Artificial Sequence
  Synthetic
gccaagcatttaggtgacactatagcggcagggggcgctactgctgtttcagagctatgctggaaacagc

SEQ ID NO: 47032 - DNA, 70 bp, Artificial Sequence
  Synthetic
gccaagcatttaggtgacactatagttccacgtcagttaaagatcgtttcagagctatgctggaaacagc

SEQ ID NO: 47033 - DNA, 70 bp, Artificial Sequence
  Synthetic
gccaagcatttaggtgacactataggctcagtgagtgacagctgcgtttcagagctatgctggaaacagc

SEQ ID NO: 47034 - DNA, 70 bp, Artificial Sequence
  Synthetic
gccaagcatttaggtgacactatagggccatagcgcaatgacatagtttcagagctatgctggaaacagc

SEQ ID NO: 47035 - DNA, 70 bp, Artificial Sequence
  Synthetic
gccaagcatttaggtgacactatagtctcctgcagtcgggactgagtttcagagctatgctggaaacagc

SEQ ID NO: 47036 - DNA, 70 bp, Artificial Sequence
  Synthetic
gccaagcatttaggtgacactatagatgaaccagcttggctgatggtttcagagctatgctggaaacagc

SEQ ID NO: 47037 - DNA, 70 bp, Artificial Sequence
  Synthetic
gccaagcatttaggtgacactatagctgcaagaacttcttgactggtttcagagctatgctggaaacagc

SEQ ID NO: 47038 - DNA, 70 bp, Artificial Sequence
  Synthetic
gccaagcatttaggtgacactataggtcattctcaaaggggaagcgtttcagagctatgctggaaacagc

SEQ ID NO: 47039 - DNA, 70 bp, Artificial Sequence
  Synthetic
gccaagcatttaggtgacactataggggctggggcacgcattcacgtttcagagctatgctggaaacagc

SEQ ID NO: 47040 - DNA, 70 bp, Artificial Sequence
  Synthetic
gccaagcatttaggtgacactatagagaaggagtagtaagtatcagtttcagagctatgctggaaacagc

SEQ ID NO: 47041 - DNA, 70 bp, Artificial Sequence
  Synthetic
gccaagcatttaggtgacactatagcaaagaggctttattgagaggtttcagagctatgctggaaacagc

SEQ ID NO: 47042 - DNA, 70 bp, Artificial Sequence
  Synthetic
gccaagcatttaggtgacactatagagagctcactggatattgcagtttcagagctatgctggaaacagc

SEQ ID NO: 47043 - DNA, 70 bp, Artificial Sequence
  Synthetic
gccaagcatttaggtgacactatagggcggtgctgcggtcagcacgtttcagagctatgctggaaacagc

SEQ ID NO: 47044 - DNA, 70 bp, Artificial Sequence
  Synthetic
gccaagcatttaggtgacactatagctgggcctggcctttctcaggtttcagagctatgctggaaacagc

SEQ ID NO: 47045 - DNA, 70 bp, Artificial Sequence
  Synthetic
gccaagcatttaggtgacactatagagcatcaagagaatatgtacgtttcagagctatgctggaaacagc

SEQ ID NO: 47046 - DNA, 70 bp, Artificial Sequence
  Synthetic
gccaagcatttaggtgacactatagtagtgcttcccggtcctaacgtttcagagctatgctggaaacagc

SEQ ID NO: 47047 - DNA, 70 bp, Artificial Sequence
  Synthetic
gccaagcatttaggtgacactatagcgattctgagacctactgaggtttcagagctatgctggaaacagc

SEQ ID NO: 47048 - DNA, 70 bp, Artificial Sequence
  Synthetic
gccaagcatttaggtgacactatagattagtgctcgaacttcatcgtttcagagctatgctggaaacagc

SEQ ID NO: 47049 - DNA, 70 bp, Artificial Sequence
  Synthetic
gccaagcatttaggtgacactatagggagctaagttagctctttcgtttcagagctatgctggaaacagc

SEQ ID NO: 47050 - DNA, 70 bp, Artificial Sequence
  Synthetic
gccaagcatttaggtgacactataggaacaaacacactgaacagcgtttcagagctatgctggaaacagc

SEQ ID NO: 47051 - DNA, 70 bp, Artificial Sequence
  Synthetic
gccaagcatttaggtgacactatagctagattcagcatttagccagtttcagagctatgctggaaacagc

SEQ ID NO: 47052 - DNA, 70 bp, Artificial Sequence
  Synthetic
gccaagcatttaggtgacactataggaagttttgtgtggaatgtggtttcagagctatgctggaaacagc

SEQ ID NO: 47053 - DNA, 70 bp, Artificial Sequence
  Synthetic
gccaagcatttaggtgacactatagcaggctgggaacaggtaatcgtttcagagctatgctggaaacagc

SEQ ID NO: 47054 - DNA, 70 bp, Artificial Sequence
  Synthetic
gccaagcatttaggtgacactatagccagaatggcacagaagtaggtttcagagctatgctggaaacagc

SEQ ID NO: 47055 - DNA, 70 bp, Artificial Sequence
  Synthetic
gccaagcatttaggtgacactatagcctggaagaagaggacgtgagtttcagagctatgctggaaacagc

SEQ ID NO: 47056 - DNA, 70 bp, Artificial Sequence
  Synthetic
gccaagcatttaggtgacactatagtggggagccagggcgctgaggtttcagagctatgctggaaacagc

SEQ ID NO: 47057 - DNA, 70 bp, Artificial Sequence
  Synthetic
gccaagcatttaggtgacactatagttagggaaaatcggaactgtgtttcagagctatgctggaaacagc

SEQ ID NO: 47058 - DNA, 70 bp, Artificial Sequence
  Synthetic
gccaagcatttaggtgacactatagtttgcatagaatgccttctggtttcagagctatgctggaaacagc

SEQ ID NO: 47059 - DNA, 70 bp, Artificial Sequence
  Synthetic
gccaagcatttaggtgacactatagcttagcatggaagaggagtggtttcagagctatgctggaaacagc

SEQ ID NO: 47060 - DNA, 70 bp, Artificial Sequence
  Synthetic
gccaagcatttaggtgacactatagtgaagaatgcagcaaggtatgtttcagagctatgctggaaacagc

SEQ ID NO: 47061 - DNA, 70 bp, Artificial Sequence
  Synthetic
gccaagcatttaggtgacactatagaacaggatgaccaaattgaggtttcagagctatgctggaaacagc

SEQ ID NO: 47062 - DNA, 70 bp, Artificial Sequence
  Synthetic
gccaagcatttaggtgacactatagaacaggatgaacaaattgaggtttcagagctatgctggaaacagc

SEQ ID NO: 47063 - DNA, 70 bp, Artificial Sequence
  Synthetic
gccaagcatttaggtgacactatagtagaaaataccagtgggaaagtttcagagctatgctggaaacagc

SEQ ID NO: 47064 - DNA, 70 bp, Artificial Sequence
  Synthetic
gccaagcatttaggtgacactatagagatagggtggcggctcagcgtttcagagctatgctggaaacagc

SEQ ID NO: 47065 - DNA, 70 bp, Artificial Sequence
  Synthetic
gccaagcatttaggtgacactatagctgaaaggccttgctataacgtttcagagctatgctggaaacagc

SEQ ID NO: 47066 - DNA, 70 bp, Artificial Sequence
  Synthetic
gccaagcatttaggtgacactatagggctctttggacttgaatccgtttcagagctatgctggaaacagc

SEQ ID NO: 47067 - DNA, 70 bp, Artificial Sequence
  Synthetic
gccaagcatttaggtgacactatagctggaggggtgtttgtgagagtttcagagctatgctggaaacagc

SEQ ID NO: 47068 - DNA, 70 bp, Artificial Sequence
  Synthetic
gccaagcatttaggtgacactatagggctccacagggatctaagggtttcagagctatgctggaaacagc

SEQ ID NO: 47069 - DNA, 70 bp, Artificial Sequence
  Synthetic
gccaagcatttaggtgacactataggtagtcgttcatactccagcgtttcagagctatgctggaaacagc

SEQ ID NO: 47070 - DNA, 70 bp, Artificial Sequence
  Synthetic
gccaagcatttaggtgacactataggtgagtcaaacaaagagaaggtttcagagctatgctggaaacagc

SEQ ID NO: 47071 - DNA, 70 bp, Artificial Sequence
  Synthetic
gccaagcatttaggtgacactatagttttgacatatcagtcagtcgtttcagagctatgctggaaacagc

SEQ ID NO: 47072 - DNA, 70 bp, Artificial Sequence
  Synthetic
gccaagcatttaggtgacactatagtatttttgcggtaacctactgtttcagagctatgctggaaacagc

SEQ ID NO: 47073 - DNA, 70 bp, Artificial Sequence
  Synthetic
gccaagcatttaggtgacactatagtctttttgtacagcggttccgtttcagagctatgctggaaacagc

SEQ ID NO: 47074 - DNA, 70 bp, Artificial Sequence
  Synthetic
gccaagcatttaggtgacactatagttacagaacgtatgttcagtgtttcagagctatgctggaaacagc

SEQ ID NO: 47075 - DNA, 70 bp, Artificial Sequence
  Synthetic
gccaagcatttaggtgacactatagacactgacctagagattagagtttcagagctatgctggaaacagc

SEQ ID NO: 47076 - DNA, 70 bp, Artificial Sequence
  Synthetic
gccaagcatttaggtgacactatagagcctgaactggtgcattaagtttcagagctatgctggaaacagc

SEQ ID NO: 47077 - DNA, 70 bp, Artificial Sequence
  Synthetic
gccaagcatttaggtgacactatagtacctctttgaaattgtggagtttcagagctatgctggaaacagc

SEQ ID NO: 47078 - DNA, 70 bp, Artificial Sequence
  Synthetic
gccaagcatttaggtgacactataggctctgaagcttcagattgagtttcagagctatgctggaaacagc

SEQ ID NO: 47079 - DNA, 70 bp, Artificial Sequence
  Synthetic
gccaagcatttaggtgacactatagcccggcgccattgggttagagtttcagagctatgctggaaacagc

SEQ ID NO: 47080 - DNA, 70 bp, Artificial Sequence
  Synthetic
gccaagcatttaggtgacactatagtaactttatgggttggtttggtttcagagctatgctggaaacagc

SEQ ID NO: 47081 - DNA, 70 bp, Artificial Sequence
  Synthetic
gccaagcatttaggtgacactatagtggattcctttggagaagaagtttcagagctatgctggaaacagc

SEQ ID NO: 47082 - DNA, 70 bp, Artificial Sequence
  Synthetic
gccaagcatttaggtgacactatagagatgcagagcatggagaaggtttcagagctatgctggaaacagc

SEQ ID NO: 47083 - DNA, 70 bp, Artificial Sequence
  Synthetic
gccaagcatttaggtgacactatagattttcatcactggtggggtgtttcagagctatgctggaaacagc

SEQ ID NO: 47084 - DNA, 70 bp, Artificial Sequence
  Synthetic
gccaagcatttaggtgacactatagactaaggactagggtgcagagtttcagagctatgctggaaacagc

SEQ ID NO: 47085 - DNA, 70 bp, Artificial Sequence
  Synthetic
gccaagcatttaggtgacactataggttcccaccaggagctaatggtttcagagctatgctggaaacagc

SEQ ID NO: 47086 - DNA, 70 bp, Artificial Sequence
  Synthetic
gccaagcatttaggtgacactatagctgggaggtcttatttcaaggtttcagagctatgctggaaacagc

SEQ ID NO: 47087 - DNA, 70 bp, Artificial Sequence
  Synthetic
gccaagcatttaggtgacactataggtcaacagttactctgtagcgtttcagagctatgctggaaacagc

SEQ ID NO: 47088 - DNA, 70 bp, Artificial Sequence
  Synthetic
gccaagcatttaggtgacactataggctgcgtgctcagcggtaaagtttcagagctatgctggaaacagc

SEQ ID NO: 47089 - DNA, 70 bp, Artificial Sequence
  Synthetic
gccaagcatttaggtgacactatagctgctgtctggctcagcccggtttcagagctatgctggaaacagc

SEQ ID NO: 47090 - DNA, 70 bp, Artificial Sequence
  Synthetic
gccaagcatttaggtgacactatagtcggctcagcagaagccccagtttcagagctatgctggaaacagc

SEQ ID NO: 47091 - DNA, 70 bp, Artificial Sequence
  Synthetic
gccaagcatttaggtgacactatagttctcatactctcctcccctgtttcagagctatgctggaaacagc

SEQ ID NO: 47092 - DNA, 70 bp, Artificial Sequence
  Synthetic
gccaagcatttaggtgacactatagtagcatgtttcttctttccagtttcagagctatgctggaaacagc

SEQ ID NO: 47093 - DNA, 70 bp, Artificial Sequence
  Synthetic
gccaagcatttaggtgacactatagggacctcactggcaaaggctgtttcagagctatgctggaaacagc

SEQ ID NO: 47094 - DNA, 70 bp, Artificial Sequence
  Synthetic
gccaagcatttaggtgacactatagaccccaaaccagactctaaggtttcagagctatgctggaaacagc

SEQ ID NO: 47095 - DNA, 70 bp, Artificial Sequence
  Synthetic
gccaagcatttaggtgacactatagatcagagagacacactgagggtttcagagctatgctggaaacagc

SEQ ID NO: 47096 - DNA, 70 bp, Artificial Sequence
  Synthetic
gccaagcatttaggtgacactatagcggcgagtatcagaaaatcggtttcagagctatgctggaaacagc

SEQ ID NO: 47097 - DNA, 70 bp, Artificial Sequence
  Synthetic
gccaagcatttaggtgacactataggccagagtcttttgctcagagtttcagagctatgctggaaacagc

SEQ ID NO: 47098 - DNA, 70 bp, Artificial Sequence
  Synthetic
gccaagcatttaggtgacactataggctgaacgggaagaagtggcgtttcagagctatgctggaaacagc

SEQ ID NO: 47099 - DNA, 70 bp, Artificial Sequence
  Synthetic
gccaagcatttaggtgacactatagaggccaaaactctccatcacgtttcagagctatgctggaaacagc

SEQ ID NO: 47100 - DNA, 70 bp, Artificial Sequence
  Synthetic
gccaagcatttaggtgacactatagcgggaaggaggatcacgcacgtttcagagctatgctggaaacagc

SEQ ID NO: 47101 - DNA, 70 bp, Artificial Sequence
  Synthetic
gccaagcatttaggtgacactatagcacacgctgtcagacctcctgtttcagagctatgctggaaacagc

SEQ ID NO: 47102 - DNA, 70 bp, Artificial Sequence
  Synthetic
gccaagcatttaggtgacactatagtctactgcttagctgtggcagtttcagagctatgctggaaacagc

SEQ ID NO: 47103 - DNA, 70 bp, Artificial Sequence
  Synthetic
gccaagcatttaggtgacactatagagctgtaagagatcaggaaggtttcagagctatgctggaaacagc

SEQ ID NO: 47104 - DNA, 70 bp, Artificial Sequence
  Synthetic
gccaagcatttaggtgacactatagcctattggaaagccttaaacgtttcagagctatgctggaaacagc

SEQ ID NO: 47105 - DNA, 70 bp, Artificial Sequence
  Synthetic
gccaagcatttaggtgacactatagagccccgctggcatagctacgtttcagagctatgctggaaacagc

SEQ ID NO: 47106 - DNA, 70 bp, Artificial Sequence
  Synthetic
gccaagcatttaggtgacactatagaatggaaagcgggaaggagagtttcagagctatgctggaaacagc

SEQ ID NO: 47107 - DNA, 70 bp, Artificial Sequence
  Synthetic
gccaagcatttaggtgacactatagcagggccatgactagaccccgtttcagagctatgctggaaacagc

SEQ ID NO: 47108 - DNA, 70 bp, Artificial Sequence
  Synthetic
gccaagcatttaggtgacactatagaggctgaactgctcacacatgtttcagagctatgctggaaacagc

SEQ ID NO: 47109 - DNA, 70 bp, Artificial Sequence
  Synthetic
gccaagcatttaggtgacactataggtgtcaactaaggccattcagtttcagagctatgctggaaacagc

SEQ ID NO: 47110 - DNA, 70 bp, Artificial Sequence
  Synthetic
gccaagcatttaggtgacactataggaaaagcacaccacaacgaggtttcagagctatgctggaaacagc

SEQ ID NO: 47111 - DNA, 70 bp, Artificial Sequence
  Synthetic
gccaagcatttaggtgacactatagtgaggaaaacaaagcacagcgtttcagagctatgctggaaacagc

SEQ ID NO: 47112 - DNA, 70 bp, Artificial Sequence
  Synthetic
gccaagcatttaggtgacactatagatatgggggtgatagctgaggtttcagagctatgctggaaacagc

SEQ ID NO: 47113 - DNA, 70 bp, Artificial Sequence
  Synthetic
gccaagcatttaggtgacactataggatacagaaaaacacggagtgtttcagagctatgctggaaacagc

SEQ ID NO: 47114 - DNA, 70 bp, Artificial Sequence
  Synthetic
gccaagcatttaggtgacactatagccaggcgtcactgctgcagcgtttcagagctatgctggaaacagc

SEQ ID NO: 47115 - DNA, 70 bp, Artificial Sequence
  Synthetic
gccaagcatttaggtgacactatagccatgccctcaggcctcatggtttcagagctatgctggaaacagc

SEQ ID NO: 47116 - DNA, 70 bp, Artificial Sequence
  Synthetic
gccaagcatttaggtgacactataggtagagctaatgccagccgcgtttcagagctatgctggaaacagc

SEQ ID NO: 47117 - DNA, 70 bp, Artificial Sequence
  Synthetic
gccaagcatttaggtgacactataggccaggagcacagacgtgtagtttcagagctatgctggaaacagc

SEQ ID NO: 47118 - DNA, 70 bp, Artificial Sequence
  Synthetic
gccaagcatttaggtgacactatagggagaaggcttgtaatgatggtttcagagctatgctggaaacagc

SEQ ID NO: 47119 - DNA, 70 bp, Artificial Sequence
  Synthetic
gccaagcatttaggtgacactataggggagaagatgatgactaaggtttcagagctatgctggaaacagc

SEQ ID NO: 47120 - DNA, 70 bp, Artificial Sequence
  Synthetic
gccaagcatttaggtgacactatagaagagagaaacagatgatgagtttcagagctatgctggaaacagc

SEQ ID NO: 47121 - DNA, 70 bp, Artificial Sequence
  Synthetic
gccaagcatttaggtgacactataggagcttggtgaagaagaaaggtttcagagctatgctggaaacagc

SEQ ID NO: 47122 - DNA, 70 bp, Artificial Sequence
  Synthetic
gccaagcatttaggtgacactatagcttagaccttttcacttgcggtttcagagctatgctggaaacagc

SEQ ID NO: 47123 - DNA, 70 bp, Artificial Sequence
  Synthetic
gccaagcatttaggtgacactatagagatgctgaagacgatggaggtttcagagctatgctggaaacagc

SEQ ID NO: 47124 - DNA, 70 bp, Artificial Sequence
  Synthetic
gccaagcatttaggtgacactatagggagagggagaagaggaagtgtttcagagctatgctggaaacagc

SEQ ID NO: 47125 - DNA, 70 bp, Artificial Sequence
  Synthetic
gccaagcatttaggtgacactatagtgctgttttctgtgaaccacgtttcagagctatgctggaaacagc

SEQ ID NO: 47126 - DNA, 70 bp, Artificial Sequence
  Synthetic
gccaagcatttaggtgacactatagaactttgggctctagacagagtttcagagctatgctggaaacagc

SEQ ID NO: 47127 - DNA, 70 bp, Artificial Sequence
  Synthetic
gccaagcatttaggtgacactatagaccccctgccgaggagagtggtttcagagctatgctggaaacagc

SEQ ID NO: 47128 - DNA, 70 bp, Artificial Sequence
  Synthetic
gccaagcatttaggtgacactatagccccacaacagctgcttgcagtttcagagctatgctggaaacagc

SEQ ID NO: 47129 - DNA, 70 bp, Artificial Sequence
  Synthetic
gccaagcatttaggtgacactatagaggagatgaggtttgtatatgtttcagagctatgctggaaacagc

SEQ ID NO: 47130 - DNA, 70 bp, Artificial Sequence
  Synthetic
gccaagcatttaggtgacactatagcgagttccatctcagtaaaagtttcagagctatgctggaaacagc

SEQ ID NO: 47131 - DNA, 70 bp, Artificial Sequence
  Synthetic
gccaagcatttaggtgacactatagccctcagagcccaacttctagtttcagagctatgctggaaacagc

SEQ ID NO: 47132 - DNA, 70 bp, Artificial Sequence
  Synthetic
gccaagcatttaggtgacactatagatcctggtggctctttgtgggtttcagagctatgctggaaacagc

SEQ ID NO: 47133 - DNA, 70 bp, Artificial Sequence
  Synthetic
gccaagcatttaggtgacactatagcatctgtgctggtgatgctggtttcagagctatgctggaaacagc

SEQ ID NO: 47134 - DNA, 70 bp, Artificial Sequence
  Synthetic
gccaagcatttaggtgacactatagattctgctgaagatctgtgggtttcagagctatgctggaaacagc

SEQ ID NO: 47135 - DNA, 70 bp, Artificial Sequence
  Synthetic
gccaagcatttaggtgacactatagctggcttggctcagtgcaaggtttcagagctatgctggaaacagc

SEQ ID NO: 47136 - DNA, 70 bp, Artificial Sequence
  Synthetic
gccaagcatttaggtgacactataggcgctgctgtacctgtgtgggtttcagagctatgctggaaacagc

SEQ ID NO: 47137 - DNA, 70 bp, Artificial Sequence
  Synthetic
gccaagcatttaggtgacactataggcgtgctgttcacggatctggtttcagagctatgctggaaacagc

SEQ ID NO: 47138 - DNA, 70 bp, Artificial Sequence
  Synthetic
gccaagcatttaggtgacactatagacactcttaaaaatctgtgggtttcagagctatgctggaaacagc

SEQ ID NO: 47139 - DNA, 70 bp, Artificial Sequence
  Synthetic
gccaagcatttaggtgacactataggtactgcttgttctctgtgggtttcagagctatgctggaaacagc

SEQ ID NO: 47140 - DNA, 70 bp, Artificial Sequence
  Synthetic
gccaagcatttaggtgacactatagaaagctcttctgctgctctggtttcagagctatgctggaaacagc

SEQ ID NO: 47141 - DNA, 70 bp, Artificial Sequence
  Synthetic
gccaagcatttaggtgacactatagctctgtggtggtgaggactagtttcagagctatgctggaaacagc

SEQ ID NO: 47142 - DNA, 70 bp, Artificial Sequence
  Synthetic
gccaagcatttaggtgacactataggctattgtgggccagtaggagtttcagagctatgctggaaacagc

SEQ ID NO: 47143 - DNA, 70 bp, Artificial Sequence
  Synthetic
gccaagcatttaggtgacactatagcttgttcttctgtgcctcaggtttcagagctatgctggaaacagc

SEQ ID NO: 47144 - DNA, 70 bp, Artificial Sequence
  Synthetic
gccaagcatttaggtgacactatagagccctcctggccttgtgcagtttcagagctatgctggaaacagc

SEQ ID NO: 47145 - DNA, 70 bp, Artificial Sequence
  Synthetic
gccaagcatttaggtgacactatagaaaggttatttcaggaacaggtttcagagctatgctggaaacagc

SEQ ID NO: 47146 - DNA, 70 bp, Artificial Sequence
  Synthetic
gccaagcatttaggtgacactataggagaggctcagtgcccgcctgtttcagagctatgctggaaacagc

SEQ ID NO: 47147 - DNA, 70 bp, Artificial Sequence
  Synthetic
gccaagcatttaggtgacactataggaactgggggctggtcacacgtttcagagctatgctggaaacagc

SEQ ID NO: 47148 - DNA, 70 bp, Artificial Sequence
  Synthetic
gccaagcatttaggtgacactatagaccctcaggactagaagccggtttcagagctatgctggaaacagc

SEQ ID NO: 47149 - DNA, 70 bp, Artificial Sequence
  Synthetic
gccaagcatttaggtgacactataggggcttctctcacaactagggtttcagagctatgctggaaacagc

SEQ ID NO: 47150 - DNA, 70 bp, Artificial Sequence
  Synthetic
gccaagcatttaggtgacactatagcagaaaaccagctgtcacccgtttcagagctatgctggaaacagc

SEQ ID NO: 47151 - DNA, 70 bp, Artificial Sequence
  Synthetic
gccaagcatttaggtgacactatagattcagatgggtacattccagtttcagagctatgctggaaacagc

SEQ ID NO: 47152 - DNA, 70 bp, Artificial Sequence
  Synthetic
gccaagcatttaggtgacactatagacagatcaacagactcgatagtttcagagctatgctggaaacagc

SEQ ID NO: 47153 - DNA, 70 bp, Artificial Sequence
  Synthetic
gccaagcatttaggtgacactatagggccggggtctcagttcttggtttcagagctatgctggaaacagc

SEQ ID NO: 47154 - DNA, 70 bp, Artificial Sequence
  Synthetic
gccaagcatttaggtgacactatagcccctcagtcctggcaatgagtttcagagctatgctggaaacagc

SEQ ID NO: 47155 - DNA, 70 bp, Artificial Sequence
  Synthetic
gccaagcatttaggtgacactatagacaacttgcctgtggaatcggtttcagagctatgctggaaacagc

SEQ ID NO: 47156 - DNA, 70 bp, Artificial Sequence
  Synthetic
gccaagcatttaggtgacactatagtggctgcgacagcccctcacgtttcagagctatgctggaaacagc

SEQ ID NO: 47157 - DNA, 70 bp, Artificial Sequence
  Synthetic
gccaagcatttaggtgacactatagcaacttcgtaccagctagaagtttcagagctatgctggaaacagc

SEQ ID NO: 47158 - DNA, 70 bp, Artificial Sequence
  Synthetic
gccaagcatttaggtgacactatagtgtgctggaggagatgggttgtttcagagctatgctggaaacagc

SEQ ID NO: 47159 - DNA, 70 bp, Artificial Sequence
  Synthetic
gccaagcatttaggtgacactatagatttcttcaagaacactacggtttcagagctatgctggaaacagc

SEQ ID NO: 47160 - DNA, 70 bp, Artificial Sequence
  Synthetic
gccaagcatttaggtgacactatagtgaagactctgatatgttacgtttcagagctatgctggaaacagc

SEQ ID NO: 47161 - DNA, 70 bp, Artificial Sequence
  Synthetic
gccaagcatttaggtgacactatagccgtcacctgtgtgagctgcgtttcagagctatgctggaaacagc

SEQ ID NO: 47162 - DNA, 70 bp, Artificial Sequence
  Synthetic
gccaagcatttaggtgacactataggctcacgctgcgcacaagtagtttcagagctatgctggaaacagc

SEQ ID NO: 47163 - DNA, 70 bp, Artificial Sequence
  Synthetic
gccaagcatttaggtgacactatagagtctctcaatacatctatcgtttcagagctatgctggaaacagc

SEQ ID NO: 47164 - DNA, 70 bp, Artificial Sequence
  Synthetic
gccaagcatttaggtgacactataggagtttcataaatgccactggtttcagagctatgctggaaacagc

SEQ ID NO: 47165 - DNA, 70 bp, Artificial Sequence
  Synthetic
gccaagcatttaggtgacactatagtgctacagtccctggagtgagtttcagagctatgctggaaacagc

SEQ ID NO: 47166 - DNA, 70 bp, Artificial Sequence
  Synthetic
gccaagcatttaggtgacactatagtgaagcctgtcctgtctcaggtttcagagctatgctggaaacagc

SEQ ID NO: 47167 - DNA, 70 bp, Artificial Sequence
  Synthetic
gccaagcatttaggtgacactataggctagagactctccactctcgtttcagagctatgctggaaacagc

SEQ ID NO: 47168 - DNA, 70 bp, Artificial Sequence
  Synthetic
gccaagcatttaggtgacactatagtcacagcatttggaagtcacgtttcagagctatgctggaaacagc

SEQ ID NO: 47169 - DNA, 70 bp, Artificial Sequence
  Synthetic
gccaagcatttaggtgacactatagcgcaggcagctctcaacactgtttcagagctatgctggaaacagc

SEQ ID NO: 47170 - DNA, 70 bp, Artificial Sequence
  Synthetic
gccaagcatttaggtgacactatagcctcttctcatgtcctcactgtttcagagctatgctggaaacagc

SEQ ID NO: 47171 - DNA, 70 bp, Artificial Sequence
  Synthetic
gccaagcatttaggtgacactataggttccaagttcgaacctgaagtttcagagctatgctggaaacagc

SEQ ID NO: 47172 - DNA, 70 bp, Artificial Sequence
  Synthetic
gccaagcatttaggtgacactatagtatttaaaagagggcaggttgtttcagagctatgctggaaacagc

SEQ ID NO: 47173 - DNA, 70 bp, Artificial Sequence
  Synthetic
gccaagcatttaggtgacactatagttcagtctcccagacaggacgtttcagagctatgctggaaacagc

SEQ ID NO: 47174 - DNA, 70 bp, Artificial Sequence
  Synthetic
gccaagcatttaggtgacactatagaacctgtcccagtttgtctggtttcagagctatgctggaaacagc

SEQ ID NO: 47175 - DNA, 70 bp, Artificial Sequence
  Synthetic
gccaagcatttaggtgacactatagatctgcatttctgagtttccgtttcagagctatgctggaaacagc

SEQ ID NO: 47176 - DNA, 70 bp, Artificial Sequence
  Synthetic
gccaagcatttaggtgacactatagcagtgtcaaaaggtgatggagtttcagagctatgctggaaacagc

SEQ ID NO: 47177 - DNA, 70 bp, Artificial Sequence
  Synthetic
gccaagcatttaggtgacactataggcctatgtcattcggatctggtttcagagctatgctggaaacagc

SEQ ID NO: 47178 - DNA, 70 bp, Artificial Sequence
  Synthetic
gccaagcatttaggtgacactatagcactacaccctggatctcctgtttcagagctatgctggaaacagc

SEQ ID NO: 47179 - DNA, 70 bp, Artificial Sequence
  Synthetic
gccaagcatttaggtgacactatagtaagatgtcagaaagctgaagtttcagagctatgctggaaacagc

SEQ ID NO: 47180 - DNA, 70 bp, Artificial Sequence
  Synthetic
gccaagcatttaggtgacactatagtcccctggctattcagtagagtttcagagctatgctggaaacagc

SEQ ID NO: 47181 - DNA, 70 bp, Artificial Sequence
  Synthetic
gccaagcatttaggtgacactatagggactacctccgtgggctgggtttcagagctatgctggaaacagc

SEQ ID NO: 47182 - DNA, 70 bp, Artificial Sequence
  Synthetic
gccaagcatttaggtgacactataggcccctgctccagtaacatagtttcagagctatgctggaaacagc

SEQ ID NO: 47183 - DNA, 70 bp, Artificial Sequence
  Synthetic
gccaagcatttaggtgacactatagccatcccaacgaggaatcaggtttcagagctatgctggaaacagc

SEQ ID NO: 47184 - DNA, 70 bp, Artificial Sequence
  Synthetic
gccaagcatttaggtgacactatagcggcctcatgccagggtgaagtttcagagctatgctggaaacagc

SEQ ID NO: 47185 - DNA, 70 bp, Artificial Sequence
  Synthetic
gccaagcatttaggtgacactatagtatgtgactgtggataatctgtttcagagctatgctggaaacagc

SEQ ID NO: 47186 - DNA, 70 bp, Artificial Sequence
  Synthetic
gccaagcatttaggtgacactatagtcacagaccttctacacaaagtttcagagctatgctggaaacagc

SEQ ID NO: 47187 - DNA, 70 bp, Artificial Sequence
  Synthetic
gccaagcatttaggtgacactatagggccgcggtcagatgtaaacgtttcagagctatgctggaaacagc

SEQ ID NO: 47188 - DNA, 70 bp, Artificial Sequence
  Synthetic
gccaagcatttaggtgacactatagcagggctggtttaaacaattgtttcagagctatgctggaaacagc

SEQ ID NO: 47189 - DNA, 70 bp, Artificial Sequence
  Synthetic
gccaagcatttaggtgacactatagggagaccccgctgtacatctgtttcagagctatgctggaaacagc

SEQ ID NO: 47190 - DNA, 70 bp, Artificial Sequence
  Synthetic
gccaagcatttaggtgacactataggcaagggatgaggtggtcacgtttcagagctatgctggaaacagc

SEQ ID NO: 47191 - DNA, 70 bp, Artificial Sequence
  Synthetic
gccaagcatttaggtgacactataggaaggtgggggcttcttcatgtttcagagctatgctggaaacagc

SEQ ID NO: 47192 - DNA, 70 bp, Artificial Sequence
  Synthetic
gccaagcatttaggtgacactatagaagagaggcaacgtgtcctagtttcagagctatgctggaaacagc

SEQ ID NO: 47193 - DNA, 70 bp, Artificial Sequence
  Synthetic
gccaagcatttaggtgacactatagcatgtgcagctatggcatttgtttcagagctatgctggaaacagc

SEQ ID NO: 47194 - DNA, 70 bp, Artificial Sequence
  Synthetic
gccaagcatttaggtgacactatagccagataagtttagggcatagtttcagagctatgctggaaacagc

SEQ ID NO: 47195 - DNA, 70 bp, Artificial Sequence
  Synthetic
gccaagcatttaggtgacactatagtcacaaggtaagacccagaagtttcagagctatgctggaaacagc

SEQ ID NO: 47196 - DNA, 70 bp, Artificial Sequence
  Synthetic
gccaagcatttaggtgacactatagccgccaccctcctggaataggtttcagagctatgctggaaacagc

SEQ ID NO: 47197 - DNA, 70 bp, Artificial Sequence
  Synthetic
gccaagcatttaggtgacactataggccttgtccctctgctgcatgtttcagagctatgctggaaacagc

SEQ ID NO: 47198 - DNA, 70 bp, Artificial Sequence
  Synthetic
gccaagcatttaggtgacactatagaagtccaatgtcatagccaggtttcagagctatgctggaaacagc

SEQ ID NO: 47199 - DNA, 70 bp, Artificial Sequence
  Synthetic
gccaagcatttaggtgacactatagaaacccttggtgtgggtctggtttcagagctatgctggaaacagc

SEQ ID NO: 47200 - DNA, 70 bp, Artificial Sequence
  Synthetic
gccaagcatttaggtgacactatagctctggctacgcacacacttgtttcagagctatgctggaaacagc

SEQ ID NO: 47201 - DNA, 70 bp, Artificial Sequence
  Synthetic
gccaagcatttaggtgacactatagctgggccacaagttcatatcgtttcagagctatgctggaaacagc

SEQ ID NO: 47202 - DNA, 70 bp, Artificial Sequence
  Synthetic
gccaagcatttaggtgacactatagaggggtggtgtcacagtgctgtttcagagctatgctggaaacagc

SEQ ID NO: 47203 - DNA, 70 bp, Artificial Sequence
  Synthetic
gccaagcatttaggtgacactatagcaggcctccattggttcagcgtttcagagctatgctggaaacagc

SEQ ID NO: 47204 - DNA, 70 bp, Artificial Sequence
  Synthetic
gccaagcatttaggtgacactataggcatcccacccgaggactgagtttcagagctatgctggaaacagc

SEQ ID NO: 47205 - DNA, 70 bp, Artificial Sequence
  Synthetic
gccaagcatttaggtgacactatagtcagcgcagcctcttgtgtagtttcagagctatgctggaaacagc

SEQ ID NO: 47206 - DNA, 70 bp, Artificial Sequence
  Synthetic
gccaagcatttaggtgacactataggctggttccctgaggttatcgtttcagagctatgctggaaacagc

SEQ ID NO: 47207 - DNA, 70 bp, Artificial Sequence
  Synthetic
gccaagcatttaggtgacactatagacacgaggaaatcgtagtcggtttcagagctatgctggaaacagc

SEQ ID NO: 47208 - DNA, 70 bp, Artificial Sequence
  Synthetic
gccaagcatttaggtgacactatagggagccttcaggggaagtaggtttcagagctatgctggaaacagc

SEQ ID NO: 47209 - DNA, 70 bp, Artificial Sequence
  Synthetic
gccaagcatttaggtgacactatagcagctcccagttggagaaaagtttcagagctatgctggaaacagc

SEQ ID NO: 47210 - DNA, 70 bp, Artificial Sequence
  Synthetic
gccaagcatttaggtgacactatagagatgaagagaaggaagatggtttcagagctatgctggaaacagc

SEQ ID NO: 47211 - DNA, 70 bp, Artificial Sequence
  Synthetic
gccaagcatttaggtgacactatagtaggtctccaaagtcagtccgtttcagagctatgctggaaacagc

SEQ ID NO: 47212 - DNA, 70 bp, Artificial Sequence
  Synthetic
gccaagcatttaggtgacactataggagacccttgtggttgactagtttcagagctatgctggaaacagc

SEQ ID NO: 47213 - DNA, 70 bp, Artificial Sequence
  Synthetic
gccaagcatttaggtgacactatagctggaggaacgaccctgaccgtttcagagctatgctggaaacagc

SEQ ID NO: 47214 - DNA, 70 bp, Artificial Sequence
  Synthetic
gccaagcatttaggtgacactatagggagcagatgcagatttagggtttcagagctatgctggaaacagc

SEQ ID NO: 47215 - DNA, 70 bp, Artificial Sequence
  Synthetic
gccaagcatttaggtgacactatagtctgggagggctaaacagccgtttcagagctatgctggaaacagc

SEQ ID NO: 47216 - DNA, 70 bp, Artificial Sequence
  Synthetic
gccaagcatttaggtgacactatagggcggcggcgggcgcctcacgtttcagagctatgctggaaacagc

SEQ ID NO: 47217 - DNA, 70 bp, Artificial Sequence
  Synthetic
gccaagcatttaggtgacactatagcaatggtctggacacttcacgtttcagagctatgctggaaacagc

SEQ ID NO: 47218 - DNA, 70 bp, Artificial Sequence
  Synthetic
gccaagcatttaggtgacactatagggggcagctcagctctccaagtttcagagctatgctggaaacagc

SEQ ID NO: 47219 - DNA, 70 bp, Artificial Sequence
  Synthetic
gccaagcatttaggtgacactatagctgggcaggtagatcctcaggtttcagagctatgctggaaacagc

SEQ ID NO: 47220 - DNA, 70 bp, Artificial Sequence
  Synthetic
gccaagcatttaggtgacactatagaggatgatagtaagttctccgtttcagagctatgctggaaacagc

SEQ ID NO: 47221 - DNA, 70 bp, Artificial Sequence
  Synthetic
gccaagcatttaggtgacactatagtctgtggcttggagatgaatgtttcagagctatgctggaaacagc

SEQ ID NO: 47222 - DNA, 70 bp, Artificial Sequence
  Synthetic
gccaagcatttaggtgacactatagttggcagacatcctgaagtagtttcagagctatgctggaaacagc

SEQ ID NO: 47223 - DNA, 70 bp, Artificial Sequence
  Synthetic
gccaagcatttaggtgacactatagtccagaatcagggaaactgagtttcagagctatgctggaaacagc

SEQ ID NO: 47224 - DNA, 70 bp, Artificial Sequence
  Synthetic
gccaagcatttaggtgacactatagggcccagggagacccctcacgtttcagagctatgctggaaacagc

SEQ ID NO: 47225 - DNA, 70 bp, Artificial Sequence
  Synthetic
gccaagcatttaggtgacactatagggaacaaggcagaccctagagtttcagagctatgctggaaacagc

SEQ ID NO: 47226 - DNA, 70 bp, Artificial Sequence
  Synthetic
gccaagcatttaggtgacactataggcaggagattctcgagtgaggtttcagagctatgctggaaacagc

SEQ ID NO: 47227 - DNA, 70 bp, Artificial Sequence
  Synthetic
gccaagcatttaggtgacactatagtaaaactggacgtagtaagtgtttcagagctatgctggaaacagc

SEQ ID NO: 47228 - DNA, 70 bp, Artificial Sequence
  Synthetic
gccaagcatttaggtgacactatagtccagaatcaggaaaactgagtttcagagctatgctggaaacagc

SEQ ID NO: 47229 - DNA, 70 bp, Artificial Sequence
  Synthetic
gccaagcatttaggtgacactatagtgggggagattctcaggtgagtttcagagctatgctggaaacagc

SEQ ID NO: 47230 - DNA, 70 bp, Artificial Sequence
  Synthetic
gccaagcatttaggtgacactatagacgtgcgcagggtcgttacagtttcagagctatgctggaaacagc

SEQ ID NO: 47231 - DNA, 70 bp, Artificial Sequence
  Synthetic
gccaagcatttaggtgacactatagccataaagcgacggcttgaggtttcagagctatgctggaaacagc

SEQ ID NO: 47232 - DNA, 70 bp, Artificial Sequence
  Synthetic
gccaagcatttaggtgacactatagacagtttgcaagtagcaagggtttcagagctatgctggaaacagc

SEQ ID NO: 47233 - DNA, 70 bp, Artificial Sequence
  Synthetic
gccaagcatttaggtgacactataggagcaccgggtctcagtcacgtttcagagctatgctggaaacagc

SEQ ID NO: 47234 - DNA, 70 bp, Artificial Sequence
  Synthetic
gccaagcatttaggtgacactatagaaactcaagattgactcatggtttcagagctatgctggaaacagc

SEQ ID NO: 47235 - DNA, 70 bp, Artificial Sequence
  Synthetic
gccaagcatttaggtgacactatagtctttctgtgctgaagggaggtttcagagctatgctggaaacagc

SEQ ID NO: 47236 - DNA, 70 bp, Artificial Sequence
  Synthetic
gccaagcatttaggtgacactatagattgaggtctcaggcagccagtttcagagctatgctggaaacagc

SEQ ID NO: 47237 - DNA, 70 bp, Artificial Sequence
  Synthetic
gccaagcatttaggtgacactataggtctgtggggacaaggaccagtttcagagctatgctggaaacagc

SEQ ID NO: 47238 - DNA, 70 bp, Artificial Sequence
  Synthetic
gccaagcatttaggtgacactatagtgccccaagctctcgtaaccgtttcagagctatgctggaaacagc

SEQ ID NO: 47239 - DNA, 70 bp, Artificial Sequence
  Synthetic
gccaagcatttaggtgacactatagcggcgttcagtgattgtcgcgtttcagagctatgctggaaacagc

SEQ ID NO: 47240 - DNA, 70 bp, Artificial Sequence
  Synthetic
gccaagcatttaggtgacactatagatgacttagatcctggggctgtttcagagctatgctggaaacagc

SEQ ID NO: 47241 - DNA, 70 bp, Artificial Sequence
  Synthetic
gccaagcatttaggtgacactataggatgtaaagccatgctaagggtttcagagctatgctggaaacagc

SEQ ID NO: 47242 - DNA, 70 bp, Artificial Sequence
  Synthetic
gccaagcatttaggtgacactatagtgccctgtggtcacagttctgtttcagagctatgctggaaacagc

SEQ ID NO: 47243 - DNA, 70 bp, Artificial Sequence
  Synthetic
gccaagcatttaggtgacactatagctgcactgctctggggtcatgtttcagagctatgctggaaacagc

SEQ ID NO: 47244 - DNA, 70 bp, Artificial Sequence
  Synthetic
gccaagcatttaggtgacactatagctgcactggtctggggtcaggtttcagagctatgctggaaacagc

SEQ ID NO: 47245 - DNA, 70 bp, Artificial Sequence
  Synthetic
gccaagcatttaggtgacactatagtcagagtctaaaagcaggctgtttcagagctatgctggaaacagc

SEQ ID NO: 47246 - DNA, 70 bp, Artificial Sequence
  Synthetic
gccaagcatttaggtgacactatagtctcattgtcggtgtcttccgtttcagagctatgctggaaacagc

SEQ ID NO: 47247 - DNA, 70 bp, Artificial Sequence
  Synthetic
gccaagcatttaggtgacactatagagcatgtgtggatgtggctggtttcagagctatgctggaaacagc

SEQ ID NO: 47248 - DNA, 70 bp, Artificial Sequence
  Synthetic
gccaagcatttaggtgacactatagtctctgctgaccagcgtgcagtttcagagctatgctggaaacagc

SEQ ID NO: 47249 - DNA, 70 bp, Artificial Sequence
  Synthetic
gccaagcatttaggtgacactatagtgaagttacaggtcagttatgtttcagagctatgctggaaacagc

SEQ ID NO: 47250 - DNA, 70 bp, Artificial Sequence
  Synthetic
gccaagcatttaggtgacactatagggagttttctacttagttccgtttcagagctatgctggaaacagc

SEQ ID NO: 47251 - DNA, 70 bp, Artificial Sequence
  Synthetic
gccaagcatttaggtgacactatagacatatctatatcttctggggtttcagagctatgctggaaacagc

SEQ ID NO: 47252 - DNA, 70 bp, Artificial Sequence
  Synthetic
gccaagcatttaggtgacactatagacaaaagaagaggagcaactgtttcagagctatgctggaaacagc

SEQ ID NO: 47253 - DNA, 70 bp, Artificial Sequence
  Synthetic
gccaagcatttaggtgacactatagaagtggccctggaaaggattgtttcagagctatgctggaaacagc

SEQ ID NO: 47254 - DNA, 70 bp, Artificial Sequence
  Synthetic
gccaagcatttaggtgacactatagagaaatggcggacttctacagtttcagagctatgctggaaacagc

SEQ ID NO: 47255 - DNA, 70 bp, Artificial Sequence
  Synthetic
gccaagcatttaggtgacactatagctgggcctgagaactgaatcgtttcagagctatgctggaaacagc

SEQ ID NO: 47256 - DNA, 70 bp, Artificial Sequence
  Synthetic
gccaagcatttaggtgacactatagcatctgctcaaagaacttgtgtttcagagctatgctggaaacagc

SEQ ID NO: 47257 - DNA, 70 bp, Artificial Sequence
  Synthetic
gccaagcatttaggtgacactatagtcgagggaccgagctgctgagtttcagagctatgctggaaacagc

SEQ ID NO: 47258 - DNA, 70 bp, Artificial Sequence
  Synthetic
gccaagcatttaggtgacactataggagagtgatttgggagaagggtttcagagctatgctggaaacagc

SEQ ID NO: 47259 - DNA, 70 bp, Artificial Sequence
  Synthetic
gccaagcatttaggtgacactatagggcgcaagtgagttatgcttgtttcagagctatgctggaaacagc

SEQ ID NO: 47260 - DNA, 70 bp, Artificial Sequence
  Synthetic
gccaagcatttaggtgacactatagcctgtggtcactcatactgcgtttcagagctatgctggaaacagc

SEQ ID NO: 47261 - DNA, 70 bp, Artificial Sequence
  Synthetic
gccaagcatttaggtgacactataggtggatgatctgctggccacgtttcagagctatgctggaaacagc

SEQ ID NO: 47262 - DNA, 70 bp, Artificial Sequence
  Synthetic
gccaagcatttaggtgacactatagaagaacatctcaggaagcacgtttcagagctatgctggaaacagc

SEQ ID NO: 47263 - DNA, 70 bp, Artificial Sequence
  Synthetic
gccaagcatttaggtgacactatagggcaaggagaatcaaaatccgtttcagagctatgctggaaacagc

SEQ ID NO: 47264 - DNA, 70 bp, Artificial Sequence
  Synthetic
gccaagcatttaggtgacactatagagcaattacggtagaatcccgtttcagagctatgctggaaacagc

SEQ ID NO: 47265 - DNA, 70 bp, Artificial Sequence
  Synthetic
gccaagcatttaggtgacactataggagatgaagcccaaatagaagtttcagagctatgctggaaacagc

SEQ ID NO: 47266 - DNA, 70 bp, Artificial Sequence
  Synthetic
gccaagcatttaggtgacactatagctggagtgtaagctatgattgtttcagagctatgctggaaacagc

SEQ ID NO: 47267 - DNA, 70 bp, Artificial Sequence
  Synthetic
gccaagcatttaggtgacactataggtatggttgttatgcagccagtttcagagctatgctggaaacagc

SEQ ID NO: 47268 - DNA, 70 bp, Artificial Sequence
  Synthetic
gccaagcatttaggtgacactatagggggccacattccagctgaggtttcagagctatgctggaaacagc

SEQ ID NO: 47269 - DNA, 70 bp, Artificial Sequence
  Synthetic
gccaagcatttaggtgacactatagcacggggtaccaaggcctgagtttcagagctatgctggaaacagc

SEQ ID NO: 47270 - DNA, 70 bp, Artificial Sequence
  Synthetic
gccaagcatttaggtgacactatagagtggcccttggacagtcaggtttcagagctatgctggaaacagc

SEQ ID NO: 47271 - DNA, 70 bp, Artificial Sequence
  Synthetic
gccaagcatttaggtgacactatagcacaaggagcagatctgagtgtttcagagctatgctggaaacagc

SEQ ID NO: 47272 - DNA, 70 bp, Artificial Sequence
  Synthetic
gccaagcatttaggtgacactatagggggaaagaccaatctggaggtttcagagctatgctggaaacagc

SEQ ID NO: 47273 - DNA, 70 bp, Artificial Sequence
  Synthetic
gccaagcatttaggtgacactatagccctgcctgacactggtcaggtttcagagctatgctggaaacagc

SEQ ID NO: 47274 - DNA, 70 bp, Artificial Sequence
  Synthetic
gccaagcatttaggtgacactataggggttcgggagccgtggagagtttcagagctatgctggaaacagc

SEQ ID NO: 47275 - DNA, 70 bp, Artificial Sequence
  Synthetic
gccaagcatttaggtgacactatagcctgaaattggaggattctggtttcagagctatgctggaaacagc

SEQ ID NO: 47276 - DNA, 70 bp, Artificial Sequence
  Synthetic
gccaagcatttaggtgacactatagggacccacagaaaaactcaagtttcagagctatgctggaaacagc

SEQ ID NO: 47277 - DNA, 70 bp, Artificial Sequence
  Synthetic
gccaagcatttaggtgacactatagtctctgcttagaagtgctctgtttcagagctatgctggaaacagc

SEQ ID NO: 47278 - DNA, 70 bp, Artificial Sequence
  Synthetic
gccaagcatttaggtgacactatagcccgcctcatcctgaaggctgtttcagagctatgctggaaacagc

SEQ ID NO: 47279 - DNA, 70 bp, Artificial Sequence
  Synthetic
gccaagcatttaggtgacactatagaactcagtgtcatcatgtaggtttcagagctatgctggaaacagc

SEQ ID NO: 47280 - DNA, 70 bp, Artificial Sequence
  Synthetic
gccaagcatttaggtgacactatagttggttggtgctgtcattgggtttcagagctatgctggaaacagc

SEQ ID NO: 47281 - DNA, 70 bp, Artificial Sequence
  Synthetic
gccaagcatttaggtgacactatagaggactacagtttggctactgtttcagagctatgctggaaacagc

SEQ ID NO: 47282 - DNA, 70 bp, Artificial Sequence
  Synthetic
gccaagcatttaggtgacactatagaatagtgcaatcatttctgcgtttcagagctatgctggaaacagc

SEQ ID NO: 47283 - DNA, 70 bp, Artificial Sequence
  Synthetic
gccaagcatttaggtgacactataggggtggaaagtaatagtcaagtttcagagctatgctggaaacagc

SEQ ID NO: 47284 - DNA, 70 bp, Artificial Sequence
  Synthetic
gccaagcatttaggtgacactataggggtgtttggagtctcagaagtttcagagctatgctggaaacagc

SEQ ID NO: 47285 - DNA, 70 bp, Artificial Sequence
  Synthetic
gccaagcatttaggtgacactataggtcagcctttcttcagggtcgtttcagagctatgctggaaacagc

SEQ ID NO: 47286 - DNA, 70 bp, Artificial Sequence
  Synthetic
gccaagcatttaggtgacactatagtagggtttccaatgcttcacgtttcagagctatgctggaaacagc

SEQ ID NO: 47287 - DNA, 70 bp, Artificial Sequence
  Synthetic
gccaagcatttaggtgacactatagcgcagcccgccttgtgccttgtttcagagctatgctggaaacagc

SEQ ID NO: 47288 - DNA, 70 bp, Artificial Sequence
  Synthetic
gccaagcatttaggtgacactatagtcagctaaggcatccctaccgtttcagagctatgctggaaacagc

SEQ ID NO: 47289 - DNA, 70 bp, Artificial Sequence
  Synthetic
gccaagcatttaggtgacactataggagtgtggctgccttcaccggtttcagagctatgctggaaacagc

SEQ ID NO: 47290 - DNA, 70 bp, Artificial Sequence
  Synthetic
gccaagcatttaggtgacactatagggatgagcagattttgaagtgtttcagagctatgctggaaacagc

SEQ ID NO: 47291 - DNA, 70 bp, Artificial Sequence
  Synthetic
gccaagcatttaggtgacactataggctggtcctagggtcatgtggtttcagagctatgctggaaacagc

SEQ ID NO: 47292 - DNA, 70 bp, Artificial Sequence
  Synthetic
gccaagcatttaggtgacactatagccggacccagcccgagtagagtttcagagctatgctggaaacagc

SEQ ID NO: 47293 - DNA, 70 bp, Artificial Sequence
  Synthetic
gccaagcatttaggtgacactatagcacagagaccactttcctaggtttcagagctatgctggaaacagc

SEQ ID NO: 47294 - DNA, 70 bp, Artificial Sequence
  Synthetic
gccaagcatttaggtgacactatagaagaaacttcgacaagagaagtttcagagctatgctggaaacagc

SEQ ID NO: 47295 - DNA, 70 bp, Artificial Sequence
  Synthetic
gccaagcatttaggtgacactatagagcgagggttgcgagggcttgtttcagagctatgctggaaacagc

SEQ ID NO: 47296 - DNA, 70 bp, Artificial Sequence
  Synthetic
gccaagcatttaggtgacactatagaggggggtcgcgttcacttcgtttcagagctatgctggaaacagc

SEQ ID NO: 47297 - DNA, 70 bp, Artificial Sequence
  Synthetic
gccaagcatttaggtgacactataggtacgaaggcctggactggcgtttcagagctatgctggaaacagc

SEQ ID NO: 47298 - DNA, 70 bp, Artificial Sequence
  Synthetic
gccaagcatttaggtgacactataggtctgtatgaaggacttgacgtttcagagctatgctggaaacagc

SEQ ID NO: 47299 - DNA, 70 bp, Artificial Sequence
  Synthetic
gccaagcatttaggtgacactataggttagcgctttgacagctcggtttcagagctatgctggaaacagc

SEQ ID NO: 47300 - DNA, 70 bp, Artificial Sequence
  Synthetic
gccaagcatttaggtgacactataggactctatgaggggctcacagtttcagagctatgctggaaacagc

SEQ ID NO: 47301 - DNA, 70 bp, Artificial Sequence
  Synthetic
gccaagcatttaggtgacactatagtctggtctatgttgctgtttgtttcagagctatgctggaaacagc

SEQ ID NO: 47302 - DNA, 70 bp, Artificial Sequence
  Synthetic
gccaagcatttaggtgacactatagtgggacaaccagaactggtagtttcagagctatgctggaaacagc

SEQ ID NO: 47303 - DNA, 70 bp, Artificial Sequence
  Synthetic
gccaagcatttaggtgacactataggtcacagagctcggatcagtgtttcagagctatgctggaaacagc

SEQ ID NO: 47304 - DNA, 70 bp, Artificial Sequence
  Synthetic
gccaagcatttaggtgacactatagtggagtcgtgacttcaattcgtttcagagctatgctggaaacagc

SEQ ID NO: 47305 - DNA, 70 bp, Artificial Sequence
  Synthetic
gccaagcatttaggtgacactatagcaaccacctgaacaggaactgtttcagagctatgctggaaacagc

SEQ ID NO: 47306 - DNA, 70 bp, Artificial Sequence
  Synthetic
gccaagcatttaggtgacactatagggcagccagggctaccacacgtttcagagctatgctggaaacagc

SEQ ID NO: 47307 - DNA, 70 bp, Artificial Sequence
  Synthetic
gccaagcatttaggtgacactatagacacaatgatgtcatagacagtttcagagctatgctggaaacagc

SEQ ID NO: 47308 - DNA, 70 bp, Artificial Sequence
  Synthetic
gccaagcatttaggtgacactatagtactgttcttcaagccaagagtttcagagctatgctggaaacagc

SEQ ID NO: 47309 - DNA, 70 bp, Artificial Sequence
  Synthetic
gccaagcatttaggtgacactatagtgagaaaccctcctggctaggtttcagagctatgctggaaacagc

SEQ ID NO: 47310 - DNA, 70 bp, Artificial Sequence
  Synthetic
gccaagcatttaggtgacactataggcggcagagggacatcacgtgtttcagagctatgctggaaacagc

SEQ ID NO: 47311 - DNA, 70 bp, Artificial Sequence
  Synthetic
gccaagcatttaggtgacactatagcagaccacttccggggtcacgtttcagagctatgctggaaacagc

SEQ ID NO: 47312 - DNA, 70 bp, Artificial Sequence
  Synthetic
gccaagcatttaggtgacactatagtcggccctcacagggtgagtgtttcagagctatgctggaaacagc

SEQ ID NO: 47313 - DNA, 70 bp, Artificial Sequence
  Synthetic
gccaagcatttaggtgacactatagtgtttccacatttacttagggtttcagagctatgctggaaacagc

SEQ ID NO: 47314 - DNA, 70 bp, Artificial Sequence
  Synthetic
gccaagcatttaggtgacactatagtcaagcacgtgtgagaatttgtttcagagctatgctggaaacagc

SEQ ID NO: 47315 - DNA, 70 bp, Artificial Sequence
  Synthetic
gccaagcatttaggtgacactatagacctccaatatggtagacttgtttcagagctatgctggaaacagc

SEQ ID NO: 47316 - DNA, 70 bp, Artificial Sequence
  Synthetic
gccaagcatttaggtgacactataggtccttctcattaaaaacccgtttcagagctatgctggaaacagc

SEQ ID NO: 47317 - DNA, 70 bp, Artificial Sequence
  Synthetic
gccaagcatttaggtgacactataggggccaggttcagagcccgcgtttcagagctatgctggaaacagc

SEQ ID NO: 47318 - DNA, 70 bp, Artificial Sequence
  Synthetic
gccaagcatttaggtgacactatagagcagcttgacgtagttctggtttcagagctatgctggaaacagc

SEQ ID NO: 47319 - DNA, 70 bp, Artificial Sequence
  Synthetic
gccaagcatttaggtgacactatagagagtggaatcaggaaaagcgtttcagagctatgctggaaacagc

SEQ ID NO: 47320 - DNA, 70 bp, Artificial Sequence
  Synthetic
gccaagcatttaggtgacactatagggttctccaaaacatcctatgtttcagagctatgctggaaacagc

SEQ ID NO: 47321 - DNA, 70 bp, Artificial Sequence
  Synthetic
gccaagcatttaggtgacactatagagaaagagaagacaacgtgtgtttcagagctatgctggaaacagc

SEQ ID NO: 47322 - DNA, 70 bp, Artificial Sequence
  Synthetic
gccaagcatttaggtgacactatagtaagaatcaacgtccgaagagtttcagagctatgctggaaacagc

SEQ ID NO: 47323 - DNA, 70 bp, Artificial Sequence
  Synthetic
gccaagcatttaggtgacactatagcagtaagatcttcggctcaggtttcagagctatgctggaaacagc

SEQ ID NO: 47324 - DNA, 70 bp, Artificial Sequence
  Synthetic
gccaagcatttaggtgacactatagtgggaaagggctttcttcacgtttcagagctatgctggaaacagc

SEQ ID NO: 47325 - DNA, 70 bp, Artificial Sequence
  Synthetic
gccaagcatttaggtgacactataggcttaacccaaatgctgagtgtttcagagctatgctggaaacagc

SEQ ID NO: 47326 - DNA, 70 bp, Artificial Sequence
  Synthetic
gccaagcatttaggtgacactataggggaagaaagaggggaaaaagtttcagagctatgctggaaacagc

SEQ ID NO: 47327 - DNA, 70 bp, Artificial Sequence
  Synthetic
gccaagcatttaggtgacactatagtggtctgcgacattgaggacgtttcagagctatgctggaaacagc

SEQ ID NO: 47328 - DNA, 70 bp, Artificial Sequence
  Synthetic
gccaagcatttaggtgacactatagtttcatccctgtctttaaacgtttcagagctatgctggaaacagc

SEQ ID NO: 47329 - DNA, 70 bp, Artificial Sequence
  Synthetic
gccaagcatttaggtgacactatagggatcagcttttctactacagtttcagagctatgctggaaacagc

SEQ ID NO: 47330 - DNA, 70 bp, Artificial Sequence
  Synthetic
gccaagcatttaggtgacactatagtgccagggccccaaagtaaagtttcagagctatgctggaaacagc

SEQ ID NO: 47331 - DNA, 70 bp, Artificial Sequence
  Synthetic
gccaagcatttaggtgacactataggggatcacagacactgatgcgtttcagagctatgctggaaacagc

SEQ ID NO: 47332 - DNA, 70 bp, Artificial Sequence
  Synthetic
gccaagcatttaggtgacactatagccgagagaggaaacacaatagtttcagagctatgctggaaacagc

SEQ ID NO: 47333 - DNA, 70 bp, Artificial Sequence
  Synthetic
gccaagcatttaggtgacactatagaacccaagaccgaggcttaagtttcagagctatgctggaaacagc

SEQ ID NO: 47334 - DNA, 70 bp, Artificial Sequence
  Synthetic
gccaagcatttaggtgacactatagctgctggggcccacggttaggtttcagagctatgctggaaacagc

SEQ ID NO: 47335 - DNA, 70 bp, Artificial Sequence
  Synthetic
gccaagcatttaggtgacactatagccacctctgtccgaagacttgtttcagagctatgctggaaacagc

SEQ ID NO: 47336 - DNA, 70 bp, Artificial Sequence
  Synthetic
gccaagcatttaggtgacactatagtcacaggccagcagtcagtggtttcagagctatgctggaaacagc

SEQ ID NO: 47337 - DNA, 70 bp, Artificial Sequence
  Synthetic
gccaagcatttaggtgacactatagttaatcacccattctgcttggtttcagagctatgctggaaacagc

SEQ ID NO: 47338 - DNA, 70 bp, Artificial Sequence
  Synthetic
gccaagcatttaggtgacactatagtgacatccctacacaaattggtttcagagctatgctggaaacagc

SEQ ID NO: 47339 - DNA, 70 bp, Artificial Sequence
  Synthetic
gccaagcatttaggtgacactatagaaaggtgaaggactgtgattgtttcagagctatgctggaaacagc

SEQ ID NO: 47340 - DNA, 70 bp, Artificial Sequence
  Synthetic
gccaagcatttaggtgacactatagttctggatggaagaagtggggtttcagagctatgctggaaacagc

SEQ ID NO: 47341 - DNA, 70 bp, Artificial Sequence
  Synthetic
gccaagcatttaggtgacactatagctcgcagggctcattctgcagtttcagagctatgctggaaacagc

SEQ ID NO: 47342 - DNA, 70 bp, Artificial Sequence
  Synthetic
gccaagcatttaggtgacactatagctggtgctcagcagtagcttgtttcagagctatgctggaaacagc

SEQ ID NO: 47343 - DNA, 70 bp, Artificial Sequence
  Synthetic
gccaagcatttaggtgacactatagggtggctcacagcgtgtgttgtttcagagctatgctggaaacagc

SEQ ID NO: 47344 - DNA, 70 bp, Artificial Sequence
  Synthetic
gccaagcatttaggtgacactataggaagtagctgacgccagtttgtttcagagctatgctggaaacagc

SEQ ID NO: 47345 - DNA, 70 bp, Artificial Sequence
  Synthetic
gccaagcatttaggtgacactatagatggagggtgtgctgtagcggtttcagagctatgctggaaacagc

SEQ ID NO: 47346 - DNA, 70 bp, Artificial Sequence
  Synthetic
gccaagcatttaggtgacactatagccagcagcggcacctcagtggtttcagagctatgctggaaacagc

SEQ ID NO: 47347 - DNA, 70 bp, Artificial Sequence
  Synthetic
gccaagcatttaggtgacactatagtgagactcgcagggtttagggtttcagagctatgctggaaacagc

SEQ ID NO: 47348 - DNA, 70 bp, Artificial Sequence
  Synthetic
gccaagcatttaggtgacactataggcaacttatgaaggcaaaacgtttcagagctatgctggaaacagc

SEQ ID NO: 47349 - DNA, 70 bp, Artificial Sequence
  Synthetic
gccaagcatttaggtgacactatagctgtagacatgctttccccagtttcagagctatgctggaaacagc

SEQ ID NO: 47350 - DNA, 70 bp, Artificial Sequence
  Synthetic
gccaagcatttaggtgacactataggatgggcggtgtcatgtcaggtttcagagctatgctggaaacagc

SEQ ID NO: 47351 - DNA, 70 bp, Artificial Sequence
  Synthetic
gccaagcatttaggtgacactatagcagccggaattcgtgtgagcgtttcagagctatgctggaaacagc

SEQ ID NO: 47352 - DNA, 70 bp, Artificial Sequence
  Synthetic
gccaagcatttaggtgacactatagcaattacaaacggatcctctgtttcagagctatgctggaaacagc

SEQ ID NO: 47353 - DNA, 70 bp, Artificial Sequence
  Synthetic
gccaagcatttaggtgacactatagataagggagagacgaagagagtttcagagctatgctggaaacagc

SEQ ID NO: 47354 - DNA, 70 bp, Artificial Sequence
  Synthetic
gccaagcatttaggtgacactatagcgatgccctgcccgagacgcgtttcagagctatgctggaaacagc

SEQ ID NO: 47355 - DNA, 70 bp, Artificial Sequence
  Synthetic
gccaagcatttaggtgacactatagcaaaatgaacagctctaaccgtttcagagctatgctggaaacagc

SEQ ID NO: 47356 - DNA, 70 bp, Artificial Sequence
  Synthetic
gccaagcatttaggtgacactataggcaacactagagacgtcttcgtttcagagctatgctggaaacagc

SEQ ID NO: 47357 - DNA, 70 bp, Artificial Sequence
  Synthetic
gccaagcatttaggtgacactatagccccatttccgtgctgccctgtttcagagctatgctggaaacagc

SEQ ID NO: 47358 - DNA, 70 bp, Artificial Sequence
  Synthetic
gccaagcatttaggtgacactatagttcttccttccctgcatcaggtttcagagctatgctggaaacagc

SEQ ID NO: 47359 - DNA, 70 bp, Artificial Sequence
  Synthetic
gccaagcatttaggtgacactatagcaccatcaagaaggactggagtttcagagctatgctggaaacagc

SEQ ID NO: 47360 - DNA, 70 bp, Artificial Sequence
  Synthetic
gccaagcatttaggtgacactataggttaaggcatcatggttagagtttcagagctatgctggaaacagc

SEQ ID NO: 47361 - DNA, 70 bp, Artificial Sequence
  Synthetic
gccaagcatttaggtgacactatagctccacatgttaaggcatcagtttcagagctatgctggaaacagc

SEQ ID NO: 47362 - DNA, 70 bp, Artificial Sequence
  Synthetic
gccaagcatttaggtgacactatagacctgtcgattaagaaggaggtttcagagctatgctggaaacagc

SEQ ID NO: 47363 - DNA, 70 bp, Artificial Sequence
  Synthetic
gccaagcatttaggtgacactatagctgcatctgccaggactggagtttcagagctatgctggaaacagc

SEQ ID NO: 47364 - DNA, 70 bp, Artificial Sequence
  Synthetic
gccaagcatttaggtgacactatagccccagcctggctgcacttggtttcagagctatgctggaaacagc

SEQ ID NO: 47365 - DNA, 70 bp, Artificial Sequence
  Synthetic
gccaagcatttaggtgacactatagcctctgctgaatatataagcgtttcagagctatgctggaaacagc

SEQ ID NO: 47366 - DNA, 70 bp, Artificial Sequence
  Synthetic
gccaagcatttaggtgacactatagggggaggcgctatagcatcagtttcagagctatgctggaaacagc

SEQ ID NO: 47367 - DNA, 70 bp, Artificial Sequence
  Synthetic
gccaagcatttaggtgacactatagggtttgtacggttatggtccgtttcagagctatgctggaaacagc

SEQ ID NO: 47368 - DNA, 70 bp, Artificial Sequence
  Synthetic
gccaagcatttaggtgacactatagattctttgccaaaggctggcgtttcagagctatgctggaaacagc

SEQ ID NO: 47369 - DNA, 70 bp, Artificial Sequence
  Synthetic
gccaagcatttaggtgacactatagctcctcagcctgcattaggggtttcagagctatgctggaaacagc

SEQ ID NO: 47370 - DNA, 70 bp, Artificial Sequence
  Synthetic
gccaagcatttaggtgacactatagggagcgtctgcgggtggagagtttcagagctatgctggaaacagc

SEQ ID NO: 47371 - DNA, 70 bp, Artificial Sequence
  Synthetic
gccaagcatttaggtgacactataggacagggtcacaccctccacgtttcagagctatgctggaaacagc

SEQ ID NO: 47372 - DNA, 70 bp, Artificial Sequence
  Synthetic
gccaagcatttaggtgacactatagagacgtcatcttcttctaaagtttcagagctatgctggaaacagc

SEQ ID NO: 47373 - DNA, 70 bp, Artificial Sequence
  Synthetic
gccaagcatttaggtgacactataggggggaggctcctgtgtgatgtttcagagctatgctggaaacagc

SEQ ID NO: 47374 - DNA, 70 bp, Artificial Sequence
  Synthetic
gccaagcatttaggtgacactataggtagcctccgagagctaagggtttcagagctatgctggaaacagc

SEQ ID NO: 47375 - DNA, 70 bp, Artificial Sequence
  Synthetic
gccaagcatttaggtgacactatagggatgaagatgagctgtaacgtttcagagctatgctggaaacagc

SEQ ID NO: 47376 - DNA, 70 bp, Artificial Sequence
  Synthetic
gccaagcatttaggtgacactatagctgccctgggacacagcagcgtttcagagctatgctggaaacagc

SEQ ID NO: 47377 - DNA, 70 bp, Artificial Sequence
  Synthetic
gccaagcatttaggtgacactatagccatctgagagactacacgtgtttcagagctatgctggaaacagc

SEQ ID NO: 47378 - DNA, 70 bp, Artificial Sequence
  Synthetic
gccaagcatttaggtgacactatagcaagatggggaaactggagagtttcagagctatgctggaaacagc

SEQ ID NO: 47379 - DNA, 70 bp, Artificial Sequence
  Synthetic
gccaagcatttaggtgacactatagtcctgtggaaacagcaggcagtttcagagctatgctggaaacagc

SEQ ID NO: 47380 - DNA, 70 bp, Artificial Sequence
  Synthetic
gccaagcatttaggtgacactatagtgttttacacagctgttcctgtttcagagctatgctggaaacagc

SEQ ID NO: 47381 - DNA, 70 bp, Artificial Sequence
  Synthetic
gccaagcatttaggtgacactataggactgaggagtcacctgacagtttcagagctatgctggaaacagc

SEQ ID NO: 47382 - DNA, 70 bp, Artificial Sequence
  Synthetic
gccaagcatttaggtgacactatagtccaaagagggtaccctaaggtttcagagctatgctggaaacagc

SEQ ID NO: 47383 - DNA, 70 bp, Artificial Sequence
  Synthetic
gccaagcatttaggtgacactatagaagcataagtcatctttccagtttcagagctatgctggaaacagc

SEQ ID NO: 47384 - DNA, 70 bp, Artificial Sequence
  Synthetic
gccaagcatttaggtgacactatagtgtatccagtccttaaagtagtttcagagctatgctggaaacagc

SEQ ID NO: 47385 - DNA, 70 bp, Artificial Sequence
  Synthetic
gccaagcatttaggtgacactatagctggtaccacagtctgacttgtttcagagctatgctggaaacagc

SEQ ID NO: 47386 - DNA, 70 bp, Artificial Sequence
  Synthetic
gccaagcatttaggtgacactatagcctcaggcctggtggctagcgtttcagagctatgctggaaacagc

SEQ ID NO: 47387 - DNA, 70 bp, Artificial Sequence
  Synthetic
gccaagcatttaggtgacactataggcacccttccgcaagtgaacgtttcagagctatgctggaaacagc

SEQ ID NO: 47388 - DNA, 70 bp, Artificial Sequence
  Synthetic
gccaagcatttaggtgacactatagcccaccacgcctctgtgaccgtttcagagctatgctggaaacagc

SEQ ID NO: 47389 - DNA, 70 bp, Artificial Sequence
  Synthetic
gccaagcatttaggtgacactataggactgccaaactacagctgggtttcagagctatgctggaaacagc

SEQ ID NO: 47390 - DNA, 70 bp, Artificial Sequence
  Synthetic
gccaagcatttaggtgacactatagtgatggttatggaagaattggtttcagagctatgctggaaacagc

SEQ ID NO: 47391 - DNA, 70 bp, Artificial Sequence
  Synthetic
gccaagcatttaggtgacactataggctcagaagtgcattagttcgtttcagagctatgctggaaacagc

SEQ ID NO: 47392 - DNA, 70 bp, Artificial Sequence
  Synthetic
gccaagcatttaggtgacactataggggatgagaccaatctataagtttcagagctatgctggaaacagc

SEQ ID NO: 47393 - DNA, 70 bp, Artificial Sequence
  Synthetic
gccaagcatttaggtgacactatagcattctggcaaaacttcagcgtttcagagctatgctggaaacagc

SEQ ID NO: 47394 - DNA, 70 bp, Artificial Sequence
  Synthetic
gccaagcatttaggtgacactatagtgtcccacggctgtcatgacgtttcagagctatgctggaaacagc

SEQ ID NO: 47395 - DNA, 70 bp, Artificial Sequence
  Synthetic
gccaagcatttaggtgacactatagtgtgatgtactgtttcagatgtttcagagctatgctggaaacagc

SEQ ID NO: 47396 - DNA, 70 bp, Artificial Sequence
  Synthetic
gccaagcatttaggtgacactatagaatattcagaatgtggtcgcgtttcagagctatgctggaaacagc

SEQ ID NO: 47397 - DNA, 70 bp, Artificial Sequence
  Synthetic
gccaagcatttaggtgacactataggttcataaaggcatttggcagtttcagagctatgctggaaacagc

SEQ ID NO: 47398 - DNA, 70 bp, Artificial Sequence
  Synthetic
gccaagcatttaggtgacactatagttaaggcaacgagttatttggtttcagagctatgctggaaacagc

SEQ ID NO: 47399 - DNA, 70 bp, Artificial Sequence
  Synthetic
gccaagcatttaggtgacactatagagctgggtcctgcccatcaggtttcagagctatgctggaaacagc

SEQ ID NO: 47400 - DNA, 70 bp, Artificial Sequence
  Synthetic
gccaagcatttaggtgacactatagcagggcaagatgctggaagggtttcagagctatgctggaaacagc

SEQ ID NO: 47401 - DNA, 70 bp, Artificial Sequence
  Synthetic
gccaagcatttaggtgacactatagatgtacttgctgtagaatgcgtttcagagctatgctggaaacagc

SEQ ID NO: 47402 - DNA, 70 bp, Artificial Sequence
  Synthetic
gccaagcatttaggtgacactatagatggaatgtcagttgagtgcgtttcagagctatgctggaaacagc

SEQ ID NO: 47403 - DNA, 70 bp, Artificial Sequence
  Synthetic
gccaagcatttaggtgacactatagccacctcaacaccaagctgtgtttcagagctatgctggaaacagc

SEQ ID NO: 47404 - DNA, 70 bp, Artificial Sequence
  Synthetic
gccaagcatttaggtgacactataggcaccccagtacaaaactgtgtttcagagctatgctggaaacagc

SEQ ID NO: 47405 - DNA, 70 bp, Artificial Sequence
  Synthetic
gccaagcatttaggtgacactatagagatctgtgggagtacattggtttcagagctatgctggaaacagc

SEQ ID NO: 47406 - DNA, 70 bp, Artificial Sequence
  Synthetic
gccaagcatttaggtgacactatagggagaaccagatgcatataggtttcagagctatgctggaaacagc

SEQ ID NO: 47407 - DNA, 70 bp, Artificial Sequence
  Synthetic
gccaagcatttaggtgacactatagagctcatccttagatttaacgtttcagagctatgctggaaacagc

SEQ ID NO: 47408 - DNA, 70 bp, Artificial Sequence
  Synthetic
gccaagcatttaggtgacactataggatttccatgacacctaagtgtttcagagctatgctggaaacagc

SEQ ID NO: 47409 - DNA, 70 bp, Artificial Sequence
  Synthetic
gccaagcatttaggtgacactatagggaccggttgtcaaatgatggtttcagagctatgctggaaacagc

SEQ ID NO: 47410 - DNA, 70 bp, Artificial Sequence
  Synthetic
gccaagcatttaggtgacactataggccttgatgaggcaatggaagtttcagagctatgctggaaacagc

SEQ ID NO: 47411 - DNA, 70 bp, Artificial Sequence
  Synthetic
gccaagcatttaggtgacactatagcaaaaacaaaacaccatgccgtttcagagctatgctggaaacagc

SEQ ID NO: 47412 - DNA, 70 bp, Artificial Sequence
  Synthetic
gccaagcatttaggtgacactatagttggagctcctctcctaggcgtttcagagctatgctggaaacagc

SEQ ID NO: 47413 - DNA, 70 bp, Artificial Sequence
  Synthetic
gccaagcatttaggtgacactatagagagcccatggggctgagcggtttcagagctatgctggaaacagc

SEQ ID NO: 47414 - DNA, 70 bp, Artificial Sequence
  Synthetic
gccaagcatttaggtgacactatagtcaatcctatactcactgaggtttcagagctatgctggaaacagc

SEQ ID NO: 47415 - DNA, 70 bp, Artificial Sequence
  Synthetic
gccaagcatttaggtgacactatagacatcatgagcatcactgttgtttcagagctatgctggaaacagc

SEQ ID NO: 47416 - DNA, 70 bp, Artificial Sequence
  Synthetic
gccaagcatttaggtgacactataggcgttcttcaagcagaactggtttcagagctatgctggaaacagc

SEQ ID NO: 47417 - DNA, 70 bp, Artificial Sequence
  Synthetic
gccaagcatttaggtgacactatagtttgctcatacagccacttggtttcagagctatgctggaaacagc

SEQ ID NO: 47418 - DNA, 70 bp, Artificial Sequence
  Synthetic
gccaagcatttaggtgacactatagatatacaagagcacctagtcgtttcagagctatgctggaaacagc

SEQ ID NO: 47419 - DNA, 70 bp, Artificial Sequence
  Synthetic
gccaagcatttaggtgacactatagttcacattcttacagcttcagtttcagagctatgctggaaacagc

SEQ ID NO: 47420 - DNA, 70 bp, Artificial Sequence
  Synthetic
gccaagcatttaggtgacactatagtctgccgtgcagtcaatcgtgtttcagagctatgctggaaacagc

SEQ ID NO: 47421 - DNA, 70 bp, Artificial Sequence
  Synthetic
gccaagcatttaggtgacactatagcatcctctggaaatcagctggtttcagagctatgctggaaacagc

SEQ ID NO: 47422 - DNA, 70 bp, Artificial Sequence
  Synthetic
gccaagcatttaggtgacactatagagcagtggcatcaacttgtcgtttcagagctatgctggaaacagc

SEQ ID NO: 47423 - DNA, 70 bp, Artificial Sequence
  Synthetic
gccaagcatttaggtgacactatagggcatcatctgtccaagagagtttcagagctatgctggaaacagc

SEQ ID NO: 47424 - DNA, 70 bp, Artificial Sequence
  Synthetic
gccaagcatttaggtgacactatagtcacgtaaatgctttttcaggtttcagagctatgctggaaacagc

SEQ ID NO: 47425 - DNA, 70 bp, Artificial Sequence
  Synthetic
gccaagcatttaggtgacactatagtggaaaaaatgctgccacaggtttcagagctatgctggaaacagc

SEQ ID NO: 47426 - DNA, 70 bp, Artificial Sequence
  Synthetic
gccaagcatttaggtgacactatagttttcaaatgctgcacacaggtttcagagctatgctggaaacagc

SEQ ID NO: 47427 - DNA, 70 bp, Artificial Sequence
  Synthetic
gccaagcatttaggtgacactatagttcagtcagctgtgaaaatggtttcagagctatgctggaaacagc

SEQ ID NO: 47428 - DNA, 70 bp, Artificial Sequence
  Synthetic
gccaagcatttaggtgacactatagccagaacaatctgcggcactgtttcagagctatgctggaaacagc

SEQ ID NO: 47429 - DNA, 70 bp, Artificial Sequence
  Synthetic
gccaagcatttaggtgacactatagtctcacaggagagggcgttcgtttcagagctatgctggaaacagc

SEQ ID NO: 47430 - DNA, 70 bp, Artificial Sequence
  Synthetic
gccaagcatttaggtgacactatagataggagatggcctaaaggagtttcagagctatgctggaaacagc

SEQ ID NO: 47431 - DNA, 70 bp, Artificial Sequence
  Synthetic
gccaagcatttaggtgacactatagccctcaagcagaagaagaaggtttcagagctatgctggaaacagc

SEQ ID NO: 47432 - DNA, 70 bp, Artificial Sequence
  Synthetic
gccaagcatttaggtgacactatagctcggggtggcaagaagagagtttcagagctatgctggaaacagc

SEQ ID NO: 47433 - DNA, 70 bp, Artificial Sequence
  Synthetic
gccaagcatttaggtgacactataggattgtgccaaggacttgaagtttcagagctatgctggaaacagc

SEQ ID NO: 47434 - DNA, 70 bp, Artificial Sequence
  Synthetic
gccaagcatttaggtgacactatagaaagttatctcacaccaatcgtttcagagctatgctggaaacagc

SEQ ID NO: 47435 - DNA, 70 bp, Artificial Sequence
  Synthetic
gccaagcatttaggtgacactatagacttcagtggatggaatctcgtttcagagctatgctggaaacagc

SEQ ID NO: 47436 - DNA, 70 bp, Artificial Sequence
  Synthetic
gccaagcatttaggtgacactatagagaacatcaaagataaacccgtttcagagctatgctggaaacagc

SEQ ID NO: 47437 - DNA, 70 bp, Artificial Sequence
  Synthetic
gccaagcatttaggtgacactatagcttttcatgtcttcacagtcgtttcagagctatgctggaaacagc

SEQ ID NO: 47438 - DNA, 70 bp, Artificial Sequence
  Synthetic
gccaagcatttaggtgacactatagaagtttgtttatctccctctgtttcagagctatgctggaaacagc

SEQ ID NO: 47439 - DNA, 70 bp, Artificial Sequence
  Synthetic
gccaagcatttaggtgacactataggagctgggttgcttccctgagtttcagagctatgctggaaacagc

SEQ ID NO: 47440 - DNA, 70 bp, Artificial Sequence
  Synthetic
gccaagcatttaggtgacactataggggtacatcacaaacagagcgtttcagagctatgctggaaacagc

SEQ ID NO: 47441 - DNA, 70 bp, Artificial Sequence
  Synthetic
gccaagcatttaggtgacactatagtgactatatcagcaaagtgagtttcagagctatgctggaaacagc

SEQ ID NO: 47442 - DNA, 70 bp, Artificial Sequence
  Synthetic
gccaagcatttaggtgacactatagctccagtgtgggtttacatggtttcagagctatgctggaaacagc

SEQ ID NO: 47443 - DNA, 70 bp, Artificial Sequence
  Synthetic
gccaagcatttaggtgacactataggcatggggggttggttctttgtttcagagctatgctggaaacagc

SEQ ID NO: 47444 - DNA, 70 bp, Artificial Sequence
  Synthetic
gccaagcatttaggtgacactatagttattcaacactcgaagtcagtttcagagctatgctggaaacagc

SEQ ID NO: 47445 - DNA, 70 bp, Artificial Sequence
  Synthetic
gccaagcatttaggtgacactatagaattagctgtttctcatccagtttcagagctatgctggaaacagc

SEQ ID NO: 47446 - DNA, 70 bp, Artificial Sequence
  Synthetic
gccaagcatttaggtgacactataggctgcagatgtgcagtgaccgtttcagagctatgctggaaacagc

SEQ ID NO: 47447 - DNA, 70 bp, Artificial Sequence
  Synthetic
gccaagcatttaggtgacactatagacccagaaggtggagctagcgtttcagagctatgctggaaacagc

SEQ ID NO: 47448 - DNA, 70 bp, Artificial Sequence
  Synthetic
gccaagcatttaggtgacactatagtgatgcagaggtgaaggaaagtttcagagctatgctggaaacagc

SEQ ID NO: 47449 - DNA, 70 bp, Artificial Sequence
  Synthetic
gccaagcatttaggtgacactatagtaaagtaggaacgactgggcgtttcagagctatgctggaaacagc

SEQ ID NO: 47450 - DNA, 70 bp, Artificial Sequence
  Synthetic
gccaagcatttaggtgacactatagatctgcatcatgttagaaaggtttcagagctatgctggaaacagc

SEQ ID NO: 47451 - DNA, 70 bp, Artificial Sequence
  Synthetic
gccaagcatttaggtgacactatagcttcagggtttatcttgaaggtttcagagctatgctggaaacagc

SEQ ID NO: 47452 - DNA, 70 bp, Artificial Sequence
  Synthetic
gccaagcatttaggtgacactataggatgaagttgagaagtcgaggtttcagagctatgctggaaacagc

SEQ ID NO: 47453 - DNA, 70 bp, Artificial Sequence
  Synthetic
gccaagcatttaggtgacactataggctggctcttgctacagagagtttcagagctatgctggaaacagc

SEQ ID NO: 47454 - DNA, 70 bp, Artificial Sequence
  Synthetic
gccaagcatttaggtgacactataggggacgtcaacagtctaggcgtttcagagctatgctggaaacagc

SEQ ID NO: 47455 - DNA, 70 bp, Artificial Sequence
  Synthetic
gccaagcatttaggtgacactatagtcaggacagtgctgaaccaagtttcagagctatgctggaaacagc

SEQ ID NO: 47456 - DNA, 70 bp, Artificial Sequence
  Synthetic
gccaagcatttaggtgacactataggggcctggggtcatggcgccgtttcagagctatgctggaaacagc

SEQ ID NO: 47457 - DNA, 70 bp, Artificial Sequence
  Synthetic
gccaagcatttaggtgacactatagggaggagaatgagaccctgggtttcagagctatgctggaaacagc

SEQ ID NO: 47458 - DNA, 70 bp, Artificial Sequence
  Synthetic
gccaagcatttaggtgacactatagcgggctcaggtgcatgagcggtttcagagctatgctggaaacagc

SEQ ID NO: 47459 - DNA, 70 bp, Artificial Sequence
  Synthetic
gccaagcatttaggtgacactatagtccatggatcagcgctgccggtttcagagctatgctggaaacagc

SEQ ID NO: 47460 - DNA, 70 bp, Artificial Sequence
  Synthetic
gccaagcatttaggtgacactatagttcattgcaacatggtcccagtttcagagctatgctggaaacagc

SEQ ID NO: 47461 - DNA, 70 bp, Artificial Sequence
  Synthetic
gccaagcatttaggtgacactataggcagcagtacctggcatgatgtttcagagctatgctggaaacagc

SEQ ID NO: 47462 - DNA, 70 bp, Artificial Sequence
  Synthetic
gccaagcatttaggtgacactataggtcctgacagccagcaggcagtttcagagctatgctggaaacagc

SEQ ID NO: 47463 - DNA, 70 bp, Artificial Sequence
  Synthetic
gccaagcatttaggtgacactatagagccagtctcacaggaagtagtttcagagctatgctggaaacagc

SEQ ID NO: 47464 - DNA, 70 bp, Artificial Sequence
  Synthetic
gccaagcatttaggtgacactatagcctttagccctgacttacacgtttcagagctatgctggaaacagc

SEQ ID NO: 47465 - DNA, 70 bp, Artificial Sequence
  Synthetic
gccaagcatttaggtgacactatagacagactccaaattagagttgtttcagagctatgctggaaacagc

SEQ ID NO: 47466 - DNA, 70 bp, Artificial Sequence
  Synthetic
gccaagcatttaggtgacactatagtcactttcactaagaggtcagtttcagagctatgctggaaacagc

SEQ ID NO: 47467 - DNA, 70 bp, Artificial Sequence
  Synthetic
gccaagcatttaggtgacactatagacatatgttcccaaagagccgtttcagagctatgctggaaacagc

SEQ ID NO: 47468 - DNA, 70 bp, Artificial Sequence
  Synthetic
gccaagcatttaggtgacactatagtcaactctctctttcacctcgtttcagagctatgctggaaacagc

SEQ ID NO: 47469 - DNA, 70 bp, Artificial Sequence
  Synthetic
gccaagcatttaggtgacactatagatgactttatctctcacttcgtttcagagctatgctggaaacagc

SEQ ID NO: 47470 - DNA, 70 bp, Artificial Sequence
  Synthetic
gccaagcatttaggtgacactatagtgttcgagagggccgtttatgtttcagagctatgctggaaacagc

SEQ ID NO: 47471 - DNA, 70 bp, Artificial Sequence
  Synthetic
gccaagcatttaggtgacactatagctatcatccacactgcagcagtttcagagctatgctggaaacagc

SEQ ID NO: 47472 - DNA, 70 bp, Artificial Sequence
  Synthetic
gccaagcatttaggtgacactataggagctcctaaatcaagtcaagtttcagagctatgctggaaacagc

SEQ ID NO: 47473 - DNA, 70 bp, Artificial Sequence
  Synthetic
gccaagcatttaggtgacactatagtagttctattctgaaaaggggtttcagagctatgctggaaacagc

SEQ ID NO: 47474 - DNA, 70 bp, Artificial Sequence
  Synthetic
gccaagcatttaggtgacactatagggccgcagctactcagaaaagtttcagagctatgctggaaacagc

SEQ ID NO: 47475 - DNA, 70 bp, Artificial Sequence
  Synthetic
gccaagcatttaggtgacactataggcaacatgtagtgtttacaggtttcagagctatgctggaaacagc

SEQ ID NO: 47476 - DNA, 70 bp, Artificial Sequence
  Synthetic
gccaagcatttaggtgacactatagtcaaaggctagagggtccacgtttcagagctatgctggaaacagc

SEQ ID NO: 47477 - DNA, 70 bp, Artificial Sequence
  Synthetic
gccaagcatttaggtgacactatagtgacaatgatgacacagccagtttcagagctatgctggaaacagc

SEQ ID NO: 47478 - DNA, 70 bp, Artificial Sequence
  Synthetic
gccaagcatttaggtgacactatagtcactcagcttcacattatcgtttcagagctatgctggaaacagc

SEQ ID NO: 47479 - DNA, 70 bp, Artificial Sequence
  Synthetic
gccaagcatttaggtgacactatagtcacaggtcatttgatcttggtttcagagctatgctggaaacagc

SEQ ID NO: 47480 - DNA, 70 bp, Artificial Sequence
  Synthetic
gccaagcatttaggtgacactatagcctcttattcccaagattaggtttcagagctatgctggaaacagc

SEQ ID NO: 47481 - DNA, 70 bp, Artificial Sequence
  Synthetic
gccaagcatttaggtgacactatagttcaggacctggacagtgaagtttcagagctatgctggaaacagc

SEQ ID NO: 47482 - DNA, 70 bp, Artificial Sequence
  Synthetic
gccaagcatttaggtgacactatagaaaaaaatctgtcccggcccgtttcagagctatgctggaaacagc

SEQ ID NO: 47483 - DNA, 70 bp, Artificial Sequence
  Synthetic
gccaagcatttaggtgacactatagggaactcttcagccacaatggtttcagagctatgctggaaacagc

SEQ ID NO: 47484 - DNA, 70 bp, Artificial Sequence
  Synthetic
gccaagcatttaggtgacactatagcgaccacaggcaaggccttggtttcagagctatgctggaaacagc

SEQ ID NO: 47485 - DNA, 70 bp, Artificial Sequence
  Synthetic
gccaagcatttaggtgacactataggcaagaaaaactgtgtagtcgtttcagagctatgctggaaacagc

SEQ ID NO: 47486 - DNA, 70 bp, Artificial Sequence
  Synthetic
gccaagcatttaggtgacactataggccttagcagtaggaggactgtttcagagctatgctggaaacagc

SEQ ID NO: 47487 - DNA, 70 bp, Artificial Sequence
  Synthetic
gccaagcatttaggtgacactatagtggggcagaggacgaggagtgtttcagagctatgctggaaacagc

SEQ ID NO: 47488 - DNA, 70 bp, Artificial Sequence
  Synthetic
gccaagcatttaggtgacactatagttcttcagcgcagttgtaaagtttcagagctatgctggaaacagc

SEQ ID NO: 47489 - DNA, 70 bp, Artificial Sequence
  Synthetic
gccaagcatttaggtgacactatagcttgttgctagcaagctggcgtttcagagctatgctggaaacagc

SEQ ID NO: 47490 - DNA, 70 bp, Artificial Sequence
  Synthetic
gccaagcatttaggtgacactatagaccaggaggtgaaagtcttcgtttcagagctatgctggaaacagc

SEQ ID NO: 47491 - DNA, 70 bp, Artificial Sequence
  Synthetic
gccaagcatttaggtgacactataggaccgaggctggctggctaggtttcagagctatgctggaaacagc

SEQ ID NO: 47492 - DNA, 70 bp, Artificial Sequence
  Synthetic
gccaagcatttaggtgacactatagtatgagcaatgctggttggcgtttcagagctatgctggaaacagc

SEQ ID NO: 47493 - DNA, 70 bp, Artificial Sequence
  Synthetic
gccaagcatttaggtgacactatagtggaggctgagggagatgaggtttcagagctatgctggaaacagc

SEQ ID NO: 47494 - DNA, 70 bp, Artificial Sequence
  Synthetic
gccaagcatttaggtgacactatagcagctcaacaacagatagacgtttcagagctatgctggaaacagc

SEQ ID NO: 47495 - DNA, 70 bp, Artificial Sequence
  Synthetic
gccaagcatttaggtgacactatagctatgatgatcaactctgctgtttcagagctatgctggaaacagc

SEQ ID NO: 47496 - DNA, 70 bp, Artificial Sequence
  Synthetic
gccaagcatttaggtgacactatagtcaatgaggttggtgtccacgtttcagagctatgctggaaacagc

SEQ ID NO: 47497 - DNA, 70 bp, Artificial Sequence
  Synthetic
gccaagcatttaggtgacactatagccgcagctctgctcataagagtttcagagctatgctggaaacagc

SEQ ID NO: 47498 - DNA, 70 bp, Artificial Sequence
  Synthetic
gccaagcatttaggtgacactataggcagcacggggtcagctctcgtttcagagctatgctggaaacagc

SEQ ID NO: 47499 - DNA, 70 bp, Artificial Sequence
  Synthetic
gccaagcatttaggtgacactataggcgctgcatgacttgctgaagtttcagagctatgctggaaacagc

SEQ ID NO: 47500 - DNA, 70 bp, Artificial Sequence
  Synthetic
gccaagcatttaggtgacactatagcatcctgcccctctcgttgagtttcagagctatgctggaaacagc

SEQ ID NO: 47501 - DNA, 70 bp, Artificial Sequence
  Synthetic
gccaagcatttaggtgacactataggttcagagaatgaaggaaacgtttcagagctatgctggaaacagc

SEQ ID NO: 47502 - DNA, 70 bp, Artificial Sequence
  Synthetic
gccaagcatttaggtgacactatagaaagttcgggcacttaattcgtttcagagctatgctggaaacagc

SEQ ID NO: 47503 - DNA, 70 bp, Artificial Sequence
  Synthetic
gccaagcatttaggtgacactataggcccagatccccatgcctgagtttcagagctatgctggaaacagc

SEQ ID NO: 47504 - DNA, 70 bp, Artificial Sequence
  Synthetic
gccaagcatttaggtgacactatagggtgtggggcccttggatgtgtttcagagctatgctggaaacagc

SEQ ID NO: 47505 - DNA, 70 bp, Artificial Sequence
  Synthetic
gccaagcatttaggtgacactatagtacaacagcagcgagcactcgtttcagagctatgctggaaacagc

SEQ ID NO: 47506 - DNA, 70 bp, Artificial Sequence
  Synthetic
gccaagcatttaggtgacactatagctcacagtcctggcattcaggtttcagagctatgctggaaacagc

SEQ ID NO: 47507 - DNA, 70 bp, Artificial Sequence
  Synthetic
gccaagcatttaggtgacactatagttaagaatctgcagcctcacgtttcagagctatgctggaaacagc

SEQ ID NO: 47508 - DNA, 70 bp, Artificial Sequence
  Synthetic
gccaagcatttaggtgacactatagttcactgcagacatttattggtttcagagctatgctggaaacagc

SEQ ID NO: 47509 - DNA, 70 bp, Artificial Sequence
  Synthetic
gccaagcatttaggtgacactatagctcttctcgttaggaccccggtttcagagctatgctggaaacagc

SEQ ID NO: 47510 - DNA, 70 bp, Artificial Sequence
  Synthetic
gccaagcatttaggtgacactataggcatcatcagtggaattcaagtttcagagctatgctggaaacagc

SEQ ID NO: 47511 - DNA, 70 bp, Artificial Sequence
  Synthetic
gccaagcatttaggtgacactatagtctgttatgcggcttgacaggtttcagagctatgctggaaacagc

SEQ ID NO: 47512 - DNA, 70 bp, Artificial Sequence
  Synthetic
gccaagcatttaggtgacactatagggaagatgacatccttcccagtttcagagctatgctggaaacagc

SEQ ID NO: 47513 - DNA, 70 bp, Artificial Sequence
  Synthetic
gccaagcatttaggtgacactatagtaatgtcccaacggatctgagtttcagagctatgctggaaacagc

SEQ ID NO: 47514 - DNA, 70 bp, Artificial Sequence
  Synthetic
gccaagcatttaggtgacactatagtattatcgagccaaatttgcgtttcagagctatgctggaaacagc

SEQ ID NO: 47515 - DNA, 70 bp, Artificial Sequence
  Synthetic
gccaagcatttaggtgacactatagtgccattcaggtgttacttggtttcagagctatgctggaaacagc

SEQ ID NO: 47516 - DNA, 70 bp, Artificial Sequence
  Synthetic
gccaagcatttaggtgacactatagaaactgctcttggattcatagtttcagagctatgctggaaacagc

SEQ ID NO: 47517 - DNA, 70 bp, Artificial Sequence
  Synthetic
gccaagcatttaggtgacactatagtcccgtgtctcatgcatcaagtttcagagctatgctggaaacagc

SEQ ID NO: 47518 - DNA, 70 bp, Artificial Sequence
  Synthetic
gccaagcatttaggtgacactataggctgcttccacagtttgggagtttcagagctatgctggaaacagc

SEQ ID NO: 47519 - DNA, 70 bp, Artificial Sequence
  Synthetic
gccaagcatttaggtgacactatagtttggaaaagatgatgacacgtttcagagctatgctggaaacagc

SEQ ID NO: 47520 - DNA, 70 bp, Artificial Sequence
  Synthetic
gccaagcatttaggtgacactatagagttccagctctcaggggttgtttcagagctatgctggaaacagc

SEQ ID NO: 47521 - DNA, 70 bp, Artificial Sequence
  Synthetic
gccaagcatttaggtgacactatagttcttgcttctcaaggctgcgtttcagagctatgctggaaacagc

SEQ ID NO: 47522 - DNA, 70 bp, Artificial Sequence
  Synthetic
gccaagcatttaggtgacactatagcctgcggctgcctgggctgagtttcagagctatgctggaaacagc

SEQ ID NO: 47523 - DNA, 70 bp, Artificial Sequence
  Synthetic
gccaagcatttaggtgacactatagcagagtatggaatgggatgtgtttcagagctatgctggaaacagc

SEQ ID NO: 47524 - DNA, 70 bp, Artificial Sequence
  Synthetic
gccaagcatttaggtgacactatagcaggcatgcaagctagacccgtttcagagctatgctggaaacagc

SEQ ID NO: 47525 - DNA, 70 bp, Artificial Sequence
  Synthetic
gccaagcatttaggtgacactatagcgggcaaggaggtgtgctaagtttcagagctatgctggaaacagc

SEQ ID NO: 47526 - DNA, 70 bp, Artificial Sequence
  Synthetic
gccaagcatttaggtgacactataggatgctgctggaggctgctggtttcagagctatgctggaaacagc

SEQ ID NO: 47527 - DNA, 70 bp, Artificial Sequence
  Synthetic
gccaagcatttaggtgacactataggccctgacccttgtataggtgtttcagagctatgctggaaacagc

SEQ ID NO: 47528 - DNA, 70 bp, Artificial Sequence
  Synthetic
gccaagcatttaggtgacactatagtagttacaacttcaaaagccgtttcagagctatgctggaaacagc

SEQ ID NO: 47529 - DNA, 70 bp, Artificial Sequence
  Synthetic
gccaagcatttaggtgacactatagctgcgttttgctagtcagacgtttcagagctatgctggaaacagc

SEQ ID NO: 47530 - DNA, 70 bp, Artificial Sequence
  Synthetic
gccaagcatttaggtgacactatagataaagtgcacaaatgacacgtttcagagctatgctggaaacagc

SEQ ID NO: 47531 - DNA, 70 bp, Artificial Sequence
  Synthetic
gccaagcatttaggtgacactatagaaaagttgcacagaacttgcgtttcagagctatgctggaaacagc

SEQ ID NO: 47532 - DNA, 70 bp, Artificial Sequence
  Synthetic
gccaagcatttaggtgacactatagcagcacttggagtctactcagtttcagagctatgctggaaacagc

SEQ ID NO: 47533 - DNA, 70 bp, Artificial Sequence
  Synthetic
gccaagcatttaggtgacactatagtacctgcagctggattttgagtttcagagctatgctggaaacagc

SEQ ID NO: 47534 - DNA, 70 bp, Artificial Sequence
  Synthetic
gccaagcatttaggtgacactatagccaggaacacttaggactatgtttcagagctatgctggaaacagc

SEQ ID NO: 47535 - DNA, 70 bp, Artificial Sequence
  Synthetic
gccaagcatttaggtgacactatagggagactgcaagattacagtgtttcagagctatgctggaaacagc

SEQ ID NO: 47536 - DNA, 70 bp, Artificial Sequence
  Synthetic
gccaagcatttaggtgacactatagcccacctgcaattcagttgtgtttcagagctatgctggaaacagc

SEQ ID NO: 47537 - DNA, 70 bp, Artificial Sequence
  Synthetic
gccaagcatttaggtgacactatagaaggaatttttacaggaaccgtttcagagctatgctggaaacagc

SEQ ID NO: 47538 - DNA, 70 bp, Artificial Sequence
  Synthetic
gccaagcatttaggtgacactatagatgtatctttgaatagctgggtttcagagctatgctggaaacagc

SEQ ID NO: 47539 - DNA, 70 bp, Artificial Sequence
  Synthetic
gccaagcatttaggtgacactatagcagcctgacatggggttcacgtttcagagctatgctggaaacagc

SEQ ID NO: 47540 - DNA, 70 bp, Artificial Sequence
  Synthetic
gccaagcatttaggtgacactatagagatagttttgtagacgagcgtttcagagctatgctggaaacagc

SEQ ID NO: 47541 - DNA, 70 bp, Artificial Sequence
  Synthetic
gccaagcatttaggtgacactatagtttcagtgcaaaacaccctggtttcagagctatgctggaaacagc

SEQ ID NO: 47542 - DNA, 70 bp, Artificial Sequence
  Synthetic
gccaagcatttaggtgacactatagtacgagaacacccagtaactgtttcagagctatgctggaaacagc

SEQ ID NO: 47543 - DNA, 70 bp, Artificial Sequence
  Synthetic
gccaagcatttaggtgacactataggaactggcagctattcaagagtttcagagctatgctggaaacagc

SEQ ID NO: 47544 - DNA, 70 bp, Artificial Sequence
  Synthetic
gccaagcatttaggtgacactatagtacttgcttttagagccagagtttcagagctatgctggaaacagc

SEQ ID NO: 47545 - DNA, 70 bp, Artificial Sequence
  Synthetic
gccaagcatttaggtgacactatagtcaagcaagcttgagttactgtttcagagctatgctggaaacagc

SEQ ID NO: 47546 - DNA, 70 bp, Artificial Sequence
  Synthetic
gccaagcatttaggtgacactatagtcttcagtaacgttggcagcgtttcagagctatgctggaaacagc

SEQ ID NO: 47547 - DNA, 70 bp, Artificial Sequence
  Synthetic
gccaagcatttaggtgacactatagcgtggaagatgacatctgatgtttcagagctatgctggaaacagc

SEQ ID NO: 47548 - DNA, 70 bp, Artificial Sequence
  Synthetic
gccaagcatttaggtgacactatagagcagaagcggttgatcatcgtttcagagctatgctggaaacagc

SEQ ID NO: 47549 - DNA, 70 bp, Artificial Sequence
  Synthetic
gccaagcatttaggtgacactatagtaagtagtctttcatgacctgtttcagagctatgctggaaacagc

SEQ ID NO: 47550 - DNA, 70 bp, Artificial Sequence
  Synthetic
gccaagcatttaggtgacactatagtggaagtagtcgaccatgttgtttcagagctatgctggaaacagc

SEQ ID NO: 47551 - DNA, 70 bp, Artificial Sequence
  Synthetic
gccaagcatttaggtgacactatagccggctattctaaaagtaacgtttcagagctatgctggaaacagc

SEQ ID NO: 47552 - DNA, 70 bp, Artificial Sequence
  Synthetic
gccaagcatttaggtgacactatagagaaactgtttcagatcctcgtttcagagctatgctggaaacagc

SEQ ID NO: 47553 - DNA, 70 bp, Artificial Sequence
  Synthetic
gccaagcatttaggtgacactatagatgtcaacagattagggcttgtttcagagctatgctggaaacagc

SEQ ID NO: 47554 - DNA, 70 bp, Artificial Sequence
  Synthetic
gccaagcatttaggtgacactatagtctcgattctaggattttccgtttcagagctatgctggaaacagc

SEQ ID NO: 47555 - DNA, 70 bp, Artificial Sequence
  Synthetic
gccaagcatttaggtgacactatagcaaattgacttctcctgagggtttcagagctatgctggaaacagc

SEQ ID NO: 47556 - DNA, 70 bp, Artificial Sequence
  Synthetic
gccaagcatttaggtgacactatagccctgcaccaggtctcaggagtttcagagctatgctggaaacagc

SEQ ID NO: 47557 - DNA, 70 bp, Artificial Sequence
  Synthetic
gccaagcatttaggtgacactatagagagcttctgacagattcaggtttcagagctatgctggaaacagc

SEQ ID NO: 47558 - DNA, 70 bp, Artificial Sequence
  Synthetic
gccaagcatttaggtgacactataggcaagtaaaggctggacaccgtttcagagctatgctggaaacagc

SEQ ID NO: 47559 - DNA, 70 bp, Artificial Sequence
  Synthetic
gccaagcatttaggtgacactatagggtcaagttactttaatgccgtttcagagctatgctggaaacagc

SEQ ID NO: 47560 - DNA, 70 bp, Artificial Sequence
  Synthetic
gccaagcatttaggtgacactatagcttcaccaactggttctgaggtttcagagctatgctggaaacagc

SEQ ID NO: 47561 - DNA, 70 bp, Artificial Sequence
  Synthetic
gccaagcatttaggtgacactataggacttctccagctggttagggtttcagagctatgctggaaacagc

SEQ ID NO: 47562 - DNA, 70 bp, Artificial Sequence
  Synthetic
gccaagcatttaggtgacactatagttctgaacatagggtcagcagtttcagagctatgctggaaacagc

SEQ ID NO: 47563 - DNA, 70 bp, Artificial Sequence
  Synthetic
gccaagcatttaggtgacactataggttacgtgcctgcaacttatgtttcagagctatgctggaaacagc

SEQ ID NO: 47564 - DNA, 70 bp, Artificial Sequence
  Synthetic
gccaagcatttaggtgacactataggaggaatcctggcattgatcgtttcagagctatgctggaaacagc

SEQ ID NO: 47565 - DNA, 70 bp, Artificial Sequence
  Synthetic
gccaagcatttaggtgacactatagtctcagacagcatttctgttgtttcagagctatgctggaaacagc

SEQ ID NO: 47566 - DNA, 70 bp, Artificial Sequence
  Synthetic
gccaagcatttaggtgacactataggtggtcacatgcagtccatggtttcagagctatgctggaaacagc

SEQ ID NO: 47567 - DNA, 70 bp, Artificial Sequence
  Synthetic
gccaagcatttaggtgacactatagctgcagttagatgcagtccagtttcagagctatgctggaaacagc

SEQ ID NO: 47568 - DNA, 70 bp, Artificial Sequence
  Synthetic
gccaagcatttaggtgacactatagattaaaggagaggtggctccgtttcagagctatgctggaaacagc

SEQ ID NO: 47569 - DNA, 70 bp, Artificial Sequence
  Synthetic
gccaagcatttaggtgacactataggcggaatgccaccggcgagggtttcagagctatgctggaaacagc

SEQ ID NO: 47570 - DNA, 70 bp, Artificial Sequence
  Synthetic
gccaagcatttaggtgacactatagcactttcgaaagctgttttcgtttcagagctatgctggaaacagc

SEQ ID NO: 47571 - DNA, 70 bp, Artificial Sequence
  Synthetic
gccaagcatttaggtgacactatagcccccatgggaaccctgaccgtttcagagctatgctggaaacagc

SEQ ID NO: 47572 - DNA, 70 bp, Artificial Sequence
  Synthetic
gccaagcatttaggtgacactatagagcggcctgcggggctcagcgtttcagagctatgctggaaacagc

SEQ ID NO: 47573 - DNA, 70 bp, Artificial Sequence
  Synthetic
gccaagcatttaggtgacactataggtgactcgaggggtgtcagcgtttcagagctatgctggaaacagc

SEQ ID NO: 47574 - DNA, 70 bp, Artificial Sequence
  Synthetic
gccaagcatttaggtgacactatagaggtctagagctgtgtgacagtttcagagctatgctggaaacagc

SEQ ID NO: 47575 - DNA, 70 bp, Artificial Sequence
  Synthetic
gccaagcatttaggtgacactataggactttatttggggtgaagagtttcagagctatgctggaaacagc

SEQ ID NO: 47576 - DNA, 70 bp, Artificial Sequence
  Synthetic
gccaagcatttaggtgacactataggcatgtccaggatgtcaggggtttcagagctatgctggaaacagc

SEQ ID NO: 47577 - DNA, 70 bp, Artificial Sequence
  Synthetic
gccaagcatttaggtgacactataggaagattttgcttgctaggagtttcagagctatgctggaaacagc

SEQ ID NO: 47578 - DNA, 70 bp, Artificial Sequence
  Synthetic
gccaagcatttaggtgacactatagataggatagaggagtgttaagtttcagagctatgctggaaacagc

SEQ ID NO: 47579 - DNA, 70 bp, Artificial Sequence
  Synthetic
gccaagcatttaggtgacactataggtgggggcgctcagcagttggtttcagagctatgctggaaacagc

SEQ ID NO: 47580 - DNA, 70 bp, Artificial Sequence
  Synthetic
gccaagcatttaggtgacactatagactgcaggcacagcaggcctgtttcagagctatgctggaaacagc

SEQ ID NO: 47581 - DNA, 70 bp, Artificial Sequence
  Synthetic
gccaagcatttaggtgacactatagtttatgatgccattttagccgtttcagagctatgctggaaacagc

SEQ ID NO: 47582 - DNA, 70 bp, Artificial Sequence
  Synthetic
gccaagcatttaggtgacactatagacatgctgcctgggcttcaggtttcagagctatgctggaaacagc

SEQ ID NO: 47583 - DNA, 70 bp, Artificial Sequence
  Synthetic
gccaagcatttaggtgacactatagggggctggcagctgtgctacgtttcagagctatgctggaaacagc

SEQ ID NO: 47584 - DNA, 70 bp, Artificial Sequence
  Synthetic
gccaagcatttaggtgacactataggtcagctgtcaaagcttagggtttcagagctatgctggaaacagc

SEQ ID NO: 47585 - DNA, 70 bp, Artificial Sequence
  Synthetic
gccaagcatttaggtgacactatagaggcatctgataaatgtggagtttcagagctatgctggaaacagc

SEQ ID NO: 47586 - DNA, 70 bp, Artificial Sequence
  Synthetic
gccaagcatttaggtgacactataggtaccccgtgtttgtgaatggtttcagagctatgctggaaacagc

SEQ ID NO: 47587 - DNA, 70 bp, Artificial Sequence
  Synthetic
gccaagcatttaggtgacactatagaggaggcttctcagcagagagtttcagagctatgctggaaacagc

SEQ ID NO: 47588 - DNA, 70 bp, Artificial Sequence
  Synthetic
gccaagcatttaggtgacactatagacgccttcaggttagacaccgtttcagagctatgctggaaacagc

SEQ ID NO: 47589 - DNA, 70 bp, Artificial Sequence
  Synthetic
gccaagcatttaggtgacactatagagctttagccgtttcttttcgtttcagagctatgctggaaacagc

SEQ ID NO: 47590 - DNA, 70 bp, Artificial Sequence
  Synthetic
gccaagcatttaggtgacactatagagtccctgaatcaaggttacgtttcagagctatgctggaaacagc

SEQ ID NO: 47591 - DNA, 70 bp, Artificial Sequence
  Synthetic
gccaagcatttaggtgacactatagattcatgctaaattgctggagtttcagagctatgctggaaacagc

SEQ ID NO: 47592 - DNA, 70 bp, Artificial Sequence
  Synthetic
gccaagcatttaggtgacactatagttttcctgtggaagaacagcgtttcagagctatgctggaaacagc

SEQ ID NO: 47593 - DNA, 70 bp, Artificial Sequence
  Synthetic
gccaagcatttaggtgacactatagaagggagcaccttccttcaagtttcagagctatgctggaaacagc

SEQ ID NO: 47594 - DNA, 70 bp, Artificial Sequence
  Synthetic
gccaagcatttaggtgacactataggggaaatactctcatcgtccgtttcagagctatgctggaaacagc

SEQ ID NO: 47595 - DNA, 70 bp, Artificial Sequence
  Synthetic
gccaagcatttaggtgacactatagcaaatggtgatggatacgctgtttcagagctatgctggaaacagc

SEQ ID NO: 47596 - DNA, 70 bp, Artificial Sequence
  Synthetic
gccaagcatttaggtgacactatagaaaacacaacgaaatgttgcgtttcagagctatgctggaaacagc

SEQ ID NO: 47597 - DNA, 70 bp, Artificial Sequence
  Synthetic
gccaagcatttaggtgacactatagttgcttctgcaattctgatagtttcagagctatgctggaaacagc

SEQ ID NO: 47598 - DNA, 70 bp, Artificial Sequence
  Synthetic
gccaagcatttaggtgacactatagaagaaaaggtggcttctcaggtttcagagctatgctggaaacagc

SEQ ID NO: 47599 - DNA, 70 bp, Artificial Sequence
  Synthetic
gccaagcatttaggtgacactatagtggcagctctcacctcttgcgtttcagagctatgctggaaacagc

SEQ ID NO: 47600 - DNA, 70 bp, Artificial Sequence
  Synthetic
gccaagcatttaggtgacactatagatcttccagcggcttagggagtttcagagctatgctggaaacagc

SEQ ID NO: 47601 - DNA, 70 bp, Artificial Sequence
  Synthetic
gccaagcatttaggtgacactatagtcattgtacacgggtctattgtttcagagctatgctggaaacagc

SEQ ID NO: 47602 - DNA, 70 bp, Artificial Sequence
  Synthetic
gccaagcatttaggtgacactatagaaacttagaggaacatagtggtttcagagctatgctggaaacagc

SEQ ID NO: 47603 - DNA, 70 bp, Artificial Sequence
  Synthetic
gccaagcatttaggtgacactatagatccccttgaaatgatttctgtttcagagctatgctggaaacagc

SEQ ID NO: 47604 - DNA, 70 bp, Artificial Sequence
  Synthetic
gccaagcatttaggtgacactataggtgaggatgagttaggtcccgtttcagagctatgctggaaacagc

SEQ ID NO: 47605 - DNA, 70 bp, Artificial Sequence
  Synthetic
gccaagcatttaggtgacactatagtatcccctacaacgactatggtttcagagctatgctggaaacagc

SEQ ID NO: 47606 - DNA, 70 bp, Artificial Sequence
  Synthetic
gccaagcatttaggtgacactatagtcagaggagttgtagatgatgtttcagagctatgctggaaacagc

SEQ ID NO: 47607 - DNA, 70 bp, Artificial Sequence
  Synthetic
gccaagcatttaggtgacactatagaacacgtacggggagtccaagtttcagagctatgctggaaacagc

SEQ ID NO: 47608 - DNA, 70 bp, Artificial Sequence
  Synthetic
gccaagcatttaggtgacactatagacgtgattttggtgtccttggtttcagagctatgctggaaacagc

SEQ ID NO: 47609 - DNA, 70 bp, Artificial Sequence
  Synthetic
gccaagcatttaggtgacactatagagggcaataccctccctcacgtttcagagctatgctggaaacagc

SEQ ID NO: 47610 - DNA, 70 bp, Artificial Sequence
  Synthetic
gccaagcatttaggtgacactatagtattctgcagcataagaaaggtttcagagctatgctggaaacagc

SEQ ID NO: 47611 - DNA, 70 bp, Artificial Sequence
  Synthetic
gccaagcatttaggtgacactatagtgaggagaagatggtgtcaagtttcagagctatgctggaaacagc

SEQ ID NO: 47612 - DNA, 70 bp, Artificial Sequence
  Synthetic
gccaagcatttaggtgacactatagaatcagccttttcacgctcagtttcagagctatgctggaaacagc

SEQ ID NO: 47613 - DNA, 70 bp, Artificial Sequence
  Synthetic
gccaagcatttaggtgacactataggctctgtgtattgtgccttggtttcagagctatgctggaaacagc

SEQ ID NO: 47614 - DNA, 70 bp, Artificial Sequence
  Synthetic
gccaagcatttaggtgacactataggcgtctcctgccttgtcgttgtttcagagctatgctggaaacagc

SEQ ID NO: 47615 - DNA, 70 bp, Artificial Sequence
  Synthetic
gccaagcatttaggtgacactatagtcagctcttatcgtacaaccgtttcagagctatgctggaaacagc

SEQ ID NO: 47616 - DNA, 70 bp, Artificial Sequence
  Synthetic
gccaagcatttaggtgacactatagtttgcaagctaactttccaggtttcagagctatgctggaaacagc

SEQ ID NO: 47617 - DNA, 70 bp, Artificial Sequence
  Synthetic
gccaagcatttaggtgacactatagtcttttcaattgcccgatgcgtttcagagctatgctggaaacagc

SEQ ID NO: 47618 - DNA, 70 bp, Artificial Sequence
  Synthetic
gccaagcatttaggtgacactataggataccatgacatcatcatcgtttcagagctatgctggaaacagc

SEQ ID NO: 47619 - DNA, 70 bp, Artificial Sequence
  Synthetic
gccaagcatttaggtgacactatagtgacaaatcacaacttgtaggtttcagagctatgctggaaacagc

SEQ ID NO: 47620 - DNA, 70 bp, Artificial Sequence
  Synthetic
gccaagcatttaggtgacactatagatctccctgtggactcaggagtttcagagctatgctggaaacagc

SEQ ID NO: 47621 - DNA, 70 bp, Artificial Sequence
  Synthetic
gccaagcatttaggtgacactatagccctagccagtgcctacaacgtttcagagctatgctggaaacagc

SEQ ID NO: 47622 - DNA, 70 bp, Artificial Sequence
  Synthetic
gccaagcatttaggtgacactatagctccccatggactcaggatggtttcagagctatgctggaaacagc

SEQ ID NO: 47623 - DNA, 70 bp, Artificial Sequence
  Synthetic
gccaagcatttaggtgacactatagagattcctgcactattttgagtttcagagctatgctggaaacagc

SEQ ID NO: 47624 - DNA, 70 bp, Artificial Sequence
  Synthetic
gccaagcatttaggtgacactatagacgtcgtcgcaccaggtaatgtttcagagctatgctggaaacagc

SEQ ID NO: 47625 - DNA, 70 bp, Artificial Sequence
  Synthetic
gccaagcatttaggtgacactatagagtatcgactctcctcagaggtttcagagctatgctggaaacagc

SEQ ID NO: 47626 - DNA, 70 bp, Artificial Sequence
  Synthetic
gccaagcatttaggtgacactatagtgacggggctgcggtcaccagtttcagagctatgctggaaacagc

SEQ ID NO: 47627 - DNA, 70 bp, Artificial Sequence
  Synthetic
gccaagcatttaggtgacactatagtgctctggtctcagaagatcgtttcagagctatgctggaaacagc

SEQ ID NO: 47628 - DNA, 70 bp, Artificial Sequence
  Synthetic
gccaagcatttaggtgacactatagtctgaacagcagcatccgctgtttcagagctatgctggaaacagc

SEQ ID NO: 47629 - DNA, 70 bp, Artificial Sequence
  Synthetic
gccaagcatttaggtgacactatagggaaaaccgagttgcagtccgtttcagagctatgctggaaacagc

SEQ ID NO: 47630 - DNA, 70 bp, Artificial Sequence
  Synthetic
gccaagcatttaggtgacactatagaccgccatgcagaagaaatcgtttcagagctatgctggaaacagc

SEQ ID NO: 47631 - DNA, 70 bp, Artificial Sequence
  Synthetic
gccaagcatttaggtgacactataggcctgaatcacttacacaatgtttcagagctatgctggaaacagc

SEQ ID NO: 47632 - DNA, 70 bp, Artificial Sequence
  Synthetic
gccaagcatttaggtgacactatagtcctcccagtcacagccctcgtttcagagctatgctggaaacagc

SEQ ID NO: 47633 - DNA, 70 bp, Artificial Sequence
  Synthetic
gccaagcatttaggtgacactataggctgttgactcatgcaaatggtttcagagctatgctggaaacagc

SEQ ID NO: 47634 - DNA, 70 bp, Artificial Sequence
  Synthetic
gccaagcatttaggtgacactatagaagaggtttctctcatcttcgtttcagagctatgctggaaacagc

SEQ ID NO: 47635 - DNA, 70 bp, Artificial Sequence
  Synthetic
gccaagcatttaggtgacactatagtcctgactatcctcaactaggtttcagagctatgctggaaacagc

SEQ ID NO: 47636 - DNA, 70 bp, Artificial Sequence
  Synthetic
gccaagcatttaggtgacactatagaggacccgtagctgctagaagtttcagagctatgctggaaacagc

SEQ ID NO: 47637 - DNA, 70 bp, Artificial Sequence
  Synthetic
gccaagcatttaggtgacactataggggtgctattgtaatgactcgtttcagagctatgctggaaacagc

SEQ ID NO: 47638 - DNA, 70 bp, Artificial Sequence
  Synthetic
gccaagcatttaggtgacactataggcagaggtcagggatgattggtttcagagctatgctggaaacagc

SEQ ID NO: 47639 - DNA, 70 bp, Artificial Sequence
  Synthetic
gccaagcatttaggtgacactatagaactggtggtattcagacctgtttcagagctatgctggaaacagc

SEQ ID NO: 47640 - DNA, 70 bp, Artificial Sequence
  Synthetic
gccaagcatttaggtgacactatagaccccacagtcccagtctgcgtttcagagctatgctggaaacagc

SEQ ID NO: 47641 - DNA, 70 bp, Artificial Sequence
  Synthetic
gccaagcatttaggtgacactatagagagaactacatgtatcttggtttcagagctatgctggaaacagc

SEQ ID NO: 47642 - DNA, 70 bp, Artificial Sequence
  Synthetic
gccaagcatttaggtgacactataggctccaaggtttaactgctcgtttcagagctatgctggaaacagc

SEQ ID NO: 47643 - DNA, 70 bp, Artificial Sequence
  Synthetic
gccaagcatttaggtgacactatagcgggttttgtctactaattcgtttcagagctatgctggaaacagc

SEQ ID NO: 47644 - DNA, 70 bp, Artificial Sequence
  Synthetic
gccaagcatttaggtgacactatagctgagataaagtacaggccagtttcagagctatgctggaaacagc

SEQ ID NO: 47645 - DNA, 70 bp, Artificial Sequence
  Synthetic
gccaagcatttaggtgacactatagttatgccaaagcaacgtctcgtttcagagctatgctggaaacagc

SEQ ID NO: 47646 - DNA, 70 bp, Artificial Sequence
  Synthetic
gccaagcatttaggtgacactatagagagatccagcgacgctcaggtttcagagctatgctggaaacagc

SEQ ID NO: 47647 - DNA, 70 bp, Artificial Sequence
  Synthetic
gccaagcatttaggtgacactatagccttccccagaccaagaagtgtttcagagctatgctggaaacagc

SEQ ID NO: 47648 - DNA, 70 bp, Artificial Sequence
  Synthetic
gccaagcatttaggtgacactatagtactgcaagtctcaggcgtggtttcagagctatgctggaaacagc

SEQ ID NO: 47649 - DNA, 70 bp, Artificial Sequence
  Synthetic
gccaagcatttaggtgacactatagctcaaggatacttttactgcgtttcagagctatgctggaaacagc

SEQ ID NO: 47650 - DNA, 70 bp, Artificial Sequence
  Synthetic
gccaagcatttaggtgacactatagttttggtccatgctcgttaagtttcagagctatgctggaaacagc

SEQ ID NO: 47651 - DNA, 70 bp, Artificial Sequence
  Synthetic
gccaagcatttaggtgacactatagctgtgggcacagtactgacggtttcagagctatgctggaaacagc

SEQ ID NO: 47652 - DNA, 70 bp, Artificial Sequence
  Synthetic
gccaagcatttaggtgacactatagaaggttgtgctctggcagtagtttcagagctatgctggaaacagc

SEQ ID NO: 47653 - DNA, 70 bp, Artificial Sequence
  Synthetic
gccaagcatttaggtgacactataggggcaccccaggctcagtctgtttcagagctatgctggaaacagc

SEQ ID NO: 47654 - DNA, 70 bp, Artificial Sequence
  Synthetic
gccaagcatttaggtgacactatagggcgccacggggatgactgagtttcagagctatgctggaaacagc

SEQ ID NO: 47655 - DNA, 70 bp, Artificial Sequence
  Synthetic
gccaagcatttaggtgacactataggcagaaggagggggagaactgtttcagagctatgctggaaacagc

SEQ ID NO: 47656 - DNA, 70 bp, Artificial Sequence
  Synthetic
gccaagcatttaggtgacactatagttccctgtatgtaagattaggtttcagagctatgctggaaacagc

SEQ ID NO: 47657 - DNA, 70 bp, Artificial Sequence
  Synthetic
gccaagcatttaggtgacactatagactggaggagtttgatctgggtttcagagctatgctggaaacagc

SEQ ID NO: 47658 - DNA, 70 bp, Artificial Sequence
  Synthetic
gccaagcatttaggtgacactatagcccgaccccaggattttcaagtttcagagctatgctggaaacagc

SEQ ID NO: 47659 - DNA, 70 bp, Artificial Sequence
  Synthetic
gccaagcatttaggtgacactatagggacttggcagctctcacctgtttcagagctatgctggaaacagc

SEQ ID NO: 47660 - DNA, 70 bp, Artificial Sequence
  Synthetic
gccaagcatttaggtgacactatagtgaagaagaccttttttcaggtttcagagctatgctggaaacagc

SEQ ID NO: 47661 - DNA, 70 bp, Artificial Sequence
  Synthetic
gccaagcatttaggtgacactatagggccaaacgccccagctctggtttcagagctatgctggaaacagc

SEQ ID NO: 47662 - DNA, 70 bp, Artificial Sequence
  Synthetic
gccaagcatttaggtgacactataggatggacagttgcacacactgtttcagagctatgctggaaacagc

SEQ ID NO: 47663 - DNA, 70 bp, Artificial Sequence
  Synthetic
gccaagcatttaggtgacactatagtcccacagccaacagattgagtttcagagctatgctggaaacagc

SEQ ID NO: 47664 - DNA, 70 bp, Artificial Sequence
  Synthetic
gccaagcatttaggtgacactataggatgatgagaccatctgagagtttcagagctatgctggaaacagc

SEQ ID NO: 47665 - DNA, 70 bp, Artificial Sequence
  Synthetic
gccaagcatttaggtgacactataggctggtcagaagcctatgatgtttcagagctatgctggaaacagc

SEQ ID NO: 47666 - DNA, 70 bp, Artificial Sequence
  Synthetic
gccaagcatttaggtgacactataggctaccccctcaggtgcacagtttcagagctatgctggaaacagc

SEQ ID NO: 47667 - DNA, 70 bp, Artificial Sequence
  Synthetic
gccaagcatttaggtgacactataggtcgtctcagtcagtgcaaggtttcagagctatgctggaaacagc

SEQ ID NO: 47668 - DNA, 70 bp, Artificial Sequence
  Synthetic
gccaagcatttaggtgacactatagacagtgtgtggtaaaatcaggtttcagagctatgctggaaacagc

SEQ ID NO: 47669 - DNA, 70 bp, Artificial Sequence
  Synthetic
gccaagcatttaggtgacactatagtgttcagtagattccgacttgtttcagagctatgctggaaacagc

SEQ ID NO: 47670 - DNA, 70 bp, Artificial Sequence
  Synthetic
gccaagcatttaggtgacactatagctgtcagtctgtctttaatcgtttcagagctatgctggaaacagc

SEQ ID NO: 47671 - DNA, 70 bp, Artificial Sequence
  Synthetic
gccaagcatttaggtgacactataggctgtgctgatgaaagagcagtttcagagctatgctggaaacagc

SEQ ID NO: 47672 - DNA, 70 bp, Artificial Sequence
  Synthetic
gccaagcatttaggtgacactatagtgagcttttttatccatggagtttcagagctatgctggaaacagc

SEQ ID NO: 47673 - DNA, 70 bp, Artificial Sequence
  Synthetic
gccaagcatttaggtgacactataggatgcaggaaatcagtagttgtttcagagctatgctggaaacagc

SEQ ID NO: 47674 - DNA, 70 bp, Artificial Sequence
  Synthetic
gccaagcatttaggtgacactatagtttcccaggatggaaagcttgtttcagagctatgctggaaacagc

SEQ ID NO: 47675 - DNA, 70 bp, Artificial Sequence
  Synthetic
gccaagcatttaggtgacactatagccaccgttagttttagaagtgtttcagagctatgctggaaacagc

SEQ ID NO: 47676 - DNA, 70 bp, Artificial Sequence
  Synthetic
gccaagcatttaggtgacactatagcttgatcgcaggttctacaggtttcagagctatgctggaaacagc

SEQ ID NO: 47677 - DNA, 70 bp, Artificial Sequence
  Synthetic
gccaagcatttaggtgacactatagccattacagtgactcggatggtttcagagctatgctggaaacagc

SEQ ID NO: 47678 - DNA, 70 bp, Artificial Sequence
  Synthetic
gccaagcatttaggtgacactataggcggaggcgcgcgccctagggtttcagagctatgctggaaacagc

SEQ ID NO: 47679 - DNA, 70 bp, Artificial Sequence
  Synthetic
gccaagcatttaggtgacactataggggacgtgccaagaagcgcagtttcagagctatgctggaaacagc

SEQ ID NO: 47680 - DNA, 70 bp, Artificial Sequence
  Synthetic
gccaagcatttaggtgacactatagtaccttggccttgagtagcagtttcagagctatgctggaaacagc

SEQ ID NO: 47681 - DNA, 70 bp, Artificial Sequence
  Synthetic
gccaagcatttaggtgacactatagttataggagcatcttcaagggtttcagagctatgctggaaacagc

SEQ ID NO: 47682 - DNA, 70 bp, Artificial Sequence
  Synthetic
gccaagcatttaggtgacactataggatttctgcagctcctcatagtttcagagctatgctggaaacagc

SEQ ID NO: 47683 - DNA, 70 bp, Artificial Sequence
  Synthetic
gccaagcatttaggtgacactatagctagctttctttacctttgggtttcagagctatgctggaaacagc

SEQ ID NO: 47684 - DNA, 70 bp, Artificial Sequence
  Synthetic
gccaagcatttaggtgacactatagccagcagcctgagtttctgagtttcagagctatgctggaaacagc

SEQ ID NO: 47685 - DNA, 70 bp, Artificial Sequence
  Synthetic
gccaagcatttaggtgacactataggtgtgggaatgctcgtgtgagtttcagagctatgctggaaacagc

SEQ ID NO: 47686 - DNA, 70 bp, Artificial Sequence
  Synthetic
gccaagcatttaggtgacactatagctgttggagaggagctataagtttcagagctatgctggaaacagc

SEQ ID NO: 47687 - DNA, 70 bp, Artificial Sequence
  Synthetic
gccaagcatttaggtgacactatagtggactcatctacttgttaagtttcagagctatgctggaaacagc

SEQ ID NO: 47688 - DNA, 70 bp, Artificial Sequence
  Synthetic
gccaagcatttaggtgacactatagccagcaatcacagtttctctgtttcagagctatgctggaaacagc

SEQ ID NO: 47689 - DNA, 70 bp, Artificial Sequence
  Synthetic
gccaagcatttaggtgacactatagaaaagaagaggtctgactgagtttcagagctatgctggaaacagc

SEQ ID NO: 47690 - DNA, 70 bp, Artificial Sequence
  Synthetic
gccaagcatttaggtgacactatagtcctacaagcatactgacaggtttcagagctatgctggaaacagc

SEQ ID NO: 47691 - DNA, 70 bp, Artificial Sequence
  Synthetic
gccaagcatttaggtgacactatagctcttcatcaggctctacccgtttcagagctatgctggaaacagc

SEQ ID NO: 47692 - DNA, 70 bp, Artificial Sequence
  Synthetic
gccaagcatttaggtgacactatagctgaaagtgccttcctgagagtttcagagctatgctggaaacagc

SEQ ID NO: 47693 - DNA, 70 bp, Artificial Sequence
  Synthetic
gccaagcatttaggtgacactatagccgtgggcctgcactacctcgtttcagagctatgctggaaacagc

SEQ ID NO: 47694 - DNA, 70 bp, Artificial Sequence
  Synthetic
gccaagcatttaggtgacactatagctacactgacagcagcactggtttcagagctatgctggaaacagc

SEQ ID NO: 47695 - DNA, 70 bp, Artificial Sequence
  Synthetic
gccaagcatttaggtgacactatagactgattcactgctatgttagtttcagagctatgctggaaacagc

SEQ ID NO: 47696 - DNA, 70 bp, Artificial Sequence
  Synthetic
gccaagcatttaggtgacactataggcaatgaagaacaactctgagtttcagagctatgctggaaacagc

SEQ ID NO: 47697 - DNA, 70 bp, Artificial Sequence
  Synthetic
gccaagcatttaggtgacactatagcgacaattctgattacagccgtttcagagctatgctggaaacagc

SEQ ID NO: 47698 - DNA, 70 bp, Artificial Sequence
  Synthetic
gccaagcatttaggtgacactatagcaggacggggggctaatagtgtttcagagctatgctggaaacagc

SEQ ID NO: 47699 - DNA, 70 bp, Artificial Sequence
  Synthetic
gccaagcatttaggtgacactatagatcctgcggcggtatcctgggtttcagagctatgctggaaacagc

SEQ ID NO: 47700 - DNA, 70 bp, Artificial Sequence
  Synthetic
gccaagcatttaggtgacactataggtggggctgaggtcagtagtgtttcagagctatgctggaaacagc

SEQ ID NO: 47701 - DNA, 70 bp, Artificial Sequence
  Synthetic
gccaagcatttaggtgacactatagctcatccgtcagcacccggagtttcagagctatgctggaaacagc

SEQ ID NO: 47702 - DNA, 70 bp, Artificial Sequence
  Synthetic
gccaagcatttaggtgacactatagagtgagaaagaccgttttcagtttcagagctatgctggaaacagc

SEQ ID NO: 47703 - DNA, 70 bp, Artificial Sequence
  Synthetic
gccaagcatttaggtgacactatagctccgcatcaacaaaacctggtttcagagctatgctggaaacagc

SEQ ID NO: 47704 - DNA, 70 bp, Artificial Sequence
  Synthetic
gccaagcatttaggtgacactatagggatgatcgtgacaagttttgtttcagagctatgctggaaacagc

SEQ ID NO: 47705 - DNA, 70 bp, Artificial Sequence
  Synthetic
gccaagcatttaggtgacactatagcaatgatcgttttgtgggcagtttcagagctatgctggaaacagc

SEQ ID NO: 47706 - DNA, 70 bp, Artificial Sequence
  Synthetic
gccaagcatttaggtgacactataggtcccgaactcctgggctcagtttcagagctatgctggaaacagc

SEQ ID NO: 47707 - DNA, 70 bp, Artificial Sequence
  Synthetic
gccaagcatttaggtgacactataggagactttgaaaaccgtgatgtttcagagctatgctggaaacagc

SEQ ID NO: 47708 - DNA, 70 bp, Artificial Sequence
  Synthetic
gccaagcatttaggtgacactatagcacttccttctttcatcttcgtttcagagctatgctggaaacagc

SEQ ID NO: 47709 - DNA, 70 bp, Artificial Sequence
  Synthetic
gccaagcatttaggtgacactataggttgctcggaactacctagagtttcagagctatgctggaaacagc

SEQ ID NO: 47710 - DNA, 70 bp, Artificial Sequence
  Synthetic
gccaagcatttaggtgacactatagcataatgcccctggtgatctgtttcagagctatgctggaaacagc

SEQ ID NO: 47711 - DNA, 70 bp, Artificial Sequence
  Synthetic
gccaagcatttaggtgacactataggtttgtggcccgcaactaccgtttcagagctatgctggaaacagc

SEQ ID NO: 47712 - DNA, 70 bp, Artificial Sequence
  Synthetic
gccaagcatttaggtgacactatagcggtgtgtacctcagactgagtttcagagctatgctggaaacagc

SEQ ID NO: 47713 - DNA, 70 bp, Artificial Sequence
  Synthetic
gccaagcatttaggtgacactatagctgttcccagcgctcacttcgtttcagagctatgctggaaacagc

SEQ ID NO: 47714 - DNA, 70 bp, Artificial Sequence
  Synthetic
gccaagcatttaggtgacactataggaccccagaccacaccgggtgtttcagagctatgctggaaacagc

SEQ ID NO: 47715 - DNA, 70 bp, Artificial Sequence
  Synthetic
gccaagcatttaggtgacactataggctcagagagggaggaagcagtttcagagctatgctggaaacagc

SEQ ID NO: 47716 - DNA, 70 bp, Artificial Sequence
  Synthetic
gccaagcatttaggtgacactatagaggaagcccactacatagttgtttcagagctatgctggaaacagc

SEQ ID NO: 47717 - DNA, 70 bp, Artificial Sequence
  Synthetic
gccaagcatttaggtgacactatagctactgcttctactactgtggtttcagagctatgctggaaacagc

SEQ ID NO: 47718 - DNA, 70 bp, Artificial Sequence
  Synthetic
gccaagcatttaggtgacactataggccttcctcctgctgcagccgtttcagagctatgctggaaacagc

SEQ ID NO: 47719 - DNA, 70 bp, Artificial Sequence
  Synthetic
gccaagcatttaggtgacactatagtcagctaaagcgacgtctccgtttcagagctatgctggaaacagc

SEQ ID NO: 47720 - DNA, 70 bp, Artificial Sequence
  Synthetic
gccaagcatttaggtgacactatagctgagacaagttcttgttaggtttcagagctatgctggaaacagc

SEQ ID NO: 47721 - DNA, 70 bp, Artificial Sequence
  Synthetic
gccaagcatttaggtgacactatagtacggaacgctttcaccaccgtttcagagctatgctggaaacagc

SEQ ID NO: 47722 - DNA, 70 bp, Artificial Sequence
  Synthetic
gccaagcatttaggtgacactataggctgtttcatctcctcctatgtttcagagctatgctggaaacagc

SEQ ID NO: 47723 - DNA, 70 bp, Artificial Sequence
  Synthetic
gccaagcatttaggtgacactatagtctgtagagagctgtccgacgtttcagagctatgctggaaacagc

SEQ ID NO: 47724 - DNA, 70 bp, Artificial Sequence
  Synthetic
gccaagcatttaggtgacactatagatgtcgaactaacatgcttcgtttcagagctatgctggaaacagc

SEQ ID NO: 47725 - DNA, 70 bp, Artificial Sequence
  Synthetic
gccaagcatttaggtgacactatagcagctcacatcttctgtcaggtttcagagctatgctggaaacagc

SEQ ID NO: 47726 - DNA, 70 bp, Artificial Sequence
  Synthetic
gccaagcatttaggtgacactatagggagaggagtggacagcagcgtttcagagctatgctggaaacagc

SEQ ID NO: 47727 - DNA, 70 bp, Artificial Sequence
  Synthetic
gccaagcatttaggtgacactatagtgcaccctgaagatgtgtaggtttcagagctatgctggaaacagc

SEQ ID NO: 47728 - DNA, 70 bp, Artificial Sequence
  Synthetic
gccaagcatttaggtgacactatagccaggaactctactattagagtttcagagctatgctggaaacagc

SEQ ID NO: 47729 - DNA, 70 bp, Artificial Sequence
  Synthetic
gccaagcatttaggtgacactatagcgacccgtatgaagggaaaggtttcagagctatgctggaaacagc

SEQ ID NO: 47730 - DNA, 70 bp, Artificial Sequence
  Synthetic
gccaagcatttaggtgacactatagttgggcactatcagggctgagtttcagagctatgctggaaacagc

SEQ ID NO: 47731 - DNA, 70 bp, Artificial Sequence
  Synthetic
gccaagcatttaggtgacactatagtgaagagcattcatcgtgaggtttcagagctatgctggaaacagc

SEQ ID NO: 47732 - DNA, 70 bp, Artificial Sequence
  Synthetic
gccaagcatttaggtgacactatagactcttttgtgatgacagctgtttcagagctatgctggaaacagc

SEQ ID NO: 47733 - DNA, 70 bp, Artificial Sequence
  Synthetic
gccaagcatttaggtgacactatagggtgaaggccctggagtagggtttcagagctatgctggaaacagc

SEQ ID NO: 47734 - DNA, 70 bp, Artificial Sequence
  Synthetic
gccaagcatttaggtgacactatagcctggtgaaggccctggagtgtttcagagctatgctggaaacagc

SEQ ID NO: 47735 - DNA, 70 bp, Artificial Sequence
  Synthetic
gccaagcatttaggtgacactataggcaaatgctgagaagacttcgtttcagagctatgctggaaacagc

SEQ ID NO: 47736 - DNA, 70 bp, Artificial Sequence
  Synthetic
gccaagcatttaggtgacactatagcctaaagctgctggcaaagagtttcagagctatgctggaaacagc

SEQ ID NO: 47737 - DNA, 70 bp, Artificial Sequence
  Synthetic
gccaagcatttaggtgacactatagctcatcctcttcgccatgtggtttcagagctatgctggaaacagc

SEQ ID NO: 47738 - DNA, 70 bp, Artificial Sequence
  Synthetic
gccaagcatttaggtgacactataggtggagacggctccttcacagtttcagagctatgctggaaacagc

SEQ ID NO: 47739 - DNA, 70 bp, Artificial Sequence
  Synthetic
gccaagcatttaggtgacactatagtagggatagaaatgattaccgtttcagagctatgctggaaacagc

SEQ ID NO: 47740 - DNA, 70 bp, Artificial Sequence
  Synthetic
gccaagcatttaggtgacactatagtatgggtctcttttgtttgagtttcagagctatgctggaaacagc

SEQ ID NO: 47741 - DNA, 70 bp, Artificial Sequence
  Synthetic
gccaagcatttaggtgacactatagaaattctcaattggttggtggtttcagagctatgctggaaacagc

SEQ ID NO: 47742 - DNA, 70 bp, Artificial Sequence
  Synthetic
gccaagcatttaggtgacactataggaaacggattgccagagaatgtttcagagctatgctggaaacagc

SEQ ID NO: 47743 - DNA, 70 bp, Artificial Sequence
  Synthetic
gccaagcatttaggtgacactatagttactttatttcttcaggccgtttcagagctatgctggaaacagc

SEQ ID NO: 47744 - DNA, 70 bp, Artificial Sequence
  Synthetic
gccaagcatttaggtgacactatagctccgcaaataccactgaaggtttcagagctatgctggaaacagc

SEQ ID NO: 47745 - DNA, 70 bp, Artificial Sequence
  Synthetic
gccaagcatttaggtgacactatagataggcaagcggggcatcatgtttcagagctatgctggaaacagc

SEQ ID NO: 47746 - DNA, 70 bp, Artificial Sequence
  Synthetic
gccaagcatttaggtgacactatagacaggcaagcgtggcatcatgtttcagagctatgctggaaacagc

SEQ ID NO: 47747 - DNA, 70 bp, Artificial Sequence
  Synthetic
gccaagcatttaggtgacactataggaagctgggcagggctatgcgtttcagagctatgctggaaacagc

SEQ ID NO: 47748 - DNA, 70 bp, Artificial Sequence
  Synthetic
gccaagcatttaggtgacactatagagcattggatttgatcacatgtttcagagctatgctggaaacagc

SEQ ID NO: 47749 - DNA, 70 bp, Artificial Sequence
  Synthetic
gccaagcatttaggtgacactataggagcattggatttgatcacagtttcagagctatgctggaaacagc

SEQ ID NO: 47750 - DNA, 70 bp, Artificial Sequence
  Synthetic
gccaagcatttaggtgacactatagtaagacagcactgccttctcgtttcagagctatgctggaaacagc

SEQ ID NO: 47751 - DNA, 70 bp, Artificial Sequence
  Synthetic
gccaagcatttaggtgacactatagtggcacagggtcacacaatcgtttcagagctatgctggaaacagc

SEQ ID NO: 47752 - DNA, 70 bp, Artificial Sequence
  Synthetic
gccaagcatttaggtgacactataggtttatagcattcagcccccgtttcagagctatgctggaaacagc

SEQ ID NO: 47753 - DNA, 70 bp, Artificial Sequence
  Synthetic
gccaagcatttaggtgacactataggacaaaccagaagattcgaagtttcagagctatgctggaaacagc

SEQ ID NO: 47754 - DNA, 70 bp, Artificial Sequence
  Synthetic
gccaagcatttaggtgacactatagccttcgagcatattcgggaagtttcagagctatgctggaaacagc

SEQ ID NO: 47755 - DNA, 70 bp, Artificial Sequence
  Synthetic
gccaagcatttaggtgacactataggttcaataacgacgacagtggtttcagagctatgctggaaacagc

SEQ ID NO: 47756 - DNA, 70 bp, Artificial Sequence
  Synthetic
gccaagcatttaggtgacactatagggatggcacagccgaggagtgtttcagagctatgctggaaacagc

SEQ ID NO: 47757 - DNA, 70 bp, Artificial Sequence
  Synthetic
gccaagcatttaggtgacactatagcaaaaatagagagcccctgtgtttcagagctatgctggaaacagc

SEQ ID NO: 47758 - DNA, 70 bp, Artificial Sequence
  Synthetic
gccaagcatttaggtgacactatagcagacctccagagtgaagatgtttcagagctatgctggaaacagc

SEQ ID NO: 47759 - DNA, 70 bp, Artificial Sequence
  Synthetic
gccaagcatttaggtgacactatagctcggagagggtctactttggtttcagagctatgctggaaacagc

SEQ ID NO: 47760 - DNA, 70 bp, Artificial Sequence
  Synthetic
gccaagcatttaggtgacactataggggccaggacgctagaagatgtttcagagctatgctggaaacagc

SEQ ID NO: 47761 - DNA, 70 bp, Artificial Sequence
  Synthetic
gccaagcatttaggtgacactatagtagcagaatgtatttcacaggtttcagagctatgctggaaacagc

SEQ ID NO: 47762 - DNA, 70 bp, Artificial Sequence
  Synthetic
gccaagcatttaggtgacactatagctgaagtatcattggccttggtttcagagctatgctggaaacagc

SEQ ID NO: 47763 - DNA, 70 bp, Artificial Sequence
  Synthetic
gccaagcatttaggtgacactatagggactcagcccatcctgagggtttcagagctatgctggaaacagc

SEQ ID NO: 47764 - DNA, 70 bp, Artificial Sequence
  Synthetic
gccaagcatttaggtgacactataggggggcctctattgggttatgtttcagagctatgctggaaacagc

SEQ ID NO: 47765 - DNA, 70 bp, Artificial Sequence
  Synthetic
gccaagcatttaggtgacactatagttcaaggcttctaatcttcagtttcagagctatgctggaaacagc

SEQ ID NO: 47766 - DNA, 70 bp, Artificial Sequence
  Synthetic
gccaagcatttaggtgacactatagcggggctagagcgcagtgtcgtttcagagctatgctggaaacagc

SEQ ID NO: 47767 - DNA, 70 bp, Artificial Sequence
  Synthetic
gccaagcatttaggtgacactatagtaatgctttgcagagtctcggtttcagagctatgctggaaacagc

SEQ ID NO: 47768 - DNA, 70 bp, Artificial Sequence
  Synthetic
gccaagcatttaggtgacactatagcaagattgattgcaacttgcgtttcagagctatgctggaaacagc

SEQ ID NO: 47769 - DNA, 70 bp, Artificial Sequence
  Synthetic
gccaagcatttaggtgacactatagtggttattgagttgcagtccgtttcagagctatgctggaaacagc

SEQ ID NO: 47770 - DNA, 70 bp, Artificial Sequence
  Synthetic
gccaagcatttaggtgacactatagtctggctgaagagaaggacggtttcagagctatgctggaaacagc

SEQ ID NO: 47771 - DNA, 70 bp, Artificial Sequence
  Synthetic
gccaagcatttaggtgacactatagaaatgccaacaggaagttttgtttcagagctatgctggaaacagc

SEQ ID NO: 47772 - DNA, 70 bp, Artificial Sequence
  Synthetic
gccaagcatttaggtgacactataggttggtgttagcaccaaacagtttcagagctatgctggaaacagc

SEQ ID NO: 47773 - DNA, 70 bp, Artificial Sequence
  Synthetic
gccaagcatttaggtgacactatagctgccgaagacctgcgctaggtttcagagctatgctggaaacagc

SEQ ID NO: 47774 - DNA, 70 bp, Artificial Sequence
  Synthetic
gccaagcatttaggtgacactatagcggtagttttcatggatttcgtttcagagctatgctggaaacagc

SEQ ID NO: 47775 - DNA, 70 bp, Artificial Sequence
  Synthetic
gccaagcatttaggtgacactatagaactaccggatttctgcctagtttcagagctatgctggaaacagc

SEQ ID NO: 47776 - DNA, 70 bp, Artificial Sequence
  Synthetic
gccaagcatttaggtgacactatagtgtgatgtacatttagttgggtttcagagctatgctggaaacagc

SEQ ID NO: 47777 - DNA, 70 bp, Artificial Sequence
  Synthetic
gccaagcatttaggtgacactataggccagaggcaggcttagcttgtttcagagctatgctggaaacagc

SEQ ID NO: 47778 - DNA, 70 bp, Artificial Sequence
  Synthetic
gccaagcatttaggtgacactatagactcctggtgggagacttcagtttcagagctatgctggaaacagc

SEQ ID NO: 47779 - DNA, 70 bp, Artificial Sequence
  Synthetic
gccaagcatttaggtgacactataggctcctgaatggcagggatggtttcagagctatgctggaaacagc

SEQ ID NO: 47780 - DNA, 70 bp, Artificial Sequence
  Synthetic
gccaagcatttaggtgacactatagaggcccgacgaatggtgatggtttcagagctatgctggaaacagc

SEQ ID NO: 47781 - DNA, 70 bp, Artificial Sequence
  Synthetic
gccaagcatttaggtgacactatagacaccaccaaaaagaaatccgtttcagagctatgctggaaacagc

SEQ ID NO: 47782 - DNA, 70 bp, Artificial Sequence
  Synthetic
gccaagcatttaggtgacactatagggtaagggatcagctgtcccgtttcagagctatgctggaaacagc

SEQ ID NO: 47783 - DNA, 70 bp, Artificial Sequence
  Synthetic
gccaagcatttaggtgacactatagacaagcccctcaagggctgagtttcagagctatgctggaaacagc

SEQ ID NO: 47784 - DNA, 70 bp, Artificial Sequence
  Synthetic
gccaagcatttaggtgacactataggtttacagtacaggaagaaggtttcagagctatgctggaaacagc

SEQ ID NO: 47785 - DNA, 70 bp, Artificial Sequence
  Synthetic
gccaagcatttaggtgacactatagaggtgtcactgtgactctttgtttcagagctatgctggaaacagc

SEQ ID NO: 47786 - DNA, 70 bp, Artificial Sequence
  Synthetic
gccaagcatttaggtgacactatagacagtttcactgttttatccgtttcagagctatgctggaaacagc

SEQ ID NO: 47787 - DNA, 70 bp, Artificial Sequence
  Synthetic
gccaagcatttaggtgacactatagctactcaaagctcacatcatgtttcagagctatgctggaaacagc

SEQ ID NO: 47788 - DNA, 70 bp, Artificial Sequence
  Synthetic
gccaagcatttaggtgacactatagctgcaagctggcctcctaaggtttcagagctatgctggaaacagc

SEQ ID NO: 47789 - DNA, 70 bp, Artificial Sequence
  Synthetic
gccaagcatttaggtgacactataggaattggagcaaagcggactgtttcagagctatgctggaaacagc

SEQ ID NO: 47790 - DNA, 70 bp, Artificial Sequence
  Synthetic
gccaagcatttaggtgacactatagcacaagctcctgaaggagtggtttcagagctatgctggaaacagc

SEQ ID NO: 47791 - DNA, 70 bp, Artificial Sequence
  Synthetic
gccaagcatttaggtgacactatagcttgcaaagctaaggcgtgcgtttcagagctatgctggaaacagc

SEQ ID NO: 47792 - DNA, 70 bp, Artificial Sequence
  Synthetic
gccaagcatttaggtgacactatagagcacagagtagagaacaacgtttcagagctatgctggaaacagc

SEQ ID NO: 47793 - DNA, 70 bp, Artificial Sequence
  Synthetic
gccaagcatttaggtgacactatagtatgccagatgtatcttggtgtttcagagctatgctggaaacagc

SEQ ID NO: 47794 - DNA, 70 bp, Artificial Sequence
  Synthetic
gccaagcatttaggtgacactatagttcatgaagtcttggcttttgtttcagagctatgctggaaacagc

SEQ ID NO: 47795 - DNA, 70 bp, Artificial Sequence
  Synthetic
gccaagcatttaggtgacactatagcccgaggtggagtgtggctggtttcagagctatgctggaaacagc

SEQ ID NO: 47796 - DNA, 70 bp, Artificial Sequence
  Synthetic
gccaagcatttaggtgacactatagaagtcacgaagaactgtaccgtttcagagctatgctggaaacagc

SEQ ID NO: 47797 - DNA, 70 bp, Artificial Sequence
  Synthetic
gccaagcatttaggtgacactatagcacctggcccatcaaaattcgtttcagagctatgctggaaacagc

SEQ ID NO: 47798 - DNA, 70 bp, Artificial Sequence
  Synthetic
gccaagcatttaggtgacactatagctggccccagcatcagatgcgtttcagagctatgctggaaacagc

SEQ ID NO: 47799 - DNA, 70 bp, Artificial Sequence
  Synthetic
gccaagcatttaggtgacactatagaaacacctttcaacacgtcagtttcagagctatgctggaaacagc

SEQ ID NO: 47800 - DNA, 70 bp, Artificial Sequence
  Synthetic
gccaagcatttaggtgacactatagtggttatacaagcagcatacgtttcagagctatgctggaaacagc

SEQ ID NO: 47801 - DNA, 70 bp, Artificial Sequence
  Synthetic
gccaagcatttaggtgacactatagaaaatccaggaccttcccaagtttcagagctatgctggaaacagc

SEQ ID NO: 47802 - DNA, 70 bp, Artificial Sequence
  Synthetic
gccaagcatttaggtgacactatagggtctaatgtaggcaagtaggtttcagagctatgctggaaacagc

SEQ ID NO: 47803 - DNA, 70 bp, Artificial Sequence
  Synthetic
gccaagcatttaggtgacactataggggtgtctctagtagatttcgtttcagagctatgctggaaacagc

SEQ ID NO: 47804 - DNA, 70 bp, Artificial Sequence
  Synthetic
gccaagcatttaggtgacactatagagaggttcattttcccgcatgtttcagagctatgctggaaacagc

SEQ ID NO: 47805 - DNA, 70 bp, Artificial Sequence
  Synthetic
gccaagcatttaggtgacactatagcaccaccaacagcagttgtagtttcagagctatgctggaaacagc

SEQ ID NO: 47806 - DNA, 70 bp, Artificial Sequence
  Synthetic
gccaagcatttaggtgacactatagcggctaagtcaggagacagtgtttcagagctatgctggaaacagc

SEQ ID NO: 47807 - DNA, 70 bp, Artificial Sequence
  Synthetic
gccaagcatttaggtgacactatagcaggacaatcttcagttcccgtttcagagctatgctggaaacagc

SEQ ID NO: 47808 - DNA, 70 bp, Artificial Sequence
  Synthetic
gccaagcatttaggtgacactatagctcatggaggtctcaggtcggtttcagagctatgctggaaacagc

SEQ ID NO: 47809 - DNA, 70 bp, Artificial Sequence
  Synthetic
gccaagcatttaggtgacactatagggttctgggtggggagtgaggtttcagagctatgctggaaacagc

SEQ ID NO: 47810 - DNA, 70 bp, Artificial Sequence
  Synthetic
gccaagcatttaggtgacactatagagagttcacatccatgtgaagtttcagagctatgctggaaacagc

SEQ ID NO: 47811 - DNA, 70 bp, Artificial Sequence
  Synthetic
gccaagcatttaggtgacactatagtctgacagtttctaaagacagtttcagagctatgctggaaacagc

SEQ ID NO: 47812 - DNA, 70 bp, Artificial Sequence
  Synthetic
gccaagcatttaggtgacactatagttcatcatgtttggccaggcgtttcagagctatgctggaaacagc

SEQ ID NO: 47813 - DNA, 70 bp, Artificial Sequence
  Synthetic
gccaagcatttaggtgacactatagttctaaaatggtgtcgacaggtttcagagctatgctggaaacagc

SEQ ID NO: 47814 - DNA, 70 bp, Artificial Sequence
  Synthetic
gccaagcatttaggtgacactatagggttgggaaaacagactcaagtttcagagctatgctggaaacagc

SEQ ID NO: 47815 - DNA, 70 bp, Artificial Sequence
  Synthetic
gccaagcatttaggtgacactatagagctgtcagggacgtgccttgtttcagagctatgctggaaacagc

SEQ ID NO: 47816 - DNA, 70 bp, Artificial Sequence
  Synthetic
gccaagcatttaggtgacactatagcaaacagaacgggcaggatagtttcagagctatgctggaaacagc

SEQ ID NO: 47817 - DNA, 70 bp, Artificial Sequence
  Synthetic
gccaagcatttaggtgacactatagccaagccatagagaagcatcgtttcagagctatgctggaaacagc

SEQ ID NO: 47818 - DNA, 70 bp, Artificial Sequence
  Synthetic
gccaagcatttaggtgacactataggtaaagtgctctcaaagcaggtttcagagctatgctggaaacagc

SEQ ID NO: 47819 - DNA, 70 bp, Artificial Sequence
  Synthetic
gccaagcatttaggtgacactatagcctctgttccctgaaggaaagtttcagagctatgctggaaacagc

SEQ ID NO: 47820 - DNA, 70 bp, Artificial Sequence
  Synthetic
gccaagcatttaggtgacactatagggcaggcactttctcgttaagtttcagagctatgctggaaacagc

SEQ ID NO: 47821 - DNA, 70 bp, Artificial Sequence
  Synthetic
gccaagcatttaggtgacactatagtatgatgacatcaactgactgtttcagagctatgctggaaacagc

SEQ ID NO: 47822 - DNA, 70 bp, Artificial Sequence
  Synthetic
gccaagcatttaggtgacactatagccctctgttgagattggaatgtttcagagctatgctggaaacagc

SEQ ID NO: 47823 - DNA, 70 bp, Artificial Sequence
  Synthetic
gccaagcatttaggtgacactatagaaaaggccccctcgctataagtttcagagctatgctggaaacagc

SEQ ID NO: 47824 - DNA, 70 bp, Artificial Sequence
  Synthetic
gccaagcatttaggtgacactatagaggcagaaacatctgcggtggtttcagagctatgctggaaacagc

SEQ ID NO: 47825 - DNA, 70 bp, Artificial Sequence
  Synthetic
gccaagcatttaggtgacactatagctctttacccaggactctgagtttcagagctatgctggaaacagc

SEQ ID NO: 47826 - DNA, 70 bp, Artificial Sequence
  Synthetic
gccaagcatttaggtgacactatagtttgagctcagtcagcctccgtttcagagctatgctggaaacagc

SEQ ID NO: 47827 - DNA, 70 bp, Artificial Sequence
  Synthetic
gccaagcatttaggtgacactatagatcagctagcaaacagtcttgtttcagagctatgctggaaacagc

SEQ ID NO: 47828 - DNA, 70 bp, Artificial Sequence
  Synthetic
gccaagcatttaggtgacactataggccagactcatttgccccgcgtttcagagctatgctggaaacagc

SEQ ID NO: 47829 - DNA, 70 bp, Artificial Sequence
  Synthetic
gccaagcatttaggtgacactatagaatctgctcttagggctcaagtttcagagctatgctggaaacagc

SEQ ID NO: 47830 - DNA, 70 bp, Artificial Sequence
  Synthetic
gccaagcatttaggtgacactatagcccttcaatctgtcgcctgagtttcagagctatgctggaaacagc

SEQ ID NO: 47831 - DNA, 70 bp, Artificial Sequence
  Synthetic
gccaagcatttaggtgacactataggctgcctccctgtgctcagagtttcagagctatgctggaaacagc

SEQ ID NO: 47832 - DNA, 70 bp, Artificial Sequence
  Synthetic
gccaagcatttaggtgacactatagtctctcgtcaaattgcttaagtttcagagctatgctggaaacagc

SEQ ID NO: 47833 - DNA, 70 bp, Artificial Sequence
  Synthetic
gccaagcatttaggtgacactatagtgctcctgttctcggcttatgtttcagagctatgctggaaacagc

SEQ ID NO: 47834 - DNA, 70 bp, Artificial Sequence
  Synthetic
gccaagcatttaggtgacactatagggaagagctggaagactggtgtttcagagctatgctggaaacagc

SEQ ID NO: 47835 - DNA, 70 bp, Artificial Sequence
  Synthetic
gccaagcatttaggtgacactataggccccttttctttcttcattgtttcagagctatgctggaaacagc

SEQ ID NO: 47836 - DNA, 70 bp, Artificial Sequence
  Synthetic
gccaagcatttaggtgacactatagcttgctcaaggcttctcatcgtttcagagctatgctggaaacagc

SEQ ID NO: 47837 - DNA, 70 bp, Artificial Sequence
  Synthetic
gccaagcatttaggtgacactataggggcgagcgcggggctcagtgtttcagagctatgctggaaacagc

SEQ ID NO: 47838 - DNA, 70 bp, Artificial Sequence
  Synthetic
gccaagcatttaggtgacactatagccctggatcagtgtctgatcgtttcagagctatgctggaaacagc

SEQ ID NO: 47839 - DNA, 70 bp, Artificial Sequence
  Synthetic
gccaagcatttaggtgacactatagtgcaaggctcaagttgaaacgtttcagagctatgctggaaacagc

SEQ ID NO: 47840 - DNA, 70 bp, Artificial Sequence
  Synthetic
gccaagcatttaggtgacactatagcgctgagaccatcatcttttgtttcagagctatgctggaaacagc

SEQ ID NO: 47841 - DNA, 70 bp, Artificial Sequence
  Synthetic
gccaagcatttaggtgacactataggccaaggacacttcatcgtggtttcagagctatgctggaaacagc

SEQ ID NO: 47842 - DNA, 70 bp, Artificial Sequence
  Synthetic
gccaagcatttaggtgacactatagggtgggtgtagccgtggctagtttcagagctatgctggaaacagc

SEQ ID NO: 47843 - DNA, 70 bp, Artificial Sequence
  Synthetic
gccaagcatttaggtgacactatagcatgcagtaccttcattcacgtttcagagctatgctggaaacagc

SEQ ID NO: 47844 - DNA, 70 bp, Artificial Sequence
  Synthetic
gccaagcatttaggtgacactataggtcaaattatctccagctccgtttcagagctatgctggaaacagc

SEQ ID NO: 47845 - DNA, 70 bp, Artificial Sequence
  Synthetic
gccaagcatttaggtgacactatagtcctcaaaatctccaaagaagtttcagagctatgctggaaacagc

SEQ ID NO: 47846 - DNA, 70 bp, Artificial Sequence
  Synthetic
gccaagcatttaggtgacactatagagtggagaaggtggactgatgtttcagagctatgctggaaacagc

SEQ ID NO: 47847 - DNA, 70 bp, Artificial Sequence
  Synthetic
gccaagcatttaggtgacactatagggattctgggcaaagtggaggtttcagagctatgctggaaacagc

SEQ ID NO: 47848 - DNA, 70 bp, Artificial Sequence
  Synthetic
gccaagcatttaggtgacactataggcagccccagggcaggaggagtttcagagctatgctggaaacagc

SEQ ID NO: 47849 - DNA, 70 bp, Artificial Sequence
  Synthetic
gccaagcatttaggtgacactatagtccaacccttgcttcctagcgtttcagagctatgctggaaacagc

SEQ ID NO: 47850 - DNA, 70 bp, Artificial Sequence
  Synthetic
gccaagcatttaggtgacactataggagtgcagtggcgcaatcatgtttcagagctatgctggaaacagc

SEQ ID NO: 47851 - DNA, 70 bp, Artificial Sequence
  Synthetic
gccaagcatttaggtgacactatagacttctattcttatgcgaaggtttcagagctatgctggaaacagc

SEQ ID NO: 47852 - DNA, 70 bp, Artificial Sequence
  Synthetic
gccaagcatttaggtgacactatagccttccaccactgcattactgtttcagagctatgctggaaacagc

SEQ ID NO: 47853 - DNA, 70 bp, Artificial Sequence
  Synthetic
gccaagcatttaggtgacactatagaatgcctgtttaagcttcaggtttcagagctatgctggaaacagc

SEQ ID NO: 47854 - DNA, 70 bp, Artificial Sequence
  Synthetic
gccaagcatttaggtgacactatagttttccgctgaagcttaaacgtttcagagctatgctggaaacagc

SEQ ID NO: 47855 - DNA, 70 bp, Artificial Sequence
  Synthetic
gccaagcatttaggtgacactatagccagcgagcatcatgtgagtgtttcagagctatgctggaaacagc

SEQ ID NO: 47856 - DNA, 70 bp, Artificial Sequence
  Synthetic
gccaagcatttaggtgacactatagggactctagagacatgtagcgtttcagagctatgctggaaacagc

SEQ ID NO: 47857 - DNA, 70 bp, Artificial Sequence
  Synthetic
gccaagcatttaggtgacactatagggaccggggccagcctaggggtttcagagctatgctggaaacagc

SEQ ID NO: 47858 - DNA, 70 bp, Artificial Sequence
  Synthetic
gccaagcatttaggtgacactatagacagcccaagatagttaagtgtttcagagctatgctggaaacagc

SEQ ID NO: 47859 - DNA, 70 bp, Artificial Sequence
  Synthetic
gccaagcatttaggtgacactatagctttttggcaggtcatgctagtttcagagctatgctggaaacagc

SEQ ID NO: 47860 - DNA, 70 bp, Artificial Sequence
  Synthetic
gccaagcatttaggtgacactatagggtgtggagggagttgcagggtttcagagctatgctggaaacagc

SEQ ID NO: 47861 - DNA, 70 bp, Artificial Sequence
  Synthetic
gccaagcatttaggtgacactatagcgatgtcaagcaagataacagtttcagagctatgctggaaacagc

SEQ ID NO: 47862 - DNA, 70 bp, Artificial Sequence
  Synthetic
gccaagcatttaggtgacactatagcagaagaaatgcacagaatcgtttcagagctatgctggaaacagc

SEQ ID NO: 47863 - DNA, 70 bp, Artificial Sequence
  Synthetic
gccaagcatttaggtgacactatagcagcaaaagaaaaggcaggcgtttcagagctatgctggaaacagc

SEQ ID NO: 47864 - DNA, 70 bp, Artificial Sequence
  Synthetic
gccaagcatttaggtgacactataggcactctcagctctgaagccgtttcagagctatgctggaaacagc

SEQ ID NO: 47865 - DNA, 70 bp, Artificial Sequence
  Synthetic
gccaagcatttaggtgacactatagagattgtccgcctgtctgaggtttcagagctatgctggaaacagc

SEQ ID NO: 47866 - DNA, 70 bp, Artificial Sequence
  Synthetic
gccaagcatttaggtgacactataggccgggccgcggcggctcaggtttcagagctatgctggaaacagc

SEQ ID NO: 47867 - DNA, 70 bp, Artificial Sequence
  Synthetic
gccaagcatttaggtgacactatagtgaggctcagatctccaccggtttcagagctatgctggaaacagc

SEQ ID NO: 47868 - DNA, 70 bp, Artificial Sequence
  Synthetic
gccaagcatttaggtgacactatagcctggacacagtgaaaattggtttcagagctatgctggaaacagc

SEQ ID NO: 47869 - DNA, 70 bp, Artificial Sequence
  Synthetic
gccaagcatttaggtgacactatagacccagcaattgaggtgtgagtttcagagctatgctggaaacagc

SEQ ID NO: 47870 - DNA, 70 bp, Artificial Sequence
  Synthetic
gccaagcatttaggtgacactatagcacgggctgccaactgcactgtttcagagctatgctggaaacagc

SEQ ID NO: 47871 - DNA, 70 bp, Artificial Sequence
  Synthetic
gccaagcatttaggtgacactataggacacagaaaggttttcgaggtttcagagctatgctggaaacagc

SEQ ID NO: 47872 - DNA, 70 bp, Artificial Sequence
  Synthetic
gccaagcatttaggtgacactatagcttcaggacatttgatatcggtttcagagctatgctggaaacagc

SEQ ID NO: 47873 - DNA, 70 bp, Artificial Sequence
  Synthetic
gccaagcatttaggtgacactataggatctgtgtctgattgccgcgtttcagagctatgctggaaacagc

SEQ ID NO: 47874 - DNA, 70 bp, Artificial Sequence
  Synthetic
gccaagcatttaggtgacactatagccccataccccagcgctgaagtttcagagctatgctggaaacagc

SEQ ID NO: 47875 - DNA, 70 bp, Artificial Sequence
  Synthetic
gccaagcatttaggtgacactatagtagataaacgcagccctacagtttcagagctatgctggaaacagc

SEQ ID NO: 47876 - DNA, 70 bp, Artificial Sequence
  Synthetic
gccaagcatttaggtgacactatagcggggacaccgggtctcctggtttcagagctatgctggaaacagc

SEQ ID NO: 47877 - DNA, 70 bp, Artificial Sequence
  Synthetic
gccaagcatttaggtgacactatagccggctggggtcagagcaccgtttcagagctatgctggaaacagc

SEQ ID NO: 47878 - DNA, 70 bp, Artificial Sequence
  Synthetic
gccaagcatttaggtgacactatagtccccaatgagagtcagcacgtttcagagctatgctggaaacagc

SEQ ID NO: 47879 - DNA, 70 bp, Artificial Sequence
  Synthetic
gccaagcatttaggtgacactatagtggggagctaggagtcccatgtttcagagctatgctggaaacagc

SEQ ID NO: 47880 - DNA, 70 bp, Artificial Sequence
  Synthetic
gccaagcatttaggtgacactatagacttccttcacttcagctgagtttcagagctatgctggaaacagc

SEQ ID NO: 47881 - DNA, 70 bp, Artificial Sequence
  Synthetic
gccaagcatttaggtgacactatagaatccccagcgggccatcacgtttcagagctatgctggaaacagc

SEQ ID NO: 47882 - DNA, 70 bp, Artificial Sequence
  Synthetic
gccaagcatttaggtgacactatagcccaggaagagacttgtctagtttcagagctatgctggaaacagc

SEQ ID NO: 47883 - DNA, 70 bp, Artificial Sequence
  Synthetic
gccaagcatttaggtgacactatagtatgccctcacacctttatggtttcagagctatgctggaaacagc

SEQ ID NO: 47884 - DNA, 70 bp, Artificial Sequence
  Synthetic
gccaagcatttaggtgacactatagccagatgaagacgctgtagcgtttcagagctatgctggaaacagc

SEQ ID NO: 47885 - DNA, 70 bp, Artificial Sequence
  Synthetic
gccaagcatttaggtgacactatagtctcgcacgggggcgtcttggtttcagagctatgctggaaacagc

SEQ ID NO: 47886 - DNA, 70 bp, Artificial Sequence
  Synthetic
gccaagcatttaggtgacactatagcgtgtaccaaaacgctagctgtttcagagctatgctggaaacagc

SEQ ID NO: 47887 - DNA, 70 bp, Artificial Sequence
  Synthetic
gccaagcatttaggtgacactataggtccattagtgtcagccccggtttcagagctatgctggaaacagc

SEQ ID NO: 47888 - DNA, 70 bp, Artificial Sequence
  Synthetic
gccaagcatttaggtgacactatagggaggagtcagtgtgaacctgtttcagagctatgctggaaacagc

SEQ ID NO: 47889 - DNA, 70 bp, Artificial Sequence
  Synthetic
gccaagcatttaggtgacactatagatcacagtggatttctggttgtttcagagctatgctggaaacagc

SEQ ID NO: 47890 - DNA, 70 bp, Artificial Sequence
  Synthetic
gccaagcatttaggtgacactatagtcaggtgaacgagtactgaggtttcagagctatgctggaaacagc

SEQ ID NO: 47891 - DNA, 70 bp, Artificial Sequence
  Synthetic
gccaagcatttaggtgacactatagtcttcgattggagctaactcgtttcagagctatgctggaaacagc

SEQ ID NO: 47892 - DNA, 70 bp, Artificial Sequence
  Synthetic
gccaagcatttaggtgacactatagtggtgcacattcagctgagcgtttcagagctatgctggaaacagc

SEQ ID NO: 47893 - DNA, 70 bp, Artificial Sequence
  Synthetic
gccaagcatttaggtgacactatagagggaagggctcagcagcgtgtttcagagctatgctggaaacagc

SEQ ID NO: 47894 - DNA, 70 bp, Artificial Sequence
  Synthetic
gccaagcatttaggtgacactatagaaagatttttcacagggcacgtttcagagctatgctggaaacagc

SEQ ID NO: 47895 - DNA, 70 bp, Artificial Sequence
  Synthetic
gccaagcatttaggtgacactatagaatactaagtcaccctcttcgtttcagagctatgctggaaacagc

SEQ ID NO: 47896 - DNA, 70 bp, Artificial Sequence
  Synthetic
gccaagcatttaggtgacactatagacagaagggcagcatcagccgtttcagagctatgctggaaacagc

SEQ ID NO: 47897 - DNA, 70 bp, Artificial Sequence
  Synthetic
gccaagcatttaggtgacactatagcagcgttctcatctgtaaaagtttcagagctatgctggaaacagc

SEQ ID NO: 47898 - DNA, 70 bp, Artificial Sequence
  Synthetic
gccaagcatttaggtgacactatagggtggctcagggtgaaggccgtttcagagctatgctggaaacagc

SEQ ID NO: 47899 - DNA, 70 bp, Artificial Sequence
  Synthetic
gccaagcatttaggtgacactatagtctttgacagacagccctgagtttcagagctatgctggaaacagc

SEQ ID NO: 47900 - DNA, 70 bp, Artificial Sequence
  Synthetic
gccaagcatttaggtgacactataggctacggcgtggagtgctgagtttcagagctatgctggaaacagc

SEQ ID NO: 47901 - DNA, 70 bp, Artificial Sequence
  Synthetic
gccaagcatttaggtgacactatagttcgacttctgtccatctgtgtttcagagctatgctggaaacagc

SEQ ID NO: 47902 - DNA, 70 bp, Artificial Sequence
  Synthetic
gccaagcatttaggtgacactatagctagtcttcttagagttgacgtttcagagctatgctggaaacagc

SEQ ID NO: 47903 - DNA, 70 bp, Artificial Sequence
  Synthetic
gccaagcatttaggtgacactatagtacagggatggttcagacaggtttcagagctatgctggaaacagc

SEQ ID NO: 47904 - DNA, 70 bp, Artificial Sequence
  Synthetic
gccaagcatttaggtgacactataggcctggatgtcaggcagagcgtttcagagctatgctggaaacagc

SEQ ID NO: 47905 - DNA, 70 bp, Artificial Sequence
  Synthetic
gccaagcatttaggtgacactatagcctccttggagggcctcagagtttcagagctatgctggaaacagc

SEQ ID NO: 47906 - DNA, 70 bp, Artificial Sequence
  Synthetic
gccaagcatttaggtgacactatagatttgccaatggaaagctctgtttcagagctatgctggaaacagc

SEQ ID NO: 47907 - DNA, 70 bp, Artificial Sequence
  Synthetic
gccaagcatttaggtgacactatagtaggaaacaccagtcttgaggtttcagagctatgctggaaacagc

SEQ ID NO: 47908 - DNA, 70 bp, Artificial Sequence
  Synthetic
gccaagcatttaggtgacactatagatctccctgctgaagtgagggtttcagagctatgctggaaacagc

SEQ ID NO: 47909 - DNA, 70 bp, Artificial Sequence
  Synthetic
gccaagcatttaggtgacactatagcctctctggtcagacatcgcgtttcagagctatgctggaaacagc

SEQ ID NO: 47910 - DNA, 70 bp, Artificial Sequence
  Synthetic
gccaagcatttaggtgacactatagttccgggcctttctcaacaggtttcagagctatgctggaaacagc

SEQ ID NO: 47911 - DNA, 70 bp, Artificial Sequence
  Synthetic
gccaagcatttaggtgacactatagaacagtgtcgtcagagtggtgtttcagagctatgctggaaacagc

SEQ ID NO: 47912 - DNA, 70 bp, Artificial Sequence
  Synthetic
gccaagcatttaggtgacactatagtcactaggtataatctttccgtttcagagctatgctggaaacagc

SEQ ID NO: 47913 - DNA, 70 bp, Artificial Sequence
  Synthetic
gccaagcatttaggtgacactatagggatgtggagcgaaggtcacgtttcagagctatgctggaaacagc

SEQ ID NO: 47914 - DNA, 70 bp, Artificial Sequence
  Synthetic
gccaagcatttaggtgacactatagtttttctgctacacctcactgtttcagagctatgctggaaacagc

SEQ ID NO: 47915 - DNA, 70 bp, Artificial Sequence
  Synthetic
gccaagcatttaggtgacactatagagcattttgttgcagagtttgtttcagagctatgctggaaacagc

SEQ ID NO: 47916 - DNA, 70 bp, Artificial Sequence
  Synthetic
gccaagcatttaggtgacactatagggcagaggctacggtgctgcgtttcagagctatgctggaaacagc

SEQ ID NO: 47917 - DNA, 70 bp, Artificial Sequence
  Synthetic
gccaagcatttaggtgacactatagttgtaagattcaggccatacgtttcagagctatgctggaaacagc

SEQ ID NO: 47918 - DNA, 70 bp, Artificial Sequence
  Synthetic
gccaagcatttaggtgacactatagcgacctgaaatctgatgaatgtttcagagctatgctggaaacagc

SEQ ID NO: 47919 - DNA, 70 bp, Artificial Sequence
  Synthetic
gccaagcatttaggtgacactataggagctaaggatcatcagcaagtttcagagctatgctggaaacagc

SEQ ID NO: 47920 - DNA, 70 bp, Artificial Sequence
  Synthetic
gccaagcatttaggtgacactatagacttacatctttcaggagctgtttcagagctatgctggaaacagc

SEQ ID NO: 47921 - DNA, 70 bp, Artificial Sequence
  Synthetic
gccaagcatttaggtgacactatagtcactccaaaaaactggcatgtttcagagctatgctggaaacagc

SEQ ID NO: 47922 - DNA, 70 bp, Artificial Sequence
  Synthetic
gccaagcatttaggtgacactatagttgcatttccagccattggtgtttcagagctatgctggaaacagc

SEQ ID NO: 47923 - DNA, 70 bp, Artificial Sequence
  Synthetic
gccaagcatttaggtgacactatagtggcatgatgtttccagcaggtttcagagctatgctggaaacagc

SEQ ID NO: 47924 - DNA, 70 bp, Artificial Sequence
  Synthetic
gccaagcatttaggtgacactatagtgcggtgggcggctcagcatgtttcagagctatgctggaaacagc

SEQ ID NO: 47925 - DNA, 70 bp, Artificial Sequence
  Synthetic
gccaagcatttaggtgacactatagcatgggcatgaggaggctacgtttcagagctatgctggaaacagc

SEQ ID NO: 47926 - DNA, 70 bp, Artificial Sequence
  Synthetic
gccaagcatttaggtgacactatagacgctggtgtccacagtgtggtttcagagctatgctggaaacagc

SEQ ID NO: 47927 - DNA, 70 bp, Artificial Sequence
  Synthetic
gccaagcatttaggtgacactatagctgcccccctcctcagctgagtttcagagctatgctggaaacagc

SEQ ID NO: 47928 - DNA, 70 bp, Artificial Sequence
  Synthetic
gccaagcatttaggtgacactataggggaagttcatcttccagccgtttcagagctatgctggaaacagc

SEQ ID NO: 47929 - DNA, 70 bp, Artificial Sequence
  Synthetic
gccaagcatttaggtgacactatagtagtcaggcggctcagaatcgtttcagagctatgctggaaacagc

SEQ ID NO: 47930 - DNA, 70 bp, Artificial Sequence
  Synthetic
gccaagcatttaggtgacactatagggcacccatcattcgatgaggtttcagagctatgctggaaacagc

SEQ ID NO: 47931 - DNA, 70 bp, Artificial Sequence
  Synthetic
gccaagcatttaggtgacactataggcacccctcatccgctgagggtttcagagctatgctggaaacagc

SEQ ID NO: 47932 - DNA, 70 bp, Artificial Sequence
  Synthetic
gccaagcatttaggtgacactatagctggcagctgatggactcaggtttcagagctatgctggaaacagc

SEQ ID NO: 47933 - DNA, 70 bp, Artificial Sequence
  Synthetic
gccaagcatttaggtgacactatagagaatcttcgtaccacaaacgtttcagagctatgctggaaacagc

SEQ ID NO: 47934 - DNA, 70 bp, Artificial Sequence
  Synthetic
gccaagcatttaggtgacactatagggaagctggaattcgtatgagtttcagagctatgctggaaacagc

SEQ ID NO: 47935 - DNA, 70 bp, Artificial Sequence
  Synthetic
gccaagcatttaggtgacactatagtcccagagagcatcacaagagtttcagagctatgctggaaacagc

SEQ ID NO: 47936 - DNA, 70 bp, Artificial Sequence
  Synthetic
gccaagcatttaggtgacactataggcaatgaggtttgtgtctacgtttcagagctatgctggaaacagc

SEQ ID NO: 47937 - DNA, 70 bp, Artificial Sequence
  Synthetic
gccaagcatttaggtgacactatagccccaagttgaaaaggaattgtttcagagctatgctggaaacagc

SEQ ID NO: 47938 - DNA, 70 bp, Artificial Sequence
  Synthetic
gccaagcatttaggtgacactatagggccatccagattcagtgaggtttcagagctatgctggaaacagc

SEQ ID NO: 47939 - DNA, 70 bp, Artificial Sequence
  Synthetic
gccaagcatttaggtgacactatagtcagggccagcagtcctcacgtttcagagctatgctggaaacagc

SEQ ID NO: 47940 - DNA, 70 bp, Artificial Sequence
  Synthetic
gccaagcatttaggtgacactataggtcaagaggaagcaactcaagtttcagagctatgctggaaacagc

SEQ ID NO: 47941 - DNA, 70 bp, Artificial Sequence
  Synthetic
gccaagcatttaggtgacactatagagccgacgggcgcctcaccggtttcagagctatgctggaaacagc

SEQ ID NO: 47942 - DNA, 70 bp, Artificial Sequence
  Synthetic
gccaagcatttaggtgacactatagcttcgctgcaatgttttcacgtttcagagctatgctggaaacagc

SEQ ID NO: 47943 - DNA, 70 bp, Artificial Sequence
  Synthetic
gccaagcatttaggtgacactatagacaggagccgcgaggactgagtttcagagctatgctggaaacagc

SEQ ID NO: 47944 - DNA, 70 bp, Artificial Sequence
  Synthetic
gccaagcatttaggtgacactatagttactttagcttaatggtgggtttcagagctatgctggaaacagc

SEQ ID NO: 47945 - DNA, 70 bp, Artificial Sequence
  Synthetic
gccaagcatttaggtgacactataggtaaccgtgaaagagtgacagtttcagagctatgctggaaacagc

SEQ ID NO: 47946 - DNA, 70 bp, Artificial Sequence
  Synthetic
gccaagcatttaggtgacactatagccgcatcggaagctcagggcgtttcagagctatgctggaaacagc

SEQ ID NO: 47947 - DNA, 70 bp, Artificial Sequence
  Synthetic
gccaagcatttaggtgacactatagggccagctggtcagccacgcgtttcagagctatgctggaaacagc

SEQ ID NO: 47948 - DNA, 70 bp, Artificial Sequence
  Synthetic
gccaagcatttaggtgacactataggctcaagtccacttctaaccgtttcagagctatgctggaaacagc

SEQ ID NO: 47949 - DNA, 70 bp, Artificial Sequence
  Synthetic
gccaagcatttaggtgacactatagaggagtgtccccggcttcatgtttcagagctatgctggaaacagc

SEQ ID NO: 47950 - DNA, 70 bp, Artificial Sequence
  Synthetic
gccaagcatttaggtgacactatagggggattgatcagacacgtagtttcagagctatgctggaaacagc

SEQ ID NO: 47951 - DNA, 70 bp, Artificial Sequence
  Synthetic
gccaagcatttaggtgacactatagatctggaagaagatgggctggtttcagagctatgctggaaacagc

SEQ ID NO: 47952 - DNA, 70 bp, Artificial Sequence
  Synthetic
gccaagcatttaggtgacactatagtggaggaaaaacacagtccagtttcagagctatgctggaaacagc

SEQ ID NO: 47953 - DNA, 70 bp, Artificial Sequence
  Synthetic
gccaagcatttaggtgacactatagattcgtgactttttcgcagcgtttcagagctatgctggaaacagc

SEQ ID NO: 47954 - DNA, 70 bp, Artificial Sequence
  Synthetic
gccaagcatttaggtgacactatagcgaagacagaagaagtagaggtttcagagctatgctggaaacagc

SEQ ID NO: 47955 - DNA, 70 bp, Artificial Sequence
  Synthetic
gccaagcatttaggtgacactatagggaaaacaggccaatctgtggtttcagagctatgctggaaacagc

SEQ ID NO: 47956 - DNA, 70 bp, Artificial Sequence
  Synthetic
gccaagcatttaggtgacactataggcagagctggccacaatatggtttcagagctatgctggaaacagc

SEQ ID NO: 47957 - DNA, 70 bp, Artificial Sequence
  Synthetic
gccaagcatttaggtgacactatagtgggagtccagtatgctacagtttcagagctatgctggaaacagc

SEQ ID NO: 47958 - DNA, 70 bp, Artificial Sequence
  Synthetic
gccaagcatttaggtgacactatagggcgggtgcaggcacctaatgtttcagagctatgctggaaacagc

SEQ ID NO: 47959 - DNA, 70 bp, Artificial Sequence
  Synthetic
gccaagcatttaggtgacactatagagtgctcagttatcattcaggtttcagagctatgctggaaacagc

SEQ ID NO: 47960 - DNA, 70 bp, Artificial Sequence
  Synthetic
gccaagcatttaggtgacactatagcgggaagttcttccaaagcagtttcagagctatgctggaaacagc

SEQ ID NO: 47961 - DNA, 70 bp, Artificial Sequence
  Synthetic
gccaagcatttaggtgacactatagcataatcagtgcttctcagagtttcagagctatgctggaaacagc

SEQ ID NO: 47962 - DNA, 70 bp, Artificial Sequence
  Synthetic
gccaagcatttaggtgacactatagttaaggcagagggtggagaagtttcagagctatgctggaaacagc

SEQ ID NO: 47963 - DNA, 70 bp, Artificial Sequence
  Synthetic
gccaagcatttaggtgacactatagacagcagctcaggtctcagggtttcagagctatgctggaaacagc

SEQ ID NO: 47964 - DNA, 70 bp, Artificial Sequence
  Synthetic
gccaagcatttaggtgacactatagtcttgattgtgaactttctggtttcagagctatgctggaaacagc

SEQ ID NO: 47965 - DNA, 70 bp, Artificial Sequence
  Synthetic
gccaagcatttaggtgacactatagacacacacagataaattcacgtttcagagctatgctggaaacagc

SEQ ID NO: 47966 - DNA, 70 bp, Artificial Sequence
  Synthetic
gccaagcatttaggtgacactatagagtggggacagcttcttcctgtttcagagctatgctggaaacagc

SEQ ID NO: 47967 - DNA, 70 bp, Artificial Sequence
  Synthetic
gccaagcatttaggtgacactataggttggacttgattccaccgcgtttcagagctatgctggaaacagc

SEQ ID NO: 47968 - DNA, 70 bp, Artificial Sequence
  Synthetic
gccaagcatttaggtgacactatagattcaccctacagggactttgtttcagagctatgctggaaacagc

SEQ ID NO: 47969 - DNA, 70 bp, Artificial Sequence
  Synthetic
gccaagcatttaggtgacactatagaccccttctattggaaattcgtttcagagctatgctggaaacagc

SEQ ID NO: 47970 - DNA, 70 bp, Artificial Sequence
  Synthetic
gccaagcatttaggtgacactatagttgaaagactctatggttaggtttcagagctatgctggaaacagc

SEQ ID NO: 47971 - DNA, 70 bp, Artificial Sequence
  Synthetic
gccaagcatttaggtgacactataggagggacccaaaagctaagcgtttcagagctatgctggaaacagc

SEQ ID NO: 47972 - DNA, 70 bp, Artificial Sequence
  Synthetic
gccaagcatttaggtgacactatagttcacccctccaaggagtctgtttcagagctatgctggaaacagc

SEQ ID NO: 47973 - DNA, 70 bp, Artificial Sequence
  Synthetic
gccaagcatttaggtgacactatagacaatgaaagggcgcttcacgtttcagagctatgctggaaacagc

SEQ ID NO: 47974 - DNA, 70 bp, Artificial Sequence
  Synthetic
gccaagcatttaggtgacactatagttggactcactagcatccctgtttcagagctatgctggaaacagc

SEQ ID NO: 47975 - DNA, 70 bp, Artificial Sequence
  Synthetic
gccaagcatttaggtgacactatagggagaagggggctccgtgaggtttcagagctatgctggaaacagc

SEQ ID NO: 47976 - DNA, 70 bp, Artificial Sequence
  Synthetic
gccaagcatttaggtgacactatagaggggtggcagcgggggcttgtttcagagctatgctggaaacagc

SEQ ID NO: 47977 - DNA, 70 bp, Artificial Sequence
  Synthetic
gccaagcatttaggtgacactatagccccatgccaggtccctagggtttcagagctatgctggaaacagc

SEQ ID NO: 47978 - DNA, 70 bp, Artificial Sequence
  Synthetic
gccaagcatttaggtgacactatagtttcttccccctgcagctctgtttcagagctatgctggaaacagc

SEQ ID NO: 47979 - DNA, 70 bp, Artificial Sequence
  Synthetic
gccaagcatttaggtgacactataggaaagaacactctgaacttcgtttcagagctatgctggaaacagc

SEQ ID NO: 47980 - DNA, 70 bp, Artificial Sequence
  Synthetic
gccaagcatttaggtgacactatagtcagaaaaatgcactatgacgtttcagagctatgctggaaacagc

SEQ ID NO: 47981 - DNA, 70 bp, Artificial Sequence
  Synthetic
gccaagcatttaggtgacactatagtggacaagaaggaagagtaagtttcagagctatgctggaaacagc

SEQ ID NO: 47982 - DNA, 70 bp, Artificial Sequence
  Synthetic
gccaagcatttaggtgacactatagctggggtcaccaccctcagggtttcagagctatgctggaaacagc

SEQ ID NO: 47983 - DNA, 70 bp, Artificial Sequence
  Synthetic
gccaagcatttaggtgacactatagggaacctcctcctgtaaagcgtttcagagctatgctggaaacagc

SEQ ID NO: 47984 - DNA, 70 bp, Artificial Sequence
  Synthetic
gccaagcatttaggtgacactatagaccgtgctgatttgtttactgtttcagagctatgctggaaacagc

SEQ ID NO: 47985 - DNA, 70 bp, Artificial Sequence
  Synthetic
gccaagcatttaggtgacactatagtgtcttttcagaagtcttgcgtttcagagctatgctggaaacagc

SEQ ID NO: 47986 - DNA, 70 bp, Artificial Sequence
  Synthetic
gccaagcatttaggtgacactatagaaagcatgcgttcgggatgggtttcagagctatgctggaaacagc

SEQ ID NO: 47987 - DNA, 70 bp, Artificial Sequence
  Synthetic
gccaagcatttaggtgacactatagagcaggttgctggtacctacgtttcagagctatgctggaaacagc

SEQ ID NO: 47988 - DNA, 70 bp, Artificial Sequence
  Synthetic
gccaagcatttaggtgacactataggaagaccacaaagctcacaagtttcagagctatgctggaaacagc

SEQ ID NO: 47989 - DNA, 70 bp, Artificial Sequence
  Synthetic
gccaagcatttaggtgacactataggctgcccacactgtataggagtttcagagctatgctggaaacagc

SEQ ID NO: 47990 - DNA, 70 bp, Artificial Sequence
  Synthetic
gccaagcatttaggtgacactataggacaattgtgctatcctgaagtttcagagctatgctggaaacagc

SEQ ID NO: 47991 - DNA, 70 bp, Artificial Sequence
  Synthetic
gccaagcatttaggtgacactatagcacagcctgcagcttcacacgtttcagagctatgctggaaacagc

SEQ ID NO: 47992 - DNA, 70 bp, Artificial Sequence
  Synthetic
gccaagcatttaggtgacactatagcagggaaccttcatgactgtgtttcagagctatgctggaaacagc

SEQ ID NO: 47993 - DNA, 70 bp, Artificial Sequence
  Synthetic
gccaagcatttaggtgacactatagcgacaagatgaacgaaatcagtttcagagctatgctggaaacagc

SEQ ID NO: 47994 - DNA, 70 bp, Artificial Sequence
  Synthetic
gccaagcatttaggtgacactatagttccgatacagcacaatggtgtttcagagctatgctggaaacagc

SEQ ID NO: 47995 - DNA, 70 bp, Artificial Sequence
  Synthetic
gccaagcatttaggtgacactatagagtttccagaagcagtgagagtttcagagctatgctggaaacagc

SEQ ID NO: 47996 - DNA, 70 bp, Artificial Sequence
  Synthetic
gccaagcatttaggtgacactatagagcaagaaagaaagttgtgtgtttcagagctatgctggaaacagc

SEQ ID NO: 47997 - DNA, 70 bp, Artificial Sequence
  Synthetic
gccaagcatttaggtgacactatagcacttatcgaagtgatccaggtttcagagctatgctggaaacagc

SEQ ID NO: 47998 - DNA, 70 bp, Artificial Sequence
  Synthetic
gccaagcatttaggtgacactatagcattctacatcccagacaaagtttcagagctatgctggaaacagc

SEQ ID NO: 47999 - DNA, 70 bp, Artificial Sequence
  Synthetic
gccaagcatttaggtgacactatagaaaggctgtggggtcagatcgtttcagagctatgctggaaacagc

SEQ ID NO: 48000 - DNA, 70 bp, Artificial Sequence
  Synthetic
gccaagcatttaggtgacactatagggcagggtctcacccgtgcagtttcagagctatgctggaaacagc

SEQ ID NO: 48001 - DNA, 70 bp, Artificial Sequence
  Synthetic
gccaagcatttaggtgacactatagtgaaacagtacgtgatcttagtttcagagctatgctggaaacagc

SEQ ID NO: 48002 - DNA, 70 bp, Artificial Sequence
  Synthetic
gccaagcatttaggtgacactataggatgtgtggcagttttcggagtttcagagctatgctggaaacagc

SEQ ID NO: 48003 - DNA, 70 bp, Artificial Sequence
  Synthetic
gccaagcatttaggtgacactatagttttagcgtgtacagtacccgtttcagagctatgctggaaacagc

SEQ ID NO: 48004 - DNA, 70 bp, Artificial Sequence
  Synthetic
gccaagcatttaggtgacactatagcccgcgcgcttagctcctctgtttcagagctatgctggaaacagc

SEQ ID NO: 48005 - DNA, 70 bp, Artificial Sequence
  Synthetic
gccaagcatttaggtgacactatagaggcatgttgacttcacttggtttcagagctatgctggaaacagc

SEQ ID NO: 48006 - DNA, 70 bp, Artificial Sequence
  Synthetic
gccaagcatttaggtgacactatagggtgatgtgagtctgggctggtttcagagctatgctggaaacagc

SEQ ID NO: 48007 - DNA, 70 bp, Artificial Sequence
  Synthetic
gccaagcatttaggtgacactatagagtcagtggcccacaagaaggtttcagagctatgctggaaacagc

SEQ ID NO: 48008 - DNA, 70 bp, Artificial Sequence
  Synthetic
gccaagcatttaggtgacactatagctggtcaacagtattgcttcgtttcagagctatgctggaaacagc

SEQ ID NO: 48009 - DNA, 70 bp, Artificial Sequence
  Synthetic
gccaagcatttaggtgacactataggctggtgcccggagattggagtttcagagctatgctggaaacagc

SEQ ID NO: 48010 - DNA, 70 bp, Artificial Sequence
  Synthetic
gccaagcatttaggtgacactatagtgctgggctcactcttcagtgtttcagagctatgctggaaacagc

SEQ ID NO: 48011 - DNA, 70 bp, Artificial Sequence
  Synthetic
gccaagcatttaggtgacactatagcaacagccttcatttatctcgtttcagagctatgctggaaacagc

SEQ ID NO: 48012 - DNA, 70 bp, Artificial Sequence
  Synthetic
gccaagcatttaggtgacactataggtcatttagttggtcacagtgtttcagagctatgctggaaacagc

SEQ ID NO: 48013 - DNA, 70 bp, Artificial Sequence
  Synthetic
gccaagcatttaggtgacactatagggtgtggagaatgcattgacgtttcagagctatgctggaaacagc

SEQ ID NO: 48014 - DNA, 70 bp, Artificial Sequence
  Synthetic
gccaagcatttaggtgacactatagaaccactatctcagtgcaatgtttcagagctatgctggaaacagc

SEQ ID NO: 48015 - DNA, 70 bp, Artificial Sequence
  Synthetic
gccaagcatttaggtgacactatagaagttcagtggccactcaaggtttcagagctatgctggaaacagc

SEQ ID NO: 48016 - DNA, 70 bp, Artificial Sequence
  Synthetic
gccaagcatttaggtgacactatagcaaccactatctcagtgcaagtttcagagctatgctggaaacagc

SEQ ID NO: 48017 - DNA, 70 bp, Artificial Sequence
  Synthetic
gccaagcatttaggtgacactatagcagagggaaatgtgctcatggtttcagagctatgctggaaacagc

SEQ ID NO: 48018 - DNA, 70 bp, Artificial Sequence
  Synthetic
gccaagcatttaggtgacactatagggtatcatgagaaatccttggtttcagagctatgctggaaacagc

SEQ ID NO: 48019 - DNA, 70 bp, Artificial Sequence
  Synthetic
gccaagcatttaggtgacactatagtgctacagtggttcttaatcgtttcagagctatgctggaaacagc

SEQ ID NO: 48020 - DNA, 70 bp, Artificial Sequence
  Synthetic
gccaagcatttaggtgacactatagttaacgcttactatgcaagggtttcagagctatgctggaaacagc

SEQ ID NO: 48021 - DNA, 70 bp, Artificial Sequence
  Synthetic
gccaagcatttaggtgacactatagggtggccctgctggaggagggtttcagagctatgctggaaacagc

SEQ ID NO: 48022 - DNA, 70 bp, Artificial Sequence
  Synthetic
gccaagcatttaggtgacactatagtgagaaagagctcagtccaagtttcagagctatgctggaaacagc

SEQ ID NO: 48023 - DNA, 70 bp, Artificial Sequence
  Synthetic
gccaagcatttaggtgacactatagggctctgagaaagaaatagggtttcagagctatgctggaaacagc

SEQ ID NO: 48024 - DNA, 70 bp, Artificial Sequence
  Synthetic
gccaagcatttaggtgacactataggatccagcagcacggtggatgtttcagagctatgctggaaacagc

SEQ ID NO: 48025 - DNA, 70 bp, Artificial Sequence
  Synthetic
gccaagcatttaggtgacactatagtcattctttagctcaaatgcgtttcagagctatgctggaaacagc

SEQ ID NO: 48026 - DNA, 70 bp, Artificial Sequence
  Synthetic
gccaagcatttaggtgacactatagcatccagggccagggaggttgtttcagagctatgctggaaacagc

SEQ ID NO: 48027 - DNA, 70 bp, Artificial Sequence
  Synthetic
gccaagcatttaggtgacactataggggggccctggtaactgtaggtttcagagctatgctggaaacagc

SEQ ID NO: 48028 - DNA, 70 bp, Artificial Sequence
  Synthetic
gccaagcatttaggtgacactataggctccaggaggcagctgagggtttcagagctatgctggaaacagc

SEQ ID NO: 48029 - DNA, 70 bp, Artificial Sequence
  Synthetic
gccaagcatttaggtgacactatagtcaacactccatgcttcagcgtttcagagctatgctggaaacagc

SEQ ID NO: 48030 - DNA, 70 bp, Artificial Sequence
  Synthetic
gccaagcatttaggtgacactatagtgcactaccacattctcggggtttcagagctatgctggaaacagc

SEQ ID NO: 48031 - DNA, 70 bp, Artificial Sequence
  Synthetic
gccaagcatttaggtgacactatagaagcatcgtctacatctcttgtttcagagctatgctggaaacagc

SEQ ID NO: 48032 - DNA, 70 bp, Artificial Sequence
  Synthetic
gccaagcatttaggtgacactatagtagctttctgacgccgtctggtttcagagctatgctggaaacagc

SEQ ID NO: 48033 - DNA, 70 bp, Artificial Sequence
  Synthetic
gccaagcatttaggtgacactatagcaggcaggccggcttctcaggtttcagagctatgctggaaacagc

SEQ ID NO: 48034 - DNA, 70 bp, Artificial Sequence
  Synthetic
gccaagcatttaggtgacactatagcagggtaaggggaggtgagtgtttcagagctatgctggaaacagc

SEQ ID NO: 48035 - DNA, 70 bp, Artificial Sequence
  Synthetic
gccaagcatttaggtgacactatagagccaaggacctggcaacccgtttcagagctatgctggaaacagc

SEQ ID NO: 48036 - DNA, 70 bp, Artificial Sequence
  Synthetic
gccaagcatttaggtgacactatagccctggcagcgacttctagagtttcagagctatgctggaaacagc

SEQ ID NO: 48037 - DNA, 70 bp, Artificial Sequence
  Synthetic
gccaagcatttaggtgacactatagggacagacgcaaggaagaaagtttcagagctatgctggaaacagc

SEQ ID NO: 48038 - DNA, 70 bp, Artificial Sequence
  Synthetic
gccaagcatttaggtgacactataggaatatacagatgttgccacgtttcagagctatgctggaaacagc

SEQ ID NO: 48039 - DNA, 70 bp, Artificial Sequence
  Synthetic
gccaagcatttaggtgacactatagacggggctcctctgacctgagtttcagagctatgctggaaacagc

SEQ ID NO: 48040 - DNA, 70 bp, Artificial Sequence
  Synthetic
gccaagcatttaggtgacactatagtaccttcatacccatctgatgtttcagagctatgctggaaacagc

SEQ ID NO: 48041 - DNA, 70 bp, Artificial Sequence
  Synthetic
gccaagcatttaggtgacactatagatctggcctcagacaactacgtttcagagctatgctggaaacagc

SEQ ID NO: 48042 - DNA, 70 bp, Artificial Sequence
  Synthetic
gccaagcatttaggtgacactatagcagtcttgcaacagttgaccgtttcagagctatgctggaaacagc

SEQ ID NO: 48043 - DNA, 70 bp, Artificial Sequence
  Synthetic
gccaagcatttaggtgacactatagtgttctccaccgaagtctaagtttcagagctatgctggaaacagc

SEQ ID NO: 48044 - DNA, 70 bp, Artificial Sequence
  Synthetic
gccaagcatttaggtgacactataggagtctctgaggaggtgatcgtttcagagctatgctggaaacagc

SEQ ID NO: 48045 - DNA, 70 bp, Artificial Sequence
  Synthetic
gccaagcatttaggtgacactataggccacagcgagactcttcaggtttcagagctatgctggaaacagc

SEQ ID NO: 48046 - DNA, 70 bp, Artificial Sequence
  Synthetic
gccaagcatttaggtgacactatagctgtcatcattgatggaggcgtttcagagctatgctggaaacagc

SEQ ID NO: 48047 - DNA, 70 bp, Artificial Sequence
  Synthetic
gccaagcatttaggtgacactatagaaatcttccaacttttctgggtttcagagctatgctggaaacagc

SEQ ID NO: 48048 - DNA, 70 bp, Artificial Sequence
  Synthetic
gccaagcatttaggtgacactatagacaaactgcaggactgggcagtttcagagctatgctggaaacagc

SEQ ID NO: 48049 - DNA, 70 bp, Artificial Sequence
  Synthetic
gccaagcatttaggtgacactatagccattaaaaggggaagataggtttcagagctatgctggaaacagc

SEQ ID NO: 48050 - DNA, 70 bp, Artificial Sequence
  Synthetic
gccaagcatttaggtgacactatagaaagcgggcccctcaagggggtttcagagctatgctggaaacagc

SEQ ID NO: 48051 - DNA, 70 bp, Artificial Sequence
  Synthetic
gccaagcatttaggtgacactatagcatggcactgggggccctaggtttcagagctatgctggaaacagc

SEQ ID NO: 48052 - DNA, 70 bp, Artificial Sequence
  Synthetic
gccaagcatttaggtgacactataggcccagagaggattgtgtgagtttcagagctatgctggaaacagc

SEQ ID NO: 48053 - DNA, 70 bp, Artificial Sequence
  Synthetic
gccaagcatttaggtgacactataggtctctgacagacaaatctagtttcagagctatgctggaaacagc

SEQ ID NO: 48054 - DNA, 70 bp, Artificial Sequence
  Synthetic
gccaagcatttaggtgacactatagtcttaagtggggtcttgcttgtttcagagctatgctggaaacagc

SEQ ID NO: 48055 - DNA, 70 bp, Artificial Sequence
  Synthetic
gccaagcatttaggtgacactataggtctcatctgggttgcctcagtttcagagctatgctggaaacagc

SEQ ID NO: 48056 - DNA, 70 bp, Artificial Sequence
  Synthetic
gccaagcatttaggtgacactatagcgcaggcgctcagttgagcagtttcagagctatgctggaaacagc

SEQ ID NO: 48057 - DNA, 70 bp, Artificial Sequence
  Synthetic
gccaagcatttaggtgacactatagactctatgtgtaacaaacctgtttcagagctatgctggaaacagc

SEQ ID NO: 48058 - DNA, 70 bp, Artificial Sequence
  Synthetic
gccaagcatttaggtgacactatagcactgacccaagcacctgaagtttcagagctatgctggaaacagc

SEQ ID NO: 48059 - DNA, 70 bp, Artificial Sequence
  Synthetic
gccaagcatttaggtgacactatagcaaagaaagtggagaagtgagtttcagagctatgctggaaacagc

SEQ ID NO: 48060 - DNA, 70 bp, Artificial Sequence
  Synthetic
gccaagcatttaggtgacactatagaggatggatctggggattaggtttcagagctatgctggaaacagc

SEQ ID NO: 48061 - DNA, 70 bp, Artificial Sequence
  Synthetic
gccaagcatttaggtgacactatagactcatgcggccttgggaaagtttcagagctatgctggaaacagc

SEQ ID NO: 48062 - DNA, 70 bp, Artificial Sequence
  Synthetic
gccaagcatttaggtgacactatagacagatgtacttgttgacttgtttcagagctatgctggaaacagc

SEQ ID NO: 48063 - DNA, 70 bp, Artificial Sequence
  Synthetic
gccaagcatttaggtgacactatagacttcattctgattcatagcgtttcagagctatgctggaaacagc

SEQ ID NO: 48064 - DNA, 70 bp, Artificial Sequence
  Synthetic
gccaagcatttaggtgacactatagcagccgacttcgacagtcttgtttcagagctatgctggaaacagc

SEQ ID NO: 48065 - DNA, 70 bp, Artificial Sequence
  Synthetic
gccaagcatttaggtgacactataggacagtgatgaaagactggagtttcagagctatgctggaaacagc

SEQ ID NO: 48066 - DNA, 70 bp, Artificial Sequence
  Synthetic
gccaagcatttaggtgacactataggagagaggcaagagatgtgagtttcagagctatgctggaaacagc

SEQ ID NO: 48067 - DNA, 70 bp, Artificial Sequence
  Synthetic
gccaagcatttaggtgacactatagcttattgggccttggaaaacgtttcagagctatgctggaaacagc

SEQ ID NO: 48068 - DNA, 70 bp, Artificial Sequence
  Synthetic
gccaagcatttaggtgacactatagggaccaggtgaaggaagatggtttcagagctatgctggaaacagc

SEQ ID NO: 48069 - DNA, 70 bp, Artificial Sequence
  Synthetic
gccaagcatttaggtgacactatagtggcgaggaggaggagaatcgtttcagagctatgctggaaacagc

SEQ ID NO: 48070 - DNA, 70 bp, Artificial Sequence
  Synthetic
gccaagcatttaggtgacactatagagaacttggtggcactcattgtttcagagctatgctggaaacagc

SEQ ID NO: 48071 - DNA, 70 bp, Artificial Sequence
  Synthetic
gccaagcatttaggtgacactatagagagtgatcctggtggttaagtttcagagctatgctggaaacagc

SEQ ID NO: 48072 - DNA, 70 bp, Artificial Sequence
  Synthetic
gccaagcatttaggtgacactatagctctgcatctcaaaacttgagtttcagagctatgctggaaacagc

SEQ ID NO: 48073 - DNA, 70 bp, Artificial Sequence
  Synthetic
gccaagcatttaggtgacactataggacgaggccctggagccctggtttcagagctatgctggaaacagc

SEQ ID NO: 48074 - DNA, 70 bp, Artificial Sequence
  Synthetic
gccaagcatttaggtgacactatagtatagcacagcagctttgttgtttcagagctatgctggaaacagc

SEQ ID NO: 48075 - DNA, 70 bp, Artificial Sequence
  Synthetic
gccaagcatttaggtgacactatagtcccactaagtttccttacagtttcagagctatgctggaaacagc

SEQ ID NO: 48076 - DNA, 70 bp, Artificial Sequence
  Synthetic
gccaagcatttaggtgacactatagacctccgtttctggggaatggtttcagagctatgctggaaacagc

SEQ ID NO: 48077 - DNA, 70 bp, Artificial Sequence
  Synthetic
gccaagcatttaggtgacactatagccatcaggattcagggcatagtttcagagctatgctggaaacagc

SEQ ID NO: 48078 - DNA, 70 bp, Artificial Sequence
  Synthetic
gccaagcatttaggtgacactatagatggcaggagtcaaggcatagtttcagagctatgctggaaacagc

SEQ ID NO: 48079 - DNA, 70 bp, Artificial Sequence
  Synthetic
gccaagcatttaggtgacactatagtcataatggttgtcaggttcgtttcagagctatgctggaaacagc

SEQ ID NO: 48080 - DNA, 70 bp, Artificial Sequence
  Synthetic
gccaagcatttaggtgacactatagacctcaagattcaaggcatagtttcagagctatgctggaaacagc

SEQ ID NO: 48081 - DNA, 70 bp, Artificial Sequence
  Synthetic
gccaagcatttaggtgacactatagggaaacccaggtgttgtgacgtttcagagctatgctggaaacagc

SEQ ID NO: 48082 - DNA, 70 bp, Artificial Sequence
  Synthetic
gccaagcatttaggtgacactatagaagtcagacaagaagaaatcgtttcagagctatgctggaaacagc

SEQ ID NO: 48083 - DNA, 70 bp, Artificial Sequence
  Synthetic
gccaagcatttaggtgacactatagctgctggacagggaggagaggtttcagagctatgctggaaacagc

SEQ ID NO: 48084 - DNA, 70 bp, Artificial Sequence
  Synthetic
gccaagcatttaggtgacactatagagcagagcgacaccctagacgtttcagagctatgctggaaacagc

SEQ ID NO: 48085 - DNA, 70 bp, Artificial Sequence
  Synthetic
gccaagcatttaggtgacactatagttggcaactacaaaaagtaggtttcagagctatgctggaaacagc

SEQ ID NO: 48086 - DNA, 70 bp, Artificial Sequence
  Synthetic
gccaagcatttaggtgacactatagctgggcgctaggtgccctctgtttcagagctatgctggaaacagc

SEQ ID NO: 48087 - DNA, 70 bp, Artificial Sequence
  Synthetic
gccaagcatttaggtgacactatagggagcgcggatggcccatccgtttcagagctatgctggaaacagc

SEQ ID NO: 48088 - DNA, 70 bp, Artificial Sequence
  Synthetic
gccaagcatttaggtgacactatagtacactcatggccattttcagtttcagagctatgctggaaacagc

SEQ ID NO: 48089 - DNA, 70 bp, Artificial Sequence
  Synthetic
gccaagcatttaggtgacactatagcagcctctgcaaacagtgcagtttcagagctatgctggaaacagc

SEQ ID NO: 48090 - DNA, 70 bp, Artificial Sequence
  Synthetic
gccaagcatttaggtgacactataggtgacagtgtttgcaaagcggtttcagagctatgctggaaacagc

SEQ ID NO: 48091 - DNA, 70 bp, Artificial Sequence
  Synthetic
gccaagcatttaggtgacactatagcccctagagagtttagtcttgtttcagagctatgctggaaacagc

SEQ ID NO: 48092 - DNA, 70 bp, Artificial Sequence
  Synthetic
gccaagcatttaggtgacactatagattcagggagcttcctttccgtttcagagctatgctggaaacagc

SEQ ID NO: 48093 - DNA, 70 bp, Artificial Sequence
  Synthetic
gccaagcatttaggtgacactatagcccccgcacctccagtgagagtttcagagctatgctggaaacagc

SEQ ID NO: 48094 - DNA, 70 bp, Artificial Sequence
  Synthetic
gccaagcatttaggtgacactatagtttcagctgctgctcagttggtttcagagctatgctggaaacagc

SEQ ID NO: 48095 - DNA, 70 bp, Artificial Sequence
  Synthetic
gccaagcatttaggtgacactatagctgtcaaagccagacttctagtttcagagctatgctggaaacagc

SEQ ID NO: 48096 - DNA, 70 bp, Artificial Sequence
  Synthetic
gccaagcatttaggtgacactatagcaagagggtgctgctaccaggtttcagagctatgctggaaacagc

SEQ ID NO: 48097 - DNA, 70 bp, Artificial Sequence
  Synthetic
gccaagcatttaggtgacactatagcacagtgctcacaactagccgtttcagagctatgctggaaacagc

SEQ ID NO: 48098 - DNA, 70 bp, Artificial Sequence
  Synthetic
gccaagcatttaggtgacactatagccacaggagatgaagactaggtttcagagctatgctggaaacagc

SEQ ID NO: 48099 - DNA, 70 bp, Artificial Sequence
  Synthetic
gccaagcatttaggtgacactatagacagcatttactgtgattaggtttcagagctatgctggaaacagc

SEQ ID NO: 48100 - DNA, 70 bp, Artificial Sequence
  Synthetic
gccaagcatttaggtgacactatagggtgtggctggcttggtcttgtttcagagctatgctggaaacagc

SEQ ID NO: 48101 - DNA, 70 bp, Artificial Sequence
  Synthetic
gccaagcatttaggtgacactatagaacgactcttctcattcttcgtttcagagctatgctggaaacagc

SEQ ID NO: 48102 - DNA, 70 bp, Artificial Sequence
  Synthetic
gccaagcatttaggtgacactatagacctcttccgaaggacctgagtttcagagctatgctggaaacagc

SEQ ID NO: 48103 - DNA, 70 bp, Artificial Sequence
  Synthetic
gccaagcatttaggtgacactatagggaggcggcccggtgttatcgtttcagagctatgctggaaacagc

SEQ ID NO: 48104 - DNA, 70 bp, Artificial Sequence
  Synthetic
gccaagcatttaggtgacactatagactgctgctattaacactctgtttcagagctatgctggaaacagc

SEQ ID NO: 48105 - DNA, 70 bp, Artificial Sequence
  Synthetic
gccaagcatttaggtgacactatagtctggctaagctcctcacgtgtttcagagctatgctggaaacagc

SEQ ID NO: 48106 - DNA, 70 bp, Artificial Sequence
  Synthetic
gccaagcatttaggtgacactatagctgcacctgctgctcaagtggtttcagagctatgctggaaacagc

SEQ ID NO: 48107 - DNA, 70 bp, Artificial Sequence
  Synthetic
gccaagcatttaggtgacactatagtgcctgggccccgccgtcatgtttcagagctatgctggaaacagc

SEQ ID NO: 48108 - DNA, 70 bp, Artificial Sequence
  Synthetic
gccaagcatttaggtgacactataggtagtttctcttcagagttggtttcagagctatgctggaaacagc

SEQ ID NO: 48109 - DNA, 70 bp, Artificial Sequence
  Synthetic
gccaagcatttaggtgacactatagagtgacggggattcagtcatgtttcagagctatgctggaaacagc

SEQ ID NO: 48110 - DNA, 70 bp, Artificial Sequence
  Synthetic
gccaagcatttaggtgacactatagatttgcaggggtataatcaagtttcagagctatgctggaaacagc

SEQ ID NO: 48111 - DNA, 70 bp, Artificial Sequence
  Synthetic
gccaagcatttaggtgacactatagcatactactagatgaccacagtttcagagctatgctggaaacagc

SEQ ID NO: 48112 - DNA, 70 bp, Artificial Sequence
  Synthetic
gccaagcatttaggtgacactataggggccccttagcaatgtcttgtttcagagctatgctggaaacagc

SEQ ID NO: 48113 - DNA, 70 bp, Artificial Sequence
  Synthetic
gccaagcatttaggtgacactatagcagctggctgccatggattggtttcagagctatgctggaaacagc

SEQ ID NO: 48114 - DNA, 70 bp, Artificial Sequence
  Synthetic
gccaagcatttaggtgacactatagacatcaatgcagctcataacgtttcagagctatgctggaaacagc

SEQ ID NO: 48115 - DNA, 70 bp, Artificial Sequence
  Synthetic
gccaagcatttaggtgacactatagcgtgcgcaccttcctgtcctgtttcagagctatgctggaaacagc

SEQ ID NO: 48116 - DNA, 70 bp, Artificial Sequence
  Synthetic
gccaagcatttaggtgacactatagcagatgtcccatgtgcagcggtttcagagctatgctggaaacagc

SEQ ID NO: 48117 - DNA, 70 bp, Artificial Sequence
  Synthetic
gccaagcatttaggtgacactatagagggttacagtgattacgatgtttcagagctatgctggaaacagc

SEQ ID NO: 48118 - DNA, 70 bp, Artificial Sequence
  Synthetic
gccaagcatttaggtgacactatagccggcgttgtgggcacctaagtttcagagctatgctggaaacagc

SEQ ID NO: 48119 - DNA, 70 bp, Artificial Sequence
  Synthetic
gccaagcatttaggtgacactatagtcctaactcactccttttacgtttcagagctatgctggaaacagc

SEQ ID NO: 48120 - DNA, 70 bp, Artificial Sequence
  Synthetic
gccaagcatttaggtgacactataggtacgagctgcagccctagcgtttcagagctatgctggaaacagc

SEQ ID NO: 48121 - DNA, 70 bp, Artificial Sequence
  Synthetic
gccaagcatttaggtgacactatagaacggtctatttataggcttgtttcagagctatgctggaaacagc

SEQ ID NO: 48122 - DNA, 70 bp, Artificial Sequence
  Synthetic
gccaagcatttaggtgacactatagatgggaccccatgggagcttgtttcagagctatgctggaaacagc

SEQ ID NO: 48123 - DNA, 70 bp, Artificial Sequence
  Synthetic
gccaagcatttaggtgacactatagtttaactgcatacttcagtcgtttcagagctatgctggaaacagc

SEQ ID NO: 48124 - DNA, 70 bp, Artificial Sequence
  Synthetic
gccaagcatttaggtgacactatagggagggaacaggggctaggagtttcagagctatgctggaaacagc

SEQ ID NO: 48125 - DNA, 70 bp, Artificial Sequence
  Synthetic
gccaagcatttaggtgacactatagcttctccagcttcttgtactgtttcagagctatgctggaaacagc

SEQ ID NO: 48126 - DNA, 70 bp, Artificial Sequence
  Synthetic
gccaagcatttaggtgacactatagtagaatcatggctaggcccggtttcagagctatgctggaaacagc

SEQ ID NO: 48127 - DNA, 70 bp, Artificial Sequence
  Synthetic
gccaagcatttaggtgacactataggtgaaaggcctcagctctgagtttcagagctatgctggaaacagc

SEQ ID NO: 48128 - DNA, 70 bp, Artificial Sequence
  Synthetic
gccaagcatttaggtgacactatagacaatatgctgagatggagagtttcagagctatgctggaaacagc

SEQ ID NO: 48129 - DNA, 70 bp, Artificial Sequence
  Synthetic
gccaagcatttaggtgacactataggtttctcactagctactaaggtttcagagctatgctggaaacagc

SEQ ID NO: 48130 - DNA, 70 bp, Artificial Sequence
  Synthetic
gccaagcatttaggtgacactatagtaaacactatcatgccaagtgtttcagagctatgctggaaacagc

SEQ ID NO: 48131 - DNA, 70 bp, Artificial Sequence
  Synthetic
gccaagcatttaggtgacactatagtaactgccagaccagccaaagtttcagagctatgctggaaacagc

SEQ ID NO: 48132 - DNA, 70 bp, Artificial Sequence
  Synthetic
gccaagcatttaggtgacactatagttgctgttcaaggaagtaaggtttcagagctatgctggaaacagc

SEQ ID NO: 48133 - DNA, 70 bp, Artificial Sequence
  Synthetic
gccaagcatttaggtgacactatagagatggggacagagtgctacgtttcagagctatgctggaaacagc

SEQ ID NO: 48134 - DNA, 70 bp, Artificial Sequence
  Synthetic
gccaagcatttaggtgacactatagaaagggcaatcagttctcccgtttcagagctatgctggaaacagc

SEQ ID NO: 48135 - DNA, 70 bp, Artificial Sequence
  Synthetic
gccaagcatttaggtgacactatagtgagtactactctttacgtcgtttcagagctatgctggaaacagc

SEQ ID NO: 48136 - DNA, 70 bp, Artificial Sequence
  Synthetic
gccaagcatttaggtgacactatagacggggcaggccctaggtgagtttcagagctatgctggaaacagc

SEQ ID NO: 48137 - DNA, 70 bp, Artificial Sequence
  Synthetic
gccaagcatttaggtgacactatagagtcctttttcatacctagtgtttcagagctatgctggaaacagc

SEQ ID NO: 48138 - DNA, 70 bp, Artificial Sequence
  Synthetic
gccaagcatttaggtgacactataggggtcatcagcaacttcttcgtttcagagctatgctggaaacagc

SEQ ID NO: 48139 - DNA, 70 bp, Artificial Sequence
  Synthetic
gccaagcatttaggtgacactataggcagtggtcacttcctgctggtttcagagctatgctggaaacagc

SEQ ID NO: 48140 - DNA, 70 bp, Artificial Sequence
  Synthetic
gccaagcatttaggtgacactatagggaggcctggcaggcctcacgtttcagagctatgctggaaacagc

SEQ ID NO: 48141 - DNA, 70 bp, Artificial Sequence
  Synthetic
gccaagcatttaggtgacactatagcttctatctacagccacattgtttcagagctatgctggaaacagc

SEQ ID NO: 48142 - DNA, 70 bp, Artificial Sequence
  Synthetic
gccaagcatttaggtgacactatagtccttatgattgaggcaaatgtttcagagctatgctggaaacagc

SEQ ID NO: 48143 - DNA, 70 bp, Artificial Sequence
  Synthetic
gccaagcatttaggtgacactatagacatggttgtggagggttgtgtttcagagctatgctggaaacagc

SEQ ID NO: 48144 - DNA, 70 bp, Artificial Sequence
  Synthetic
gccaagcatttaggtgacactatagggaaatggagcagcaccaaagtttcagagctatgctggaaacagc

SEQ ID NO: 48145 - DNA, 70 bp, Artificial Sequence
  Synthetic
gccaagcatttaggtgacactatagatcaagtaagggacacttgagtttcagagctatgctggaaacagc

SEQ ID NO: 48146 - DNA, 70 bp, Artificial Sequence
  Synthetic
gccaagcatttaggtgacactatagtcttgcgcttgcagataaccgtttcagagctatgctggaaacagc

SEQ ID NO: 48147 - DNA, 70 bp, Artificial Sequence
  Synthetic
gccaagcatttaggtgacactatagcaaggactgcctgatctcaggtttcagagctatgctggaaacagc

SEQ ID NO: 48148 - DNA, 70 bp, Artificial Sequence
  Synthetic
gccaagcatttaggtgacactatagaatatggtagtacgctcatggtttcagagctatgctggaaacagc

SEQ ID NO: 48149 - DNA, 70 bp, Artificial Sequence
  Synthetic
gccaagcatttaggtgacactatagtccagaatgtccagtgttgggtttcagagctatgctggaaacagc

SEQ ID NO: 48150 - DNA, 70 bp, Artificial Sequence
  Synthetic
gccaagcatttaggtgacactatagagcatctggtttcgagttaggtttcagagctatgctggaaacagc

SEQ ID NO: 48151 - DNA, 70 bp, Artificial Sequence
  Synthetic
gccaagcatttaggtgacactatagtgaattctcggaggagctaggtttcagagctatgctggaaacagc

SEQ ID NO: 48152 - DNA, 70 bp, Artificial Sequence
  Synthetic
gccaagcatttaggtgacactatagggctgggcgggctgactcaggtttcagagctatgctggaaacagc

SEQ ID NO: 48153 - DNA, 70 bp, Artificial Sequence
  Synthetic
gccaagcatttaggtgacactatagggccgggcgggtggactcaggtttcagagctatgctggaaacagc

SEQ ID NO: 48154 - DNA, 70 bp, Artificial Sequence
  Synthetic
gccaagcatttaggtgacactatagatcgaaacaaaggtcaccgcgtttcagagctatgctggaaacagc

SEQ ID NO: 48155 - DNA, 70 bp, Artificial Sequence
  Synthetic
gccaagcatttaggtgacactatagatcttgggattcaaccatctgtttcagagctatgctggaaacagc

SEQ ID NO: 48156 - DNA, 70 bp, Artificial Sequence
  Synthetic
gccaagcatttaggtgacactatagccaggacattaaactctgatgtttcagagctatgctggaaacagc

SEQ ID NO: 48157 - DNA, 70 bp, Artificial Sequence
  Synthetic
gccaagcatttaggtgacactatagaccatggtgtctaaagatatgtttcagagctatgctggaaacagc

SEQ ID NO: 48158 - DNA, 70 bp, Artificial Sequence
  Synthetic
gccaagcatttaggtgacactataggtccaaaggctcactgcaatgtttcagagctatgctggaaacagc

SEQ ID NO: 48159 - DNA, 70 bp, Artificial Sequence
  Synthetic
gccaagcatttaggtgacactataggggtcttctagctcatagaagtttcagagctatgctggaaacagc

SEQ ID NO: 48160 - DNA, 70 bp, Artificial Sequence
  Synthetic
gccaagcatttaggtgacactatagtgcttgtctttttcccgaaggtttcagagctatgctggaaacagc

SEQ ID NO: 48161 - DNA, 70 bp, Artificial Sequence
  Synthetic
gccaagcatttaggtgacactatagttggtttgccatcttgttacgtttcagagctatgctggaaacagc

SEQ ID NO: 48162 - DNA, 70 bp, Artificial Sequence
  Synthetic
gccaagcatttaggtgacactatagagactaatctactgaagtgagtttcagagctatgctggaaacagc

SEQ ID NO: 48163 - DNA, 70 bp, Artificial Sequence
  Synthetic
gccaagcatttaggtgacactatagtgcaggctgtctcgatgtccgtttcagagctatgctggaaacagc

SEQ ID NO: 48164 - DNA, 70 bp, Artificial Sequence
  Synthetic
gccaagcatttaggtgacactatagcctttgggatctcacaaaaagtttcagagctatgctggaaacagc

SEQ ID NO: 48165 - DNA, 70 bp, Artificial Sequence
  Synthetic
gccaagcatttaggtgacactatagcttgtccccatggaatacgtgtttcagagctatgctggaaacagc

SEQ ID NO: 48166 - DNA, 70 bp, Artificial Sequence
  Synthetic
gccaagcatttaggtgacactataggactccagttcttcatcaaagtttcagagctatgctggaaacagc

SEQ ID NO: 48167 - DNA, 70 bp, Artificial Sequence
  Synthetic
gccaagcatttaggtgacactatagggcttttcctttccctcagtgtttcagagctatgctggaaacagc

SEQ ID NO: 48168 - DNA, 70 bp, Artificial Sequence
  Synthetic
gccaagcatttaggtgacactataggggatctccatggctcaggagtttcagagctatgctggaaacagc

SEQ ID NO: 48169 - DNA, 70 bp, Artificial Sequence
  Synthetic
gccaagcatttaggtgacactataggtaacaagaggcagcatgaagtttcagagctatgctggaaacagc

SEQ ID NO: 48170 - DNA, 70 bp, Artificial Sequence
  Synthetic
gccaagcatttaggtgacactatagaacaccacctctcacaatttgtttcagagctatgctggaaacagc

SEQ ID NO: 48171 - DNA, 70 bp, Artificial Sequence
  Synthetic
gccaagcatttaggtgacactatagattagctttcaaaaggtgtcgtttcagagctatgctggaaacagc

SEQ ID NO: 48172 - DNA, 70 bp, Artificial Sequence
  Synthetic
gccaagcatttaggtgacactatagtatcgcttcgcttttttcacgtttcagagctatgctggaaacagc

SEQ ID NO: 48173 - DNA, 70 bp, Artificial Sequence
  Synthetic
gccaagcatttaggtgacactatagtcttaggaagtgtcctgagagtttcagagctatgctggaaacagc

SEQ ID NO: 48174 - DNA, 70 bp, Artificial Sequence
  Synthetic
gccaagcatttaggtgacactatagaggtgggcagctcatctctcgtttcagagctatgctggaaacagc

SEQ ID NO: 48175 - DNA, 70 bp, Artificial Sequence
  Synthetic
gccaagcatttaggtgacactatagctccctctcttggggttcaggtttcagagctatgctggaaacagc

SEQ ID NO: 48176 - DNA, 70 bp, Artificial Sequence
  Synthetic
gccaagcatttaggtgacactatagggtcagggttttctgttcaagtttcagagctatgctggaaacagc

SEQ ID NO: 48177 - DNA, 70 bp, Artificial Sequence
  Synthetic
gccaagcatttaggtgacactatagcacgtgagcgacagaaatgagtttcagagctatgctggaaacagc

SEQ ID NO: 48178 - DNA, 70 bp, Artificial Sequence
  Synthetic
gccaagcatttaggtgacactatagctcagtgccctgactacaatgtttcagagctatgctggaaacagc

SEQ ID NO: 48179 - DNA, 70 bp, Artificial Sequence
  Synthetic
gccaagcatttaggtgacactatagatgtcagtgaagttcatccagtttcagagctatgctggaaacagc

SEQ ID NO: 48180 - DNA, 70 bp, Artificial Sequence
  Synthetic
gccaagcatttaggtgacactataggccagggcgtggtcagcgttgtttcagagctatgctggaaacagc

SEQ ID NO: 48181 - DNA, 70 bp, Artificial Sequence
  Synthetic
gccaagcatttaggtgacactatagattggctcaggctgcatcacgtttcagagctatgctggaaacagc

SEQ ID NO: 48182 - DNA, 70 bp, Artificial Sequence
  Synthetic
gccaagcatttaggtgacactatagcacaacgggcagcttctagcgtttcagagctatgctggaaacagc

SEQ ID NO: 48183 - DNA, 70 bp, Artificial Sequence
  Synthetic
gccaagcatttaggtgacactatagggcagaacagctaggtgaaggtttcagagctatgctggaaacagc

SEQ ID NO: 48184 - DNA, 70 bp, Artificial Sequence
  Synthetic
gccaagcatttaggtgacactatagtatggactgctgcattgaaagtttcagagctatgctggaaacagc

SEQ ID NO: 48185 - DNA, 70 bp, Artificial Sequence
  Synthetic
gccaagcatttaggtgacactatagtgaagcccgaccgcgagctcgtttcagagctatgctggaaacagc

SEQ ID NO: 48186 - DNA, 70 bp, Artificial Sequence
  Synthetic
gccaagcatttaggtgacactataggaggccctgtgcaagtgaccgtttcagagctatgctggaaacagc

SEQ ID NO: 48187 - DNA, 70 bp, Artificial Sequence
  Synthetic
gccaagcatttaggtgacactatagtgaacagtcatcggatctacgtttcagagctatgctggaaacagc

SEQ ID NO: 48188 - DNA, 70 bp, Artificial Sequence
  Synthetic
gccaagcatttaggtgacactatagtctcttccaggatcaggctggtttcagagctatgctggaaacagc

SEQ ID NO: 48189 - DNA, 70 bp, Artificial Sequence
  Synthetic
gccaagcatttaggtgacactataggcggtcccaggagctacctggtttcagagctatgctggaaacagc

SEQ ID NO: 48190 - DNA, 70 bp, Artificial Sequence
  Synthetic
gccaagcatttaggtgacactataggcggaggggggcgtcactgtgtttcagagctatgctggaaacagc

SEQ ID NO: 48191 - DNA, 70 bp, Artificial Sequence
  Synthetic
gccaagcatttaggtgacactatagctactttcttaatggctgctgtttcagagctatgctggaaacagc

SEQ ID NO: 48192 - DNA, 70 bp, Artificial Sequence
  Synthetic
gccaagcatttaggtgacactatagggagtgtgcattctcattgtgtttcagagctatgctggaaacagc

SEQ ID NO: 48193 - DNA, 70 bp, Artificial Sequence
  Synthetic
gccaagcatttaggtgacactatagcaacgtctgcaccgaacagcgtttcagagctatgctggaaacagc

SEQ ID NO: 48194 - DNA, 70 bp, Artificial Sequence
  Synthetic
gccaagcatttaggtgacactatagcggactacagtttgtcatcagtttcagagctatgctggaaacagc

SEQ ID NO: 48195 - DNA, 70 bp, Artificial Sequence
  Synthetic
gccaagcatttaggtgacactatagctgcaaaccctcatctgaaggtttcagagctatgctggaaacagc

SEQ ID NO: 48196 - DNA, 70 bp, Artificial Sequence
  Synthetic
gccaagcatttaggtgacactatagtctgatcagcagaagtcagcgtttcagagctatgctggaaacagc

SEQ ID NO: 48197 - DNA, 70 bp, Artificial Sequence
  Synthetic
gccaagcatttaggtgacactataggctgccatccaagtcttcacgtttcagagctatgctggaaacagc

SEQ ID NO: 48198 - DNA, 70 bp, Artificial Sequence
  Synthetic
gccaagcatttaggtgacactatagggactcttctaccagagctggtttcagagctatgctggaaacagc

SEQ ID NO: 48199 - DNA, 70 bp, Artificial Sequence
  Synthetic
gccaagcatttaggtgacactataggtgctgaccgtggcatcctggtttcagagctatgctggaaacagc

SEQ ID NO: 48200 - DNA, 70 bp, Artificial Sequence
  Synthetic
gccaagcatttaggtgacactatagctcatgcgctcagcaccaaagtttcagagctatgctggaaacagc

SEQ ID NO: 48201 - DNA, 70 bp, Artificial Sequence
  Synthetic
gccaagcatttaggtgacactatagctgatgctggacttgaagctgtttcagagctatgctggaaacagc

SEQ ID NO: 48202 - DNA, 70 bp, Artificial Sequence
  Synthetic
gccaagcatttaggtgacactatagaattgcaaaccggcaatcaagtttcagagctatgctggaaacagc

SEQ ID NO: 48203 - DNA, 70 bp, Artificial Sequence
  Synthetic
gccaagcatttaggtgacactataggtagtcataattcctcagtggtttcagagctatgctggaaacagc

SEQ ID NO: 48204 - DNA, 70 bp, Artificial Sequence
  Synthetic
gccaagcatttaggtgacactatagtgaaaggcttcaaagctagcgtttcagagctatgctggaaacagc

SEQ ID NO: 48205 - DNA, 70 bp, Artificial Sequence
  Synthetic
gccaagcatttaggtgacactataggcacaattacttctgtgatcgtttcagagctatgctggaaacagc

SEQ ID NO: 48206 - DNA, 70 bp, Artificial Sequence
  Synthetic
gccaagcatttaggtgacactatagctctcactcatttgtttcaggtttcagagctatgctggaaacagc

SEQ ID NO: 48207 - DNA, 70 bp, Artificial Sequence
  Synthetic
gccaagcatttaggtgacactatagaggaagggccgcagcaagaggtttcagagctatgctggaaacagc

SEQ ID NO: 48208 - DNA, 70 bp, Artificial Sequence
  Synthetic
gccaagcatttaggtgacactatagtggttctgctcagtagcagtgtttcagagctatgctggaaacagc

SEQ ID NO: 48209 - DNA, 70 bp, Artificial Sequence
  Synthetic
gccaagcatttaggtgacactataggatgcctggacagaggacaagtttcagagctatgctggaaacagc

SEQ ID NO: 48210 - DNA, 70 bp, Artificial Sequence
  Synthetic
gccaagcatttaggtgacactatagtggctggctgcagtcagtaggtttcagagctatgctggaaacagc

SEQ ID NO: 48211 - DNA, 70 bp, Artificial Sequence
  Synthetic
gccaagcatttaggtgacactatagtttctcacattcttccgtacgtttcagagctatgctggaaacagc

SEQ ID NO: 48212 - DNA, 70 bp, Artificial Sequence
  Synthetic
gccaagcatttaggtgacactataggcaaaaccaacagcatttgcgtttcagagctatgctggaaacagc

SEQ ID NO: 48213 - DNA, 70 bp, Artificial Sequence
  Synthetic
gccaagcatttaggtgacactatagacctcagtgacattgactgagtttcagagctatgctggaaacagc

SEQ ID NO: 48214 - DNA, 70 bp, Artificial Sequence
  Synthetic
gccaagcatttaggtgacactatagtgattcagactcaggctaaggtttcagagctatgctggaaacagc

SEQ ID NO: 48215 - DNA, 70 bp, Artificial Sequence
  Synthetic
gccaagcatttaggtgacactatagagcagtgactcagaatgaacgtttcagagctatgctggaaacagc

SEQ ID NO: 48216 - DNA, 70 bp, Artificial Sequence
  Synthetic
gccaagcatttaggtgacactataggagtgtgctcgttgctgtgtgtttcagagctatgctggaaacagc

SEQ ID NO: 48217 - DNA, 70 bp, Artificial Sequence
  Synthetic
gccaagcatttaggtgacactatagactctggaaattcatgtcaagtttcagagctatgctggaaacagc

SEQ ID NO: 48218 - DNA, 70 bp, Artificial Sequence
  Synthetic
gccaagcatttaggtgacactatagtccgtgtccaatgattaggcgtttcagagctatgctggaaacagc

SEQ ID NO: 48219 - DNA, 70 bp, Artificial Sequence
  Synthetic
gccaagcatttaggtgacactatagtgtggacctggtggaagttggtttcagagctatgctggaaacagc

SEQ ID NO: 48220 - DNA, 70 bp, Artificial Sequence
  Synthetic
gccaagcatttaggtgacactatagggaaaacctgttttctaaccgtttcagagctatgctggaaacagc

SEQ ID NO: 48221 - DNA, 70 bp, Artificial Sequence
  Synthetic
gccaagcatttaggtgacactatagtatctgcttcaatggcacaggtttcagagctatgctggaaacagc

SEQ ID NO: 48222 - DNA, 70 bp, Artificial Sequence
  Synthetic
gccaagcatttaggtgacactatagggtggtctagagttaggtctgtttcagagctatgctggaaacagc

SEQ ID NO: 48223 - DNA, 70 bp, Artificial Sequence
  Synthetic
gccaagcatttaggtgacactatagactttgaagggtcatatcaagtttcagagctatgctggaaacagc

SEQ ID NO: 48224 - DNA, 70 bp, Artificial Sequence
  Synthetic
gccaagcatttaggtgacactataggttttggtctgtaggatgaggtttcagagctatgctggaaacagc

SEQ ID NO: 48225 - DNA, 70 bp, Artificial Sequence
  Synthetic
gccaagcatttaggtgacactatagtgtgatggcgatgaggacgagtttcagagctatgctggaaacagc

SEQ ID NO: 48226 - DNA, 70 bp, Artificial Sequence
  Synthetic
gccaagcatttaggtgacactataggtgtccctaaccctccctgagtttcagagctatgctggaaacagc

SEQ ID NO: 48227 - DNA, 70 bp, Artificial Sequence
  Synthetic
gccaagcatttaggtgacactatagaatcaggtacagactctcaagtttcagagctatgctggaaacagc

SEQ ID NO: 48228 - DNA, 70 bp, Artificial Sequence
  Synthetic
gccaagcatttaggtgacactatagtggagccaccttcgcttaaagtttcagagctatgctggaaacagc

SEQ ID NO: 48229 - DNA, 70 bp, Artificial Sequence
  Synthetic
gccaagcatttaggtgacactatagaccgctccaaggacaagtgagtttcagagctatgctggaaacagc

SEQ ID NO: 48230 - DNA, 70 bp, Artificial Sequence
  Synthetic
gccaagcatttaggtgacactataggccaggtcgggggctcagtcgtttcagagctatgctggaaacagc

SEQ ID NO: 48231 - DNA, 70 bp, Artificial Sequence
  Synthetic
gccaagcatttaggtgacactatagacagccaaactctgctaaccgtttcagagctatgctggaaacagc

SEQ ID NO: 48232 - DNA, 70 bp, Artificial Sequence
  Synthetic
gccaagcatttaggtgacactatagcggcaaactctgtagctaatgtttcagagctatgctggaaacagc

SEQ ID NO: 48233 - DNA, 70 bp, Artificial Sequence
  Synthetic
gccaagcatttaggtgacactatagtgccaaattgccaaacacaagtttcagagctatgctggaaacagc

SEQ ID NO: 48234 - DNA, 70 bp, Artificial Sequence
  Synthetic
gccaagcatttaggtgacactatagtggataaatgaactggaactgtttcagagctatgctggaaacagc

SEQ ID NO: 48235 - DNA, 70 bp, Artificial Sequence
  Synthetic
gccaagcatttaggtgacactatagtgaaacagaggatggacagtgtttcagagctatgctggaaacagc

SEQ ID NO: 48236 - DNA, 70 bp, Artificial Sequence
  Synthetic
gccaagcatttaggtgacactatagaatagagtacattgaagctcgtttcagagctatgctggaaacagc

SEQ ID NO: 48237 - DNA, 70 bp, Artificial Sequence
  Synthetic
gccaagcatttaggtgacactataggcctggtcaggtcagctccagtttcagagctatgctggaaacagc

SEQ ID NO: 48238 - DNA, 70 bp, Artificial Sequence
  Synthetic
gccaagcatttaggtgacactatagcctcagaagagaaaatcggagtttcagagctatgctggaaacagc

SEQ ID NO: 48239 - DNA, 70 bp, Artificial Sequence
  Synthetic
gccaagcatttaggtgacactatagtacatttcacagctacagaagtttcagagctatgctggaaacagc

SEQ ID NO: 48240 - DNA, 70 bp, Artificial Sequence
  Synthetic
gccaagcatttaggtgacactatagtcaaacctcaaaaggacactgtttcagagctatgctggaaacagc

SEQ ID NO: 48241 - DNA, 70 bp, Artificial Sequence
  Synthetic
gccaagcatttaggtgacactatagacaggtttcacttcttcttcgtttcagagctatgctggaaacagc

SEQ ID NO: 48242 - DNA, 70 bp, Artificial Sequence
  Synthetic
gccaagcatttaggtgacactataggcagtatcaatcactatcgcgtttcagagctatgctggaaacagc

SEQ ID NO: 48243 - DNA, 70 bp, Artificial Sequence
  Synthetic
gccaagcatttaggtgacactatagaggcccagccctgcccttacgtttcagagctatgctggaaacagc

SEQ ID NO: 48244 - DNA, 70 bp, Artificial Sequence
  Synthetic
gccaagcatttaggtgacactataggtgtagtgtgaagcaggcaggtttcagagctatgctggaaacagc

SEQ ID NO: 48245 - DNA, 70 bp, Artificial Sequence
  Synthetic
gccaagcatttaggtgacactataggccccgtggggtcagggcaggtttcagagctatgctggaaacagc

SEQ ID NO: 48246 - DNA, 70 bp, Artificial Sequence
  Synthetic
gccaagcatttaggtgacactatagagtgtgtctaaggctgctcggtttcagagctatgctggaaacagc

SEQ ID NO: 48247 - DNA, 70 bp, Artificial Sequence
  Synthetic
gccaagcatttaggtgacactatagaggtgacatgttaacttttcgtttcagagctatgctggaaacagc

SEQ ID NO: 48248 - DNA, 70 bp, Artificial Sequence
  Synthetic
gccaagcatttaggtgacactatagtcagaggctactctcgtagcgtttcagagctatgctggaaacagc

SEQ ID NO: 48249 - DNA, 70 bp, Artificial Sequence
  Synthetic
gccaagcatttaggtgacactatagggctttccctcaaggtcatagtttcagagctatgctggaaacagc

SEQ ID NO: 48250 - DNA, 70 bp, Artificial Sequence
  Synthetic
gccaagcatttaggtgacactatagtctttgctacgtacagcaaagtttcagagctatgctggaaacagc

SEQ ID NO: 48251 - DNA, 70 bp, Artificial Sequence
  Synthetic
gccaagcatttaggtgacactatagttttaagggggttcagatccgtttcagagctatgctggaaacagc

SEQ ID NO: 48252 - DNA, 70 bp, Artificial Sequence
  Synthetic
gccaagcatttaggtgacactataggggttagccatctcatgggagtttcagagctatgctggaaacagc

SEQ ID NO: 48253 - DNA, 70 bp, Artificial Sequence
  Synthetic
gccaagcatttaggtgacactatagagctcctcttctccgctcaggtttcagagctatgctggaaacagc

SEQ ID NO: 48254 - DNA, 70 bp, Artificial Sequence
  Synthetic
gccaagcatttaggtgacactatagttttcttcaggaactagagcgtttcagagctatgctggaaacagc

SEQ ID NO: 48255 - DNA, 70 bp, Artificial Sequence
  Synthetic
gccaagcatttaggtgacactatagagtgggaggactgggagtgagtttcagagctatgctggaaacagc

SEQ ID NO: 48256 - DNA, 70 bp, Artificial Sequence
  Synthetic
gccaagcatttaggtgacactatagctgctcctgtctgaggtgacgtttcagagctatgctggaaacagc

SEQ ID NO: 48257 - DNA, 70 bp, Artificial Sequence
  Synthetic
gccaagcatttaggtgacactatagcgccagaggaactcttcctggtttcagagctatgctggaaacagc

SEQ ID NO: 48258 - DNA, 70 bp, Artificial Sequence
  Synthetic
gccaagcatttaggtgacactatagtgggcatggtcaccagaatggtttcagagctatgctggaaacagc

SEQ ID NO: 48259 - DNA, 70 bp, Artificial Sequence
  Synthetic
gccaagcatttaggtgacactataggagcacaaacatctcagcctgtttcagagctatgctggaaacagc

SEQ ID NO: 48260 - DNA, 70 bp, Artificial Sequence
  Synthetic
gccaagcatttaggtgacactatagtcggtccttgttaaaattctgtttcagagctatgctggaaacagc

SEQ ID NO: 48261 - DNA, 70 bp, Artificial Sequence
  Synthetic
gccaagcatttaggtgacactatagaggacatacggatcgatgaggtttcagagctatgctggaaacagc

SEQ ID NO: 48262 - DNA, 70 bp, Artificial Sequence
  Synthetic
gccaagcatttaggtgacactatagttcctgtggccagaggtcaggtttcagagctatgctggaaacagc

SEQ ID NO: 48263 - DNA, 70 bp, Artificial Sequence
  Synthetic
gccaagcatttaggtgacactatagttccaggactcaactgtaacgtttcagagctatgctggaaacagc

SEQ ID NO: 48264 - DNA, 70 bp, Artificial Sequence
  Synthetic
gccaagcatttaggtgacactatagctcactgcagcagagcgctggtttcagagctatgctggaaacagc

SEQ ID NO: 48265 - DNA, 70 bp, Artificial Sequence
  Synthetic
gccaagcatttaggtgacactatagacgagggggagctgggctcagtttcagagctatgctggaaacagc

SEQ ID NO: 48266 - DNA, 70 bp, Artificial Sequence
  Synthetic
gccaagcatttaggtgacactataggtatgattcagagtacagccgtttcagagctatgctggaaacagc

SEQ ID NO: 48267 - DNA, 70 bp, Artificial Sequence
  Synthetic
gccaagcatttaggtgacactatagaatggcacttcaatagaagagtttcagagctatgctggaaacagc

SEQ ID NO: 48268 - DNA, 70 bp, Artificial Sequence
  Synthetic
gccaagcatttaggtgacactatagacattgggcaggatctctatgtttcagagctatgctggaaacagc

SEQ ID NO: 48269 - DNA, 70 bp, Artificial Sequence
  Synthetic
gccaagcatttaggtgacactataggaagatcagcatcacagcatgtttcagagctatgctggaaacagc

SEQ ID NO: 48270 - DNA, 70 bp, Artificial Sequence
  Synthetic
gccaagcatttaggtgacactataggcactaggcgtttcataccagtttcagagctatgctggaaacagc

SEQ ID NO: 48271 - DNA, 70 bp, Artificial Sequence
  Synthetic
gccaagcatttaggtgacactatagtctggaaactgtcaagatgcgtttcagagctatgctggaaacagc

SEQ ID NO: 48272 - DNA, 70 bp, Artificial Sequence
  Synthetic
gccaagcatttaggtgacactatagtcccagaccccgaggctactgtttcagagctatgctggaaacagc

SEQ ID NO: 48273 - DNA, 70 bp, Artificial Sequence
  Synthetic
gccaagcatttaggtgacactatagttcctcagagtcagaaacaggtttcagagctatgctggaaacagc

SEQ ID NO: 48274 - DNA, 70 bp, Artificial Sequence
  Synthetic
gccaagcatttaggtgacactatagcccggcgttggatcatttgagtttcagagctatgctggaaacagc

SEQ ID NO: 48275 - DNA, 70 bp, Artificial Sequence
  Synthetic
gccaagcatttaggtgacactatagcgaggtcatcttctacacctgtttcagagctatgctggaaacagc

SEQ ID NO: 48276 - DNA, 70 bp, Artificial Sequence
  Synthetic
gccaagcatttaggtgacactatagatggcactggggtacagggagtttcagagctatgctggaaacagc

SEQ ID NO: 48277 - DNA, 70 bp, Artificial Sequence
  Synthetic
gccaagcatttaggtgacactataggagctcattttctatgcctggtttcagagctatgctggaaacagc

SEQ ID NO: 48278 - DNA, 70 bp, Artificial Sequence
  Synthetic
gccaagcatttaggtgacactataggacttggaggttgctctcaggtttcagagctatgctggaaacagc

SEQ ID NO: 48279 - DNA, 70 bp, Artificial Sequence
  Synthetic
gccaagcatttaggtgacactataggtttgaaagctctgctgcacgtttcagagctatgctggaaacagc

SEQ ID NO: 48280 - DNA, 70 bp, Artificial Sequence
  Synthetic
gccaagcatttaggtgacactatagagacaacttttctgaatctcgtttcagagctatgctggaaacagc

SEQ ID NO: 48281 - DNA, 70 bp, Artificial Sequence
  Synthetic
gccaagcatttaggtgacactatagaggcccgctgcctcctttatgtttcagagctatgctggaaacagc

SEQ ID NO: 48282 - DNA, 70 bp, Artificial Sequence
  Synthetic
gccaagcatttaggtgacactatagagaagaagaaatggaaactcgtttcagagctatgctggaaacagc

SEQ ID NO: 48283 - DNA, 70 bp, Artificial Sequence
  Synthetic
gccaagcatttaggtgacactatagagttaacatgtcacagcttcgtttcagagctatgctggaaacagc

SEQ ID NO: 48284 - DNA, 70 bp, Artificial Sequence
  Synthetic
gccaagcatttaggtgacactataggcgcttgtatgagagggactgtttcagagctatgctggaaacagc

SEQ ID NO: 48285 - DNA, 70 bp, Artificial Sequence
  Synthetic
gccaagcatttaggtgacactatagtgatgaggcttccaagaatggtttcagagctatgctggaaacagc

SEQ ID NO: 48286 - DNA, 70 bp, Artificial Sequence
  Synthetic
gccaagcatttaggtgacactatagaaaaccagaagacattgatggtttcagagctatgctggaaacagc

SEQ ID NO: 48287 - DNA, 70 bp, Artificial Sequence
  Synthetic
gccaagcatttaggtgacactatagtgtaaggaggaacttctcttgtttcagagctatgctggaaacagc

SEQ ID NO: 48288 - DNA, 70 bp, Artificial Sequence
  Synthetic
gccaagcatttaggtgacactatagcgggggcggaagggcctagcgtttcagagctatgctggaaacagc

SEQ ID NO: 48289 - DNA, 70 bp, Artificial Sequence
  Synthetic
gccaagcatttaggtgacactatagtagtgaggtgctaacatgtggtttcagagctatgctggaaacagc

SEQ ID NO: 48290 - DNA, 70 bp, Artificial Sequence
  Synthetic
gccaagcatttaggtgacactatagcaggcctgctatgcaccggcgtttcagagctatgctggaaacagc

SEQ ID NO: 48291 - DNA, 70 bp, Artificial Sequence
  Synthetic
gccaagcatttaggtgacactatagataccatcatgtacagttgcgtttcagagctatgctggaaacagc

SEQ ID NO: 48292 - DNA, 70 bp, Artificial Sequence
  Synthetic
gccaagcatttaggtgacactatagaatatgcatccatatgtgtggtttcagagctatgctggaaacagc

SEQ ID NO: 48293 - DNA, 70 bp, Artificial Sequence
  Synthetic
gccaagcatttaggtgacactatagcccagccaaggggcaccttagtttcagagctatgctggaaacagc

SEQ ID NO: 48294 - DNA, 70 bp, Artificial Sequence
  Synthetic
gccaagcatttaggtgacactatagagaagaacattcttacatgcgtttcagagctatgctggaaacagc

SEQ ID NO: 48295 - DNA, 70 bp, Artificial Sequence
  Synthetic
gccaagcatttaggtgacactatagggaattgattctataggctcgtttcagagctatgctggaaacagc

SEQ ID NO: 48296 - DNA, 70 bp, Artificial Sequence
  Synthetic
gccaagcatttaggtgacactatagtctctcagtttgagaagaatgtttcagagctatgctggaaacagc

SEQ ID NO: 48297 - DNA, 70 bp, Artificial Sequence
  Synthetic
gccaagcatttaggtgacactatagatgtcaacctgactggattagtttcagagctatgctggaaacagc

SEQ ID NO: 48298 - DNA, 70 bp, Artificial Sequence
  Synthetic
gccaagcatttaggtgacactataggagaagtctcagaaagctgagtttcagagctatgctggaaacagc

SEQ ID NO: 48299 - DNA, 70 bp, Artificial Sequence
  Synthetic
gccaagcatttaggtgacactatagagagggtggagaaagctgaagtttcagagctatgctggaaacagc

SEQ ID NO: 48300 - DNA, 70 bp, Artificial Sequence
  Synthetic
gccaagcatttaggtgacactatagctctcttcttcttttcacgcgtttcagagctatgctggaaacagc

SEQ ID NO: 48301 - DNA, 70 bp, Artificial Sequence
  Synthetic
gccaagcatttaggtgacactataggtgaggaaatgcttcagatggtttcagagctatgctggaaacagc

SEQ ID NO: 48302 - DNA, 70 bp, Artificial Sequence
  Synthetic
gccaagcatttaggtgacactatagagagcatcaggctgacttatgtttcagagctatgctggaaacagc

SEQ ID NO: 48303 - DNA, 70 bp, Artificial Sequence
  Synthetic
gccaagcatttaggtgacactatagcaatcagaaccataagctacgtttcagagctatgctggaaacagc

SEQ ID NO: 48304 - DNA, 70 bp, Artificial Sequence
  Synthetic
gccaagcatttaggtgacactataggtgaggacagaactgaataggtttcagagctatgctggaaacagc

SEQ ID NO: 48305 - DNA, 70 bp, Artificial Sequence
  Synthetic
gccaagcatttaggtgacactatagctcttttcagctcctcttccgtttcagagctatgctggaaacagc

SEQ ID NO: 48306 - DNA, 70 bp, Artificial Sequence
  Synthetic
gccaagcatttaggtgacactataggtcttctctgtctcatccccgtttcagagctatgctggaaacagc

SEQ ID NO: 48307 - DNA, 70 bp, Artificial Sequence
  Synthetic
gccaagcatttaggtgacactatagagatcagaaacgcagagcttgtttcagagctatgctggaaacagc

SEQ ID NO: 48308 - DNA, 70 bp, Artificial Sequence
  Synthetic
gccaagcatttaggtgacactatagcctccccaggggtgaaatgtgtttcagagctatgctggaaacagc

SEQ ID NO: 48309 - DNA, 70 bp, Artificial Sequence
  Synthetic
gccaagcatttaggtgacactatagcccgccctggactggtggtggtttcagagctatgctggaaacagc

SEQ ID NO: 48310 - DNA, 70 bp, Artificial Sequence
  Synthetic
gccaagcatttaggtgacactatagctatgcattcagtgttgttggtttcagagctatgctggaaacagc

SEQ ID NO: 48311 - DNA, 70 bp, Artificial Sequence
  Synthetic
gccaagcatttaggtgacactatagatgtaggtgtatgttcgagagtttcagagctatgctggaaacagc

SEQ ID NO: 48312 - DNA, 70 bp, Artificial Sequence
  Synthetic
gccaagcatttaggtgacactatagagattagggccctacgtaatgtttcagagctatgctggaaacagc

SEQ ID NO: 48313 - DNA, 70 bp, Artificial Sequence
  Synthetic
gccaagcatttaggtgacactatagcactgaaagagcaaagccccgtttcagagctatgctggaaacagc

SEQ ID NO: 48314 - DNA, 70 bp, Artificial Sequence
  Synthetic
gccaagcatttaggtgacactatagactttcacaggatgattagggtttcagagctatgctggaaacagc

SEQ ID NO: 48315 - DNA, 70 bp, Artificial Sequence
  Synthetic
gccaagcatttaggtgacactatagttgtttctgcatctgtcactgtttcagagctatgctggaaacagc

SEQ ID NO: 48316 - DNA, 70 bp, Artificial Sequence
  Synthetic
gccaagcatttaggtgacactatagtgcctacaaatggagtgttggtttcagagctatgctggaaacagc

SEQ ID NO: 48317 - DNA, 70 bp, Artificial Sequence
  Synthetic
gccaagcatttaggtgacactatagaccgcgtggtgacttagaaggtttcagagctatgctggaaacagc

SEQ ID NO: 48318 - DNA, 70 bp, Artificial Sequence
  Synthetic
gccaagcatttaggtgacactatagtgtcgtggctgctctggctggtttcagagctatgctggaaacagc

SEQ ID NO: 48319 - DNA, 70 bp, Artificial Sequence
  Synthetic
gccaagcatttaggtgacactatagtctctgatcaaggcagctgagtttcagagctatgctggaaacagc

SEQ ID NO: 48320 - DNA, 70 bp, Artificial Sequence
  Synthetic
gccaagcatttaggtgacactataggttcccatcaccgtggagtggtttcagagctatgctggaaacagc

SEQ ID NO: 48321 - DNA, 70 bp, Artificial Sequence
  Synthetic
gccaagcatttaggtgacactatagtctgaatctgaagctgaagagtttcagagctatgctggaaacagc

SEQ ID NO: 48322 - DNA, 70 bp, Artificial Sequence
  Synthetic
gccaagcatttaggtgacactatagagaatccgaatcggaaggtggtttcagagctatgctggaaacagc

SEQ ID NO: 48323 - DNA, 70 bp, Artificial Sequence
  Synthetic
gccaagcatttaggtgacactatagtggggaggggtcagagttcagtttcagagctatgctggaaacagc

SEQ ID NO: 48324 - DNA, 70 bp, Artificial Sequence
  Synthetic
gccaagcatttaggtgacactataggacctctcctcacaacgcgagtttcagagctatgctggaaacagc

SEQ ID NO: 48325 - DNA, 70 bp, Artificial Sequence
  Synthetic
gccaagcatttaggtgacactatagtttctcaatctcctcactgtgtttcagagctatgctggaaacagc

SEQ ID NO: 48326 - DNA, 70 bp, Artificial Sequence
  Synthetic
gccaagcatttaggtgacactatagggagagccgagaagggcctggtttcagagctatgctggaaacagc

SEQ ID NO: 48327 - DNA, 70 bp, Artificial Sequence
  Synthetic
gccaagcatttaggtgacactatagtgaacttttcttttatgcccgtttcagagctatgctggaaacagc

SEQ ID NO: 48328 - DNA, 70 bp, Artificial Sequence
  Synthetic
gccaagcatttaggtgacactataggcctggaagaagagagtatcgtttcagagctatgctggaaacagc

SEQ ID NO: 48329 - DNA, 70 bp, Artificial Sequence
  Synthetic
gccaagcatttaggtgacactatagagttgaacaagcaccgttttgtttcagagctatgctggaaacagc

SEQ ID NO: 48330 - DNA, 70 bp, Artificial Sequence
  Synthetic
gccaagcatttaggtgacactatagaaaagagaagtcattcctcggtttcagagctatgctggaaacagc

SEQ ID NO: 48331 - DNA, 70 bp, Artificial Sequence
  Synthetic
gccaagcatttaggtgacactatagagcacgcctgggggcctcaggtttcagagctatgctggaaacagc

SEQ ID NO: 48332 - DNA, 70 bp, Artificial Sequence
  Synthetic
gccaagcatttaggtgacactatagagtcattcctcgaggttaatgtttcagagctatgctggaaacagc

SEQ ID NO: 48333 - DNA, 70 bp, Artificial Sequence
  Synthetic
gccaagcatttaggtgacactatagcatcatggagggcctatttagtttcagagctatgctggaaacagc

SEQ ID NO: 48334 - DNA, 70 bp, Artificial Sequence
  Synthetic
gccaagcatttaggtgacactatagtgcacaggtgattgagctgtgtttcagagctatgctggaaacagc

SEQ ID NO: 48335 - DNA, 70 bp, Artificial Sequence
  Synthetic
gccaagcatttaggtgacactatagttggtgaatttgcacagatcgtttcagagctatgctggaaacagc

SEQ ID NO: 48336 - DNA, 70 bp, Artificial Sequence
  Synthetic
gccaagcatttaggtgacactatagggtgctgggatgcgctgctggtttcagagctatgctggaaacagc

SEQ ID NO: 48337 - DNA, 70 bp, Artificial Sequence
  Synthetic
gccaagcatttaggtgacactataggctggtcagatgactgagcagtttcagagctatgctggaaacagc

SEQ ID NO: 48338 - DNA, 70 bp, Artificial Sequence
  Synthetic
gccaagcatttaggtgacactatagtacacattggtgcgtaagaggtttcagagctatgctggaaacagc

SEQ ID NO: 48339 - DNA, 70 bp, Artificial Sequence
  Synthetic
gccaagcatttaggtgacactatagtctgtcctgtcgatttcagtgtttcagagctatgctggaaacagc

SEQ ID NO: 48340 - DNA, 70 bp, Artificial Sequence
  Synthetic
gccaagcatttaggtgacactatagggaggggctgctcagggagcgtttcagagctatgctggaaacagc

SEQ ID NO: 48341 - DNA, 70 bp, Artificial Sequence
  Synthetic
gccaagcatttaggtgacactatagcagatctagtgtctgcgattgtttcagagctatgctggaaacagc

SEQ ID NO: 48342 - DNA, 70 bp, Artificial Sequence
  Synthetic
gccaagcatttaggtgacactatagctcaatgtttggtttcacaggtttcagagctatgctggaaacagc

SEQ ID NO: 48343 - DNA, 70 bp, Artificial Sequence
  Synthetic
gccaagcatttaggtgacactataggatgccatagctgttatcaagtttcagagctatgctggaaacagc

SEQ ID NO: 48344 - DNA, 70 bp, Artificial Sequence
  Synthetic
gccaagcatttaggtgacactatagaactcaagaaatgccttctggtttcagagctatgctggaaacagc

SEQ ID NO: 48345 - DNA, 70 bp, Artificial Sequence
  Synthetic
gccaagcatttaggtgacactataggagttctccactatctcctggtttcagagctatgctggaaacagc

SEQ ID NO: 48346 - DNA, 70 bp, Artificial Sequence
  Synthetic
gccaagcatttaggtgacactatagtcctccgcaaagtatgcagagtttcagagctatgctggaaacagc

SEQ ID NO: 48347 - DNA, 70 bp, Artificial Sequence
  Synthetic
gccaagcatttaggtgacactatagtggtttcagatgtgccttctgtttcagagctatgctggaaacagc

SEQ ID NO: 48348 - DNA, 70 bp, Artificial Sequence
  Synthetic
gccaagcatttaggtgacactatagtctggagaaagactttcaaagtttcagagctatgctggaaacagc

SEQ ID NO: 48349 - DNA, 70 bp, Artificial Sequence
  Synthetic
gccaagcatttaggtgacactatagaggcattttttggaagaaaggtttcagagctatgctggaaacagc

SEQ ID NO: 48350 - DNA, 70 bp, Artificial Sequence
  Synthetic
gccaagcatttaggtgacactatagccagctccttcaaaggaatggtttcagagctatgctggaaacagc

SEQ ID NO: 48351 - DNA, 70 bp, Artificial Sequence
  Synthetic
gccaagcatttaggtgacactataggcggccttcgaagcctgaaggtttcagagctatgctggaaacagc

SEQ ID NO: 48352 - DNA, 70 bp, Artificial Sequence
  Synthetic
gccaagcatttaggtgacactatagggccgccccaggaagagcaagtttcagagctatgctggaaacagc

SEQ ID NO: 48353 - DNA, 70 bp, Artificial Sequence
  Synthetic
gccaagcatttaggtgacactatagctttgggagtgctacacctggtttcagagctatgctggaaacagc

SEQ ID NO: 48354 - DNA, 70 bp, Artificial Sequence
  Synthetic
gccaagcatttaggtgacactatagttttctgtgcatttgtatcggtttcagagctatgctggaaacagc

SEQ ID NO: 48355 - DNA, 70 bp, Artificial Sequence
  Synthetic
gccaagcatttaggtgacactatagcctcagggctcttagtctaagtttcagagctatgctggaaacagc

SEQ ID NO: 48356 - DNA, 70 bp, Artificial Sequence
  Synthetic
gccaagcatttaggtgacactatagaaagggtccctgtctcaggagtttcagagctatgctggaaacagc

SEQ ID NO: 48357 - DNA, 70 bp, Artificial Sequence
  Synthetic
gccaagcatttaggtgacactataggcggactcagaaatgtgagggtttcagagctatgctggaaacagc

SEQ ID NO: 48358 - DNA, 70 bp, Artificial Sequence
  Synthetic
gccaagcatttaggtgacactatagggatcgtgttctacttcatggtttcagagctatgctggaaacagc

SEQ ID NO: 48359 - DNA, 70 bp, Artificial Sequence
  Synthetic
gccaagcatttaggtgacactataggtcgtcactgtcgaactctggtttcagagctatgctggaaacagc

SEQ ID NO: 48360 - DNA, 70 bp, Artificial Sequence
  Synthetic
gccaagcatttaggtgacactatagggcaccattgctctccagccgtttcagagctatgctggaaacagc

SEQ ID NO: 48361 - DNA, 70 bp, Artificial Sequence
  Synthetic
gccaagcatttaggtgacactataggcaaggagacagggctagttgtttcagagctatgctggaaacagc

SEQ ID NO: 48362 - DNA, 70 bp, Artificial Sequence
  Synthetic
gccaagcatttaggtgacactatagacagacgagtcggagacttggtttcagagctatgctggaaacagc

SEQ ID NO: 48363 - DNA, 70 bp, Artificial Sequence
  Synthetic
gccaagcatttaggtgacactatagcaatggatgaagagctggaagtttcagagctatgctggaaacagc

SEQ ID NO: 48364 - DNA, 70 bp, Artificial Sequence
  Synthetic
gccaagcatttaggtgacactatagcggtgggagcccagagagtggtttcagagctatgctggaaacagc

SEQ ID NO: 48365 - DNA, 70 bp, Artificial Sequence
  Synthetic
gccaagcatttaggtgacactatagtcctcccaagcgctcacaccgtttcagagctatgctggaaacagc

SEQ ID NO: 48366 - DNA, 70 bp, Artificial Sequence
  Synthetic
gccaagcatttaggtgacactatagatgccgcagagcttattgaggtttcagagctatgctggaaacagc

SEQ ID NO: 48367 - DNA, 70 bp, Artificial Sequence
  Synthetic
gccaagcatttaggtgacactatagccaaaagagacgcattcaatgtttcagagctatgctggaaacagc

SEQ ID NO: 48368 - DNA, 70 bp, Artificial Sequence
  Synthetic
gccaagcatttaggtgacactatagagctcagaggatgactaaatgtttcagagctatgctggaaacagc

SEQ ID NO: 48369 - DNA, 70 bp, Artificial Sequence
  Synthetic
gccaagcatttaggtgacactataggtttgggagttatgaaccacgtttcagagctatgctggaaacagc

SEQ ID NO: 48370 - DNA, 70 bp, Artificial Sequence
  Synthetic
gccaagcatttaggtgacactatagatgttgtctatacgatgtgagtttcagagctatgctggaaacagc

SEQ ID NO: 48371 - DNA, 70 bp, Artificial Sequence
  Synthetic
gccaagcatttaggtgacactatagctaagtttactggctccaaagtttcagagctatgctggaaacagc

SEQ ID NO: 48372 - DNA, 70 bp, Artificial Sequence
  Synthetic
gccaagcatttaggtgacactatagaattgctacaagcaactcttgtttcagagctatgctggaaacagc

SEQ ID NO: 48373 - DNA, 70 bp, Artificial Sequence
  Synthetic
gccaagcatttaggtgacactatagtcatttcagacttaccattggtttcagagctatgctggaaacagc

SEQ ID NO: 48374 - DNA, 70 bp, Artificial Sequence
  Synthetic
gccaagcatttaggtgacactatagttaacgcctgattctacttagtttcagagctatgctggaaacagc

SEQ ID NO: 48375 - DNA, 70 bp, Artificial Sequence
  Synthetic
gccaagcatttaggtgacactatagacaacgtggaactgacctaggtttcagagctatgctggaaacagc

SEQ ID NO: 48376 - DNA, 70 bp, Artificial Sequence
  Synthetic
gccaagcatttaggtgacactatagtctggacaatggatcatattgtttcagagctatgctggaaacagc

SEQ ID NO: 48377 - DNA, 70 bp, Artificial Sequence
  Synthetic
gccaagcatttaggtgacactatagttataccactgttatggtgtgtttcagagctatgctggaaacagc

SEQ ID NO: 48378 - DNA, 70 bp, Artificial Sequence
  Synthetic
gccaagcatttaggtgacactatagcagcgtttgattgcattagggtttcagagctatgctggaaacagc

SEQ ID NO: 48379 - DNA, 70 bp, Artificial Sequence
  Synthetic
gccaagcatttaggtgacactatagctgcaacccctgatttaagagtttcagagctatgctggaaacagc

SEQ ID NO: 48380 - DNA, 70 bp, Artificial Sequence
  Synthetic
gccaagcatttaggtgacactatagtgcctctgtgaatcagtcacgtttcagagctatgctggaaacagc

SEQ ID NO: 48381 - DNA, 70 bp, Artificial Sequence
  Synthetic
gccaagcatttaggtgacactatagcccagccctgggccctgagcgtttcagagctatgctggaaacagc

SEQ ID NO: 48382 - DNA, 70 bp, Artificial Sequence
  Synthetic
gccaagcatttaggtgacactataggggaagccggaaaaagggaagtttcagagctatgctggaaacagc

SEQ ID NO: 48383 - DNA, 70 bp, Artificial Sequence
  Synthetic
gccaagcatttaggtgacactatagtggtgcccagtgtgggctacgtttcagagctatgctggaaacagc

SEQ ID NO: 48384 - DNA, 70 bp, Artificial Sequence
  Synthetic
gccaagcatttaggtgacactatagcgagggccttttgcaaacgggtttcagagctatgctggaaacagc

SEQ ID NO: 48385 - DNA, 70 bp, Artificial Sequence
  Synthetic
gccaagcatttaggtgacactatagggtatcagagtcagataaaggtttcagagctatgctggaaacagc

SEQ ID NO: 48386 - DNA, 70 bp, Artificial Sequence
  Synthetic
gccaagcatttaggtgacactatagaagtcggcctctctctcctggtttcagagctatgctggaaacagc

SEQ ID NO: 48387 - DNA, 70 bp, Artificial Sequence
  Synthetic
gccaagcatttaggtgacactatagttatgagggccttgggtcatgtttcagagctatgctggaaacagc

SEQ ID NO: 48388 - DNA, 70 bp, Artificial Sequence
  Synthetic
gccaagcatttaggtgacactataggcgctgtgtgtcgggcgtaggtttcagagctatgctggaaacagc

SEQ ID NO: 48389 - DNA, 70 bp, Artificial Sequence
  Synthetic
gccaagcatttaggtgacactatagttttgcattgcgatggctgagtttcagagctatgctggaaacagc

SEQ ID NO: 48390 - DNA, 70 bp, Artificial Sequence
  Synthetic
gccaagcatttaggtgacactatagaagtactactccaggcacgggtttcagagctatgctggaaacagc

SEQ ID NO: 48391 - DNA, 70 bp, Artificial Sequence
  Synthetic
gccaagcatttaggtgacactatagaggtttagctctcatcttcagtttcagagctatgctggaaacagc

SEQ ID NO: 48392 - DNA, 70 bp, Artificial Sequence
  Synthetic
gccaagcatttaggtgacactatagtagactaggagatttgtggggtttcagagctatgctggaaacagc

SEQ ID NO: 48393 - DNA, 70 bp, Artificial Sequence
  Synthetic
gccaagcatttaggtgacactatagaggcagagtcacatttgttcgtttcagagctatgctggaaacagc

SEQ ID NO: 48394 - DNA, 70 bp, Artificial Sequence
  Synthetic
gccaagcatttaggtgacactatagatctataagggtttagtgctgtttcagagctatgctggaaacagc

SEQ ID NO: 48395 - DNA, 70 bp, Artificial Sequence
  Synthetic
gccaagcatttaggtgacactatagggcagataccactggagggcgtttcagagctatgctggaaacagc

SEQ ID NO: 48396 - DNA, 70 bp, Artificial Sequence
  Synthetic
gccaagcatttaggtgacactatagtctaagcagtcatgggacttgtttcagagctatgctggaaacagc

SEQ ID NO: 48397 - DNA, 70 bp, Artificial Sequence
  Synthetic
gccaagcatttaggtgacactatagtgtaagtgagcattcaccacgtttcagagctatgctggaaacagc

SEQ ID NO: 48398 - DNA, 70 bp, Artificial Sequence
  Synthetic
gccaagcatttaggtgacactatagcatggctgggttcagtttgcgtttcagagctatgctggaaacagc

SEQ ID NO: 48399 - DNA, 70 bp, Artificial Sequence
  Synthetic
gccaagcatttaggtgacactatagcccaattctgaaggtggaaagtttcagagctatgctggaaacagc

SEQ ID NO: 48400 - DNA, 70 bp, Artificial Sequence
  Synthetic
gccaagcatttaggtgacactatagcgagctcttccccgcttgacgtttcagagctatgctggaaacagc

SEQ ID NO: 48401 - DNA, 70 bp, Artificial Sequence
  Synthetic
gccaagcatttaggtgacactatagcacagggaggtactgcttatgtttcagagctatgctggaaacagc

SEQ ID NO: 48402 - DNA, 70 bp, Artificial Sequence
  Synthetic
gccaagcatttaggtgacactatagtacttgctcccatttcttctgtttcagagctatgctggaaacagc

SEQ ID NO: 48403 - DNA, 70 bp, Artificial Sequence
  Synthetic
gccaagcatttaggtgacactatagtgattgtagagttagggtccgtttcagagctatgctggaaacagc

SEQ ID NO: 48404 - DNA, 70 bp, Artificial Sequence
  Synthetic
gccaagcatttaggtgacactatagttgaatggtaggttgagtgagtttcagagctatgctggaaacagc

SEQ ID NO: 48405 - DNA, 70 bp, Artificial Sequence
  Synthetic
gccaagcatttaggtgacactatagagggagggccaactctcagggtttcagagctatgctggaaacagc

SEQ ID NO: 48406 - DNA, 70 bp, Artificial Sequence
  Synthetic
gccaagcatttaggtgacactatagaagaaagccagtgacaagtagtttcagagctatgctggaaacagc

SEQ ID NO: 48407 - DNA, 70 bp, Artificial Sequence
  Synthetic
gccaagcatttaggtgacactatagactgtgggagtcaagtaaaagtttcagagctatgctggaaacagc

SEQ ID NO: 48408 - DNA, 70 bp, Artificial Sequence
  Synthetic
gccaagcatttaggtgacactataggcaaatcacctgctaaccttgtttcagagctatgctggaaacagc

SEQ ID NO: 48409 - DNA, 70 bp, Artificial Sequence
  Synthetic
gccaagcatttaggtgacactatagttcttctgactcatttcctcgtttcagagctatgctggaaacagc

SEQ ID NO: 48410 - DNA, 70 bp, Artificial Sequence
  Synthetic
gccaagcatttaggtgacactatagcctcaagaaacccttgaattgtttcagagctatgctggaaacagc

SEQ ID NO: 48411 - DNA, 70 bp, Artificial Sequence
  Synthetic
gccaagcatttaggtgacactatagacctcaagtttctcaacagggtttcagagctatgctggaaacagc

SEQ ID NO: 48412 - DNA, 70 bp, Artificial Sequence
  Synthetic
gccaagcatttaggtgacactataggcttagagctgtgttacctggtttcagagctatgctggaaacagc

SEQ ID NO: 48413 - DNA, 70 bp, Artificial Sequence
  Synthetic
gccaagcatttaggtgacactataggtcaacagatgtcatagcacgtttcagagctatgctggaaacagc

SEQ ID NO: 48414 - DNA, 70 bp, Artificial Sequence
  Synthetic
gccaagcatttaggtgacactataggttaacttgtctttcgtagggtttcagagctatgctggaaacagc

SEQ ID NO: 48415 - DNA, 70 bp, Artificial Sequence
  Synthetic
gccaagcatttaggtgacactatagtactcattgaagaacttgtcgtttcagagctatgctggaaacagc

SEQ ID NO: 48416 - DNA, 70 bp, Artificial Sequence
  Synthetic
gccaagcatttaggtgacactatagcaagatggagattcctgttcgtttcagagctatgctggaaacagc

SEQ ID NO: 48417 - DNA, 70 bp, Artificial Sequence
  Synthetic
gccaagcatttaggtgacactatagctcgcaactagtgatgactggtttcagagctatgctggaaacagc

SEQ ID NO: 48418 - DNA, 70 bp, Artificial Sequence
  Synthetic
gccaagcatttaggtgacactatagagaaagactttgggagcggagtttcagagctatgctggaaacagc

SEQ ID NO: 48419 - DNA, 70 bp, Artificial Sequence
  Synthetic
gccaagcatttaggtgacactatagtacagctggtaaggactgatgtttcagagctatgctggaaacagc

SEQ ID NO: 48420 - DNA, 70 bp, Artificial Sequence
  Synthetic
gccaagcatttaggtgacactatagcagggtgtgccgtcctcagagtttcagagctatgctggaaacagc

SEQ ID NO: 48421 - DNA, 70 bp, Artificial Sequence
  Synthetic
gccaagcatttaggtgacactatagaggccgaggcgggcagggacgtttcagagctatgctggaaacagc

SEQ ID NO: 48422 - DNA, 70 bp, Artificial Sequence
  Synthetic
gccaagcatttaggtgacactataggaccacagactgggaaaagtgtttcagagctatgctggaaacagc

SEQ ID NO: 48423 - DNA, 70 bp, Artificial Sequence
  Synthetic
gccaagcatttaggtgacactatagagatttaagcagctgttcaagtttcagagctatgctggaaacagc

SEQ ID NO: 48424 - DNA, 70 bp, Artificial Sequence
  Synthetic
gccaagcatttaggtgacactatagactttacattcattaccccagtttcagagctatgctggaaacagc

SEQ ID NO: 48425 - DNA, 70 bp, Artificial Sequence
  Synthetic
gccaagcatttaggtgacactatagcggcctcctgcggctctgacgtttcagagctatgctggaaacagc

SEQ ID NO: 48426 - DNA, 70 bp, Artificial Sequence
  Synthetic
gccaagcatttaggtgacactatagtgagccctggccctgctgctgtttcagagctatgctggaaacagc

SEQ ID NO: 48427 - DNA, 70 bp, Artificial Sequence
  Synthetic
gccaagcatttaggtgacactatagaaatctggttagtgatgaccgtttcagagctatgctggaaacagc

SEQ ID NO: 48428 - DNA, 70 bp, Artificial Sequence
  Synthetic
gccaagcatttaggtgacactataggtttctcctcttgtcatcatgtttcagagctatgctggaaacagc

SEQ ID NO: 48429 - DNA, 70 bp, Artificial Sequence
  Synthetic
gccaagcatttaggtgacactatagaaattcatcttcagagctgtgtttcagagctatgctggaaacagc

SEQ ID NO: 48430 - DNA, 70 bp, Artificial Sequence
  Synthetic
gccaagcatttaggtgacactatagtttgccactggtgtttgaaggtttcagagctatgctggaaacagc

SEQ ID NO: 48431 - DNA, 70 bp, Artificial Sequence
  Synthetic
gccaagcatttaggtgacactatagtgaccctgtccaaatgaaaagtttcagagctatgctggaaacagc

SEQ ID NO: 48432 - DNA, 70 bp, Artificial Sequence
  Synthetic
gccaagcatttaggtgacactatagtcaatgaatgagttcaagtcgtttcagagctatgctggaaacagc

SEQ ID NO: 48433 - DNA, 70 bp, Artificial Sequence
  Synthetic
gccaagcatttaggtgacactataggcattcagctcaagcaaatcgtttcagagctatgctggaaacagc

SEQ ID NO: 48434 - DNA, 70 bp, Artificial Sequence
  Synthetic
gccaagcatttaggtgacactatagggtttgctcattaccagtccgtttcagagctatgctggaaacagc

SEQ ID NO: 48435 - DNA, 70 bp, Artificial Sequence
  Synthetic
gccaagcatttaggtgacactataggcactggcaaccagtgctacgtttcagagctatgctggaaacagc

SEQ ID NO: 48436 - DNA, 70 bp, Artificial Sequence
  Synthetic
gccaagcatttaggtgacactatagacctgttatcccagcactctgtttcagagctatgctggaaacagc

SEQ ID NO: 48437 - DNA, 70 bp, Artificial Sequence
  Synthetic
gccaagcatttaggtgacactatagagaaaatgacaaggagtatcgtttcagagctatgctggaaacagc

SEQ ID NO: 48438 - DNA, 70 bp, Artificial Sequence
  Synthetic
gccaagcatttaggtgacactatagtacaactccagaagagatctgtttcagagctatgctggaaacagc

SEQ ID NO: 48439 - DNA, 70 bp, Artificial Sequence
  Synthetic
gccaagcatttaggtgacactatagtacgccactgcactccagctgtttcagagctatgctggaaacagc

SEQ ID NO: 48440 - DNA, 70 bp, Artificial Sequence
  Synthetic
gccaagcatttaggtgacactatagtgcattcaacaagtagtccagtttcagagctatgctggaaacagc

SEQ ID NO: 48441 - DNA, 70 bp, Artificial Sequence
  Synthetic
gccaagcatttaggtgacactataggcgaggaaacattttctaccgtttcagagctatgctggaaacagc

SEQ ID NO: 48442 - DNA, 70 bp, Artificial Sequence
  Synthetic
gccaagcatttaggtgacactatagtaccaatagatgactaagccgtttcagagctatgctggaaacagc

SEQ ID NO: 48443 - DNA, 70 bp, Artificial Sequence
  Synthetic
gccaagcatttaggtgacactatagttcagggtcaagctatgctggtttcagagctatgctggaaacagc

SEQ ID NO: 48444 - DNA, 70 bp, Artificial Sequence
  Synthetic
gccaagcatttaggtgacactatagagaggcgagggctcgtcattgtttcagagctatgctggaaacagc

SEQ ID NO: 48445 - DNA, 70 bp, Artificial Sequence
  Synthetic
gccaagcatttaggtgacactatagtgtgttcagcatcttcctgcgtttcagagctatgctggaaacagc

SEQ ID NO: 48446 - DNA, 70 bp, Artificial Sequence
  Synthetic
gccaagcatttaggtgacactatagcttgacatcaaggcctagttgtttcagagctatgctggaaacagc

SEQ ID NO: 48447 - DNA, 70 bp, Artificial Sequence
  Synthetic
gccaagcatttaggtgacactatagcggcgctcagctgattctccgtttcagagctatgctggaaacagc

SEQ ID NO: 48448 - DNA, 70 bp, Artificial Sequence
  Synthetic
gccaagcatttaggtgacactatagaagccagggggaaaaactaggtttcagagctatgctggaaacagc

SEQ ID NO: 48449 - DNA, 70 bp, Artificial Sequence
  Synthetic
gccaagcatttaggtgacactatagtgacgcacactttcaatacagtttcagagctatgctggaaacagc

SEQ ID NO: 48450 - DNA, 70 bp, Artificial Sequence
  Synthetic
gccaagcatttaggtgacactatagagcgagcccagcttctaaatgtttcagagctatgctggaaacagc

SEQ ID NO: 48451 - DNA, 70 bp, Artificial Sequence
  Synthetic
gccaagcatttaggtgacactatagtcaagagttctggttctgtcgtttcagagctatgctggaaacagc

SEQ ID NO: 48452 - DNA, 70 bp, Artificial Sequence
  Synthetic
gccaagcatttaggtgacactatagcacatacagagaagtcacacgtttcagagctatgctggaaacagc

SEQ ID NO: 48453 - DNA, 70 bp, Artificial Sequence
  Synthetic
gccaagcatttaggtgacactatagagagacggcaagacaggtctgtttcagagctatgctggaaacagc

SEQ ID NO: 48454 - DNA, 70 bp, Artificial Sequence
  Synthetic
gccaagcatttaggtgacactataggttctaccgcaaccgctcaggtttcagagctatgctggaaacagc

SEQ ID NO: 48455 - DNA, 70 bp, Artificial Sequence
  Synthetic
gccaagcatttaggtgacactatagttagcagccattcagttaaggtttcagagctatgctggaaacagc

SEQ ID NO: 48456 - DNA, 70 bp, Artificial Sequence
  Synthetic
gccaagcatttaggtgacactatagaatttagacattcatcagccgtttcagagctatgctggaaacagc

SEQ ID NO: 48457 - DNA, 70 bp, Artificial Sequence
  Synthetic
gccaagcatttaggtgacactatagggggattcagaaccccacacgtttcagagctatgctggaaacagc

SEQ ID NO: 48458 - DNA, 70 bp, Artificial Sequence
  Synthetic
gccaagcatttaggtgacactataggcttctgtctcccgaaaagagtttcagagctatgctggaaacagc

SEQ ID NO: 48459 - DNA, 70 bp, Artificial Sequence
  Synthetic
gccaagcatttaggtgacactatagtcagactccctctgcaaacagtttcagagctatgctggaaacagc

SEQ ID NO: 48460 - DNA, 70 bp, Artificial Sequence
  Synthetic
gccaagcatttaggtgacactatagatgggtggtggtgtccctaggtttcagagctatgctggaaacagc

SEQ ID NO: 48461 - DNA, 70 bp, Artificial Sequence
  Synthetic
gccaagcatttaggtgacactatagggcagctatagttgctccaggtttcagagctatgctggaaacagc

SEQ ID NO: 48462 - DNA, 70 bp, Artificial Sequence
  Synthetic
gccaagcatttaggtgacactatagagatcattctgttgcgtttagtttcagagctatgctggaaacagc

SEQ ID NO: 48463 - DNA, 70 bp, Artificial Sequence
  Synthetic
gccaagcatttaggtgacactatagatcgacccagaagcctgagggtttcagagctatgctggaaacagc

SEQ ID NO: 48464 - DNA, 70 bp, Artificial Sequence
  Synthetic
gccaagcatttaggtgacactatagtggcgagaggagctatttaggtttcagagctatgctggaaacagc

SEQ ID NO: 48465 - DNA, 70 bp, Artificial Sequence
  Synthetic
gccaagcatttaggtgacactatagagttgggattacaggtgcccgtttcagagctatgctggaaacagc

SEQ ID NO: 48466 - DNA, 70 bp, Artificial Sequence
  Synthetic
gccaagcatttaggtgacactatagcgggacagtcacttgtactggtttcagagctatgctggaaacagc

SEQ ID NO: 48467 - DNA, 70 bp, Artificial Sequence
  Synthetic
gccaagcatttaggtgacactatagtctagtcacagctactcagggtttcagagctatgctggaaacagc

SEQ ID NO: 48468 - DNA, 70 bp, Artificial Sequence
  Synthetic
gccaagcatttaggtgacactatagtttcgtgttttcagtcgcctgtttcagagctatgctggaaacagc

SEQ ID NO: 48469 - DNA, 70 bp, Artificial Sequence
  Synthetic
gccaagcatttaggtgacactatagccaccaagcagccgctgagagtttcagagctatgctggaaacagc

SEQ ID NO: 48470 - DNA, 70 bp, Artificial Sequence
  Synthetic
gccaagcatttaggtgacactatagacacctataatcccacacttgtttcagagctatgctggaaacagc

SEQ ID NO: 48471 - DNA, 70 bp, Artificial Sequence
  Synthetic
gccaagcatttaggtgacactatagggggccctggagaggccatagtttcagagctatgctggaaacagc

SEQ ID NO: 48472 - DNA, 70 bp, Artificial Sequence
  Synthetic
gccaagcatttaggtgacactatagtacagagcgagaacttgacggtttcagagctatgctggaaacagc

SEQ ID NO: 48473 - DNA, 70 bp, Artificial Sequence
  Synthetic
gccaagcatttaggtgacactatagcggctctttaggcccctttcgtttcagagctatgctggaaacagc

SEQ ID NO: 48474 - DNA, 70 bp, Artificial Sequence
  Synthetic
gccaagcatttaggtgacactatagttgtttactctccaagtacagtttcagagctatgctggaaacagc

SEQ ID NO: 48475 - DNA, 70 bp, Artificial Sequence
  Synthetic
gccaagcatttaggtgacactatagaacttcaaaccccaaaacacgtttcagagctatgctggaaacagc

SEQ ID NO: 48476 - DNA, 70 bp, Artificial Sequence
  Synthetic
gccaagcatttaggtgacactatagtggcctggaggagggtcagggtttcagagctatgctggaaacagc

SEQ ID NO: 48477 - DNA, 70 bp, Artificial Sequence
  Synthetic
gccaagcatttaggtgacactatagcacgggttggcgggctcctcgtttcagagctatgctggaaacagc

SEQ ID NO: 48478 - DNA, 70 bp, Artificial Sequence
  Synthetic
gccaagcatttaggtgacactatagattactggagcttggcattcgtttcagagctatgctggaaacagc

SEQ ID NO: 48479 - DNA, 70 bp, Artificial Sequence
  Synthetic
gccaagcatttaggtgacactatagtttgggaagcagcatctcatgtttcagagctatgctggaaacagc

SEQ ID NO: 48480 - DNA, 70 bp, Artificial Sequence
  Synthetic
gccaagcatttaggtgacactatagatggaactaactttctagaggtttcagagctatgctggaaacagc

SEQ ID NO: 48481 - DNA, 70 bp, Artificial Sequence
  Synthetic
gccaagcatttaggtgacactatagtcagatgcttcaataaagctgtttcagagctatgctggaaacagc

SEQ ID NO: 48482 - DNA, 70 bp, Artificial Sequence
  Synthetic
gccaagcatttaggtgacactatagtcttctctcccaaaatgaatgtttcagagctatgctggaaacagc

SEQ ID NO: 48483 - DNA, 70 bp, Artificial Sequence
  Synthetic
gccaagcatttaggtgacactatagcaggacacggggtgagttaggtttcagagctatgctggaaacagc

SEQ ID NO: 48484 - DNA, 70 bp, Artificial Sequence
  Synthetic
gccaagcatttaggtgacactatagacaagacgacactgagcaaagtttcagagctatgctggaaacagc

SEQ ID NO: 48485 - DNA, 70 bp, Artificial Sequence
  Synthetic
gccaagcatttaggtgacactatagtctacagagctgggtcgtttgtttcagagctatgctggaaacagc

SEQ ID NO: 48486 - DNA, 70 bp, Artificial Sequence
  Synthetic
gccaagcatttaggtgacactatagtcagaggtggaaggctcagcgtttcagagctatgctggaaacagc

SEQ ID NO: 48487 - DNA, 70 bp, Artificial Sequence
  Synthetic
gccaagcatttaggtgacactatagtaagaaactcaacttcgaccgtttcagagctatgctggaaacagc

SEQ ID NO: 48488 - DNA, 70 bp, Artificial Sequence
  Synthetic
gccaagcatttaggtgacactataggggcgctcaggagttcccaggtttcagagctatgctggaaacagc

SEQ ID NO: 48489 - DNA, 70 bp, Artificial Sequence
  Synthetic
gccaagcatttaggtgacactatagtgcggaggcatttgctcaacgtttcagagctatgctggaaacagc

SEQ ID NO: 48490 - DNA, 70 bp, Artificial Sequence
  Synthetic
gccaagcatttaggtgacactataggctcactcaggagtccatccgtttcagagctatgctggaaacagc

SEQ ID NO: 48491 - DNA, 70 bp, Artificial Sequence
  Synthetic
gccaagcatttaggtgacactataggttggggcagtctcaactacgtttcagagctatgctggaaacagc

SEQ ID NO: 48492 - DNA, 70 bp, Artificial Sequence
  Synthetic
gccaagcatttaggtgacactatagaaaagggaagggcagattcagtttcagagctatgctggaaacagc

SEQ ID NO: 48493 - DNA, 70 bp, Artificial Sequence
  Synthetic
gccaagcatttaggtgacactatagtgggaaacaatgacatgaatgtttcagagctatgctggaaacagc

SEQ ID NO: 48494 - DNA, 70 bp, Artificial Sequence
  Synthetic
gccaagcatttaggtgacactataggcttccccaagggcagtgaggtttcagagctatgctggaaacagc

SEQ ID NO: 48495 - DNA, 70 bp, Artificial Sequence
  Synthetic
gccaagcatttaggtgacactatagtcttcttacggttcagtctcgtttcagagctatgctggaaacagc

SEQ ID NO: 48496 - DNA, 70 bp, Artificial Sequence
  Synthetic
gccaagcatttaggtgacactatagcaggattcatcctgtgtaaggtttcagagctatgctggaaacagc

SEQ ID NO: 48497 - DNA, 70 bp, Artificial Sequence
  Synthetic
gccaagcatttaggtgacactatagaaggacagctatcacattttgtttcagagctatgctggaaacagc

SEQ ID NO: 48498 - DNA, 70 bp, Artificial Sequence
  Synthetic
gccaagcatttaggtgacactatagagagtgactcatgatcccaggtttcagagctatgctggaaacagc

SEQ ID NO: 48499 - DNA, 70 bp, Artificial Sequence
  Synthetic
gccaagcatttaggtgacactatagcttttcagaagtatgtctgggtttcagagctatgctggaaacagc

SEQ ID NO: 48500 - DNA, 70 bp, Artificial Sequence
  Synthetic
gccaagcatttaggtgacactatagggcttggattcagctgtcccgtttcagagctatgctggaaacagc

SEQ ID NO: 48501 - DNA, 70 bp, Artificial Sequence
  Synthetic
gccaagcatttaggtgacactatagttgccgctctaaaacatgttgtttcagagctatgctggaaacagc

SEQ ID NO: 48502 - DNA, 70 bp, Artificial Sequence
  Synthetic
gccaagcatttaggtgacactatagacttcgtcctgtgttgtagcgtttcagagctatgctggaaacagc

SEQ ID NO: 48503 - DNA, 70 bp, Artificial Sequence
  Synthetic
gccaagcatttaggtgacactatagggggctgcggacacactgaggtttcagagctatgctggaaacagc

SEQ ID NO: 48504 - DNA, 70 bp, Artificial Sequence
  Synthetic
gccaagcatttaggtgacactatagtgacttagctcctactctgcgtttcagagctatgctggaaacagc

SEQ ID NO: 48505 - DNA, 70 bp, Artificial Sequence
  Synthetic
gccaagcatttaggtgacactatagaaaagatgctgttagaacaggtttcagagctatgctggaaacagc

SEQ ID NO: 48506 - DNA, 70 bp, Artificial Sequence
  Synthetic
gccaagcatttaggtgacactatagtctggacggttcattctacagtttcagagctatgctggaaacagc

SEQ ID NO: 48507 - DNA, 70 bp, Artificial Sequence
  Synthetic
gccaagcatttaggtgacactataggggagggaaatagagcaccagtttcagagctatgctggaaacagc

SEQ ID NO: 48508 - DNA, 70 bp, Artificial Sequence
  Synthetic
gccaagcatttaggtgacactatagtgttttgctggtgttctttggtttcagagctatgctggaaacagc

SEQ ID NO: 48509 - DNA, 70 bp, Artificial Sequence
  Synthetic
gccaagcatttaggtgacactatagttcttatcttctctgaaggggtttcagagctatgctggaaacagc

SEQ ID NO: 48510 - DNA, 70 bp, Artificial Sequence
  Synthetic
gccaagcatttaggtgacactatagttaccttggatgaggatagcgtttcagagctatgctggaaacagc

SEQ ID NO: 48511 - DNA, 70 bp, Artificial Sequence
  Synthetic
gccaagcatttaggtgacactatagatttctgttggtccttttgtgtttcagagctatgctggaaacagc

SEQ ID NO: 48512 - DNA, 70 bp, Artificial Sequence
  Synthetic
gccaagcatttaggtgacactatagcggtcaccgaaaatgtgaaggtttcagagctatgctggaaacagc

SEQ ID NO: 48513 - DNA, 70 bp, Artificial Sequence
  Synthetic
gccaagcatttaggtgacactataggcttcttagaagaactggatgtttcagagctatgctggaaacagc

SEQ ID NO: 48514 - DNA, 70 bp, Artificial Sequence
  Synthetic
gccaagcatttaggtgacactatagactaacgacctgcactgattgtttcagagctatgctggaaacagc

SEQ ID NO: 48515 - DNA, 70 bp, Artificial Sequence
  Synthetic
gccaagcatttaggtgacactatagttggagaccaagctctaatggtttcagagctatgctggaaacagc

SEQ ID NO: 48516 - DNA, 70 bp, Artificial Sequence
  Synthetic
gccaagcatttaggtgacactatagcgagatccagtatgatgactgtttcagagctatgctggaaacagc

SEQ ID NO: 48517 - DNA, 70 bp, Artificial Sequence
  Synthetic
gccaagcatttaggtgacactatagtccagtgtcttcactcagcagtttcagagctatgctggaaacagc

SEQ ID NO: 48518 - DNA, 70 bp, Artificial Sequence
  Synthetic
gccaagcatttaggtgacactatagtgggggagcggaggtctacggtttcagagctatgctggaaacagc

SEQ ID NO: 48519 - DNA, 70 bp, Artificial Sequence
  Synthetic
gccaagcatttaggtgacactatagtgcgtcacataatggaaaaagtttcagagctatgctggaaacagc

SEQ ID NO: 48520 - DNA, 70 bp, Artificial Sequence
  Synthetic
gccaagcatttaggtgacactatagaggagacggtgtttgagtccgtttcagagctatgctggaaacagc

SEQ ID NO: 48521 - DNA, 70 bp, Artificial Sequence
  Synthetic
gccaagcatttaggtgacactatagggccccgagaggtcagcctggtttcagagctatgctggaaacagc

SEQ ID NO: 48522 - DNA, 70 bp, Artificial Sequence
  Synthetic
gccaagcatttaggtgacactatagcagctccagcgattcggacagtttcagagctatgctggaaacagc

SEQ ID NO: 48523 - DNA, 70 bp, Artificial Sequence
  Synthetic
gccaagcatttaggtgacactatagccctgtccagggcccttcaggtttcagagctatgctggaaacagc

SEQ ID NO: 48524 - DNA, 70 bp, Artificial Sequence
  Synthetic
gccaagcatttaggtgacactatagcccccagtcctcagcctcacgtttcagagctatgctggaaacagc

SEQ ID NO: 48525 - DNA, 70 bp, Artificial Sequence
  Synthetic
gccaagcatttaggtgacactatagtgccctggaggaggtgaacagtttcagagctatgctggaaacagc

SEQ ID NO: 48526 - DNA, 70 bp, Artificial Sequence
  Synthetic
gccaagcatttaggtgacactatagccgcccacaggtgggctagagtttcagagctatgctggaaacagc

SEQ ID NO: 48527 - DNA, 70 bp, Artificial Sequence
  Synthetic
gccaagcatttaggtgacactatagtcctgaatgcagctcaaaccgtttcagagctatgctggaaacagc

SEQ ID NO: 48528 - DNA, 70 bp, Artificial Sequence
  Synthetic
gccaagcatttaggtgacactatagtggggccagcgtcctcaggagtttcagagctatgctggaaacagc

SEQ ID NO: 48529 - DNA, 70 bp, Artificial Sequence
  Synthetic
gccaagcatttaggtgacactataggagaccgcagccgcagctaagtttcagagctatgctggaaacagc

SEQ ID NO: 48530 - DNA, 70 bp, Artificial Sequence
  Synthetic
gccaagcatttaggtgacactataggggccacaaggcacactggggtttcagagctatgctggaaacagc

SEQ ID NO: 48531 - DNA, 70 bp, Artificial Sequence
  Synthetic
gccaagcatttaggtgacactatagtgtgctagtcatgtgacctcgtttcagagctatgctggaaacagc

SEQ ID NO: 48532 - DNA, 70 bp, Artificial Sequence
  Synthetic
gccaagcatttaggtgacactatagcccaccctggagggagttgtgtttcagagctatgctggaaacagc

SEQ ID NO: 48533 - DNA, 70 bp, Artificial Sequence
  Synthetic
gccaagcatttaggtgacactatagacctggcaggggtcactcccgtttcagagctatgctggaaacagc

SEQ ID NO: 48534 - DNA, 70 bp, Artificial Sequence
  Synthetic
gccaagcatttaggtgacactatagctgcggggtgggcagcgcaggtttcagagctatgctggaaacagc

SEQ ID NO: 48535 - DNA, 70 bp, Artificial Sequence
  Synthetic
gccaagcatttaggtgacactataggcccctgctgactcgctactgtttcagagctatgctggaaacagc

SEQ ID NO: 48536 - DNA, 70 bp, Artificial Sequence
  Synthetic
gccaagcatttaggtgacactatagtcctggtagcatgcctttatgtttcagagctatgctggaaacagc

SEQ ID NO: 48537 - DNA, 70 bp, Artificial Sequence
  Synthetic
gccaagcatttaggtgacactataggcttccaagagactagtccggtttcagagctatgctggaaacagc

SEQ ID NO: 48538 - DNA, 70 bp, Artificial Sequence
  Synthetic
gccaagcatttaggtgacactataggggggcggagccgaacgagggtttcagagctatgctggaaacagc

SEQ ID NO: 48539 - DNA, 70 bp, Artificial Sequence
  Synthetic
gccaagcatttaggtgacactatagggactgggagacagagtactgtttcagagctatgctggaaacagc

SEQ ID NO: 48540 - DNA, 70 bp, Artificial Sequence
  Synthetic
gccaagcatttaggtgacactatagttttcgattttggttcccaggtttcagagctatgctggaaacagc

SEQ ID NO: 48541 - DNA, 70 bp, Artificial Sequence
  Synthetic
gccaagcatttaggtgacactatagagtatacgttcaggtaaggtgtttcagagctatgctggaaacagc

SEQ ID NO: 48542 - DNA, 70 bp, Artificial Sequence
  Synthetic
gccaagcatttaggtgacactatagcagtcattgtcagaaccattgtttcagagctatgctggaaacagc

SEQ ID NO: 48543 - DNA, 70 bp, Artificial Sequence
  Synthetic
gccaagcatttaggtgacactataggttggttcagaaaatgactggtttcagagctatgctggaaacagc

SEQ ID NO: 48544 - DNA, 70 bp, Artificial Sequence
  Synthetic
gccaagcatttaggtgacactatagagctctggcagtgaattaaggtttcagagctatgctggaaacagc

SEQ ID NO: 48545 - DNA, 70 bp, Artificial Sequence
  Synthetic
gccaagcatttaggtgacactatagtcttcacaacagtagagctcgtttcagagctatgctggaaacagc

SEQ ID NO: 48546 - DNA, 70 bp, Artificial Sequence
  Synthetic
gccaagcatttaggtgacactatagcaagacaacgaggcagtgaggtttcagagctatgctggaaacagc

SEQ ID NO: 48547 - DNA, 70 bp, Artificial Sequence
  Synthetic
gccaagcatttaggtgacactataggtggggcgcagagttacaccgtttcagagctatgctggaaacagc

SEQ ID NO: 48548 - DNA, 70 bp, Artificial Sequence
  Synthetic
gccaagcatttaggtgacactatagtccttcttcctggaagagtagtttcagagctatgctggaaacagc

SEQ ID NO: 48549 - DNA, 70 bp, Artificial Sequence
  Synthetic
gccaagcatttaggtgacactatagagaatgtcagtcttcaactggtttcagagctatgctggaaacagc

SEQ ID NO: 48550 - DNA, 70 bp, Artificial Sequence
  Synthetic
gccaagcatttaggtgacactatagggaggcgctccaagaaaggagtttcagagctatgctggaaacagc

SEQ ID NO: 48551 - DNA, 70 bp, Artificial Sequence
  Synthetic
gccaagcatttaggtgacactatagactgctggacatggtttgcagtttcagagctatgctggaaacagc

SEQ ID NO: 48552 - DNA, 70 bp, Artificial Sequence
  Synthetic
gccaagcatttaggtgacactatagtctccaggctcttttcaagggtttcagagctatgctggaaacagc

SEQ ID NO: 48553 - DNA, 70 bp, Artificial Sequence
  Synthetic
gccaagcatttaggtgacactatagggtatccttcgtgcgctaatgtttcagagctatgctggaaacagc

SEQ ID NO: 48554 - DNA, 70 bp, Artificial Sequence
  Synthetic
gccaagcatttaggtgacactataggaagaagctgggactgttgagtttcagagctatgctggaaacagc

SEQ ID NO: 48555 - DNA, 70 bp, Artificial Sequence
  Synthetic
gccaagcatttaggtgacactataggctagcagagctgccactccgtttcagagctatgctggaaacagc

SEQ ID NO: 48556 - DNA, 70 bp, Artificial Sequence
  Synthetic
gccaagcatttaggtgacactatagtttaatcaaggctctactgagtttcagagctatgctggaaacagc

SEQ ID NO: 48557 - DNA, 70 bp, Artificial Sequence
  Synthetic
gccaagcatttaggtgacactataggggatcagcacttcacaaacgtttcagagctatgctggaaacagc

SEQ ID NO: 48558 - DNA, 70 bp, Artificial Sequence
  Synthetic
gccaagcatttaggtgacactatagctccatggaggctcagcgtggtttcagagctatgctggaaacagc

SEQ ID NO: 48559 - DNA, 70 bp, Artificial Sequence
  Synthetic
gccaagcatttaggtgacactatagagtacttcatttggccactcgtttcagagctatgctggaaacagc

SEQ ID NO: 48560 - DNA, 70 bp, Artificial Sequence
  Synthetic
gccaagcatttaggtgacactatagtcctgtggagggtagcagaagtttcagagctatgctggaaacagc

SEQ ID NO: 48561 - DNA, 70 bp, Artificial Sequence
  Synthetic
gccaagcatttaggtgacactatagactaaataatgtaacgccacgtttcagagctatgctggaaacagc

SEQ ID NO: 48562 - DNA, 70 bp, Artificial Sequence
  Synthetic
gccaagcatttaggtgacactataggattctgttggtctcttagagtttcagagctatgctggaaacagc

SEQ ID NO: 48563 - DNA, 70 bp, Artificial Sequence
  Synthetic
gccaagcatttaggtgacactatagttctgaagtgttttccaaacgtttcagagctatgctggaaacagc

SEQ ID NO: 48564 - DNA, 70 bp, Artificial Sequence
  Synthetic
gccaagcatttaggtgacactatagggtggcagctctcagaagtggtttcagagctatgctggaaacagc

SEQ ID NO: 48565 - DNA, 70 bp, Artificial Sequence
  Synthetic
gccaagcatttaggtgacactatagcgtatcagcaatgtctgaccgtttcagagctatgctggaaacagc

SEQ ID NO: 48566 - DNA, 70 bp, Artificial Sequence
  Synthetic
gccaagcatttaggtgacactatagtggggtcaaagtctgcagaagtttcagagctatgctggaaacagc

SEQ ID NO: 48567 - DNA, 70 bp, Artificial Sequence
  Synthetic
gccaagcatttaggtgacactataggaacaagtcacagctgcagcgtttcagagctatgctggaaacagc

SEQ ID NO: 48568 - DNA, 70 bp, Artificial Sequence
  Synthetic
gccaagcatttaggtgacactatagacgatgatgcagaaatgtaggtttcagagctatgctggaaacagc

SEQ ID NO: 48569 - DNA, 70 bp, Artificial Sequence
  Synthetic
gccaagcatttaggtgacactatagagtaccctcttctaatgaaagtttcagagctatgctggaaacagc

SEQ ID NO: 48570 - DNA, 70 bp, Artificial Sequence
  Synthetic
gccaagcatttaggtgacactataggccagcggaatatgatcaaggtttcagagctatgctggaaacagc

SEQ ID NO: 48571 - DNA, 70 bp, Artificial Sequence
  Synthetic
gccaagcatttaggtgacactatagcagcaggaactaaatcagatgtttcagagctatgctggaaacagc

SEQ ID NO: 48572 - DNA, 70 bp, Artificial Sequence
  Synthetic
gccaagcatttaggtgacactatagagggatctgtcaacactagggtttcagagctatgctggaaacagc

SEQ ID NO: 48573 - DNA, 70 bp, Artificial Sequence
  Synthetic
gccaagcatttaggtgacactatagagcttccaatcataaaaccagtttcagagctatgctggaaacagc

SEQ ID NO: 48574 - DNA, 70 bp, Artificial Sequence
  Synthetic
gccaagcatttaggtgacactatagagtactcttcaaagttctcagtttcagagctatgctggaaacagc

SEQ ID NO: 48575 - DNA, 70 bp, Artificial Sequence
  Synthetic
gccaagcatttaggtgacactataggaagacgggatttgattttcgtttcagagctatgctggaaacagc

SEQ ID NO: 48576 - DNA, 70 bp, Artificial Sequence
  Synthetic
gccaagcatttaggtgacactatagggattactgttcggaagaaggtttcagagctatgctggaaacagc

SEQ ID NO: 48577 - DNA, 70 bp, Artificial Sequence
  Synthetic
gccaagcatttaggtgacactataggcaggccatcacagtcataggtttcagagctatgctggaaacagc

SEQ ID NO: 48578 - DNA, 70 bp, Artificial Sequence
  Synthetic
gccaagcatttaggtgacactatagggccccaggaccaggcctaagtttcagagctatgctggaaacagc

SEQ ID NO: 48579 - DNA, 70 bp, Artificial Sequence
  Synthetic
gccaagcatttaggtgacactatagagagcagaggctctattcaagtttcagagctatgctggaaacagc

SEQ ID NO: 48580 - DNA, 70 bp, Artificial Sequence
  Synthetic
gccaagcatttaggtgacactatagcgaggaggatgtagaatcaagtttcagagctatgctggaaacagc

SEQ ID NO: 48581 - DNA, 70 bp, Artificial Sequence
  Synthetic
gccaagcatttaggtgacactataggttcacagtcgctcccgctcgtttcagagctatgctggaaacagc

SEQ ID NO: 48582 - DNA, 70 bp, Artificial Sequence
  Synthetic
gccaagcatttaggtgacactatagacagttgcagtccttgctgcgtttcagagctatgctggaaacagc

SEQ ID NO: 48583 - DNA, 70 bp, Artificial Sequence
  Synthetic
gccaagcatttaggtgacactatagacagaggctctgaggcctgagtttcagagctatgctggaaacagc

SEQ ID NO: 48584 - DNA, 70 bp, Artificial Sequence
  Synthetic
gccaagcatttaggtgacactatagaacagcccgctatgggacaggtttcagagctatgctggaaacagc

SEQ ID NO: 48585 - DNA, 70 bp, Artificial Sequence
  Synthetic
gccaagcatttaggtgacactatagcattggagagtactctgtgagtttcagagctatgctggaaacagc

SEQ ID NO: 48586 - DNA, 70 bp, Artificial Sequence
  Synthetic
gccaagcatttaggtgacactatagtcccctccaaactcacgcaggtttcagagctatgctggaaacagc

SEQ ID NO: 48587 - DNA, 70 bp, Artificial Sequence
  Synthetic
gccaagcatttaggtgacactatagactctcagtgagtcagtcccgtttcagagctatgctggaaacagc

SEQ ID NO: 48588 - DNA, 70 bp, Artificial Sequence
  Synthetic
gccaagcatttaggtgacactatagttcttctttgctggttctccgtttcagagctatgctggaaacagc

SEQ ID NO: 48589 - DNA, 70 bp, Artificial Sequence
  Synthetic
gccaagcatttaggtgacactatagttgcaaagaggtgaatgttggtttcagagctatgctggaaacagc

SEQ ID NO: 48590 - DNA, 70 bp, Artificial Sequence
  Synthetic
gccaagcatttaggtgacactatagggagtctggcaagaggaaatgtttcagagctatgctggaaacagc

SEQ ID NO: 48591 - DNA, 70 bp, Artificial Sequence
  Synthetic
gccaagcatttaggtgacactatagggggatgtatttcatgtagagtttcagagctatgctggaaacagc

SEQ ID NO: 48592 - DNA, 70 bp, Artificial Sequence
  Synthetic
gccaagcatttaggtgacactatagtagacagaaaccagaggtaagtttcagagctatgctggaaacagc

SEQ ID NO: 48593 - DNA, 70 bp, Artificial Sequence
  Synthetic
gccaagcatttaggtgacactatagagcctcatctttcagtcaacgtttcagagctatgctggaaacagc

SEQ ID NO: 48594 - DNA, 70 bp, Artificial Sequence
  Synthetic
gccaagcatttaggtgacactatagcaactgggaaggcttatcaggtttcagagctatgctggaaacagc

SEQ ID NO: 48595 - DNA, 70 bp, Artificial Sequence
  Synthetic
gccaagcatttaggtgacactatagtcccagttgactgaaagatggtttcagagctatgctggaaacagc

SEQ ID NO: 48596 - DNA, 70 bp, Artificial Sequence
  Synthetic
gccaagcatttaggtgacactatagagcagcagcagtcatcctcagtttcagagctatgctggaaacagc

SEQ ID NO: 48597 - DNA, 70 bp, Artificial Sequence
  Synthetic
gccaagcatttaggtgacactataggggaggagagttaaagtcaggtttcagagctatgctggaaacagc

SEQ ID NO: 48598 - DNA, 70 bp, Artificial Sequence
  Synthetic
gccaagcatttaggtgacactataggccagcactgcggtacttaagtttcagagctatgctggaaacagc

SEQ ID NO: 48599 - DNA, 70 bp, Artificial Sequence
  Synthetic
gccaagcatttaggtgacactatagtatttttcttccagtgggaagtttcagagctatgctggaaacagc

SEQ ID NO: 48600 - DNA, 70 bp, Artificial Sequence
  Synthetic
gccaagcatttaggtgacactatagccttccctggctcaggcagagtttcagagctatgctggaaacagc

SEQ ID NO: 48601 - DNA, 70 bp, Artificial Sequence
  Synthetic
gccaagcatttaggtgacactatagcctgctctttccagatatgggtttcagagctatgctggaaacagc

SEQ ID NO: 48602 - DNA, 70 bp, Artificial Sequence
  Synthetic
gccaagcatttaggtgacactatagtcagcatctgtctgctctacgtttcagagctatgctggaaacagc

SEQ ID NO: 48603 - DNA, 70 bp, Artificial Sequence
  Synthetic
gccaagcatttaggtgacactatagctgctcttccccgactaggggtttcagagctatgctggaaacagc

SEQ ID NO: 48604 - DNA, 70 bp, Artificial Sequence
  Synthetic
gccaagcatttaggtgacactatagggagacgtggggagctcagtgtttcagagctatgctggaaacagc

SEQ ID NO: 48605 - DNA, 70 bp, Artificial Sequence
  Synthetic
gccaagcatttaggtgacactatagttcttctgtacccggattaggtttcagagctatgctggaaacagc

SEQ ID NO: 48606 - DNA, 70 bp, Artificial Sequence
  Synthetic
gccaagcatttaggtgacactatagggcctcaagcggcagcatgagtttcagagctatgctggaaacagc

SEQ ID NO: 48607 - DNA, 70 bp, Artificial Sequence
  Synthetic
gccaagcatttaggtgacactatagatcatctaccccgactgagcgtttcagagctatgctggaaacagc

SEQ ID NO: 48608 - DNA, 70 bp, Artificial Sequence
  Synthetic
gccaagcatttaggtgacactataggcacgccaccgagccctagcgtttcagagctatgctggaaacagc

SEQ ID NO: 48609 - DNA, 70 bp, Artificial Sequence
  Synthetic
gccaagcatttaggtgacactatagggctgctcctgggcacgtgagtttcagagctatgctggaaacagc

SEQ ID NO: 48610 - DNA, 70 bp, Artificial Sequence
  Synthetic
gccaagcatttaggtgacactataggtggcatgtctatacctcgtgtttcagagctatgctggaaacagc

SEQ ID NO: 48611 - DNA, 70 bp, Artificial Sequence
  Synthetic
gccaagcatttaggtgacactatagaaagagcaggaatcctgcaagtttcagagctatgctggaaacagc

SEQ ID NO: 48612 - DNA, 70 bp, Artificial Sequence
  Synthetic
gccaagcatttaggtgacactatagcggggctcacagtagctccggtttcagagctatgctggaaacagc

SEQ ID NO: 48613 - DNA, 70 bp, Artificial Sequence
  Synthetic
gccaagcatttaggtgacactatagagtgggcactaagcaaagacgtttcagagctatgctggaaacagc

SEQ ID NO: 48614 - DNA, 70 bp, Artificial Sequence
  Synthetic
gccaagcatttaggtgacactataggccggcttcagggtcagggcgtttcagagctatgctggaaacagc

SEQ ID NO: 48615 - DNA, 70 bp, Artificial Sequence
  Synthetic
gccaagcatttaggtgacactatagtcaaggccgaggacgactgagtttcagagctatgctggaaacagc

SEQ ID NO: 48616 - DNA, 70 bp, Artificial Sequence
  Synthetic
gccaagcatttaggtgacactataggtcaacgtataagagaaaccgtttcagagctatgctggaaacagc

SEQ ID NO: 48617 - DNA, 70 bp, Artificial Sequence
  Synthetic
gccaagcatttaggtgacactataggccggccgccgagctgtagcgtttcagagctatgctggaaacagc

SEQ ID NO: 48618 - DNA, 70 bp, Artificial Sequence
  Synthetic
gccaagcatttaggtgacactatagtttaaactctcctctgtcacgtttcagagctatgctggaaacagc

SEQ ID NO: 48619 - DNA, 70 bp, Artificial Sequence
  Synthetic
gccaagcatttaggtgacactatagtataaactctcctctgtcacgtttcagagctatgctggaaacagc

SEQ ID NO: 48620 - DNA, 70 bp, Artificial Sequence
  Synthetic
gccaagcatttaggtgacactatagcaagaaagagatggaggagggtttcagagctatgctggaaacagc

SEQ ID NO: 48621 - DNA, 70 bp, Artificial Sequence
  Synthetic
gccaagcatttaggtgacactatagccaagaacacattcacactcgtttcagagctatgctggaaacagc

SEQ ID NO: 48622 - DNA, 70 bp, Artificial Sequence
  Synthetic
gccaagcatttaggtgacactatagtggatcaagggagtgatgaagtttcagagctatgctggaaacagc

SEQ ID NO: 48623 - DNA, 70 bp, Artificial Sequence
  Synthetic
gccaagcatttaggtgacactatagtggtatcttcaagccttaaggtttcagagctatgctggaaacagc

SEQ ID NO: 48624 - DNA, 70 bp, Artificial Sequence
  Synthetic
gccaagcatttaggtgacactatagtgtatctggattagtcctcagtttcagagctatgctggaaacagc

SEQ ID NO: 48625 - DNA, 70 bp, Artificial Sequence
  Synthetic
gccaagcatttaggtgacactatagagattatactcatgccatgtgtttcagagctatgctggaaacagc

SEQ ID NO: 48626 - DNA, 70 bp, Artificial Sequence
  Synthetic
gccaagcatttaggtgacactatagggctcagtggccatggctaggtttcagagctatgctggaaacagc

SEQ ID NO: 48627 - DNA, 70 bp, Artificial Sequence
  Synthetic
gccaagcatttaggtgacactataggggaggggctctcaggcccagtttcagagctatgctggaaacagc

SEQ ID NO: 48628 - DNA, 70 bp, Artificial Sequence
  Synthetic
gccaagcatttaggtgacactataggggccaagcgtttaaagctggtttcagagctatgctggaaacagc

SEQ ID NO: 48629 - DNA, 70 bp, Artificial Sequence
  Synthetic
gccaagcatttaggtgacactatagaagatggtctggttccctaggtttcagagctatgctggaaacagc

SEQ ID NO: 48630 - DNA, 70 bp, Artificial Sequence
  Synthetic
gccaagcatttaggtgacactatagtctttgagctgaagccctaggtttcagagctatgctggaaacagc

SEQ ID NO: 48631 - DNA, 70 bp, Artificial Sequence
  Synthetic
gccaagcatttaggtgacactatagggatccacatcagaagaatagtttcagagctatgctggaaacagc

SEQ ID NO: 48632 - DNA, 70 bp, Artificial Sequence
  Synthetic
gccaagcatttaggtgacactatagcactgcccggcaccagttacgtttcagagctatgctggaaacagc

SEQ ID NO: 48633 - DNA, 70 bp, Artificial Sequence
  Synthetic
gccaagcatttaggtgacactataggagaaaacgaagaaacacacgtttcagagctatgctggaaacagc

SEQ ID NO: 48634 - DNA, 70 bp, Artificial Sequence
  Synthetic
gccaagcatttaggtgacactatagttatggactaaggtgtcccagtttcagagctatgctggaaacagc

SEQ ID NO: 48635 - DNA, 70 bp, Artificial Sequence
  Synthetic
gccaagcatttaggtgacactatagtgtcatctccgtccagttaagtttcagagctatgctggaaacagc

SEQ ID NO: 48636 - DNA, 70 bp, Artificial Sequence
  Synthetic
gccaagcatttaggtgacactatagagtttctctccaattcatcagtttcagagctatgctggaaacagc

SEQ ID NO: 48637 - DNA, 70 bp, Artificial Sequence
  Synthetic
gccaagcatttaggtgacactataggcctccagggactcctagcggtttcagagctatgctggaaacagc

SEQ ID NO: 48638 - DNA, 70 bp, Artificial Sequence
  Synthetic
gccaagcatttaggtgacactatagctgccatccattatgactgagtttcagagctatgctggaaacagc

SEQ ID NO: 48639 - DNA, 70 bp, Artificial Sequence
  Synthetic
gccaagcatttaggtgacactatagctgtacaccatcagtcataagtttcagagctatgctggaaacagc

SEQ ID NO: 48640 - DNA, 70 bp, Artificial Sequence
  Synthetic
gccaagcatttaggtgacactatagggcatcagtgttttctgcaagtttcagagctatgctggaaacagc

SEQ ID NO: 48641 - DNA, 70 bp, Artificial Sequence
  Synthetic
gccaagcatttaggtgacactataggactggcacggctttgactggtttcagagctatgctggaaacagc

SEQ ID NO: 48642 - DNA, 70 bp, Artificial Sequence
  Synthetic
gccaagcatttaggtgacactatagaccaaagctctcaaaaatgagtttcagagctatgctggaaacagc

SEQ ID NO: 48643 - DNA, 70 bp, Artificial Sequence
  Synthetic
gccaagcatttaggtgacactataggattcagtgcacgccctgctgtttcagagctatgctggaaacagc

SEQ ID NO: 48644 - DNA, 70 bp, Artificial Sequence
  Synthetic
gccaagcatttaggtgacactatagagagccactacccttctagagtttcagagctatgctggaaacagc

SEQ ID NO: 48645 - DNA, 70 bp, Artificial Sequence
  Synthetic
gccaagcatttaggtgacactatagagatgggaaaactactatctgtttcagagctatgctggaaacagc

SEQ ID NO: 48646 - DNA, 70 bp, Artificial Sequence
  Synthetic
gccaagcatttaggtgacactataggttcaggtcctgcggtcactgtttcagagctatgctggaaacagc

SEQ ID NO: 48647 - DNA, 70 bp, Artificial Sequence
  Synthetic
gccaagcatttaggtgacactatagaggaaggtgctggaactcacgtttcagagctatgctggaaacagc

SEQ ID NO: 48648 - DNA, 70 bp, Artificial Sequence
  Synthetic
gccaagcatttaggtgacactatagagtcacagaagaaagggccagtttcagagctatgctggaaacagc

SEQ ID NO: 48649 - DNA, 70 bp, Artificial Sequence
  Synthetic
gccaagcatttaggtgacactatagtgcgtgggtgaacatcagtggtttcagagctatgctggaaacagc

SEQ ID NO: 48650 - DNA, 70 bp, Artificial Sequence
  Synthetic
gccaagcatttaggtgacactatagtctgtgactcacactcaggggtttcagagctatgctggaaacagc

SEQ ID NO: 48651 - DNA, 70 bp, Artificial Sequence
  Synthetic
gccaagcatttaggtgacactataggcccccagcctgtggacgccgtttcagagctatgctggaaacagc

SEQ ID NO: 48652 - DNA, 70 bp, Artificial Sequence
  Synthetic
gccaagcatttaggtgacactatagagtacttacttgctgaatctgtttcagagctatgctggaaacagc

SEQ ID NO: 48653 - DNA, 70 bp, Artificial Sequence
  Synthetic
gccaagcatttaggtgacactatagtaaggcacacaggctatgtggtttcagagctatgctggaaacagc

SEQ ID NO: 48654 - DNA, 70 bp, Artificial Sequence
  Synthetic
gccaagcatttaggtgacactatagtcagctggtgaacttcatctgtttcagagctatgctggaaacagc

SEQ ID NO: 48655 - DNA, 70 bp, Artificial Sequence
  Synthetic
gccaagcatttaggtgacactatagtccatgcggatgggatcatagtttcagagctatgctggaaacagc

SEQ ID NO: 48656 - DNA, 70 bp, Artificial Sequence
  Synthetic
gccaagcatttaggtgacactatagacaacatagcttttgttgctgtttcagagctatgctggaaacagc

SEQ ID NO: 48657 - DNA, 70 bp, Artificial Sequence
  Synthetic
gccaagcatttaggtgacactataggcatccacattacagcagaggtttcagagctatgctggaaacagc

SEQ ID NO: 48658 - DNA, 70 bp, Artificial Sequence
  Synthetic
gccaagcatttaggtgacactatagtaggtcagttgtttatgggtgtttcagagctatgctggaaacagc

SEQ ID NO: 48659 - DNA, 70 bp, Artificial Sequence
  Synthetic
gccaagcatttaggtgacactatagtgcaatccatccccttaatcgtttcagagctatgctggaaacagc

SEQ ID NO: 48660 - DNA, 70 bp, Artificial Sequence
  Synthetic
gccaagcatttaggtgacactataggtctctggagacagattaaggtttcagagctatgctggaaacagc

SEQ ID NO: 48661 - DNA, 70 bp, Artificial Sequence
  Synthetic
gccaagcatttaggtgacactatagggaggctggctgtcaggactgtttcagagctatgctggaaacagc

SEQ ID NO: 48662 - DNA, 70 bp, Artificial Sequence
  Synthetic
gccaagcatttaggtgacactataggtcaagacctggagcgaagagtttcagagctatgctggaaacagc

SEQ ID NO: 48663 - DNA, 70 bp, Artificial Sequence
  Synthetic
gccaagcatttaggtgacactatagaggagcctgtactcaagaaagtttcagagctatgctggaaacagc

SEQ ID NO: 48664 - DNA, 70 bp, Artificial Sequence
  Synthetic
gccaagcatttaggtgacactatagtcactgtgccctccccacaagtttcagagctatgctggaaacagc

SEQ ID NO: 48665 - DNA, 70 bp, Artificial Sequence
  Synthetic
gccaagcatttaggtgacactatagtcccaagtagctgagattacgtttcagagctatgctggaaacagc

SEQ ID NO: 48666 - DNA, 70 bp, Artificial Sequence
  Synthetic
gccaagcatttaggtgacactatagtctccctctgccacaggagagtttcagagctatgctggaaacagc

SEQ ID NO: 48667 - DNA, 70 bp, Artificial Sequence
  Synthetic
gccaagcatttaggtgacactataggctacttggaacactaaagcgtttcagagctatgctggaaacagc

SEQ ID NO: 48668 - DNA, 70 bp, Artificial Sequence
  Synthetic
gccaagcatttaggtgacactatagtttcacttgctacttgtctcgtttcagagctatgctggaaacagc

SEQ ID NO: 48669 - DNA, 70 bp, Artificial Sequence
  Synthetic
gccaagcatttaggtgacactatagcccgtggagccctgcacgtagtttcagagctatgctggaaacagc

SEQ ID NO: 48670 - DNA, 70 bp, Artificial Sequence
  Synthetic
gccaagcatttaggtgacactatagaaccccagcccccagctctggtttcagagctatgctggaaacagc

SEQ ID NO: 48671 - DNA, 70 bp, Artificial Sequence
  Synthetic
gccaagcatttaggtgacactatagcaagtcagctccttaatcacgtttcagagctatgctggaaacagc

SEQ ID NO: 48672 - DNA, 70 bp, Artificial Sequence
  Synthetic
gccaagcatttaggtgacactatagtcaggctgcgtcagtctttcgtttcagagctatgctggaaacagc

SEQ ID NO: 48673 - DNA, 70 bp, Artificial Sequence
  Synthetic
gccaagcatttaggtgacactataggcgccctcctgctgctctgagtttcagagctatgctggaaacagc

SEQ ID NO: 48674 - DNA, 70 bp, Artificial Sequence
  Synthetic
gccaagcatttaggtgacactatagctgctccccttcctgtagaggtttcagagctatgctggaaacagc

SEQ ID NO: 48675 - DNA, 70 bp, Artificial Sequence
  Synthetic
gccaagcatttaggtgacactatagaagccaggggctcaggctacgtttcagagctatgctggaaacagc

SEQ ID NO: 48676 - DNA, 70 bp, Artificial Sequence
  Synthetic
gccaagcatttaggtgacactataggaaggcgaagttacaacctggtttcagagctatgctggaaacagc

SEQ ID NO: 48677 - DNA, 70 bp, Artificial Sequence
  Synthetic
gccaagcatttaggtgacactatagagtcgtcgaatggtttcatcgtttcagagctatgctggaaacagc

SEQ ID NO: 48678 - DNA, 70 bp, Artificial Sequence
  Synthetic
gccaagcatttaggtgacactatagatattttcaagctcctcttcgtttcagagctatgctggaaacagc

SEQ ID NO: 48679 - DNA, 70 bp, Artificial Sequence
  Synthetic
gccaagcatttaggtgacactatagttagctgaaagggagaacacgtttcagagctatgctggaaacagc

SEQ ID NO: 48680 - DNA, 70 bp, Artificial Sequence
  Synthetic
gccaagcatttaggtgacactatagtggactagaaatgacagatggtttcagagctatgctggaaacagc

SEQ ID NO: 48681 - DNA, 70 bp, Artificial Sequence
  Synthetic
gccaagcatttaggtgacactatagaggcctgaagctactcgatggtttcagagctatgctggaaacagc

SEQ ID NO: 48682 - DNA, 70 bp, Artificial Sequence
  Synthetic
gccaagcatttaggtgacactatagcatcctgggcagcacgttaggtttcagagctatgctggaaacagc

SEQ ID NO: 48683 - DNA, 70 bp, Artificial Sequence
  Synthetic
gccaagcatttaggtgacactataggtagtcatcgtagttgacgcgtttcagagctatgctggaaacagc

SEQ ID NO: 48684 - DNA, 70 bp, Artificial Sequence
  Synthetic
gccaagcatttaggtgacactataggggaaagtaatagtggtcaggtttcagagctatgctggaaacagc

SEQ ID NO: 48685 - DNA, 70 bp, Artificial Sequence
  Synthetic
gccaagcatttaggtgacactataggcagcagatctgctgtctatgtttcagagctatgctggaaacagc

SEQ ID NO: 48686 - DNA, 70 bp, Artificial Sequence
  Synthetic
gccaagcatttaggtgacactatagtgaagcccccacaagcaaaagtttcagagctatgctggaaacagc

SEQ ID NO: 48687 - DNA, 70 bp, Artificial Sequence
  Synthetic
gccaagcatttaggtgacactatagcagccctccttgctcctagagtttcagagctatgctggaaacagc

SEQ ID NO: 48688 - DNA, 70 bp, Artificial Sequence
  Synthetic
gccaagcatttaggtgacactatagggaggcgaggagagctgagcgtttcagagctatgctggaaacagc

SEQ ID NO: 48689 - DNA, 70 bp, Artificial Sequence
  Synthetic
gccaagcatttaggtgacactatagcagaagcagtaagttctgacgtttcagagctatgctggaaacagc

SEQ ID NO: 48690 - DNA, 70 bp, Artificial Sequence
  Synthetic
gccaagcatttaggtgacactataggccttcaacatggtcagtgtgtttcagagctatgctggaaacagc

SEQ ID NO: 48691 - DNA, 70 bp, Artificial Sequence
  Synthetic
gccaagcatttaggtgacactatagttccatagagaatcacttcagtttcagagctatgctggaaacagc

SEQ ID NO: 48692 - DNA, 70 bp, Artificial Sequence
  Synthetic
gccaagcatttaggtgacactatagagagggtctctccacaggaggtttcagagctatgctggaaacagc

SEQ ID NO: 48693 - DNA, 70 bp, Artificial Sequence
  Synthetic
gccaagcatttaggtgacactataggcaagaggaggtgtcctgacgtttcagagctatgctggaaacagc

SEQ ID NO: 48694 - DNA, 70 bp, Artificial Sequence
  Synthetic
gccaagcatttaggtgacactatagccaccggagactcaagatgagtttcagagctatgctggaaacagc

SEQ ID NO: 48695 - DNA, 70 bp, Artificial Sequence
  Synthetic
gccaagcatttaggtgacactatagtaggagatgctcttttcactgtttcagagctatgctggaaacagc

SEQ ID NO: 48696 - DNA, 70 bp, Artificial Sequence
  Synthetic
gccaagcatttaggtgacactatagatactcgagaacataaagaggtttcagagctatgctggaaacagc

SEQ ID NO: 48697 - DNA, 70 bp, Artificial Sequence
  Synthetic
gccaagcatttaggtgacactataggccctcgagatgttttcaccgtttcagagctatgctggaaacagc

SEQ ID NO: 48698 - DNA, 70 bp, Artificial Sequence
  Synthetic
gccaagcatttaggtgacactatagaaactgcactttccccaaaggtttcagagctatgctggaaacagc

SEQ ID NO: 48699 - DNA, 70 bp, Artificial Sequence
  Synthetic
gccaagcatttaggtgacactatagttgtgatgatttccattctggtttcagagctatgctggaaacagc

SEQ ID NO: 48700 - DNA, 70 bp, Artificial Sequence
  Synthetic
gccaagcatttaggtgacactatagttagctgtgctacggtcaccgtttcagagctatgctggaaacagc

SEQ ID NO: 48701 - DNA, 70 bp, Artificial Sequence
  Synthetic
gccaagcatttaggtgacactataggcccctttattcgcttcagggtttcagagctatgctggaaacagc

SEQ ID NO: 48702 - DNA, 70 bp, Artificial Sequence
  Synthetic
gccaagcatttaggtgacactataggccattctagatggtttcaggtttcagagctatgctggaaacagc

SEQ ID NO: 48703 - DNA, 70 bp, Artificial Sequence
  Synthetic
gccaagcatttaggtgacactatagttagcgtaagatggatgaacgtttcagagctatgctggaaacagc

SEQ ID NO: 48704 - DNA, 70 bp, Artificial Sequence
  Synthetic
gccaagcatttaggtgacactatagattgagagtgaggggccttggtttcagagctatgctggaaacagc

SEQ ID NO: 48705 - DNA, 70 bp, Artificial Sequence
  Synthetic
gccaagcatttaggtgacactatagaagcatggaaggaattcagggtttcagagctatgctggaaacagc

SEQ ID NO: 48706 - DNA, 70 bp, Artificial Sequence
  Synthetic
gccaagcatttaggtgacactatagggaatgggggtgtggtcagtgtttcagagctatgctggaaacagc

SEQ ID NO: 48707 - DNA, 70 bp, Artificial Sequence
  Synthetic
gccaagcatttaggtgacactatagtgacattgtttgagggacaggtttcagagctatgctggaaacagc

SEQ ID NO: 48708 - DNA, 70 bp, Artificial Sequence
  Synthetic
gccaagcatttaggtgacactatagtaaaagcagtctcaacagttgtttcagagctatgctggaaacagc

SEQ ID NO: 48709 - DNA, 70 bp, Artificial Sequence
  Synthetic
gccaagcatttaggtgacactatagtcgctgtgcctcattttgaagtttcagagctatgctggaaacagc

SEQ ID NO: 48710 - DNA, 70 bp, Artificial Sequence
  Synthetic
gccaagcatttaggtgacactatagcaatgccatccatgcgtgaggtttcagagctatgctggaaacagc

SEQ ID NO: 48711 - DNA, 70 bp, Artificial Sequence
  Synthetic
gccaagcatttaggtgacactatagccctgtcttgggctctaatggtttcagagctatgctggaaacagc

SEQ ID NO: 48712 - DNA, 70 bp, Artificial Sequence
  Synthetic
gccaagcatttaggtgacactataggccaggatggcgctacttctgtttcagagctatgctggaaacagc

SEQ ID NO: 48713 - DNA, 70 bp, Artificial Sequence
  Synthetic
gccaagcatttaggtgacactatagcagagcccagtctctaggaggtttcagagctatgctggaaacagc

SEQ ID NO: 48714 - DNA, 70 bp, Artificial Sequence
  Synthetic
gccaagcatttaggtgacactatagcctgaattttatgctgtgccgtttcagagctatgctggaaacagc

SEQ ID NO: 48715 - DNA, 70 bp, Artificial Sequence
  Synthetic
gccaagcatttaggtgacactatagtttcgtagaaaagggtgaaagtttcagagctatgctggaaacagc

SEQ ID NO: 48716 - DNA, 70 bp, Artificial Sequence
  Synthetic
gccaagcatttaggtgacactatagtcaagaacctactatgtgaagtttcagagctatgctggaaacagc

SEQ ID NO: 48717 - DNA, 70 bp, Artificial Sequence
  Synthetic
gccaagcatttaggtgacactatagtctggggacatttctatcccgtttcagagctatgctggaaacagc

SEQ ID NO: 48718 - DNA, 70 bp, Artificial Sequence
  Synthetic
gccaagcatttaggtgacactataggcggggcaactaatttaaaagtttcagagctatgctggaaacagc

SEQ ID NO: 48719 - DNA, 70 bp, Artificial Sequence
  Synthetic
gccaagcatttaggtgacactatagggaactggggaccaagtttggtttcagagctatgctggaaacagc

SEQ ID NO: 48720 - DNA, 70 bp, Artificial Sequence
  Synthetic
gccaagcatttaggtgacactataggtctcgttctgtcgcttagcgtttcagagctatgctggaaacagc

SEQ ID NO: 48721 - DNA, 70 bp, Artificial Sequence
  Synthetic
gccaagcatttaggtgacactatagtacctggttgtgagagtctggtttcagagctatgctggaaacagc

SEQ ID NO: 48722 - DNA, 70 bp, Artificial Sequence
  Synthetic
gccaagcatttaggtgacactataggggctgattagcactcaaaggtttcagagctatgctggaaacagc

SEQ ID NO: 48723 - DNA, 70 bp, Artificial Sequence
  Synthetic
gccaagcatttaggtgacactatagcacgcagttcttttgcagccgtttcagagctatgctggaaacagc

SEQ ID NO: 48724 - DNA, 70 bp, Artificial Sequence
  Synthetic
gccaagcatttaggtgacactataggactgttctggacttggaaggtttcagagctatgctggaaacagc

SEQ ID NO: 48725 - DNA, 70 bp, Artificial Sequence
  Synthetic
gccaagcatttaggtgacactataggcagaatcaggtagacactcgtttcagagctatgctggaaacagc

SEQ ID NO: 48726 - DNA, 70 bp, Artificial Sequence
  Synthetic
gccaagcatttaggtgacactatagaacagggaaatactatgagtgtttcagagctatgctggaaacagc

SEQ ID NO: 48727 - DNA, 70 bp, Artificial Sequence
  Synthetic
gccaagcatttaggtgacactatagctgataaggatggtatgttcgtttcagagctatgctggaaacagc

SEQ ID NO: 48728 - DNA, 70 bp, Artificial Sequence
  Synthetic
gccaagcatttaggtgacactataggaatctggacgctgctcagcgtttcagagctatgctggaaacagc

SEQ ID NO: 48729 - DNA, 70 bp, Artificial Sequence
  Synthetic
gccaagcatttaggtgacactatagctatcgtttcaatcacttccgtttcagagctatgctggaaacagc

SEQ ID NO: 48730 - DNA, 70 bp, Artificial Sequence
  Synthetic
gccaagcatttaggtgacactataggggcagatgttacaagtgacgtttcagagctatgctggaaacagc

SEQ ID NO: 48731 - DNA, 70 bp, Artificial Sequence
  Synthetic
gccaagcatttaggtgacactatagtccccgagcgctcagataaggtttcagagctatgctggaaacagc

SEQ ID NO: 48732 - DNA, 70 bp, Artificial Sequence
  Synthetic
gccaagcatttaggtgacactatagctggtccagagcattaaacagtttcagagctatgctggaaacagc

SEQ ID NO: 48733 - DNA, 70 bp, Artificial Sequence
  Synthetic
gccaagcatttaggtgacactatagctgggcagtagacatgtcaagtttcagagctatgctggaaacagc

SEQ ID NO: 48734 - DNA, 70 bp, Artificial Sequence
  Synthetic
gccaagcatttaggtgacactatagggtaaacacactggctaagcgtttcagagctatgctggaaacagc

SEQ ID NO: 48735 - DNA, 70 bp, Artificial Sequence
  Synthetic
gccaagcatttaggtgacactatagctcaggggtgccaggtgtgagtttcagagctatgctggaaacagc

SEQ ID NO: 48736 - DNA, 70 bp, Artificial Sequence
  Synthetic
gccaagcatttaggtgacactatagcagcgcaagacaatccacttgtttcagagctatgctggaaacagc

SEQ ID NO: 48737 - DNA, 70 bp, Artificial Sequence
  Synthetic
gccaagcatttaggtgacactataggctgaagaaagctgagttgagtttcagagctatgctggaaacagc

SEQ ID NO: 48738 - DNA, 70 bp, Artificial Sequence
  Synthetic
gccaagcatttaggtgacactatagcagtctagaacttctacctcgtttcagagctatgctggaaacagc

SEQ ID NO: 48739 - DNA, 70 bp, Artificial Sequence
  Synthetic
gccaagcatttaggtgacactatagatttggatgagactgattaggtttcagagctatgctggaaacagc

SEQ ID NO: 48740 - DNA, 70 bp, Artificial Sequence
  Synthetic
gccaagcatttaggtgacactatagtggtacttaagtcttccttcgtttcagagctatgctggaaacagc

SEQ ID NO: 48741 - DNA, 70 bp, Artificial Sequence
  Synthetic
gccaagcatttaggtgacactatagtttcatccttttcgatgtgggtttcagagctatgctggaaacagc

SEQ ID NO: 48742 - DNA, 70 bp, Artificial Sequence
  Synthetic
gccaagcatttaggtgacactatagcacatttctctattagccacgtttcagagctatgctggaaacagc

SEQ ID NO: 48743 - DNA, 70 bp, Artificial Sequence
  Synthetic
gccaagcatttaggtgacactatagtggaagaggtcttctcaaacgtttcagagctatgctggaaacagc

SEQ ID NO: 48744 - DNA, 70 bp, Artificial Sequence
  Synthetic
gccaagcatttaggtgacactataggctgccgaagctaccaaaaagtttcagagctatgctggaaacagc

SEQ ID NO: 48745 - DNA, 70 bp, Artificial Sequence
  Synthetic
gccaagcatttaggtgacactatagttgaaacctgatgactgattgtttcagagctatgctggaaacagc

SEQ ID NO: 48746 - DNA, 70 bp, Artificial Sequence
  Synthetic
gccaagcatttaggtgacactatagcttgtcttccagttgctaatgtttcagagctatgctggaaacagc

SEQ ID NO: 48747 - DNA, 70 bp, Artificial Sequence
  Synthetic
gccaagcatttaggtgacactatagtgctggccagcggggcactggtttcagagctatgctggaaacagc

SEQ ID NO: 48748 - DNA, 70 bp, Artificial Sequence
  Synthetic
gccaagcatttaggtgacactatagtcatcgccatttaactgagtgtttcagagctatgctggaaacagc

SEQ ID NO: 48749 - DNA, 70 bp, Artificial Sequence
  Synthetic
gccaagcatttaggtgacactataggatgaacatgttgtgtctctgtttcagagctatgctggaaacagc

SEQ ID NO: 48750 - DNA, 70 bp, Artificial Sequence
  Synthetic
gccaagcatttaggtgacactatagtaaaatgctgtcaagttggcgtttcagagctatgctggaaacagc

SEQ ID NO: 48751 - DNA, 70 bp, Artificial Sequence
  Synthetic
gccaagcatttaggtgacactatagccagaagacccaggcagtgtgtttcagagctatgctggaaacagc

SEQ ID NO: 48752 - DNA, 70 bp, Artificial Sequence
  Synthetic
gccaagcatttaggtgacactatagtcggagatggaggtgtaggcgtttcagagctatgctggaaacagc

SEQ ID NO: 48753 - DNA, 70 bp, Artificial Sequence
  Synthetic
gccaagcatttaggtgacactatagtaacattctgatctaggcgagtttcagagctatgctggaaacagc

SEQ ID NO: 48754 - DNA, 70 bp, Artificial Sequence
  Synthetic
gccaagcatttaggtgacactataggagactctgctgcatacactgtttcagagctatgctggaaacagc

SEQ ID NO: 48755 - DNA, 70 bp, Artificial Sequence
  Synthetic
gccaagcatttaggtgacactatagtcaattgtgtcaggcatcacgtttcagagctatgctggaaacagc

SEQ ID NO: 48756 - DNA, 70 bp, Artificial Sequence
  Synthetic
gccaagcatttaggtgacactatagttcctgcctcattcactcatgtttcagagctatgctggaaacagc

SEQ ID NO: 48757 - DNA, 70 bp, Artificial Sequence
  Synthetic
gccaagcatttaggtgacactataggaggggaccgtgtgtttgctgtttcagagctatgctggaaacagc

SEQ ID NO: 48758 - DNA, 70 bp, Artificial Sequence
  Synthetic
gccaagcatttaggtgacactataggaagacagtcaatatcgtgagtttcagagctatgctggaaacagc

SEQ ID NO: 48759 - DNA, 70 bp, Artificial Sequence
  Synthetic
gccaagcatttaggtgacactatagatggctcctcctgagccggcgtttcagagctatgctggaaacagc

SEQ ID NO: 48760 - DNA, 70 bp, Artificial Sequence
  Synthetic
gccaagcatttaggtgacactatagcgtgcctggaccgcgcctacgtttcagagctatgctggaaacagc

SEQ ID NO: 48761 - DNA, 70 bp, Artificial Sequence
  Synthetic
gccaagcatttaggtgacactatagtgagccggcaggctcccggtgtttcagagctatgctggaaacagc

SEQ ID NO: 48762 - DNA, 70 bp, Artificial Sequence
  Synthetic
gccaagcatttaggtgacactatagttggttgcgaattgccaggagtttcagagctatgctggaaacagc

SEQ ID NO: 48763 - DNA, 70 bp, Artificial Sequence
  Synthetic
gccaagcatttaggtgacactatagcaatgatatccaggtcttacgtttcagagctatgctggaaacagc

SEQ ID NO: 48764 - DNA, 70 bp, Artificial Sequence
  Synthetic
gccaagcatttaggtgacactatagagttctcaggattcaggctcgtttcagagctatgctggaaacagc

SEQ ID NO: 48765 - DNA, 70 bp, Artificial Sequence
  Synthetic
gccaagcatttaggtgacactataggacacaggctgaaatgccaagtttcagagctatgctggaaacagc

SEQ ID NO: 48766 - DNA, 70 bp, Artificial Sequence
  Synthetic
gccaagcatttaggtgacactataggccacggggatgcttcaggagtttcagagctatgctggaaacagc

SEQ ID NO: 48767 - DNA, 70 bp, Artificial Sequence
  Synthetic
gccaagcatttaggtgacactataggacccctgaaagaacaagaagtttcagagctatgctggaaacagc

SEQ ID NO: 48768 - DNA, 70 bp, Artificial Sequence
  Synthetic
gccaagcatttaggtgacactatagtgggagactggagtttaaacgtttcagagctatgctggaaacagc

SEQ ID NO: 48769 - DNA, 70 bp, Artificial Sequence
  Synthetic
gccaagcatttaggtgacactatagtcacagcttgattttgtttggtttcagagctatgctggaaacagc

SEQ ID NO: 48770 - DNA, 70 bp, Artificial Sequence
  Synthetic
gccaagcatttaggtgacactatagtgctaagttctcagtcttgagtttcagagctatgctggaaacagc

SEQ ID NO: 48771 - DNA, 70 bp, Artificial Sequence
  Synthetic
gccaagcatttaggtgacactataggaacaattgggaatctcctggtttcagagctatgctggaaacagc

SEQ ID NO: 48772 - DNA, 70 bp, Artificial Sequence
  Synthetic
gccaagcatttaggtgacactatagcaggactcttgaacattctcgtttcagagctatgctggaaacagc

SEQ ID NO: 48773 - DNA, 70 bp, Artificial Sequence
  Synthetic
gccaagcatttaggtgacactatagcttgagcagcaaagtactgggtttcagagctatgctggaaacagc

SEQ ID NO: 48774 - DNA, 70 bp, Artificial Sequence
  Synthetic
gccaagcatttaggtgacactatagtcacatagcaactcccaaaagtttcagagctatgctggaaacagc

SEQ ID NO: 48775 - DNA, 70 bp, Artificial Sequence
  Synthetic
gccaagcatttaggtgacactatagtgacagcagctagtggtgcggtttcagagctatgctggaaacagc

SEQ ID NO: 48776 - DNA, 70 bp, Artificial Sequence
  Synthetic
gccaagcatttaggtgacactataggctgagctctatctcataaggtttcagagctatgctggaaacagc

SEQ ID NO: 48777 - DNA, 70 bp, Artificial Sequence
  Synthetic
gccaagcatttaggtgacactatagactgcatcctggaaagtgttgtttcagagctatgctggaaacagc

SEQ ID NO: 48778 - DNA, 70 bp, Artificial Sequence
  Synthetic
gccaagcatttaggtgacactataggggcgaaggcaaatacaggagtttcagagctatgctggaaacagc

SEQ ID NO: 48779 - DNA, 70 bp, Artificial Sequence
  Synthetic
gccaagcatttaggtgacactatagcccttcggccagtcttaaacgtttcagagctatgctggaaacagc

SEQ ID NO: 48780 - DNA, 70 bp, Artificial Sequence
  Synthetic
gccaagcatttaggtgacactataggggcctttggaaatttatcagtttcagagctatgctggaaacagc

SEQ ID NO: 48781 - DNA, 70 bp, Artificial Sequence
  Synthetic
gccaagcatttaggtgacactatagaagaggaggaatctgttctcgtttcagagctatgctggaaacagc

SEQ ID NO: 48782 - DNA, 70 bp, Artificial Sequence
  Synthetic
gccaagcatttaggtgacactatagaagagaacccctggctcagggtttcagagctatgctggaaacagc

SEQ ID NO: 48783 - DNA, 70 bp, Artificial Sequence
  Synthetic
gccaagcatttaggtgacactatagcaaggtcaaggatcagggctgtttcagagctatgctggaaacagc

SEQ ID NO: 48784 - DNA, 70 bp, Artificial Sequence
  Synthetic
gccaagcatttaggtgacactataggtctccagggacttggctcggtttcagagctatgctggaaacagc

SEQ ID NO: 48785 - DNA, 70 bp, Artificial Sequence
  Synthetic
gccaagcatttaggtgacactatagccaagccctaggttgcagtggtttcagagctatgctggaaacagc

SEQ ID NO: 48786 - DNA, 70 bp, Artificial Sequence
  Synthetic
gccaagcatttaggtgacactatagagaataaaatctgcatgtccgtttcagagctatgctggaaacagc

SEQ ID NO: 48787 - DNA, 70 bp, Artificial Sequence
  Synthetic
gccaagcatttaggtgacactatagtgattcacaaacaggaaacagtttcagagctatgctggaaacagc

SEQ ID NO: 48788 - DNA, 70 bp, Artificial Sequence
  Synthetic
gccaagcatttaggtgacactatagagagtttgtgaatttcaggtgtttcagagctatgctggaaacagc

SEQ ID NO: 48789 - DNA, 70 bp, Artificial Sequence
  Synthetic
gccaagcatttaggtgacactatagacagagtggtgttacggcgggtttcagagctatgctggaaacagc

SEQ ID NO: 48790 - DNA, 70 bp, Artificial Sequence
  Synthetic
gccaagcatttaggtgacactataggcaagacacagctttcaatcgtttcagagctatgctggaaacagc

SEQ ID NO: 48791 - DNA, 70 bp, Artificial Sequence
  Synthetic
gccaagcatttaggtgacactatagggggagcggcgtcttaattagtttcagagctatgctggaaacagc

SEQ ID NO: 48792 - DNA, 70 bp, Artificial Sequence
  Synthetic
gccaagcatttaggtgacactatagaggcacggctctgggcactggtttcagagctatgctggaaacagc

SEQ ID NO: 48793 - DNA, 70 bp, Artificial Sequence
  Synthetic
gccaagcatttaggtgacactatagcaaaggacctggaacctcaggtttcagagctatgctggaaacagc

SEQ ID NO: 48794 - DNA, 70 bp, Artificial Sequence
  Synthetic
gccaagcatttaggtgacactataggaggtgctgtatttcctaatgtttcagagctatgctggaaacagc

SEQ ID NO: 48795 - DNA, 70 bp, Artificial Sequence
  Synthetic
gccaagcatttaggtgacactatagagaggggagacccgggaaaggtttcagagctatgctggaaacagc

SEQ ID NO: 48796 - DNA, 70 bp, Artificial Sequence
  Synthetic
gccaagcatttaggtgacactatagtcatggagagaagctttgtagtttcagagctatgctggaaacagc

SEQ ID NO: 48797 - DNA, 70 bp, Artificial Sequence
  Synthetic
gccaagcatttaggtgacactatagtgaagtgccccctaattttcgtttcagagctatgctggaaacagc

SEQ ID NO: 48798 - DNA, 70 bp, Artificial Sequence
  Synthetic
gccaagcatttaggtgacactatagatgaacaccttgcttcacttgtttcagagctatgctggaaacagc

SEQ ID NO: 48799 - DNA, 70 bp, Artificial Sequence
  Synthetic
gccaagcatttaggtgacactatagtgcttttcagaatgtagtccgtttcagagctatgctggaaacagc

SEQ ID NO: 48800 - DNA, 70 bp, Artificial Sequence
  Synthetic
gccaagcatttaggtgacactatagtgctggtcagtactctactcgtttcagagctatgctggaaacagc

SEQ ID NO: 48801 - DNA, 70 bp, Artificial Sequence
  Synthetic
gccaagcatttaggtgacactatagaaccgctttctcagaactgtgtttcagagctatgctggaaacagc

SEQ ID NO: 48802 - DNA, 70 bp, Artificial Sequence
  Synthetic
gccaagcatttaggtgacactatagagtgtttaacaagtacttgcgtttcagagctatgctggaaacagc

SEQ ID NO: 48803 - DNA, 70 bp, Artificial Sequence
  Synthetic
gccaagcatttaggtgacactatagcagggcctccaggagcctacgtttcagagctatgctggaaacagc

SEQ ID NO: 48804 - DNA, 70 bp, Artificial Sequence
  Synthetic
gccaagcatttaggtgacactatagctgtcagttgtgtagtctttgtttcagagctatgctggaaacagc

SEQ ID NO: 48805 - DNA, 70 bp, Artificial Sequence
  Synthetic
gccaagcatttaggtgacactatagttcaggcccatccgctaggcgtttcagagctatgctggaaacagc

SEQ ID NO: 48806 - DNA, 70 bp, Artificial Sequence
  Synthetic
gccaagcatttaggtgacactataggggatgaagcaccaattctagtttcagagctatgctggaaacagc

SEQ ID NO: 48807 - DNA, 70 bp, Artificial Sequence
  Synthetic
gccaagcatttaggtgacactatagttcttaactgctgtcagttcgtttcagagctatgctggaaacagc

SEQ ID NO: 48808 - DNA, 70 bp, Artificial Sequence
  Synthetic
gccaagcatttaggtgacactataggctggcacggtgctacttgagtttcagagctatgctggaaacagc

SEQ ID NO: 48809 - DNA, 70 bp, Artificial Sequence
  Synthetic
gccaagcatttaggtgacactatagcgggagatctttttcagctagtttcagagctatgctggaaacagc

SEQ ID NO: 48810 - DNA, 70 bp, Artificial Sequence
  Synthetic
gccaagcatttaggtgacactataggtctgtctcttcagatttcagtttcagagctatgctggaaacagc

SEQ ID NO: 48811 - DNA, 70 bp, Artificial Sequence
  Synthetic
gccaagcatttaggtgacactataggctgcagctgctctcctagtgtttcagagctatgctggaaacagc

SEQ ID NO: 48812 - DNA, 70 bp, Artificial Sequence
  Synthetic
gccaagcatttaggtgacactatagatcactgtcacagccgtcacgtttcagagctatgctggaaacagc

SEQ ID NO: 48813 - DNA, 70 bp, Artificial Sequence
  Synthetic
gccaagcatttaggtgacactatagggacagccgattaatgtcctgtttcagagctatgctggaaacagc

SEQ ID NO: 48814 - DNA, 70 bp, Artificial Sequence
  Synthetic
gccaagcatttaggtgacactatagaggatttatttgagctctgcgtttcagagctatgctggaaacagc

SEQ ID NO: 48815 - DNA, 70 bp, Artificial Sequence
  Synthetic
gccaagcatttaggtgacactataggggtctggggttccccctaggtttcagagctatgctggaaacagc

SEQ ID NO: 48816 - DNA, 70 bp, Artificial Sequence
  Synthetic
gccaagcatttaggtgacactataggagagggaaggcaggaactagtttcagagctatgctggaaacagc

SEQ ID NO: 48817 - DNA, 70 bp, Artificial Sequence
  Synthetic
gccaagcatttaggtgacactatagaagtgaaaggtgcatatctagtttcagagctatgctggaaacagc

SEQ ID NO: 48818 - DNA, 70 bp, Artificial Sequence
  Synthetic
gccaagcatttaggtgacactatagtgctggtttcacaaatgagggtttcagagctatgctggaaacagc

SEQ ID NO: 48819 - DNA, 70 bp, Artificial Sequence
  Synthetic
gccaagcatttaggtgacactatagcttgggtttcacagaagcatgtttcagagctatgctggaaacagc

SEQ ID NO: 48820 - DNA, 70 bp, Artificial Sequence
  Synthetic
gccaagcatttaggtgacactatagcctgacagatcagctatggcgtttcagagctatgctggaaacagc

SEQ ID NO: 48821 - DNA, 70 bp, Artificial Sequence
  Synthetic
gccaagcatttaggtgacactatagtacagacgcaggcttgctgagtttcagagctatgctggaaacagc

SEQ ID NO: 48822 - DNA, 70 bp, Artificial Sequence
  Synthetic
gccaagcatttaggtgacactatagcagtcaagtgtttctgaagcgtttcagagctatgctggaaacagc

SEQ ID NO: 48823 - DNA, 70 bp, Artificial Sequence
  Synthetic
gccaagcatttaggtgacactatagtgcagaccagttccacgtccgtttcagagctatgctggaaacagc

SEQ ID NO: 48824 - DNA, 70 bp, Artificial Sequence
  Synthetic
gccaagcatttaggtgacactataggtgttcagtgagagtagagagtttcagagctatgctggaaacagc

SEQ ID NO: 48825 - DNA, 70 bp, Artificial Sequence
  Synthetic
gccaagcatttaggtgacactatagacatgcctgatgaagagtttgtttcagagctatgctggaaacagc

SEQ ID NO: 48826 - DNA, 70 bp, Artificial Sequence
  Synthetic
gccaagcatttaggtgacactataggatgatgcaatggaattgctgtttcagagctatgctggaaacagc

SEQ ID NO: 48827 - DNA, 70 bp, Artificial Sequence
  Synthetic
gccaagcatttaggtgacactatagtgtcctacgctggtctactcgtttcagagctatgctggaaacagc

SEQ ID NO: 48828 - DNA, 70 bp, Artificial Sequence
  Synthetic
gccaagcatttaggtgacactatagcatcagcttcgctgggtttggtttcagagctatgctggaaacagc

SEQ ID NO: 48829 - DNA, 70 bp, Artificial Sequence
  Synthetic
gccaagcatttaggtgacactatagttctgttctctaaccttggagtttcagagctatgctggaaacagc

SEQ ID NO: 48830 - DNA, 70 bp, Artificial Sequence
  Synthetic
gccaagcatttaggtgacactatagtgaagagggtcacctttagtgtttcagagctatgctggaaacagc

SEQ ID NO: 48831 - DNA, 70 bp, Artificial Sequence
  Synthetic
gccaagcatttaggtgacactatagtcattaacaatcaccagctcgtttcagagctatgctggaaacagc

SEQ ID NO: 48832 - DNA, 70 bp, Artificial Sequence
  Synthetic
gccaagcatttaggtgacactatagagtccagggacctccctgaagtttcagagctatgctggaaacagc

SEQ ID NO: 48833 - DNA, 70 bp, Artificial Sequence
  Synthetic
gccaagcatttaggtgacactatagcgagcaaaaaacctttctgtgtttcagagctatgctggaaacagc

SEQ ID NO: 48834 - DNA, 70 bp, Artificial Sequence
  Synthetic
gccaagcatttaggtgacactatagttgctttcatgacgctgctggtttcagagctatgctggaaacagc

SEQ ID NO: 48835 - DNA, 70 bp, Artificial Sequence
  Synthetic
gccaagcatttaggtgacactatagagcgaaggcaaggaagtagagtttcagagctatgctggaaacagc

SEQ ID NO: 48836 - DNA, 70 bp, Artificial Sequence
  Synthetic
gccaagcatttaggtgacactatagagatacaaatcttggcttaggtttcagagctatgctggaaacagc

SEQ ID NO: 48837 - DNA, 70 bp, Artificial Sequence
  Synthetic
gccaagcatttaggtgacactataggcggctcggtcgccctgagcgtttcagagctatgctggaaacagc

SEQ ID NO: 48838 - DNA, 70 bp, Artificial Sequence
  Synthetic
gccaagcatttaggtgacactatagggtttctaattcaggagttcgtttcagagctatgctggaaacagc

SEQ ID NO: 48839 - DNA, 70 bp, Artificial Sequence
  Synthetic
gccaagcatttaggtgacactatagttctggggcacaggtgattcgtttcagagctatgctggaaacagc

SEQ ID NO: 48840 - DNA, 70 bp, Artificial Sequence
  Synthetic
gccaagcatttaggtgacactatagtcagagcccatcagtggcaggtttcagagctatgctggaaacagc

SEQ ID NO: 48841 - DNA, 70 bp, Artificial Sequence
  Synthetic
gccaagcatttaggtgacactatagttctggtttttgcagtacaagtttcagagctatgctggaaacagc

SEQ ID NO: 48842 - DNA, 70 bp, Artificial Sequence
  Synthetic
gccaagcatttaggtgacactatagcactgtacgacatttttcaggtttcagagctatgctggaaacagc

SEQ ID NO: 48843 - DNA, 70 bp, Artificial Sequence
  Synthetic
gccaagcatttaggtgacactatagatttttcattggggaactctgtttcagagctatgctggaaacagc

SEQ ID NO: 48844 - DNA, 70 bp, Artificial Sequence
  Synthetic
gccaagcatttaggtgacactatagttctaggtcccaccgctcaggtttcagagctatgctggaaacagc

SEQ ID NO: 48845 - DNA, 70 bp, Artificial Sequence
  Synthetic
gccaagcatttaggtgacactataggccatccatctgcgattgaggtttcagagctatgctggaaacagc

SEQ ID NO: 48846 - DNA, 70 bp, Artificial Sequence
  Synthetic
gccaagcatttaggtgacactatagctggagaaaagcatcgtgacgtttcagagctatgctggaaacagc

SEQ ID NO: 48847 - DNA, 70 bp, Artificial Sequence
  Synthetic
gccaagcatttaggtgacactatagccggttccctgggctcatccgtttcagagctatgctggaaacagc

SEQ ID NO: 48848 - DNA, 70 bp, Artificial Sequence
  Synthetic
gccaagcatttaggtgacactatagtctctactgactagatttgggtttcagagctatgctggaaacagc

SEQ ID NO: 48849 - DNA, 70 bp, Artificial Sequence
  Synthetic
gccaagcatttaggtgacactatagaactctatcccttgactagtgtttcagagctatgctggaaacagc

SEQ ID NO: 48850 - DNA, 70 bp, Artificial Sequence
  Synthetic
gccaagcatttaggtgacactatagagaatgtcaatgatcaaaccgtttcagagctatgctggaaacagc

SEQ ID NO: 48851 - DNA, 70 bp, Artificial Sequence
  Synthetic
gccaagcatttaggtgacactatagttcctagacatccaccggatgtttcagagctatgctggaaacagc

SEQ ID NO: 48852 - DNA, 70 bp, Artificial Sequence
  Synthetic
gccaagcatttaggtgacactatagcacaaacccagggagtcagggtttcagagctatgctggaaacagc

SEQ ID NO: 48853 - DNA, 70 bp, Artificial Sequence
  Synthetic
gccaagcatttaggtgacactatagggtcaaataggtctaattgggtttcagagctatgctggaaacagc

SEQ ID NO: 48854 - DNA, 70 bp, Artificial Sequence
  Synthetic
gccaagcatttaggtgacactataggcccggaacctgggcttatagtttcagagctatgctggaaacagc

SEQ ID NO: 48855 - DNA, 70 bp, Artificial Sequence
  Synthetic
gccaagcatttaggtgacactatagtgaatctaagggatctggaagtttcagagctatgctggaaacagc

SEQ ID NO: 48856 - DNA, 70 bp, Artificial Sequence
  Synthetic
gccaagcatttaggtgacactatagtgggggctcttggagcctaggtttcagagctatgctggaaacagc

SEQ ID NO: 48857 - DNA, 70 bp, Artificial Sequence
  Synthetic
gccaagcatttaggtgacactatagccatagcttagtgcccacccgtttcagagctatgctggaaacagc

SEQ ID NO: 48858 - DNA, 70 bp, Artificial Sequence
  Synthetic
gccaagcatttaggtgacactatagcctcttgatagatgtcactcgtttcagagctatgctggaaacagc

SEQ ID NO: 48859 - DNA, 70 bp, Artificial Sequence
  Synthetic
gccaagcatttaggtgacactatagggtggccagcgccaacctgcgtttcagagctatgctggaaacagc

SEQ ID NO: 48860 - DNA, 70 bp, Artificial Sequence
  Synthetic
gccaagcatttaggtgacactatagcctatcccgactatcgttgcgtttcagagctatgctggaaacagc

SEQ ID NO: 48861 - DNA, 70 bp, Artificial Sequence
  Synthetic
gccaagcatttaggtgacactatagtatttattgctctgccccctgtttcagagctatgctggaaacagc

SEQ ID NO: 48862 - DNA, 70 bp, Artificial Sequence
  Synthetic
gccaagcatttaggtgacactatagttcggatatgggtagtatgagtttcagagctatgctggaaacagc

SEQ ID NO: 48863 - DNA, 70 bp, Artificial Sequence
  Synthetic
gccaagcatttaggtgacactatagataacatttcggccaccaccgtttcagagctatgctggaaacagc

SEQ ID NO: 48864 - DNA, 70 bp, Artificial Sequence
  Synthetic
gccaagcatttaggtgacactatagccacatgttggcggatgcaggtttcagagctatgctggaaacagc

SEQ ID NO: 48865 - DNA, 70 bp, Artificial Sequence
  Synthetic
gccaagcatttaggtgacactatagtgaaggggctgaggttgacagtttcagagctatgctggaaacagc

SEQ ID NO: 48866 - DNA, 70 bp, Artificial Sequence
  Synthetic
gccaagcatttaggtgacactatagggcttctcactctgccccaggtttcagagctatgctggaaacagc

SEQ ID NO: 48867 - DNA, 70 bp, Artificial Sequence
  Synthetic
gccaagcatttaggtgacactataggttccatcagtcgttttcctgtttcagagctatgctggaaacagc

SEQ ID NO: 48868 - DNA, 70 bp, Artificial Sequence
  Synthetic
gccaagcatttaggtgacactatagcaacactgcagccagataaggtttcagagctatgctggaaacagc

SEQ ID NO: 48869 - DNA, 70 bp, Artificial Sequence
  Synthetic
gccaagcatttaggtgacactatagaaagaagaggtccacattcagtttcagagctatgctggaaacagc

SEQ ID NO: 48870 - DNA, 70 bp, Artificial Sequence
  Synthetic
gccaagcatttaggtgacactatagcgccaccgccccaatggggtgtttcagagctatgctggaaacagc

SEQ ID NO: 48871 - DNA, 70 bp, Artificial Sequence
  Synthetic
gccaagcatttaggtgacactatagatgcaacgtatgcgatgaaagtttcagagctatgctggaaacagc

SEQ ID NO: 48872 - DNA, 70 bp, Artificial Sequence
  Synthetic
gccaagcatttaggtgacactatagaatcaccccagggattcgtagtttcagagctatgctggaaacagc

SEQ ID NO: 48873 - DNA, 70 bp, Artificial Sequence
  Synthetic
gccaagcatttaggtgacactatagattggtgacagctgtcatgagtttcagagctatgctggaaacagc

SEQ ID NO: 48874 - DNA, 70 bp, Artificial Sequence
  Synthetic
gccaagcatttaggtgacactatagtcttgcacactagtgtagaagtttcagagctatgctggaaacagc

SEQ ID NO: 48875 - DNA, 70 bp, Artificial Sequence
  Synthetic
gccaagcatttaggtgacactatagcaagcgtcctgctaacgagagtttcagagctatgctggaaacagc

SEQ ID NO: 48876 - DNA, 70 bp, Artificial Sequence
  Synthetic
gccaagcatttaggtgacactatagctcggctgaggtttttttgagtttcagagctatgctggaaacagc

SEQ ID NO: 48877 - DNA, 70 bp, Artificial Sequence
  Synthetic
gccaagcatttaggtgacactatagattgatttagaagacacagggtttcagagctatgctggaaacagc

SEQ ID NO: 48878 - DNA, 70 bp, Artificial Sequence
  Synthetic
gccaagcatttaggtgacactatagacacaagcagctgacaaaatgtttcagagctatgctggaaacagc

SEQ ID NO: 48879 - DNA, 70 bp, Artificial Sequence
  Synthetic
gccaagcatttaggtgacactatagctcactgttctgcccttcaggtttcagagctatgctggaaacagc

SEQ ID NO: 48880 - DNA, 70 bp, Artificial Sequence
  Synthetic
gccaagcatttaggtgacactatagaatgaatggctcctcaagtagtttcagagctatgctggaaacagc

SEQ ID NO: 48881 - DNA, 70 bp, Artificial Sequence
  Synthetic
gccaagcatttaggtgacactatagaaggggagtctcagcgaccagtttcagagctatgctggaaacagc

SEQ ID NO: 48882 - DNA, 70 bp, Artificial Sequence
  Synthetic
gccaagcatttaggtgacactataggagactgaggcccacgcttggtttcagagctatgctggaaacagc

SEQ ID NO: 48883 - DNA, 70 bp, Artificial Sequence
  Synthetic
gccaagcatttaggtgacactatagggaaagaggctctcactttggtttcagagctatgctggaaacagc

SEQ ID NO: 48884 - DNA, 70 bp, Artificial Sequence
  Synthetic
gccaagcatttaggtgacactatagctcagcacaagccacgactggtttcagagctatgctggaaacagc

SEQ ID NO: 48885 - DNA, 70 bp, Artificial Sequence
  Synthetic
gccaagcatttaggtgacactatagtatgggaccatcttatttgagtttcagagctatgctggaaacagc

SEQ ID NO: 48886 - DNA, 70 bp, Artificial Sequence
  Synthetic
gccaagcatttaggtgacactataggtgagagcttccttcaaatggtttcagagctatgctggaaacagc

SEQ ID NO: 48887 - DNA, 70 bp, Artificial Sequence
  Synthetic
gccaagcatttaggtgacactatagtggccggcttcctgcgatgagtttcagagctatgctggaaacagc

SEQ ID NO: 48888 - DNA, 70 bp, Artificial Sequence
  Synthetic
gccaagcatttaggtgacactatagaggccactaatgagggcacagtttcagagctatgctggaaacagc

SEQ ID NO: 48889 - DNA, 70 bp, Artificial Sequence
  Synthetic
gccaagcatttaggtgacactataggaatgttttagggggttgctgtttcagagctatgctggaaacagc

SEQ ID NO: 48890 - DNA, 70 bp, Artificial Sequence
  Synthetic
gccaagcatttaggtgacactatagacacgccaccccttggctctgtttcagagctatgctggaaacagc

SEQ ID NO: 48891 - DNA, 70 bp, Artificial Sequence
  Synthetic
gccaagcatttaggtgacactatagttaagaagagcattgaactggtttcagagctatgctggaaacagc

SEQ ID NO: 48892 - DNA, 70 bp, Artificial Sequence
  Synthetic
gccaagcatttaggtgacactataggcagatgggcagctcaggccgtttcagagctatgctggaaacagc

SEQ ID NO: 48893 - DNA, 70 bp, Artificial Sequence
  Synthetic
gccaagcatttaggtgacactatagctaatgactctgtcactaaggtttcagagctatgctggaaacagc

SEQ ID NO: 48894 - DNA, 70 bp, Artificial Sequence
  Synthetic
gccaagcatttaggtgacactatagtggacgtaaagtggggatgcgtttcagagctatgctggaaacagc

SEQ ID NO: 48895 - DNA, 70 bp, Artificial Sequence
  Synthetic
gccaagcatttaggtgacactatagtagccgagactggagcctaggtttcagagctatgctggaaacagc

SEQ ID NO: 48896 - DNA, 70 bp, Artificial Sequence
  Synthetic
gccaagcatttaggtgacactatagatcaagttaaatacctaggcgtttcagagctatgctggaaacagc

SEQ ID NO: 48897 - DNA, 70 bp, Artificial Sequence
  Synthetic
gccaagcatttaggtgacactataggattaagcttcttgctgagcgtttcagagctatgctggaaacagc

SEQ ID NO: 48898 - DNA, 70 bp, Artificial Sequence
  Synthetic
gccaagcatttaggtgacactatagggggccggggagctcttcaagtttcagagctatgctggaaacagc

SEQ ID NO: 48899 - DNA, 70 bp, Artificial Sequence
  Synthetic
gccaagcatttaggtgacactatagaaaactgcaaatacaggaaggtttcagagctatgctggaaacagc

SEQ ID NO: 48900 - DNA, 70 bp, Artificial Sequence
  Synthetic
gccaagcatttaggtgacactatagcgactacatggacatttgaggtttcagagctatgctggaaacagc

SEQ ID NO: 48901 - DNA, 70 bp, Artificial Sequence
  Synthetic
gccaagcatttaggtgacactatagggggccagtgctaggaactcgtttcagagctatgctggaaacagc

SEQ ID NO: 48902 - DNA, 70 bp, Artificial Sequence
  Synthetic
gccaagcatttaggtgacactatagggggcctctgctagaactgcgtttcagagctatgctggaaacagc

SEQ ID NO: 48903 - DNA, 70 bp, Artificial Sequence
  Synthetic
gccaagcatttaggtgacactatagaggggccctcgcggcctcaggtttcagagctatgctggaaacagc

SEQ ID NO: 48904 - DNA, 70 bp, Artificial Sequence
  Synthetic
gccaagcatttaggtgacactatagagtttgtgcgaatgatgtctgtttcagagctatgctggaaacagc

SEQ ID NO: 48905 - DNA, 70 bp, Artificial Sequence
  Synthetic
gccaagcatttaggtgacactatagattccctcctggagcctcaggtttcagagctatgctggaaacagc

SEQ ID NO: 48906 - DNA, 70 bp, Artificial Sequence
  Synthetic
gccaagcatttaggtgacactatagaagatgatgtctcgctgagggtttcagagctatgctggaaacagc

SEQ ID NO: 48907 - DNA, 70 bp, Artificial Sequence
  Synthetic
gccaagcatttaggtgacactataggccaaccaggtgctgcgcaggtttcagagctatgctggaaacagc

SEQ ID NO: 48908 - DNA, 70 bp, Artificial Sequence
  Synthetic
gccaagcatttaggtgacactatagagacacctccacaactgaaagtttcagagctatgctggaaacagc

SEQ ID NO: 48909 - DNA, 70 bp, Artificial Sequence
  Synthetic
gccaagcatttaggtgacactatagacgtttgtgagcagtagtcagtttcagagctatgctggaaacagc

SEQ ID NO: 48910 - DNA, 70 bp, Artificial Sequence
  Synthetic
gccaagcatttaggtgacactatagggggaatcaacagctgaatagtttcagagctatgctggaaacagc

SEQ ID NO: 48911 - DNA, 70 bp, Artificial Sequence
  Synthetic
gccaagcatttaggtgacactatagcctggagggggagctgtgaagtttcagagctatgctggaaacagc

SEQ ID NO: 48912 - DNA, 70 bp, Artificial Sequence
  Synthetic
gccaagcatttaggtgacactatagtggacagtccaggcctcactgtttcagagctatgctggaaacagc

SEQ ID NO: 48913 - DNA, 70 bp, Artificial Sequence
  Synthetic
gccaagcatttaggtgacactatagatcgacagtgtgtaccgtgagtttcagagctatgctggaaacagc

SEQ ID NO: 48914 - DNA, 70 bp, Artificial Sequence
  Synthetic
gccaagcatttaggtgacactataggccgagagcacatggcgcacgtttcagagctatgctggaaacagc

SEQ ID NO: 48915 - DNA, 70 bp, Artificial Sequence
  Synthetic
gccaagcatttaggtgacactatagacagcgagagtgacgatgatgtttcagagctatgctggaaacagc

SEQ ID NO: 48916 - DNA, 70 bp, Artificial Sequence
  Synthetic
gccaagcatttaggtgacactataggtgagactgggaggtcaggggtttcagagctatgctggaaacagc

SEQ ID NO: 48917 - DNA, 70 bp, Artificial Sequence
  Synthetic
gccaagcatttaggtgacactatagcacggtgcagctagcaccaggtttcagagctatgctggaaacagc

SEQ ID NO: 48918 - DNA, 70 bp, Artificial Sequence
  Synthetic
gccaagcatttaggtgacactatagcatctggcagcgcccactacgtttcagagctatgctggaaacagc

SEQ ID NO: 48919 - DNA, 70 bp, Artificial Sequence
  Synthetic
gccaagcatttaggtgacactataggcccctcgctgggggctacagtttcagagctatgctggaaacagc

SEQ ID NO: 48920 - DNA, 70 bp, Artificial Sequence
  Synthetic
gccaagcatttaggtgacactatagaagaagatgacaaatgctaggtttcagagctatgctggaaacagc

SEQ ID NO: 48921 - DNA, 70 bp, Artificial Sequence
  Synthetic
gccaagcatttaggtgacactatagggggaggggtgggaattcaggtttcagagctatgctggaaacagc

SEQ ID NO: 48922 - DNA, 70 bp, Artificial Sequence
  Synthetic
gccaagcatttaggtgacactataggaaagtggggcaggactcaggtttcagagctatgctggaaacagc

SEQ ID NO: 48923 - DNA, 70 bp, Artificial Sequence
  Synthetic
gccaagcatttaggtgacactataggcagatgaccccgtgtagctgtttcagagctatgctggaaacagc

SEQ ID NO: 48924 - DNA, 70 bp, Artificial Sequence
  Synthetic
gccaagcatttaggtgacactatagccagcaagaggaagagatgagtttcagagctatgctggaaacagc

SEQ ID NO: 48925 - DNA, 70 bp, Artificial Sequence
  Synthetic
gccaagcatttaggtgacactatagctgtgtgggcatcacagcctgtttcagagctatgctggaaacagc

SEQ ID NO: 48926 - DNA, 70 bp, Artificial Sequence
  Synthetic
gccaagcatttaggtgacactatagtctgcattgaaaatctcttcgtttcagagctatgctggaaacagc

SEQ ID NO: 48927 - DNA, 70 bp, Artificial Sequence
  Synthetic
gccaagcatttaggtgacactatagttttagaaggtcataacagggtttcagagctatgctggaaacagc

SEQ ID NO: 48928 - DNA, 70 bp, Artificial Sequence
  Synthetic
gccaagcatttaggtgacactataggggtggggcagggtgctcaggtttcagagctatgctggaaacagc

SEQ ID NO: 48929 - DNA, 70 bp, Artificial Sequence
  Synthetic
gccaagcatttaggtgacactatagtgcttttgatgctcttctcagtttcagagctatgctggaaacagc

SEQ ID NO: 48930 - DNA, 70 bp, Artificial Sequence
  Synthetic
gccaagcatttaggtgacactatagaggctgggtggtgtcaccgcgtttcagagctatgctggaaacagc

SEQ ID NO: 48931 - DNA, 70 bp, Artificial Sequence
  Synthetic
gccaagcatttaggtgacactatagaggcgtctacattcgctgaggtttcagagctatgctggaaacagc

SEQ ID NO: 48932 - DNA, 70 bp, Artificial Sequence
  Synthetic
gccaagcatttaggtgacactataggcaggaacatgccatgtagtgtttcagagctatgctggaaacagc

SEQ ID NO: 48933 - DNA, 70 bp, Artificial Sequence
  Synthetic
gccaagcatttaggtgacactatagcacaaacgggcaaaactcatgtttcagagctatgctggaaacagc

SEQ ID NO: 48934 - DNA, 70 bp, Artificial Sequence
  Synthetic
gccaagcatttaggtgacactatagaggctgtcagtagctatcctgtttcagagctatgctggaaacagc

SEQ ID NO: 48935 - DNA, 70 bp, Artificial Sequence
  Synthetic
gccaagcatttaggtgacactatagattagactcaaagcctatgtgtttcagagctatgctggaaacagc

SEQ ID NO: 48936 - DNA, 70 bp, Artificial Sequence
  Synthetic
gccaagcatttaggtgacactataggccgcaggagggttagtgctgtttcagagctatgctggaaacagc

SEQ ID NO: 48937 - DNA, 70 bp, Artificial Sequence
  Synthetic
gccaagcatttaggtgacactatagcgaggcccgcggtctttatagtttcagagctatgctggaaacagc

SEQ ID NO: 48938 - DNA, 70 bp, Artificial Sequence
  Synthetic
gccaagcatttaggtgacactatagaggtcagaggtcagttcagagtttcagagctatgctggaaacagc

SEQ ID NO: 48939 - DNA, 70 bp, Artificial Sequence
  Synthetic
gccaagcatttaggtgacactatagaaagggcaggcggctcacacgtttcagagctatgctggaaacagc

SEQ ID NO: 48940 - DNA, 70 bp, Artificial Sequence
  Synthetic
gccaagcatttaggtgacactataggggggcggccgaggctcagcgtttcagagctatgctggaaacagc

SEQ ID NO: 48941 - DNA, 70 bp, Artificial Sequence
  Synthetic
gccaagcatttaggtgacactataggtctcacgcgtggctctagggtttcagagctatgctggaaacagc

SEQ ID NO: 48942 - DNA, 70 bp, Artificial Sequence
  Synthetic
gccaagcatttaggtgacactatagtccgaggggcgggcctcagcgtttcagagctatgctggaaacagc

SEQ ID NO: 48943 - DNA, 70 bp, Artificial Sequence
  Synthetic
gccaagcatttaggtgacactatagggaaaaccacgcctgtgtaggtttcagagctatgctggaaacagc

SEQ ID NO: 48944 - DNA, 70 bp, Artificial Sequence
  Synthetic
gccaagcatttaggtgacactataggctaccgctatcggcggtgagtttcagagctatgctggaaacagc

SEQ ID NO: 48945 - DNA, 70 bp, Artificial Sequence
  Synthetic
gccaagcatttaggtgacactatagcattcactatctgtacccccgtttcagagctatgctggaaacagc

SEQ ID NO: 48946 - DNA, 70 bp, Artificial Sequence
  Synthetic
gccaagcatttaggtgacactataggaagcaagccaaaggagacagtttcagagctatgctggaaacagc

SEQ ID NO: 48947 - DNA, 70 bp, Artificial Sequence
  Synthetic
gccaagcatttaggtgacactatagaccgtgctgggccgtttctagtttcagagctatgctggaaacagc

SEQ ID NO: 48948 - DNA, 70 bp, Artificial Sequence
  Synthetic
gccaagcatttaggtgacactataggctataatcaatgcagaagggtttcagagctatgctggaaacagc

SEQ ID NO: 48949 - DNA, 70 bp, Artificial Sequence
  Synthetic
gccaagcatttaggtgacactatagttttctcttcagcattgactgtttcagagctatgctggaaacagc

SEQ ID NO: 48950 - DNA, 70 bp, Artificial Sequence
  Synthetic
gccaagcatttaggtgacactataggtcaggaggggacgacaagagtttcagagctatgctggaaacagc

SEQ ID NO: 48951 - DNA, 70 bp, Artificial Sequence
  Synthetic
gccaagcatttaggtgacactatagcgacggacacaagaggaaaggtttcagagctatgctggaaacagc

SEQ ID NO: 48952 - DNA, 70 bp, Artificial Sequence
  Synthetic
gccaagcatttaggtgacactatagcagcatgaaggacagcgatggtttcagagctatgctggaaacagc

SEQ ID NO: 48953 - DNA, 70 bp, Artificial Sequence
  Synthetic
gccaagcatttaggtgacactataggacagtgacgaagaagaagagtttcagagctatgctggaaacagc

SEQ ID NO: 48954 - DNA, 70 bp, Artificial Sequence
  Synthetic
gccaagcatttaggtgacactatagaggatacaggctgggcgcgggtttcagagctatgctggaaacagc

SEQ ID NO: 48955 - DNA, 70 bp, Artificial Sequence
  Synthetic
gccaagcatttaggtgacactatagtggttttctggctttttctcgtttcagagctatgctggaaacagc

SEQ ID NO: 48956 - DNA, 70 bp, Artificial Sequence
  Synthetic
gccaagcatttaggtgacactatagtgctcttattctctgtgctggtttcagagctatgctggaaacagc

SEQ ID NO: 48957 - DNA, 70 bp, Artificial Sequence
  Synthetic
gccaagcatttaggtgacactatagagcgagccccccatgtaaaggtttcagagctatgctggaaacagc

SEQ ID NO: 48958 - DNA, 70 bp, Artificial Sequence
  Synthetic
gccaagcatttaggtgacactatagtctcgtacagatccttcaaagtttcagagctatgctggaaacagc

SEQ ID NO: 48959 - DNA, 70 bp, Artificial Sequence
  Synthetic
gccaagcatttaggtgacactatagaggaaagggaggagtttagtgtttcagagctatgctggaaacagc

SEQ ID NO: 48960 - DNA, 70 bp, Artificial Sequence
  Synthetic
gccaagcatttaggtgacactatagattcagctgctcaggcttgagtttcagagctatgctggaaacagc

SEQ ID NO: 48961 - DNA, 70 bp, Artificial Sequence
  Synthetic
gccaagcatttaggtgacactatagattcatctgctcaggcttgagtttcagagctatgctggaaacagc

SEQ ID NO: 48962 - DNA, 70 bp, Artificial Sequence
  Synthetic
gccaagcatttaggtgacactataggagggagtaagatcactcaagtttcagagctatgctggaaacagc

SEQ ID NO: 48963 - DNA, 70 bp, Artificial Sequence
  Synthetic
gccaagcatttaggtgacactataggttgggatactcagagagaggtttcagagctatgctggaaacagc

SEQ ID NO: 48964 - DNA, 70 bp, Artificial Sequence
  Synthetic
gccaagcatttaggtgacactatagtctcagcactctcctcgcctgtttcagagctatgctggaaacagc

SEQ ID NO: 48965 - DNA, 70 bp, Artificial Sequence
  Synthetic
gccaagcatttaggtgacactatagtgtcctagtgaacacttaaagtttcagagctatgctggaaacagc

SEQ ID NO: 48966 - DNA, 70 bp, Artificial Sequence
  Synthetic
gccaagcatttaggtgacactatagtaaggtcacttcccccactagtttcagagctatgctggaaacagc

SEQ ID NO: 48967 - DNA, 70 bp, Artificial Sequence
  Synthetic
gccaagcatttaggtgacactatagacctacttcagcaaagtgtggtttcagagctatgctggaaacagc

SEQ ID NO: 48968 - DNA, 70 bp, Artificial Sequence
  Synthetic
gccaagcatttaggtgacactataggccctgctcccctcctaagggtttcagagctatgctggaaacagc

SEQ ID NO: 48969 - DNA, 70 bp, Artificial Sequence
  Synthetic
gccaagcatttaggtgacactatagtcacaacacaccgacgtgtagtttcagagctatgctggaaacagc

SEQ ID NO: 48970 - DNA, 70 bp, Artificial Sequence
  Synthetic
gccaagcatttaggtgacactatagaatgaggaagacagatcaaggtttcagagctatgctggaaacagc

SEQ ID NO: 48971 - DNA, 70 bp, Artificial Sequence
  Synthetic
gccaagcatttaggtgacactatagggtggatgagctacatattggtttcagagctatgctggaaacagc

SEQ ID NO: 48972 - DNA, 70 bp, Artificial Sequence
  Synthetic
gccaagcatttaggtgacactatagcttggctttgtagattcatcgtttcagagctatgctggaaacagc

SEQ ID NO: 48973 - DNA, 70 bp, Artificial Sequence
  Synthetic
gccaagcatttaggtgacactataggaagcagatattgatggagagtttcagagctatgctggaaacagc

SEQ ID NO: 48974 - DNA, 70 bp, Artificial Sequence
  Synthetic
gccaagcatttaggtgacactataggaagcagatattgatggtgagtttcagagctatgctggaaacagc

SEQ ID NO: 48975 - DNA, 70 bp, Artificial Sequence
  Synthetic
gccaagcatttaggtgacactatagagatgatgactgcaaagtgagtttcagagctatgctggaaacagc

SEQ ID NO: 48976 - DNA, 70 bp, Artificial Sequence
  Synthetic
gccaagcatttaggtgacactatagtggtgggcgccggcctcactgtttcagagctatgctggaaacagc

SEQ ID NO: 48977 - DNA, 70 bp, Artificial Sequence
  Synthetic
gccaagcatttaggtgacactatagttcctggacgggactattgagtttcagagctatgctggaaacagc

SEQ ID NO: 48978 - DNA, 70 bp, Artificial Sequence
  Synthetic
gccaagcatttaggtgacactatagaggatgctcgcccaggagtggtttcagagctatgctggaaacagc

SEQ ID NO: 48979 - DNA, 70 bp, Artificial Sequence
  Synthetic
gccaagcatttaggtgacactataggctgcggcagctgcacctacgtttcagagctatgctggaaacagc

SEQ ID NO: 48980 - DNA, 70 bp, Artificial Sequence
  Synthetic
gccaagcatttaggtgacactatagccagatactccggagcggcagtttcagagctatgctggaaacagc

SEQ ID NO: 48981 - DNA, 70 bp, Artificial Sequence
  Synthetic
gccaagcatttaggtgacactataggccaaggacgagctgtagaggtttcagagctatgctggaaacagc

SEQ ID NO: 48982 - DNA, 70 bp, Artificial Sequence
  Synthetic
gccaagcatttaggtgacactatagtgctgtcgggaaaaattaacgtttcagagctatgctggaaacagc

SEQ ID NO: 48983 - DNA, 70 bp, Artificial Sequence
  Synthetic
gccaagcatttaggtgacactataggaactcatcatgccgtactagtttcagagctatgctggaaacagc

SEQ ID NO: 48984 - DNA, 70 bp, Artificial Sequence
  Synthetic
gccaagcatttaggtgacactatagcttgtcaacgatctcctcctgtttcagagctatgctggaaacagc

SEQ ID NO: 48985 - DNA, 70 bp, Artificial Sequence
  Synthetic
gccaagcatttaggtgacactataggggctggagacgtcactgcggtttcagagctatgctggaaacagc

SEQ ID NO: 48986 - DNA, 70 bp, Artificial Sequence
  Synthetic
gccaagcatttaggtgacactatagacactgccccaccagctctagtttcagagctatgctggaaacagc

SEQ ID NO: 48987 - DNA, 70 bp, Artificial Sequence
  Synthetic
gccaagcatttaggtgacactatagctcgtcttcagtgtcagctggtttcagagctatgctggaaacagc

SEQ ID NO: 48988 - DNA, 70 bp, Artificial Sequence
  Synthetic
gccaagcatttaggtgacactataggcactctggaagcaagtgacgtttcagagctatgctggaaacagc

SEQ ID NO: 48989 - DNA, 70 bp, Artificial Sequence
  Synthetic
gccaagcatttaggtgacactatagcactgccgggcagggcagacgtttcagagctatgctggaaacagc

SEQ ID NO: 48990 - DNA, 70 bp, Artificial Sequence
  Synthetic
gccaagcatttaggtgacactatagcgtccacttccacagatctggtttcagagctatgctggaaacagc

SEQ ID NO: 48991 - DNA, 70 bp, Artificial Sequence
  Synthetic
gccaagcatttaggtgacactatagcttcactgcagcggggccacgtttcagagctatgctggaaacagc

SEQ ID NO: 48992 - DNA, 70 bp, Artificial Sequence
  Synthetic
gccaagcatttaggtgacactatagaccaaaaagctttctgctaggtttcagagctatgctggaaacagc

SEQ ID NO: 48993 - DNA, 70 bp, Artificial Sequence
  Synthetic
gccaagcatttaggtgacactatagatgttcattttcatcgctcggtttcagagctatgctggaaacagc

SEQ ID NO: 48994 - DNA, 70 bp, Artificial Sequence
  Synthetic
gccaagcatttaggtgacactatagatttacttgatgggtactgtgtttcagagctatgctggaaacagc

SEQ ID NO: 48995 - DNA, 70 bp, Artificial Sequence
  Synthetic
gccaagcatttaggtgacactatagtctttgtggcaaaacatctagtttcagagctatgctggaaacagc

SEQ ID NO: 48996 - DNA, 70 bp, Artificial Sequence
  Synthetic
gccaagcatttaggtgacactatagctcactgcagcggtgcggcagtttcagagctatgctggaaacagc

SEQ ID NO: 48997 - DNA, 70 bp, Artificial Sequence
  Synthetic
gccaagcatttaggtgacactatagttatttcttgccgggcgcgggtttcagagctatgctggaaacagc

SEQ ID NO: 48998 - DNA, 70 bp, Artificial Sequence
  Synthetic
gccaagcatttaggtgacactatagctttgggggagttagacaccgtttcagagctatgctggaaacagc

SEQ ID NO: 48999 - DNA, 70 bp, Artificial Sequence
  Synthetic
gccaagcatttaggtgacactatagcgcgcgcggccagggatgttgtttcagagctatgctggaaacagc

SEQ ID NO: 49000 - DNA, 70 bp, Artificial Sequence
  Synthetic
gccaagcatttaggtgacactatagaaggaagctgtttagtactcgtttcagagctatgctggaaacagc

SEQ ID NO: 49001 - DNA, 70 bp, Artificial Sequence
  Synthetic
gccaagcatttaggtgacactatagccaccagtacttacaccagtgtttcagagctatgctggaaacagc

SEQ ID NO: 49002 - DNA, 70 bp, Artificial Sequence
  Synthetic
gccaagcatttaggtgacactatagccccggcgtccaggaagacggtttcagagctatgctggaaacagc

SEQ ID NO: 49003 - DNA, 70 bp, Artificial Sequence
  Synthetic
gccaagcatttaggtgacactatagagacagggactcacattcccgtttcagagctatgctggaaacagc

SEQ ID NO: 49004 - DNA, 70 bp, Artificial Sequence
  Synthetic
gccaagcatttaggtgacactataggagcgatccaggcagctactgtttcagagctatgctggaaacagc

SEQ ID NO: 49005 - DNA, 70 bp, Artificial Sequence
  Synthetic
gccaagcatttaggtgacactatagggaggaagtgctcttgtgaggtttcagagctatgctggaaacagc

SEQ ID NO: 49006 - DNA, 70 bp, Artificial Sequence
  Synthetic
gccaagcatttaggtgacactatagtggctggacaggcgggtgtggtttcagagctatgctggaaacagc

SEQ ID NO: 49007 - DNA, 70 bp, Artificial Sequence
  Synthetic
gccaagcatttaggtgacactatagttggtcaaaataagcagaaggtttcagagctatgctggaaacagc

SEQ ID NO: 49008 - DNA, 70 bp, Artificial Sequence
  Synthetic
gccaagcatttaggtgacactatagagggaggaggccagctgagtgtttcagagctatgctggaaacagc

SEQ ID NO: 49009 - DNA, 70 bp, Artificial Sequence
  Synthetic
gccaagcatttaggtgacactataggacttcgcccattttgctatgtttcagagctatgctggaaacagc

SEQ ID NO: 49010 - DNA, 70 bp, Artificial Sequence
  Synthetic
gccaagcatttaggtgacactatagcacacactaggactctgtccgtttcagagctatgctggaaacagc

SEQ ID NO: 49011 - DNA, 70 bp, Artificial Sequence
  Synthetic
gccaagcatttaggtgacactatagaccggggtcatttacgagtcgtttcagagctatgctggaaacagc

SEQ ID NO: 49012 - DNA, 70 bp, Artificial Sequence
  Synthetic
gccaagcatttaggtgacactatagtcccaacttctatgccttaggtttcagagctatgctggaaacagc

SEQ ID NO: 49013 - DNA, 70 bp, Artificial Sequence
  Synthetic
gccaagcatttaggtgacactatagaccgcccgggtggggctattgtttcagagctatgctggaaacagc

SEQ ID NO: 49014 - DNA, 70 bp, Artificial Sequence
  Synthetic
gccaagcatttaggtgacactatagaaagcaatgtcacattgctagtttcagagctatgctggaaacagc

SEQ ID NO: 49015 - DNA, 70 bp, Artificial Sequence
  Synthetic
gccaagcatttaggtgacactatagcacggtgttgagaacacagtgtttcagagctatgctggaaacagc

SEQ ID NO: 49016 - DNA, 70 bp, Artificial Sequence
  Synthetic
gccaagcatttaggtgacactatagctgtatgtcttcaagttcctgtttcagagctatgctggaaacagc

SEQ ID NO: 49017 - DNA, 70 bp, Artificial Sequence
  Synthetic
gccaagcatttaggtgacactatagtaccaaaagagaggcaccgcgtttcagagctatgctggaaacagc

SEQ ID NO: 49018 - DNA, 70 bp, Artificial Sequence
  Synthetic
gccaagcatttaggtgacactatagttccaatgtgtcagccctcagtttcagagctatgctggaaacagc

SEQ ID NO: 49019 - DNA, 70 bp, Artificial Sequence
  Synthetic
gccaagcatttaggtgacactatagcgcctcgtgcagtcttaacagtttcagagctatgctggaaacagc

SEQ ID NO: 49020 - DNA, 70 bp, Artificial Sequence
  Synthetic
gccaagcatttaggtgacactatagccgggactggccacatgaccgtttcagagctatgctggaaacagc

SEQ ID NO: 49021 - DNA, 70 bp, Artificial Sequence
  Synthetic
gccaagcatttaggtgacactatagcagttctaaccctgagctgggtttcagagctatgctggaaacagc

SEQ ID NO: 49022 - DNA, 70 bp, Artificial Sequence
  Synthetic
gccaagcatttaggtgacactatagagcccccagcacagactcaagtttcagagctatgctggaaacagc

SEQ ID NO: 49023 - DNA, 70 bp, Artificial Sequence
  Synthetic
gccaagcatttaggtgacactatagatcggaagcgtgaaatacgagtttcagagctatgctggaaacagc

SEQ ID NO: 49024 - DNA, 70 bp, Artificial Sequence
  Synthetic
gccaagcatttaggtgacactatagagattgtttcactctcttcggtttcagagctatgctggaaacagc

SEQ ID NO: 49025 - DNA, 70 bp, Artificial Sequence
  Synthetic
gccaagcatttaggtgacactatagaccacagtgacagaaattgcgtttcagagctatgctggaaacagc

SEQ ID NO: 49026 - DNA, 70 bp, Artificial Sequence
  Synthetic
gccaagcatttaggtgacactatagcactgaacctgcagaaattagtttcagagctatgctggaaacagc

SEQ ID NO: 49027 - DNA, 70 bp, Artificial Sequence
  Synthetic
gccaagcatttaggtgacactatagttttcaaggactggaaatgagtttcagagctatgctggaaacagc

SEQ ID NO: 49028 - DNA, 70 bp, Artificial Sequence
  Synthetic
gccaagcatttaggtgacactatagcagctgaccatgtttgcatggtttcagagctatgctggaaacagc

SEQ ID NO: 49029 - DNA, 70 bp, Artificial Sequence
  Synthetic
gccaagcatttaggtgacactataggcagtgatgaaaacctaacagtttcagagctatgctggaaacagc

SEQ ID NO: 49030 - DNA, 70 bp, Artificial Sequence
  Synthetic
gccaagcatttaggtgacactatagagatgaccatgtggggataggtttcagagctatgctggaaacagc

SEQ ID NO: 49031 - DNA, 70 bp, Artificial Sequence
  Synthetic
gccaagcatttaggtgacactatagggaggtggccaccttctcctgtttcagagctatgctggaaacagc

SEQ ID NO: 49032 - DNA, 70 bp, Artificial Sequence
  Synthetic
gccaagcatttaggtgacactatagtgcttcagttgtacatgaccgtttcagagctatgctggaaacagc

SEQ ID NO: 49033 - DNA, 70 bp, Artificial Sequence
  Synthetic
gccaagcatttaggtgacactatagatggcactgtactcctgagagtttcagagctatgctggaaacagc

SEQ ID NO: 49034 - DNA, 70 bp, Artificial Sequence
  Synthetic
gccaagcatttaggtgacactatagggcatggtggtcacagcggtgtttcagagctatgctggaaacagc

SEQ ID NO: 49035 - DNA, 70 bp, Artificial Sequence
  Synthetic
gccaagcatttaggtgacactatagcagctggatcccgagaatacgtttcagagctatgctggaaacagc

SEQ ID NO: 49036 - DNA, 70 bp, Artificial Sequence
  Synthetic
gccaagcatttaggtgacactatagcagcctggttcaggcatacagtttcagagctatgctggaaacagc

SEQ ID NO: 49037 - DNA, 70 bp, Artificial Sequence
  Synthetic
gccaagcatttaggtgacactataggcaggtgtcagacagccatggtttcagagctatgctggaaacagc

SEQ ID NO: 49038 - DNA, 70 bp, Artificial Sequence
  Synthetic
gccaagcatttaggtgacactataggagctcagtgagatcatcgcgtttcagagctatgctggaaacagc

SEQ ID NO: 49039 - DNA, 70 bp, Artificial Sequence
  Synthetic
gccaagcatttaggtgacactatagagatcacacaacttcagtgagtttcagagctatgctggaaacagc

SEQ ID NO: 49040 - DNA, 70 bp, Artificial Sequence
  Synthetic
gccaagcatttaggtgacactatagtgctgcgtgttggtctgaccgtttcagagctatgctggaaacagc

SEQ ID NO: 49041 - DNA, 70 bp, Artificial Sequence
  Synthetic
gccaagcatttaggtgacactatagggctctcagtacaaagaacagtttcagagctatgctggaaacagc

SEQ ID NO: 49042 - DNA, 70 bp, Artificial Sequence
  Synthetic
gccaagcatttaggtgacactatagctgactatgtattcctgaacgtttcagagctatgctggaaacagc

SEQ ID NO: 49043 - DNA, 70 bp, Artificial Sequence
  Synthetic
gccaagcatttaggtgacactatagttgaccatgtattcctgaaggtttcagagctatgctggaaacagc

SEQ ID NO: 49044 - DNA, 70 bp, Artificial Sequence
  Synthetic
gccaagcatttaggtgacactatagcacgaggtaatattttgtgggtttcagagctatgctggaaacagc

SEQ ID NO: 49045 - DNA, 70 bp, Artificial Sequence
  Synthetic
gccaagcatttaggtgacactatagacttgctgagtgttcatttggtttcagagctatgctggaaacagc

SEQ ID NO: 49046 - DNA, 70 bp, Artificial Sequence
  Synthetic
gccaagcatttaggtgacactatagagggtggagtgattcttctcgtttcagagctatgctggaaacagc

SEQ ID NO: 49047 - DNA, 70 bp, Artificial Sequence
  Synthetic
gccaagcatttaggtgacactataggagcaatttatggaagtagcgtttcagagctatgctggaaacagc

SEQ ID NO: 49048 - DNA, 70 bp, Artificial Sequence
  Synthetic
gccaagcatttaggtgacactatagcggagctgctcacagctgccgtttcagagctatgctggaaacagc

SEQ ID NO: 49049 - DNA, 70 bp, Artificial Sequence
  Synthetic
gccaagcatttaggtgacactatagattaaagactaaatcccccagtttcagagctatgctggaaacagc

SEQ ID NO: 49050 - DNA, 70 bp, Artificial Sequence
  Synthetic
gccaagcatttaggtgacactatagggcaatggcaaggttgattagtttcagagctatgctggaaacagc

SEQ ID NO: 49051 - DNA, 70 bp, Artificial Sequence
  Synthetic
gccaagcatttaggtgacactataggtcatgtgcttaaagcttccgtttcagagctatgctggaaacagc

SEQ ID NO: 49052 - DNA, 70 bp, Artificial Sequence
  Synthetic
gccaagcatttaggtgacactatagaagatactcagctacaagatgtttcagagctatgctggaaacagc

SEQ ID NO: 49053 - DNA, 70 bp, Artificial Sequence
  Synthetic
gccaagcatttaggtgacactatagaagatccttagctacaagatgtttcagagctatgctggaaacagc

SEQ ID NO: 49054 - DNA, 70 bp, Artificial Sequence
  Synthetic
gccaagcatttaggtgacactatagcaagaagtgtgttgtgcaacgtttcagagctatgctggaaacagc

SEQ ID NO: 49055 - DNA, 70 bp, Artificial Sequence
  Synthetic
gccaagcatttaggtgacactatagttctcttcaaagcctccaccgtttcagagctatgctggaaacagc

SEQ ID NO: 49056 - DNA, 70 bp, Artificial Sequence
  Synthetic
gccaagcatttaggtgacactatagcaggtctcgatactggtcaagtttcagagctatgctggaaacagc

SEQ ID NO: 49057 - DNA, 70 bp, Artificial Sequence
  Synthetic
gccaagcatttaggtgacactatagagaagctctgaagaatgaccgtttcagagctatgctggaaacagc

SEQ ID NO: 49058 - DNA, 70 bp, Artificial Sequence
  Synthetic
gccaagcatttaggtgacactatagcctggatcggcttaattatcgtttcagagctatgctggaaacagc

SEQ ID NO: 49059 - DNA, 70 bp, Artificial Sequence
  Synthetic
gccaagcatttaggtgacactatagcccagcagcagtgaggcctggtttcagagctatgctggaaacagc

SEQ ID NO: 49060 - DNA, 70 bp, Artificial Sequence
  Synthetic
gccaagcatttaggtgacactataggacgaggaccagctgtgagggtttcagagctatgctggaaacagc

SEQ ID NO: 49061 - DNA, 70 bp, Artificial Sequence
  Synthetic
gccaagcatttaggtgacactatagagaacgctttacgtcagcccgtttcagagctatgctggaaacagc

SEQ ID NO: 49062 - DNA, 70 bp, Artificial Sequence
  Synthetic
gccaagcatttaggtgacactataggaaggggcacggtgcatcatgtttcagagctatgctggaaacagc

SEQ ID NO: 49063 - DNA, 70 bp, Artificial Sequence
  Synthetic
gccaagcatttaggtgacactataggctcgaggcagctgctcaccgtttcagagctatgctggaaacagc

SEQ ID NO: 49064 - DNA, 70 bp, Artificial Sequence
  Synthetic
gccaagcatttaggtgacactatagtgtgtactaagctaatttccgtttcagagctatgctggaaacagc

SEQ ID NO: 49065 - DNA, 70 bp, Artificial Sequence
  Synthetic
gccaagcatttaggtgacactatagttaggtaaagagttgcaaacgtttcagagctatgctggaaacagc

SEQ ID NO: 49066 - DNA, 70 bp, Artificial Sequence
  Synthetic
gccaagcatttaggtgacactatagtcaaatagtacttccttcctgtttcagagctatgctggaaacagc

SEQ ID NO: 49067 - DNA, 70 bp, Artificial Sequence
  Synthetic
gccaagcatttaggtgacactatagcctcaacttgcctcaaagatgtttcagagctatgctggaaacagc

SEQ ID NO: 49068 - DNA, 70 bp, Artificial Sequence
  Synthetic
gccaagcatttaggtgacactataggcccccctaggtcatctgccgtttcagagctatgctggaaacagc

SEQ ID NO: 49069 - DNA, 70 bp, Artificial Sequence
  Synthetic
gccaagcatttaggtgacactataggggtctgtcagagcccccctgtttcagagctatgctggaaacagc

SEQ ID NO: 49070 - DNA, 70 bp, Artificial Sequence
  Synthetic
gccaagcatttaggtgacactatagaagcagggcagaagaggggagtttcagagctatgctggaaacagc

SEQ ID NO: 49071 - DNA, 70 bp, Artificial Sequence
  Synthetic
gccaagcatttaggtgacactatagtgtgtgacaaatgatacgtagtttcagagctatgctggaaacagc

SEQ ID NO: 49072 - DNA, 70 bp, Artificial Sequence
  Synthetic
gccaagcatttaggtgacactataggctgtctaagataggacacggtttcagagctatgctggaaacagc

SEQ ID NO: 49073 - DNA, 70 bp, Artificial Sequence
  Synthetic
gccaagcatttaggtgacactataggggctgatgcagctacaagcgtttcagagctatgctggaaacagc

SEQ ID NO: 49074 - DNA, 70 bp, Artificial Sequence
  Synthetic
gccaagcatttaggtgacactatagtccccctcctgcgcgctgaggtttcagagctatgctggaaacagc

SEQ ID NO: 49075 - DNA, 70 bp, Artificial Sequence
  Synthetic
gccaagcatttaggtgacactatagagcgacaacaccgacactgagtttcagagctatgctggaaacagc

SEQ ID NO: 49076 - DNA, 70 bp, Artificial Sequence
  Synthetic
gccaagcatttaggtgacactatagcattggggccgtttgttaaggtttcagagctatgctggaaacagc

SEQ ID NO: 49077 - DNA, 70 bp, Artificial Sequence
  Synthetic
gccaagcatttaggtgacactatagcaaagaaccagcattgtctagtttcagagctatgctggaaacagc

SEQ ID NO: 49078 - DNA, 70 bp, Artificial Sequence
  Synthetic
gccaagcatttaggtgacactatagtttaacttggctcacagaaagtttcagagctatgctggaaacagc

SEQ ID NO: 49079 - DNA, 70 bp, Artificial Sequence
  Synthetic
gccaagcatttaggtgacactatagcagagcgagagctaaaattggtttcagagctatgctggaaacagc

SEQ ID NO: 49080 - DNA, 70 bp, Artificial Sequence
  Synthetic
gccaagcatttaggtgacactatagtgcttttaatgctcttcagagtttcagagctatgctggaaacagc

SEQ ID NO: 49081 - DNA, 70 bp, Artificial Sequence
  Synthetic
gccaagcatttaggtgacactatagccatgcactacgggagctaggtttcagagctatgctggaaacagc

SEQ ID NO: 49082 - DNA, 70 bp, Artificial Sequence
  Synthetic
gccaagcatttaggtgacactatagctctttttctgcttcttcccgtttcagagctatgctggaaacagc

SEQ ID NO: 49083 - DNA, 70 bp, Artificial Sequence
  Synthetic
gccaagcatttaggtgacactataggagaggagaggatcagggatgtttcagagctatgctggaaacagc

SEQ ID NO: 49084 - DNA, 70 bp, Artificial Sequence
  Synthetic
gccaagcatttaggtgacactatagggcagttgtcagtctgttccgtttcagagctatgctggaaacagc

SEQ ID NO: 49085 - DNA, 70 bp, Artificial Sequence
  Synthetic
gccaagcatttaggtgacactatagtggtccgtaagccacaataagtttcagagctatgctggaaacagc

SEQ ID NO: 49086 - DNA, 70 bp, Artificial Sequence
  Synthetic
gccaagcatttaggtgacactatagagtgctatttgaagtgagacgtttcagagctatgctggaaacagc

SEQ ID NO: 49087 - DNA, 70 bp, Artificial Sequence
  Synthetic
gccaagcatttaggtgacactataggaagagcttcttcagcttctgtttcagagctatgctggaaacagc

SEQ ID NO: 49088 - DNA, 70 bp, Artificial Sequence
  Synthetic
gccaagcatttaggtgacactatagaatggaagcttccagtgagggtttcagagctatgctggaaacagc

SEQ ID NO: 49089 - DNA, 70 bp, Artificial Sequence
  Synthetic
gccaagcatttaggtgacactatagcatttgacaaatcaggcactgtttcagagctatgctggaaacagc

SEQ ID NO: 49090 - DNA, 70 bp, Artificial Sequence
  Synthetic
gccaagcatttaggtgacactataggaccaaaaatcagcgggctggtttcagagctatgctggaaacagc

SEQ ID NO: 49091 - DNA, 70 bp, Artificial Sequence
  Synthetic
gccaagcatttaggtgacactatagctcctgaagtgcttatgaaggtttcagagctatgctggaaacagc

SEQ ID NO: 49092 - DNA, 70 bp, Artificial Sequence
  Synthetic
gccaagcatttaggtgacactatagttaggagtagctgagcaatcgtttcagagctatgctggaaacagc

SEQ ID NO: 49093 - DNA, 70 bp, Artificial Sequence
  Synthetic
gccaagcatttaggtgacactatagttgcatttggttggagcaaggtttcagagctatgctggaaacagc

SEQ ID NO: 49094 - DNA, 70 bp, Artificial Sequence
  Synthetic
gccaagcatttaggtgacactataggcgcagctagcgatttcgacgtttcagagctatgctggaaacagc

SEQ ID NO: 49095 - DNA, 70 bp, Artificial Sequence
  Synthetic
gccaagcatttaggtgacactatagcatcaagccccctccacctggtttcagagctatgctggaaacagc

SEQ ID NO: 49096 - DNA, 70 bp, Artificial Sequence
  Synthetic
gccaagcatttaggtgacactatagagcattcctttaggacttaagtttcagagctatgctggaaacagc

SEQ ID NO: 49097 - DNA, 70 bp, Artificial Sequence
  Synthetic
gccaagcatttaggtgacactatagctcatctctcttgaaaaggtgtttcagagctatgctggaaacagc

SEQ ID NO: 49098 - DNA, 70 bp, Artificial Sequence
  Synthetic
gccaagcatttaggtgacactatagccctgtctcctgggtctattgtttcagagctatgctggaaacagc

SEQ ID NO: 49099 - DNA, 70 bp, Artificial Sequence
  Synthetic
gccaagcatttaggtgacactatagaggcggcgttcactccagcagtttcagagctatgctggaaacagc

SEQ ID NO: 49100 - DNA, 70 bp, Artificial Sequence
  Synthetic
gccaagcatttaggtgacactatagctggagggctcagtccagcagtttcagagctatgctggaaacagc

SEQ ID NO: 49101 - DNA, 70 bp, Artificial Sequence
  Synthetic
gccaagcatttaggtgacactatagagatgtttctacctcttcccgtttcagagctatgctggaaacagc

SEQ ID NO: 49102 - DNA, 70 bp, Artificial Sequence
  Synthetic
gccaagcatttaggtgacactatagacctccctgaaggacagacagtttcagagctatgctggaaacagc

SEQ ID NO: 49103 - DNA, 70 bp, Artificial Sequence
  Synthetic
gccaagcatttaggtgacactatagctcgaccccccatgcgcagggtttcagagctatgctggaaacagc

SEQ ID NO: 49104 - DNA, 70 bp, Artificial Sequence
  Synthetic
gccaagcatttaggtgacactataggctataatgaaagtgcatccgtttcagagctatgctggaaacagc

SEQ ID NO: 49105 - DNA, 70 bp, Artificial Sequence
  Synthetic
gccaagcatttaggtgacactatagtgccaagctccaggagctacgtttcagagctatgctggaaacagc

SEQ ID NO: 49106 - DNA, 70 bp, Artificial Sequence
  Synthetic
gccaagcatttaggtgacactatagtgtcatggatagtctttcaagtttcagagctatgctggaaacagc

SEQ ID NO: 49107 - DNA, 70 bp, Artificial Sequence
  Synthetic
gccaagcatttaggtgacactatagactgcagatacagccgtttcgtttcagagctatgctggaaacagc

SEQ ID NO: 49108 - DNA, 70 bp, Artificial Sequence
  Synthetic
gccaagcatttaggtgacactatagcggtggcagcagtgaacagagtttcagagctatgctggaaacagc

SEQ ID NO: 49109 - DNA, 70 bp, Artificial Sequence
  Synthetic
gccaagcatttaggtgacactataggatggggaggtgacatcatggtttcagagctatgctggaaacagc

SEQ ID NO: 49110 - DNA, 70 bp, Artificial Sequence
  Synthetic
gccaagcatttaggtgacactatagatagagttcttttgtgagcagtttcagagctatgctggaaacagc

SEQ ID NO: 49111 - DNA, 70 bp, Artificial Sequence
  Synthetic
gccaagcatttaggtgacactatagagatatttctacctctttccgtttcagagctatgctggaaacagc

SEQ ID NO: 49112 - DNA, 70 bp, Artificial Sequence
  Synthetic
gccaagcatttaggtgacactatagagagatttctacctctttccgtttcagagctatgctggaaacagc

SEQ ID NO: 49113 - DNA, 70 bp, Artificial Sequence
  Synthetic
gccaagcatttaggtgacactatagagttagcattgaggcaaaacgtttcagagctatgctggaaacagc

SEQ ID NO: 49114 - DNA, 70 bp, Artificial Sequence
  Synthetic
gccaagcatttaggtgacactatagggcaactctgtcattcacccgtttcagagctatgctggaaacagc

SEQ ID NO: 49115 - DNA, 70 bp, Artificial Sequence
  Synthetic
gccaagcatttaggtgacactatagttgactgaagtagagttcctgtttcagagctatgctggaaacagc

SEQ ID NO: 49116 - DNA, 70 bp, Artificial Sequence
  Synthetic
gccaagcatttaggtgacactataggcccaaacttcacagcattagtttcagagctatgctggaaacagc

SEQ ID NO: 49117 - DNA, 70 bp, Artificial Sequence
  Synthetic
gccaagcatttaggtgacactatagttgtcttcccttctgattgagtttcagagctatgctggaaacagc

SEQ ID NO: 49118 - DNA, 70 bp, Artificial Sequence
  Synthetic
gccaagcatttaggtgacactatagtgcatatttagccgccaagtgtttcagagctatgctggaaacagc

SEQ ID NO: 49119 - DNA, 70 bp, Artificial Sequence
  Synthetic
gccaagcatttaggtgacactatagctggttgctttaatttcctcgtttcagagctatgctggaaacagc

SEQ ID NO: 49120 - DNA, 70 bp, Artificial Sequence
  Synthetic
gccaagcatttaggtgacactatagggagggcgagatcaacacaggtttcagagctatgctggaaacagc

SEQ ID NO: 49121 - DNA, 70 bp, Artificial Sequence
  Synthetic
gccaagcatttaggtgacactatagtggattgaggatgtgctttcgtttcagagctatgctggaaacagc

SEQ ID NO: 49122 - DNA, 70 bp, Artificial Sequence
  Synthetic
gccaagcatttaggtgacactatagagctttgtcatcagtggtgggtttcagagctatgctggaaacagc

SEQ ID NO: 49123 - DNA, 70 bp, Artificial Sequence
  Synthetic
gccaagcatttaggtgacactatagttcagagggacactgggatggtttcagagctatgctggaaacagc

SEQ ID NO: 49124 - DNA, 70 bp, Artificial Sequence
  Synthetic
gccaagcatttaggtgacactatagtctttagtcatcttttggctgtttcagagctatgctggaaacagc

SEQ ID NO: 49125 - DNA, 70 bp, Artificial Sequence
  Synthetic
gccaagcatttaggtgacactatagcaggaaggcctggcttcctggtttcagagctatgctggaaacagc

SEQ ID NO: 49126 - DNA, 70 bp, Artificial Sequence
  Synthetic
gccaagcatttaggtgacactatagcaagcagagaagcactagaagtttcagagctatgctggaaacagc

SEQ ID NO: 49127 - DNA, 70 bp, Artificial Sequence
  Synthetic
gccaagcatttaggtgacactatagatcgagggactcacttctccgtttcagagctatgctggaaacagc

SEQ ID NO: 49128 - DNA, 70 bp, Artificial Sequence
  Synthetic
gccaagcatttaggtgacactatagctgcagcctcctcgccctaggtttcagagctatgctggaaacagc

SEQ ID NO: 49129 - DNA, 70 bp, Artificial Sequence
  Synthetic
gccaagcatttaggtgacactatagagggagaaggcaaatctgtggtttcagagctatgctggaaacagc

SEQ ID NO: 49130 - DNA, 70 bp, Artificial Sequence
  Synthetic
gccaagcatttaggtgacactatagcgctcgggggcggcctaagcgtttcagagctatgctggaaacagc

SEQ ID NO: 49131 - DNA, 70 bp, Artificial Sequence
  Synthetic
gccaagcatttaggtgacactatagaggctggagaagaggacttcgtttcagagctatgctggaaacagc

SEQ ID NO: 49132 - DNA, 70 bp, Artificial Sequence
  Synthetic
gccaagcatttaggtgacactatagagtgcaggcactgatgaactgtttcagagctatgctggaaacagc

SEQ ID NO: 49133 - DNA, 70 bp, Artificial Sequence
  Synthetic
gccaagcatttaggtgacactatagaaggtggatgagaagtagctgtttcagagctatgctggaaacagc

SEQ ID NO: 49134 - DNA, 70 bp, Artificial Sequence
  Synthetic
gccaagcatttaggtgacactatagggctgctcttgtgttttttagtttcagagctatgctggaaacagc

SEQ ID NO: 49135 - DNA, 70 bp, Artificial Sequence
  Synthetic
gccaagcatttaggtgacactatagcgtggaggacattccaaagagtttcagagctatgctggaaacagc

SEQ ID NO: 49136 - DNA, 70 bp, Artificial Sequence
  Synthetic
gccaagcatttaggtgacactatagaccctgtggaccggcctcaggtttcagagctatgctggaaacagc

SEQ ID NO: 49137 - DNA, 70 bp, Artificial Sequence
  Synthetic
gccaagcatttaggtgacactatagctcccactagaagaagtctggtttcagagctatgctggaaacagc

SEQ ID NO: 49138 - DNA, 70 bp, Artificial Sequence
  Synthetic
gccaagcatttaggtgacactatagtttctttgaggtttgtgaaggtttcagagctatgctggaaacagc

SEQ ID NO: 49139 - DNA, 70 bp, Artificial Sequence
  Synthetic
gccaagcatttaggtgacactatagggtcatcaactgtctctccagtttcagagctatgctggaaacagc

SEQ ID NO: 49140 - DNA, 70 bp, Artificial Sequence
  Synthetic
gccaagcatttaggtgacactatagtcaagaagcgccggagcaaggtttcagagctatgctggaaacagc

SEQ ID NO: 49141 - DNA, 70 bp, Artificial Sequence
  Synthetic
gccaagcatttaggtgacactatagtttctttctgcaagttgatggtttcagagctatgctggaaacagc

SEQ ID NO: 49142 - DNA, 70 bp, Artificial Sequence
  Synthetic
gccaagcatttaggtgacactatagggggtccaagtattcaatccgtttcagagctatgctggaaacagc

SEQ ID NO: 49143 - DNA, 70 bp, Artificial Sequence
  Synthetic
gccaagcatttaggtgacactatagggaccccaggtctggagattgtttcagagctatgctggaaacagc

SEQ ID NO: 49144 - DNA, 70 bp, Artificial Sequence
  Synthetic
gccaagcatttaggtgacactatagcaaggtggtgctgcggaagggtttcagagctatgctggaaacagc

SEQ ID NO: 49145 - DNA, 70 bp, Artificial Sequence
  Synthetic
gccaagcatttaggtgacactatagggagtcggacgccgtgctgggtttcagagctatgctggaaacagc

SEQ ID NO: 49146 - DNA, 70 bp, Artificial Sequence
  Synthetic
gccaagcatttaggtgacactatagacggtggctctaagctcagggtttcagagctatgctggaaacagc

SEQ ID NO: 49147 - DNA, 70 bp, Artificial Sequence
  Synthetic
gccaagcatttaggtgacactatagaaatggagagtgtagcctgagtttcagagctatgctggaaacagc

SEQ ID NO: 49148 - DNA, 70 bp, Artificial Sequence
  Synthetic
gccaagcatttaggtgacactatagttaaagcactcatcgtaaaggtttcagagctatgctggaaacagc

SEQ ID NO: 49149 - DNA, 70 bp, Artificial Sequence
  Synthetic
gccaagcatttaggtgacactataggagggaagcagggagagactgtttcagagctatgctggaaacagc

SEQ ID NO: 49150 - DNA, 70 bp, Artificial Sequence
  Synthetic
gccaagcatttaggtgacactataggtccggggctcagagtccgtgtttcagagctatgctggaaacagc

SEQ ID NO: 49151 - DNA, 70 bp, Artificial Sequence
  Synthetic
gccaagcatttaggtgacactatagccaggggccagtggggtcaggtttcagagctatgctggaaacagc

SEQ ID NO: 49152 - DNA, 70 bp, Artificial Sequence
  Synthetic
gccaagcatttaggtgacactatagcctggttccaatttaggtgggtttcagagctatgctggaaacagc

SEQ ID NO: 49153 - DNA, 70 bp, Artificial Sequence
  Synthetic
gccaagcatttaggtgacactatagtcacagctgctggcagtaacgtttcagagctatgctggaaacagc

SEQ ID NO: 49154 - DNA, 70 bp, Artificial Sequence
  Synthetic
gccaagcatttaggtgacactatagtggtgtgctaggtagctacagtttcagagctatgctggaaacagc

SEQ ID NO: 49155 - DNA, 70 bp, Artificial Sequence
  Synthetic
gccaagcatttaggtgacactatagggctgctatagatttagacggtttcagagctatgctggaaacagc

SEQ ID NO: 49156 - DNA, 70 bp, Artificial Sequence
  Synthetic
gccaagcatttaggtgacactatagaggaccctgccccggcctgagtttcagagctatgctggaaacagc

SEQ ID NO: 49157 - DNA, 70 bp, Artificial Sequence
  Synthetic
gccaagcatttaggtgacactatagggtctatatcttgtctgatcgtttcagagctatgctggaaacagc

SEQ ID NO: 49158 - DNA, 70 bp, Artificial Sequence
  Synthetic
gccaagcatttaggtgacactatagcctggtgtttcctctctgacgtttcagagctatgctggaaacagc

SEQ ID NO: 49159 - DNA, 70 bp, Artificial Sequence
  Synthetic
gccaagcatttaggtgacactatagagggggctctgtgtttataggtttcagagctatgctggaaacagc

SEQ ID NO: 49160 - DNA, 70 bp, Artificial Sequence
  Synthetic
gccaagcatttaggtgacactatagagccaccgccctcgttcaccgtttcagagctatgctggaaacagc

SEQ ID NO: 49161 - DNA, 70 bp, Artificial Sequence
  Synthetic
gccaagcatttaggtgacactatagctttctggtgttccccctatgtttcagagctatgctggaaacagc

SEQ ID NO: 49162 - DNA, 70 bp, Artificial Sequence
  Synthetic
gccaagcatttaggtgacactatagagagttgaacagtggtgagcgtttcagagctatgctggaaacagc

SEQ ID NO: 49163 - DNA, 70 bp, Artificial Sequence
  Synthetic
gccaagcatttaggtgacactatagatgacaaagttgtgcaaaacgtttcagagctatgctggaaacagc

SEQ ID NO: 49164 - DNA, 70 bp, Artificial Sequence
  Synthetic
gccaagcatttaggtgacactatagcatgttctggtagtggatgggtttcagagctatgctggaaacagc

SEQ ID NO: 49165 - DNA, 70 bp, Artificial Sequence
  Synthetic
gccaagcatttaggtgacactatagagcgctccggacttcacttcgtttcagagctatgctggaaacagc

SEQ ID NO: 49166 - DNA, 70 bp, Artificial Sequence
  Synthetic
gccaagcatttaggtgacactatagtgacagaaacagaaaagcaggtttcagagctatgctggaaacagc

SEQ ID NO: 49167 - DNA, 70 bp, Artificial Sequence
  Synthetic
gccaagcatttaggtgacactatagctctgctgttcagtgaagtggtttcagagctatgctggaaacagc

SEQ ID NO: 49168 - DNA, 70 bp, Artificial Sequence
  Synthetic
gccaagcatttaggtgacactatagtcattctcttctgcctttaggtttcagagctatgctggaaacagc

SEQ ID NO: 49169 - DNA, 70 bp, Artificial Sequence
  Synthetic
gccaagcatttaggtgacactatagttttttgtcatcatcctccggtttcagagctatgctggaaacagc

SEQ ID NO: 49170 - DNA, 70 bp, Artificial Sequence
  Synthetic
gccaagcatttaggtgacactatagacaggaagcatgcgtacagtgtttcagagctatgctggaaacagc

SEQ ID NO: 49171 - DNA, 70 bp, Artificial Sequence
  Synthetic
gccaagcatttaggtgacactatagcggggcttcagtaatgcctcgtttcagagctatgctggaaacagc

SEQ ID NO: 49172 - DNA, 70 bp, Artificial Sequence
  Synthetic
gccaagcatttaggtgacactatagagacttggtgctggcgaaaggtttcagagctatgctggaaacagc

SEQ ID NO: 49173 - DNA, 70 bp, Artificial Sequence
  Synthetic
gccaagcatttaggtgacactatagggagtacgtgacggtgtagcgtttcagagctatgctggaaacagc

SEQ ID NO: 49174 - DNA, 70 bp, Artificial Sequence
  Synthetic
gccaagcatttaggtgacactatagaagaaacagcaaagagctaagtttcagagctatgctggaaacagc

SEQ ID NO: 49175 - DNA, 70 bp, Artificial Sequence
  Synthetic
gccaagcatttaggtgacactatagattggggcgagcaagtgagggtttcagagctatgctggaaacagc

SEQ ID NO: 49176 - DNA, 70 bp, Artificial Sequence
  Synthetic
gccaagcatttaggtgacactatagtgattcagaacttcccactggtttcagagctatgctggaaacagc

SEQ ID NO: 49177 - DNA, 70 bp, Artificial Sequence
  Synthetic
gccaagcatttaggtgacactatagaaggaaagtaacacggaccagtttcagagctatgctggaaacagc

SEQ ID NO: 49178 - DNA, 70 bp, Artificial Sequence
  Synthetic
gccaagcatttaggtgacactatagggggtcttcattttctcttcgtttcagagctatgctggaaacagc

SEQ ID NO: 49179 - DNA, 70 bp, Artificial Sequence
  Synthetic
gccaagcatttaggtgacactatagcatgatccagccgtgcgctcgtttcagagctatgctggaaacagc

SEQ ID NO: 49180 - DNA, 70 bp, Artificial Sequence
  Synthetic
gccaagcatttaggtgacactatagctgcagcggctccgcaggtggtttcagagctatgctggaaacagc

SEQ ID NO: 49181 - DNA, 70 bp, Artificial Sequence
  Synthetic
gccaagcatttaggtgacactataggagcccaggggcttgtgagggtttcagagctatgctggaaacagc

SEQ ID NO: 49182 - DNA, 70 bp, Artificial Sequence
  Synthetic
gccaagcatttaggtgacactatagtggctggttctggagcccaggtttcagagctatgctggaaacagc

SEQ ID NO: 49183 - DNA, 70 bp, Artificial Sequence
  Synthetic
gccaagcatttaggtgacactatagtgacagtccggagaggcccagtttcagagctatgctggaaacagc

SEQ ID NO: 49184 - DNA, 70 bp, Artificial Sequence
  Synthetic
gccaagcatttaggtgacactatagcagacgtgagtcaccgtgccgtttcagagctatgctggaaacagc

SEQ ID NO: 49185 - DNA, 70 bp, Artificial Sequence
  Synthetic
gccaagcatttaggtgacactatagttgcctctcttatacgcaacgtttcagagctatgctggaaacagc

SEQ ID NO: 49186 - DNA, 70 bp, Artificial Sequence
  Synthetic
gccaagcatttaggtgacactatagattatctgtgtgggtctattgtttcagagctatgctggaaacagc

SEQ ID NO: 49187 - DNA, 70 bp, Artificial Sequence
  Synthetic
gccaagcatttaggtgacactatagtactgggaaagaatgttaccgtttcagagctatgctggaaacagc

SEQ ID NO: 49188 - DNA, 70 bp, Artificial Sequence
  Synthetic
gccaagcatttaggtgacactatagtacactggcaccattctcctgtttcagagctatgctggaaacagc

SEQ ID NO: 49189 - DNA, 70 bp, Artificial Sequence
  Synthetic
gccaagcatttaggtgacactatagagccggcacctagcaactgagtttcagagctatgctggaaacagc

SEQ ID NO: 49190 - DNA, 70 bp, Artificial Sequence
  Synthetic
gccaagcatttaggtgacactatagacggtgttgggatgtgctatgtttcagagctatgctggaaacagc

SEQ ID NO: 49191 - DNA, 70 bp, Artificial Sequence
  Synthetic
gccaagcatttaggtgacactatagacaggaagctctaggccaccgtttcagagctatgctggaaacagc

SEQ ID NO: 49192 - DNA, 70 bp, Artificial Sequence
  Synthetic
gccaagcatttaggtgacactatagaactcaggcacttgcaaaacgtttcagagctatgctggaaacagc

SEQ ID NO: 49193 - DNA, 70 bp, Artificial Sequence
  Synthetic
gccaagcatttaggtgacactatagagatttcagtggccacatccgtttcagagctatgctggaaacagc

SEQ ID NO: 49194 - DNA, 70 bp, Artificial Sequence
  Synthetic
gccaagcatttaggtgacactatagatagaagtcagcagacgtctgtttcagagctatgctggaaacagc

SEQ ID NO: 49195 - DNA, 70 bp, Artificial Sequence
  Synthetic
gccaagcatttaggtgacactatagctgtaccaggttgactgatggtttcagagctatgctggaaacagc

SEQ ID NO: 49196 - DNA, 70 bp, Artificial Sequence
  Synthetic
gccaagcatttaggtgacactatagggggacgctggggtcactaggtttcagagctatgctggaaacagc

SEQ ID NO: 49197 - DNA, 70 bp, Artificial Sequence
  Synthetic
gccaagcatttaggtgacactatagccatcacctaccgcttcaaggtttcagagctatgctggaaacagc

SEQ ID NO: 49198 - DNA, 70 bp, Artificial Sequence
  Synthetic
gccaagcatttaggtgacactatagagctggaccccctttttgaggtttcagagctatgctggaaacagc

SEQ ID NO: 49199 - DNA, 70 bp, Artificial Sequence
  Synthetic
gccaagcatttaggtgacactataggaaggagggacgacagctgagtttcagagctatgctggaaacagc

SEQ ID NO: 49200 - DNA, 70 bp, Artificial Sequence
  Synthetic
gccaagcatttaggtgacactatagtgctatcttgcagcagctcggtttcagagctatgctggaaacagc

SEQ ID NO: 49201 - DNA, 70 bp, Artificial Sequence
  Synthetic
gccaagcatttaggtgacactatagcagaactctcaagcatcattgtttcagagctatgctggaaacagc

SEQ ID NO: 49202 - DNA, 70 bp, Artificial Sequence
  Synthetic
gccaagcatttaggtgacactataggctattccaacctggagacagtttcagagctatgctggaaacagc

SEQ ID NO: 49203 - DNA, 70 bp, Artificial Sequence
  Synthetic
gccaagcatttaggtgacactatagcctctggctacttcccagcagtttcagagctatgctggaaacagc

SEQ ID NO: 49204 - DNA, 70 bp, Artificial Sequence
  Synthetic
gccaagcatttaggtgacactatagcgtgcccctcgtgttagcccgtttcagagctatgctggaaacagc

SEQ ID NO: 49205 - DNA, 70 bp, Artificial Sequence
  Synthetic
gccaagcatttaggtgacactatagcgcgcatgtcaggcagccccgtttcagagctatgctggaaacagc

SEQ ID NO: 49206 - DNA, 70 bp, Artificial Sequence
  Synthetic
gccaagcatttaggtgacactataggatgaggacaaggatgaggagtttcagagctatgctggaaacagc

SEQ ID NO: 49207 - DNA, 70 bp, Artificial Sequence
  Synthetic
gccaagcatttaggtgacactataggtgacagtggctgctaggaggtttcagagctatgctggaaacagc

SEQ ID NO: 49208 - DNA, 70 bp, Artificial Sequence
  Synthetic
gccaagcatttaggtgacactatagtactagcacagaagaagagagtttcagagctatgctggaaacagc

SEQ ID NO: 49209 - DNA, 70 bp, Artificial Sequence
  Synthetic
gccaagcatttaggtgacactatagggggcagggcatgcctcagtgtttcagagctatgctggaaacagc

SEQ ID NO: 49210 - DNA, 70 bp, Artificial Sequence
  Synthetic
gccaagcatttaggtgacactatagcacccagaccccggggacacgtttcagagctatgctggaaacagc

SEQ ID NO: 49211 - DNA, 70 bp, Artificial Sequence
  Synthetic
gccaagcatttaggtgacactatagtggggggtgcttttactgatgtttcagagctatgctggaaacagc

SEQ ID NO: 49212 - DNA, 70 bp, Artificial Sequence
  Synthetic
gccaagcatttaggtgacactatagttccccaaggcaccaaatcagtttcagagctatgctggaaacagc

SEQ ID NO: 49213 - DNA, 70 bp, Artificial Sequence
  Synthetic
gccaagcatttaggtgacactatagcaaatagacgacagtggcaagtttcagagctatgctggaaacagc

SEQ ID NO: 49214 - DNA, 70 bp, Artificial Sequence
  Synthetic
gccaagcatttaggtgacactatagccccaagttctgggctcactgtttcagagctatgctggaaacagc

SEQ ID NO: 49215 - DNA, 70 bp, Artificial Sequence
  Synthetic
gccaagcatttaggtgacactatagagcatcttaaggacctcttggtttcagagctatgctggaaacagc

SEQ ID NO: 49216 - DNA, 70 bp, Artificial Sequence
  Synthetic
gccaagcatttaggtgacactatagtgatacttgatggcaaagaagtttcagagctatgctggaaacagc

SEQ ID NO: 49217 - DNA, 70 bp, Artificial Sequence
  Synthetic
gccaagcatttaggtgacactatagcaatggtactagtgggaattgtttcagagctatgctggaaacagc

SEQ ID NO: 49218 - DNA, 70 bp, Artificial Sequence
  Synthetic
gccaagcatttaggtgacactataggtggctctatctcaaatactgtttcagagctatgctggaaacagc

SEQ ID NO: 49219 - DNA, 70 bp, Artificial Sequence
  Synthetic
gccaagcatttaggtgacactatagaaattgtcctgttggagaaagtttcagagctatgctggaaacagc

SEQ ID NO: 49220 - DNA, 70 bp, Artificial Sequence
  Synthetic
gccaagcatttaggtgacactatagtttctgaagacacaagactcgtttcagagctatgctggaaacagc

SEQ ID NO: 49221 - DNA, 70 bp, Artificial Sequence
  Synthetic
gccaagcatttaggtgacactataggcagaagacaggcaagcaatgtttcagagctatgctggaaacagc

SEQ ID NO: 49222 - DNA, 70 bp, Artificial Sequence
  Synthetic
gccaagcatttaggtgacactatagcgctcactcactctccgagtgtttcagagctatgctggaaacagc

SEQ ID NO: 49223 - DNA, 70 bp, Artificial Sequence
  Synthetic
gccaagcatttaggtgacactatagtccagggctataactcagacgtttcagagctatgctggaaacagc

SEQ ID NO: 49224 - DNA, 70 bp, Artificial Sequence
  Synthetic
gccaagcatttaggtgacactatagggctttgctctggtgctggtgtttcagagctatgctggaaacagc

SEQ ID NO: 49225 - DNA, 70 bp, Artificial Sequence
  Synthetic
gccaagcatttaggtgacactatagagccagagccgcagctgtgagtttcagagctatgctggaaacagc

SEQ ID NO: 49226 - DNA, 70 bp, Artificial Sequence
  Synthetic
gccaagcatttaggtgacactatagaagagttgctacaggcttccgtttcagagctatgctggaaacagc

SEQ ID NO: 49227 - DNA, 70 bp, Artificial Sequence
  Synthetic
gccaagcatttaggtgacactatagacttagatggtgagagaaaggtttcagagctatgctggaaacagc

SEQ ID NO: 49228 - DNA, 70 bp, Artificial Sequence
  Synthetic
gccaagcatttaggtgacactatagtagtttgctccagatgacgggtttcagagctatgctggaaacagc

SEQ ID NO: 49229 - DNA, 70 bp, Artificial Sequence
  Synthetic
gccaagcatttaggtgacactatagtccagtgcaagcccttagacgtttcagagctatgctggaaacagc

SEQ ID NO: 49230 - DNA, 70 bp, Artificial Sequence
  Synthetic
gccaagcatttaggtgacactataggtctttaaggactggtcttcgtttcagagctatgctggaaacagc

SEQ ID NO: 49231 - DNA, 70 bp, Artificial Sequence
  Synthetic
gccaagcatttaggtgacactatagcaaaattggggaagaggcgggtttcagagctatgctggaaacagc

SEQ ID NO: 49232 - DNA, 70 bp, Artificial Sequence
  Synthetic
gccaagcatttaggtgacactatagaacaccacagttattgtgtggtttcagagctatgctggaaacagc

SEQ ID NO: 49233 - DNA, 70 bp, Artificial Sequence
  Synthetic
gccaagcatttaggtgacactatagaatggatcacaccttctgcagtttcagagctatgctggaaacagc

SEQ ID NO: 49234 - DNA, 70 bp, Artificial Sequence
  Synthetic
gccaagcatttaggtgacactatagggaaccagtcctgaatcctagtttcagagctatgctggaaacagc

SEQ ID NO: 49235 - DNA, 70 bp, Artificial Sequence
  Synthetic
gccaagcatttaggtgacactatagtcctagaggagaagctatatgtttcagagctatgctggaaacagc

SEQ ID NO: 49236 - DNA, 70 bp, Artificial Sequence
  Synthetic
gccaagcatttaggtgacactatagttgcaagaggaaaaagaaaggtttcagagctatgctggaaacagc

SEQ ID NO: 49237 - DNA, 70 bp, Artificial Sequence
  Synthetic
gccaagcatttaggtgacactataggagccaatatgaggcacatagtttcagagctatgctggaaacagc

SEQ ID NO: 49238 - DNA, 70 bp, Artificial Sequence
  Synthetic
gccaagcatttaggtgacactatagaaaacctccaagaaaggacagtttcagagctatgctggaaacagc

SEQ ID NO: 49239 - DNA, 70 bp, Artificial Sequence
  Synthetic
gccaagcatttaggtgacactatagtgcagttggaagacatatacgtttcagagctatgctggaaacagc

SEQ ID NO: 49240 - DNA, 70 bp, Artificial Sequence
  Synthetic
gccaagcatttaggtgacactatagagcaccgtgaaaacctgaaggtttcagagctatgctggaaacagc

SEQ ID NO: 49241 - DNA, 70 bp, Artificial Sequence
  Synthetic
gccaagcatttaggtgacactatagattttgcttctgcacacagggtttcagagctatgctggaaacagc

SEQ ID NO: 49242 - DNA, 70 bp, Artificial Sequence
  Synthetic
gccaagcatttaggtgacactatagagtatcattctgaggtacaggtttcagagctatgctggaaacagc

SEQ ID NO: 49243 - DNA, 70 bp, Artificial Sequence
  Synthetic
gccaagcatttaggtgacactatagagaagcaccgtcgctctcgggtttcagagctatgctggaaacagc

SEQ ID NO: 49244 - DNA, 70 bp, Artificial Sequence
  Synthetic
gccaagcatttaggtgacactatagattctcaccttaagcgtagagtttcagagctatgctggaaacagc

SEQ ID NO: 49245 - DNA, 70 bp, Artificial Sequence
  Synthetic
gccaagcatttaggtgacactatagctcagagaacactagagactgtttcagagctatgctggaaacagc

SEQ ID NO: 49246 - DNA, 70 bp, Artificial Sequence
  Synthetic
gccaagcatttaggtgacactatagaaagccagcacgtttatttcgtttcagagctatgctggaaacagc

SEQ ID NO: 49247 - DNA, 70 bp, Artificial Sequence
  Synthetic
gccaagcatttaggtgacactatagccagccccctccagtgtgaggtttcagagctatgctggaaacagc

SEQ ID NO: 49248 - DNA, 70 bp, Artificial Sequence
  Synthetic
gccaagcatttaggtgacactatagagctggtcatcgacaggtgagtttcagagctatgctggaaacagc

SEQ ID NO: 49249 - DNA, 70 bp, Artificial Sequence
  Synthetic
gccaagcatttaggtgacactataggccctgggccacaggctacagtttcagagctatgctggaaacagc

SEQ ID NO: 49250 - DNA, 70 bp, Artificial Sequence
  Synthetic
gccaagcatttaggtgacactatagactagaaagcttgcaaactcgtttcagagctatgctggaaacagc

SEQ ID NO: 49251 - DNA, 70 bp, Artificial Sequence
  Synthetic
gccaagcatttaggtgacactatagcagccacctttcagcaagaggtttcagagctatgctggaaacagc

SEQ ID NO: 49252 - DNA, 70 bp, Artificial Sequence
  Synthetic
gccaagcatttaggtgacactatagtatccttgaccactttactggtttcagagctatgctggaaacagc

SEQ ID NO: 49253 - DNA, 70 bp, Artificial Sequence
  Synthetic
gccaagcatttaggtgacactataggctgcggcagaagcctccccgtttcagagctatgctggaaacagc

SEQ ID NO: 49254 - DNA, 70 bp, Artificial Sequence
  Synthetic
gccaagcatttaggtgacactatagggggaagtgccaggctcacagtttcagagctatgctggaaacagc

SEQ ID NO: 49255 - DNA, 70 bp, Artificial Sequence
  Synthetic
gccaagcatttaggtgacactatagagctatgaaaaacggtagtagtttcagagctatgctggaaacagc

SEQ ID NO: 49256 - DNA, 70 bp, Artificial Sequence
  Synthetic
gccaagcatttaggtgacactataggtgagtctgacacacagccagtttcagagctatgctggaaacagc

SEQ ID NO: 49257 - DNA, 70 bp, Artificial Sequence
  Synthetic
gccaagcatttaggtgacactatagtccagttctggaatcatggagtttcagagctatgctggaaacagc

SEQ ID NO: 49258 - DNA, 70 bp, Artificial Sequence
  Synthetic
gccaagcatttaggtgacactatagacttgggttcagaaactcacgtttcagagctatgctggaaacagc

SEQ ID NO: 49259 - DNA, 70 bp, Artificial Sequence
  Synthetic
gccaagcatttaggtgacactatagagaagctgtaaatggccttggtttcagagctatgctggaaacagc

SEQ ID NO: 49260 - DNA, 70 bp, Artificial Sequence
  Synthetic
gccaagcatttaggtgacactataggccaacagaccaactcagatgtttcagagctatgctggaaacagc

SEQ ID NO: 49261 - DNA, 70 bp, Artificial Sequence
  Synthetic
gccaagcatttaggtgacactatagattggcacagaaagatcttcgtttcagagctatgctggaaacagc

SEQ ID NO: 49262 - DNA, 70 bp, Artificial Sequence
  Synthetic
gccaagcatttaggtgacactatagagagaaggctaggttttacagtttcagagctatgctggaaacagc

SEQ ID NO: 49263 - DNA, 70 bp, Artificial Sequence
  Synthetic
gccaagcatttaggtgacactatagagttttgaaagtaactgtgggtttcagagctatgctggaaacagc

SEQ ID NO: 49264 - DNA, 70 bp, Artificial Sequence
  Synthetic
gccaagcatttaggtgacactatagttctcagtacatttaaccacgtttcagagctatgctggaaacagc

SEQ ID NO: 49265 - DNA, 70 bp, Artificial Sequence
  Synthetic
gccaagcatttaggtgacactatagcaaagagccgcagttatttggtttcagagctatgctggaaacagc

SEQ ID NO: 49266 - DNA, 70 bp, Artificial Sequence
  Synthetic
gccaagcatttaggtgacactataggatggcacatgcgaaaacgagtttcagagctatgctggaaacagc

SEQ ID NO: 49267 - DNA, 70 bp, Artificial Sequence
  Synthetic
gccaagcatttaggtgacactatagccttctcctattccagaaccgtttcagagctatgctggaaacagc

SEQ ID NO: 49268 - DNA, 70 bp, Artificial Sequence
  Synthetic
gccaagcatttaggtgacactatagatgactttaacacgcttagtgtttcagagctatgctggaaacagc

SEQ ID NO: 49269 - DNA, 70 bp, Artificial Sequence
  Synthetic
gccaagcatttaggtgacactatagtgcatcaacaagtccaagatgtttcagagctatgctggaaacagc

SEQ ID NO: 49270 - DNA, 70 bp, Artificial Sequence
  Synthetic
gccaagcatttaggtgacactataggggcggagggtcacacatacgtttcagagctatgctggaaacagc

SEQ ID NO: 49271 - DNA, 70 bp, Artificial Sequence
  Synthetic
gccaagcatttaggtgacactatagtgtcacttgttctatgaactgtttcagagctatgctggaaacagc

SEQ ID NO: 49272 - DNA, 70 bp, Artificial Sequence
  Synthetic
gccaagcatttaggtgacactatagtggcttctgacatatatagggtttcagagctatgctggaaacagc

SEQ ID NO: 49273 - DNA, 70 bp, Artificial Sequence
  Synthetic
gccaagcatttaggtgacactatagcccacgaggttcagtcagccgtttcagagctatgctggaaacagc

SEQ ID NO: 49274 - DNA, 70 bp, Artificial Sequence
  Synthetic
gccaagcatttaggtgacactataggggctacttcttctttttctgtttcagagctatgctggaaacagc

SEQ ID NO: 49275 - DNA, 70 bp, Artificial Sequence
  Synthetic
gccaagcatttaggtgacactataggccccacggagtcccctcacgtttcagagctatgctggaaacagc

SEQ ID NO: 49276 - DNA, 70 bp, Artificial Sequence
  Synthetic
gccaagcatttaggtgacactatagcgtgcctgtcagcagaacaggtttcagagctatgctggaaacagc

SEQ ID NO: 49277 - DNA, 70 bp, Artificial Sequence
  Synthetic
gccaagcatttaggtgacactatagaccagcatgaactagaacaggtttcagagctatgctggaaacagc

SEQ ID NO: 49278 - DNA, 70 bp, Artificial Sequence
  Synthetic
gccaagcatttaggtgacactatagtctcccttattcattccattgtttcagagctatgctggaaacagc

SEQ ID NO: 49279 - DNA, 70 bp, Artificial Sequence
  Synthetic
gccaagcatttaggtgacactatagcatccacgcctcgttattaagtttcagagctatgctggaaacagc

SEQ ID NO: 49280 - DNA, 70 bp, Artificial Sequence
  Synthetic
gccaagcatttaggtgacactatagcgctgggcctctggcctagagtttcagagctatgctggaaacagc

SEQ ID NO: 49281 - DNA, 70 bp, Artificial Sequence
  Synthetic
gccaagcatttaggtgacactatagggaaaatgttgggggtcactgtttcagagctatgctggaaacagc

SEQ ID NO: 49282 - DNA, 70 bp, Artificial Sequence
  Synthetic
gccaagcatttaggtgacactatagttcccatggtcacttgtgccgtttcagagctatgctggaaacagc

SEQ ID NO: 49283 - DNA, 70 bp, Artificial Sequence
  Synthetic
gccaagcatttaggtgacactataggctatgttaaacggttagaggtttcagagctatgctggaaacagc

SEQ ID NO: 49284 - DNA, 70 bp, Artificial Sequence
  Synthetic
gccaagcatttaggtgacactataggtccttgagtaagacaagtcgtttcagagctatgctggaaacagc

SEQ ID NO: 49285 - DNA, 70 bp, Artificial Sequence
  Synthetic
gccaagcatttaggtgacactatagaaattctcatcagagaccacgtttcagagctatgctggaaacagc

SEQ ID NO: 49286 - DNA, 70 bp, Artificial Sequence
  Synthetic
gccaagcatttaggtgacactatagtgaagcactgaagaattagcgtttcagagctatgctggaaacagc

SEQ ID NO: 49287 - DNA, 70 bp, Artificial Sequence
  Synthetic
gccaagcatttaggtgacactatagaggcgcaggctggtcagtacgtttcagagctatgctggaaacagc

SEQ ID NO: 49288 - DNA, 70 bp, Artificial Sequence
  Synthetic
gccaagcatttaggtgacactatagaagtgggattctctctgtccgtttcagagctatgctggaaacagc

SEQ ID NO: 49289 - DNA, 70 bp, Artificial Sequence
  Synthetic
gccaagcatttaggtgacactatagtttcaactgtgggtttgcccgtttcagagctatgctggaaacagc

SEQ ID NO: 49290 - DNA, 70 bp, Artificial Sequence
  Synthetic
gccaagcatttaggtgacactatagggccgggtccgggaggcctggtttcagagctatgctggaaacagc

SEQ ID NO: 49291 - DNA, 70 bp, Artificial Sequence
  Synthetic
gccaagcatttaggtgacactatagaccccaagccccagcctgaagtttcagagctatgctggaaacagc

SEQ ID NO: 49292 - DNA, 70 bp, Artificial Sequence
  Synthetic
gccaagcatttaggtgacactatagggcagaagccagagcctactgtttcagagctatgctggaaacagc

SEQ ID NO: 49293 - DNA, 70 bp, Artificial Sequence
  Synthetic
gccaagcatttaggtgacactatagagagggaaatggatgaacttgtttcagagctatgctggaaacagc

SEQ ID NO: 49294 - DNA, 70 bp, Artificial Sequence
  Synthetic
gccaagcatttaggtgacactataggtgaaggccaatagcattcagtttcagagctatgctggaaacagc

SEQ ID NO: 49295 - DNA, 70 bp, Artificial Sequence
  Synthetic
gccaagcatttaggtgacactatagggggcctggctgggcctactgtttcagagctatgctggaaacagc

SEQ ID NO: 49296 - DNA, 70 bp, Artificial Sequence
  Synthetic
gccaagcatttaggtgacactatagcatcttgtgcatctgccaaagtttcagagctatgctggaaacagc

SEQ ID NO: 49297 - DNA, 70 bp, Artificial Sequence
  Synthetic
gccaagcatttaggtgacactatagtgaggagcagtccgctgcgtgtttcagagctatgctggaaacagc

SEQ ID NO: 49298 - DNA, 70 bp, Artificial Sequence
  Synthetic
gccaagcatttaggtgacactataggactgcccaaacccaggtacgtttcagagctatgctggaaacagc

SEQ ID NO: 49299 - DNA, 70 bp, Artificial Sequence
  Synthetic
gccaagcatttaggtgacactatagcccctacctgcgggggtaacgtttcagagctatgctggaaacagc

SEQ ID NO: 49300 - DNA, 70 bp, Artificial Sequence
  Synthetic
gccaagcatttaggtgacactataggcttctctgaaggagacacagtttcagagctatgctggaaacagc

SEQ ID NO: 49301 - DNA, 70 bp, Artificial Sequence
  Synthetic
gccaagcatttaggtgacactatagatggacttgattctgatgaggtttcagagctatgctggaaacagc

SEQ ID NO: 49302 - DNA, 70 bp, Artificial Sequence
  Synthetic
gccaagcatttaggtgacactatagatttactgttctgctgctgcgtttcagagctatgctggaaacagc

SEQ ID NO: 49303 - DNA, 70 bp, Artificial Sequence
  Synthetic
gccaagcatttaggtgacactatagaccgcacccccaaagtcactgtttcagagctatgctggaaacagc

SEQ ID NO: 49304 - DNA, 70 bp, Artificial Sequence
  Synthetic
gccaagcatttaggtgacactatagtcaggtctgctgagagttaggtttcagagctatgctggaaacagc

SEQ ID NO: 49305 - DNA, 70 bp, Artificial Sequence
  Synthetic
gccaagcatttaggtgacactatagagcaagtaaggaggggaaaagtttcagagctatgctggaaacagc

SEQ ID NO: 49306 - DNA, 70 bp, Artificial Sequence
  Synthetic
gccaagcatttaggtgacactataggtattctgcacagagttccagtttcagagctatgctggaaacagc

SEQ ID NO: 49307 - DNA, 70 bp, Artificial Sequence
  Synthetic
gccaagcatttaggtgacactatagtttgatagcagtgatgatgagtttcagagctatgctggaaacagc

SEQ ID NO: 49308 - DNA, 70 bp, Artificial Sequence
  Synthetic
gccaagcatttaggtgacactatagagctgctgtttgttaccagagtttcagagctatgctggaaacagc

SEQ ID NO: 49309 - DNA, 70 bp, Artificial Sequence
  Synthetic
gccaagcatttaggtgacactataggagctactactagcactagagtttcagagctatgctggaaacagc

SEQ ID NO: 49310 - DNA, 70 bp, Artificial Sequence
  Synthetic
gccaagcatttaggtgacactatagagtccaggctgctccctagggtttcagagctatgctggaaacagc

SEQ ID NO: 49311 - DNA, 70 bp, Artificial Sequence
  Synthetic
gccaagcatttaggtgacactatagctggtgagcgttagcattcggtttcagagctatgctggaaacagc

SEQ ID NO: 49312 - DNA, 70 bp, Artificial Sequence
  Synthetic
gccaagcatttaggtgacactataggcaggcacgtgcacgaacacgtttcagagctatgctggaaacagc

SEQ ID NO: 49313 - DNA, 70 bp, Artificial Sequence
  Synthetic
gccaagcatttaggtgacactatagcagcgagtccggatttaagggtttcagagctatgctggaaacagc

SEQ ID NO: 49314 - DNA, 70 bp, Artificial Sequence
  Synthetic
gccaagcatttaggtgacactatagaaaaaaaaggacacagagaggtttcagagctatgctggaaacagc

SEQ ID NO: 49315 - DNA, 70 bp, Artificial Sequence
  Synthetic
gccaagcatttaggtgacactatagattaaggacatcttccacatgtttcagagctatgctggaaacagc

SEQ ID NO: 49316 - DNA, 70 bp, Artificial Sequence
  Synthetic
gccaagcatttaggtgacactatagatctctgggatggctttacagtttcagagctatgctggaaacagc

SEQ ID NO: 49317 - DNA, 70 bp, Artificial Sequence
  Synthetic
gccaagcatttaggtgacactatagaaatcagagtcctctcataagtttcagagctatgctggaaacagc

SEQ ID NO: 49318 - DNA, 70 bp, Artificial Sequence
  Synthetic
gccaagcatttaggtgacactatagaggaggggccaggggttagcgtttcagagctatgctggaaacagc

SEQ ID NO: 49319 - DNA, 70 bp, Artificial Sequence
  Synthetic
gccaagcatttaggtgacactataggaagatggagagacagattggtttcagagctatgctggaaacagc

SEQ ID NO: 49320 - DNA, 70 bp, Artificial Sequence
  Synthetic
gccaagcatttaggtgacactatagaatgttgtagttacggatctgtttcagagctatgctggaaacagc

SEQ ID NO: 49321 - DNA, 70 bp, Artificial Sequence
  Synthetic
gccaagcatttaggtgacactatagcgggtggcaggaggagctaggtttcagagctatgctggaaacagc

SEQ ID NO: 49322 - DNA, 70 bp, Artificial Sequence
  Synthetic
gccaagcatttaggtgacactatagttggaggcttgaagtgaattgtttcagagctatgctggaaacagc

SEQ ID NO: 49323 - DNA, 70 bp, Artificial Sequence
  Synthetic
gccaagcatttaggtgacactatagtcttctttttgtactgccttgtttcagagctatgctggaaacagc

SEQ ID NO: 49324 - DNA, 70 bp, Artificial Sequence
  Synthetic
gccaagcatttaggtgacactatagctaagctcatgcattaaggcgtttcagagctatgctggaaacagc

SEQ ID NO: 49325 - DNA, 70 bp, Artificial Sequence
  Synthetic
gccaagcatttaggtgacactatagtacagcgccctgaggtaggcgtttcagagctatgctggaaacagc

SEQ ID NO: 49326 - DNA, 70 bp, Artificial Sequence
  Synthetic
gccaagcatttaggtgacactatagctggacatgcggtcataacggtttcagagctatgctggaaacagc

SEQ ID NO: 49327 - DNA, 70 bp, Artificial Sequence
  Synthetic
gccaagcatttaggtgacactatagtttttttgagctgactcttcgtttcagagctatgctggaaacagc

SEQ ID NO: 49328 - DNA, 70 bp, Artificial Sequence
  Synthetic
gccaagcatttaggtgacactatagccccatgcatgcacctcacagtttcagagctatgctggaaacagc

SEQ ID NO: 49329 - DNA, 70 bp, Artificial Sequence
  Synthetic
gccaagcatttaggtgacactataggttggatgttgtttatcaccgtttcagagctatgctggaaacagc

SEQ ID NO: 49330 - DNA, 70 bp, Artificial Sequence
  Synthetic
gccaagcatttaggtgacactatagcttgattttcagctaaaggcgtttcagagctatgctggaaacagc

SEQ ID NO: 49331 - DNA, 70 bp, Artificial Sequence
  Synthetic
gccaagcatttaggtgacactatagattaggttacggaaatgaacgtttcagagctatgctggaaacagc

SEQ ID NO: 49332 - DNA, 70 bp, Artificial Sequence
  Synthetic
gccaagcatttaggtgacactatagcccaggccctgcaccctatggtttcagagctatgctggaaacagc

SEQ ID NO: 49333 - DNA, 70 bp, Artificial Sequence
  Synthetic
gccaagcatttaggtgacactatagcattctcaaaagtatgggtggtttcagagctatgctggaaacagc

SEQ ID NO: 49334 - DNA, 70 bp, Artificial Sequence
  Synthetic
gccaagcatttaggtgacactatagtttcaatcagtcttccgcttgtttcagagctatgctggaaacagc

SEQ ID NO: 49335 - DNA, 70 bp, Artificial Sequence
  Synthetic
gccaagcatttaggtgacactatagatgctggctacgccctgcctgtttcagagctatgctggaaacagc

SEQ ID NO: 49336 - DNA, 70 bp, Artificial Sequence
  Synthetic
gccaagcatttaggtgacactatagaggaatcagactgctgaatagtttcagagctatgctggaaacagc

SEQ ID NO: 49337 - DNA, 70 bp, Artificial Sequence
  Synthetic
gccaagcatttaggtgacactatagttcccggtgccccgggcatggtttcagagctatgctggaaacagc

SEQ ID NO: 49338 - DNA, 70 bp, Artificial Sequence
  Synthetic
gccaagcatttaggtgacactatagaagaaaagcagaagagacgtgtttcagagctatgctggaaacagc

SEQ ID NO: 49339 - DNA, 70 bp, Artificial Sequence
  Synthetic
gccaagcatttaggtgacactatagctcaaagcactgagcgatgcgtttcagagctatgctggaaacagc

SEQ ID NO: 49340 - DNA, 70 bp, Artificial Sequence
  Synthetic
gccaagcatttaggtgacactatagtttcttggagaggctcttgggtttcagagctatgctggaaacagc

SEQ ID NO: 49341 - DNA, 70 bp, Artificial Sequence
  Synthetic
gccaagcatttaggtgacactataggaaacggcgcctgcatcgctgtttcagagctatgctggaaacagc

SEQ ID NO: 49342 - DNA, 70 bp, Artificial Sequence
  Synthetic
gccaagcatttaggtgacactatagtaagtcgaaagtgtttggtcgtttcagagctatgctggaaacagc

SEQ ID NO: 49343 - DNA, 70 bp, Artificial Sequence
  Synthetic
gccaagcatttaggtgacactatagggtacaagcacgaaatcctggtttcagagctatgctggaaacagc

SEQ ID NO: 49344 - DNA, 70 bp, Artificial Sequence
  Synthetic
gccaagcatttaggtgacactataggagcaagaagaccagctgtggtttcagagctatgctggaaacagc

SEQ ID NO: 49345 - DNA, 70 bp, Artificial Sequence
  Synthetic
gccaagcatttaggtgacactatagctgctcagtaagggtatccagtttcagagctatgctggaaacagc

SEQ ID NO: 49346 - DNA, 70 bp, Artificial Sequence
  Synthetic
gccaagcatttaggtgacactatagttgagttttacacaagcaacgtttcagagctatgctggaaacagc

SEQ ID NO: 49347 - DNA, 70 bp, Artificial Sequence
  Synthetic
gccaagcatttaggtgacactatagggcggtcaaaagaaaatggcgtttcagagctatgctggaaacagc

SEQ ID NO: 49348 - DNA, 70 bp, Artificial Sequence
  Synthetic
gccaagcatttaggtgacactatagtttgtagtgcaagatgaggagtttcagagctatgctggaaacagc

SEQ ID NO: 49349 - DNA, 70 bp, Artificial Sequence
  Synthetic
gccaagcatttaggtgacactatagttatatgtgatgtggctttcgtttcagagctatgctggaaacagc

SEQ ID NO: 49350 - DNA, 70 bp, Artificial Sequence
  Synthetic
gccaagcatttaggtgacactatagtctggaataatggacgccgcgtttcagagctatgctggaaacagc

SEQ ID NO: 49351 - DNA, 70 bp, Artificial Sequence
  Synthetic
gccaagcatttaggtgacactatagcaggttcgtgtcctggaattgtttcagagctatgctggaaacagc

SEQ ID NO: 49352 - DNA, 70 bp, Artificial Sequence
  Synthetic
gccaagcatttaggtgacactatagaaaaagagtgcatctcacatgtttcagagctatgctggaaacagc

SEQ ID NO: 49353 - DNA, 70 bp, Artificial Sequence
  Synthetic
gccaagcatttaggtgacactatagcctgttcccccgatgattgagtttcagagctatgctggaaacagc

SEQ ID NO: 49354 - DNA, 70 bp, Artificial Sequence
  Synthetic
gccaagcatttaggtgacactatagacagaagagtggccctacaagtttcagagctatgctggaaacagc

SEQ ID NO: 49355 - DNA, 70 bp, Artificial Sequence
  Synthetic
gccaagcatttaggtgacactataggccgtcctgagctcagatctgtttcagagctatgctggaaacagc

SEQ ID NO: 49356 - DNA, 70 bp, Artificial Sequence
  Synthetic
gccaagcatttaggtgacactataggtattcccaggagctactaagtttcagagctatgctggaaacagc

SEQ ID NO: 49357 - DNA, 70 bp, Artificial Sequence
  Synthetic
gccaagcatttaggtgacactataggtgttgctgtcagcagcagcgtttcagagctatgctggaaacagc

SEQ ID NO: 49358 - DNA, 70 bp, Artificial Sequence
  Synthetic
gccaagcatttaggtgacactatagtgctgttcccacggtgtcacgtttcagagctatgctggaaacagc

SEQ ID NO: 49359 - DNA, 70 bp, Artificial Sequence
  Synthetic
gccaagcatttaggtgacactatagcagaccgtgtggtatgagtagtttcagagctatgctggaaacagc

SEQ ID NO: 49360 - DNA, 70 bp, Artificial Sequence
  Synthetic
gccaagcatttaggtgacactatagctccgccatctctctccatagtttcagagctatgctggaaacagc

SEQ ID NO: 49361 - DNA, 70 bp, Artificial Sequence
  Synthetic
gccaagcatttaggtgacactatagcagcttcatacactctcaaagtttcagagctatgctggaaacagc

SEQ ID NO: 49362 - DNA, 70 bp, Artificial Sequence
  Synthetic
gccaagcatttaggtgacactatagacttgcctggcaatagcattgtttcagagctatgctggaaacagc

SEQ ID NO: 49363 - DNA, 70 bp, Artificial Sequence
  Synthetic
gccaagcatttaggtgacactatagacttaactgtttctgtgcacgtttcagagctatgctggaaacagc

SEQ ID NO: 49364 - DNA, 70 bp, Artificial Sequence
  Synthetic
gccaagcatttaggtgacactatagggtgaggaagcactcagggagtttcagagctatgctggaaacagc

SEQ ID NO: 49365 - DNA, 70 bp, Artificial Sequence
  Synthetic
gccaagcatttaggtgacactatagcacggctggggatgttcagggtttcagagctatgctggaaacagc

SEQ ID NO: 49366 - DNA, 70 bp, Artificial Sequence
  Synthetic
gccaagcatttaggtgacactatagctggacagtgacgacagcaagtttcagagctatgctggaaacagc

SEQ ID NO: 49367 - DNA, 70 bp, Artificial Sequence
  Synthetic
gccaagcatttaggtgacactatagtctcatcgatctggtcaagagtttcagagctatgctggaaacagc

SEQ ID NO: 49368 - DNA, 70 bp, Artificial Sequence
  Synthetic
gccaagcatttaggtgacactatagcagagctggatggggactgagtttcagagctatgctggaaacagc

SEQ ID NO: 49369 - DNA, 70 bp, Artificial Sequence
  Synthetic
gccaagcatttaggtgacactatagggaatccctgttcatggcacgtttcagagctatgctggaaacagc

SEQ ID NO: 49370 - DNA, 70 bp, Artificial Sequence
  Synthetic
gccaagcatttaggtgacactatagggggagcagctcaggagggagtttcagagctatgctggaaacagc

SEQ ID NO: 49371 - DNA, 70 bp, Artificial Sequence
  Synthetic
gccaagcatttaggtgacactatagcagctgcttagctgctcatcgtttcagagctatgctggaaacagc

SEQ ID NO: 49372 - DNA, 70 bp, Artificial Sequence
  Synthetic
gccaagcatttaggtgacactatagtaccttgcaagattcttcaagtttcagagctatgctggaaacagc

SEQ ID NO: 49373 - DNA, 70 bp, Artificial Sequence
  Synthetic
gccaagcatttaggtgacactatagtggcggctgggtcctctagggtttcagagctatgctggaaacagc

SEQ ID NO: 49374 - DNA, 70 bp, Artificial Sequence
  Synthetic
gccaagcatttaggtgacactatagagggtcaggggacatctcacgtttcagagctatgctggaaacagc

SEQ ID NO: 49375 - DNA, 70 bp, Artificial Sequence
  Synthetic
gccaagcatttaggtgacactatagggcccctctactcctcagccgtttcagagctatgctggaaacagc

SEQ ID NO: 49376 - DNA, 70 bp, Artificial Sequence
  Synthetic
gccaagcatttaggtgacactatagagaggcacagaaaaatgctggtttcagagctatgctggaaacagc

SEQ ID NO: 49377 - DNA, 70 bp, Artificial Sequence
  Synthetic
gccaagcatttaggtgacactataggctttggagttggagattttgtttcagagctatgctggaaacagc

SEQ ID NO: 49378 - DNA, 70 bp, Artificial Sequence
  Synthetic
gccaagcatttaggtgacactataggtagcagagttcaagtcttcgtttcagagctatgctggaaacagc

SEQ ID NO: 49379 - DNA, 70 bp, Artificial Sequence
  Synthetic
gccaagcatttaggtgacactatagggactatatcaaggacatgagtttcagagctatgctggaaacagc

SEQ ID NO: 49380 - DNA, 70 bp, Artificial Sequence
  Synthetic
gccaagcatttaggtgacactatagacccagtggtccgggagttcgtttcagagctatgctggaaacagc

SEQ ID NO: 49381 - DNA, 70 bp, Artificial Sequence
  Synthetic
gccaagcatttaggtgacactatagcactaaagcctggtcatcacgtttcagagctatgctggaaacagc

SEQ ID NO: 49382 - DNA, 70 bp, Artificial Sequence
  Synthetic
gccaagcatttaggtgacactatagggaggcttcaagacctctcagtttcagagctatgctggaaacagc

SEQ ID NO: 49383 - DNA, 70 bp, Artificial Sequence
  Synthetic
gccaagcatttaggtgacactatagcctgaagctgaatgcctgaggtttcagagctatgctggaaacagc

SEQ ID NO: 49384 - DNA, 70 bp, Artificial Sequence
  Synthetic
gccaagcatttaggtgacactatagcggtcataggttaactgctggtttcagagctatgctggaaacagc

SEQ ID NO: 49385 - DNA, 70 bp, Artificial Sequence
  Synthetic
gccaagcatttaggtgacactatagggagtgagtgttcaagtcttgtttcagagctatgctggaaacagc

SEQ ID NO: 49386 - DNA, 70 bp, Artificial Sequence
  Synthetic
gccaagcatttaggtgacactatagcgcaaatccaaaacagacttgtttcagagctatgctggaaacagc

SEQ ID NO: 49387 - DNA, 70 bp, Artificial Sequence
  Synthetic
gccaagcatttaggtgacactatagtcactgggctatggccctttgtttcagagctatgctggaaacagc

SEQ ID NO: 49388 - DNA, 70 bp, Artificial Sequence
  Synthetic
gccaagcatttaggtgacactatagtgtcagctatttaaggaagggtttcagagctatgctggaaacagc

SEQ ID NO: 49389 - DNA, 70 bp, Artificial Sequence
  Synthetic
gccaagcatttaggtgacactatagttgacaagttcaattcttccgtttcagagctatgctggaaacagc

SEQ ID NO: 49390 - DNA, 70 bp, Artificial Sequence
  Synthetic
gccaagcatttaggtgacactatagtagcaggtggtttggttgccgtttcagagctatgctggaaacagc

SEQ ID NO: 49391 - DNA, 70 bp, Artificial Sequence
  Synthetic
gccaagcatttaggtgacactatagctcctgatatcagctaattcgtttcagagctatgctggaaacagc

SEQ ID NO: 49392 - DNA, 70 bp, Artificial Sequence
  Synthetic
gccaagcatttaggtgacactatagcagctgagtcacaattgtttgtttcagagctatgctggaaacagc

SEQ ID NO: 49393 - DNA, 70 bp, Artificial Sequence
  Synthetic
gccaagcatttaggtgacactatagtttgggatgctaaggaaaatgtttcagagctatgctggaaacagc

SEQ ID NO: 49394 - DNA, 70 bp, Artificial Sequence
  Synthetic
gccaagcatttaggtgacactatagcaggggaaacacgaaacatagtttcagagctatgctggaaacagc

SEQ ID NO: 49395 - DNA, 70 bp, Artificial Sequence
  Synthetic
gccaagcatttaggtgacactatagcctggagctgagtgcctgaggtttcagagctatgctggaaacagc

SEQ ID NO: 49396 - DNA, 70 bp, Artificial Sequence
  Synthetic
gccaagcatttaggtgacactataggagcagctcagttcagttccgtttcagagctatgctggaaacagc

SEQ ID NO: 49397 - DNA, 70 bp, Artificial Sequence
  Synthetic
gccaagcatttaggtgacactatagaagatgcctaccacaggcaagtttcagagctatgctggaaacagc

SEQ ID NO: 49398 - DNA, 70 bp, Artificial Sequence
  Synthetic
gccaagcatttaggtgacactatagatgggacctttgaggtcatcgtttcagagctatgctggaaacagc

SEQ ID NO: 49399 - DNA, 70 bp, Artificial Sequence
  Synthetic
gccaagcatttaggtgacactatagcctctgctcccagccagctggtttcagagctatgctggaaacagc

SEQ ID NO: 49400 - DNA, 70 bp, Artificial Sequence
  Synthetic
gccaagcatttaggtgacactatagtaccaggctggcagggaatggtttcagagctatgctggaaacagc

SEQ ID NO: 49401 - DNA, 70 bp, Artificial Sequence
  Synthetic
gccaagcatttaggtgacactatagtaccccacccgctccttgaagtttcagagctatgctggaaacagc

SEQ ID NO: 49402 - DNA, 70 bp, Artificial Sequence
  Synthetic
gccaagcatttaggtgacactatagtctttggagatgagctaggagtttcagagctatgctggaaacagc

SEQ ID NO: 49403 - DNA, 70 bp, Artificial Sequence
  Synthetic
gccaagcatttaggtgacactatagatgttcaaagctttggagttgtttcagagctatgctggaaacagc

SEQ ID NO: 49404 - DNA, 70 bp, Artificial Sequence
  Synthetic
gccaagcatttaggtgacactatagcagggattccatgaagcatcgtttcagagctatgctggaaacagc

SEQ ID NO: 49405 - DNA, 70 bp, Artificial Sequence
  Synthetic
gccaagcatttaggtgacactatagtggaccaggactcagcatgagtttcagagctatgctggaaacagc

SEQ ID NO: 49406 - DNA, 70 bp, Artificial Sequence
  Synthetic
gccaagcatttaggtgacactatagggtctccgtagagcttcagcgtttcagagctatgctggaaacagc

SEQ ID NO: 49407 - DNA, 70 bp, Artificial Sequence
  Synthetic
gccaagcatttaggtgacactatagtattgtagaagaagaactgcgtttcagagctatgctggaaacagc

SEQ ID NO: 49408 - DNA, 70 bp, Artificial Sequence
  Synthetic
gccaagcatttaggtgacactatagtgttacagatttagtgtctcgtttcagagctatgctggaaacagc

SEQ ID NO: 49409 - DNA, 70 bp, Artificial Sequence
  Synthetic
gccaagcatttaggtgacactatagtttagccaaggctgtggcaagtttcagagctatgctggaaacagc

SEQ ID NO: 49410 - DNA, 70 bp, Artificial Sequence
  Synthetic
gccaagcatttaggtgacactataggcagcagcaagtttctagcagtttcagagctatgctggaaacagc

SEQ ID NO: 49411 - DNA, 70 bp, Artificial Sequence
  Synthetic
gccaagcatttaggtgacactatagcccactgataggaaggtcctgtttcagagctatgctggaaacagc

SEQ ID NO: 49412 - DNA, 70 bp, Artificial Sequence
  Synthetic
gccaagcatttaggtgacactataggtggctgctgctagagtaccgtttcagagctatgctggaaacagc

SEQ ID NO: 49413 - DNA, 70 bp, Artificial Sequence
  Synthetic
gccaagcatttaggtgacactatagctagagttctgacttccattgtttcagagctatgctggaaacagc

SEQ ID NO: 49414 - DNA, 70 bp, Artificial Sequence
  Synthetic
gccaagcatttaggtgacactatagtgcgggacgtggacatctgagtttcagagctatgctggaaacagc

SEQ ID NO: 49415 - DNA, 70 bp, Artificial Sequence
  Synthetic
gccaagcatttaggtgacactatagggcccaactggcatcctcacgtttcagagctatgctggaaacagc

SEQ ID NO: 49416 - DNA, 70 bp, Artificial Sequence
  Synthetic
gccaagcatttaggtgacactataggagggcctctccagggctacgtttcagagctatgctggaaacagc

SEQ ID NO: 49417 - DNA, 70 bp, Artificial Sequence
  Synthetic
gccaagcatttaggtgacactatagcccctcagccagaagatagtgtttcagagctatgctggaaacagc

SEQ ID NO: 49418 - DNA, 70 bp, Artificial Sequence
  Synthetic
gccaagcatttaggtgacactatagtggggtggtcacgccatttcgtttcagagctatgctggaaacagc

SEQ ID NO: 49419 - DNA, 70 bp, Artificial Sequence
  Synthetic
gccaagcatttaggtgacactatagcttctttagtgttttcctgggtttcagagctatgctggaaacagc

SEQ ID NO: 49420 - DNA, 70 bp, Artificial Sequence
  Synthetic
gccaagcatttaggtgacactataggacacacttacagcctcacagtttcagagctatgctggaaacagc

SEQ ID NO: 49421 - DNA, 70 bp, Artificial Sequence
  Synthetic
gccaagcatttaggtgacactatagtcctgaaatggtcccttaacgtttcagagctatgctggaaacagc

SEQ ID NO: 49422 - DNA, 70 bp, Artificial Sequence
  Synthetic
gccaagcatttaggtgacactataggaaggtgcactcttgatcacgtttcagagctatgctggaaacagc

SEQ ID NO: 49423 - DNA, 70 bp, Artificial Sequence
  Synthetic
gccaagcatttaggtgacactatagatggttagagagattctaccgtttcagagctatgctggaaacagc

SEQ ID NO: 49424 - DNA, 70 bp, Artificial Sequence
  Synthetic
gccaagcatttaggtgacactataggctcccgacaatggatcaacgtttcagagctatgctggaaacagc

SEQ ID NO: 49425 - DNA, 70 bp, Artificial Sequence
  Synthetic
gccaagcatttaggtgacactatagtgaaactacatgacagaaacgtttcagagctatgctggaaacagc

SEQ ID NO: 49426 - DNA, 70 bp, Artificial Sequence
  Synthetic
gccaagcatttaggtgacactataggtggaggcagaggggctagtgtttcagagctatgctggaaacagc

SEQ ID NO: 49427 - DNA, 70 bp, Artificial Sequence
  Synthetic
gccaagcatttaggtgacactataggtctgagtgtttcttacaacgtttcagagctatgctggaaacagc

SEQ ID NO: 49428 - DNA, 70 bp, Artificial Sequence
  Synthetic
gccaagcatttaggtgacactatagcaccggctgctttgacagatgtttcagagctatgctggaaacagc

SEQ ID NO: 49429 - DNA, 70 bp, Artificial Sequence
  Synthetic
gccaagcatttaggtgacactatagaggctcacgttatctcatccgtttcagagctatgctggaaacagc

SEQ ID NO: 49430 - DNA, 70 bp, Artificial Sequence
  Synthetic
gccaagcatttaggtgacactataggctcaggacatggcaggcacgtttcagagctatgctggaaacagc

SEQ ID NO: 49431 - DNA, 70 bp, Artificial Sequence
  Synthetic
gccaagcatttaggtgacactatagtgaggtgggaggatcacttggtttcagagctatgctggaaacagc

SEQ ID NO: 49432 - DNA, 70 bp, Artificial Sequence
  Synthetic
gccaagcatttaggtgacactatagagcaggcatcggaggtgagggtttcagagctatgctggaaacagc

SEQ ID NO: 49433 - DNA, 70 bp, Artificial Sequence
  Synthetic
gccaagcatttaggtgacactatagtcttagtcacttaccctcaggtttcagagctatgctggaaacagc

SEQ ID NO: 49434 - DNA, 70 bp, Artificial Sequence
  Synthetic
gccaagcatttaggtgacactatagatctgttttatttcgagctcgtttcagagctatgctggaaacagc

SEQ ID NO: 49435 - DNA, 70 bp, Artificial Sequence
  Synthetic
gccaagcatttaggtgacactatagggcctgggccaggaccttaggtttcagagctatgctggaaacagc

SEQ ID NO: 49436 - DNA, 70 bp, Artificial Sequence
  Synthetic
gccaagcatttaggtgacactatagtttttttacttaggaagggggtttcagagctatgctggaaacagc

SEQ ID NO: 49437 - DNA, 70 bp, Artificial Sequence
  Synthetic
gccaagcatttaggtgacactataggactcactgttaagtgcccagtttcagagctatgctggaaacagc

SEQ ID NO: 49438 - DNA, 70 bp, Artificial Sequence
  Synthetic
gccaagcatttaggtgacactataggtgattggcatcaggaccgtgtttcagagctatgctggaaacagc

SEQ ID NO: 49439 - DNA, 70 bp, Artificial Sequence
  Synthetic
gccaagcatttaggtgacactatagcctccgtagttaagagatgagtttcagagctatgctggaaacagc

SEQ ID NO: 49440 - DNA, 70 bp, Artificial Sequence
  Synthetic
gccaagcatttaggtgacactatagtaaagccatcctctcttaaagtttcagagctatgctggaaacagc

SEQ ID NO: 49441 - DNA, 70 bp, Artificial Sequence
  Synthetic
gccaagcatttaggtgacactatagcaacatttggccgctttcttgtttcagagctatgctggaaacagc

SEQ ID NO: 49442 - DNA, 70 bp, Artificial Sequence
  Synthetic
gccaagcatttaggtgacactatagcggttttatgtaaaccgaccgtttcagagctatgctggaaacagc

SEQ ID NO: 49443 - DNA, 70 bp, Artificial Sequence
  Synthetic
gccaagcatttaggtgacactatagtcgcactaatggaagacaaagtttcagagctatgctggaaacagc

SEQ ID NO: 49444 - DNA, 70 bp, Artificial Sequence
  Synthetic
gccaagcatttaggtgacactataggggagcatgaactctctgctgtttcagagctatgctggaaacagc

SEQ ID NO: 49445 - DNA, 70 bp, Artificial Sequence
  Synthetic
gccaagcatttaggtgacactatagagtctctcctgggacaactagtttcagagctatgctggaaacagc

SEQ ID NO: 49446 - DNA, 70 bp, Artificial Sequence
  Synthetic
gccaagcatttaggtgacactataggccagtcttcaggacaaagagtttcagagctatgctggaaacagc

SEQ ID NO: 49447 - DNA, 70 bp, Artificial Sequence
  Synthetic
gccaagcatttaggtgacactatagggggagcaggaagtctcggcgtttcagagctatgctggaaacagc

SEQ ID NO: 49448 - DNA, 70 bp, Artificial Sequence
  Synthetic
gccaagcatttaggtgacactatagctctccatccacagcagagcgtttcagagctatgctggaaacagc

SEQ ID NO: 49449 - DNA, 70 bp, Artificial Sequence
  Synthetic
gccaagcatttaggtgacactatagatcatggagatcatgatccagtttcagagctatgctggaaacagc

SEQ ID NO: 49450 - DNA, 70 bp, Artificial Sequence
  Synthetic
gccaagcatttaggtgacactatagatatctgtgggcttgtgacagtttcagagctatgctggaaacagc

SEQ ID NO: 49451 - DNA, 70 bp, Artificial Sequence
  Synthetic
gccaagcatttaggtgacactatagagctttctatcacatagtgagtttcagagctatgctggaaacagc

SEQ ID NO: 49452 - DNA, 70 bp, Artificial Sequence
  Synthetic
gccaagcatttaggtgacactatagcaggcagaagagtcgcctatgtttcagagctatgctggaaacagc

SEQ ID NO: 49453 - DNA, 70 bp, Artificial Sequence
  Synthetic
gccaagcatttaggtgacactatagagcgtagactacattttgtggtttcagagctatgctggaaacagc

SEQ ID NO: 49454 - DNA, 70 bp, Artificial Sequence
  Synthetic
gccaagcatttaggtgacactatagcctcagagaagacccctcaggtttcagagctatgctggaaacagc

SEQ ID NO: 49455 - DNA, 70 bp, Artificial Sequence
  Synthetic
gccaagcatttaggtgacactataggtggatgctagtttacacttgtttcagagctatgctggaaacagc

SEQ ID NO: 49456 - DNA, 70 bp, Artificial Sequence
  Synthetic
gccaagcatttaggtgacactatagccccctgcccacctttgagcgtttcagagctatgctggaaacagc

SEQ ID NO: 49457 - DNA, 70 bp, Artificial Sequence
  Synthetic
gccaagcatttaggtgacactatagagaatacatgaggtgctattgtttcagagctatgctggaaacagc

SEQ ID NO: 49458 - DNA, 70 bp, Artificial Sequence
  Synthetic
gccaagcatttaggtgacactatagaaactctaggccagcaggatgtttcagagctatgctggaaacagc

SEQ ID NO: 49459 - DNA, 70 bp, Artificial Sequence
  Synthetic
gccaagcatttaggtgacactatagtcaggttttcagaattccctgtttcagagctatgctggaaacagc

SEQ ID NO: 49460 - DNA, 70 bp, Artificial Sequence
  Synthetic
gccaagcatttaggtgacactatagaagacgagaatatcgattaggtttcagagctatgctggaaacagc

SEQ ID NO: 49461 - DNA, 70 bp, Artificial Sequence
  Synthetic
gccaagcatttaggtgacactatagatcacaagtctctctatagtgtttcagagctatgctggaaacagc

SEQ ID NO: 49462 - DNA, 70 bp, Artificial Sequence
  Synthetic
gccaagcatttaggtgacactatagcttggattgagcattcactggtttcagagctatgctggaaacagc

SEQ ID NO: 49463 - DNA, 70 bp, Artificial Sequence
  Synthetic
gccaagcatttaggtgacactataggtggctttattagttttcccgtttcagagctatgctggaaacagc

SEQ ID NO: 49464 - DNA, 70 bp, Artificial Sequence
  Synthetic
gccaagcatttaggtgacactatagagcacgtgggaatgcttaacgtttcagagctatgctggaaacagc

SEQ ID NO: 49465 - DNA, 70 bp, Artificial Sequence
  Synthetic
gccaagcatttaggtgacactatagccttgcctagcactcactccgtttcagagctatgctggaaacagc

SEQ ID NO: 49466 - DNA, 70 bp, Artificial Sequence
  Synthetic
gccaagcatttaggtgacactataggtggtaaacactcgataatcgtttcagagctatgctggaaacagc

SEQ ID NO: 49467 - DNA, 70 bp, Artificial Sequence
  Synthetic
gccaagcatttaggtgacactatagcttcattcttcagattctccgtttcagagctatgctggaaacagc

SEQ ID NO: 49468 - DNA, 70 bp, Artificial Sequence
  Synthetic
gccaagcatttaggtgacactataggctggaatgtcttctctgaagtttcagagctatgctggaaacagc

SEQ ID NO: 49469 - DNA, 70 bp, Artificial Sequence
  Synthetic
gccaagcatttaggtgacactatagttgatgaaattatgcgagctgtttcagagctatgctggaaacagc

SEQ ID NO: 49470 - DNA, 70 bp, Artificial Sequence
  Synthetic
gccaagcatttaggtgacactatagatgggtggggtgcctctcaggtttcagagctatgctggaaacagc

SEQ ID NO: 49471 - DNA, 70 bp, Artificial Sequence
  Synthetic
gccaagcatttaggtgacactatagtccaagtgggaagaaagactgtttcagagctatgctggaaacagc

SEQ ID NO: 49472 - DNA, 70 bp, Artificial Sequence
  Synthetic
gccaagcatttaggtgacactatagaaagaaacacccacctcctggtttcagagctatgctggaaacagc

SEQ ID NO: 49473 - DNA, 70 bp, Artificial Sequence
  Synthetic
gccaagcatttaggtgacactatagacatcttcttcttggattgagtttcagagctatgctggaaacagc

SEQ ID NO: 49474 - DNA, 70 bp, Artificial Sequence
  Synthetic
gccaagcatttaggtgacactataggaagacgaggaggaagatgagtttcagagctatgctggaaacagc

SEQ ID NO: 49475 - DNA, 70 bp, Artificial Sequence
  Synthetic
gccaagcatttaggtgacactatagaaatgactgaagagtgatgagtttcagagctatgctggaaacagc

SEQ ID NO: 49476 - DNA, 70 bp, Artificial Sequence
  Synthetic
gccaagcatttaggtgacactatagttggatcttaggcaaagcccgtttcagagctatgctggaaacagc

SEQ ID NO: 49477 - DNA, 70 bp, Artificial Sequence
  Synthetic
gccaagcatttaggtgacactatagcctgtacaggagtctcaagcgtttcagagctatgctggaaacagc

SEQ ID NO: 49478 - DNA, 70 bp, Artificial Sequence
  Synthetic
gccaagcatttaggtgacactatagaatgctggtcaccagccttggtttcagagctatgctggaaacagc

SEQ ID NO: 49479 - DNA, 70 bp, Artificial Sequence
  Synthetic
gccaagcatttaggtgacactatagcattctgagccacactgaaagtttcagagctatgctggaaacagc

SEQ ID NO: 49480 - DNA, 70 bp, Artificial Sequence
  Synthetic
gccaagcatttaggtgacactataggccacactgaaaaggaaaatgtttcagagctatgctggaaacagc

SEQ ID NO: 49481 - DNA, 70 bp, Artificial Sequence
  Synthetic
gccaagcatttaggtgacactatagaagtcattttgtggcttcaggtttcagagctatgctggaaacagc

SEQ ID NO: 49482 - DNA, 70 bp, Artificial Sequence
  Synthetic
gccaagcatttaggtgacactatagatgggtctgtttacagagtggtttcagagctatgctggaaacagc

SEQ ID NO: 49483 - DNA, 70 bp, Artificial Sequence
  Synthetic
gccaagcatttaggtgacactatagctggaatgtagttccttgtggtttcagagctatgctggaaacagc

SEQ ID NO: 49484 - DNA, 70 bp, Artificial Sequence
  Synthetic
gccaagcatttaggtgacactatagggccaggtactcacagcgtcgtttcagagctatgctggaaacagc

SEQ ID NO: 49485 - DNA, 70 bp, Artificial Sequence
  Synthetic
gccaagcatttaggtgacactatagcgtctggtaggtgctgtcctgtttcagagctatgctggaaacagc

SEQ ID NO: 49486 - DNA, 70 bp, Artificial Sequence
  Synthetic
gccaagcatttaggtgacactataggtgggggtaatagagttagcgtttcagagctatgctggaaacagc

SEQ ID NO: 49487 - DNA, 70 bp, Artificial Sequence
  Synthetic
gccaagcatttaggtgacactatagaccttcagcactaaatgtgtgtttcagagctatgctggaaacagc

SEQ ID NO: 49488 - DNA, 70 bp, Artificial Sequence
  Synthetic
gccaagcatttaggtgacactatagctggccacctgaggatcaccgtttcagagctatgctggaaacagc

SEQ ID NO: 49489 - DNA, 70 bp, Artificial Sequence
  Synthetic
gccaagcatttaggtgacactatagtaggtcttgcgctttggttcgtttcagagctatgctggaaacagc

SEQ ID NO: 49490 - DNA, 70 bp, Artificial Sequence
  Synthetic
gccaagcatttaggtgacactataggagacatgatgatggctcatgtttcagagctatgctggaaacagc

SEQ ID NO: 49491 - DNA, 70 bp, Artificial Sequence
  Synthetic
gccaagcatttaggtgacactataggtcagggggaagagtctcacgtttcagagctatgctggaaacagc

SEQ ID NO: 49492 - DNA, 70 bp, Artificial Sequence
  Synthetic
gccaagcatttaggtgacactataggatgtggcaaggcgagtcacgtttcagagctatgctggaaacagc

SEQ ID NO: 49493 - DNA, 70 bp, Artificial Sequence
  Synthetic
gccaagcatttaggtgacactatagaaagcaaatgtcaccagagtgtttcagagctatgctggaaacagc

SEQ ID NO: 49494 - DNA, 70 bp, Artificial Sequence
  Synthetic
gccaagcatttaggtgacactataggatagttaccctggtcatatgtttcagagctatgctggaaacagc

SEQ ID NO: 49495 - DNA, 70 bp, Artificial Sequence
  Synthetic
gccaagcatttaggtgacactatagatgagttttctgctgccccagtttcagagctatgctggaaacagc

SEQ ID NO: 49496 - DNA, 70 bp, Artificial Sequence
  Synthetic
gccaagcatttaggtgacactatagctggaaacgtcaccggaatcgtttcagagctatgctggaaacagc

SEQ ID NO: 49497 - DNA, 70 bp, Artificial Sequence
  Synthetic
gccaagcatttaggtgacactatagaaacaaggtgaaggcatctggtttcagagctatgctggaaacagc

SEQ ID NO: 49498 - DNA, 70 bp, Artificial Sequence
  Synthetic
gccaagcatttaggtgacactatagtcacatcaccagatttgtgagtttcagagctatgctggaaacagc

SEQ ID NO: 49499 - DNA, 70 bp, Artificial Sequence
  Synthetic
gccaagcatttaggtgacactatagcaggatttgttttcttccaggtttcagagctatgctggaaacagc

SEQ ID NO: 49500 - DNA, 70 bp, Artificial Sequence
  Synthetic
gccaagcatttaggtgacactatagtgtcccatcagaaccgtgacgtttcagagctatgctggaaacagc

SEQ ID NO: 49501 - DNA, 70 bp, Artificial Sequence
  Synthetic
gccaagcatttaggtgacactatagggggtgaagttctgctacgcgtttcagagctatgctggaaacagc

SEQ ID NO: 49502 - DNA, 70 bp, Artificial Sequence
  Synthetic
gccaagcatttaggtgacactatagccatccagtgtcaatgtttggtttcagagctatgctggaaacagc

SEQ ID NO: 49503 - DNA, 70 bp, Artificial Sequence
  Synthetic
gccaagcatttaggtgacactatagtcccccggactgcgatgacagtttcagagctatgctggaaacagc

SEQ ID NO: 49504 - DNA, 70 bp, Artificial Sequence
  Synthetic
gccaagcatttaggtgacactatagagtctttggtctgcgagagagtttcagagctatgctggaaacagc

SEQ ID NO: 49505 - DNA, 70 bp, Artificial Sequence
  Synthetic
gccaagcatttaggtgacactatagagttccagttgttgtttcacgtttcagagctatgctggaaacagc

SEQ ID NO: 49506 - DNA, 70 bp, Artificial Sequence
  Synthetic
gccaagcatttaggtgacactataggtcaacagccagtctcttcggtttcagagctatgctggaaacagc

SEQ ID NO: 49507 - DNA, 70 bp, Artificial Sequence
  Synthetic
gccaagcatttaggtgacactatagtcgattgagccgcaaagagcgtttcagagctatgctggaaacagc

SEQ ID NO: 49508 - DNA, 70 bp, Artificial Sequence
  Synthetic
gccaagcatttaggtgacactatagtacagggcacaggccatggagtttcagagctatgctggaaacagc

SEQ ID NO: 49509 - DNA, 70 bp, Artificial Sequence
  Synthetic
gccaagcatttaggtgacactatagtgcagaaccagcgtgtgatggtttcagagctatgctggaaacagc

SEQ ID NO: 49510 - DNA, 70 bp, Artificial Sequence
  Synthetic
gccaagcatttaggtgacactatagtcccgcaggtgctggctcaggtttcagagctatgctggaaacagc

SEQ ID NO: 49511 - DNA, 70 bp, Artificial Sequence
  Synthetic
gccaagcatttaggtgacactatagcagacatcatgctaggtgctgtttcagagctatgctggaaacagc

SEQ ID NO: 49512 - DNA, 70 bp, Artificial Sequence
  Synthetic
gccaagcatttaggtgacactatagtgaatgtcagtgctacaccagtttcagagctatgctggaaacagc

SEQ ID NO: 49513 - DNA, 70 bp, Artificial Sequence
  Synthetic
gccaagcatttaggtgacactatagttgctgtcagagtgtttcaggtttcagagctatgctggaaacagc

SEQ ID NO: 49514 - DNA, 70 bp, Artificial Sequence
  Synthetic
gccaagcatttaggtgacactataggcagcctatcgctcctgacagtttcagagctatgctggaaacagc

SEQ ID NO: 49515 - DNA, 70 bp, Artificial Sequence
  Synthetic
gccaagcatttaggtgacactatagagctgtcctgtcttcttgaggtttcagagctatgctggaaacagc

SEQ ID NO: 49516 - DNA, 70 bp, Artificial Sequence
  Synthetic
gccaagcatttaggtgacactatagcccagcaggctcaggtgtaggtttcagagctatgctggaaacagc

SEQ ID NO: 49517 - DNA, 70 bp, Artificial Sequence
  Synthetic
gccaagcatttaggtgacactatagcagtgtgataaggaagacatgtttcagagctatgctggaaacagc

SEQ ID NO: 49518 - DNA, 70 bp, Artificial Sequence
  Synthetic
gccaagcatttaggtgacactatagtgatggacagcagatgctacgtttcagagctatgctggaaacagc

SEQ ID NO: 49519 - DNA, 70 bp, Artificial Sequence
  Synthetic
gccaagcatttaggtgacactatagtcagcctggctctatcttccgtttcagagctatgctggaaacagc

SEQ ID NO: 49520 - DNA, 70 bp, Artificial Sequence
  Synthetic
gccaagcatttaggtgacactatagacaggccttggaggactcctgtttcagagctatgctggaaacagc

SEQ ID NO: 49521 - DNA, 70 bp, Artificial Sequence
  Synthetic
gccaagcatttaggtgacactatagtgcagatccatctctctaaggtttcagagctatgctggaaacagc

SEQ ID NO: 49522 - DNA, 70 bp, Artificial Sequence
  Synthetic
gccaagcatttaggtgacactataggaccacaaagaaggtcttgagtttcagagctatgctggaaacagc

SEQ ID NO: 49523 - DNA, 70 bp, Artificial Sequence
  Synthetic
gccaagcatttaggtgacactatagtgcaggctaaggcctgctgagtttcagagctatgctggaaacagc

SEQ ID NO: 49524 - DNA, 70 bp, Artificial Sequence
  Synthetic
gccaagcatttaggtgacactatagttcctctgcccaggttgaccgtttcagagctatgctggaaacagc

SEQ ID NO: 49525 - DNA, 70 bp, Artificial Sequence
  Synthetic
gccaagcatttaggtgacactatagccaccttggtctcagagccagtttcagagctatgctggaaacagc

SEQ ID NO: 49526 - DNA, 70 bp, Artificial Sequence
  Synthetic
gccaagcatttaggtgacactatagtcgaagtttgtctcagcgtagtttcagagctatgctggaaacagc

SEQ ID NO: 49527 - DNA, 70 bp, Artificial Sequence
  Synthetic
gccaagcatttaggtgacactatagttcaaactgagagaaaagtcgtttcagagctatgctggaaacagc

SEQ ID NO: 49528 - DNA, 70 bp, Artificial Sequence
  Synthetic
gccaagcatttaggtgacactataggaagactgtgttttggtagtgtttcagagctatgctggaaacagc

SEQ ID NO: 49529 - DNA, 70 bp, Artificial Sequence
  Synthetic
gccaagcatttaggtgacactatagcagaagacctcgctgccctggtttcagagctatgctggaaacagc

SEQ ID NO: 49530 - DNA, 70 bp, Artificial Sequence
  Synthetic
gccaagcatttaggtgacactatagtaccacagggtcagcctcccgtttcagagctatgctggaaacagc

SEQ ID NO: 49531 - DNA, 70 bp, Artificial Sequence
  Synthetic
gccaagcatttaggtgacactatagtgctcttgtgggttcctcacgtttcagagctatgctggaaacagc

SEQ ID NO: 49532 - DNA, 70 bp, Artificial Sequence
  Synthetic
gccaagcatttaggtgacactataggagccccacaggagaaaggcgtttcagagctatgctggaaacagc

SEQ ID NO: 49533 - DNA, 70 bp, Artificial Sequence
  Synthetic
gccaagcatttaggtgacactataggctgataccgaattgtgactgtttcagagctatgctggaaacagc

SEQ ID NO: 49534 - DNA, 70 bp, Artificial Sequence
  Synthetic
gccaagcatttaggtgacactataggatcttactcagtgttggtggtttcagagctatgctggaaacagc

SEQ ID NO: 49535 - DNA, 70 bp, Artificial Sequence
  Synthetic
gccaagcatttaggtgacactatagttggggagggcggggcctaagtttcagagctatgctggaaacagc

SEQ ID NO: 49536 - DNA, 70 bp, Artificial Sequence
  Synthetic
gccaagcatttaggtgacactataggatgtgcaagatgaatcctcgtttcagagctatgctggaaacagc

SEQ ID NO: 49537 - DNA, 70 bp, Artificial Sequence
  Synthetic
gccaagcatttaggtgacactatagaccttggaggaaactgggctgtttcagagctatgctggaaacagc

SEQ ID NO: 49538 - DNA, 70 bp, Artificial Sequence
  Synthetic
gccaagcatttaggtgacactataggtcagatgcgtctctgattcgtttcagagctatgctggaaacagc

SEQ ID NO: 49539 - DNA, 70 bp, Artificial Sequence
  Synthetic
gccaagcatttaggtgacactatagttcccgggggcagactacacgtttcagagctatgctggaaacagc

SEQ ID NO: 49540 - DNA, 70 bp, Artificial Sequence
  Synthetic
gccaagcatttaggtgacactatagttcaaggaaaccagttgagggtttcagagctatgctggaaacagc

SEQ ID NO: 49541 - DNA, 70 bp, Artificial Sequence
  Synthetic
gccaagcatttaggtgacactataggcctggcctcgtgcctcaaagtttcagagctatgctggaaacagc

SEQ ID NO: 49542 - DNA, 70 bp, Artificial Sequence
  Synthetic
gccaagcatttaggtgacactatagggccaagaagccaaccaatagtttcagagctatgctggaaacagc

SEQ ID NO: 49543 - DNA, 70 bp, Artificial Sequence
  Synthetic
gccaagcatttaggtgacactatagtcagtgcaggagagacagtggtttcagagctatgctggaaacagc

SEQ ID NO: 49544 - DNA, 70 bp, Artificial Sequence
  Synthetic
gccaagcatttaggtgacactatagtcagagtttgagtaagccaagtttcagagctatgctggaaacagc

SEQ ID NO: 49545 - DNA, 70 bp, Artificial Sequence
  Synthetic
gccaagcatttaggtgacactatagaactgcaagaatcaaagccagtttcagagctatgctggaaacagc

SEQ ID NO: 49546 - DNA, 70 bp, Artificial Sequence
  Synthetic
gccaagcatttaggtgacactataggaatgtggacatgaagattggtttcagagctatgctggaaacagc

SEQ ID NO: 49547 - DNA, 70 bp, Artificial Sequence
  Synthetic
gccaagcatttaggtgacactatagtctcatcagctgtcataaacgtttcagagctatgctggaaacagc

SEQ ID NO: 49548 - DNA, 70 bp, Artificial Sequence
  Synthetic
gccaagcatttaggtgacactatagaccactccagcagagcagaggtttcagagctatgctggaaacagc

SEQ ID NO: 49549 - DNA, 70 bp, Artificial Sequence
  Synthetic
gccaagcatttaggtgacactatagctctgtgggtctcatcagttgtttcagagctatgctggaaacagc

SEQ ID NO: 49550 - DNA, 70 bp, Artificial Sequence
  Synthetic
gccaagcatttaggtgacactatagagaagactatacaacctcctgtttcagagctatgctggaaacagc

SEQ ID NO: 49551 - DNA, 70 bp, Artificial Sequence
  Synthetic
gccaagcatttaggtgacactatagagcctccttgcacagtgtgggtttcagagctatgctggaaacagc

SEQ ID NO: 49552 - DNA, 70 bp, Artificial Sequence
  Synthetic
gccaagcatttaggtgacactataggctcatctcaggtaagtaacgtttcagagctatgctggaaacagc

SEQ ID NO: 49553 - DNA, 70 bp, Artificial Sequence
  Synthetic
gccaagcatttaggtgacactatagatgatctgcatggggctcaggtttcagagctatgctggaaacagc

SEQ ID NO: 49554 - DNA, 70 bp, Artificial Sequence
  Synthetic
gccaagcatttaggtgacactatagcacctcttctgcttcagttggtttcagagctatgctggaaacagc

SEQ ID NO: 49555 - DNA, 70 bp, Artificial Sequence
  Synthetic
gccaagcatttaggtgacactatagtactgcagatcatagccctagtttcagagctatgctggaaacagc

SEQ ID NO: 49556 - DNA, 70 bp, Artificial Sequence
  Synthetic
gccaagcatttaggtgacactatagtggctaagtcagcaagcccagtttcagagctatgctggaaacagc

SEQ ID NO: 49557 - DNA, 70 bp, Artificial Sequence
  Synthetic
gccaagcatttaggtgacactatagcaagaactggagtgacctaggtttcagagctatgctggaaacagc

SEQ ID NO: 49558 - DNA, 70 bp, Artificial Sequence
  Synthetic
gccaagcatttaggtgacactatagtataatcgcaacgttttggggtttcagagctatgctggaaacagc

SEQ ID NO: 49559 - DNA, 70 bp, Artificial Sequence
  Synthetic
gccaagcatttaggtgacactatagacaacctgtatcccaagcaggtttcagagctatgctggaaacagc

SEQ ID NO: 49560 - DNA, 70 bp, Artificial Sequence
  Synthetic
gccaagcatttaggtgacactatagcagcctgcagtgtacttactgtttcagagctatgctggaaacagc

SEQ ID NO: 49561 - DNA, 70 bp, Artificial Sequence
  Synthetic
gccaagcatttaggtgacactatagtggtgttgacttagggatgagtttcagagctatgctggaaacagc

SEQ ID NO: 49562 - DNA, 70 bp, Artificial Sequence
  Synthetic
gccaagcatttaggtgacactatagctgcacccaccaggaagatggtttcagagctatgctggaaacagc

SEQ ID NO: 49563 - DNA, 70 bp, Artificial Sequence
  Synthetic
gccaagcatttaggtgacactataggatgtggctgtcatctgctcgtttcagagctatgctggaaacagc

SEQ ID NO: 49564 - DNA, 70 bp, Artificial Sequence
  Synthetic
gccaagcatttaggtgacactataggacatcagcgcagcctaggcgtttcagagctatgctggaaacagc

SEQ ID NO: 49565 - DNA, 70 bp, Artificial Sequence
  Synthetic
gccaagcatttaggtgacactataggtggctacgaggtgatgtaggtttcagagctatgctggaaacagc

SEQ ID NO: 49566 - DNA, 70 bp, Artificial Sequence
  Synthetic
gccaagcatttaggtgacactatagggtttgaagcaaatgctcaggtttcagagctatgctggaaacagc

SEQ ID NO: 49567 - DNA, 70 bp, Artificial Sequence
  Synthetic
gccaagcatttaggtgacactatagaaacacagaggtcagcagcagtttcagagctatgctggaaacagc

SEQ ID NO: 49568 - DNA, 70 bp, Artificial Sequence
  Synthetic
gccaagcatttaggtgacactataggcaggggcccactgggtcacgtttcagagctatgctggaaacagc

SEQ ID NO: 49569 - DNA, 70 bp, Artificial Sequence
  Synthetic
gccaagcatttaggtgacactatagactttggacagatgactcaagtttcagagctatgctggaaacagc

SEQ ID NO: 49570 - DNA, 70 bp, Artificial Sequence
  Synthetic
gccaagcatttaggtgacactatagtaatcagcagcagtggtcaggtttcagagctatgctggaaacagc

SEQ ID NO: 49571 - DNA, 70 bp, Artificial Sequence
  Synthetic
gccaagcatttaggtgacactatagtgcaaaggactgtcctaatcgtttcagagctatgctggaaacagc

SEQ ID NO: 49572 - DNA, 70 bp, Artificial Sequence
  Synthetic
gccaagcatttaggtgacactatagccgcctctgctgctctcacagtttcagagctatgctggaaacagc

SEQ ID NO: 49573 - DNA, 70 bp, Artificial Sequence
  Synthetic
gccaagcatttaggtgacactataggaggacccgtcttctgggctgtttcagagctatgctggaaacagc

SEQ ID NO: 49574 - DNA, 70 bp, Artificial Sequence
  Synthetic
gccaagcatttaggtgacactatagggtgtcacggcttctccagcgtttcagagctatgctggaaacagc

SEQ ID NO: 49575 - DNA, 70 bp, Artificial Sequence
  Synthetic
gccaagcatttaggtgacactatagggcgacctggctctcactccgtttcagagctatgctggaaacagc

SEQ ID NO: 49576 - DNA, 70 bp, Artificial Sequence
  Synthetic
gccaagcatttaggtgacactatagttctgcggacactgttatacgtttcagagctatgctggaaacagc

SEQ ID NO: 49577 - DNA, 70 bp, Artificial Sequence
  Synthetic
gccaagcatttaggtgacactatagcggaacagctccgtgtactggtttcagagctatgctggaaacagc

SEQ ID NO: 49578 - DNA, 70 bp, Artificial Sequence
  Synthetic
gccaagcatttaggtgacactatagagcaaggtccccaagtactggtttcagagctatgctggaaacagc

SEQ ID NO: 49579 - DNA, 70 bp, Artificial Sequence
  Synthetic
gccaagcatttaggtgacactatagaagacagaactggtatgagcgtttcagagctatgctggaaacagc

SEQ ID NO: 49580 - DNA, 70 bp, Artificial Sequence
  Synthetic
gccaagcatttaggtgacactatagcttatcagcaaactgcacttgtttcagagctatgctggaaacagc

SEQ ID NO: 49581 - DNA, 70 bp, Artificial Sequence
  Synthetic
gccaagcatttaggtgacactatagatttcatagcttgaagtcccgtttcagagctatgctggaaacagc

SEQ ID NO: 49582 - DNA, 70 bp, Artificial Sequence
  Synthetic
gccaagcatttaggtgacactatagtcgaacttttaaaaacacgcgtttcagagctatgctggaaacagc

SEQ ID NO: 49583 - DNA, 70 bp, Artificial Sequence
  Synthetic
gccaagcatttaggtgacactatagcgcccagatgtagatatcacgtttcagagctatgctggaaacagc

SEQ ID NO: 49584 - DNA, 70 bp, Artificial Sequence
  Synthetic
gccaagcatttaggtgacactataggttagacgtatctcgccgaagtttcagagctatgctggaaacagc

SEQ ID NO: 49585 - DNA, 70 bp, Artificial Sequence
  Synthetic
gccaagcatttaggtgacactatagtaatgtagtggctgttgcacgtttcagagctatgctggaaacagc

SEQ ID NO: 49586 - DNA, 70 bp, Artificial Sequence
  Synthetic
gccaagcatttaggtgacactataggcctatgttttcaggatccagtttcagagctatgctggaaacagc

SEQ ID NO: 49587 - DNA, 70 bp, Artificial Sequence
  Synthetic
gccaagcatttaggtgacactatagactggagaaatgttccagaagtttcagagctatgctggaaacagc

SEQ ID NO: 49588 - DNA, 70 bp, Artificial Sequence
  Synthetic
gccaagcatttaggtgacactatagcccatggatcctgaaaacatgtttcagagctatgctggaaacagc

SEQ ID NO: 49589 - DNA, 70 bp, Artificial Sequence
  Synthetic
gccaagcatttaggtgacactataggaagccgggctctcctccgcgtttcagagctatgctggaaacagc

SEQ ID NO: 49590 - DNA, 70 bp, Artificial Sequence
  Synthetic
gccaagcatttaggtgacactataggctgactctagaccatctcggtttcagagctatgctggaaacagc

SEQ ID NO: 49591 - DNA, 70 bp, Artificial Sequence
  Synthetic
gccaagcatttaggtgacactatagcactttcagcagtctgtcccgtttcagagctatgctggaaacagc

SEQ ID NO: 49592 - DNA, 70 bp, Artificial Sequence
  Synthetic
gccaagcatttaggtgacactatagacttgcaggagatacactgcgtttcagagctatgctggaaacagc

SEQ ID NO: 49593 - DNA, 70 bp, Artificial Sequence
  Synthetic
gccaagcatttaggtgacactataggcaaagtctcacgagactaggtttcagagctatgctggaaacagc

SEQ ID NO: 49594 - DNA, 70 bp, Artificial Sequence
  Synthetic
gccaagcatttaggtgacactatagaagaaaaaagaaaaagggccgtttcagagctatgctggaaacagc

SEQ ID NO: 49595 - DNA, 70 bp, Artificial Sequence
  Synthetic
gccaagcatttaggtgacactatagctggctctgcgttggcattcgtttcagagctatgctggaaacagc

SEQ ID NO: 49596 - DNA, 70 bp, Artificial Sequence
  Synthetic
gccaagcatttaggtgacactatagccgaaccagcccggatctgagtttcagagctatgctggaaacagc

SEQ ID NO: 49597 - DNA, 70 bp, Artificial Sequence
  Synthetic
gccaagcatttaggtgacactataggggcattctctggctgtcacgtttcagagctatgctggaaacagc

SEQ ID NO: 49598 - DNA, 70 bp, Artificial Sequence
  Synthetic
gccaagcatttaggtgacactatagcgcctcggaatccactaagagtttcagagctatgctggaaacagc

SEQ ID NO: 49599 - DNA, 70 bp, Artificial Sequence
  Synthetic
gccaagcatttaggtgacactatagttgaacaaaatgagcctgaagtttcagagctatgctggaaacagc

SEQ ID NO: 49600 - DNA, 70 bp, Artificial Sequence
  Synthetic
gccaagcatttaggtgacactatagactgtgctggcccagagctagtttcagagctatgctggaaacagc

SEQ ID NO: 49601 - DNA, 70 bp, Artificial Sequence
  Synthetic
gccaagcatttaggtgacactatagtgtagacctctctactgggggtttcagagctatgctggaaacagc

SEQ ID NO: 49602 - DNA, 70 bp, Artificial Sequence
  Synthetic
gccaagcatttaggtgacactatagcgctgaagaagaagaaagccgtttcagagctatgctggaaacagc

SEQ ID NO: 49603 - DNA, 70 bp, Artificial Sequence
  Synthetic
gccaagcatttaggtgacactataggagaaattggtaaggagagcgtttcagagctatgctggaaacagc

SEQ ID NO: 49604 - DNA, 70 bp, Artificial Sequence
  Synthetic
gccaagcatttaggtgacactataggagggaaggcatcgctcagagtttcagagctatgctggaaacagc

SEQ ID NO: 49605 - DNA, 70 bp, Artificial Sequence
  Synthetic
gccaagcatttaggtgacactatagtggagaggtaagttttccctgtttcagagctatgctggaaacagc

SEQ ID NO: 49606 - DNA, 70 bp, Artificial Sequence
  Synthetic
gccaagcatttaggtgacactatagatcctgctattctgtctcgagtttcagagctatgctggaaacagc

SEQ ID NO: 49607 - DNA, 70 bp, Artificial Sequence
  Synthetic
gccaagcatttaggtgacactataggaaccaccagatctgcttcagtttcagagctatgctggaaacagc

SEQ ID NO: 49608 - DNA, 70 bp, Artificial Sequence
  Synthetic
gccaagcatttaggtgacactataggagaggaatagcgtttgtttgtttcagagctatgctggaaacagc

SEQ ID NO: 49609 - DNA, 70 bp, Artificial Sequence
  Synthetic
gccaagcatttaggtgacactatagctgactggagtcacgtgctggtttcagagctatgctggaaacagc

SEQ ID NO: 49610 - DNA, 70 bp, Artificial Sequence
  Synthetic
gccaagcatttaggtgacactatagggtgatgggttggtcttcaggtttcagagctatgctggaaacagc

SEQ ID NO: 49611 - DNA, 70 bp, Artificial Sequence
  Synthetic
gccaagcatttaggtgacactatagctagtagcaattccatacaggtttcagagctatgctggaaacagc

SEQ ID NO: 49612 - DNA, 70 bp, Artificial Sequence
  Synthetic
gccaagcatttaggtgacactataggtcttctgtcacgccatagtgtttcagagctatgctggaaacagc

SEQ ID NO: 49613 - DNA, 70 bp, Artificial Sequence
  Synthetic
gccaagcatttaggtgacactataggtcgtctgaagaagctctgagtttcagagctatgctggaaacagc

SEQ ID NO: 49614 - DNA, 70 bp, Artificial Sequence
  Synthetic
gccaagcatttaggtgacactataggactggcgcaggcccctcacgtttcagagctatgctggaaacagc

SEQ ID NO: 49615 - DNA, 70 bp, Artificial Sequence
  Synthetic
gccaagcatttaggtgacactatagagtggctggaatgttatcatgtttcagagctatgctggaaacagc

SEQ ID NO: 49616 - DNA, 70 bp, Artificial Sequence
  Synthetic
gccaagcatttaggtgacactatagagatgaacgattattgggctgtttcagagctatgctggaaacagc

SEQ ID NO: 49617 - DNA, 70 bp, Artificial Sequence
  Synthetic
gccaagcatttaggtgacactatagggagagcagcatgacagatggtttcagagctatgctggaaacagc

SEQ ID NO: 49618 - DNA, 70 bp, Artificial Sequence
  Synthetic
gccaagcatttaggtgacactatagatctgttcttcttgggttatgtttcagagctatgctggaaacagc

SEQ ID NO: 49619 - DNA, 70 bp, Artificial Sequence
  Synthetic
gccaagcatttaggtgacactatagtgaggatgactctggcacgggtttcagagctatgctggaaacagc

SEQ ID NO: 49620 - DNA, 70 bp, Artificial Sequence
  Synthetic
gccaagcatttaggtgacactatagtcccaagacgggcgatgagagtttcagagctatgctggaaacagc

SEQ ID NO: 49621 - DNA, 70 bp, Artificial Sequence
  Synthetic
gccaagcatttaggtgacactatagagatgatgaacccaaaatgagtttcagagctatgctggaaacagc

SEQ ID NO: 49622 - DNA, 70 bp, Artificial Sequence
  Synthetic
gccaagcatttaggtgacactataggggatggtctcattaaattggtttcagagctatgctggaaacagc

SEQ ID NO: 49623 - DNA, 70 bp, Artificial Sequence
  Synthetic
gccaagcatttaggtgacactatagctccggaaactcaacccaaagtttcagagctatgctggaaacagc

SEQ ID NO: 49624 - DNA, 70 bp, Artificial Sequence
  Synthetic
gccaagcatttaggtgacactatagttcatagcagcacacacctggtttcagagctatgctggaaacagc

SEQ ID NO: 49625 - DNA, 70 bp, Artificial Sequence
  Synthetic
gccaagcatttaggtgacactatagccagtgctgaggcagctcacgtttcagagctatgctggaaacagc

SEQ ID NO: 49626 - DNA, 70 bp, Artificial Sequence
  Synthetic
gccaagcatttaggtgacactatagctggcggcttcaggtgtcacgtttcagagctatgctggaaacagc

SEQ ID NO: 49627 - DNA, 70 bp, Artificial Sequence
  Synthetic
gccaagcatttaggtgacactatagcaaggagagctctccaattcgtttcagagctatgctggaaacagc

SEQ ID NO: 49628 - DNA, 70 bp, Artificial Sequence
  Synthetic
gccaagcatttaggtgacactatagtgatgaggtcaaggtgtgaggtttcagagctatgctggaaacagc

SEQ ID NO: 49629 - DNA, 70 bp, Artificial Sequence
  Synthetic
gccaagcatttaggtgacactatagaggcagcctcgtgtcctatggtttcagagctatgctggaaacagc

SEQ ID NO: 49630 - DNA, 70 bp, Artificial Sequence
  Synthetic
gccaagcatttaggtgacactatagggatgaggtgctgaatgtaagtttcagagctatgctggaaacagc

SEQ ID NO: 49631 - DNA, 70 bp, Artificial Sequence
  Synthetic
gccaagcatttaggtgacactataggatgaaatccgtgtgtgagggtttcagagctatgctggaaacagc

SEQ ID NO: 49632 - DNA, 70 bp, Artificial Sequence
  Synthetic
gccaagcatttaggtgacactatagcggggaatgagggaacctaggtttcagagctatgctggaaacagc

SEQ ID NO: 49633 - DNA, 70 bp, Artificial Sequence
  Synthetic
gccaagcatttaggtgacactatagaggccatggagcaattctaggtttcagagctatgctggaaacagc

SEQ ID NO: 49634 - DNA, 70 bp, Artificial Sequence
  Synthetic
gccaagcatttaggtgacactatagcagctcgtggatacgaaggcgtttcagagctatgctggaaacagc

SEQ ID NO: 49635 - DNA, 70 bp, Artificial Sequence
  Synthetic
gccaagcatttaggtgacactatagacttatttccctcctgtcctgtttcagagctatgctggaaacagc

SEQ ID NO: 49636 - DNA, 70 bp, Artificial Sequence
  Synthetic
gccaagcatttaggtgacactatagtagatatgctgatttgctgcgtttcagagctatgctggaaacagc

SEQ ID NO: 49637 - DNA, 70 bp, Artificial Sequence
  Synthetic
gccaagcatttaggtgacactatagcaaggaaacccgtttgacaagtttcagagctatgctggaaacagc

SEQ ID NO: 49638 - DNA, 70 bp, Artificial Sequence
  Synthetic
gccaagcatttaggtgacactatagtctgctgttattcttgaagcgtttcagagctatgctggaaacagc

SEQ ID NO: 49639 - DNA, 70 bp, Artificial Sequence
  Synthetic
gccaagcatttaggtgacactatagggttttgggaaacattggacgtttcagagctatgctggaaacagc

SEQ ID NO: 49640 - DNA, 70 bp, Artificial Sequence
  Synthetic
gccaagcatttaggtgacactataggctctctgactgccttggaagtttcagagctatgctggaaacagc

SEQ ID NO: 49641 - DNA, 70 bp, Artificial Sequence
  Synthetic
gccaagcatttaggtgacactatagtttcagttcaaatggcaaacgtttcagagctatgctggaaacagc

SEQ ID NO: 49642 - DNA, 70 bp, Artificial Sequence
  Synthetic
gccaagcatttaggtgacactatagcctgagactcccagatcttcgtttcagagctatgctggaaacagc

SEQ ID NO: 49643 - DNA, 70 bp, Artificial Sequence
  Synthetic
gccaagcatttaggtgacactataggtggccagagaggatgcctggtttcagagctatgctggaaacagc

SEQ ID NO: 49644 - DNA, 70 bp, Artificial Sequence
  Synthetic
gccaagcatttaggtgacactatagctttcccttggtggagagctgtttcagagctatgctggaaacagc

SEQ ID NO: 49645 - DNA, 70 bp, Artificial Sequence
  Synthetic
gccaagcatttaggtgacactatagatcctggtggagacctgagcgtttcagagctatgctggaaacagc

SEQ ID NO: 49646 - DNA, 70 bp, Artificial Sequence
  Synthetic
gccaagcatttaggtgacactatagccactgcatctcattcaaccgtttcagagctatgctggaaacagc

SEQ ID NO: 49647 - DNA, 70 bp, Artificial Sequence
  Synthetic
gccaagcatttaggtgacactatagtagccaaatatcatggctttgtttcagagctatgctggaaacagc

SEQ ID NO: 49648 - DNA, 70 bp, Artificial Sequence
  Synthetic
gccaagcatttaggtgacactataggctggtagaagacaattaaggtttcagagctatgctggaaacagc

SEQ ID NO: 49649 - DNA, 70 bp, Artificial Sequence
  Synthetic
gccaagcatttaggtgacactatagcaactttggtgtctcatttggtttcagagctatgctggaaacagc

SEQ ID NO: 49650 - DNA, 70 bp, Artificial Sequence
  Synthetic
gccaagcatttaggtgacactatagaatggatcaagttattctgcgtttcagagctatgctggaaacagc

SEQ ID NO: 49651 - DNA, 70 bp, Artificial Sequence
  Synthetic
gccaagcatttaggtgacactatagcactcactgctttcattttggtttcagagctatgctggaaacagc

SEQ ID NO: 49652 - DNA, 70 bp, Artificial Sequence
  Synthetic
gccaagcatttaggtgacactatagggactcacgaagttagaagcgtttcagagctatgctggaaacagc

SEQ ID NO: 49653 - DNA, 70 bp, Artificial Sequence
  Synthetic
gccaagcatttaggtgacactatagaagcagcatcaagaccacgagtttcagagctatgctggaaacagc

SEQ ID NO: 49654 - DNA, 70 bp, Artificial Sequence
  Synthetic
gccaagcatttaggtgacactatagcgttgtcattcacatcagacgtttcagagctatgctggaaacagc

SEQ ID NO: 49655 - DNA, 70 bp, Artificial Sequence
  Synthetic
gccaagcatttaggtgacactatagctgttcatacccttgtccccgtttcagagctatgctggaaacagc

SEQ ID NO: 49656 - DNA, 70 bp, Artificial Sequence
  Synthetic
gccaagcatttaggtgacactataggaggcggcgaggacgactaggtttcagagctatgctggaaacagc

SEQ ID NO: 49657 - DNA, 70 bp, Artificial Sequence
  Synthetic
gccaagcatttaggtgacactatagagcagaaatgtatggtggtggtttcagagctatgctggaaacagc

SEQ ID NO: 49658 - DNA, 70 bp, Artificial Sequence
  Synthetic
gccaagcatttaggtgacactatagtcccaaagagacaacacgcggtttcagagctatgctggaaacagc

SEQ ID NO: 49659 - DNA, 70 bp, Artificial Sequence
  Synthetic
gccaagcatttaggtgacactatagacttcctttcctctatgtgggtttcagagctatgctggaaacagc

SEQ ID NO: 49660 - DNA, 70 bp, Artificial Sequence
  Synthetic
gccaagcatttaggtgacactatagatcgtcatcaaaagtgtcttgtttcagagctatgctggaaacagc

SEQ ID NO: 49661 - DNA, 70 bp, Artificial Sequence
  Synthetic
gccaagcatttaggtgacactatagaccctgataaagtcacttaagtttcagagctatgctggaaacagc

SEQ ID NO: 49662 - DNA, 70 bp, Artificial Sequence
  Synthetic
gccaagcatttaggtgacactatagaagctaagctgaagaggctggtttcagagctatgctggaaacagc

SEQ ID NO: 49663 - DNA, 70 bp, Artificial Sequence
  Synthetic
gccaagcatttaggtgacactatagaagttctgtgcctagcacgagtttcagagctatgctggaaacagc

SEQ ID NO: 49664 - DNA, 70 bp, Artificial Sequence
  Synthetic
gccaagcatttaggtgacactatagagcgaacttctcttgaatgagtttcagagctatgctggaaacagc

SEQ ID NO: 49665 - DNA, 70 bp, Artificial Sequence
  Synthetic
gccaagcatttaggtgacactatagcgccccagggtcaggctgtcgtttcagagctatgctggaaacagc

SEQ ID NO: 49666 - DNA, 70 bp, Artificial Sequence
  Synthetic
gccaagcatttaggtgacactatagcctgaaggcgactgtctgaagtttcagagctatgctggaaacagc

SEQ ID NO: 49667 - DNA, 70 bp, Artificial Sequence
  Synthetic
gccaagcatttaggtgacactatagtttcaaattcagcttctcaggtttcagagctatgctggaaacagc

SEQ ID NO: 49668 - DNA, 70 bp, Artificial Sequence
  Synthetic
gccaagcatttaggtgacactatagatctgaaagaacaacttagggtttcagagctatgctggaaacagc

SEQ ID NO: 49669 - DNA, 70 bp, Artificial Sequence
  Synthetic
gccaagcatttaggtgacactatagtcctgtactcaaaccagccggtttcagagctatgctggaaacagc

SEQ ID NO: 49670 - DNA, 70 bp, Artificial Sequence
  Synthetic
gccaagcatttaggtgacactatagtgaaaatgcaggctctggtcgtttcagagctatgctggaaacagc

SEQ ID NO: 49671 - DNA, 70 bp, Artificial Sequence
  Synthetic
gccaagcatttaggtgacactatagtgcagtgcagtcaaataattgtttcagagctatgctggaaacagc

SEQ ID NO: 49672 - DNA, 70 bp, Artificial Sequence
  Synthetic
gccaagcatttaggtgacactatagcttgctgacatgtatggtgggtttcagagctatgctggaaacagc

SEQ ID NO: 49673 - DNA, 70 bp, Artificial Sequence
  Synthetic
gccaagcatttaggtgacactataggacccgcgccgctgtggtgagtttcagagctatgctggaaacagc

SEQ ID NO: 49674 - DNA, 70 bp, Artificial Sequence
  Synthetic
gccaagcatttaggtgacactatagcggcagggcgaggggctagggtttcagagctatgctggaaacagc

SEQ ID NO: 49675 - DNA, 70 bp, Artificial Sequence
  Synthetic
gccaagcatttaggtgacactatagaatccctgagctgtgtttgtgtttcagagctatgctggaaacagc

SEQ ID NO: 49676 - DNA, 70 bp, Artificial Sequence
  Synthetic
gccaagcatttaggtgacactatagccaccctgcctgggctgttcgtttcagagctatgctggaaacagc

SEQ ID NO: 49677 - DNA, 70 bp, Artificial Sequence
  Synthetic
gccaagcatttaggtgacactataggatggacagccagactaggtgtttcagagctatgctggaaacagc

SEQ ID NO: 49678 - DNA, 70 bp, Artificial Sequence
  Synthetic
gccaagcatttaggtgacactataggtcacagctctgtgatctccgtttcagagctatgctggaaacagc

SEQ ID NO: 49679 - DNA, 70 bp, Artificial Sequence
  Synthetic
gccaagcatttaggtgacactatagtcaaccaatgttggttagatgtttcagagctatgctggaaacagc

SEQ ID NO: 49680 - DNA, 70 bp, Artificial Sequence
  Synthetic
gccaagcatttaggtgacactataggggccagcccgggcgctcaggtttcagagctatgctggaaacagc

SEQ ID NO: 49681 - DNA, 70 bp, Artificial Sequence
  Synthetic
gccaagcatttaggtgacactatagttcaaaagcgactccgtttggtttcagagctatgctggaaacagc

SEQ ID NO: 49682 - DNA, 70 bp, Artificial Sequence
  Synthetic
gccaagcatttaggtgacactatagagagaacaggtagttaggaggtttcagagctatgctggaaacagc

SEQ ID NO: 49683 - DNA, 70 bp, Artificial Sequence
  Synthetic
gccaagcatttaggtgacactatagtggcggggaggacgactagggtttcagagctatgctggaaacagc

SEQ ID NO: 49684 - DNA, 70 bp, Artificial Sequence
  Synthetic
gccaagcatttaggtgacactatagcatgtatggaggtggtgaaggtttcagagctatgctggaaacagc

SEQ ID NO: 49685 - DNA, 70 bp, Artificial Sequence
  Synthetic
gccaagcatttaggtgacactatagggaggagctgctgtattagggtttcagagctatgctggaaacagc

SEQ ID NO: 49686 - DNA, 70 bp, Artificial Sequence
  Synthetic
gccaagcatttaggtgacactatagtgcagatatgtatggaggaggtttcagagctatgctggaaacagc

SEQ ID NO: 49687 - DNA, 70 bp, Artificial Sequence
  Synthetic
gccaagcatttaggtgacactatagagctctttcagagcaagcccgtttcagagctatgctggaaacagc

SEQ ID NO: 49688 - DNA, 70 bp, Artificial Sequence
  Synthetic
gccaagcatttaggtgacactataggctatgagtacaaactctctgtttcagagctatgctggaaacagc

SEQ ID NO: 49689 - DNA, 70 bp, Artificial Sequence
  Synthetic
gccaagcatttaggtgacactatagctgggcgaactctactctgtgtttcagagctatgctggaaacagc

SEQ ID NO: 49690 - DNA, 70 bp, Artificial Sequence
  Synthetic
gccaagcatttaggtgacactatagtgatagtgaccgagactaaggtttcagagctatgctggaaacagc

SEQ ID NO: 49691 - DNA, 70 bp, Artificial Sequence
  Synthetic
gccaagcatttaggtgacactataggaagaagagtgtgcacaacagtttcagagctatgctggaaacagc

SEQ ID NO: 49692 - DNA, 70 bp, Artificial Sequence
  Synthetic
gccaagcatttaggtgacactatagtgaataaggcaatttcgcaggtttcagagctatgctggaaacagc

SEQ ID NO: 49693 - DNA, 70 bp, Artificial Sequence
  Synthetic
gccaagcatttaggtgacactataggacaccacggacctgtgacagtttcagagctatgctggaaacagc

SEQ ID NO: 49694 - DNA, 70 bp, Artificial Sequence
  Synthetic
gccaagcatttaggtgacactatagccacacccaggaaagtaaacgtttcagagctatgctggaaacagc

SEQ ID NO: 49695 - DNA, 70 bp, Artificial Sequence
  Synthetic
gccaagcatttaggtgacactatagggagcccggcgctggctctggtttcagagctatgctggaaacagc

SEQ ID NO: 49696 - DNA, 70 bp, Artificial Sequence
  Synthetic
gccaagcatttaggtgacactatagtgatgactcctacatctaaggtttcagagctatgctggaaacagc

SEQ ID NO: 49697 - DNA, 70 bp, Artificial Sequence
  Synthetic
gccaagcatttaggtgacactatagcgtacaagcgcctgtgctaagtttcagagctatgctggaaacagc

SEQ ID NO: 49698 - DNA, 70 bp, Artificial Sequence
  Synthetic
gccaagcatttaggtgacactataggctccagcgtcacttcttctgtttcagagctatgctggaaacagc

SEQ ID NO: 49699 - DNA, 70 bp, Artificial Sequence
  Synthetic
gccaagcatttaggtgacactataggatccagccaaacgaatttcgtttcagagctatgctggaaacagc

SEQ ID NO: 49700 - DNA, 70 bp, Artificial Sequence
  Synthetic
gccaagcatttaggtgacactatagtatccctcctggtcagtacagtttcagagctatgctggaaacagc

SEQ ID NO: 49701 - DNA, 70 bp, Artificial Sequence
  Synthetic
gccaagcatttaggtgacactataggcaagcgctgtaaaccctgagtttcagagctatgctggaaacagc

SEQ ID NO: 49702 - DNA, 70 bp, Artificial Sequence
  Synthetic
gccaagcatttaggtgacactatagtgccgcgagccaggctgaccgtttcagagctatgctggaaacagc

SEQ ID NO: 49703 - DNA, 70 bp, Artificial Sequence
  Synthetic
gccaagcatttaggtgacactataggcttcagcctcaagttctgagtttcagagctatgctggaaacagc

SEQ ID NO: 49704 - DNA, 70 bp, Artificial Sequence
  Synthetic
gccaagcatttaggtgacactatagctgaagtctctgggttagtagtttcagagctatgctggaaacagc

SEQ ID NO: 49705 - DNA, 70 bp, Artificial Sequence
  Synthetic
gccaagcatttaggtgacactatagctggcagaggcagaggcagagtttcagagctatgctggaaacagc

SEQ ID NO: 49706 - DNA, 70 bp, Artificial Sequence
  Synthetic
gccaagcatttaggtgacactataggagaaagcatgcgggcctttgtttcagagctatgctggaaacagc

SEQ ID NO: 49707 - DNA, 70 bp, Artificial Sequence
  Synthetic
gccaagcatttaggtgacactatagggaagctggtacagctgagagtttcagagctatgctggaaacagc

SEQ ID NO: 49708 - DNA, 70 bp, Artificial Sequence
  Synthetic
gccaagcatttaggtgacactatagcagcccagtttagcaaatgcgtttcagagctatgctggaaacagc

SEQ ID NO: 49709 - DNA, 70 bp, Artificial Sequence
  Synthetic
gccaagcatttaggtgacactatagtcggtctgtggcttagaactgtttcagagctatgctggaaacagc

SEQ ID NO: 49710 - DNA, 70 bp, Artificial Sequence
  Synthetic
gccaagcatttaggtgacactatagaattcttcttatccagagacgtttcagagctatgctggaaacagc

SEQ ID NO: 49711 - DNA, 70 bp, Artificial Sequence
  Synthetic
gccaagcatttaggtgacactatagttcatgatcgacacgtgaaagtttcagagctatgctggaaacagc

SEQ ID NO: 49712 - DNA, 70 bp, Artificial Sequence
  Synthetic
gccaagcatttaggtgacactatagcaggacgagggaagaacagggtttcagagctatgctggaaacagc

SEQ ID NO: 49713 - DNA, 70 bp, Artificial Sequence
  Synthetic
gccaagcatttaggtgacactatagcaacgggagctggtcagtacgtttcagagctatgctggaaacagc

SEQ ID NO: 49714 - DNA, 70 bp, Artificial Sequence
  Synthetic
gccaagcatttaggtgacactatagaaggctatcagagtcgaagagtttcagagctatgctggaaacagc

SEQ ID NO: 49715 - DNA, 70 bp, Artificial Sequence
  Synthetic
gccaagcatttaggtgacactatagccgattcctcagcgtctagggtttcagagctatgctggaaacagc

SEQ ID NO: 49716 - DNA, 70 bp, Artificial Sequence
  Synthetic
gccaagcatttaggtgacactatagggccaacttctcacccctccgtttcagagctatgctggaaacagc

SEQ ID NO: 49717 - DNA, 70 bp, Artificial Sequence
  Synthetic
gccaagcatttaggtgacactatagccaacaaggcagctaggatcgtttcagagctatgctggaaacagc

SEQ ID NO: 49718 - DNA, 70 bp, Artificial Sequence
  Synthetic
gccaagcatttaggtgacactataggcggaacgcccgcacgtaacgtttcagagctatgctggaaacagc

SEQ ID NO: 49719 - DNA, 70 bp, Artificial Sequence
  Synthetic
gccaagcatttaggtgacactatagtaaaagagtcactatggctcgtttcagagctatgctggaaacagc

SEQ ID NO: 49720 - DNA, 70 bp, Artificial Sequence
  Synthetic
gccaagcatttaggtgacactatagtgtggccttgacattctcaagtttcagagctatgctggaaacagc

SEQ ID NO: 49721 - DNA, 70 bp, Artificial Sequence
  Synthetic
gccaagcatttaggtgacactatagagccactccattgctcactcgtttcagagctatgctggaaacagc

SEQ ID NO: 49722 - DNA, 70 bp, Artificial Sequence
  Synthetic
gccaagcatttaggtgacactataggggggtcccggggcctaggggtttcagagctatgctggaaacagc

SEQ ID NO: 49723 - DNA, 70 bp, Artificial Sequence
  Synthetic
gccaagcatttaggtgacactataggctacagtgctcaccgatccgtttcagagctatgctggaaacagc

SEQ ID NO: 49724 - DNA, 70 bp, Artificial Sequence
  Synthetic
gccaagcatttaggtgacactatagcggcccctgggtatccctaggtttcagagctatgctggaaacagc

SEQ ID NO: 49725 - DNA, 70 bp, Artificial Sequence
  Synthetic
gccaagcatttaggtgacactatagtctctgcaggaccactctgagtttcagagctatgctggaaacagc

SEQ ID NO: 49726 - DNA, 70 bp, Artificial Sequence
  Synthetic
gccaagcatttaggtgacactataggaaagttcttctcaggagccgtttcagagctatgctggaaacagc

SEQ ID NO: 49727 - DNA, 70 bp, Artificial Sequence
  Synthetic
gccaagcatttaggtgacactatagacacggagggtgtcacagaggtttcagagctatgctggaaacagc

SEQ ID NO: 49728 - DNA, 70 bp, Artificial Sequence
  Synthetic
gccaagcatttaggtgacactatagagtccgctatactaactagagtttcagagctatgctggaaacagc

SEQ ID NO: 49729 - DNA, 70 bp, Artificial Sequence
  Synthetic
gccaagcatttaggtgacactatagtcggagctgaatacagcctggtttcagagctatgctggaaacagc

SEQ ID NO: 49730 - DNA, 70 bp, Artificial Sequence
  Synthetic
gccaagcatttaggtgacactatagagaacagaggccttagaacagtttcagagctatgctggaaacagc

SEQ ID NO: 49731 - DNA, 70 bp, Artificial Sequence
  Synthetic
gccaagcatttaggtgacactatagagtactcacatcagacacatgtttcagagctatgctggaaacagc

SEQ ID NO: 49732 - DNA, 70 bp, Artificial Sequence
  Synthetic
gccaagcatttaggtgacactatagagtttgagcgcgtcttctgagtttcagagctatgctggaaacagc

SEQ ID NO: 49733 - DNA, 70 bp, Artificial Sequence
  Synthetic
gccaagcatttaggtgacactatagtccgtgggcttggctctgctgtttcagagctatgctggaaacagc

SEQ ID NO: 49734 - DNA, 70 bp, Artificial Sequence
  Synthetic
gccaagcatttaggtgacactataggcttcaagaacagaataagggtttcagagctatgctggaaacagc

SEQ ID NO: 49735 - DNA, 70 bp, Artificial Sequence
  Synthetic
gccaagcatttaggtgacactatagtcctagctcctttaaatgttgtttcagagctatgctggaaacagc

SEQ ID NO: 49736 - DNA, 70 bp, Artificial Sequence
  Synthetic
gccaagcatttaggtgacactatagaccaaaatggttctcagtgcgtttcagagctatgctggaaacagc

SEQ ID NO: 49737 - DNA, 70 bp, Artificial Sequence
  Synthetic
gccaagcatttaggtgacactataggtggagatggccattgcgaggtttcagagctatgctggaaacagc

SEQ ID NO: 49738 - DNA, 70 bp, Artificial Sequence
  Synthetic
gccaagcatttaggtgacactatagtgcattttctactctacatcgtttcagagctatgctggaaacagc

SEQ ID NO: 49739 - DNA, 70 bp, Artificial Sequence
  Synthetic
gccaagcatttaggtgacactatagtgttacagctcacctcacacgtttcagagctatgctggaaacagc

SEQ ID NO: 49740 - DNA, 70 bp, Artificial Sequence
  Synthetic
gccaagcatttaggtgacactatagagttttctgaaagcaagtgagtttcagagctatgctggaaacagc

SEQ ID NO: 49741 - DNA, 70 bp, Artificial Sequence
  Synthetic
gccaagcatttaggtgacactatagttttgagcggaagtacctgtgtttcagagctatgctggaaacagc

SEQ ID NO: 49742 - DNA, 70 bp, Artificial Sequence
  Synthetic
gccaagcatttaggtgacactatagcatgagaatgcggcactgacgtttcagagctatgctggaaacagc

SEQ ID NO: 49743 - DNA, 70 bp, Artificial Sequence
  Synthetic
gccaagcatttaggtgacactatagccctaccagcacaaattacagtttcagagctatgctggaaacagc

SEQ ID NO: 49744 - DNA, 70 bp, Artificial Sequence
  Synthetic
gccaagcatttaggtgacactatagggcggattagggcttcctctgtttcagagctatgctggaaacagc

SEQ ID NO: 49745 - DNA, 70 bp, Artificial Sequence
  Synthetic
gccaagcatttaggtgacactatagtttacgtttgacgtcttctggtttcagagctatgctggaaacagc

SEQ ID NO: 49746 - DNA, 70 bp, Artificial Sequence
  Synthetic
gccaagcatttaggtgacactatagagaccccgcgcaagaggctggtttcagagctatgctggaaacagc

SEQ ID NO: 49747 - DNA, 70 bp, Artificial Sequence
  Synthetic
gccaagcatttaggtgacactataggaagccaaggaagaggaatggtttcagagctatgctggaaacagc

SEQ ID NO: 49748 - DNA, 70 bp, Artificial Sequence
  Synthetic
gccaagcatttaggtgacactataggatggcccagctcctcagccgtttcagagctatgctggaaacagc

SEQ ID NO: 49749 - DNA, 70 bp, Artificial Sequence
  Synthetic
gccaagcatttaggtgacactataggcctctctggttctttcaatgtttcagagctatgctggaaacagc

SEQ ID NO: 49750 - DNA, 70 bp, Artificial Sequence
  Synthetic
gccaagcatttaggtgacactatagtgtagaagcaggcatgcgtagtttcagagctatgctggaaacagc

SEQ ID NO: 49751 - DNA, 70 bp, Artificial Sequence
  Synthetic
gccaagcatttaggtgacactatagtcttgaggatgttttagtgcgtttcagagctatgctggaaacagc

SEQ ID NO: 49752 - DNA, 70 bp, Artificial Sequence
  Synthetic
gccaagcatttaggtgacactatagtcacttctggtagtaaattggtttcagagctatgctggaaacagc

SEQ ID NO: 49753 - DNA, 70 bp, Artificial Sequence
  Synthetic
gccaagcatttaggtgacactatagaacctggcgtcagtcccccggtttcagagctatgctggaaacagc

SEQ ID NO: 49754 - DNA, 70 bp, Artificial Sequence
  Synthetic
gccaagcatttaggtgacactataggaacgagctcggtcgtaggcgtttcagagctatgctggaaacagc

SEQ ID NO: 49755 - DNA, 70 bp, Artificial Sequence
  Synthetic
gccaagcatttaggtgacactatagatgcaggcaaacggggctgggtttcagagctatgctggaaacagc

SEQ ID NO: 49756 - DNA, 70 bp, Artificial Sequence
  Synthetic
gccaagcatttaggtgacactatagactcttaaatgctctgccctgtttcagagctatgctggaaacagc

SEQ ID NO: 49757 - DNA, 70 bp, Artificial Sequence
  Synthetic
gccaagcatttaggtgacactataggggaatggatcctctcacctgtttcagagctatgctggaaacagc

SEQ ID NO: 49758 - DNA, 70 bp, Artificial Sequence
  Synthetic
gccaagcatttaggtgacactatagcttgatggtctgtattgcccgtttcagagctatgctggaaacagc

SEQ ID NO: 49759 - DNA, 70 bp, Artificial Sequence
  Synthetic
gccaagcatttaggtgacactatagtggagatcagagctctgtttgtttcagagctatgctggaaacagc

SEQ ID NO: 49760 - DNA, 70 bp, Artificial Sequence
  Synthetic
gccaagcatttaggtgacactatagctcgctggagaacaactaaggtttcagagctatgctggaaacagc

SEQ ID NO: 49761 - DNA, 70 bp, Artificial Sequence
  Synthetic
gccaagcatttaggtgacactatagcagcagccccgggaaacctggtttcagagctatgctggaaacagc

SEQ ID NO: 49762 - DNA, 70 bp, Artificial Sequence
  Synthetic
gccaagcatttaggtgacactatagcatctgagcagcactcactcgtttcagagctatgctggaaacagc

SEQ ID NO: 49763 - DNA, 70 bp, Artificial Sequence
  Synthetic
gccaagcatttaggtgacactatagtctggaagacactgattgacgtttcagagctatgctggaaacagc

SEQ ID NO: 49764 - DNA, 70 bp, Artificial Sequence
  Synthetic
gccaagcatttaggtgacactatagaagaatgagaggagagtgatgtttcagagctatgctggaaacagc

SEQ ID NO: 49765 - DNA, 70 bp, Artificial Sequence
  Synthetic
gccaagcatttaggtgacactataggctgctgtgcgtcttgacttgtttcagagctatgctggaaacagc

SEQ ID NO: 49766 - DNA, 70 bp, Artificial Sequence
  Synthetic
gccaagcatttaggtgacactatagctttagcttcagcccatcatgtttcagagctatgctggaaacagc

SEQ ID NO: 49767 - DNA, 70 bp, Artificial Sequence
  Synthetic
gccaagcatttaggtgacactataggcaatgctgatccttttcaggtttcagagctatgctggaaacagc

SEQ ID NO: 49768 - DNA, 70 bp, Artificial Sequence
  Synthetic
gccaagcatttaggtgacactatagacccactgcccgcctgttaagtttcagagctatgctggaaacagc

SEQ ID NO: 49769 - DNA, 70 bp, Artificial Sequence
  Synthetic
gccaagcatttaggtgacactataggccccgaacgggctcttaacgtttcagagctatgctggaaacagc

SEQ ID NO: 49770 - DNA, 70 bp, Artificial Sequence
  Synthetic
gccaagcatttaggtgacactataggttggtcagtagcgaactgtgtttcagagctatgctggaaacagc

SEQ ID NO: 49771 - DNA, 70 bp, Artificial Sequence
  Synthetic
gccaagcatttaggtgacactatagacccaccttgaaggtataacgtttcagagctatgctggaaacagc

SEQ ID NO: 49772 - DNA, 70 bp, Artificial Sequence
  Synthetic
gccaagcatttaggtgacactatagccaccacagaggacgagtaggtttcagagctatgctggaaacagc

SEQ ID NO: 49773 - DNA, 70 bp, Artificial Sequence
  Synthetic
gccaagcatttaggtgacactataggactgttgagtaactctcctgtttcagagctatgctggaaacagc

SEQ ID NO: 49774 - DNA, 70 bp, Artificial Sequence
  Synthetic
gccaagcatttaggtgacactatagaccagacacgtgctgaggaggtttcagagctatgctggaaacagc

SEQ ID NO: 49775 - DNA, 70 bp, Artificial Sequence
  Synthetic
gccaagcatttaggtgacactatagagccactcacaatacaattagtttcagagctatgctggaaacagc

SEQ ID NO: 49776 - DNA, 70 bp, Artificial Sequence
  Synthetic
gccaagcatttaggtgacactatagctgccaagcatgtagaaagcgtttcagagctatgctggaaacagc

SEQ ID NO: 49777 - DNA, 70 bp, Artificial Sequence
  Synthetic
gccaagcatttaggtgacactatagctctccaatgcctgtgaaaggtttcagagctatgctggaaacagc

SEQ ID NO: 49778 - DNA, 70 bp, Artificial Sequence
  Synthetic
gccaagcatttaggtgacactatagtgcagaacccggtgggtcacgtttcagagctatgctggaaacagc

SEQ ID NO: 49779 - DNA, 70 bp, Artificial Sequence
  Synthetic
gccaagcatttaggtgacactatagtcaacctattgagatacagcgtttcagagctatgctggaaacagc

SEQ ID NO: 49780 - DNA, 70 bp, Artificial Sequence
  Synthetic
gccaagcatttaggtgacactatagttgtgccactataaagtcaagtttcagagctatgctggaaacagc

SEQ ID NO: 49781 - DNA, 70 bp, Artificial Sequence
  Synthetic
gccaagcatttaggtgacactatagttaacatggattctatccctgtttcagagctatgctggaaacagc

SEQ ID NO: 49782 - DNA, 70 bp, Artificial Sequence
  Synthetic
gccaagcatttaggtgacactatagccatgttaaagtacttgcaggtttcagagctatgctggaaacagc

SEQ ID NO: 49783 - DNA, 70 bp, Artificial Sequence
  Synthetic
gccaagcatttaggtgacactatagctcccttttcagctacctgcgtttcagagctatgctggaaacagc

SEQ ID NO: 49784 - DNA, 70 bp, Artificial Sequence
  Synthetic
gccaagcatttaggtgacactatagatttctgtggctgttagggagtttcagagctatgctggaaacagc

SEQ ID NO: 49785 - DNA, 70 bp, Artificial Sequence
  Synthetic
gccaagcatttaggtgacactatagtgttaggtgggtcattggaggtttcagagctatgctggaaacagc

SEQ ID NO: 49786 - DNA, 70 bp, Artificial Sequence
  Synthetic
gccaagcatttaggtgacactatagcagggtcacgctgttaccccgtttcagagctatgctggaaacagc

SEQ ID NO: 49787 - DNA, 70 bp, Artificial Sequence
  Synthetic
gccaagcatttaggtgacactatagtgatcaaccactactcaatcgtttcagagctatgctggaaacagc

SEQ ID NO: 49788 - DNA, 70 bp, Artificial Sequence
  Synthetic
gccaagcatttaggtgacactataggctggtgccaacttcctgatgtttcagagctatgctggaaacagc

SEQ ID NO: 49789 - DNA, 70 bp, Artificial Sequence
  Synthetic
gccaagcatttaggtgacactatagattagacggaggggttgattgtttcagagctatgctggaaacagc

SEQ ID NO: 49790 - DNA, 70 bp, Artificial Sequence
  Synthetic
gccaagcatttaggtgacactatagctctgacagctccatctcctgtttcagagctatgctggaaacagc

SEQ ID NO: 49791 - DNA, 70 bp, Artificial Sequence
  Synthetic
gccaagcatttaggtgacactatagtgtgtggcaggtcaggaccagtttcagagctatgctggaaacagc

SEQ ID NO: 49792 - DNA, 70 bp, Artificial Sequence
  Synthetic
gccaagcatttaggtgacactataggatggaccacaaagcagaaggtttcagagctatgctggaaacagc

SEQ ID NO: 49793 - DNA, 70 bp, Artificial Sequence
  Synthetic
gccaagcatttaggtgacactatagatagatggaagctgctgtccgtttcagagctatgctggaaacagc

SEQ ID NO: 49794 - DNA, 70 bp, Artificial Sequence
  Synthetic
gccaagcatttaggtgacactatagcaaagcagatgtggtctcttgtttcagagctatgctggaaacagc

SEQ ID NO: 49795 - DNA, 70 bp, Artificial Sequence
  Synthetic
gccaagcatttaggtgacactatagcatgattggagtgctggttggtttcagagctatgctggaaacagc

SEQ ID NO: 49796 - DNA, 70 bp, Artificial Sequence
  Synthetic
gccaagcatttaggtgacactatagctgctatatcagagccacccgtttcagagctatgctggaaacagc

SEQ ID NO: 49797 - DNA, 70 bp, Artificial Sequence
  Synthetic
gccaagcatttaggtgacactataggattggagtactggctgggagtttcagagctatgctggaaacagc

SEQ ID NO: 49798 - DNA, 70 bp, Artificial Sequence
  Synthetic
gccaagcatttaggtgacactatagctactatatcagagccacccgtttcagagctatgctggaaacagc

SEQ ID NO: 49799 - DNA, 70 bp, Artificial Sequence
  Synthetic
gccaagcatttaggtgacactataggccatgggcaactgcgcgtggtttcagagctatgctggaaacagc

SEQ ID NO: 49800 - DNA, 70 bp, Artificial Sequence
  Synthetic
gccaagcatttaggtgacactatagtcctccggccactgctagcggtttcagagctatgctggaaacagc

SEQ ID NO: 49801 - DNA, 70 bp, Artificial Sequence
  Synthetic
gccaagcatttaggtgacactatagccgccccggccgcgcgttacgtttcagagctatgctggaaacagc

SEQ ID NO: 49802 - DNA, 70 bp, Artificial Sequence
  Synthetic
gccaagcatttaggtgacactatagggcgtggggggttgcagctggtttcagagctatgctggaaacagc

SEQ ID NO: 49803 - DNA, 70 bp, Artificial Sequence
  Synthetic
gccaagcatttaggtgacactatagacagcagatggcgacaatgcgtttcagagctatgctggaaacagc

SEQ ID NO: 49804 - DNA, 70 bp, Artificial Sequence
  Synthetic
gccaagcatttaggtgacactataggggaggctgaacgtgatgacgtttcagagctatgctggaaacagc

SEQ ID NO: 49805 - DNA, 70 bp, Artificial Sequence
  Synthetic
gccaagcatttaggtgacactatagactgagaagtctggaatgtagtttcagagctatgctggaaacagc

SEQ ID NO: 49806 - DNA, 70 bp, Artificial Sequence
  Synthetic
gccaagcatttaggtgacactatagtaacattggcatgaatgccagtttcagagctatgctggaaacagc

SEQ ID NO: 49807 - DNA, 70 bp, Artificial Sequence
  Synthetic
gccaagcatttaggtgacactatagtaagcctccaacacttccccgtttcagagctatgctggaaacagc

SEQ ID NO: 49808 - DNA, 70 bp, Artificial Sequence
  Synthetic
gccaagcatttaggtgacactatagctcagatgcctgcagtcattgtttcagagctatgctggaaacagc

SEQ ID NO: 49809 - DNA, 70 bp, Artificial Sequence
  Synthetic
gccaagcatttaggtgacactataggactcaggaaaatgttcagtgtttcagagctatgctggaaacagc

SEQ ID NO: 49810 - DNA, 70 bp, Artificial Sequence
  Synthetic
gccaagcatttaggtgacactatagttacatcgactggatcaattgtttcagagctatgctggaaacagc

SEQ ID NO: 49811 - DNA, 70 bp, Artificial Sequence
  Synthetic
gccaagcatttaggtgacactatagctacaacgactggatcaattgtttcagagctatgctggaaacagc

SEQ ID NO: 49812 - DNA, 70 bp, Artificial Sequence
  Synthetic
gccaagcatttaggtgacactatagcagctgggccttggttctaggtttcagagctatgctggaaacagc

SEQ ID NO: 49813 - DNA, 70 bp, Artificial Sequence
  Synthetic
gccaagcatttaggtgacactatagcagaggggagcacgctcagtgtttcagagctatgctggaaacagc

SEQ ID NO: 49814 - DNA, 70 bp, Artificial Sequence
  Synthetic
gccaagcatttaggtgacactatagctctggggttaggatcagtagtttcagagctatgctggaaacagc

SEQ ID NO: 49815 - DNA, 70 bp, Artificial Sequence
  Synthetic
gccaagcatttaggtgacactatagatgccaaccggccctactgagtttcagagctatgctggaaacagc

SEQ ID NO: 49816 - DNA, 70 bp, Artificial Sequence
  Synthetic
gccaagcatttaggtgacactataggaaagaagtgtgctcaaggagtttcagagctatgctggaaacagc

SEQ ID NO: 49817 - DNA, 70 bp, Artificial Sequence
  Synthetic
gccaagcatttaggtgacactataggctcccgccggcgctcagtagtttcagagctatgctggaaacagc

SEQ ID NO: 49818 - DNA, 70 bp, Artificial Sequence
  Synthetic
gccaagcatttaggtgacactatagccacagtctcgcgctgagctgtttcagagctatgctggaaacagc

SEQ ID NO: 49819 - DNA, 70 bp, Artificial Sequence
  Synthetic
gccaagcatttaggtgacactatagggggagaccaggactcgcacgtttcagagctatgctggaaacagc

SEQ ID NO: 49820 - DNA, 70 bp, Artificial Sequence
  Synthetic
gccaagcatttaggtgacactatagaccaaccagagcaagtgtttgtttcagagctatgctggaaacagc

SEQ ID NO: 49821 - DNA, 70 bp, Artificial Sequence
  Synthetic
gccaagcatttaggtgacactatagcggctgtgggcgcggtcagtgtttcagagctatgctggaaacagc

SEQ ID NO: 49822 - DNA, 70 bp, Artificial Sequence
  Synthetic
gccaagcatttaggtgacactatagtcagtgaaagcaggtcagtagtttcagagctatgctggaaacagc

SEQ ID NO: 49823 - DNA, 70 bp, Artificial Sequence
  Synthetic
gccaagcatttaggtgacactatagactgggagcgcccaggccgagtttcagagctatgctggaaacagc

SEQ ID NO: 49824 - DNA, 70 bp, Artificial Sequence
  Synthetic
gccaagcatttaggtgacactatagccacggcccagggttaatgcgtttcagagctatgctggaaacagc

SEQ ID NO: 49825 - DNA, 70 bp, Artificial Sequence
  Synthetic
gccaagcatttaggtgacactatagaagtgagggtcactcctgaggtttcagagctatgctggaaacagc

SEQ ID NO: 49826 - DNA, 70 bp, Artificial Sequence
  Synthetic
gccaagcatttaggtgacactataggtgaagaagaagaagttgtggtttcagagctatgctggaaacagc

SEQ ID NO: 49827 - DNA, 70 bp, Artificial Sequence
  Synthetic
gccaagcatttaggtgacactatagatgacactaatggggtgagcgtttcagagctatgctggaaacagc

SEQ ID NO: 49828 - DNA, 70 bp, Artificial Sequence
  Synthetic
gccaagcatttaggtgacactatagcccccaggtattattttttcgtttcagagctatgctggaaacagc

SEQ ID NO: 49829 - DNA, 70 bp, Artificial Sequence
  Synthetic
gccaagcatttaggtgacactatagcggggccttgaggagggactgtttcagagctatgctggaaacagc

SEQ ID NO: 49830 - DNA, 70 bp, Artificial Sequence
  Synthetic
gccaagcatttaggtgacactatagcaggcgggagttcgaggtctgtttcagagctatgctggaaacagc

SEQ ID NO: 49831 - DNA, 70 bp, Artificial Sequence
  Synthetic
gccaagcatttaggtgacactatagtcatctacgttaaagacaccgtttcagagctatgctggaaacagc

SEQ ID NO: 49832 - DNA, 70 bp, Artificial Sequence
  Synthetic
gccaagcatttaggtgacactataggaagaacactttcctcattcgtttcagagctatgctggaaacagc

SEQ ID NO: 49833 - DNA, 70 bp, Artificial Sequence
  Synthetic
gccaagcatttaggtgacactataggtctactgagttttgcactcgtttcagagctatgctggaaacagc

SEQ ID NO: 49834 - DNA, 70 bp, Artificial Sequence
  Synthetic
gccaagcatttaggtgacactataggacacacaaagtgccttcacgtttcagagctatgctggaaacagc

SEQ ID NO: 49835 - DNA, 70 bp, Artificial Sequence
  Synthetic
gccaagcatttaggtgacactataggctgcagaacaatttccttagtttcagagctatgctggaaacagc

SEQ ID NO: 49836 - DNA, 70 bp, Artificial Sequence
  Synthetic
gccaagcatttaggtgacactatagtcttccattcccagagcagagtttcagagctatgctggaaacagc

SEQ ID NO: 49837 - DNA, 70 bp, Artificial Sequence
  Synthetic
gccaagcatttaggtgacactataggaccgttagataactcacaggtttcagagctatgctggaaacagc

SEQ ID NO: 49838 - DNA, 70 bp, Artificial Sequence
  Synthetic
gccaagcatttaggtgacactataggggtaatgtgctaatggacagtttcagagctatgctggaaacagc

SEQ ID NO: 49839 - DNA, 70 bp, Artificial Sequence
  Synthetic
gccaagcatttaggtgacactatagagaagctttccatcagtaaagtttcagagctatgctggaaacagc

SEQ ID NO: 49840 - DNA, 70 bp, Artificial Sequence
  Synthetic
gccaagcatttaggtgacactatagatcaaatagtggttaccccagtttcagagctatgctggaaacagc

SEQ ID NO: 49841 - DNA, 70 bp, Artificial Sequence
  Synthetic
gccaagcatttaggtgacactataggtagcttcagcacatactgagtttcagagctatgctggaaacagc

SEQ ID NO: 49842 - DNA, 70 bp, Artificial Sequence
  Synthetic
gccaagcatttaggtgacactatagcaaacacgatcaggtcaattgtttcagagctatgctggaaacagc

SEQ ID NO: 49843 - DNA, 70 bp, Artificial Sequence
  Synthetic
gccaagcatttaggtgacactatagcaggggccagccaccctcacgtttcagagctatgctggaaacagc

SEQ ID NO: 49844 - DNA, 70 bp, Artificial Sequence
  Synthetic
gccaagcatttaggtgacactatagccccctgctctactgtgaccgtttcagagctatgctggaaacagc

SEQ ID NO: 49845 - DNA, 70 bp, Artificial Sequence
  Synthetic
gccaagcatttaggtgacactataggtgtgtttcctcgccacagggtttcagagctatgctggaaacagc

SEQ ID NO: 49846 - DNA, 70 bp, Artificial Sequence
  Synthetic
gccaagcatttaggtgacactatagtgctgaggcaccctgggtgagtttcagagctatgctggaaacagc

SEQ ID NO: 49847 - DNA, 70 bp, Artificial Sequence
  Synthetic
gccaagcatttaggtgacactataggaaaatctacctccgacaaggtttcagagctatgctggaaacagc

SEQ ID NO: 49848 - DNA, 70 bp, Artificial Sequence
  Synthetic
gccaagcatttaggtgacactataggatacaatgggacaaacagagtttcagagctatgctggaaacagc

SEQ ID NO: 49849 - DNA, 70 bp, Artificial Sequence
  Synthetic
gccaagcatttaggtgacactatagttgggtatgcaagtgagcaggtttcagagctatgctggaaacagc

SEQ ID NO: 49850 - DNA, 70 bp, Artificial Sequence
  Synthetic
gccaagcatttaggtgacactatagagaaaagttggatatgagtcgtttcagagctatgctggaaacagc

SEQ ID NO: 49851 - DNA, 70 bp, Artificial Sequence
  Synthetic
gccaagcatttaggtgacactataggataaaatcgctttgtgcaggtttcagagctatgctggaaacagc

SEQ ID NO: 49852 - DNA, 70 bp, Artificial Sequence
  Synthetic
gccaagcatttaggtgacactatagtgggttcaagtgcacatgtggtttcagagctatgctggaaacagc

SEQ ID NO: 49853 - DNA, 70 bp, Artificial Sequence
  Synthetic
gccaagcatttaggtgacactatagtgaagaagcctataagaaacgtttcagagctatgctggaaacagc

SEQ ID NO: 49854 - DNA, 70 bp, Artificial Sequence
  Synthetic
gccaagcatttaggtgacactataggccagcagaggctggagtgggtttcagagctatgctggaaacagc

SEQ ID NO: 49855 - DNA, 70 bp, Artificial Sequence
  Synthetic
gccaagcatttaggtgacactatagtcggaaagtcagctccgaaagtttcagagctatgctggaaacagc

SEQ ID NO: 49856 - DNA, 70 bp, Artificial Sequence
  Synthetic
gccaagcatttaggtgacactatagtgttgaagcctggccactacgtttcagagctatgctggaaacagc

SEQ ID NO: 49857 - DNA, 70 bp, Artificial Sequence
  Synthetic
gccaagcatttaggtgacactatagtagactgctcttctcatcccgtttcagagctatgctggaaacagc

SEQ ID NO: 49858 - DNA, 70 bp, Artificial Sequence
  Synthetic
gccaagcatttaggtgacactataggatggtcttgtgctctttcagtttcagagctatgctggaaacagc

SEQ ID NO: 49859 - DNA, 70 bp, Artificial Sequence
  Synthetic
gccaagcatttaggtgacactataggcatgtactggccgcagcaagtttcagagctatgctggaaacagc

SEQ ID NO: 49860 - DNA, 70 bp, Artificial Sequence
  Synthetic
gccaagcatttaggtgacactatagagggatctcagccgtggctggtttcagagctatgctggaaacagc

SEQ ID NO: 49861 - DNA, 70 bp, Artificial Sequence
  Synthetic
gccaagcatttaggtgacactataggctgagatccctagaagtccgtttcagagctatgctggaaacagc

SEQ ID NO: 49862 - DNA, 70 bp, Artificial Sequence
  Synthetic
gccaagcatttaggtgacactatagacgtacgccaagcgctgacggtttcagagctatgctggaaacagc

SEQ ID NO: 49863 - DNA, 70 bp, Artificial Sequence
  Synthetic
gccaagcatttaggtgacactatagtgactacatatcaaggcagagtttcagagctatgctggaaacagc

SEQ ID NO: 49864 - DNA, 70 bp, Artificial Sequence
  Synthetic
gccaagcatttaggtgacactatagccgacagatcagagagatttgtttcagagctatgctggaaacagc

SEQ ID NO: 49865 - DNA, 70 bp, Artificial Sequence
  Synthetic
gccaagcatttaggtgacactatagtctcttgtctctgcagctgcgtttcagagctatgctggaaacagc

SEQ ID NO: 49866 - DNA, 70 bp, Artificial Sequence
  Synthetic
gccaagcatttaggtgacactatagaagttcacaacccaaaaaaggtttcagagctatgctggaaacagc

SEQ ID NO: 49867 - DNA, 70 bp, Artificial Sequence
  Synthetic
gccaagcatttaggtgacactatagacgccaagtaccaagtgaccgtttcagagctatgctggaaacagc

SEQ ID NO: 49868 - DNA, 70 bp, Artificial Sequence
  Synthetic
gccaagcatttaggtgacactatagctatgttcaggagaatgtgagtttcagagctatgctggaaacagc

SEQ ID NO: 49869 - DNA, 70 bp, Artificial Sequence
  Synthetic
gccaagcatttaggtgacactatagctatctagccaacaagataggtttcagagctatgctggaaacagc

SEQ ID NO: 49870 - DNA, 70 bp, Artificial Sequence
  Synthetic
gccaagcatttaggtgacactatagatttcatctgcaaaagcaacgtttcagagctatgctggaaacagc

SEQ ID NO: 49871 - DNA, 70 bp, Artificial Sequence
  Synthetic
gccaagcatttaggtgacactataggtgaaggtgtatcgcttctggtttcagagctatgctggaaacagc

SEQ ID NO: 49872 - DNA, 70 bp, Artificial Sequence
  Synthetic
gccaagcatttaggtgacactatagattcaaccccgatggggaaggtttcagagctatgctggaaacagc

SEQ ID NO: 49873 - DNA, 70 bp, Artificial Sequence
  Synthetic
gccaagcatttaggtgacactatagccaggtctggggcctagatcgtttcagagctatgctggaaacagc

SEQ ID NO: 49874 - DNA, 70 bp, Artificial Sequence
  Synthetic
gccaagcatttaggtgacactatagtcaactgcagtcctgtggctgtttcagagctatgctggaaacagc

SEQ ID NO: 49875 - DNA, 70 bp, Artificial Sequence
  Synthetic
gccaagcatttaggtgacactatagcgactaattggtgaagctctgtttcagagctatgctggaaacagc

SEQ ID NO: 49876 - DNA, 70 bp, Artificial Sequence
  Synthetic
gccaagcatttaggtgacactatagtcctggctgtggctgctaccgtttcagagctatgctggaaacagc

SEQ ID NO: 49877 - DNA, 70 bp, Artificial Sequence
  Synthetic
gccaagcatttaggtgacactatagtaggtgacctttagtaaatggtttcagagctatgctggaaacagc

SEQ ID NO: 49878 - DNA, 70 bp, Artificial Sequence
  Synthetic
gccaagcatttaggtgacactatagttatgcccaaaacagagcaagtttcagagctatgctggaaacagc

SEQ ID NO: 49879 - DNA, 70 bp, Artificial Sequence
  Synthetic
gccaagcatttaggtgacactatagagaagcccggaaatgcttgcgtttcagagctatgctggaaacagc

SEQ ID NO: 49880 - DNA, 70 bp, Artificial Sequence
  Synthetic
gccaagcatttaggtgacactatagatcagatcagtgaaaagcaggtttcagagctatgctggaaacagc

SEQ ID NO: 49881 - DNA, 70 bp, Artificial Sequence
  Synthetic
gccaagcatttaggtgacactataggagacaaagtctttacttccgtttcagagctatgctggaaacagc

SEQ ID NO: 49882 - DNA, 70 bp, Artificial Sequence
  Synthetic
gccaagcatttaggtgacactatagaagaatcgcttgaacctggggtttcagagctatgctggaaacagc

SEQ ID NO: 49883 - DNA, 70 bp, Artificial Sequence
  Synthetic
gccaagcatttaggtgacactatagaagaaacagagattacacacgtttcagagctatgctggaaacagc

SEQ ID NO: 49884 - DNA, 70 bp, Artificial Sequence
  Synthetic
gccaagcatttaggtgacactatagatgtccaaatcactacttgtgtttcagagctatgctggaaacagc

SEQ ID NO: 49885 - DNA, 70 bp, Artificial Sequence
  Synthetic
gccaagcatttaggtgacactatagactttgaacagtattccacagtttcagagctatgctggaaacagc

SEQ ID NO: 49886 - DNA, 70 bp, Artificial Sequence
  Synthetic
gccaagcatttaggtgacactatagacaaagcagtagtttgtgttgtttcagagctatgctggaaacagc

SEQ ID NO: 49887 - DNA, 70 bp, Artificial Sequence
  Synthetic
gccaagcatttaggtgacactatagagcatcaagacagtgtaagagtttcagagctatgctggaaacagc

SEQ ID NO: 49888 - DNA, 70 bp, Artificial Sequence
  Synthetic
gccaagcatttaggtgacactatagtgagaagagatgatatcatggtttcagagctatgctggaaacagc

SEQ ID NO: 49889 - DNA, 70 bp, Artificial Sequence
  Synthetic
gccaagcatttaggtgacactatagttcaaatctaaagcactccagtttcagagctatgctggaaacagc

SEQ ID NO: 49890 - DNA, 70 bp, Artificial Sequence
  Synthetic
gccaagcatttaggtgacactatagctttgggacgctgaggctgggtttcagagctatgctggaaacagc

SEQ ID NO: 49891 - DNA, 70 bp, Artificial Sequence
  Synthetic
gccaagcatttaggtgacactatagtcatcacattctagagcgctgtttcagagctatgctggaaacagc

SEQ ID NO: 49892 - DNA, 70 bp, Artificial Sequence
  Synthetic
gccaagcatttaggtgacactatagccatgtgaaggggtttaaccgtttcagagctatgctggaaacagc

SEQ ID NO: 49893 - DNA, 70 bp, Artificial Sequence
  Synthetic
gccaagcatttaggtgacactatagaagagttcctcataccgtctgtttcagagctatgctggaaacagc

SEQ ID NO: 49894 - DNA, 70 bp, Artificial Sequence
  Synthetic
gccaagcatttaggtgacactatagtaggacctgaagacctccaggtttcagagctatgctggaaacagc

SEQ ID NO: 49895 - DNA, 70 bp, Artificial Sequence
  Synthetic
gccaagcatttaggtgacactatagttagaagaggagatgaagctgtttcagagctatgctggaaacagc

SEQ ID NO: 49896 - DNA, 70 bp, Artificial Sequence
  Synthetic
gccaagcatttaggtgacactatagtttctttactgcaggtacaagtttcagagctatgctggaaacagc

SEQ ID NO: 49897 - DNA, 70 bp, Artificial Sequence
  Synthetic
gccaagcatttaggtgacactataggcttctcggcaggagtcagcgtttcagagctatgctggaaacagc

SEQ ID NO: 49898 - DNA, 70 bp, Artificial Sequence
  Synthetic
gccaagcatttaggtgacactatagctgaatctgcatgtgctgttgtttcagagctatgctggaaacagc

SEQ ID NO: 49899 - DNA, 70 bp, Artificial Sequence
  Synthetic
gccaagcatttaggtgacactataggacagtcagatcaggaatgcgtttcagagctatgctggaaacagc

SEQ ID NO: 49900 - DNA, 70 bp, Artificial Sequence
  Synthetic
gccaagcatttaggtgacactatagtgaagaagatctgctatttcgtttcagagctatgctggaaacagc

SEQ ID NO: 49901 - DNA, 70 bp, Artificial Sequence
  Synthetic
gccaagcatttaggtgacactatagaagattcaaagtgaactggagtttcagagctatgctggaaacagc

SEQ ID NO: 49902 - DNA, 70 bp, Artificial Sequence
  Synthetic
gccaagcatttaggtgacactatagtctccaagaacatcattctcgtttcagagctatgctggaaacagc

SEQ ID NO: 49903 - DNA, 70 bp, Artificial Sequence
  Synthetic
gccaagcatttaggtgacactataggaaaactgtgtcacacagtggtttcagagctatgctggaaacagc

SEQ ID NO: 49904 - DNA, 70 bp, Artificial Sequence
  Synthetic
gccaagcatttaggtgacactataggaccgctatgctcaggacatgtttcagagctatgctggaaacagc

SEQ ID NO: 49905 - DNA, 70 bp, Artificial Sequence
  Synthetic
gccaagcatttaggtgacactatagtgaagagaagaagaaactaggtttcagagctatgctggaaacagc

SEQ ID NO: 49906 - DNA, 70 bp, Artificial Sequence
  Synthetic
gccaagcatttaggtgacactataggggctcccgcagattctagcgtttcagagctatgctggaaacagc

SEQ ID NO: 49907 - DNA, 70 bp, Artificial Sequence
  Synthetic
gccaagcatttaggtgacactatagattatcaagtctggcctcatgtttcagagctatgctggaaacagc

SEQ ID NO: 49908 - DNA, 70 bp, Artificial Sequence
  Synthetic
gccaagcatttaggtgacactatagacatttcagctattgcatgtgtttcagagctatgctggaaacagc

SEQ ID NO: 49909 - DNA, 70 bp, Artificial Sequence
  Synthetic
gccaagcatttaggtgacactatagttctgaagacatgtatgtgcgtttcagagctatgctggaaacagc

SEQ ID NO: 49910 - DNA, 70 bp, Artificial Sequence
  Synthetic
gccaagcatttaggtgacactataggctcttcaagctgaaactccgtttcagagctatgctggaaacagc

SEQ ID NO: 49911 - DNA, 70 bp, Artificial Sequence
  Synthetic
gccaagcatttaggtgacactatagccagccccgagatgagctctgtttcagagctatgctggaaacagc

SEQ ID NO: 49912 - DNA, 70 bp, Artificial Sequence
  Synthetic
gccaagcatttaggtgacactataggcttctcagctgtgtgagtcgtttcagagctatgctggaaacagc

SEQ ID NO: 49913 - DNA, 70 bp, Artificial Sequence
  Synthetic
gccaagcatttaggtgacactatagcagtctttatggaggaagcagtttcagagctatgctggaaacagc

SEQ ID NO: 49914 - DNA, 70 bp, Artificial Sequence
  Synthetic
gccaagcatttaggtgacactatagcgggcccctccacactcactgtttcagagctatgctggaaacagc

SEQ ID NO: 49915 - DNA, 70 bp, Artificial Sequence
  Synthetic
gccaagcatttaggtgacactataggagtgcggctgccgctaaccgtttcagagctatgctggaaacagc

SEQ ID NO: 49916 - DNA, 70 bp, Artificial Sequence
  Synthetic
gccaagcatttaggtgacactatagtggttcagtcattcttacgagtttcagagctatgctggaaacagc

SEQ ID NO: 49917 - DNA, 70 bp, Artificial Sequence
  Synthetic
gccaagcatttaggtgacactatagtcctgtaggcttccagctaagtttcagagctatgctggaaacagc

SEQ ID NO: 49918 - DNA, 70 bp, Artificial Sequence
  Synthetic
gccaagcatttaggtgacactatagcacacaacagccacatagccgtttcagagctatgctggaaacagc

SEQ ID NO: 49919 - DNA, 70 bp, Artificial Sequence
  Synthetic
gccaagcatttaggtgacactatagtactgggctgaagagtaagggtttcagagctatgctggaaacagc

SEQ ID NO: 49920 - DNA, 70 bp, Artificial Sequence
  Synthetic
gccaagcatttaggtgacactatagtgcgatcatccttcgataccgtttcagagctatgctggaaacagc

SEQ ID NO: 49921 - DNA, 70 bp, Artificial Sequence
  Synthetic
gccaagcatttaggtgacactatagtttctatgcctggcgggagcgtttcagagctatgctggaaacagc

SEQ ID NO: 49922 - DNA, 70 bp, Artificial Sequence
  Synthetic
gccaagcatttaggtgacactatagcctgactggctcctgctccagtttcagagctatgctggaaacagc

SEQ ID NO: 49923 - DNA, 70 bp, Artificial Sequence
  Synthetic
gccaagcatttaggtgacactatagacagctctatgtgttctgtcgtttcagagctatgctggaaacagc

SEQ ID NO: 49924 - DNA, 70 bp, Artificial Sequence
  Synthetic
gccaagcatttaggtgacactatagagctctgtgtgtctctcttcgtttcagagctatgctggaaacagc

SEQ ID NO: 49925 - DNA, 70 bp, Artificial Sequence
  Synthetic
gccaagcatttaggtgacactatagaggttcaggcctggcctcaggtttcagagctatgctggaaacagc

SEQ ID NO: 49926 - DNA, 70 bp, Artificial Sequence
  Synthetic
gccaagcatttaggtgacactatagagaagcagaggcaattctaagtttcagagctatgctggaaacagc

SEQ ID NO: 49927 - DNA, 70 bp, Artificial Sequence
  Synthetic
gccaagcatttaggtgacactatagctggattttaccacaagagtgtttcagagctatgctggaaacagc

SEQ ID NO: 49928 - DNA, 70 bp, Artificial Sequence
  Synthetic
gccaagcatttaggtgacactatagaaaagaaaaagaaaggctgggtttcagagctatgctggaaacagc

SEQ ID NO: 49929 - DNA, 70 bp, Artificial Sequence
  Synthetic
gccaagcatttaggtgacactatagttctgaaccgacttcagtaagtttcagagctatgctggaaacagc

SEQ ID NO: 49930 - DNA, 70 bp, Artificial Sequence
  Synthetic
gccaagcatttaggtgacactatagacactgatcttaatagaggcgtttcagagctatgctggaaacagc

SEQ ID NO: 49931 - DNA, 70 bp, Artificial Sequence
  Synthetic
gccaagcatttaggtgacactatagtaatagcaatgaactcctctgtttcagagctatgctggaaacagc

SEQ ID NO: 49932 - DNA, 70 bp, Artificial Sequence
  Synthetic
gccaagcatttaggtgacactataggagacttctagctcaagctcgtttcagagctatgctggaaacagc

SEQ ID NO: 49933 - DNA, 70 bp, Artificial Sequence
  Synthetic
gccaagcatttaggtgacactatagactgatggacaaggaggagggtttcagagctatgctggaaacagc

SEQ ID NO: 49934 - DNA, 70 bp, Artificial Sequence
  Synthetic
gccaagcatttaggtgacactatagccaggtgggctcttaggattgtttcagagctatgctggaaacagc

SEQ ID NO: 49935 - DNA, 70 bp, Artificial Sequence
  Synthetic
gccaagcatttaggtgacactatagtcttctctctgtgtcctactgtttcagagctatgctggaaacagc

SEQ ID NO: 49936 - DNA, 70 bp, Artificial Sequence
  Synthetic
gccaagcatttaggtgacactatagaaagtgaaaagagcgggtacgtttcagagctatgctggaaacagc

SEQ ID NO: 49937 - DNA, 70 bp, Artificial Sequence
  Synthetic
gccaagcatttaggtgacactatagtggcgtgttactgcgtgtcagtttcagagctatgctggaaacagc

SEQ ID NO: 49938 - DNA, 70 bp, Artificial Sequence
  Synthetic
gccaagcatttaggtgacactataggtatctcccagttcagaacagtttcagagctatgctggaaacagc

SEQ ID NO: 49939 - DNA, 70 bp, Artificial Sequence
  Synthetic
gccaagcatttaggtgacactatagggtgaacttaactagagatggtttcagagctatgctggaaacagc

SEQ ID NO: 49940 - DNA, 70 bp, Artificial Sequence
  Synthetic
gccaagcatttaggtgacactatagtgttgagtgctttgccccgcgtttcagagctatgctggaaacagc

SEQ ID NO: 49941 - DNA, 70 bp, Artificial Sequence
  Synthetic
gccaagcatttaggtgacactataggaaaccagaaatgacagcaggtttcagagctatgctggaaacagc

SEQ ID NO: 49942 - DNA, 70 bp, Artificial Sequence
  Synthetic
gccaagcatttaggtgacactatagctgcaatctacgagaagagtgtttcagagctatgctggaaacagc

SEQ ID NO: 49943 - DNA, 70 bp, Artificial Sequence
  Synthetic
gccaagcatttaggtgacactatagatagcaaactcaaaggtctggtttcagagctatgctggaaacagc

SEQ ID NO: 49944 - DNA, 70 bp, Artificial Sequence
  Synthetic
gccaagcatttaggtgacactataggagagcaaatcaaagctttggtttcagagctatgctggaaacagc

SEQ ID NO: 49945 - DNA, 70 bp, Artificial Sequence
  Synthetic
gccaagcatttaggtgacactatagagctacctctgtgaactgaggtttcagagctatgctggaaacagc

SEQ ID NO: 49946 - DNA, 70 bp, Artificial Sequence
  Synthetic
gccaagcatttaggtgacactatagtcaaatcaaaaacaggctcagtttcagagctatgctggaaacagc

SEQ ID NO: 49947 - DNA, 70 bp, Artificial Sequence
  Synthetic
gccaagcatttaggtgacactatagcaccatcaagggtgctccttgtttcagagctatgctggaaacagc

SEQ ID NO: 49948 - DNA, 70 bp, Artificial Sequence
  Synthetic
gccaagcatttaggtgacactatagtgaatttgttgggtatacacgtttcagagctatgctggaaacagc

SEQ ID NO: 49949 - DNA, 70 bp, Artificial Sequence
  Synthetic
gccaagcatttaggtgacactataggacatctcatcagcttcagggtttcagagctatgctggaaacagc

SEQ ID NO: 49950 - DNA, 70 bp, Artificial Sequence
  Synthetic
gccaagcatttaggtgacactatagtgatgctcacggaactacgggtttcagagctatgctggaaacagc

SEQ ID NO: 49951 - DNA, 70 bp, Artificial Sequence
  Synthetic
gccaagcatttaggtgacactatagcaggaggaagccttttcaacgtttcagagctatgctggaaacagc

SEQ ID NO: 49952 - DNA, 70 bp, Artificial Sequence
  Synthetic
gccaagcatttaggtgacactataggaaggagagagaaaagacatgtttcagagctatgctggaaacagc

SEQ ID NO: 49953 - DNA, 70 bp, Artificial Sequence
  Synthetic
gccaagcatttaggtgacactataggctcaccagagggggtcagtgtttcagagctatgctggaaacagc

SEQ ID NO: 49954 - DNA, 70 bp, Artificial Sequence
  Synthetic
gccaagcatttaggtgacactatagttcaggttagaacgtcatttgtttcagagctatgctggaaacagc

SEQ ID NO: 49955 - DNA, 70 bp, Artificial Sequence
  Synthetic
gccaagcatttaggtgacactatagctctacgtcttccaccgggcgtttcagagctatgctggaaacagc

SEQ ID NO: 49956 - DNA, 70 bp, Artificial Sequence
  Synthetic
gccaagcatttaggtgacactataggcctacaactaaacgatgccgtttcagagctatgctggaaacagc

SEQ ID NO: 49957 - DNA, 70 bp, Artificial Sequence
  Synthetic
gccaagcatttaggtgacactatagaacactcactggcttttatagtttcagagctatgctggaaacagc

SEQ ID NO: 49958 - DNA, 70 bp, Artificial Sequence
  Synthetic
gccaagcatttaggtgacactatagccaaagctcctggcctagctgtttcagagctatgctggaaacagc

SEQ ID NO: 49959 - DNA, 70 bp, Artificial Sequence
  Synthetic
gccaagcatttaggtgacactatagtgggcgcgggcatttacggagtttcagagctatgctggaaacagc

SEQ ID NO: 49960 - DNA, 70 bp, Artificial Sequence
  Synthetic
gccaagcatttaggtgacactatagtcgaggaggagccttgcagagtttcagagctatgctggaaacagc

SEQ ID NO: 49961 - DNA, 70 bp, Artificial Sequence
  Synthetic
gccaagcatttaggtgacactatagctggaggggtatcagaaagagtttcagagctatgctggaaacagc

SEQ ID NO: 49962 - DNA, 70 bp, Artificial Sequence
  Synthetic
gccaagcatttaggtgacactatagctgtgtcagggctaggaggcgtttcagagctatgctggaaacagc

SEQ ID NO: 49963 - DNA, 70 bp, Artificial Sequence
  Synthetic
gccaagcatttaggtgacactatagtgctctgtgcagaggcttaggtttcagagctatgctggaaacagc

SEQ ID NO: 49964 - DNA, 70 bp, Artificial Sequence
  Synthetic
gccaagcatttaggtgacactataggcaggggagggaggggctaggtttcagagctatgctggaaacagc

SEQ ID NO: 49965 - DNA, 70 bp, Artificial Sequence
  Synthetic
gccaagcatttaggtgacactatagacagacagaaggaacaacaagtttcagagctatgctggaaacagc

SEQ ID NO: 49966 - DNA, 70 bp, Artificial Sequence
  Synthetic
gccaagcatttaggtgacactatagcccctaatgtccgtacagctgtttcagagctatgctggaaacagc

SEQ ID NO: 49967 - DNA, 70 bp, Artificial Sequence
  Synthetic
gccaagcatttaggtgacactatagcgcctggaggccgcctgagcgtttcagagctatgctggaaacagc

SEQ ID NO: 49968 - DNA, 70 bp, Artificial Sequence
  Synthetic
gccaagcatttaggtgacactatagaaactccaagatgaggatttgtttcagagctatgctggaaacagc

SEQ ID NO: 49969 - DNA, 70 bp, Artificial Sequence
  Synthetic
gccaagcatttaggtgacactatagcctgcggaaggccgggacttgtttcagagctatgctggaaacagc

SEQ ID NO: 49970 - DNA, 70 bp, Artificial Sequence
  Synthetic
gccaagcatttaggtgacactatagatcgacagcgtcctggcctagtttcagagctatgctggaaacagc

SEQ ID NO: 49971 - DNA, 70 bp, Artificial Sequence
  Synthetic
gccaagcatttaggtgacactatagttgaaattgagcgagatctcgtttcagagctatgctggaaacagc

SEQ ID NO: 49972 - DNA, 70 bp, Artificial Sequence
  Synthetic
gccaagcatttaggtgacactatagaacatgttgggatgggaaacgtttcagagctatgctggaaacagc

SEQ ID NO: 49973 - DNA, 70 bp, Artificial Sequence
  Synthetic
gccaagcatttaggtgacactatagaccttcgatcagaagttcaggtttcagagctatgctggaaacagc

SEQ ID NO: 49974 - DNA, 70 bp, Artificial Sequence
  Synthetic
gccaagcatttaggtgacactatagaatgtgtcagaatgggaaacgtttcagagctatgctggaaacagc

SEQ ID NO: 49975 - DNA, 70 bp, Artificial Sequence
  Synthetic
gccaagcatttaggtgacactataggaataccccagatgcgaatagtttcagagctatgctggaaacagc

SEQ ID NO: 49976 - DNA, 70 bp, Artificial Sequence
  Synthetic
gccaagcatttaggtgacactatagtgcttgcttcattcacatatgtttcagagctatgctggaaacagc

SEQ ID NO: 49977 - DNA, 70 bp, Artificial Sequence
  Synthetic
gccaagcatttaggtgacactatagggattagctaccatgtaggagtttcagagctatgctggaaacagc

SEQ ID NO: 49978 - DNA, 70 bp, Artificial Sequence
  Synthetic
gccaagcatttaggtgacactataggggccagaaggggctcacaagtttcagagctatgctggaaacagc

SEQ ID NO: 49979 - DNA, 70 bp, Artificial Sequence
  Synthetic
gccaagcatttaggtgacactatagacacttggagagaaattggggtttcagagctatgctggaaacagc

SEQ ID NO: 49980 - DNA, 70 bp, Artificial Sequence
  Synthetic
gccaagcatttaggtgacactataggcagagctatggacattcaggtttcagagctatgctggaaacagc

SEQ ID NO: 49981 - DNA, 70 bp, Artificial Sequence
  Synthetic
gccaagcatttaggtgacactataggcagttccatgttaatcacagtttcagagctatgctggaaacagc

SEQ ID NO: 49982 - DNA, 70 bp, Artificial Sequence
  Synthetic
gccaagcatttaggtgacactatagtggtttcttatgtgtaggaggtttcagagctatgctggaaacagc

SEQ ID NO: 49983 - DNA, 70 bp, Artificial Sequence
  Synthetic
gccaagcatttaggtgacactatagttactagatgtcctataggagtttcagagctatgctggaaacagc

SEQ ID NO: 49984 - DNA, 70 bp, Artificial Sequence
  Synthetic
gccaagcatttaggtgacactatagttgcaaagaccctgaggaaggtttcagagctatgctggaaacagc

SEQ ID NO: 49985 - DNA, 70 bp, Artificial Sequence
  Synthetic
gccaagcatttaggtgacactatagaagaagaggtgcaagatacagtttcagagctatgctggaaacagc

SEQ ID NO: 49986 - DNA, 70 bp, Artificial Sequence
  Synthetic
gccaagcatttaggtgacactatagtactgcagtggcacgccgtggtttcagagctatgctggaaacagc

SEQ ID NO: 49987 - DNA, 70 bp, Artificial Sequence
  Synthetic
gccaagcatttaggtgacactatagatcccgtctcccggggccctgtttcagagctatgctggaaacagc

SEQ ID NO: 49988 - DNA, 70 bp, Artificial Sequence
  Synthetic
gccaagcatttaggtgacactatagccccgatcctcccacaataagtttcagagctatgctggaaacagc

SEQ ID NO: 49989 - DNA, 70 bp, Artificial Sequence
  Synthetic
gccaagcatttaggtgacactatagaactcacaagattgttgactgtttcagagctatgctggaaacagc

SEQ ID NO: 49990 - DNA, 70 bp, Artificial Sequence
  Synthetic
gccaagcatttaggtgacactatagcttgaggaccacgagctaacgtttcagagctatgctggaaacagc

SEQ ID NO: 49991 - DNA, 70 bp, Artificial Sequence
  Synthetic
gccaagcatttaggtgacactatagcccgggagagcactcagatcgtttcagagctatgctggaaacagc

SEQ ID NO: 49992 - DNA, 70 bp, Artificial Sequence
  Synthetic
gccaagcatttaggtgacactatagcaccatggagactaccattggtttcagagctatgctggaaacagc

SEQ ID NO: 49993 - DNA, 70 bp, Artificial Sequence
  Synthetic
gccaagcatttaggtgacactatagctgggtcacatttgtggctggtttcagagctatgctggaaacagc

SEQ ID NO: 49994 - DNA, 70 bp, Artificial Sequence
  Synthetic
gccaagcatttaggtgacactatagtgaggtgcacattgttcaaggtttcagagctatgctggaaacagc

SEQ ID NO: 49995 - DNA, 70 bp, Artificial Sequence
  Synthetic
gccaagcatttaggtgacactatagcgatgtcttcaaagagtcttgtttcagagctatgctggaaacagc

SEQ ID NO: 49996 - DNA, 70 bp, Artificial Sequence
  Synthetic
gccaagcatttaggtgacactatagtctgtcccagcgcggtgatggtttcagagctatgctggaaacagc

SEQ ID NO: 49997 - DNA, 70 bp, Artificial Sequence
  Synthetic
gccaagcatttaggtgacactatagggctctggcgctggtgtgaggtttcagagctatgctggaaacagc

SEQ ID NO: 49998 - DNA, 70 bp, Artificial Sequence
  Synthetic
gccaagcatttaggtgacactatagagatgagcatcttttcgcttgtttcagagctatgctggaaacagc

SEQ ID NO: 49999 - DNA, 70 bp, Artificial Sequence
  Synthetic
gccaagcatttaggtgacactatagaaagctggccgccattaaacgtttcagagctatgctggaaacagc

SEQ ID NO: 50000 - DNA, 70 bp, Artificial Sequence
  Synthetic
gccaagcatttaggtgacactatagcagtgtggagcagataaggtgtttcagagctatgctggaaacagc

SEQ ID NO: 50001 - DNA, 70 bp, Artificial Sequence
  Synthetic
gccaagcatttaggtgacactatagtgctctcaggatgcacccaggtttcagagctatgctggaaacagc

SEQ ID NO: 50002 - DNA, 70 bp, Artificial Sequence
  Synthetic
gccaagcatttaggtgacactatagagaagccgaggtcccatcaagtttcagagctatgctggaaacagc

SEQ ID NO: 50003 - DNA, 70 bp, Artificial Sequence
  Synthetic
gccaagcatttaggtgacactatagcaaatttgctgctcctccaggtttcagagctatgctggaaacagc

SEQ ID NO: 50004 - DNA, 70 bp, Artificial Sequence
  Synthetic
gccaagcatttaggtgacactatagctagtggcaggagtcaaggtgtttcagagctatgctggaaacagc

SEQ ID NO: 50005 - DNA, 70 bp, Artificial Sequence
  Synthetic
gccaagcatttaggtgacactatagtacttgtccattttcagctggtttcagagctatgctggaaacagc

SEQ ID NO: 50006 - DNA, 70 bp, Artificial Sequence
  Synthetic
gccaagcatttaggtgacactatagctgagctccctgccctgaaggtttcagagctatgctggaaacagc

SEQ ID NO: 50007 - DNA, 70 bp, Artificial Sequence
  Synthetic
gccaagcatttaggtgacactataggtgccgacttgcaaacggatgtttcagagctatgctggaaacagc

SEQ ID NO: 50008 - DNA, 70 bp, Artificial Sequence
  Synthetic
gccaagcatttaggtgacactatagagaagttcaacctggagagagtttcagagctatgctggaaacagc

SEQ ID NO: 50009 - DNA, 70 bp, Artificial Sequence
  Synthetic
gccaagcatttaggtgacactatagcagagcatgcttgagaaggggtttcagagctatgctggaaacagc

SEQ ID NO: 50010 - DNA, 70 bp, Artificial Sequence
  Synthetic
gccaagcatttaggtgacactatagggctaagcagtcaacactccgtttcagagctatgctggaaacagc

SEQ ID NO: 50011 - DNA, 70 bp, Artificial Sequence
  Synthetic
gccaagcatttaggtgacactatagactgcaaccaaagaagaggagtttcagagctatgctggaaacagc

SEQ ID NO: 50012 - DNA, 70 bp, Artificial Sequence
  Synthetic
gccaagcatttaggtgacactatagccgtcagaggagtcctcagggtttcagagctatgctggaaacagc

SEQ ID NO: 50013 - DNA, 70 bp, Artificial Sequence
  Synthetic
gccaagcatttaggtgacactatagctgcgtgagcgccgcccacagtttcagagctatgctggaaacagc

SEQ ID NO: 50014 - DNA, 70 bp, Artificial Sequence
  Synthetic
gccaagcatttaggtgacactataggatgaaatcttgagagcagtgtttcagagctatgctggaaacagc

SEQ ID NO: 50015 - DNA, 70 bp, Artificial Sequence
  Synthetic
gccaagcatttaggtgacactatagggtgttccacttacttcttggtttcagagctatgctggaaacagc

SEQ ID NO: 50016 - DNA, 70 bp, Artificial Sequence
  Synthetic
gccaagcatttaggtgacactatagtgatgcttccaccagatgtcgtttcagagctatgctggaaacagc

SEQ ID NO: 50017 - DNA, 70 bp, Artificial Sequence
  Synthetic
gccaagcatttaggtgacactatagtgttgctgttggctgtgttggtttcagagctatgctggaaacagc

SEQ ID NO: 50018 - DNA, 70 bp, Artificial Sequence
  Synthetic
gccaagcatttaggtgacactatagcggagcatacctggagtagtgtttcagagctatgctggaaacagc

SEQ ID NO: 50019 - DNA, 70 bp, Artificial Sequence
  Synthetic
gccaagcatttaggtgacactatagatcttcctcctcaagacagcgtttcagagctatgctggaaacagc

SEQ ID NO: 50020 - DNA, 70 bp, Artificial Sequence
  Synthetic
gccaagcatttaggtgacactatagagctcattcctggtgcaagtgtttcagagctatgctggaaacagc

SEQ ID NO: 50021 - DNA, 70 bp, Artificial Sequence
  Synthetic
gccaagcatttaggtgacactatagtgttctagtgatctctccaagtttcagagctatgctggaaacagc

SEQ ID NO: 50022 - DNA, 70 bp, Artificial Sequence
  Synthetic
gccaagcatttaggtgacactataggatctgtatagacgactgacgtttcagagctatgctggaaacagc

SEQ ID NO: 50023 - DNA, 70 bp, Artificial Sequence
  Synthetic
gccaagcatttaggtgacactataggtctgcatcttcactgctgcgtttcagagctatgctggaaacagc

SEQ ID NO: 50024 - DNA, 70 bp, Artificial Sequence
  Synthetic
gccaagcatttaggtgacactatagactacaaccagatgcccctggtttcagagctatgctggaaacagc

SEQ ID NO: 50025 - DNA, 70 bp, Artificial Sequence
  Synthetic
gccaagcatttaggtgacactataggttctaattggtgtcgttgtgtttcagagctatgctggaaacagc

SEQ ID NO: 50026 - DNA, 70 bp, Artificial Sequence
  Synthetic
gccaagcatttaggtgacactataggctagactcacttgatgggggtttcagagctatgctggaaacagc

SEQ ID NO: 50027 - DNA, 70 bp, Artificial Sequence
  Synthetic
gccaagcatttaggtgacactatagtcagtcatcagcatcttcacgtttcagagctatgctggaaacagc

SEQ ID NO: 50028 - DNA, 70 bp, Artificial Sequence
  Synthetic
gccaagcatttaggtgacactatagtagtacatcgtcgtcatctggtttcagagctatgctggaaacagc

SEQ ID NO: 50029 - DNA, 70 bp, Artificial Sequence
  Synthetic
gccaagcatttaggtgacactatagagcagcaactgtcttagcgcgtttcagagctatgctggaaacagc

SEQ ID NO: 50030 - DNA, 70 bp, Artificial Sequence
  Synthetic
gccaagcatttaggtgacactatagttggcttcctgccacatgatgtttcagagctatgctggaaacagc

SEQ ID NO: 50031 - DNA, 70 bp, Artificial Sequence
  Synthetic
gccaagcatttaggtgacactatagaacacagcagcacacacagcgtttcagagctatgctggaaacagc

SEQ ID NO: 50032 - DNA, 70 bp, Artificial Sequence
  Synthetic
gccaagcatttaggtgacactatagggccagggacgagtgtaagtgtttcagagctatgctggaaacagc

SEQ ID NO: 50033 - DNA, 70 bp, Artificial Sequence
  Synthetic
gccaagcatttaggtgacactatagatcatatctgtgaacagacagtttcagagctatgctggaaacagc

SEQ ID NO: 50034 - DNA, 70 bp, Artificial Sequence
  Synthetic
gccaagcatttaggtgacactatagcagctgcaggcactacggcggtttcagagctatgctggaaacagc

SEQ ID NO: 50035 - DNA, 70 bp, Artificial Sequence
  Synthetic
gccaagcatttaggtgacactatagccaatgacagtcagccccttgtttcagagctatgctggaaacagc

SEQ ID NO: 50036 - DNA, 70 bp, Artificial Sequence
  Synthetic
gccaagcatttaggtgacactatagtgcagcgagtgcatccttgagtttcagagctatgctggaaacagc

SEQ ID NO: 50037 - DNA, 70 bp, Artificial Sequence
  Synthetic
gccaagcatttaggtgacactataggaagccttggctccctgtgagtttcagagctatgctggaaacagc

SEQ ID NO: 50038 - DNA, 70 bp, Artificial Sequence
  Synthetic
gccaagcatttaggtgacactatagcagctgtgattgctgcaactgtttcagagctatgctggaaacagc

SEQ ID NO: 50039 - DNA, 70 bp, Artificial Sequence
  Synthetic
gccaagcatttaggtgacactatagctggataaaactcctcagtcgtttcagagctatgctggaaacagc

SEQ ID NO: 50040 - DNA, 70 bp, Artificial Sequence
  Synthetic
gccaagcatttaggtgacactatagtgctaatctggtcgaaaaatgtttcagagctatgctggaaacagc

SEQ ID NO: 50041 - DNA, 70 bp, Artificial Sequence
  Synthetic
gccaagcatttaggtgacactatagttctacgacctgctctaggtgtttcagagctatgctggaaacagc

SEQ ID NO: 50042 - DNA, 70 bp, Artificial Sequence
  Synthetic
gccaagcatttaggtgacactatagggctttagcgactcaattccgtttcagagctatgctggaaacagc

SEQ ID NO: 50043 - DNA, 70 bp, Artificial Sequence
  Synthetic
gccaagcatttaggtgacactatagccaccagaagaggaagcttggtttcagagctatgctggaaacagc

SEQ ID NO: 50044 - DNA, 70 bp, Artificial Sequence
  Synthetic
gccaagcatttaggtgacactataggggagggtggagtcaggatggtttcagagctatgctggaaacagc

SEQ ID NO: 50045 - DNA, 70 bp, Artificial Sequence
  Synthetic
gccaagcatttaggtgacactatagtatgttgtgtttatgcccgagtttcagagctatgctggaaacagc

SEQ ID NO: 50046 - DNA, 70 bp, Artificial Sequence
  Synthetic
gccaagcatttaggtgacactatagtagaggagtcctctgaataagtttcagagctatgctggaaacagc

SEQ ID NO: 50047 - DNA, 70 bp, Artificial Sequence
  Synthetic
gccaagcatttaggtgacactatagtggaagtattttgttatgccgtttcagagctatgctggaaacagc

SEQ ID NO: 50048 - DNA, 70 bp, Artificial Sequence
  Synthetic
gccaagcatttaggtgacactatagtaattttgaaggtgcttctcgtttcagagctatgctggaaacagc

SEQ ID NO: 50049 - DNA, 70 bp, Artificial Sequence
  Synthetic
gccaagcatttaggtgacactataggccaggcctgcgtggccttagtttcagagctatgctggaaacagc

SEQ ID NO: 50050 - DNA, 70 bp, Artificial Sequence
  Synthetic
gccaagcatttaggtgacactatagggggcacggctagttcctcagtttcagagctatgctggaaacagc

SEQ ID NO: 50051 - DNA, 70 bp, Artificial Sequence
  Synthetic
gccaagcatttaggtgacactataggccttcgggatcaagtgtgagtttcagagctatgctggaaacagc

SEQ ID NO: 50052 - DNA, 70 bp, Artificial Sequence
  Synthetic
gccaagcatttaggtgacactatagggggcactcagtccctccgcgtttcagagctatgctggaaacagc

SEQ ID NO: 50053 - DNA, 70 bp, Artificial Sequence
  Synthetic
gccaagcatttaggtgacactataggaacggcaactcaaggctttgtttcagagctatgctggaaacagc

SEQ ID NO: 50054 - DNA, 70 bp, Artificial Sequence
  Synthetic
gccaagcatttaggtgacactatagtggccacactccgcagctaggtttcagagctatgctggaaacagc

SEQ ID NO: 50055 - DNA, 70 bp, Artificial Sequence
  Synthetic
gccaagcatttaggtgacactatagactaaagcagttggctgagtgtttcagagctatgctggaaacagc

SEQ ID NO: 50056 - DNA, 70 bp, Artificial Sequence
  Synthetic
gccaagcatttaggtgacactatagtgggctggatccatgtaatggtttcagagctatgctggaaacagc

SEQ ID NO: 50057 - DNA, 70 bp, Artificial Sequence
  Synthetic
gccaagcatttaggtgacactatagtatcaaacaattggcagcttgtttcagagctatgctggaaacagc

SEQ ID NO: 50058 - DNA, 70 bp, Artificial Sequence
  Synthetic
gccaagcatttaggtgacactatagaaatcatcttcatccagttcgtttcagagctatgctggaaacagc

SEQ ID NO: 50059 - DNA, 70 bp, Artificial Sequence
  Synthetic
gccaagcatttaggtgacactatagatgatgcaaatctatgaagcgtttcagagctatgctggaaacagc

SEQ ID NO: 50060 - DNA, 70 bp, Artificial Sequence
  Synthetic
gccaagcatttaggtgacactatagctggtggcagcttcgtaacggtttcagagctatgctggaaacagc

SEQ ID NO: 50061 - DNA, 70 bp, Artificial Sequence
  Synthetic
gccaagcatttaggtgacactatagttcacttgagggtcctacaagtttcagagctatgctggaaacagc

SEQ ID NO: 50062 - DNA, 70 bp, Artificial Sequence
  Synthetic
gccaagcatttaggtgacactatagacggtatcagagactggtgggtttcagagctatgctggaaacagc

SEQ ID NO: 50063 - DNA, 70 bp, Artificial Sequence
  Synthetic
gccaagcatttaggtgacactatagaaatctgcacaatcagctttgtttcagagctatgctggaaacagc

SEQ ID NO: 50064 - DNA, 70 bp, Artificial Sequence
  Synthetic
gccaagcatttaggtgacactataggtcaaaatggcatttgacaggtttcagagctatgctggaaacagc

SEQ ID NO: 50065 - DNA, 70 bp, Artificial Sequence
  Synthetic
gccaagcatttaggtgacactatagggaatggcttgaaatcacaagtttcagagctatgctggaaacagc

SEQ ID NO: 50066 - DNA, 70 bp, Artificial Sequence
  Synthetic
gccaagcatttaggtgacactatagtaccagaaaagaaagtggcagtttcagagctatgctggaaacagc

SEQ ID NO: 50067 - DNA, 70 bp, Artificial Sequence
  Synthetic
gccaagcatttaggtgacactataggatgccacaacagattgagtgtttcagagctatgctggaaacagc

SEQ ID NO: 50068 - DNA, 70 bp, Artificial Sequence
  Synthetic
gccaagcatttaggtgacactataggcatccgatttcttcactaagtttcagagctatgctggaaacagc

SEQ ID NO: 50069 - DNA, 70 bp, Artificial Sequence
  Synthetic
gccaagcatttaggtgacactatagggcacaaacggagtcacttcgtttcagagctatgctggaaacagc

SEQ ID NO: 50070 - DNA, 70 bp, Artificial Sequence
  Synthetic
gccaagcatttaggtgacactatagctactctttgaacaggagcagtttcagagctatgctggaaacagc

SEQ ID NO: 50071 - DNA, 70 bp, Artificial Sequence
  Synthetic
gccaagcatttaggtgacactatagccaggcgggctaagtgctatgtttcagagctatgctggaaacagc

SEQ ID NO: 50072 - DNA, 70 bp, Artificial Sequence
  Synthetic
gccaagcatttaggtgacactatagatgtcatcaagcacctgaacgtttcagagctatgctggaaacagc

SEQ ID NO: 50073 - DNA, 70 bp, Artificial Sequence
  Synthetic
gccaagcatttaggtgacactatagtttaggagtcagcttcatcagtttcagagctatgctggaaacagc

SEQ ID NO: 50074 - DNA, 70 bp, Artificial Sequence
  Synthetic
gccaagcatttaggtgacactatagaaagaagccgaaggctcttagtttcagagctatgctggaaacagc

SEQ ID NO: 50075 - DNA, 70 bp, Artificial Sequence
  Synthetic
gccaagcatttaggtgacactatagctgtctgtcttgcctaacaggtttcagagctatgctggaaacagc

SEQ ID NO: 50076 - DNA, 70 bp, Artificial Sequence
  Synthetic
gccaagcatttaggtgacactatagtatgtcttggtcactttgtcgtttcagagctatgctggaaacagc

SEQ ID NO: 50077 - DNA, 70 bp, Artificial Sequence
  Synthetic
gccaagcatttaggtgacactatagggagaggggactatcagcatgtttcagagctatgctggaaacagc

SEQ ID NO: 50078 - DNA, 70 bp, Artificial Sequence
  Synthetic
gccaagcatttaggtgacactatagataagaacataggcgctacagtttcagagctatgctggaaacagc

SEQ ID NO: 50079 - DNA, 70 bp, Artificial Sequence
  Synthetic
gccaagcatttaggtgacactatagtgatacaacctcattctacagtttcagagctatgctggaaacagc

SEQ ID NO: 50080 - DNA, 70 bp, Artificial Sequence
  Synthetic
gccaagcatttaggtgacactatagatcggcactgccaggtaggcgtttcagagctatgctggaaacagc

SEQ ID NO: 50081 - DNA, 70 bp, Artificial Sequence
  Synthetic
gccaagcatttaggtgacactatagaagagaagttgtactggcaggtttcagagctatgctggaaacagc

SEQ ID NO: 50082 - DNA, 70 bp, Artificial Sequence
  Synthetic
gccaagcatttaggtgacactatagggaaccctagccgtgtttgcgtttcagagctatgctggaaacagc

SEQ ID NO: 50083 - DNA, 70 bp, Artificial Sequence
  Synthetic
gccaagcatttaggtgacactataggacttagtcccagccctcacgtttcagagctatgctggaaacagc

SEQ ID NO: 50084 - DNA, 70 bp, Artificial Sequence
  Synthetic
gccaagcatttaggtgacactataggcagtcagatcattccagctgtttcagagctatgctggaaacagc

SEQ ID NO: 50085 - DNA, 70 bp, Artificial Sequence
  Synthetic
gccaagcatttaggtgacactatagtagtgcttatgcatcttcccgtttcagagctatgctggaaacagc

SEQ ID NO: 50086 - DNA, 70 bp, Artificial Sequence
  Synthetic
gccaagcatttaggtgacactatagagattggaaattcatagcccgtttcagagctatgctggaaacagc

SEQ ID NO: 50087 - DNA, 70 bp, Artificial Sequence
  Synthetic
gccaagcatttaggtgacactatagctggctggcatgatctaggagtttcagagctatgctggaaacagc

SEQ ID NO: 50088 - DNA, 70 bp, Artificial Sequence
  Synthetic
gccaagcatttaggtgacactatagccagtacgaaaacagtcatcgtttcagagctatgctggaaacagc

SEQ ID NO: 50089 - DNA, 70 bp, Artificial Sequence
  Synthetic
gccaagcatttaggtgacactatagttcttgatcggatgtttctggtttcagagctatgctggaaacagc

SEQ ID NO: 50090 - DNA, 70 bp, Artificial Sequence
  Synthetic
gccaagcatttaggtgacactatagcagccactacttgggaacacgtttcagagctatgctggaaacagc

SEQ ID NO: 50091 - DNA, 70 bp, Artificial Sequence
  Synthetic
gccaagcatttaggtgacactataggcgtggttacgcaaagtcttgtttcagagctatgctggaaacagc

SEQ ID NO: 50092 - DNA, 70 bp, Artificial Sequence
  Synthetic
gccaagcatttaggtgacactatagtcatagaccgattcttcatggtttcagagctatgctggaaacagc

SEQ ID NO: 50093 - DNA, 70 bp, Artificial Sequence
  Synthetic
gccaagcatttaggtgacactatagaccctccagtcttcaaggaagtttcagagctatgctggaaacagc

SEQ ID NO: 50094 - DNA, 70 bp, Artificial Sequence
  Synthetic
gccaagcatttaggtgacactatagagatgaggaagggcctcactgtttcagagctatgctggaaacagc

SEQ ID NO: 50095 - DNA, 70 bp, Artificial Sequence
  Synthetic
gccaagcatttaggtgacactataggtggctacatagttaccattgtttcagagctatgctggaaacagc

SEQ ID NO: 50096 - DNA, 70 bp, Artificial Sequence
  Synthetic
gccaagcatttaggtgacactatagacgctgcccagcgtgactgagtttcagagctatgctggaaacagc

SEQ ID NO: 50097 - DNA, 70 bp, Artificial Sequence
  Synthetic
gccaagcatttaggtgacactatagtccctccaaggcattcagaggtttcagagctatgctggaaacagc

SEQ ID NO: 50098 - DNA, 70 bp, Artificial Sequence
  Synthetic
gccaagcatttaggtgacactataggacaagcgcttcatctaggggtttcagagctatgctggaaacagc

SEQ ID NO: 50099 - DNA, 70 bp, Artificial Sequence
  Synthetic
gccaagcatttaggtgacactatagaagtcggtgcgagctaaggcgtttcagagctatgctggaaacagc

SEQ ID NO: 50100 - DNA, 70 bp, Artificial Sequence
  Synthetic
gccaagcatttaggtgacactatagagtggttggttggctcagtcgtttcagagctatgctggaaacagc

SEQ ID NO: 50101 - DNA, 70 bp, Artificial Sequence
  Synthetic
gccaagcatttaggtgacactatagttccgccccttctcgtgaccgtttcagagctatgctggaaacagc

SEQ ID NO: 50102 - DNA, 70 bp, Artificial Sequence
  Synthetic
gccaagcatttaggtgacactatagttagcaaaaagtctggtttcgtttcagagctatgctggaaacagc

SEQ ID NO: 50103 - DNA, 70 bp, Artificial Sequence
  Synthetic
gccaagcatttaggtgacactatagaccccctttattccaatttcgtttcagagctatgctggaaacagc

SEQ ID NO: 50104 - DNA, 70 bp, Artificial Sequence
  Synthetic
gccaagcatttaggtgacactatagaacgcgaaagctttcagtctgtttcagagctatgctggaaacagc

SEQ ID NO: 50105 - DNA, 70 bp, Artificial Sequence
  Synthetic
gccaagcatttaggtgacactatagcctacctgcggctgctctaggtttcagagctatgctggaaacagc

SEQ ID NO: 50106 - DNA, 70 bp, Artificial Sequence
  Synthetic
gccaagcatttaggtgacactatagtcactgctgacacgcctcctgtttcagagctatgctggaaacagc

SEQ ID NO: 50107 - DNA, 70 bp, Artificial Sequence
  Synthetic
gccaagcatttaggtgacactatagatgctgttccccattattcagtttcagagctatgctggaaacagc

SEQ ID NO: 50108 - DNA, 70 bp, Artificial Sequence
  Synthetic
gccaagcatttaggtgacactatagtcgcggatgaggcgtttgcggtttcagagctatgctggaaacagc

SEQ ID NO: 50109 - DNA, 70 bp, Artificial Sequence
  Synthetic
gccaagcatttaggtgacactatagcggaagccccgtctctaaaagtttcagagctatgctggaaacagc

SEQ ID NO: 50110 - DNA, 70 bp, Artificial Sequence
  Synthetic
gccaagcatttaggtgacactatagaccttctgggtcacgtaggggtttcagagctatgctggaaacagc

SEQ ID NO: 50111 - DNA, 70 bp, Artificial Sequence
  Synthetic
gccaagcatttaggtgacactatagcctgagcaaatccactaagagtttcagagctatgctggaaacagc

SEQ ID NO: 50112 - DNA, 70 bp, Artificial Sequence
  Synthetic
gccaagcatttaggtgacactatagaaggcccagagttctcagtcgtttcagagctatgctggaaacagc

SEQ ID NO: 50113 - DNA, 70 bp, Artificial Sequence
  Synthetic
gccaagcatttaggtgacactatagcctcgcacccccgaaattaggtttcagagctatgctggaaacagc

SEQ ID NO: 50114 - DNA, 70 bp, Artificial Sequence
  Synthetic
gccaagcatttaggtgacactataggacagggatgggaggctacggtttcagagctatgctggaaacagc

SEQ ID NO: 50115 - DNA, 70 bp, Artificial Sequence
  Synthetic
gccaagcatttaggtgacactatagctttgcagatctgtactgaggtttcagagctatgctggaaacagc

SEQ ID NO: 50116 - DNA, 70 bp, Artificial Sequence
  Synthetic
gccaagcatttaggtgacactatagagtcgtgagacagtatttaagtttcagagctatgctggaaacagc

SEQ ID NO: 50117 - DNA, 70 bp, Artificial Sequence
  Synthetic
gccaagcatttaggtgacactataggcaataataatggctcagtggtttcagagctatgctggaaacagc

SEQ ID NO: 50118 - DNA, 70 bp, Artificial Sequence
  Synthetic
gccaagcatttaggtgacactatagccatgcaactggctgaactcgtttcagagctatgctggaaacagc

SEQ ID NO: 50119 - DNA, 70 bp, Artificial Sequence
  Synthetic
gccaagcatttaggtgacactataggcggcgcagcctgtacatcagtttcagagctatgctggaaacagc

SEQ ID NO: 50120 - DNA, 70 bp, Artificial Sequence
  Synthetic
gccaagcatttaggtgacactatagggagggaaaatggtgtttaagtttcagagctatgctggaaacagc

SEQ ID NO: 50121 - DNA, 70 bp, Artificial Sequence
  Synthetic
gccaagcatttaggtgacactataggtcagagcatatgacaagtggtttcagagctatgctggaaacagc

SEQ ID NO: 50122 - DNA, 70 bp, Artificial Sequence
  Synthetic
gccaagcatttaggtgacactataggatgggcaggcttcaatcatgtttcagagctatgctggaaacagc

SEQ ID NO: 50123 - DNA, 70 bp, Artificial Sequence
  Synthetic
gccaagcatttaggtgacactatagcatgaggcaaatgaggaacagtttcagagctatgctggaaacagc

SEQ ID NO: 50124 - DNA, 70 bp, Artificial Sequence
  Synthetic
gccaagcatttaggtgacactatagtaatagtgcttaaatggccagtttcagagctatgctggaaacagc

SEQ ID NO: 50125 - DNA, 70 bp, Artificial Sequence
  Synthetic
gccaagcatttaggtgacactatagaataagagagtcatttgtcggtttcagagctatgctggaaacagc

SEQ ID NO: 50126 - DNA, 70 bp, Artificial Sequence
  Synthetic
gccaagcatttaggtgacactatagaccatgctgtgtctgttatggtttcagagctatgctggaaacagc

SEQ ID NO: 50127 - DNA, 70 bp, Artificial Sequence
  Synthetic
gccaagcatttaggtgacactatagcgggacccaggtcctctagtgtttcagagctatgctggaaacagc

SEQ ID NO: 50128 - DNA, 70 bp, Artificial Sequence
  Synthetic
gccaagcatttaggtgacactatagccaaagtcgaggtagctcaggtttcagagctatgctggaaacagc

SEQ ID NO: 50129 - DNA, 70 bp, Artificial Sequence
  Synthetic
gccaagcatttaggtgacactatagagccttcaaacctggggaaagtttcagagctatgctggaaacagc

SEQ ID NO: 50130 - DNA, 70 bp, Artificial Sequence
  Synthetic
gccaagcatttaggtgacactatagcaatcttcatgatgcctagggtttcagagctatgctggaaacagc

SEQ ID NO: 50131 - DNA, 70 bp, Artificial Sequence
  Synthetic
gccaagcatttaggtgacactatagagctgtatgccctgggctaggtttcagagctatgctggaaacagc

SEQ ID NO: 50132 - DNA, 70 bp, Artificial Sequence
  Synthetic
gccaagcatttaggtgacactatagcacgctggggctgctgtcacgtttcagagctatgctggaaacagc

SEQ ID NO: 50133 - DNA, 70 bp, Artificial Sequence
  Synthetic
gccaagcatttaggtgacactatagactttccacatccggatctggtttcagagctatgctggaaacagc

SEQ ID NO: 50134 - DNA, 70 bp, Artificial Sequence
  Synthetic
gccaagcatttaggtgacactatagccttccacatccgaatctgagtttcagagctatgctggaaacagc

SEQ ID NO: 50135 - DNA, 70 bp, Artificial Sequence
  Synthetic
gccaagcatttaggtgacactatagtcctttcggattcacttctggtttcagagctatgctggaaacagc

SEQ ID NO: 50136 - DNA, 70 bp, Artificial Sequence
  Synthetic
gccaagcatttaggtgacactatagcagctgccacaggcaggtgagtttcagagctatgctggaaacagc

SEQ ID NO: 50137 - DNA, 70 bp, Artificial Sequence
  Synthetic
gccaagcatttaggtgacactatagggcaggttcacgtgtggatagtttcagagctatgctggaaacagc

SEQ ID NO: 50138 - DNA, 70 bp, Artificial Sequence
  Synthetic
gccaagcatttaggtgacactatagccgcctccattcctactaaggtttcagagctatgctggaaacagc

SEQ ID NO: 50139 - DNA, 70 bp, Artificial Sequence
  Synthetic
gccaagcatttaggtgacactatagtcactgcagtatcttcagacgtttcagagctatgctggaaacagc

SEQ ID NO: 50140 - DNA, 70 bp, Artificial Sequence
  Synthetic
gccaagcatttaggtgacactatagagcacagctgggatcatctcgtttcagagctatgctggaaacagc

SEQ ID NO: 50141 - DNA, 70 bp, Artificial Sequence
  Synthetic
gccaagcatttaggtgacactatagaccacaaaacttagttgatcgtttcagagctatgctggaaacagc

SEQ ID NO: 50142 - DNA, 70 bp, Artificial Sequence
  Synthetic
gccaagcatttaggtgacactatagggtagggtccggcagtgaccgtttcagagctatgctggaaacagc

SEQ ID NO: 50143 - DNA, 70 bp, Artificial Sequence
  Synthetic
gccaagcatttaggtgacactataggctcttggagatgtacaggagtttcagagctatgctggaaacagc

SEQ ID NO: 50144 - DNA, 70 bp, Artificial Sequence
  Synthetic
gccaagcatttaggtgacactatagtctcaggacgtcagagagctgtttcagagctatgctggaaacagc

SEQ ID NO: 50145 - DNA, 70 bp, Artificial Sequence
  Synthetic
gccaagcatttaggtgacactatagatactgagattcacagtttcgtttcagagctatgctggaaacagc

SEQ ID NO: 50146 - DNA, 70 bp, Artificial Sequence
  Synthetic
gccaagcatttaggtgacactatagaaatatgcctctgtgctatagtttcagagctatgctggaaacagc

SEQ ID NO: 50147 - DNA, 70 bp, Artificial Sequence
  Synthetic
gccaagcatttaggtgacactatagactttagtatgtgtacctccgtttcagagctatgctggaaacagc

SEQ ID NO: 50148 - DNA, 70 bp, Artificial Sequence
  Synthetic
gccaagcatttaggtgacactatagactgtcataactgtctctgtgtttcagagctatgctggaaacagc

SEQ ID NO: 50149 - DNA, 70 bp, Artificial Sequence
  Synthetic
gccaagcatttaggtgacactatagagagacagttatgacagttagtttcagagctatgctggaaacagc

SEQ ID NO: 50150 - DNA, 70 bp, Artificial Sequence
  Synthetic
gccaagcatttaggtgacactatagttactcgttgtgtgtagctggtttcagagctatgctggaaacagc

SEQ ID NO: 50151 - DNA, 70 bp, Artificial Sequence
  Synthetic
gccaagcatttaggtgacactataggaagagactggagacaatgtgtttcagagctatgctggaaacagc

SEQ ID NO: 50152 - DNA, 70 bp, Artificial Sequence
  Synthetic
gccaagcatttaggtgacactatagagttagagtgatgtcatctcgtttcagagctatgctggaaacagc

SEQ ID NO: 50153 - DNA, 70 bp, Artificial Sequence
  Synthetic
gccaagcatttaggtgacactataggtgggctccccactctgagggtttcagagctatgctggaaacagc

SEQ ID NO: 50154 - DNA, 70 bp, Artificial Sequence
  Synthetic
gccaagcatttaggtgacactatagttgccccgtacagtcagagcgtttcagagctatgctggaaacagc

SEQ ID NO: 50155 - DNA, 70 bp, Artificial Sequence
  Synthetic
gccaagcatttaggtgacactatagcccgctgtcccaggtgaacagtttcagagctatgctggaaacagc

SEQ ID NO: 50156 - DNA, 70 bp, Artificial Sequence
  Synthetic
gccaagcatttaggtgacactatagacttggcattagcagctagagtttcagagctatgctggaaacagc

SEQ ID NO: 50157 - DNA, 70 bp, Artificial Sequence
  Synthetic
gccaagcatttaggtgacactataggagtcaacagctcactctgcgtttcagagctatgctggaaacagc

SEQ ID NO: 50158 - DNA, 70 bp, Artificial Sequence
  Synthetic
gccaagcatttaggtgacactatagccggctccgtgagctgctgagtttcagagctatgctggaaacagc

SEQ ID NO: 50159 - DNA, 70 bp, Artificial Sequence
  Synthetic
gccaagcatttaggtgacactatagggtccctctatcaggttttggtttcagagctatgctggaaacagc

SEQ ID NO: 50160 - DNA, 70 bp, Artificial Sequence
  Synthetic
gccaagcatttaggtgacactatagactgtgccgggtgtactatggtttcagagctatgctggaaacagc

SEQ ID NO: 50161 - DNA, 70 bp, Artificial Sequence
  Synthetic
gccaagcatttaggtgacactatagagccattctggcaggggctcgtttcagagctatgctggaaacagc

SEQ ID NO: 50162 - DNA, 70 bp, Artificial Sequence
  Synthetic
gccaagcatttaggtgacactatagaggcgctgcctgtaacattggtttcagagctatgctggaaacagc

SEQ ID NO: 50163 - DNA, 70 bp, Artificial Sequence
  Synthetic
gccaagcatttaggtgacactatagagtggagaagattcacgaaagtttcagagctatgctggaaacagc

SEQ ID NO: 50164 - DNA, 70 bp, Artificial Sequence
  Synthetic
gccaagcatttaggtgacactatagagacgacttgaaaaaaagacgtttcagagctatgctggaaacagc

SEQ ID NO: 50165 - DNA, 70 bp, Artificial Sequence
  Synthetic
gccaagcatttaggtgacactatagtgtgggccgggcttcatttcgtttcagagctatgctggaaacagc

SEQ ID NO: 50166 - DNA, 70 bp, Artificial Sequence
  Synthetic
gccaagcatttaggtgacactatagcaacattgacagttggtggagtttcagagctatgctggaaacagc

SEQ ID NO: 50167 - DNA, 70 bp, Artificial Sequence
  Synthetic
gccaagcatttaggtgacactatagtttcatgcacaggctttttcgtttcagagctatgctggaaacagc

SEQ ID NO: 50168 - DNA, 70 bp, Artificial Sequence
  Synthetic
gccaagcatttaggtgacactatagggtgggcaggcgcctacttcgtttcagagctatgctggaaacagc

SEQ ID NO: 50169 - DNA, 70 bp, Artificial Sequence
  Synthetic
gccaagcatttaggtgacactatagggcgatggggagttaatgctgtttcagagctatgctggaaacagc

SEQ ID NO: 50170 - DNA, 70 bp, Artificial Sequence
  Synthetic
gccaagcatttaggtgacactatagccaccccctctgcctcagttgtttcagagctatgctggaaacagc

SEQ ID NO: 50171 - DNA, 70 bp, Artificial Sequence
  Synthetic
gccaagcatttaggtgacactataggcttgccagcttcatttcttgtttcagagctatgctggaaacagc

SEQ ID NO: 50172 - DNA, 70 bp, Artificial Sequence
  Synthetic
gccaagcatttaggtgacactatagaagagaagaatatgtggttcgtttcagagctatgctggaaacagc

SEQ ID NO: 50173 - DNA, 70 bp, Artificial Sequence
  Synthetic
gccaagcatttaggtgacactatagatgtctccacgcacagctaagtttcagagctatgctggaaacagc

SEQ ID NO: 50174 - DNA, 70 bp, Artificial Sequence
  Synthetic
gccaagcatttaggtgacactataggatcccactactgatgtttcgtttcagagctatgctggaaacagc

SEQ ID NO: 50175 - DNA, 70 bp, Artificial Sequence
  Synthetic
gccaagcatttaggtgacactatagcccactcttctgcctaatgtgtttcagagctatgctggaaacagc

SEQ ID NO: 50176 - DNA, 70 bp, Artificial Sequence
  Synthetic
gccaagcatttaggtgacactatagagtgtcagtttgagcttgcggtttcagagctatgctggaaacagc

SEQ ID NO: 50177 - DNA, 70 bp, Artificial Sequence
  Synthetic
gccaagcatttaggtgacactatagagctgacattaaatttggtcgtttcagagctatgctggaaacagc

SEQ ID NO: 50178 - DNA, 70 bp, Artificial Sequence
  Synthetic
gccaagcatttaggtgacactatagctgcagctgtcaatagcctagtttcagagctatgctggaaacagc

SEQ ID NO: 50179 - DNA, 70 bp, Artificial Sequence
  Synthetic
gccaagcatttaggtgacactatagagagcagacaagaaagagaagtttcagagctatgctggaaacagc

SEQ ID NO: 50180 - DNA, 70 bp, Artificial Sequence
  Synthetic
gccaagcatttaggtgacactatagcttcgttaaggttcaaatgggtttcagagctatgctggaaacagc

SEQ ID NO: 50181 - DNA, 70 bp, Artificial Sequence
  Synthetic
gccaagcatttaggtgacactatagtcagcagcccctgtggctaggtttcagagctatgctggaaacagc

SEQ ID NO: 50182 - DNA, 70 bp, Artificial Sequence
  Synthetic
gccaagcatttaggtgacactatagaccctgcacctgggggctcagtttcagagctatgctggaaacagc

SEQ ID NO: 50183 - DNA, 70 bp, Artificial Sequence
  Synthetic
gccaagcatttaggtgacactatagaggtcgtgggagggggtcaagtttcagagctatgctggaaacagc

SEQ ID NO: 50184 - DNA, 70 bp, Artificial Sequence
  Synthetic
gccaagcatttaggtgacactataggccacccacgaggggctcatgtttcagagctatgctggaaacagc

SEQ ID NO: 50185 - DNA, 70 bp, Artificial Sequence
  Synthetic
gccaagcatttaggtgacactatagagttgaacattattgaagcggtttcagagctatgctggaaacagc

SEQ ID NO: 50186 - DNA, 70 bp, Artificial Sequence
  Synthetic
gccaagcatttaggtgacactatagggagagagaagaaacggaaggtttcagagctatgctggaaacagc

SEQ ID NO: 50187 - DNA, 70 bp, Artificial Sequence
  Synthetic
gccaagcatttaggtgacactatagacatgatggattcggggtccgtttcagagctatgctggaaacagc

SEQ ID NO: 50188 - DNA, 70 bp, Artificial Sequence
  Synthetic
gccaagcatttaggtgacactatagcccttagaccgagaagtagggtttcagagctatgctggaaacagc

SEQ ID NO: 50189 - DNA, 70 bp, Artificial Sequence
  Synthetic
gccaagcatttaggtgacactatagtagttgaagagaatggaatcgtttcagagctatgctggaaacagc

SEQ ID NO: 50190 - DNA, 70 bp, Artificial Sequence
  Synthetic
gccaagcatttaggtgacactataggggtgggctgggctgtcagagtttcagagctatgctggaaacagc

SEQ ID NO: 50191 - DNA, 70 bp, Artificial Sequence
  Synthetic
gccaagcatttaggtgacactatagctctcgctggcccagacgtggtttcagagctatgctggaaacagc

SEQ ID NO: 50192 - DNA, 70 bp, Artificial Sequence
  Synthetic
gccaagcatttaggtgacactatagccgccagctccaaagtgagcgtttcagagctatgctggaaacagc

SEQ ID NO: 50193 - DNA, 70 bp, Artificial Sequence
  Synthetic
gccaagcatttaggtgacactatagccgccagccccaaagtgagcgtttcagagctatgctggaaacagc

SEQ ID NO: 50194 - DNA, 70 bp, Artificial Sequence
  Synthetic
gccaagcatttaggtgacactatagtcacacgtagtctttcccgcgtttcagagctatgctggaaacagc

SEQ ID NO: 50195 - DNA, 70 bp, Artificial Sequence
  Synthetic
gccaagcatttaggtgacactatagtctcggacaaagtatcatgggtttcagagctatgctggaaacagc

SEQ ID NO: 50196 - DNA, 70 bp, Artificial Sequence
  Synthetic
gccaagcatttaggtgacactatagaagagtgcccacgtataagagtttcagagctatgctggaaacagc

SEQ ID NO: 50197 - DNA, 70 bp, Artificial Sequence
  Synthetic
gccaagcatttaggtgacactataggtttcacacaccacttaatggtttcagagctatgctggaaacagc

SEQ ID NO: 50198 - DNA, 70 bp, Artificial Sequence
  Synthetic
gccaagcatttaggtgacactatagcggccacgcacagcgggtacgtttcagagctatgctggaaacagc

SEQ ID NO: 50199 - DNA, 70 bp, Artificial Sequence
  Synthetic
gccaagcatttaggtgacactataggggccagagctgctacacgtgtttcagagctatgctggaaacagc

SEQ ID NO: 50200 - DNA, 70 bp, Artificial Sequence
  Synthetic
gccaagcatttaggtgacactatagaatgtatgctgtagacacaagtttcagagctatgctggaaacagc

SEQ ID NO: 50201 - DNA, 70 bp, Artificial Sequence
  Synthetic
gccaagcatttaggtgacactatagaaggaggcattagacataacgtttcagagctatgctggaaacagc

SEQ ID NO: 50202 - DNA, 70 bp, Artificial Sequence
  Synthetic
gccaagcatttaggtgacactataggcattacacatagtcgtgctgtttcagagctatgctggaaacagc

SEQ ID NO: 50203 - DNA, 70 bp, Artificial Sequence
  Synthetic
gccaagcatttaggtgacactatagctggggcataggatgggcatgtttcagagctatgctggaaacagc

SEQ ID NO: 50204 - DNA, 70 bp, Artificial Sequence
  Synthetic
gccaagcatttaggtgacactataggcggagctcagacgtactctgtttcagagctatgctggaaacagc

SEQ ID NO: 50205 - DNA, 70 bp, Artificial Sequence
  Synthetic
gccaagcatttaggtgacactatagggactggacattacacacccgtttcagagctatgctggaaacagc

SEQ ID NO: 50206 - DNA, 70 bp, Artificial Sequence
  Synthetic
gccaagcatttaggtgacactatagttcttcacacataccctgtcgtttcagagctatgctggaaacagc

SEQ ID NO: 50207 - DNA, 70 bp, Artificial Sequence
  Synthetic
gccaagcatttaggtgacactatagcaattccacacacaatctgagtttcagagctatgctggaaacagc

SEQ ID NO: 50208 - DNA, 70 bp, Artificial Sequence
  Synthetic
gccaagcatttaggtgacactatagcctttctggcttagtgtttcgtttcagagctatgctggaaacagc

SEQ ID NO: 50209 - DNA, 70 bp, Artificial Sequence
  Synthetic
gccaagcatttaggtgacactatagcaggctctacaagcgtctaggtttcagagctatgctggaaacagc

SEQ ID NO: 50210 - DNA, 70 bp, Artificial Sequence
  Synthetic
gccaagcatttaggtgacactatagagtgtccctacctggaagatgtttcagagctatgctggaaacagc

SEQ ID NO: 50211 - DNA, 70 bp, Artificial Sequence
  Synthetic
gccaagcatttaggtgacactatagcatgctaagacctaggaaccgtttcagagctatgctggaaacagc

SEQ ID NO: 50212 - DNA, 70 bp, Artificial Sequence
  Synthetic
gccaagcatttaggtgacactatagaccgcaaggactacgtctaagtttcagagctatgctggaaacagc

SEQ ID NO: 50213 - DNA, 70 bp, Artificial Sequence
  Synthetic
gccaagcatttaggtgacactatagccgtacggccaagtgcatccgtttcagagctatgctggaaacagc

SEQ ID NO: 50214 - DNA, 70 bp, Artificial Sequence
  Synthetic
gccaagcatttaggtgacactataggctgccagcaactacgtgtagtttcagagctatgctggaaacagc

SEQ ID NO: 50215 - DNA, 70 bp, Artificial Sequence
  Synthetic
gccaagcatttaggtgacactatagacaagaagaactacgtctgagtttcagagctatgctggaaacagc

SEQ ID NO: 50216 - DNA, 70 bp, Artificial Sequence
  Synthetic
gccaagcatttaggtgacactatagaccaagaattacgtctgacggtttcagagctatgctggaaacagc

SEQ ID NO: 50217 - DNA, 70 bp, Artificial Sequence
  Synthetic
gccaagcatttaggtgacactatagccatctttattggctgggcagtttcagagctatgctggaaacagc

SEQ ID NO: 50218 - DNA, 70 bp, Artificial Sequence
  Synthetic
gccaagcatttaggtgacactatagtccaaggagtatgtgtgaccgtttcagagctatgctggaaacagc

SEQ ID NO: 50219 - DNA, 70 bp, Artificial Sequence
  Synthetic
gccaagcatttaggtgacactatagcaactacacatactgacttcgtttcagagctatgctggaaacagc

SEQ ID NO: 50220 - DNA, 70 bp, Artificial Sequence
  Synthetic
gccaagcatttaggtgacactatagaagagggactacgtgtgagggtttcagagctatgctggaaacagc

SEQ ID NO: 50221 - DNA, 70 bp, Artificial Sequence
  Synthetic
gccaagcatttaggtgacactatagcttaatgaaggcatatcgtggtttcagagctatgctggaaacagc

SEQ ID NO: 50222 - DNA, 70 bp, Artificial Sequence
  Synthetic
gccaagcatttaggtgacactatagaggctgcagtcacagacacagtttcagagctatgctggaaacagc

SEQ ID NO: 50223 - DNA, 70 bp, Artificial Sequence
  Synthetic
gccaagcatttaggtgacactatagaggcagctcagtgactctccgtttcagagctatgctggaaacagc

SEQ ID NO: 50224 - DNA, 70 bp, Artificial Sequence
  Synthetic
gccaagcatttaggtgacactatagtgcgagttccccttctagcggtttcagagctatgctggaaacagc

SEQ ID NO: 50225 - DNA, 70 bp, Artificial Sequence
  Synthetic
gccaagcatttaggtgacactatagacatattttagggaggcatggtttcagagctatgctggaaacagc

SEQ ID NO: 50226 - DNA, 70 bp, Artificial Sequence
  Synthetic
gccaagcatttaggtgacactatagttccactcgtggtatgagaggtttcagagctatgctggaaacagc

SEQ ID NO: 50227 - DNA, 70 bp, Artificial Sequence
  Synthetic
gccaagcatttaggtgacactatagcccagtgaagactgaggattgtttcagagctatgctggaaacagc

SEQ ID NO: 50228 - DNA, 70 bp, Artificial Sequence
  Synthetic
gccaagcatttaggtgacactatagtgtacgtctctaactattgagtttcagagctatgctggaaacagc

SEQ ID NO: 50229 - DNA, 70 bp, Artificial Sequence
  Synthetic
gccaagcatttaggtgacactatagcttggctctagtgatgcatagtttcagagctatgctggaaacagc

SEQ ID NO: 50230 - DNA, 70 bp, Artificial Sequence
  Synthetic
gccaagcatttaggtgacactatagaagctggtgctgccagccgagtttcagagctatgctggaaacagc

SEQ ID NO: 50231 - DNA, 70 bp, Artificial Sequence
  Synthetic
gccaagcatttaggtgacactatagggcactgactcagtcctcaggtttcagagctatgctggaaacagc

SEQ ID NO: 50232 - DNA, 70 bp, Artificial Sequence
  Synthetic
gccaagcatttaggtgacactatagcctcggccctgggcttcaacgtttcagagctatgctggaaacagc

SEQ ID NO: 50233 - DNA, 70 bp, Artificial Sequence
  Synthetic
gccaagcatttaggtgacactataggtcctcatcgtggatgttatgtttcagagctatgctggaaacagc

SEQ ID NO: 50234 - DNA, 70 bp, Artificial Sequence
  Synthetic
gccaagcatttaggtgacactatagcggtggggcccagggtcctggtttcagagctatgctggaaacagc

SEQ ID NO: 50235 - DNA, 70 bp, Artificial Sequence
  Synthetic
gccaagcatttaggtgacactataggacaagacaggatcaatgaagtttcagagctatgctggaaacagc

SEQ ID NO: 50236 - DNA, 70 bp, Artificial Sequence
  Synthetic
gccaagcatttaggtgacactatagccccctgaaacattaggcgagtttcagagctatgctggaaacagc

SEQ ID NO: 50237 - DNA, 70 bp, Artificial Sequence
  Synthetic
gccaagcatttaggtgacactatagcctctttgcattaaggtagtgtttcagagctatgctggaaacagc

SEQ ID NO: 50238 - DNA, 70 bp, Artificial Sequence
  Synthetic
gccaagcatttaggtgacactataggatggagtccatagttccaggtttcagagctatgctggaaacagc

SEQ ID NO: 50239 - DNA, 70 bp, Artificial Sequence
  Synthetic
gccaagcatttaggtgacactatagtctgctgggaccccttagatgtttcagagctatgctggaaacagc

SEQ ID NO: 50240 - DNA, 70 bp, Artificial Sequence
  Synthetic
gccaagcatttaggtgacactatagccgaaagaaaatggatttgcgtttcagagctatgctggaaacagc

SEQ ID NO: 50241 - DNA, 70 bp, Artificial Sequence
  Synthetic
gccaagcatttaggtgacactatagaagatggcctatacttgagggtttcagagctatgctggaaacagc

SEQ ID NO: 50242 - DNA, 70 bp, Artificial Sequence
  Synthetic
gccaagcatttaggtgacactatagcattggagaaagacctattggtttcagagctatgctggaaacagc

SEQ ID NO: 50243 - DNA, 70 bp, Artificial Sequence
  Synthetic
gccaagcatttaggtgacactatagccagttcgggatcgtgtagcgtttcagagctatgctggaaacagc

SEQ ID NO: 50244 - DNA, 70 bp, Artificial Sequence
  Synthetic
gccaagcatttaggtgacactatagatctcacaaactgacctttggtttcagagctatgctggaaacagc

SEQ ID NO: 50245 - DNA, 70 bp, Artificial Sequence
  Synthetic
gccaagcatttaggtgacactatagatcttgcaaattgacttctggtttcagagctatgctggaaacagc

SEQ ID NO: 50246 - DNA, 70 bp, Artificial Sequence
  Synthetic
gccaagcatttaggtgacactatagttctagttcaatgttgttccgtttcagagctatgctggaaacagc

SEQ ID NO: 50247 - DNA, 70 bp, Artificial Sequence
  Synthetic
gccaagcatttaggtgacactatagtttcggatttgtgaaatggtgtttcagagctatgctggaaacagc

SEQ ID NO: 50248 - DNA, 70 bp, Artificial Sequence
  Synthetic
gccaagcatttaggtgacactatagatgaaggcagcatcccttccgtttcagagctatgctggaaacagc

SEQ ID NO: 50249 - DNA, 70 bp, Artificial Sequence
  Synthetic
gccaagcatttaggtgacactatagatgggtccttcatcccctaggtttcagagctatgctggaaacagc

SEQ ID NO: 50250 - DNA, 70 bp, Artificial Sequence
  Synthetic
gccaagcatttaggtgacactatagcaggttgctcttagttactggtttcagagctatgctggaaacagc

SEQ ID NO: 50251 - DNA, 70 bp, Artificial Sequence
  Synthetic
gccaagcatttaggtgacactatagacggctggatctgtgagaaagtttcagagctatgctggaaacagc

SEQ ID NO: 50252 - DNA, 70 bp, Artificial Sequence
  Synthetic
gccaagcatttaggtgacactataggtggagaacccaacaatagcgtttcagagctatgctggaaacagc

SEQ ID NO: 50253 - DNA, 70 bp, Artificial Sequence
  Synthetic
gccaagcatttaggtgacactatagcaactattcgtctctgaagcgtttcagagctatgctggaaacagc

SEQ ID NO: 50254 - DNA, 70 bp, Artificial Sequence
  Synthetic
gccaagcatttaggtgacactatagcacagggaactgtgatcattgtttcagagctatgctggaaacagc

SEQ ID NO: 50255 - DNA, 70 bp, Artificial Sequence
  Synthetic
gccaagcatttaggtgacactatagggaaacctacaggatggggcgtttcagagctatgctggaaacagc

SEQ ID NO: 50256 - DNA, 70 bp, Artificial Sequence
  Synthetic
gccaagcatttaggtgacactatagacccatctccaaattgtgtagtttcagagctatgctggaaacagc

SEQ ID NO: 50257 - DNA, 70 bp, Artificial Sequence
  Synthetic
gccaagcatttaggtgacactatagatgagggcacactacacagtgtttcagagctatgctggaaacagc

SEQ ID NO: 50258 - DNA, 70 bp, Artificial Sequence
  Synthetic
gccaagcatttaggtgacactatagttcaaagctgtggaattcaagtttcagagctatgctggaaacagc

SEQ ID NO: 50259 - DNA, 70 bp, Artificial Sequence
  Synthetic
gccaagcatttaggtgacactatagacacaatttctttcagacaggtttcagagctatgctggaaacagc

SEQ ID NO: 50260 - DNA, 70 bp, Artificial Sequence
  Synthetic
gccaagcatttaggtgacactatagtgcataagggaaaatgttacgtttcagagctatgctggaaacagc

SEQ ID NO: 50261 - DNA, 70 bp, Artificial Sequence
  Synthetic
gccaagcatttaggtgacactatagacgcaaaagaagagtacgaagtttcagagctatgctggaaacagc

SEQ ID NO: 50262 - DNA, 70 bp, Artificial Sequence
  Synthetic
gccaagcatttaggtgacactatagacctaatggaacatgtgtttgtttcagagctatgctggaaacagc

SEQ ID NO: 50263 - DNA, 70 bp, Artificial Sequence
  Synthetic
gccaagcatttaggtgacactatagtcccaggaggggcttatttggtttcagagctatgctggaaacagc

SEQ ID NO: 50264 - DNA, 70 bp, Artificial Sequence
  Synthetic
gccaagcatttaggtgacactatagtgtggctaaacagaagagttgtttcagagctatgctggaaacagc

SEQ ID NO: 50265 - DNA, 70 bp, Artificial Sequence
  Synthetic
gccaagcatttaggtgacactataggacgcggggtggggcgctaggtttcagagctatgctggaaacagc

SEQ ID NO: 50266 - DNA, 70 bp, Artificial Sequence
  Synthetic
gccaagcatttaggtgacactatagtacctgtcccagtgataagggtttcagagctatgctggaaacagc

SEQ ID NO: 50267 - DNA, 70 bp, Artificial Sequence
  Synthetic
gccaagcatttaggtgacactatagaaaatggctgtgctcaggatgtttcagagctatgctggaaacagc

SEQ ID NO: 50268 - DNA, 70 bp, Artificial Sequence
  Synthetic
gccaagcatttaggtgacactatagaggaacaagtaccactgaaagtttcagagctatgctggaaacagc

SEQ ID NO: 50269 - DNA, 70 bp, Artificial Sequence
  Synthetic
gccaagcatttaggtgacactatagtgttcaatctcttgatcagcgtttcagagctatgctggaaacagc

SEQ ID NO: 50270 - DNA, 70 bp, Artificial Sequence
  Synthetic
gccaagcatttaggtgacactatagatttgcaaaggcatcttgctgtttcagagctatgctggaaacagc

SEQ ID NO: 50271 - DNA, 70 bp, Artificial Sequence
  Synthetic
gccaagcatttaggtgacactatagccactggaggcttcatcagagtttcagagctatgctggaaacagc

SEQ ID NO: 50272 - DNA, 70 bp, Artificial Sequence
  Synthetic
gccaagcatttaggtgacactatagggacaaagctcagaaacaaggtttcagagctatgctggaaacagc

SEQ ID NO: 50273 - DNA, 70 bp, Artificial Sequence
  Synthetic
gccaagcatttaggtgacactataggggcggagatgcagtcttaggtttcagagctatgctggaaacagc

SEQ ID NO: 50274 - DNA, 70 bp, Artificial Sequence
  Synthetic
gccaagcatttaggtgacactatagaacttctgcttcttcccaaagtttcagagctatgctggaaacagc

SEQ ID NO: 50275 - DNA, 70 bp, Artificial Sequence
  Synthetic
gccaagcatttaggtgacactatagtgacctatcggggaattaatgtttcagagctatgctggaaacagc

SEQ ID NO: 50276 - DNA, 70 bp, Artificial Sequence
  Synthetic
gccaagcatttaggtgacactatagttcttcagaaggtcaaagaagtttcagagctatgctggaaacagc

SEQ ID NO: 50277 - DNA, 70 bp, Artificial Sequence
  Synthetic
gccaagcatttaggtgacactatagactccagtcgggatatcagtgtttcagagctatgctggaaacagc

SEQ ID NO: 50278 - DNA, 70 bp, Artificial Sequence
  Synthetic
gccaagcatttaggtgacactatagccgcaacccaagcagatgacgtttcagagctatgctggaaacagc

SEQ ID NO: 50279 - DNA, 70 bp, Artificial Sequence
  Synthetic
gccaagcatttaggtgacactatagatgctgcaatgcttcatccagtttcagagctatgctggaaacagc

SEQ ID NO: 50280 - DNA, 70 bp, Artificial Sequence
  Synthetic
gccaagcatttaggtgacactatagtgatgggaagaaggaagcacgtttcagagctatgctggaaacagc

SEQ ID NO: 50281 - DNA, 70 bp, Artificial Sequence
  Synthetic
gccaagcatttaggtgacactatagtcccacaactggatgttagcgtttcagagctatgctggaaacagc

SEQ ID NO: 50282 - DNA, 70 bp, Artificial Sequence
  Synthetic
gccaagcatttaggtgacactatagccattgtaattcagaccgttgtttcagagctatgctggaaacagc

SEQ ID NO: 50283 - DNA, 70 bp, Artificial Sequence
  Synthetic
gccaagcatttaggtgacactatagatcccgagtatcaggagagcgtttcagagctatgctggaaacagc

SEQ ID NO: 50284 - DNA, 70 bp, Artificial Sequence
  Synthetic
gccaagcatttaggtgacactatagatcagaaacaaaacactctcgtttcagagctatgctggaaacagc

SEQ ID NO: 50285 - DNA, 70 bp, Artificial Sequence
  Synthetic
gccaagcatttaggtgacactatagacacccttcacgtcagcagtgtttcagagctatgctggaaacagc

SEQ ID NO: 50286 - DNA, 70 bp, Artificial Sequence
  Synthetic
gccaagcatttaggtgacactatagcaggtactggtcagatgcacgtttcagagctatgctggaaacagc

SEQ ID NO: 50287 - DNA, 70 bp, Artificial Sequence
  Synthetic
gccaagcatttaggtgacactatagcacctcttgcctctgtagccgtttcagagctatgctggaaacagc

SEQ ID NO: 50288 - DNA, 70 bp, Artificial Sequence
  Synthetic
gccaagcatttaggtgacactatagaacagttgctggacagtttggtttcagagctatgctggaaacagc

SEQ ID NO: 50289 - DNA, 70 bp, Artificial Sequence
  Synthetic
gccaagcatttaggtgacactatagaggaagcacgtgtgctactggtttcagagctatgctggaaacagc

SEQ ID NO: 50290 - DNA, 70 bp, Artificial Sequence
  Synthetic
gccaagcatttaggtgacactatagtctacttcagatccatgaacgtttcagagctatgctggaaacagc

SEQ ID NO: 50291 - DNA, 70 bp, Artificial Sequence
  Synthetic
gccaagcatttaggtgacactataggcaggcaggtggctgctagagtttcagagctatgctggaaacagc

SEQ ID NO: 50292 - DNA, 70 bp, Artificial Sequence
  Synthetic
gccaagcatttaggtgacactatagcccagctctcaggtgctagcgtttcagagctatgctggaaacagc

SEQ ID NO: 50293 - DNA, 70 bp, Artificial Sequence
  Synthetic
gccaagcatttaggtgacactataggggtgggcagtctcactgctgtttcagagctatgctggaaacagc

SEQ ID NO: 50294 - DNA, 70 bp, Artificial Sequence
  Synthetic
gccaagcatttaggtgacactataggaaaattggaaggcagaagtgtttcagagctatgctggaaacagc

SEQ ID NO: 50295 - DNA, 70 bp, Artificial Sequence
  Synthetic
gccaagcatttaggtgacactatagatgcttcctgccttcgaatagtttcagagctatgctggaaacagc

SEQ ID NO: 50296 - DNA, 70 bp, Artificial Sequence
  Synthetic
gccaagcatttaggtgacactataggactttaatgtctcaggagcgtttcagagctatgctggaaacagc

SEQ ID NO: 50297 - DNA, 70 bp, Artificial Sequence
  Synthetic
gccaagcatttaggtgacactataggccggtgccatatgatttaggtttcagagctatgctggaaacagc

SEQ ID NO: 50298 - DNA, 70 bp, Artificial Sequence
  Synthetic
gccaagcatttaggtgacactataggccagcagaggacaagaaaagtttcagagctatgctggaaacagc

SEQ ID NO: 50299 - DNA, 70 bp, Artificial Sequence
  Synthetic
gccaagcatttaggtgacactataggggcgccccacacggactgagtttcagagctatgctggaaacagc

SEQ ID NO: 50300 - DNA, 70 bp, Artificial Sequence
  Synthetic
gccaagcatttaggtgacactatagagctgtttgcagcatctgctgtttcagagctatgctggaaacagc

SEQ ID NO: 50301 - DNA, 70 bp, Artificial Sequence
  Synthetic
gccaagcatttaggtgacactatagggaccatgcagagtttcaaagtttcagagctatgctggaaacagc

SEQ ID NO: 50302 - DNA, 70 bp, Artificial Sequence
  Synthetic
gccaagcatttaggtgacactataggtcagttccaggctcagctggtttcagagctatgctggaaacagc

SEQ ID NO: 50303 - DNA, 70 bp, Artificial Sequence
  Synthetic
gccaagcatttaggtgacactatagtgcagatctaatgtactgaagtttcagagctatgctggaaacagc

SEQ ID NO: 50304 - DNA, 70 bp, Artificial Sequence
  Synthetic
gccaagcatttaggtgacactatagagaggccacggtcacagctggtttcagagctatgctggaaacagc

SEQ ID NO: 50305 - DNA, 70 bp, Artificial Sequence
  Synthetic
gccaagcatttaggtgacactatagcagaataaaattccgtccctgtttcagagctatgctggaaacagc

SEQ ID NO: 50306 - DNA, 70 bp, Artificial Sequence
  Synthetic
gccaagcatttaggtgacactatagaaaacagatgatagcacttcgtttcagagctatgctggaaacagc

SEQ ID NO: 50307 - DNA, 70 bp, Artificial Sequence
  Synthetic
gccaagcatttaggtgacactatagtttgacccacatggttaagcgtttcagagctatgctggaaacagc

SEQ ID NO: 50308 - DNA, 70 bp, Artificial Sequence
  Synthetic
gccaagcatttaggtgacactatagggggcacgggtcagtagctggtttcagagctatgctggaaacagc

SEQ ID NO: 50309 - DNA, 70 bp, Artificial Sequence
  Synthetic
gccaagcatttaggtgacactataggcagacccctgggcactagtgtttcagagctatgctggaaacagc

SEQ ID NO: 50310 - DNA, 70 bp, Artificial Sequence
  Synthetic
gccaagcatttaggtgacactatagacccccccacaccgctactagtttcagagctatgctggaaacagc

SEQ ID NO: 50311 - DNA, 70 bp, Artificial Sequence
  Synthetic
gccaagcatttaggtgacactataggtggctcttcagtgcaccaggtttcagagctatgctggaaacagc

SEQ ID NO: 50312 - DNA, 70 bp, Artificial Sequence
  Synthetic
gccaagcatttaggtgacactatagagaagaatggtatgcaagacgtttcagagctatgctggaaacagc

SEQ ID NO: 50313 - DNA, 70 bp, Artificial Sequence
  Synthetic
gccaagcatttaggtgacactatagtgcacctagcaggcacctaggtttcagagctatgctggaaacagc

SEQ ID NO: 50314 - DNA, 70 bp, Artificial Sequence
  Synthetic
gccaagcatttaggtgacactataggacagccacagcctggctttgtttcagagctatgctggaaacagc

SEQ ID NO: 50315 - DNA, 70 bp, Artificial Sequence
  Synthetic
gccaagcatttaggtgacactatagggagagtctgcgcaagcaaggtttcagagctatgctggaaacagc

SEQ ID NO: 50316 - DNA, 70 bp, Artificial Sequence
  Synthetic
gccaagcatttaggtgacactatagaggaataccgcaaaaagcacgtttcagagctatgctggaaacagc

SEQ ID NO: 50317 - DNA, 70 bp, Artificial Sequence
  Synthetic
gccaagcatttaggtgacactatagagtcattgtcactctcatccgtttcagagctatgctggaaacagc

SEQ ID NO: 50318 - DNA, 70 bp, Artificial Sequence
  Synthetic
gccaagcatttaggtgacactatagccgagcgtgcagggatagaggtttcagagctatgctggaaacagc

SEQ ID NO: 50319 - DNA, 70 bp, Artificial Sequence
  Synthetic
gccaagcatttaggtgacactatagtaacttcattggctacgtaggtttcagagctatgctggaaacagc

SEQ ID NO: 50320 - DNA, 70 bp, Artificial Sequence
  Synthetic
gccaagcatttaggtgacactatagtcagggttcagtccagagccgtttcagagctatgctggaaacagc

SEQ ID NO: 50321 - DNA, 70 bp, Artificial Sequence
  Synthetic
gccaagcatttaggtgacactatagcatgcaaccattgctttctcgtttcagagctatgctggaaacagc

SEQ ID NO: 50322 - DNA, 70 bp, Artificial Sequence
  Synthetic
gccaagcatttaggtgacactatagtacgcttgccacctccatcagtttcagagctatgctggaaacagc

SEQ ID NO: 50323 - DNA, 70 bp, Artificial Sequence
  Synthetic
gccaagcatttaggtgacactatagtccaggattaatttgcctgcgtttcagagctatgctggaaacagc

SEQ ID NO: 50324 - DNA, 70 bp, Artificial Sequence
  Synthetic
gccaagcatttaggtgacactatagagagcacatttgcctactaagtttcagagctatgctggaaacagc

SEQ ID NO: 50325 - DNA, 70 bp, Artificial Sequence
  Synthetic
gccaagcatttaggtgacactatagcctacattgacgaggccagagtttcagagctatgctggaaacagc

SEQ ID NO: 50326 - DNA, 70 bp, Artificial Sequence
  Synthetic
gccaagcatttaggtgacactataggaagcttccaacaagcatgtgtttcagagctatgctggaaacagc

SEQ ID NO: 50327 - DNA, 70 bp, Artificial Sequence
  Synthetic
gccaagcatttaggtgacactatagtatttttcggattcctctgggtttcagagctatgctggaaacagc

SEQ ID NO: 50328 - DNA, 70 bp, Artificial Sequence
  Synthetic
gccaagcatttaggtgacactatagttgatgcagacttccgtgttgtttcagagctatgctggaaacagc

SEQ ID NO: 50329 - DNA, 70 bp, Artificial Sequence
  Synthetic
gccaagcatttaggtgacactatagcttgagctgggagcttcaccgtttcagagctatgctggaaacagc

SEQ ID NO: 50330 - DNA, 70 bp, Artificial Sequence
  Synthetic
gccaagcatttaggtgacactatagcagtgaggatcaaagcatgcgtttcagagctatgctggaaacagc

SEQ ID NO: 50331 - DNA, 70 bp, Artificial Sequence
  Synthetic
gccaagcatttaggtgacactataggtgcagatttttgacaaggagtttcagagctatgctggaaacagc

SEQ ID NO: 50332 - DNA, 70 bp, Artificial Sequence
  Synthetic
gccaagcatttaggtgacactatagacggttcactaaaactattcgtttcagagctatgctggaaacagc

SEQ ID NO: 50333 - DNA, 70 bp, Artificial Sequence
  Synthetic
gccaagcatttaggtgacactatagcagtgtgtttcgtcaaaagtgtttcagagctatgctggaaacagc

SEQ ID NO: 50334 - DNA, 70 bp, Artificial Sequence
  Synthetic
gccaagcatttaggtgacactataggggatgtcaggggtcattccgtttcagagctatgctggaaacagc

SEQ ID NO: 50335 - DNA, 70 bp, Artificial Sequence
  Synthetic
gccaagcatttaggtgacactatagttaggacacagacttagaaagtttcagagctatgctggaaacagc

SEQ ID NO: 50336 - DNA, 70 bp, Artificial Sequence
  Synthetic
gccaagcatttaggtgacactatagggcatttactctatgtcggggtttcagagctatgctggaaacagc

SEQ ID NO: 50337 - DNA, 70 bp, Artificial Sequence
  Synthetic
gccaagcatttaggtgacactatagggcgccgggctggcttcagggtttcagagctatgctggaaacagc

SEQ ID NO: 50338 - DNA, 70 bp, Artificial Sequence
  Synthetic
gccaagcatttaggtgacactataggcaaagggaaagaaatgactgtttcagagctatgctggaaacagc

SEQ ID NO: 50339 - DNA, 70 bp, Artificial Sequence
  Synthetic
gccaagcatttaggtgacactatagccgactcggactctgactgagtttcagagctatgctggaaacagc

SEQ ID NO: 50340 - DNA, 70 bp, Artificial Sequence
  Synthetic
gccaagcatttaggtgacactatagatccagcgcctggacacgtggtttcagagctatgctggaaacagc

SEQ ID NO: 50341 - DNA, 70 bp, Artificial Sequence
  Synthetic
gccaagcatttaggtgacactatagacctgctgagtttgaatcacgtttcagagctatgctggaaacagc

SEQ ID NO: 50342 - DNA, 70 bp, Artificial Sequence
  Synthetic
gccaagcatttaggtgacactatagggtagccccagagtcactgcgtttcagagctatgctggaaacagc

SEQ ID NO: 50343 - DNA, 70 bp, Artificial Sequence
  Synthetic
gccaagcatttaggtgacactatagcagagtctttaggcattaaggtttcagagctatgctggaaacagc

SEQ ID NO: 50344 - DNA, 70 bp, Artificial Sequence
  Synthetic
gccaagcatttaggtgacactatagggggttgtggcctcatcagagtttcagagctatgctggaaacagc

SEQ ID NO: 50345 - DNA, 70 bp, Artificial Sequence
  Synthetic
gccaagcatttaggtgacactatagggtaaatcactgtatggtccgtttcagagctatgctggaaacagc

SEQ ID NO: 50346 - DNA, 70 bp, Artificial Sequence
  Synthetic
gccaagcatttaggtgacactatagctccttcatccagatgcacagtttcagagctatgctggaaacagc

SEQ ID NO: 50347 - DNA, 70 bp, Artificial Sequence
  Synthetic
gccaagcatttaggtgacactatagtgaatgctgccattgctaaagtttcagagctatgctggaaacagc

SEQ ID NO: 50348 - DNA, 70 bp, Artificial Sequence
  Synthetic
gccaagcatttaggtgacactatagtagagcccccggattctgtagtttcagagctatgctggaaacagc

SEQ ID NO: 50349 - DNA, 70 bp, Artificial Sequence
  Synthetic
gccaagcatttaggtgacactatagtgccatctcaacttctttttgtttcagagctatgctggaaacagc

SEQ ID NO: 50350 - DNA, 70 bp, Artificial Sequence
  Synthetic
gccaagcatttaggtgacactatagaaggtgcacactgtggagcagtttcagagctatgctggaaacagc

SEQ ID NO: 50351 - DNA, 70 bp, Artificial Sequence
  Synthetic
gccaagcatttaggtgacactataggtacaaaatccgagaactctgtttcagagctatgctggaaacagc

SEQ ID NO: 50352 - DNA, 70 bp, Artificial Sequence
  Synthetic
gccaagcatttaggtgacactatagtctttctcagttctgagcttgtttcagagctatgctggaaacagc

SEQ ID NO: 50353 - DNA, 70 bp, Artificial Sequence
  Synthetic
gccaagcatttaggtgacactatagtgcacgggaatgcacaattggtttcagagctatgctggaaacagc

SEQ ID NO: 50354 - DNA, 70 bp, Artificial Sequence
  Synthetic
gccaagcatttaggtgacactataggttcttgtgattaatggagcgtttcagagctatgctggaaacagc

SEQ ID NO: 50355 - DNA, 70 bp, Artificial Sequence
  Synthetic
gccaagcatttaggtgacactatagggtctcccagctgaaggactgtttcagagctatgctggaaacagc

SEQ ID NO: 50356 - DNA, 70 bp, Artificial Sequence
  Synthetic
gccaagcatttaggtgacactatagtgtcattgaacatgaggcctgtttcagagctatgctggaaacagc

SEQ ID NO: 50357 - DNA, 70 bp, Artificial Sequence
  Synthetic
gccaagcatttaggtgacactataggaactgaagatccgagagtagtttcagagctatgctggaaacagc

SEQ ID NO: 50358 - DNA, 70 bp, Artificial Sequence
  Synthetic
gccaagcatttaggtgacactatagtcggttctatgtagagtcgagtttcagagctatgctggaaacagc

SEQ ID NO: 50359 - DNA, 70 bp, Artificial Sequence
  Synthetic
gccaagcatttaggtgacactatagtcgtcagcagcagccagctcgtttcagagctatgctggaaacagc

SEQ ID NO: 50360 - DNA, 70 bp, Artificial Sequence
  Synthetic
gccaagcatttaggtgacactatagcggggatgctacaaaaacaggtttcagagctatgctggaaacagc

SEQ ID NO: 50361 - DNA, 70 bp, Artificial Sequence
  Synthetic
gccaagcatttaggtgacactatagggatggggatggggtcactcgtttcagagctatgctggaaacagc

SEQ ID NO: 50362 - DNA, 70 bp, Artificial Sequence
  Synthetic
gccaagcatttaggtgacactataggaggagaaggcggagtaagggtttcagagctatgctggaaacagc

SEQ ID NO: 50363 - DNA, 70 bp, Artificial Sequence
  Synthetic
gccaagcatttaggtgacactataggtctgcacatcacatatcccgtttcagagctatgctggaaacagc

SEQ ID NO: 50364 - DNA, 70 bp, Artificial Sequence
  Synthetic
gccaagcatttaggtgacactatagttctgctgagggcggagaaggtttcagagctatgctggaaacagc

SEQ ID NO: 50365 - DNA, 70 bp, Artificial Sequence
  Synthetic
gccaagcatttaggtgacactatagcatattgtcagaaggaaggagtttcagagctatgctggaaacagc

SEQ ID NO: 50366 - DNA, 70 bp, Artificial Sequence
  Synthetic
gccaagcatttaggtgacactatagacgttggtgagtttctaagggtttcagagctatgctggaaacagc

SEQ ID NO: 50367 - DNA, 70 bp, Artificial Sequence
  Synthetic
gccaagcatttaggtgacactatagaaaggtagtagaagaaggaggtttcagagctatgctggaaacagc

SEQ ID NO: 50368 - DNA, 70 bp, Artificial Sequence
  Synthetic
gccaagcatttaggtgacactatagacatgaagaagcagagcaaggtttcagagctatgctggaaacagc

SEQ ID NO: 50369 - DNA, 70 bp, Artificial Sequence
  Synthetic
gccaagcatttaggtgacactatagcgaggttacggtgattagcagtttcagagctatgctggaaacagc

SEQ ID NO: 50370 - DNA, 70 bp, Artificial Sequence
  Synthetic
gccaagcatttaggtgacactatagtcaacttacctgttgccactgtttcagagctatgctggaaacagc

SEQ ID NO: 50371 - DNA, 70 bp, Artificial Sequence
  Synthetic
gccaagcatttaggtgacactatagagagtgctggccagggtcaggtttcagagctatgctggaaacagc

SEQ ID NO: 50372 - DNA, 70 bp, Artificial Sequence
  Synthetic
gccaagcatttaggtgacactataggaggcagcaggggaaaacatgtttcagagctatgctggaaacagc

SEQ ID NO: 50373 - DNA, 70 bp, Artificial Sequence
  Synthetic
gccaagcatttaggtgacactatagtgaatgagtgtgtgctagaggtttcagagctatgctggaaacagc

SEQ ID NO: 50374 - DNA, 70 bp, Artificial Sequence
  Synthetic
gccaagcatttaggtgacactatagaaactgttgactcactgagagtttcagagctatgctggaaacagc

SEQ ID NO: 50375 - DNA, 70 bp, Artificial Sequence
  Synthetic
gccaagcatttaggtgacactatagggtggcccgtatcttgggcagtttcagagctatgctggaaacagc

SEQ ID NO: 50376 - DNA, 70 bp, Artificial Sequence
  Synthetic
gccaagcatttaggtgacactataggaaggccttgtggccctagggtttcagagctatgctggaaacagc

SEQ ID NO: 50377 - DNA, 70 bp, Artificial Sequence
  Synthetic
gccaagcatttaggtgacactatagcaggaggaggccggctactggtttcagagctatgctggaaacagc

SEQ ID NO: 50378 - DNA, 70 bp, Artificial Sequence
  Synthetic
gccaagcatttaggtgacactataggattaccaatatagcgaccagtttcagagctatgctggaaacagc

SEQ ID NO: 50379 - DNA, 70 bp, Artificial Sequence
  Synthetic
gccaagcatttaggtgacactatagacacctctgatcacatgacagtttcagagctatgctggaaacagc

SEQ ID NO: 50380 - DNA, 70 bp, Artificial Sequence
  Synthetic
gccaagcatttaggtgacactatagtgcagccagcgcggcctagagtttcagagctatgctggaaacagc

SEQ ID NO: 50381 - DNA, 70 bp, Artificial Sequence
  Synthetic
gccaagcatttaggtgacactatagttgtctcttcttttcagtgtgtttcagagctatgctggaaacagc

SEQ ID NO: 50382 - DNA, 70 bp, Artificial Sequence
  Synthetic
gccaagcatttaggtgacactatagggcggaacccaggcgtttaagtttcagagctatgctggaaacagc

SEQ ID NO: 50383 - DNA, 70 bp, Artificial Sequence
  Synthetic
gccaagcatttaggtgacactatagccacgagaatgccatctgacgtttcagagctatgctggaaacagc

SEQ ID NO: 50384 - DNA, 70 bp, Artificial Sequence
  Synthetic
gccaagcatttaggtgacactataggagatgcagtttcgtctaacgtttcagagctatgctggaaacagc

SEQ ID NO: 50385 - DNA, 70 bp, Artificial Sequence
  Synthetic
gccaagcatttaggtgacactatagtctttgtctatatatggcacgtttcagagctatgctggaaacagc

SEQ ID NO: 50386 - DNA, 70 bp, Artificial Sequence
  Synthetic
gccaagcatttaggtgacactataggtatcactttctctgcacaggtttcagagctatgctggaaacagc

SEQ ID NO: 50387 - DNA, 70 bp, Artificial Sequence
  Synthetic
gccaagcatttaggtgacactatagtttgacattttggtctcagagtttcagagctatgctggaaacagc

SEQ ID NO: 50388 - DNA, 70 bp, Artificial Sequence
  Synthetic
gccaagcatttaggtgacactatagttttagaaggcttgctgagcgtttcagagctatgctggaaacagc

SEQ ID NO: 50389 - DNA, 70 bp, Artificial Sequence
  Synthetic
gccaagcatttaggtgacactataggagggaggggccggtgtcacgtttcagagctatgctggaaacagc

SEQ ID NO: 50390 - DNA, 70 bp, Artificial Sequence
  Synthetic
gccaagcatttaggtgacactatagtacaagtctccacactactggtttcagagctatgctggaaacagc

SEQ ID NO: 50391 - DNA, 70 bp, Artificial Sequence
  Synthetic
gccaagcatttaggtgacactatagggttgctcctctttgcctaagtttcagagctatgctggaaacagc

SEQ ID NO: 50392 - DNA, 70 bp, Artificial Sequence
  Synthetic
gccaagcatttaggtgacactataggcatccaccttcctggcagggtttcagagctatgctggaaacagc

SEQ ID NO: 50393 - DNA, 70 bp, Artificial Sequence
  Synthetic
gccaagcatttaggtgacactatagacttgcctaatcggaggtaggtttcagagctatgctggaaacagc

SEQ ID NO: 50394 - DNA, 70 bp, Artificial Sequence
  Synthetic
gccaagcatttaggtgacactatagtgattcattgctcacaggaagtttcagagctatgctggaaacagc

SEQ ID NO: 50395 - DNA, 70 bp, Artificial Sequence
  Synthetic
gccaagcatttaggtgacactatagttcatgtcatgactgcttgtgtttcagagctatgctggaaacagc

SEQ ID NO: 50396 - DNA, 70 bp, Artificial Sequence
  Synthetic
gccaagcatttaggtgacactatagtcaacaacatgcagcagtgagtttcagagctatgctggaaacagc

SEQ ID NO: 50397 - DNA, 70 bp, Artificial Sequence
  Synthetic
gccaagcatttaggtgacactatagggaacagggaaggatcactggtttcagagctatgctggaaacagc

SEQ ID NO: 50398 - DNA, 70 bp, Artificial Sequence
  Synthetic
gccaagcatttaggtgacactatagtttcagatttgactttctgcgtttcagagctatgctggaaacagc

SEQ ID NO: 50399 - DNA, 70 bp, Artificial Sequence
  Synthetic
gccaagcatttaggtgacactatagtggtgagaacactcatatgagtttcagagctatgctggaaacagc

SEQ ID NO: 50400 - DNA, 70 bp, Artificial Sequence
  Synthetic
gccaagcatttaggtgacactatagttcgttttcccaggctaggtgtttcagagctatgctggaaacagc

SEQ ID NO: 50401 - DNA, 70 bp, Artificial Sequence
  Synthetic
gccaagcatttaggtgacactatagtgctaatcatactgagctctgtttcagagctatgctggaaacagc

SEQ ID NO: 50402 - DNA, 70 bp, Artificial Sequence
  Synthetic
gccaagcatttaggtgacactatagaaagtagctcactctggcttgtttcagagctatgctggaaacagc

SEQ ID NO: 50403 - DNA, 70 bp, Artificial Sequence
  Synthetic
gccaagcatttaggtgacactataggctcatcatgcgatatgtgcgtttcagagctatgctggaaacagc

SEQ ID NO: 50404 - DNA, 70 bp, Artificial Sequence
  Synthetic
gccaagcatttaggtgacactatagagctctgagtcacttcccatgtttcagagctatgctggaaacagc

SEQ ID NO: 50405 - DNA, 70 bp, Artificial Sequence
  Synthetic
gccaagcatttaggtgacactatagatgtatcttagtgtgtctgcgtttcagagctatgctggaaacagc

SEQ ID NO: 50406 - DNA, 70 bp, Artificial Sequence
  Synthetic
gccaagcatttaggtgacactataggggtgggctcagagctcatcgtttcagagctatgctggaaacagc

SEQ ID NO: 50407 - DNA, 70 bp, Artificial Sequence
  Synthetic
gccaagcatttaggtgacactataggcaagggtcaaagatcttctgtttcagagctatgctggaaacagc

SEQ ID NO: 50408 - DNA, 70 bp, Artificial Sequence
  Synthetic
gccaagcatttaggtgacactataggcatcaggctcacagagcctgtttcagagctatgctggaaacagc

SEQ ID NO: 50409 - DNA, 70 bp, Artificial Sequence
  Synthetic
gccaagcatttaggtgacactataggacctctctgattgctgatggtttcagagctatgctggaaacagc

SEQ ID NO: 50410 - DNA, 70 bp, Artificial Sequence
  Synthetic
gccaagcatttaggtgacactatagtatgtaagagagatctcttggtttcagagctatgctggaaacagc

SEQ ID NO: 50411 - DNA, 70 bp, Artificial Sequence
  Synthetic
gccaagcatttaggtgacactatagtcagaaagagccactttcaggtttcagagctatgctggaaacagc

SEQ ID NO: 50412 - DNA, 70 bp, Artificial Sequence
  Synthetic
gccaagcatttaggtgacactatagcaaaaggatagagattgcaggtttcagagctatgctggaaacagc

SEQ ID NO: 50413 - DNA, 70 bp, Artificial Sequence
  Synthetic
gccaagcatttaggtgacactataggtctggaatgctgctaggaggtttcagagctatgctggaaacagc

SEQ ID NO: 50414 - DNA, 70 bp, Artificial Sequence
  Synthetic
gccaagcatttaggtgacactatagttgcttcctctaacacatgagtttcagagctatgctggaaacagc

SEQ ID NO: 50415 - DNA, 70 bp, Artificial Sequence
  Synthetic
gccaagcatttaggtgacactatagatgagagacaattattgagggtttcagagctatgctggaaacagc

SEQ ID NO: 50416 - DNA, 70 bp, Artificial Sequence
  Synthetic
gccaagcatttaggtgacactatagagactgggatcccagcacgtgtttcagagctatgctggaaacagc

SEQ ID NO: 50417 - DNA, 70 bp, Artificial Sequence
  Synthetic
gccaagcatttaggtgacactataggatcaagagactgctggcaggtttcagagctatgctggaaacagc

SEQ ID NO: 50418 - DNA, 70 bp, Artificial Sequence
  Synthetic
gccaagcatttaggtgacactatagatcttctttcatcttcacctgtttcagagctatgctggaaacagc

SEQ ID NO: 50419 - DNA, 70 bp, Artificial Sequence
  Synthetic
gccaagcatttaggtgacactatagatgctgaaaatgacaaggaagtttcagagctatgctggaaacagc

SEQ ID NO: 50420 - DNA, 70 bp, Artificial Sequence
  Synthetic
gccaagcatttaggtgacactataggcagcttcaggttctcaatagtttcagagctatgctggaaacagc

SEQ ID NO: 50421 - DNA, 70 bp, Artificial Sequence
  Synthetic
gccaagcatttaggtgacactatagctttggcatccttgtctactgtttcagagctatgctggaaacagc

SEQ ID NO: 50422 - DNA, 70 bp, Artificial Sequence
  Synthetic
gccaagcatttaggtgacactatagggtgagtgtcaacgatcaccgtttcagagctatgctggaaacagc

SEQ ID NO: 50423 - DNA, 70 bp, Artificial Sequence
  Synthetic
gccaagcatttaggtgacactatagggttccaggatcagagctccgtttcagagctatgctggaaacagc

SEQ ID NO: 50424 - DNA, 70 bp, Artificial Sequence
  Synthetic
gccaagcatttaggtgacactatagaaaggagttaatatcaccacgtttcagagctatgctggaaacagc

SEQ ID NO: 50425 - DNA, 70 bp, Artificial Sequence
  Synthetic
gccaagcatttaggtgacactatagtaatgatttccctcacagctgtttcagagctatgctggaaacagc

SEQ ID NO: 50426 - DNA, 70 bp, Artificial Sequence
  Synthetic
gccaagcatttaggtgacactatagaggaagaccacagggatttggtttcagagctatgctggaaacagc

SEQ ID NO: 50427 - DNA, 70 bp, Artificial Sequence
  Synthetic
gccaagcatttaggtgacactatagttaagtcagcagttttcaccgtttcagagctatgctggaaacagc

SEQ ID NO: 50428 - DNA, 70 bp, Artificial Sequence
  Synthetic
gccaagcatttaggtgacactatagatggaaagaaaatgggtgctgtttcagagctatgctggaaacagc

SEQ ID NO: 50429 - DNA, 70 bp, Artificial Sequence
  Synthetic
gccaagcatttaggtgacactatagccttctgactcattcagaccgtttcagagctatgctggaaacagc

SEQ ID NO: 50430 - DNA, 70 bp, Artificial Sequence
  Synthetic
gccaagcatttaggtgacactatagaaaggaatggctcatttgaggtttcagagctatgctggaaacagc

SEQ ID NO: 50431 - DNA, 70 bp, Artificial Sequence
  Synthetic
gccaagcatttaggtgacactatagtctctgttgatagatgcgtagtttcagagctatgctggaaacagc

SEQ ID NO: 50432 - DNA, 70 bp, Artificial Sequence
  Synthetic
gccaagcatttaggtgacactatagagagaatgtagacagtgctggtttcagagctatgctggaaacagc

SEQ ID NO: 50433 - DNA, 70 bp, Artificial Sequence
  Synthetic
gccaagcatttaggtgacactatagcacagtgagcgagtgtaaacgtttcagagctatgctggaaacagc

SEQ ID NO: 50434 - DNA, 70 bp, Artificial Sequence
  Synthetic
gccaagcatttaggtgacactatagacaagacagtattcctcatcgtttcagagctatgctggaaacagc

SEQ ID NO: 50435 - DNA, 70 bp, Artificial Sequence
  Synthetic
gccaagcatttaggtgacactatagtgaggagccgggggggagtcgtttcagagctatgctggaaacagc

SEQ ID NO: 50436 - DNA, 70 bp, Artificial Sequence
  Synthetic
gccaagcatttaggtgacactatagtgcgggaggtttttcagtctgtttcagagctatgctggaaacagc

SEQ ID NO: 50437 - DNA, 70 bp, Artificial Sequence
  Synthetic
gccaagcatttaggtgacactatagaaacggtgatgaagtgaaaagtttcagagctatgctggaaacagc

SEQ ID NO: 50438 - DNA, 70 bp, Artificial Sequence
  Synthetic
gccaagcatttaggtgacactatagggagttgcagagtctggagggtttcagagctatgctggaaacagc

SEQ ID NO: 50439 - DNA, 70 bp, Artificial Sequence
  Synthetic
gccaagcatttaggtgacactatagagggcgtcagggtcctaatcgtttcagagctatgctggaaacagc

SEQ ID NO: 50440 - DNA, 70 bp, Artificial Sequence
  Synthetic
gccaagcatttaggtgacactatagtaggtggtttggggtctcaggtttcagagctatgctggaaacagc

SEQ ID NO: 50441 - DNA, 70 bp, Artificial Sequence
  Synthetic
gccaagcatttaggtgacactataggcaagattcagaggaagaaagtttcagagctatgctggaaacagc

SEQ ID NO: 50442 - DNA, 70 bp, Artificial Sequence
  Synthetic
gccaagcatttaggtgacactatagagaaacaactgcaaaatcctgtttcagagctatgctggaaacagc

SEQ ID NO: 50443 - DNA, 70 bp, Artificial Sequence
  Synthetic
gccaagcatttaggtgacactatagcccttaacatttgggtaatggtttcagagctatgctggaaacagc

SEQ ID NO: 50444 - DNA, 70 bp, Artificial Sequence
  Synthetic
gccaagcatttaggtgacactatagcactgagaacttttcagtcggtttcagagctatgctggaaacagc

SEQ ID NO: 50445 - DNA, 70 bp, Artificial Sequence
  Synthetic
gccaagcatttaggtgacactatagacctctgaaatattggcattgtttcagagctatgctggaaacagc

SEQ ID NO: 50446 - DNA, 70 bp, Artificial Sequence
  Synthetic
gccaagcatttaggtgacactatagctcaggccaagcgcttctgagtttcagagctatgctggaaacagc

SEQ ID NO: 50447 - DNA, 70 bp, Artificial Sequence
  Synthetic
gccaagcatttaggtgacactatagtctgttcattcacacgagcagtttcagagctatgctggaaacagc

SEQ ID NO: 50448 - DNA, 70 bp, Artificial Sequence
  Synthetic
gccaagcatttaggtgacactatagtgtggcagggtaacatttaagtttcagagctatgctggaaacagc

SEQ ID NO: 50449 - DNA, 70 bp, Artificial Sequence
  Synthetic
gccaagcatttaggtgacactatagtcttagaatcccagcaataagtttcagagctatgctggaaacagc

SEQ ID NO: 50450 - DNA, 70 bp, Artificial Sequence
  Synthetic
gccaagcatttaggtgacactatagactgacaagctgtctgaacagtttcagagctatgctggaaacagc

SEQ ID NO: 50451 - DNA, 70 bp, Artificial Sequence
  Synthetic
gccaagcatttaggtgacactatagaaggctgctctgctgttgccgtttcagagctatgctggaaacagc

SEQ ID NO: 50452 - DNA, 70 bp, Artificial Sequence
  Synthetic
gccaagcatttaggtgacactataggatcattgcctgtccatctagtttcagagctatgctggaaacagc

SEQ ID NO: 50453 - DNA, 70 bp, Artificial Sequence
  Synthetic
gccaagcatttaggtgacactataggtgctcatccaggcagctacgtttcagagctatgctggaaacagc

SEQ ID NO: 50454 - DNA, 70 bp, Artificial Sequence
  Synthetic
gccaagcatttaggtgacactataggcacctggctttacctgatggtttcagagctatgctggaaacagc

SEQ ID NO: 50455 - DNA, 70 bp, Artificial Sequence
  Synthetic
gccaagcatttaggtgacactatagaatggttcagctgcttcaaagtttcagagctatgctggaaacagc

SEQ ID NO: 50456 - DNA, 70 bp, Artificial Sequence
  Synthetic
gccaagcatttaggtgacactatagactggttacaagatgatcatgtttcagagctatgctggaaacagc

SEQ ID NO: 50457 - DNA, 70 bp, Artificial Sequence
  Synthetic
gccaagcatttaggtgacactatagagaagcgtctgcacttgctggtttcagagctatgctggaaacagc

SEQ ID NO: 50458 - DNA, 70 bp, Artificial Sequence
  Synthetic
gccaagcatttaggtgacactatagtcagtaattcacactccgcagtttcagagctatgctggaaacagc

SEQ ID NO: 50459 - DNA, 70 bp, Artificial Sequence
  Synthetic
gccaagcatttaggtgacactataggcccagcgtggggccctagcgtttcagagctatgctggaaacagc

SEQ ID NO: 50460 - DNA, 70 bp, Artificial Sequence
  Synthetic
gccaagcatttaggtgacactatagtggagaggtcatactcaggcgtttcagagctatgctggaaacagc

SEQ ID NO: 50461 - DNA, 70 bp, Artificial Sequence
  Synthetic
gccaagcatttaggtgacactatagagctctgtgtgtactcacatgtttcagagctatgctggaaacagc

SEQ ID NO: 50462 - DNA, 70 bp, Artificial Sequence
  Synthetic
gccaagcatttaggtgacactataggttggtcctgtttgttttctgtttcagagctatgctggaaacagc

SEQ ID NO: 50463 - DNA, 70 bp, Artificial Sequence
  Synthetic
gccaagcatttaggtgacactataggcctgtctgcttcatgggatgtttcagagctatgctggaaacagc

SEQ ID NO: 50464 - DNA, 70 bp, Artificial Sequence
  Synthetic
gccaagcatttaggtgacactatagggtggggaggacaactaagggtttcagagctatgctggaaacagc

SEQ ID NO: 50465 - DNA, 70 bp, Artificial Sequence
  Synthetic
gccaagcatttaggtgacactatagtacaacgggcaaggctatccgtttcagagctatgctggaaacagc

SEQ ID NO: 50466 - DNA, 70 bp, Artificial Sequence
  Synthetic
gccaagcatttaggtgacactataggcttaccagtccaaggctgcgtttcagagctatgctggaaacagc

SEQ ID NO: 50467 - DNA, 70 bp, Artificial Sequence
  Synthetic
gccaagcatttaggtgacactatagtcctgaggctatcagactccgtttcagagctatgctggaaacagc

SEQ ID NO: 50468 - DNA, 70 bp, Artificial Sequence
  Synthetic
gccaagcatttaggtgacactatagtgacagacgctaggaagtaagtttcagagctatgctggaaacagc

SEQ ID NO: 50469 - DNA, 70 bp, Artificial Sequence
  Synthetic
gccaagcatttaggtgacactatagggtggggaatttcagccaaagtttcagagctatgctggaaacagc

SEQ ID NO: 50470 - DNA, 70 bp, Artificial Sequence
  Synthetic
gccaagcatttaggtgacactatagaagtctatgctgggcggagagtttcagagctatgctggaaacagc

SEQ ID NO: 50471 - DNA, 70 bp, Artificial Sequence
  Synthetic
gccaagcatttaggtgacactataggcatccaggcggtggctactgtttcagagctatgctggaaacagc

SEQ ID NO: 50472 - DNA, 70 bp, Artificial Sequence
  Synthetic
gccaagcatttaggtgacactatagatgcccatcagcgcacaggtgtttcagagctatgctggaaacagc

SEQ ID NO: 50473 - DNA, 70 bp, Artificial Sequence
  Synthetic
gccaagcatttaggtgacactatagttgggatggagggagtttacgtttcagagctatgctggaaacagc

SEQ ID NO: 50474 - DNA, 70 bp, Artificial Sequence
  Synthetic
gccaagcatttaggtgacactatagcaggaattctttgtggacatgtttcagagctatgctggaaacagc

SEQ ID NO: 50475 - DNA, 70 bp, Artificial Sequence
  Synthetic
gccaagcatttaggtgacactatagccagggcctctgggagtgacgtttcagagctatgctggaaacagc

SEQ ID NO: 50476 - DNA, 70 bp, Artificial Sequence
  Synthetic
gccaagcatttaggtgacactatagggcatcagacactaatagttgtttcagagctatgctggaaacagc

SEQ ID NO: 50477 - DNA, 70 bp, Artificial Sequence
  Synthetic
gccaagcatttaggtgacactataggtaatgtgaagggtccctaagtttcagagctatgctggaaacagc

SEQ ID NO: 50478 - DNA, 70 bp, Artificial Sequence
  Synthetic
gccaagcatttaggtgacactatagggctgcctgtgcctggctgcgtttcagagctatgctggaaacagc

SEQ ID NO: 50479 - DNA, 70 bp, Artificial Sequence
  Synthetic
gccaagcatttaggtgacactatagtttcgttcagttttgagatggtttcagagctatgctggaaacagc

SEQ ID NO: 50480 - DNA, 70 bp, Artificial Sequence
  Synthetic
gccaagcatttaggtgacactataggcttacccatgcctggctgtgtttcagagctatgctggaaacagc

SEQ ID NO: 50481 - DNA, 70 bp, Artificial Sequence
  Synthetic
gccaagcatttaggtgacactatagtgaacagcaaagcagacagcgtttcagagctatgctggaaacagc

SEQ ID NO: 50482 - DNA, 70 bp, Artificial Sequence
  Synthetic
gccaagcatttaggtgacactataggggctctcacttcctgctgcgtttcagagctatgctggaaacagc

SEQ ID NO: 50483 - DNA, 70 bp, Artificial Sequence
  Synthetic
gccaagcatttaggtgacactataggccacgaggtcagaggtcaggtttcagagctatgctggaaacagc

SEQ ID NO: 50484 - DNA, 70 bp, Artificial Sequence
  Synthetic
gccaagcatttaggtgacactatagtgtcaagaaacctgcattcagtttcagagctatgctggaaacagc

SEQ ID NO: 50485 - DNA, 70 bp, Artificial Sequence
  Synthetic
gccaagcatttaggtgacactatagggtttttacaagaagcagacgtttcagagctatgctggaaacagc

SEQ ID NO: 50486 - DNA, 70 bp, Artificial Sequence
  Synthetic
gccaagcatttaggtgacactatagcaagaatttggtgtggacgtgtttcagagctatgctggaaacagc

SEQ ID NO: 50487 - DNA, 70 bp, Artificial Sequence
  Synthetic
gccaagcatttaggtgacactatagatgttcttctcatacagactgtttcagagctatgctggaaacagc

SEQ ID NO: 50488 - DNA, 70 bp, Artificial Sequence
  Synthetic
gccaagcatttaggtgacactatagcctggcagagatggtgttgcgtttcagagctatgctggaaacagc

SEQ ID NO: 50489 - DNA, 70 bp, Artificial Sequence
  Synthetic
gccaagcatttaggtgacactatagtgcatgaagaacctgtgagcgtttcagagctatgctggaaacagc

SEQ ID NO: 50490 - DNA, 70 bp, Artificial Sequence
  Synthetic
gccaagcatttaggtgacactatagcggcatcccacccagttgtggtttcagagctatgctggaaacagc

SEQ ID NO: 50491 - DNA, 70 bp, Artificial Sequence
  Synthetic
gccaagcatttaggtgacactatagtccatcaactgtgaaagctggtttcagagctatgctggaaacagc

SEQ ID NO: 50492 - DNA, 70 bp, Artificial Sequence
  Synthetic
gccaagcatttaggtgacactatagtacgtccaagaaaaaactgcgtttcagagctatgctggaaacagc

SEQ ID NO: 50493 - DNA, 70 bp, Artificial Sequence
  Synthetic
gccaagcatttaggtgacactatagagctatacttcacgcagaccgtttcagagctatgctggaaacagc

SEQ ID NO: 50494 - DNA, 70 bp, Artificial Sequence
  Synthetic
gccaagcatttaggtgacactataggatgtcaagtgtgcatgaaggtttcagagctatgctggaaacagc

SEQ ID NO: 50495 - DNA, 70 bp, Artificial Sequence
  Synthetic
gccaagcatttaggtgacactatagtgtatgaaaagcctgtaggggtttcagagctatgctggaaacagc

SEQ ID NO: 50496 - DNA, 70 bp, Artificial Sequence
  Synthetic
gccaagcatttaggtgacactataggccggcttgcttcatgggctgtttcagagctatgctggaaacagc

SEQ ID NO: 50497 - DNA, 70 bp, Artificial Sequence
  Synthetic
gccaagcatttaggtgacactatagaggaattcggcgttgaaattgtttcagagctatgctggaaacagc

SEQ ID NO: 50498 - DNA, 70 bp, Artificial Sequence
  Synthetic
gccaagcatttaggtgacactatagctctcagctgctgaagcagagtttcagagctatgctggaaacagc

SEQ ID NO: 50499 - DNA, 70 bp, Artificial Sequence
  Synthetic
gccaagcatttaggtgacactataggtctccaggaaggtggcgctgtttcagagctatgctggaaacagc

SEQ ID NO: 50500 - DNA, 70 bp, Artificial Sequence
  Synthetic
gccaagcatttaggtgacactatagcggagctgttttgtgctgaagtttcagagctatgctggaaacagc

SEQ ID NO: 50501 - DNA, 70 bp, Artificial Sequence
  Synthetic
gccaagcatttaggtgacactatagggcggcgctagcagatccaggtttcagagctatgctggaaacagc

SEQ ID NO: 50502 - DNA, 70 bp, Artificial Sequence
  Synthetic
gccaagcatttaggtgacactataggggtgcccgggctttagcaggtttcagagctatgctggaaacagc

SEQ ID NO: 50503 - DNA, 70 bp, Artificial Sequence
  Synthetic
gccaagcatttaggtgacactatagcccggagtcatcagtgtgatgtttcagagctatgctggaaacagc

SEQ ID NO: 50504 - DNA, 70 bp, Artificial Sequence
  Synthetic
gccaagcatttaggtgacactatagttcatatggaaaatgctccagtttcagagctatgctggaaacagc

SEQ ID NO: 50505 - DNA, 70 bp, Artificial Sequence
  Synthetic
gccaagcatttaggtgacactatagtctcccaacccagagaacgggtttcagagctatgctggaaacagc

SEQ ID NO: 50506 - DNA, 70 bp, Artificial Sequence
  Synthetic
gccaagcatttaggtgacactatagtgaagatacaaggtcatcatgtttcagagctatgctggaaacagc

SEQ ID NO: 50507 - DNA, 70 bp, Artificial Sequence
  Synthetic
gccaagcatttaggtgacactatagcccatacctttaagaatggagtttcagagctatgctggaaacagc

SEQ ID NO: 50508 - DNA, 70 bp, Artificial Sequence
  Synthetic
gccaagcatttaggtgacactatagcattatctgggcctcagtccgtttcagagctatgctggaaacagc

SEQ ID NO: 50509 - DNA, 70 bp, Artificial Sequence
  Synthetic
gccaagcatttaggtgacactatagtatgtccactcctccttttcgtttcagagctatgctggaaacagc

SEQ ID NO: 50510 - DNA, 70 bp, Artificial Sequence
  Synthetic
gccaagcatttaggtgacactataggaccccccccgcgggttatggtttcagagctatgctggaaacagc

SEQ ID NO: 50511 - DNA, 70 bp, Artificial Sequence
  Synthetic
gccaagcatttaggtgacactatagtgcagcagtaagcctttcaagtttcagagctatgctggaaacagc

SEQ ID NO: 50512 - DNA, 70 bp, Artificial Sequence
  Synthetic
gccaagcatttaggtgacactatagtgatgctcaaggccccttgagtttcagagctatgctggaaacagc

SEQ ID NO: 50513 - DNA, 70 bp, Artificial Sequence
  Synthetic
gccaagcatttaggtgacactatagggaggggtcggggagaaatcgtttcagagctatgctggaaacagc

SEQ ID NO: 50514 - DNA, 70 bp, Artificial Sequence
  Synthetic
gccaagcatttaggtgacactatagaatgttgagctacaaaccaggtttcagagctatgctggaaacagc

SEQ ID NO: 50515 - DNA, 70 bp, Artificial Sequence
  Synthetic
gccaagcatttaggtgacactatagccaccagtgatttctataaggtttcagagctatgctggaaacagc

SEQ ID NO: 50516 - DNA, 70 bp, Artificial Sequence
  Synthetic
gccaagcatttaggtgacactataggaactcacagacaaagtacagtttcagagctatgctggaaacagc

SEQ ID NO: 50517 - DNA, 70 bp, Artificial Sequence
  Synthetic
gccaagcatttaggtgacactatagcttcatgtgtgagtttgacagtttcagagctatgctggaaacagc

SEQ ID NO: 50518 - DNA, 70 bp, Artificial Sequence
  Synthetic
gccaagcatttaggtgacactatagacttcatttgcgaaaaagacgtttcagagctatgctggaaacagc

SEQ ID NO: 50519 - DNA, 70 bp, Artificial Sequence
  Synthetic
gccaagcatttaggtgacactatagtgcccgggatgaactctgaggtttcagagctatgctggaaacagc

SEQ ID NO: 50520 - DNA, 70 bp, Artificial Sequence
  Synthetic
gccaagcatttaggtgacactatagcttcaagggatgagctatgagtttcagagctatgctggaaacagc

SEQ ID NO: 50521 - DNA, 70 bp, Artificial Sequence
  Synthetic
gccaagcatttaggtgacactatagtgcacgggtttgttcaccgtgtttcagagctatgctggaaacagc

SEQ ID NO: 50522 - DNA, 70 bp, Artificial Sequence
  Synthetic
gccaagcatttaggtgacactatagcctgccgctacttcacctgagtttcagagctatgctggaaacagc

SEQ ID NO: 50523 - DNA, 70 bp, Artificial Sequence
  Synthetic
gccaagcatttaggtgacactatagtacatcatcttcagttaggcgtttcagagctatgctggaaacagc

SEQ ID NO: 50524 - DNA, 70 bp, Artificial Sequence
  Synthetic
gccaagcatttaggtgacactatagagagactatacaagcacagcgtttcagagctatgctggaaacagc

SEQ ID NO: 50525 - DNA, 70 bp, Artificial Sequence
  Synthetic
gccaagcatttaggtgacactatagagatgaagacaaatcactgtgtttcagagctatgctggaaacagc

SEQ ID NO: 50526 - DNA, 70 bp, Artificial Sequence
  Synthetic
gccaagcatttaggtgacactatagagagcaactcagttgtaactgtttcagagctatgctggaaacagc

SEQ ID NO: 50527 - DNA, 70 bp, Artificial Sequence
  Synthetic
gccaagcatttaggtgacactatagctgatgagctccctgggctggtttcagagctatgctggaaacagc

SEQ ID NO: 50528 - DNA, 70 bp, Artificial Sequence
  Synthetic
gccaagcatttaggtgacactataggaggtgtgagcgcagactgcgtttcagagctatgctggaaacagc

SEQ ID NO: 50529 - DNA, 70 bp, Artificial Sequence
  Synthetic
gccaagcatttaggtgacactatagggccctggctcaaacactgtgtttcagagctatgctggaaacagc

SEQ ID NO: 50530 - DNA, 70 bp, Artificial Sequence
  Synthetic
gccaagcatttaggtgacactatagtcagcagaaacactccatgcgtttcagagctatgctggaaacagc

SEQ ID NO: 50531 - DNA, 70 bp, Artificial Sequence
  Synthetic
gccaagcatttaggtgacactatagggtcctgcagttgaaataacgtttcagagctatgctggaaacagc

SEQ ID NO: 50532 - DNA, 70 bp, Artificial Sequence
  Synthetic
gccaagcatttaggtgacactatagcagctggctggatcatttacgtttcagagctatgctggaaacagc

SEQ ID NO: 50533 - DNA, 70 bp, Artificial Sequence
  Synthetic
gccaagcatttaggtgacactatagcatcagctgcggcaagcctagtttcagagctatgctggaaacagc

SEQ ID NO: 50534 - DNA, 70 bp, Artificial Sequence
  Synthetic
gccaagcatttaggtgacactatagagggcccaggcagcgaagcagtttcagagctatgctggaaacagc

SEQ ID NO: 50535 - DNA, 70 bp, Artificial Sequence
  Synthetic
gccaagcatttaggtgacactataggccacacacggaggctcagggtttcagagctatgctggaaacagc

SEQ ID NO: 50536 - DNA, 70 bp, Artificial Sequence
  Synthetic
gccaagcatttaggtgacactatagagtcctctgcagtttcgctagtttcagagctatgctggaaacagc

SEQ ID NO: 50537 - DNA, 70 bp, Artificial Sequence
  Synthetic
gccaagcatttaggtgacactatagcagggaatggccttaagtctgtttcagagctatgctggaaacagc

SEQ ID NO: 50538 - DNA, 70 bp, Artificial Sequence
  Synthetic
gccaagcatttaggtgacactatagtgacacaacagatatcaatcgtttcagagctatgctggaaacagc

SEQ ID NO: 50539 - DNA, 70 bp, Artificial Sequence
  Synthetic
gccaagcatttaggtgacactatagcagtacgctcccagcgcctggtttcagagctatgctggaaacagc

SEQ ID NO: 50540 - DNA, 70 bp, Artificial Sequence
  Synthetic
gccaagcatttaggtgacactatagcttggcatctgtgggataaggtttcagagctatgctggaaacagc

SEQ ID NO: 50541 - DNA, 70 bp, Artificial Sequence
  Synthetic
gccaagcatttaggtgacactatagacttctgacagtcacctgcagtttcagagctatgctggaaacagc

SEQ ID NO: 50542 - DNA, 70 bp, Artificial Sequence
  Synthetic
gccaagcatttaggtgacactatagggtactaaccctcagaaggggtttcagagctatgctggaaacagc

SEQ ID NO: 50543 - DNA, 70 bp, Artificial Sequence
  Synthetic
gccaagcatttaggtgacactatagtccaagatggtctttgaaacgtttcagagctatgctggaaacagc

SEQ ID NO: 50544 - DNA, 70 bp, Artificial Sequence
  Synthetic
gccaagcatttaggtgacactatagccaggctgtagtcagtaaacgtttcagagctatgctggaaacagc

SEQ ID NO: 50545 - DNA, 70 bp, Artificial Sequence
  Synthetic
gccaagcatttaggtgacactatagggctcacaagaagatgattcgtttcagagctatgctggaaacagc

SEQ ID NO: 50546 - DNA, 70 bp, Artificial Sequence
  Synthetic
gccaagcatttaggtgacactatagcaaggattcactgagccatcgtttcagagctatgctggaaacagc

SEQ ID NO: 50547 - DNA, 70 bp, Artificial Sequence
  Synthetic
gccaagcatttaggtgacactatagtctccaaaaggttattcactgtttcagagctatgctggaaacagc

SEQ ID NO: 50548 - DNA, 70 bp, Artificial Sequence
  Synthetic
gccaagcatttaggtgacactatagtggatctgcttatcccacgtgtttcagagctatgctggaaacagc

SEQ ID NO: 50549 - DNA, 70 bp, Artificial Sequence
  Synthetic
gccaagcatttaggtgacactatagtatccatggattgatgtctcgtttcagagctatgctggaaacagc

SEQ ID NO: 50550 - DNA, 70 bp, Artificial Sequence
  Synthetic
gccaagcatttaggtgacactatagcgcgggctctttttctgatggtttcagagctatgctggaaacagc

SEQ ID NO: 50551 - DNA, 70 bp, Artificial Sequence
  Synthetic
gccaagcatttaggtgacactatagttggtccaagtcgaattgaagtttcagagctatgctggaaacagc

SEQ ID NO: 50552 - DNA, 70 bp, Artificial Sequence
  Synthetic
gccaagcatttaggtgacactatagaagaagatgtccaaagtgaagtttcagagctatgctggaaacagc

SEQ ID NO: 50553 - DNA, 70 bp, Artificial Sequence
  Synthetic
gccaagcatttaggtgacactataggctgccccagccggccctaggtttcagagctatgctggaaacagc

SEQ ID NO: 50554 - DNA, 70 bp, Artificial Sequence
  Synthetic
gccaagcatttaggtgacactatagagccagactgacggattatggtttcagagctatgctggaaacagc

SEQ ID NO: 50555 - DNA, 70 bp, Artificial Sequence
  Synthetic
gccaagcatttaggtgacactataggcagccagagggcatctcacgtttcagagctatgctggaaacagc

SEQ ID NO: 50556 - DNA, 70 bp, Artificial Sequence
  Synthetic
gccaagcatttaggtgacactatagcacagccatgcatagatgtggtttcagagctatgctggaaacagc

SEQ ID NO: 50557 - DNA, 70 bp, Artificial Sequence
  Synthetic
gccaagcatttaggtgacactatagaacagtgaggtcttcaccgagtttcagagctatgctggaaacagc

SEQ ID NO: 50558 - DNA, 70 bp, Artificial Sequence
  Synthetic
gccaagcatttaggtgacactatagccaggttcttcagtctgccagtttcagagctatgctggaaacagc

SEQ ID NO: 50559 - DNA, 70 bp, Artificial Sequence
  Synthetic
gccaagcatttaggtgacactatagcatgaggtgcaccagacttggtttcagagctatgctggaaacagc

SEQ ID NO: 50560 - DNA, 70 bp, Artificial Sequence
  Synthetic
gccaagcatttaggtgacactatagatgaagtccatcacacataagtttcagagctatgctggaaacagc

SEQ ID NO: 50561 - DNA, 70 bp, Artificial Sequence
  Synthetic
gccaagcatttaggtgacactatagggattgtccttgggaatttggtttcagagctatgctggaaacagc

SEQ ID NO: 50562 - DNA, 70 bp, Artificial Sequence
  Synthetic
gccaagcatttaggtgacactatagttcagcttttcatgcacagcgtttcagagctatgctggaaacagc

SEQ ID NO: 50563 - DNA, 70 bp, Artificial Sequence
  Synthetic
gccaagcatttaggtgacactatagcaggagctcaggccaagcccgtttcagagctatgctggaaacagc

SEQ ID NO: 50564 - DNA, 70 bp, Artificial Sequence
  Synthetic
gccaagcatttaggtgacactatagtcgcgagtatctccgtttccgtttcagagctatgctggaaacagc

SEQ ID NO: 50565 - DNA, 70 bp, Artificial Sequence
  Synthetic
gccaagcatttaggtgacactatagggcattgtggccattcattcgtttcagagctatgctggaaacagc

SEQ ID NO: 50566 - DNA, 70 bp, Artificial Sequence
  Synthetic
gccaagcatttaggtgacactataggagtactcatttgcttgcaagtttcagagctatgctggaaacagc

SEQ ID NO: 50567 - DNA, 70 bp, Artificial Sequence
  Synthetic
gccaagcatttaggtgacactatagtatccaggccggatgcagaggtttcagagctatgctggaaacagc

SEQ ID NO: 50568 - DNA, 70 bp, Artificial Sequence
  Synthetic
gccaagcatttaggtgacactatagaagaggcaggcccagcagtagtttcagagctatgctggaaacagc

SEQ ID NO: 50569 - DNA, 70 bp, Artificial Sequence
  Synthetic
gccaagcatttaggtgacactatagcccccatggaggctgtcatggtttcagagctatgctggaaacagc

SEQ ID NO: 50570 - DNA, 70 bp, Artificial Sequence
  Synthetic
gccaagcatttaggtgacactatagtctaaaccagcgtcggtgaggtttcagagctatgctggaaacagc

SEQ ID NO: 50571 - DNA, 70 bp, Artificial Sequence
  Synthetic
gccaagcatttaggtgacactatagattagtttaggagaaaggtcgtttcagagctatgctggaaacagc

SEQ ID NO: 50572 - DNA, 70 bp, Artificial Sequence
  Synthetic
gccaagcatttaggtgacactatagcaaatagagaagtagcttcggtttcagagctatgctggaaacagc

SEQ ID NO: 50573 - DNA, 70 bp, Artificial Sequence
  Synthetic
gccaagcatttaggtgacactatagaggccctgcggggctctactgtttcagagctatgctggaaacagc

SEQ ID NO: 50574 - DNA, 70 bp, Artificial Sequence
  Synthetic
gccaagcatttaggtgacactatagatggagaacggggatgcgtagtttcagagctatgctggaaacagc

SEQ ID NO: 50575 - DNA, 70 bp, Artificial Sequence
  Synthetic
gccaagcatttaggtgacactatagtggcaaagatagcagcctgagtttcagagctatgctggaaacagc

SEQ ID NO: 50576 - DNA, 70 bp, Artificial Sequence
  Synthetic
gccaagcatttaggtgacactataggagatcaaaaacttgcggatgtttcagagctatgctggaaacagc

SEQ ID NO: 50577 - DNA, 70 bp, Artificial Sequence
  Synthetic
gccaagcatttaggtgacactataggctggggagctaacagttctgtttcagagctatgctggaaacagc

SEQ ID NO: 50578 - DNA, 70 bp, Artificial Sequence
  Synthetic
gccaagcatttaggtgacactataggtgcgagctggtggacggcagtttcagagctatgctggaaacagc

SEQ ID NO: 50579 - DNA, 70 bp, Artificial Sequence
  Synthetic
gccaagcatttaggtgacactatagaggcgtggacgaggacgagtgtttcagagctatgctggaaacagc

SEQ ID NO: 50580 - DNA, 70 bp, Artificial Sequence
  Synthetic
gccaagcatttaggtgacactatagatgggtgaggttttatttgcgtttcagagctatgctggaaacagc

SEQ ID NO: 50581 - DNA, 70 bp, Artificial Sequence
  Synthetic
gccaagcatttaggtgacactatagggggctggggttactccgtcgtttcagagctatgctggaaacagc

SEQ ID NO: 50582 - DNA, 70 bp, Artificial Sequence
  Synthetic
gccaagcatttaggtgacactatagggcgtcccagtgctctcagcgtttcagagctatgctggaaacagc

SEQ ID NO: 50583 - DNA, 70 bp, Artificial Sequence
  Synthetic
gccaagcatttaggtgacactataggagagttggcacctttgatggtttcagagctatgctggaaacagc

SEQ ID NO: 50584 - DNA, 70 bp, Artificial Sequence
  Synthetic
gccaagcatttaggtgacactatagaaatactgtccagcttcaaagtttcagagctatgctggaaacagc

SEQ ID NO: 50585 - DNA, 70 bp, Artificial Sequence
  Synthetic
gccaagcatttaggtgacactatagctctgtgcagctttgaagccgtttcagagctatgctggaaacagc

SEQ ID NO: 50586 - DNA, 70 bp, Artificial Sequence
  Synthetic
gccaagcatttaggtgacactatagtgctgacttcaattatatccgtttcagagctatgctggaaacagc

SEQ ID NO: 50587 - DNA, 70 bp, Artificial Sequence
  Synthetic
gccaagcatttaggtgacactatagccagttctacatgattcctggtttcagagctatgctggaaacagc

SEQ ID NO: 50588 - DNA, 70 bp, Artificial Sequence
  Synthetic
gccaagcatttaggtgacactataggcctccataaactgtcaaacgtttcagagctatgctggaaacagc

SEQ ID NO: 50589 - DNA, 70 bp, Artificial Sequence
  Synthetic
gccaagcatttaggtgacactatagggagaattccccttcctagagtttcagagctatgctggaaacagc

SEQ ID NO: 50590 - DNA, 70 bp, Artificial Sequence
  Synthetic
gccaagcatttaggtgacactatagagcagtgactctgctggcttgtttcagagctatgctggaaacagc

SEQ ID NO: 50591 - DNA, 70 bp, Artificial Sequence
  Synthetic
gccaagcatttaggtgacactataggctggctttggcgtatacacgtttcagagctatgctggaaacagc

SEQ ID NO: 50592 - DNA, 70 bp, Artificial Sequence
  Synthetic
gccaagcatttaggtgacactatagtggtcctctaagaatcatttgtttcagagctatgctggaaacagc

SEQ ID NO: 50593 - DNA, 70 bp, Artificial Sequence
  Synthetic
gccaagcatttaggtgacactataggtcttagtcttaaggctttcgtttcagagctatgctggaaacagc

SEQ ID NO: 50594 - DNA, 70 bp, Artificial Sequence
  Synthetic
gccaagcatttaggtgacactatagaaggaatgcatgagagccctgtttcagagctatgctggaaacagc

SEQ ID NO: 50595 - DNA, 70 bp, Artificial Sequence
  Synthetic
gccaagcatttaggtgacactatagaggagtttctgaatctgactgtttcagagctatgctggaaacagc

SEQ ID NO: 50596 - DNA, 70 bp, Artificial Sequence
  Synthetic
gccaagcatttaggtgacactatagaatacgtctgcagcactcaggtttcagagctatgctggaaacagc

SEQ ID NO: 50597 - DNA, 70 bp, Artificial Sequence
  Synthetic
gccaagcatttaggtgacactatagctgccgttgtgttttctttcgtttcagagctatgctggaaacagc

SEQ ID NO: 50598 - DNA, 70 bp, Artificial Sequence
  Synthetic
gccaagcatttaggtgacactatagtgtcattcactgctaagttagtttcagagctatgctggaaacagc

SEQ ID NO: 50599 - DNA, 70 bp, Artificial Sequence
  Synthetic
gccaagcatttaggtgacactatagcaagaggatgctggacatgagtttcagagctatgctggaaacagc

SEQ ID NO: 50600 - DNA, 70 bp, Artificial Sequence
  Synthetic
gccaagcatttaggtgacactatagaactggtcatttattagcaggtttcagagctatgctggaaacagc

SEQ ID NO: 50601 - DNA, 70 bp, Artificial Sequence
  Synthetic
gccaagcatttaggtgacactataggggactacgaaaagaacgaggtttcagagctatgctggaaacagc

SEQ ID NO: 50602 - DNA, 70 bp, Artificial Sequence
  Synthetic
gccaagcatttaggtgacactataggttatccatagcctttagaggtttcagagctatgctggaaacagc

SEQ ID NO: 50603 - DNA, 70 bp, Artificial Sequence
  Synthetic
gccaagcatttaggtgacactataggggactatgagaagaagcaggtttcagagctatgctggaaacagc

SEQ ID NO: 50604 - DNA, 70 bp, Artificial Sequence
  Synthetic
gccaagcatttaggtgacactatagatgcggtttacactttgtcagtttcagagctatgctggaaacagc

SEQ ID NO: 50605 - DNA, 70 bp, Artificial Sequence
  Synthetic
gccaagcatttaggtgacactataggtgctcagtgtgccagctgcgtttcagagctatgctggaaacagc

SEQ ID NO: 50606 - DNA, 70 bp, Artificial Sequence
  Synthetic
gccaagcatttaggtgacactatagtattcatcttcgtagccagtgtttcagagctatgctggaaacagc

SEQ ID NO: 50607 - DNA, 70 bp, Artificial Sequence
  Synthetic
gccaagcatttaggtgacactataggggggcgtccggggcctcaggtttcagagctatgctggaaacagc

SEQ ID NO: 50608 - DNA, 70 bp, Artificial Sequence
  Synthetic
gccaagcatttaggtgacactatagtttcccgggaagatctgaacgtttcagagctatgctggaaacagc

SEQ ID NO: 50609 - DNA, 70 bp, Artificial Sequence
  Synthetic
gccaagcatttaggtgacactatagattattcgtggcttagacacgtttcagagctatgctggaaacagc

SEQ ID NO: 50610 - DNA, 70 bp, Artificial Sequence
  Synthetic
gccaagcatttaggtgacactatagtttgaggagatgaggaaggcgtttcagagctatgctggaaacagc

SEQ ID NO: 50611 - DNA, 70 bp, Artificial Sequence
  Synthetic
gccaagcatttaggtgacactatagtgaaggagcggatcagcgccgtttcagagctatgctggaaacagc

SEQ ID NO: 50612 - DNA, 70 bp, Artificial Sequence
  Synthetic
gccaagcatttaggtgacactatagggcttcatttcccaagaagcgtttcagagctatgctggaaacagc

SEQ ID NO: 50613 - DNA, 70 bp, Artificial Sequence
  Synthetic
gccaagcatttaggtgacactatagcaggcctcgtttcaggtagagtttcagagctatgctggaaacagc

SEQ ID NO: 50614 - DNA, 70 bp, Artificial Sequence
  Synthetic
gccaagcatttaggtgacactatagtggaaaaacttttgtagctcgtttcagagctatgctggaaacagc

SEQ ID NO: 50615 - DNA, 70 bp, Artificial Sequence
  Synthetic
gccaagcatttaggtgacactatagtgggctgcgaagccatgtaggtttcagagctatgctggaaacagc

SEQ ID NO: 50616 - DNA, 70 bp, Artificial Sequence
  Synthetic
gccaagcatttaggtgacactataggagttaccccaaaggaatgggtttcagagctatgctggaaacagc

SEQ ID NO: 50617 - DNA, 70 bp, Artificial Sequence
  Synthetic
gccaagcatttaggtgacactataggcagagttaccccaaaagaggtttcagagctatgctggaaacagc

SEQ ID NO: 50618 - DNA, 70 bp, Artificial Sequence
  Synthetic
gccaagcatttaggtgacactataggcagttggtgtcttactacagtttcagagctatgctggaaacagc

SEQ ID NO: 50619 - DNA, 70 bp, Artificial Sequence
  Synthetic
gccaagcatttaggtgacactatagtacaggaggccagagtgaaggtttcagagctatgctggaaacagc

SEQ ID NO: 50620 - DNA, 70 bp, Artificial Sequence
  Synthetic
gccaagcatttaggtgacactataggcagttcagaaggaattagagtttcagagctatgctggaaacagc

SEQ ID NO: 50621 - DNA, 70 bp, Artificial Sequence
  Synthetic
gccaagcatttaggtgacactatagattttgtagaacggtgtaaggtttcagagctatgctggaaacagc

SEQ ID NO: 50622 - DNA, 70 bp, Artificial Sequence
  Synthetic
gccaagcatttaggtgacactatagtgtcaaagggtcagctcagtgtttcagagctatgctggaaacagc

SEQ ID NO: 50623 - DNA, 70 bp, Artificial Sequence
  Synthetic
gccaagcatttaggtgacactatagttcttccccagggccctaatgtttcagagctatgctggaaacagc

SEQ ID NO: 50624 - DNA, 70 bp, Artificial Sequence
  Synthetic
gccaagcatttaggtgacactatagttctttaggaagtatgcttggtttcagagctatgctggaaacagc

SEQ ID NO: 50625 - DNA, 70 bp, Artificial Sequence
  Synthetic
gccaagcatttaggtgacactataggcagagccatcgcctagtaggtttcagagctatgctggaaacagc

SEQ ID NO: 50626 - DNA, 70 bp, Artificial Sequence
  Synthetic
gccaagcatttaggtgacactatagattcagggtgtgctccatgagtttcagagctatgctggaaacagc

SEQ ID NO: 50627 - DNA, 70 bp, Artificial Sequence
  Synthetic
gccaagcatttaggtgacactatagccctcagtcgtgctgctagtgtttcagagctatgctggaaacagc

SEQ ID NO: 50628 - DNA, 70 bp, Artificial Sequence
  Synthetic
gccaagcatttaggtgacactatagctcagggacatttctttagcgtttcagagctatgctggaaacagc

SEQ ID NO: 50629 - DNA, 70 bp, Artificial Sequence
  Synthetic
gccaagcatttaggtgacactataggtggttgtaggattatctcagtttcagagctatgctggaaacagc

SEQ ID NO: 50630 - DNA, 70 bp, Artificial Sequence
  Synthetic
gccaagcatttaggtgacactatagtcagctttctcaactagtacgtttcagagctatgctggaaacagc

SEQ ID NO: 50631 - DNA, 70 bp, Artificial Sequence
  Synthetic
gccaagcatttaggtgacactatagaaatagcttggcatgtcattgtttcagagctatgctggaaacagc

SEQ ID NO: 50632 - DNA, 70 bp, Artificial Sequence
  Synthetic
gccaagcatttaggtgacactatagggatgaaacagacactgaaggtttcagagctatgctggaaacagc

SEQ ID NO: 50633 - DNA, 70 bp, Artificial Sequence
  Synthetic
gccaagcatttaggtgacactatagaggaagaattgatggaatgggtttcagagctatgctggaaacagc

SEQ ID NO: 50634 - DNA, 70 bp, Artificial Sequence
  Synthetic
gccaagcatttaggtgacactataggcaaggccagctcctctagcgtttcagagctatgctggaaacagc

SEQ ID NO: 50635 - DNA, 70 bp, Artificial Sequence
  Synthetic
gccaagcatttaggtgacactatagtttgctattcttagttccaggtttcagagctatgctggaaacagc

SEQ ID NO: 50636 - DNA, 70 bp, Artificial Sequence
  Synthetic
gccaagcatttaggtgacactatagggcccgtggctcagctccaggtttcagagctatgctggaaacagc

SEQ ID NO: 50637 - DNA, 70 bp, Artificial Sequence
  Synthetic
gccaagcatttaggtgacactatagtttcattccgctggaactaagtttcagagctatgctggaaacagc

SEQ ID NO: 50638 - DNA, 70 bp, Artificial Sequence
  Synthetic
gccaagcatttaggtgacactataggcaggatgtgtgcaaataaagtttcagagctatgctggaaacagc

SEQ ID NO: 50639 - DNA, 70 bp, Artificial Sequence
  Synthetic
gccaagcatttaggtgacactatagtgtcttcaattacggcttctgtttcagagctatgctggaaacagc

SEQ ID NO: 50640 - DNA, 70 bp, Artificial Sequence
  Synthetic
gccaagcatttaggtgacactatagttcttgagcatgtcctgcaggtttcagagctatgctggaaacagc

SEQ ID NO: 50641 - DNA, 70 bp, Artificial Sequence
  Synthetic
gccaagcatttaggtgacactatagtccccctctgccacttgacagtttcagagctatgctggaaacagc

SEQ ID NO: 50642 - DNA, 70 bp, Artificial Sequence
  Synthetic
gccaagcatttaggtgacactatagcaaggcccaggccacactgggtttcagagctatgctggaaacagc

SEQ ID NO: 50643 - DNA, 70 bp, Artificial Sequence
  Synthetic
gccaagcatttaggtgacactataggaagtgttccgtgatgtgaggtttcagagctatgctggaaacagc

SEQ ID NO: 50644 - DNA, 70 bp, Artificial Sequence
  Synthetic
gccaagcatttaggtgacactatagtaggctttgttgcagctgaggtttcagagctatgctggaaacagc

SEQ ID NO: 50645 - DNA, 70 bp, Artificial Sequence
  Synthetic
gccaagcatttaggtgacactatagtggcactgtgggtttcaggcgtttcagagctatgctggaaacagc

SEQ ID NO: 50646 - DNA, 70 bp, Artificial Sequence
  Synthetic
gccaagcatttaggtgacactatagctatcgaggctcgggcagcagtttcagagctatgctggaaacagc

SEQ ID NO: 50647 - DNA, 70 bp, Artificial Sequence
  Synthetic
gccaagcatttaggtgacactatagcctccaagggaacctaggccgtttcagagctatgctggaaacagc

SEQ ID NO: 50648 - DNA, 70 bp, Artificial Sequence
  Synthetic
gccaagcatttaggtgacactataggctgggcactggagctcagggtttcagagctatgctggaaacagc

SEQ ID NO: 50649 - DNA, 70 bp, Artificial Sequence
  Synthetic
gccaagcatttaggtgacactatagtcactgcttctgttgtttcggtttcagagctatgctggaaacagc

SEQ ID NO: 50650 - DNA, 70 bp, Artificial Sequence
  Synthetic
gccaagcatttaggtgacactatagagttcatggtgctagtgttcgtttcagagctatgctggaaacagc

SEQ ID NO: 50651 - DNA, 70 bp, Artificial Sequence
  Synthetic
gccaagcatttaggtgacactatagaggttcagatgtgcgtgtgcgtttcagagctatgctggaaacagc

SEQ ID NO: 50652 - DNA, 70 bp, Artificial Sequence
  Synthetic
gccaagcatttaggtgacactataggaaaagctgttactctgaaggtttcagagctatgctggaaacagc

SEQ ID NO: 50653 - DNA, 70 bp, Artificial Sequence
  Synthetic
gccaagcatttaggtgacactataggtccggagggaggcagtcacgtttcagagctatgctggaaacagc

SEQ ID NO: 50654 - DNA, 70 bp, Artificial Sequence
  Synthetic
gccaagcatttaggtgacactatagcatcttcacggtgtgcagccgtttcagagctatgctggaaacagc

SEQ ID NO: 50655 - DNA, 70 bp, Artificial Sequence
  Synthetic
gccaagcatttaggtgacactatagtgagtctgtaacacatgtgtgtttcagagctatgctggaaacagc

SEQ ID NO: 50656 - DNA, 70 bp, Artificial Sequence
  Synthetic
gccaagcatttaggtgacactatagggcacatccgtggtgtaggtgtttcagagctatgctggaaacagc

SEQ ID NO: 50657 - DNA, 70 bp, Artificial Sequence
  Synthetic
gccaagcatttaggtgacactatagccagctccagagcagccctggtttcagagctatgctggaaacagc

SEQ ID NO: 50658 - DNA, 70 bp, Artificial Sequence
  Synthetic
gccaagcatttaggtgacactatagcacttagagaagagacatgcgtttcagagctatgctggaaacagc

SEQ ID NO: 50659 - DNA, 70 bp, Artificial Sequence
  Synthetic
gccaagcatttaggtgacactatagtctacgccatccaagggactgtttcagagctatgctggaaacagc

SEQ ID NO: 50660 - DNA, 70 bp, Artificial Sequence
  Synthetic
gccaagcatttaggtgacactatagaggaatagaagacgatctcagtttcagagctatgctggaaacagc

SEQ ID NO: 50661 - DNA, 70 bp, Artificial Sequence
  Synthetic
gccaagcatttaggtgacactatagtcttactgtttctaggacctgtttcagagctatgctggaaacagc

SEQ ID NO: 50662 - DNA, 70 bp, Artificial Sequence
  Synthetic
gccaagcatttaggtgacactatagcactacaggcagtacagtgcgtttcagagctatgctggaaacagc

SEQ ID NO: 50663 - DNA, 70 bp, Artificial Sequence
  Synthetic
gccaagcatttaggtgacactatagggcatccacggggctagaaggtttcagagctatgctggaaacagc

SEQ ID NO: 50664 - DNA, 70 bp, Artificial Sequence
  Synthetic
gccaagcatttaggtgacactatagactggacgcattggattagagtttcagagctatgctggaaacagc

SEQ ID NO: 50665 - DNA, 70 bp, Artificial Sequence
  Synthetic
gccaagcatttaggtgacactatagcaggcacagtctcagtgaacgtttcagagctatgctggaaacagc

SEQ ID NO: 50666 - DNA, 70 bp, Artificial Sequence
  Synthetic
gccaagcatttaggtgacactataggggcacttggcctttctcaggtttcagagctatgctggaaacagc

SEQ ID NO: 50667 - DNA, 70 bp, Artificial Sequence
  Synthetic
gccaagcatttaggtgacactatagtgataggaaactaacagacggtttcagagctatgctggaaacagc

SEQ ID NO: 50668 - DNA, 70 bp, Artificial Sequence
  Synthetic
gccaagcatttaggtgacactatagaacgcttagatcttgcttccgtttcagagctatgctggaaacagc

SEQ ID NO: 50669 - DNA, 70 bp, Artificial Sequence
  Synthetic
gccaagcatttaggtgacactataggatgacgatattcgcgctctgtttcagagctatgctggaaacagc

SEQ ID NO: 50670 - DNA, 70 bp, Artificial Sequence
  Synthetic
gccaagcatttaggtgacactatagaccgggatagagaacgggacgtttcagagctatgctggaaacagc

SEQ ID NO: 50671 - DNA, 70 bp, Artificial Sequence
  Synthetic
gccaagcatttaggtgacactataggctccagtggaattacttttgtttcagagctatgctggaaacagc

SEQ ID NO: 50672 - DNA, 70 bp, Artificial Sequence
  Synthetic
gccaagcatttaggtgacactatagttgtctcaagtatctgaactgtttcagagctatgctggaaacagc

SEQ ID NO: 50673 - DNA, 70 bp, Artificial Sequence
  Synthetic
gccaagcatttaggtgacactatagtgatcttttccaagttcccagtttcagagctatgctggaaacagc

SEQ ID NO: 50674 - DNA, 70 bp, Artificial Sequence
  Synthetic
gccaagcatttaggtgacactatagttcccaaggcctacagctgagtttcagagctatgctggaaacagc

SEQ ID NO: 50675 - DNA, 70 bp, Artificial Sequence
  Synthetic
gccaagcatttaggtgacactatagtgctggaaggagtcagaagtgtttcagagctatgctggaaacagc

SEQ ID NO: 50676 - DNA, 70 bp, Artificial Sequence
  Synthetic
gccaagcatttaggtgacactataggcccagaagttaacttttgagtttcagagctatgctggaaacagc

SEQ ID NO: 50677 - DNA, 70 bp, Artificial Sequence
  Synthetic
gccaagcatttaggtgacactatagacatcacatagattgcactcgtttcagagctatgctggaaacagc

SEQ ID NO: 50678 - DNA, 70 bp, Artificial Sequence
  Synthetic
gccaagcatttaggtgacactatagaaaggatgggatccttatgtgtttcagagctatgctggaaacagc

SEQ ID NO: 50679 - DNA, 70 bp, Artificial Sequence
  Synthetic
gccaagcatttaggtgacactatagaacattcatgcagctcttctgtttcagagctatgctggaaacagc

SEQ ID NO: 50680 - DNA, 70 bp, Artificial Sequence
  Synthetic
gccaagcatttaggtgacactatagggagcggctaaggggacagagtttcagagctatgctggaaacagc

SEQ ID NO: 50681 - DNA, 70 bp, Artificial Sequence
  Synthetic
gccaagcatttaggtgacactatagggcagaagagacgacagcgtgtttcagagctatgctggaaacagc

SEQ ID NO: 50682 - DNA, 70 bp, Artificial Sequence
  Synthetic
gccaagcatttaggtgacactatagtagtacttgagcagccagcggtttcagagctatgctggaaacagc

SEQ ID NO: 50683 - DNA, 70 bp, Artificial Sequence
  Synthetic
gccaagcatttaggtgacactatagttcatttgtttgcagagttcgtttcagagctatgctggaaacagc

SEQ ID NO: 50684 - DNA, 70 bp, Artificial Sequence
  Synthetic
gccaagcatttaggtgacactatagtcacatgatgctcttatagtgtttcagagctatgctggaaacagc

SEQ ID NO: 50685 - DNA, 70 bp, Artificial Sequence
  Synthetic
gccaagcatttaggtgacactatagcagtttgtcttctgatcagcgtttcagagctatgctggaaacagc

SEQ ID NO: 50686 - DNA, 70 bp, Artificial Sequence
  Synthetic
gccaagcatttaggtgacactataggaatttatgtccgagagtgagtttcagagctatgctggaaacagc

SEQ ID NO: 50687 - DNA, 70 bp, Artificial Sequence
  Synthetic
gccaagcatttaggtgacactatagggtctacgtccgagagtgaggtttcagagctatgctggaaacagc

SEQ ID NO: 50688 - DNA, 70 bp, Artificial Sequence
  Synthetic
gccaagcatttaggtgacactatagaaatcctgctgtggctgatagtttcagagctatgctggaaacagc

SEQ ID NO: 50689 - DNA, 70 bp, Artificial Sequence
  Synthetic
gccaagcatttaggtgacactatagggtcggaaggaccagtctgagtttcagagctatgctggaaacagc

SEQ ID NO: 50690 - DNA, 70 bp, Artificial Sequence
  Synthetic
gccaagcatttaggtgacactatagagtcactcggggctggtcacgtttcagagctatgctggaaacagc

SEQ ID NO: 50691 - DNA, 70 bp, Artificial Sequence
  Synthetic
gccaagcatttaggtgacactatagtacacggctgcgggatgacagtttcagagctatgctggaaacagc

SEQ ID NO: 50692 - DNA, 70 bp, Artificial Sequence
  Synthetic
gccaagcatttaggtgacactataggggtagacttcataacagaggtttcagagctatgctggaaacagc

SEQ ID NO: 50693 - DNA, 70 bp, Artificial Sequence
  Synthetic
gccaagcatttaggtgacactatagctcacctggagattctgaacgtttcagagctatgctggaaacagc

SEQ ID NO: 50694 - DNA, 70 bp, Artificial Sequence
  Synthetic
gccaagcatttaggtgacactatagctgtggggatgaggacctgagtttcagagctatgctggaaacagc

SEQ ID NO: 50695 - DNA, 70 bp, Artificial Sequence
  Synthetic
gccaagcatttaggtgacactatagtcctgcacatgttggagtgagtttcagagctatgctggaaacagc

SEQ ID NO: 50696 - DNA, 70 bp, Artificial Sequence
  Synthetic
gccaagcatttaggtgacactatagccaccaggacgtgtggtcacgtttcagagctatgctggaaacagc

SEQ ID NO: 50697 - DNA, 70 bp, Artificial Sequence
  Synthetic
gccaagcatttaggtgacactatagagtcctaggggctcagagctgtttcagagctatgctggaaacagc

SEQ ID NO: 50698 - DNA, 70 bp, Artificial Sequence
  Synthetic
gccaagcatttaggtgacactatagtgcaatggagagactgatttgtttcagagctatgctggaaacagc

SEQ ID NO: 50699 - DNA, 70 bp, Artificial Sequence
  Synthetic
gccaagcatttaggtgacactatagaccggaggagagactcatctgtttcagagctatgctggaaacagc

SEQ ID NO: 50700 - DNA, 70 bp, Artificial Sequence
  Synthetic
gccaagcatttaggtgacactatagtcaagttgccgccggaagaggtttcagagctatgctggaaacagc

SEQ ID NO: 50701 - DNA, 70 bp, Artificial Sequence
  Synthetic
gccaagcatttaggtgacactatagtgcaggagaggggacctagagtttcagagctatgctggaaacagc

SEQ ID NO: 50702 - DNA, 70 bp, Artificial Sequence
  Synthetic
gccaagcatttaggtgacactatagatcttcagtgtctgggatcggtttcagagctatgctggaaacagc

SEQ ID NO: 50703 - DNA, 70 bp, Artificial Sequence
  Synthetic
gccaagcatttaggtgacactatagaggacacaattagcctggcagtttcagagctatgctggaaacagc

SEQ ID NO: 50704 - DNA, 70 bp, Artificial Sequence
  Synthetic
gccaagcatttaggtgacactatagccagctgtgctcttctatgcgtttcagagctatgctggaaacagc

SEQ ID NO: 50705 - DNA, 70 bp, Artificial Sequence
  Synthetic
gccaagcatttaggtgacactatagatgctgctccggctgctgaggtttcagagctatgctggaaacagc

SEQ ID NO: 50706 - DNA, 70 bp, Artificial Sequence
  Synthetic
gccaagcatttaggtgacactatagaatctgatttgtggcagtaagtttcagagctatgctggaaacagc

SEQ ID NO: 50707 - DNA, 70 bp, Artificial Sequence
  Synthetic
gccaagcatttaggtgacactatagagcaaccaagttgttgttcagtttcagagctatgctggaaacagc

SEQ ID NO: 50708 - DNA, 70 bp, Artificial Sequence
  Synthetic
gccaagcatttaggtgacactatagattttgcaggacagatactcgtttcagagctatgctggaaacagc

SEQ ID NO: 50709 - DNA, 70 bp, Artificial Sequence
  Synthetic
gccaagcatttaggtgacactatagcaccaccatcaaactctcctgtttcagagctatgctggaaacagc

SEQ ID NO: 50710 - DNA, 70 bp, Artificial Sequence
  Synthetic
gccaagcatttaggtgacactataggtgaacaccactttctaaaggtttcagagctatgctggaaacagc

SEQ ID NO: 50711 - DNA, 70 bp, Artificial Sequence
  Synthetic
gccaagcatttaggtgacactatagtgtaccacagatgttgtagcgtttcagagctatgctggaaacagc

SEQ ID NO: 50712 - DNA, 70 bp, Artificial Sequence
  Synthetic
gccaagcatttaggtgacactatagcgtgcagggctggaggcggcgtttcagagctatgctggaaacagc

SEQ ID NO: 50713 - DNA, 70 bp, Artificial Sequence
  Synthetic
gccaagcatttaggtgacactataggcacagcatcagcagccacggtttcagagctatgctggaaacagc

SEQ ID NO: 50714 - DNA, 70 bp, Artificial Sequence
  Synthetic
gccaagcatttaggtgacactatagcatgcagatgagatgtgagcgtttcagagctatgctggaaacagc

SEQ ID NO: 50715 - DNA, 70 bp, Artificial Sequence
  Synthetic
gccaagcatttaggtgacactatagattcaggtctgttctgtgaggtttcagagctatgctggaaacagc

SEQ ID NO: 50716 - DNA, 70 bp, Artificial Sequence
  Synthetic
gccaagcatttaggtgacactatagacgctagagaagtttgtggagtttcagagctatgctggaaacagc

SEQ ID NO: 50717 - DNA, 70 bp, Artificial Sequence
  Synthetic
gccaagcatttaggtgacactatagcagatgctaatagcaattccgtttcagagctatgctggaaacagc

SEQ ID NO: 50718 - DNA, 70 bp, Artificial Sequence
  Synthetic
gccaagcatttaggtgacactataggctgattacacctttgatgtgtttcagagctatgctggaaacagc

SEQ ID NO: 50719 - DNA, 70 bp, Artificial Sequence
  Synthetic
gccaagcatttaggtgacactatagtagtaatacaaaggtcagtcgtttcagagctatgctggaaacagc

SEQ ID NO: 50720 - DNA, 70 bp, Artificial Sequence
  Synthetic
gccaagcatttaggtgacactatagtaagagaagacgacgccttcgtttcagagctatgctggaaacagc

SEQ ID NO: 50721 - DNA, 70 bp, Artificial Sequence
  Synthetic
gccaagcatttaggtgacactatagtcttctggtgtcacgattttgtttcagagctatgctggaaacagc

SEQ ID NO: 50722 - DNA, 70 bp, Artificial Sequence
  Synthetic
gccaagcatttaggtgacactatagcagttcccagaaaggcctgagtttcagagctatgctggaaacagc

SEQ ID NO: 50723 - DNA, 70 bp, Artificial Sequence
  Synthetic
gccaagcatttaggtgacactatagcaatccagacagtctgaccggtttcagagctatgctggaaacagc

SEQ ID NO: 50724 - DNA, 70 bp, Artificial Sequence
  Synthetic
gccaagcatttaggtgacactataggtgctggagggcttcatcaagtttcagagctatgctggaaacagc

SEQ ID NO: 50725 - DNA, 70 bp, Artificial Sequence
  Synthetic
gccaagcatttaggtgacactataggggtaagtccggcacattacgtttcagagctatgctggaaacagc

SEQ ID NO: 50726 - DNA, 70 bp, Artificial Sequence
  Synthetic
gccaagcatttaggtgacactataggactctcattgaggaactcagtttcagagctatgctggaaacagc

SEQ ID NO: 50727 - DNA, 70 bp, Artificial Sequence
  Synthetic
gccaagcatttaggtgacactataggcatatatcagactagcacggtttcagagctatgctggaaacagc

SEQ ID NO: 50728 - DNA, 70 bp, Artificial Sequence
  Synthetic
gccaagcatttaggtgacactataggggagaacaaatgtctttcagtttcagagctatgctggaaacagc

SEQ ID NO: 50729 - DNA, 70 bp, Artificial Sequence
  Synthetic
gccaagcatttaggtgacactataggtctgggtgtatcctcagcagtttcagagctatgctggaaacagc

SEQ ID NO: 50730 - DNA, 70 bp, Artificial Sequence
  Synthetic
gccaagcatttaggtgacactatagaggaaactcatggagattatgtttcagagctatgctggaaacagc

SEQ ID NO: 50731 - DNA, 70 bp, Artificial Sequence
  Synthetic
gccaagcatttaggtgacactatagatcggggaattctgtttgtcgtttcagagctatgctggaaacagc

SEQ ID NO: 50732 - DNA, 70 bp, Artificial Sequence
  Synthetic
gccaagcatttaggtgacactatagcagtccacagcagtctgagcgtttcagagctatgctggaaacagc

SEQ ID NO: 50733 - DNA, 70 bp, Artificial Sequence
  Synthetic
gccaagcatttaggtgacactataggagagaagccagagcagagggtttcagagctatgctggaaacagc

SEQ ID NO: 50734 - DNA, 70 bp, Artificial Sequence
  Synthetic
gccaagcatttaggtgacactataggcgaccgaggggtcacacaggtttcagagctatgctggaaacagc

SEQ ID NO: 50735 - DNA, 70 bp, Artificial Sequence
  Synthetic
gccaagcatttaggtgacactatagttgcctttcttcacactgttgtttcagagctatgctggaaacagc

SEQ ID NO: 50736 - DNA, 70 bp, Artificial Sequence
  Synthetic
gccaagcatttaggtgacactatagacctggtttacttgaaagtggtttcagagctatgctggaaacagc

SEQ ID NO: 50737 - DNA, 70 bp, Artificial Sequence
  Synthetic
gccaagcatttaggtgacactataggagccgctgtagcctagggcgtttcagagctatgctggaaacagc

SEQ ID NO: 50738 - DNA, 70 bp, Artificial Sequence
  Synthetic
gccaagcatttaggtgacactatagggtgtgaacattggcgatgtgtttcagagctatgctggaaacagc

SEQ ID NO: 50739 - DNA, 70 bp, Artificial Sequence
  Synthetic
gccaagcatttaggtgacactatagtctgcacctcgagataacgtgtttcagagctatgctggaaacagc

SEQ ID NO: 50740 - DNA, 70 bp, Artificial Sequence
  Synthetic
gccaagcatttaggtgacactatagtggtacttttagtagagacagtttcagagctatgctggaaacagc

SEQ ID NO: 50741 - DNA, 70 bp, Artificial Sequence
  Synthetic
gccaagcatttaggtgacactatagctcagtgtcacacagacaaggtttcagagctatgctggaaacagc

SEQ ID NO: 50742 - DNA, 70 bp, Artificial Sequence
  Synthetic
gccaagcatttaggtgacactatagtgacaaacgtagagatatcggtttcagagctatgctggaaacagc

SEQ ID NO: 50743 - DNA, 70 bp, Artificial Sequence
  Synthetic
gccaagcatttaggtgacactataggttactcaaggaaaagtgcagtttcagagctatgctggaaacagc

SEQ ID NO: 50744 - DNA, 70 bp, Artificial Sequence
  Synthetic
gccaagcatttaggtgacactatagaatgctgtttgaacaattgcgtttcagagctatgctggaaacagc

SEQ ID NO: 50745 - DNA, 70 bp, Artificial Sequence
  Synthetic
gccaagcatttaggtgacactatagacagaatcctccaggaggaagtttcagagctatgctggaaacagc

SEQ ID NO: 50746 - DNA, 70 bp, Artificial Sequence
  Synthetic
gccaagcatttaggtgacactatagccttccggatctttgctgtcgtttcagagctatgctggaaacagc

SEQ ID NO: 50747 - DNA, 70 bp, Artificial Sequence
  Synthetic
gccaagcatttaggtgacactatagtactcagctgaagtcctcatgtttcagagctatgctggaaacagc

SEQ ID NO: 50748 - DNA, 70 bp, Artificial Sequence
  Synthetic
gccaagcatttaggtgacactatagtcagtatcggctctgattgggtttcagagctatgctggaaacagc

SEQ ID NO: 50749 - DNA, 70 bp, Artificial Sequence
  Synthetic
gccaagcatttaggtgacactatagagcaatcactcgttttcatcgtttcagagctatgctggaaacagc

SEQ ID NO: 50750 - DNA, 70 bp, Artificial Sequence
  Synthetic
gccaagcatttaggtgacactatagctgagcccctacagcttatcgtttcagagctatgctggaaacagc

SEQ ID NO: 50751 - DNA, 70 bp, Artificial Sequence
  Synthetic
gccaagcatttaggtgacactataggctcctacgtggcgttgtgagtttcagagctatgctggaaacagc

SEQ ID NO: 50752 - DNA, 70 bp, Artificial Sequence
  Synthetic
gccaagcatttaggtgacactatagaacactaacactttccatccgtttcagagctatgctggaaacagc

SEQ ID NO: 50753 - DNA, 70 bp, Artificial Sequence
  Synthetic
gccaagcatttaggtgacactatagttatggccggaagactgttcgtttcagagctatgctggaaacagc

SEQ ID NO: 50754 - DNA, 70 bp, Artificial Sequence
  Synthetic
gccaagcatttaggtgacactatagcgcgcatccacgttcaaccggtttcagagctatgctggaaacagc

SEQ ID NO: 50755 - DNA, 70 bp, Artificial Sequence
  Synthetic
gccaagcatttaggtgacactataggaaaaatcaaagtgctcgaggtttcagagctatgctggaaacagc

SEQ ID NO: 50756 - DNA, 70 bp, Artificial Sequence
  Synthetic
gccaagcatttaggtgacactatagctctcatcgacgtcctcatcgtttcagagctatgctggaaacagc

SEQ ID NO: 50757 - DNA, 70 bp, Artificial Sequence
  Synthetic
gccaagcatttaggtgacactataggagtcggggaagtcatggctgtttcagagctatgctggaaacagc

SEQ ID NO: 50758 - DNA, 70 bp, Artificial Sequence
  Synthetic
gccaagcatttaggtgacactatagccagcaggagctcatttctcgtttcagagctatgctggaaacagc

SEQ ID NO: 50759 - DNA, 70 bp, Artificial Sequence
  Synthetic
gccaagcatttaggtgacactataggctgggagcttcagtcccttgtttcagagctatgctggaaacagc

SEQ ID NO: 50760 - DNA, 70 bp, Artificial Sequence
  Synthetic
gccaagcatttaggtgacactatagatcctgtcccgagactgatggtttcagagctatgctggaaacagc

SEQ ID NO: 50761 - DNA, 70 bp, Artificial Sequence
  Synthetic
gccaagcatttaggtgacactatagttgctctttcaagcaatttcgtttcagagctatgctggaaacagc

SEQ ID NO: 50762 - DNA, 70 bp, Artificial Sequence
  Synthetic
gccaagcatttaggtgacactatagaaaccccagctgtggccctggtttcagagctatgctggaaacagc

SEQ ID NO: 50763 - DNA, 70 bp, Artificial Sequence
  Synthetic
gccaagcatttaggtgacactatagataactgaaggcaaagtccagtttcagagctatgctggaaacagc

SEQ ID NO: 50764 - DNA, 70 bp, Artificial Sequence
  Synthetic
gccaagcatttaggtgacactatagtgcgagcccagctgctgagcgtttcagagctatgctggaaacagc

SEQ ID NO: 50765 - DNA, 70 bp, Artificial Sequence
  Synthetic
gccaagcatttaggtgacactataggagcactacacaatactctcgtttcagagctatgctggaaacagc

SEQ ID NO: 50766 - DNA, 70 bp, Artificial Sequence
  Synthetic
gccaagcatttaggtgacactatagtttggttgctgtgggctagcgtttcagagctatgctggaaacagc

SEQ ID NO: 50767 - DNA, 70 bp, Artificial Sequence
  Synthetic
gccaagcatttaggtgacactatagcggatggaccgcctgtgagcgtttcagagctatgctggaaacagc

SEQ ID NO: 50768 - DNA, 70 bp, Artificial Sequence
  Synthetic
gccaagcatttaggtgacactatagtggtgatgaggtgccctcatgtttcagagctatgctggaaacagc

SEQ ID NO: 50769 - DNA, 70 bp, Artificial Sequence
  Synthetic
gccaagcatttaggtgacactatagtcgaaacgtctcttcaacaggtttcagagctatgctggaaacagc

SEQ ID NO: 50770 - DNA, 70 bp, Artificial Sequence
  Synthetic
gccaagcatttaggtgacactatagggaagtttcagatcttgtaggtttcagagctatgctggaaacagc

SEQ ID NO: 50771 - DNA, 70 bp, Artificial Sequence
  Synthetic
gccaagcatttaggtgacactataggtgctctgtctctggactttgtttcagagctatgctggaaacagc

SEQ ID NO: 50772 - DNA, 70 bp, Artificial Sequence
  Synthetic
gccaagcatttaggtgacactatagaaccccagagctgccgagcagtttcagagctatgctggaaacagc

SEQ ID NO: 50773 - DNA, 70 bp, Artificial Sequence
  Synthetic
gccaagcatttaggtgacactatagaagaaagggcatctatttctgtttcagagctatgctggaaacagc

SEQ ID NO: 50774 - DNA, 70 bp, Artificial Sequence
  Synthetic
gccaagcatttaggtgacactatagagcttttaatcagctactgtgtttcagagctatgctggaaacagc

SEQ ID NO: 50775 - DNA, 70 bp, Artificial Sequence
  Synthetic
gccaagcatttaggtgacactatagggggccgtggagcctagtgcgtttcagagctatgctggaaacagc

SEQ ID NO: 50776 - DNA, 70 bp, Artificial Sequence
  Synthetic
gccaagcatttaggtgacactatagcgcaggatccagcagtgaacgtttcagagctatgctggaaacagc

SEQ ID NO: 50777 - DNA, 70 bp, Artificial Sequence
  Synthetic
gccaagcatttaggtgacactataggagtgaggtgtggactcactgtttcagagctatgctggaaacagc

SEQ ID NO: 50778 - DNA, 70 bp, Artificial Sequence
  Synthetic
gccaagcatttaggtgacactatagatggtggggagggcactagtgtttcagagctatgctggaaacagc

SEQ ID NO: 50779 - DNA, 70 bp, Artificial Sequence
  Synthetic
gccaagcatttaggtgacactatagccgcttccccagcagctgaagtttcagagctatgctggaaacagc

SEQ ID NO: 50780 - DNA, 70 bp, Artificial Sequence
  Synthetic
gccaagcatttaggtgacactatagtgttcaggtatataggaccagtttcagagctatgctggaaacagc

SEQ ID NO: 50781 - DNA, 70 bp, Artificial Sequence
  Synthetic
gccaagcatttaggtgacactataggggaaaagtttcaaagcacggtttcagagctatgctggaaacagc

SEQ ID NO: 50782 - DNA, 70 bp, Artificial Sequence
  Synthetic
gccaagcatttaggtgacactataggggagaagaaacacagaaatgtttcagagctatgctggaaacagc

SEQ ID NO: 50783 - DNA, 70 bp, Artificial Sequence
  Synthetic
gccaagcatttaggtgacactatagaggcacagcttagtacaaatgtttcagagctatgctggaaacagc

SEQ ID NO: 50784 - DNA, 70 bp, Artificial Sequence
  Synthetic
gccaagcatttaggtgacactatagtggctctcttagacgagtcagtttcagagctatgctggaaacagc

SEQ ID NO: 50785 - DNA, 70 bp, Artificial Sequence
  Synthetic
gccaagcatttaggtgacactatagaggctctttgcggagagtgggtttcagagctatgctggaaacagc

SEQ ID NO: 50786 - DNA, 70 bp, Artificial Sequence
  Synthetic
gccaagcatttaggtgacactatagatgccagagtgggctctctggtttcagagctatgctggaaacagc

SEQ ID NO: 50787 - DNA, 70 bp, Artificial Sequence
  Synthetic
gccaagcatttaggtgacactatagtcaatcggttccaggctcaggtttcagagctatgctggaaacagc

SEQ ID NO: 50788 - DNA, 70 bp, Artificial Sequence
  Synthetic
gccaagcatttaggtgacactatagagtcttacagactttaaagcgtttcagagctatgctggaaacagc

SEQ ID NO: 50789 - DNA, 70 bp, Artificial Sequence
  Synthetic
gccaagcatttaggtgacactatagcatgtcattactccacaatggtttcagagctatgctggaaacagc

SEQ ID NO: 50790 - DNA, 70 bp, Artificial Sequence
  Synthetic
gccaagcatttaggtgacactatagctgcacttgactcttcaactgtttcagagctatgctggaaacagc

SEQ ID NO: 50791 - DNA, 70 bp, Artificial Sequence
  Synthetic
gccaagcatttaggtgacactatagatctatgattcctggtcatcgtttcagagctatgctggaaacagc

SEQ ID NO: 50792 - DNA, 70 bp, Artificial Sequence
  Synthetic
gccaagcatttaggtgacactatagattcatggtagtggggctacgtttcagagctatgctggaaacagc

SEQ ID NO: 50793 - DNA, 70 bp, Artificial Sequence
  Synthetic
gccaagcatttaggtgacactatagatttttctgaacagcttccagtttcagagctatgctggaaacagc

SEQ ID NO: 50794 - DNA, 70 bp, Artificial Sequence
  Synthetic
gccaagcatttaggtgacactatagagtttgtggactctaagtcagtttcagagctatgctggaaacagc

SEQ ID NO: 50795 - DNA, 70 bp, Artificial Sequence
  Synthetic
gccaagcatttaggtgacactataggcaagacagagaaggctcacgtttcagagctatgctggaaacagc

SEQ ID NO: 50796 - DNA, 70 bp, Artificial Sequence
  Synthetic
gccaagcatttaggtgacactatagaaggaagttccaggaacaaagtttcagagctatgctggaaacagc

SEQ ID NO: 50797 - DNA, 70 bp, Artificial Sequence
  Synthetic
gccaagcatttaggtgacactatagtggccaggtcgtgggctcctgtttcagagctatgctggaaacagc

SEQ ID NO: 50798 - DNA, 70 bp, Artificial Sequence
  Synthetic
gccaagcatttaggtgacactataggaaagaaagatccgtcaagcgtttcagagctatgctggaaacagc

SEQ ID NO: 50799 - DNA, 70 bp, Artificial Sequence
  Synthetic
gccaagcatttaggtgacactatagagtttaaagcagtgtcacacgtttcagagctatgctggaaacagc

SEQ ID NO: 50800 - DNA, 70 bp, Artificial Sequence
  Synthetic
gccaagcatttaggtgacactatagggtggaactgccagtgtagagtttcagagctatgctggaaacagc

SEQ ID NO: 50801 - DNA, 70 bp, Artificial Sequence
  Synthetic
gccaagcatttaggtgacactatagaacaactatcagttctgctggtttcagagctatgctggaaacagc

SEQ ID NO: 50802 - DNA, 70 bp, Artificial Sequence
  Synthetic
gccaagcatttaggtgacactatagcatctggccggtctcactccgtttcagagctatgctggaaacagc

SEQ ID NO: 50803 - DNA, 70 bp, Artificial Sequence
  Synthetic
gccaagcatttaggtgacactatagtctccgcctccgcgacacgggtttcagagctatgctggaaacagc

SEQ ID NO: 50804 - DNA, 70 bp, Artificial Sequence
  Synthetic
gccaagcatttaggtgacactatagcggggtcttctccaaggttggtttcagagctatgctggaaacagc

SEQ ID NO: 50805 - DNA, 70 bp, Artificial Sequence
  Synthetic
gccaagcatttaggtgacactataggtctcaggtaatttccttcagtttcagagctatgctggaaacagc

SEQ ID NO: 50806 - DNA, 70 bp, Artificial Sequence
  Synthetic
gccaagcatttaggtgacactatagttcagtttgtctttgatctggtttcagagctatgctggaaacagc

SEQ ID NO: 50807 - DNA, 70 bp, Artificial Sequence
  Synthetic
gccaagcatttaggtgacactataggggtctcaacacacctccccgtttcagagctatgctggaaacagc

SEQ ID NO: 50808 - DNA, 70 bp, Artificial Sequence
  Synthetic
gccaagcatttaggtgacactataggggagggcttggctcagggcgtttcagagctatgctggaaacagc

SEQ ID NO: 50809 - DNA, 70 bp, Artificial Sequence
  Synthetic
gccaagcatttaggtgacactataggaggcgctggggagcttctagtttcagagctatgctggaaacagc

SEQ ID NO: 50810 - DNA, 70 bp, Artificial Sequence
  Synthetic
gccaagcatttaggtgacactatagaaacaagcacaaaaggccatgtttcagagctatgctggaaacagc

SEQ ID NO: 50811 - DNA, 70 bp, Artificial Sequence
  Synthetic
gccaagcatttaggtgacactatagtcttctgtttctgtttgcgagtttcagagctatgctggaaacagc

SEQ ID NO: 50812 - DNA, 70 bp, Artificial Sequence
  Synthetic
gccaagcatttaggtgacactatagaggacaaacagtgaagctgtgtttcagagctatgctggaaacagc

SEQ ID NO: 50813 - DNA, 70 bp, Artificial Sequence
  Synthetic
gccaagcatttaggtgacactatagcgttcagatttcctgaccatgtttcagagctatgctggaaacagc

SEQ ID NO: 50814 - DNA, 70 bp, Artificial Sequence
  Synthetic
gccaagcatttaggtgacactatagttttggcgagattttggcttgtttcagagctatgctggaaacagc

SEQ ID NO: 50815 - DNA, 70 bp, Artificial Sequence
  Synthetic
gccaagcatttaggtgacactatagggagggcagctgtggcttctgtttcagagctatgctggaaacagc

SEQ ID NO: 50816 - DNA, 70 bp, Artificial Sequence
  Synthetic
gccaagcatttaggtgacactatagtggaaccccactggcttagagtttcagagctatgctggaaacagc

SEQ ID NO: 50817 - DNA, 70 bp, Artificial Sequence
  Synthetic
gccaagcatttaggtgacactatagagagggtagctgtggcttctgtttcagagctatgctggaaacagc

SEQ ID NO: 50818 - DNA, 70 bp, Artificial Sequence
  Synthetic
gccaagcatttaggtgacactatagagggcagctgtggcttctaggtttcagagctatgctggaaacagc

SEQ ID NO: 50819 - DNA, 70 bp, Artificial Sequence
  Synthetic
gccaagcatttaggtgacactatagaggcggaggccagccgtcacgtttcagagctatgctggaaacagc

SEQ ID NO: 50820 - DNA, 70 bp, Artificial Sequence
  Synthetic
gccaagcatttaggtgacactatagtctgaacacagtctgtacaggtttcagagctatgctggaaacagc

SEQ ID NO: 50821 - DNA, 70 bp, Artificial Sequence
  Synthetic
gccaagcatttaggtgacactatagagacatcatggccagcgagggtttcagagctatgctggaaacagc

SEQ ID NO: 50822 - DNA, 70 bp, Artificial Sequence
  Synthetic
gccaagcatttaggtgacactataggtttgcacaatggtataacggtttcagagctatgctggaaacagc

SEQ ID NO: 50823 - DNA, 70 bp, Artificial Sequence
  Synthetic
gccaagcatttaggtgacactatagaaaataacgtcatgctacaggtttcagagctatgctggaaacagc

SEQ ID NO: 50824 - DNA, 70 bp, Artificial Sequence
  Synthetic
gccaagcatttaggtgacactatagacactaatggggttatgaacgtttcagagctatgctggaaacagc

SEQ ID NO: 50825 - DNA, 70 bp, Artificial Sequence
  Synthetic
gccaagcatttaggtgacactatagccttggtgtttttatgccgtgtttcagagctatgctggaaacagc

SEQ ID NO: 50826 - DNA, 70 bp, Artificial Sequence
  Synthetic
gccaagcatttaggtgacactatagcagcaggcccaaacccccacgtttcagagctatgctggaaacagc

SEQ ID NO: 50827 - DNA, 70 bp, Artificial Sequence
  Synthetic
gccaagcatttaggtgacactatagtttgtcagtttgcttgcctggtttcagagctatgctggaaacagc

SEQ ID NO: 50828 - DNA, 70 bp, Artificial Sequence
  Synthetic
gccaagcatttaggtgacactatagtttcagtttgcttgcctgtcgtttcagagctatgctggaaacagc

SEQ ID NO: 50829 - DNA, 70 bp, Artificial Sequence
  Synthetic
gccaagcatttaggtgacactataggcaataaggagagttctcatgtttcagagctatgctggaaacagc

SEQ ID NO: 50830 - DNA, 70 bp, Artificial Sequence
  Synthetic
gccaagcatttaggtgacactatagagacgagcagctacttgccggtttcagagctatgctggaaacagc

SEQ ID NO: 50831 - DNA, 70 bp, Artificial Sequence
  Synthetic
gccaagcatttaggtgacactatagtttgaccatctcgggaagtggtttcagagctatgctggaaacagc

SEQ ID NO: 50832 - DNA, 70 bp, Artificial Sequence
  Synthetic
gccaagcatttaggtgacactatagtgagctttgtgaccagtgccgtttcagagctatgctggaaacagc

SEQ ID NO: 50833 - DNA, 70 bp, Artificial Sequence
  Synthetic
gccaagcatttaggtgacactatagtgggaggcactggtcacttggtttcagagctatgctggaaacagc

SEQ ID NO: 50834 - DNA, 70 bp, Artificial Sequence
  Synthetic
gccaagcatttaggtgacactatagagcgcctgcagaggtggagggtttcagagctatgctggaaacagc

SEQ ID NO: 50835 - DNA, 70 bp, Artificial Sequence
  Synthetic
gccaagcatttaggtgacactatagtctgtgtccagagtcatttggtttcagagctatgctggaaacagc

SEQ ID NO: 50836 - DNA, 70 bp, Artificial Sequence
  Synthetic
gccaagcatttaggtgacactatagccgctggcgctcagcagtaagtttcagagctatgctggaaacagc

SEQ ID NO: 50837 - DNA, 70 bp, Artificial Sequence
  Synthetic
gccaagcatttaggtgacactatagtgtgctttccagtggtctcagtttcagagctatgctggaaacagc

SEQ ID NO: 50838 - DNA, 70 bp, Artificial Sequence
  Synthetic
gccaagcatttaggtgacactatagatgcctgttccagctgccacgtttcagagctatgctggaaacagc

SEQ ID NO: 50839 - DNA, 70 bp, Artificial Sequence
  Synthetic
gccaagcatttaggtgacactatagaatcagcgaatcgtcttgacgtttcagagctatgctggaaacagc

SEQ ID NO: 50840 - DNA, 70 bp, Artificial Sequence
  Synthetic
gccaagcatttaggtgacactatagaatggccagtactgggtgtggtttcagagctatgctggaaacagc

SEQ ID NO: 50841 - DNA, 70 bp, Artificial Sequence
  Synthetic
gccaagcatttaggtgacactatagcaaaggtgaccaggctgactgtttcagagctatgctggaaacagc

SEQ ID NO: 50842 - DNA, 70 bp, Artificial Sequence
  Synthetic
gccaagcatttaggtgacactatagtgactcctcctctttcaggcgtttcagagctatgctggaaacagc

SEQ ID NO: 50843 - DNA, 70 bp, Artificial Sequence
  Synthetic
gccaagcatttaggtgacactatagcagggcctgtcgactgcacagtttcagagctatgctggaaacagc

SEQ ID NO: 50844 - DNA, 70 bp, Artificial Sequence
  Synthetic
gccaagcatttaggtgacactatagagacatcctggtcctcacacgtttcagagctatgctggaaacagc

SEQ ID NO: 50845 - DNA, 70 bp, Artificial Sequence
  Synthetic
gccaagcatttaggtgacactatagactccctctggcagtgtgacgtttcagagctatgctggaaacagc

SEQ ID NO: 50846 - DNA, 70 bp, Artificial Sequence
  Synthetic
gccaagcatttaggtgacactatagaacagggactgtctcaaccagtttcagagctatgctggaaacagc

SEQ ID NO: 50847 - DNA, 70 bp, Artificial Sequence
  Synthetic
gccaagcatttaggtgacactataggccttggtccactctgagtggtttcagagctatgctggaaacagc

SEQ ID NO: 50848 - DNA, 70 bp, Artificial Sequence
  Synthetic
gccaagcatttaggtgacactatagttggtttgggggtctgcctggtttcagagctatgctggaaacagc

SEQ ID NO: 50849 - DNA, 70 bp, Artificial Sequence
  Synthetic
gccaagcatttaggtgacactataggttcagggtttacatcttacgtttcagagctatgctggaaacagc

SEQ ID NO: 50850 - DNA, 70 bp, Artificial Sequence
  Synthetic
gccaagcatttaggtgacactatagtggaggccttacacaacaaggtttcagagctatgctggaaacagc

SEQ ID NO: 50851 - DNA, 70 bp, Artificial Sequence
  Synthetic
gccaagcatttaggtgacactatagtccaggtgtcaagaatcctagtttcagagctatgctggaaacagc

SEQ ID NO: 50852 - DNA, 70 bp, Artificial Sequence
  Synthetic
gccaagcatttaggtgacactatagcaaaagctgcagcagtgactgtttcagagctatgctggaaacagc

SEQ ID NO: 50853 - DNA, 70 bp, Artificial Sequence
  Synthetic
gccaagcatttaggtgacactatagtccaggtgtcaagaagcctagtttcagagctatgctggaaacagc

SEQ ID NO: 50854 - DNA, 70 bp, Artificial Sequence
  Synthetic
gccaagcatttaggtgacactatagccacctgtcaggacgcctaggtttcagagctatgctggaaacagc

SEQ ID NO: 50855 - DNA, 70 bp, Artificial Sequence
  Synthetic
gccaagcatttaggtgacactatagccaggtgtcaagaagcctaggtttcagagctatgctggaaacagc

SEQ ID NO: 50856 - DNA, 70 bp, Artificial Sequence
  Synthetic
gccaagcatttaggtgacactatagacaagtgccggaaagtctaggtttcagagctatgctggaaacagc

SEQ ID NO: 50857 - DNA, 70 bp, Artificial Sequence
  Synthetic
gccaagcatttaggtgacactatagtctgcacacagttgtgctttgtttcagagctatgctggaaacagc

SEQ ID NO: 50858 - DNA, 70 bp, Artificial Sequence
  Synthetic
gccaagcatttaggtgacactataggaggcgggggtcagtgacaagtttcagagctatgctggaaacagc

SEQ ID NO: 50859 - DNA, 70 bp, Artificial Sequence
  Synthetic
gccaagcatttaggtgacactataggaatggtgaattcactgtgagtttcagagctatgctggaaacagc

SEQ ID NO: 50860 - DNA, 70 bp, Artificial Sequence
  Synthetic
gccaagcatttaggtgacactatagaagccattccgagggacaaagtttcagagctatgctggaaacagc

SEQ ID NO: 50861 - DNA, 70 bp, Artificial Sequence
  Synthetic
gccaagcatttaggtgacactatagtgtgagtgggtttcactcaggtttcagagctatgctggaaacagc

SEQ ID NO: 50862 - DNA, 70 bp, Artificial Sequence
  Synthetic
gccaagcatttaggtgacactatagaacaaggatgacgagctgacgtttcagagctatgctggaaacagc

SEQ ID NO: 50863 - DNA, 70 bp, Artificial Sequence
  Synthetic
gccaagcatttaggtgacactatagccaaagtcaggatcagaaatgtttcagagctatgctggaaacagc

SEQ ID NO: 50864 - DNA, 70 bp, Artificial Sequence
  Synthetic
gccaagcatttaggtgacactatagggagagggtggctcagtcaggtttcagagctatgctggaaacagc

SEQ ID NO: 50865 - DNA, 70 bp, Artificial Sequence
  Synthetic
gccaagcatttaggtgacactatagatccactggagcaccttgatgtttcagagctatgctggaaacagc

SEQ ID NO: 50866 - DNA, 70 bp, Artificial Sequence
  Synthetic
gccaagcatttaggtgacactatagatccactggagcgtcttgaagtttcagagctatgctggaaacagc

SEQ ID NO: 50867 - DNA, 70 bp, Artificial Sequence
  Synthetic
gccaagcatttaggtgacactatagcagcagaagcggattcggtagtttcagagctatgctggaaacagc

SEQ ID NO: 50868 - DNA, 70 bp, Artificial Sequence
  Synthetic
gccaagcatttaggtgacactataggaaactgtacattgaagcaggtttcagagctatgctggaaacagc

SEQ ID NO: 50869 - DNA, 70 bp, Artificial Sequence
  Synthetic
gccaagcatttaggtgacactatagtaaatcctccttgtcctaatgtttcagagctatgctggaaacagc

SEQ ID NO: 50870 - DNA, 70 bp, Artificial Sequence
  Synthetic
gccaagcatttaggtgacactatagtgggcagaaacctcagatgagtttcagagctatgctggaaacagc

SEQ ID NO: 50871 - DNA, 70 bp, Artificial Sequence
  Synthetic
gccaagcatttaggtgacactatagtgcaaggacctactgcagtcgtttcagagctatgctggaaacagc

SEQ ID NO: 50872 - DNA, 70 bp, Artificial Sequence
  Synthetic
gccaagcatttaggtgacactatagagagaaggatgcagaaaacagtttcagagctatgctggaaacagc

SEQ ID NO: 50873 - DNA, 70 bp, Artificial Sequence
  Synthetic
gccaagcatttaggtgacactatagagagaaggatgtggaaaacagtttcagagctatgctggaaacagc

SEQ ID NO: 50874 - DNA, 70 bp, Artificial Sequence
  Synthetic
gccaagcatttaggtgacactataggacggcccaaaagggaacgtgtttcagagctatgctggaaacagc

SEQ ID NO: 50875 - DNA, 70 bp, Artificial Sequence
  Synthetic
gccaagcatttaggtgacactatagtgtcattacgatttatgcacgtttcagagctatgctggaaacagc

SEQ ID NO: 50876 - DNA, 70 bp, Artificial Sequence
  Synthetic
gccaagcatttaggtgacactatagtctggtcagaggagataggagtttcagagctatgctggaaacagc

SEQ ID NO: 50877 - DNA, 70 bp, Artificial Sequence
  Synthetic
gccaagcatttaggtgacactatagacatcctgtacgcttttagggtttcagagctatgctggaaacagc

SEQ ID NO: 50878 - DNA, 70 bp, Artificial Sequence
  Synthetic
gccaagcatttaggtgacactatagctcagcctccctcagggcaggtttcagagctatgctggaaacagc

SEQ ID NO: 50879 - DNA, 70 bp, Artificial Sequence
  Synthetic
gccaagcatttaggtgacactatagcagtcagtcggctaaatgtggtttcagagctatgctggaaacagc

SEQ ID NO: 50880 - DNA, 70 bp, Artificial Sequence
  Synthetic
gccaagcatttaggtgacactatagctcaggctccctcagggcaggtttcagagctatgctggaaacagc

SEQ ID NO: 50881 - DNA, 70 bp, Artificial Sequence
  Synthetic
gccaagcatttaggtgacactatagccccagcccccacattctgagtttcagagctatgctggaaacagc

SEQ ID NO: 50882 - DNA, 70 bp, Artificial Sequence
  Synthetic
gccaagcatttaggtgacactatagaccccaaccccgcattctgagtttcagagctatgctggaaacagc

SEQ ID NO: 50883 - DNA, 70 bp, Artificial Sequence
  Synthetic
gccaagcatttaggtgacactatagaccccaaccccacattctgagtttcagagctatgctggaaacagc

SEQ ID NO: 50884 - DNA, 70 bp, Artificial Sequence
  Synthetic
gccaagcatttaggtgacactataggccagtgaccagttgtagccgtttcagagctatgctggaaacagc

SEQ ID NO: 50885 - DNA, 70 bp, Artificial Sequence
  Synthetic
gccaagcatttaggtgacactatagcattctctgctattgctcgtgtttcagagctatgctggaaacagc

SEQ ID NO: 50886 - DNA, 70 bp, Artificial Sequence
  Synthetic
gccaagcatttaggtgacactataggttcatctctgtaacagcttgtttcagagctatgctggaaacagc

SEQ ID NO: 50887 - DNA, 70 bp, Artificial Sequence
  Synthetic
gccaagcatttaggtgacactatagatccttgcagttcagttaacgtttcagagctatgctggaaacagc

SEQ ID NO: 50888 - DNA, 70 bp, Artificial Sequence
  Synthetic
gccaagcatttaggtgacactataggcacaaggctccgccatcacgtttcagagctatgctggaaacagc

SEQ ID NO: 50889 - DNA, 70 bp, Artificial Sequence
  Synthetic
gccaagcatttaggtgacactataggaggtcaggagtgagagacagtttcagagctatgctggaaacagc

SEQ ID NO: 50890 - DNA, 70 bp, Artificial Sequence
  Synthetic
gccaagcatttaggtgacactatagaacacgatggataagtgagagtttcagagctatgctggaaacagc

SEQ ID NO: 50891 - DNA, 70 bp, Artificial Sequence
  Synthetic
gccaagcatttaggtgacactataggagggagtaggcgcgtcacagtttcagagctatgctggaaacagc

SEQ ID NO: 50892 - DNA, 70 bp, Artificial Sequence
  Synthetic
gccaagcatttaggtgacactataggctacagggacctctctgcagtttcagagctatgctggaaacagc

SEQ ID NO: 50893 - DNA, 70 bp, Artificial Sequence
  Synthetic
gccaagcatttaggtgacactataggcttcatggcatcttagtaggtttcagagctatgctggaaacagc

SEQ ID NO: 50894 - DNA, 70 bp, Artificial Sequence
  Synthetic
gccaagcatttaggtgacactatagtggcaaaggcttttcccgctgtttcagagctatgctggaaacagc

SEQ ID NO: 50895 - DNA, 70 bp, Artificial Sequence
  Synthetic
gccaagcatttaggtgacactatagtgtcaggtgataaatgtttggtttcagagctatgctggaaacagc

SEQ ID NO: 50896 - DNA, 70 bp, Artificial Sequence
  Synthetic
gccaagcatttaggtgacactatagaccttcaccaacatcggctcgtttcagagctatgctggaaacagc

SEQ ID NO: 50897 - DNA, 70 bp, Artificial Sequence
  Synthetic
gccaagcatttaggtgacactatagcaagaggaagctgaatgaaggtttcagagctatgctggaaacagc

SEQ ID NO: 50898 - DNA, 70 bp, Artificial Sequence
  Synthetic
gccaagcatttaggtgacactatagccgctgcccgcgctcacatggtttcagagctatgctggaaacagc

SEQ ID NO: 50899 - DNA, 70 bp, Artificial Sequence
  Synthetic
gccaagcatttaggtgacactatagcttcattcagcttcctcttggtttcagagctatgctggaaacagc

SEQ ID NO: 50900 - DNA, 70 bp, Artificial Sequence
  Synthetic
gccaagcatttaggtgacactatagccacggccagggagctagtggtttcagagctatgctggaaacagc

SEQ ID NO: 50901 - DNA, 70 bp, Artificial Sequence
  Synthetic
gccaagcatttaggtgacactatagttggaagcagggcaggctaagtttcagagctatgctggaaacagc

SEQ ID NO: 50902 - DNA, 70 bp, Artificial Sequence
  Synthetic
gccaagcatttaggtgacactatagtgctgcacagactctgcaatgtttcagagctatgctggaaacagc

SEQ ID NO: 50903 - DNA, 70 bp, Artificial Sequence
  Synthetic
gccaagcatttaggtgacactatagagtctttgtacttaatctgggtttcagagctatgctggaaacagc

SEQ ID NO: 50904 - DNA, 70 bp, Artificial Sequence
  Synthetic
gccaagcatttaggtgacactatagccagctgctgcccgggggctgtttcagagctatgctggaaacagc

SEQ ID NO: 50905 - DNA, 70 bp, Artificial Sequence
  Synthetic
gccaagcatttaggtgacactatagcaggaagatgtacggagacagtttcagagctatgctggaaacagc

SEQ ID NO: 50906 - DNA, 70 bp, Artificial Sequence
  Synthetic
gccaagcatttaggtgacactatagtactagctgtgacttccactgtttcagagctatgctggaaacagc

SEQ ID NO: 50907 - DNA, 70 bp, Artificial Sequence
  Synthetic
gccaagcatttaggtgacactatagaaggagatgcttctactggagtttcagagctatgctggaaacagc

SEQ ID NO: 50908 - DNA, 70 bp, Artificial Sequence
  Synthetic
gccaagcatttaggtgacactataggctgtcaggctgtcagtttcgtttcagagctatgctggaaacagc

SEQ ID NO: 50909 - DNA, 70 bp, Artificial Sequence
  Synthetic
gccaagcatttaggtgacactatagttttcacattctggctctgtgtttcagagctatgctggaaacagc

SEQ ID NO: 50910 - DNA, 70 bp, Artificial Sequence
  Synthetic
gccaagcatttaggtgacactatagcctcagcgagttcaaagctagtttcagagctatgctggaaacagc

SEQ ID NO: 50911 - DNA, 70 bp, Artificial Sequence
  Synthetic
gccaagcatttaggtgacactatagggctgcctggatcagggacagtttcagagctatgctggaaacagc

SEQ ID NO: 50912 - DNA, 70 bp, Artificial Sequence
  Synthetic
gccaagcatttaggtgacactatagttaaaacctatcgtcctagagtttcagagctatgctggaaacagc

SEQ ID NO: 50913 - DNA, 70 bp, Artificial Sequence
  Synthetic
gccaagcatttaggtgacactatagaattcactcatgacttgcaagtttcagagctatgctggaaacagc

SEQ ID NO: 50914 - DNA, 70 bp, Artificial Sequence
  Synthetic
gccaagcatttaggtgacactatagtggaggaatgcattattttcgtttcagagctatgctggaaacagc

SEQ ID NO: 50915 - DNA, 70 bp, Artificial Sequence
  Synthetic
gccaagcatttaggtgacactatagatgggtctcagttacaaatagtttcagagctatgctggaaacagc

SEQ ID NO: 50916 - DNA, 70 bp, Artificial Sequence
  Synthetic
gccaagcatttaggtgacactatagttggactaagagagccatcagtttcagagctatgctggaaacagc

SEQ ID NO: 50917 - DNA, 70 bp, Artificial Sequence
  Synthetic
gccaagcatttaggtgacactatagttacaggtcagtatcaaaccgtttcagagctatgctggaaacagc

SEQ ID NO: 50918 - DNA, 70 bp, Artificial Sequence
  Synthetic
gccaagcatttaggtgacactataggcctgtctcatcttctgaaggtttcagagctatgctggaaacagc

SEQ ID NO: 50919 - DNA, 70 bp, Artificial Sequence
  Synthetic
gccaagcatttaggtgacactataggcttgctggagaacttctaggtttcagagctatgctggaaacagc

SEQ ID NO: 50920 - DNA, 70 bp, Artificial Sequence
  Synthetic
gccaagcatttaggtgacactataggtgctaaatcttctgcatcagtttcagagctatgctggaaacagc

SEQ ID NO: 50921 - DNA, 70 bp, Artificial Sequence
  Synthetic
gccaagcatttaggtgacactatagttggttttggatgatgaggggtttcagagctatgctggaaacagc

SEQ ID NO: 50922 - DNA, 70 bp, Artificial Sequence
  Synthetic
gccaagcatttaggtgacactatagtcccccgactcctgggtgtggtttcagagctatgctggaaacagc

SEQ ID NO: 50923 - DNA, 70 bp, Artificial Sequence
  Synthetic
gccaagcatttaggtgacactataggtttctgcaagcagcttgaagtttcagagctatgctggaaacagc

SEQ ID NO: 50924 - DNA, 70 bp, Artificial Sequence
  Synthetic
gccaagcatttaggtgacactatagtccctgggtgctagttcagcgtttcagagctatgctggaaacagc

SEQ ID NO: 50925 - DNA, 70 bp, Artificial Sequence
  Synthetic
gccaagcatttaggtgacactatagagttcggtgatttcagagtcgtttcagagctatgctggaaacagc

SEQ ID NO: 50926 - DNA, 70 bp, Artificial Sequence
  Synthetic
gccaagcatttaggtgacactatagagagccaaggatagctgagtgtttcagagctatgctggaaacagc

SEQ ID NO: 50927 - DNA, 70 bp, Artificial Sequence
  Synthetic
gccaagcatttaggtgacactatagtgggtcagatgatagtgactgtttcagagctatgctggaaacagc

SEQ ID NO: 50928 - DNA, 70 bp, Artificial Sequence
  Synthetic
gccaagcatttaggtgacactataggagggagccgcgggctcagtgtttcagagctatgctggaaacagc

SEQ ID NO: 50929 - DNA, 70 bp, Artificial Sequence
  Synthetic
gccaagcatttaggtgacactatagtgtgttccatgggtttactggtttcagagctatgctggaaacagc

SEQ ID NO: 50930 - DNA, 70 bp, Artificial Sequence
  Synthetic
gccaagcatttaggtgacactataggcaggagctgcgggctcagtgtttcagagctatgctggaaacagc

SEQ ID NO: 50931 - DNA, 70 bp, Artificial Sequence
  Synthetic
gccaagcatttaggtgacactataggggtgtccgcctacatcgacgtttcagagctatgctggaaacagc

SEQ ID NO: 50932 - DNA, 70 bp, Artificial Sequence
  Synthetic
gccaagcatttaggtgacactatagcctgtggtgagctcagttgtgtttcagagctatgctggaaacagc

SEQ ID NO: 50933 - DNA, 70 bp, Artificial Sequence
  Synthetic
gccaagcatttaggtgacactatagggttgctgtggtcatcagtagtttcagagctatgctggaaacagc

SEQ ID NO: 50934 - DNA, 70 bp, Artificial Sequence
  Synthetic
gccaagcatttaggtgacactatagtccacgcaccgatcagtactgtttcagagctatgctggaaacagc

SEQ ID NO: 50935 - DNA, 70 bp, Artificial Sequence
  Synthetic
gccaagcatttaggtgacactataggaaggcataccctacaatttgtttcagagctatgctggaaacagc

SEQ ID NO: 50936 - DNA, 70 bp, Artificial Sequence
  Synthetic
gccaagcatttaggtgacactataggccacatctgaggaacaaacgtttcagagctatgctggaaacagc

SEQ ID NO: 50937 - DNA, 70 bp, Artificial Sequence
  Synthetic
gccaagcatttaggtgacactatagttagccccaacgtctgttcagtttcagagctatgctggaaacagc

SEQ ID NO: 50938 - DNA, 70 bp, Artificial Sequence
  Synthetic
gccaagcatttaggtgacactataggcggacgccttgggaactaggtttcagagctatgctggaaacagc

SEQ ID NO: 50939 - DNA, 70 bp, Artificial Sequence
  Synthetic
gccaagcatttaggtgacactatagatattcaaggtctgtcagacgtttcagagctatgctggaaacagc

SEQ ID NO: 50940 - DNA, 70 bp, Artificial Sequence
  Synthetic
gccaagcatttaggtgacactataggccccagcagtcccctaagggtttcagagctatgctggaaacagc

SEQ ID NO: 50941 - DNA, 70 bp, Artificial Sequence
  Synthetic
gccaagcatttaggtgacactatagtcggcggtggtggactgaaggtttcagagctatgctggaaacagc

SEQ ID NO: 50942 - DNA, 70 bp, Artificial Sequence
  Synthetic
gccaagcatttaggtgacactatagcgagaagaagagtcagtcacgtttcagagctatgctggaaacagc

SEQ ID NO: 50943 - DNA, 70 bp, Artificial Sequence
  Synthetic
gccaagcatttaggtgacactataggctgccacggctcacaccaggtttcagagctatgctggaaacagc

SEQ ID NO: 50944 - DNA, 70 bp, Artificial Sequence
  Synthetic
gccaagcatttaggtgacactatagggctggctggagtcacatctgtttcagagctatgctggaaacagc

SEQ ID NO: 50945 - DNA, 70 bp, Artificial Sequence
  Synthetic
gccaagcatttaggtgacactatagagctaccccactgtgtgagcgtttcagagctatgctggaaacagc

SEQ ID NO: 50946 - DNA, 70 bp, Artificial Sequence
  Synthetic
gccaagcatttaggtgacactatagggttatgcccatgtcaaaatgtttcagagctatgctggaaacagc

SEQ ID NO: 50947 - DNA, 70 bp, Artificial Sequence
  Synthetic
gccaagcatttaggtgacactatagcctcttacccagaaatctaggtttcagagctatgctggaaacagc

SEQ ID NO: 50948 - DNA, 70 bp, Artificial Sequence
  Synthetic
gccaagcatttaggtgacactatagccatccatcagctcacacatgtttcagagctatgctggaaacagc

SEQ ID NO: 50949 - DNA, 70 bp, Artificial Sequence
  Synthetic
gccaagcatttaggtgacactatagggggccaggtgggttcaggggtttcagagctatgctggaaacagc

SEQ ID NO: 50950 - DNA, 70 bp, Artificial Sequence
  Synthetic
gccaagcatttaggtgacactatagtttggggaccccatcgtttagtttcagagctatgctggaaacagc

SEQ ID NO: 50951 - DNA, 70 bp, Artificial Sequence
  Synthetic
gccaagcatttaggtgacactatagggagcaaaaacacgcttcacgtttcagagctatgctggaaacagc

SEQ ID NO: 50952 - DNA, 70 bp, Artificial Sequence
  Synthetic
gccaagcatttaggtgacactatagtatgtggagctgcggcagtagtttcagagctatgctggaaacagc

SEQ ID NO: 50953 - DNA, 70 bp, Artificial Sequence
  Synthetic
gccaagcatttaggtgacactatagtgtaggcaggcctatttgttgtttcagagctatgctggaaacagc

SEQ ID NO: 50954 - DNA, 70 bp, Artificial Sequence
  Synthetic
gccaagcatttaggtgacactatagccctcctagggactagctgcgtttcagagctatgctggaaacagc

SEQ ID NO: 50955 - DNA, 70 bp, Artificial Sequence
  Synthetic
gccaagcatttaggtgacactatagggaggcccgaagtcgctagagtttcagagctatgctggaaacagc

SEQ ID NO: 50956 - DNA, 70 bp, Artificial Sequence
  Synthetic
gccaagcatttaggtgacactatagcacgtcctcacgctcagctcgtttcagagctatgctggaaacagc

SEQ ID NO: 50957 - DNA, 70 bp, Artificial Sequence
  Synthetic
gccaagcatttaggtgacactataggatccgggactgtctgattggtttcagagctatgctggaaacagc

SEQ ID NO: 50958 - DNA, 70 bp, Artificial Sequence
  Synthetic
gccaagcatttaggtgacactatagcgactacgcgttggtgtgaggtttcagagctatgctggaaacagc

SEQ ID NO: 50959 - DNA, 70 bp, Artificial Sequence
  Synthetic
gccaagcatttaggtgacactatagtagcatgccttcctctacatgtttcagagctatgctggaaacagc

SEQ ID NO: 50960 - DNA, 70 bp, Artificial Sequence
  Synthetic
gccaagcatttaggtgacactataggaccatgcccttgcttaggagtttcagagctatgctggaaacagc

SEQ ID NO: 50961 - DNA, 70 bp, Artificial Sequence
  Synthetic
gccaagcatttaggtgacactataggtgtcttggcaggaaagagagtttcagagctatgctggaaacagc

SEQ ID NO: 50962 - DNA, 70 bp, Artificial Sequence
  Synthetic
gccaagcatttaggtgacactatagttaacttgggacagctaagtgtttcagagctatgctggaaacagc

SEQ ID NO: 50963 - DNA, 70 bp, Artificial Sequence
  Synthetic
gccaagcatttaggtgacactataggtggaggaaggcctgcgagagtttcagagctatgctggaaacagc

SEQ ID NO: 50964 - DNA, 70 bp, Artificial Sequence
  Synthetic
gccaagcatttaggtgacactataggagtccggcgagtgcctcaagtttcagagctatgctggaaacagc

SEQ ID NO: 50965 - DNA, 70 bp, Artificial Sequence
  Synthetic
gccaagcatttaggtgacactatagaaaggacacctacagttactgtttcagagctatgctggaaacagc

SEQ ID NO: 50966 - DNA, 70 bp, Artificial Sequence
  Synthetic
gccaagcatttaggtgacactatagtgtattcatctgccgacgccgtttcagagctatgctggaaacagc

SEQ ID NO: 50967 - DNA, 70 bp, Artificial Sequence
  Synthetic
gccaagcatttaggtgacactataggtgtatactttgcgatcctcgtttcagagctatgctggaaacagc

SEQ ID NO: 50968 - DNA, 70 bp, Artificial Sequence
  Synthetic
gccaagcatttaggtgacactatagagatgcgtcaggccacgtaggtttcagagctatgctggaaacagc

SEQ ID NO: 50969 - DNA, 70 bp, Artificial Sequence
  Synthetic
gccaagcatttaggtgacactatagtttaattgaccgggactacagtttcagagctatgctggaaacagc

SEQ ID NO: 50970 - DNA, 70 bp, Artificial Sequence
  Synthetic
gccaagcatttaggtgacactatagactacgaatactaagaacccgtttcagagctatgctggaaacagc

SEQ ID NO: 50971 - DNA, 70 bp, Artificial Sequence
  Synthetic
gccaagcatttaggtgacactataggaccccaagtctagggctacgtttcagagctatgctggaaacagc

SEQ ID NO: 50972 - DNA, 70 bp, Artificial Sequence
  Synthetic
gccaagcatttaggtgacactataggatgaggcctatgactgagggtttcagagctatgctggaaacagc

SEQ ID NO: 50973 - DNA, 70 bp, Artificial Sequence
  Synthetic
gccaagcatttaggtgacactatagggaacagggctcatcatggcgtttcagagctatgctggaaacagc

SEQ ID NO: 50974 - DNA, 70 bp, Artificial Sequence
  Synthetic
gccaagcatttaggtgacactatagcagagaggtctggctacaccgtttcagagctatgctggaaacagc

SEQ ID NO: 50975 - DNA, 70 bp, Artificial Sequence
  Synthetic
gccaagcatttaggtgacactataggggctgcggctggtgacttggtttcagagctatgctggaaacagc

SEQ ID NO: 50976 - DNA, 70 bp, Artificial Sequence
  Synthetic
gccaagcatttaggtgacactatagtatcgaatgggagttctgaggtttcagagctatgctggaaacagc

SEQ ID NO: 50977 - DNA, 70 bp, Artificial Sequence
  Synthetic
gccaagcatttaggtgacactatagccctggagtgggagttctgagtttcagagctatgctggaaacagc

SEQ ID NO: 50978 - DNA, 70 bp, Artificial Sequence
  Synthetic
gccaagcatttaggtgacactataggttaatagttctgcagcttcgtttcagagctatgctggaaacagc

SEQ ID NO: 50979 - DNA, 70 bp, Artificial Sequence
  Synthetic
gccaagcatttaggtgacactataggtcttcaagaactgtgcaaagtttcagagctatgctggaaacagc

SEQ ID NO: 50980 - DNA, 70 bp, Artificial Sequence
  Synthetic
gccaagcatttaggtgacactatagctggagacttttctcttcgcgtttcagagctatgctggaaacagc

SEQ ID NO: 50981 - DNA, 70 bp, Artificial Sequence
  Synthetic
gccaagcatttaggtgacactatagacagagaacttcggtagctcgtttcagagctatgctggaaacagc

SEQ ID NO: 50982 - DNA, 70 bp, Artificial Sequence
  Synthetic
gccaagcatttaggtgacactataggtcacatgtacttcagtttggtttcagagctatgctggaaacagc

SEQ ID NO: 50983 - DNA, 70 bp, Artificial Sequence
  Synthetic
gccaagcatttaggtgacactatagtcataaaaaaacaagcagccgtttcagagctatgctggaaacagc

SEQ ID NO: 50984 - DNA, 70 bp, Artificial Sequence
  Synthetic
gccaagcatttaggtgacactatagtccagtgaataaaagaaggagtttcagagctatgctggaaacagc

SEQ ID NO: 50985 - DNA, 70 bp, Artificial Sequence
  Synthetic
gccaagcatttaggtgacactatagtgctatttgagatctgcagtgtttcagagctatgctggaaacagc

SEQ ID NO: 50986 - DNA, 70 bp, Artificial Sequence
  Synthetic
gccaagcatttaggtgacactatagtgagccctatgactttactcgtttcagagctatgctggaaacagc

SEQ ID NO: 50987 - DNA, 70 bp, Artificial Sequence
  Synthetic
gccaagcatttaggtgacactatagcactgcagtttgctcagtgggtttcagagctatgctggaaacagc

SEQ ID NO: 50988 - DNA, 70 bp, Artificial Sequence
  Synthetic
gccaagcatttaggtgacactatagagatttggatcctacaaagagtttcagagctatgctggaaacagc

SEQ ID NO: 50989 - DNA, 70 bp, Artificial Sequence
  Synthetic
gccaagcatttaggtgacactatagacaggccagaggagttcacagtttcagagctatgctggaaacagc

SEQ ID NO: 50990 - DNA, 70 bp, Artificial Sequence
  Synthetic
gccaagcatttaggtgacactatagtgcattgctccttctctgaagtttcagagctatgctggaaacagc

SEQ ID NO: 50991 - DNA, 70 bp, Artificial Sequence
  Synthetic
gccaagcatttaggtgacactatagttccagcacagagcaaggatgtttcagagctatgctggaaacagc

SEQ ID NO: 50992 - DNA, 70 bp, Artificial Sequence
  Synthetic
gccaagcatttaggtgacactatagtccactgccagaagctacatgtttcagagctatgctggaaacagc

SEQ ID NO: 50993 - DNA, 70 bp, Artificial Sequence
  Synthetic
gccaagcatttaggtgacactatagaagtacccttacaagactgagtttcagagctatgctggaaacagc

SEQ ID NO: 50994 - DNA, 70 bp, Artificial Sequence
  Synthetic
gccaagcatttaggtgacactatagttaggggcagctaccttagcgtttcagagctatgctggaaacagc

SEQ ID NO: 50995 - DNA, 70 bp, Artificial Sequence
  Synthetic
gccaagcatttaggtgacactatagcctcctcccttctggtcagtgtttcagagctatgctggaaacagc

SEQ ID NO: 50996 - DNA, 70 bp, Artificial Sequence
  Synthetic
gccaagcatttaggtgacactatagtgaaagcagttagcaaggaagtttcagagctatgctggaaacagc

SEQ ID NO: 50997 - DNA, 70 bp, Artificial Sequence
  Synthetic
gccaagcatttaggtgacactatagatcccaaatcgaagcaagcagtttcagagctatgctggaaacagc

SEQ ID NO: 50998 - DNA, 70 bp, Artificial Sequence
  Synthetic
gccaagcatttaggtgacactatagtttttcagatgctcttttccgtttcagagctatgctggaaacagc

SEQ ID NO: 50999 - DNA, 70 bp, Artificial Sequence
  Synthetic
gccaagcatttaggtgacactatagcctctcctggggatgtgtaagtttcagagctatgctggaaacagc

SEQ ID NO: 51000 - DNA, 70 bp, Artificial Sequence
  Synthetic
gccaagcatttaggtgacactatagaaagtggattcaggagtaccgtttcagagctatgctggaaacagc

SEQ ID NO: 51001 - DNA, 70 bp, Artificial Sequence
  Synthetic
gccaagcatttaggtgacactatagacttgtttaaagctttctccgtttcagagctatgctggaaacagc

SEQ ID NO: 51002 - DNA, 70 bp, Artificial Sequence
  Synthetic
gccaagcatttaggtgacactatagagagaaaggctgcccagaaagtttcagagctatgctggaaacagc

SEQ ID NO: 51003 - DNA, 70 bp, Artificial Sequence
  Synthetic
gccaagcatttaggtgacactataggccttcactaggctttgcccgtttcagagctatgctggaaacagc

SEQ ID NO: 51004 - DNA, 70 bp, Artificial Sequence
  Synthetic
gccaagcatttaggtgacactatagtttctcttaaacactggaacgtttcagagctatgctggaaacagc

SEQ ID NO: 51005 - DNA, 70 bp, Artificial Sequence
  Synthetic
gccaagcatttaggtgacactatagacgcctggaacgagaagcgcgtttcagagctatgctggaaacagc

SEQ ID NO: 51006 - DNA, 70 bp, Artificial Sequence
  Synthetic
gccaagcatttaggtgacactatagttggctcaggtattagagtcgtttcagagctatgctggaaacagc

SEQ ID NO: 51007 - DNA, 70 bp, Artificial Sequence
  Synthetic
gccaagcatttaggtgacactatagggcgctcagagctcctacaagtttcagagctatgctggaaacagc

SEQ ID NO: 51008 - DNA, 70 bp, Artificial Sequence
  Synthetic
gccaagcatttaggtgacactatagcctccttccttctggtcagtgtttcagagctatgctggaaacagc

SEQ ID NO: 51009 - DNA, 70 bp, Artificial Sequence
  Synthetic
gccaagcatttaggtgacactatagcttacttctctcctgtcagtgtttcagagctatgctggaaacagc

SEQ ID NO: 51010 - DNA, 70 bp, Artificial Sequence
  Synthetic
gccaagcatttaggtgacactatagttctttagaaaaggggcttcgtttcagagctatgctggaaacagc

SEQ ID NO: 51011 - DNA, 70 bp, Artificial Sequence
  Synthetic
gccaagcatttaggtgacactatagttgtggagaagtttttgaaggtttcagagctatgctggaaacagc

SEQ ID NO: 51012 - DNA, 70 bp, Artificial Sequence
  Synthetic
gccaagcatttaggtgacactatagcccagattcagcagatgtgagtttcagagctatgctggaaacagc

SEQ ID NO: 51013 - DNA, 70 bp, Artificial Sequence
  Synthetic
gccaagcatttaggtgacactatagccttcatcgatggttttcaggtttcagagctatgctggaaacagc

SEQ ID NO: 51014 - DNA, 70 bp, Artificial Sequence
  Synthetic
gccaagcatttaggtgacactatagcaggaggtcttagagagtaggtttcagagctatgctggaaacagc

SEQ ID NO: 51015 - DNA, 70 bp, Artificial Sequence
  Synthetic
gccaagcatttaggtgacactataggcctcctactcgggcttgtggtttcagagctatgctggaaacagc

SEQ ID NO: 51016 - DNA, 70 bp, Artificial Sequence
  Synthetic
gccaagcatttaggtgacactatagtcttttacatctgtgttagcgtttcagagctatgctggaaacagc

SEQ ID NO: 51017 - DNA, 70 bp, Artificial Sequence
  Synthetic
gccaagcatttaggtgacactatagcacctctctcaccacgttctgtttcagagctatgctggaaacagc

SEQ ID NO: 51018 - DNA, 70 bp, Artificial Sequence
  Synthetic
gccaagcatttaggtgacactatagaccctggcaaggcctataacgtttcagagctatgctggaaacagc

SEQ ID NO: 51019 - DNA, 70 bp, Artificial Sequence
  Synthetic
gccaagcatttaggtgacactatagagcaatgtaaatccatagaggtttcagagctatgctggaaacagc

SEQ ID NO: 51020 - DNA, 70 bp, Artificial Sequence
  Synthetic
gccaagcatttaggtgacactatagggtgttatctcagcatacacgtttcagagctatgctggaaacagc

SEQ ID NO: 51021 - DNA, 70 bp, Artificial Sequence
  Synthetic
gccaagcatttaggtgacactatagtttgcaatctgggtaacgatgtttcagagctatgctggaaacagc

SEQ ID NO: 51022 - DNA, 70 bp, Artificial Sequence
  Synthetic
gccaagcatttaggtgacactatagacacctgacaggaaggcctggtttcagagctatgctggaaacagc

SEQ ID NO: 51023 - DNA, 70 bp, Artificial Sequence
  Synthetic
gccaagcatttaggtgacactataggagacaaacacctgacaggagtttcagagctatgctggaaacagc

SEQ ID NO: 51024 - DNA, 70 bp, Artificial Sequence
  Synthetic
gccaagcatttaggtgacactatagcatacctaggaaaggaggcagtttcagagctatgctggaaacagc

SEQ ID NO: 51025 - DNA, 70 bp, Artificial Sequence
  Synthetic
gccaagcatttaggtgacactatagtgtcacacttcatgccccaagtttcagagctatgctggaaacagc

SEQ ID NO: 51026 - DNA, 70 bp, Artificial Sequence
  Synthetic
gccaagcatttaggtgacactatagtttggtcgaggagtgatagcgtttcagagctatgctggaaacagc

SEQ ID NO: 51027 - DNA, 70 bp, Artificial Sequence
  Synthetic
gccaagcatttaggtgacactataggttcctcactgacaagttccgtttcagagctatgctggaaacagc

SEQ ID NO: 51028 - DNA, 70 bp, Artificial Sequence
  Synthetic
gccaagcatttaggtgacactatagctagagacatcacagaactggtttcagagctatgctggaaacagc

SEQ ID NO: 51029 - DNA, 70 bp, Artificial Sequence
  Synthetic
gccaagcatttaggtgacactataggacaaccagttcaaataaccgtttcagagctatgctggaaacagc

SEQ ID NO: 51030 - DNA, 70 bp, Artificial Sequence
  Synthetic
gccaagcatttaggtgacactatagagtgcatatcgtcggtatctgtttcagagctatgctggaaacagc

SEQ ID NO: 51031 - DNA, 70 bp, Artificial Sequence
  Synthetic
gccaagcatttaggtgacactatagcacaatgtcaaaagatggaggtttcagagctatgctggaaacagc

SEQ ID NO: 51032 - DNA, 70 bp, Artificial Sequence
  Synthetic
gccaagcatttaggtgacactataggcttggtggttttattgagtgtttcagagctatgctggaaacagc

SEQ ID NO: 51033 - DNA, 70 bp, Artificial Sequence
  Synthetic
gccaagcatttaggtgacactatagtgttgagctcctaatcatttgtttcagagctatgctggaaacagc

SEQ ID NO: 51034 - DNA, 70 bp, Artificial Sequence
  Synthetic
gccaagcatttaggtgacactatagcttatagagggtcacggctcgtttcagagctatgctggaaacagc

SEQ ID NO: 51035 - DNA, 70 bp, Artificial Sequence
  Synthetic
gccaagcatttaggtgacactataggtccgggccaggaggctcaggtttcagagctatgctggaaacagc

SEQ ID NO: 51036 - DNA, 70 bp, Artificial Sequence
  Synthetic
gccaagcatttaggtgacactatagccagcgctgaagcattccgagtttcagagctatgctggaaacagc

SEQ ID NO: 51037 - DNA, 70 bp, Artificial Sequence
  Synthetic
gccaagcatttaggtgacactatagccttccggtggtttcagtgagtttcagagctatgctggaaacagc

SEQ ID NO: 51038 - DNA, 70 bp, Artificial Sequence
  Synthetic
gccaagcatttaggtgacactataggggccggccgggcgcatcacgtttcagagctatgctggaaacagc

SEQ ID NO: 51039 - DNA, 70 bp, Artificial Sequence
  Synthetic
gccaagcatttaggtgacactatagtcttgggagagcaggtcaccgtttcagagctatgctggaaacagc

SEQ ID NO: 51040 - DNA, 70 bp, Artificial Sequence
  Synthetic
gccaagcatttaggtgacactatagttcactccccatcatgcagcgtttcagagctatgctggaaacagc

SEQ ID NO: 51041 - DNA, 70 bp, Artificial Sequence
  Synthetic
gccaagcatttaggtgacactatagctacttgccgaggaagaaaagtttcagagctatgctggaaacagc

SEQ ID NO: 51042 - DNA, 70 bp, Artificial Sequence
  Synthetic
gccaagcatttaggtgacactatagggctgggaagagctcatggtgtttcagagctatgctggaaacagc

SEQ ID NO: 51043 - DNA, 70 bp, Artificial Sequence
  Synthetic
gccaagcatttaggtgacactataggtatcgcctatacatggcaggtttcagagctatgctggaaacagc

SEQ ID NO: 51044 - DNA, 70 bp, Artificial Sequence
  Synthetic
gccaagcatttaggtgacactatagaccaaagttaaacaagcctcgtttcagagctatgctggaaacagc

SEQ ID NO: 51045 - DNA, 70 bp, Artificial Sequence
  Synthetic
gccaagcatttaggtgacactataggaaagcaaatcctcctgagggtttcagagctatgctggaaacagc

SEQ ID NO: 51046 - DNA, 70 bp, Artificial Sequence
  Synthetic
gccaagcatttaggtgacactataggctacacgtggaaatatgaagtttcagagctatgctggaaacagc

SEQ ID NO: 51047 - DNA, 70 bp, Artificial Sequence
  Synthetic
gccaagcatttaggtgacactatagtgatgatctcacggagttgtgtttcagagctatgctggaaacagc

SEQ ID NO: 51048 - DNA, 70 bp, Artificial Sequence
  Synthetic
gccaagcatttaggtgacactataggaagaggctacggcttagaggtttcagagctatgctggaaacagc

SEQ ID NO: 51049 - DNA, 70 bp, Artificial Sequence
  Synthetic
gccaagcatttaggtgacactataggaagctggaggatgctcagtgtttcagagctatgctggaaacagc

SEQ ID NO: 51050 - DNA, 70 bp, Artificial Sequence
  Synthetic
gccaagcatttaggtgacactataggagcacgtggaggtgttagtgtttcagagctatgctggaaacagc

SEQ ID NO: 51051 - DNA, 70 bp, Artificial Sequence
  Synthetic
gccaagcatttaggtgacactatagaaggtgctccttgatcatgtgtttcagagctatgctggaaacagc

SEQ ID NO: 51052 - DNA, 70 bp, Artificial Sequence
  Synthetic
gccaagcatttaggtgacactatagagcgctgcttcgtcttctgagtttcagagctatgctggaaacagc

SEQ ID NO: 51053 - DNA, 70 bp, Artificial Sequence
  Synthetic
gccaagcatttaggtgacactatagccagtgccatttacagaacagtttcagagctatgctggaaacagc

SEQ ID NO: 51054 - DNA, 70 bp, Artificial Sequence
  Synthetic
gccaagcatttaggtgacactatagagagaggccagggctagaaggtttcagagctatgctggaaacagc

SEQ ID NO: 51055 - DNA, 70 bp, Artificial Sequence
  Synthetic
gccaagcatttaggtgacactatagctttgctatttgctagctgcgtttcagagctatgctggaaacagc

SEQ ID NO: 51056 - DNA, 70 bp, Artificial Sequence
  Synthetic
gccaagcatttaggtgacactataggcgaggtcacacgacctcgtgtttcagagctatgctggaaacagc

SEQ ID NO: 51057 - DNA, 70 bp, Artificial Sequence
  Synthetic
gccaagcatttaggtgacactatagaaaatgaaatgcactccccggtttcagagctatgctggaaacagc

SEQ ID NO: 51058 - DNA, 70 bp, Artificial Sequence
  Synthetic
gccaagcatttaggtgacactatagaccgcaatggaaacgtcctagtttcagagctatgctggaaacagc

SEQ ID NO: 51059 - DNA, 70 bp, Artificial Sequence
  Synthetic
gccaagcatttaggtgacactatagacttagctctggatgaggctgtttcagagctatgctggaaacagc

SEQ ID NO: 51060 - DNA, 70 bp, Artificial Sequence
  Synthetic
gccaagcatttaggtgacactatagagacactggacagggtcactgtttcagagctatgctggaaacagc

SEQ ID NO: 51061 - DNA, 70 bp, Artificial Sequence
  Synthetic
gccaagcatttaggtgacactatagctttgtcggcattaagaagagtttcagagctatgctggaaacagc

SEQ ID NO: 51062 - DNA, 70 bp, Artificial Sequence
  Synthetic
gccaagcatttaggtgacactatagagtccctcgccagcagctgagtttcagagctatgctggaaacagc

SEQ ID NO: 51063 - DNA, 70 bp, Artificial Sequence
  Synthetic
gccaagcatttaggtgacactatagaggatcttctgcttagcaaggtttcagagctatgctggaaacagc

SEQ ID NO: 51064 - DNA, 70 bp, Artificial Sequence
  Synthetic
gccaagcatttaggtgacactatagactgccctcttcggggccgtgtttcagagctatgctggaaacagc

SEQ ID NO: 51065 - DNA, 70 bp, Artificial Sequence
  Synthetic
gccaagcatttaggtgacactatagtatccaactgtcactcccacgtttcagagctatgctggaaacagc

SEQ ID NO: 51066 - DNA, 70 bp, Artificial Sequence
  Synthetic
gccaagcatttaggtgacactatagttccagatacagaagtaggggtttcagagctatgctggaaacagc

SEQ ID NO: 51067 - DNA, 70 bp, Artificial Sequence
  Synthetic
gccaagcatttaggtgacactatagtaaagcagcttatgaatccagtttcagagctatgctggaaacagc

SEQ ID NO: 51068 - DNA, 70 bp, Artificial Sequence
  Synthetic
gccaagcatttaggtgacactatagtgcaaagaagaagggcaagtgtttcagagctatgctggaaacagc

SEQ ID NO: 51069 - DNA, 70 bp, Artificial Sequence
  Synthetic
gccaagcatttaggtgacactatagacaaactcattgttggactcgtttcagagctatgctggaaacagc

SEQ ID NO: 51070 - DNA, 70 bp, Artificial Sequence
  Synthetic
gccaagcatttaggtgacactatagccatcctctctgatcactgcgtttcagagctatgctggaaacagc

SEQ ID NO: 51071 - DNA, 70 bp, Artificial Sequence
  Synthetic
gccaagcatttaggtgacactataggcagagacgtgattagttgagtttcagagctatgctggaaacagc

SEQ ID NO: 51072 - DNA, 70 bp, Artificial Sequence
  Synthetic
gccaagcatttaggtgacactatagagttaatcgctctgaaagtggtttcagagctatgctggaaacagc

SEQ ID NO: 51073 - DNA, 70 bp, Artificial Sequence
  Synthetic
gccaagcatttaggtgacactatagaggctgagggtagcacctaagtttcagagctatgctggaaacagc

SEQ ID NO: 51074 - DNA, 70 bp, Artificial Sequence
  Synthetic
gccaagcatttaggtgacactatagaagaaactcagacaggtgtcgtttcagagctatgctggaaacagc

SEQ ID NO: 51075 - DNA, 70 bp, Artificial Sequence
  Synthetic
gccaagcatttaggtgacactatagccaaatgcagctgcgctcttgtttcagagctatgctggaaacagc

SEQ ID NO: 51076 - DNA, 70 bp, Artificial Sequence
  Synthetic
gccaagcatttaggtgacactataggtggtgtcttcttcaattgagtttcagagctatgctggaaacagc

SEQ ID NO: 51077 - DNA, 70 bp, Artificial Sequence
  Synthetic
gccaagcatttaggtgacactataggcttgcctcttgcttcttatgtttcagagctatgctggaaacagc

SEQ ID NO: 51078 - DNA, 70 bp, Artificial Sequence
  Synthetic
gccaagcatttaggtgacactatagcatcatcaagggaagaagctgtttcagagctatgctggaaacagc

SEQ ID NO: 51079 - DNA, 70 bp, Artificial Sequence
  Synthetic
gccaagcatttaggtgacactatagccgggccagagccagtgatggtttcagagctatgctggaaacagc

SEQ ID NO: 51080 - DNA, 70 bp, Artificial Sequence
  Synthetic
gccaagcatttaggtgacactatagttatcgctggcaaaacgcgagtttcagagctatgctggaaacagc

SEQ ID NO: 51081 - DNA, 70 bp, Artificial Sequence
  Synthetic
gccaagcatttaggtgacactatagaagctcatcagatttccccagtttcagagctatgctggaaacagc

SEQ ID NO: 51082 - DNA, 70 bp, Artificial Sequence
  Synthetic
gccaagcatttaggtgacactataggtgggtcttgggttagactggtttcagagctatgctggaaacagc

SEQ ID NO: 51083 - DNA, 70 bp, Artificial Sequence
  Synthetic
gccaagcatttaggtgacactatagcgccttcggttgcggggaatgtttcagagctatgctggaaacagc

SEQ ID NO: 51084 - DNA, 70 bp, Artificial Sequence
  Synthetic
gccaagcatttaggtgacactatagcagctcagcactgtctctgcgtttcagagctatgctggaaacagc

SEQ ID NO: 51085 - DNA, 70 bp, Artificial Sequence
  Synthetic
gccaagcatttaggtgacactataggagcatcaacctacagttttgtttcagagctatgctggaaacagc

SEQ ID NO: 51086 - DNA, 70 bp, Artificial Sequence
  Synthetic
gccaagcatttaggtgacactatagttctgttaacaaatcgcacggtttcagagctatgctggaaacagc

SEQ ID NO: 51087 - DNA, 70 bp, Artificial Sequence
  Synthetic
gccaagcatttaggtgacactatagccagcacagccctcgctcaggtttcagagctatgctggaaacagc

SEQ ID NO: 51088 - DNA, 70 bp, Artificial Sequence
  Synthetic
gccaagcatttaggtgacactatagccggcacagccctcgctcaggtttcagagctatgctggaaacagc

SEQ ID NO: 51089 - DNA, 70 bp, Artificial Sequence
  Synthetic
gccaagcatttaggtgacactatagcgcttcctgccccgctgaaggtttcagagctatgctggaaacagc

SEQ ID NO: 51090 - DNA, 70 bp, Artificial Sequence
  Synthetic
gccaagcatttaggtgacactatagctatctgcccttcttcagacgtttcagagctatgctggaaacagc

SEQ ID NO: 51091 - DNA, 70 bp, Artificial Sequence
  Synthetic
gccaagcatttaggtgacactatagccatctgtgcttcttcagacgtttcagagctatgctggaaacagc

SEQ ID NO: 51092 - DNA, 70 bp, Artificial Sequence
  Synthetic
gccaagcatttaggtgacactatagtgggctagcattcttcagacgtttcagagctatgctggaaacagc

SEQ ID NO: 51093 - DNA, 70 bp, Artificial Sequence
  Synthetic
gccaagcatttaggtgacactatagccatctgctcttcttcagacgtttcagagctatgctggaaacagc

SEQ ID NO: 51094 - DNA, 70 bp, Artificial Sequence
  Synthetic
gccaagcatttaggtgacactatagtgtgctgtgccccgctagaagtttcagagctatgctggaaacagc

SEQ ID NO: 51095 - DNA, 70 bp, Artificial Sequence
  Synthetic
gccaagcatttaggtgacactataggtcctccacacactcatgaggtttcagagctatgctggaaacagc

SEQ ID NO: 51096 - DNA, 70 bp, Artificial Sequence
  Synthetic
gccaagcatttaggtgacactataggaagggccggggcgttagcggtttcagagctatgctggaaacagc

SEQ ID NO: 51097 - DNA, 70 bp, Artificial Sequence
  Synthetic
gccaagcatttaggtgacactatagccgcctctgcgctgttcctcgtttcagagctatgctggaaacagc

SEQ ID NO: 51098 - DNA, 70 bp, Artificial Sequence
  Synthetic
gccaagcatttaggtgacactatagagcgtctttcagcacagatggtttcagagctatgctggaaacagc

SEQ ID NO: 51099 - DNA, 70 bp, Artificial Sequence
  Synthetic
gccaagcatttaggtgacactatagccaagttgccttccttcatcgtttcagagctatgctggaaacagc

SEQ ID NO: 51100 - DNA, 70 bp, Artificial Sequence
  Synthetic
gccaagcatttaggtgacactatagcccctcctgactggaagattgtttcagagctatgctggaaacagc

SEQ ID NO: 51101 - DNA, 70 bp, Artificial Sequence
  Synthetic
gccaagcatttaggtgacactataggtgtgcggtgcccaggccctgtttcagagctatgctggaaacagc

SEQ ID NO: 51102 - DNA, 70 bp, Artificial Sequence
  Synthetic
gccaagcatttaggtgacactatagtcaattcggcattgcccttcgtttcagagctatgctggaaacagc

SEQ ID NO: 51103 - DNA, 70 bp, Artificial Sequence
  Synthetic
gccaagcatttaggtgacactataggaaaattcaggctccacttagtttcagagctatgctggaaacagc

SEQ ID NO: 51104 - DNA, 70 bp, Artificial Sequence
  Synthetic
gccaagcatttaggtgacactatagctttcagggcagaacttctcgtttcagagctatgctggaaacagc

SEQ ID NO: 51105 - DNA, 70 bp, Artificial Sequence
  Synthetic
gccaagcatttaggtgacactatagttaagagatgggattacaaggtttcagagctatgctggaaacagc

SEQ ID NO: 51106 - DNA, 70 bp, Artificial Sequence
  Synthetic
gccaagcatttaggtgacactatagagtttgtctttttctctgacgtttcagagctatgctggaaacagc

SEQ ID NO: 51107 - DNA, 70 bp, Artificial Sequence
  Synthetic
gccaagcatttaggtgacactatagtcaagagatggaaccctaaggtttcagagctatgctggaaacagc

SEQ ID NO: 51108 - DNA, 70 bp, Artificial Sequence
  Synthetic
gccaagcatttaggtgacactataggggaaatcaggctccacttagtttcagagctatgctggaaacagc

SEQ ID NO: 51109 - DNA, 70 bp, Artificial Sequence
  Synthetic
gccaagcatttaggtgacactatagcctcctaagcgtaatttcaggtttcagagctatgctggaaacagc

SEQ ID NO: 51110 - DNA, 70 bp, Artificial Sequence
  Synthetic
gccaagcatttaggtgacactatagccaccacccccctgctgagggtttcagagctatgctggaaacagc

SEQ ID NO: 51111 - DNA, 70 bp, Artificial Sequence
  Synthetic
gccaagcatttaggtgacactatagaagacaaggaccagctttgagtttcagagctatgctggaaacagc

SEQ ID NO: 51112 - DNA, 70 bp, Artificial Sequence
  Synthetic
gccaagcatttaggtgacactatagtgcccttctcaggaggatcagtttcagagctatgctggaaacagc

SEQ ID NO: 51113 - DNA, 70 bp, Artificial Sequence
  Synthetic
gccaagcatttaggtgacactatagagccactgggccctgggtctgtttcagagctatgctggaaacagc

SEQ ID NO: 51114 - DNA, 70 bp, Artificial Sequence
  Synthetic
gccaagcatttaggtgacactataggtcactgtgagttcgcacccgtttcagagctatgctggaaacagc

SEQ ID NO: 51115 - DNA, 70 bp, Artificial Sequence
  Synthetic
gccaagcatttaggtgacactataggtcactgcaagcttacattcgtttcagagctatgctggaaacagc

SEQ ID NO: 51116 - DNA, 70 bp, Artificial Sequence
  Synthetic
gccaagcatttaggtgacactataggtctctgcagaactcagctcgtttcagagctatgctggaaacagc

SEQ ID NO: 51117 - DNA, 70 bp, Artificial Sequence
  Synthetic
gccaagcatttaggtgacactatagcgcgcccacgctcaggcccggtttcagagctatgctggaaacagc

SEQ ID NO: 51118 - DNA, 70 bp, Artificial Sequence
  Synthetic
gccaagcatttaggtgacactatagcgagtagaacccctgggctggtttcagagctatgctggaaacagc

SEQ ID NO: 51119 - DNA, 70 bp, Artificial Sequence
  Synthetic
gccaagcatttaggtgacactataggcatctggatcaagttgaaggtttcagagctatgctggaaacagc

SEQ ID NO: 51120 - DNA, 70 bp, Artificial Sequence
  Synthetic
gccaagcatttaggtgacactatagaacattcagagagtttcttcgtttcagagctatgctggaaacagc

SEQ ID NO: 51121 - DNA, 70 bp, Artificial Sequence
  Synthetic
gccaagcatttaggtgacactatagaaacacatggattccattctgtttcagagctatgctggaaacagc

SEQ ID NO: 51122 - DNA, 70 bp, Artificial Sequence
  Synthetic
gccaagcatttaggtgacactatagcttcgtttgtaacggataacgtttcagagctatgctggaaacagc

SEQ ID NO: 51123 - DNA, 70 bp, Artificial Sequence
  Synthetic
gccaagcatttaggtgacactataggaccagtcccgggcaggcttgtttcagagctatgctggaaacagc

SEQ ID NO: 51124 - DNA, 70 bp, Artificial Sequence
  Synthetic
gccaagcatttaggtgacactatagaaaagtggagaagagaaagagtttcagagctatgctggaaacagc

SEQ ID NO: 51125 - DNA, 70 bp, Artificial Sequence
  Synthetic
gccaagcatttaggtgacactatagaactacagccgcttgttgttgtttcagagctatgctggaaacagc

SEQ ID NO: 51126 - DNA, 70 bp, Artificial Sequence
  Synthetic
gccaagcatttaggtgacactatagcttggccaagctcactctgtgtttcagagctatgctggaaacagc

SEQ ID NO: 51127 - DNA, 70 bp, Artificial Sequence
  Synthetic
gccaagcatttaggtgacactataggtcattgaacagcctgtagagtttcagagctatgctggaaacagc

SEQ ID NO: 51128 - DNA, 70 bp, Artificial Sequence
  Synthetic
gccaagcatttaggtgacactataggtggagcatgctgtcctcaggtttcagagctatgctggaaacagc

SEQ ID NO: 51129 - DNA, 70 bp, Artificial Sequence
  Synthetic
gccaagcatttaggtgacactatagaaggcctctttgccagaaaagtttcagagctatgctggaaacagc

SEQ ID NO: 51130 - DNA, 70 bp, Artificial Sequence
  Synthetic
gccaagcatttaggtgacactatagtgttagtgtgtggttgagaagtttcagagctatgctggaaacagc

SEQ ID NO: 51131 - DNA, 70 bp, Artificial Sequence
  Synthetic
gccaagcatttaggtgacactatagtgacacagcagcagcagctggtttcagagctatgctggaaacagc

SEQ ID NO: 51132 - DNA, 70 bp, Artificial Sequence
  Synthetic
gccaagcatttaggtgacactatagtctctgttgctgctgtctctgtttcagagctatgctggaaacagc

SEQ ID NO: 51133 - DNA, 70 bp, Artificial Sequence
  Synthetic
gccaagcatttaggtgacactataggcacgctcagtgtcgcttcggtttcagagctatgctggaaacagc

SEQ ID NO: 51134 - DNA, 70 bp, Artificial Sequence
  Synthetic
gccaagcatttaggtgacactataggatttcagtcaagaagaagcgtttcagagctatgctggaaacagc

SEQ ID NO: 51135 - DNA, 70 bp, Artificial Sequence
  Synthetic
gccaagcatttaggtgacactatagtgttggcaacgaggaaacgagtttcagagctatgctggaaacagc

SEQ ID NO: 51136 - DNA, 70 bp, Artificial Sequence
  Synthetic
gccaagcatttaggtgacactatagccaggaatctcactgcttgcgtttcagagctatgctggaaacagc

SEQ ID NO: 51137 - DNA, 70 bp, Artificial Sequence
  Synthetic
gccaagcatttaggtgacactatagaggaagaaagtcgcttttgagtttcagagctatgctggaaacagc

SEQ ID NO: 51138 - DNA, 70 bp, Artificial Sequence
  Synthetic
gccaagcatttaggtgacactatagtgccagatcgtcagcgctaagtttcagagctatgctggaaacagc

SEQ ID NO: 51139 - DNA, 70 bp, Artificial Sequence
  Synthetic
gccaagcatttaggtgacactatagctccttatcctggaaacgcagtttcagagctatgctggaaacagc

SEQ ID NO: 51140 - DNA, 70 bp, Artificial Sequence
  Synthetic
gccaagcatttaggtgacactatagcgctgcccagccaggcctgagtttcagagctatgctggaaacagc

SEQ ID NO: 51141 - DNA, 70 bp, Artificial Sequence
  Synthetic
gccaagcatttaggtgacactatagctctgctgctgtcagtcatcgtttcagagctatgctggaaacagc

SEQ ID NO: 51142 - DNA, 70 bp, Artificial Sequence
  Synthetic
gccaagcatttaggtgacactatagaaccggctaaattattgaccgtttcagagctatgctggaaacagc

SEQ ID NO: 51143 - DNA, 70 bp, Artificial Sequence
  Synthetic
gccaagcatttaggtgacactataggatgagtcgagagggctgaggtttcagagctatgctggaaacagc

SEQ ID NO: 51144 - DNA, 70 bp, Artificial Sequence
  Synthetic
gccaagcatttaggtgacactataggacctgcgctatctagctacgtttcagagctatgctggaaacagc

SEQ ID NO: 51145 - DNA, 70 bp, Artificial Sequence
  Synthetic
gccaagcatttaggtgacactatagtaggcaaaaggatttccaaagtttcagagctatgctggaaacagc

SEQ ID NO: 51146 - DNA, 70 bp, Artificial Sequence
  Synthetic
gccaagcatttaggtgacactataggctgggtcagggcactcatggtttcagagctatgctggaaacagc

SEQ ID NO: 51147 - DNA, 70 bp, Artificial Sequence
  Synthetic
gccaagcatttaggtgacactatagctcagtaatctgcaatttgggtttcagagctatgctggaaacagc

SEQ ID NO: 51148 - DNA, 70 bp, Artificial Sequence
  Synthetic
gccaagcatttaggtgacactataggcggcagaacagatgctgaagtttcagagctatgctggaaacagc

SEQ ID NO: 51149 - DNA, 70 bp, Artificial Sequence
  Synthetic
gccaagcatttaggtgacactatagacagttgtattcagcctgaagtttcagagctatgctggaaacagc

SEQ ID NO: 51150 - DNA, 70 bp, Artificial Sequence
  Synthetic
gccaagcatttaggtgacactatagtgcatagcagcactatcatggtttcagagctatgctggaaacagc

SEQ ID NO: 51151 - DNA, 70 bp, Artificial Sequence
  Synthetic
gccaagcatttaggtgacactatagctctttgaaactgatgacgagtttcagagctatgctggaaacagc

SEQ ID NO: 51152 - DNA, 70 bp, Artificial Sequence
  Synthetic
gccaagcatttaggtgacactatagaagggagctgacagccacaggtttcagagctatgctggaaacagc

SEQ ID NO: 51153 - DNA, 70 bp, Artificial Sequence
  Synthetic
gccaagcatttaggtgacactatagaaggtcatgaccatggtgtggtttcagagctatgctggaaacagc

SEQ ID NO: 51154 - DNA, 70 bp, Artificial Sequence
  Synthetic
gccaagcatttaggtgacactatagtttccgttcgggttctctcagtttcagagctatgctggaaacagc

SEQ ID NO: 51155 - DNA, 70 bp, Artificial Sequence
  Synthetic
gccaagcatttaggtgacactatagagttcatgacaacaaggtgcgtttcagagctatgctggaaacagc

SEQ ID NO: 51156 - DNA, 70 bp, Artificial Sequence
  Synthetic
gccaagcatttaggtgacactatagcaggcgcttgcgggttaagggtttcagagctatgctggaaacagc

SEQ ID NO: 51157 - DNA, 70 bp, Artificial Sequence
  Synthetic
gccaagcatttaggtgacactatagccccgccaagcaagatgagcgtttcagagctatgctggaaacagc

SEQ ID NO: 51158 - DNA, 70 bp, Artificial Sequence
  Synthetic
gccaagcatttaggtgacactatagagtgtggacgtggcctgaccgtttcagagctatgctggaaacagc

SEQ ID NO: 51159 - DNA, 70 bp, Artificial Sequence
  Synthetic
gccaagcatttaggtgacactatagcctccactgagccacatttagtttcagagctatgctggaaacagc

SEQ ID NO: 51160 - DNA, 70 bp, Artificial Sequence
  Synthetic
gccaagcatttaggtgacactataggcttctgagagctgtgcgtggtttcagagctatgctggaaacagc

SEQ ID NO: 51161 - DNA, 70 bp, Artificial Sequence
  Synthetic
gccaagcatttaggtgacactatagcgatgctcagttcatgctttgtttcagagctatgctggaaacagc

SEQ ID NO: 51162 - DNA, 70 bp, Artificial Sequence
  Synthetic
gccaagcatttaggtgacactataggcagtcactggagtcttcaggtttcagagctatgctggaaacagc

SEQ ID NO: 51163 - DNA, 70 bp, Artificial Sequence
  Synthetic
gccaagcatttaggtgacactatagcttccaaactcattcagcttgtttcagagctatgctggaaacagc

SEQ ID NO: 51164 - DNA, 70 bp, Artificial Sequence
  Synthetic
gccaagcatttaggtgacactatagtcacctgacgtccttgtctagtttcagagctatgctggaaacagc

SEQ ID NO: 51165 - DNA, 70 bp, Artificial Sequence
  Synthetic
gccaagcatttaggtgacactatagatgctgtgatcttggcttaggtttcagagctatgctggaaacagc

SEQ ID NO: 51166 - DNA, 70 bp, Artificial Sequence
  Synthetic
gccaagcatttaggtgacactatagaagccagaggctgccctcacgtttcagagctatgctggaaacagc

SEQ ID NO: 51167 - DNA, 70 bp, Artificial Sequence
  Synthetic
gccaagcatttaggtgacactataggaggagcagcacctcctaacgtttcagagctatgctggaaacagc

SEQ ID NO: 51168 - DNA, 70 bp, Artificial Sequence
  Synthetic
gccaagcatttaggtgacactatagcgtggagtgcgggctgcgctgtttcagagctatgctggaaacagc

SEQ ID NO: 51169 - DNA, 70 bp, Artificial Sequence
  Synthetic
gccaagcatttaggtgacactatagatccaggcttaacattttcggtttcagagctatgctggaaacagc

SEQ ID NO: 51170 - DNA, 70 bp, Artificial Sequence
  Synthetic
gccaagcatttaggtgacactatagagtggatcaagatattacgcgtttcagagctatgctggaaacagc

SEQ ID NO: 51171 - DNA, 70 bp, Artificial Sequence
  Synthetic
gccaagcatttaggtgacactatagtaaagatgaacgaccgagatgtttcagagctatgctggaaacagc

SEQ ID NO: 51172 - DNA, 70 bp, Artificial Sequence
  Synthetic
gccaagcatttaggtgacactatagaatttaaggagtgagtcgttgtttcagagctatgctggaaacagc

SEQ ID NO: 51173 - DNA, 70 bp, Artificial Sequence
  Synthetic
gccaagcatttaggtgacactatagtcaatgagctctttctgcttgtttcagagctatgctggaaacagc

SEQ ID NO: 51174 - DNA, 70 bp, Artificial Sequence
  Synthetic
gccaagcatttaggtgacactatagaggataatacctgtaggatagtttcagagctatgctggaaacagc

SEQ ID NO: 51175 - DNA, 70 bp, Artificial Sequence
  Synthetic
gccaagcatttaggtgacactataggagagcacgatgatctcttcgtttcagagctatgctggaaacagc

SEQ ID NO: 51176 - DNA, 70 bp, Artificial Sequence
  Synthetic
gccaagcatttaggtgacactatagggaccgaagcatacaaatgggtttcagagctatgctggaaacagc

SEQ ID NO: 51177 - DNA, 70 bp, Artificial Sequence
  Synthetic
gccaagcatttaggtgacactatagggtcaggctgagcagtgatggtttcagagctatgctggaaacagc

SEQ ID NO: 51178 - DNA, 70 bp, Artificial Sequence
  Synthetic
gccaagcatttaggtgacactataggcggcgccgcgggctagcgtgtttcagagctatgctggaaacagc

SEQ ID NO: 51179 - DNA, 70 bp, Artificial Sequence
  Synthetic
gccaagcatttaggtgacactatagataacaacttggaaaggagagtttcagagctatgctggaaacagc

SEQ ID NO: 51180 - DNA, 70 bp, Artificial Sequence
  Synthetic
gccaagcatttaggtgacactatagggtggctacaccatctggtggtttcagagctatgctggaaacagc

SEQ ID NO: 51181 - DNA, 70 bp, Artificial Sequence
  Synthetic
gccaagcatttaggtgacactatagtacctcaaaatgctttaggggtttcagagctatgctggaaacagc

SEQ ID NO: 51182 - DNA, 70 bp, Artificial Sequence
  Synthetic
gccaagcatttaggtgacactataggcatcactttagaagaagtcgtttcagagctatgctggaaacagc

SEQ ID NO: 51183 - DNA, 70 bp, Artificial Sequence
  Synthetic
gccaagcatttaggtgacactatagacaagctacacagaaaagaggtttcagagctatgctggaaacagc

SEQ ID NO: 51184 - DNA, 70 bp, Artificial Sequence
  Synthetic
gccaagcatttaggtgacactatagcggagctgactcagggcagagtttcagagctatgctggaaacagc

SEQ ID NO: 51185 - DNA, 70 bp, Artificial Sequence
  Synthetic
gccaagcatttaggtgacactatagtggctgtagactcaggttaggtttcagagctatgctggaaacagc

SEQ ID NO: 51186 - DNA, 70 bp, Artificial Sequence
  Synthetic
gccaagcatttaggtgacactatagggtgggggcaaaggctgagggtttcagagctatgctggaaacagc

SEQ ID NO: 51187 - DNA, 70 bp, Artificial Sequence
  Synthetic
gccaagcatttaggtgacactatagagctttcatggcatcttcctgtttcagagctatgctggaaacagc

SEQ ID NO: 51188 - DNA, 70 bp, Artificial Sequence
  Synthetic
gccaagcatttaggtgacactatagcactacaaacaagcaactgtgtttcagagctatgctggaaacagc

SEQ ID NO: 51189 - DNA, 70 bp, Artificial Sequence
  Synthetic
gccaagcatttaggtgacactataggcttcgagggtggtgattaggtttcagagctatgctggaaacagc

SEQ ID NO: 51190 - DNA, 70 bp, Artificial Sequence
  Synthetic
gccaagcatttaggtgacactatagggcagcgggtggctcagaaggtttcagagctatgctggaaacagc

SEQ ID NO: 51191 - DNA, 70 bp, Artificial Sequence
  Synthetic
gccaagcatttaggtgacactatagtggagatggtctagtcctccgtttcagagctatgctggaaacagc

SEQ ID NO: 51192 - DNA, 70 bp, Artificial Sequence
  Synthetic
gccaagcatttaggtgacactatagaggggcccactgctagctgcgtttcagagctatgctggaaacagc

SEQ ID NO: 51193 - DNA, 70 bp, Artificial Sequence
  Synthetic
gccaagcatttaggtgacactataggtcagccagagccggatgtcgtttcagagctatgctggaaacagc

SEQ ID NO: 51194 - DNA, 70 bp, Artificial Sequence
  Synthetic
gccaagcatttaggtgacactatagtacgtggagctcattgagtggtttcagagctatgctggaaacagc

SEQ ID NO: 51195 - DNA, 70 bp, Artificial Sequence
  Synthetic
gccaagcatttaggtgacactataggggatgtggggcagcctcacgtttcagagctatgctggaaacagc

SEQ ID NO: 51196 - DNA, 70 bp, Artificial Sequence
  Synthetic
gccaagcatttaggtgacactatagtcaagccatttacgctgcaggtttcagagctatgctggaaacagc

SEQ ID NO: 51197 - DNA, 70 bp, Artificial Sequence
  Synthetic
gccaagcatttaggtgacactatagagatctagtagcataaaagcgtttcagagctatgctggaaacagc

SEQ ID NO: 51198 - DNA, 70 bp, Artificial Sequence
  Synthetic
gccaagcatttaggtgacactatagtgcgagcggcttctaggacagtttcagagctatgctggaaacagc

SEQ ID NO: 51199 - DNA, 70 bp, Artificial Sequence
  Synthetic
gccaagcatttaggtgacactatagacttactggggctgtctgaagtttcagagctatgctggaaacagc

SEQ ID NO: 51200 - DNA, 70 bp, Artificial Sequence
  Synthetic
gccaagcatttaggtgacactatagatcttatctctgaatgagtggtttcagagctatgctggaaacagc

SEQ ID NO: 51201 - DNA, 70 bp, Artificial Sequence
  Synthetic
gccaagcatttaggtgacactatagctcagggtgccttagtggacgtttcagagctatgctggaaacagc

SEQ ID NO: 51202 - DNA, 70 bp, Artificial Sequence
  Synthetic
gccaagcatttaggtgacactataggggctggaggttggatctacgtttcagagctatgctggaaacagc

SEQ ID NO: 51203 - DNA, 70 bp, Artificial Sequence
  Synthetic
gccaagcatttaggtgacactatagatggaaactatgctgggctcgtttcagagctatgctggaaacagc

SEQ ID NO: 51204 - DNA, 70 bp, Artificial Sequence
  Synthetic
gccaagcatttaggtgacactatagtatgcaggcctctggagctagtttcagagctatgctggaaacagc

SEQ ID NO: 51205 - DNA, 70 bp, Artificial Sequence
  Synthetic
gccaagcatttaggtgacactatagtacgcaggcctctggagttagtttcagagctatgctggaaacagc

SEQ ID NO: 51206 - DNA, 70 bp, Artificial Sequence
  Synthetic
gccaagcatttaggtgacactatagagagaagaagaaacacgtaggtttcagagctatgctggaaacagc

SEQ ID NO: 51207 - DNA, 70 bp, Artificial Sequence
  Synthetic
gccaagcatttaggtgacactatagatacgtggatcgtgctgtgagtttcagagctatgctggaaacagc

SEQ ID NO: 51208 - DNA, 70 bp, Artificial Sequence
  Synthetic
gccaagcatttaggtgacactatagatctttacagtgatgcagttgtttcagagctatgctggaaacagc

SEQ ID NO: 51209 - DNA, 70 bp, Artificial Sequence
  Synthetic
gccaagcatttaggtgacactatagccagatgatatgtgacactggtttcagagctatgctggaaacagc

SEQ ID NO: 51210 - DNA, 70 bp, Artificial Sequence
  Synthetic
gccaagcatttaggtgacactatagatggcccaggaaccatcatggtttcagagctatgctggaaacagc

SEQ ID NO: 51211 - DNA, 70 bp, Artificial Sequence
  Synthetic
gccaagcatttaggtgacactatagtgccctgcagaattagctgtgtttcagagctatgctggaaacagc

SEQ ID NO: 51212 - DNA, 70 bp, Artificial Sequence
  Synthetic
gccaagcatttaggtgacactatagccacctgcagaattagctgagtttcagagctatgctggaaacagc

SEQ ID NO: 51213 - DNA, 70 bp, Artificial Sequence
  Synthetic
gccaagcatttaggtgacactatagcatcctgaagaattaaccgtgtttcagagctatgctggaaacagc

SEQ ID NO: 51214 - DNA, 70 bp, Artificial Sequence
  Synthetic
gccaagcatttaggtgacactatagattcaattcgttgccttttggtttcagagctatgctggaaacagc

SEQ ID NO: 51215 - DNA, 70 bp, Artificial Sequence
  Synthetic
gccaagcatttaggtgacactatagtgctgatgttgacttaaagcgtttcagagctatgctggaaacagc

SEQ ID NO: 51216 - DNA, 70 bp, Artificial Sequence
  Synthetic
gccaagcatttaggtgacactatagagagaatgaaaatgaggatggtttcagagctatgctggaaacagc

SEQ ID NO: 51217 - DNA, 70 bp, Artificial Sequence
  Synthetic
gccaagcatttaggtgacactatagactacactctgagtatctccgtttcagagctatgctggaaacagc

SEQ ID NO: 51218 - DNA, 70 bp, Artificial Sequence
  Synthetic
gccaagcatttaggtgacactatagctaggtatgaggcctcaagagtttcagagctatgctggaaacagc

SEQ ID NO: 51219 - DNA, 70 bp, Artificial Sequence
  Synthetic
gccaagcatttaggtgacactatagtgcagtgcataccatcctgagtttcagagctatgctggaaacagc

SEQ ID NO: 51220 - DNA, 70 bp, Artificial Sequence
  Synthetic
gccaagcatttaggtgacactatagtgcagtgcatgccatcctgagtttcagagctatgctggaaacagc

SEQ ID NO: 51221 - DNA, 70 bp, Artificial Sequence
  Synthetic
gccaagcatttaggtgacactatagcttctgccttacgcctagtggtttcagagctatgctggaaacagc

SEQ ID NO: 51222 - DNA, 70 bp, Artificial Sequence
  Synthetic
gccaagcatttaggtgacactatagacacgcacacatgttcactcgtttcagagctatgctggaaacagc

SEQ ID NO: 51223 - DNA, 70 bp, Artificial Sequence
  Synthetic
gccaagcatttaggtgacactatagctcatcacaagtgatatggcgtttcagagctatgctggaaacagc

SEQ ID NO: 51224 - DNA, 70 bp, Artificial Sequence
  Synthetic
gccaagcatttaggtgacactatagaaaagcagcatcatcttcaagtttcagagctatgctggaaacagc

SEQ ID NO: 51225 - DNA, 70 bp, Artificial Sequence
  Synthetic
gccaagcatttaggtgacactatagttaaaaggctgagcctgtgagtttcagagctatgctggaaacagc

SEQ ID NO: 51226 - DNA, 70 bp, Artificial Sequence
  Synthetic
gccaagcatttaggtgacactatagacagctatagtactgagtcagtttcagagctatgctggaaacagc

SEQ ID NO: 51227 - DNA, 70 bp, Artificial Sequence
  Synthetic
gccaagcatttaggtgacactataggacgtctttaacgtcatggagtttcagagctatgctggaaacagc

SEQ ID NO: 51228 - DNA, 70 bp, Artificial Sequence
  Synthetic
gccaagcatttaggtgacactatagatccacgaagctgctgtctcgtttcagagctatgctggaaacagc

SEQ ID NO: 51229 - DNA, 70 bp, Artificial Sequence
  Synthetic
gccaagcatttaggtgacactataggatgggcatgagattacagtgtttcagagctatgctggaaacagc

SEQ ID NO: 51230 - DNA, 70 bp, Artificial Sequence
  Synthetic
gccaagcatttaggtgacactatagaaacaaggactatgctgccggtttcagagctatgctggaaacagc

SEQ ID NO: 51231 - DNA, 70 bp, Artificial Sequence
  Synthetic
gccaagcatttaggtgacactatagggagctgctggctctcaagagtttcagagctatgctggaaacagc

SEQ ID NO: 51232 - DNA, 70 bp, Artificial Sequence
  Synthetic
gccaagcatttaggtgacactatagaggtggttttgttaatctacgtttcagagctatgctggaaacagc

SEQ ID NO: 51233 - DNA, 70 bp, Artificial Sequence
  Synthetic
gccaagcatttaggtgacactatagcctggagccacctgatgacagtttcagagctatgctggaaacagc

SEQ ID NO: 51234 - DNA, 70 bp, Artificial Sequence
  Synthetic
gccaagcatttaggtgacactataggaactgaccagattcaggtcgtttcagagctatgctggaaacagc

SEQ ID NO: 51235 - DNA, 70 bp, Artificial Sequence
  Synthetic
gccaagcatttaggtgacactatagttattaggaacacacatcaggtttcagagctatgctggaaacagc

SEQ ID NO: 51236 - DNA, 70 bp, Artificial Sequence
  Synthetic
gccaagcatttaggtgacactatagagaggtgcctatcttaacacgtttcagagctatgctggaaacagc

SEQ ID NO: 51237 - DNA, 70 bp, Artificial Sequence
  Synthetic
gccaagcatttaggtgacactatagcacaaatagagatgctagcagtttcagagctatgctggaaacagc

SEQ ID NO: 51238 - DNA, 70 bp, Artificial Sequence
  Synthetic
gccaagcatttaggtgacactataggaagacgcaaccaggatgtggtttcagagctatgctggaaacagc

SEQ ID NO: 51239 - DNA, 70 bp, Artificial Sequence
  Synthetic
gccaagcatttaggtgacactatagtcttattaaaagggcgagttgtttcagagctatgctggaaacagc

SEQ ID NO: 51240 - DNA, 70 bp, Artificial Sequence
  Synthetic
gccaagcatttaggtgacactataggtctgcaggaggctcagtctgtttcagagctatgctggaaacagc

SEQ ID NO: 51241 - DNA, 70 bp, Artificial Sequence
  Synthetic
gccaagcatttaggtgacactataggcacaagagggttgtggagcgtttcagagctatgctggaaacagc

SEQ ID NO: 51242 - DNA, 70 bp, Artificial Sequence
  Synthetic
gccaagcatttaggtgacactatagagagagtggaaattggaagcgtttcagagctatgctggaaacagc

SEQ ID NO: 51243 - DNA, 70 bp, Artificial Sequence
  Synthetic
gccaagcatttaggtgacactatagtgtactctcctgtcttcagcgtttcagagctatgctggaaacagc

SEQ ID NO: 51244 - DNA, 70 bp, Artificial Sequence
  Synthetic
gccaagcatttaggtgacactatagcgcttgatcccaggagttaagtttcagagctatgctggaaacagc

SEQ ID NO: 51245 - DNA, 70 bp, Artificial Sequence
  Synthetic
gccaagcatttaggtgacactatagttatatgagaagctggcaacgtttcagagctatgctggaaacagc

SEQ ID NO: 51246 - DNA, 70 bp, Artificial Sequence
  Synthetic
gccaagcatttaggtgacactatagactgtaagtaaatcatccccgtttcagagctatgctggaaacagc

SEQ ID NO: 51247 - DNA, 70 bp, Artificial Sequence
  Synthetic
gccaagcatttaggtgacactataggtgcgctctgccattcaactgtttcagagctatgctggaaacagc

SEQ ID NO: 51248 - DNA, 70 bp, Artificial Sequence
  Synthetic
gccaagcatttaggtgacactatagacttattctgctccagtcatgtttcagagctatgctggaaacagc

SEQ ID NO: 51249 - DNA, 70 bp, Artificial Sequence
  Synthetic
gccaagcatttaggtgacactatagttgagtcatgctgaagagatgtttcagagctatgctggaaacagc

SEQ ID NO: 51250 - DNA, 70 bp, Artificial Sequence
  Synthetic
gccaagcatttaggtgacactatagttggtatcagtggctatggggtttcagagctatgctggaaacagc

SEQ ID NO: 51251 - DNA, 70 bp, Artificial Sequence
  Synthetic
gccaagcatttaggtgacactatagaatacatgtgctgctatcaagtttcagagctatgctggaaacagc

SEQ ID NO: 51252 - DNA, 70 bp, Artificial Sequence
  Synthetic
gccaagcatttaggtgacactatagcctgctcaagctcttgcagggtttcagagctatgctggaaacagc

SEQ ID NO: 51253 - DNA, 70 bp, Artificial Sequence
  Synthetic
gccaagcatttaggtgacactatagactgcctacgcggggtgaaggtttcagagctatgctggaaacagc

SEQ ID NO: 51254 - DNA, 70 bp, Artificial Sequence
  Synthetic
gccaagcatttaggtgacactatagtccacttttggtttatttgggtttcagagctatgctggaaacagc

SEQ ID NO: 51255 - DNA, 70 bp, Artificial Sequence
  Synthetic
gccaagcatttaggtgacactatagtaggaagaagcaaatggacagtttcagagctatgctggaaacagc

SEQ ID NO: 51256 - DNA, 70 bp, Artificial Sequence
  Synthetic
gccaagcatttaggtgacactatagttcctaatcattttcaggacgtttcagagctatgctggaaacagc

SEQ ID NO: 51257 - DNA, 70 bp, Artificial Sequence
  Synthetic
gccaagcatttaggtgacactatagagatacacagaagaagcctagtttcagagctatgctggaaacagc

SEQ ID NO: 51258 - DNA, 70 bp, Artificial Sequence
  Synthetic
gccaagcatttaggtgacactatagactcactgaagcttttgactgtttcagagctatgctggaaacagc

SEQ ID NO: 51259 - DNA, 70 bp, Artificial Sequence
  Synthetic
gccaagcatttaggtgacactatagaaaggagtgcttaggagatggtttcagagctatgctggaaacagc

SEQ ID NO: 51260 - DNA, 70 bp, Artificial Sequence
  Synthetic
gccaagcatttaggtgacactataggatgaacggatgaagaagctgtttcagagctatgctggaaacagc

SEQ ID NO: 51261 - DNA, 70 bp, Artificial Sequence
  Synthetic
gccaagcatttaggtgacactatagagcagctatcactcctctgcgtttcagagctatgctggaaacagc

SEQ ID NO: 51262 - DNA, 70 bp, Artificial Sequence
  Synthetic
gccaagcatttaggtgacactatagccagtgtgtggaaatcactggtttcagagctatgctggaaacagc

SEQ ID NO: 51263 - DNA, 70 bp, Artificial Sequence
  Synthetic
gccaagcatttaggtgacactataggggcccacttcttccttaaagtttcagagctatgctggaaacagc

SEQ ID NO: 51264 - DNA, 70 bp, Artificial Sequence
  Synthetic
gccaagcatttaggtgacactatagccaccattcactgtcttctcgtttcagagctatgctggaaacagc

SEQ ID NO: 51265 - DNA, 70 bp, Artificial Sequence
  Synthetic
gccaagcatttaggtgacactatagagagatgctagacttgcgtcgtttcagagctatgctggaaacagc

SEQ ID NO: 51266 - DNA, 70 bp, Artificial Sequence
  Synthetic
gccaagcatttaggtgacactatagagtggtggggcctggtgaatgtttcagagctatgctggaaacagc

SEQ ID NO: 51267 - DNA, 70 bp, Artificial Sequence
  Synthetic
gccaagcatttaggtgacactatagtcatagtcttctttaggtgggtttcagagctatgctggaaacagc

SEQ ID NO: 51268 - DNA, 70 bp, Artificial Sequence
  Synthetic
gccaagcatttaggtgacactataggtggccatctttctaggttggtttcagagctatgctggaaacagc

SEQ ID NO: 51269 - DNA, 70 bp, Artificial Sequence
  Synthetic
gccaagcatttaggtgacactatagttgcacgccctcaaattgctgtttcagagctatgctggaaacagc

SEQ ID NO: 51270 - DNA, 70 bp, Artificial Sequence
  Synthetic
gccaagcatttaggtgacactatagcttaacttgctgcctagaaagtttcagagctatgctggaaacagc

SEQ ID NO: 51271 - DNA, 70 bp, Artificial Sequence
  Synthetic
gccaagcatttaggtgacactataggtcccgaggagcagacttaggtttcagagctatgctggaaacagc

SEQ ID NO: 51272 - DNA, 70 bp, Artificial Sequence
  Synthetic
gccaagcatttaggtgacactatagtaaagacaaacagatgtcctgtttcagagctatgctggaaacagc

SEQ ID NO: 51273 - DNA, 70 bp, Artificial Sequence
  Synthetic
gccaagcatttaggtgacactataggttcttgctatgatgtctgagtttcagagctatgctggaaacagc

SEQ ID NO: 51274 - DNA, 70 bp, Artificial Sequence
  Synthetic
gccaagcatttaggtgacactataggcactctcccctcctttacagtttcagagctatgctggaaacagc

SEQ ID NO: 51275 - DNA, 70 bp, Artificial Sequence
  Synthetic
gccaagcatttaggtgacactataggtgtgtggagggagctcagcgtttcagagctatgctggaaacagc

SEQ ID NO: 51276 - DNA, 70 bp, Artificial Sequence
  Synthetic
gccaagcatttaggtgacactatagtgggtggctggggcctaggtgtttcagagctatgctggaaacagc

SEQ ID NO: 51277 - DNA, 70 bp, Artificial Sequence
  Synthetic
gccaagcatttaggtgacactatagctgaactggaaaaggtggatgtttcagagctatgctggaaacagc

SEQ ID NO: 51278 - DNA, 70 bp, Artificial Sequence
  Synthetic
gccaagcatttaggtgacactataggcacacgcccccacagctgagtttcagagctatgctggaaacagc

SEQ ID NO: 51279 - DNA, 70 bp, Artificial Sequence
  Synthetic
gccaagcatttaggtgacactatagggccccctgcccttggctaagtttcagagctatgctggaaacagc

SEQ ID NO: 51280 - DNA, 70 bp, Artificial Sequence
  Synthetic
gccaagcatttaggtgacactatagtgtctctcacttccgtgtccgtttcagagctatgctggaaacagc

SEQ ID NO: 51281 - DNA, 70 bp, Artificial Sequence
  Synthetic
gccaagcatttaggtgacactataggctgcgagcagagagggagtgtttcagagctatgctggaaacagc

SEQ ID NO: 51282 - DNA, 70 bp, Artificial Sequence
  Synthetic
gccaagcatttaggtgacactatagtagtcagtgcggtggtgagagtttcagagctatgctggaaacagc

SEQ ID NO: 51283 - DNA, 70 bp, Artificial Sequence
  Synthetic
gccaagcatttaggtgacactatagtccttcaagagagttcagatgtttcagagctatgctggaaacagc

SEQ ID NO: 51284 - DNA, 70 bp, Artificial Sequence
  Synthetic
gccaagcatttaggtgacactatagatctctgttgacattcattggtttcagagctatgctggaaacagc

SEQ ID NO: 51285 - DNA, 70 bp, Artificial Sequence
  Synthetic
gccaagcatttaggtgacactatagtttactgtaaaggctgatcagtttcagagctatgctggaaacagc

SEQ ID NO: 51286 - DNA, 70 bp, Artificial Sequence
  Synthetic
gccaagcatttaggtgacactatagacacattcagtcatggattcgtttcagagctatgctggaaacagc

SEQ ID NO: 51287 - DNA, 70 bp, Artificial Sequence
  Synthetic
gccaagcatttaggtgacactatagagcccttcaaaaatcagcaggtttcagagctatgctggaaacagc

SEQ ID NO: 51288 - DNA, 70 bp, Artificial Sequence
  Synthetic
gccaagcatttaggtgacactatagtgtgtgaaactcgaagtgctgtttcagagctatgctggaaacagc

SEQ ID NO: 51289 - DNA, 70 bp, Artificial Sequence
  Synthetic
gccaagcatttaggtgacactatagtgctcccaattgttcatgctgtttcagagctatgctggaaacagc

SEQ ID NO: 51290 - DNA, 70 bp, Artificial Sequence
  Synthetic
gccaagcatttaggtgacactatagctcggaacagctgctcattggtttcagagctatgctggaaacagc

SEQ ID NO: 51291 - DNA, 70 bp, Artificial Sequence
  Synthetic
gccaagcatttaggtgacactataggtgattgaagggtcctaaaagtttcagagctatgctggaaacagc

SEQ ID NO: 51292 - DNA, 70 bp, Artificial Sequence
  Synthetic
gccaagcatttaggtgacactatagaaataggaagaggcagtgaggtttcagagctatgctggaaacagc

SEQ ID NO: 51293 - DNA, 70 bp, Artificial Sequence
  Synthetic
gccaagcatttaggtgacactatagtgtcatctacaggtttgactgtttcagagctatgctggaaacagc

SEQ ID NO: 51294 - DNA, 70 bp, Artificial Sequence
  Synthetic
gccaagcatttaggtgacactataggaaggagaagtccgactgaggtttcagagctatgctggaaacagc

SEQ ID NO: 51295 - DNA, 70 bp, Artificial Sequence
  Synthetic
gccaagcatttaggtgacactatagggcagaggatgcactcaacagtttcagagctatgctggaaacagc

SEQ ID NO: 51296 - DNA, 70 bp, Artificial Sequence
  Synthetic
gccaagcatttaggtgacactataggagggctgtcgacctcacacgtttcagagctatgctggaaacagc

SEQ ID NO: 51297 - DNA, 70 bp, Artificial Sequence
  Synthetic
gccaagcatttaggtgacactatagcaccttctgctccttcaacagtttcagagctatgctggaaacagc

SEQ ID NO: 51298 - DNA, 70 bp, Artificial Sequence
  Synthetic
gccaagcatttaggtgacactataggggaaggactggggtcaggcgtttcagagctatgctggaaacagc

SEQ ID NO: 51299 - DNA, 70 bp, Artificial Sequence
  Synthetic
gccaagcatttaggtgacactataggcagattggcaagatagggagtttcagagctatgctggaaacagc

SEQ ID NO: 51300 - DNA, 70 bp, Artificial Sequence
  Synthetic
gccaagcatttaggtgacactatagtgcccaggagagataatagagtttcagagctatgctggaaacagc

SEQ ID NO: 51301 - DNA, 70 bp, Artificial Sequence
  Synthetic
gccaagcatttaggtgacactatagatcagaaggttctgaacagcgtttcagagctatgctggaaacagc

SEQ ID NO: 51302 - DNA, 70 bp, Artificial Sequence
  Synthetic
gccaagcatttaggtgacactatagtttagcagaggatgaagagcgtttcagagctatgctggaaacagc

SEQ ID NO: 51303 - DNA, 70 bp, Artificial Sequence
  Synthetic
gccaagcatttaggtgacactatagccaggacccactgttcattcgtttcagagctatgctggaaacagc

SEQ ID NO: 51304 - DNA, 70 bp, Artificial Sequence
  Synthetic
gccaagcatttaggtgacactataggaagtcggcctcttcctgatgtttcagagctatgctggaaacagc

SEQ ID NO: 51305 - DNA, 70 bp, Artificial Sequence
  Synthetic
gccaagcatttaggtgacactataggagtggtttcatttacgtgagtttcagagctatgctggaaacagc

SEQ ID NO: 51306 - DNA, 70 bp, Artificial Sequence
  Synthetic
gccaagcatttaggtgacactataggcaagaaatcatctgacagcgtttcagagctatgctggaaacagc

SEQ ID NO: 51307 - DNA, 70 bp, Artificial Sequence
  Synthetic
gccaagcatttaggtgacactatagggctggtggagcttctcagtgtttcagagctatgctggaaacagc

SEQ ID NO: 51308 - DNA, 70 bp, Artificial Sequence
  Synthetic
gccaagcatttaggtgacactatagtcagagacatccaagttggagtttcagagctatgctggaaacagc

SEQ ID NO: 51309 - DNA, 70 bp, Artificial Sequence
  Synthetic
gccaagcatttaggtgacactatagcggagtttcagtaaagcattgtttcagagctatgctggaaacagc

SEQ ID NO: 51310 - DNA, 70 bp, Artificial Sequence
  Synthetic
gccaagcatttaggtgacactatagagtgctgtgtcaggcaaagagtttcagagctatgctggaaacagc

SEQ ID NO: 51311 - DNA, 70 bp, Artificial Sequence
  Synthetic
gccaagcatttaggtgacactatagtttgcacttgtacttggctggtttcagagctatgctggaaacagc

SEQ ID NO: 51312 - DNA, 70 bp, Artificial Sequence
  Synthetic
gccaagcatttaggtgacactataggcaactcaacgctgaagacagtttcagagctatgctggaaacagc

SEQ ID NO: 51313 - DNA, 70 bp, Artificial Sequence
  Synthetic
gccaagcatttaggtgacactatagttgccccaccagagacgagggtttcagagctatgctggaaacagc

SEQ ID NO: 51314 - DNA, 70 bp, Artificial Sequence
  Synthetic
gccaagcatttaggtgacactatagtttgtcaaaatcaggttgctgtttcagagctatgctggaaacagc

SEQ ID NO: 51315 - DNA, 70 bp, Artificial Sequence
  Synthetic
gccaagcatttaggtgacactatagaacccaaaaaggtgtacagcgtttcagagctatgctggaaacagc

SEQ ID NO: 51316 - DNA, 70 bp, Artificial Sequence
  Synthetic
gccaagcatttaggtgacactatagacgaagaagaacagaggcttgtttcagagctatgctggaaacagc

SEQ ID NO: 51317 - DNA, 70 bp, Artificial Sequence
  Synthetic
gccaagcatttaggtgacactataggcaaagaaggacgcctcttcgtttcagagctatgctggaaacagc

SEQ ID NO: 51318 - DNA, 70 bp, Artificial Sequence
  Synthetic
gccaagcatttaggtgacactatagctctggcacgtggtggttacgtttcagagctatgctggaaacagc

SEQ ID NO: 51319 - DNA, 70 bp, Artificial Sequence
  Synthetic
gccaagcatttaggtgacactataggaggagatgtctatctcatcgtttcagagctatgctggaaacagc

SEQ ID NO: 51320 - DNA, 70 bp, Artificial Sequence
  Synthetic
gccaagcatttaggtgacactatagtcccagggggttgactggtggtttcagagctatgctggaaacagc

SEQ ID NO: 51321 - DNA, 70 bp, Artificial Sequence
  Synthetic
gccaagcatttaggtgacactatagtccagtagatgatgagtcatgtttcagagctatgctggaaacagc

SEQ ID NO: 51322 - DNA, 70 bp, Artificial Sequence
  Synthetic
gccaagcatttaggtgacactatagactgtcggctcagaagtccagtttcagagctatgctggaaacagc

SEQ ID NO: 51323 - DNA, 70 bp, Artificial Sequence
  Synthetic
gccaagcatttaggtgacactatagagtcgatgggacagttagaggtttcagagctatgctggaaacagc

SEQ ID NO: 51324 - DNA, 70 bp, Artificial Sequence
  Synthetic
gccaagcatttaggtgacactatagaaatggaaagacctcaaggagtttcagagctatgctggaaacagc

SEQ ID NO: 51325 - DNA, 70 bp, Artificial Sequence
  Synthetic
gccaagcatttaggtgacactatagtcataaaagaagagctgatcgtttcagagctatgctggaaacagc

SEQ ID NO: 51326 - DNA, 70 bp, Artificial Sequence
  Synthetic
gccaagcatttaggtgacactatagggaaaaatgaagaagcggaagtttcagagctatgctggaaacagc

SEQ ID NO: 51327 - DNA, 70 bp, Artificial Sequence
  Synthetic
gccaagcatttaggtgacactatagggccgtgtggggctcagaccgtttcagagctatgctggaaacagc

SEQ ID NO: 51328 - DNA, 70 bp, Artificial Sequence
  Synthetic
gccaagcatttaggtgacactatagtcttattgggaatatcctgtgtttcagagctatgctggaaacagc

SEQ ID NO: 51329 - DNA, 70 bp, Artificial Sequence
  Synthetic
gccaagcatttaggtgacactatagctcagtcaaaactccgtttggtttcagagctatgctggaaacagc

SEQ ID NO: 51330 - DNA, 70 bp, Artificial Sequence
  Synthetic
gccaagcatttaggtgacactatagaagcagagggcggcctaggcgtttcagagctatgctggaaacagc

SEQ ID NO: 51331 - DNA, 70 bp, Artificial Sequence
  Synthetic
gccaagcatttaggtgacactatagctaatgctctccctttccaagtttcagagctatgctggaaacagc

SEQ ID NO: 51332 - DNA, 70 bp, Artificial Sequence
  Synthetic
gccaagcatttaggtgacactatagaaaacctggacaaagacgcagtttcagagctatgctggaaacagc

SEQ ID NO: 51333 - DNA, 70 bp, Artificial Sequence
  Synthetic
gccaagcatttaggtgacactatagaagatgcggaagaggatgtggtttcagagctatgctggaaacagc

SEQ ID NO: 51334 - DNA, 70 bp, Artificial Sequence
  Synthetic
gccaagcatttaggtgacactatagggatttagggatctcagattgtttcagagctatgctggaaacagc

SEQ ID NO: 51335 - DNA, 70 bp, Artificial Sequence
  Synthetic
gccaagcatttaggtgacactatagagaggcccaacaacctcagggtttcagagctatgctggaaacagc

SEQ ID NO: 51336 - DNA, 70 bp, Artificial Sequence
  Synthetic
gccaagcatttaggtgacactatagattgaggacctgatatcattgtttcagagctatgctggaaacagc

SEQ ID NO: 51337 - DNA, 70 bp, Artificial Sequence
  Synthetic
gccaagcatttaggtgacactatagggctgccaggaaagtcacctgtttcagagctatgctggaaacagc

SEQ ID NO: 51338 - DNA, 70 bp, Artificial Sequence
  Synthetic
gccaagcatttaggtgacactatagggtgagtagactgtataacagtttcagagctatgctggaaacagc

SEQ ID NO: 51339 - DNA, 70 bp, Artificial Sequence
  Synthetic
gccaagcatttaggtgacactatagggttacaggagctaatcttagtttcagagctatgctggaaacagc

SEQ ID NO: 51340 - DNA, 70 bp, Artificial Sequence
  Synthetic
gccaagcatttaggtgacactatagtaaggtttctcatcttctacgtttcagagctatgctggaaacagc

SEQ ID NO: 51341 - DNA, 70 bp, Artificial Sequence
  Synthetic
gccaagcatttaggtgacactatagagttgtactcagttgttcaagtttcagagctatgctggaaacagc

SEQ ID NO: 51342 - DNA, 70 bp, Artificial Sequence
  Synthetic
gccaagcatttaggtgacactatagtaagcgtgacaatgtagtccgtttcagagctatgctggaaacagc

SEQ ID NO: 51343 - DNA, 70 bp, Artificial Sequence
  Synthetic
gccaagcatttaggtgacactatagtgcccaagactcagtctatcgtttcagagctatgctggaaacagc

SEQ ID NO: 51344 - DNA, 70 bp, Artificial Sequence
  Synthetic
gccaagcatttaggtgacactataggcggccgatggagcctcacagtttcagagctatgctggaaacagc

SEQ ID NO: 51345 - DNA, 70 bp, Artificial Sequence
  Synthetic
gccaagcatttaggtgacactataggccaggcccaaggctgcagagtttcagagctatgctggaaacagc

SEQ ID NO: 51346 - DNA, 70 bp, Artificial Sequence
  Synthetic
gccaagcatttaggtgacactataggaactcatcaggaagacaaagtttcagagctatgctggaaacagc

SEQ ID NO: 51347 - DNA, 70 bp, Artificial Sequence
  Synthetic
gccaagcatttaggtgacactatagatccttctctgctaagctctgtttcagagctatgctggaaacagc

SEQ ID NO: 51348 - DNA, 70 bp, Artificial Sequence
  Synthetic
gccaagcatttaggtgacactatagcttgcagcatcaagttcctcgtttcagagctatgctggaaacagc

SEQ ID NO: 51349 - DNA, 70 bp, Artificial Sequence
  Synthetic
gccaagcatttaggtgacactatagcctgccagtcctggatcagggtttcagagctatgctggaaacagc

SEQ ID NO: 51350 - DNA, 70 bp, Artificial Sequence
  Synthetic
gccaagcatttaggtgacactataggctaagagaggctaattttcgtttcagagctatgctggaaacagc

SEQ ID NO: 51351 - DNA, 70 bp, Artificial Sequence
  Synthetic
gccaagcatttaggtgacactatagacatctgaatgtgagcccaggtttcagagctatgctggaaacagc

SEQ ID NO: 51352 - DNA, 70 bp, Artificial Sequence
  Synthetic
gccaagcatttaggtgacactatagggagccaggtcccgatgtgggtttcagagctatgctggaaacagc

SEQ ID NO: 51353 - DNA, 70 bp, Artificial Sequence
  Synthetic
gccaagcatttaggtgacactatagcatctaccagggaagactctgtttcagagctatgctggaaacagc

SEQ ID NO: 51354 - DNA, 70 bp, Artificial Sequence
  Synthetic
gccaagcatttaggtgacactataggttgggaactgcctcattgggtttcagagctatgctggaaacagc

SEQ ID NO: 51355 - DNA, 70 bp, Artificial Sequence
  Synthetic
gccaagcatttaggtgacactatagagcgacagcagagtctgtaggtttcagagctatgctggaaacagc

SEQ ID NO: 51356 - DNA, 70 bp, Artificial Sequence
  Synthetic
gccaagcatttaggtgacactatagtctctgttctcatccctcaggtttcagagctatgctggaaacagc

SEQ ID NO: 51357 - DNA, 70 bp, Artificial Sequence
  Synthetic
gccaagcatttaggtgacactataggccaagtgctgcaagtgagcgtttcagagctatgctggaaacagc

SEQ ID NO: 51358 - DNA, 70 bp, Artificial Sequence
  Synthetic
gccaagcatttaggtgacactatagtctttcttcggcagcattttgtttcagagctatgctggaaacagc

SEQ ID NO: 51359 - DNA, 70 bp, Artificial Sequence
  Synthetic
gccaagcatttaggtgacactatagtgcatgctgtttgagaaaatgtttcagagctatgctggaaacagc

SEQ ID NO: 51360 - DNA, 70 bp, Artificial Sequence
  Synthetic
gccaagcatttaggtgacactatagactttctctgctgcagacaggtttcagagctatgctggaaacagc

SEQ ID NO: 51361 - DNA, 70 bp, Artificial Sequence
  Synthetic
gccaagcatttaggtgacactatagtaatctataatgctcccacagtttcagagctatgctggaaacagc

SEQ ID NO: 51362 - DNA, 70 bp, Artificial Sequence
  Synthetic
gccaagcatttaggtgacactatagacctttgaagtaaagattgggtttcagagctatgctggaaacagc

SEQ ID NO: 51363 - DNA, 70 bp, Artificial Sequence
  Synthetic
gccaagcatttaggtgacactatagtgagagcactacacccaaaagtttcagagctatgctggaaacagc

SEQ ID NO: 51364 - DNA, 70 bp, Artificial Sequence
  Synthetic
gccaagcatttaggtgacactataggaaagatgcgaaaaagtgaggtttcagagctatgctggaaacagc

SEQ ID NO: 51365 - DNA, 70 bp, Artificial Sequence
  Synthetic
gccaagcatttaggtgacactatagtgcaagcagcaatgagttccgtttcagagctatgctggaaacagc

SEQ ID NO: 51366 - DNA, 70 bp, Artificial Sequence
  Synthetic
gccaagcatttaggtgacactatagactcagtagggactcaagaagtttcagagctatgctggaaacagc

SEQ ID NO: 51367 - DNA, 70 bp, Artificial Sequence
  Synthetic
gccaagcatttaggtgacactatagtaacccctgctgtgcggtatgtttcagagctatgctggaaacagc

SEQ ID NO: 51368 - DNA, 70 bp, Artificial Sequence
  Synthetic
gccaagcatttaggtgacactatagtcagtgcagcaaatttttctgtttcagagctatgctggaaacagc

SEQ ID NO: 51369 - DNA, 70 bp, Artificial Sequence
  Synthetic
gccaagcatttaggtgacactatagatagctcacttgtctcttttgtttcagagctatgctggaaacagc

SEQ ID NO: 51370 - DNA, 70 bp, Artificial Sequence
  Synthetic
gccaagcatttaggtgacactatagactgtttgtaactgacaagtgtttcagagctatgctggaaacagc

SEQ ID NO: 51371 - DNA, 70 bp, Artificial Sequence
  Synthetic
gccaagcatttaggtgacactatagcgagaggaagtcatgagctagtttcagagctatgctggaaacagc

SEQ ID NO: 51372 - DNA, 70 bp, Artificial Sequence
  Synthetic
gccaagcatttaggtgacactatagaccagcactcaaggtagtctgtttcagagctatgctggaaacagc

SEQ ID NO: 51373 - DNA, 70 bp, Artificial Sequence
  Synthetic
gccaagcatttaggtgacactatagcttcatttttggagctgttggtttcagagctatgctggaaacagc

SEQ ID NO: 51374 - DNA, 70 bp, Artificial Sequence
  Synthetic
gccaagcatttaggtgacactatagagactgcagaagttgattccgtttcagagctatgctggaaacagc

SEQ ID NO: 51375 - DNA, 70 bp, Artificial Sequence
  Synthetic
gccaagcatttaggtgacactatagaggcttcaaagcagttaaaagtttcagagctatgctggaaacagc

SEQ ID NO: 51376 - DNA, 70 bp, Artificial Sequence
  Synthetic
gccaagcatttaggtgacactatagtcatattcatgcttggggacgtttcagagctatgctggaaacagc

SEQ ID NO: 51377 - DNA, 70 bp, Artificial Sequence
  Synthetic
gccaagcatttaggtgacactatagtgagtaagagctgtctgagagtttcagagctatgctggaaacagc

SEQ ID NO: 51378 - DNA, 70 bp, Artificial Sequence
  Synthetic
gccaagcatttaggtgacactatagaggctggaatgttcaaccaggtttcagagctatgctggaaacagc

SEQ ID NO: 51379 - DNA, 70 bp, Artificial Sequence
  Synthetic
gccaagcatttaggtgacactatagtttatgtagactgtgtcttcgtttcagagctatgctggaaacagc

SEQ ID NO: 51380 - DNA, 70 bp, Artificial Sequence
  Synthetic
gccaagcatttaggtgacactatagttagactgtgaaaatggtgagtttcagagctatgctggaaacagc

SEQ ID NO: 51381 - DNA, 70 bp, Artificial Sequence
  Synthetic
gccaagcatttaggtgacactataggaagcagaagagcagtaatggtttcagagctatgctggaaacagc

SEQ ID NO: 51382 - DNA, 70 bp, Artificial Sequence
  Synthetic
gccaagcatttaggtgacactatagtatccaactccggttcccaagtttcagagctatgctggaaacagc

SEQ ID NO: 51383 - DNA, 70 bp, Artificial Sequence
  Synthetic
gccaagcatttaggtgacactatagaaattgacggacaaaagaaggtttcagagctatgctggaaacagc

SEQ ID NO: 51384 - DNA, 70 bp, Artificial Sequence
  Synthetic
gccaagcatttaggtgacactatagatcattagaagtgaagcttcgtttcagagctatgctggaaacagc

SEQ ID NO: 51385 - DNA, 70 bp, Artificial Sequence
  Synthetic
gccaagcatttaggtgacactatagcaaggagaagaaacacacaagtttcagagctatgctggaaacagc

SEQ ID NO: 51386 - DNA, 70 bp, Artificial Sequence
  Synthetic
gccaagcatttaggtgacactatagagttttgtgcagaaaccaatgtttcagagctatgctggaaacagc

SEQ ID NO: 51387 - DNA, 70 bp, Artificial Sequence
  Synthetic
gccaagcatttaggtgacactatagggtttcttatgtcagggtgcgtttcagagctatgctggaaacagc

SEQ ID NO: 51388 - DNA, 70 bp, Artificial Sequence
  Synthetic
gccaagcatttaggtgacactatagggcgactgcaaggtacttgcgtttcagagctatgctggaaacagc

SEQ ID NO: 51389 - DNA, 70 bp, Artificial Sequence
  Synthetic
gccaagcatttaggtgacactatagcccgcaagccaaagatccatgtttcagagctatgctggaaacagc

SEQ ID NO: 51390 - DNA, 70 bp, Artificial Sequence
  Synthetic
gccaagcatttaggtgacactatagtgctgcaaaaagccatgagggtttcagagctatgctggaaacagc

SEQ ID NO: 51391 - DNA, 70 bp, Artificial Sequence
  Synthetic
gccaagcatttaggtgacactatagccaaaaaggagagatggtgcgtttcagagctatgctggaaacagc

SEQ ID NO: 51392 - DNA, 70 bp, Artificial Sequence
  Synthetic
gccaagcatttaggtgacactatagagtttcctggatgggtgcaggtttcagagctatgctggaaacagc

SEQ ID NO: 51393 - DNA, 70 bp, Artificial Sequence
  Synthetic
gccaagcatttaggtgacactataggtgtacaggctggcaaaagagtttcagagctatgctggaaacagc

SEQ ID NO: 51394 - DNA, 70 bp, Artificial Sequence
  Synthetic
gccaagcatttaggtgacactatagattactggccagtgctaactgtttcagagctatgctggaaacagc

SEQ ID NO: 51395 - DNA, 70 bp, Artificial Sequence
  Synthetic
gccaagcatttaggtgacactatagaatcacagtccactttggacgtttcagagctatgctggaaacagc

SEQ ID NO: 51396 - DNA, 70 bp, Artificial Sequence
  Synthetic
gccaagcatttaggtgacactatagcgtaagtcaatgtgatgaaggtttcagagctatgctggaaacagc

SEQ ID NO: 51397 - DNA, 70 bp, Artificial Sequence
  Synthetic
gccaagcatttaggtgacactatagtgggagaccttcgagtgagcgtttcagagctatgctggaaacagc

SEQ ID NO: 51398 - DNA, 70 bp, Artificial Sequence
  Synthetic
gccaagcatttaggtgacactatagacttcaggtggcttttgtgggtttcagagctatgctggaaacagc

SEQ ID NO: 51399 - DNA, 70 bp, Artificial Sequence
  Synthetic
gccaagcatttaggtgacactataggccatgaaggtcgagctatggtttcagagctatgctggaaacagc

SEQ ID NO: 51400 - DNA, 70 bp, Artificial Sequence
  Synthetic
gccaagcatttaggtgacactatagttgttccttgggagaaagaagtttcagagctatgctggaaacagc

SEQ ID NO: 51401 - DNA, 70 bp, Artificial Sequence
  Synthetic
gccaagcatttaggtgacactatagtgatcttaagaagtgctttggtttcagagctatgctggaaacagc

SEQ ID NO: 51402 - DNA, 70 bp, Artificial Sequence
  Synthetic
gccaagcatttaggtgacactatagaataagttcctgaagggactgtttcagagctatgctggaaacagc

SEQ ID NO: 51403 - DNA, 70 bp, Artificial Sequence
  Synthetic
gccaagcatttaggtgacactatagtcacctgctctacagactaggtttcagagctatgctggaaacagc

SEQ ID NO: 51404 - DNA, 70 bp, Artificial Sequence
  Synthetic
gccaagcatttaggtgacactatagaatagaattttgcggagtctgtttcagagctatgctggaaacagc

SEQ ID NO: 51405 - DNA, 70 bp, Artificial Sequence
  Synthetic
gccaagcatttaggtgacactatagagaagaaacagaagaaaccagtttcagagctatgctggaaacagc

SEQ ID NO: 51406 - DNA, 70 bp, Artificial Sequence
  Synthetic
gccaagcatttaggtgacactataggggaaagtcgccatttggaagtttcagagctatgctggaaacagc

SEQ ID NO: 51407 - DNA, 70 bp, Artificial Sequence
  Synthetic
gccaagcatttaggtgacactataggttgttaactgctttctcctgtttcagagctatgctggaaacagc

SEQ ID NO: 51408 - DNA, 70 bp, Artificial Sequence
  Synthetic
gccaagcatttaggtgacactatagatggaatgtcgaaaaaccttgtttcagagctatgctggaaacagc

SEQ ID NO: 51409 - DNA, 70 bp, Artificial Sequence
  Synthetic
gccaagcatttaggtgacactataggcttaaggtctctagcattcgtttcagagctatgctggaaacagc

SEQ ID NO: 51410 - DNA, 70 bp, Artificial Sequence
  Synthetic
gccaagcatttaggtgacactataggagtggtgcaggaagtgtttgtttcagagctatgctggaaacagc

SEQ ID NO: 51411 - DNA, 70 bp, Artificial Sequence
  Synthetic
gccaagcatttaggtgacactatagctggagacgtcccttgtcaagtttcagagctatgctggaaacagc

SEQ ID NO: 51412 - DNA, 70 bp, Artificial Sequence
  Synthetic
gccaagcatttaggtgacactatagtgcacacatgtatgaggatggtttcagagctatgctggaaacagc

SEQ ID NO: 51413 - DNA, 70 bp, Artificial Sequence
  Synthetic
gccaagcatttaggtgacactatagaggatcactcatcaaaggaggtttcagagctatgctggaaacagc

SEQ ID NO: 51414 - DNA, 70 bp, Artificial Sequence
  Synthetic
gccaagcatttaggtgacactatagcaaggcatactgctcaaaacgtttcagagctatgctggaaacagc

SEQ ID NO: 51415 - DNA, 70 bp, Artificial Sequence
  Synthetic
gccaagcatttaggtgacactatagcccttggctttgttctaggggtttcagagctatgctggaaacagc

SEQ ID NO: 51416 - DNA, 70 bp, Artificial Sequence
  Synthetic
gccaagcatttaggtgacactataggatgacagcatcgaagatctgtttcagagctatgctggaaacagc

SEQ ID NO: 51417 - DNA, 70 bp, Artificial Sequence
  Synthetic
gccaagcatttaggtgacactatagtatcttagactacggaacttgtttcagagctatgctggaaacagc

SEQ ID NO: 51418 - DNA, 70 bp, Artificial Sequence
  Synthetic
gccaagcatttaggtgacactataggaaaccacagctgctaatgtgtttcagagctatgctggaaacagc

SEQ ID NO: 51419 - DNA, 70 bp, Artificial Sequence
  Synthetic
gccaagcatttaggtgacactatagcagctacacatctacagcttgtttcagagctatgctggaaacagc

SEQ ID NO: 51420 - DNA, 70 bp, Artificial Sequence
  Synthetic
gccaagcatttaggtgacactatagtactcaggtagacataagctgtttcagagctatgctggaaacagc

SEQ ID NO: 51421 - DNA, 70 bp, Artificial Sequence
  Synthetic
gccaagcatttaggtgacactatagttggaataagttctctgtctgtttcagagctatgctggaaacagc

SEQ ID NO: 51422 - DNA, 70 bp, Artificial Sequence
  Synthetic
gccaagcatttaggtgacactatagcaggtgcagcctggcctcacgtttcagagctatgctggaaacagc

SEQ ID NO: 51423 - DNA, 70 bp, Artificial Sequence
  Synthetic
gccaagcatttaggtgacactataggcatcactgcactttatcctgtttcagagctatgctggaaacagc

SEQ ID NO: 51424 - DNA, 70 bp, Artificial Sequence
  Synthetic
gccaagcatttaggtgacactatagggttgtcttctctgtattgtgtttcagagctatgctggaaacagc

SEQ ID NO: 51425 - DNA, 70 bp, Artificial Sequence
  Synthetic
gccaagcatttaggtgacactataggattgtcatggaagtcatgggtttcagagctatgctggaaacagc

SEQ ID NO: 51426 - DNA, 70 bp, Artificial Sequence
  Synthetic
gccaagcatttaggtgacactatagtggtgactgatttaagacatgtttcagagctatgctggaaacagc

SEQ ID NO: 51427 - DNA, 70 bp, Artificial Sequence
  Synthetic
gccaagcatttaggtgacactatagcgacttggagaccagtgaaggtttcagagctatgctggaaacagc

SEQ ID NO: 51428 - DNA, 70 bp, Artificial Sequence
  Synthetic
gccaagcatttaggtgacactatagggtgagggccagcggcttgggtttcagagctatgctggaaacagc

SEQ ID NO: 51429 - DNA, 70 bp, Artificial Sequence
  Synthetic
gccaagcatttaggtgacactatagtccagaagcactttatgaaagtttcagagctatgctggaaacagc

SEQ ID NO: 51430 - DNA, 70 bp, Artificial Sequence
  Synthetic
gccaagcatttaggtgacactatagccccttgcttggcctcaggagtttcagagctatgctggaaacagc

SEQ ID NO: 51431 - DNA, 70 bp, Artificial Sequence
  Synthetic
gccaagcatttaggtgacactatagctgggtgggggtcactgctggtttcagagctatgctggaaacagc

SEQ ID NO: 51432 - DNA, 70 bp, Artificial Sequence
  Synthetic
gccaagcatttaggtgacactatagggagggctctcaacactcacgtttcagagctatgctggaaacagc

SEQ ID NO: 51433 - DNA, 70 bp, Artificial Sequence
  Synthetic
gccaagcatttaggtgacactatagcacttcatgctgctgctgtggtttcagagctatgctggaaacagc

SEQ ID NO: 51434 - DNA, 70 bp, Artificial Sequence
  Synthetic
gccaagcatttaggtgacactatagacccaacggccagagctaacgtttcagagctatgctggaaacagc

SEQ ID NO: 51435 - DNA, 70 bp, Artificial Sequence
  Synthetic
gccaagcatttaggtgacactatagttatagtttagtgtggcgccgtttcagagctatgctggaaacagc

SEQ ID NO: 51436 - DNA, 70 bp, Artificial Sequence
  Synthetic
gccaagcatttaggtgacactatagtatgcgacactgctgcacgtgtttcagagctatgctggaaacagc

SEQ ID NO: 51437 - DNA, 70 bp, Artificial Sequence
  Synthetic
gccaagcatttaggtgacactatagctcgtttctcttcttccagagtttcagagctatgctggaaacagc

SEQ ID NO: 51438 - DNA, 70 bp, Artificial Sequence
  Synthetic
gccaagcatttaggtgacactatagaaggctcaactcacatcaaagtttcagagctatgctggaaacagc

SEQ ID NO: 51439 - DNA, 70 bp, Artificial Sequence
  Synthetic
gccaagcatttaggtgacactatagcacttcccgctgctgctatggtttcagagctatgctggaaacagc

SEQ ID NO: 51440 - DNA, 70 bp, Artificial Sequence
  Synthetic
gccaagcatttaggtgacactatagcctctgtagctcagtgacccgtttcagagctatgctggaaacagc

SEQ ID NO: 51441 - DNA, 70 bp, Artificial Sequence
  Synthetic
gccaagcatttaggtgacactatagacgtggtgtgtacgtgtcacgtttcagagctatgctggaaacagc

SEQ ID NO: 51442 - DNA, 70 bp, Artificial Sequence
  Synthetic
gccaagcatttaggtgacactatagctgaatggactctgtgctttgtttcagagctatgctggaaacagc

SEQ ID NO: 51443 - DNA, 70 bp, Artificial Sequence
  Synthetic
gccaagcatttaggtgacactatagctatgaggccccagcggcaggtttcagagctatgctggaaacagc

SEQ ID NO: 51444 - DNA, 70 bp, Artificial Sequence
  Synthetic
gccaagcatttaggtgacactatagggctggctcagttcacctccgtttcagagctatgctggaaacagc

SEQ ID NO: 51445 - DNA, 70 bp, Artificial Sequence
  Synthetic
gccaagcatttaggtgacactatagagagctgacaattacataacgtttcagagctatgctggaaacagc

SEQ ID NO: 51446 - DNA, 70 bp, Artificial Sequence
  Synthetic
gccaagcatttaggtgacactatagcctcaatactgtggtgtagagtttcagagctatgctggaaacagc

SEQ ID NO: 51447 - DNA, 70 bp, Artificial Sequence
  Synthetic
gccaagcatttaggtgacactatagtctgctgcctgtggctatgggtttcagagctatgctggaaacagc

SEQ ID NO: 51448 - DNA, 70 bp, Artificial Sequence
  Synthetic
gccaagcatttaggtgacactatagtgtgcaccgtggacgtgtgagtttcagagctatgctggaaacagc

SEQ ID NO: 51449 - DNA, 70 bp, Artificial Sequence
  Synthetic
gccaagcatttaggtgacactatagtttggcttcttgagctaagggtttcagagctatgctggaaacagc

SEQ ID NO: 51450 - DNA, 70 bp, Artificial Sequence
  Synthetic
gccaagcatttaggtgacactatagcacaggattattccttgcttgtttcagagctatgctggaaacagc

SEQ ID NO: 51451 - DNA, 70 bp, Artificial Sequence
  Synthetic
gccaagcatttaggtgacactatagtactctgtactcactgtgcagtttcagagctatgctggaaacagc

SEQ ID NO: 51452 - DNA, 70 bp, Artificial Sequence
  Synthetic
gccaagcatttaggtgacactatagggacagaggctaggcctcgagtttcagagctatgctggaaacagc

SEQ ID NO: 51453 - DNA, 70 bp, Artificial Sequence
  Synthetic
gccaagcatttaggtgacactatagtataaaggcgactgaatagagtttcagagctatgctggaaacagc

SEQ ID NO: 51454 - DNA, 70 bp, Artificial Sequence
  Synthetic
gccaagcatttaggtgacactataggcagcttcttctcgttgagagtttcagagctatgctggaaacagc

SEQ ID NO: 51455 - DNA, 70 bp, Artificial Sequence
  Synthetic
gccaagcatttaggtgacactatagaaggagcactccacagtcgggtttcagagctatgctggaaacagc

SEQ ID NO: 51456 - DNA, 70 bp, Artificial Sequence
  Synthetic
gccaagcatttaggtgacactatagttccaagctctttaattcccgtttcagagctatgctggaaacagc

SEQ ID NO: 51457 - DNA, 70 bp, Artificial Sequence
  Synthetic
gccaagcatttaggtgacactatagagggtcaaacagcagtttccgtttcagagctatgctggaaacagc

SEQ ID NO: 51458 - DNA, 70 bp, Artificial Sequence
  Synthetic
gccaagcatttaggtgacactatagggctacagttgagatctcgagtttcagagctatgctggaaacagc

SEQ ID NO: 51459 - DNA, 70 bp, Artificial Sequence
  Synthetic
gccaagcatttaggtgacactatagctgagagcgatcctaggtaggtttcagagctatgctggaaacagc

SEQ ID NO: 51460 - DNA, 70 bp, Artificial Sequence
  Synthetic
gccaagcatttaggtgacactatagccaggagacggctgtgtagcgtttcagagctatgctggaaacagc

SEQ ID NO: 51461 - DNA, 70 bp, Artificial Sequence
  Synthetic
gccaagcatttaggtgacactatagggtggacgtcaccacggcacgtttcagagctatgctggaaacagc

SEQ ID NO: 51462 - DNA, 70 bp, Artificial Sequence
  Synthetic
gccaagcatttaggtgacactatagagccagaaacccgcctgtacgtttcagagctatgctggaaacagc

SEQ ID NO: 51463 - DNA, 70 bp, Artificial Sequence
  Synthetic
gccaagcatttaggtgacactatagacaagaagacctcatgagaggtttcagagctatgctggaaacagc

SEQ ID NO: 51464 - DNA, 70 bp, Artificial Sequence
  Synthetic
gccaagcatttaggtgacactatagaaggccgccaggcactgagcgtttcagagctatgctggaaacagc

SEQ ID NO: 51465 - DNA, 70 bp, Artificial Sequence
  Synthetic
gccaagcatttaggtgacactatagtgctgcctggaatcttctaagtttcagagctatgctggaaacagc

SEQ ID NO: 51466 - DNA, 70 bp, Artificial Sequence
  Synthetic
gccaagcatttaggtgacactatagaggctgatgcagtgcccagagtttcagagctatgctggaaacagc

SEQ ID NO: 51467 - DNA, 70 bp, Artificial Sequence
  Synthetic
gccaagcatttaggtgacactatagggatacatcagcgtttgtctgtttcagagctatgctggaaacagc

SEQ ID NO: 51468 - DNA, 70 bp, Artificial Sequence
  Synthetic
gccaagcatttaggtgacactatagacctgccctggccaccgctcgtttcagagctatgctggaaacagc

SEQ ID NO: 51469 - DNA, 70 bp, Artificial Sequence
  Synthetic
gccaagcatttaggtgacactatagtctgatgtccaggaggagaagtttcagagctatgctggaaacagc

SEQ ID NO: 51470 - DNA, 70 bp, Artificial Sequence
  Synthetic
gccaagcatttaggtgacactatagtggacatcagagagaacaccgtttcagagctatgctggaaacagc

SEQ ID NO: 51471 - DNA, 70 bp, Artificial Sequence
  Synthetic
gccaagcatttaggtgacactatagacttgatgtgtttcccctccgtttcagagctatgctggaaacagc

SEQ ID NO: 51472 - DNA, 70 bp, Artificial Sequence
  Synthetic
gccaagcatttaggtgacactatagcgcttagcggaggagctactgtttcagagctatgctggaaacagc

SEQ ID NO: 51473 - DNA, 70 bp, Artificial Sequence
  Synthetic
gccaagcatttaggtgacactatagggagcagatcatcggaggtggtttcagagctatgctggaaacagc

SEQ ID NO: 51474 - DNA, 70 bp, Artificial Sequence
  Synthetic
gccaagcatttaggtgacactatagtgagaagaacgaggactgaggtttcagagctatgctggaaacagc

SEQ ID NO: 51475 - DNA, 70 bp, Artificial Sequence
  Synthetic
gccaagcatttaggtgacactataggttagaacttgctagtgtaggtttcagagctatgctggaaacagc

SEQ ID NO: 51476 - DNA, 70 bp, Artificial Sequence
  Synthetic
gccaagcatttaggtgacactatagccagatgaggcccacggagcgtttcagagctatgctggaaacagc

SEQ ID NO: 51477 - DNA, 70 bp, Artificial Sequence
  Synthetic
gccaagcatttaggtgacactataggctggctcagacatttaaatgtttcagagctatgctggaaacagc

SEQ ID NO: 51478 - DNA, 70 bp, Artificial Sequence
  Synthetic
gccaagcatttaggtgacactatagctttcctcctctacaaacaagtttcagagctatgctggaaacagc

SEQ ID NO: 51479 - DNA, 70 bp, Artificial Sequence
  Synthetic
gccaagcatttaggtgacactataggacttcctccctggctgtgagtttcagagctatgctggaaacagc

SEQ ID NO: 51480 - DNA, 70 bp, Artificial Sequence
  Synthetic
gccaagcatttaggtgacactatagggcctgagggttaggagagcgtttcagagctatgctggaaacagc

SEQ ID NO: 51481 - DNA, 70 bp, Artificial Sequence
  Synthetic
gccaagcatttaggtgacactatagagtggtccagatgtcagaaggtttcagagctatgctggaaacagc

SEQ ID NO: 51482 - DNA, 70 bp, Artificial Sequence
  Synthetic
gccaagcatttaggtgacactatagccaggcccaggagcctgagggtttcagagctatgctggaaacagc

SEQ ID NO: 51483 - DNA, 70 bp, Artificial Sequence
  Synthetic
gccaagcatttaggtgacactatagctactccactcggctctgaggtttcagagctatgctggaaacagc

SEQ ID NO: 51484 - DNA, 70 bp, Artificial Sequence
  Synthetic
gccaagcatttaggtgacactataggcatgaacactttcaaaggggtttcagagctatgctggaaacagc

SEQ ID NO: 51485 - DNA, 70 bp, Artificial Sequence
  Synthetic
gccaagcatttaggtgacactatagagctggcatcttcagagcacgtttcagagctatgctggaaacagc

SEQ ID NO: 51486 - DNA, 70 bp, Artificial Sequence
  Synthetic
gccaagcatttaggtgacactatagggctgtctcccggtcctcaggtttcagagctatgctggaaacagc

SEQ ID NO: 51487 - DNA, 70 bp, Artificial Sequence
  Synthetic
gccaagcatttaggtgacactatagggctgtctccgggtcctcaggtttcagagctatgctggaaacagc

SEQ ID NO: 51488 - DNA, 70 bp, Artificial Sequence
  Synthetic
gccaagcatttaggtgacactatagctggatggacaaggaaaaaggtttcagagctatgctggaaacagc

SEQ ID NO: 51489 - DNA, 70 bp, Artificial Sequence
  Synthetic
gccaagcatttaggtgacactatagcgctggagctggagcttgacgtttcagagctatgctggaaacagc

SEQ ID NO: 51490 - DNA, 70 bp, Artificial Sequence
  Synthetic
gccaagcatttaggtgacactatagtgagaactttaagagtggtggtttcagagctatgctggaaacagc

SEQ ID NO: 51491 - DNA, 70 bp, Artificial Sequence
  Synthetic
gccaagcatttaggtgacactataggtcagagtactaggagttctgtttcagagctatgctggaaacagc

SEQ ID NO: 51492 - DNA, 70 bp, Artificial Sequence
  Synthetic
gccaagcatttaggtgacactatagagctcaatgtcccggaggaggtttcagagctatgctggaaacagc

SEQ ID NO: 51493 - DNA, 70 bp, Artificial Sequence
  Synthetic
gccaagcatttaggtgacactatagttagctgagtcacactgcctgtttcagagctatgctggaaacagc

SEQ ID NO: 51494 - DNA, 70 bp, Artificial Sequence
  Synthetic
gccaagcatttaggtgacactatagatcctgagacaggatatcacgtttcagagctatgctggaaacagc

SEQ ID NO: 51495 - DNA, 70 bp, Artificial Sequence
  Synthetic
gccaagcatttaggtgacactatagcaaaagtcatcatcaagcgagtttcagagctatgctggaaacagc

SEQ ID NO: 51496 - DNA, 70 bp, Artificial Sequence
  Synthetic
gccaagcatttaggtgacactatagtcagtactgtgaatattcctgtttcagagctatgctggaaacagc

SEQ ID NO: 51497 - DNA, 70 bp, Artificial Sequence
  Synthetic
gccaagcatttaggtgacactataggcaaaacacgagaagagctagtttcagagctatgctggaaacagc

SEQ ID NO: 51498 - DNA, 70 bp, Artificial Sequence
  Synthetic
gccaagcatttaggtgacactatagaatgacagctatctttacaggtttcagagctatgctggaaacagc

SEQ ID NO: 51499 - DNA, 70 bp, Artificial Sequence
  Synthetic
gccaagcatttaggtgacactataggcgcacatcaaagctgccacgtttcagagctatgctggaaacagc

SEQ ID NO: 51500 - DNA, 70 bp, Artificial Sequence
  Synthetic
gccaagcatttaggtgacactatagtgtgtttgctggggagtcacgtttcagagctatgctggaaacagc

SEQ ID NO: 51501 - DNA, 70 bp, Artificial Sequence
  Synthetic
gccaagcatttaggtgacactatagtcctggggcggctcagtttcgtttcagagctatgctggaaacagc

SEQ ID NO: 51502 - DNA, 70 bp, Artificial Sequence
  Synthetic
gccaagcatttaggtgacactatagcggaagcagcacgtgtgagcgtttcagagctatgctggaaacagc

SEQ ID NO: 51503 - DNA, 70 bp, Artificial Sequence
  Synthetic
gccaagcatttaggtgacactatagtagctgtgggctcctctcacgtttcagagctatgctggaaacagc

SEQ ID NO: 51504 - DNA, 70 bp, Artificial Sequence
  Synthetic
gccaagcatttaggtgacactataggtcagctgtaatatccatccgtttcagagctatgctggaaacagc

SEQ ID NO: 51505 - DNA, 70 bp, Artificial Sequence
  Synthetic
gccaagcatttaggtgacactataggcagccaggtttctggtcaggtttcagagctatgctggaaacagc

SEQ ID NO: 51506 - DNA, 70 bp, Artificial Sequence
  Synthetic
gccaagcatttaggtgacactatagcctcagctcacagaccaaaggtttcagagctatgctggaaacagc

SEQ ID NO: 51507 - DNA, 70 bp, Artificial Sequence
  Synthetic
gccaagcatttaggtgacactatagcgaaaggaaacaggctaagggtttcagagctatgctggaaacagc

SEQ ID NO: 51508 - DNA, 70 bp, Artificial Sequence
  Synthetic
gccaagcatttaggtgacactatagtcacaattgtgctgatgatcgtttcagagctatgctggaaacagc

SEQ ID NO: 51509 - DNA, 70 bp, Artificial Sequence
  Synthetic
gccaagcatttaggtgacactatagagcaatgaggtggtcagtccgtttcagagctatgctggaaacagc

SEQ ID NO: 51510 - DNA, 70 bp, Artificial Sequence
  Synthetic
gccaagcatttaggtgacactatagacaaactgctcatcactgtcgtttcagagctatgctggaaacagc

SEQ ID NO: 51511 - DNA, 70 bp, Artificial Sequence
  Synthetic
gccaagcatttaggtgacactatagagctttccgacggcgctgaagtttcagagctatgctggaaacagc

SEQ ID NO: 51512 - DNA, 70 bp, Artificial Sequence
  Synthetic
gccaagcatttaggtgacactatagcctgggctgtcactcaatctgtttcagagctatgctggaaacagc

SEQ ID NO: 51513 - DNA, 70 bp, Artificial Sequence
  Synthetic
gccaagcatttaggtgacactatagtttgaacaaagaactgggacgtttcagagctatgctggaaacagc

SEQ ID NO: 51514 - DNA, 70 bp, Artificial Sequence
  Synthetic
gccaagcatttaggtgacactatagggacagggaagaggaggtgggtttcagagctatgctggaaacagc

SEQ ID NO: 51515 - DNA, 70 bp, Artificial Sequence
  Synthetic
gccaagcatttaggtgacactatagcctacctgcgtgaggattgagtttcagagctatgctggaaacagc

SEQ ID NO: 51516 - DNA, 70 bp, Artificial Sequence
  Synthetic
gccaagcatttaggtgacactatagcagagatgtgactgcacaccgtttcagagctatgctggaaacagc

SEQ ID NO: 51517 - DNA, 70 bp, Artificial Sequence
  Synthetic
gccaagcatttaggtgacactataggttggccgtgcaagctaatggtttcagagctatgctggaaacagc

SEQ ID NO: 51518 - DNA, 70 bp, Artificial Sequence
  Synthetic
gccaagcatttaggtgacactatagtagatgagatagctccattggtttcagagctatgctggaaacagc

SEQ ID NO: 51519 - DNA, 70 bp, Artificial Sequence
  Synthetic
gccaagcatttaggtgacactatagtccaagatcagctacataaagtttcagagctatgctggaaacagc

SEQ ID NO: 51520 - DNA, 70 bp, Artificial Sequence
  Synthetic
gccaagcatttaggtgacactatagaagctcgtaatcttgccagcgtttcagagctatgctggaaacagc

SEQ ID NO: 51521 - DNA, 70 bp, Artificial Sequence
  Synthetic
gccaagcatttaggtgacactatagatgaaaacactgtgagaaaggtttcagagctatgctggaaacagc

SEQ ID NO: 51522 - DNA, 70 bp, Artificial Sequence
  Synthetic
gccaagcatttaggtgacactatagtggttacaaactttcagaacgtttcagagctatgctggaaacagc

SEQ ID NO: 51523 - DNA, 70 bp, Artificial Sequence
  Synthetic
gccaagcatttaggtgacactatagagagtcactgtggaagtagtgtttcagagctatgctggaaacagc

SEQ ID NO: 51524 - DNA, 70 bp, Artificial Sequence
  Synthetic
gccaagcatttaggtgacactatagtaaaaagcggtttcagctatgtttcagagctatgctggaaacagc

SEQ ID NO: 51525 - DNA, 70 bp, Artificial Sequence
  Synthetic
gccaagcatttaggtgacactatagaaagctgcaactcccagtccgtttcagagctatgctggaaacagc

SEQ ID NO: 51526 - DNA, 70 bp, Artificial Sequence
  Synthetic
gccaagcatttaggtgacactatagccggggcgtctaggcctgcggtttcagagctatgctggaaacagc

SEQ ID NO: 51527 - DNA, 70 bp, Artificial Sequence
  Synthetic
gccaagcatttaggtgacactatagcggctttctgggtggaggtggtttcagagctatgctggaaacagc

SEQ ID NO: 51528 - DNA, 70 bp, Artificial Sequence
  Synthetic
gccaagcatttaggtgacactatagaatgtccacctcttcattacgtttcagagctatgctggaaacagc

SEQ ID NO: 51529 - DNA, 70 bp, Artificial Sequence
  Synthetic
gccaagcatttaggtgacactatagctacatggattcaacgcagagtttcagagctatgctggaaacagc

SEQ ID NO: 51530 - DNA, 70 bp, Artificial Sequence
  Synthetic
gccaagcatttaggtgacactataggttgctcatatctgtttcacgtttcagagctatgctggaaacagc

SEQ ID NO: 51531 - DNA, 70 bp, Artificial Sequence
  Synthetic
gccaagcatttaggtgacactatagaggccactggtgctgaatttgtttcagagctatgctggaaacagc

SEQ ID NO: 51532 - DNA, 70 bp, Artificial Sequence
  Synthetic
gccaagcatttaggtgacactatagaacatttgggagtttatgcagtttcagagctatgctggaaacagc

SEQ ID NO: 51533 - DNA, 70 bp, Artificial Sequence
  Synthetic
gccaagcatttaggtgacactataggaaaagctccacagttaatcgtttcagagctatgctggaaacagc

SEQ ID NO: 51534 - DNA, 70 bp, Artificial Sequence
  Synthetic
gccaagcatttaggtgacactataggcccatgtcactggtcagcggtttcagagctatgctggaaacagc

SEQ ID NO: 51535 - DNA, 70 bp, Artificial Sequence
  Synthetic
gccaagcatttaggtgacactatagcgcccgctggttctcaatttgtttcagagctatgctggaaacagc

SEQ ID NO: 51536 - DNA, 70 bp, Artificial Sequence
  Synthetic
gccaagcatttaggtgacactatagtggcagtcagagaaggtagggtttcagagctatgctggaaacagc

SEQ ID NO: 51537 - DNA, 70 bp, Artificial Sequence
  Synthetic
gccaagcatttaggtgacactatagccccggcacggcctatggttgtttcagagctatgctggaaacagc

SEQ ID NO: 51538 - DNA, 70 bp, Artificial Sequence
  Synthetic
gccaagcatttaggtgacactataggtgctgcgctcacatgttgtgtttcagagctatgctggaaacagc

SEQ ID NO: 51539 - DNA, 70 bp, Artificial Sequence
  Synthetic
gccaagcatttaggtgacactatagtgaagtttgtctacagaggcgtttcagagctatgctggaaacagc

SEQ ID NO: 51540 - DNA, 70 bp, Artificial Sequence
  Synthetic
gccaagcatttaggtgacactatagccagttagaccccatctacggtttcagagctatgctggaaacagc

SEQ ID NO: 51541 - DNA, 70 bp, Artificial Sequence
  Synthetic
gccaagcatttaggtgacactataggagacgagactacatgttgtgtttcagagctatgctggaaacagc

SEQ ID NO: 51542 - DNA, 70 bp, Artificial Sequence
  Synthetic
gccaagcatttaggtgacactataggggcgttccgggctcacatggtttcagagctatgctggaaacagc

SEQ ID NO: 51543 - DNA, 70 bp, Artificial Sequence
  Synthetic
gccaagcatttaggtgacactataggcaagtgcgtgatcatgtgagtttcagagctatgctggaaacagc

SEQ ID NO: 51544 - DNA, 70 bp, Artificial Sequence
  Synthetic
gccaagcatttaggtgacactatagcttgtcaagcagcttctcaggtttcagagctatgctggaaacagc

SEQ ID NO: 51545 - DNA, 70 bp, Artificial Sequence
  Synthetic
gccaagcatttaggtgacactatagcagggcattgtaattaggtagtttcagagctatgctggaaacagc

SEQ ID NO: 51546 - DNA, 70 bp, Artificial Sequence
  Synthetic
gccaagcatttaggtgacactatagtgacagactctatcttgatggtttcagagctatgctggaaacagc

SEQ ID NO: 51547 - DNA, 70 bp, Artificial Sequence
  Synthetic
gccaagcatttaggtgacactatagacttcaaacatggaccttaagtttcagagctatgctggaaacagc

SEQ ID NO: 51548 - DNA, 70 bp, Artificial Sequence
  Synthetic
gccaagcatttaggtgacactataggatacgggacctagctctccgtttcagagctatgctggaaacagc

SEQ ID NO: 51549 - DNA, 70 bp, Artificial Sequence
  Synthetic
gccaagcatttaggtgacactatagggcggctggtggagctcagcgtttcagagctatgctggaaacagc

SEQ ID NO: 51550 - DNA, 70 bp, Artificial Sequence
  Synthetic
gccaagcatttaggtgacactatagtagctcaggtgaaagccattgtttcagagctatgctggaaacagc

SEQ ID NO: 51551 - DNA, 70 bp, Artificial Sequence
  Synthetic
gccaagcatttaggtgacactatagtgcttcttcaaatctgcaacgtttcagagctatgctggaaacagc

SEQ ID NO: 51552 - DNA, 70 bp, Artificial Sequence
  Synthetic
gccaagcatttaggtgacactataggagaaaccggaggcagatgggtttcagagctatgctggaaacagc

SEQ ID NO: 51553 - DNA, 70 bp, Artificial Sequence
  Synthetic
gccaagcatttaggtgacactataggtccacgaagcacaagcctggtttcagagctatgctggaaacagc

SEQ ID NO: 51554 - DNA, 70 bp, Artificial Sequence
  Synthetic
gccaagcatttaggtgacactatagagaagtcagcaacttgcctggtttcagagctatgctggaaacagc

SEQ ID NO: 51555 - DNA, 70 bp, Artificial Sequence
  Synthetic
gccaagcatttaggtgacactatagggtatgcaaagtgagatgacgtttcagagctatgctggaaacagc

SEQ ID NO: 51556 - DNA, 70 bp, Artificial Sequence
  Synthetic
gccaagcatttaggtgacactatagatgatctaatctcctcggtggtttcagagctatgctggaaacagc

SEQ ID NO: 51557 - DNA, 70 bp, Artificial Sequence
  Synthetic
gccaagcatttaggtgacactatagaaagaattattgtaggggccgtttcagagctatgctggaaacagc

SEQ ID NO: 51558 - DNA, 70 bp, Artificial Sequence
  Synthetic
gccaagcatttaggtgacactatagaaatcagcagtacctccttagtttcagagctatgctggaaacagc

SEQ ID NO: 51559 - DNA, 70 bp, Artificial Sequence
  Synthetic
gccaagcatttaggtgacactatagaacaagtactcactgctgaggtttcagagctatgctggaaacagc

SEQ ID NO: 51560 - DNA, 70 bp, Artificial Sequence
  Synthetic
gccaagcatttaggtgacactatagaagaataaactgtgcaggtagtttcagagctatgctggaaacagc

SEQ ID NO: 51561 - DNA, 70 bp, Artificial Sequence
  Synthetic
gccaagcatttaggtgacactatagagttgtgcactacctaccatgtttcagagctatgctggaaacagc

SEQ ID NO: 51562 - DNA, 70 bp, Artificial Sequence
  Synthetic
gccaagcatttaggtgacactatagcagagccaccggaaaccatagtttcagagctatgctggaaacagc

SEQ ID NO: 51563 - DNA, 70 bp, Artificial Sequence
  Synthetic
gccaagcatttaggtgacactataggagtttggttcaggatgtcggtttcagagctatgctggaaacagc

SEQ ID NO: 51564 - DNA, 70 bp, Artificial Sequence
  Synthetic
gccaagcatttaggtgacactataggcctctcatcttctacagacgtttcagagctatgctggaaacagc

SEQ ID NO: 51565 - DNA, 70 bp, Artificial Sequence
  Synthetic
gccaagcatttaggtgacactataggctgagaaaccggaggcagagtttcagagctatgctggaaacagc

SEQ ID NO: 51566 - DNA, 70 bp, Artificial Sequence
  Synthetic
gccaagcatttaggtgacactatagggtctttagccgtccagaaagtttcagagctatgctggaaacagc

SEQ ID NO: 51567 - DNA, 70 bp, Artificial Sequence
  Synthetic
gccaagcatttaggtgacactatagtttgggaccatgctccaaatgtttcagagctatgctggaaacagc

SEQ ID NO: 51568 - DNA, 70 bp, Artificial Sequence
  Synthetic
gccaagcatttaggtgacactatagttaacacactcggaactttcgtttcagagctatgctggaaacagc

SEQ ID NO: 51569 - DNA, 70 bp, Artificial Sequence
  Synthetic
gccaagcatttaggtgacactatagtcaggctatagcagctgagggtttcagagctatgctggaaacagc

SEQ ID NO: 51570 - DNA, 70 bp, Artificial Sequence
  Synthetic
gccaagcatttaggtgacactataggcaggggcctccctatagccgtttcagagctatgctggaaacagc

SEQ ID NO: 51571 - DNA, 70 bp, Artificial Sequence
  Synthetic
gccaagcatttaggtgacactatagcttggcattaattctctccagtttcagagctatgctggaaacagc

SEQ ID NO: 51572 - DNA, 70 bp, Artificial Sequence
  Synthetic
gccaagcatttaggtgacactatagtttcagaggccacagttaccgtttcagagctatgctggaaacagc

SEQ ID NO: 51573 - DNA, 70 bp, Artificial Sequence
  Synthetic
gccaagcatttaggtgacactatagagtatgttgactacaggtgagtttcagagctatgctggaaacagc

SEQ ID NO: 51574 - DNA, 70 bp, Artificial Sequence
  Synthetic
gccaagcatttaggtgacactatagcttcttcttcttcttcttgggtttcagagctatgctggaaacagc

SEQ ID NO: 51575 - DNA, 70 bp, Artificial Sequence
  Synthetic
gccaagcatttaggtgacactatagatcaagccagtaattcttctgtttcagagctatgctggaaacagc

SEQ ID NO: 51576 - DNA, 70 bp, Artificial Sequence
  Synthetic
gccaagcatttaggtgacactatagtttctgacacacatggagtcgtttcagagctatgctggaaacagc

SEQ ID NO: 51577 - DNA, 70 bp, Artificial Sequence
  Synthetic
gccaagcatttaggtgacactatagcgccgctgcactgctgggaggtttcagagctatgctggaaacagc

SEQ ID NO: 51578 - DNA, 70 bp, Artificial Sequence
  Synthetic
gccaagcatttaggtgacactatagtcgagcatgctgccgattgcgtttcagagctatgctggaaacagc

SEQ ID NO: 51579 - DNA, 70 bp, Artificial Sequence
  Synthetic
gccaagcatttaggtgacactatagggccctctcggcagctgtaggtttcagagctatgctggaaacagc

SEQ ID NO: 51580 - DNA, 70 bp, Artificial Sequence
  Synthetic
gccaagcatttaggtgacactatagttctaaactcagcaagccacgtttcagagctatgctggaaacagc

SEQ ID NO: 51581 - DNA, 70 bp, Artificial Sequence
  Synthetic
gccaagcatttaggtgacactatagaggctggtaagttgacatttgtttcagagctatgctggaaacagc

SEQ ID NO: 51582 - DNA, 70 bp, Artificial Sequence
  Synthetic
gccaagcatttaggtgacactatagcttcagtgatcacctagattgtttcagagctatgctggaaacagc

SEQ ID NO: 51583 - DNA, 70 bp, Artificial Sequence
  Synthetic
gccaagcatttaggtgacactataggcaaatcttgctgcgtcattgtttcagagctatgctggaaacagc

SEQ ID NO: 51584 - DNA, 70 bp, Artificial Sequence
  Synthetic
gccaagcatttaggtgacactatagatgttgcctcaccagccctggtttcagagctatgctggaaacagc

SEQ ID NO: 51585 - DNA, 70 bp, Artificial Sequence
  Synthetic
gccaagcatttaggtgacactatagtgtcctcagagctaacataagtttcagagctatgctggaaacagc

SEQ ID NO: 51586 - DNA, 70 bp, Artificial Sequence
  Synthetic
gccaagcatttaggtgacactatagaccttcttcactcattagccgtttcagagctatgctggaaacagc

SEQ ID NO: 51587 - DNA, 70 bp, Artificial Sequence
  Synthetic
gccaagcatttaggtgacactataggcctttaacactcatatgtcgtttcagagctatgctggaaacagc

SEQ ID NO: 51588 - DNA, 70 bp, Artificial Sequence
  Synthetic
gccaagcatttaggtgacactatagtggttcttacatctgggttcgtttcagagctatgctggaaacagc

SEQ ID NO: 51589 - DNA, 70 bp, Artificial Sequence
  Synthetic
gccaagcatttaggtgacactatagtttcatctggattccctcaagtttcagagctatgctggaaacagc

SEQ ID NO: 51590 - DNA, 70 bp, Artificial Sequence
  Synthetic
gccaagcatttaggtgacactataggggattcttcagagtttttcgtttcagagctatgctggaaacagc

SEQ ID NO: 51591 - DNA, 70 bp, Artificial Sequence
  Synthetic
gccaagcatttaggtgacactataggcaggaatcagagtctctctgtttcagagctatgctggaaacagc

SEQ ID NO: 51592 - DNA, 70 bp, Artificial Sequence
  Synthetic
gccaagcatttaggtgacactatagagcacagcattctcctagaggtttcagagctatgctggaaacagc

SEQ ID NO: 51593 - DNA, 70 bp, Artificial Sequence
  Synthetic
gccaagcatttaggtgacactatagggctgcggggcgctcagagcgtttcagagctatgctggaaacagc

SEQ ID NO: 51594 - DNA, 70 bp, Artificial Sequence
  Synthetic
gccaagcatttaggtgacactatagaaacactggacagtctaaatgtttcagagctatgctggaaacagc

SEQ ID NO: 51595 - DNA, 70 bp, Artificial Sequence
  Synthetic
gccaagcatttaggtgacactatagaggcccagacccggctctgagtttcagagctatgctggaaacagc

SEQ ID NO: 51596 - DNA, 70 bp, Artificial Sequence
  Synthetic
gccaagcatttaggtgacactatagggcccagaccaggctgtgacgtttcagagctatgctggaaacagc

SEQ ID NO: 51597 - DNA, 70 bp, Artificial Sequence
  Synthetic
gccaagcatttaggtgacactatagtcctgcatggtctcagagccgtttcagagctatgctggaaacagc

SEQ ID NO: 51598 - DNA, 70 bp, Artificial Sequence
  Synthetic
gccaagcatttaggtgacactatagggattactgcagtttagaccgtttcagagctatgctggaaacagc

SEQ ID NO: 51599 - DNA, 70 bp, Artificial Sequence
  Synthetic
gccaagcatttaggtgacactatagactttttcacctctacaaccgtttcagagctatgctggaaacagc

SEQ ID NO: 51600 - DNA, 70 bp, Artificial Sequence
  Synthetic
gccaagcatttaggtgacactatagcagcaaggaggccggcgacggtttcagagctatgctggaaacagc

SEQ ID NO: 51601 - DNA, 70 bp, Artificial Sequence
  Synthetic
gccaagcatttaggtgacactataggaaagaccacagcactgtgagtttcagagctatgctggaaacagc

SEQ ID NO: 51602 - DNA, 70 bp, Artificial Sequence
  Synthetic
gccaagcatttaggtgacactatagtgagtgcgtcatagcaactggtttcagagctatgctggaaacagc

SEQ ID NO: 51603 - DNA, 70 bp, Artificial Sequence
  Synthetic
gccaagcatttaggtgacactatagattctgtccgtgaaatgaatgtttcagagctatgctggaaacagc

SEQ ID NO: 51604 - DNA, 70 bp, Artificial Sequence
  Synthetic
gccaagcatttaggtgacactatagtccttccatctacgctcggggtttcagagctatgctggaaacagc

SEQ ID NO: 51605 - DNA, 70 bp, Artificial Sequence
  Synthetic
gccaagcatttaggtgacactatagtgaatgtgtcattgccacgggtttcagagctatgctggaaacagc

SEQ ID NO: 51606 - DNA, 70 bp, Artificial Sequence
  Synthetic
gccaagcatttaggtgacactatagcctcctcctggatctttagggtttcagagctatgctggaaacagc

SEQ ID NO: 51607 - DNA, 70 bp, Artificial Sequence
  Synthetic
gccaagcatttaggtgacactatagcagtgttccctcttgggattgtttcagagctatgctggaaacagc

SEQ ID NO: 51608 - DNA, 70 bp, Artificial Sequence
  Synthetic
gccaagcatttaggtgacactatagcagcaaccccaacttatgtggtttcagagctatgctggaaacagc

SEQ ID NO: 51609 - DNA, 70 bp, Artificial Sequence
  Synthetic
gccaagcatttaggtgacactatagcagggtggggcggctctggagtttcagagctatgctggaaacagc

SEQ ID NO: 51610 - DNA, 70 bp, Artificial Sequence
  Synthetic
gccaagcatttaggtgacactatagggggcgccccggtgagcgcggtttcagagctatgctggaaacagc

SEQ ID NO: 51611 - DNA, 70 bp, Artificial Sequence
  Synthetic
gccaagcatttaggtgacactatagggtgctcagtacacagccccgtttcagagctatgctggaaacagc

SEQ ID NO: 51612 - DNA, 70 bp, Artificial Sequence
  Synthetic
gccaagcatttaggtgacactatagccccagattcacatcatctggtttcagagctatgctggaaacagc

SEQ ID NO: 51613 - DNA, 70 bp, Artificial Sequence
  Synthetic
gccaagcatttaggtgacactatagtccgggacactctattagatgtttcagagctatgctggaaacagc

SEQ ID NO: 51614 - DNA, 70 bp, Artificial Sequence
  Synthetic
gccaagcatttaggtgacactatagtgggcaactcacatcatctggtttcagagctatgctggaaacagc

SEQ ID NO: 51615 - DNA, 70 bp, Artificial Sequence
  Synthetic
gccaagcatttaggtgacactatagatggacagacatcactactggtttcagagctatgctggaaacagc

SEQ ID NO: 51616 - DNA, 70 bp, Artificial Sequence
  Synthetic
gccaagcatttaggtgacactatagggtggtactttcaaacaacggtttcagagctatgctggaaacagc

SEQ ID NO: 51617 - DNA, 70 bp, Artificial Sequence
  Synthetic
gccaagcatttaggtgacactatagagcctgagctgaggtctcacgtttcagagctatgctggaaacagc

SEQ ID NO: 51618 - DNA, 70 bp, Artificial Sequence
  Synthetic
gccaagcatttaggtgacactataggacagggctaaaggctaggcgtttcagagctatgctggaaacagc

SEQ ID NO: 51619 - DNA, 70 bp, Artificial Sequence
  Synthetic
gccaagcatttaggtgacactataggtgggagtcgactgggctgagtttcagagctatgctggaaacagc

SEQ ID NO: 51620 - DNA, 70 bp, Artificial Sequence
  Synthetic
gccaagcatttaggtgacactataggaaagccaagaagccgtgaggtttcagagctatgctggaaacagc

SEQ ID NO: 51621 - DNA, 70 bp, Artificial Sequence
  Synthetic
gccaagcatttaggtgacactatagagaagaggagcctcggtagggtttcagagctatgctggaaacagc

SEQ ID NO: 51622 - DNA, 70 bp, Artificial Sequence
  Synthetic
gccaagcatttaggtgacactatagttggaagccagacagtcagtgtttcagagctatgctggaaacagc

SEQ ID NO: 51623 - DNA, 70 bp, Artificial Sequence
  Synthetic
gccaagcatttaggtgacactatagtggggatgccaaggagtagggtttcagagctatgctggaaacagc

SEQ ID NO: 51624 - DNA, 70 bp, Artificial Sequence
  Synthetic
gccaagcatttaggtgacactatagccctggaaagccaatgagaggtttcagagctatgctggaaacagc

SEQ ID NO: 51625 - DNA, 70 bp, Artificial Sequence
  Synthetic
gccaagcatttaggtgacactatagtcagtcatgacagatgaagagtttcagagctatgctggaaacagc

SEQ ID NO: 51626 - DNA, 70 bp, Artificial Sequence
  Synthetic
gccaagcatttaggtgacactatagtgtcttagagggggacaacagtttcagagctatgctggaaacagc

SEQ ID NO: 51627 - DNA, 70 bp, Artificial Sequence
  Synthetic
gccaagcatttaggtgacactataggcttcagaaaaaaggtggaagtttcagagctatgctggaaacagc

SEQ ID NO: 51628 - DNA, 70 bp, Artificial Sequence
  Synthetic
gccaagcatttaggtgacactataggcagtgggtgaagttttggtgtttcagagctatgctggaaacagc

SEQ ID NO: 51629 - DNA, 70 bp, Artificial Sequence
  Synthetic
gccaagcatttaggtgacactataggctccttgtctggaggtcacgtttcagagctatgctggaaacagc

SEQ ID NO: 51630 - DNA, 70 bp, Artificial Sequence
  Synthetic
gccaagcatttaggtgacactataggctgatgctaatagccgtctgtttcagagctatgctggaaacagc

SEQ ID NO: 51631 - DNA, 70 bp, Artificial Sequence
  Synthetic
gccaagcatttaggtgacactatagcgaagacagttctagggttcgtttcagagctatgctggaaacagc

SEQ ID NO: 51632 - DNA, 70 bp, Artificial Sequence
  Synthetic
gccaagcatttaggtgacactatagaggccaggcctagggacctggtttcagagctatgctggaaacagc

SEQ ID NO: 51633 - DNA, 70 bp, Artificial Sequence
  Synthetic
gccaagcatttaggtgacactataggttctagggttcagggagcggtttcagagctatgctggaaacagc

SEQ ID NO: 51634 - DNA, 70 bp, Artificial Sequence
  Synthetic
gccaagcatttaggtgacactatagagtcactcccgtcatcgagggtttcagagctatgctggaaacagc

SEQ ID NO: 51635 - DNA, 70 bp, Artificial Sequence
  Synthetic
gccaagcatttaggtgacactatagcactcgtgtctctcagtgaagtttcagagctatgctggaaacagc

SEQ ID NO: 51636 - DNA, 70 bp, Artificial Sequence
  Synthetic
gccaagcatttaggtgacactataggttgagtgttctagagtctggtttcagagctatgctggaaacagc

SEQ ID NO: 51637 - DNA, 70 bp, Artificial Sequence
  Synthetic
gccaagcatttaggtgacactatagcattacggattgtcctgattgtttcagagctatgctggaaacagc

SEQ ID NO: 51638 - DNA, 70 bp, Artificial Sequence
  Synthetic
gccaagcatttaggtgacactatagggcgctccggagaagcagtagtttcagagctatgctggaaacagc

SEQ ID NO: 51639 - DNA, 70 bp, Artificial Sequence
  Synthetic
gccaagcatttaggtgacactataggggcgggcctggggcctagtgtttcagagctatgctggaaacagc

SEQ ID NO: 51640 - DNA, 70 bp, Artificial Sequence
  Synthetic
gccaagcatttaggtgacactatagatgcatctccctcttgagctgtttcagagctatgctggaaacagc

SEQ ID NO: 51641 - DNA, 70 bp, Artificial Sequence
  Synthetic
gccaagcatttaggtgacactatagcatctctgggtttctagctcgtttcagagctatgctggaaacagc

SEQ ID NO: 51642 - DNA, 70 bp, Artificial Sequence
  Synthetic
gccaagcatttaggtgacactatagttcaaaggatgtcgaagattgtttcagagctatgctggaaacagc

SEQ ID NO: 51643 - DNA, 70 bp, Artificial Sequence
  Synthetic
gccaagcatttaggtgacactatagagaaggcctctctcttctgagtttcagagctatgctggaaacagc

SEQ ID NO: 51644 - DNA, 70 bp, Artificial Sequence
  Synthetic
gccaagcatttaggtgacactatagcaactccccgagtggcacaggtttcagagctatgctggaaacagc

SEQ ID NO: 51645 - DNA, 70 bp, Artificial Sequence
  Synthetic
gccaagcatttaggtgacactatagtttaaagggctaaactgatcgtttcagagctatgctggaaacagc

SEQ ID NO: 51646 - DNA, 70 bp, Artificial Sequence
  Synthetic
gccaagcatttaggtgacactatagaaaagcattgggcaaaacccgtttcagagctatgctggaaacagc

SEQ ID NO: 51647 - DNA, 70 bp, Artificial Sequence
  Synthetic
gccaagcatttaggtgacactatagtttgaaagtcacccaatatggtttcagagctatgctggaaacagc

SEQ ID NO: 51648 - DNA, 70 bp, Artificial Sequence
  Synthetic
gccaagcatttaggtgacactatagggggaaaactatgatgctttgtttcagagctatgctggaaacagc

SEQ ID NO: 51649 - DNA, 70 bp, Artificial Sequence
  Synthetic
gccaagcatttaggtgacactatagtatgcaggatggtagtgtgcgtttcagagctatgctggaaacagc

SEQ ID NO: 51650 - DNA, 70 bp, Artificial Sequence
  Synthetic
gccaagcatttaggtgacactataggttgggtcagactccagtttgtttcagagctatgctggaaacagc

SEQ ID NO: 51651 - DNA, 70 bp, Artificial Sequence
  Synthetic
gccaagcatttaggtgacactatagaggcctacaggattatgaaggtttcagagctatgctggaaacagc

SEQ ID NO: 51652 - DNA, 70 bp, Artificial Sequence
  Synthetic
gccaagcatttaggtgacactatagtgtatacgtgcaggtcactagtttcagagctatgctggaaacagc

SEQ ID NO: 51653 - DNA, 70 bp, Artificial Sequence
  Synthetic
gccaagcatttaggtgacactatagaaaccagcgtggtcactgtggtttcagagctatgctggaaacagc

SEQ ID NO: 51654 - DNA, 70 bp, Artificial Sequence
  Synthetic
gccaagcatttaggtgacactatagctgtctgagtctagtagtccgtttcagagctatgctggaaacagc

SEQ ID NO: 51655 - DNA, 70 bp, Artificial Sequence
  Synthetic
gccaagcatttaggtgacactataggttaatcagaattcagggtggtttcagagctatgctggaaacagc

SEQ ID NO: 51656 - DNA, 70 bp, Artificial Sequence
  Synthetic
gccaagcatttaggtgacactataggctctgcttctagaagcgtagtttcagagctatgctggaaacagc

SEQ ID NO: 51657 - DNA, 70 bp, Artificial Sequence
  Synthetic
gccaagcatttaggtgacactataggctggattgctgggtggtatgtttcagagctatgctggaaacagc

SEQ ID NO: 51658 - DNA, 70 bp, Artificial Sequence
  Synthetic
gccaagcatttaggtgacactatagtgtcagttggatgactaaatgtttcagagctatgctggaaacagc

SEQ ID NO: 51659 - DNA, 70 bp, Artificial Sequence
  Synthetic
gccaagcatttaggtgacactatagagggatttaggacttttccggtttcagagctatgctggaaacagc

SEQ ID NO: 51660 - DNA, 70 bp, Artificial Sequence
  Synthetic
gccaagcatttaggtgacactatagatattttctgatttccggtggtttcagagctatgctggaaacagc

SEQ ID NO: 51661 - DNA, 70 bp, Artificial Sequence
  Synthetic
gccaagcatttaggtgacactatagtagtcactggatcacaatgcgtttcagagctatgctggaaacagc

SEQ ID NO: 51662 - DNA, 70 bp, Artificial Sequence
  Synthetic
gccaagcatttaggtgacactatagtgctggaatgccattttcaggtttcagagctatgctggaaacagc

SEQ ID NO: 51663 - DNA, 70 bp, Artificial Sequence
  Synthetic
gccaagcatttaggtgacactatagcaggagcgagctaaacctgtgtttcagagctatgctggaaacagc

SEQ ID NO: 51664 - DNA, 70 bp, Artificial Sequence
  Synthetic
gccaagcatttaggtgacactatagcgcctgagcccgggaggcaggtttcagagctatgctggaaacagc

SEQ ID NO: 51665 - DNA, 70 bp, Artificial Sequence
  Synthetic
gccaagcatttaggtgacactatagggaggaggtctcagctgtccgtttcagagctatgctggaaacagc

SEQ ID NO: 51666 - DNA, 70 bp, Artificial Sequence
  Synthetic
gccaagcatttaggtgacactatagtgtgccagctggataactgagtttcagagctatgctggaaacagc

SEQ ID NO: 51667 - DNA, 70 bp, Artificial Sequence
  Synthetic
gccaagcatttaggtgacactataggttacttgacatcacacagagtttcagagctatgctggaaacagc

SEQ ID NO: 51668 - DNA, 70 bp, Artificial Sequence
  Synthetic
gccaagcatttaggtgacactatagtgccagctgagcgaatgaaagtttcagagctatgctggaaacagc

SEQ ID NO: 51669 - DNA, 70 bp, Artificial Sequence
  Synthetic
gccaagcatttaggtgacactatagaaggaacactggattggacggtttcagagctatgctggaaacagc

SEQ ID NO: 51670 - DNA, 70 bp, Artificial Sequence
  Synthetic
gccaagcatttaggtgacactatagtcactggatcctgagaggaggtttcagagctatgctggaaacagc

SEQ ID NO: 51671 - DNA, 70 bp, Artificial Sequence
  Synthetic
gccaagcatttaggtgacactataggctctgcaggatgctaaatcgtttcagagctatgctggaaacagc

SEQ ID NO: 51672 - DNA, 70 bp, Artificial Sequence
  Synthetic
gccaagcatttaggtgacactatagagtgaaaatcaagacctgaggtttcagagctatgctggaaacagc

SEQ ID NO: 51673 - DNA, 70 bp, Artificial Sequence
  Synthetic
gccaagcatttaggtgacactatagggaagaaggggatgaagaaggtttcagagctatgctggaaacagc

SEQ ID NO: 51674 - DNA, 70 bp, Artificial Sequence
  Synthetic
gccaagcatttaggtgacactatagtcagtgtcagacctcttaatgtttcagagctatgctggaaacagc

SEQ ID NO: 51675 - DNA, 70 bp, Artificial Sequence
  Synthetic
gccaagcatttaggtgacactatagttgtttgcagagtttactgagtttcagagctatgctggaaacagc

SEQ ID NO: 51676 - DNA, 70 bp, Artificial Sequence
  Synthetic
gccaagcatttaggtgacactatagagatccactggaaactaggcgtttcagagctatgctggaaacagc

SEQ ID NO: 51677 - DNA, 70 bp, Artificial Sequence
  Synthetic
gccaagcatttaggtgacactataggaggctggggaggacgaggagtttcagagctatgctggaaacagc

SEQ ID NO: 51678 - DNA, 70 bp, Artificial Sequence
  Synthetic
gccaagcatttaggtgacactatagcagtgccagacggcatgacggtttcagagctatgctggaaacagc

SEQ ID NO: 51679 - DNA, 70 bp, Artificial Sequence
  Synthetic
gccaagcatttaggtgacactataggggagctcagatagctatatgtttcagagctatgctggaaacagc

SEQ ID NO: 51680 - DNA, 70 bp, Artificial Sequence
  Synthetic
gccaagcatttaggtgacactatagaaggtatacaatggactgcagtttcagagctatgctggaaacagc

SEQ ID NO: 51681 - DNA, 70 bp, Artificial Sequence
  Synthetic
gccaagcatttaggtgacactatagtggcccaggactatccatgcgtttcagagctatgctggaaacagc

SEQ ID NO: 51682 - DNA, 70 bp, Artificial Sequence
  Synthetic
gccaagcatttaggtgacactatagacagtcatgtcagcaatgccgtttcagagctatgctggaaacagc

SEQ ID NO: 51683 - DNA, 70 bp, Artificial Sequence
  Synthetic
gccaagcatttaggtgacactatagcggcttaccagtctttataagtttcagagctatgctggaaacagc

SEQ ID NO: 51684 - DNA, 70 bp, Artificial Sequence
  Synthetic
gccaagcatttaggtgacactatagtataccaaagaccaagtagagtttcagagctatgctggaaacagc

SEQ ID NO: 51685 - DNA, 70 bp, Artificial Sequence
  Synthetic
gccaagcatttaggtgacactatagaggttgggcccggtgttcaggtttcagagctatgctggaaacagc

SEQ ID NO: 51686 - DNA, 70 bp, Artificial Sequence
  Synthetic
gccaagcatttaggtgacactatagtccagctcagaacacatctggtttcagagctatgctggaaacagc

SEQ ID NO: 51687 - DNA, 70 bp, Artificial Sequence
  Synthetic
gccaagcatttaggtgacactatagagggtggaagtggaggaagagtttcagagctatgctggaaacagc

SEQ ID NO: 51688 - DNA, 70 bp, Artificial Sequence
  Synthetic
gccaagcatttaggtgacactatagagttcttcattctatgaggcgtttcagagctatgctggaaacagc

SEQ ID NO: 51689 - DNA, 70 bp, Artificial Sequence
  Synthetic
gccaagcatttaggtgacactataggcagcacctaccctgttcctgtttcagagctatgctggaaacagc

SEQ ID NO: 51690 - DNA, 70 bp, Artificial Sequence
  Synthetic
gccaagcatttaggtgacactatagaccaaaggcaatcactagacgtttcagagctatgctggaaacagc

SEQ ID NO: 51691 - DNA, 70 bp, Artificial Sequence
  Synthetic
gccaagcatttaggtgacactatagtaaggagcagctgctgcgctgtttcagagctatgctggaaacagc

SEQ ID NO: 51692 - DNA, 70 bp, Artificial Sequence
  Synthetic
gccaagcatttaggtgacactatagtgcaaaagaagtctaccaaagtttcagagctatgctggaaacagc

SEQ ID NO: 51693 - DNA, 70 bp, Artificial Sequence
  Synthetic
gccaagcatttaggtgacactatagcaaatggatggacagcaagtgtttcagagctatgctggaaacagc

SEQ ID NO: 51694 - DNA, 70 bp, Artificial Sequence
  Synthetic
gccaagcatttaggtgacactatagactacatacactgactgttcgtttcagagctatgctggaaacagc

SEQ ID NO: 51695 - DNA, 70 bp, Artificial Sequence
  Synthetic
gccaagcatttaggtgacactataggtacaagttgctggttgaacgtttcagagctatgctggaaacagc

SEQ ID NO: 51696 - DNA, 70 bp, Artificial Sequence
  Synthetic
gccaagcatttaggtgacactatagaaatcaaggcaagaggaatagtttcagagctatgctggaaacagc

SEQ ID NO: 51697 - DNA, 70 bp, Artificial Sequence
  Synthetic
gccaagcatttaggtgacactatagatccatctgtatcgatcctggtttcagagctatgctggaaacagc

SEQ ID NO: 51698 - DNA, 70 bp, Artificial Sequence
  Synthetic
gccaagcatttaggtgacactatagaagacggtgggtttctcgctgtttcagagctatgctggaaacagc

SEQ ID NO: 51699 - DNA, 70 bp, Artificial Sequence
  Synthetic
gccaagcatttaggtgacactatagcatagtttctgaacttcctcgtttcagagctatgctggaaacagc

SEQ ID NO: 51700 - DNA, 70 bp, Artificial Sequence
  Synthetic
gccaagcatttaggtgacactatagtatttcaagtctgatagccagtttcagagctatgctggaaacagc

SEQ ID NO: 51701 - DNA, 70 bp, Artificial Sequence
  Synthetic
gccaagcatttaggtgacactatagaagagaaggggcatcaacgtgtttcagagctatgctggaaacagc

SEQ ID NO: 51702 - DNA, 70 bp, Artificial Sequence
  Synthetic
gccaagcatttaggtgacactatagggtccttaagcatcaatgttgtttcagagctatgctggaaacagc

SEQ ID NO: 51703 - DNA, 70 bp, Artificial Sequence
  Synthetic
gccaagcatttaggtgacactatagatggcctgaactagactgaggtttcagagctatgctggaaacagc

SEQ ID NO: 51704 - DNA, 70 bp, Artificial Sequence
  Synthetic
gccaagcatttaggtgacactatagggctggagctggggctacgtgtttcagagctatgctggaaacagc

SEQ ID NO: 51705 - DNA, 70 bp, Artificial Sequence
  Synthetic
gccaagcatttaggtgacactatagcctacgcagaggtggctgaggtttcagagctatgctggaaacagc

SEQ ID NO: 51706 - DNA, 70 bp, Artificial Sequence
  Synthetic
gccaagcatttaggtgacactatagtaaggagatcctcctttgtcgtttcagagctatgctggaaacagc

SEQ ID NO: 51707 - DNA, 70 bp, Artificial Sequence
  Synthetic
gccaagcatttaggtgacactatagggactgcatgaaacgatacagtttcagagctatgctggaaacagc

SEQ ID NO: 51708 - DNA, 70 bp, Artificial Sequence
  Synthetic
gccaagcatttaggtgacactatagaggtgctcttgcatgacctggtttcagagctatgctggaaacagc

SEQ ID NO: 51709 - DNA, 70 bp, Artificial Sequence
  Synthetic
gccaagcatttaggtgacactataggggaagtttcttttcacctcgtttcagagctatgctggaaacagc

SEQ ID NO: 51710 - DNA, 70 bp, Artificial Sequence
  Synthetic
gccaagcatttaggtgacactatagcagtgtttccaaggatgaaggtttcagagctatgctggaaacagc

SEQ ID NO: 51711 - DNA, 70 bp, Artificial Sequence
  Synthetic
gccaagcatttaggtgacactataggcctgggcggttaacatttggtttcagagctatgctggaaacagc

SEQ ID NO: 51712 - DNA, 70 bp, Artificial Sequence
  Synthetic
gccaagcatttaggtgacactatagaggcattaatgagatgttccgtttcagagctatgctggaaacagc

SEQ ID NO: 51713 - DNA, 70 bp, Artificial Sequence
  Synthetic
gccaagcatttaggtgacactatagtctacttgatgtttttcagggtttcagagctatgctggaaacagc

SEQ ID NO: 51714 - DNA, 70 bp, Artificial Sequence
  Synthetic
gccaagcatttaggtgacactatagaataaccttgatcaaggagagtttcagagctatgctggaaacagc

SEQ ID NO: 51715 - DNA, 70 bp, Artificial Sequence
  Synthetic
gccaagcatttaggtgacactatagttcaatcccttcagctcagggtttcagagctatgctggaaacagc

SEQ ID NO: 51716 - DNA, 70 bp, Artificial Sequence
  Synthetic
gccaagcatttaggtgacactatagggaaaatggcagccgtgtctgtttcagagctatgctggaaacagc

SEQ ID NO: 51717 - DNA, 70 bp, Artificial Sequence
  Synthetic
gccaagcatttaggtgacactatagagcaggagcgacaacggctagtttcagagctatgctggaaacagc

SEQ ID NO: 51718 - DNA, 70 bp, Artificial Sequence
  Synthetic
gccaagcatttaggtgacactatagcatccaggtgagcccctcaggtttcagagctatgctggaaacagc

SEQ ID NO: 51719 - DNA, 70 bp, Artificial Sequence
  Synthetic
gccaagcatttaggtgacactatagaccccagctaccacactgacgtttcagagctatgctggaaacagc

SEQ ID NO: 51720 - DNA, 70 bp, Artificial Sequence
  Synthetic
gccaagcatttaggtgacactatagtctcatttgcatttgtaggcgtttcagagctatgctggaaacagc

SEQ ID NO: 51721 - DNA, 70 bp, Artificial Sequence
  Synthetic
gccaagcatttaggtgacactatagcagagtcagcctccaaggtcgtttcagagctatgctggaaacagc

SEQ ID NO: 51722 - DNA, 70 bp, Artificial Sequence
  Synthetic
gccaagcatttaggtgacactatagaatataagggcttttggcctgtttcagagctatgctggaaacagc

SEQ ID NO: 51723 - DNA, 70 bp, Artificial Sequence
  Synthetic
gccaagcatttaggtgacactataggcattctttggcggtcctgggtttcagagctatgctggaaacagc

SEQ ID NO: 51724 - DNA, 70 bp, Artificial Sequence
  Synthetic
gccaagcatttaggtgacactataggagaccaccgaaagtaaaaagtttcagagctatgctggaaacagc

SEQ ID NO: 51725 - DNA, 70 bp, Artificial Sequence
  Synthetic
gccaagcatttaggtgacactataggcaaatcttccaaaggaggagtttcagagctatgctggaaacagc

SEQ ID NO: 51726 - DNA, 70 bp, Artificial Sequence
  Synthetic
gccaagcatttaggtgacactatagtccagtaattaaaggggatggtttcagagctatgctggaaacagc

SEQ ID NO: 51727 - DNA, 70 bp, Artificial Sequence
  Synthetic
gccaagcatttaggtgacactataggcaccctggctgtgtgcgtcgtttcagagctatgctggaaacagc

SEQ ID NO: 51728 - DNA, 70 bp, Artificial Sequence
  Synthetic
gccaagcatttaggtgacactataggtgcaataatgccttccagtgtttcagagctatgctggaaacagc

SEQ ID NO: 51729 - DNA, 70 bp, Artificial Sequence
  Synthetic
gccaagcatttaggtgacactatagcacttcagcatcacctccacgtttcagagctatgctggaaacagc

SEQ ID NO: 51730 - DNA, 70 bp, Artificial Sequence
  Synthetic
gccaagcatttaggtgacactatagtagggggacgctcaggcagcgtttcagagctatgctggaaacagc

SEQ ID NO: 51731 - DNA, 70 bp, Artificial Sequence
  Synthetic
gccaagcatttaggtgacactatagccagccaggcctcgagtcatgtttcagagctatgctggaaacagc

SEQ ID NO: 51732 - DNA, 70 bp, Artificial Sequence
  Synthetic
gccaagcatttaggtgacactatagagtgacagattttttgctgtgtttcagagctatgctggaaacagc

SEQ ID NO: 51733 - DNA, 70 bp, Artificial Sequence
  Synthetic
gccaagcatttaggtgacactatagttagatcttataagctctgcgtttcagagctatgctggaaacagc

SEQ ID NO: 51734 - DNA, 70 bp, Artificial Sequence
  Synthetic
gccaagcatttaggtgacactatagcaccaagccttcagaagtgggtttcagagctatgctggaaacagc

SEQ ID NO: 51735 - DNA, 70 bp, Artificial Sequence
  Synthetic
gccaagcatttaggtgacactatagatggagtcactgtttaaccagtttcagagctatgctggaaacagc

SEQ ID NO: 51736 - DNA, 70 bp, Artificial Sequence
  Synthetic
gccaagcatttaggtgacactatagagttttaatcagtgtgaccagtttcagagctatgctggaaacagc

SEQ ID NO: 51737 - DNA, 70 bp, Artificial Sequence
  Synthetic
gccaagcatttaggtgacactataggccttgcaggtattctgaatgtttcagagctatgctggaaacagc

SEQ ID NO: 51738 - DNA, 70 bp, Artificial Sequence
  Synthetic
gccaagcatttaggtgacactatagttggtagacgggctcaagacgtttcagagctatgctggaaacagc

SEQ ID NO: 51739 - DNA, 70 bp, Artificial Sequence
  Synthetic
gccaagcatttaggtgacactatagggggagcgcaggagtcagctgtttcagagctatgctggaaacagc

SEQ ID NO: 51740 - DNA, 70 bp, Artificial Sequence
  Synthetic
gccaagcatttaggtgacactatagaagaggagggatctgtttaggtttcagagctatgctggaaacagc

SEQ ID NO: 51741 - DNA, 70 bp, Artificial Sequence
  Synthetic
gccaagcatttaggtgacactatagatcactatcagtgacccctggtttcagagctatgctggaaacagc

SEQ ID NO: 51742 - DNA, 70 bp, Artificial Sequence
  Synthetic
gccaagcatttaggtgacactatagccatggctgacgctcctcaggtttcagagctatgctggaaacagc

SEQ ID NO: 51743 - DNA, 70 bp, Artificial Sequence
  Synthetic
gccaagcatttaggtgacactatagaaatccgggagactcatcttgtttcagagctatgctggaaacagc

SEQ ID NO: 51744 - DNA, 70 bp, Artificial Sequence
  Synthetic
gccaagcatttaggtgacactatagcgagccatccctgctcgactgtttcagagctatgctggaaacagc

SEQ ID NO: 51745 - DNA, 70 bp, Artificial Sequence
  Synthetic
gccaagcatttaggtgacactatagatgaatgatgggggttaggagtttcagagctatgctggaaacagc

SEQ ID NO: 51746 - DNA, 70 bp, Artificial Sequence
  Synthetic
gccaagcatttaggtgacactataggacacttcgtttagtctaacgtttcagagctatgctggaaacagc

SEQ ID NO: 51747 - DNA, 70 bp, Artificial Sequence
  Synthetic
gccaagcatttaggtgacactatagttactgcggaaagcttgtccgtttcagagctatgctggaaacagc

SEQ ID NO: 51748 - DNA, 70 bp, Artificial Sequence
  Synthetic
gccaagcatttaggtgacactatagaacgtgggctcaggtgtactgtttcagagctatgctggaaacagc

SEQ ID NO: 51749 - DNA, 70 bp, Artificial Sequence
  Synthetic
gccaagcatttaggtgacactatagaaaggaggaggaagctgctagtttcagagctatgctggaaacagc

SEQ ID NO: 51750 - DNA, 70 bp, Artificial Sequence
  Synthetic
gccaagcatttaggtgacactatagagtattttgcgtgtgtgtaagtttcagagctatgctggaaacagc

SEQ ID NO: 51751 - DNA, 70 bp, Artificial Sequence
  Synthetic
gccaagcatttaggtgacactatagccctgactctcagggtatgcgtttcagagctatgctggaaacagc

SEQ ID NO: 51752 - DNA, 70 bp, Artificial Sequence
  Synthetic
gccaagcatttaggtgacactatagcatgcaaagtagtccttcaggtttcagagctatgctggaaacagc

SEQ ID NO: 51753 - DNA, 70 bp, Artificial Sequence
  Synthetic
gccaagcatttaggtgacactatagaaagcagttcttcaccagctgtttcagagctatgctggaaacagc

SEQ ID NO: 51754 - DNA, 70 bp, Artificial Sequence
  Synthetic
gccaagcatttaggtgacactatagtctaagccataatctcttaggtttcagagctatgctggaaacagc

SEQ ID NO: 51755 - DNA, 70 bp, Artificial Sequence
  Synthetic
gccaagcatttaggtgacactatagcgcggtgctcagagcccaccgtttcagagctatgctggaaacagc

SEQ ID NO: 51756 - DNA, 70 bp, Artificial Sequence
  Synthetic
gccaagcatttaggtgacactataggtgagattaagtcaagtggtgtttcagagctatgctggaaacagc

SEQ ID NO: 51757 - DNA, 70 bp, Artificial Sequence
  Synthetic
gccaagcatttaggtgacactatagaccgtgggaaagaaatgcctgtttcagagctatgctggaaacagc

SEQ ID NO: 51758 - DNA, 70 bp, Artificial Sequence
  Synthetic
gccaagcatttaggtgacactataggaagcacctccacagacctggtttcagagctatgctggaaacagc

SEQ ID NO: 51759 - DNA, 70 bp, Artificial Sequence
  Synthetic
gccaagcatttaggtgacactataggaaaaagcagcaaatgcagcgtttcagagctatgctggaaacagc

SEQ ID NO: 51760 - DNA, 70 bp, Artificial Sequence
  Synthetic
gccaagcatttaggtgacactatagggctctgtcctcagcctgaggtttcagagctatgctggaaacagc

SEQ ID NO: 51761 - DNA, 70 bp, Artificial Sequence
  Synthetic
gccaagcatttaggtgacactatagcagtcgctgagcacagccccgtttcagagctatgctggaaacagc

SEQ ID NO: 51762 - DNA, 70 bp, Artificial Sequence
  Synthetic
gccaagcatttaggtgacactataggcgacgtcactgcacgatccgtttcagagctatgctggaaacagc

SEQ ID NO: 51763 - DNA, 70 bp, Artificial Sequence
  Synthetic
gccaagcatttaggtgacactatagcatctagtgctgaagtctgagtttcagagctatgctggaaacagc

SEQ ID NO: 51764 - DNA, 70 bp, Artificial Sequence
  Synthetic
gccaagcatttaggtgacactatagccaagatacgctgaagtgtggtttcagagctatgctggaaacagc

SEQ ID NO: 51765 - DNA, 70 bp, Artificial Sequence
  Synthetic
gccaagcatttaggtgacactatagcctagtcagcagcagctcacgtttcagagctatgctggaaacagc

SEQ ID NO: 51766 - DNA, 70 bp, Artificial Sequence
  Synthetic
gccaagcatttaggtgacactatagcggccgaggggagcagtgaggtttcagagctatgctggaaacagc

SEQ ID NO: 51767 - DNA, 70 bp, Artificial Sequence
  Synthetic
gccaagcatttaggtgacactatagcttataactgagagaccttggtttcagagctatgctggaaacagc

SEQ ID NO: 51768 - DNA, 70 bp, Artificial Sequence
  Synthetic
gccaagcatttaggtgacactatagagggagggcaagatccttacgtttcagagctatgctggaaacagc

SEQ ID NO: 51769 - DNA, 70 bp, Artificial Sequence
  Synthetic
gccaagcatttaggtgacactatagccccacaataccgaaatccagtttcagagctatgctggaaacagc

SEQ ID NO: 51770 - DNA, 70 bp, Artificial Sequence
  Synthetic
gccaagcatttaggtgacactatagtttggtccttgtgggctcaggtttcagagctatgctggaaacagc

SEQ ID NO: 51771 - DNA, 70 bp, Artificial Sequence
  Synthetic
gccaagcatttaggtgacactataggcatcttctcacttctttcagtttcagagctatgctggaaacagc

SEQ ID NO: 51772 - DNA, 70 bp, Artificial Sequence
  Synthetic
gccaagcatttaggtgacactatagtcgaatgagccttcgcaaaagtttcagagctatgctggaaacagc

SEQ ID NO: 51773 - DNA, 70 bp, Artificial Sequence
  Synthetic
gccaagcatttaggtgacactatagtgtgaaacccagttgtcacagtttcagagctatgctggaaacagc

SEQ ID NO: 51774 - DNA, 70 bp, Artificial Sequence
  Synthetic
gccaagcatttaggtgacactatagcaactacagggaaatggcgagtttcagagctatgctggaaacagc

SEQ ID NO: 51775 - DNA, 70 bp, Artificial Sequence
  Synthetic
gccaagcatttaggtgacactataggtgacacgttcaccaactatgtttcagagctatgctggaaacagc

SEQ ID NO: 51776 - DNA, 70 bp, Artificial Sequence
  Synthetic
gccaagcatttaggtgacactatagggtgagggtggggccctagggtttcagagctatgctggaaacagc

SEQ ID NO: 51777 - DNA, 70 bp, Artificial Sequence
  Synthetic
gccaagcatttaggtgacactatagtcagagggctctacctgagagtttcagagctatgctggaaacagc

SEQ ID NO: 51778 - DNA, 70 bp, Artificial Sequence
  Synthetic
gccaagcatttaggtgacactatagctctgctgcctctgtcacttgtttcagagctatgctggaaacagc

SEQ ID NO: 51779 - DNA, 70 bp, Artificial Sequence
  Synthetic
gccaagcatttaggtgacactatagatgaggttcaggatgtgccagtttcagagctatgctggaaacagc

SEQ ID NO: 51780 - DNA, 70 bp, Artificial Sequence
  Synthetic
gccaagcatttaggtgacactatagctctgctgggcgttcagggcgtttcagagctatgctggaaacagc

SEQ ID NO: 51781 - DNA, 70 bp, Artificial Sequence
  Synthetic
gccaagcatttaggtgacactatagctcgccagcactgtggtcacgtttcagagctatgctggaaacagc

SEQ ID NO: 51782 - DNA, 70 bp, Artificial Sequence
  Synthetic
gccaagcatttaggtgacactatagctgtcagtgctcagatctgtgtttcagagctatgctggaaacagc

SEQ ID NO: 51783 - DNA, 70 bp, Artificial Sequence
  Synthetic
gccaagcatttaggtgacactatagtcaagccagattcttgaaaagtttcagagctatgctggaaacagc

SEQ ID NO: 51784 - DNA, 70 bp, Artificial Sequence
  Synthetic
gccaagcatttaggtgacactatagagcggctctctgtgtgtcatgtttcagagctatgctggaaacagc

SEQ ID NO: 51785 - DNA, 70 bp, Artificial Sequence
  Synthetic
gccaagcatttaggtgacactataggggatctgcggctctcaagggtttcagagctatgctggaaacagc

SEQ ID NO: 51786 - DNA, 70 bp, Artificial Sequence
  Synthetic
gccaagcatttaggtgacactatagcctggggggcctccatcaccgtttcagagctatgctggaaacagc

SEQ ID NO: 51787 - DNA, 70 bp, Artificial Sequence
  Synthetic
gccaagcatttaggtgacactatagctggcgctgtgacctcactggtttcagagctatgctggaaacagc

SEQ ID NO: 51788 - DNA, 70 bp, Artificial Sequence
  Synthetic
gccaagcatttaggtgacactatagctacctcctgatattgctgagtttcagagctatgctggaaacagc

SEQ ID NO: 51789 - DNA, 70 bp, Artificial Sequence
  Synthetic
gccaagcatttaggtgacactatagggaacagacaacgcaagctggtttcagagctatgctggaaacagc

SEQ ID NO: 51790 - DNA, 70 bp, Artificial Sequence
  Synthetic
gccaagcatttaggtgacactatagtggtttgcaccctaacactcgtttcagagctatgctggaaacagc

SEQ ID NO: 51791 - DNA, 70 bp, Artificial Sequence
  Synthetic
gccaagcatttaggtgacactatagaaccatgttccagcaaagccgtttcagagctatgctggaaacagc

SEQ ID NO: 51792 - DNA, 70 bp, Artificial Sequence
  Synthetic
gccaagcatttaggtgacactatagctctcacatggttaacattcgtttcagagctatgctggaaacagc

SEQ ID NO: 51793 - DNA, 70 bp, Artificial Sequence
  Synthetic
gccaagcatttaggtgacactataggtggcaggcggcacagttgggtttcagagctatgctggaaacagc

SEQ ID NO: 51794 - DNA, 70 bp, Artificial Sequence
  Synthetic
gccaagcatttaggtgacactatagtcgaacgagctgatatcgaagtttcagagctatgctggaaacagc

SEQ ID NO: 51795 - DNA, 70 bp, Artificial Sequence
  Synthetic
gccaagcatttaggtgacactatagggcgtgggcaaagctcagcagtttcagagctatgctggaaacagc

SEQ ID NO: 51796 - DNA, 70 bp, Artificial Sequence
  Synthetic
gccaagcatttaggtgacactatagaaggctcaggggccaactacgtttcagagctatgctggaaacagc

SEQ ID NO: 51797 - DNA, 70 bp, Artificial Sequence
  Synthetic
gccaagcatttaggtgacactataggcctcctctgggatgggacagtttcagagctatgctggaaacagc

SEQ ID NO: 51798 - DNA, 70 bp, Artificial Sequence
  Synthetic
gccaagcatttaggtgacactataggtgtctatctagatcaggaagtttcagagctatgctggaaacagc

SEQ ID NO: 51799 - DNA, 70 bp, Artificial Sequence
  Synthetic
gccaagcatttaggtgacactatagcgcctactccaagatcaccggtttcagagctatgctggaaacagc

SEQ ID NO: 51800 - DNA, 70 bp, Artificial Sequence
  Synthetic
gccaagcatttaggtgacactatagtctggtctcccaggtttcacgtttcagagctatgctggaaacagc

SEQ ID NO: 51801 - DNA, 70 bp, Artificial Sequence
  Synthetic
gccaagcatttaggtgacactatagccttcccagtccttattctggtttcagagctatgctggaaacagc

SEQ ID NO: 51802 - DNA, 70 bp, Artificial Sequence
  Synthetic
gccaagcatttaggtgacactataggactgtgtcagcagagccacgtttcagagctatgctggaaacagc

SEQ ID NO: 51803 - DNA, 70 bp, Artificial Sequence
  Synthetic
gccaagcatttaggtgacactatagtacatcaccctcacctaggcgtttcagagctatgctggaaacagc

SEQ ID NO: 51804 - DNA, 70 bp, Artificial Sequence
  Synthetic
gccaagcatttaggtgacactatagaaccagaactcctcttgatggtttcagagctatgctggaaacagc

SEQ ID NO: 51805 - DNA, 70 bp, Artificial Sequence
  Synthetic
gccaagcatttaggtgacactatagagcctttggctgccaggcctgtttcagagctatgctggaaacagc

SEQ ID NO: 51806 - DNA, 70 bp, Artificial Sequence
  Synthetic
gccaagcatttaggtgacactatagtcgcccacagcagataaaaagtttcagagctatgctggaaacagc

SEQ ID NO: 51807 - DNA, 70 bp, Artificial Sequence
  Synthetic
gccaagcatttaggtgacactatagggagcgcgtcaaggagccaggtttcagagctatgctggaaacagc

SEQ ID NO: 51808 - DNA, 70 bp, Artificial Sequence
  Synthetic
gccaagcatttaggtgacactataggcctatgaggatgagggaaggtttcagagctatgctggaaacagc

SEQ ID NO: 51809 - DNA, 70 bp, Artificial Sequence
  Synthetic
gccaagcatttaggtgacactatagactaattctttgttggctgagtttcagagctatgctggaaacagc

SEQ ID NO: 51810 - DNA, 70 bp, Artificial Sequence
  Synthetic
gccaagcatttaggtgacactatagcttagtactgcagcaaaagagtttcagagctatgctggaaacagc

SEQ ID NO: 51811 - DNA, 70 bp, Artificial Sequence
  Synthetic
gccaagcatttaggtgacactatagactcattctttgttgactgagtttcagagctatgctggaaacagc

SEQ ID NO: 51812 - DNA, 70 bp, Artificial Sequence
  Synthetic
gccaagcatttaggtgacactatagtcagaatctcaaagcatcaagtttcagagctatgctggaaacagc

SEQ ID NO: 51813 - DNA, 70 bp, Artificial Sequence
  Synthetic
gccaagcatttaggtgacactatagttagatgttctgtagttgtcgtttcagagctatgctggaaacagc

SEQ ID NO: 51814 - DNA, 70 bp, Artificial Sequence
  Synthetic
gccaagcatttaggtgacactataggcaatctcactgataaaagggtttcagagctatgctggaaacagc

SEQ ID NO: 51815 - DNA, 70 bp, Artificial Sequence
  Synthetic
gccaagcatttaggtgacactatagattgctggatgaaagactaggtttcagagctatgctggaaacagc

SEQ ID NO: 51816 - DNA, 70 bp, Artificial Sequence
  Synthetic
gccaagcatttaggtgacactatagctcaactgccaaaaggcaatgtttcagagctatgctggaaacagc

SEQ ID NO: 51817 - DNA, 70 bp, Artificial Sequence
  Synthetic
gccaagcatttaggtgacactatagtccacctctgggagtgggaggtttcagagctatgctggaaacagc

SEQ ID NO: 51818 - DNA, 70 bp, Artificial Sequence
  Synthetic
gccaagcatttaggtgacactatagtatggtgaatccaagttggggtttcagagctatgctggaaacagc

SEQ ID NO: 51819 - DNA, 70 bp, Artificial Sequence
  Synthetic
gccaagcatttaggtgacactatagtgaccaagaaggctcagtgagtttcagagctatgctggaaacagc

SEQ ID NO: 51820 - DNA, 70 bp, Artificial Sequence
  Synthetic
gccaagcatttaggtgacactataggtcagaagcgcagccccctggtttcagagctatgctggaaacagc

SEQ ID NO: 51821 - DNA, 70 bp, Artificial Sequence
  Synthetic
gccaagcatttaggtgacactataggatacgttatgaccttcatcgtttcagagctatgctggaaacagc

SEQ ID NO: 51822 - DNA, 70 bp, Artificial Sequence
  Synthetic
gccaagcatttaggtgacactatagtcatcttcttctggttcctggtttcagagctatgctggaaacagc

SEQ ID NO: 51823 - DNA, 70 bp, Artificial Sequence
  Synthetic
gccaagcatttaggtgacactataggccccatctggccaagcttggtttcagagctatgctggaaacagc

SEQ ID NO: 51824 - DNA, 70 bp, Artificial Sequence
  Synthetic
gccaagcatttaggtgacactataggttttatgaagtggctcatggtttcagagctatgctggaaacagc

SEQ ID NO: 51825 - DNA, 70 bp, Artificial Sequence
  Synthetic
gccaagcatttaggtgacactatagcagaggctgcaaggctcactgtttcagagctatgctggaaacagc

SEQ ID NO: 51826 - DNA, 70 bp, Artificial Sequence
  Synthetic
gccaagcatttaggtgacactatagagcgaaagaggacgaggagggtttcagagctatgctggaaacagc

SEQ ID NO: 51827 - DNA, 70 bp, Artificial Sequence
  Synthetic
gccaagcatttaggtgacactatagccctccagtcctgtgctcaggtttcagagctatgctggaaacagc

SEQ ID NO: 51828 - DNA, 70 bp, Artificial Sequence
  Synthetic
gccaagcatttaggtgacactataggagcagcaatacgtgatccagtttcagagctatgctggaaacagc

SEQ ID NO: 51829 - DNA, 70 bp, Artificial Sequence
  Synthetic
gccaagcatttaggtgacactatagctcccggtgggcaggctcaggtttcagagctatgctggaaacagc

SEQ ID NO: 51830 - DNA, 70 bp, Artificial Sequence
  Synthetic
gccaagcatttaggtgacactatagtctacagctggcacttgagtgtttcagagctatgctggaaacagc

SEQ ID NO: 51831 - DNA, 70 bp, Artificial Sequence
  Synthetic
gccaagcatttaggtgacactatagtatgccccgactgtgctaaggtttcagagctatgctggaaacagc

SEQ ID NO: 51832 - DNA, 70 bp, Artificial Sequence
  Synthetic
gccaagcatttaggtgacactataggatttatggctgaagtggctgtttcagagctatgctggaaacagc

SEQ ID NO: 51833 - DNA, 70 bp, Artificial Sequence
  Synthetic
gccaagcatttaggtgacactatagaacatattgtcttcaaggtggtttcagagctatgctggaaacagc

SEQ ID NO: 51834 - DNA, 70 bp, Artificial Sequence
  Synthetic
gccaagcatttaggtgacactatagtcctgatattctattcccatgtttcagagctatgctggaaacagc

SEQ ID NO: 51835 - DNA, 70 bp, Artificial Sequence
  Synthetic
gccaagcatttaggtgacactatagaaactggttcacttcatccagtttcagagctatgctggaaacagc

SEQ ID NO: 51836 - DNA, 70 bp, Artificial Sequence
  Synthetic
gccaagcatttaggtgacactatagtttatcatctctctcgacttgtttcagagctatgctggaaacagc

SEQ ID NO: 51837 - DNA, 70 bp, Artificial Sequence
  Synthetic
gccaagcatttaggtgacactatagcacagtcgtattcagtcatcgtttcagagctatgctggaaacagc

SEQ ID NO: 51838 - DNA, 70 bp, Artificial Sequence
  Synthetic
gccaagcatttaggtgacactatagggactttgtaaacactgttcgtttcagagctatgctggaaacagc

SEQ ID NO: 51839 - DNA, 70 bp, Artificial Sequence
  Synthetic
gccaagcatttaggtgacactatagtgaaatactgtggtgaagtagtttcagagctatgctggaaacagc

SEQ ID NO: 51840 - DNA, 70 bp, Artificial Sequence
  Synthetic
gccaagcatttaggtgacactatagaaatctgcgctacttgtttcgtttcagagctatgctggaaacagc

SEQ ID NO: 51841 - DNA, 70 bp, Artificial Sequence
  Synthetic
gccaagcatttaggtgacactatagatatgggcgattttgtcatggtttcagagctatgctggaaacagc

SEQ ID NO: 51842 - DNA, 70 bp, Artificial Sequence
  Synthetic
gccaagcatttaggtgacactatagagaaattcaatgggatttgggtttcagagctatgctggaaacagc

SEQ ID NO: 51843 - DNA, 70 bp, Artificial Sequence
  Synthetic
gccaagcatttaggtgacactataggtgcttgcaaaggaaagatggtttcagagctatgctggaaacagc

SEQ ID NO: 51844 - DNA, 70 bp, Artificial Sequence
  Synthetic
gccaagcatttaggtgacactataggagggacccattaatattgggtttcagagctatgctggaaacagc

SEQ ID NO: 51845 - DNA, 70 bp, Artificial Sequence
  Synthetic
gccaagcatttaggtgacactatagtctgtgaatccggtgtgttagtttcagagctatgctggaaacagc

SEQ ID NO: 51846 - DNA, 70 bp, Artificial Sequence
  Synthetic
gccaagcatttaggtgacactatagaccgatggcacacacttcaggtttcagagctatgctggaaacagc

SEQ ID NO: 51847 - DNA, 70 bp, Artificial Sequence
  Synthetic
gccaagcatttaggtgacactatagcagcccaggagctctagcccgtttcagagctatgctggaaacagc

SEQ ID NO: 51848 - DNA, 70 bp, Artificial Sequence
  Synthetic
gccaagcatttaggtgacactataggtgatattagaacggccgccgtttcagagctatgctggaaacagc

SEQ ID NO: 51849 - DNA, 70 bp, Artificial Sequence
  Synthetic
gccaagcatttaggtgacactatagcctgggcgtctaggagagaggtttcagagctatgctggaaacagc

SEQ ID NO: 51850 - DNA, 70 bp, Artificial Sequence
  Synthetic
gccaagcatttaggtgacactatagggtcgagtggcatttggtaagtttcagagctatgctggaaacagc

SEQ ID NO: 51851 - DNA, 70 bp, Artificial Sequence
  Synthetic
gccaagcatttaggtgacactatagataggcaggcaggtcactgcgtttcagagctatgctggaaacagc

SEQ ID NO: 51852 - DNA, 70 bp, Artificial Sequence
  Synthetic
gccaagcatttaggtgacactatagtaatcaggcgggatcttctcgtttcagagctatgctggaaacagc

SEQ ID NO: 51853 - DNA, 70 bp, Artificial Sequence
  Synthetic
gccaagcatttaggtgacactatagaggatatccacagaaatcaagtttcagagctatgctggaaacagc

SEQ ID NO: 51854 - DNA, 70 bp, Artificial Sequence
  Synthetic
gccaagcatttaggtgacactatagcgttcattgttaatagggcagtttcagagctatgctggaaacagc

SEQ ID NO: 51855 - DNA, 70 bp, Artificial Sequence
  Synthetic
gccaagcatttaggtgacactatagcccctcagcacctgatgaaggtttcagagctatgctggaaacagc

SEQ ID NO: 51856 - DNA, 70 bp, Artificial Sequence
  Synthetic
gccaagcatttaggtgacactataggatccttcatcaacgtctaggtttcagagctatgctggaaacagc

SEQ ID NO: 51857 - DNA, 70 bp, Artificial Sequence
  Synthetic
gccaagcatttaggtgacactatagcgggtacccacaaaatgagcgtttcagagctatgctggaaacagc

SEQ ID NO: 51858 - DNA, 70 bp, Artificial Sequence
  Synthetic
gccaagcatttaggtgacactatagggctgacattcatctagtctgtttcagagctatgctggaaacagc

SEQ ID NO: 51859 - DNA, 70 bp, Artificial Sequence
  Synthetic
gccaagcatttaggtgacactatagttcaattatgtggaggcttcgtttcagagctatgctggaaacagc

SEQ ID NO: 51860 - DNA, 70 bp, Artificial Sequence
  Synthetic
gccaagcatttaggtgacactatagatattttctggagctcccccgtttcagagctatgctggaaacagc

SEQ ID NO: 51861 - DNA, 70 bp, Artificial Sequence
  Synthetic
gccaagcatttaggtgacactatagattcatctgcgagttcaggtgtttcagagctatgctggaaacagc

SEQ ID NO: 51862 - DNA, 70 bp, Artificial Sequence
  Synthetic
gccaagcatttaggtgacactataggcaggcagcagagtcagcaggtttcagagctatgctggaaacagc

SEQ ID NO: 51863 - DNA, 70 bp, Artificial Sequence
  Synthetic
gccaagcatttaggtgacactatagtcaagatcctgtcttgctgagtttcagagctatgctggaaacagc

SEQ ID NO: 51864 - DNA, 70 bp, Artificial Sequence
  Synthetic
gccaagcatttaggtgacactatagctgcgtgcctgctgctgagcgtttcagagctatgctggaaacagc

SEQ ID NO: 51865 - DNA, 70 bp, Artificial Sequence
  Synthetic
gccaagcatttaggtgacactatagagtttaatggaatccattcggtttcagagctatgctggaaacagc

SEQ ID NO: 51866 - DNA, 70 bp, Artificial Sequence
  Synthetic
gccaagcatttaggtgacactatagagaccatacgttggaggatggtttcagagctatgctggaaacagc

SEQ ID NO: 51867 - DNA, 70 bp, Artificial Sequence
  Synthetic
gccaagcatttaggtgacactatagaagtacagtccgcagcgggtgtttcagagctatgctggaaacagc

SEQ ID NO: 51868 - DNA, 70 bp, Artificial Sequence
  Synthetic
gccaagcatttaggtgacactatagtccagatcgtgaagaagtaagtttcagagctatgctggaaacagc

SEQ ID NO: 51869 - DNA, 70 bp, Artificial Sequence
  Synthetic
gccaagcatttaggtgacactatagtcccaccaaggaacagagcggtttcagagctatgctggaaacagc

SEQ ID NO: 51870 - DNA, 70 bp, Artificial Sequence
  Synthetic
gccaagcatttaggtgacactatagtccacagaagggcttcacccgtttcagagctatgctggaaacagc

SEQ ID NO: 51871 - DNA, 70 bp, Artificial Sequence
  Synthetic
gccaagcatttaggtgacactatagttgatgtcttcagtctcatcgtttcagagctatgctggaaacagc

SEQ ID NO: 51872 - DNA, 70 bp, Artificial Sequence
  Synthetic
gccaagcatttaggtgacactatagggggatctggctccatcaaggtttcagagctatgctggaaacagc

SEQ ID NO: 51873 - DNA, 70 bp, Artificial Sequence
  Synthetic
gccaagcatttaggtgacactatagaatcagagtgtgtcctctaagtttcagagctatgctggaaacagc

SEQ ID NO: 51874 - DNA, 70 bp, Artificial Sequence
  Synthetic
gccaagcatttaggtgacactatagatcacctggaacccaaatttgtttcagagctatgctggaaacagc

SEQ ID NO: 51875 - DNA, 70 bp, Artificial Sequence
  Synthetic
gccaagcatttaggtgacactatagttctgctagtgtcctaaattgtttcagagctatgctggaaacagc

SEQ ID NO: 51876 - DNA, 70 bp, Artificial Sequence
  Synthetic
gccaagcatttaggtgacactatagagtgaaaagcaggaagaagagtttcagagctatgctggaaacagc

SEQ ID NO: 51877 - DNA, 70 bp, Artificial Sequence
  Synthetic
gccaagcatttaggtgacactataggaatccattagaggacacacgtttcagagctatgctggaaacagc

SEQ ID NO: 51878 - DNA, 70 bp, Artificial Sequence
  Synthetic
gccaagcatttaggtgacactataggtcatgctgtctgttataccgtttcagagctatgctggaaacagc

SEQ ID NO: 51879 - DNA, 70 bp, Artificial Sequence
  Synthetic
gccaagcatttaggtgacactatagaaatcctacaccctggtgtagtttcagagctatgctggaaacagc

SEQ ID NO: 51880 - DNA, 70 bp, Artificial Sequence
  Synthetic
gccaagcatttaggtgacactatagtctcattcttcgatgcaaaagtttcagagctatgctggaaacagc

SEQ ID NO: 51881 - DNA, 70 bp, Artificial Sequence
  Synthetic
gccaagcatttaggtgacactatagaagctctgcaggatatagccgtttcagagctatgctggaaacagc

SEQ ID NO: 51882 - DNA, 70 bp, Artificial Sequence
  Synthetic
gccaagcatttaggtgacactatagttcagtgctaacactgtgatgtttcagagctatgctggaaacagc

SEQ ID NO: 51883 - DNA, 70 bp, Artificial Sequence
  Synthetic
gccaagcatttaggtgacactatagtggactctgatggatcgcctgtttcagagctatgctggaaacagc

SEQ ID NO: 51884 - DNA, 70 bp, Artificial Sequence
  Synthetic
gccaagcatttaggtgacactataggtgcaatatagcaagtagtcgtttcagagctatgctggaaacagc

SEQ ID NO: 51885 - DNA, 70 bp, Artificial Sequence
  Synthetic
gccaagcatttaggtgacactatagatgctgtacagtgctatgctgtttcagagctatgctggaaacagc

SEQ ID NO: 51886 - DNA, 70 bp, Artificial Sequence
  Synthetic
gccaagcatttaggtgacactatagtcattctggtcatattagacgtttcagagctatgctggaaacagc

SEQ ID NO: 51887 - DNA, 70 bp, Artificial Sequence
  Synthetic
gccaagcatttaggtgacactataggaccataaagcacttactgtgtttcagagctatgctggaaacagc

SEQ ID NO: 51888 - DNA, 70 bp, Artificial Sequence
  Synthetic
gccaagcatttaggtgacactataggccatacatggatctggatcgtttcagagctatgctggaaacagc

SEQ ID NO: 51889 - DNA, 70 bp, Artificial Sequence
  Synthetic
gccaagcatttaggtgacactatagagaactactgctaaatgagtgtttcagagctatgctggaaacagc

SEQ ID NO: 51890 - DNA, 70 bp, Artificial Sequence
  Synthetic
gccaagcatttaggtgacactatagtctaatcatcactggttgaggtttcagagctatgctggaaacagc

SEQ ID NO: 51891 - DNA, 70 bp, Artificial Sequence
  Synthetic
gccaagcatttaggtgacactatagccaattgcactatctctttggtttcagagctatgctggaaacagc

SEQ ID NO: 51892 - DNA, 70 bp, Artificial Sequence
  Synthetic
gccaagcatttaggtgacactataggcctctactattcttcctaagtttcagagctatgctggaaacagc

SEQ ID NO: 51893 - DNA, 70 bp, Artificial Sequence
  Synthetic
gccaagcatttaggtgacactatagtggcactgaataatctacacgtttcagagctatgctggaaacagc

SEQ ID NO: 51894 - DNA, 70 bp, Artificial Sequence
  Synthetic
gccaagcatttaggtgacactataggaatcatctagtcctctgttgtttcagagctatgctggaaacagc

SEQ ID NO: 51895 - DNA, 70 bp, Artificial Sequence
  Synthetic
gccaagcatttaggtgacactataggggaggcttaggccgaagaagtttcagagctatgctggaaacagc

SEQ ID NO: 51896 - DNA, 70 bp, Artificial Sequence
  Synthetic
gccaagcatttaggtgacactataggggcgacgtgtcctctgaacgtttcagagctatgctggaaacagc

SEQ ID NO: 51897 - DNA, 70 bp, Artificial Sequence
  Synthetic
gccaagcatttaggtgacactatagtaagtgtgtgaatggtccgtgtttcagagctatgctggaaacagc

SEQ ID NO: 51898 - DNA, 70 bp, Artificial Sequence
  Synthetic
gccaagcatttaggtgacactataggagagatcaggcttttactcgtttcagagctatgctggaaacagc

SEQ ID NO: 51899 - DNA, 70 bp, Artificial Sequence
  Synthetic
gccaagcatttaggtgacactatagaagtcccaggaggacttctggtttcagagctatgctggaaacagc

SEQ ID NO: 51900 - DNA, 70 bp, Artificial Sequence
  Synthetic
gccaagcatttaggtgacactataggctgcaagatgaagcttatcgtttcagagctatgctggaaacagc

SEQ ID NO: 51901 - DNA, 70 bp, Artificial Sequence
  Synthetic
gccaagcatttaggtgacactataggctgggtttgcacttagaacgtttcagagctatgctggaaacagc

SEQ ID NO: 51902 - DNA, 70 bp, Artificial Sequence
  Synthetic
gccaagcatttaggtgacactatagtgttagttaagacctgcagtgtttcagagctatgctggaaacagc

SEQ ID NO: 51903 - DNA, 70 bp, Artificial Sequence
  Synthetic
gccaagcatttaggtgacactatagttttggtggatgcgtctagagtttcagagctatgctggaaacagc

SEQ ID NO: 51904 - DNA, 70 bp, Artificial Sequence
  Synthetic
gccaagcatttaggtgacactatagcagttggatcacttgagatcgtttcagagctatgctggaaacagc

SEQ ID NO: 51905 - DNA, 70 bp, Artificial Sequence
  Synthetic
gccaagcatttaggtgacactataggtgcaggaggccttcgcacagtttcagagctatgctggaaacagc

SEQ ID NO: 51906 - DNA, 70 bp, Artificial Sequence
  Synthetic
gccaagcatttaggtgacactatagagagctgatgaagttgctgagtttcagagctatgctggaaacagc

SEQ ID NO: 51907 - DNA, 70 bp, Artificial Sequence
  Synthetic
gccaagcatttaggtgacactatagagataagcaattcacactacgtttcagagctatgctggaaacagc

SEQ ID NO: 51908 - DNA, 70 bp, Artificial Sequence
  Synthetic
gccaagcatttaggtgacactatagatgaaggtgctagtacatgcgtttcagagctatgctggaaacagc

SEQ ID NO: 51909 - DNA, 70 bp, Artificial Sequence
  Synthetic
gccaagcatttaggtgacactatagatgcagaatgggaaagacaggtttcagagctatgctggaaacagc

SEQ ID NO: 51910 - DNA, 70 bp, Artificial Sequence
  Synthetic
gccaagcatttaggtgacactatagctggtgaaggagctccattcgtttcagagctatgctggaaacagc

SEQ ID NO: 51911 - DNA, 70 bp, Artificial Sequence
  Synthetic
gccaagcatttaggtgacactatagtgtcacacaggatcgcgtaggtttcagagctatgctggaaacagc

SEQ ID NO: 51912 - DNA, 70 bp, Artificial Sequence
  Synthetic
gccaagcatttaggtgacactatagttctgtttatgtgtacagaggtttcagagctatgctggaaacagc

SEQ ID NO: 51913 - DNA, 70 bp, Artificial Sequence
  Synthetic
gccaagcatttaggtgacactataggaggacagcgactcttaaatgtttcagagctatgctggaaacagc

SEQ ID NO: 51914 - DNA, 70 bp, Artificial Sequence
  Synthetic
gccaagcatttaggtgacactatagggggtttatgcgtaagtgacgtttcagagctatgctggaaacagc

SEQ ID NO: 51915 - DNA, 70 bp, Artificial Sequence
  Synthetic
gccaagcatttaggtgacactatagtgctctggagataaggaaacgtttcagagctatgctggaaacagc

SEQ ID NO: 51916 - DNA, 70 bp, Artificial Sequence
  Synthetic
gccaagcatttaggtgacactatagcaaacgcaaactcaggaaaagtttcagagctatgctggaaacagc

SEQ ID NO: 51917 - DNA, 70 bp, Artificial Sequence
  Synthetic
gccaagcatttaggtgacactataggaggctgcagccaaggcttggtttcagagctatgctggaaacagc

SEQ ID NO: 51918 - DNA, 70 bp, Artificial Sequence
  Synthetic
gccaagcatttaggtgacactatagtgcgaggtcactgctgctccgtttcagagctatgctggaaacagc

SEQ ID NO: 51919 - DNA, 70 bp, Artificial Sequence
  Synthetic
gccaagcatttaggtgacactatagagggtatcacagatgactgagtttcagagctatgctggaaacagc

SEQ ID NO: 51920 - DNA, 70 bp, Artificial Sequence
  Synthetic
gccaagcatttaggtgacactatagaaagaggagctgaaagccaagtttcagagctatgctggaaacagc

SEQ ID NO: 51921 - DNA, 70 bp, Artificial Sequence
  Synthetic
gccaagcatttaggtgacactatagactgcccaggagaaggactggtttcagagctatgctggaaacagc

SEQ ID NO: 51922 - DNA, 70 bp, Artificial Sequence
  Synthetic
gccaagcatttaggtgacactatagagaagccgctgggggagctagtttcagagctatgctggaaacagc

SEQ ID NO: 51923 - DNA, 70 bp, Artificial Sequence
  Synthetic
gccaagcatttaggtgacactatagaaatacaacagagtgccatcgtttcagagctatgctggaaacagc

SEQ ID NO: 51924 - DNA, 70 bp, Artificial Sequence
  Synthetic
gccaagcatttaggtgacactatagccaccattatgagaacttctgtttcagagctatgctggaaacagc

SEQ ID NO: 51925 - DNA, 70 bp, Artificial Sequence
  Synthetic
gccaagcatttaggtgacactatagaggctcagaagttctcataggtttcagagctatgctggaaacagc

SEQ ID NO: 51926 - DNA, 70 bp, Artificial Sequence
  Synthetic
gccaagcatttaggtgacactatagtaaagcacaatcaggatcttgtttcagagctatgctggaaacagc

SEQ ID NO: 51927 - DNA, 70 bp, Artificial Sequence
  Synthetic
gccaagcatttaggtgacactatagtaattcagattagaggtgtggtttcagagctatgctggaaacagc

SEQ ID NO: 51928 - DNA, 70 bp, Artificial Sequence
  Synthetic
gccaagcatttaggtgacactatagatcaccactaacctgtgagggtttcagagctatgctggaaacagc

SEQ ID NO: 51929 - DNA, 70 bp, Artificial Sequence
  Synthetic
gccaagcatttaggtgacactatagggaggatggcagggagctgtgtttcagagctatgctggaaacagc

SEQ ID NO: 51930 - DNA, 70 bp, Artificial Sequence
  Synthetic
gccaagcatttaggtgacactatagtgggcagtgccctggcctgagtttcagagctatgctggaaacagc

SEQ ID NO: 51931 - DNA, 70 bp, Artificial Sequence
  Synthetic
gccaagcatttaggtgacactatagaagaaagccccctggaaggcgtttcagagctatgctggaaacagc

SEQ ID NO: 51932 - DNA, 70 bp, Artificial Sequence
  Synthetic
gccaagcatttaggtgacactatagctgaggctacttgtacgcgtgtttcagagctatgctggaaacagc

SEQ ID NO: 51933 - DNA, 70 bp, Artificial Sequence
  Synthetic
gccaagcatttaggtgacactatagagtctagtcaaatgccataagtttcagagctatgctggaaacagc

SEQ ID NO: 51934 - DNA, 70 bp, Artificial Sequence
  Synthetic
gccaagcatttaggtgacactataggacctctcccagctgctgaagtttcagagctatgctggaaacagc

SEQ ID NO: 51935 - DNA, 70 bp, Artificial Sequence
  Synthetic
gccaagcatttaggtgacactatagaaagctgatgggcgtggagagtttcagagctatgctggaaacagc

SEQ ID NO: 51936 - DNA, 70 bp, Artificial Sequence
  Synthetic
gccaagcatttaggtgacactatagccaggacaggtttgtatcacgtttcagagctatgctggaaacagc

SEQ ID NO: 51937 - DNA, 70 bp, Artificial Sequence
  Synthetic
gccaagcatttaggtgacactatagcctgttttgggatcacaaacgtttcagagctatgctggaaacagc

SEQ ID NO: 51938 - DNA, 70 bp, Artificial Sequence
  Synthetic
gccaagcatttaggtgacactataggagacggggcggttctgatcgtttcagagctatgctggaaacagc

SEQ ID NO: 51939 - DNA, 70 bp, Artificial Sequence
  Synthetic
gccaagcatttaggtgacactataggacacctgatgccttactgggtttcagagctatgctggaaacagc

SEQ ID NO: 51940 - DNA, 70 bp, Artificial Sequence
  Synthetic
gccaagcatttaggtgacactatagctgttgggggctgccttcaggtttcagagctatgctggaaacagc

SEQ ID NO: 51941 - DNA, 70 bp, Artificial Sequence
  Synthetic
gccaagcatttaggtgacactatagtcccgcaagggcggcaagtggtttcagagctatgctggaaacagc

SEQ ID NO: 51942 - DNA, 70 bp, Artificial Sequence
  Synthetic
gccaagcatttaggtgacactataggggcagcatggaaatcattggtttcagagctatgctggaaacagc

SEQ ID NO: 51943 - DNA, 70 bp, Artificial Sequence
  Synthetic
gccaagcatttaggtgacactataggctcgtgggatggctcacaggtttcagagctatgctggaaacagc

SEQ ID NO: 51944 - DNA, 70 bp, Artificial Sequence
  Synthetic
gccaagcatttaggtgacactatagcagcttcgtacatatcaagagtttcagagctatgctggaaacagc

SEQ ID NO: 51945 - DNA, 70 bp, Artificial Sequence
  Synthetic
gccaagcatttaggtgacactatagtgagctttggttctttgaacgtttcagagctatgctggaaacagc

SEQ ID NO: 51946 - DNA, 70 bp, Artificial Sequence
  Synthetic
gccaagcatttaggtgacactatagcaggtgctgtgtcactgagggtttcagagctatgctggaaacagc

SEQ ID NO: 51947 - DNA, 70 bp, Artificial Sequence
  Synthetic
gccaagcatttaggtgacactatagcatccctgacatctatgagagtttcagagctatgctggaaacagc

SEQ ID NO: 51948 - DNA, 70 bp, Artificial Sequence
  Synthetic
gccaagcatttaggtgacactatagacattacagtcttctgagaagtttcagagctatgctggaaacagc

SEQ ID NO: 51949 - DNA, 70 bp, Artificial Sequence
  Synthetic
gccaagcatttaggtgacactatagctccgtcgtataattatcgtgtttcagagctatgctggaaacagc

SEQ ID NO: 51950 - DNA, 70 bp, Artificial Sequence
  Synthetic
gccaagcatttaggtgacactatagctaccagcgaacgaaataaggtttcagagctatgctggaaacagc

SEQ ID NO: 51951 - DNA, 70 bp, Artificial Sequence
  Synthetic
gccaagcatttaggtgacactataggcagggtctggaagcatgaggtttcagagctatgctggaaacagc

SEQ ID NO: 51952 - DNA, 70 bp, Artificial Sequence
  Synthetic
gccaagcatttaggtgacactatagaaaaggagggaggactgagcgtttcagagctatgctggaaacagc

SEQ ID NO: 51953 - DNA, 70 bp, Artificial Sequence
  Synthetic
gccaagcatttaggtgacactataggccttcaagcttcaagcctcgtttcagagctatgctggaaacagc

SEQ ID NO: 51954 - DNA, 70 bp, Artificial Sequence
  Synthetic
gccaagcatttaggtgacactataggaggggaagttgaaaccctagtttcagagctatgctggaaacagc

SEQ ID NO: 51955 - DNA, 70 bp, Artificial Sequence
  Synthetic
gccaagcatttaggtgacactatagcccagggcggctctaacagcgtttcagagctatgctggaaacagc

SEQ ID NO: 51956 - DNA, 70 bp, Artificial Sequence
  Synthetic
gccaagcatttaggtgacactatagtcctccatcccagttttagcgtttcagagctatgctggaaacagc

SEQ ID NO: 51957 - DNA, 70 bp, Artificial Sequence
  Synthetic
gccaagcatttaggtgacactatagtagattgcagagagtccaccgtttcagagctatgctggaaacagc

SEQ ID NO: 51958 - DNA, 70 bp, Artificial Sequence
  Synthetic
gccaagcatttaggtgacactatagcccgtgcaccaggcctcacggtttcagagctatgctggaaacagc

SEQ ID NO: 51959 - DNA, 70 bp, Artificial Sequence
  Synthetic
gccaagcatttaggtgacactataggggcagcgtggaggtcatcggtttcagagctatgctggaaacagc

SEQ ID NO: 51960 - DNA, 70 bp, Artificial Sequence
  Synthetic
gccaagcatttaggtgacactataggccggccacggggccctagggtttcagagctatgctggaaacagc

SEQ ID NO: 51961 - DNA, 70 bp, Artificial Sequence
  Synthetic
gccaagcatttaggtgacactatagtcaggaggttttggttccacgtttcagagctatgctggaaacagc

SEQ ID NO: 51962 - DNA, 70 bp, Artificial Sequence
  Synthetic
gccaagcatttaggtgacactataggaagagctggccagagagacgtttcagagctatgctggaaacagc

SEQ ID NO: 51963 - DNA, 70 bp, Artificial Sequence
  Synthetic
gccaagcatttaggtgacactatagcctccgcctccgcgcggcaggtttcagagctatgctggaaacagc

SEQ ID NO: 51964 - DNA, 70 bp, Artificial Sequence
  Synthetic
gccaagcatttaggtgacactatagtgactgtgttcaccacgttcgtttcagagctatgctggaaacagc

SEQ ID NO: 51965 - DNA, 70 bp, Artificial Sequence
  Synthetic
gccaagcatttaggtgacactatagctgaatgggaccctctcaaagtttcagagctatgctggaaacagc

SEQ ID NO: 51966 - DNA, 70 bp, Artificial Sequence
  Synthetic
gccaagcatttaggtgacactataggaacccctgcgagttcttcggtttcagagctatgctggaaacagc

SEQ ID NO: 51967 - DNA, 70 bp, Artificial Sequence
  Synthetic
gccaagcatttaggtgacactatagcaatcccagcgagttctttggtttcagagctatgctggaaacagc

SEQ ID NO: 51968 - DNA, 70 bp, Artificial Sequence
  Synthetic
gccaagcatttaggtgacactatagtttgtggatgtgatgtgagcgtttcagagctatgctggaaacagc

SEQ ID NO: 51969 - DNA, 70 bp, Artificial Sequence
  Synthetic
gccaagcatttaggtgacactatagggggtctctctctgtcgcctgtttcagagctatgctggaaacagc

SEQ ID NO: 51970 - DNA, 70 bp, Artificial Sequence
  Synthetic
gccaagcatttaggtgacactatagaaagcattactatttgggaggtttcagagctatgctggaaacagc

SEQ ID NO: 51971 - DNA, 70 bp, Artificial Sequence
  Synthetic
gccaagcatttaggtgacactatagagcacctaacttgagcagaggtttcagagctatgctggaaacagc

SEQ ID NO: 51972 - DNA, 70 bp, Artificial Sequence
  Synthetic
gccaagcatttaggtgacactatagtggctccaaatctcctttttgtttcagagctatgctggaaacagc

SEQ ID NO: 51973 - DNA, 70 bp, Artificial Sequence
  Synthetic
gccaagcatttaggtgacactataggagagcatcctgccctcagtgtttcagagctatgctggaaacagc

SEQ ID NO: 51974 - DNA, 70 bp, Artificial Sequence
  Synthetic
gccaagcatttaggtgacactatagtcggtaggtgcaacagttatgtttcagagctatgctggaaacagc

SEQ ID NO: 51975 - DNA, 70 bp, Artificial Sequence
  Synthetic
gccaagcatttaggtgacactatagcctcgcagcttctacgagcggtttcagagctatgctggaaacagc

SEQ ID NO: 51976 - DNA, 70 bp, Artificial Sequence
  Synthetic
gccaagcatttaggtgacactatagctcaagcaatcctcctatgtgtttcagagctatgctggaaacagc

SEQ ID NO: 51977 - DNA, 70 bp, Artificial Sequence
  Synthetic
gccaagcatttaggtgacactatagctgttgagttatctgcctaggtttcagagctatgctggaaacagc

SEQ ID NO: 51978 - DNA, 70 bp, Artificial Sequence
  Synthetic
gccaagcatttaggtgacactatagccccttttcaggaactaagcgtttcagagctatgctggaaacagc

SEQ ID NO: 51979 - DNA, 70 bp, Artificial Sequence
  Synthetic
gccaagcatttaggtgacactatagcaagaagcttctccttccgtgtttcagagctatgctggaaacagc

SEQ ID NO: 51980 - DNA, 70 bp, Artificial Sequence
  Synthetic
gccaagcatttaggtgacactataggactcgaaagccagactctagtttcagagctatgctggaaacagc

SEQ ID NO: 51981 - DNA, 70 bp, Artificial Sequence
  Synthetic
gccaagcatttaggtgacactatagcaagaccagtggattcagtggtttcagagctatgctggaaacagc

SEQ ID NO: 51982 - DNA, 70 bp, Artificial Sequence
  Synthetic
gccaagcatttaggtgacactatagctcgatttgtttccaagactgtttcagagctatgctggaaacagc

SEQ ID NO: 51983 - DNA, 70 bp, Artificial Sequence
  Synthetic
gccaagcatttaggtgacactatagtcaaaatgaacttggctagcgtttcagagctatgctggaaacagc

SEQ ID NO: 51984 - DNA, 70 bp, Artificial Sequence
  Synthetic
gccaagcatttaggtgacactatagttgctgtttgggattattacgtttcagagctatgctggaaacagc

SEQ ID NO: 51985 - DNA, 70 bp, Artificial Sequence
  Synthetic
gccaagcatttaggtgacactataggccattcttctgttcaaatcgtttcagagctatgctggaaacagc

SEQ ID NO: 51986 - DNA, 70 bp, Artificial Sequence
  Synthetic
gccaagcatttaggtgacactatagcctcttcaagtcaggctagggtttcagagctatgctggaaacagc

SEQ ID NO: 51987 - DNA, 70 bp, Artificial Sequence
  Synthetic
gccaagcatttaggtgacactatagaagaaaaacagctttctccagtttcagagctatgctggaaacagc

SEQ ID NO: 51988 - DNA, 70 bp, Artificial Sequence
  Synthetic
gccaagcatttaggtgacactatagagcagggcccgaggagttgagtttcagagctatgctggaaacagc

SEQ ID NO: 51989 - DNA, 70 bp, Artificial Sequence
  Synthetic
gccaagcatttaggtgacactatagagccaagagagtggcttattgtttcagagctatgctggaaacagc

SEQ ID NO: 51990 - DNA, 70 bp, Artificial Sequence
  Synthetic
gccaagcatttaggtgacactatagccatcgcaggtctattcacagtttcagagctatgctggaaacagc

SEQ ID NO: 51991 - DNA, 70 bp, Artificial Sequence
  Synthetic
gccaagcatttaggtgacactatagaggtcaaatagacagtccgagtttcagagctatgctggaaacagc

SEQ ID NO: 51992 - DNA, 70 bp, Artificial Sequence
  Synthetic
gccaagcatttaggtgacactatagttctgggacagctctactgagtttcagagctatgctggaaacagc

SEQ ID NO: 51993 - DNA, 70 bp, Artificial Sequence
  Synthetic
gccaagcatttaggtgacactatagaacgttgacaatacagttcagtttcagagctatgctggaaacagc

SEQ ID NO: 51994 - DNA, 70 bp, Artificial Sequence
  Synthetic
gccaagcatttaggtgacactatagacggtcattctaaaggcaccgtttcagagctatgctggaaacagc

SEQ ID NO: 51995 - DNA, 70 bp, Artificial Sequence
  Synthetic
gccaagcatttaggtgacactatagcctgctcctcttggttggtcgtttcagagctatgctggaaacagc

SEQ ID NO: 51996 - DNA, 70 bp, Artificial Sequence
  Synthetic
gccaagcatttaggtgacactatagtgtagtcacgagctagctacgtttcagagctatgctggaaacagc

SEQ ID NO: 51997 - DNA, 70 bp, Artificial Sequence
  Synthetic
gccaagcatttaggtgacactataggagggggcagggtcacgagcgtttcagagctatgctggaaacagc

SEQ ID NO: 51998 - DNA, 70 bp, Artificial Sequence
  Synthetic
gccaagcatttaggtgacactatagtgagctcagctaacaagtttgtttcagagctatgctggaaacagc

SEQ ID NO: 51999 - DNA, 70 bp, Artificial Sequence
  Synthetic
gccaagcatttaggtgacactatagtgccaaaactgattagctaggtttcagagctatgctggaaacagc

SEQ ID NO: 52000 - DNA, 70 bp, Artificial Sequence
  Synthetic
gccaagcatttaggtgacactatagctcagcaaaggtcatacaatgtttcagagctatgctggaaacagc

SEQ ID NO: 52001 - DNA, 70 bp, Artificial Sequence
  Synthetic
gccaagcatttaggtgacactatagctggtgaagcccttcagctggtttcagagctatgctggaaacagc

SEQ ID NO: 52002 - DNA, 70 bp, Artificial Sequence
  Synthetic
gccaagcatttaggtgacactatagttgcccaatttgaagtgaaagtttcagagctatgctggaaacagc

SEQ ID NO: 52003 - DNA, 70 bp, Artificial Sequence
  Synthetic
gccaagcatttaggtgacactatagctcagggctaacagtcatccgtttcagagctatgctggaaacagc

SEQ ID NO: 52004 - DNA, 70 bp, Artificial Sequence
  Synthetic
gccaagcatttaggtgacactataggcttagtaactgtgactgatgtttcagagctatgctggaaacagc

SEQ ID NO: 52005 - DNA, 70 bp, Artificial Sequence
  Synthetic
gccaagcatttaggtgacactatagagcttctggggtgaatcaccgtttcagagctatgctggaaacagc

SEQ ID NO: 52006 - DNA, 70 bp, Artificial Sequence
  Synthetic
gccaagcatttaggtgacactatagcagccagacgggcagccttcgtttcagagctatgctggaaacagc

SEQ ID NO: 52007 - DNA, 70 bp, Artificial Sequence
  Synthetic
gccaagcatttaggtgacactatagatcagatcttgggcaactgcgtttcagagctatgctggaaacagc

SEQ ID NO: 52008 - DNA, 70 bp, Artificial Sequence
  Synthetic
gccaagcatttaggtgacactatagacccccctggatttctgacagtttcagagctatgctggaaacagc

SEQ ID NO: 52009 - DNA, 70 bp, Artificial Sequence
  Synthetic
gccaagcatttaggtgacactatagggacctgttgattaattgaggtttcagagctatgctggaaacagc

SEQ ID NO: 52010 - DNA, 70 bp, Artificial Sequence
  Synthetic
gccaagcatttaggtgacactatagcacatgaagtcttccaccaggtttcagagctatgctggaaacagc

SEQ ID NO: 52011 - DNA, 70 bp, Artificial Sequence
  Synthetic
gccaagcatttaggtgacactatagggcatgtccctgtcagtcaggtttcagagctatgctggaaacagc

SEQ ID NO: 52012 - DNA, 70 bp, Artificial Sequence
  Synthetic
gccaagcatttaggtgacactatagttaaagttgtagtcatctgcgtttcagagctatgctggaaacagc

SEQ ID NO: 52013 - DNA, 70 bp, Artificial Sequence
  Synthetic
gccaagcatttaggtgacactatagtgcttgaagtaagcaactgagtttcagagctatgctggaaacagc

SEQ ID NO: 52014 - DNA, 70 bp, Artificial Sequence
  Synthetic
gccaagcatttaggtgacactatagaggttagtcagcgccgccgcgtttcagagctatgctggaaacagc

SEQ ID NO: 52015 - DNA, 70 bp, Artificial Sequence
  Synthetic
gccaagcatttaggtgacactatagagccaacatctgttgattaagtttcagagctatgctggaaacagc

SEQ ID NO: 52016 - DNA, 70 bp, Artificial Sequence
  Synthetic
gccaagcatttaggtgacactataggggccagctggaggtgcagagtttcagagctatgctggaaacagc

SEQ ID NO: 52017 - DNA, 70 bp, Artificial Sequence
  Synthetic
gccaagcatttaggtgacactatagggtggacagccacatcatgagtttcagagctatgctggaaacagc

SEQ ID NO: 52018 - DNA, 70 bp, Artificial Sequence
  Synthetic
gccaagcatttaggtgacactataggacttgcagttgagtgagtcgtttcagagctatgctggaaacagc

SEQ ID NO: 52019 - DNA, 70 bp, Artificial Sequence
  Synthetic
gccaagcatttaggtgacactataggatttgcagctgagtgaatcgtttcagagctatgctggaaacagc

SEQ ID NO: 52020 - DNA, 70 bp, Artificial Sequence
  Synthetic
gccaagcatttaggtgacactatagccagttgggctgtttaggaagtttcagagctatgctggaaacagc

SEQ ID NO: 52021 - DNA, 70 bp, Artificial Sequence
  Synthetic
gccaagcatttaggtgacactatagttcaagacagcatcactattgtttcagagctatgctggaaacagc

SEQ ID NO: 52022 - DNA, 70 bp, Artificial Sequence
  Synthetic
gccaagcatttaggtgacactatagcgaaacatcctctccctagcgtttcagagctatgctggaaacagc

SEQ ID NO: 52023 - DNA, 70 bp, Artificial Sequence
  Synthetic
gccaagcatttaggtgacactatagtattgagctcagtgcctgccgtttcagagctatgctggaaacagc

SEQ ID NO: 52024 - DNA, 70 bp, Artificial Sequence
  Synthetic
gccaagcatttaggtgacactatagagcacaacggctaatgaagagtttcagagctatgctggaaacagc

SEQ ID NO: 52025 - DNA, 70 bp, Artificial Sequence
  Synthetic
gccaagcatttaggtgacactatagtcaaggcaattctttcacatgtttcagagctatgctggaaacagc

SEQ ID NO: 52026 - DNA, 70 bp, Artificial Sequence
  Synthetic
gccaagcatttaggtgacactatagttcaggagaaggccagtcccgtttcagagctatgctggaaacagc

SEQ ID NO: 52027 - DNA, 70 bp, Artificial Sequence
  Synthetic
gccaagcatttaggtgacactatagaagcagttcttctttacatcgtttcagagctatgctggaaacagc

SEQ ID NO: 52028 - DNA, 70 bp, Artificial Sequence
  Synthetic
gccaagcatttaggtgacactatagtggtagtcccgccaatgtgagtttcagagctatgctggaaacagc

SEQ ID NO: 52029 - DNA, 70 bp, Artificial Sequence
  Synthetic
gccaagcatttaggtgacactatagaccgtaattaggagtatgccgtttcagagctatgctggaaacagc

SEQ ID NO: 52030 - DNA, 70 bp, Artificial Sequence
  Synthetic
gccaagcatttaggtgacactatagatgagcctgggcaagtagcagtttcagagctatgctggaaacagc

SEQ ID NO: 52031 - DNA, 70 bp, Artificial Sequence
  Synthetic
gccaagcatttaggtgacactatagcttcgcggttatgggatttcgtttcagagctatgctggaaacagc

SEQ ID NO: 52032 - DNA, 70 bp, Artificial Sequence
  Synthetic
gccaagcatttaggtgacactataggacttgcgtagcttgtgtaggtttcagagctatgctggaaacagc

SEQ ID NO: 52033 - DNA, 70 bp, Artificial Sequence
  Synthetic
gccaagcatttaggtgacactatagttctctcttgttcgttttccgtttcagagctatgctggaaacagc

SEQ ID NO: 52034 - DNA, 70 bp, Artificial Sequence
  Synthetic
gccaagcatttaggtgacactataggccaagagcaagaagaactggtttcagagctatgctggaaacagc

SEQ ID NO: 52035 - DNA, 70 bp, Artificial Sequence
  Synthetic
gccaagcatttaggtgacactatagctgaaacttcttcactgaacgtttcagagctatgctggaaacagc

SEQ ID NO: 52036 - DNA, 70 bp, Artificial Sequence
  Synthetic
gccaagcatttaggtgacactataggatagcaatctattcaccccgtttcagagctatgctggaaacagc

SEQ ID NO: 52037 - DNA, 70 bp, Artificial Sequence
  Synthetic
gccaagcatttaggtgacactatagcttacttgttggtctgtgatgtttcagagctatgctggaaacagc

SEQ ID NO: 52038 - DNA, 70 bp, Artificial Sequence
  Synthetic
gccaagcatttaggtgacactatagcacaagtgcgaagtctggtagtttcagagctatgctggaaacagc

SEQ ID NO: 52039 - DNA, 70 bp, Artificial Sequence
  Synthetic
gccaagcatttaggtgacactataggggcagccaggctcaccacagtttcagagctatgctggaaacagc

SEQ ID NO: 52040 - DNA, 70 bp, Artificial Sequence
  Synthetic
gccaagcatttaggtgacactatagacgcgagggctctcagagctgtttcagagctatgctggaaacagc

SEQ ID NO: 52041 - DNA, 70 bp, Artificial Sequence
  Synthetic
gccaagcatttaggtgacactatagcaaggttgggcattgggtgggtttcagagctatgctggaaacagc

SEQ ID NO: 52042 - DNA, 70 bp, Artificial Sequence
  Synthetic
gccaagcatttaggtgacactatagttagaggctattgctaagaagtttcagagctatgctggaaacagc

SEQ ID NO: 52043 - DNA, 70 bp, Artificial Sequence
  Synthetic
gccaagcatttaggtgacactatagaagcggactcccaaatttgtgtttcagagctatgctggaaacagc

SEQ ID NO: 52044 - DNA, 70 bp, Artificial Sequence
  Synthetic
gccaagcatttaggtgacactataggtcacacgagccagtgtgaggtttcagagctatgctggaaacagc

SEQ ID NO: 52045 - DNA, 70 bp, Artificial Sequence
  Synthetic
gccaagcatttaggtgacactatagcaggggcagctggttctcacgtttcagagctatgctggaaacagc

SEQ ID NO: 52046 - DNA, 70 bp, Artificial Sequence
  Synthetic
gccaagcatttaggtgacactatagccctgcagatgtacttagaggtttcagagctatgctggaaacagc

SEQ ID NO: 52047 - DNA, 70 bp, Artificial Sequence
  Synthetic
gccaagcatttaggtgacactatagagatgaatgcacaaatgctggtttcagagctatgctggaaacagc

SEQ ID NO: 52048 - DNA, 70 bp, Artificial Sequence
  Synthetic
gccaagcatttaggtgacactatagtggggtgactcattcttcctgtttcagagctatgctggaaacagc

SEQ ID NO: 52049 - DNA, 70 bp, Artificial Sequence
  Synthetic
gccaagcatttaggtgacactatagagaggatgatgactcaaatcgtttcagagctatgctggaaacagc

SEQ ID NO: 52050 - DNA, 70 bp, Artificial Sequence
  Synthetic
gccaagcatttaggtgacactatagtggcctttcctctctggtaggtttcagagctatgctggaaacagc

SEQ ID NO: 52051 - DNA, 70 bp, Artificial Sequence
  Synthetic
gccaagcatttaggtgacactatagacaaagtctctcagcagagagtttcagagctatgctggaaacagc

SEQ ID NO: 52052 - DNA, 70 bp, Artificial Sequence
  Synthetic
gccaagcatttaggtgacactatagtgatgttcttcatggagatagtttcagagctatgctggaaacagc

SEQ ID NO: 52053 - DNA, 70 bp, Artificial Sequence
  Synthetic
gccaagcatttaggtgacactatagagctggacctggagtatgtggtttcagagctatgctggaaacagc

SEQ ID NO: 52054 - DNA, 70 bp, Artificial Sequence
  Synthetic
gccaagcatttaggtgacactataggcgccggctcagactagctcgtttcagagctatgctggaaacagc

SEQ ID NO: 52055 - DNA, 70 bp, Artificial Sequence
  Synthetic
gccaagcatttaggtgacactatagggagtatgtgaggagtggctgtttcagagctatgctggaaacagc

SEQ ID NO: 52056 - DNA, 70 bp, Artificial Sequence
  Synthetic
gccaagcatttaggtgacactatagatgacgtacagattgaaaccgtttcagagctatgctggaaacagc

SEQ ID NO: 52057 - DNA, 70 bp, Artificial Sequence
  Synthetic
gccaagcatttaggtgacactataggccttccttccttctttgaagtttcagagctatgctggaaacagc

SEQ ID NO: 52058 - DNA, 70 bp, Artificial Sequence
  Synthetic
gccaagcatttaggtgacactatagttcgaagtactgacagccatgtttcagagctatgctggaaacagc

SEQ ID NO: 52059 - DNA, 70 bp, Artificial Sequence
  Synthetic
gccaagcatttaggtgacactatagagagggaagacacaactcatgtttcagagctatgctggaaacagc

SEQ ID NO: 52060 - DNA, 70 bp, Artificial Sequence
  Synthetic
gccaagcatttaggtgacactatagatggggggaatctaggatgcgtttcagagctatgctggaaacagc

SEQ ID NO: 52061 - DNA, 70 bp, Artificial Sequence
  Synthetic
gccaagcatttaggtgacactatagtttctcagcagaaaccttgtgtttcagagctatgctggaaacagc

SEQ ID NO: 52062 - DNA, 70 bp, Artificial Sequence
  Synthetic
gccaagcatttaggtgacactatagacctcattagagttaagggcgtttcagagctatgctggaaacagc

SEQ ID NO: 52063 - DNA, 70 bp, Artificial Sequence
  Synthetic
gccaagcatttaggtgacactatagtcttgtggacatcacatttcgtttcagagctatgctggaaacagc

SEQ ID NO: 52064 - DNA, 70 bp, Artificial Sequence
  Synthetic
gccaagcatttaggtgacactataggcttttcaggatgcagcatggtttcagagctatgctggaaacagc

SEQ ID NO: 52065 - DNA, 70 bp, Artificial Sequence
  Synthetic
gccaagcatttaggtgacactatagctggtggtggggctgtgaccgtttcagagctatgctggaaacagc

SEQ ID NO: 52066 - DNA, 70 bp, Artificial Sequence
  Synthetic
gccaagcatttaggtgacactatagcccactgcactctgcttagagtttcagagctatgctggaaacagc

SEQ ID NO: 52067 - DNA, 70 bp, Artificial Sequence
  Synthetic
gccaagcatttaggtgacactatagaaggcaggcttagcagctaagtttcagagctatgctggaaacagc

SEQ ID NO: 52068 - DNA, 70 bp, Artificial Sequence
  Synthetic
gccaagcatttaggtgacactatagtagactttctagttgctgatgtttcagagctatgctggaaacagc

SEQ ID NO: 52069 - DNA, 70 bp, Artificial Sequence
  Synthetic
gccaagcatttaggtgacactatagtagactttctagttgccgatgtttcagagctatgctggaaacagc

SEQ ID NO: 52070 - DNA, 70 bp, Artificial Sequence
  Synthetic
gccaagcatttaggtgacactatagcgacagattgaccagatggtgtttcagagctatgctggaaacagc

SEQ ID NO: 52071 - DNA, 70 bp, Artificial Sequence
  Synthetic
gccaagcatttaggtgacactatagccagtggttatgaggagtctgtttcagagctatgctggaaacagc

SEQ ID NO: 52072 - DNA, 70 bp, Artificial Sequence
  Synthetic
gccaagcatttaggtgacactatagagcatttgaaatgatggagagtttcagagctatgctggaaacagc

SEQ ID NO: 52073 - DNA, 70 bp, Artificial Sequence
  Synthetic
gccaagcatttaggtgacactatagacgccgctcccgtgcctcacgtttcagagctatgctggaaacagc

SEQ ID NO: 52074 - DNA, 70 bp, Artificial Sequence
  Synthetic
gccaagcatttaggtgacactatagcttcgccgggtccgctgaacgtttcagagctatgctggaaacagc

SEQ ID NO: 52075 - DNA, 70 bp, Artificial Sequence
  Synthetic
gccaagcatttaggtgacactatagctttgtgttcatttcgccctgtttcagagctatgctggaaacagc

SEQ ID NO: 52076 - DNA, 70 bp, Artificial Sequence
  Synthetic
gccaagcatttaggtgacactatagctgcacagaggaggaatgaggtttcagagctatgctggaaacagc

SEQ ID NO: 52077 - DNA, 70 bp, Artificial Sequence
  Synthetic
gccaagcatttaggtgacactatagtgacccacaaccgagcacatgtttcagagctatgctggaaacagc

SEQ ID NO: 52078 - DNA, 70 bp, Artificial Sequence
  Synthetic
gccaagcatttaggtgacactatagacactatctcttcctccaccgtttcagagctatgctggaaacagc

SEQ ID NO: 52079 - DNA, 70 bp, Artificial Sequence
  Synthetic
gccaagcatttaggtgacactatagcaaggaccaacaaagcaagcgtttcagagctatgctggaaacagc

SEQ ID NO: 52080 - DNA, 70 bp, Artificial Sequence
  Synthetic
gccaagcatttaggtgacactatagctgcaggcctgtcctcctaagtttcagagctatgctggaaacagc

SEQ ID NO: 52081 - DNA, 70 bp, Artificial Sequence
  Synthetic
gccaagcatttaggtgacactataggtcagttcatgctgtccttagtttcagagctatgctggaaacagc

SEQ ID NO: 52082 - DNA, 70 bp, Artificial Sequence
  Synthetic
gccaagcatttaggtgacactataggcacgactgcttttcctccagtttcagagctatgctggaaacagc

SEQ ID NO: 52083 - DNA, 70 bp, Artificial Sequence
  Synthetic
gccaagcatttaggtgacactatagtaaaccaaaacccaacaatggtttcagagctatgctggaaacagc

SEQ ID NO: 52084 - DNA, 70 bp, Artificial Sequence
  Synthetic
gccaagcatttaggtgacactatagggctctgtgcagtcactgaagtttcagagctatgctggaaacagc

SEQ ID NO: 52085 - DNA, 70 bp, Artificial Sequence
  Synthetic
gccaagcatttaggtgacactatagtcaatgacttgcaaggataagtttcagagctatgctggaaacagc

SEQ ID NO: 52086 - DNA, 70 bp, Artificial Sequence
  Synthetic
gccaagcatttaggtgacactatagtgatgccagtatttggcgctgtttcagagctatgctggaaacagc

SEQ ID NO: 52087 - DNA, 70 bp, Artificial Sequence
  Synthetic
gccaagcatttaggtgacactatagggtgggtgtcatcaaagcaggtttcagagctatgctggaaacagc

SEQ ID NO: 52088 - DNA, 70 bp, Artificial Sequence
  Synthetic
gccaagcatttaggtgacactataggcgcagaaggcgcagaaggcgtttcagagctatgctggaaacagc

SEQ ID NO: 52089 - DNA, 70 bp, Artificial Sequence
  Synthetic
gccaagcatttaggtgacactatagatgattctgggctggactgtgtttcagagctatgctggaaacagc

SEQ ID NO: 52090 - DNA, 70 bp, Artificial Sequence
  Synthetic
gccaagcatttaggtgacactatagataccatgccaggccctcgtgtttcagagctatgctggaaacagc

SEQ ID NO: 52091 - DNA, 70 bp, Artificial Sequence
  Synthetic
gccaagcatttaggtgacactatagtggaaacagtgtagcagcatgtttcagagctatgctggaaacagc

SEQ ID NO: 52092 - DNA, 70 bp, Artificial Sequence
  Synthetic
gccaagcatttaggtgacactatagcagcaagggtgatgtcaagcgtttcagagctatgctggaaacagc

SEQ ID NO: 52093 - DNA, 70 bp, Artificial Sequence
  Synthetic
gccaagcatttaggtgacactatagggccaggggcaggtcagtgagtttcagagctatgctggaaacagc

SEQ ID NO: 52094 - DNA, 70 bp, Artificial Sequence
  Synthetic
gccaagcatttaggtgacactatagcttagtgccattcagctctggtttcagagctatgctggaaacagc

SEQ ID NO: 52095 - DNA, 70 bp, Artificial Sequence
  Synthetic
gccaagcatttaggtgacactatagcagggcagctgtgtgaggtggtttcagagctatgctggaaacagc

SEQ ID NO: 52096 - DNA, 70 bp, Artificial Sequence
  Synthetic
gccaagcatttaggtgacactatagctatgtgcagtccatggatggtttcagagctatgctggaaacagc

SEQ ID NO: 52097 - DNA, 70 bp, Artificial Sequence
  Synthetic
gccaagcatttaggtgacactatagggaggagatcaccaagtttggtttcagagctatgctggaaacagc

SEQ ID NO: 52098 - DNA, 70 bp, Artificial Sequence
  Synthetic
gccaagcatttaggtgacactatagagctgaggcacacagaggtagtttcagagctatgctggaaacagc

SEQ ID NO: 52099 - DNA, 70 bp, Artificial Sequence
  Synthetic
gccaagcatttaggtgacactatagatggcatggacagcttctaggtttcagagctatgctggaaacagc

SEQ ID NO: 52100 - DNA, 70 bp, Artificial Sequence
  Synthetic
gccaagcatttaggtgacactataggtgggcaaagccttcaatcagtttcagagctatgctggaaacagc

SEQ ID NO: 52101 - DNA, 70 bp, Artificial Sequence
  Synthetic
gccaagcatttaggtgacactatagcttcctggacaaattgtagggtttcagagctatgctggaaacagc

SEQ ID NO: 52102 - DNA, 70 bp, Artificial Sequence
  Synthetic
gccaagcatttaggtgacactataggcccagatggaggagtaaccgtttcagagctatgctggaaacagc

SEQ ID NO: 52103 - DNA, 70 bp, Artificial Sequence
  Synthetic
gccaagcatttaggtgacactataggagtcgtgtgtgagtcctacgtttcagagctatgctggaaacagc

SEQ ID NO: 52104 - DNA, 70 bp, Artificial Sequence
  Synthetic
gccaagcatttaggtgacactatagcttcgacacccacaagcgcagtttcagagctatgctggaaacagc

SEQ ID NO: 52105 - DNA, 70 bp, Artificial Sequence
  Synthetic
gccaagcatttaggtgacactatagtcatcgctcgtgcttgatgtgtttcagagctatgctggaaacagc

SEQ ID NO: 52106 - DNA, 70 bp, Artificial Sequence
  Synthetic
gccaagcatttaggtgacactatagcttgagcttcaaattccatcgtttcagagctatgctggaaacagc

SEQ ID NO: 52107 - DNA, 70 bp, Artificial Sequence
  Synthetic
gccaagcatttaggtgacactatagtgccctgaactatggacagagtttcagagctatgctggaaacagc

SEQ ID NO: 52108 - DNA, 70 bp, Artificial Sequence
  Synthetic
gccaagcatttaggtgacactatagaccggaaaggactgttcttggtttcagagctatgctggaaacagc

SEQ ID NO: 52109 - DNA, 70 bp, Artificial Sequence
  Synthetic
gccaagcatttaggtgacactatagctagttgatgtagtacacctgtttcagagctatgctggaaacagc

SEQ ID NO: 52110 - DNA, 70 bp, Artificial Sequence
  Synthetic
gccaagcatttaggtgacactatagggattcgatagttaaagcacgtttcagagctatgctggaaacagc

SEQ ID NO: 52111 - DNA, 70 bp, Artificial Sequence
  Synthetic
gccaagcatttaggtgacactatagtgaaactactaaccatgttcgtttcagagctatgctggaaacagc

SEQ ID NO: 52112 - DNA, 70 bp, Artificial Sequence
  Synthetic
gccaagcatttaggtgacactatagctggagctaagggtagctttgtttcagagctatgctggaaacagc

SEQ ID NO: 52113 - DNA, 70 bp, Artificial Sequence
  Synthetic
gccaagcatttaggtgacactataggcctttttctcaagaggaaagtttcagagctatgctggaaacagc

SEQ ID NO: 52114 - DNA, 70 bp, Artificial Sequence
  Synthetic
gccaagcatttaggtgacactatagggagtttcgctccgtcgcccgtttcagagctatgctggaaacagc

SEQ ID NO: 52115 - DNA, 70 bp, Artificial Sequence
  Synthetic
gccaagcatttaggtgacactatagagtgaatgttacacagactcgtttcagagctatgctggaaacagc

SEQ ID NO: 52116 - DNA, 70 bp, Artificial Sequence
  Synthetic
gccaagcatttaggtgacactatagtatggaaatttggtctcaaggtttcagagctatgctggaaacagc

SEQ ID NO: 52117 - DNA, 70 bp, Artificial Sequence
  Synthetic
gccaagcatttaggtgacactatagttctcttgcaaaccttccccgtttcagagctatgctggaaacagc

SEQ ID NO: 52118 - DNA, 70 bp, Artificial Sequence
  Synthetic
gccaagcatttaggtgacactatagcacacagcaggggtgtctacgtttcagagctatgctggaaacagc

SEQ ID NO: 52119 - DNA, 70 bp, Artificial Sequence
  Synthetic
gccaagcatttaggtgacactatagagtgggacccaaatctacaagtttcagagctatgctggaaacagc

SEQ ID NO: 52120 - DNA, 70 bp, Artificial Sequence
  Synthetic
gccaagcatttaggtgacactatagtgaaggggagctcccatgtcgtttcagagctatgctggaaacagc

SEQ ID NO: 52121 - DNA, 70 bp, Artificial Sequence
  Synthetic
gccaagcatttaggtgacactatagacagaagaggcagaaaacaggtttcagagctatgctggaaacagc

SEQ ID NO: 52122 - DNA, 70 bp, Artificial Sequence
  Synthetic
gccaagcatttaggtgacactatagggtgggccagtaacctcagcgtttcagagctatgctggaaacagc

SEQ ID NO: 52123 - DNA, 70 bp, Artificial Sequence
  Synthetic
gccaagcatttaggtgacactatagatcttaacacagagcttgtggtttcagagctatgctggaaacagc

SEQ ID NO: 52124 - DNA, 70 bp, Artificial Sequence
  Synthetic
gccaagcatttaggtgacactataggctccctcctgctcctcagagtttcagagctatgctggaaacagc

SEQ ID NO: 52125 - DNA, 70 bp, Artificial Sequence
  Synthetic
gccaagcatttaggtgacactatagtgagtgttttacacttgatcgtttcagagctatgctggaaacagc

SEQ ID NO: 52126 - DNA, 70 bp, Artificial Sequence
  Synthetic
gccaagcatttaggtgacactatagaggatgtgctctcatggagagtttcagagctatgctggaaacagc

SEQ ID NO: 52127 - DNA, 70 bp, Artificial Sequence
  Synthetic
gccaagcatttaggtgacactatagggacgcgtttggcttagagggtttcagagctatgctggaaacagc

SEQ ID NO: 52128 - DNA, 70 bp, Artificial Sequence
  Synthetic
gccaagcatttaggtgacactataggcaggactatgtattgaagtgtttcagagctatgctggaaacagc

SEQ ID NO: 52129 - DNA, 70 bp, Artificial Sequence
  Synthetic
gccaagcatttaggtgacactatagcagtccacctttaagtagcggtttcagagctatgctggaaacagc

SEQ ID NO: 52130 - DNA, 70 bp, Artificial Sequence
  Synthetic
gccaagcatttaggtgacactatagtggagcatgcagaaaagcaggtttcagagctatgctggaaacagc

SEQ ID NO: 52131 - DNA, 70 bp, Artificial Sequence
  Synthetic
gccaagcatttaggtgacactatagggtgtggcatacaccttcacgtttcagagctatgctggaaacagc

SEQ ID NO: 52132 - DNA, 70 bp, Artificial Sequence
  Synthetic
gccaagcatttaggtgacactatagggggctgggactaggaacccgtttcagagctatgctggaaacagc

SEQ ID NO: 52133 - DNA, 70 bp, Artificial Sequence
  Synthetic
gccaagcatttaggtgacactatagggggagggggcagagctagggtttcagagctatgctggaaacagc

SEQ ID NO: 52134 - DNA, 70 bp, Artificial Sequence
  Synthetic
gccaagcatttaggtgacactatagggagcctgtcccctcatcacgtttcagagctatgctggaaacagc

SEQ ID NO: 52135 - DNA, 70 bp, Artificial Sequence
  Synthetic
gccaagcatttaggtgacactataggacaagatggagcattgatggtttcagagctatgctggaaacagc

SEQ ID NO: 52136 - DNA, 70 bp, Artificial Sequence
  Synthetic
gccaagcatttaggtgacactataggcagtaatagcaagagacaggtttcagagctatgctggaaacagc

SEQ ID NO: 52137 - DNA, 70 bp, Artificial Sequence
  Synthetic
gccaagcatttaggtgacactatagataatgtcaaaagcatcgccgtttcagagctatgctggaaacagc

SEQ ID NO: 52138 - DNA, 70 bp, Artificial Sequence
  Synthetic
gccaagcatttaggtgacactatagcccggcgaacatctactacagtttcagagctatgctggaaacagc

SEQ ID NO: 52139 - DNA, 70 bp, Artificial Sequence
  Synthetic
gccaagcatttaggtgacactatagatttactacaaggtctgagagtttcagagctatgctggaaacagc

SEQ ID NO: 52140 - DNA, 70 bp, Artificial Sequence
  Synthetic
gccaagcatttaggtgacactatagacatctactacaaggtatgagtttcagagctatgctggaaacagc

SEQ ID NO: 52141 - DNA, 70 bp, Artificial Sequence
  Synthetic
gccaagcatttaggtgacactatagagatctgtgtgtgtactgatgtttcagagctatgctggaaacagc

SEQ ID NO: 52142 - DNA, 70 bp, Artificial Sequence
  Synthetic
gccaagcatttaggtgacactatagattcagtatacacacagatcgtttcagagctatgctggaaacagc

SEQ ID NO: 52143 - DNA, 70 bp, Artificial Sequence
  Synthetic
gccaagcatttaggtgacactatagtcactagcctggctccatgagtttcagagctatgctggaaacagc

SEQ ID NO: 52144 - DNA, 70 bp, Artificial Sequence
  Synthetic
gccaagcatttaggtgacactatagcaggagtccacgcactcacagtttcagagctatgctggaaacagc

SEQ ID NO: 52145 - DNA, 70 bp, Artificial Sequence
  Synthetic
gccaagcatttaggtgacactatagttcactgagtcagctccattgtttcagagctatgctggaaacagc

SEQ ID NO: 52146 - DNA, 70 bp, Artificial Sequence
  Synthetic
gccaagcatttaggtgacactatagtccagatagccttttatctggtttcagagctatgctggaaacagc

SEQ ID NO: 52147 - DNA, 70 bp, Artificial Sequence
  Synthetic
gccaagcatttaggtgacactatagcagtcacgagtctttcttgcgtttcagagctatgctggaaacagc

SEQ ID NO: 52148 - DNA, 70 bp, Artificial Sequence
  Synthetic
gccaagcatttaggtgacactatagcttatcgatgattgacgccggtttcagagctatgctggaaacagc

SEQ ID NO: 52149 - DNA, 70 bp, Artificial Sequence
  Synthetic
gccaagcatttaggtgacactatagcaaggccagctggtgttactgtttcagagctatgctggaaacagc

SEQ ID NO: 52150 - DNA, 70 bp, Artificial Sequence
  Synthetic
gccaagcatttaggtgacactatagaaaaccgtaaaggaaatcacgtttcagagctatgctggaaacagc

SEQ ID NO: 52151 - DNA, 70 bp, Artificial Sequence
  Synthetic
gccaagcatttaggtgacactatagagatttgcagacacagtgaagtttcagagctatgctggaaacagc

SEQ ID NO: 52152 - DNA, 70 bp, Artificial Sequence
  Synthetic
gccaagcatttaggtgacactatagcgtgaaggcatgaggctcaggtttcagagctatgctggaaacagc

SEQ ID NO: 52153 - DNA, 70 bp, Artificial Sequence
  Synthetic
gccaagcatttaggtgacactataggccatccaaactgcacctacgtttcagagctatgctggaaacagc

SEQ ID NO: 52154 - DNA, 70 bp, Artificial Sequence
  Synthetic
gccaagcatttaggtgacactatagtgctttgtggcgcgacccttgtttcagagctatgctggaaacagc

SEQ ID NO: 52155 - DNA, 70 bp, Artificial Sequence
  Synthetic
gccaagcatttaggtgacactatagaataaaccttcagattcggtgtttcagagctatgctggaaacagc

SEQ ID NO: 52156 - DNA, 70 bp, Artificial Sequence
  Synthetic
gccaagcatttaggtgacactatagctctgggactggccactagggtttcagagctatgctggaaacagc

SEQ ID NO: 52157 - DNA, 70 bp, Artificial Sequence
  Synthetic
gccaagcatttaggtgacactatagagcacggtcagtcttcagtggtttcagagctatgctggaaacagc

SEQ ID NO: 52158 - DNA, 70 bp, Artificial Sequence
  Synthetic
gccaagcatttaggtgacactatagtgacagcaaccttttctcccgtttcagagctatgctggaaacagc

SEQ ID NO: 52159 - DNA, 70 bp, Artificial Sequence
  Synthetic
gccaagcatttaggtgacactataggagtctcatctcaaggtgtcgtttcagagctatgctggaaacagc

SEQ ID NO: 52160 - DNA, 70 bp, Artificial Sequence
  Synthetic
gccaagcatttaggtgacactataggtggtcaccacctgcgcctggtttcagagctatgctggaaacagc

SEQ ID NO: 52161 - DNA, 70 bp, Artificial Sequence
  Synthetic
gccaagcatttaggtgacactatagtcttgctcagagagaagcgagtttcagagctatgctggaaacagc

SEQ ID NO: 52162 - DNA, 70 bp, Artificial Sequence
  Synthetic
gccaagcatttaggtgacactatagaggcaagatggccaagaaaggtttcagagctatgctggaaacagc

SEQ ID NO: 52163 - DNA, 70 bp, Artificial Sequence
  Synthetic
gccaagcatttaggtgacactataggagcgctgcgtgctgagctggtttcagagctatgctggaaacagc

SEQ ID NO: 52164 - DNA, 70 bp, Artificial Sequence
  Synthetic
gccaagcatttaggtgacactatagccaagcgcagacatgagtgagtttcagagctatgctggaaacagc

SEQ ID NO: 52165 - DNA, 70 bp, Artificial Sequence
  Synthetic
gccaagcatttaggtgacactatagaagggctccgccgagtgagcgtttcagagctatgctggaaacagc

SEQ ID NO: 52166 - DNA, 70 bp, Artificial Sequence
  Synthetic
gccaagcatttaggtgacactatagaggaaagttgccgagtgatggtttcagagctatgctggaaacagc

SEQ ID NO: 52167 - DNA, 70 bp, Artificial Sequence
  Synthetic
gccaagcatttaggtgacactatagcctgcccaaggccgactgaggtttcagagctatgctggaaacagc

SEQ ID NO: 52168 - DNA, 70 bp, Artificial Sequence
  Synthetic
gccaagcatttaggtgacactatagtttcattttctctccatcctgtttcagagctatgctggaaacagc

SEQ ID NO: 52169 - DNA, 70 bp, Artificial Sequence
  Synthetic
gccaagcatttaggtgacactatagaaagaatggcaaagcttggcgtttcagagctatgctggaaacagc

SEQ ID NO: 52170 - DNA, 70 bp, Artificial Sequence
  Synthetic
gccaagcatttaggtgacactataggctggccggcggcgtctcatgtttcagagctatgctggaaacagc

SEQ ID NO: 52171 - DNA, 70 bp, Artificial Sequence
  Synthetic
gccaagcatttaggtgacactatagacaaaattgtttggcttctcgtttcagagctatgctggaaacagc

SEQ ID NO: 52172 - DNA, 70 bp, Artificial Sequence
  Synthetic
gccaagcatttaggtgacactatagtcctcaccataagtcaccaagtttcagagctatgctggaaacagc

SEQ ID NO: 52173 - DNA, 70 bp, Artificial Sequence
  Synthetic
gccaagcatttaggtgacactataggtccgttctcatgtgttgacgtttcagagctatgctggaaacagc

SEQ ID NO: 52174 - DNA, 70 bp, Artificial Sequence
  Synthetic
gccaagcatttaggtgacactataggttgcttaagaagaccaccagtttcagagctatgctggaaacagc

SEQ ID NO: 52175 - DNA, 70 bp, Artificial Sequence
  Synthetic
gccaagcatttaggtgacactataggccaaactgaaggctactgcgtttcagagctatgctggaaacagc

SEQ ID NO: 52176 - DNA, 70 bp, Artificial Sequence
  Synthetic
gccaagcatttaggtgacactatagaatcgtctgaccgaagaactgtttcagagctatgctggaaacagc

SEQ ID NO: 52177 - DNA, 70 bp, Artificial Sequence
  Synthetic
gccaagcatttaggtgacactatagaaccctctgatagaagaactgtttcagagctatgctggaaacagc

SEQ ID NO: 52178 - DNA, 70 bp, Artificial Sequence
  Synthetic
gccaagcatttaggtgacactatagagtcctctggccgactgagtgtttcagagctatgctggaaacagc

SEQ ID NO: 52179 - DNA, 70 bp, Artificial Sequence
  Synthetic
gccaagcatttaggtgacactatagggcagcttttgaaatttctggtttcagagctatgctggaaacagc

SEQ ID NO: 52180 - DNA, 70 bp, Artificial Sequence
  Synthetic
gccaagcatttaggtgacactatagacgatcagctgaaggttcatgtttcagagctatgctggaaacagc

SEQ ID NO: 52181 - DNA, 70 bp, Artificial Sequence
  Synthetic
gccaagcatttaggtgacactatagggaggagagtgaagaggagggtttcagagctatgctggaaacagc

SEQ ID NO: 52182 - DNA, 70 bp, Artificial Sequence
  Synthetic
gccaagcatttaggtgacactatagtgaatttcatcatcatctccgtttcagagctatgctggaaacagc

SEQ ID NO: 52183 - DNA, 70 bp, Artificial Sequence
  Synthetic
gccaagcatttaggtgacactatagcatctccaatatcgtcaaacgtttcagagctatgctggaaacagc

SEQ ID NO: 52184 - DNA, 70 bp, Artificial Sequence
  Synthetic
gccaagcatttaggtgacactataggaggaacagcttaaggttcagtttcagagctatgctggaaacagc

SEQ ID NO: 52185 - DNA, 70 bp, Artificial Sequence
  Synthetic
gccaagcatttaggtgacactataggagctggaagatttggaattgtttcagagctatgctggaaacagc

SEQ ID NO: 52186 - DNA, 70 bp, Artificial Sequence
  Synthetic
gccaagcatttaggtgacactataggacggaaaggatgggggcgtgtttcagagctatgctggaaacagc

SEQ ID NO: 52187 - DNA, 70 bp, Artificial Sequence
  Synthetic
gccaagcatttaggtgacactataggtgtgtcgttcatttttctcgtttcagagctatgctggaaacagc

SEQ ID NO: 52188 - DNA, 70 bp, Artificial Sequence
  Synthetic
gccaagcatttaggtgacactatagacaacttaaggctaattgctgtttcagagctatgctggaaacagc

SEQ ID NO: 52189 - DNA, 70 bp, Artificial Sequence
  Synthetic
gccaagcatttaggtgacactatagtgaggtatctttgctttggcgtttcagagctatgctggaaacagc

SEQ ID NO: 52190 - DNA, 70 bp, Artificial Sequence
  Synthetic
gccaagcatttaggtgacactataggagctcatcgctgactgctggtttcagagctatgctggaaacagc

SEQ ID NO: 52191 - DNA, 70 bp, Artificial Sequence
  Synthetic
gccaagcatttaggtgacactataggatggtagagttcactcatcgtttcagagctatgctggaaacagc

SEQ ID NO: 52192 - DNA, 70 bp, Artificial Sequence
  Synthetic
gccaagcatttaggtgacactatagaactcagtcactgtggaggagtttcagagctatgctggaaacagc

SEQ ID NO: 52193 - DNA, 70 bp, Artificial Sequence
  Synthetic
gccaagcatttaggtgacactatagcccacttgaggcaaagataagtttcagagctatgctggaaacagc

SEQ ID NO: 52194 - DNA, 70 bp, Artificial Sequence
  Synthetic
gccaagcatttaggtgacactataggaactcagatctccatgagcgtttcagagctatgctggaaacagc

SEQ ID NO: 52195 - DNA, 70 bp, Artificial Sequence
  Synthetic
gccaagcatttaggtgacactatagaagagcagtgaccagtgacggtttcagagctatgctggaaacagc

SEQ ID NO: 52196 - DNA, 70 bp, Artificial Sequence
  Synthetic
gccaagcatttaggtgacactataggtggctaaaagaggcagaaggtttcagagctatgctggaaacagc

SEQ ID NO: 52197 - DNA, 70 bp, Artificial Sequence
  Synthetic
gccaagcatttaggtgacactataggtctgtcacttcttcttgccgtttcagagctatgctggaaacagc

SEQ ID NO: 52198 - DNA, 70 bp, Artificial Sequence
  Synthetic
gccaagcatttaggtgacactatagagatgatgatgcagaagaaagtttcagagctatgctggaaacagc

SEQ ID NO: 52199 - DNA, 70 bp, Artificial Sequence
  Synthetic
gccaagcatttaggtgacactatagaccggcttccaggctgtcacgtttcagagctatgctggaaacagc

SEQ ID NO: 52200 - DNA, 70 bp, Artificial Sequence
  Synthetic
gccaagcatttaggtgacactatagcttcagtcatcatctactgtgtttcagagctatgctggaaacagc

SEQ ID NO: 52201 - DNA, 70 bp, Artificial Sequence
  Synthetic
gccaagcatttaggtgacactatagtgagacttaacgtcgtactggtttcagagctatgctggaaacagc

SEQ ID NO: 52202 - DNA, 70 bp, Artificial Sequence
  Synthetic
gccaagcatttaggtgacactatagctcgggaatcaggagtgaccgtttcagagctatgctggaaacagc

SEQ ID NO: 52203 - DNA, 70 bp, Artificial Sequence
  Synthetic
gccaagcatttaggtgacactatagaacagagtggagagctcagtgtttcagagctatgctggaaacagc

SEQ ID NO: 52204 - DNA, 70 bp, Artificial Sequence
  Synthetic
gccaagcatttaggtgacactatagagatgaggaggaagaggagggtttcagagctatgctggaaacagc

SEQ ID NO: 52205 - DNA, 70 bp, Artificial Sequence
  Synthetic
gccaagcatttaggtgacactatagaactgggcaactcaagattcgtttcagagctatgctggaaacagc

SEQ ID NO: 52206 - DNA, 70 bp, Artificial Sequence
  Synthetic
gccaagcatttaggtgacactatagactgcttggggtccattcacgtttcagagctatgctggaaacagc

SEQ ID NO: 52207 - DNA, 70 bp, Artificial Sequence
  Synthetic
gccaagcatttaggtgacactatagacagtggcagctggcttagtgtttcagagctatgctggaaacagc

SEQ ID NO: 52208 - DNA, 70 bp, Artificial Sequence
  Synthetic
gccaagcatttaggtgacactatagtgttgtattcttgaagagccgtttcagagctatgctggaaacagc

SEQ ID NO: 52209 - DNA, 70 bp, Artificial Sequence
  Synthetic
gccaagcatttaggtgacactatagaactcaaattcgaagtactggtttcagagctatgctggaaacagc

SEQ ID NO: 52210 - DNA, 70 bp, Artificial Sequence
  Synthetic
gccaagcatttaggtgacactataggattatggtggttatgatgggtttcagagctatgctggaaacagc

SEQ ID NO: 52211 - DNA, 70 bp, Artificial Sequence
  Synthetic
gccaagcatttaggtgacactatagaaacacctgaagttactggggtttcagagctatgctggaaacagc

SEQ ID NO: 52212 - DNA, 70 bp, Artificial Sequence
  Synthetic
gccaagcatttaggtgacactatagaatcgaaccctgaagaagatgtttcagagctatgctggaaacagc

SEQ ID NO: 52213 - DNA, 70 bp, Artificial Sequence
  Synthetic
gccaagcatttaggtgacactatagaggtatcagaaagactcaaagtttcagagctatgctggaaacagc

SEQ ID NO: 52214 - DNA, 70 bp, Artificial Sequence
  Synthetic
gccaagcatttaggtgacactatagtgttgctgacctcatctgaggtttcagagctatgctggaaacagc

SEQ ID NO: 52215 - DNA, 70 bp, Artificial Sequence
  Synthetic
gccaagcatttaggtgacactatagggtggacggtttggccgtaagtttcagagctatgctggaaacagc

SEQ ID NO: 52216 - DNA, 70 bp, Artificial Sequence
  Synthetic
gccaagcatttaggtgacactatagggaggagatgcccatgaatggtttcagagctatgctggaaacagc

SEQ ID NO: 52217 - DNA, 70 bp, Artificial Sequence
  Synthetic
gccaagcatttaggtgacactatagcggcatctcatcaatctgaggtttcagagctatgctggaaacagc

SEQ ID NO: 52218 - DNA, 70 bp, Artificial Sequence
  Synthetic
gccaagcatttaggtgacactatagacaggatgtagaggtctattgtttcagagctatgctggaaacagc

SEQ ID NO: 52219 - DNA, 70 bp, Artificial Sequence
  Synthetic
gccaagcatttaggtgacactataggcggctccaccactaaaaatgtttcagagctatgctggaaacagc

SEQ ID NO: 52220 - DNA, 70 bp, Artificial Sequence
  Synthetic
gccaagcatttaggtgacactatagaacaagtttgtggtgtgagggtttcagagctatgctggaaacagc

SEQ ID NO: 52221 - DNA, 70 bp, Artificial Sequence
  Synthetic
gccaagcatttaggtgacactataggagggggagcgtccgatcaggtttcagagctatgctggaaacagc

SEQ ID NO: 52222 - DNA, 70 bp, Artificial Sequence
  Synthetic
gccaagcatttaggtgacactatagcctacctcccaacaccattagtttcagagctatgctggaaacagc

SEQ ID NO: 52223 - DNA, 70 bp, Artificial Sequence
  Synthetic
gccaagcatttaggtgacactatagggtcatggcacattcaaccggtttcagagctatgctggaaacagc

SEQ ID NO: 52224 - DNA, 70 bp, Artificial Sequence
  Synthetic
gccaagcatttaggtgacactatagcatgcttttgaaggtggacggtttcagagctatgctggaaacagc

SEQ ID NO: 52225 - DNA, 70 bp, Artificial Sequence
  Synthetic
gccaagcatttaggtgacactatagggctggaactgctgatcattgtttcagagctatgctggaaacagc

SEQ ID NO: 52226 - DNA, 70 bp, Artificial Sequence
  Synthetic
gccaagcatttaggtgacactatagaagtatactctcaagcaagcgtttcagagctatgctggaaacagc

SEQ ID NO: 52227 - DNA, 70 bp, Artificial Sequence
  Synthetic
gccaagcatttaggtgacactatagttggaataccgacagtgagcgtttcagagctatgctggaaacagc

SEQ ID NO: 52228 - DNA, 70 bp, Artificial Sequence
  Synthetic
gccaagcatttaggtgacactatagaggagtctgaccacaactgagtttcagagctatgctggaaacagc

SEQ ID NO: 52229 - DNA, 70 bp, Artificial Sequence
  Synthetic
gccaagcatttaggtgacactatagttcttcagcagtttctaaccgtttcagagctatgctggaaacagc

SEQ ID NO: 52230 - DNA, 70 bp, Artificial Sequence
  Synthetic
gccaagcatttaggtgacactatagcagcattcattcgatgtttcgtttcagagctatgctggaaacagc

SEQ ID NO: 52231 - DNA, 70 bp, Artificial Sequence
  Synthetic
gccaagcatttaggtgacactatagggaagcagaagaggagtctggtttcagagctatgctggaaacagc

SEQ ID NO: 52232 - DNA, 70 bp, Artificial Sequence
  Synthetic
gccaagcatttaggtgacactatagtagagaggaagtcgttcaaagtttcagagctatgctggaaacagc

SEQ ID NO: 52233 - DNA, 70 bp, Artificial Sequence
  Synthetic
gccaagcatttaggtgacactataggttgcatccatccctttaaagtttcagagctatgctggaaacagc

SEQ ID NO: 52234 - DNA, 70 bp, Artificial Sequence
  Synthetic
gccaagcatttaggtgacactatagcaaggccatggcaaaataacgtttcagagctatgctggaaacagc

SEQ ID NO: 52235 - DNA, 70 bp, Artificial Sequence
  Synthetic
gccaagcatttaggtgacactatagtgatgtttccgtttatttgcgtttcagagctatgctggaaacagc

SEQ ID NO: 52236 - DNA, 70 bp, Artificial Sequence
  Synthetic
gccaagcatttaggtgacactataggagtgactggcagcttattggtttcagagctatgctggaaacagc

SEQ ID NO: 52237 - DNA, 70 bp, Artificial Sequence
  Synthetic
gccaagcatttaggtgacactatagcttggaaggtgactcaggtggtttcagagctatgctggaaacagc

SEQ ID NO: 52238 - DNA, 70 bp, Artificial Sequence
  Synthetic
gccaagcatttaggtgacactatagccaggcccgggagtcatagcgtttcagagctatgctggaaacagc

SEQ ID NO: 52239 - DNA, 70 bp, Artificial Sequence
  Synthetic
gccaagcatttaggtgacactatagcttctgctagagtcacttctgtttcagagctatgctggaaacagc

SEQ ID NO: 52240 - DNA, 70 bp, Artificial Sequence
  Synthetic
gccaagcatttaggtgacactatagagggtctcccagatcttcacgtttcagagctatgctggaaacagc

SEQ ID NO: 52241 - DNA, 70 bp, Artificial Sequence
  Synthetic
gccaagcatttaggtgacactataggccagcaggacccactgagagtttcagagctatgctggaaacagc

SEQ ID NO: 52242 - DNA, 70 bp, Artificial Sequence
  Synthetic
gccaagcatttaggtgacactatagaagcatgagcgagttatttggtttcagagctatgctggaaacagc

SEQ ID NO: 52243 - DNA, 70 bp, Artificial Sequence
  Synthetic
gccaagcatttaggtgacactatagagcctcaatggataccgtctgtttcagagctatgctggaaacagc

SEQ ID NO: 52244 - DNA, 70 bp, Artificial Sequence
  Synthetic
gccaagcatttaggtgacactatagcaagaccagcaaacagcacagtttcagagctatgctggaaacagc

SEQ ID NO: 52245 - DNA, 70 bp, Artificial Sequence
  Synthetic
gccaagcatttaggtgacactatagaatgggaaattcaggacttggtttcagagctatgctggaaacagc

SEQ ID NO: 52246 - DNA, 70 bp, Artificial Sequence
  Synthetic
gccaagcatttaggtgacactatagatcaaagcaaactgaagcaggtttcagagctatgctggaaacagc

SEQ ID NO: 52247 - DNA, 70 bp, Artificial Sequence
  Synthetic
gccaagcatttaggtgacactatagtatgaaacaaaacgaactgcgtttcagagctatgctggaaacagc

SEQ ID NO: 52248 - DNA, 70 bp, Artificial Sequence
  Synthetic
gccaagcatttaggtgacactatagacaggaagggcaatagctgagtttcagagctatgctggaaacagc

SEQ ID NO: 52249 - DNA, 70 bp, Artificial Sequence
  Synthetic
gccaagcatttaggtgacactatagttctccagagtcggaactgagtttcagagctatgctggaaacagc

SEQ ID NO: 52250 - DNA, 70 bp, Artificial Sequence
  Synthetic
gccaagcatttaggtgacactatagacccctttgcttatatgtcagtttcagagctatgctggaaacagc

SEQ ID NO: 52251 - DNA, 70 bp, Artificial Sequence
  Synthetic
gccaagcatttaggtgacactatagaaaaaatgcacacgggtggcgtttcagagctatgctggaaacagc

SEQ ID NO: 52252 - DNA, 70 bp, Artificial Sequence
  Synthetic
gccaagcatttaggtgacactatagggggggctcaggacttgtgcgtttcagagctatgctggaaacagc

SEQ ID NO: 52253 - DNA, 70 bp, Artificial Sequence
  Synthetic
gccaagcatttaggtgacactataggggggggtcacagcttctgcgtttcagagctatgctggaaacagc

SEQ ID NO: 52254 - DNA, 70 bp, Artificial Sequence
  Synthetic
gccaagcatttaggtgacactataggtggtagtagtcatggcttcgtttcagagctatgctggaaacagc

SEQ ID NO: 52255 - DNA, 70 bp, Artificial Sequence
  Synthetic
gccaagcatttaggtgacactatagtcccattgcgccccgtagccgtttcagagctatgctggaaacagc

SEQ ID NO: 52256 - DNA, 70 bp, Artificial Sequence
  Synthetic
gccaagcatttaggtgacactataggagtttgaagaaagcagtacgtttcagagctatgctggaaacagc

SEQ ID NO: 52257 - DNA, 70 bp, Artificial Sequence
  Synthetic
gccaagcatttaggtgacactataggcataggttatgtcttctgtgtttcagagctatgctggaaacagc

SEQ ID NO: 52258 - DNA, 70 bp, Artificial Sequence
  Synthetic
gccaagcatttaggtgacactatagggtagcttgctcgctctttagtttcagagctatgctggaaacagc

SEQ ID NO: 52259 - DNA, 70 bp, Artificial Sequence
  Synthetic
gccaagcatttaggtgacactatagaccagcggcagctgcaggctgtttcagagctatgctggaaacagc

SEQ ID NO: 52260 - DNA, 70 bp, Artificial Sequence
  Synthetic
gccaagcatttaggtgacactatagaccaacagcaagcagagtcagtttcagagctatgctggaaacagc

SEQ ID NO: 52261 - DNA, 70 bp, Artificial Sequence
  Synthetic
gccaagcatttaggtgacactataggagtttgaggaaaagaacaggtttcagagctatgctggaaacagc

SEQ ID NO: 52262 - DNA, 70 bp, Artificial Sequence
  Synthetic
gccaagcatttaggtgacactataggtctatgactgtaactgaaggtttcagagctatgctggaaacagc

SEQ ID NO: 52263 - DNA, 70 bp, Artificial Sequence
  Synthetic
gccaagcatttaggtgacactatagatagacaaagtcatagctgcgtttcagagctatgctggaaacagc

SEQ ID NO: 52264 - DNA, 70 bp, Artificial Sequence
  Synthetic
gccaagcatttaggtgacactataggtcatagcagaagttgaagtgtttcagagctatgctggaaacagc

SEQ ID NO: 52265 - DNA, 70 bp, Artificial Sequence
  Synthetic
gccaagcatttaggtgacactatagcatgttgattaaaccttccggtttcagagctatgctggaaacagc

SEQ ID NO: 52266 - DNA, 70 bp, Artificial Sequence
  Synthetic
gccaagcatttaggtgacactatagtgatgaaagtgttccattgtgtttcagagctatgctggaaacagc

SEQ ID NO: 52267 - DNA, 70 bp, Artificial Sequence
  Synthetic
gccaagcatttaggtgacactatagctcactcatccgaaggcgtagtttcagagctatgctggaaacagc

SEQ ID NO: 52268 - DNA, 70 bp, Artificial Sequence
  Synthetic
gccaagcatttaggtgacactatagaaaaaatgtggcaggtaagggtttcagagctatgctggaaacagc

SEQ ID NO: 52269 - DNA, 70 bp, Artificial Sequence
  Synthetic
gccaagcatttaggtgacactatagaggaagctcattttctcttcgtttcagagctatgctggaaacagc

SEQ ID NO: 52270 - DNA, 70 bp, Artificial Sequence
  Synthetic
gccaagcatttaggtgacactataggcaagtcctcagtttatcgtgtttcagagctatgctggaaacagc

SEQ ID NO: 52271 - DNA, 70 bp, Artificial Sequence
  Synthetic
gccaagcatttaggtgacactataggcaagtcctgagtttatcgtgtttcagagctatgctggaaacagc

SEQ ID NO: 52272 - DNA, 70 bp, Artificial Sequence
  Synthetic
gccaagcatttaggtgacactatagaaggcaattcgagactacaagtttcagagctatgctggaaacagc

SEQ ID NO: 52273 - DNA, 70 bp, Artificial Sequence
  Synthetic
gccaagcatttaggtgacactatagcacaggtccacccacgctgggtttcagagctatgctggaaacagc

SEQ ID NO: 52274 - DNA, 70 bp, Artificial Sequence
  Synthetic
gccaagcatttaggtgacactatagaatgaacaagccgtgcagtggtttcagagctatgctggaaacagc

SEQ ID NO: 52275 - DNA, 70 bp, Artificial Sequence
  Synthetic
gccaagcatttaggtgacactatagaattgcactggaactgctgagtttcagagctatgctggaaacagc

SEQ ID NO: 52276 - DNA, 70 bp, Artificial Sequence
  Synthetic
gccaagcatttaggtgacactatagtcctctgtgtcgctactgatgtttcagagctatgctggaaacagc

SEQ ID NO: 52277 - DNA, 70 bp, Artificial Sequence
  Synthetic
gccaagcatttaggtgacactatagtctaggccatgcttctcagtgtttcagagctatgctggaaacagc

SEQ ID NO: 52278 - DNA, 70 bp, Artificial Sequence
  Synthetic
gccaagcatttaggtgacactataggcctacttcactgcagcaaagtttcagagctatgctggaaacagc

SEQ ID NO: 52279 - DNA, 70 bp, Artificial Sequence
  Synthetic
gccaagcatttaggtgacactatagtgttctctccaaaccttcacgtttcagagctatgctggaaacagc

SEQ ID NO: 52280 - DNA, 70 bp, Artificial Sequence
  Synthetic
gccaagcatttaggtgacactataggctggaaaaacagccatgaagtttcagagctatgctggaaacagc

SEQ ID NO: 52281 - DNA, 70 bp, Artificial Sequence
  Synthetic
gccaagcatttaggtgacactatagctctggtggctggttcaggcgtttcagagctatgctggaaacagc

SEQ ID NO: 52282 - DNA, 70 bp, Artificial Sequence
  Synthetic
gccaagcatttaggtgacactataggaagccaaggaagctgcggagtttcagagctatgctggaaacagc

SEQ ID NO: 52283 - DNA, 70 bp, Artificial Sequence
  Synthetic
gccaagcatttaggtgacactatagaggcctacatcggcaaaatggtttcagagctatgctggaaacagc

SEQ ID NO: 52284 - DNA, 70 bp, Artificial Sequence
  Synthetic
gccaagcatttaggtgacactatagttgcccaaaactgtgaaaaagtttcagagctatgctggaaacagc

SEQ ID NO: 52285 - DNA, 70 bp, Artificial Sequence
  Synthetic
gccaagcatttaggtgacactatagctgcagtcactcagtctagcgtttcagagctatgctggaaacagc

SEQ ID NO: 52286 - DNA, 70 bp, Artificial Sequence
  Synthetic
gccaagcatttaggtgacactatagtggttacactttgcaagctggtttcagagctatgctggaaacagc

SEQ ID NO: 52287 - DNA, 70 bp, Artificial Sequence
  Synthetic
gccaagcatttaggtgacactatagtggtgaagatgctgaaataagtttcagagctatgctggaaacagc

SEQ ID NO: 52288 - DNA, 70 bp, Artificial Sequence
  Synthetic
gccaagcatttaggtgacactatagaagaagcacctggacttctagtttcagagctatgctggaaacagc

SEQ ID NO: 52289 - DNA, 70 bp, Artificial Sequence
  Synthetic
gccaagcatttaggtgacactatagctcactgtgtctgacaagtcgtttcagagctatgctggaaacagc

SEQ ID NO: 52290 - DNA, 70 bp, Artificial Sequence
  Synthetic
gccaagcatttaggtgacactatagtctgcatgcagcgactaagggtttcagagctatgctggaaacagc

SEQ ID NO: 52291 - DNA, 70 bp, Artificial Sequence
  Synthetic
gccaagcatttaggtgacactataggggtggggtcagggattctagtttcagagctatgctggaaacagc

SEQ ID NO: 52292 - DNA, 70 bp, Artificial Sequence
  Synthetic
gccaagcatttaggtgacactatagtgacgacctggatatttgacgtttcagagctatgctggaaacagc

SEQ ID NO: 52293 - DNA, 70 bp, Artificial Sequence
  Synthetic
gccaagcatttaggtgacactatagaaatcaggtcacagaacagcgtttcagagctatgctggaaacagc

SEQ ID NO: 52294 - DNA, 70 bp, Artificial Sequence
  Synthetic
gccaagcatttaggtgacactatagtcagcatcagcaatacacccgtttcagagctatgctggaaacagc

SEQ ID NO: 52295 - DNA, 70 bp, Artificial Sequence
  Synthetic
gccaagcatttaggtgacactatagcttttcacaaagcagaatgggtttcagagctatgctggaaacagc

SEQ ID NO: 52296 - DNA, 70 bp, Artificial Sequence
  Synthetic
gccaagcatttaggtgacactatagagtctttgttctttatcgccgtttcagagctatgctggaaacagc

SEQ ID NO: 52297 - DNA, 70 bp, Artificial Sequence
  Synthetic
gccaagcatttaggtgacactatagtgaccagcctgggccctcacgtttcagagctatgctggaaacagc

SEQ ID NO: 52298 - DNA, 70 bp, Artificial Sequence
  Synthetic
gccaagcatttaggtgacactataggcccgcgccaccgccacagggtttcagagctatgctggaaacagc

SEQ ID NO: 52299 - DNA, 70 bp, Artificial Sequence
  Synthetic
gccaagcatttaggtgacactatagagacatttgtctattgtctggtttcagagctatgctggaaacagc

SEQ ID NO: 52300 - DNA, 70 bp, Artificial Sequence
  Synthetic
gccaagcatttaggtgacactatagttgcagatcacccagtcttagtttcagagctatgctggaaacagc

SEQ ID NO: 52301 - DNA, 70 bp, Artificial Sequence
  Synthetic
gccaagcatttaggtgacactataggctcggtcttcaaaaaataggtttcagagctatgctggaaacagc

SEQ ID NO: 52302 - DNA, 70 bp, Artificial Sequence
  Synthetic
gccaagcatttaggtgacactatagagaatggagttcagtggtgggtttcagagctatgctggaaacagc

SEQ ID NO: 52303 - DNA, 70 bp, Artificial Sequence
  Synthetic
gccaagcatttaggtgacactatagggagccactgggcttaaagagtttcagagctatgctggaaacagc

SEQ ID NO: 52304 - DNA, 70 bp, Artificial Sequence
  Synthetic
gccaagcatttaggtgacactatagatggtgcacgtctactgaaagtttcagagctatgctggaaacagc

SEQ ID NO: 52305 - DNA, 70 bp, Artificial Sequence
  Synthetic
gccaagcatttaggtgacactataggctggcaaaaggaggtagtcgtttcagagctatgctggaaacagc

SEQ ID NO: 52306 - DNA, 70 bp, Artificial Sequence
  Synthetic
gccaagcatttaggtgacactataggtcctacacttgtgctaggcgtttcagagctatgctggaaacagc

SEQ ID NO: 52307 - DNA, 70 bp, Artificial Sequence
  Synthetic
gccaagcatttaggtgacactatagcgcagtgtcgctgaagccctgtttcagagctatgctggaaacagc

SEQ ID NO: 52308 - DNA, 70 bp, Artificial Sequence
  Synthetic
gccaagcatttaggtgacactataggttggtcccactaatggaaagtttcagagctatgctggaaacagc

SEQ ID NO: 52309 - DNA, 70 bp, Artificial Sequence
  Synthetic
gccaagcatttaggtgacactatagttcctcaagctgtcagttctgtttcagagctatgctggaaacagc

SEQ ID NO: 52310 - DNA, 70 bp, Artificial Sequence
  Synthetic
gccaagcatttaggtgacactatagagaaggcaaccccttctagagtttcagagctatgctggaaacagc

SEQ ID NO: 52311 - DNA, 70 bp, Artificial Sequence
  Synthetic
gccaagcatttaggtgacactataggcactatctaaagagagatggtttcagagctatgctggaaacagc

SEQ ID NO: 52312 - DNA, 70 bp, Artificial Sequence
  Synthetic
gccaagcatttaggtgacactatagcctgatctcctgctggacctgtttcagagctatgctggaaacagc

SEQ ID NO: 52313 - DNA, 70 bp, Artificial Sequence
  Synthetic
gccaagcatttaggtgacactatagagcctttgaggaagtatggggtttcagagctatgctggaaacagc

SEQ ID NO: 52314 - DNA, 70 bp, Artificial Sequence
  Synthetic
gccaagcatttaggtgacactataggccgggacgagagaggctgagtttcagagctatgctggaaacagc

SEQ ID NO: 52315 - DNA, 70 bp, Artificial Sequence
  Synthetic
gccaagcatttaggtgacactataggagcttgaacacgcgtagacgtttcagagctatgctggaaacagc

SEQ ID NO: 52316 - DNA, 70 bp, Artificial Sequence
  Synthetic
gccaagcatttaggtgacactatagttcctttcccacctctaagggtttcagagctatgctggaaacagc

SEQ ID NO: 52317 - DNA, 70 bp, Artificial Sequence
  Synthetic
gccaagcatttaggtgacactatagccagggcaagccaactagacgtttcagagctatgctggaaacagc

SEQ ID NO: 52318 - DNA, 70 bp, Artificial Sequence
  Synthetic
gccaagcatttaggtgacactatagaagacacaagcatcatgcaggtttcagagctatgctggaaacagc

SEQ ID NO: 52319 - DNA, 70 bp, Artificial Sequence
  Synthetic
gccaagcatttaggtgacactatagcagtggcgggtggtctgatggtttcagagctatgctggaaacagc

SEQ ID NO: 52320 - DNA, 70 bp, Artificial Sequence
  Synthetic
gccaagcatttaggtgacactatagcaggcagcgatcaaacgtcggtttcagagctatgctggaaacagc

SEQ ID NO: 52321 - DNA, 70 bp, Artificial Sequence
  Synthetic
gccaagcatttaggtgacactatagcgggtctaaacagtgtgtgcgtttcagagctatgctggaaacagc

SEQ ID NO: 52322 - DNA, 70 bp, Artificial Sequence
  Synthetic
gccaagcatttaggtgacactataggaagccagggtgttaggacggtttcagagctatgctggaaacagc

SEQ ID NO: 52323 - DNA, 70 bp, Artificial Sequence
  Synthetic
gccaagcatttaggtgacactatagcatctcagcatctctcagtggtttcagagctatgctggaaacagc

SEQ ID NO: 52324 - DNA, 70 bp, Artificial Sequence
  Synthetic
gccaagcatttaggtgacactatagaagtatgtggtcagcactgggtttcagagctatgctggaaacagc

SEQ ID NO: 52325 - DNA, 70 bp, Artificial Sequence
  Synthetic
gccaagcatttaggtgacactatagctggtcctgagaaagaaatagtttcagagctatgctggaaacagc

SEQ ID NO: 52326 - DNA, 70 bp, Artificial Sequence
  Synthetic
gccaagcatttaggtgacactatagatgaatgaatgaatggtggagtttcagagctatgctggaaacagc

SEQ ID NO: 52327 - DNA, 70 bp, Artificial Sequence
  Synthetic
gccaagcatttaggtgacactatagctacatccacctacggaagcgtttcagagctatgctggaaacagc

SEQ ID NO: 52328 - DNA, 70 bp, Artificial Sequence
  Synthetic
gccaagcatttaggtgacactatagcttctcagagctctgctgaagtttcagagctatgctggaaacagc

SEQ ID NO: 52329 - DNA, 70 bp, Artificial Sequence
  Synthetic
gccaagcatttaggtgacactataggtcacctccaatgactaggggtttcagagctatgctggaaacagc

SEQ ID NO: 52330 - DNA, 70 bp, Artificial Sequence
  Synthetic
gccaagcatttaggtgacactataggaggtcacgtctatttcctcgtttcagagctatgctggaaacagc

SEQ ID NO: 52331 - DNA, 70 bp, Artificial Sequence
  Synthetic
gccaagcatttaggtgacactatagaagggacgcaccatattaacgtttcagagctatgctggaaacagc

SEQ ID NO: 52332 - DNA, 70 bp, Artificial Sequence
  Synthetic
gccaagcatttaggtgacactatagactcgctctcgtctttgtccgtttcagagctatgctggaaacagc

SEQ ID NO: 52333 - DNA, 70 bp, Artificial Sequence
  Synthetic
gccaagcatttaggtgacactatagaagtcggacagcgagtaggggtttcagagctatgctggaaacagc

SEQ ID NO: 52334 - DNA, 70 bp, Artificial Sequence
  Synthetic
gccaagcatttaggtgacactataggcaagtcaaatactgcataggtttcagagctatgctggaaacagc

SEQ ID NO: 52335 - DNA, 70 bp, Artificial Sequence
  Synthetic
gccaagcatttaggtgacactataggcttactacttcaggcctaggtttcagagctatgctggaaacagc

SEQ ID NO: 52336 - DNA, 70 bp, Artificial Sequence
  Synthetic
gccaagcatttaggtgacactatagttaagaaggcagatgtttccgtttcagagctatgctggaaacagc

SEQ ID NO: 52337 - DNA, 70 bp, Artificial Sequence
  Synthetic
gccaagcatttaggtgacactatagctgcaagcggattggctacagtttcagagctatgctggaaacagc

SEQ ID NO: 52338 - DNA, 70 bp, Artificial Sequence
  Synthetic
gccaagcatttaggtgacactatagtcacggcgggcagtaagtgagtttcagagctatgctggaaacagc

SEQ ID NO: 52339 - DNA, 70 bp, Artificial Sequence
  Synthetic
gccaagcatttaggtgacactatagtggctcgaagttctattagggtttcagagctatgctggaaacagc

SEQ ID NO: 52340 - DNA, 70 bp, Artificial Sequence
  Synthetic
gccaagcatttaggtgacactatagcccagcaccaggtggggcaggtttcagagctatgctggaaacagc

SEQ ID NO: 52341 - DNA, 70 bp, Artificial Sequence
  Synthetic
gccaagcatttaggtgacactataggcatgccccaaaggagactcgtttcagagctatgctggaaacagc

SEQ ID NO: 52342 - DNA, 70 bp, Artificial Sequence
  Synthetic
gccaagcatttaggtgacactatagggcaaggactggcagtaggggtttcagagctatgctggaaacagc

SEQ ID NO: 52343 - DNA, 70 bp, Artificial Sequence
  Synthetic
gccaagcatttaggtgacactatagggggcccggcatgctcactggtttcagagctatgctggaaacagc

SEQ ID NO: 52344 - DNA, 70 bp, Artificial Sequence
  Synthetic
gccaagcatttaggtgacactatagcccctgctccaccagcagcagtttcagagctatgctggaaacagc

SEQ ID NO: 52345 - DNA, 70 bp, Artificial Sequence
  Synthetic
gccaagcatttaggtgacactatagttattcagcccctgcatgaggtttcagagctatgctggaaacagc

SEQ ID NO: 52346 - DNA, 70 bp, Artificial Sequence
  Synthetic
gccaagcatttaggtgacactataggctacctgctgcagccctgagtttcagagctatgctggaaacagc

SEQ ID NO: 52347 - DNA, 70 bp, Artificial Sequence
  Synthetic
gccaagcatttaggtgacactataggcccaaagtcttcgtgaagagtttcagagctatgctggaaacagc

SEQ ID NO: 52348 - DNA, 70 bp, Artificial Sequence
  Synthetic
gccaagcatttaggtgacactatagaaacaactagaacacgacatgtttcagagctatgctggaaacagc

SEQ ID NO: 52349 - DNA, 70 bp, Artificial Sequence
  Synthetic
gccaagcatttaggtgacactatagttgcctgcccacagcttactgtttcagagctatgctggaaacagc

SEQ ID NO: 52350 - DNA, 70 bp, Artificial Sequence
  Synthetic
gccaagcatttaggtgacactataggcagaggaatcacagcacacgtttcagagctatgctggaaacagc

SEQ ID NO: 52351 - DNA, 70 bp, Artificial Sequence
  Synthetic
gccaagcatttaggtgacactatagggagcctccagcttctcactgtttcagagctatgctggaaacagc

SEQ ID NO: 52352 - DNA, 70 bp, Artificial Sequence
  Synthetic
gccaagcatttaggtgacactatagacaggagcatcctctggatagtttcagagctatgctggaaacagc

SEQ ID NO: 52353 - DNA, 70 bp, Artificial Sequence
  Synthetic
gccaagcatttaggtgacactatagaacaacccttctctaggttggtttcagagctatgctggaaacagc

SEQ ID NO: 52354 - DNA, 70 bp, Artificial Sequence
  Synthetic
gccaagcatttaggtgacactatagagcacttaattttcttgagcgtttcagagctatgctggaaacagc

SEQ ID NO: 52355 - DNA, 70 bp, Artificial Sequence
  Synthetic
gccaagcatttaggtgacactatagtggaagctgtgtgcctttgagtttcagagctatgctggaaacagc

SEQ ID NO: 52356 - DNA, 70 bp, Artificial Sequence
  Synthetic
gccaagcatttaggtgacactatagtggaaattctgtggcttcgagtttcagagctatgctggaaacagc

SEQ ID NO: 52357 - DNA, 70 bp, Artificial Sequence
  Synthetic
gccaagcatttaggtgacactatagatagaaacaccatcagagaagtttcagagctatgctggaaacagc

SEQ ID NO: 52358 - DNA, 70 bp, Artificial Sequence
  Synthetic
gccaagcatttaggtgacactatagatatcagtcttcttggctaagtttcagagctatgctggaaacagc

SEQ ID NO: 52359 - DNA, 70 bp, Artificial Sequence
  Synthetic
gccaagcatttaggtgacactatagtctcgctctcatatgtatgcgtttcagagctatgctggaaacagc

SEQ ID NO: 52360 - DNA, 70 bp, Artificial Sequence
  Synthetic
gccaagcatttaggtgacactatagagttgcaaaatttcagagacgtttcagagctatgctggaaacagc

SEQ ID NO: 52361 - DNA, 70 bp, Artificial Sequence
  Synthetic
gccaagcatttaggtgacactatagagcacatgtcacccaattaagtttcagagctatgctggaaacagc

SEQ ID NO: 52362 - DNA, 70 bp, Artificial Sequence
  Synthetic
gccaagcatttaggtgacactatagttcagcatgcatatcttgtagtttcagagctatgctggaaacagc

SEQ ID NO: 52363 - DNA, 70 bp, Artificial Sequence
  Synthetic
gccaagcatttaggtgacactatagatatgatcagttatgcaagcgtttcagagctatgctggaaacagc

SEQ ID NO: 52364 - DNA, 70 bp, Artificial Sequence
  Synthetic
gccaagcatttaggtgacactataggaccgtgattcttctgtctggtttcagagctatgctggaaacagc

SEQ ID NO: 52365 - DNA, 70 bp, Artificial Sequence
  Synthetic
gccaagcatttaggtgacactatagccgggcagcatcattcaactgtttcagagctatgctggaaacagc

SEQ ID NO: 52366 - DNA, 70 bp, Artificial Sequence
  Synthetic
gccaagcatttaggtgacactatagtcgtcaccagcaagcttgcggtttcagagctatgctggaaacagc

SEQ ID NO: 52367 - DNA, 70 bp, Artificial Sequence
  Synthetic
gccaagcatttaggtgacactatagttgttgttgaacagaagtaggtttcagagctatgctggaaacagc

SEQ ID NO: 52368 - DNA, 70 bp, Artificial Sequence
  Synthetic
gccaagcatttaggtgacactatagaggtcccccagtcttctgaggtttcagagctatgctggaaacagc

SEQ ID NO: 52369 - DNA, 70 bp, Artificial Sequence
  Synthetic
gccaagcatttaggtgacactatagcttcaaacagacttcactgcgtttcagagctatgctggaaacagc

SEQ ID NO: 52370 - DNA, 70 bp, Artificial Sequence
  Synthetic
gccaagcatttaggtgacactatagttcacaagccttcatatttcgtttcagagctatgctggaaacagc

SEQ ID NO: 52371 - DNA, 70 bp, Artificial Sequence
  Synthetic
gccaagcatttaggtgacactatagtgcccccgtcggcccctaaagtttcagagctatgctggaaacagc

SEQ ID NO: 52372 - DNA, 70 bp, Artificial Sequence
  Synthetic
gccaagcatttaggtgacactatagacaaattcacagaggagactgtttcagagctatgctggaaacagc

SEQ ID NO: 52373 - DNA, 70 bp, Artificial Sequence
  Synthetic
gccaagcatttaggtgacactatagctcagtcagaatccactgcagtttcagagctatgctggaaacagc

SEQ ID NO: 52374 - DNA, 70 bp, Artificial Sequence
  Synthetic
gccaagcatttaggtgacactataggagctgtgagctggatcacagtttcagagctatgctggaaacagc

SEQ ID NO: 52375 - DNA, 70 bp, Artificial Sequence
  Synthetic
gccaagcatttaggtgacactatagaaggaagtacgtggcctcaagtttcagagctatgctggaaacagc

SEQ ID NO: 52376 - DNA, 70 bp, Artificial Sequence
  Synthetic
gccaagcatttaggtgacactataggccctgttaaaggatggcttgtttcagagctatgctggaaacagc

SEQ ID NO: 52377 - DNA, 70 bp, Artificial Sequence
  Synthetic
gccaagcatttaggtgacactatagggctgccgtactgaggtgatgtttcagagctatgctggaaacagc

SEQ ID NO: 52378 - DNA, 70 bp, Artificial Sequence
  Synthetic
gccaagcatttaggtgacactataggggatggctcggccactatggtttcagagctatgctggaaacagc

SEQ ID NO: 52379 - DNA, 70 bp, Artificial Sequence
  Synthetic
gccaagcatttaggtgacactatagtccaggagttcggctttcccgtttcagagctatgctggaaacagc

SEQ ID NO: 52380 - DNA, 70 bp, Artificial Sequence
  Synthetic
gccaagcatttaggtgacactatagggagtacaggtggggccgtggtttcagagctatgctggaaacagc

SEQ ID NO: 52381 - DNA, 70 bp, Artificial Sequence
  Synthetic
gccaagcatttaggtgacactatagcttctggttgcaggactagtgtttcagagctatgctggaaacagc

SEQ ID NO: 52382 - DNA, 70 bp, Artificial Sequence
  Synthetic
gccaagcatttaggtgacactatagaaaggctggcatgctgagcagtttcagagctatgctggaaacagc

SEQ ID NO: 52383 - DNA, 70 bp, Artificial Sequence
  Synthetic
gccaagcatttaggtgacactatagttcttcttaaatggccacttgtttcagagctatgctggaaacagc

SEQ ID NO: 52384 - DNA, 70 bp, Artificial Sequence
  Synthetic
gccaagcatttaggtgacactatagacacctcaaaaggcatgggagtttcagagctatgctggaaacagc

SEQ ID NO: 52385 - DNA, 70 bp, Artificial Sequence
  Synthetic
gccaagcatttaggtgacactatagtgtctagtgtactctgtgaggtttcagagctatgctggaaacagc

SEQ ID NO: 52386 - DNA, 70 bp, Artificial Sequence
  Synthetic
gccaagcatttaggtgacactatagaagcctccgtgccagtagtcgtttcagagctatgctggaaacagc

SEQ ID NO: 52387 - DNA, 70 bp, Artificial Sequence
  Synthetic
gccaagcatttaggtgacactatagggtagaaggcctggctcagggtttcagagctatgctggaaacagc

SEQ ID NO: 52388 - DNA, 70 bp, Artificial Sequence
  Synthetic
gccaagcatttaggtgacactataggggcaaatccccacaggagagtttcagagctatgctggaaacagc

SEQ ID NO: 52389 - DNA, 70 bp, Artificial Sequence
  Synthetic
gccaagcatttaggtgacactatagagctcactcatcagcaatctgtttcagagctatgctggaaacagc

SEQ ID NO: 52390 - DNA, 70 bp, Artificial Sequence
  Synthetic
gccaagcatttaggtgacactatagggagagggacaagaagccacgtttcagagctatgctggaaacagc

SEQ ID NO: 52391 - DNA, 70 bp, Artificial Sequence
  Synthetic
gccaagcatttaggtgacactatagaacagagttggctgaggaaggtttcagagctatgctggaaacagc

SEQ ID NO: 52392 - DNA, 70 bp, Artificial Sequence
  Synthetic
gccaagcatttaggtgacactataggatcacaccagaagatggaggtttcagagctatgctggaaacagc

SEQ ID NO: 52393 - DNA, 70 bp, Artificial Sequence
  Synthetic
gccaagcatttaggtgacactatagtgcagacattgaccatgaccgtttcagagctatgctggaaacagc

SEQ ID NO: 52394 - DNA, 70 bp, Artificial Sequence
  Synthetic
gccaagcatttaggtgacactatagaacttgaagaagccatagaagtttcagagctatgctggaaacagc

SEQ ID NO: 52395 - DNA, 70 bp, Artificial Sequence
  Synthetic
gccaagcatttaggtgacactatagaggatcaagtctctgtcttggtttcagagctatgctggaaacagc

SEQ ID NO: 52396 - DNA, 70 bp, Artificial Sequence
  Synthetic
gccaagcatttaggtgacactatagttggctgctgtggttggttcgtttcagagctatgctggaaacagc

SEQ ID NO: 52397 - DNA, 70 bp, Artificial Sequence
  Synthetic
gccaagcatttaggtgacactatagaaggggagaatttcacagttgtttcagagctatgctggaaacagc

SEQ ID NO: 52398 - DNA, 70 bp, Artificial Sequence
  Synthetic
gccaagcatttaggtgacactatagagaaccagaagaacttaggagtttcagagctatgctggaaacagc

SEQ ID NO: 52399 - DNA, 70 bp, Artificial Sequence
  Synthetic
gccaagcatttaggtgacactatagcaacactcatatctcagtcagtttcagagctatgctggaaacagc

SEQ ID NO: 52400 - DNA, 70 bp, Artificial Sequence
  Synthetic
gccaagcatttaggtgacactatagtacaggccctcagagctcaggtttcagagctatgctggaaacagc

SEQ ID NO: 52401 - DNA, 70 bp, Artificial Sequence
  Synthetic
gccaagcatttaggtgacactatagtactgaccactgagctctgagtttcagagctatgctggaaacagc

SEQ ID NO: 52402 - DNA, 70 bp, Artificial Sequence
  Synthetic
gccaagcatttaggtgacactatagagtttaagctgatagttcaggtttcagagctatgctggaaacagc

SEQ ID NO: 52403 - DNA, 70 bp, Artificial Sequence
  Synthetic
gccaagcatttaggtgacactatagagacaacacagtagcgatgggtttcagagctatgctggaaacagc

SEQ ID NO: 52404 - DNA, 70 bp, Artificial Sequence
  Synthetic
gccaagcatttaggtgacactatagagcagagacaacagtagctagtttcagagctatgctggaaacagc

SEQ ID NO: 52405 - DNA, 70 bp, Artificial Sequence
  Synthetic
gccaagcatttaggtgacactatagggagatgggtgagatgcatagtttcagagctatgctggaaacagc

SEQ ID NO: 52406 - DNA, 70 bp, Artificial Sequence
  Synthetic
gccaagcatttaggtgacactataggcgggtgctggacgagaggagtttcagagctatgctggaaacagc

SEQ ID NO: 52407 - DNA, 70 bp, Artificial Sequence
  Synthetic
gccaagcatttaggtgacactatagtccctatgcacaggctcaccgtttcagagctatgctggaaacagc

SEQ ID NO: 52408 - DNA, 70 bp, Artificial Sequence
  Synthetic
gccaagcatttaggtgacactatagtcagtgttaactatcgtatggtttcagagctatgctggaaacagc

SEQ ID NO: 52409 - DNA, 70 bp, Artificial Sequence
  Synthetic
gccaagcatttaggtgacactatagtcttcacaaaggcctcacaggtttcagagctatgctggaaacagc

SEQ ID NO: 52410 - DNA, 70 bp, Artificial Sequence
  Synthetic
gccaagcatttaggtgacactatagttgcagtattcagggattcagtttcagagctatgctggaaacagc

SEQ ID NO: 52411 - DNA, 70 bp, Artificial Sequence
  Synthetic
gccaagcatttaggtgacactatagccagggggtgcaggtgtgaggtttcagagctatgctggaaacagc

SEQ ID NO: 52412 - DNA, 70 bp, Artificial Sequence
  Synthetic
gccaagcatttaggtgacactatagttggctgggggccgtggggtgtttcagagctatgctggaaacagc

SEQ ID NO: 52413 - DNA, 70 bp, Artificial Sequence
  Synthetic
gccaagcatttaggtgacactatagaggccctgtcgaggctcagagtttcagagctatgctggaaacagc

SEQ ID NO: 52414 - DNA, 70 bp, Artificial Sequence
  Synthetic
gccaagcatttaggtgacactatagcccgaacagccgctggatatgtttcagagctatgctggaaacagc

SEQ ID NO: 52415 - DNA, 70 bp, Artificial Sequence
  Synthetic
gccaagcatttaggtgacactatagcttccgtcccgtgctttacagtttcagagctatgctggaaacagc

SEQ ID NO: 52416 - DNA, 70 bp, Artificial Sequence
  Synthetic
gccaagcatttaggtgacactatagttattcagtactggctcagagtttcagagctatgctggaaacagc

SEQ ID NO: 52417 - DNA, 70 bp, Artificial Sequence
  Synthetic
gccaagcatttaggtgacactatagcgctgtggctcaggtgacctgtttcagagctatgctggaaacagc

SEQ ID NO: 52418 - DNA, 70 bp, Artificial Sequence
  Synthetic
gccaagcatttaggtgacactatagggtgcagctggtaaacggaagtttcagagctatgctggaaacagc

SEQ ID NO: 52419 - DNA, 70 bp, Artificial Sequence
  Synthetic
gccaagcatttaggtgacactatagatgatgcacatacaggagaagtttcagagctatgctggaaacagc

SEQ ID NO: 52420 - DNA, 70 bp, Artificial Sequence
  Synthetic
gccaagcatttaggtgacactatagagaggttaagtgttagagttgtttcagagctatgctggaaacagc

SEQ ID NO: 52421 - DNA, 70 bp, Artificial Sequence
  Synthetic
gccaagcatttaggtgacactatagcaaaggccgctgcttctagtgtttcagagctatgctggaaacagc

SEQ ID NO: 52422 - DNA, 70 bp, Artificial Sequence
  Synthetic
gccaagcatttaggtgacactatagaaagcaggctaccagcaaaagtttcagagctatgctggaaacagc

SEQ ID NO: 52423 - DNA, 70 bp, Artificial Sequence
  Synthetic
gccaagcatttaggtgacactatagatgctacatttacatggaacgtttcagagctatgctggaaacagc

SEQ ID NO: 52424 - DNA, 70 bp, Artificial Sequence
  Synthetic
gccaagcatttaggtgacactatagtcaccaggacccagagctgggtttcagagctatgctggaaacagc

SEQ ID NO: 52425 - DNA, 70 bp, Artificial Sequence
  Synthetic
gccaagcatttaggtgacactatagccctgctggctgtacatcaggtttcagagctatgctggaaacagc

SEQ ID NO: 52426 - DNA, 70 bp, Artificial Sequence
  Synthetic
gccaagcatttaggtgacactatagaagtcagtcaccaacggcaagtttcagagctatgctggaaacagc

SEQ ID NO: 52427 - DNA, 70 bp, Artificial Sequence
  Synthetic
gccaagcatttaggtgacactataggaaccagattcagtctgtgggtttcagagctatgctggaaacagc

SEQ ID NO: 52428 - DNA, 70 bp, Artificial Sequence
  Synthetic
gccaagcatttaggtgacactatagagcaatgactgttcttgcgggtttcagagctatgctggaaacagc

SEQ ID NO: 52429 - DNA, 70 bp, Artificial Sequence
  Synthetic
gccaagcatttaggtgacactatagagccggtgtcagacctgcacgtttcagagctatgctggaaacagc

SEQ ID NO: 52430 - DNA, 70 bp, Artificial Sequence
  Synthetic
gccaagcatttaggtgacactataggttcctgcaggtcagtactggtttcagagctatgctggaaacagc

SEQ ID NO: 52431 - DNA, 70 bp, Artificial Sequence
  Synthetic
gccaagcatttaggtgacactataggaggcagcagggctcagtgggtttcagagctatgctggaaacagc

SEQ ID NO: 52432 - DNA, 70 bp, Artificial Sequence
  Synthetic
gccaagcatttaggtgacactatagagttcctgtcggtgctggaggtttcagagctatgctggaaacagc

SEQ ID NO: 52433 - DNA, 70 bp, Artificial Sequence
  Synthetic
gccaagcatttaggtgacactatagttctacatctttgagaccacgtttcagagctatgctggaaacagc

SEQ ID NO: 52434 - DNA, 70 bp, Artificial Sequence
  Synthetic
gccaagcatttaggtgacactatagtgcaagacctgctggactaggtttcagagctatgctggaaacagc

SEQ ID NO: 52435 - DNA, 70 bp, Artificial Sequence
  Synthetic
gccaagcatttaggtgacactatagatttgttcactatgtcaggtgtttcagagctatgctggaaacagc

SEQ ID NO: 52436 - DNA, 70 bp, Artificial Sequence
  Synthetic
gccaagcatttaggtgacactatagattatagtggaaatgtgtccgtttcagagctatgctggaaacagc

SEQ ID NO: 52437 - DNA, 70 bp, Artificial Sequence
  Synthetic
gccaagcatttaggtgacactataggaagcaggctgaccagctacgtttcagagctatgctggaaacagc

SEQ ID NO: 52438 - DNA, 70 bp, Artificial Sequence
  Synthetic
gccaagcatttaggtgacactatagtctcacaaggtcatcccaacgtttcagagctatgctggaaacagc

SEQ ID NO: 52439 - DNA, 70 bp, Artificial Sequence
  Synthetic
gccaagcatttaggtgacactatagccccttccgccctggattatgtttcagagctatgctggaaacagc

SEQ ID NO: 52440 - DNA, 70 bp, Artificial Sequence
  Synthetic
gccaagcatttaggtgacactatagccaggcccaggcactagagagtttcagagctatgctggaaacagc

SEQ ID NO: 52441 - DNA, 70 bp, Artificial Sequence
  Synthetic
gccaagcatttaggtgacactatagtgggacggggcggggctcaggtttcagagctatgctggaaacagc

SEQ ID NO: 52442 - DNA, 70 bp, Artificial Sequence
  Synthetic
gccaagcatttaggtgacactatagaggacaggggacagatgaccgtttcagagctatgctggaaacagc

SEQ ID NO: 52443 - DNA, 70 bp, Artificial Sequence
  Synthetic
gccaagcatttaggtgacactatagcaaattctgggggatcaacagtttcagagctatgctggaaacagc

SEQ ID NO: 52444 - DNA, 70 bp, Artificial Sequence
  Synthetic
gccaagcatttaggtgacactatagcagctatgtggcttgctcttgtttcagagctatgctggaaacagc

SEQ ID NO: 52445 - DNA, 70 bp, Artificial Sequence
  Synthetic
gccaagcatttaggtgacactatagcttgcaggtgttcaggcagtgtttcagagctatgctggaaacagc

SEQ ID NO: 52446 - DNA, 70 bp, Artificial Sequence
  Synthetic
gccaagcatttaggtgacactataggtttattcttgcaggtgttcgtttcagagctatgctggaaacagc

SEQ ID NO: 52447 - DNA, 70 bp, Artificial Sequence
  Synthetic
gccaagcatttaggtgacactatagctggatttatgtagacagaggtttcagagctatgctggaaacagc

SEQ ID NO: 52448 - DNA, 70 bp, Artificial Sequence
  Synthetic
gccaagcatttaggtgacactatagtctctctctctacagtgactgtttcagagctatgctggaaacagc

SEQ ID NO: 52449 - DNA, 70 bp, Artificial Sequence
  Synthetic
gccaagcatttaggtgacactatagtatttggtcgcagctactgagtttcagagctatgctggaaacagc

SEQ ID NO: 52450 - DNA, 70 bp, Artificial Sequence
  Synthetic
gccaagcatttaggtgacactatagggaacaagaagacttagaacgtttcagagctatgctggaaacagc

SEQ ID NO: 52451 - DNA, 70 bp, Artificial Sequence
  Synthetic
gccaagcatttaggtgacactataggcggaggactcaacttacaggtttcagagctatgctggaaacagc

SEQ ID NO: 52452 - DNA, 70 bp, Artificial Sequence
  Synthetic
gccaagcatttaggtgacactatagacacacggccctcgcctagggtttcagagctatgctggaaacagc

SEQ ID NO: 52453 - DNA, 70 bp, Artificial Sequence
  Synthetic
gccaagcatttaggtgacactatagcagttttggagccatggtaagtttcagagctatgctggaaacagc

SEQ ID NO: 52454 - DNA, 70 bp, Artificial Sequence
  Synthetic
gccaagcatttaggtgacactataggcggaaccaagctggcttacgtttcagagctatgctggaaacagc

SEQ ID NO: 52455 - DNA, 70 bp, Artificial Sequence
  Synthetic
gccaagcatttaggtgacactatagggagtggaatcttttgatgagtttcagagctatgctggaaacagc

SEQ ID NO: 52456 - DNA, 70 bp, Artificial Sequence
  Synthetic
gccaagcatttaggtgacactatagggaaggcgaggtggaaatgggtttcagagctatgctggaaacagc

SEQ ID NO: 52457 - DNA, 70 bp, Artificial Sequence
  Synthetic
gccaagcatttaggtgacactataggaggaggggggaggacagctgtttcagagctatgctggaaacagc

SEQ ID NO: 52458 - DNA, 70 bp, Artificial Sequence
  Synthetic
gccaagcatttaggtgacactataggtgtctaagctggtgcctaagtttcagagctatgctggaaacagc

SEQ ID NO: 52459 - DNA, 70 bp, Artificial Sequence
  Synthetic
gccaagcatttaggtgacactatagcctcatttatgcatgtttgggtttcagagctatgctggaaacagc

SEQ ID NO: 52460 - DNA, 70 bp, Artificial Sequence
  Synthetic
gccaagcatttaggtgacactatagtatgaatagcggtaacagctgtttcagagctatgctggaaacagc

SEQ ID NO: 52461 - DNA, 70 bp, Artificial Sequence
  Synthetic
gccaagcatttaggtgacactatagtcagcctggcgagggacatggtttcagagctatgctggaaacagc

SEQ ID NO: 52462 - DNA, 70 bp, Artificial Sequence
  Synthetic
gccaagcatttaggtgacactatagaattagacaaggctcccaacgtttcagagctatgctggaaacagc

SEQ ID NO: 52463 - DNA, 70 bp, Artificial Sequence
  Synthetic
gccaagcatttaggtgacactataggggttccttgatttcttcacgtttcagagctatgctggaaacagc

SEQ ID NO: 52464 - DNA, 70 bp, Artificial Sequence
  Synthetic
gccaagcatttaggtgacactatagcagtagagggtggtcacttggtttcagagctatgctggaaacagc

SEQ ID NO: 52465 - DNA, 70 bp, Artificial Sequence
  Synthetic
gccaagcatttaggtgacactataggatcctgaagctgacgcaacgtttcagagctatgctggaaacagc

SEQ ID NO: 52466 - DNA, 70 bp, Artificial Sequence
  Synthetic
gccaagcatttaggtgacactatagtgaagaaaacatcggttggagtttcagagctatgctggaaacagc

SEQ ID NO: 52467 - DNA, 70 bp, Artificial Sequence
  Synthetic
gccaagcatttaggtgacactataggactctgaggacttggctaagtttcagagctatgctggaaacagc

SEQ ID NO: 52468 - DNA, 70 bp, Artificial Sequence
  Synthetic
gccaagcatttaggtgacactatagtactatccactctccaaactgtttcagagctatgctggaaacagc

SEQ ID NO: 52469 - DNA, 70 bp, Artificial Sequence
  Synthetic
gccaagcatttaggtgacactataggtggctgctctgtggcctgagtttcagagctatgctggaaacagc

SEQ ID NO: 52470 - DNA, 70 bp, Artificial Sequence
  Synthetic
gccaagcatttaggtgacactatagaagaccgttggactcacgaggtttcagagctatgctggaaacagc

SEQ ID NO: 52471 - DNA, 70 bp, Artificial Sequence
  Synthetic
gccaagcatttaggtgacactatagcttggccttctggttcacacgtttcagagctatgctggaaacagc

SEQ ID NO: 52472 - DNA, 70 bp, Artificial Sequence
  Synthetic
gccaagcatttaggtgacactatagggcaccgcagctcatctaccgtttcagagctatgctggaaacagc

SEQ ID NO: 52473 - DNA, 70 bp, Artificial Sequence
  Synthetic
gccaagcatttaggtgacactatagggagcaggagttacgttctcgtttcagagctatgctggaaacagc

SEQ ID NO: 52474 - DNA, 70 bp, Artificial Sequence
  Synthetic
gccaagcatttaggtgacactatagtcaccttggccgctgtctaagtttcagagctatgctggaaacagc

SEQ ID NO: 52475 - DNA, 70 bp, Artificial Sequence
  Synthetic
gccaagcatttaggtgacactatagttacagacaccggaatactggtttcagagctatgctggaaacagc

SEQ ID NO: 52476 - DNA, 70 bp, Artificial Sequence
  Synthetic
gccaagcatttaggtgacactatagttttgtccacagtgcttatggtttcagagctatgctggaaacagc

SEQ ID NO: 52477 - DNA, 70 bp, Artificial Sequence
  Synthetic
gccaagcatttaggtgacactatagccccataaagcagggtcaaggtttcagagctatgctggaaacagc

SEQ ID NO: 52478 - DNA, 70 bp, Artificial Sequence
  Synthetic
gccaagcatttaggtgacactatagtccgttgcatcccaaagccagtttcagagctatgctggaaacagc

SEQ ID NO: 52479 - DNA, 70 bp, Artificial Sequence
  Synthetic
gccaagcatttaggtgacactataggagggcatatgggcatagccgtttcagagctatgctggaaacagc

SEQ ID NO: 52480 - DNA, 70 bp, Artificial Sequence
  Synthetic
gccaagcatttaggtgacactatagcaaaatgttgggattacagggtttcagagctatgctggaaacagc

SEQ ID NO: 52481 - DNA, 70 bp, Artificial Sequence
  Synthetic
gccaagcatttaggtgacactatagtcatcagggtactttcaagagtttcagagctatgctggaaacagc

SEQ ID NO: 52482 - DNA, 70 bp, Artificial Sequence
  Synthetic
gccaagcatttaggtgacactatagattgctcagcagctctgagtgtttcagagctatgctggaaacagc

SEQ ID NO: 52483 - DNA, 70 bp, Artificial Sequence
  Synthetic
gccaagcatttaggtgacactatagctcagcactgtggaagcagcgtttcagagctatgctggaaacagc

SEQ ID NO: 52484 - DNA, 70 bp, Artificial Sequence
  Synthetic
gccaagcatttaggtgacactatagacccgctcttcaagcgctttgtttcagagctatgctggaaacagc

SEQ ID NO: 52485 - DNA, 70 bp, Artificial Sequence
  Synthetic
gccaagcatttaggtgacactatagtttgcagaagtcgtatcaaagtttcagagctatgctggaaacagc

SEQ ID NO: 52486 - DNA, 70 bp, Artificial Sequence
  Synthetic
gccaagcatttaggtgacactataggacgtgcgaggggaagaaaagtttcagagctatgctggaaacagc

SEQ ID NO: 52487 - DNA, 70 bp, Artificial Sequence
  Synthetic
gccaagcatttaggtgacactatagcttctggtggtgaaggaattgtttcagagctatgctggaaacagc

SEQ ID NO: 52488 - DNA, 70 bp, Artificial Sequence
  Synthetic
gccaagcatttaggtgacactatagaaagtcaagagcataacttcgtttcagagctatgctggaaacagc

SEQ ID NO: 52489 - DNA, 70 bp, Artificial Sequence
  Synthetic
gccaagcatttaggtgacactataggagaagaagttcacacctccgtttcagagctatgctggaaacagc

SEQ ID NO: 52490 - DNA, 70 bp, Artificial Sequence
  Synthetic
gccaagcatttaggtgacactatagttatgtggtactctgtgtatgtttcagagctatgctggaaacagc

SEQ ID NO: 52491 - DNA, 70 bp, Artificial Sequence
  Synthetic
gccaagcatttaggtgacactatagtcctgttctcacattctacagtttcagagctatgctggaaacagc

SEQ ID NO: 52492 - DNA, 70 bp, Artificial Sequence
  Synthetic
gccaagcatttaggtgacactatagtggagcagcagtgatgaagagtttcagagctatgctggaaacagc

SEQ ID NO: 52493 - DNA, 70 bp, Artificial Sequence
  Synthetic
gccaagcatttaggtgacactatagagagttgccgcaagtctgaagtttcagagctatgctggaaacagc

SEQ ID NO: 52494 - DNA, 70 bp, Artificial Sequence
  Synthetic
gccaagcatttaggtgacactatagtggagcaccgagactcctgagtttcagagctatgctggaaacagc

SEQ ID NO: 52495 - DNA, 70 bp, Artificial Sequence
  Synthetic
gccaagcatttaggtgacactatagtgtcctcctgggcgtgtgaggtttcagagctatgctggaaacagc

SEQ ID NO: 52496 - DNA, 70 bp, Artificial Sequence
  Synthetic
gccaagcatttaggtgacactatagagccatatgccttctcatctgtttcagagctatgctggaaacagc

SEQ ID NO: 52497 - DNA, 70 bp, Artificial Sequence
  Synthetic
gccaagcatttaggtgacactatagagtagccgccttgcaaatccgtttcagagctatgctggaaacagc

SEQ ID NO: 52498 - DNA, 70 bp, Artificial Sequence
  Synthetic
gccaagcatttaggtgacactatagtcattcaaagaccacactaagtttcagagctatgctggaaacagc

SEQ ID NO: 52499 - DNA, 70 bp, Artificial Sequence
  Synthetic
gccaagcatttaggtgacactatagagacagaagaagagaaactggtttcagagctatgctggaaacagc

SEQ ID NO: 52500 - DNA, 70 bp, Artificial Sequence
  Synthetic
gccaagcatttaggtgacactataggtcaatgcatcttgcccagcgtttcagagctatgctggaaacagc

SEQ ID NO: 52501 - DNA, 70 bp, Artificial Sequence
  Synthetic
gccaagcatttaggtgacactataggaggtaagtggttgtctgtggtttcagagctatgctggaaacagc

SEQ ID NO: 52502 - DNA, 70 bp, Artificial Sequence
  Synthetic
gccaagcatttaggtgacactatagtccctagatcaattttcttcgtttcagagctatgctggaaacagc

SEQ ID NO: 52503 - DNA, 70 bp, Artificial Sequence
  Synthetic
gccaagcatttaggtgacactataggtcggcaggcccaacaggctgtttcagagctatgctggaaacagc

SEQ ID NO: 52504 - DNA, 70 bp, Artificial Sequence
  Synthetic
gccaagcatttaggtgacactatagctaaaatgtggcatttgtgggtttcagagctatgctggaaacagc

SEQ ID NO: 52505 - DNA, 70 bp, Artificial Sequence
  Synthetic
gccaagcatttaggtgacactatagtgagactcaggccttcaatggtttcagagctatgctggaaacagc

SEQ ID NO: 52506 - DNA, 70 bp, Artificial Sequence
  Synthetic
gccaagcatttaggtgacactatagtgtcactggcatgtctgcaagtttcagagctatgctggaaacagc

SEQ ID NO: 52507 - DNA, 70 bp, Artificial Sequence
  Synthetic
gccaagcatttaggtgacactataggacatcgaagccgttctgatgtttcagagctatgctggaaacagc

SEQ ID NO: 52508 - DNA, 70 bp, Artificial Sequence
  Synthetic
gccaagcatttaggtgacactatagggcgagtgtcttcatgatgtgtttcagagctatgctggaaacagc

SEQ ID NO: 52509 - DNA, 70 bp, Artificial Sequence
  Synthetic
gccaagcatttaggtgacactataggagaagagcagtgactaaaagtttcagagctatgctggaaacagc

SEQ ID NO: 52510 - DNA, 70 bp, Artificial Sequence
  Synthetic
gccaagcatttaggtgacactataggctgaaaaacagatcaagtcgtttcagagctatgctggaaacagc

SEQ ID NO: 52511 - DNA, 70 bp, Artificial Sequence
  Synthetic
gccaagcatttaggtgacactatagacagcaaagaacaaacagaagtttcagagctatgctggaaacagc

SEQ ID NO: 52512 - DNA, 70 bp, Artificial Sequence
  Synthetic
gccaagcatttaggtgacactatagagctctgacgaaggtgaagagtttcagagctatgctggaaacagc

SEQ ID NO: 52513 - DNA, 70 bp, Artificial Sequence
  Synthetic
gccaagcatttaggtgacactatagccccaacaacgtgcaggtctgtttcagagctatgctggaaacagc

SEQ ID NO: 52514 - DNA, 70 bp, Artificial Sequence
  Synthetic
gccaagcatttaggtgacactataggactttgagatgatgatctggtttcagagctatgctggaaacagc

SEQ ID NO: 52515 - DNA, 70 bp, Artificial Sequence
  Synthetic
gccaagcatttaggtgacactatagggttcactcttctatctatggtttcagagctatgctggaaacagc

SEQ ID NO: 52516 - DNA, 70 bp, Artificial Sequence
  Synthetic
gccaagcatttaggtgacactatagattgccctttgtcacagttcgtttcagagctatgctggaaacagc

SEQ ID NO: 52517 - DNA, 70 bp, Artificial Sequence
  Synthetic
gccaagcatttaggtgacactatagtctaaactctggttttaagggtttcagagctatgctggaaacagc

SEQ ID NO: 52518 - DNA, 70 bp, Artificial Sequence
  Synthetic
gccaagcatttaggtgacactatagttctttctctccccaactaagtttcagagctatgctggaaacagc

SEQ ID NO: 52519 - DNA, 70 bp, Artificial Sequence
  Synthetic
gccaagcatttaggtgacactatagatccaaaacaaagagagcacgtttcagagctatgctggaaacagc

SEQ ID NO: 52520 - DNA, 70 bp, Artificial Sequence
  Synthetic
gccaagcatttaggtgacactatagacccttggagacggccactagtttcagagctatgctggaaacagc

SEQ ID NO: 52521 - DNA, 70 bp, Artificial Sequence
  Synthetic
gccaagcatttaggtgacactatagtcccaggaatcttcataaaagtttcagagctatgctggaaacagc

SEQ ID NO: 52522 - DNA, 70 bp, Artificial Sequence
  Synthetic
gccaagcatttaggtgacactatagctcaaggctccttctttttagtttcagagctatgctggaaacagc

SEQ ID NO: 52523 - DNA, 70 bp, Artificial Sequence
  Synthetic
gccaagcatttaggtgacactatagccagttacgaaaagaacaaggtttcagagctatgctggaaacagc

SEQ ID NO: 52524 - DNA, 70 bp, Artificial Sequence
  Synthetic
gccaagcatttaggtgacactatagtcctatcggaaaatcagaaagtttcagagctatgctggaaacagc

SEQ ID NO: 52525 - DNA, 70 bp, Artificial Sequence
  Synthetic
gccaagcatttaggtgacactataggagatcgtaggtgcacacccgtttcagagctatgctggaaacagc

SEQ ID NO: 52526 - DNA, 70 bp, Artificial Sequence
  Synthetic
gccaagcatttaggtgacactataggaggggccgccctcgctcaggtttcagagctatgctggaaacagc

SEQ ID NO: 52527 - DNA, 70 bp, Artificial Sequence
  Synthetic
gccaagcatttaggtgacactatagggggccacagggaggtgagggtttcagagctatgctggaaacagc

SEQ ID NO: 52528 - DNA, 70 bp, Artificial Sequence
  Synthetic
gccaagcatttaggtgacactatagtcataactaggtccactttcgtttcagagctatgctggaaacagc

SEQ ID NO: 52529 - DNA, 70 bp, Artificial Sequence
  Synthetic
gccaagcatttaggtgacactatagaaagagcaactatttcctgtgtttcagagctatgctggaaacagc

SEQ ID NO: 52530 - DNA, 70 bp, Artificial Sequence
  Synthetic
gccaagcatttaggtgacactatagagaagtcagagttccaccttgtttcagagctatgctggaaacagc

SEQ ID NO: 52531 - DNA, 70 bp, Artificial Sequence
  Synthetic
gccaagcatttaggtgacactataggagaaagaggagctgtaaaagtttcagagctatgctggaaacagc

SEQ ID NO: 52532 - DNA, 70 bp, Artificial Sequence
  Synthetic
gccaagcatttaggtgacactatagaactagcacccagtgaatatgtttcagagctatgctggaaacagc

SEQ ID NO: 52533 - DNA, 70 bp, Artificial Sequence
  Synthetic
gccaagcatttaggtgacactatagggtctaaggagaaaccacatgtttcagagctatgctggaaacagc

SEQ ID NO: 52534 - DNA, 70 bp, Artificial Sequence
  Synthetic
gccaagcatttaggtgacactatagatcccagttcagacttggaagtttcagagctatgctggaaacagc

SEQ ID NO: 52535 - DNA, 70 bp, Artificial Sequence
  Synthetic
gccaagcatttaggtgacactatagcaagagtcacccttctaagggtttcagagctatgctggaaacagc

SEQ ID NO: 52536 - DNA, 70 bp, Artificial Sequence
  Synthetic
gccaagcatttaggtgacactatagataaaggaatggaaatgccggtttcagagctatgctggaaacagc

SEQ ID NO: 52537 - DNA, 70 bp, Artificial Sequence
  Synthetic
gccaagcatttaggtgacactatagagtttcaaatagggcaatgagtttcagagctatgctggaaacagc

SEQ ID NO: 52538 - DNA, 70 bp, Artificial Sequence
  Synthetic
gccaagcatttaggtgacactatagtatagagacaagggccaaaggtttcagagctatgctggaaacagc

SEQ ID NO: 52539 - DNA, 70 bp, Artificial Sequence
  Synthetic
gccaagcatttaggtgacactatagaagattccgggaaactatgggtttcagagctatgctggaaacagc

SEQ ID NO: 52540 - DNA, 70 bp, Artificial Sequence
  Synthetic
gccaagcatttaggtgacactatagtgtgcagctgagatttcctcgtttcagagctatgctggaaacagc

SEQ ID NO: 52541 - DNA, 70 bp, Artificial Sequence
  Synthetic
gccaagcatttaggtgacactatagccagagtcaagctggctctcgtttcagagctatgctggaaacagc

SEQ ID NO: 52542 - DNA, 70 bp, Artificial Sequence
  Synthetic
gccaagcatttaggtgacactatagctgtggcactggtcaatttcgtttcagagctatgctggaaacagc

SEQ ID NO: 52543 - DNA, 70 bp, Artificial Sequence
  Synthetic
gccaagcatttaggtgacactatagattaggggtgttgcagtactgtttcagagctatgctggaaacagc

SEQ ID NO: 52544 - DNA, 70 bp, Artificial Sequence
  Synthetic
gccaagcatttaggtgacactatagtggagttttttcatgcattcgtttcagagctatgctggaaacagc

SEQ ID NO: 52545 - DNA, 70 bp, Artificial Sequence
  Synthetic
gccaagcatttaggtgacactatagtgcttgaaactgctctgtttgtttcagagctatgctggaaacagc

SEQ ID NO: 52546 - DNA, 70 bp, Artificial Sequence
  Synthetic
gccaagcatttaggtgacactatagaatcacagccgggatcagcggtttcagagctatgctggaaacagc

SEQ ID NO: 52547 - DNA, 70 bp, Artificial Sequence
  Synthetic
gccaagcatttaggtgacactatagatggcttgcctgtctctctggtttcagagctatgctggaaacagc

SEQ ID NO: 52548 - DNA, 70 bp, Artificial Sequence
  Synthetic
gccaagcatttaggtgacactataggggacatcgctaagtactaggtttcagagctatgctggaaacagc

SEQ ID NO: 52549 - DNA, 70 bp, Artificial Sequence
  Synthetic
gccaagcatttaggtgacactataggaagctgagatgttcaacttgtttcagagctatgctggaaacagc

SEQ ID NO: 52550 - DNA, 70 bp, Artificial Sequence
  Synthetic
gccaagcatttaggtgacactataggaccagaggctttagacacggtttcagagctatgctggaaacagc

SEQ ID NO: 52551 - DNA, 70 bp, Artificial Sequence
  Synthetic
gccaagcatttaggtgacactataggccagggagctctcagaccggtttcagagctatgctggaaacagc

SEQ ID NO: 52552 - DNA, 70 bp, Artificial Sequence
  Synthetic
gccaagcatttaggtgacactataggccaggcgtcactgagactggtttcagagctatgctggaaacagc

SEQ ID NO: 52553 - DNA, 70 bp, Artificial Sequence
  Synthetic
gccaagcatttaggtgacactatagtcttttgcctgaagcaacgagtttcagagctatgctggaaacagc

SEQ ID NO: 52554 - DNA, 70 bp, Artificial Sequence
  Synthetic
gccaagcatttaggtgacactatagtgatgctcctgtcccacgtcgtttcagagctatgctggaaacagc

SEQ ID NO: 52555 - DNA, 70 bp, Artificial Sequence
  Synthetic
gccaagcatttaggtgacactatagtgtcccacgtcaggcatgcggtttcagagctatgctggaaacagc

SEQ ID NO: 52556 - DNA, 70 bp, Artificial Sequence
  Synthetic
gccaagcatttaggtgacactatagggcctacaatactggagttagtttcagagctatgctggaaacagc

SEQ ID NO: 52557 - DNA, 70 bp, Artificial Sequence
  Synthetic
gccaagcatttaggtgacactatagcaggactctacccaaagaatgtttcagagctatgctggaaacagc

SEQ ID NO: 52558 - DNA, 70 bp, Artificial Sequence
  Synthetic
gccaagcatttaggtgacactatagatgaagagctgagtgcctgcgtttcagagctatgctggaaacagc

SEQ ID NO: 52559 - DNA, 70 bp, Artificial Sequence
  Synthetic
gccaagcatttaggtgacactatagcaaggaatgggtgtgtttgtgtttcagagctatgctggaaacagc

SEQ ID NO: 52560 - DNA, 70 bp, Artificial Sequence
  Synthetic
gccaagcatttaggtgacactatagctcgaggccatgatggactggtttcagagctatgctggaaacagc

SEQ ID NO: 52561 - DNA, 70 bp, Artificial Sequence
  Synthetic
gccaagcatttaggtgacactataggctccaagccagatgttacagtttcagagctatgctggaaacagc

SEQ ID NO: 52562 - DNA, 70 bp, Artificial Sequence
  Synthetic
gccaagcatttaggtgacactataggggagcttttagtcagacctgtttcagagctatgctggaaacagc

SEQ ID NO: 52563 - DNA, 70 bp, Artificial Sequence
  Synthetic
gccaagcatttaggtgacactatagccctgcccggcgcaaagcttgtttcagagctatgctggaaacagc

SEQ ID NO: 52564 - DNA, 70 bp, Artificial Sequence
  Synthetic
gccaagcatttaggtgacactatagggctcctgtacacatcacatgtttcagagctatgctggaaacagc

SEQ ID NO: 52565 - DNA, 70 bp, Artificial Sequence
  Synthetic
gccaagcatttaggtgacactatagcaaggacaagggcagctcctgtttcagagctatgctggaaacagc

SEQ ID NO: 52566 - DNA, 70 bp, Artificial Sequence
  Synthetic
gccaagcatttaggtgacactatagtgcggctatgtcatcgcctggtttcagagctatgctggaaacagc

SEQ ID NO: 52567 - DNA, 70 bp, Artificial Sequence
  Synthetic
gccaagcatttaggtgacactataggaattctcatcatcagcttcgtttcagagctatgctggaaacagc

SEQ ID NO: 52568 - DNA, 70 bp, Artificial Sequence
  Synthetic
gccaagcatttaggtgacactatagtcacacagaagaaaggagttgtttcagagctatgctggaaacagc

SEQ ID NO: 52569 - DNA, 70 bp, Artificial Sequence
  Synthetic
gccaagcatttaggtgacactataggggagctgcatttacagatggtttcagagctatgctggaaacagc

SEQ ID NO: 52570 - DNA, 70 bp, Artificial Sequence
  Synthetic
gccaagcatttaggtgacactatagttttgaccttgatgactactgtttcagagctatgctggaaacagc

SEQ ID NO: 52571 - DNA, 70 bp, Artificial Sequence
  Synthetic
gccaagcatttaggtgacactatagattttccaagtggcagattagtttcagagctatgctggaaacagc

SEQ ID NO: 52572 - DNA, 70 bp, Artificial Sequence
  Synthetic
gccaagcatttaggtgacactatagccaagctgaaggagattggggtttcagagctatgctggaaacagc

SEQ ID NO: 52573 - DNA, 70 bp, Artificial Sequence
  Synthetic
gccaagcatttaggtgacactatagctgacaacaagcacagtgtggtttcagagctatgctggaaacagc

SEQ ID NO: 52574 - DNA, 70 bp, Artificial Sequence
  Synthetic
gccaagcatttaggtgacactatagggaggaggacctgcttacaagtttcagagctatgctggaaacagc

SEQ ID NO: 52575 - DNA, 70 bp, Artificial Sequence
  Synthetic
gccaagcatttaggtgacactatagtcatagctctgtatttcctagtttcagagctatgctggaaacagc

SEQ ID NO: 52576 - DNA, 70 bp, Artificial Sequence
  Synthetic
gccaagcatttaggtgacactatagacagaagtgagatcaggcaggtttcagagctatgctggaaacagc

SEQ ID NO: 52577 - DNA, 70 bp, Artificial Sequence
  Synthetic
gccaagcatttaggtgacactatagacttttaatgcagtaacctcgtttcagagctatgctggaaacagc

SEQ ID NO: 52578 - DNA, 70 bp, Artificial Sequence
  Synthetic
gccaagcatttaggtgacactatagtaaccggctgcagagggtcagtttcagagctatgctggaaacagc

SEQ ID NO: 52579 - DNA, 70 bp, Artificial Sequence
  Synthetic
gccaagcatttaggtgacactatagcctgaggaaatcaaagtcgagtttcagagctatgctggaaacagc

SEQ ID NO: 52580 - DNA, 70 bp, Artificial Sequence
  Synthetic
gccaagcatttaggtgacactataggatggggtggctggtcacttgtttcagagctatgctggaaacagc

SEQ ID NO: 52581 - DNA, 70 bp, Artificial Sequence
  Synthetic
gccaagcatttaggtgacactatagcacattcactgctcagtaaggtttcagagctatgctggaaacagc

SEQ ID NO: 52582 - DNA, 70 bp, Artificial Sequence
  Synthetic
gccaagcatttaggtgacactatagagccagatgccgacgagtgagtttcagagctatgctggaaacagc

SEQ ID NO: 52583 - DNA, 70 bp, Artificial Sequence
  Synthetic
gccaagcatttaggtgacactatagcagcccgacacggaggactggtttcagagctatgctggaaacagc

SEQ ID NO: 52584 - DNA, 70 bp, Artificial Sequence
  Synthetic
gccaagcatttaggtgacactatagaacccccacccctacaacgagtttcagagctatgctggaaacagc

SEQ ID NO: 52585 - DNA, 70 bp, Artificial Sequence
  Synthetic
gccaagcatttaggtgacactataggactgtgcgggaggcggacggtttcagagctatgctggaaacagc

SEQ ID NO: 52586 - DNA, 70 bp, Artificial Sequence
  Synthetic
gccaagcatttaggtgacactatagcagctgctgttgccaagcccgtttcagagctatgctggaaacagc

SEQ ID NO: 52587 - DNA, 70 bp, Artificial Sequence
  Synthetic
gccaagcatttaggtgacactatagttcatcaacattcggtcaaggtttcagagctatgctggaaacagc

SEQ ID NO: 52588 - DNA, 70 bp, Artificial Sequence
  Synthetic
gccaagcatttaggtgacactatagaccttcctctctagttaagggtttcagagctatgctggaaacagc

SEQ ID NO: 52589 - DNA, 70 bp, Artificial Sequence
  Synthetic
gccaagcatttaggtgacactatagctagtaagagtagccaccctgtttcagagctatgctggaaacagc

SEQ ID NO: 52590 - DNA, 70 bp, Artificial Sequence
  Synthetic
gccaagcatttaggtgacactatagaacttagtaagcaaagccttgtttcagagctatgctggaaacagc

SEQ ID NO: 52591 - DNA, 70 bp, Artificial Sequence
  Synthetic
gccaagcatttaggtgacactatagaccaagaagatgaatgctgagtttcagagctatgctggaaacagc

SEQ ID NO: 52592 - DNA, 70 bp, Artificial Sequence
  Synthetic
gccaagcatttaggtgacactataggccagaaatctctccgtgaggtttcagagctatgctggaaacagc

SEQ ID NO: 52593 - DNA, 70 bp, Artificial Sequence
  Synthetic
gccaagcatttaggtgacactatagttttggctatttggggtcacgtttcagagctatgctggaaacagc

SEQ ID NO: 52594 - DNA, 70 bp, Artificial Sequence
  Synthetic
gccaagcatttaggtgacactatagagcctgaatcgctactattagtttcagagctatgctggaaacagc

SEQ ID NO: 52595 - DNA, 70 bp, Artificial Sequence
  Synthetic
gccaagcatttaggtgacactatagccgcatgcactattactgatgtttcagagctatgctggaaacagc

SEQ ID NO: 52596 - DNA, 70 bp, Artificial Sequence
  Synthetic
gccaagcatttaggtgacactatagcatgtggttttcagtagaacgtttcagagctatgctggaaacagc

SEQ ID NO: 52597 - DNA, 70 bp, Artificial Sequence
  Synthetic
gccaagcatttaggtgacactatagaaagtgaagctggggacagtgtttcagagctatgctggaaacagc

SEQ ID NO: 52598 - DNA, 70 bp, Artificial Sequence
  Synthetic
gccaagcatttaggtgacactatagacatagagacacagggaagggtttcagagctatgctggaaacagc

SEQ ID NO: 52599 - DNA, 70 bp, Artificial Sequence
  Synthetic
gccaagcatttaggtgacactatagggccatgagggccttgggcagtttcagagctatgctggaaacagc

SEQ ID NO: 52600 - DNA, 70 bp, Artificial Sequence
  Synthetic
gccaagcatttaggtgacactatagagggaaagaaaagatgaagagtttcagagctatgctggaaacagc

SEQ ID NO: 52601 - DNA, 70 bp, Artificial Sequence
  Synthetic
gccaagcatttaggtgacactatagatttataacagttctgcagggtttcagagctatgctggaaacagc

SEQ ID NO: 52602 - DNA, 70 bp, Artificial Sequence
  Synthetic
gccaagcatttaggtgacactatagacaatgtggattccatcaaagtttcagagctatgctggaaacagc

SEQ ID NO: 52603 - DNA, 70 bp, Artificial Sequence
  Synthetic
gccaagcatttaggtgacactatagtcacagtgatggtcagacaggtttcagagctatgctggaaacagc

SEQ ID NO: 52604 - DNA, 70 bp, Artificial Sequence
  Synthetic
gccaagcatttaggtgacactatagagccagggtctggacaactggtttcagagctatgctggaaacagc

SEQ ID NO: 52605 - DNA, 70 bp, Artificial Sequence
  Synthetic
gccaagcatttaggtgacactatagtgggatcagcaccacgtaaggtttcagagctatgctggaaacagc

SEQ ID NO: 52606 - DNA, 70 bp, Artificial Sequence
  Synthetic
gccaagcatttaggtgacactatagccgcgctcccttcgctgacagtttcagagctatgctggaaacagc

SEQ ID NO: 52607 - DNA, 70 bp, Artificial Sequence
  Synthetic
gccaagcatttaggtgacactatagcccttcatgcagagtcaatggtttcagagctatgctggaaacagc

SEQ ID NO: 52608 - DNA, 70 bp, Artificial Sequence
  Synthetic
gccaagcatttaggtgacactatagggtgcccctcactagataaggtttcagagctatgctggaaacagc

SEQ ID NO: 52609 - DNA, 70 bp, Artificial Sequence
  Synthetic
gccaagcatttaggtgacactatagcccgccggaccagagggacggtttcagagctatgctggaaacagc

SEQ ID NO: 52610 - DNA, 70 bp, Artificial Sequence
  Synthetic
gccaagcatttaggtgacactatagccggcagcataatgaaaagtgtttcagagctatgctggaaacagc

SEQ ID NO: 52611 - DNA, 70 bp, Artificial Sequence
  Synthetic
gccaagcatttaggtgacactataggcggggtctctgcatctagtgtttcagagctatgctggaaacagc

SEQ ID NO: 52612 - DNA, 70 bp, Artificial Sequence
  Synthetic
gccaagcatttaggtgacactatagctctagggcagatttagaaagtttcagagctatgctggaaacagc

SEQ ID NO: 52613 - DNA, 70 bp, Artificial Sequence
  Synthetic
gccaagcatttaggtgacactatagaaagcagctatcaagacagcgtttcagagctatgctggaaacagc

SEQ ID NO: 52614 - DNA, 70 bp, Artificial Sequence
  Synthetic
gccaagcatttaggtgacactatagagcagttaactcttttcactgtttcagagctatgctggaaacagc

SEQ ID NO: 52615 - DNA, 70 bp, Artificial Sequence
  Synthetic
gccaagcatttaggtgacactatagattgtctggctgtcctcagagtttcagagctatgctggaaacagc

SEQ ID NO: 52616 - DNA, 70 bp, Artificial Sequence
  Synthetic
gccaagcatttaggtgacactatagaatgagctctggaaaaacttgtttcagagctatgctggaaacagc

SEQ ID NO: 52617 - DNA, 70 bp, Artificial Sequence
  Synthetic
gccaagcatttaggtgacactatagttgcagcagtctgcatttacgtttcagagctatgctggaaacagc

SEQ ID NO: 52618 - DNA, 70 bp, Artificial Sequence
  Synthetic
gccaagcatttaggtgacactatagtggagtgctcagctctacacgtttcagagctatgctggaaacagc

SEQ ID NO: 52619 - DNA, 70 bp, Artificial Sequence
  Synthetic
gccaagcatttaggtgacactatagtcttctttcacaaggtttaggtttcagagctatgctggaaacagc

SEQ ID NO: 52620 - DNA, 70 bp, Artificial Sequence
  Synthetic
gccaagcatttaggtgacactatagtgtggtacacagcttcagaggtttcagagctatgctggaaacagc

SEQ ID NO: 52621 - DNA, 70 bp, Artificial Sequence
  Synthetic
gccaagcatttaggtgacactatagtcatggttgaagaagctgctgtttcagagctatgctggaaacagc

SEQ ID NO: 52622 - DNA, 70 bp, Artificial Sequence
  Synthetic
gccaagcatttaggtgacactatagcggaggctacttgagcagctgtttcagagctatgctggaaacagc

SEQ ID NO: 52623 - DNA, 70 bp, Artificial Sequence
  Synthetic
gccaagcatttaggtgacactatagtggtttattctgcgagcagcgtttcagagctatgctggaaacagc

SEQ ID NO: 52624 - DNA, 70 bp, Artificial Sequence
  Synthetic
gccaagcatttaggtgacactataggacctcgggcccagcgctgagtttcagagctatgctggaaacagc

SEQ ID NO: 52625 - DNA, 70 bp, Artificial Sequence
  Synthetic
gccaagcatttaggtgacactatagagccagagagaactagacgcgtttcagagctatgctggaaacagc

SEQ ID NO: 52626 - DNA, 70 bp, Artificial Sequence
  Synthetic
gccaagcatttaggtgacactatagaagataactaccgtttagcagtttcagagctatgctggaaacagc

SEQ ID NO: 52627 - DNA, 70 bp, Artificial Sequence
  Synthetic
gccaagcatttaggtgacactatagagtcggagtggagaactgcagtttcagagctatgctggaaacagc

SEQ ID NO: 52628 - DNA, 70 bp, Artificial Sequence
  Synthetic
gccaagcatttaggtgacactatagctcagctgaagtgtcgagcagtttcagagctatgctggaaacagc

SEQ ID NO: 52629 - DNA, 70 bp, Artificial Sequence
  Synthetic
gccaagcatttaggtgacactatagcatgtgaggtctacatgtgcgtttcagagctatgctggaaacagc

SEQ ID NO: 52630 - DNA, 70 bp, Artificial Sequence
  Synthetic
gccaagcatttaggtgacactatagcagcagccaccactcatgaagtttcagagctatgctggaaacagc

SEQ ID NO: 52631 - DNA, 70 bp, Artificial Sequence
  Synthetic
gccaagcatttaggtgacactatagagcagggtcagagcagtcacgtttcagagctatgctggaaacagc

SEQ ID NO: 52632 - DNA, 70 bp, Artificial Sequence
  Synthetic
gccaagcatttaggtgacactatagctagcagcaggctcaggcaggtttcagagctatgctggaaacagc

SEQ ID NO: 52633 - DNA, 70 bp, Artificial Sequence
  Synthetic
gccaagcatttaggtgacactatagtctctgccctggtctcatgagtttcagagctatgctggaaacagc

SEQ ID NO: 52634 - DNA, 70 bp, Artificial Sequence
  Synthetic
gccaagcatttaggtgacactatagtcctgaaagtacaacatcaggtttcagagctatgctggaaacagc

SEQ ID NO: 52635 - DNA, 70 bp, Artificial Sequence
  Synthetic
gccaagcatttaggtgacactatagactaggatggctttcttatcgtttcagagctatgctggaaacagc

SEQ ID NO: 52636 - DNA, 70 bp, Artificial Sequence
  Synthetic
gccaagcatttaggtgacactatagactgaaaaagacaaggttgtgtttcagagctatgctggaaacagc

SEQ ID NO: 52637 - DNA, 70 bp, Artificial Sequence
  Synthetic
gccaagcatttaggtgacactatagttcttaggtctgcaagaattgtttcagagctatgctggaaacagc

SEQ ID NO: 52638 - DNA, 70 bp, Artificial Sequence
  Synthetic
gccaagcatttaggtgacactataggtcttccaggactatctctggtttcagagctatgctggaaacagc

SEQ ID NO: 52639 - DNA, 70 bp, Artificial Sequence
  Synthetic
gccaagcatttaggtgacactatagttggaacaggagggataagggtttcagagctatgctggaaacagc

SEQ ID NO: 52640 - DNA, 70 bp, Artificial Sequence
  Synthetic
gccaagcatttaggtgacactatagatatcaactttctgccaatcgtttcagagctatgctggaaacagc

SEQ ID NO: 52641 - DNA, 70 bp, Artificial Sequence
  Synthetic
gccaagcatttaggtgacactatagtcctgtatgatttcacaatcgtttcagagctatgctggaaacagc

SEQ ID NO: 52642 - DNA, 70 bp, Artificial Sequence
  Synthetic
gccaagcatttaggtgacactatagtgaggcctctatcttgctgggtttcagagctatgctggaaacagc

SEQ ID NO: 52643 - DNA, 70 bp, Artificial Sequence
  Synthetic
gccaagcatttaggtgacactatagaggcgttactccaagagctggtttcagagctatgctggaaacagc

SEQ ID NO: 52644 - DNA, 70 bp, Artificial Sequence
  Synthetic
gccaagcatttaggtgacactatagtcaggcttctggttcagggcgtttcagagctatgctggaaacagc

SEQ ID NO: 52645 - DNA, 70 bp, Artificial Sequence
  Synthetic
gccaagcatttaggtgacactataggttgatgtgcaaatcatcccgtttcagagctatgctggaaacagc

SEQ ID NO: 52646 - DNA, 70 bp, Artificial Sequence
  Synthetic
gccaagcatttaggtgacactatagaaatgtggtggctgtttattgtttcagagctatgctggaaacagc

SEQ ID NO: 52647 - DNA, 70 bp, Artificial Sequence
  Synthetic
gccaagcatttaggtgacactatagtgctttttcttgttttgcacgtttcagagctatgctggaaacagc

SEQ ID NO: 52648 - DNA, 70 bp, Artificial Sequence
  Synthetic
gccaagcatttaggtgacactataggacaaagagtcagaactgtggtttcagagctatgctggaaacagc

SEQ ID NO: 52649 - DNA, 70 bp, Artificial Sequence
  Synthetic
gccaagcatttaggtgacactatagcgagacattgagcgactttggtttcagagctatgctggaaacagc

SEQ ID NO: 52650 - DNA, 70 bp, Artificial Sequence
  Synthetic
gccaagcatttaggtgacactataggtttcataagctgccaatgtgtttcagagctatgctggaaacagc

SEQ ID NO: 52651 - DNA, 70 bp, Artificial Sequence
  Synthetic
gccaagcatttaggtgacactatagagcctggagaagccctaggggtttcagagctatgctggaaacagc

SEQ ID NO: 52652 - DNA, 70 bp, Artificial Sequence
  Synthetic
gccaagcatttaggtgacactatagtggcatatggaaaaccaaacgtttcagagctatgctggaaacagc

SEQ ID NO: 52653 - DNA, 70 bp, Artificial Sequence
  Synthetic
gccaagcatttaggtgacactatagagtgcttcaagttcatctaggtttcagagctatgctggaaacagc

SEQ ID NO: 52654 - DNA, 70 bp, Artificial Sequence
  Synthetic
gccaagcatttaggtgacactatagaaagtgccgagcgctgttacgtttcagagctatgctggaaacagc

SEQ ID NO: 52655 - DNA, 70 bp, Artificial Sequence
  Synthetic
gccaagcatttaggtgacactatagggagctggagtatttatagcgtttcagagctatgctggaaacagc

SEQ ID NO: 52656 - DNA, 70 bp, Artificial Sequence
  Synthetic
gccaagcatttaggtgacactatagatactcttcatccagttaaggtttcagagctatgctggaaacagc

SEQ ID NO: 52657 - DNA, 70 bp, Artificial Sequence
  Synthetic
gccaagcatttaggtgacactataggaaaatcaagctctaaagccgtttcagagctatgctggaaacagc

SEQ ID NO: 52658 - DNA, 70 bp, Artificial Sequence
  Synthetic
gccaagcatttaggtgacactatagaatactctaattccagtgctgtttcagagctatgctggaaacagc

SEQ ID NO: 52659 - DNA, 70 bp, Artificial Sequence
  Synthetic
gccaagcatttaggtgacactatagatgggctggcaacatgtatcgtttcagagctatgctggaaacagc

SEQ ID NO: 52660 - DNA, 70 bp, Artificial Sequence
  Synthetic
gccaagcatttaggtgacactatagtgatggagatgaacaaaatggtttcagagctatgctggaaacagc

SEQ ID NO: 52661 - DNA, 70 bp, Artificial Sequence
  Synthetic
gccaagcatttaggtgacactatagttcttacgataaatcccaccgtttcagagctatgctggaaacagc

SEQ ID NO: 52662 - DNA, 70 bp, Artificial Sequence
  Synthetic
gccaagcatttaggtgacactataggtggggcctgggagggctaagtttcagagctatgctggaaacagc

SEQ ID NO: 52663 - DNA, 70 bp, Artificial Sequence
  Synthetic
gccaagcatttaggtgacactataggaggaggtagcagatgtcaagtttcagagctatgctggaaacagc

SEQ ID NO: 52664 - DNA, 70 bp, Artificial Sequence
  Synthetic
gccaagcatttaggtgacactatagggtcctggcctggctgttacgtttcagagctatgctggaaacagc

SEQ ID NO: 52665 - DNA, 70 bp, Artificial Sequence
  Synthetic
gccaagcatttaggtgacactatagaggcaggcgccacgttcatggtttcagagctatgctggaaacagc

SEQ ID NO: 52666 - DNA, 70 bp, Artificial Sequence
  Synthetic
gccaagcatttaggtgacactatagtgagtgggatctcactttaagtttcagagctatgctggaaacagc

SEQ ID NO: 52667 - DNA, 70 bp, Artificial Sequence
  Synthetic
gccaagcatttaggtgacactatagaaaactcaagcagtgtgaatgtttcagagctatgctggaaacagc

SEQ ID NO: 52668 - DNA, 70 bp, Artificial Sequence
  Synthetic
gccaagcatttaggtgacactataggagccgaccaggctcacaccgtttcagagctatgctggaaacagc

SEQ ID NO: 52669 - DNA, 70 bp, Artificial Sequence
  Synthetic
gccaagcatttaggtgacactataggtccctgagcaatcaggaaagtttcagagctatgctggaaacagc

SEQ ID NO: 52670 - DNA, 70 bp, Artificial Sequence
  Synthetic
gccaagcatttaggtgacactatagcagcttcctgtgcattcacagtttcagagctatgctggaaacagc

SEQ ID NO: 52671 - DNA, 70 bp, Artificial Sequence
  Synthetic
gccaagcatttaggtgacactatagttagaatgcaatgtgacagagtttcagagctatgctggaaacagc

SEQ ID NO: 52672 - DNA, 70 bp, Artificial Sequence
  Synthetic
gccaagcatttaggtgacactatagtgatcagtttggagagtagggtttcagagctatgctggaaacagc

SEQ ID NO: 52673 - DNA, 70 bp, Artificial Sequence
  Synthetic
gccaagcatttaggtgacactataggttattcaggttactagagcgtttcagagctatgctggaaacagc

SEQ ID NO: 52674 - DNA, 70 bp, Artificial Sequence
  Synthetic
gccaagcatttaggtgacactataggaggacctggaaaactcaatgtttcagagctatgctggaaacagc

SEQ ID NO: 52675 - DNA, 70 bp, Artificial Sequence
  Synthetic
gccaagcatttaggtgacactataggtaagcagtggagtgatttcgtttcagagctatgctggaaacagc

SEQ ID NO: 52676 - DNA, 70 bp, Artificial Sequence
  Synthetic
gccaagcatttaggtgacactatagccttccccactttgtgtcacgtttcagagctatgctggaaacagc

SEQ ID NO: 52677 - DNA, 70 bp, Artificial Sequence
  Synthetic
gccaagcatttaggtgacactatagccccactgaatgtttcataagtttcagagctatgctggaaacagc

SEQ ID NO: 52678 - DNA, 70 bp, Artificial Sequence
  Synthetic
gccaagcatttaggtgacactatagaggagtggggcagagctggagtttcagagctatgctggaaacagc

SEQ ID NO: 52679 - DNA, 70 bp, Artificial Sequence
  Synthetic
gccaagcatttaggtgacactataggcacttcgcctggaactcttgtttcagagctatgctggaaacagc

SEQ ID NO: 52680 - DNA, 70 bp, Artificial Sequence
  Synthetic
gccaagcatttaggtgacactataggggctgctgggctagggaaagtttcagagctatgctggaaacagc

SEQ ID NO: 52681 - DNA, 70 bp, Artificial Sequence
  Synthetic
gccaagcatttaggtgacactatagaggcacaggacctctactgagtttcagagctatgctggaaacagc

SEQ ID NO: 52682 - DNA, 70 bp, Artificial Sequence
  Synthetic
gccaagcatttaggtgacactatagaccatctccccctcaggacagtttcagagctatgctggaaacagc

SEQ ID NO: 52683 - DNA, 70 bp, Artificial Sequence
  Synthetic
gccaagcatttaggtgacactatagccggtatgtcaactggattagtttcagagctatgctggaaacagc

SEQ ID NO: 52684 - DNA, 70 bp, Artificial Sequence
  Synthetic
gccaagcatttaggtgacactatagggagttgtcactgcgtcttcgtttcagagctatgctggaaacagc

SEQ ID NO: 52685 - DNA, 70 bp, Artificial Sequence
  Synthetic
gccaagcatttaggtgacactatagctgaaaagcagtcatcctgagtttcagagctatgctggaaacagc

SEQ ID NO: 52686 - DNA, 70 bp, Artificial Sequence
  Synthetic
gccaagcatttaggtgacactatagctgtccaggaaagttttagggtttcagagctatgctggaaacagc

SEQ ID NO: 52687 - DNA, 70 bp, Artificial Sequence
  Synthetic
gccaagcatttaggtgacactatagagcctcatcctgctgtgaccgtttcagagctatgctggaaacagc

SEQ ID NO: 52688 - DNA, 70 bp, Artificial Sequence
  Synthetic
gccaagcatttaggtgacactatagaaagcacagaagacgtgacggtttcagagctatgctggaaacagc

SEQ ID NO: 52689 - DNA, 70 bp, Artificial Sequence
  Synthetic
gccaagcatttaggtgacactatagcacctgcctcagcctctcaagtttcagagctatgctggaaacagc

SEQ ID NO: 52690 - DNA, 70 bp, Artificial Sequence
  Synthetic
gccaagcatttaggtgacactatagctgccgagggggctgtcatggtttcagagctatgctggaaacagc

SEQ ID NO: 52691 - DNA, 70 bp, Artificial Sequence
  Synthetic
gccaagcatttaggtgacactataggccagaaggagttcgcccccgtttcagagctatgctggaaacagc

SEQ ID NO: 52692 - DNA, 70 bp, Artificial Sequence
  Synthetic
gccaagcatttaggtgacactataggggggcagcttaggagccaggtttcagagctatgctggaaacagc

SEQ ID NO: 52693 - DNA, 70 bp, Artificial Sequence
  Synthetic
gccaagcatttaggtgacactatagtgaatgaccctggcagtcaagtttcagagctatgctggaaacagc

SEQ ID NO: 52694 - DNA, 70 bp, Artificial Sequence
  Synthetic
gccaagcatttaggtgacactataggcctgcctcagcctctcaaagtttcagagctatgctggaaacagc

SEQ ID NO: 52695 - DNA, 70 bp, Artificial Sequence
  Synthetic
gccaagcatttaggtgacactatagccctgaggccagccctcaccgtttcagagctatgctggaaacagc

SEQ ID NO: 52696 - DNA, 70 bp, Artificial Sequence
  Synthetic
gccaagcatttaggtgacactataggacaatgtcacccaatgtcagtttcagagctatgctggaaacagc

SEQ ID NO: 52697 - DNA, 70 bp, Artificial Sequence
  Synthetic
gccaagcatttaggtgacactatagaactcagtctcaaactcttagtttcagagctatgctggaaacagc

SEQ ID NO: 52698 - DNA, 70 bp, Artificial Sequence
  Synthetic
gccaagcatttaggtgacactatagatgaaggagtagaagccaaagtttcagagctatgctggaaacagc

SEQ ID NO: 52699 - DNA, 70 bp, Artificial Sequence
  Synthetic
gccaagcatttaggtgacactatagcactcgcacttatgagaaaggtttcagagctatgctggaaacagc

SEQ ID NO: 52700 - DNA, 70 bp, Artificial Sequence
  Synthetic
gccaagcatttaggtgacactatagtgctctctcataaactctcggtttcagagctatgctggaaacagc

SEQ ID NO: 52701 - DNA, 70 bp, Artificial Sequence
  Synthetic
gccaagcatttaggtgacactatagtttttcatagatccgagtacgtttcagagctatgctggaaacagc

SEQ ID NO: 52702 - DNA, 70 bp, Artificial Sequence
  Synthetic
gccaagcatttaggtgacactatagtgagcgcgtgagcaagagacgtttcagagctatgctggaaacagc

SEQ ID NO: 52703 - DNA, 70 bp, Artificial Sequence
  Synthetic
gccaagcatttaggtgacactatagaaggaaggaaggaggaagaagtttcagagctatgctggaaacagc

SEQ ID NO: 52704 - DNA, 70 bp, Artificial Sequence
  Synthetic
gccaagcatttaggtgacactatagtgctgttcgccactatgagagtttcagagctatgctggaaacagc

SEQ ID NO: 52705 - DNA, 70 bp, Artificial Sequence
  Synthetic
gccaagcatttaggtgacactatagcagcaccagaatctacgaaagtttcagagctatgctggaaacagc

SEQ ID NO: 52706 - DNA, 70 bp, Artificial Sequence
  Synthetic
gccaagcatttaggtgacactatagtacctccgaagcgtcctgatgtttcagagctatgctggaaacagc

SEQ ID NO: 52707 - DNA, 70 bp, Artificial Sequence
  Synthetic
gccaagcatttaggtgacactatagggcagggtggctgttgttatgtttcagagctatgctggaaacagc

SEQ ID NO: 52708 - DNA, 70 bp, Artificial Sequence
  Synthetic
gccaagcatttaggtgacactatagggctgtggcttcatttgtgagtttcagagctatgctggaaacagc

SEQ ID NO: 52709 - DNA, 70 bp, Artificial Sequence
  Synthetic
gccaagcatttaggtgacactatagacgcctacctccatcagtgagtttcagagctatgctggaaacagc

SEQ ID NO: 52710 - DNA, 70 bp, Artificial Sequence
  Synthetic
gccaagcatttaggtgacactataggagcttgtggggctgtaatggtttcagagctatgctggaaacagc

SEQ ID NO: 52711 - DNA, 70 bp, Artificial Sequence
  Synthetic
gccaagcatttaggtgacactatagactcttttgcttcaaggaaagtttcagagctatgctggaaacagc

SEQ ID NO: 52712 - DNA, 70 bp, Artificial Sequence
  Synthetic
gccaagcatttaggtgacactatagaacttctgtgtggctgagtcgtttcagagctatgctggaaacagc

SEQ ID NO: 52713 - DNA, 70 bp, Artificial Sequence
  Synthetic
gccaagcatttaggtgacactataggagcagagaaaatctcatgagtttcagagctatgctggaaacagc

SEQ ID NO: 52714 - DNA, 70 bp, Artificial Sequence
  Synthetic
gccaagcatttaggtgacactatagtgtgagactacaggaatgaagtttcagagctatgctggaaacagc

SEQ ID NO: 52715 - DNA, 70 bp, Artificial Sequence
  Synthetic
gccaagcatttaggtgacactatagccctcagcttcccgtttctggtttcagagctatgctggaaacagc

SEQ ID NO: 52716 - DNA, 70 bp, Artificial Sequence
  Synthetic
gccaagcatttaggtgacactatagcgaggctggcatacacgggcgtttcagagctatgctggaaacagc

SEQ ID NO: 52717 - DNA, 70 bp, Artificial Sequence
  Synthetic
gccaagcatttaggtgacactatagagtcactgggcccatcacaagtttcagagctatgctggaaacagc

SEQ ID NO: 52718 - DNA, 70 bp, Artificial Sequence
  Synthetic
gccaagcatttaggtgacactatagtcatcaacaaggtggtgtgagtttcagagctatgctggaaacagc

SEQ ID NO: 52719 - DNA, 70 bp, Artificial Sequence
  Synthetic
gccaagcatttaggtgacactataggtagtgggaagcggaaagaagtttcagagctatgctggaaacagc

SEQ ID NO: 52720 - DNA, 70 bp, Artificial Sequence
  Synthetic
gccaagcatttaggtgacactatagtttggcactaaccgagaatggtttcagagctatgctggaaacagc

SEQ ID NO: 52721 - DNA, 70 bp, Artificial Sequence
  Synthetic
gccaagcatttaggtgacactatagcccggacacctgctcctcaagtttcagagctatgctggaaacagc

SEQ ID NO: 52722 - DNA, 70 bp, Artificial Sequence
  Synthetic
gccaagcatttaggtgacactataggcagtcatcatcttccaaatgtttcagagctatgctggaaacagc

SEQ ID NO: 52723 - DNA, 70 bp, Artificial Sequence
  Synthetic
gccaagcatttaggtgacactatagttctatcagtagtaaccgtagtttcagagctatgctggaaacagc

SEQ ID NO: 52724 - DNA, 70 bp, Artificial Sequence
  Synthetic
gccaagcatttaggtgacactatagctgccggcacatcatgtcaggtttcagagctatgctggaaacagc

SEQ ID NO: 52725 - DNA, 70 bp, Artificial Sequence
  Synthetic
gccaagcatttaggtgacactataggtctggctcaagctgccttcgtttcagagctatgctggaaacagc

SEQ ID NO: 52726 - DNA, 70 bp, Artificial Sequence
  Synthetic
gccaagcatttaggtgacactataggtgtgcacttcagacttagtgtttcagagctatgctggaaacagc

SEQ ID NO: 52727 - DNA, 70 bp, Artificial Sequence
  Synthetic
gccaagcatttaggtgacactatagtcaacagcctgcagcagcgagtttcagagctatgctggaaacagc

SEQ ID NO: 52728 - DNA, 70 bp, Artificial Sequence
  Synthetic
gccaagcatttaggtgacactatagtcaatacttcacagcagggagtttcagagctatgctggaaacagc

SEQ ID NO: 52729 - DNA, 70 bp, Artificial Sequence
  Synthetic
gccaagcatttaggtgacactatagccccagcggacttaaaagacgtttcagagctatgctggaaacagc

SEQ ID NO: 52730 - DNA, 70 bp, Artificial Sequence
  Synthetic
gccaagcatttaggtgacactatagtgtaataggcacagaacgttgtttcagagctatgctggaaacagc

SEQ ID NO: 52731 - DNA, 70 bp, Artificial Sequence
  Synthetic
gccaagcatttaggtgacactatagagcgaagagagagagctgtagtttcagagctatgctggaaacagc

SEQ ID NO: 52732 - DNA, 70 bp, Artificial Sequence
  Synthetic
gccaagcatttaggtgacactatagcgcccaagcccaggagtcctgtttcagagctatgctggaaacagc

SEQ ID NO: 52733 - DNA, 70 bp, Artificial Sequence
  Synthetic
gccaagcatttaggtgacactatagctggagcagaaaatgacatcgtttcagagctatgctggaaacagc

SEQ ID NO: 52734 - DNA, 70 bp, Artificial Sequence
  Synthetic
gccaagcatttaggtgacactataggggggatgcaggctctgagagtttcagagctatgctggaaacagc

SEQ ID NO: 52735 - DNA, 70 bp, Artificial Sequence
  Synthetic
gccaagcatttaggtgacactatagcaaaatgtgaggaacaggatgtttcagagctatgctggaaacagc

SEQ ID NO: 52736 - DNA, 70 bp, Artificial Sequence
  Synthetic
gccaagcatttaggtgacactataggagcccagcagctgaaggctgtttcagagctatgctggaaacagc

SEQ ID NO: 52737 - DNA, 70 bp, Artificial Sequence
  Synthetic
gccaagcatttaggtgacactatagtccacgcactgtcttacacagtttcagagctatgctggaaacagc

SEQ ID NO: 52738 - DNA, 70 bp, Artificial Sequence
  Synthetic
gccaagcatttaggtgacactatagttcaagaagtcttcatcatcgtttcagagctatgctggaaacagc

SEQ ID NO: 52739 - DNA, 70 bp, Artificial Sequence
  Synthetic
gccaagcatttaggtgacactataggagccgcggcggtcacacctgtttcagagctatgctggaaacagc

SEQ ID NO: 52740 - DNA, 70 bp, Artificial Sequence
  Synthetic
gccaagcatttaggtgacactatagtgtagaaatgatgagtgatggtttcagagctatgctggaaacagc

SEQ ID NO: 52741 - DNA, 70 bp, Artificial Sequence
  Synthetic
gccaagcatttaggtgacactatagagatcatcagattgaacccagtttcagagctatgctggaaacagc

SEQ ID NO: 52742 - DNA, 70 bp, Artificial Sequence
  Synthetic
gccaagcatttaggtgacactatagaagcagaatgacaagggagggtttcagagctatgctggaaacagc

SEQ ID NO: 52743 - DNA, 70 bp, Artificial Sequence
  Synthetic
gccaagcatttaggtgacactatagacaattgagtaatgtgctaggtttcagagctatgctggaaacagc

SEQ ID NO: 52744 - DNA, 70 bp, Artificial Sequence
  Synthetic
gccaagcatttaggtgacactatagttgaaagcacagccgtgaccgtttcagagctatgctggaaacagc

SEQ ID NO: 52745 - DNA, 70 bp, Artificial Sequence
  Synthetic
gccaagcatttaggtgacactatagtcacacagacatgagctgcagtttcagagctatgctggaaacagc

SEQ ID NO: 52746 - DNA, 70 bp, Artificial Sequence
  Synthetic
gccaagcatttaggtgacactatagagagctccctgatggtctgagtttcagagctatgctggaaacagc

SEQ ID NO: 52747 - DNA, 70 bp, Artificial Sequence
  Synthetic
gccaagcatttaggtgacactatagaattgaggaagctgaaggatgtttcagagctatgctggaaacagc

SEQ ID NO: 52748 - DNA, 70 bp, Artificial Sequence
  Synthetic
gccaagcatttaggtgacactatagaagaggaagttagaagagaagtttcagagctatgctggaaacagc

SEQ ID NO: 52749 - DNA, 70 bp, Artificial Sequence
  Synthetic
gccaagcatttaggtgacactataggcagcacacagtgaaataaggtttcagagctatgctggaaacagc

SEQ ID NO: 52750 - DNA, 70 bp, Artificial Sequence
  Synthetic
gccaagcatttaggtgacactatagccgcagagaagctgctctgggtttcagagctatgctggaaacagc

SEQ ID NO: 52751 - DNA, 70 bp, Artificial Sequence
  Synthetic
gccaagcatttaggtgacactatagaaaatgcacaagagattacggtttcagagctatgctggaaacagc

SEQ ID NO: 52752 - DNA, 70 bp, Artificial Sequence
  Synthetic
gccaagcatttaggtgacactatagcaaaaggacaaaacacccatgtttcagagctatgctggaaacagc

SEQ ID NO: 52753 - DNA, 70 bp, Artificial Sequence
  Synthetic
gccaagcatttaggtgacactatagaagaatgatcttagtgttgggtttcagagctatgctggaaacagc

SEQ ID NO: 52754 - DNA, 70 bp, Artificial Sequence
  Synthetic
gccaagcatttaggtgacactatagatgagcatgaccagtggagagtttcagagctatgctggaaacagc

SEQ ID NO: 52755 - DNA, 70 bp, Artificial Sequence
  Synthetic
gccaagcatttaggtgacactatagaactgtggcacaacggaaaggtttcagagctatgctggaaacagc

SEQ ID NO: 52756 - DNA, 70 bp, Artificial Sequence
  Synthetic
gccaagcatttaggtgacactatagccatagggcagctcacaacagtttcagagctatgctggaaacagc

SEQ ID NO: 52757 - DNA, 70 bp, Artificial Sequence
  Synthetic
gccaagcatttaggtgacactatagcggtctcgctcccaggtaaagtttcagagctatgctggaaacagc

SEQ ID NO: 52758 - DNA, 70 bp, Artificial Sequence
  Synthetic
gccaagcatttaggtgacactatagttagacgaaagttcatctaggtttcagagctatgctggaaacagc

SEQ ID NO: 52759 - DNA, 70 bp, Artificial Sequence
  Synthetic
gccaagcatttaggtgacactatagtcagaaatggttaagtcactgtttcagagctatgctggaaacagc

SEQ ID NO: 52760 - DNA, 70 bp, Artificial Sequence
  Synthetic
gccaagcatttaggtgacactatagtcctgccttgaccagatgtggtttcagagctatgctggaaacagc

SEQ ID NO: 52761 - DNA, 70 bp, Artificial Sequence
  Synthetic
gccaagcatttaggtgacactatagcctgtgtcaccttctgatacgtttcagagctatgctggaaacagc

SEQ ID NO: 52762 - DNA, 70 bp, Artificial Sequence
  Synthetic
gccaagcatttaggtgacactatagattacatgcttgcaactttggtttcagagctatgctggaaacagc

SEQ ID NO: 52763 - DNA, 70 bp, Artificial Sequence
  Synthetic
gccaagcatttaggtgacactatagcatagtctcaaggtcagaaggtttcagagctatgctggaaacagc

SEQ ID NO: 52764 - DNA, 70 bp, Artificial Sequence
  Synthetic
gccaagcatttaggtgacactatagctacttccagctacttttgagtttcagagctatgctggaaacagc

SEQ ID NO: 52765 - DNA, 70 bp, Artificial Sequence
  Synthetic
gccaagcatttaggtgacactataggcccctttgatcaatggactgtttcagagctatgctggaaacagc

SEQ ID NO: 52766 - DNA, 70 bp, Artificial Sequence
  Synthetic
gccaagcatttaggtgacactatagtcctcttccaaaggaagcaggtttcagagctatgctggaaacagc

SEQ ID NO: 52767 - DNA, 70 bp, Artificial Sequence
  Synthetic
gccaagcatttaggtgacactatagccccggggataacgacatgggtttcagagctatgctggaaacagc

SEQ ID NO: 52768 - DNA, 70 bp, Artificial Sequence
  Synthetic
gccaagcatttaggtgacactataggactggtactatagtgtttggtttcagagctatgctggaaacagc

SEQ ID NO: 52769 - DNA, 70 bp, Artificial Sequence
  Synthetic
gccaagcatttaggtgacactatagccctgaggtcttcaccttctgtttcagagctatgctggaaacagc

SEQ ID NO: 52770 - DNA, 70 bp, Artificial Sequence
  Synthetic
gccaagcatttaggtgacactatagctccttcatctgcaagttcagtttcagagctatgctggaaacagc

SEQ ID NO: 52771 - DNA, 70 bp, Artificial Sequence
  Synthetic
gccaagcatttaggtgacactatagagagtaatgctaatactagggtttcagagctatgctggaaacagc

SEQ ID NO: 52772 - DNA, 70 bp, Artificial Sequence
  Synthetic
gccaagcatttaggtgacactataggaggatgtcaaaactacaccgtttcagagctatgctggaaacagc

SEQ ID NO: 52773 - DNA, 70 bp, Artificial Sequence
  Synthetic
gccaagcatttaggtgacactatagctgccctcagaggagtgaaagtttcagagctatgctggaaacagc

SEQ ID NO: 52774 - DNA, 70 bp, Artificial Sequence
  Synthetic
gccaagcatttaggtgacactatagaggggtgcagactgagttctgtttcagagctatgctggaaacagc

SEQ ID NO: 52775 - DNA, 70 bp, Artificial Sequence
  Synthetic
gccaagcatttaggtgacactatagtcaggaatatctcattgtctgtttcagagctatgctggaaacagc

SEQ ID NO: 52776 - DNA, 70 bp, Artificial Sequence
  Synthetic
gccaagcatttaggtgacactatagtgtgggtgaagattcagctcgtttcagagctatgctggaaacagc

SEQ ID NO: 52777 - DNA, 70 bp, Artificial Sequence
  Synthetic
gccaagcatttaggtgacactataggatgtgggtcactgttcctcgtttcagagctatgctggaaacagc

SEQ ID NO: 52778 - DNA, 70 bp, Artificial Sequence
  Synthetic
gccaagcatttaggtgacactatagtgggggaggaaactagttgtgtttcagagctatgctggaaacagc

SEQ ID NO: 52779 - DNA, 70 bp, Artificial Sequence
  Synthetic
gccaagcatttaggtgacactataggaggtgttctataactgagggtttcagagctatgctggaaacagc

SEQ ID NO: 52780 - DNA, 70 bp, Artificial Sequence
  Synthetic
gccaagcatttaggtgacactatagctggatcaagtcacaagtcagtttcagagctatgctggaaacagc

SEQ ID NO: 52781 - DNA, 70 bp, Artificial Sequence
  Synthetic
gccaagcatttaggtgacactatagtcttaatgttatggtgagtcgtttcagagctatgctggaaacagc

SEQ ID NO: 52782 - DNA, 70 bp, Artificial Sequence
  Synthetic
gccaagcatttaggtgacactatagatacagctgattcactcattgtttcagagctatgctggaaacagc

SEQ ID NO: 52783 - DNA, 70 bp, Artificial Sequence
  Synthetic
gccaagcatttaggtgacactataggactcaactacttcaagtaggtttcagagctatgctggaaacagc

SEQ ID NO: 52784 - DNA, 70 bp, Artificial Sequence
  Synthetic
gccaagcatttaggtgacactatagaaggaggctctcttatcaatgtttcagagctatgctggaaacagc

SEQ ID NO: 52785 - DNA, 70 bp, Artificial Sequence
  Synthetic
gccaagcatttaggtgacactatagtgattccaagtccatgtgaggtttcagagctatgctggaaacagc

SEQ ID NO: 52786 - DNA, 70 bp, Artificial Sequence
  Synthetic
gccaagcatttaggtgacactatagaacttcaagaagcctaagctgtttcagagctatgctggaaacagc

SEQ ID NO: 52787 - DNA, 70 bp, Artificial Sequence
  Synthetic
gccaagcatttaggtgacactataggatgtggccaaaactatttggtttcagagctatgctggaaacagc

SEQ ID NO: 52788 - DNA, 70 bp, Artificial Sequence
  Synthetic
gccaagcatttaggtgacactataggctgcaattttttgcaggaagtttcagagctatgctggaaacagc

SEQ ID NO: 52789 - DNA, 70 bp, Artificial Sequence
  Synthetic
gccaagcatttaggtgacactatagggtggtttcaagatgtcactgtttcagagctatgctggaaacagc

SEQ ID NO: 52790 - DNA, 70 bp, Artificial Sequence
  Synthetic
gccaagcatttaggtgacactatagcgaaccaggcagggaccatagtttcagagctatgctggaaacagc

SEQ ID NO: 52791 - DNA, 70 bp, Artificial Sequence
  Synthetic
gccaagcatttaggtgacactatagaaggacttgctggctcatgtgtttcagagctatgctggaaacagc

SEQ ID NO: 52792 - DNA, 70 bp, Artificial Sequence
  Synthetic
gccaagcatttaggtgacactatagtacagcctgactatttggacgtttcagagctatgctggaaacagc

SEQ ID NO: 52793 - DNA, 70 bp, Artificial Sequence
  Synthetic
gccaagcatttaggtgacactataggtggaatgtcctgaaatgttgtttcagagctatgctggaaacagc

SEQ ID NO: 52794 - DNA, 70 bp, Artificial Sequence
  Synthetic
gccaagcatttaggtgacactatagactcaaccaatgaggagtaagtttcagagctatgctggaaacagc

SEQ ID NO: 52795 - DNA, 70 bp, Artificial Sequence
  Synthetic
gccaagcatttaggtgacactatagactgtcactcttcccgtgtcgtttcagagctatgctggaaacagc

SEQ ID NO: 52796 - DNA, 70 bp, Artificial Sequence
  Synthetic
gccaagcatttaggtgacactataggctgctcaagcagtggttaggtttcagagctatgctggaaacagc

SEQ ID NO: 52797 - DNA, 70 bp, Artificial Sequence
  Synthetic
gccaagcatttaggtgacactatagtttatgggactggtccacatgtttcagagctatgctggaaacagc

SEQ ID NO: 52798 - DNA, 70 bp, Artificial Sequence
  Synthetic
gccaagcatttaggtgacactatagttgatgctgcatttgaattggtttcagagctatgctggaaacagc

SEQ ID NO: 52799 - DNA, 70 bp, Artificial Sequence
  Synthetic
gccaagcatttaggtgacactatagcaagatcttgggtgactttggtttcagagctatgctggaaacagc

SEQ ID NO: 52800 - DNA, 70 bp, Artificial Sequence
  Synthetic
gccaagcatttaggtgacactatagtggaagaaagttaaggattggtttcagagctatgctggaaacagc

SEQ ID NO: 52801 - DNA, 70 bp, Artificial Sequence
  Synthetic
gccaagcatttaggtgacactatagagatgttatttatggtgtgggtttcagagctatgctggaaacagc

SEQ ID NO: 52802 - DNA, 70 bp, Artificial Sequence
  Synthetic
gccaagcatttaggtgacactatagttgccttcatggtggtaagagtttcagagctatgctggaaacagc

SEQ ID NO: 52803 - DNA, 70 bp, Artificial Sequence
  Synthetic
gccaagcatttaggtgacactatagctccccagccccggaagggcgtttcagagctatgctggaaacagc

SEQ ID NO: 52804 - DNA, 70 bp, Artificial Sequence
  Synthetic
gccaagcatttaggtgacactatagctcttcttcactttcctcatgtttcagagctatgctggaaacagc

SEQ ID NO: 52805 - DNA, 70 bp, Artificial Sequence
  Synthetic
gccaagcatttaggtgacactataggcaagtgatacgagattttcgtttcagagctatgctggaaacagc

SEQ ID NO: 52806 - DNA, 70 bp, Artificial Sequence
  Synthetic
gccaagcatttaggtgacactatagatacctctgctactctgtttgtttcagagctatgctggaaacagc

SEQ ID NO: 52807 - DNA, 70 bp, Artificial Sequence
  Synthetic
gccaagcatttaggtgacactatagagaagctgcattggctgcacgtttcagagctatgctggaaacagc

SEQ ID NO: 52808 - DNA, 70 bp, Artificial Sequence
  Synthetic
gccaagcatttaggtgacactatagacgtctgtactaatagccctgtttcagagctatgctggaaacagc

SEQ ID NO: 52809 - DNA, 70 bp, Artificial Sequence
  Synthetic
gccaagcatttaggtgacactatagttacatacggacggctgacagtttcagagctatgctggaaacagc

SEQ ID NO: 52810 - DNA, 70 bp, Artificial Sequence
  Synthetic
gccaagcatttaggtgacactatagccaggctcgtggcagggatagtttcagagctatgctggaaacagc

SEQ ID NO: 52811 - DNA, 70 bp, Artificial Sequence
  Synthetic
gccaagcatttaggtgacactataggagggcctactggaaggaatgtttcagagctatgctggaaacagc

SEQ ID NO: 52812 - DNA, 70 bp, Artificial Sequence
  Synthetic
gccaagcatttaggtgacactatagacaaagagaaaatggtttgggtttcagagctatgctggaaacagc

SEQ ID NO: 52813 - DNA, 70 bp, Artificial Sequence
  Synthetic
gccaagcatttaggtgacactatagcatagttaggtaaaagacccgtttcagagctatgctggaaacagc

SEQ ID NO: 52814 - DNA, 70 bp, Artificial Sequence
  Synthetic
gccaagcatttaggtgacactatagccagaagcagctcttggcttgtttcagagctatgctggaaacagc

SEQ ID NO: 52815 - DNA, 70 bp, Artificial Sequence
  Synthetic
gccaagcatttaggtgacactatagcggaggttctctctctgctggtttcagagctatgctggaaacagc

SEQ ID NO: 52816 - DNA, 70 bp, Artificial Sequence
  Synthetic
gccaagcatttaggtgacactatagcggcgcttcaccctctgctggtttcagagctatgctggaaacagc

SEQ ID NO: 52817 - DNA, 70 bp, Artificial Sequence
  Synthetic
gccaagcatttaggtgacactatagggctgcaggctttaccagtggtttcagagctatgctggaaacagc

SEQ ID NO: 52818 - DNA, 70 bp, Artificial Sequence
  Synthetic
gccaagcatttaggtgacactatagtttgcaggtgatcaccactggtttcagagctatgctggaaacagc

SEQ ID NO: 52819 - DNA, 70 bp, Artificial Sequence
  Synthetic
gccaagcatttaggtgacactatagagaaagctaagctgacctgagtttcagagctatgctggaaacagc

SEQ ID NO: 52820 - DNA, 70 bp, Artificial Sequence
  Synthetic
gccaagcatttaggtgacactatagcgtctggagacgtcagggacgtttcagagctatgctggaaacagc

SEQ ID NO: 52821 - DNA, 70 bp, Artificial Sequence
  Synthetic
gccaagcatttaggtgacactatagtgtttcattctccaaaggacgtttcagagctatgctggaaacagc

SEQ ID NO: 52822 - DNA, 70 bp, Artificial Sequence
  Synthetic
gccaagcatttaggtgacactatagggtgctctcagcacagcagcgtttcagagctatgctggaaacagc

SEQ ID NO: 52823 - DNA, 70 bp, Artificial Sequence
  Synthetic
gccaagcatttaggtgacactatagttaatgttaaacgccatcaggtttcagagctatgctggaaacagc

SEQ ID NO: 52824 - DNA, 70 bp, Artificial Sequence
  Synthetic
gccaagcatttaggtgacactatagttgacgttgaacaccatcaggtttcagagctatgctggaaacagc

SEQ ID NO: 52825 - DNA, 70 bp, Artificial Sequence
  Synthetic
gccaagcatttaggtgacactatagtccccattggagttaatttagtttcagagctatgctggaaacagc

SEQ ID NO: 52826 - DNA, 70 bp, Artificial Sequence
  Synthetic
gccaagcatttaggtgacactatagcaagcacgaagagctgtaaggtttcagagctatgctggaaacagc

SEQ ID NO: 52827 - DNA, 70 bp, Artificial Sequence
  Synthetic
gccaagcatttaggtgacactatagtatcgtgtctaatactcagcgtttcagagctatgctggaaacagc

SEQ ID NO: 52828 - DNA, 70 bp, Artificial Sequence
  Synthetic
gccaagcatttaggtgacactatagagataccgcgcttggcgagagtttcagagctatgctggaaacagc

SEQ ID NO: 52829 - DNA, 70 bp, Artificial Sequence
  Synthetic
gccaagcatttaggtgacactatagtttatgcttgaatgggcagcgtttcagagctatgctggaaacagc

SEQ ID NO: 52830 - DNA, 70 bp, Artificial Sequence
  Synthetic
gccaagcatttaggtgacactatagacctttagaacaggatgatggtttcagagctatgctggaaacagc

SEQ ID NO: 52831 - DNA, 70 bp, Artificial Sequence
  Synthetic
gccaagcatttaggtgacactatagtgaagaggatgatgaagatggtttcagagctatgctggaaacagc

SEQ ID NO: 52832 - DNA, 70 bp, Artificial Sequence
  Synthetic
gccaagcatttaggtgacactatagttttatggtgggacagagacgtttcagagctatgctggaaacagc

SEQ ID NO: 52833 - DNA, 70 bp, Artificial Sequence
  Synthetic
gccaagcatttaggtgacactatagctggatgaggtgcttcactggtttcagagctatgctggaaacagc

SEQ ID NO: 52834 - DNA, 70 bp, Artificial Sequence
  Synthetic
gccaagcatttaggtgacactatagcccctggaaagacatctaaagtttcagagctatgctggaaacagc

SEQ ID NO: 52835 - DNA, 70 bp, Artificial Sequence
  Synthetic
gccaagcatttaggtgacactatagtgtgggccagtctctcaggggtttcagagctatgctggaaacagc

SEQ ID NO: 52836 - DNA, 70 bp, Artificial Sequence
  Synthetic
gccaagcatttaggtgacactataggaacaaaagaggagggtcaggtttcagagctatgctggaaacagc

SEQ ID NO: 52837 - DNA, 70 bp, Artificial Sequence
  Synthetic
gccaagcatttaggtgacactatagggccctctccgcgtggctaggtttcagagctatgctggaaacagc

SEQ ID NO: 52838 - DNA, 70 bp, Artificial Sequence
  Synthetic
gccaagcatttaggtgacactataggcgtgcctcgaagtcagtccgtttcagagctatgctggaaacagc

SEQ ID NO: 52839 - DNA, 70 bp, Artificial Sequence
  Synthetic
gccaagcatttaggtgacactatagatccgctgggatgctacttggtttcagagctatgctggaaacagc

SEQ ID NO: 52840 - DNA, 70 bp, Artificial Sequence
  Synthetic
gccaagcatttaggtgacactatagtctttcagaatgtgaagtacgtttcagagctatgctggaaacagc

SEQ ID NO: 52841 - DNA, 70 bp, Artificial Sequence
  Synthetic
gccaagcatttaggtgacactatagagtacttggtgaaccattccgtttcagagctatgctggaaacagc

SEQ ID NO: 52842 - DNA, 70 bp, Artificial Sequence
  Synthetic
gccaagcatttaggtgacactataggtttcagtccctgaaactgcgtttcagagctatgctggaaacagc

SEQ ID NO: 52843 - DNA, 70 bp, Artificial Sequence
  Synthetic
gccaagcatttaggtgacactatagctcttgcatccctccaatcagtttcagagctatgctggaaacagc

SEQ ID NO: 52844 - DNA, 70 bp, Artificial Sequence
  Synthetic
gccaagcatttaggtgacactatagtattccccggctgttgacacgtttcagagctatgctggaaacagc

SEQ ID NO: 52845 - DNA, 70 bp, Artificial Sequence
  Synthetic
gccaagcatttaggtgacactataggagctgaagagagctcctaggtttcagagctatgctggaaacagc

SEQ ID NO: 52846 - DNA, 70 bp, Artificial Sequence
  Synthetic
gccaagcatttaggtgacactataggagaagcacacaggtgctgggtttcagagctatgctggaaacagc

SEQ ID NO: 52847 - DNA, 70 bp, Artificial Sequence
  Synthetic
gccaagcatttaggtgacactatagacgttctggaccaggtatgagtttcagagctatgctggaaacagc

SEQ ID NO: 52848 - DNA, 70 bp, Artificial Sequence
  Synthetic
gccaagcatttaggtgacactatagttctgtcttccagggttcacgtttcagagctatgctggaaacagc

SEQ ID NO: 52849 - DNA, 70 bp, Artificial Sequence
  Synthetic
gccaagcatttaggtgacactatagacgggggcagccgggagactgtttcagagctatgctggaaacagc

SEQ ID NO: 52850 - DNA, 70 bp, Artificial Sequence
  Synthetic
gccaagcatttaggtgacactatagtgtagggacggagaaactaggtttcagagctatgctggaaacagc

SEQ ID NO: 52851 - DNA, 70 bp, Artificial Sequence
  Synthetic
gccaagcatttaggtgacactatagtgaggtgggcagatcacttggtttcagagctatgctggaaacagc

SEQ ID NO: 52852 - DNA, 70 bp, Artificial Sequence
  Synthetic
gccaagcatttaggtgacactatagtccagggagtcctcattcaggtttcagagctatgctggaaacagc

SEQ ID NO: 52853 - DNA, 70 bp, Artificial Sequence
  Synthetic
gccaagcatttaggtgacactatagactcctagcacagctcagtggtttcagagctatgctggaaacagc

SEQ ID NO: 52854 - DNA, 70 bp, Artificial Sequence
  Synthetic
gccaagcatttaggtgacactatagccagacaccgtgagtgttaagtttcagagctatgctggaaacagc

SEQ ID NO: 52855 - DNA, 70 bp, Artificial Sequence
  Synthetic
gccaagcatttaggtgacactatagtgcttctggtggatctgagcgtttcagagctatgctggaaacagc

SEQ ID NO: 52856 - DNA, 70 bp, Artificial Sequence
  Synthetic
gccaagcatttaggtgacactatagcagggctgtgtgcggcttatgtttcagagctatgctggaaacagc

SEQ ID NO: 52857 - DNA, 70 bp, Artificial Sequence
  Synthetic
gccaagcatttaggtgacactatagcacctatatcaatgcacacggtttcagagctatgctggaaacagc

SEQ ID NO: 52858 - DNA, 70 bp, Artificial Sequence
  Synthetic
gccaagcatttaggtgacactatagaaacatcaacatctgcttcagtttcagagctatgctggaaacagc

SEQ ID NO: 52859 - DNA, 70 bp, Artificial Sequence
  Synthetic
gccaagcatttaggtgacactatagaaatgcttctgttaggttctgtttcagagctatgctggaaacagc

SEQ ID NO: 52860 - DNA, 70 bp, Artificial Sequence
  Synthetic
gccaagcatttaggtgacactatagcttgatttctcctgggttaagtttcagagctatgctggaaacagc

SEQ ID NO: 52861 - DNA, 70 bp, Artificial Sequence
  Synthetic
gccaagcatttaggtgacactatagacacaaagtcaaaaccaccagtttcagagctatgctggaaacagc

SEQ ID NO: 52862 - DNA, 70 bp, Artificial Sequence
  Synthetic
gccaagcatttaggtgacactatagggtcacggcctggacaagaagtttcagagctatgctggaaacagc

SEQ ID NO: 52863 - DNA, 70 bp, Artificial Sequence
  Synthetic
gccaagcatttaggtgacactatagtcaggttggtcctgtagcaggtttcagagctatgctggaaacagc

SEQ ID NO: 52864 - DNA, 70 bp, Artificial Sequence
  Synthetic
gccaagcatttaggtgacactatagcgggaggataaagaccaccagtttcagagctatgctggaaacagc

SEQ ID NO: 52865 - DNA, 70 bp, Artificial Sequence
  Synthetic
gccaagcatttaggtgacactatagttcatgtgttcctgactggagtttcagagctatgctggaaacagc

SEQ ID NO: 52866 - DNA, 70 bp, Artificial Sequence
  Synthetic
gccaagcatttaggtgacactatagactggaatgaacttatgaacgtttcagagctatgctggaaacagc

SEQ ID NO: 52867 - DNA, 70 bp, Artificial Sequence
  Synthetic
gccaagcatttaggtgacactatagtgggaaaccaaaagcaacatgtttcagagctatgctggaaacagc

SEQ ID NO: 52868 - DNA, 70 bp, Artificial Sequence
  Synthetic
gccaagcatttaggtgacactataggtgagggtcaggagctaggtgtttcagagctatgctggaaacagc

SEQ ID NO: 52869 - DNA, 70 bp, Artificial Sequence
  Synthetic
gccaagcatttaggtgacactatagagagcagattatttaggcacgtttcagagctatgctggaaacagc

SEQ ID NO: 52870 - DNA, 70 bp, Artificial Sequence
  Synthetic
gccaagcatttaggtgacactataggccacaacagctacgtcatggtttcagagctatgctggaaacagc

SEQ ID NO: 52871 - DNA, 70 bp, Artificial Sequence
  Synthetic
gccaagcatttaggtgacactataggatggcggccagctctgaccgtttcagagctatgctggaaacagc

SEQ ID NO: 52872 - DNA, 70 bp, Artificial Sequence
  Synthetic
gccaagcatttaggtgacactatagcccctttggagctgggagttgtttcagagctatgctggaaacagc

SEQ ID NO: 52873 - DNA, 70 bp, Artificial Sequence
  Synthetic
gccaagcatttaggtgacactatagtttctcttgtgaatatggccgtttcagagctatgctggaaacagc

SEQ ID NO: 52874 - DNA, 70 bp, Artificial Sequence
  Synthetic
gccaagcatttaggtgacactatagctccatttaggagtagctatgtttcagagctatgctggaaacagc

SEQ ID NO: 52875 - DNA, 70 bp, Artificial Sequence
  Synthetic
gccaagcatttaggtgacactatagagaagaaagctctagctgaagtttcagagctatgctggaaacagc

SEQ ID NO: 52876 - DNA, 70 bp, Artificial Sequence
  Synthetic
gccaagcatttaggtgacactatagaggctaacttgacaagctaagtttcagagctatgctggaaacagc

SEQ ID NO: 52877 - DNA, 70 bp, Artificial Sequence
  Synthetic
gccaagcatttaggtgacactataggagaattacaagtgtgagaggtttcagagctatgctggaaacagc

SEQ ID NO: 52878 - DNA, 70 bp, Artificial Sequence
  Synthetic
gccaagcatttaggtgacactatagcggcggacactacctcgccggtttcagagctatgctggaaacagc

SEQ ID NO: 52879 - DNA, 70 bp, Artificial Sequence
  Synthetic
gccaagcatttaggtgacactatagggagcttatcacagagaaaagtttcagagctatgctggaaacagc

SEQ ID NO: 52880 - DNA, 70 bp, Artificial Sequence
  Synthetic
gccaagcatttaggtgacactataggttcattaaggttttgcagcgtttcagagctatgctggaaacagc

SEQ ID NO: 52881 - DNA, 70 bp, Artificial Sequence
  Synthetic
gccaagcatttaggtgacactatagaggctggagggcagggtcaggtttcagagctatgctggaaacagc

SEQ ID NO: 52882 - DNA, 70 bp, Artificial Sequence
  Synthetic
gccaagcatttaggtgacactataggccctggagcactcaccctcgtttcagagctatgctggaaacagc

SEQ ID NO: 52883 - DNA, 70 bp, Artificial Sequence
  Synthetic
gccaagcatttaggtgacactataggatgatcaaaccacagacttgtttcagagctatgctggaaacagc

SEQ ID NO: 52884 - DNA, 70 bp, Artificial Sequence
  Synthetic
gccaagcatttaggtgacactatagagtgtgacagagaggtgtgagtttcagagctatgctggaaacagc

SEQ ID NO: 52885 - DNA, 70 bp, Artificial Sequence
  Synthetic
gccaagcatttaggtgacactatagcacacctctctgtcacactggtttcagagctatgctggaaacagc

SEQ ID NO: 52886 - DNA, 70 bp, Artificial Sequence
  Synthetic
gccaagcatttaggtgacactatagatcactccttatcaacatctgtttcagagctatgctggaaacagc

SEQ ID NO: 52887 - DNA, 70 bp, Artificial Sequence
  Synthetic
gccaagcatttaggtgacactatagagtgctggcaatcagggcaagtttcagagctatgctggaaacagc

SEQ ID NO: 52888 - DNA, 70 bp, Artificial Sequence
  Synthetic
gccaagcatttaggtgacactataggtttgcatgaacagtttcctgtttcagagctatgctggaaacagc

SEQ ID NO: 52889 - DNA, 70 bp, Artificial Sequence
  Synthetic
gccaagcatttaggtgacactataggtaaaaggcgccaagtgctcgtttcagagctatgctggaaacagc

SEQ ID NO: 52890 - DNA, 70 bp, Artificial Sequence
  Synthetic
gccaagcatttaggtgacactataggtcgccttcccttattgctagtttcagagctatgctggaaacagc

SEQ ID NO: 52891 - DNA, 70 bp, Artificial Sequence
  Synthetic
gccaagcatttaggtgacactatagttttttctcactcgatacaggtttcagagctatgctggaaacagc

SEQ ID NO: 52892 - DNA, 70 bp, Artificial Sequence
  Synthetic
gccaagcatttaggtgacactatagcttgaggcagcctgctctatgtttcagagctatgctggaaacagc

SEQ ID NO: 52893 - DNA, 70 bp, Artificial Sequence
  Synthetic
gccaagcatttaggtgacactatagcgcctgccacattcagtagcgtttcagagctatgctggaaacagc

SEQ ID NO: 52894 - DNA, 70 bp, Artificial Sequence
  Synthetic
gccaagcatttaggtgacactatagccttggagggtaatgtctacgtttcagagctatgctggaaacagc

SEQ ID NO: 52895 - DNA, 70 bp, Artificial Sequence
  Synthetic
gccaagcatttaggtgacactatagttctgcttgtaccttaactagtttcagagctatgctggaaacagc

SEQ ID NO: 52896 - DNA, 70 bp, Artificial Sequence
  Synthetic
gccaagcatttaggtgacactatagttctccaatagtcttcatgagtttcagagctatgctggaaacagc

SEQ ID NO: 52897 - DNA, 70 bp, Artificial Sequence
  Synthetic
gccaagcatttaggtgacactataggatctgggccagactcacaagtttcagagctatgctggaaacagc

SEQ ID NO: 52898 - DNA, 70 bp, Artificial Sequence
  Synthetic
gccaagcatttaggtgacactatagcgcctacccgtctacagatagtttcagagctatgctggaaacagc

SEQ ID NO: 52899 - DNA, 70 bp, Artificial Sequence
  Synthetic
gccaagcatttaggtgacactatagtcagcacccagggtatagatgtttcagagctatgctggaaacagc

SEQ ID NO: 52900 - DNA, 70 bp, Artificial Sequence
  Synthetic
gccaagcatttaggtgacactatagccactcacttccaagccctggtttcagagctatgctggaaacagc

SEQ ID NO: 52901 - DNA, 70 bp, Artificial Sequence
  Synthetic
gccaagcatttaggtgacactatagaacagacaactacaactttggtttcagagctatgctggaaacagc

SEQ ID NO: 52902 - DNA, 70 bp, Artificial Sequence
  Synthetic
gccaagcatttaggtgacactatagagcacctgcaaaatcagtaagtttcagagctatgctggaaacagc

SEQ ID NO: 52903 - DNA, 70 bp, Artificial Sequence
  Synthetic
gccaagcatttaggtgacactataggctgtggcggtggctcattcgtttcagagctatgctggaaacagc

SEQ ID NO: 52904 - DNA, 70 bp, Artificial Sequence
  Synthetic
gccaagcatttaggtgacactataggcgtttggggctgctgaagcgtttcagagctatgctggaaacagc

SEQ ID NO: 52905 - DNA, 70 bp, Artificial Sequence
  Synthetic
gccaagcatttaggtgacactatagagggagcaggcgcactcacggtttcagagctatgctggaaacagc

SEQ ID NO: 52906 - DNA, 70 bp, Artificial Sequence
  Synthetic
gccaagcatttaggtgacactataggccacctgcacaaagcagcagtttcagagctatgctggaaacagc

SEQ ID NO: 52907 - DNA, 70 bp, Artificial Sequence
  Synthetic
gccaagcatttaggtgacactatagcgggaggcacagtggcctgagtttcagagctatgctggaaacagc

SEQ ID NO: 52908 - DNA, 70 bp, Artificial Sequence
  Synthetic
gccaagcatttaggtgacactatagcaggaggcacagtagcctgagtttcagagctatgctggaaacagc

SEQ ID NO: 52909 - DNA, 70 bp, Artificial Sequence
  Synthetic
gccaagcatttaggtgacactatagggtaccagagtgaggcgtaggtttcagagctatgctggaaacagc

SEQ ID NO: 52910 - DNA, 70 bp, Artificial Sequence
  Synthetic
gccaagcatttaggtgacactatagagctgcgaagatttctctctgtttcagagctatgctggaaacagc

SEQ ID NO: 52911 - DNA, 70 bp, Artificial Sequence
  Synthetic
gccaagcatttaggtgacactatagaggggaggataccgggcactgtttcagagctatgctggaaacagc

SEQ ID NO: 52912 - DNA, 70 bp, Artificial Sequence
  Synthetic
gccaagcatttaggtgacactatagtgtcattggaaaagtgaaccgtttcagagctatgctggaaacagc

SEQ ID NO: 52913 - DNA, 70 bp, Artificial Sequence
  Synthetic
gccaagcatttaggtgacactatagctatacacagaggcactgtagtttcagagctatgctggaaacagc

SEQ ID NO: 52914 - DNA, 70 bp, Artificial Sequence
  Synthetic
gccaagcatttaggtgacactatagaaagaacagcaactagtccagtttcagagctatgctggaaacagc

SEQ ID NO: 52915 - DNA, 70 bp, Artificial Sequence
  Synthetic
gccaagcatttaggtgacactatagttgtttaggacaagtggtaggtttcagagctatgctggaaacagc

SEQ ID NO: 52916 - DNA, 70 bp, Artificial Sequence
  Synthetic
gccaagcatttaggtgacactatagataaatgagggcctctgactgtttcagagctatgctggaaacagc

SEQ ID NO: 52917 - DNA, 70 bp, Artificial Sequence
  Synthetic
gccaagcatttaggtgacactataggcccacctttcctaactcaggtttcagagctatgctggaaacagc

SEQ ID NO: 52918 - DNA, 70 bp, Artificial Sequence
  Synthetic
gccaagcatttaggtgacactataggcagagagtctggacaaactgtttcagagctatgctggaaacagc

SEQ ID NO: 52919 - DNA, 70 bp, Artificial Sequence
  Synthetic
gccaagcatttaggtgacactataggcagaaagtctggacaaactgtttcagagctatgctggaaacagc

SEQ ID NO: 52920 - DNA, 70 bp, Artificial Sequence
  Synthetic
gccaagcatttaggtgacactataggcagagagtctgggcaaactgtttcagagctatgctggaaacagc

SEQ ID NO: 52921 - DNA, 70 bp, Artificial Sequence
  Synthetic
gccaagcatttaggtgacactatagacgacattcccaaagtcagcgtttcagagctatgctggaaacagc

SEQ ID NO: 52922 - DNA, 70 bp, Artificial Sequence
  Synthetic
gccaagcatttaggtgacactatagggagccaatgcccgtctctggtttcagagctatgctggaaacagc

SEQ ID NO: 52923 - DNA, 70 bp, Artificial Sequence
  Synthetic
gccaagcatttaggtgacactatagagaagcacggccagctagcagtttcagagctatgctggaaacagc

SEQ ID NO: 52924 - DNA, 70 bp, Artificial Sequence
  Synthetic
gccaagcatttaggtgacactataggcagtgtcagcttcgttcttgtttcagagctatgctggaaacagc

SEQ ID NO: 52925 - DNA, 70 bp, Artificial Sequence
  Synthetic
gccaagcatttaggtgacactatagtcccccagaagcaagactaagtttcagagctatgctggaaacagc

SEQ ID NO: 52926 - DNA, 70 bp, Artificial Sequence
  Synthetic
gccaagcatttaggtgacactatagcccccgaagccattttaggggtttcagagctatgctggaaacagc

SEQ ID NO: 52927 - DNA, 70 bp, Artificial Sequence
  Synthetic
gccaagcatttaggtgacactataggcggaggagctcagcccgaggtttcagagctatgctggaaacagc

SEQ ID NO: 52928 - DNA, 70 bp, Artificial Sequence
  Synthetic
gccaagcatttaggtgacactatagccttcggctctcagcgcgccgtttcagagctatgctggaaacagc

SEQ ID NO: 52929 - DNA, 70 bp, Artificial Sequence
  Synthetic
gccaagcatttaggtgacactatagcggctgctgctagatgataagtttcagagctatgctggaaacagc

SEQ ID NO: 52930 - DNA, 70 bp, Artificial Sequence
  Synthetic
gccaagcatttaggtgacactatagttaattgcagggtagccaaggtttcagagctatgctggaaacagc

SEQ ID NO: 52931 - DNA, 70 bp, Artificial Sequence
  Synthetic
gccaagcatttaggtgacactatagcagggtctgagtcagttacagtttcagagctatgctggaaacagc

SEQ ID NO: 52932 - DNA, 70 bp, Artificial Sequence
  Synthetic
gccaagcatttaggtgacactatagcaggtctcaaggttagttacgtttcagagctatgctggaaacagc

SEQ ID NO: 52933 - DNA, 70 bp, Artificial Sequence
  Synthetic
gccaagcatttaggtgacactatagctgcactttcgtggatcaaagtttcagagctatgctggaaacagc

SEQ ID NO: 52934 - DNA, 70 bp, Artificial Sequence
  Synthetic
gccaagcatttaggtgacactatagagaggcatcggaagaagattgtttcagagctatgctggaaacagc

SEQ ID NO: 52935 - DNA, 70 bp, Artificial Sequence
  Synthetic
gccaagcatttaggtgacactatagacttgcactgcacgttgaatgtttcagagctatgctggaaacagc

SEQ ID NO: 52936 - DNA, 70 bp, Artificial Sequence
  Synthetic
gccaagcatttaggtgacactatagtgcatcggaagaagattagagtttcagagctatgctggaaacagc

SEQ ID NO: 52937 - DNA, 70 bp, Artificial Sequence
  Synthetic
gccaagcatttaggtgacactatagtgagaatatgtatatcgggagtttcagagctatgctggaaacagc

SEQ ID NO: 52938 - DNA, 70 bp, Artificial Sequence
  Synthetic
gccaagcatttaggtgacactataggagcatcttcaagaaagcaagtttcagagctatgctggaaacagc

SEQ ID NO: 52939 - DNA, 70 bp, Artificial Sequence
  Synthetic
gccaagcatttaggtgacactatagaagcattgctcgaatctgttgtttcagagctatgctggaaacagc

SEQ ID NO: 52940 - DNA, 70 bp, Artificial Sequence
  Synthetic
gccaagcatttaggtgacactatagccagaattgttattgcagcagtttcagagctatgctggaaacagc

SEQ ID NO: 52941 - DNA, 70 bp, Artificial Sequence
  Synthetic
gccaagcatttaggtgacactataggcagcctcctggatgctcaggtttcagagctatgctggaaacagc

SEQ ID NO: 52942 - DNA, 70 bp, Artificial Sequence
  Synthetic
gccaagcatttaggtgacactatagctctggcaggcgggtgttaggtttcagagctatgctggaaacagc

SEQ ID NO: 52943 - DNA, 70 bp, Artificial Sequence
  Synthetic
gccaagcatttaggtgacactataggagcagatcgagaacaactggtttcagagctatgctggaaacagc

SEQ ID NO: 52944 - DNA, 70 bp, Artificial Sequence
  Synthetic
gccaagcatttaggtgacactatagcatcgtcatcttcgtaattggtttcagagctatgctggaaacagc

SEQ ID NO: 52945 - DNA, 70 bp, Artificial Sequence
  Synthetic
gccaagcatttaggtgacactatagcagatagagaagaactgagggtttcagagctatgctggaaacagc

SEQ ID NO: 52946 - DNA, 70 bp, Artificial Sequence
  Synthetic
gccaagcatttaggtgacactatagcctggacttgaatttgattggtttcagagctatgctggaaacagc

SEQ ID NO: 52947 - DNA, 70 bp, Artificial Sequence
  Synthetic
gccaagcatttaggtgacactatagactccccaagccaaaaaggagtttcagagctatgctggaaacagc

SEQ ID NO: 52948 - DNA, 70 bp, Artificial Sequence
  Synthetic
gccaagcatttaggtgacactataggcctgccaggcccaggactggtttcagagctatgctggaaacagc

SEQ ID NO: 52949 - DNA, 70 bp, Artificial Sequence
  Synthetic
gccaagcatttaggtgacactatagctcaaagactacctactgcggtttcagagctatgctggaaacagc

SEQ ID NO: 52950 - DNA, 70 bp, Artificial Sequence
  Synthetic
gccaagcatttaggtgacactatagtttggcacaattaccggtgcgtttcagagctatgctggaaacagc

SEQ ID NO: 52951 - DNA, 70 bp, Artificial Sequence
  Synthetic
gccaagcatttaggtgacactatagaacaccaagtactcttgatggtttcagagctatgctggaaacagc

SEQ ID NO: 52952 - DNA, 70 bp, Artificial Sequence
  Synthetic
gccaagcatttaggtgacactatagcacactgagggagctgcagggtttcagagctatgctggaaacagc

SEQ ID NO: 52953 - DNA, 70 bp, Artificial Sequence
  Synthetic
gccaagcatttaggtgacactatagcagctctgggtcttatttaagtttcagagctatgctggaaacagc

SEQ ID NO: 52954 - DNA, 70 bp, Artificial Sequence
  Synthetic
gccaagcatttaggtgacactatagagccctggctcctctttaaagtttcagagctatgctggaaacagc

SEQ ID NO: 52955 - DNA, 70 bp, Artificial Sequence
  Synthetic
gccaagcatttaggtgacactatagggaagtgcagaggagcccaggtttcagagctatgctggaaacagc

SEQ ID NO: 52956 - DNA, 70 bp, Artificial Sequence
  Synthetic
gccaagcatttaggtgacactatagtctgtctgcccctttctcaagtttcagagctatgctggaaacagc

SEQ ID NO: 52957 - DNA, 70 bp, Artificial Sequence
  Synthetic
gccaagcatttaggtgacactatagttctgctgtgcccttcacgcgtttcagagctatgctggaaacagc

SEQ ID NO: 52958 - DNA, 70 bp, Artificial Sequence
  Synthetic
gccaagcatttaggtgacactatagctccgagtggccggatgcgggtttcagagctatgctggaaacagc

SEQ ID NO: 52959 - DNA, 70 bp, Artificial Sequence
  Synthetic
gccaagcatttaggtgacactatagccacagctggccccacccatgtttcagagctatgctggaaacagc

SEQ ID NO: 52960 - DNA, 70 bp, Artificial Sequence
  Synthetic
gccaagcatttaggtgacactatagtacctaggagagcacttcttgtttcagagctatgctggaaacagc

SEQ ID NO: 52961 - DNA, 70 bp, Artificial Sequence
  Synthetic
gccaagcatttaggtgacactatagtgtgttaaatatctcagcaggtttcagagctatgctggaaacagc

SEQ ID NO: 52962 - DNA, 70 bp, Artificial Sequence
  Synthetic
gccaagcatttaggtgacactatagcttctggatgtttcacagccgtttcagagctatgctggaaacagc

SEQ ID NO: 52963 - DNA, 70 bp, Artificial Sequence
  Synthetic
gccaagcatttaggtgacactatagtctgtactctcttctatctcgtttcagagctatgctggaaacagc

SEQ ID NO: 52964 - DNA, 70 bp, Artificial Sequence
  Synthetic
gccaagcatttaggtgacactatagccttgaggtctgtcatggaggtttcagagctatgctggaaacagc

SEQ ID NO: 52965 - DNA, 70 bp, Artificial Sequence
  Synthetic
gccaagcatttaggtgacactatagcaggtcgcagcattatcaaagtttcagagctatgctggaaacagc

SEQ ID NO: 52966 - DNA, 70 bp, Artificial Sequence
  Synthetic
gccaagcatttaggtgacactatagcgggtggtcctggctgtcacgtttcagagctatgctggaaacagc

SEQ ID NO: 52967 - DNA, 70 bp, Artificial Sequence
  Synthetic
gccaagcatttaggtgacactatagaggccagtctgcttctacttgtttcagagctatgctggaaacagc

SEQ ID NO: 52968 - DNA, 70 bp, Artificial Sequence
  Synthetic
gccaagcatttaggtgacactatagatgcctcttctcagccatctgtttcagagctatgctggaaacagc

SEQ ID NO: 52969 - DNA, 70 bp, Artificial Sequence
  Synthetic
gccaagcatttaggtgacactataggccagagacccccatgtgaagtttcagagctatgctggaaacagc

SEQ ID NO: 52970 - DNA, 70 bp, Artificial Sequence
  Synthetic
gccaagcatttaggtgacactataggcgcaagatagtggaactccgtttcagagctatgctggaaacagc

SEQ ID NO: 52971 - DNA, 70 bp, Artificial Sequence
  Synthetic
gccaagcatttaggtgacactatagaggcctcccctcacttctgagtttcagagctatgctggaaacagc

SEQ ID NO: 52972 - DNA, 70 bp, Artificial Sequence
  Synthetic
gccaagcatttaggtgacactatagcgctcggcaggcagccacccgtttcagagctatgctggaaacagc

SEQ ID NO: 52973 - DNA, 70 bp, Artificial Sequence
  Synthetic
gccaagcatttaggtgacactataggctgggttcagaaagccatcgtttcagagctatgctggaaacagc

SEQ ID NO: 52974 - DNA, 70 bp, Artificial Sequence
  Synthetic
gccaagcatttaggtgacactataggggctcggggtggtgatcaggtttcagagctatgctggaaacagc

SEQ ID NO: 52975 - DNA, 70 bp, Artificial Sequence
  Synthetic
gccaagcatttaggtgacactatagcccaatgagaacaagtttcggtttcagagctatgctggaaacagc

SEQ ID NO: 52976 - DNA, 70 bp, Artificial Sequence
  Synthetic
gccaagcatttaggtgacactatagcctttggctaggactcaaaggtttcagagctatgctggaaacagc

SEQ ID NO: 52977 - DNA, 70 bp, Artificial Sequence
  Synthetic
gccaagcatttaggtgacactatagaacacggagcagttactgatgtttcagagctatgctggaaacagc

SEQ ID NO: 52978 - DNA, 70 bp, Artificial Sequence
  Synthetic
gccaagcatttaggtgacactatagcttggggggcaaccctgaacgtttcagagctatgctggaaacagc

SEQ ID NO: 52979 - DNA, 70 bp, Artificial Sequence
  Synthetic
gccaagcatttaggtgacactatagcaggaaatcacacagttgctgtttcagagctatgctggaaacagc

SEQ ID NO: 52980 - DNA, 70 bp, Artificial Sequence
  Synthetic
gccaagcatttaggtgacactatagaggctgggacatgctgctaggtttcagagctatgctggaaacagc

SEQ ID NO: 52981 - DNA, 70 bp, Artificial Sequence
  Synthetic
gccaagcatttaggtgacactatagtcttgcttttgaacgtgcccgtttcagagctatgctggaaacagc

SEQ ID NO: 52982 - DNA, 70 bp, Artificial Sequence
  Synthetic
gccaagcatttaggtgacactatagcgccgacctcgtggacgacagtttcagagctatgctggaaacagc

SEQ ID NO: 52983 - DNA, 70 bp, Artificial Sequence
  Synthetic
gccaagcatttaggtgacactatagagaggcagtggcacactgatgtttcagagctatgctggaaacagc

SEQ ID NO: 52984 - DNA, 70 bp, Artificial Sequence
  Synthetic
gccaagcatttaggtgacactatagtgtgtgagtcctacagtgtggtttcagagctatgctggaaacagc

SEQ ID NO: 52985 - DNA, 70 bp, Artificial Sequence
  Synthetic
gccaagcatttaggtgacactatagctacagagagcacttggagagtttcagagctatgctggaaacagc

SEQ ID NO: 52986 - DNA, 70 bp, Artificial Sequence
  Synthetic
gccaagcatttaggtgacactataggattctggagtccatctagagtttcagagctatgctggaaacagc

SEQ ID NO: 52987 - DNA, 70 bp, Artificial Sequence
  Synthetic
gccaagcatttaggtgacactatagtcctggccgtgggtggttatgtttcagagctatgctggaaacagc

SEQ ID NO: 52988 - DNA, 70 bp, Artificial Sequence
  Synthetic
gccaagcatttaggtgacactatagcattgtagcaggaaccattggtttcagagctatgctggaaacagc

SEQ ID NO: 52989 - DNA, 70 bp, Artificial Sequence
  Synthetic
gccaagcatttaggtgacactatagtcaggttccctcctcctcaggtttcagagctatgctggaaacagc

SEQ ID NO: 52990 - DNA, 70 bp, Artificial Sequence
  Synthetic
gccaagcatttaggtgacactatagagctcagtacaagtaccattgtttcagagctatgctggaaacagc

SEQ ID NO: 52991 - DNA, 70 bp, Artificial Sequence
  Synthetic
gccaagcatttaggtgacactatagttagcaataagaagtgaggagtttcagagctatgctggaaacagc

SEQ ID NO: 52992 - DNA, 70 bp, Artificial Sequence
  Synthetic
gccaagcatttaggtgacactatagtcaacaagcagaagatgatggtttcagagctatgctggaaacagc

SEQ ID NO: 52993 - DNA, 70 bp, Artificial Sequence
  Synthetic
gccaagcatttaggtgacactatagcgtcgttagagagaatgtccgtttcagagctatgctggaaacagc

SEQ ID NO: 52994 - DNA, 70 bp, Artificial Sequence
  Synthetic
gccaagcatttaggtgacactatagaacagtacctcattgctcttgtttcagagctatgctggaaacagc

SEQ ID NO: 52995 - DNA, 70 bp, Artificial Sequence
  Synthetic
gccaagcatttaggtgacactatagtcttaaaacagctatcagtcgtttcagagctatgctggaaacagc

SEQ ID NO: 52996 - DNA, 70 bp, Artificial Sequence
  Synthetic
gccaagcatttaggtgacactatagtcaaaggccaggctcaggaggtttcagagctatgctggaaacagc

SEQ ID NO: 52997 - DNA, 70 bp, Artificial Sequence
  Synthetic
gccaagcatttaggtgacactatagggaagacattacactagttggtttcagagctatgctggaaacagc

SEQ ID NO: 52998 - DNA, 70 bp, Artificial Sequence
  Synthetic
gccaagcatttaggtgacactatagggaggaggtggtggtggtgggtttcagagctatgctggaaacagc

SEQ ID NO: 52999 - DNA, 70 bp, Artificial Sequence
  Synthetic
gccaagcatttaggtgacactataggatggaggcccccagtgttggtttcagagctatgctggaaacagc

SEQ ID NO: 53000 - DNA, 70 bp, Artificial Sequence
  Synthetic
gccaagcatttaggtgacactatagatcaagttcactttcttcacgtttcagagctatgctggaaacagc

SEQ ID NO: 53001 - DNA, 70 bp, Artificial Sequence
  Synthetic
gccaagcatttaggtgacactatagatcaagttcactgtcttcatgtttcagagctatgctggaaacagc

SEQ ID NO: 53002 - DNA, 70 bp, Artificial Sequence
  Synthetic
gccaagcatttaggtgacactatagaggtggcaacaagatgggaagtttcagagctatgctggaaacagc

SEQ ID NO: 53003 - DNA, 70 bp, Artificial Sequence
  Synthetic
gccaagcatttaggtgacactatagaaaatcactgcaccaattccgtttcagagctatgctggaaacagc

SEQ ID NO: 53004 - DNA, 70 bp, Artificial Sequence
  Synthetic
gccaagcatttaggtgacactataggtctgccatgtggttgcagtgtttcagagctatgctggaaacagc

SEQ ID NO: 53005 - DNA, 70 bp, Artificial Sequence
  Synthetic
gccaagcatttaggtgacactatagggagcctcatctcttctgacgtttcagagctatgctggaaacagc

SEQ ID NO: 53006 - DNA, 70 bp, Artificial Sequence
  Synthetic
gccaagcatttaggtgacactataggaaaaagagcttctcacacggtttcagagctatgctggaaacagc

SEQ ID NO: 53007 - DNA, 70 bp, Artificial Sequence
  Synthetic
gccaagcatttaggtgacactatagcctccactcacaagatcgtggtttcagagctatgctggaaacagc

SEQ ID NO: 53008 - DNA, 70 bp, Artificial Sequence
  Synthetic
gccaagcatttaggtgacactatagcaaacgaacctaaaagtgaggtttcagagctatgctggaaacagc

SEQ ID NO: 53009 - DNA, 70 bp, Artificial Sequence
  Synthetic
gccaagcatttaggtgacactataggctgcgaactcaagtctagagtttcagagctatgctggaaacagc

SEQ ID NO: 53010 - DNA, 70 bp, Artificial Sequence
  Synthetic
gccaagcatttaggtgacactatagtaacagatcaaatgaccttggtttcagagctatgctggaaacagc

SEQ ID NO: 53011 - DNA, 70 bp, Artificial Sequence
  Synthetic
gccaagcatttaggtgacactatagaagcacagaagctgttatgggtttcagagctatgctggaaacagc

SEQ ID NO: 53012 - DNA, 70 bp, Artificial Sequence
  Synthetic
gccaagcatttaggtgacactatagcgaagtaagtgctggagaaagtttcagagctatgctggaaacagc

SEQ ID NO: 53013 - DNA, 70 bp, Artificial Sequence
  Synthetic
gccaagcatttaggtgacactatagcttgcagcactccaagtaaagtttcagagctatgctggaaacagc

SEQ ID NO: 53014 - DNA, 70 bp, Artificial Sequence
  Synthetic
gccaagcatttaggtgacactataggtcccttggtggatggtcaggtttcagagctatgctggaaacagc

SEQ ID NO: 53015 - DNA, 70 bp, Artificial Sequence
  Synthetic
gccaagcatttaggtgacactatagcgcaggcctcagttctgtatgtttcagagctatgctggaaacagc

SEQ ID NO: 53016 - DNA, 70 bp, Artificial Sequence
  Synthetic
gccaagcatttaggtgacactatagcttcaaaacgtggcagctacgtttcagagctatgctggaaacagc

SEQ ID NO: 53017 - DNA, 70 bp, Artificial Sequence
  Synthetic
gccaagcatttaggtgacactatagaagaaccagccaagaagaaagtttcagagctatgctggaaacagc

SEQ ID NO: 53018 - DNA, 70 bp, Artificial Sequence
  Synthetic
gccaagcatttaggtgacactataggtgtgtgataattctcagtggtttcagagctatgctggaaacagc

SEQ ID NO: 53019 - DNA, 70 bp, Artificial Sequence
  Synthetic
gccaagcatttaggtgacactatagagtaactcatcagaaggctggtttcagagctatgctggaaacagc

SEQ ID NO: 53020 - DNA, 70 bp, Artificial Sequence
  Synthetic
gccaagcatttaggtgacactatagtctatcttttcctatagggagtttcagagctatgctggaaacagc

SEQ ID NO: 53021 - DNA, 70 bp, Artificial Sequence
  Synthetic
gccaagcatttaggtgacactatagcagcagacacaagacttcttgtttcagagctatgctggaaacagc

SEQ ID NO: 53022 - DNA, 70 bp, Artificial Sequence
  Synthetic
gccaagcatttaggtgacactatagacaaagagaaacactgctttgtttcagagctatgctggaaacagc

SEQ ID NO: 53023 - DNA, 70 bp, Artificial Sequence
  Synthetic
gccaagcatttaggtgacactatagtcttcagtatctcatagtgcgtttcagagctatgctggaaacagc

SEQ ID NO: 53024 - DNA, 70 bp, Artificial Sequence
  Synthetic
gccaagcatttaggtgacactatagctcttaaactttgagcgtgcgtttcagagctatgctggaaacagc

SEQ ID NO: 53025 - DNA, 70 bp, Artificial Sequence
  Synthetic
gccaagcatttaggtgacactatagaagagtctcttgtgtattgagtttcagagctatgctggaaacagc

SEQ ID NO: 53026 - DNA, 70 bp, Artificial Sequence
  Synthetic
gccaagcatttaggtgacactatagggctggaagtagaagcttaggtttcagagctatgctggaaacagc

SEQ ID NO: 53027 - DNA, 70 bp, Artificial Sequence
  Synthetic
gccaagcatttaggtgacactatagccacaccttgggcggtcacggtttcagagctatgctggaaacagc

SEQ ID NO: 53028 - DNA, 70 bp, Artificial Sequence
  Synthetic
gccaagcatttaggtgacactatagggggatggtcagggggaagggtttcagagctatgctggaaacagc

SEQ ID NO: 53029 - DNA, 70 bp, Artificial Sequence
  Synthetic
gccaagcatttaggtgacactatagtgtagcaggggtcacaaaaagtttcagagctatgctggaaacagc

SEQ ID NO: 53030 - DNA, 70 bp, Artificial Sequence
  Synthetic
gccaagcatttaggtgacactatagagctgttgggtgtggagggcgtttcagagctatgctggaaacagc

SEQ ID NO: 53031 - DNA, 70 bp, Artificial Sequence
  Synthetic
gccaagcatttaggtgacactatagacacaggaggctgcgtgacagtttcagagctatgctggaaacagc

SEQ ID NO: 53032 - DNA, 70 bp, Artificial Sequence
  Synthetic
gccaagcatttaggtgacactatagagagaccaatcttcacaaaagtttcagagctatgctggaaacagc

SEQ ID NO: 53033 - DNA, 70 bp, Artificial Sequence
  Synthetic
gccaagcatttaggtgacactatagtgccaattccactaattgttgtttcagagctatgctggaaacagc

SEQ ID NO: 53034 - DNA, 70 bp, Artificial Sequence
  Synthetic
gccaagcatttaggtgacactatagttggagattcatgagaacctgtttcagagctatgctggaaacagc

SEQ ID NO: 53035 - DNA, 70 bp, Artificial Sequence
  Synthetic
gccaagcatttaggtgacactatagtttcactctagaccaagcttgtttcagagctatgctggaaacagc

SEQ ID NO: 53036 - DNA, 70 bp, Artificial Sequence
  Synthetic
gccaagcatttaggtgacactatagcccctgaaaaaaaggagctggtttcagagctatgctggaaacagc

SEQ ID NO: 53037 - DNA, 70 bp, Artificial Sequence
  Synthetic
gccaagcatttaggtgacactataggaggaatctcagacgtttttgtttcagagctatgctggaaacagc

SEQ ID NO: 53038 - DNA, 70 bp, Artificial Sequence
  Synthetic
gccaagcatttaggtgacactatagcgtgagcgtgcgggagggctgtttcagagctatgctggaaacagc

SEQ ID NO: 53039 - DNA, 70 bp, Artificial Sequence
  Synthetic
gccaagcatttaggtgacactatagggggcctgaagggggctgaggtttcagagctatgctggaaacagc

SEQ ID NO: 53040 - DNA, 70 bp, Artificial Sequence
  Synthetic
gccaagcatttaggtgacactataggtcaacaaaggatgctcggagtttcagagctatgctggaaacagc

SEQ ID NO: 53041 - DNA, 70 bp, Artificial Sequence
  Synthetic
gccaagcatttaggtgacactatagtgcacatttacagcagcaacgtttcagagctatgctggaaacagc

SEQ ID NO: 53042 - DNA, 70 bp, Artificial Sequence
  Synthetic
gccaagcatttaggtgacactatagaaaatcaagacgtgaattgggtttcagagctatgctggaaacagc

SEQ ID NO: 53043 - DNA, 70 bp, Artificial Sequence
  Synthetic
gccaagcatttaggtgacactatagattcacctctgctctctgaagtttcagagctatgctggaaacagc

SEQ ID NO: 53044 - DNA, 70 bp, Artificial Sequence
  Synthetic
gccaagcatttaggtgacactatagcctggattcccagcagcacagtttcagagctatgctggaaacagc

SEQ ID NO: 53045 - DNA, 70 bp, Artificial Sequence
  Synthetic
gccaagcatttaggtgacactatagtgattatggcagctgtgagggtttcagagctatgctggaaacagc

SEQ ID NO: 53046 - DNA, 70 bp, Artificial Sequence
  Synthetic
gccaagcatttaggtgacactatagctgatgctgagtctccacaagtttcagagctatgctggaaacagc

SEQ ID NO: 53047 - DNA, 70 bp, Artificial Sequence
  Synthetic
gccaagcatttaggtgacactatagtaaaccagtccccaaagatggtttcagagctatgctggaaacagc

SEQ ID NO: 53048 - DNA, 70 bp, Artificial Sequence
  Synthetic
gccaagcatttaggtgacactatagggccgcgctggggcgatcacgtttcagagctatgctggaaacagc

SEQ ID NO: 53049 - DNA, 70 bp, Artificial Sequence
  Synthetic
gccaagcatttaggtgacactatagaaagacttaagagttggcatgtttcagagctatgctggaaacagc

SEQ ID NO: 53050 - DNA, 70 bp, Artificial Sequence
  Synthetic
gccaagcatttaggtgacactataggacgtcacttgcactgttcggtttcagagctatgctggaaacagc

SEQ ID NO: 53051 - DNA, 70 bp, Artificial Sequence
  Synthetic
gccaagcatttaggtgacactatagcccagactccccaaagaggagtttcagagctatgctggaaacagc

SEQ ID NO: 53052 - DNA, 70 bp, Artificial Sequence
  Synthetic
gccaagcatttaggtgacactatagacatctcattcagcctgagtgtttcagagctatgctggaaacagc

SEQ ID NO: 53053 - DNA, 70 bp, Artificial Sequence
  Synthetic
gccaagcatttaggtgacactatagtgaacttcagttcttcacctgtttcagagctatgctggaaacagc

SEQ ID NO: 53054 - DNA, 70 bp, Artificial Sequence
  Synthetic
gccaagcatttaggtgacactatagatgtgaagcggagtgctgcggtttcagagctatgctggaaacagc

SEQ ID NO: 53055 - DNA, 70 bp, Artificial Sequence
  Synthetic
gccaagcatttaggtgacactataggaatattacagggctgggctgtttcagagctatgctggaaacagc

SEQ ID NO: 53056 - DNA, 70 bp, Artificial Sequence
  Synthetic
gccaagcatttaggtgacactatagacccaccttgatgcctagtggtttcagagctatgctggaaacagc

SEQ ID NO: 53057 - DNA, 70 bp, Artificial Sequence
  Synthetic
gccaagcatttaggtgacactatagagacacaaagatgaaaagctgtttcagagctatgctggaaacagc

SEQ ID NO: 53058 - DNA, 70 bp, Artificial Sequence
  Synthetic
gccaagcatttaggtgacactataggcggagcggcggtagttctcgtttcagagctatgctggaaacagc

SEQ ID NO: 53059 - DNA, 70 bp, Artificial Sequence
  Synthetic
gccaagcatttaggtgacactatagtctctgagtactggttctgagtttcagagctatgctggaaacagc

SEQ ID NO: 53060 - DNA, 70 bp, Artificial Sequence
  Synthetic
gccaagcatttaggtgacactatagggcccgtgctggcacctcacgtttcagagctatgctggaaacagc

SEQ ID NO: 53061 - DNA, 70 bp, Artificial Sequence
  Synthetic
gccaagcatttaggtgacactatagctccagcccgaggctcagaagtttcagagctatgctggaaacagc

SEQ ID NO: 53062 - DNA, 70 bp, Artificial Sequence
  Synthetic
gccaagcatttaggtgacactatagtatccccctatgacttctgagtttcagagctatgctggaaacagc

SEQ ID NO: 53063 - DNA, 70 bp, Artificial Sequence
  Synthetic
gccaagcatttaggtgacactataggactacctcagtggtgaactgtttcagagctatgctggaaacagc

SEQ ID NO: 53064 - DNA, 70 bp, Artificial Sequence
  Synthetic
gccaagcatttaggtgacactatagttggggaggctctcagaatggtttcagagctatgctggaaacagc

SEQ ID NO: 53065 - DNA, 70 bp, Artificial Sequence
  Synthetic
gccaagcatttaggtgacactatagcagctgcagttgctttagttgtttcagagctatgctggaaacagc

SEQ ID NO: 53066 - DNA, 70 bp, Artificial Sequence
  Synthetic
gccaagcatttaggtgacactatagcaggcagggcaggtgctcacgtttcagagctatgctggaaacagc

SEQ ID NO: 53067 - DNA, 70 bp, Artificial Sequence
  Synthetic
gccaagcatttaggtgacactatagtgtgtgcagaaaaatcaggcgtttcagagctatgctggaaacagc

SEQ ID NO: 53068 - DNA, 70 bp, Artificial Sequence
  Synthetic
gccaagcatttaggtgacactatagagctcgggctgacaggtgaggtttcagagctatgctggaaacagc

SEQ ID NO: 53069 - DNA, 70 bp, Artificial Sequence
  Synthetic
gccaagcatttaggtgacactatagatcccccggaggtggaggcggtttcagagctatgctggaaacagc

SEQ ID NO: 53070 - DNA, 70 bp, Artificial Sequence
  Synthetic
gccaagcatttaggtgacactatagccaaagagtctatggactgggtttcagagctatgctggaaacagc

SEQ ID NO: 53071 - DNA, 70 bp, Artificial Sequence
  Synthetic
gccaagcatttaggtgacactatagaggctgaaggtcacgctgctgtttcagagctatgctggaaacagc

SEQ ID NO: 53072 - DNA, 70 bp, Artificial Sequence
  Synthetic
gccaagcatttaggtgacactatagggggaagctccagaaggtgagtttcagagctatgctggaaacagc

SEQ ID NO: 53073 - DNA, 70 bp, Artificial Sequence
  Synthetic
gccaagcatttaggtgacactatagggcaggcgggtcagacctgcgtttcagagctatgctggaaacagc

SEQ ID NO: 53074 - DNA, 70 bp, Artificial Sequence
  Synthetic
gccaagcatttaggtgacactatagcctcgcgctactcaatgacggtttcagagctatgctggaaacagc

SEQ ID NO: 53075 - DNA, 70 bp, Artificial Sequence
  Synthetic
gccaagcatttaggtgacactatagggcgaggcaggagcgctagggtttcagagctatgctggaaacagc

SEQ ID NO: 53076 - DNA, 70 bp, Artificial Sequence
  Synthetic
gccaagcatttaggtgacactatagcaagtgtgcaccactataccgtttcagagctatgctggaaacagc

SEQ ID NO: 53077 - DNA, 70 bp, Artificial Sequence
  Synthetic
gccaagcatttaggtgacactataggccgaacctgtggtggtgaggtttcagagctatgctggaaacagc

SEQ ID NO: 53078 - DNA, 70 bp, Artificial Sequence
  Synthetic
gccaagcatttaggtgacactatagcttctcaaggacagctagttgtttcagagctatgctggaaacagc

SEQ ID NO: 53079 - DNA, 70 bp, Artificial Sequence
  Synthetic
gccaagcatttaggtgacactataggaagtggacagcgactgtgcgtttcagagctatgctggaaacagc

SEQ ID NO: 53080 - DNA, 70 bp, Artificial Sequence
  Synthetic
gccaagcatttaggtgacactatagttgaccacctccattgtcatgtttcagagctatgctggaaacagc

SEQ ID NO: 53081 - DNA, 70 bp, Artificial Sequence
  Synthetic
gccaagcatttaggtgacactatagtgtgatgcctctctggtaatgtttcagagctatgctggaaacagc

SEQ ID NO: 53082 - DNA, 70 bp, Artificial Sequence
  Synthetic
gccaagcatttaggtgacactatagaatcgcgagtgcggtcactggtttcagagctatgctggaaacagc

SEQ ID NO: 53083 - DNA, 70 bp, Artificial Sequence
  Synthetic
gccaagcatttaggtgacactatagatcatgcagtttttaccaaggtttcagagctatgctggaaacagc

SEQ ID NO: 53084 - DNA, 70 bp, Artificial Sequence
  Synthetic
gccaagcatttaggtgacactataggttatcaatctgcgaacagagtttcagagctatgctggaaacagc

SEQ ID NO: 53085 - DNA, 70 bp, Artificial Sequence
  Synthetic
gccaagcatttaggtgacactatagtcaagggtcattcgccagaggtttcagagctatgctggaaacagc

SEQ ID NO: 53086 - DNA, 70 bp, Artificial Sequence
  Synthetic
gccaagcatttaggtgacactatagcaggtctgtggctgcctagcgtttcagagctatgctggaaacagc

SEQ ID NO: 53087 - DNA, 70 bp, Artificial Sequence
  Synthetic
gccaagcatttaggtgacactatagcaacccggctttcttctgaagtttcagagctatgctggaaacagc

SEQ ID NO: 53088 - DNA, 70 bp, Artificial Sequence
  Synthetic
gccaagcatttaggtgacactatagcctacgctcgtggcgtgattgtttcagagctatgctggaaacagc

SEQ ID NO: 53089 - DNA, 70 bp, Artificial Sequence
  Synthetic
gccaagcatttaggtgacactatagaagcaggtctgtgtcctcacgtttcagagctatgctggaaacagc

SEQ ID NO: 53090 - DNA, 70 bp, Artificial Sequence
  Synthetic
gccaagcatttaggtgacactatagagtgtatctgtatcatgtgtgtttcagagctatgctggaaacagc

SEQ ID NO: 53091 - DNA, 70 bp, Artificial Sequence
  Synthetic
gccaagcatttaggtgacactatagaatattcagtcccaaaccaagtttcagagctatgctggaaacagc

SEQ ID NO: 53092 - DNA, 70 bp, Artificial Sequence
  Synthetic
gccaagcatttaggtgacactatagataaattgcaggacagaactgtttcagagctatgctggaaacagc

SEQ ID NO: 53093 - DNA, 70 bp, Artificial Sequence
  Synthetic
gccaagcatttaggtgacactatagagtccagtcgctaggacagagtttcagagctatgctggaaacagc

SEQ ID NO: 53094 - DNA, 70 bp, Artificial Sequence
  Synthetic
gccaagcatttaggtgacactatagctgctcttcctcgtcttctggtttcagagctatgctggaaacagc

SEQ ID NO: 53095 - DNA, 70 bp, Artificial Sequence
  Synthetic
gccaagcatttaggtgacactatagggtgaccaacagcagcgtgtgtttcagagctatgctggaaacagc

SEQ ID NO: 53096 - DNA, 70 bp, Artificial Sequence
  Synthetic
gccaagcatttaggtgacactatagtctggagtttgtctatgaaagtttcagagctatgctggaaacagc

SEQ ID NO: 53097 - DNA, 70 bp, Artificial Sequence
  Synthetic
gccaagcatttaggtgacactatagtaatggcactcatacatctggtttcagagctatgctggaaacagc

SEQ ID NO: 53098 - DNA, 70 bp, Artificial Sequence
  Synthetic
gccaagcatttaggtgacactatagtgatttcgtctgtgaatgaagtttcagagctatgctggaaacagc

SEQ ID NO: 53099 - DNA, 70 bp, Artificial Sequence
  Synthetic
gccaagcatttaggtgacactatagcatgagggggattaggtctcgtttcagagctatgctggaaacagc

SEQ ID NO: 53100 - DNA, 70 bp, Artificial Sequence
  Synthetic
gccaagcatttaggtgacactatagtcgacctcttcaagttttaagtttcagagctatgctggaaacagc

SEQ ID NO: 53101 - DNA, 70 bp, Artificial Sequence
  Synthetic
gccaagcatttaggtgacactatagtagtgctggactaggacagagtttcagagctatgctggaaacagc

SEQ ID NO: 53102 - DNA, 70 bp, Artificial Sequence
  Synthetic
gccaagcatttaggtgacactatagattgttgttagggctgcagagtttcagagctatgctggaaacagc

SEQ ID NO: 53103 - DNA, 70 bp, Artificial Sequence
  Synthetic
gccaagcatttaggtgacactatagcggaagccatagactctcttgtttcagagctatgctggaaacagc

SEQ ID NO: 53104 - DNA, 70 bp, Artificial Sequence
  Synthetic
gccaagcatttaggtgacactatagagcagaaggcttgctaaaaagtttcagagctatgctggaaacagc

SEQ ID NO: 53105 - DNA, 70 bp, Artificial Sequence
  Synthetic
gccaagcatttaggtgacactatagcagggtgtctatagcccgatgtttcagagctatgctggaaacagc

SEQ ID NO: 53106 - DNA, 70 bp, Artificial Sequence
  Synthetic
gccaagcatttaggtgacactatagacacgagaactcactaaagagtttcagagctatgctggaaacagc

SEQ ID NO: 53107 - DNA, 70 bp, Artificial Sequence
  Synthetic
gccaagcatttaggtgacactatagtcagtccctcacctcctgacgtttcagagctatgctggaaacagc

SEQ ID NO: 53108 - DNA, 70 bp, Artificial Sequence
  Synthetic
gccaagcatttaggtgacactatagtgaacaagttgataaagtccgtttcagagctatgctggaaacagc

SEQ ID NO: 53109 - DNA, 70 bp, Artificial Sequence
  Synthetic
gccaagcatttaggtgacactatagtcaaccttggcatgcagtcagtttcagagctatgctggaaacagc

SEQ ID NO: 53110 - DNA, 70 bp, Artificial Sequence
  Synthetic
gccaagcatttaggtgacactatagaaaagggactgaagctgaaggtttcagagctatgctggaaacagc

SEQ ID NO: 53111 - DNA, 70 bp, Artificial Sequence
  Synthetic
gccaagcatttaggtgacactatagcctgagagaaaagcaaccttgtttcagagctatgctggaaacagc

SEQ ID NO: 53112 - DNA, 70 bp, Artificial Sequence
  Synthetic
gccaagcatttaggtgacactatagatccactattgtgatgtcaagtttcagagctatgctggaaacagc

SEQ ID NO: 53113 - DNA, 70 bp, Artificial Sequence
  Synthetic
gccaagcatttaggtgacactatagagaccctgcaggaaatttacgtttcagagctatgctggaaacagc

SEQ ID NO: 53114 - DNA, 70 bp, Artificial Sequence
  Synthetic
gccaagcatttaggtgacactatagaagtgtgtgaagttgtagatgtttcagagctatgctggaaacagc

SEQ ID NO: 53115 - DNA, 70 bp, Artificial Sequence
  Synthetic
gccaagcatttaggtgacactataggagtttcagcctctgtatccgtttcagagctatgctggaaacagc

SEQ ID NO: 53116 - DNA, 70 bp, Artificial Sequence
  Synthetic
gccaagcatttaggtgacactatagtgagtggattcttgaagaaggtttcagagctatgctggaaacagc

SEQ ID NO: 53117 - DNA, 70 bp, Artificial Sequence
  Synthetic
gccaagcatttaggtgacactatagtaggagacgtatcttcctcggtttcagagctatgctggaaacagc

SEQ ID NO: 53118 - DNA, 70 bp, Artificial Sequence
  Synthetic
gccaagcatttaggtgacactataggtggaaggcggctgctaaccgtttcagagctatgctggaaacagc

SEQ ID NO: 53119 - DNA, 70 bp, Artificial Sequence
  Synthetic
gccaagcatttaggtgacactatagctttgctcgtacaaagtacagtttcagagctatgctggaaacagc

SEQ ID NO: 53120 - DNA, 70 bp, Artificial Sequence
  Synthetic
gccaagcatttaggtgacactatagcaggaagtgcccagagtaaggtttcagagctatgctggaaacagc

SEQ ID NO: 53121 - DNA, 70 bp, Artificial Sequence
  Synthetic
gccaagcatttaggtgacactatagcccatctgctgaaccctgacgtttcagagctatgctggaaacagc

SEQ ID NO: 53122 - DNA, 70 bp, Artificial Sequence
  Synthetic
gccaagcatttaggtgacactatagctcagggggtgtcagggcaggtttcagagctatgctggaaacagc

SEQ ID NO: 53123 - DNA, 70 bp, Artificial Sequence
  Synthetic
gccaagcatttaggtgacactatagagccactgtcatccgtccaagtttcagagctatgctggaaacagc

SEQ ID NO: 53124 - DNA, 70 bp, Artificial Sequence
  Synthetic
gccaagcatttaggtgacactataggggccggccgggaggagggggtttcagagctatgctggaaacagc

SEQ ID NO: 53125 - DNA, 70 bp, Artificial Sequence
  Synthetic
gccaagcatttaggtgacactatagctgaggatttaggtagacaggtttcagagctatgctggaaacagc

SEQ ID NO: 53126 - DNA, 70 bp, Artificial Sequence
  Synthetic
gccaagcatttaggtgacactatagagcagaactggaaagataaggtttcagagctatgctggaaacagc

SEQ ID NO: 53127 - DNA, 70 bp, Artificial Sequence
  Synthetic
gccaagcatttaggtgacactatagtgcttttctttgtaccaggcgtttcagagctatgctggaaacagc

SEQ ID NO: 53128 - DNA, 70 bp, Artificial Sequence
  Synthetic
gccaagcatttaggtgacactatagtggacagctgtcagaaaatcgtttcagagctatgctggaaacagc

SEQ ID NO: 53129 - DNA, 70 bp, Artificial Sequence
  Synthetic
gccaagcatttaggtgacactatagtcaatcacatgaatgacagcgtttcagagctatgctggaaacagc

SEQ ID NO: 53130 - DNA, 70 bp, Artificial Sequence
  Synthetic
gccaagcatttaggtgacactataggtgctttttatgcagccacagtttcagagctatgctggaaacagc

SEQ ID NO: 53131 - DNA, 70 bp, Artificial Sequence
  Synthetic
gccaagcatttaggtgacactatagctggacttgaggctctacaggtttcagagctatgctggaaacagc

SEQ ID NO: 53132 - DNA, 70 bp, Artificial Sequence
  Synthetic
gccaagcatttaggtgacactatagaaaacagcggcccctgaactgtttcagagctatgctggaaacagc

SEQ ID NO: 53133 - DNA, 70 bp, Artificial Sequence
  Synthetic
gccaagcatttaggtgacactatagagagatgtaagtgtatgttcgtttcagagctatgctggaaacagc

SEQ ID NO: 53134 - DNA, 70 bp, Artificial Sequence
  Synthetic
gccaagcatttaggtgacactatagagtaagtgactccagcattcgtttcagagctatgctggaaacagc

SEQ ID NO: 53135 - DNA, 70 bp, Artificial Sequence
  Synthetic
gccaagcatttaggtgacactatagctggtgttgtggaaggagcagtttcagagctatgctggaaacagc

SEQ ID NO: 53136 - DNA, 70 bp, Artificial Sequence
  Synthetic
gccaagcatttaggtgacactatagggggtggccctgacggtcatgtttcagagctatgctggaaacagc

SEQ ID NO: 53137 - DNA, 70 bp, Artificial Sequence
  Synthetic
gccaagcatttaggtgacactatagcttgccagccagaggcgctggtttcagagctatgctggaaacagc

SEQ ID NO: 53138 - DNA, 70 bp, Artificial Sequence
  Synthetic
gccaagcatttaggtgacactataggctggtgctggactttgatggtttcagagctatgctggaaacagc

SEQ ID NO: 53139 - DNA, 70 bp, Artificial Sequence
  Synthetic
gccaagcatttaggtgacactatagtgtttttgtatagaatgggggtttcagagctatgctggaaacagc

SEQ ID NO: 53140 - DNA, 70 bp, Artificial Sequence
  Synthetic
gccaagcatttaggtgacactatagctgaggcacatccctaaacagtttcagagctatgctggaaacagc

SEQ ID NO: 53141 - DNA, 70 bp, Artificial Sequence
  Synthetic
gccaagcatttaggtgacactatagtggaggctgcaggcctgagcgtttcagagctatgctggaaacagc

SEQ ID NO: 53142 - DNA, 70 bp, Artificial Sequence
  Synthetic
gccaagcatttaggtgacactatagagagaaatccaggaccctgagtttcagagctatgctggaaacagc

SEQ ID NO: 53143 - DNA, 70 bp, Artificial Sequence
  Synthetic
gccaagcatttaggtgacactatagaaaggaagctctggagaagggtttcagagctatgctggaaacagc

SEQ ID NO: 53144 - DNA, 70 bp, Artificial Sequence
  Synthetic
gccaagcatttaggtgacactatagggtgtttacttgcagacactgtttcagagctatgctggaaacagc

SEQ ID NO: 53145 - DNA, 70 bp, Artificial Sequence
  Synthetic
gccaagcatttaggtgacactataggtgccaattttcaaccagtagtttcagagctatgctggaaacagc

SEQ ID NO: 53146 - DNA, 70 bp, Artificial Sequence
  Synthetic
gccaagcatttaggtgacactatagtatcagttgtttttggggttgtttcagagctatgctggaaacagc

SEQ ID NO: 53147 - DNA, 70 bp, Artificial Sequence
  Synthetic
gccaagcatttaggtgacactatagctattctaaagctactgtgggtttcagagctatgctggaaacagc

SEQ ID NO: 53148 - DNA, 70 bp, Artificial Sequence
  Synthetic
gccaagcatttaggtgacactataggctgtatccatgctcaagaggtttcagagctatgctggaaacagc

SEQ ID NO: 53149 - DNA, 70 bp, Artificial Sequence
  Synthetic
gccaagcatttaggtgacactataggaacggatgccagatgattagtttcagagctatgctggaaacagc

SEQ ID NO: 53150 - DNA, 70 bp, Artificial Sequence
  Synthetic
gccaagcatttaggtgacactataggatggagaaatggagagcgcgtttcagagctatgctggaaacagc

SEQ ID NO: 53151 - DNA, 70 bp, Artificial Sequence
  Synthetic
gccaagcatttaggtgacactatagcccactgagccgctgctacggtttcagagctatgctggaaacagc

SEQ ID NO: 53152 - DNA, 70 bp, Artificial Sequence
  Synthetic
gccaagcatttaggtgacactatagccaactgagccgctgctacggtttcagagctatgctggaaacagc

SEQ ID NO: 53153 - DNA, 70 bp, Artificial Sequence
  Synthetic
gccaagcatttaggtgacactataggagaagtaaagctacaaaccgtttcagagctatgctggaaacagc

SEQ ID NO: 53154 - DNA, 70 bp, Artificial Sequence
  Synthetic
gccaagcatttaggtgacactatagattactgttgacatggtcgtgtttcagagctatgctggaaacagc

SEQ ID NO: 53155 - DNA, 70 bp, Artificial Sequence
  Synthetic
gccaagcatttaggtgacactatagatggagactaaatacggttcgtttcagagctatgctggaaacagc

SEQ ID NO: 53156 - DNA, 70 bp, Artificial Sequence
  Synthetic
gccaagcatttaggtgacactataggatgggggtcatttgtcttggtttcagagctatgctggaaacagc

SEQ ID NO: 53157 - DNA, 70 bp, Artificial Sequence
  Synthetic
gccaagcatttaggtgacactatagctcctttttgcagtggacacgtttcagagctatgctggaaacagc

SEQ ID NO: 53158 - DNA, 70 bp, Artificial Sequence
  Synthetic
gccaagcatttaggtgacactatagcggaatggcggatggtcagggtttcagagctatgctggaaacagc

SEQ ID NO: 53159 - DNA, 70 bp, Artificial Sequence
  Synthetic
gccaagcatttaggtgacactatagtgcgggttcagcagctcaccgtttcagagctatgctggaaacagc

SEQ ID NO: 53160 - DNA, 70 bp, Artificial Sequence
  Synthetic
gccaagcatttaggtgacactataggatacctggcggattgttgagtttcagagctatgctggaaacagc

SEQ ID NO: 53161 - DNA, 70 bp, Artificial Sequence
  Synthetic
gccaagcatttaggtgacactatagacccagatcccctcacctgagtttcagagctatgctggaaacagc

SEQ ID NO: 53162 - DNA, 70 bp, Artificial Sequence
  Synthetic
gccaagcatttaggtgacactatagtgaagatgtggaaatcacacgtttcagagctatgctggaaacagc

SEQ ID NO: 53163 - DNA, 70 bp, Artificial Sequence
  Synthetic
gccaagcatttaggtgacactataggttgccccccgccccgctgcgtttcagagctatgctggaaacagc

SEQ ID NO: 53164 - DNA, 70 bp, Artificial Sequence
  Synthetic
gccaagcatttaggtgacactatagtagctggggagttgtcaggcgtttcagagctatgctggaaacagc

SEQ ID NO: 53165 - DNA, 70 bp, Artificial Sequence
  Synthetic
gccaagcatttaggtgacactatagaaggtgcggcccgcctagacgtttcagagctatgctggaaacagc

SEQ ID NO: 53166 - DNA, 70 bp, Artificial Sequence
  Synthetic
gccaagcatttaggtgacactataggaggccggcctgggctaggcgtttcagagctatgctggaaacagc

SEQ ID NO: 53167 - DNA, 70 bp, Artificial Sequence
  Synthetic
gccaagcatttaggtgacactataggttcggatgatgcttcgatagtttcagagctatgctggaaacagc

SEQ ID NO: 53168 - DNA, 70 bp, Artificial Sequence
  Synthetic
gccaagcatttaggtgacactatagaatgtttgctttcctcagccgtttcagagctatgctggaaacagc

SEQ ID NO: 53169 - DNA, 70 bp, Artificial Sequence
  Synthetic
gccaagcatttaggtgacactatagggggacacatatggaggacagtttcagagctatgctggaaacagc

SEQ ID NO: 53170 - DNA, 70 bp, Artificial Sequence
  Synthetic
gccaagcatttaggtgacactatagtcacagaagagtagatgactgtttcagagctatgctggaaacagc

SEQ ID NO: 53171 - DNA, 70 bp, Artificial Sequence
  Synthetic
gccaagcatttaggtgacactatagcactctgggtaaggggctaggtttcagagctatgctggaaacagc

SEQ ID NO: 53172 - DNA, 70 bp, Artificial Sequence
  Synthetic
gccaagcatttaggtgacactatagggctaagtgttacaaagacagtttcagagctatgctggaaacagc

SEQ ID NO: 53173 - DNA, 70 bp, Artificial Sequence
  Synthetic
gccaagcatttaggtgacactatagagctggaaagatcagctctagtttcagagctatgctggaaacagc

SEQ ID NO: 53174 - DNA, 70 bp, Artificial Sequence
  Synthetic
gccaagcatttaggtgacactataggacgtgtggactcatctgtggtttcagagctatgctggaaacagc

SEQ ID NO: 53175 - DNA, 70 bp, Artificial Sequence
  Synthetic
gccaagcatttaggtgacactatagggggagaagcagcattgaaggtttcagagctatgctggaaacagc

SEQ ID NO: 53176 - DNA, 70 bp, Artificial Sequence
  Synthetic
gccaagcatttaggtgacactatagaccccttagcgactgtgagggtttcagagctatgctggaaacagc

SEQ ID NO: 53177 - DNA, 70 bp, Artificial Sequence
  Synthetic
gccaagcatttaggtgacactatagctccgtggatgaaacctcacgtttcagagctatgctggaaacagc

SEQ ID NO: 53178 - DNA, 70 bp, Artificial Sequence
  Synthetic
gccaagcatttaggtgacactatagctattcagcagtagcctttggtttcagagctatgctggaaacagc

SEQ ID NO: 53179 - DNA, 70 bp, Artificial Sequence
  Synthetic
gccaagcatttaggtgacactatagacgcccttggaacaatcggcgtttcagagctatgctggaaacagc

SEQ ID NO: 53180 - DNA, 70 bp, Artificial Sequence
  Synthetic
gccaagcatttaggtgacactatagactcctgtggagagctgagggtttcagagctatgctggaaacagc

SEQ ID NO: 53181 - DNA, 70 bp, Artificial Sequence
  Synthetic
gccaagcatttaggtgacactatagcagccttggctcctggtaatgtttcagagctatgctggaaacagc

SEQ ID NO: 53182 - DNA, 70 bp, Artificial Sequence
  Synthetic
gccaagcatttaggtgacactatagttgtttacttttcgctaggagtttcagagctatgctggaaacagc

SEQ ID NO: 53183 - DNA, 70 bp, Artificial Sequence
  Synthetic
gccaagcatttaggtgacactatagacagaagactatgttcagacgtttcagagctatgctggaaacagc

SEQ ID NO: 53184 - DNA, 70 bp, Artificial Sequence
  Synthetic
gccaagcatttaggtgacactatagttgcgcgcaaaatctacaaggtttcagagctatgctggaaacagc

SEQ ID NO: 53185 - DNA, 70 bp, Artificial Sequence
  Synthetic
gccaagcatttaggtgacactatagcctatttgttctagttcagggtttcagagctatgctggaaacagc

SEQ ID NO: 53186 - DNA, 70 bp, Artificial Sequence
  Synthetic
gccaagcatttaggtgacactatagggtccaggtgttcatgtcaggtttcagagctatgctggaaacagc

SEQ ID NO: 53187 - DNA, 70 bp, Artificial Sequence
  Synthetic
gccaagcatttaggtgacactatagtatgttatacctcggtagttgtttcagagctatgctggaaacagc

SEQ ID NO: 53188 - DNA, 70 bp, Artificial Sequence
  Synthetic
gccaagcatttaggtgacactatagggggctggggctgggctcaggtttcagagctatgctggaaacagc

SEQ ID NO: 53189 - DNA, 70 bp, Artificial Sequence
  Synthetic
gccaagcatttaggtgacactatagccggcgggggtcacagctgcgtttcagagctatgctggaaacagc

SEQ ID NO: 53190 - DNA, 70 bp, Artificial Sequence
  Synthetic
gccaagcatttaggtgacactatagcttcatcccggaagatctgggtttcagagctatgctggaaacagc

SEQ ID NO: 53191 - DNA, 70 bp, Artificial Sequence
  Synthetic
gccaagcatttaggtgacactatagagaactcttgaagagtttgtgtttcagagctatgctggaaacagc

SEQ ID NO: 53192 - DNA, 70 bp, Artificial Sequence
  Synthetic
gccaagcatttaggtgacactatagacaaaagtctctagcttttcgtttcagagctatgctggaaacagc

SEQ ID NO: 53193 - DNA, 70 bp, Artificial Sequence
  Synthetic
gccaagcatttaggtgacactataggcagcagggaagtttaaaaggtttcagagctatgctggaaacagc

SEQ ID NO: 53194 - DNA, 70 bp, Artificial Sequence
  Synthetic
gccaagcatttaggtgacactataggatagaggcagagatgatcagtttcagagctatgctggaaacagc

SEQ ID NO: 53195 - DNA, 70 bp, Artificial Sequence
  Synthetic
gccaagcatttaggtgacactatagttctgaagttcactgaacttgtttcagagctatgctggaaacagc

SEQ ID NO: 53196 - DNA, 70 bp, Artificial Sequence
  Synthetic
gccaagcatttaggtgacactataggcatggactaattagtctccgtttcagagctatgctggaaacagc

SEQ ID NO: 53197 - DNA, 70 bp, Artificial Sequence
  Synthetic
gccaagcatttaggtgacactatagggatcgttgtgggctcataggtttcagagctatgctggaaacagc

SEQ ID NO: 53198 - DNA, 70 bp, Artificial Sequence
  Synthetic
gccaagcatttaggtgacactatagagctgtgagaagaaggaaaggtttcagagctatgctggaaacagc

SEQ ID NO: 53199 - DNA, 70 bp, Artificial Sequence
  Synthetic
gccaagcatttaggtgacactatagccacaaattgaccggcggtcgtttcagagctatgctggaaacagc

SEQ ID NO: 53200 - DNA, 70 bp, Artificial Sequence
  Synthetic
gccaagcatttaggtgacactatagaccagtggttgggtgtgaatgtttcagagctatgctggaaacagc

SEQ ID NO: 53201 - DNA, 70 bp, Artificial Sequence
  Synthetic
gccaagcatttaggtgacactatagtgtcaactgggaaatcaaaagtttcagagctatgctggaaacagc

SEQ ID NO: 53202 - DNA, 70 bp, Artificial Sequence
  Synthetic
gccaagcatttaggtgacactataggcaatcagacagccctcagagtttcagagctatgctggaaacagc

SEQ ID NO: 53203 - DNA, 70 bp, Artificial Sequence
  Synthetic
gccaagcatttaggtgacactatagatccgaaagcggcatcggtggtttcagagctatgctggaaacagc

SEQ ID NO: 53204 - DNA, 70 bp, Artificial Sequence
  Synthetic
gccaagcatttaggtgacactatagactctgtgtgattctcatgggtttcagagctatgctggaaacagc

SEQ ID NO: 53205 - DNA, 70 bp, Artificial Sequence
  Synthetic
gccaagcatttaggtgacactatagtgatattgaatggggcttctgtttcagagctatgctggaaacagc

SEQ ID NO: 53206 - DNA, 70 bp, Artificial Sequence
  Synthetic
gccaagcatttaggtgacactatagggaggagacccttcaggacggtttcagagctatgctggaaacagc

SEQ ID NO: 53207 - DNA, 70 bp, Artificial Sequence
  Synthetic
gccaagcatttaggtgacactatagtccaaagggcaaggttaggtgtttcagagctatgctggaaacagc

SEQ ID NO: 53208 - DNA, 70 bp, Artificial Sequence
  Synthetic
gccaagcatttaggtgacactatagataaagttgctgctctatgtgtttcagagctatgctggaaacagc

SEQ ID NO: 53209 - DNA, 70 bp, Artificial Sequence
  Synthetic
gccaagcatttaggtgacactatagggacccttagcctcgatcacgtttcagagctatgctggaaacagc

SEQ ID NO: 53210 - DNA, 70 bp, Artificial Sequence
  Synthetic
gccaagcatttaggtgacactatagagctctgcactgtcctagtcgtttcagagctatgctggaaacagc

SEQ ID NO: 53211 - DNA, 70 bp, Artificial Sequence
  Synthetic
gccaagcatttaggtgacactatagtgtgcggcaagaacgcaagggtttcagagctatgctggaaacagc

SEQ ID NO: 53212 - DNA, 70 bp, Artificial Sequence
  Synthetic
gccaagcatttaggtgacactatagtctgtagtgaagtccgaactgtttcagagctatgctggaaacagc

SEQ ID NO: 53213 - DNA, 70 bp, Artificial Sequence
  Synthetic
gccaagcatttaggtgacactatagggtggcctgtgctgaaagctgtttcagagctatgctggaaacagc

SEQ ID NO: 53214 - DNA, 70 bp, Artificial Sequence
  Synthetic
gccaagcatttaggtgacactataggttaaaatggctcccttttcgtttcagagctatgctggaaacagc

SEQ ID NO: 53215 - DNA, 70 bp, Artificial Sequence
  Synthetic
gccaagcatttaggtgacactatagttaacttagtctagggggacgtttcagagctatgctggaaacagc

SEQ ID NO: 53216 - DNA, 70 bp, Artificial Sequence
  Synthetic
gccaagcatttaggtgacactatagttcccacttcttcagcctatgtttcagagctatgctggaaacagc

SEQ ID NO: 53217 - DNA, 70 bp, Artificial Sequence
  Synthetic
gccaagcatttaggtgacactatagcgtattggggactattgctggtttcagagctatgctggaaacagc

SEQ ID NO: 53218 - DNA, 70 bp, Artificial Sequence
  Synthetic
gccaagcatttaggtgacactataggacccgagacaagacctagagtttcagagctatgctggaaacagc

SEQ ID NO: 53219 - DNA, 70 bp, Artificial Sequence
  Synthetic
gccaagcatttaggtgacactataggcggctggcagtggctcagtgtttcagagctatgctggaaacagc

SEQ ID NO: 53220 - DNA, 70 bp, Artificial Sequence
  Synthetic
gccaagcatttaggtgacactatagcacggagcagctgcgcccatgtttcagagctatgctggaaacagc

SEQ ID NO: 53221 - DNA, 70 bp, Artificial Sequence
  Synthetic
gccaagcatttaggtgacactatagaatctgtagaacaagagttcgtttcagagctatgctggaaacagc

SEQ ID NO: 53222 - DNA, 70 bp, Artificial Sequence
  Synthetic
gccaagcatttaggtgacactatagaggttcaggatgatcatccagtttcagagctatgctggaaacagc

SEQ ID NO: 53223 - DNA, 70 bp, Artificial Sequence
  Synthetic
gccaagcatttaggtgacactatagtaacacactcgcatcttccagtttcagagctatgctggaaacagc

SEQ ID NO: 53224 - DNA, 70 bp, Artificial Sequence
  Synthetic
gccaagcatttaggtgacactatagtggatagaagcatttcaggagtttcagagctatgctggaaacagc

SEQ ID NO: 53225 - DNA, 70 bp, Artificial Sequence
  Synthetic
gccaagcatttaggtgacactatagtctctttaatcagaagagacgtttcagagctatgctggaaacagc

SEQ ID NO: 53226 - DNA, 70 bp, Artificial Sequence
  Synthetic
gccaagcatttaggtgacactatagtgctcactttcttccaatgggtttcagagctatgctggaaacagc

SEQ ID NO: 53227 - DNA, 70 bp, Artificial Sequence
  Synthetic
gccaagcatttaggtgacactataggtccagggactacatttcaggtttcagagctatgctggaaacagc

SEQ ID NO: 53228 - DNA, 70 bp, Artificial Sequence
  Synthetic
gccaagcatttaggtgacactatagggaacaccaaccatgaatgggtttcagagctatgctggaaacagc

SEQ ID NO: 53229 - DNA, 70 bp, Artificial Sequence
  Synthetic
gccaagcatttaggtgacactatagctggctacgttgattcattggtttcagagctatgctggaaacagc

SEQ ID NO: 53230 - DNA, 70 bp, Artificial Sequence
  Synthetic
gccaagcatttaggtgacactataggttgtcttactcttgttgacgtttcagagctatgctggaaacagc

SEQ ID NO: 53231 - DNA, 70 bp, Artificial Sequence
  Synthetic
gccaagcatttaggtgacactatagtatatagccatgaatggagagtttcagagctatgctggaaacagc

SEQ ID NO: 53232 - DNA, 70 bp, Artificial Sequence
  Synthetic
gccaagcatttaggtgacactatagccagagacctctttcactatgtttcagagctatgctggaaacagc

SEQ ID NO: 53233 - DNA, 70 bp, Artificial Sequence
  Synthetic
gccaagcatttaggtgacactatagccccagcccctcacgtagtcgtttcagagctatgctggaaacagc

SEQ ID NO: 53234 - DNA, 70 bp, Artificial Sequence
  Synthetic
gccaagcatttaggtgacactatagcgcggcggggtggcctaggcgtttcagagctatgctggaaacagc

SEQ ID NO: 53235 - DNA, 70 bp, Artificial Sequence
  Synthetic
gccaagcatttaggtgacactatagttggcactgctcagggagacgtttcagagctatgctggaaacagc

SEQ ID NO: 53236 - DNA, 70 bp, Artificial Sequence
  Synthetic
gccaagcatttaggtgacactatagaatcagctcttagcagacatgtttcagagctatgctggaaacagc

SEQ ID NO: 53237 - DNA, 70 bp, Artificial Sequence
  Synthetic
gccaagcatttaggtgacactatagcacttcaagtgtacatcagtgtttcagagctatgctggaaacagc

SEQ ID NO: 53238 - DNA, 70 bp, Artificial Sequence
  Synthetic
gccaagcatttaggtgacactatagctggcttcaggaagcgtagcgtttcagagctatgctggaaacagc

SEQ ID NO: 53239 - DNA, 70 bp, Artificial Sequence
  Synthetic
gccaagcatttaggtgacactatagcgcccacttcctgcccgtccgtttcagagctatgctggaaacagc

SEQ ID NO: 53240 - DNA, 70 bp, Artificial Sequence
  Synthetic
gccaagcatttaggtgacactatagtggtctcctgaggccctgaggtttcagagctatgctggaaacagc

SEQ ID NO: 53241 - DNA, 70 bp, Artificial Sequence
  Synthetic
gccaagcatttaggtgacactatagcccttcgccaagttcatctagtttcagagctatgctggaaacagc

SEQ ID NO: 53242 - DNA, 70 bp, Artificial Sequence
  Synthetic
gccaagcatttaggtgacactataggaggccagtgcgcactagctgtttcagagctatgctggaaacagc

SEQ ID NO: 53243 - DNA, 70 bp, Artificial Sequence
  Synthetic
gccaagcatttaggtgacactatagtcctctggagggtcacagccgtttcagagctatgctggaaacagc

SEQ ID NO: 53244 - DNA, 70 bp, Artificial Sequence
  Synthetic
gccaagcatttaggtgacactatagcttgcagtcatctgtgaactgtttcagagctatgctggaaacagc

SEQ ID NO: 53245 - DNA, 70 bp, Artificial Sequence
  Synthetic
gccaagcatttaggtgacactatagtacagactcaagtttcgcttgtttcagagctatgctggaaacagc

SEQ ID NO: 53246 - DNA, 70 bp, Artificial Sequence
  Synthetic
gccaagcatttaggtgacactatagcatttccttcccaggatctagtttcagagctatgctggaaacagc

SEQ ID NO: 53247 - DNA, 70 bp, Artificial Sequence
  Synthetic
gccaagcatttaggtgacactatagaacagcccactttcttcctagtttcagagctatgctggaaacagc

SEQ ID NO: 53248 - DNA, 70 bp, Artificial Sequence
  Synthetic
gccaagcatttaggtgacactataggagggccaggcagcacctatgtttcagagctatgctggaaacagc

SEQ ID NO: 53249 - DNA, 70 bp, Artificial Sequence
  Synthetic
gccaagcatttaggtgacactatagatacagttcaggtactttgtgtttcagagctatgctggaaacagc

SEQ ID NO: 53250 - DNA, 70 bp, Artificial Sequence
  Synthetic
gccaagcatttaggtgacactatagcaggacacgtcatgctaatggtttcagagctatgctggaaacagc

SEQ ID NO: 53251 - DNA, 70 bp, Artificial Sequence
  Synthetic
gccaagcatttaggtgacactatagcagcttcttccgagggtgacgtttcagagctatgctggaaacagc

SEQ ID NO: 53252 - DNA, 70 bp, Artificial Sequence
  Synthetic
gccaagcatttaggtgacactatagaattgacaaagaagttgcaggtttcagagctatgctggaaacagc

SEQ ID NO: 53253 - DNA, 70 bp, Artificial Sequence
  Synthetic
gccaagcatttaggtgacactatagccccgtggctattcctaggtgtttcagagctatgctggaaacagc

SEQ ID NO: 53254 - DNA, 70 bp, Artificial Sequence
  Synthetic
gccaagcatttaggtgacactatagggcgtgtgggtggcagtcaggtttcagagctatgctggaaacagc

SEQ ID NO: 53255 - DNA, 70 bp, Artificial Sequence
  Synthetic
gccaagcatttaggtgacactatagcagtgatgttgcggattatcgtttcagagctatgctggaaacagc

SEQ ID NO: 53256 - DNA, 70 bp, Artificial Sequence
  Synthetic
gccaagcatttaggtgacactatagtgcagtgtttttgaaatgcagtttcagagctatgctggaaacagc

SEQ ID NO: 53257 - DNA, 70 bp, Artificial Sequence
  Synthetic
gccaagcatttaggtgacactatagccaacagtgatttgagtctggtttcagagctatgctggaaacagc

SEQ ID NO: 53258 - DNA, 70 bp, Artificial Sequence
  Synthetic
gccaagcatttaggtgacactatagtggactggagagaaggcactgtttcagagctatgctggaaacagc

SEQ ID NO: 53259 - DNA, 70 bp, Artificial Sequence
  Synthetic
gccaagcatttaggtgacactatagcctcagtatccacacataaagtttcagagctatgctggaaacagc

SEQ ID NO: 53260 - DNA, 70 bp, Artificial Sequence
  Synthetic
gccaagcatttaggtgacactatagacgtccaccttgagtcctacgtttcagagctatgctggaaacagc

SEQ ID NO: 53261 - DNA, 70 bp, Artificial Sequence
  Synthetic
gccaagcatttaggtgacactatagcaagcagttggtagaagactgtttcagagctatgctggaaacagc

SEQ ID NO: 53262 - DNA, 70 bp, Artificial Sequence
  Synthetic
gccaagcatttaggtgacactatagtgggggctcgcggacgtgaagtttcagagctatgctggaaacagc

SEQ ID NO: 53263 - DNA, 70 bp, Artificial Sequence
  Synthetic
gccaagcatttaggtgacactatagctccttccccttcgggtctggtttcagagctatgctggaaacagc

SEQ ID NO: 53264 - DNA, 70 bp, Artificial Sequence
  Synthetic
gccaagcatttaggtgacactatagcatccactatcagtgctagagtttcagagctatgctggaaacagc

SEQ ID NO: 53265 - DNA, 70 bp, Artificial Sequence
  Synthetic
gccaagcatttaggtgacactatagccacctggggggagccaaacgtttcagagctatgctggaaacagc

SEQ ID NO: 53266 - DNA, 70 bp, Artificial Sequence
  Synthetic
gccaagcatttaggtgacactatagatatgactcactttaccctggtttcagagctatgctggaaacagc

SEQ ID NO: 53267 - DNA, 70 bp, Artificial Sequence
  Synthetic
gccaagcatttaggtgacactatagagttgtgttcccgagactacgtttcagagctatgctggaaacagc

SEQ ID NO: 53268 - DNA, 70 bp, Artificial Sequence
  Synthetic
gccaagcatttaggtgacactatagatcatgaatgatgactgaacgtttcagagctatgctggaaacagc

SEQ ID NO: 53269 - DNA, 70 bp, Artificial Sequence
  Synthetic
gccaagcatttaggtgacactataggtggtattctctgaaatctggtttcagagctatgctggaaacagc

SEQ ID NO: 53270 - DNA, 70 bp, Artificial Sequence
  Synthetic
gccaagcatttaggtgacactatagctacaagtcctccttcaaaggtttcagagctatgctggaaacagc

SEQ ID NO: 53271 - DNA, 70 bp, Artificial Sequence
  Synthetic
gccaagcatttaggtgacactataggacaggctatgtctgatcccgtttcagagctatgctggaaacagc

SEQ ID NO: 53272 - DNA, 70 bp, Artificial Sequence
  Synthetic
gccaagcatttaggtgacactataggtaaaacctaaggacatgctgtttcagagctatgctggaaacagc

SEQ ID NO: 53273 - DNA, 70 bp, Artificial Sequence
  Synthetic
gccaagcatttaggtgacactataggtttctctagtactttccacgtttcagagctatgctggaaacagc

SEQ ID NO: 53274 - DNA, 70 bp, Artificial Sequence
  Synthetic
gccaagcatttaggtgacactatagcaatcccttacggaagtgatgtttcagagctatgctggaaacagc

SEQ ID NO: 53275 - DNA, 70 bp, Artificial Sequence
  Synthetic
gccaagcatttaggtgacactataggctgggaatacagtactcaagtttcagagctatgctggaaacagc

SEQ ID NO: 53276 - DNA, 70 bp, Artificial Sequence
  Synthetic
gccaagcatttaggtgacactatagagcagaagccgcagctctgcgtttcagagctatgctggaaacagc

SEQ ID NO: 53277 - DNA, 70 bp, Artificial Sequence
  Synthetic
gccaagcatttaggtgacactatagcctgtcagtttacagcttttgtttcagagctatgctggaaacagc

SEQ ID NO: 53278 - DNA, 70 bp, Artificial Sequence
  Synthetic
gccaagcatttaggtgacactatagtcacggagcattttttgcaggtttcagagctatgctggaaacagc

SEQ ID NO: 53279 - DNA, 70 bp, Artificial Sequence
  Synthetic
gccaagcatttaggtgacactatagtcagatgtctttcccacagtgtttcagagctatgctggaaacagc

SEQ ID NO: 53280 - DNA, 70 bp, Artificial Sequence
  Synthetic
gccaagcatttaggtgacactatagacagaagcagttcaggcagtgtttcagagctatgctggaaacagc

SEQ ID NO: 53281 - DNA, 70 bp, Artificial Sequence
  Synthetic
gccaagcatttaggtgacactatagccctggcttagggccctgccgtttcagagctatgctggaaacagc

SEQ ID NO: 53282 - DNA, 70 bp, Artificial Sequence
  Synthetic
gccaagcatttaggtgacactatagcggaatggacactgacatctgtttcagagctatgctggaaacagc

SEQ ID NO: 53283 - DNA, 70 bp, Artificial Sequence
  Synthetic
gccaagcatttaggtgacactataggtcctggcctggaggtgtgagtttcagagctatgctggaaacagc

SEQ ID NO: 53284 - DNA, 70 bp, Artificial Sequence
  Synthetic
gccaagcatttaggtgacactataggtgtcacagctgcaactccggtttcagagctatgctggaaacagc

SEQ ID NO: 53285 - DNA, 70 bp, Artificial Sequence
  Synthetic
gccaagcatttaggtgacactataggtccgggaggaccgctagacgtttcagagctatgctggaaacagc

SEQ ID NO: 53286 - DNA, 70 bp, Artificial Sequence
  Synthetic
gccaagcatttaggtgacactataggccatgggacccgactaggtgtttcagagctatgctggaaacagc

SEQ ID NO: 53287 - DNA, 70 bp, Artificial Sequence
  Synthetic
gccaagcatttaggtgacactatagctgcgcctgtatcatgactggtttcagagctatgctggaaacagc

SEQ ID NO: 53288 - DNA, 70 bp, Artificial Sequence
  Synthetic
gccaagcatttaggtgacactatagttctagggttagggcttcacgtttcagagctatgctggaaacagc

SEQ ID NO: 53289 - DNA, 70 bp, Artificial Sequence
  Synthetic
gccaagcatttaggtgacactatagtggacctgcgctcttttcacgtttcagagctatgctggaaacagc

SEQ ID NO: 53290 - DNA, 70 bp, Artificial Sequence
  Synthetic
gccaagcatttaggtgacactatagtgactcagcagttctacttcgtttcagagctatgctggaaacagc

SEQ ID NO: 53291 - DNA, 70 bp, Artificial Sequence
  Synthetic
gccaagcatttaggtgacactatagtcagcctagcatatctcaaagtttcagagctatgctggaaacagc

SEQ ID NO: 53292 - DNA, 70 bp, Artificial Sequence
  Synthetic
gccaagcatttaggtgacactatagtttggttgtggaaagtaagtgtttcagagctatgctggaaacagc

SEQ ID NO: 53293 - DNA, 70 bp, Artificial Sequence
  Synthetic
gccaagcatttaggtgacactatagtgtacggctccggacactgagtttcagagctatgctggaaacagc

SEQ ID NO: 53294 - DNA, 70 bp, Artificial Sequence
  Synthetic
gccaagcatttaggtgacactatagcgaatgaactccagatgaaagtttcagagctatgctggaaacagc

SEQ ID NO: 53295 - DNA, 70 bp, Artificial Sequence
  Synthetic
gccaagcatttaggtgacactatagtcggaggggggaagggctgagtttcagagctatgctggaaacagc

SEQ ID NO: 53296 - DNA, 70 bp, Artificial Sequence
  Synthetic
gccaagcatttaggtgacactataggaaggatgttgagttcaatggtttcagagctatgctggaaacagc

SEQ ID NO: 53297 - DNA, 70 bp, Artificial Sequence
  Synthetic
gccaagcatttaggtgacactatagactgtaatttgtgattgtcggtttcagagctatgctggaaacagc

SEQ ID NO: 53298 - DNA, 70 bp, Artificial Sequence
  Synthetic
gccaagcatttaggtgacactatagcgaagctacacctgcagaatgtttcagagctatgctggaaacagc

SEQ ID NO: 53299 - DNA, 70 bp, Artificial Sequence
  Synthetic
gccaagcatttaggtgacactatagtgtccaagtccaaatcctgagtttcagagctatgctggaaacagc

SEQ ID NO: 53300 - DNA, 70 bp, Artificial Sequence
  Synthetic
gccaagcatttaggtgacactatagctttcagttatgcttgcggcgtttcagagctatgctggaaacagc

SEQ ID NO: 53301 - DNA, 70 bp, Artificial Sequence
  Synthetic
gccaagcatttaggtgacactatagtcaaattcaaactacagctcgtttcagagctatgctggaaacagc

SEQ ID NO: 53302 - DNA, 70 bp, Artificial Sequence
  Synthetic
gccaagcatttaggtgacactatagctggcagtcagtccatgcccgtttcagagctatgctggaaacagc

SEQ ID NO: 53303 - DNA, 70 bp, Artificial Sequence
  Synthetic
gccaagcatttaggtgacactatagggtgacactaagtcccagacgtttcagagctatgctggaaacagc

SEQ ID NO: 53304 - DNA, 70 bp, Artificial Sequence
  Synthetic
gccaagcatttaggtgacactatagggtccacgaggagctctgaggtttcagagctatgctggaaacagc

SEQ ID NO: 53305 - DNA, 70 bp, Artificial Sequence
  Synthetic
gccaagcatttaggtgacactatagagtctccaaaaagaagctcagtttcagagctatgctggaaacagc

SEQ ID NO: 53306 - DNA, 70 bp, Artificial Sequence
  Synthetic
gccaagcatttaggtgacactatagtctcttccctaacaagttacgtttcagagctatgctggaaacagc

SEQ ID NO: 53307 - DNA, 70 bp, Artificial Sequence
  Synthetic
gccaagcatttaggtgacactatagtcatcatgatgctttggtgggtttcagagctatgctggaaacagc

SEQ ID NO: 53308 - DNA, 70 bp, Artificial Sequence
  Synthetic
gccaagcatttaggtgacactataggacgatgacattgactggctgtttcagagctatgctggaaacagc

SEQ ID NO: 53309 - DNA, 70 bp, Artificial Sequence
  Synthetic
gccaagcatttaggtgacactataggcttctaaaactggaatgacgtttcagagctatgctggaaacagc

SEQ ID NO: 53310 - DNA, 70 bp, Artificial Sequence
  Synthetic
gccaagcatttaggtgacactatagtggattcatgtgcacatgtcgtttcagagctatgctggaaacagc

SEQ ID NO: 53311 - DNA, 70 bp, Artificial Sequence
  Synthetic
gccaagcatttaggtgacactatagagctgctcaacttagagtgagtttcagagctatgctggaaacagc

SEQ ID NO: 53312 - DNA, 70 bp, Artificial Sequence
  Synthetic
gccaagcatttaggtgacactatagctgccccaagctcatctagcgtttcagagctatgctggaaacagc

SEQ ID NO: 53313 - DNA, 70 bp, Artificial Sequence
  Synthetic
gccaagcatttaggtgacactatagtgcaaccctggtgttcgagggtttcagagctatgctggaaacagc

SEQ ID NO: 53314 - DNA, 70 bp, Artificial Sequence
  Synthetic
gccaagcatttaggtgacactatagtgcaaaactcacttttgaaggtttcagagctatgctggaaacagc

SEQ ID NO: 53315 - DNA, 70 bp, Artificial Sequence
  Synthetic
gccaagcatttaggtgacactatagggcagggagccagtctcagggtttcagagctatgctggaaacagc

SEQ ID NO: 53316 - DNA, 70 bp, Artificial Sequence
  Synthetic
gccaagcatttaggtgacactatagccttggcgtggcgtcatacggtttcagagctatgctggaaacagc

SEQ ID NO: 53317 - DNA, 70 bp, Artificial Sequence
  Synthetic
gccaagcatttaggtgacactatagtgagatggaaaggattgcatgtttcagagctatgctggaaacagc

SEQ ID NO: 53318 - DNA, 70 bp, Artificial Sequence
  Synthetic
gccaagcatttaggtgacactatagctacagcaggagaaagttgagtttcagagctatgctggaaacagc

SEQ ID NO: 53319 - DNA, 70 bp, Artificial Sequence
  Synthetic
gccaagcatttaggtgacactatagtatgctatagttcatcgtgtgtttcagagctatgctggaaacagc

SEQ ID NO: 53320 - DNA, 70 bp, Artificial Sequence
  Synthetic
gccaagcatttaggtgacactatagccacctaggtggtcagttccgtttcagagctatgctggaaacagc

SEQ ID NO: 53321 - DNA, 70 bp, Artificial Sequence
  Synthetic
gccaagcatttaggtgacactatagggtttagagttcatcgtgttgtttcagagctatgctggaaacagc

SEQ ID NO: 53322 - DNA, 70 bp, Artificial Sequence
  Synthetic
gccaagcatttaggtgacactatagcagggtctgcgcaagatgttgtttcagagctatgctggaaacagc

SEQ ID NO: 53323 - DNA, 70 bp, Artificial Sequence
  Synthetic
gccaagcatttaggtgacactatagctgctgagtctgacgggaaggtttcagagctatgctggaaacagc

SEQ ID NO: 53324 - DNA, 70 bp, Artificial Sequence
  Synthetic
gccaagcatttaggtgacactatagagttggcttcaatgtattcggtttcagagctatgctggaaacagc

SEQ ID NO: 53325 - DNA, 70 bp, Artificial Sequence
  Synthetic
gccaagcatttaggtgacactataggcctatttctgagtgggatggtttcagagctatgctggaaacagc

SEQ ID NO: 53326 - DNA, 70 bp, Artificial Sequence
  Synthetic
gccaagcatttaggtgacactatagttccgaagtttacactgtgcgtttcagagctatgctggaaacagc

SEQ ID NO: 53327 - DNA, 70 bp, Artificial Sequence
  Synthetic
gccaagcatttaggtgacactatagctagggtgggaggtcatgtggtttcagagctatgctggaaacagc

SEQ ID NO: 53328 - DNA, 70 bp, Artificial Sequence
  Synthetic
gccaagcatttaggtgacactataggcccctgcattactgagatcgtttcagagctatgctggaaacagc

SEQ ID NO: 53329 - DNA, 70 bp, Artificial Sequence
  Synthetic
gccaagcatttaggtgacactatagtcctgtatgaccgagggtaagtttcagagctatgctggaaacagc

SEQ ID NO: 53330 - DNA, 70 bp, Artificial Sequence
  Synthetic
gccaagcatttaggtgacactatagcacaacaatcacaccgagatgtttcagagctatgctggaaacagc

SEQ ID NO: 53331 - DNA, 70 bp, Artificial Sequence
  Synthetic
gccaagcatttaggtgacactataggccccacagcctcggagtctgtttcagagctatgctggaaacagc

SEQ ID NO: 53332 - DNA, 70 bp, Artificial Sequence
  Synthetic
gccaagcatttaggtgacactatagaataaggacccaggtttatggtttcagagctatgctggaaacagc

SEQ ID NO: 53333 - DNA, 70 bp, Artificial Sequence
  Synthetic
gccaagcatttaggtgacactatagtgctgtctgttgaccatgaagtttcagagctatgctggaaacagc

SEQ ID NO: 53334 - DNA, 70 bp, Artificial Sequence
  Synthetic
gccaagcatttaggtgacactatagacccacgtgccttcacacttgtttcagagctatgctggaaacagc

SEQ ID NO: 53335 - DNA, 70 bp, Artificial Sequence
  Synthetic
gccaagcatttaggtgacactataggtgccagcctgtcttaggccgtttcagagctatgctggaaacagc

SEQ ID NO: 53336 - DNA, 70 bp, Artificial Sequence
  Synthetic
gccaagcatttaggtgacactatagccatctggattcatgttttcgtttcagagctatgctggaaacagc

SEQ ID NO: 53337 - DNA, 70 bp, Artificial Sequence
  Synthetic
gccaagcatttaggtgacactatagatctgtcccttgtctgattagtttcagagctatgctggaaacagc

SEQ ID NO: 53338 - DNA, 70 bp, Artificial Sequence
  Synthetic
gccaagcatttaggtgacactatagagactcagggcaccacaacggtttcagagctatgctggaaacagc

SEQ ID NO: 53339 - DNA, 70 bp, Artificial Sequence
  Synthetic
gccaagcatttaggtgacactatagtaaggcactgtgacatgaaagtttcagagctatgctggaaacagc

SEQ ID NO: 53340 - DNA, 70 bp, Artificial Sequence
  Synthetic
gccaagcatttaggtgacactataggaggcacttttgggattcaagtttcagagctatgctggaaacagc

SEQ ID NO: 53341 - DNA, 70 bp, Artificial Sequence
  Synthetic
gccaagcatttaggtgacactatagaaggctcaggctgttctcaagtttcagagctatgctggaaacagc

SEQ ID NO: 53342 - DNA, 70 bp, Artificial Sequence
  Synthetic
gccaagcatttaggtgacactataggccactggtgtgcaggtgtggtttcagagctatgctggaaacagc

SEQ ID NO: 53343 - DNA, 70 bp, Artificial Sequence
  Synthetic
gccaagcatttaggtgacactatagggtgggcgggcatcatgtgtgtttcagagctatgctggaaacagc

SEQ ID NO: 53344 - DNA, 70 bp, Artificial Sequence
  Synthetic
gccaagcatttaggtgacactataggggcctctggctgtcacgtagtttcagagctatgctggaaacagc

SEQ ID NO: 53345 - DNA, 70 bp, Artificial Sequence
  Synthetic
gccaagcatttaggtgacactataggagtgtgagtgatctgagtcgtttcagagctatgctggaaacagc

SEQ ID NO: 53346 - DNA, 70 bp, Artificial Sequence
  Synthetic
gccaagcatttaggtgacactatagacaaaaaggctgttttctctgtttcagagctatgctggaaacagc

SEQ ID NO: 53347 - DNA, 70 bp, Artificial Sequence
  Synthetic
gccaagcatttaggtgacactatagcggaaggaaatggaagtagtgtttcagagctatgctggaaacagc

SEQ ID NO: 53348 - DNA, 70 bp, Artificial Sequence
  Synthetic
gccaagcatttaggtgacactataggcttcgtgtcaaactctagagtttcagagctatgctggaaacagc

SEQ ID NO: 53349 - DNA, 70 bp, Artificial Sequence
  Synthetic
gccaagcatttaggtgacactatagggtgatgatgacgatgacgagtttcagagctatgctggaaacagc

SEQ ID NO: 53350 - DNA, 70 bp, Artificial Sequence
  Synthetic
gccaagcatttaggtgacactatagctcaggtcgaagattcgtaggtttcagagctatgctggaaacagc

SEQ ID NO: 53351 - DNA, 70 bp, Artificial Sequence
  Synthetic
gccaagcatttaggtgacactatagctgcttgtggagcactgaccgtttcagagctatgctggaaacagc

SEQ ID NO: 53352 - DNA, 70 bp, Artificial Sequence
  Synthetic
gccaagcatttaggtgacactatagtatacaatttcatggggacagtttcagagctatgctggaaacagc

SEQ ID NO: 53353 - DNA, 70 bp, Artificial Sequence
  Synthetic
gccaagcatttaggtgacactatagatagacaagaaagcggcttcgtttcagagctatgctggaaacagc

SEQ ID NO: 53354 - DNA, 70 bp, Artificial Sequence
  Synthetic
gccaagcatttaggtgacactatagaagaaagtcacgcgggcagagtttcagagctatgctggaaacagc

SEQ ID NO: 53355 - DNA, 70 bp, Artificial Sequence
  Synthetic
gccaagcatttaggtgacactatagaattgctgattctgactgctgtttcagagctatgctggaaacagc

SEQ ID NO: 53356 - DNA, 70 bp, Artificial Sequence
  Synthetic
gccaagcatttaggtgacactataggtcagaggatcatctctgaggtttcagagctatgctggaaacagc

SEQ ID NO: 53357 - DNA, 70 bp, Artificial Sequence
  Synthetic
gccaagcatttaggtgacactatagctgaaagccagcagatttatgtttcagagctatgctggaaacagc

SEQ ID NO: 53358 - DNA, 70 bp, Artificial Sequence
  Synthetic
gccaagcatttaggtgacactatagctctgcccacatcgcctcacgtttcagagctatgctggaaacagc

SEQ ID NO: 53359 - DNA, 70 bp, Artificial Sequence
  Synthetic
gccaagcatttaggtgacactataggcgcctgttgtcaaggttacgtttcagagctatgctggaaacagc

SEQ ID NO: 53360 - DNA, 70 bp, Artificial Sequence
  Synthetic
gccaagcatttaggtgacactatagtcagcctggagggaagggctgtttcagagctatgctggaaacagc

SEQ ID NO: 53361 - DNA, 70 bp, Artificial Sequence
  Synthetic
gccaagcatttaggtgacactatagaagggaaggagagtagaagtgtttcagagctatgctggaaacagc

SEQ ID NO: 53362 - DNA, 70 bp, Artificial Sequence
  Synthetic
gccaagcatttaggtgacactatagtgtgtcttcatcttagttaggtttcagagctatgctggaaacagc

SEQ ID NO: 53363 - DNA, 70 bp, Artificial Sequence
  Synthetic
gccaagcatttaggtgacactatagataaaaccaagacatgactcgtttcagagctatgctggaaacagc

SEQ ID NO: 53364 - DNA, 70 bp, Artificial Sequence
  Synthetic
gccaagcatttaggtgacactatagagaggggcatctcttctcccgtttcagagctatgctggaaacagc

SEQ ID NO: 53365 - DNA, 70 bp, Artificial Sequence
  Synthetic
gccaagcatttaggtgacactatagcagaacttgcgttctgttaagtttcagagctatgctggaaacagc

SEQ ID NO: 53366 - DNA, 70 bp, Artificial Sequence
  Synthetic
gccaagcatttaggtgacactatagtgcctccgagagggtctcaggtttcagagctatgctggaaacagc

SEQ ID NO: 53367 - DNA, 70 bp, Artificial Sequence
  Synthetic
gccaagcatttaggtgacactatagtagctttctggctttgcttggtttcagagctatgctggaaacagc

SEQ ID NO: 53368 - DNA, 70 bp, Artificial Sequence
  Synthetic
gccaagcatttaggtgacactatagctgactaggaccattgaagtgtttcagagctatgctggaaacagc

SEQ ID NO: 53369 - DNA, 70 bp, Artificial Sequence
  Synthetic
gccaagcatttaggtgacactatagatgatgattaggtcaacacagtttcagagctatgctggaaacagc

SEQ ID NO: 53370 - DNA, 70 bp, Artificial Sequence
  Synthetic
gccaagcatttaggtgacactatagtacctagtaagtctttggcggtttcagagctatgctggaaacagc

SEQ ID NO: 53371 - DNA, 70 bp, Artificial Sequence
  Synthetic
gccaagcatttaggtgacactatagtcccggaataaaggggcctagtttcagagctatgctggaaacagc

SEQ ID NO: 53372 - DNA, 70 bp, Artificial Sequence
  Synthetic
gccaagcatttaggtgacactatagtgatgacaagagtagttgaagtttcagagctatgctggaaacagc

SEQ ID NO: 53373 - DNA, 70 bp, Artificial Sequence
  Synthetic
gccaagcatttaggtgacactatagtgccatcatttcactctgtggtttcagagctatgctggaaacagc

SEQ ID NO: 53374 - DNA, 70 bp, Artificial Sequence
  Synthetic
gccaagcatttaggtgacactataggggctgctcagatctcgatggtttcagagctatgctggaaacagc

SEQ ID NO: 53375 - DNA, 70 bp, Artificial Sequence
  Synthetic
gccaagcatttaggtgacactatagggtcagcaaccactcgtgaagtttcagagctatgctggaaacagc

SEQ ID NO: 53376 - DNA, 70 bp, Artificial Sequence
  Synthetic
gccaagcatttaggtgacactataggcaagaggacgtgaggaacagtttcagagctatgctggaaacagc

SEQ ID NO: 53377 - DNA, 70 bp, Artificial Sequence
  Synthetic
gccaagcatttaggtgacactatagattaggagactcagtatccagtttcagagctatgctggaaacagc

SEQ ID NO: 53378 - DNA, 70 bp, Artificial Sequence
  Synthetic
gccaagcatttaggtgacactatagtggaaagatgatttactctcgtttcagagctatgctggaaacagc

SEQ ID NO: 53379 - DNA, 70 bp, Artificial Sequence
  Synthetic
gccaagcatttaggtgacactatagtgcgaaggctgctcaagtaggtttcagagctatgctggaaacagc

SEQ ID NO: 53380 - DNA, 70 bp, Artificial Sequence
  Synthetic
gccaagcatttaggtgacactatagaggaatctggtcaagtgagcgtttcagagctatgctggaaacagc

SEQ ID NO: 53381 - DNA, 70 bp, Artificial Sequence
  Synthetic
gccaagcatttaggtgacactatagttcatatgtcgaagtctgttgtttcagagctatgctggaaacagc

SEQ ID NO: 53382 - DNA, 70 bp, Artificial Sequence
  Synthetic
gccaagcatttaggtgacactatagagttacatctatgtatgacggtttcagagctatgctggaaacagc

SEQ ID NO: 53383 - DNA, 70 bp, Artificial Sequence
  Synthetic
gccaagcatttaggtgacactatagaaggctgaagagaaggaaaagtttcagagctatgctggaaacagc

SEQ ID NO: 53384 - DNA, 70 bp, Artificial Sequence
  Synthetic
gccaagcatttaggtgacactataggggtctccatccctggaaaggtttcagagctatgctggaaacagc

SEQ ID NO: 53385 - DNA, 70 bp, Artificial Sequence
  Synthetic
gccaagcatttaggtgacactatagcgggcggcctcgcgcttcaggtttcagagctatgctggaaacagc

SEQ ID NO: 53386 - DNA, 70 bp, Artificial Sequence
  Synthetic
gccaagcatttaggtgacactatagaaatcatctctcagacagaggtttcagagctatgctggaaacagc

SEQ ID NO: 53387 - DNA, 70 bp, Artificial Sequence
  Synthetic
gccaagcatttaggtgacactatagaaaagaaagcaaacagcacagtttcagagctatgctggaaacagc

SEQ ID NO: 53388 - DNA, 70 bp, Artificial Sequence
  Synthetic
gccaagcatttaggtgacactatagtttgcagccatcattgtgctgtttcagagctatgctggaaacagc

SEQ ID NO: 53389 - DNA, 70 bp, Artificial Sequence
  Synthetic
gccaagcatttaggtgacactatagtttcttcactcaaacgtcgagtttcagagctatgctggaaacagc

SEQ ID NO: 53390 - DNA, 70 bp, Artificial Sequence
  Synthetic
gccaagcatttaggtgacactatagcaccagagcaccagggcggggtttcagagctatgctggaaacagc

SEQ ID NO: 53391 - DNA, 70 bp, Artificial Sequence
  Synthetic
gccaagcatttaggtgacactatagccaccctgtgcctcatgctcgtttcagagctatgctggaaacagc

SEQ ID NO: 53392 - DNA, 70 bp, Artificial Sequence
  Synthetic
gccaagcatttaggtgacactatagtgtcatactggcggcagaaggtttcagagctatgctggaaacagc

SEQ ID NO: 53393 - DNA, 70 bp, Artificial Sequence
  Synthetic
gccaagcatttaggtgacactatagctctggaagtacacttggaagtttcagagctatgctggaaacagc

SEQ ID NO: 53394 - DNA, 70 bp, Artificial Sequence
  Synthetic
gccaagcatttaggtgacactatagtacctatttccctgttaagggtttcagagctatgctggaaacagc

SEQ ID NO: 53395 - DNA, 70 bp, Artificial Sequence
  Synthetic
gccaagcatttaggtgacactatagcgctatactgcctcattgtggtttcagagctatgctggaaacagc

SEQ ID NO: 53396 - DNA, 70 bp, Artificial Sequence
  Synthetic
gccaagcatttaggtgacactatagaacccactttgggcacaactgtttcagagctatgctggaaacagc

SEQ ID NO: 53397 - DNA, 70 bp, Artificial Sequence
  Synthetic
gccaagcatttaggtgacactatagaggagtatttgtgcaacatagtttcagagctatgctggaaacagc

SEQ ID NO: 53398 - DNA, 70 bp, Artificial Sequence
  Synthetic
gccaagcatttaggtgacactatagaagagtatttgagccacatagtttcagagctatgctggaaacagc

SEQ ID NO: 53399 - DNA, 70 bp, Artificial Sequence
  Synthetic
gccaagcatttaggtgacactatagctgtgctgtgtttgctttgagtttcagagctatgctggaaacagc

SEQ ID NO: 53400 - DNA, 70 bp, Artificial Sequence
  Synthetic
gccaagcatttaggtgacactatagtatggaccagagcatatggtgtttcagagctatgctggaaacagc

SEQ ID NO: 53401 - DNA, 70 bp, Artificial Sequence
  Synthetic
gccaagcatttaggtgacactatagtttgagtgaagtagcctaaggtttcagagctatgctggaaacagc

SEQ ID NO: 53402 - DNA, 70 bp, Artificial Sequence
  Synthetic
gccaagcatttaggtgacactataggcctggccctaatgctgctggtttcagagctatgctggaaacagc

SEQ ID NO: 53403 - DNA, 70 bp, Artificial Sequence
  Synthetic
gccaagcatttaggtgacactataggggaggactgaactcagccagtttcagagctatgctggaaacagc

SEQ ID NO: 53404 - DNA, 70 bp, Artificial Sequence
  Synthetic
gccaagcatttaggtgacactatagatgctggggccccgtctcgtgtttcagagctatgctggaaacagc

SEQ ID NO: 53405 - DNA, 70 bp, Artificial Sequence
  Synthetic
gccaagcatttaggtgacactatagtgcgctctttgcgccagctcgtttcagagctatgctggaaacagc

SEQ ID NO: 53406 - DNA, 70 bp, Artificial Sequence
  Synthetic
gccaagcatttaggtgacactatagatgagaaactgtctgtccaagtttcagagctatgctggaaacagc

SEQ ID NO: 53407 - DNA, 70 bp, Artificial Sequence
  Synthetic
gccaagcatttaggtgacactatagtgaagatcttcatgtttctcgtttcagagctatgctggaaacagc

SEQ ID NO: 53408 - DNA, 70 bp, Artificial Sequence
  Synthetic
gccaagcatttaggtgacactatagacgctgctggccctgtgagggtttcagagctatgctggaaacagc

SEQ ID NO: 53409 - DNA, 70 bp, Artificial Sequence
  Synthetic
gccaagcatttaggtgacactatagtctaaagagttcacagagcggtttcagagctatgctggaaacagc

SEQ ID NO: 53410 - DNA, 70 bp, Artificial Sequence
  Synthetic
gccaagcatttaggtgacactatagccaaccctcctcgctttgtggtttcagagctatgctggaaacagc

SEQ ID NO: 53411 - DNA, 70 bp, Artificial Sequence
  Synthetic
gccaagcatttaggtgacactatagactgaccgacttcctgcagggtttcagagctatgctggaaacagc

SEQ ID NO: 53412 - DNA, 70 bp, Artificial Sequence
  Synthetic
gccaagcatttaggtgacactatagcttgaactcccccactctgcgtttcagagctatgctggaaacagc

SEQ ID NO: 53413 - DNA, 70 bp, Artificial Sequence
  Synthetic
gccaagcatttaggtgacactatagccgggagctaggaagtgtttgtttcagagctatgctggaaacagc

SEQ ID NO: 53414 - DNA, 70 bp, Artificial Sequence
  Synthetic
gccaagcatttaggtgacactataggaagccgtcgtcttcttaaggtttcagagctatgctggaaacagc

SEQ ID NO: 53415 - DNA, 70 bp, Artificial Sequence
  Synthetic
gccaagcatttaggtgacactatagttgcttaatgcatcctagcagtttcagagctatgctggaaacagc

SEQ ID NO: 53416 - DNA, 70 bp, Artificial Sequence
  Synthetic
gccaagcatttaggtgacactatagctccgccttgcactcggtgggtttcagagctatgctggaaacagc

SEQ ID NO: 53417 - DNA, 70 bp, Artificial Sequence
  Synthetic
gccaagcatttaggtgacactatagcaagggcggctccttgcactgtttcagagctatgctggaaacagc

SEQ ID NO: 53418 - DNA, 70 bp, Artificial Sequence
  Synthetic
gccaagcatttaggtgacactatagacagtcgtagacgaaagctcgtttcagagctatgctggaaacagc

SEQ ID NO: 53419 - DNA, 70 bp, Artificial Sequence
  Synthetic
gccaagcatttaggtgacactatagtcagtatttcgtgcagtcgtgtttcagagctatgctggaaacagc

SEQ ID NO: 53420 - DNA, 70 bp, Artificial Sequence
  Synthetic
gccaagcatttaggtgacactataggtgtcgagaactttactgctgtttcagagctatgctggaaacagc

SEQ ID NO: 53421 - DNA, 70 bp, Artificial Sequence
  Synthetic
gccaagcatttaggtgacactataggggcctgctgcggtcagaaggtttcagagctatgctggaaacagc

SEQ ID NO: 53422 - DNA, 70 bp, Artificial Sequence
  Synthetic
gccaagcatttaggtgacactataggccaaatggccggcgcaatagtttcagagctatgctggaaacagc

SEQ ID NO: 53423 - DNA, 70 bp, Artificial Sequence
  Synthetic
gccaagcatttaggtgacactatagcactcccacctggctctagggtttcagagctatgctggaaacagc

SEQ ID NO: 53424 - DNA, 70 bp, Artificial Sequence
  Synthetic
gccaagcatttaggtgacactatagaggcggtggcagagggctctgtttcagagctatgctggaaacagc

SEQ ID NO: 53425 - DNA, 70 bp, Artificial Sequence
  Synthetic
gccaagcatttaggtgacactatagcgggcacctgtcggcctcgtgtttcagagctatgctggaaacagc

SEQ ID NO: 53426 - DNA, 70 bp, Artificial Sequence
  Synthetic
gccaagcatttaggtgacactatagcggcctcgtcggcgctgctggtttcagagctatgctggaaacagc

SEQ ID NO: 53427 - DNA, 70 bp, Artificial Sequence
  Synthetic
gccaagcatttaggtgacactatagccactgcctgatacctcagcgtttcagagctatgctggaaacagc

SEQ ID NO: 53428 - DNA, 70 bp, Artificial Sequence
  Synthetic
gccaagcatttaggtgacactatagcgtccctacgctggctcacagtttcagagctatgctggaaacagc

SEQ ID NO: 53429 - DNA, 70 bp, Artificial Sequence
  Synthetic
gccaagcatttaggtgacactatagcaaggccaggaggggctcaggtttcagagctatgctggaaacagc

SEQ ID NO: 53430 - DNA, 70 bp, Artificial Sequence
  Synthetic
gccaagcatttaggtgacactatagatcaagccttgcgtgatgtggtttcagagctatgctggaaacagc

SEQ ID NO: 53431 - DNA, 70 bp, Artificial Sequence
  Synthetic
gccaagcatttaggtgacactatagtaagccctgcgtcatgtgaagtttcagagctatgctggaaacagc

SEQ ID NO: 53432 - DNA, 70 bp, Artificial Sequence
  Synthetic
gccaagcatttaggtgacactatagtttacgacgggactgtctgggtttcagagctatgctggaaacagc

SEQ ID NO: 53433 - DNA, 70 bp, Artificial Sequence
  Synthetic
gccaagcatttaggtgacactatagccctgtcttaagagcctcacgtttcagagctatgctggaaacagc

SEQ ID NO: 53434 - DNA, 70 bp, Artificial Sequence
  Synthetic
gccaagcatttaggtgacactatagcagggagggcaccgaggtctgtttcagagctatgctggaaacagc

SEQ ID NO: 53435 - DNA, 70 bp, Artificial Sequence
  Synthetic
gccaagcatttaggtgacactatagggaagggaccgaagtttgaagtttcagagctatgctggaaacagc

SEQ ID NO: 53436 - DNA, 70 bp, Artificial Sequence
  Synthetic
gccaagcatttaggtgacactatagtgagagtctgctctacacctgtttcagagctatgctggaaacagc

SEQ ID NO: 53437 - DNA, 70 bp, Artificial Sequence
  Synthetic
gccaagcatttaggtgacactatagcgtgggggccttcttgtaaggtttcagagctatgctggaaacagc

SEQ ID NO: 53438 - DNA, 70 bp, Artificial Sequence
  Synthetic
gccaagcatttaggtgacactataggatccctgatgacttcgactgtttcagagctatgctggaaacagc

SEQ ID NO: 53439 - DNA, 70 bp, Artificial Sequence
  Synthetic
gccaagcatttaggtgacactatagtgattgggattcaattgtgtgtttcagagctatgctggaaacagc

SEQ ID NO: 53440 - DNA, 70 bp, Artificial Sequence
  Synthetic
gccaagcatttaggtgacactataggggccaggcaccggggagtggtttcagagctatgctggaaacagc

SEQ ID NO: 53441 - DNA, 70 bp, Artificial Sequence
  Synthetic
gccaagcatttaggtgacactataggctctcccggtcgctagttcgtttcagagctatgctggaaacagc

SEQ ID NO: 53442 - DNA, 70 bp, Artificial Sequence
  Synthetic
gccaagcatttaggtgacactatagcgtgccattgtttgctttacgtttcagagctatgctggaaacagc

SEQ ID NO: 53443 - DNA, 70 bp, Artificial Sequence
  Synthetic
gccaagcatttaggtgacactatagcggtgggctctcagagatcggtttcagagctatgctggaaacagc

SEQ ID NO: 53444 - DNA, 70 bp, Artificial Sequence
  Synthetic
gccaagcatttaggtgacactatagtgcggtgcttggctagcaaagtttcagagctatgctggaaacagc

SEQ ID NO: 53445 - DNA, 70 bp, Artificial Sequence
  Synthetic
gccaagcatttaggtgacactataggcagggctctactgtagctcgtttcagagctatgctggaaacagc

SEQ ID NO: 53446 - DNA, 70 bp, Artificial Sequence
  Synthetic
gccaagcatttaggtgacactatagagctgggcacagctcatgccgtttcagagctatgctggaaacagc

SEQ ID NO: 53447 - DNA, 70 bp, Artificial Sequence
  Synthetic
gccaagcatttaggtgacactataggctggaattcgtacatgtttgtttcagagctatgctggaaacagc

SEQ ID NO: 53448 - DNA, 70 bp, Artificial Sequence
  Synthetic
gccaagcatttaggtgacactatagaaaggggcagaaagagcaaagtttcagagctatgctggaaacagc

SEQ ID NO: 53449 - DNA, 70 bp, Artificial Sequence
  Synthetic
gccaagcatttaggtgacactatagtgaggctgacagctcaaagcgtttcagagctatgctggaaacagc

SEQ ID NO: 53450 - DNA, 70 bp, Artificial Sequence
  Synthetic
gccaagcatttaggtgacactatagatagctgggtgtcaggctgagtttcagagctatgctggaaacagc

SEQ ID NO: 53451 - DNA, 70 bp, Artificial Sequence
  Synthetic
gccaagcatttaggtgacactatagagagctgggtgccaggctgagtttcagagctatgctggaaacagc

SEQ ID NO: 53452 - DNA, 70 bp, Artificial Sequence
  Synthetic
gccaagcatttaggtgacactatagcatggatgagggcgagggacgtttcagagctatgctggaaacagc

SEQ ID NO: 53453 - DNA, 70 bp, Artificial Sequence
  Synthetic
gccaagcatttaggtgacactatagagagctgggtgccgggctgagtttcagagctatgctggaaacagc

SEQ ID NO: 53454 - DNA, 70 bp, Artificial Sequence
  Synthetic
gccaagcatttaggtgacactatagattcaaaatggggaagggttgtttcagagctatgctggaaacagc

SEQ ID NO: 53455 - DNA, 70 bp, Artificial Sequence
  Synthetic
gccaagcatttaggtgacactatagtgaaccagtaaacgaggacagtttcagagctatgctggaaacagc

SEQ ID NO: 53456 - DNA, 70 bp, Artificial Sequence
  Synthetic
gccaagcatttaggtgacactataggcaatatgcacttacaggttgtttcagagctatgctggaaacagc

SEQ ID NO: 53457 - DNA, 70 bp, Artificial Sequence
  Synthetic
gccaagcatttaggtgacactatagagagcctttatctgaagatcgtttcagagctatgctggaaacagc

SEQ ID NO: 53458 - DNA, 70 bp, Artificial Sequence
  Synthetic
gccaagcatttaggtgacactatagttccttgatcttgaggtcaggtttcagagctatgctggaaacagc

SEQ ID NO: 53459 - DNA, 70 bp, Artificial Sequence
  Synthetic
gccaagcatttaggtgacactatagcgggagaagaactgtcctaagtttcagagctatgctggaaacagc

SEQ ID NO: 53460 - DNA, 70 bp, Artificial Sequence
  Synthetic
gccaagcatttaggtgacactatagcccgcggcgctactcaggctgtttcagagctatgctggaaacagc

SEQ ID NO: 53461 - DNA, 70 bp, Artificial Sequence
  Synthetic
gccaagcatttaggtgacactatagcttggggttaaagatcaaaggtttcagagctatgctggaaacagc

SEQ ID NO: 53462 - DNA, 70 bp, Artificial Sequence
  Synthetic
gccaagcatttaggtgacactatagaagagagaggtcaacaactcgtttcagagctatgctggaaacagc

SEQ ID NO: 53463 - DNA, 70 bp, Artificial Sequence
  Synthetic
gccaagcatttaggtgacactatagctcagatgatgttgttctccgtttcagagctatgctggaaacagc

SEQ ID NO: 53464 - DNA, 70 bp, Artificial Sequence
  Synthetic
gccaagcatttaggtgacactataggtccgtcgatagcaacaaaggtttcagagctatgctggaaacagc

SEQ ID NO: 53465 - DNA, 70 bp, Artificial Sequence
  Synthetic
gccaagcatttaggtgacactatagtactcaaagaagaacattccgtttcagagctatgctggaaacagc

SEQ ID NO: 53466 - DNA, 70 bp, Artificial Sequence
  Synthetic
gccaagcatttaggtgacactatagcaaccccgggccttggctacgtttcagagctatgctggaaacagc

SEQ ID NO: 53467 - DNA, 70 bp, Artificial Sequence
  Synthetic
gccaagcatttaggtgacactatagacagcaacttatagctattcgtttcagagctatgctggaaacagc

SEQ ID NO: 53468 - DNA, 70 bp, Artificial Sequence
  Synthetic
gccaagcatttaggtgacactatagatgaagatcgttttgggatggtttcagagctatgctggaaacagc

SEQ ID NO: 53469 - DNA, 70 bp, Artificial Sequence
  Synthetic
gccaagcatttaggtgacactataggagttacaggcaaagtgagggtttcagagctatgctggaaacagc

SEQ ID NO: 53470 - DNA, 70 bp, Artificial Sequence
  Synthetic
gccaagcatttaggtgacactatagactgagttacaggcaatgtggtttcagagctatgctggaaacagc

SEQ ID NO: 53471 - DNA, 70 bp, Artificial Sequence
  Synthetic
gccaagcatttaggtgacactatagacggagttacaagcaatgtggtttcagagctatgctggaaacagc

SEQ ID NO: 53472 - DNA, 70 bp, Artificial Sequence
  Synthetic
gccaagcatttaggtgacactatagtgtgatttttcatctgtctcgtttcagagctatgctggaaacagc

SEQ ID NO: 53473 - DNA, 70 bp, Artificial Sequence
  Synthetic
gccaagcatttaggtgacactataggaggcggcttacacgttcaagtttcagagctatgctggaaacagc

SEQ ID NO: 53474 - DNA, 70 bp, Artificial Sequence
  Synthetic
gccaagcatttaggtgacactatagggtgtgaaatattgtggtcagtttcagagctatgctggaaacagc

SEQ ID NO: 53475 - DNA, 70 bp, Artificial Sequence
  Synthetic
gccaagcatttaggtgacactatagccccgggcgtgttagctgccgtttcagagctatgctggaaacagc

SEQ ID NO: 53476 - DNA, 70 bp, Artificial Sequence
  Synthetic
gccaagcatttaggtgacactatagaggaggcctgcgtcagagcagtttcagagctatgctggaaacagc

SEQ ID NO: 53477 - DNA, 70 bp, Artificial Sequence
  Synthetic
gccaagcatttaggtgacactatagaatggcaaacaaaagactgtgtttcagagctatgctggaaacagc

SEQ ID NO: 53478 - DNA, 70 bp, Artificial Sequence
  Synthetic
gccaagcatttaggtgacactatagcttctgagctgtcattgtgagtttcagagctatgctggaaacagc

SEQ ID NO: 53479 - DNA, 70 bp, Artificial Sequence
  Synthetic
gccaagcatttaggtgacactatagactctgcttacagtccgtgagtttcagagctatgctggaaacagc

SEQ ID NO: 53480 - DNA, 70 bp, Artificial Sequence
  Synthetic
gccaagcatttaggtgacactataggacagatactgcaagtgactgtttcagagctatgctggaaacagc

SEQ ID NO: 53481 - DNA, 70 bp, Artificial Sequence
  Synthetic
gccaagcatttaggtgacactataggactgtcagtggatcagatggtttcagagctatgctggaaacagc

SEQ ID NO: 53482 - DNA, 70 bp, Artificial Sequence
  Synthetic
gccaagcatttaggtgacactatagggatcagatgaggctaagctgtttcagagctatgctggaaacagc

SEQ ID NO: 53483 - DNA, 70 bp, Artificial Sequence
  Synthetic
gccaagcatttaggtgacactatagctacatttgagacactgcgtgtttcagagctatgctggaaacagc

SEQ ID NO: 53484 - DNA, 70 bp, Artificial Sequence
  Synthetic
gccaagcatttaggtgacactatagaccacaggagtttgtggtgtgtttcagagctatgctggaaacagc

SEQ ID NO: 53485 - DNA, 70 bp, Artificial Sequence
  Synthetic
gccaagcatttaggtgacactatagcacctcatcctctacatgctgtttcagagctatgctggaaacagc

SEQ ID NO: 53486 - DNA, 70 bp, Artificial Sequence
  Synthetic
gccaagcatttaggtgacactatagtgctgggtctgtttactgcagtttcagagctatgctggaaacagc

SEQ ID NO: 53487 - DNA, 70 bp, Artificial Sequence
  Synthetic
gccaagcatttaggtgacactatagaccaaagtactgatgaataggtttcagagctatgctggaaacagc

SEQ ID NO: 53488 - DNA, 70 bp, Artificial Sequence
  Synthetic
gccaagcatttaggtgacactataggcagttcagactaatgttccgtttcagagctatgctggaaacagc

SEQ ID NO: 53489 - DNA, 70 bp, Artificial Sequence
  Synthetic
gccaagcatttaggtgacactataggcaacagcagcatcaggggtgtttcagagctatgctggaaacagc

SEQ ID NO: 53490 - DNA, 70 bp, Artificial Sequence
  Synthetic
gccaagcatttaggtgacactatagctgctcattgacacctgagagtttcagagctatgctggaaacagc

SEQ ID NO: 53491 - DNA, 70 bp, Artificial Sequence
  Synthetic
gccaagcatttaggtgacactatagcttctcaggtgtcaatgagcgtttcagagctatgctggaaacagc

SEQ ID NO: 53492 - DNA, 70 bp, Artificial Sequence
  Synthetic
gccaagcatttaggtgacactatagggactttacacaacaaactcgtttcagagctatgctggaaacagc

SEQ ID NO: 53493 - DNA, 70 bp, Artificial Sequence
  Synthetic
gccaagcatttaggtgacactatagacacaccaactgctgaagacgtttcagagctatgctggaaacagc

SEQ ID NO: 53494 - DNA, 70 bp, Artificial Sequence
  Synthetic
gccaagcatttaggtgacactataggacagcctggagcagggctggtttcagagctatgctggaaacagc

SEQ ID NO: 53495 - DNA, 70 bp, Artificial Sequence
  Synthetic
gccaagcatttaggtgacactataggcatccacggccctgtaaacgtttcagagctatgctggaaacagc

SEQ ID NO: 53496 - DNA, 70 bp, Artificial Sequence
  Synthetic
gccaagcatttaggtgacactatagtctgtcgaaagtctggttaggtttcagagctatgctggaaacagc

SEQ ID NO: 53497 - DNA, 70 bp, Artificial Sequence
  Synthetic
gccaagcatttaggtgacactatagggcagatgccctacttaatagtttcagagctatgctggaaacagc

SEQ ID NO: 53498 - DNA, 70 bp, Artificial Sequence
  Synthetic
gccaagcatttaggtgacactatagccatcggctccccaagattagtttcagagctatgctggaaacagc

SEQ ID NO: 53499 - DNA, 70 bp, Artificial Sequence
  Synthetic
gccaagcatttaggtgacactataggactggggtcatgtctgtaggtttcagagctatgctggaaacagc

SEQ ID NO: 53500 - DNA, 70 bp, Artificial Sequence
  Synthetic
gccaagcatttaggtgacactatagggccctgcagctgtggttaggtttcagagctatgctggaaacagc

SEQ ID NO: 53501 - DNA, 70 bp, Artificial Sequence
  Synthetic
gccaagcatttaggtgacactatagcaatgctttccaggctcacagtttcagagctatgctggaaacagc

SEQ ID NO: 53502 - DNA, 70 bp, Artificial Sequence
  Synthetic
gccaagcatttaggtgacactatagggaccgggaagtccctacaggtttcagagctatgctggaaacagc

SEQ ID NO: 53503 - DNA, 70 bp, Artificial Sequence
  Synthetic
gccaagcatttaggtgacactatagttctggcactagtctctgacgtttcagagctatgctggaaacagc

SEQ ID NO: 53504 - DNA, 70 bp, Artificial Sequence
  Synthetic
gccaagcatttaggtgacactatagatgggaaatatggtgagcacgtttcagagctatgctggaaacagc

SEQ ID NO: 53505 - DNA, 70 bp, Artificial Sequence
  Synthetic
gccaagcatttaggtgacactatagggatttagttgcgtgcttgcgtttcagagctatgctggaaacagc

SEQ ID NO: 53506 - DNA, 70 bp, Artificial Sequence
  Synthetic
gccaagcatttaggtgacactatagagctgaaagcaattcgcttagtttcagagctatgctggaaacagc

SEQ ID NO: 53507 - DNA, 70 bp, Artificial Sequence
  Synthetic
gccaagcatttaggtgacactatagcgtcctcctgaactgtagtcgtttcagagctatgctggaaacagc

SEQ ID NO: 53508 - DNA, 70 bp, Artificial Sequence
  Synthetic
gccaagcatttaggtgacactataggcctcgctctgggagtactagtttcagagctatgctggaaacagc

SEQ ID NO: 53509 - DNA, 70 bp, Artificial Sequence
  Synthetic
gccaagcatttaggtgacactatagaccgcgctttgggagtactggtttcagagctatgctggaaacagc

SEQ ID NO: 53510 - DNA, 70 bp, Artificial Sequence
  Synthetic
gccaagcatttaggtgacactatagagagtgtatctgggaattttgtttcagagctatgctggaaacagc

SEQ ID NO: 53511 - DNA, 70 bp, Artificial Sequence
  Synthetic
gccaagcatttaggtgacactatagcctgcaggcctgtcgtcaccgtttcagagctatgctggaaacagc

SEQ ID NO: 53512 - DNA, 70 bp, Artificial Sequence
  Synthetic
gccaagcatttaggtgacactatagggtgcctgggggcctaggtggtttcagagctatgctggaaacagc

SEQ ID NO: 53513 - DNA, 70 bp, Artificial Sequence
  Synthetic
gccaagcatttaggtgacactatagatagttcttcagagttctccgtttcagagctatgctggaaacagc

SEQ ID NO: 53514 - DNA, 70 bp, Artificial Sequence
  Synthetic
gccaagcatttaggtgacactatagtgaagtgttctcacagcactgtttcagagctatgctggaaacagc

SEQ ID NO: 53515 - DNA, 70 bp, Artificial Sequence
  Synthetic
gccaagcatttaggtgacactataggggtgtctaaaggtacataagtttcagagctatgctggaaacagc

SEQ ID NO: 53516 - DNA, 70 bp, Artificial Sequence
  Synthetic
gccaagcatttaggtgacactataggggcccagctactgctccttgtttcagagctatgctggaaacagc

SEQ ID NO: 53517 - DNA, 70 bp, Artificial Sequence
  Synthetic
gccaagcatttaggtgacactatagttttgggctaaatgacttaggtttcagagctatgctggaaacagc

SEQ ID NO: 53518 - DNA, 70 bp, Artificial Sequence
  Synthetic
gccaagcatttaggtgacactataggagaactgagtttcagatgtgtttcagagctatgctggaaacagc

SEQ ID NO: 53519 - DNA, 70 bp, Artificial Sequence
  Synthetic
gccaagcatttaggtgacactatagaaaagcttcagtgttcatccgtttcagagctatgctggaaacagc

SEQ ID NO: 53520 - DNA, 70 bp, Artificial Sequence
  Synthetic
gccaagcatttaggtgacactatagatataggaaagctgtagtccgtttcagagctatgctggaaacagc

SEQ ID NO: 53521 - DNA, 70 bp, Artificial Sequence
  Synthetic
gccaagcatttaggtgacactatagctactggaagtaaagcactcgtttcagagctatgctggaaacagc

SEQ ID NO: 53522 - DNA, 70 bp, Artificial Sequence
  Synthetic
gccaagcatttaggtgacactatagagcaccaaagagatctaatggtttcagagctatgctggaaacagc

SEQ ID NO: 53523 - DNA, 70 bp, Artificial Sequence
  Synthetic
gccaagcatttaggtgacactatagaggtggtgagtctgcagaaggtttcagagctatgctggaaacagc

SEQ ID NO: 53524 - DNA, 70 bp, Artificial Sequence
  Synthetic
gccaagcatttaggtgacactataggtgggtgggtgaggtatgaagtttcagagctatgctggaaacagc

SEQ ID NO: 53525 - DNA, 70 bp, Artificial Sequence
  Synthetic
gccaagcatttaggtgacactatagatttattgagtcgtccatctgtttcagagctatgctggaaacagc

SEQ ID NO: 53526 - DNA, 70 bp, Artificial Sequence
  Synthetic
gccaagcatttaggtgacactatagtggagacccggcaggagtgagtttcagagctatgctggaaacagc

SEQ ID NO: 53527 - DNA, 70 bp, Artificial Sequence
  Synthetic
gccaagcatttaggtgacactataggcaggaccttcgacgctggagtttcagagctatgctggaaacagc

SEQ ID NO: 53528 - DNA, 70 bp, Artificial Sequence
  Synthetic
gccaagcatttaggtgacactatagggactgcttggagacccggcgtttcagagctatgctggaaacagc

SEQ ID NO: 53529 - DNA, 70 bp, Artificial Sequence
  Synthetic
gccaagcatttaggtgacactataggctgggttggtgcagcctaggtttcagagctatgctggaaacagc

SEQ ID NO: 53530 - DNA, 70 bp, Artificial Sequence
  Synthetic
gccaagcatttaggtgacactatagggtgtcacagtggaatagtggtttcagagctatgctggaaacagc

SEQ ID NO: 53531 - DNA, 70 bp, Artificial Sequence
  Synthetic
gccaagcatttaggtgacactatagacaagcgcaaccaagcctaagtttcagagctatgctggaaacagc

SEQ ID NO: 53532 - DNA, 70 bp, Artificial Sequence
  Synthetic
gccaagcatttaggtgacactatagggtttaacaggttctgagcagtttcagagctatgctggaaacagc

SEQ ID NO: 53533 - DNA, 70 bp, Artificial Sequence
  Synthetic
gccaagcatttaggtgacactatagtttcattatcactgtctcccgtttcagagctatgctggaaacagc

SEQ ID NO: 53534 - DNA, 70 bp, Artificial Sequence
  Synthetic
gccaagcatttaggtgacactatagtctgggctcaggtgtgtttcgtttcagagctatgctggaaacagc

SEQ ID NO: 53535 - DNA, 70 bp, Artificial Sequence
  Synthetic
gccaagcatttaggtgacactataggggctcaagtctctttgacggtttcagagctatgctggaaacagc

SEQ ID NO: 53536 - DNA, 70 bp, Artificial Sequence
  Synthetic
gccaagcatttaggtgacactatagtgggcgagtatctcttcgaagtttcagagctatgctggaaacagc

SEQ ID NO: 53537 - DNA, 70 bp, Artificial Sequence
  Synthetic
gccaagcatttaggtgacactatagtctgcttgttttcatttccagtttcagagctatgctggaaacagc

SEQ ID NO: 53538 - DNA, 70 bp, Artificial Sequence
  Synthetic
gccaagcatttaggtgacactatagtctggaagcaaaaccctagagtttcagagctatgctggaaacagc

SEQ ID NO: 53539 - DNA, 70 bp, Artificial Sequence
  Synthetic
gccaagcatttaggtgacactatagccctcagtgccacaccctgcgtttcagagctatgctggaaacagc

SEQ ID NO: 53540 - DNA, 70 bp, Artificial Sequence
  Synthetic
gccaagcatttaggtgacactatagccaaagagcacagcaacgtagtttcagagctatgctggaaacagc

SEQ ID NO: 53541 - DNA, 70 bp, Artificial Sequence
  Synthetic
gccaagcatttaggtgacactatagacagcatcctccagcacctcgtttcagagctatgctggaaacagc

SEQ ID NO: 53542 - DNA, 70 bp, Artificial Sequence
  Synthetic
gccaagcatttaggtgacactataggcaggcgcaggcccacagccgtttcagagctatgctggaaacagc

SEQ ID NO: 53543 - DNA, 70 bp, Artificial Sequence
  Synthetic
gccaagcatttaggtgacactataggcttggactataaagctgacgtttcagagctatgctggaaacagc

SEQ ID NO: 53544 - DNA, 70 bp, Artificial Sequence
  Synthetic
gccaagcatttaggtgacactataggatgccgtgtaaatggggctgtttcagagctatgctggaaacagc

SEQ ID NO: 53545 - DNA, 70 bp, Artificial Sequence
  Synthetic
gccaagcatttaggtgacactatagcagagagaagccagcttcatgtttcagagctatgctggaaacagc

SEQ ID NO: 53546 - DNA, 70 bp, Artificial Sequence
  Synthetic
gccaagcatttaggtgacactatagttgctcggacttgcatcttagtttcagagctatgctggaaacagc

SEQ ID NO: 53547 - DNA, 70 bp, Artificial Sequence
  Synthetic
gccaagcatttaggtgacactatagctgcttggcatggcatcctagtttcagagctatgctggaaacagc

SEQ ID NO: 53548 - DNA, 70 bp, Artificial Sequence
  Synthetic
gccaagcatttaggtgacactataggcttttgctgttgtggcaacgtttcagagctatgctggaaacagc

SEQ ID NO: 53549 - DNA, 70 bp, Artificial Sequence
  Synthetic
gccaagcatttaggtgacactataggtcttcaccaggcctacagcgtttcagagctatgctggaaacagc

SEQ ID NO: 53550 - DNA, 70 bp, Artificial Sequence
  Synthetic
gccaagcatttaggtgacactataggtgggcagtgggctcatcaggtttcagagctatgctggaaacagc

SEQ ID NO: 53551 - DNA, 70 bp, Artificial Sequence
  Synthetic
gccaagcatttaggtgacactataggggagccaggctaattaatagtttcagagctatgctggaaacagc

SEQ ID NO: 53552 - DNA, 70 bp, Artificial Sequence
  Synthetic
gccaagcatttaggtgacactatagcttgtctccactctggacatgtttcagagctatgctggaaacagc

SEQ ID NO: 53553 - DNA, 70 bp, Artificial Sequence
  Synthetic
gccaagcatttaggtgacactataggttttggggcctagtattcagtttcagagctatgctggaaacagc

SEQ ID NO: 53554 - DNA, 70 bp, Artificial Sequence
  Synthetic
gccaagcatttaggtgacactatagaacagagcagacgaaattttgtttcagagctatgctggaaacagc

SEQ ID NO: 53555 - DNA, 70 bp, Artificial Sequence
  Synthetic
gccaagcatttaggtgacactatagggccccactcggaaaaaggcgtttcagagctatgctggaaacagc

SEQ ID NO: 53556 - DNA, 70 bp, Artificial Sequence
  Synthetic
gccaagcatttaggtgacactatagccagcattagtgcttgagtagtttcagagctatgctggaaacagc

SEQ ID NO: 53557 - DNA, 70 bp, Artificial Sequence
  Synthetic
gccaagcatttaggtgacactatagagcggcttggttcacctgaggtttcagagctatgctggaaacagc

SEQ ID NO: 53558 - DNA, 70 bp, Artificial Sequence
  Synthetic
gccaagcatttaggtgacactatagacttggccagctggttcgaggtttcagagctatgctggaaacagc

SEQ ID NO: 53559 - DNA, 70 bp, Artificial Sequence
  Synthetic
gccaagcatttaggtgacactatagggaccttgagggttggtttcgtttcagagctatgctggaaacagc

SEQ ID NO: 53560 - DNA, 70 bp, Artificial Sequence
  Synthetic
gccaagcatttaggtgacactataggagctttatttctcagcctcgtttcagagctatgctggaaacagc

SEQ ID NO: 53561 - DNA, 70 bp, Artificial Sequence
  Synthetic
gccaagcatttaggtgacactatagtggcttgcgatcatgtgaaagtttcagagctatgctggaaacagc

SEQ ID NO: 53562 - DNA, 70 bp, Artificial Sequence
  Synthetic
gccaagcatttaggtgacactatagctgctaggtagtcaaagaaggtttcagagctatgctggaaacagc

SEQ ID NO: 53563 - DNA, 70 bp, Artificial Sequence
  Synthetic
gccaagcatttaggtgacactatagctgtggctgttccatccctggtttcagagctatgctggaaacagc

SEQ ID NO: 53564 - DNA, 70 bp, Artificial Sequence
  Synthetic
gccaagcatttaggtgacactatagtaaggctttagtgagctctggtttcagagctatgctggaaacagc

SEQ ID NO: 53565 - DNA, 70 bp, Artificial Sequence
  Synthetic
gccaagcatttaggtgacactatagtgggcatcaagcatcttttcgtttcagagctatgctggaaacagc

SEQ ID NO: 53566 - DNA, 70 bp, Artificial Sequence
  Synthetic
gccaagcatttaggtgacactatagcaagaagcagcagtcctgaagtttcagagctatgctggaaacagc

SEQ ID NO: 53567 - DNA, 70 bp, Artificial Sequence
  Synthetic
gccaagcatttaggtgacactatagtcagttaatgaaaatgggctgtttcagagctatgctggaaacagc

SEQ ID NO: 53568 - DNA, 70 bp, Artificial Sequence
  Synthetic
gccaagcatttaggtgacactataggttgggtagtatggtgaatggtttcagagctatgctggaaacagc

SEQ ID NO: 53569 - DNA, 70 bp, Artificial Sequence
  Synthetic
gccaagcatttaggtgacactatagccaggtgtttctaccgcctggtttcagagctatgctggaaacagc

SEQ ID NO: 53570 - DNA, 70 bp, Artificial Sequence
  Synthetic
gccaagcatttaggtgacactataggtgggggcaataagaagcgcgtttcagagctatgctggaaacagc

SEQ ID NO: 53571 - DNA, 70 bp, Artificial Sequence
  Synthetic
gccaagcatttaggtgacactatagggctcagcccaaagctgatggtttcagagctatgctggaaacagc

SEQ ID NO: 53572 - DNA, 70 bp, Artificial Sequence
  Synthetic
gccaagcatttaggtgacactatagtgccggaacagtatcttaccgtttcagagctatgctggaaacagc

SEQ ID NO: 53573 - DNA, 70 bp, Artificial Sequence
  Synthetic
gccaagcatttaggtgacactatagtgtcctgtgatgctcacgtcgtttcagagctatgctggaaacagc

SEQ ID NO: 53574 - DNA, 70 bp, Artificial Sequence
  Synthetic
gccaagcatttaggtgacactataggtcctgtgctcagcaagtaggtttcagagctatgctggaaacagc

SEQ ID NO: 53575 - DNA, 70 bp, Artificial Sequence
  Synthetic
gccaagcatttaggtgacactatagctgggttctcaaaggtccctgtttcagagctatgctggaaacagc

SEQ ID NO: 53576 - DNA, 70 bp, Artificial Sequence
  Synthetic
gccaagcatttaggtgacactatagggttatgccggaatcgttgcgtttcagagctatgctggaaacagc

SEQ ID NO: 53577 - DNA, 70 bp, Artificial Sequence
  Synthetic
gccaagcatttaggtgacactatagcagccagcccgactcctagggtttcagagctatgctggaaacagc

SEQ ID NO: 53578 - DNA, 70 bp, Artificial Sequence
  Synthetic
gccaagcatttaggtgacactatagcacttcagttctctgctttcgtttcagagctatgctggaaacagc

SEQ ID NO: 53579 - DNA, 70 bp, Artificial Sequence
  Synthetic
gccaagcatttaggtgacactatagggcagaagattccgctgtgggtttcagagctatgctggaaacagc

SEQ ID NO: 53580 - DNA, 70 bp, Artificial Sequence
  Synthetic
gccaagcatttaggtgacactatagtgttacacgccgccgccaccgtttcagagctatgctggaaacagc

SEQ ID NO: 53581 - DNA, 70 bp, Artificial Sequence
  Synthetic
gccaagcatttaggtgacactatagtgtccttcggagttacctaggtttcagagctatgctggaaacagc

SEQ ID NO: 53582 - DNA, 70 bp, Artificial Sequence
  Synthetic
gccaagcatttaggtgacactatagtatcactagattttgttcgggtttcagagctatgctggaaacagc

SEQ ID NO: 53583 - DNA, 70 bp, Artificial Sequence
  Synthetic
gccaagcatttaggtgacactatagtactgaggtgctgaagctacgtttcagagctatgctggaaacagc

SEQ ID NO: 53584 - DNA, 70 bp, Artificial Sequence
  Synthetic
gccaagcatttaggtgacactatagtccgcagacccgggccttacgtttcagagctatgctggaaacagc

SEQ ID NO: 53585 - DNA, 70 bp, Artificial Sequence
  Synthetic
gccaagcatttaggtgacactatagccgctttgtcaccgtgggatgtttcagagctatgctggaaacagc

SEQ ID NO: 53586 - DNA, 70 bp, Artificial Sequence
  Synthetic
gccaagcatttaggtgacactataggctcaccaacagcaaacaaggtttcagagctatgctggaaacagc

SEQ ID NO: 53587 - DNA, 70 bp, Artificial Sequence
  Synthetic
gccaagcatttaggtgacactatagtcgcccacctgcgtgtgaacgtttcagagctatgctggaaacagc

SEQ ID NO: 53588 - DNA, 70 bp, Artificial Sequence
  Synthetic
gccaagcatttaggtgacactataggcctgggggcgtccctcacagtttcagagctatgctggaaacagc

SEQ ID NO: 53589 - DNA, 70 bp, Artificial Sequence
  Synthetic
gccaagcatttaggtgacactatagagacaagacaaattaagcacgtttcagagctatgctggaaacagc

SEQ ID NO: 53590 - DNA, 70 bp, Artificial Sequence
  Synthetic
gccaagcatttaggtgacactatagggcagtgagactgtggtatagtttcagagctatgctggaaacagc

SEQ ID NO: 53591 - DNA, 70 bp, Artificial Sequence
  Synthetic
gccaagcatttaggtgacactataggtccctgtcgcacgtgtagggtttcagagctatgctggaaacagc

SEQ ID NO: 53592 - DNA, 70 bp, Artificial Sequence
  Synthetic
gccaagcatttaggtgacactataggtgagaaaagagcagggagggtttcagagctatgctggaaacagc

SEQ ID NO: 53593 - DNA, 70 bp, Artificial Sequence
  Synthetic
gccaagcatttaggtgacactatagcagcagcaagggggagactggtttcagagctatgctggaaacagc

SEQ ID NO: 53594 - DNA, 70 bp, Artificial Sequence
  Synthetic
gccaagcatttaggtgacactataggccattgtcccaggtctgaggtttcagagctatgctggaaacagc

SEQ ID NO: 53595 - DNA, 70 bp, Artificial Sequence
  Synthetic
gccaagcatttaggtgacactatagcgccaggcctgtgtggctaggtttcagagctatgctggaaacagc

SEQ ID NO: 53596 - DNA, 70 bp, Artificial Sequence
  Synthetic
gccaagcatttaggtgacactataggtcctgcccggcaggtttacgtttcagagctatgctggaaacagc

SEQ ID NO: 53597 - DNA, 70 bp, Artificial Sequence
  Synthetic
gccaagcatttaggtgacactatagggtctcccacagttcctagggtttcagagctatgctggaaacagc

SEQ ID NO: 53598 - DNA, 70 bp, Artificial Sequence
  Synthetic
gccaagcatttaggtgacactatagctgcatgtggattttcctgtgtttcagagctatgctggaaacagc

SEQ ID NO: 53599 - DNA, 70 bp, Artificial Sequence
  Synthetic
gccaagcatttaggtgacactatagtccatgaagattcactgccggtttcagagctatgctggaaacagc

SEQ ID NO: 53600 - DNA, 70 bp, Artificial Sequence
  Synthetic
gccaagcatttaggtgacactatagcaaatggagggccgcttcacgtttcagagctatgctggaaacagc

SEQ ID NO: 53601 - DNA, 70 bp, Artificial Sequence
  Synthetic
gccaagcatttaggtgacactatagggctggcattatagatgctggtttcagagctatgctggaaacagc

SEQ ID NO: 53602 - DNA, 70 bp, Artificial Sequence
  Synthetic
gccaagcatttaggtgacactatagtcttacaacgacttcttgtggtttcagagctatgctggaaacagc

SEQ ID NO: 53603 - DNA, 70 bp, Artificial Sequence
  Synthetic
gccaagcatttaggtgacactatagggaaagaagagtcagtagaggtttcagagctatgctggaaacagc

SEQ ID NO: 53604 - DNA, 70 bp, Artificial Sequence
  Synthetic
gccaagcatttaggtgacactatagacacaagaagtcaggaagaggtttcagagctatgctggaaacagc

SEQ ID NO: 53605 - DNA, 70 bp, Artificial Sequence
  Synthetic
gccaagcatttaggtgacactatagtagccttcaagtggtgtgaggtttcagagctatgctggaaacagc

SEQ ID NO: 53606 - DNA, 70 bp, Artificial Sequence
  Synthetic
gccaagcatttaggtgacactatagtgcccagggctcagagcttggtttcagagctatgctggaaacagc

SEQ ID NO: 53607 - DNA, 70 bp, Artificial Sequence
  Synthetic
gccaagcatttaggtgacactatagctcgtcagctggtgttagccgtttcagagctatgctggaaacagc

SEQ ID NO: 53608 - DNA, 70 bp, Artificial Sequence
  Synthetic
gccaagcatttaggtgacactatagtttcatttcacactcttcgcgtttcagagctatgctggaaacagc

SEQ ID NO: 53609 - DNA, 70 bp, Artificial Sequence
  Synthetic
gccaagcatttaggtgacactataggtggccctctcatcacagctgtttcagagctatgctggaaacagc

SEQ ID NO: 53610 - DNA, 70 bp, Artificial Sequence
  Synthetic
gccaagcatttaggtgacactatagaaggcaatccaaagtatgaggtttcagagctatgctggaaacagc

SEQ ID NO: 53611 - DNA, 70 bp, Artificial Sequence
  Synthetic
gccaagcatttaggtgacactatagaggggcgccaagctgtgactgtttcagagctatgctggaaacagc

SEQ ID NO: 53612 - DNA, 70 bp, Artificial Sequence
  Synthetic
gccaagcatttaggtgacactatagtacagtgacgaaagtgtctagtttcagagctatgctggaaacagc

SEQ ID NO: 53613 - DNA, 70 bp, Artificial Sequence
  Synthetic
gccaagcatttaggtgacactataggagtgtctatgggaaatgaggtttcagagctatgctggaaacagc

SEQ ID NO: 53614 - DNA, 70 bp, Artificial Sequence
  Synthetic
gccaagcatttaggtgacactatagagaacacttttggcttctgagtttcagagctatgctggaaacagc

SEQ ID NO: 53615 - DNA, 70 bp, Artificial Sequence
  Synthetic
gccaagcatttaggtgacactatagccgaccggcttagctgtgatgtttcagagctatgctggaaacagc

SEQ ID NO: 53616 - DNA, 70 bp, Artificial Sequence
  Synthetic
gccaagcatttaggtgacactatagcccaggcctcccacccttacgtttcagagctatgctggaaacagc

SEQ ID NO: 53617 - DNA, 70 bp, Artificial Sequence
  Synthetic
gccaagcatttaggtgacactatagtgcttctctgcaaacggaaagtttcagagctatgctggaaacagc

SEQ ID NO: 53618 - DNA, 70 bp, Artificial Sequence
  Synthetic
gccaagcatttaggtgacactatagagaggcctacagacagaagtgtttcagagctatgctggaaacagc

SEQ ID NO: 53619 - DNA, 70 bp, Artificial Sequence
  Synthetic
gccaagcatttaggtgacactatagatgactgcggcaaagcacacgtttcagagctatgctggaaacagc

SEQ ID NO: 53620 - DNA, 70 bp, Artificial Sequence
  Synthetic
gccaagcatttaggtgacactatagttaagatgaaacagttgccagtttcagagctatgctggaaacagc

SEQ ID NO: 53621 - DNA, 70 bp, Artificial Sequence
  Synthetic
gccaagcatttaggtgacactatagtttcaccatggttgaagagggtttcagagctatgctggaaacagc

SEQ ID NO: 53622 - DNA, 70 bp, Artificial Sequence
  Synthetic
gccaagcatttaggtgacactatagaaagatctattgatgtggtggtttcagagctatgctggaaacagc

SEQ ID NO: 53623 - DNA, 70 bp, Artificial Sequence
  Synthetic
gccaagcatttaggtgacactatagaaacagagaacctgtattaggtttcagagctatgctggaaacagc

SEQ ID NO: 53624 - DNA, 70 bp, Artificial Sequence
  Synthetic
gccaagcatttaggtgacactatagccaccactatctactgtttggtttcagagctatgctggaaacagc

SEQ ID NO: 53625 - DNA, 70 bp, Artificial Sequence
  Synthetic
gccaagcatttaggtgacactatagcacatttggggcatttaacagtttcagagctatgctggaaacagc

SEQ ID NO: 53626 - DNA, 70 bp, Artificial Sequence
  Synthetic
gccaagcatttaggtgacactatagagccgcctctccaaaataacgtttcagagctatgctggaaacagc

SEQ ID NO: 53627 - DNA, 70 bp, Artificial Sequence
  Synthetic
gccaagcatttaggtgacactatagactgacttccattgtatcttgtttcagagctatgctggaaacagc

SEQ ID NO: 53628 - DNA, 70 bp, Artificial Sequence
  Synthetic
gccaagcatttaggtgacactatagtggctttactatgtacactggtttcagagctatgctggaaacagc

SEQ ID NO: 53629 - DNA, 70 bp, Artificial Sequence
  Synthetic
gccaagcatttaggtgacactatagccttcttcaacatcgtctatgtttcagagctatgctggaaacagc

SEQ ID NO: 53630 - DNA, 70 bp, Artificial Sequence
  Synthetic
gccaagcatttaggtgacactatagagtgaatggaaacacgatccgtttcagagctatgctggaaacagc

SEQ ID NO: 53631 - DNA, 70 bp, Artificial Sequence
  Synthetic
gccaagcatttaggtgacactataggcctgagtcctgtgctcacagtttcagagctatgctggaaacagc

SEQ ID NO: 53632 - DNA, 70 bp, Artificial Sequence
  Synthetic
gccaagcatttaggtgacactataggcttgtttgccttaacttgtgtttcagagctatgctggaaacagc

SEQ ID NO: 53633 - DNA, 70 bp, Artificial Sequence
  Synthetic
gccaagcatttaggtgacactatagttcaacttggtttattgggtgtttcagagctatgctggaaacagc

SEQ ID NO: 53634 - DNA, 70 bp, Artificial Sequence
  Synthetic
gccaagcatttaggtgacactatagtcctacctctacctgtgagggtttcagagctatgctggaaacagc

SEQ ID NO: 53635 - DNA, 70 bp, Artificial Sequence
  Synthetic
gccaagcatttaggtgacactatagtcaaaagccagagaggcctagtttcagagctatgctggaaacagc

SEQ ID NO: 53636 - DNA, 70 bp, Artificial Sequence
  Synthetic
gccaagcatttaggtgacactatagtgagcaacacttagagatacgtttcagagctatgctggaaacagc

SEQ ID NO: 53637 - DNA, 70 bp, Artificial Sequence
  Synthetic
gccaagcatttaggtgacactataggtccctgcaagaacctgcatgtttcagagctatgctggaaacagc

SEQ ID NO: 53638 - DNA, 70 bp, Artificial Sequence
  Synthetic
gccaagcatttaggtgacactatagtgctagccaatgtattttacgtttcagagctatgctggaaacagc

SEQ ID NO: 53639 - DNA, 70 bp, Artificial Sequence
  Synthetic
gccaagcatttaggtgacactatagcactgggggactaatacatagtttcagagctatgctggaaacagc

SEQ ID NO: 53640 - DNA, 70 bp, Artificial Sequence
  Synthetic
gccaagcatttaggtgacactatagtgctgctggaaagatgatccgtttcagagctatgctggaaacagc

SEQ ID NO: 53641 - DNA, 70 bp, Artificial Sequence
  Synthetic
gccaagcatttaggtgacactatagattggtcagtgttttcctaggtttcagagctatgctggaaacagc

SEQ ID NO: 53642 - DNA, 70 bp, Artificial Sequence
  Synthetic
gccaagcatttaggtgacactatagatgtcattgacacctattctgtttcagagctatgctggaaacagc

SEQ ID NO: 53643 - DNA, 70 bp, Artificial Sequence
  Synthetic
gccaagcatttaggtgacactatagcgaaggatgattacagatccgtttcagagctatgctggaaacagc

SEQ ID NO: 53644 - DNA, 70 bp, Artificial Sequence
  Synthetic
gccaagcatttaggtgacactatagtgttggttgctacggtgatggtttcagagctatgctggaaacagc

SEQ ID NO: 53645 - DNA, 70 bp, Artificial Sequence
  Synthetic
gccaagcatttaggtgacactatagattgaagaaatagaacgcctgtttcagagctatgctggaaacagc

SEQ ID NO: 53646 - DNA, 70 bp, Artificial Sequence
  Synthetic
gccaagcatttaggtgacactatagtccacattcatctcaatggagtttcagagctatgctggaaacagc

SEQ ID NO: 53647 - DNA, 70 bp, Artificial Sequence
  Synthetic
gccaagcatttaggtgacactatagttaatctccctgaacggtgagtttcagagctatgctggaaacagc

SEQ ID NO: 53648 - DNA, 70 bp, Artificial Sequence
  Synthetic
gccaagcatttaggtgacactatagatctctcttcaggaacgctggtttcagagctatgctggaaacagc

SEQ ID NO: 53649 - DNA, 70 bp, Artificial Sequence
  Synthetic
gccaagcatttaggtgacactataggtccccgccgggctgtcactgtttcagagctatgctggaaacagc

SEQ ID NO: 53650 - DNA, 70 bp, Artificial Sequence
  Synthetic
gccaagcatttaggtgacactatagtctggggcacccagctcctggtttcagagctatgctggaaacagc

SEQ ID NO: 53651 - DNA, 70 bp, Artificial Sequence
  Synthetic
gccaagcatttaggtgacactatagctggatgagatagacttactgtttcagagctatgctggaaacagc

SEQ ID NO: 53652 - DNA, 70 bp, Artificial Sequence
  Synthetic
gccaagcatttaggtgacactataggaggtgaaaaggcctgaagagtttcagagctatgctggaaacagc

SEQ ID NO: 53653 - DNA, 70 bp, Artificial Sequence
  Synthetic
gccaagcatttaggtgacactataggaagctcatagccaggaacagtttcagagctatgctggaaacagc

SEQ ID NO: 53654 - DNA, 70 bp, Artificial Sequence
  Synthetic
gccaagcatttaggtgacactatagggaaccagcaactcaacgtcgtttcagagctatgctggaaacagc

SEQ ID NO: 53655 - DNA, 70 bp, Artificial Sequence
  Synthetic
gccaagcatttaggtgacactataggaagctgatagccaggaacagtttcagagctatgctggaaacagc

SEQ ID NO: 53656 - DNA, 70 bp, Artificial Sequence
  Synthetic
gccaagcatttaggtgacactatagggctcccggcccctcttctggtttcagagctatgctggaaacagc

SEQ ID NO: 53657 - DNA, 70 bp, Artificial Sequence
  Synthetic
gccaagcatttaggtgacactatagcctcctcagaagacatcgaggtttcagagctatgctggaaacagc

SEQ ID NO: 53658 - DNA, 70 bp, Artificial Sequence
  Synthetic
gccaagcatttaggtgacactatagcggtgggacgtcaccaccgcgtttcagagctatgctggaaacagc

SEQ ID NO: 53659 - DNA, 70 bp, Artificial Sequence
  Synthetic
gccaagcatttaggtgacactatagccgttcctgggggcgtagaggtttcagagctatgctggaaacagc

SEQ ID NO: 53660 - DNA, 70 bp, Artificial Sequence
  Synthetic
gccaagcatttaggtgacactatagtgcggagctcagggaccttggtttcagagctatgctggaaacagc

SEQ ID NO: 53661 - DNA, 70 bp, Artificial Sequence
  Synthetic
gccaagcatttaggtgacactatagtctgtagtctgatgtttatggtttcagagctatgctggaaacagc

SEQ ID NO: 53662 - DNA, 70 bp, Artificial Sequence
  Synthetic
gccaagcatttaggtgacactatagccctgttaagtattagcgtggtttcagagctatgctggaaacagc

SEQ ID NO: 53663 - DNA, 70 bp, Artificial Sequence
  Synthetic
gccaagcatttaggtgacactatagggctttggcacgcaagcctggtttcagagctatgctggaaacagc

SEQ ID NO: 53664 - DNA, 70 bp, Artificial Sequence
  Synthetic
gccaagcatttaggtgacactataggccaaggtgctgtgcttgtggtttcagagctatgctggaaacagc

SEQ ID NO: 53665 - DNA, 70 bp, Artificial Sequence
  Synthetic
gccaagcatttaggtgacactatagagtttgtttgctaccaaaccgtttcagagctatgctggaaacagc

SEQ ID NO: 53666 - DNA, 70 bp, Artificial Sequence
  Synthetic
gccaagcatttaggtgacactatagtggggctttggttttgcttggtttcagagctatgctggaaacagc

SEQ ID NO: 53667 - DNA, 70 bp, Artificial Sequence
  Synthetic
gccaagcatttaggtgacactatagttcaagttttctgtggcttagtttcagagctatgctggaaacagc

SEQ ID NO: 53668 - DNA, 70 bp, Artificial Sequence
  Synthetic
gccaagcatttaggtgacactatagtgagtctgcgcaggtgctaggtttcagagctatgctggaaacagc

SEQ ID NO: 53669 - DNA, 70 bp, Artificial Sequence
  Synthetic
gccaagcatttaggtgacactatagggtctcagaatatttctggcgtttcagagctatgctggaaacagc

SEQ ID NO: 53670 - DNA, 70 bp, Artificial Sequence
  Synthetic
gccaagcatttaggtgacactatagacacaccaactcaacagtctgtttcagagctatgctggaaacagc

SEQ ID NO: 53671 - DNA, 70 bp, Artificial Sequence
  Synthetic
gccaagcatttaggtgacactatagtggcatttggaaggttaagggtttcagagctatgctggaaacagc

SEQ ID NO: 53672 - DNA, 70 bp, Artificial Sequence
  Synthetic
gccaagcatttaggtgacactatagccaactcggatcatcagaaagtttcagagctatgctggaaacagc

SEQ ID NO: 53673 - DNA, 70 bp, Artificial Sequence
  Synthetic
gccaagcatttaggtgacactatagacatgatcttcatgtgcccagtttcagagctatgctggaaacagc

SEQ ID NO: 53674 - DNA, 70 bp, Artificial Sequence
  Synthetic
gccaagcatttaggtgacactatagttgcaaagtgctatcattacgtttcagagctatgctggaaacagc

SEQ ID NO: 53675 - DNA, 70 bp, Artificial Sequence
  Synthetic
gccaagcatttaggtgacactataggggatgctatgtgctcgatggtttcagagctatgctggaaacagc

SEQ ID NO: 53676 - DNA, 70 bp, Artificial Sequence
  Synthetic
gccaagcatttaggtgacactatagtgggacatggtgagctcttggtttcagagctatgctggaaacagc

SEQ ID NO: 53677 - DNA, 70 bp, Artificial Sequence
  Synthetic
gccaagcatttaggtgacactataggcagattgtgaacaatgggtgtttcagagctatgctggaaacagc

SEQ ID NO: 53678 - DNA, 70 bp, Artificial Sequence
  Synthetic
gccaagcatttaggtgacactatagttttgaccagatcaatgctggtttcagagctatgctggaaacagc

SEQ ID NO: 53679 - DNA, 70 bp, Artificial Sequence
  Synthetic
gccaagcatttaggtgacactatagagctgttgccacacacatgagtttcagagctatgctggaaacagc

SEQ ID NO: 53680 - DNA, 70 bp, Artificial Sequence
  Synthetic
gccaagcatttaggtgacactatagtaagaactccatcaagtagagtttcagagctatgctggaaacagc

SEQ ID NO: 53681 - DNA, 70 bp, Artificial Sequence
  Synthetic
gccaagcatttaggtgacactatagccccggtgggtcaggacgcggtttcagagctatgctggaaacagc

SEQ ID NO: 53682 - DNA, 70 bp, Artificial Sequence
  Synthetic
gccaagcatttaggtgacactatagctcaacctgcagcagtaggagtttcagagctatgctggaaacagc

SEQ ID NO: 53683 - DNA, 70 bp, Artificial Sequence
  Synthetic
gccaagcatttaggtgacactatagcatcagatccactccaaaaagtttcagagctatgctggaaacagc

SEQ ID NO: 53684 - DNA, 70 bp, Artificial Sequence
  Synthetic
gccaagcatttaggtgacactatagttctcatttgtacatcaggtgtttcagagctatgctggaaacagc

SEQ ID NO: 53685 - DNA, 70 bp, Artificial Sequence
  Synthetic
gccaagcatttaggtgacactatagcagtgaagccatatcaaaaggtttcagagctatgctggaaacagc

SEQ ID NO: 53686 - DNA, 70 bp, Artificial Sequence
  Synthetic
gccaagcatttaggtgacactatagttgaagacaccagacctgctgtttcagagctatgctggaaacagc

SEQ ID NO: 53687 - DNA, 70 bp, Artificial Sequence
  Synthetic
gccaagcatttaggtgacactatagtcagttgtggctctttgtctgtttcagagctatgctggaaacagc

SEQ ID NO: 53688 - DNA, 70 bp, Artificial Sequence
  Synthetic
gccaagcatttaggtgacactatagcgttttactggagtcacaatgtttcagagctatgctggaaacagc

SEQ ID NO: 53689 - DNA, 70 bp, Artificial Sequence
  Synthetic
gccaagcatttaggtgacactatagcagcaccatctgaggatcacgtttcagagctatgctggaaacagc

SEQ ID NO: 53690 - DNA, 70 bp, Artificial Sequence
  Synthetic
gccaagcatttaggtgacactataggaaactggatcaaacacgcagtttcagagctatgctggaaacagc

SEQ ID NO: 53691 - DNA, 70 bp, Artificial Sequence
  Synthetic
gccaagcatttaggtgacactatagatctgtgaacagcctgtgaagtttcagagctatgctggaaacagc

SEQ ID NO: 53692 - DNA, 70 bp, Artificial Sequence
  Synthetic
gccaagcatttaggtgacactatagcctttcttctttctaggagtgtttcagagctatgctggaaacagc

SEQ ID NO: 53693 - DNA, 70 bp, Artificial Sequence
  Synthetic
gccaagcatttaggtgacactatagttgaagacatctatgacttcgtttcagagctatgctggaaacagc

SEQ ID NO: 53694 - DNA, 70 bp, Artificial Sequence
  Synthetic
gccaagcatttaggtgacactatagacatgagtacaattggttgagtttcagagctatgctggaaacagc

SEQ ID NO: 53695 - DNA, 70 bp, Artificial Sequence
  Synthetic
gccaagcatttaggtgacactatagcagcatcctgacggttgatggtttcagagctatgctggaaacagc

SEQ ID NO: 53696 - DNA, 70 bp, Artificial Sequence
  Synthetic
gccaagcatttaggtgacactatagccaggcggcagggtttattcgtttcagagctatgctggaaacagc

SEQ ID NO: 53697 - DNA, 70 bp, Artificial Sequence
  Synthetic
gccaagcatttaggtgacactatagtggtcggcgtggtcaggcgagtttcagagctatgctggaaacagc

SEQ ID NO: 53698 - DNA, 70 bp, Artificial Sequence
  Synthetic
gccaagcatttaggtgacactatagcggggtgggggctcagccttgtttcagagctatgctggaaacagc

SEQ ID NO: 53699 - DNA, 70 bp, Artificial Sequence
  Synthetic
gccaagcatttaggtgacactataggcactgtggaaggccgaggtgtttcagagctatgctggaaacagc

SEQ ID NO: 53700 - DNA, 70 bp, Artificial Sequence
  Synthetic
gccaagcatttaggtgacactatagcgtgttcattccccttgagggtttcagagctatgctggaaacagc

SEQ ID NO: 53701 - DNA, 70 bp, Artificial Sequence
  Synthetic
gccaagcatttaggtgacactatagaacatcccttgggttatcgcgtttcagagctatgctggaaacagc

SEQ ID NO: 53702 - DNA, 70 bp, Artificial Sequence
  Synthetic
gccaagcatttaggtgacactatagcaacattgccactgactggggtttcagagctatgctggaaacagc

SEQ ID NO: 53703 - DNA, 70 bp, Artificial Sequence
  Synthetic
gccaagcatttaggtgacactatagcagctgtgatcaagacctccgtttcagagctatgctggaaacagc

SEQ ID NO: 53704 - DNA, 70 bp, Artificial Sequence
  Synthetic
gccaagcatttaggtgacactatagtactgtttgaagacatcagagtttcagagctatgctggaaacagc

SEQ ID NO: 53705 - DNA, 70 bp, Artificial Sequence
  Synthetic
gccaagcatttaggtgacactatagttagagttcaggcatgttctgtttcagagctatgctggaaacagc

SEQ ID NO: 53706 - DNA, 70 bp, Artificial Sequence
  Synthetic
gccaagcatttaggtgacactatagggtccaggggtcttactcctgtttcagagctatgctggaaacagc

SEQ ID NO: 53707 - DNA, 70 bp, Artificial Sequence
  Synthetic
gccaagcatttaggtgacactatagttcagccgagacaagtgaaagtttcagagctatgctggaaacagc

SEQ ID NO: 53708 - DNA, 70 bp, Artificial Sequence
  Synthetic
gccaagcatttaggtgacactatagtcatcttgaggaacttcagagtttcagagctatgctggaaacagc

SEQ ID NO: 53709 - DNA, 70 bp, Artificial Sequence
  Synthetic
gccaagcatttaggtgacactataggccttggtcttggtcactttgtttcagagctatgctggaaacagc

SEQ ID NO: 53710 - DNA, 70 bp, Artificial Sequence
  Synthetic
gccaagcatttaggtgacactatagttatttgctggagtggttgcgtttcagagctatgctggaaacagc

SEQ ID NO: 53711 - DNA, 70 bp, Artificial Sequence
  Synthetic
gccaagcatttaggtgacactatagggtggtggtttcagagggaggtttcagagctatgctggaaacagc

SEQ ID NO: 53712 - DNA, 70 bp, Artificial Sequence
  Synthetic
gccaagcatttaggtgacactatagtgcaattcattaatggctgggtttcagagctatgctggaaacagc

SEQ ID NO: 53713 - DNA, 70 bp, Artificial Sequence
  Synthetic
gccaagcatttaggtgacactatagcagctgggcagttcagatctgtttcagagctatgctggaaacagc

SEQ ID NO: 53714 - DNA, 70 bp, Artificial Sequence
  Synthetic
gccaagcatttaggtgacactatagcatcggagaaagccgtgagcgtttcagagctatgctggaaacagc

SEQ ID NO: 53715 - DNA, 70 bp, Artificial Sequence
  Synthetic
gccaagcatttaggtgacactatagaaagagacaatcgaggaatggtttcagagctatgctggaaacagc

SEQ ID NO: 53716 - DNA, 70 bp, Artificial Sequence
  Synthetic
gccaagcatttaggtgacactatagaacttgcttagagttttaccgtttcagagctatgctggaaacagc

SEQ ID NO: 53717 - DNA, 70 bp, Artificial Sequence
  Synthetic
gccaagcatttaggtgacactatagcaagatctgttgggttaaaggtttcagagctatgctggaaacagc

SEQ ID NO: 53718 - DNA, 70 bp, Artificial Sequence
  Synthetic
gccaagcatttaggtgacactataggggcgcgagggctaaaagaggtttcagagctatgctggaaacagc

SEQ ID NO: 53719 - DNA, 70 bp, Artificial Sequence
  Synthetic
gccaagcatttaggtgacactatagtgacatgccaaatgtctatagtttcagagctatgctggaaacagc

SEQ ID NO: 53720 - DNA, 70 bp, Artificial Sequence
  Synthetic
gccaagcatttaggtgacactatagtgccagttataaggctaagagtttcagagctatgctggaaacagc

SEQ ID NO: 53721 - DNA, 70 bp, Artificial Sequence
  Synthetic
gccaagcatttaggtgacactatagagccagattcctggatgtgagtttcagagctatgctggaaacagc

SEQ ID NO: 53722 - DNA, 70 bp, Artificial Sequence
  Synthetic
gccaagcatttaggtgacactataggaggaggagtcctgggtctggtttcagagctatgctggaaacagc

SEQ ID NO: 53723 - DNA, 70 bp, Artificial Sequence
  Synthetic
gccaagcatttaggtgacactatagtcttcctttttctttgcagtgtttcagagctatgctggaaacagc

SEQ ID NO: 53724 - DNA, 70 bp, Artificial Sequence
  Synthetic
gccaagcatttaggtgacactatagcgtggagcccgccgcagcctgtttcagagctatgctggaaacagc

SEQ ID NO: 53725 - DNA, 70 bp, Artificial Sequence
  Synthetic
gccaagcatttaggtgacactataggtggacatggagatctagatgtttcagagctatgctggaaacagc

SEQ ID NO: 53726 - DNA, 70 bp, Artificial Sequence
  Synthetic
gccaagcatttaggtgacactatagccccaggggggcagctacgtgtttcagagctatgctggaaacagc

SEQ ID NO: 53727 - DNA, 70 bp, Artificial Sequence
  Synthetic
gccaagcatttaggtgacactatagcttcggccgccgcagtgctggtttcagagctatgctggaaacagc

SEQ ID NO: 53728 - DNA, 70 bp, Artificial Sequence
  Synthetic
gccaagcatttaggtgacactatagtggctccgctcagctcatgagtttcagagctatgctggaaacagc

SEQ ID NO: 53729 - DNA, 70 bp, Artificial Sequence
  Synthetic
gccaagcatttaggtgacactatagatggtgaccgccatgggctagtttcagagctatgctggaaacagc

SEQ ID NO: 53730 - DNA, 70 bp, Artificial Sequence
  Synthetic
gccaagcatttaggtgacactatagtcgagcagggctctaacccagtttcagagctatgctggaaacagc

SEQ ID NO: 53731 - DNA, 70 bp, Artificial Sequence
  Synthetic
gccaagcatttaggtgacactatagggtcttggccgacagtcacggtttcagagctatgctggaaacagc

SEQ ID NO: 53732 - DNA, 70 bp, Artificial Sequence
  Synthetic
gccaagcatttaggtgacactataggtgtgcgctggccttggcctgtttcagagctatgctggaaacagc

SEQ ID NO: 53733 - DNA, 70 bp, Artificial Sequence
  Synthetic
gccaagcatttaggtgacactatagtggcggcgtgggctcaggccgtttcagagctatgctggaaacagc

SEQ ID NO: 53734 - DNA, 70 bp, Artificial Sequence
  Synthetic
gccaagcatttaggtgacactataggctacatatggactcatgttgtttcagagctatgctggaaacagc

SEQ ID NO: 53735 - DNA, 70 bp, Artificial Sequence
  Synthetic
gccaagcatttaggtgacactatagtggctcgcactatttccacggtttcagagctatgctggaaacagc

SEQ ID NO: 53736 - DNA, 70 bp, Artificial Sequence
  Synthetic
gccaagcatttaggtgacactataggcgttatttctgtccactgagtttcagagctatgctggaaacagc

SEQ ID NO: 53737 - DNA, 70 bp, Artificial Sequence
  Synthetic
gccaagcatttaggtgacactatagacaatgacagcttcttctccgtttcagagctatgctggaaacagc

SEQ ID NO: 53738 - DNA, 70 bp, Artificial Sequence
  Synthetic
gccaagcatttaggtgacactataggaatgagctactcagctgtggtttcagagctatgctggaaacagc

SEQ ID NO: 53739 - DNA, 70 bp, Artificial Sequence
  Synthetic
gccaagcatttaggtgacactatagtgctcttcctctgtggcagcgtttcagagctatgctggaaacagc

SEQ ID NO: 53740 - DNA, 70 bp, Artificial Sequence
  Synthetic
gccaagcatttaggtgacactataggcccaccctggtgccctcacgtttcagagctatgctggaaacagc

SEQ ID NO: 53741 - DNA, 70 bp, Artificial Sequence
  Synthetic
gccaagcatttaggtgacactatagcagtcctacttggactgaacgtttcagagctatgctggaaacagc

SEQ ID NO: 53742 - DNA, 70 bp, Artificial Sequence
  Synthetic
gccaagcatttaggtgacactataggttcaccatcctgtggtcaggtttcagagctatgctggaaacagc

SEQ ID NO: 53743 - DNA, 70 bp, Artificial Sequence
  Synthetic
gccaagcatttaggtgacactatagttgagtatctgctccatcacgtttcagagctatgctggaaacagc

SEQ ID NO: 53744 - DNA, 70 bp, Artificial Sequence
  Synthetic
gccaagcatttaggtgacactatagagtggaagtggctcttcagagtttcagagctatgctggaaacagc

SEQ ID NO: 53745 - DNA, 70 bp, Artificial Sequence
  Synthetic
gccaagcatttaggtgacactatagacagttcagacggctcactcgtttcagagctatgctggaaacagc

SEQ ID NO: 53746 - DNA, 70 bp, Artificial Sequence
  Synthetic
gccaagcatttaggtgacactatagtggccttgaagcacatctgtgtttcagagctatgctggaaacagc

SEQ ID NO: 53747 - DNA, 70 bp, Artificial Sequence
  Synthetic
gccaagcatttaggtgacactataggtggatctgccgaattgaaggtttcagagctatgctggaaacagc

SEQ ID NO: 53748 - DNA, 70 bp, Artificial Sequence
  Synthetic
gccaagcatttaggtgacactatagcccacctctgaggtcaactagtttcagagctatgctggaaacagc

SEQ ID NO: 53749 - DNA, 70 bp, Artificial Sequence
  Synthetic
gccaagcatttaggtgacactatagagatgaagtgacggttcagggtttcagagctatgctggaaacagc

SEQ ID NO: 53750 - DNA, 70 bp, Artificial Sequence
  Synthetic
gccaagcatttaggtgacactatagagctccgtggtcagctcctcgtttcagagctatgctggaaacagc

SEQ ID NO: 53751 - DNA, 70 bp, Artificial Sequence
  Synthetic
gccaagcatttaggtgacactatagaggctctggtctttagcttagtttcagagctatgctggaaacagc

SEQ ID NO: 53752 - DNA, 70 bp, Artificial Sequence
  Synthetic
gccaagcatttaggtgacactatagccagatgagaagcaaatcatgtttcagagctatgctggaaacagc

SEQ ID NO: 53753 - DNA, 70 bp, Artificial Sequence
  Synthetic
gccaagcatttaggtgacactatagaaacagaaaaacgaaccacagtttcagagctatgctggaaacagc

SEQ ID NO: 53754 - DNA, 70 bp, Artificial Sequence
  Synthetic
gccaagcatttaggtgacactataggaagttgggtactttcacctgtttcagagctatgctggaaacagc

SEQ ID NO: 53755 - DNA, 70 bp, Artificial Sequence
  Synthetic
gccaagcatttaggtgacactatagggagtagggacaaaatatctgtttcagagctatgctggaaacagc

SEQ ID NO: 53756 - DNA, 70 bp, Artificial Sequence
  Synthetic
gccaagcatttaggtgacactatagcatcgttattaacagtcctcgtttcagagctatgctggaaacagc

SEQ ID NO: 53757 - DNA, 70 bp, Artificial Sequence
  Synthetic
gccaagcatttaggtgacactatagaagcataagctccccttttagtttcagagctatgctggaaacagc

SEQ ID NO: 53758 - DNA, 70 bp, Artificial Sequence
  Synthetic
gccaagcatttaggtgacactatagtgtaataggctgagaaatccgtttcagagctatgctggaaacagc

SEQ ID NO: 53759 - DNA, 70 bp, Artificial Sequence
  Synthetic
gccaagcatttaggtgacactatagaacaaatggagcagggggccgtttcagagctatgctggaaacagc

SEQ ID NO: 53760 - DNA, 70 bp, Artificial Sequence
  Synthetic
gccaagcatttaggtgacactataggagcgatgtggactacagctgtttcagagctatgctggaaacagc

SEQ ID NO: 53761 - DNA, 70 bp, Artificial Sequence
  Synthetic
gccaagcatttaggtgacactatagtagaacaggcccggccctgagtttcagagctatgctggaaacagc

SEQ ID NO: 53762 - DNA, 70 bp, Artificial Sequence
  Synthetic
gccaagcatttaggtgacactatagtaaacatgcttcaggactacgtttcagagctatgctggaaacagc

SEQ ID NO: 53763 - DNA, 70 bp, Artificial Sequence
  Synthetic
gccaagcatttaggtgacactatagaaagagaccacttgcaacaagtttcagagctatgctggaaacagc

SEQ ID NO: 53764 - DNA, 70 bp, Artificial Sequence
  Synthetic
gccaagcatttaggtgacactatagggaagtggggcgactgcacggtttcagagctatgctggaaacagc

SEQ ID NO: 53765 - DNA, 70 bp, Artificial Sequence
  Synthetic
gccaagcatttaggtgacactatagtggcatcatctcttgccagagtttcagagctatgctggaaacagc

SEQ ID NO: 53766 - DNA, 70 bp, Artificial Sequence
  Synthetic
gccaagcatttaggtgacactatagtagttggtctggacttcgatgtttcagagctatgctggaaacagc

SEQ ID NO: 53767 - DNA, 70 bp, Artificial Sequence
  Synthetic
gccaagcatttaggtgacactatagcgtaggtgttcacggcctccgtttcagagctatgctggaaacagc

SEQ ID NO: 53768 - DNA, 70 bp, Artificial Sequence
  Synthetic
gccaagcatttaggtgacactatagtgatggagcggctcacttgcgtttcagagctatgctggaaacagc

SEQ ID NO: 53769 - DNA, 70 bp, Artificial Sequence
  Synthetic
gccaagcatttaggtgacactataggatggctgaggaatcaagtagtttcagagctatgctggaaacagc

SEQ ID NO: 53770 - DNA, 70 bp, Artificial Sequence
  Synthetic
gccaagcatttaggtgacactatagtaggtgatgctctcctatgagtttcagagctatgctggaaacagc

SEQ ID NO: 53771 - DNA, 70 bp, Artificial Sequence
  Synthetic
gccaagcatttaggtgacactatagttcagaccaaaatcactgacgtttcagagctatgctggaaacagc

SEQ ID NO: 53772 - DNA, 70 bp, Artificial Sequence
  Synthetic
gccaagcatttaggtgacactataggggtcccagcagggttcagagtttcagagctatgctggaaacagc

SEQ ID NO: 53773 - DNA, 70 bp, Artificial Sequence
  Synthetic
gccaagcatttaggtgacactatagaagagttcctgactctcattgtttcagagctatgctggaaacagc

SEQ ID NO: 53774 - DNA, 70 bp, Artificial Sequence
  Synthetic
gccaagcatttaggtgacactataggcctgctggagtcggggtaggtttcagagctatgctggaaacagc

SEQ ID NO: 53775 - DNA, 70 bp, Artificial Sequence
  Synthetic
gccaagcatttaggtgacactatagttcttcttgccacctttttggtttcagagctatgctggaaacagc

SEQ ID NO: 53776 - DNA, 70 bp, Artificial Sequence
  Synthetic
gccaagcatttaggtgacactataggctggtgtggtgtctgcacagtttcagagctatgctggaaacagc

SEQ ID NO: 53777 - DNA, 70 bp, Artificial Sequence
  Synthetic
gccaagcatttaggtgacactatagcttgcggccactgctctcacgtttcagagctatgctggaaacagc

SEQ ID NO: 53778 - DNA, 70 bp, Artificial Sequence
  Synthetic
gccaagcatttaggtgacactatagacatgggttcactgaacgtcgtttcagagctatgctggaaacagc

SEQ ID NO: 53779 - DNA, 70 bp, Artificial Sequence
  Synthetic
gccaagcatttaggtgacactatagagttacttggatcagcatttgtttcagagctatgctggaaacagc

SEQ ID NO: 53780 - DNA, 70 bp, Artificial Sequence
  Synthetic
gccaagcatttaggtgacactatagtcggtcattgtgaaaagtaggtttcagagctatgctggaaacagc

SEQ ID NO: 53781 - DNA, 70 bp, Artificial Sequence
  Synthetic
gccaagcatttaggtgacactatagaaagatttgggtcatctcaagtttcagagctatgctggaaacagc

SEQ ID NO: 53782 - DNA, 70 bp, Artificial Sequence
  Synthetic
gccaagcatttaggtgacactataggtcagttactcagacagagtgtttcagagctatgctggaaacagc

SEQ ID NO: 53783 - DNA, 70 bp, Artificial Sequence
  Synthetic
gccaagcatttaggtgacactatagcgacaccatcctgacatgaggtttcagagctatgctggaaacagc

SEQ ID NO: 53784 - DNA, 70 bp, Artificial Sequence
  Synthetic
gccaagcatttaggtgacactatagacacagcaaatggtcacacggtttcagagctatgctggaaacagc

SEQ ID NO: 53785 - DNA, 70 bp, Artificial Sequence
  Synthetic
gccaagcatttaggtgacactataggcatttgagacacaaagcttgtttcagagctatgctggaaacagc

SEQ ID NO: 53786 - DNA, 70 bp, Artificial Sequence
  Synthetic
gccaagcatttaggtgacactatagaatagctcaaaaataccagcgtttcagagctatgctggaaacagc

SEQ ID NO: 53787 - DNA, 70 bp, Artificial Sequence
  Synthetic
gccaagcatttaggtgacactatagtcaaagttcagtcccatagagtttcagagctatgctggaaacagc

SEQ ID NO: 53788 - DNA, 70 bp, Artificial Sequence
  Synthetic
gccaagcatttaggtgacactatagttgaagaacagcagagagacgtttcagagctatgctggaaacagc

SEQ ID NO: 53789 - DNA, 70 bp, Artificial Sequence
  Synthetic
gccaagcatttaggtgacactatagagaaagcaaacactccctaggtttcagagctatgctggaaacagc

SEQ ID NO: 53790 - DNA, 70 bp, Artificial Sequence
  Synthetic
gccaagcatttaggtgacactatagtgggctgtgatcttctacccgtttcagagctatgctggaaacagc

SEQ ID NO: 53791 - DNA, 70 bp, Artificial Sequence
  Synthetic
gccaagcatttaggtgacactatagtccagccacttcactataaagtttcagagctatgctggaaacagc

SEQ ID NO: 53792 - DNA, 70 bp, Artificial Sequence
  Synthetic
gccaagcatttaggtgacactatagattatctcctgcgaaaactcgtttcagagctatgctggaaacagc

SEQ ID NO: 53793 - DNA, 70 bp, Artificial Sequence
  Synthetic
gccaagcatttaggtgacactataggcagcttgaggattttagtggtttcagagctatgctggaaacagc

SEQ ID NO: 53794 - DNA, 70 bp, Artificial Sequence
  Synthetic
gccaagcatttaggtgacactataggaagctcttgcagaaaatccgtttcagagctatgctggaaacagc

SEQ ID NO: 53795 - DNA, 70 bp, Artificial Sequence
  Synthetic
gccaagcatttaggtgacactatagaccatggaacattaaggaaagtttcagagctatgctggaaacagc

SEQ ID NO: 53796 - DNA, 70 bp, Artificial Sequence
  Synthetic
gccaagcatttaggtgacactatagaccatttccttaatgttccagtttcagagctatgctggaaacagc

SEQ ID NO: 53797 - DNA, 70 bp, Artificial Sequence
  Synthetic
gccaagcatttaggtgacactatagccgagggtcttacactgagcgtttcagagctatgctggaaacagc

SEQ ID NO: 53798 - DNA, 70 bp, Artificial Sequence
  Synthetic
gccaagcatttaggtgacactatagacccagaccaaattatttctgtttcagagctatgctggaaacagc

SEQ ID NO: 53799 - DNA, 70 bp, Artificial Sequence
  Synthetic
gccaagcatttaggtgacactatagttttttcttgaggtaccagtgtttcagagctatgctggaaacagc

SEQ ID NO: 53800 - DNA, 70 bp, Artificial Sequence
  Synthetic
gccaagcatttaggtgacactatagaagatggcaggtcacaaatcgtttcagagctatgctggaaacagc

SEQ ID NO: 53801 - DNA, 70 bp, Artificial Sequence
  Synthetic
gccaagcatttaggtgacactatagaagttctccctcacctggtagtttcagagctatgctggaaacagc

SEQ ID NO: 53802 - DNA, 70 bp, Artificial Sequence
  Synthetic
gccaagcatttaggtgacactatagaccgtgaaagtctagaagtggtttcagagctatgctggaaacagc

SEQ ID NO: 53803 - DNA, 70 bp, Artificial Sequence
  Synthetic
gccaagcatttaggtgacactatagccaccctggagtggtctcacgtttcagagctatgctggaaacagc

SEQ ID NO: 53804 - DNA, 70 bp, Artificial Sequence
  Synthetic
gccaagcatttaggtgacactatagcgctgtggctgctcttaagggtttcagagctatgctggaaacagc

SEQ ID NO: 53805 - DNA, 70 bp, Artificial Sequence
  Synthetic
gccaagcatttaggtgacactatagccaggactgctcatatgcaggtttcagagctatgctggaaacagc

SEQ ID NO: 53806 - DNA, 70 bp, Artificial Sequence
  Synthetic
gccaagcatttaggtgacactataggcgtggcagagtgtgggtgcgtttcagagctatgctggaaacagc

SEQ ID NO: 53807 - DNA, 70 bp, Artificial Sequence
  Synthetic
gccaagcatttaggtgacactatagcgatgaatgtgggtgtgggtgtttcagagctatgctggaaacagc

SEQ ID NO: 53808 - DNA, 70 bp, Artificial Sequence
  Synthetic
gccaagcatttaggtgacactatagtcgtggagtcgtgtggctgcgtttcagagctatgctggaaacagc

SEQ ID NO: 53809 - DNA, 70 bp, Artificial Sequence
  Synthetic
gccaagcatttaggtgacactataggtgttctctctagatgaccggtttcagagctatgctggaaacagc

SEQ ID NO: 53810 - DNA, 70 bp, Artificial Sequence
  Synthetic
gccaagcatttaggtgacactatagagtcgtgcggctgcaggtaggtttcagagctatgctggaaacagc

SEQ ID NO: 53811 - DNA, 70 bp, Artificial Sequence
  Synthetic
gccaagcatttaggtgacactatagtggtggaggcctgcggctgcgtttcagagctatgctggaaacagc

SEQ ID NO: 53812 - DNA, 70 bp, Artificial Sequence
  Synthetic
gccaagcatttaggtgacactataggaggaccatttgttaacgacgtttcagagctatgctggaaacagc

SEQ ID NO: 53813 - DNA, 70 bp, Artificial Sequence
  Synthetic
gccaagcatttaggtgacactatagcgcaaacagaacgacgtcttgtttcagagctatgctggaaacagc

SEQ ID NO: 53814 - DNA, 70 bp, Artificial Sequence
  Synthetic
gccaagcatttaggtgacactatagcgcaagaagaatgacatctagtttcagagctatgctggaaacagc

SEQ ID NO: 53815 - DNA, 70 bp, Artificial Sequence
  Synthetic
gccaagcatttaggtgacactatagaagcattccgctaaaaggtggtttcagagctatgctggaaacagc

SEQ ID NO: 53816 - DNA, 70 bp, Artificial Sequence
  Synthetic
gccaagcatttaggtgacactatagagactatccaacaaagcttagtttcagagctatgctggaaacagc

SEQ ID NO: 53817 - DNA, 70 bp, Artificial Sequence
  Synthetic
gccaagcatttaggtgacactataggaggcattcaagtaagtttcgtttcagagctatgctggaaacagc

SEQ ID NO: 53818 - DNA, 70 bp, Artificial Sequence
  Synthetic
gccaagcatttaggtgacactatagtgaaggccattgcagctattgtttcagagctatgctggaaacagc

SEQ ID NO: 53819 - DNA, 70 bp, Artificial Sequence
  Synthetic
gccaagcatttaggtgacactatagaaacagcagtgctgctgacagtttcagagctatgctggaaacagc

SEQ ID NO: 53820 - DNA, 70 bp, Artificial Sequence
  Synthetic
gccaagcatttaggtgacactatagtcgaggcttctggacttagggtttcagagctatgctggaaacagc

SEQ ID NO: 53821 - DNA, 70 bp, Artificial Sequence
  Synthetic
gccaagcatttaggtgacactatagtcagagtggaagtaagaatggtttcagagctatgctggaaacagc

SEQ ID NO: 53822 - DNA, 70 bp, Artificial Sequence
  Synthetic
gccaagcatttaggtgacactatagagaccctcatagagcggagtgtttcagagctatgctggaaacagc

SEQ ID NO: 53823 - DNA, 70 bp, Artificial Sequence
  Synthetic
gccaagcatttaggtgacactatagagaagtattattgctcttccgtttcagagctatgctggaaacagc

SEQ ID NO: 53824 - DNA, 70 bp, Artificial Sequence
  Synthetic
gccaagcatttaggtgacactatagccatgacctctctgtactctgtttcagagctatgctggaaacagc

SEQ ID NO: 53825 - DNA, 70 bp, Artificial Sequence
  Synthetic
gccaagcatttaggtgacactatagagagatcagctacatcaagagtttcagagctatgctggaaacagc

SEQ ID NO: 53826 - DNA, 70 bp, Artificial Sequence
  Synthetic
gccaagcatttaggtgacactatagctctgaagtgaggctcttaggtttcagagctatgctggaaacagc

SEQ ID NO: 53827 - DNA, 70 bp, Artificial Sequence
  Synthetic
gccaagcatttaggtgacactatagaagatgagcagcttctgactgtttcagagctatgctggaaacagc

SEQ ID NO: 53828 - DNA, 70 bp, Artificial Sequence
  Synthetic
gccaagcatttaggtgacactatagaaattcacatacagaaggtcgtttcagagctatgctggaaacagc

SEQ ID NO: 53829 - DNA, 70 bp, Artificial Sequence
  Synthetic
gccaagcatttaggtgacactatagcacacttcctggcctctcatgtttcagagctatgctggaaacagc

SEQ ID NO: 53830 - DNA, 70 bp, Artificial Sequence
  Synthetic
gccaagcatttaggtgacactatagtcccataggtgtgcaagcaggtttcagagctatgctggaaacagc

SEQ ID NO: 53831 - DNA, 70 bp, Artificial Sequence
  Synthetic
gccaagcatttaggtgacactatagtgccctgagctcagaacttcgtttcagagctatgctggaaacagc

SEQ ID NO: 53832 - DNA, 70 bp, Artificial Sequence
  Synthetic
gccaagcatttaggtgacactatagagttttaatctctggcgtaagtttcagagctatgctggaaacagc

SEQ ID NO: 53833 - DNA, 70 bp, Artificial Sequence
  Synthetic
gccaagcatttaggtgacactatagcccatcgagctggactgaacgtttcagagctatgctggaaacagc

SEQ ID NO: 53834 - DNA, 70 bp, Artificial Sequence
  Synthetic
gccaagcatttaggtgacactataggagcacaaggatgtgatgtggtttcagagctatgctggaaacagc

SEQ ID NO: 53835 - DNA, 70 bp, Artificial Sequence
  Synthetic
gccaagcatttaggtgacactataggcaggcagctaaccgcgagcgtttcagagctatgctggaaacagc

SEQ ID NO: 53836 - DNA, 70 bp, Artificial Sequence
  Synthetic
gccaagcatttaggtgacactatagggagcgctgcagtgtcacgagtttcagagctatgctggaaacagc

SEQ ID NO: 53837 - DNA, 70 bp, Artificial Sequence
  Synthetic
gccaagcatttaggtgacactatagggatggctcctgtgactagagtttcagagctatgctggaaacagc

SEQ ID NO: 53838 - DNA, 70 bp, Artificial Sequence
  Synthetic
gccaagcatttaggtgacactatagggcaccgggagacgcagcatgtttcagagctatgctggaaacagc

SEQ ID NO: 53839 - DNA, 70 bp, Artificial Sequence
  Synthetic
gccaagcatttaggtgacactatagagccagcacaatctcaagtggtttcagagctatgctggaaacagc

SEQ ID NO: 53840 - DNA, 70 bp, Artificial Sequence
  Synthetic
gccaagcatttaggtgacactatagattaatgacgtcttcttgtggtttcagagctatgctggaaacagc

SEQ ID NO: 53841 - DNA, 70 bp, Artificial Sequence
  Synthetic
gccaagcatttaggtgacactataggtttgtgcctgctgtagaaagtttcagagctatgctggaaacagc

SEQ ID NO: 53842 - DNA, 70 bp, Artificial Sequence
  Synthetic
gccaagcatttaggtgacactatagacactgctcaaccggagaaggtttcagagctatgctggaaacagc

SEQ ID NO: 53843 - DNA, 70 bp, Artificial Sequence
  Synthetic
gccaagcatttaggtgacactatagtctaagcagccaggtataaagtttcagagctatgctggaaacagc

SEQ ID NO: 53844 - DNA, 70 bp, Artificial Sequence
  Synthetic
gccaagcatttaggtgacactatagttagacaggctgcatccctagtttcagagctatgctggaaacagc

SEQ ID NO: 53845 - DNA, 70 bp, Artificial Sequence
  Synthetic
gccaagcatttaggtgacactatagtcaatctgtgctaacagtaggtttcagagctatgctggaaacagc

SEQ ID NO: 53846 - DNA, 70 bp, Artificial Sequence
  Synthetic
gccaagcatttaggtgacactataggcccaggaaggagagctcaggtttcagagctatgctggaaacagc

SEQ ID NO: 53847 - DNA, 70 bp, Artificial Sequence
  Synthetic
gccaagcatttaggtgacactataggagcccaggtgcaggctcatgtttcagagctatgctggaaacagc

SEQ ID NO: 53848 - DNA, 70 bp, Artificial Sequence
  Synthetic
gccaagcatttaggtgacactatagaaatctgtgactgtagagtggtttcagagctatgctggaaacagc

SEQ ID NO: 53849 - DNA, 70 bp, Artificial Sequence
  Synthetic
gccaagcatttaggtgacactatagaagtctgtaactgtggaatggtttcagagctatgctggaaacagc

SEQ ID NO: 53850 - DNA, 70 bp, Artificial Sequence
  Synthetic
gccaagcatttaggtgacactatagagataatagggtggacagaggtttcagagctatgctggaaacagc

SEQ ID NO: 53851 - DNA, 70 bp, Artificial Sequence
  Synthetic
gccaagcatttaggtgacactatagctcggttcccacagcctacagtttcagagctatgctggaaacagc

SEQ ID NO: 53852 - DNA, 70 bp, Artificial Sequence
  Synthetic
gccaagcatttaggtgacactataggctcctgagcctatggtagcgtttcagagctatgctggaaacagc

SEQ ID NO: 53853 - DNA, 70 bp, Artificial Sequence
  Synthetic
gccaagcatttaggtgacactatagctcccggccctgctctgattgtttcagagctatgctggaaacagc

SEQ ID NO: 53854 - DNA, 70 bp, Artificial Sequence
  Synthetic
gccaagcatttaggtgacactatagctaatgaatcagagttctccgtttcagagctatgctggaaacagc

SEQ ID NO: 53855 - DNA, 70 bp, Artificial Sequence
  Synthetic
gccaagcatttaggtgacactatagcacgaagttgttggggagcggtttcagagctatgctggaaacagc

SEQ ID NO: 53856 - DNA, 70 bp, Artificial Sequence
  Synthetic
gccaagcatttaggtgacactatagccccagcccctctgttctaggtttcagagctatgctggaaacagc

SEQ ID NO: 53857 - DNA, 70 bp, Artificial Sequence
  Synthetic
gccaagcatttaggtgacactatagttcccagacctggctgtcttgtttcagagctatgctggaaacagc

SEQ ID NO: 53858 - DNA, 70 bp, Artificial Sequence
  Synthetic
gccaagcatttaggtgacactatagcctactgactacctcttgctgtttcagagctatgctggaaacagc

SEQ ID NO: 53859 - DNA, 70 bp, Artificial Sequence
  Synthetic
gccaagcatttaggtgacactatagacagcgtcctctggggtcatgtttcagagctatgctggaaacagc

SEQ ID NO: 53860 - DNA, 70 bp, Artificial Sequence
  Synthetic
gccaagcatttaggtgacactatagccccgggagaacagataagggtttcagagctatgctggaaacagc

SEQ ID NO: 53861 - DNA, 70 bp, Artificial Sequence
  Synthetic
gccaagcatttaggtgacactatagaacttctcttgatactccaggtttcagagctatgctggaaacagc

SEQ ID NO: 53862 - DNA, 70 bp, Artificial Sequence
  Synthetic
gccaagcatttaggtgacactatagtgaagacatcatcaaaaagggtttcagagctatgctggaaacagc

SEQ ID NO: 53863 - DNA, 70 bp, Artificial Sequence
  Synthetic
gccaagcatttaggtgacactataggtccactcagagttctgaaggtttcagagctatgctggaaacagc

SEQ ID NO: 53864 - DNA, 70 bp, Artificial Sequence
  Synthetic
gccaagcatttaggtgacactataggaactgtgggaaatattgacgtttcagagctatgctggaaacagc

SEQ ID NO: 53865 - DNA, 70 bp, Artificial Sequence
  Synthetic
gccaagcatttaggtgacactatagaatgcggttttcacagcattgtttcagagctatgctggaaacagc

SEQ ID NO: 53866 - DNA, 70 bp, Artificial Sequence
  Synthetic
gccaagcatttaggtgacactatagttgagccgactacactcagtgtttcagagctatgctggaaacagc

SEQ ID NO: 53867 - DNA, 70 bp, Artificial Sequence
  Synthetic
gccaagcatttaggtgacactatagagtggctggttgacaacggcgtttcagagctatgctggaaacagc

SEQ ID NO: 53868 - DNA, 70 bp, Artificial Sequence
  Synthetic
gccaagcatttaggtgacactatagtttactaaggctactagctcgtttcagagctatgctggaaacagc

SEQ ID NO: 53869 - DNA, 70 bp, Artificial Sequence
  Synthetic
gccaagcatttaggtgacactatagctcctggagcactcagtagcgtttcagagctatgctggaaacagc

SEQ ID NO: 53870 - DNA, 70 bp, Artificial Sequence
  Synthetic
gccaagcatttaggtgacactatagagcagtgtcttagtagcctggtttcagagctatgctggaaacagc

SEQ ID NO: 53871 - DNA, 70 bp, Artificial Sequence
  Synthetic
gccaagcatttaggtgacactatagctgccaccttggctcccaaggtttcagagctatgctggaaacagc

SEQ ID NO: 53872 - DNA, 70 bp, Artificial Sequence
  Synthetic
gccaagcatttaggtgacactatagccccttccaggggttctaacgtttcagagctatgctggaaacagc

SEQ ID NO: 53873 - DNA, 70 bp, Artificial Sequence
  Synthetic
gccaagcatttaggtgacactatagggggcaggcccaggcactaggtttcagagctatgctggaaacagc

SEQ ID NO: 53874 - DNA, 70 bp, Artificial Sequence
  Synthetic
gccaagcatttaggtgacactatagagacatctactttctccacggtttcagagctatgctggaaacagc

SEQ ID NO: 53875 - DNA, 70 bp, Artificial Sequence
  Synthetic
gccaagcatttaggtgacactataggccccaccccgctgctctacgtttcagagctatgctggaaacagc

SEQ ID NO: 53876 - DNA, 70 bp, Artificial Sequence
  Synthetic
gccaagcatttaggtgacactatagtggagcaatcagtagccagcgtttcagagctatgctggaaacagc

SEQ ID NO: 53877 - DNA, 70 bp, Artificial Sequence
  Synthetic
gccaagcatttaggtgacactatagcgctctgtggagggcagctggtttcagagctatgctggaaacagc

SEQ ID NO: 53878 - DNA, 70 bp, Artificial Sequence
  Synthetic
gccaagcatttaggtgacactatagttttattaggacaaggctgggtttcagagctatgctggaaacagc

SEQ ID NO: 53879 - DNA, 70 bp, Artificial Sequence
  Synthetic
gccaagcatttaggtgacactatagttttgtgtcaaacttgctgtgtttcagagctatgctggaaacagc

SEQ ID NO: 53880 - DNA, 70 bp, Artificial Sequence
  Synthetic
gccaagcatttaggtgacactatagaggtgtttgtggcgctgagggtttcagagctatgctggaaacagc

SEQ ID NO: 53881 - DNA, 70 bp, Artificial Sequence
  Synthetic
gccaagcatttaggtgacactatagccagtgtctgcaggagaggggtttcagagctatgctggaaacagc

SEQ ID NO: 53882 - DNA, 70 bp, Artificial Sequence
  Synthetic
gccaagcatttaggtgacactataggcaactatgctggcaactgggtttcagagctatgctggaaacagc

SEQ ID NO: 53883 - DNA, 70 bp, Artificial Sequence
  Synthetic
gccaagcatttaggtgacactatagaaggcatgattttgttcagtgtttcagagctatgctggaaacagc

SEQ ID NO: 53884 - DNA, 70 bp, Artificial Sequence
  Synthetic
gccaagcatttaggtgacactatagcatgtaaattggctcatctggtttcagagctatgctggaaacagc

SEQ ID NO: 53885 - DNA, 70 bp, Artificial Sequence
  Synthetic
gccaagcatttaggtgacactatagacaggaggaatcttcatcccgtttcagagctatgctggaaacagc

SEQ ID NO: 53886 - DNA, 70 bp, Artificial Sequence
  Synthetic
gccaagcatttaggtgacactatagggtgctgacatctatgtgctgtttcagagctatgctggaaacagc

SEQ ID NO: 53887 - DNA, 70 bp, Artificial Sequence
  Synthetic
gccaagcatttaggtgacactataggcttgtgggcgatcacttgtgtttcagagctatgctggaaacagc

SEQ ID NO: 53888 - DNA, 70 bp, Artificial Sequence
  Synthetic
gccaagcatttaggtgacactatagagagagaagggagaaggcacgtttcagagctatgctggaaacagc

SEQ ID NO: 53889 - DNA, 70 bp, Artificial Sequence
  Synthetic
gccaagcatttaggtgacactatagaagatgaaagttctcgggccgtttcagagctatgctggaaacagc

SEQ ID NO: 53890 - DNA, 70 bp, Artificial Sequence
  Synthetic
gccaagcatttaggtgacactatagctgttctgaaccgttgtcacgtttcagagctatgctggaaacagc

SEQ ID NO: 53891 - DNA, 70 bp, Artificial Sequence
  Synthetic
gccaagcatttaggtgacactatagacgcaagcgcaggcgctactgtttcagagctatgctggaaacagc

SEQ ID NO: 53892 - DNA, 70 bp, Artificial Sequence
  Synthetic
gccaagcatttaggtgacactatagtcgttagtactgtgtgaaatgtttcagagctatgctggaaacagc

SEQ ID NO: 53893 - DNA, 70 bp, Artificial Sequence
  Synthetic
gccaagcatttaggtgacactatagttctggtgagatcgagagcggtttcagagctatgctggaaacagc

SEQ ID NO: 53894 - DNA, 70 bp, Artificial Sequence
  Synthetic
gccaagcatttaggtgacactatagcatgggtgaaatcgagacgtgtttcagagctatgctggaaacagc

SEQ ID NO: 53895 - DNA, 70 bp, Artificial Sequence
  Synthetic
gccaagcatttaggtgacactatagtaggacctgcgctgtcagtcgtttcagagctatgctggaaacagc

SEQ ID NO: 53896 - DNA, 70 bp, Artificial Sequence
  Synthetic
gccaagcatttaggtgacactataggcatcaagtgtttgactctggtttcagagctatgctggaaacagc

SEQ ID NO: 53897 - DNA, 70 bp, Artificial Sequence
  Synthetic
gccaagcatttaggtgacactataggggatctgtaactataacctgtttcagagctatgctggaaacagc

SEQ ID NO: 53898 - DNA, 70 bp, Artificial Sequence
  Synthetic
gccaagcatttaggtgacactatagtattttgttacgtctgttcggtttcagagctatgctggaaacagc

SEQ ID NO: 53899 - DNA, 70 bp, Artificial Sequence
  Synthetic
gccaagcatttaggtgacactatagcaagtccagcacaggctcaagtttcagagctatgctggaaacagc

SEQ ID NO: 53900 - DNA, 70 bp, Artificial Sequence
  Synthetic
gccaagcatttaggtgacactatagtgctttcagaaatatggcatgtttcagagctatgctggaaacagc

SEQ ID NO: 53901 - DNA, 70 bp, Artificial Sequence
  Synthetic
gccaagcatttaggtgacactatagttttaaggagtttttcggctgtttcagagctatgctggaaacagc

SEQ ID NO: 53902 - DNA, 70 bp, Artificial Sequence
  Synthetic
gccaagcatttaggtgacactatagtagaatttagcagcgttttcgtttcagagctatgctggaaacagc

SEQ ID NO: 53903 - DNA, 70 bp, Artificial Sequence
  Synthetic
gccaagcatttaggtgacactatagtctgttggactcttcaaaccgtttcagagctatgctggaaacagc

SEQ ID NO: 53904 - DNA, 70 bp, Artificial Sequence
  Synthetic
gccaagcatttaggtgacactatagaggttttcagctcttttctcgtttcagagctatgctggaaacagc

SEQ ID NO: 53905 - DNA, 70 bp, Artificial Sequence
  Synthetic
gccaagcatttaggtgacactatagcctcggcgcatggtcatgacgtttcagagctatgctggaaacagc

SEQ ID NO: 53906 - DNA, 70 bp, Artificial Sequence
  Synthetic
gccaagcatttaggtgacactatagtctggagagtactcagtctcgtttcagagctatgctggaaacagc

SEQ ID NO: 53907 - DNA, 70 bp, Artificial Sequence
  Synthetic
gccaagcatttaggtgacactatagtcttcttgtaattctgaacggtttcagagctatgctggaaacagc

SEQ ID NO: 53908 - DNA, 70 bp, Artificial Sequence
  Synthetic
gccaagcatttaggtgacactatagattgcacctctggttgcatcgtttcagagctatgctggaaacagc

SEQ ID NO: 53909 - DNA, 70 bp, Artificial Sequence
  Synthetic
gccaagcatttaggtgacactatagagacaaacctctgcaggctcgtttcagagctatgctggaaacagc

SEQ ID NO: 53910 - DNA, 70 bp, Artificial Sequence
  Synthetic
gccaagcatttaggtgacactatagtccgggggcagtcctagtaggtttcagagctatgctggaaacagc

SEQ ID NO: 53911 - DNA, 70 bp, Artificial Sequence
  Synthetic
gccaagcatttaggtgacactatagattggtgatgccaaacgaaggtttcagagctatgctggaaacagc

SEQ ID NO: 53912 - DNA, 70 bp, Artificial Sequence
  Synthetic
gccaagcatttaggtgacactatagtaccgcggggggccgtagctgtttcagagctatgctggaaacagc

SEQ ID NO: 53913 - DNA, 70 bp, Artificial Sequence
  Synthetic
gccaagcatttaggtgacactataggttggaaagttactgctagggtttcagagctatgctggaaacagc

SEQ ID NO: 53914 - DNA, 70 bp, Artificial Sequence
  Synthetic
gccaagcatttaggtgacactataggaggtcactgcttcttctctgtttcagagctatgctggaaacagc

SEQ ID NO: 53915 - DNA, 70 bp, Artificial Sequence
  Synthetic
gccaagcatttaggtgacactatagaaagagaacaacaactgacagtttcagagctatgctggaaacagc

SEQ ID NO: 53916 - DNA, 70 bp, Artificial Sequence
  Synthetic
gccaagcatttaggtgacactatagcaagatacagcagctaatgagtttcagagctatgctggaaacagc

SEQ ID NO: 53917 - DNA, 70 bp, Artificial Sequence
  Synthetic
gccaagcatttaggtgacactatagccactgcaagcaaaacaaacgtttcagagctatgctggaaacagc

SEQ ID NO: 53918 - DNA, 70 bp, Artificial Sequence
  Synthetic
gccaagcatttaggtgacactatagaagcctgtatctagatctccgtttcagagctatgctggaaacagc

SEQ ID NO: 53919 - DNA, 70 bp, Artificial Sequence
  Synthetic
gccaagcatttaggtgacactatagatggagggggagattatttagtttcagagctatgctggaaacagc

SEQ ID NO: 53920 - DNA, 70 bp, Artificial Sequence
  Synthetic
gccaagcatttaggtgacactataggcaggcacccgggcactagagtttcagagctatgctggaaacagc

SEQ ID NO: 53921 - DNA, 70 bp, Artificial Sequence
  Synthetic
gccaagcatttaggtgacactatagcttcttagaagcagagctgcgtttcagagctatgctggaaacagc

SEQ ID NO: 53922 - DNA, 70 bp, Artificial Sequence
  Synthetic
gccaagcatttaggtgacactatagtaaaggagggtcacactgatgtttcagagctatgctggaaacagc

SEQ ID NO: 53923 - DNA, 70 bp, Artificial Sequence
  Synthetic
gccaagcatttaggtgacactatagtacggttagatcgtctgaccgtttcagagctatgctggaaacagc

SEQ ID NO: 53924 - DNA, 70 bp, Artificial Sequence
  Synthetic
gccaagcatttaggtgacactatagtgtttagatctgaagatctggtttcagagctatgctggaaacagc

SEQ ID NO: 53925 - DNA, 70 bp, Artificial Sequence
  Synthetic
gccaagcatttaggtgacactataggcctggtatgtggcatcagcgtttcagagctatgctggaaacagc

SEQ ID NO: 53926 - DNA, 70 bp, Artificial Sequence
  Synthetic
gccaagcatttaggtgacactatagaactgggcaatgcgttaaacgtttcagagctatgctggaaacagc

SEQ ID NO: 53927 - DNA, 70 bp, Artificial Sequence
  Synthetic
gccaagcatttaggtgacactatagacccctgccctgtggtcagagtttcagagctatgctggaaacagc

SEQ ID NO: 53928 - DNA, 70 bp, Artificial Sequence
  Synthetic
gccaagcatttaggtgacactatagcggccccagtggatgcaggtgtttcagagctatgctggaaacagc

SEQ ID NO: 53929 - DNA, 70 bp, Artificial Sequence
  Synthetic
gccaagcatttaggtgacactataggaagaaaaccatcttgtgaggtttcagagctatgctggaaacagc

SEQ ID NO: 53930 - DNA, 70 bp, Artificial Sequence
  Synthetic
gccaagcatttaggtgacactatagagtggtcaaaatgcaatcacgtttcagagctatgctggaaacagc

SEQ ID NO: 53931 - DNA, 70 bp, Artificial Sequence
  Synthetic
gccaagcatttaggtgacactataggctgtggcactcacacactggtttcagagctatgctggaaacagc

SEQ ID NO: 53932 - DNA, 70 bp, Artificial Sequence
  Synthetic
gccaagcatttaggtgacactatagccgccaggattaaatccagagtttcagagctatgctggaaacagc

SEQ ID NO: 53933 - DNA, 70 bp, Artificial Sequence
  Synthetic
gccaagcatttaggtgacactatagagaccaccgtgtggatctgagtttcagagctatgctggaaacagc

SEQ ID NO: 53934 - DNA, 70 bp, Artificial Sequence
  Synthetic
gccaagcatttaggtgacactatagggacccagagatgcctgagtgtttcagagctatgctggaaacagc

SEQ ID NO: 53935 - DNA, 70 bp, Artificial Sequence
  Synthetic
gccaagcatttaggtgacactataggactctgcctatgtgtgagagtttcagagctatgctggaaacagc

SEQ ID NO: 53936 - DNA, 70 bp, Artificial Sequence
  Synthetic
gccaagcatttaggtgacactatagaggcggtgcccgcccctagagtttcagagctatgctggaaacagc

SEQ ID NO: 53937 - DNA, 70 bp, Artificial Sequence
  Synthetic
gccaagcatttaggtgacactataggagagccaggaagtctgagtgtttcagagctatgctggaaacagc

SEQ ID NO: 53938 - DNA, 70 bp, Artificial Sequence
  Synthetic
gccaagcatttaggtgacactatagacaactcaatctccagaaaggtttcagagctatgctggaaacagc

SEQ ID NO: 53939 - DNA, 70 bp, Artificial Sequence
  Synthetic
gccaagcatttaggtgacactatagatcggagcaaggtacatctcgtttcagagctatgctggaaacagc

SEQ ID NO: 53940 - DNA, 70 bp, Artificial Sequence
  Synthetic
gccaagcatttaggtgacactatagattggagcaagatatatctcgtttcagagctatgctggaaacagc

SEQ ID NO: 53941 - DNA, 70 bp, Artificial Sequence
  Synthetic
gccaagcatttaggtgacactatagcagtgaaacgctccatgaatgtttcagagctatgctggaaacagc

SEQ ID NO: 53942 - DNA, 70 bp, Artificial Sequence
  Synthetic
gccaagcatttaggtgacactataggctaatgtaatcacctacacgtttcagagctatgctggaaacagc

SEQ ID NO: 53943 - DNA, 70 bp, Artificial Sequence
  Synthetic
gccaagcatttaggtgacactatagttccttctgtggagacacgggtttcagagctatgctggaaacagc

SEQ ID NO: 53944 - DNA, 70 bp, Artificial Sequence
  Synthetic
gccaagcatttaggtgacactatagctgtgcagacattcatgtttgtttcagagctatgctggaaacagc

SEQ ID NO: 53945 - DNA, 70 bp, Artificial Sequence
  Synthetic
gccaagcatttaggtgacactatagctgaagcaaaacagtgcctggtttcagagctatgctggaaacagc

SEQ ID NO: 53946 - DNA, 70 bp, Artificial Sequence
  Synthetic
gccaagcatttaggtgacactatagcaggctttcatcatcatacagtttcagagctatgctggaaacagc

SEQ ID NO: 53947 - DNA, 70 bp, Artificial Sequence
  Synthetic
gccaagcatttaggtgacactatagggagttaagtgggcactgaagtttcagagctatgctggaaacagc

SEQ ID NO: 53948 - DNA, 70 bp, Artificial Sequence
  Synthetic
gccaagcatttaggtgacactataggaaccagtacattaagtgaggtttcagagctatgctggaaacagc

SEQ ID NO: 53949 - DNA, 70 bp, Artificial Sequence
  Synthetic
gccaagcatttaggtgacactatagtcagacacagttttacagcggtttcagagctatgctggaaacagc

SEQ ID NO: 53950 - DNA, 70 bp, Artificial Sequence
  Synthetic
gccaagcatttaggtgacactatagcatagttctgagcagagatggtttcagagctatgctggaaacagc

SEQ ID NO: 53951 - DNA, 70 bp, Artificial Sequence
  Synthetic
gccaagcatttaggtgacactatagaagctaccttaaaggcagcagtttcagagctatgctggaaacagc

SEQ ID NO: 53952 - DNA, 70 bp, Artificial Sequence
  Synthetic
gccaagcatttaggtgacactataggggctgctttatggcgaatggtttcagagctatgctggaaacagc

SEQ ID NO: 53953 - DNA, 70 bp, Artificial Sequence
  Synthetic
gccaagcatttaggtgacactataggccctcttttgttcagaaaagtttcagagctatgctggaaacagc

SEQ ID NO: 53954 - DNA, 70 bp, Artificial Sequence
  Synthetic
gccaagcatttaggtgacactatagtgcagcacatcactgatttagtttcagagctatgctggaaacagc

SEQ ID NO: 53955 - DNA, 70 bp, Artificial Sequence
  Synthetic
gccaagcatttaggtgacactatagggactactttcccaggtatcgtttcagagctatgctggaaacagc

SEQ ID NO: 53956 - DNA, 70 bp, Artificial Sequence
  Synthetic
gccaagcatttaggtgacactataggtgacatcaggagcgccagagtttcagagctatgctggaaacagc

SEQ ID NO: 53957 - DNA, 70 bp, Artificial Sequence
  Synthetic
gccaagcatttaggtgacactatagagtgtgcagaaaggtcaggcgtttcagagctatgctggaaacagc

SEQ ID NO: 53958 - DNA, 70 bp, Artificial Sequence
  Synthetic
gccaagcatttaggtgacactatagtgacacgagagctcaaggacgtttcagagctatgctggaaacagc

SEQ ID NO: 53959 - DNA, 70 bp, Artificial Sequence
  Synthetic
gccaagcatttaggtgacactatagctctttaggcactagagttggtttcagagctatgctggaaacagc

SEQ ID NO: 53960 - DNA, 70 bp, Artificial Sequence
  Synthetic
gccaagcatttaggtgacactatagtcctgaacatgatgacctaggtttcagagctatgctggaaacagc

SEQ ID NO: 53961 - DNA, 70 bp, Artificial Sequence
  Synthetic
gccaagcatttaggtgacactatagattccttgcagttatgcaatgtttcagagctatgctggaaacagc

SEQ ID NO: 53962 - DNA, 70 bp, Artificial Sequence
  Synthetic
gccaagcatttaggtgacactataggtgcactaccgcgagtagccgtttcagagctatgctggaaacagc

SEQ ID NO: 53963 - DNA, 70 bp, Artificial Sequence
  Synthetic
gccaagcatttaggtgacactataggtacttgtgctgtaccaaaagtttcagagctatgctggaaacagc

SEQ ID NO: 53964 - DNA, 70 bp, Artificial Sequence
  Synthetic
gccaagcatttaggtgacactataggcctttaatccattcagcttgtttcagagctatgctggaaacagc

SEQ ID NO: 53965 - DNA, 70 bp, Artificial Sequence
  Synthetic
gccaagcatttaggtgacactatagaaaagaaaagatggaggaaggtttcagagctatgctggaaacagc

SEQ ID NO: 53966 - DNA, 70 bp, Artificial Sequence
  Synthetic
gccaagcatttaggtgacactatagacgagaagaccttatgaaccgtttcagagctatgctggaaacagc

SEQ ID NO: 53967 - DNA, 70 bp, Artificial Sequence
  Synthetic
gccaagcatttaggtgacactatagaggcctgggctgcctagcaggtttcagagctatgctggaaacagc

SEQ ID NO: 53968 - DNA, 70 bp, Artificial Sequence
  Synthetic
gccaagcatttaggtgacactatagttaacaagttacttcttcgggtttcagagctatgctggaaacagc

SEQ ID NO: 53969 - DNA, 70 bp, Artificial Sequence
  Synthetic
gccaagcatttaggtgacactatagccatctacacagacacctgagtttcagagctatgctggaaacagc

SEQ ID NO: 53970 - DNA, 70 bp, Artificial Sequence
  Synthetic
gccaagcatttaggtgacactatagtgggctcagttcaccacagcgtttcagagctatgctggaaacagc

SEQ ID NO: 53971 - DNA, 70 bp, Artificial Sequence
  Synthetic
gccaagcatttaggtgacactatagccaagagagcttttagccttgtttcagagctatgctggaaacagc

SEQ ID NO: 53972 - DNA, 70 bp, Artificial Sequence
  Synthetic
gccaagcatttaggtgacactatagtgaaagtgttctagctcgaggtttcagagctatgctggaaacagc

SEQ ID NO: 53973 - DNA, 70 bp, Artificial Sequence
  Synthetic
gccaagcatttaggtgacactatagagagagcgggccttaatttagtttcagagctatgctggaaacagc

SEQ ID NO: 53974 - DNA, 70 bp, Artificial Sequence
  Synthetic
gccaagcatttaggtgacactatagaggcccgctctctggagggagtttcagagctatgctggaaacagc

SEQ ID NO: 53975 - DNA, 70 bp, Artificial Sequence
  Synthetic
gccaagcatttaggtgacactatagattctcacagcactacattagtttcagagctatgctggaaacagc

SEQ ID NO: 53976 - DNA, 70 bp, Artificial Sequence
  Synthetic
gccaagcatttaggtgacactatagaacccaaagcttcaggttaagtttcagagctatgctggaaacagc

SEQ ID NO: 53977 - DNA, 70 bp, Artificial Sequence
  Synthetic
gccaagcatttaggtgacactataggaggtccagcctccatcacggtttcagagctatgctggaaacagc

SEQ ID NO: 53978 - DNA, 70 bp, Artificial Sequence
  Synthetic
gccaagcatttaggtgacactatagggcgctggagtctcagctgcgtttcagagctatgctggaaacagc

SEQ ID NO: 53979 - DNA, 70 bp, Artificial Sequence
  Synthetic
gccaagcatttaggtgacactataggaagagagtgagatctaggggtttcagagctatgctggaaacagc

SEQ ID NO: 53980 - DNA, 70 bp, Artificial Sequence
  Synthetic
gccaagcatttaggtgacactatagcaacctttcagacccttcacgtttcagagctatgctggaaacagc

SEQ ID NO: 53981 - DNA, 70 bp, Artificial Sequence
  Synthetic
gccaagcatttaggtgacactatagtagggcacatctatttcttggtttcagagctatgctggaaacagc

SEQ ID NO: 53982 - DNA, 70 bp, Artificial Sequence
  Synthetic
gccaagcatttaggtgacactatagcaaaaaagctaatgggaagcgtttcagagctatgctggaaacagc

SEQ ID NO: 53983 - DNA, 70 bp, Artificial Sequence
  Synthetic
gccaagcatttaggtgacactatagaaccacgcggaaactctacggtttcagagctatgctggaaacagc

SEQ ID NO: 53984 - DNA, 70 bp, Artificial Sequence
  Synthetic
gccaagcatttaggtgacactatagtcttctcaaccttaaatccagtttcagagctatgctggaaacagc

SEQ ID NO: 53985 - DNA, 70 bp, Artificial Sequence
  Synthetic
gccaagcatttaggtgacactatagagtgctgccagagtgcccctgtttcagagctatgctggaaacagc

SEQ ID NO: 53986 - DNA, 70 bp, Artificial Sequence
  Synthetic
gccaagcatttaggtgacactatagttgaagaacaagaagcagaagtttcagagctatgctggaaacagc

SEQ ID NO: 53987 - DNA, 70 bp, Artificial Sequence
  Synthetic
gccaagcatttaggtgacactatagctgacgcggctaaagcagatgtttcagagctatgctggaaacagc

SEQ ID NO: 53988 - DNA, 70 bp, Artificial Sequence
  Synthetic
gccaagcatttaggtgacactatagactcataggcttcacaaagagtttcagagctatgctggaaacagc

SEQ ID NO: 53989 - DNA, 70 bp, Artificial Sequence
  Synthetic
gccaagcatttaggtgacactataggaattgctgcctatactgaggtttcagagctatgctggaaacagc

SEQ ID NO: 53990 - DNA, 70 bp, Artificial Sequence
  Synthetic
gccaagcatttaggtgacactatagaggacttggccgccctcactgtttcagagctatgctggaaacagc

SEQ ID NO: 53991 - DNA, 70 bp, Artificial Sequence
  Synthetic
gccaagcatttaggtgacactatagagtgtcacctgagtcaaatggtttcagagctatgctggaaacagc

SEQ ID NO: 53992 - DNA, 70 bp, Artificial Sequence
  Synthetic
gccaagcatttaggtgacactatagaccgtccataagaatcttgagtttcagagctatgctggaaacagc

SEQ ID NO: 53993 - DNA, 70 bp, Artificial Sequence
  Synthetic
gccaagcatttaggtgacactatagagtacttgaagttggaggaggtttcagagctatgctggaaacagc

SEQ ID NO: 53994 - DNA, 70 bp, Artificial Sequence
  Synthetic
gccaagcatttaggtgacactatagtttctaagttctctttggacgtttcagagctatgctggaaacagc

SEQ ID NO: 53995 - DNA, 70 bp, Artificial Sequence
  Synthetic
gccaagcatttaggtgacactatagaaggaagcactgaagattgagtttcagagctatgctggaaacagc

SEQ ID NO: 53996 - DNA, 70 bp, Artificial Sequence
  Synthetic
gccaagcatttaggtgacactatagtgctggtgataacagctagggtttcagagctatgctggaaacagc

SEQ ID NO: 53997 - DNA, 70 bp, Artificial Sequence
  Synthetic
gccaagcatttaggtgacactatagttgagatctcggtatatcttgtttcagagctatgctggaaacagc

SEQ ID NO: 53998 - DNA, 70 bp, Artificial Sequence
  Synthetic
gccaagcatttaggtgacactataggggtagagttatatcagctagtttcagagctatgctggaaacagc

SEQ ID NO: 53999 - DNA, 70 bp, Artificial Sequence
  Synthetic
gccaagcatttaggtgacactatagtgagcttaactacaaggtgtgtttcagagctatgctggaaacagc

SEQ ID NO: 54000 - DNA, 70 bp, Artificial Sequence
  Synthetic
gccaagcatttaggtgacactatagctgctccagctggcctaagagtttcagagctatgctggaaacagc

SEQ ID NO: 54001 - DNA, 70 bp, Artificial Sequence
  Synthetic
gccaagcatttaggtgacactatagtggtgtgaccttcacatagagtttcagagctatgctggaaacagc

SEQ ID NO: 54002 - DNA, 70 bp, Artificial Sequence
  Synthetic
gccaagcatttaggtgacactataggtactggaagggctcatcgcgtttcagagctatgctggaaacagc

SEQ ID NO: 54003 - DNA, 70 bp, Artificial Sequence
  Synthetic
gccaagcatttaggtgacactataggttcaggattggcatcacaggtttcagagctatgctggaaacagc

SEQ ID NO: 54004 - DNA, 70 bp, Artificial Sequence
  Synthetic
gccaagcatttaggtgacactatagttatcaaactcacatggcctgtttcagagctatgctggaaacagc

SEQ ID NO: 54005 - DNA, 70 bp, Artificial Sequence
  Synthetic
gccaagcatttaggtgacactatagagcagcttcattgtctaaaagtttcagagctatgctggaaacagc

SEQ ID NO: 54006 - DNA, 70 bp, Artificial Sequence
  Synthetic
gccaagcatttaggtgacactataggtccttgtggctggcatcaggtttcagagctatgctggaaacagc

SEQ ID NO: 54007 - DNA, 70 bp, Artificial Sequence
  Synthetic
gccaagcatttaggtgacactataggcagttttttactgggctaggtttcagagctatgctggaaacagc

SEQ ID NO: 54008 - DNA, 70 bp, Artificial Sequence
  Synthetic
gccaagcatttaggtgacactatagtggcccatgggggtcagagtgtttcagagctatgctggaaacagc

SEQ ID NO: 54009 - DNA, 70 bp, Artificial Sequence
  Synthetic
gccaagcatttaggtgacactatagtgttcctgcggcctcggtgagtttcagagctatgctggaaacagc

SEQ ID NO: 54010 - DNA, 70 bp, Artificial Sequence
  Synthetic
gccaagcatttaggtgacactataggtcgacagcttagtgtatgtgtttcagagctatgctggaaacagc

SEQ ID NO: 54011 - DNA, 70 bp, Artificial Sequence
  Synthetic
gccaagcatttaggtgacactatagggcaagcagccctgacctaagtttcagagctatgctggaaacagc

SEQ ID NO: 54012 - DNA, 70 bp, Artificial Sequence
  Synthetic
gccaagcatttaggtgacactatagtctctaaagggcatataacagtttcagagctatgctggaaacagc

SEQ ID NO: 54013 - DNA, 70 bp, Artificial Sequence
  Synthetic
gccaagcatttaggtgacactatagtggtgatgaacttggacagcgtttcagagctatgctggaaacagc

SEQ ID NO: 54014 - DNA, 70 bp, Artificial Sequence
  Synthetic
gccaagcatttaggtgacactatagccgaggcgctgctcaggcatgtttcagagctatgctggaaacagc

SEQ ID NO: 54015 - DNA, 70 bp, Artificial Sequence
  Synthetic
gccaagcatttaggtgacactataggtggtcttagaggattaactgtttcagagctatgctggaaacagc

SEQ ID NO: 54016 - DNA, 70 bp, Artificial Sequence
  Synthetic
gccaagcatttaggtgacactatagctgtcggctacttccgctcggtttcagagctatgctggaaacagc

SEQ ID NO: 54017 - DNA, 70 bp, Artificial Sequence
  Synthetic
gccaagcatttaggtgacactataggaatggttacgtgagaaactgtttcagagctatgctggaaacagc

SEQ ID NO: 54018 - DNA, 70 bp, Artificial Sequence
  Synthetic
gccaagcatttaggtgacactatagagacaacttttcttggagccgtttcagagctatgctggaaacagc

SEQ ID NO: 54019 - DNA, 70 bp, Artificial Sequence
  Synthetic
gccaagcatttaggtgacactatagggtgccagggtggtcagagagtttcagagctatgctggaaacagc

SEQ ID NO: 54020 - DNA, 70 bp, Artificial Sequence
  Synthetic
gccaagcatttaggtgacactataggtcagcaatatattgccatggtttcagagctatgctggaaacagc

SEQ ID NO: 54021 - DNA, 70 bp, Artificial Sequence
  Synthetic
gccaagcatttaggtgacactatagaggggtcactaagactgcttgtttcagagctatgctggaaacagc

SEQ ID NO: 54022 - DNA, 70 bp, Artificial Sequence
  Synthetic
gccaagcatttaggtgacactatagacatggctttgcatccgtaggtttcagagctatgctggaaacagc

SEQ ID NO: 54023 - DNA, 70 bp, Artificial Sequence
  Synthetic
gccaagcatttaggtgacactatagaaccagatcatcctctgagtgtttcagagctatgctggaaacagc

SEQ ID NO: 54024 - DNA, 70 bp, Artificial Sequence
  Synthetic
gccaagcatttaggtgacactataggcctcgtatcatcatgtgaggtttcagagctatgctggaaacagc

SEQ ID NO: 54025 - DNA, 70 bp, Artificial Sequence
  Synthetic
gccaagcatttaggtgacactatagtccccagggttagctgaacagtttcagagctatgctggaaacagc

SEQ ID NO: 54026 - DNA, 70 bp, Artificial Sequence
  Synthetic
gccaagcatttaggtgacactatagggtgaatccaatcttcagtggtttcagagctatgctggaaacagc

SEQ ID NO: 54027 - DNA, 70 bp, Artificial Sequence
  Synthetic
gccaagcatttaggtgacactataggcccccaggaactactgagtgtttcagagctatgctggaaacagc

SEQ ID NO: 54028 - DNA, 70 bp, Artificial Sequence
  Synthetic
gccaagcatttaggtgacactatagtgggcctgggcgctcagaccgtttcagagctatgctggaaacagc

SEQ ID NO: 54029 - DNA, 70 bp, Artificial Sequence
  Synthetic
gccaagcatttaggtgacactatagactgcagcatgatgtccttcgtttcagagctatgctggaaacagc

SEQ ID NO: 54030 - DNA, 70 bp, Artificial Sequence
  Synthetic
gccaagcatttaggtgacactatagactgtagcataagctgcttggtttcagagctatgctggaaacagc

SEQ ID NO: 54031 - DNA, 70 bp, Artificial Sequence
  Synthetic
gccaagcatttaggtgacactatagtgggcagcagcttttagacagtttcagagctatgctggaaacagc

SEQ ID NO: 54032 - DNA, 70 bp, Artificial Sequence
  Synthetic
gccaagcatttaggtgacactatagggtggggcctgggtcacagcgtttcagagctatgctggaaacagc

SEQ ID NO: 54033 - DNA, 70 bp, Artificial Sequence
  Synthetic
gccaagcatttaggtgacactatagctgcacattcttagtatctggtttcagagctatgctggaaacagc

SEQ ID NO: 54034 - DNA, 70 bp, Artificial Sequence
  Synthetic
gccaagcatttaggtgacactatagggactgcggcctcttctgaggtttcagagctatgctggaaacagc

SEQ ID NO: 54035 - DNA, 70 bp, Artificial Sequence
  Synthetic
gccaagcatttaggtgacactatagctgcacattcttcgtgtctggtttcagagctatgctggaaacagc

SEQ ID NO: 54036 - DNA, 70 bp, Artificial Sequence
  Synthetic
gccaagcatttaggtgacactatagaagcagtatgagctcttgtggtttcagagctatgctggaaacagc

SEQ ID NO: 54037 - DNA, 70 bp, Artificial Sequence
  Synthetic
gccaagcatttaggtgacactataggccaaaaacctgcggggctggtttcagagctatgctggaaacagc

SEQ ID NO: 54038 - DNA, 70 bp, Artificial Sequence
  Synthetic
gccaagcatttaggtgacactataggccaacaacctccggggctggtttcagagctatgctggaaacagc

SEQ ID NO: 54039 - DNA, 70 bp, Artificial Sequence
  Synthetic
gccaagcatttaggtgacactataggaacctgaaggagtacaatcgtttcagagctatgctggaaacagc

SEQ ID NO: 54040 - DNA, 70 bp, Artificial Sequence
  Synthetic
gccaagcatttaggtgacactataggctgcaaggagcaacagcgagtttcagagctatgctggaaacagc

SEQ ID NO: 54041 - DNA, 70 bp, Artificial Sequence
  Synthetic
gccaagcatttaggtgacactatagcagtacgagctgctctaagagtttcagagctatgctggaaacagc

SEQ ID NO: 54042 - DNA, 70 bp, Artificial Sequence
  Synthetic
gccaagcatttaggtgacactataggatcctcatctgcttcacaagtttcagagctatgctggaaacagc

SEQ ID NO: 54043 - DNA, 70 bp, Artificial Sequence
  Synthetic
gccaagcatttaggtgacactatagaaagactgtggcctcttctggtttcagagctatgctggaaacagc

SEQ ID NO: 54044 - DNA, 70 bp, Artificial Sequence
  Synthetic
gccaagcatttaggtgacactatagggaatggtgaggattagaaggtttcagagctatgctggaaacagc

SEQ ID NO: 54045 - DNA, 70 bp, Artificial Sequence
  Synthetic
gccaagcatttaggtgacactatagattttgggtgtcagtagcacgtttcagagctatgctggaaacagc

SEQ ID NO: 54046 - DNA, 70 bp, Artificial Sequence
  Synthetic
gccaagcatttaggtgacactatagaagtacattggcctttgctggtttcagagctatgctggaaacagc

SEQ ID NO: 54047 - DNA, 70 bp, Artificial Sequence
  Synthetic
gccaagcatttaggtgacactataggggatagcttcctcaagatcgtttcagagctatgctggaaacagc

SEQ ID NO: 54048 - DNA, 70 bp, Artificial Sequence
  Synthetic
gccaagcatttaggtgacactataggagtgggtgagtcatgcgcggtttcagagctatgctggaaacagc

SEQ ID NO: 54049 - DNA, 70 bp, Artificial Sequence
  Synthetic
gccaagcatttaggtgacactatagtcctcaagatctggaactaagtttcagagctatgctggaaacagc

SEQ ID NO: 54050 - DNA, 70 bp, Artificial Sequence
  Synthetic
gccaagcatttaggtgacactatagctcaaaatctggaactgagggtttcagagctatgctggaaacagc

SEQ ID NO: 54051 - DNA, 70 bp, Artificial Sequence
  Synthetic
gccaagcatttaggtgacactataggggacagttttcttagaatcgtttcagagctatgctggaaacagc

SEQ ID NO: 54052 - DNA, 70 bp, Artificial Sequence
  Synthetic
gccaagcatttaggtgacactatagtgctttctgctctggatcatgtttcagagctatgctggaaacagc

SEQ ID NO: 54053 - DNA, 70 bp, Artificial Sequence
  Synthetic
gccaagcatttaggtgacactatagttctggactacacaacacgcgtttcagagctatgctggaaacagc

SEQ ID NO: 54054 - DNA, 70 bp, Artificial Sequence
  Synthetic
gccaagcatttaggtgacactataggagtcttcagagtaaagcacgtttcagagctatgctggaaacagc

SEQ ID NO: 54055 - DNA, 70 bp, Artificial Sequence
  Synthetic
gccaagcatttaggtgacactatagacagctgcctttttctttaagtttcagagctatgctggaaacagc

SEQ ID NO: 54056 - DNA, 70 bp, Artificial Sequence
  Synthetic
gccaagcatttaggtgacactatagttcaaatctcaccctttgaggtttcagagctatgctggaaacagc

SEQ ID NO: 54057 - DNA, 70 bp, Artificial Sequence
  Synthetic
gccaagcatttaggtgacactataggggccgggtgcggggctcacgtttcagagctatgctggaaacagc

SEQ ID NO: 54058 - DNA, 70 bp, Artificial Sequence
  Synthetic
gccaagcatttaggtgacactatagtggcattgccctgggttcatgtttcagagctatgctggaaacagc

SEQ ID NO: 54059 - DNA, 70 bp, Artificial Sequence
  Synthetic
gccaagcatttaggtgacactatagggcccctctcaaagacttaagtttcagagctatgctggaaacagc

SEQ ID NO: 54060 - DNA, 70 bp, Artificial Sequence
  Synthetic
gccaagcatttaggtgacactataggaagggacaggggagctcaggtttcagagctatgctggaaacagc

SEQ ID NO: 54061 - DNA, 70 bp, Artificial Sequence
  Synthetic
gccaagcatttaggtgacactatagtccctggacattgctaccaggtttcagagctatgctggaaacagc

SEQ ID NO: 54062 - DNA, 70 bp, Artificial Sequence
  Synthetic
gccaagcatttaggtgacactataggtttcaagtctgcagctgccgtttcagagctatgctggaaacagc

SEQ ID NO: 54063 - DNA, 70 bp, Artificial Sequence
  Synthetic
gccaagcatttaggtgacactatagtgactctgaaggactctggggtttcagagctatgctggaaacagc

SEQ ID NO: 54064 - DNA, 70 bp, Artificial Sequence
  Synthetic
gccaagcatttaggtgacactatagcacaaaagaggcgcttgtcggtttcagagctatgctggaaacagc

SEQ ID NO: 54065 - DNA, 70 bp, Artificial Sequence
  Synthetic
gccaagcatttaggtgacactatagcccttcaaggagctcaaagggtttcagagctatgctggaaacagc

SEQ ID NO: 54066 - DNA, 70 bp, Artificial Sequence
  Synthetic
gccaagcatttaggtgacactatagtttccctctactctcatcctgtttcagagctatgctggaaacagc

SEQ ID NO: 54067 - DNA, 70 bp, Artificial Sequence
  Synthetic
gccaagcatttaggtgacactatagcccttatgccctgctgggtggtttcagagctatgctggaaacagc

SEQ ID NO: 54068 - DNA, 70 bp, Artificial Sequence
  Synthetic
gccaagcatttaggtgacactatagaagaagaccaatgactcagagtttcagagctatgctggaaacagc

SEQ ID NO: 54069 - DNA, 70 bp, Artificial Sequence
  Synthetic
gccaagcatttaggtgacactatagctgtctgaggagactacagcgtttcagagctatgctggaaacagc

SEQ ID NO: 54070 - DNA, 70 bp, Artificial Sequence
  Synthetic
gccaagcatttaggtgacactatagggcaatgctgatgatggtgtgtttcagagctatgctggaaacagc

SEQ ID NO: 54071 - DNA, 70 bp, Artificial Sequence
  Synthetic
gccaagcatttaggtgacactataggacaaggtgagagggctcaggtttcagagctatgctggaaacagc

SEQ ID NO: 54072 - DNA, 70 bp, Artificial Sequence
  Synthetic
gccaagcatttaggtgacactatagacttcatccacgtgctcaaggtttcagagctatgctggaaacagc

SEQ ID NO: 54073 - DNA, 70 bp, Artificial Sequence
  Synthetic
gccaagcatttaggtgacactatagtattaaagttttgcagtggcgtttcagagctatgctggaaacagc

SEQ ID NO: 54074 - DNA, 70 bp, Artificial Sequence
  Synthetic
gccaagcatttaggtgacactatagagcacaggctaatcgctgtagtttcagagctatgctggaaacagc

SEQ ID NO: 54075 - DNA, 70 bp, Artificial Sequence
  Synthetic
gccaagcatttaggtgacactataggcatgtgcacaataaacttggtttcagagctatgctggaaacagc

SEQ ID NO: 54076 - DNA, 70 bp, Artificial Sequence
  Synthetic
gccaagcatttaggtgacactatagaagaaaactacatgtgtcgggtttcagagctatgctggaaacagc

SEQ ID NO: 54077 - DNA, 70 bp, Artificial Sequence
  Synthetic
gccaagcatttaggtgacactatagttctttgtgtatcctccttcgtttcagagctatgctggaaacagc

SEQ ID NO: 54078 - DNA, 70 bp, Artificial Sequence
  Synthetic
gccaagcatttaggtgacactatagggggtgacccaggactgcgtgtttcagagctatgctggaaacagc

SEQ ID NO: 54079 - DNA, 70 bp, Artificial Sequence
  Synthetic
gccaagcatttaggtgacactataggtctgattgaagaggaaactgtttcagagctatgctggaaacagc

SEQ ID NO: 54080 - DNA, 70 bp, Artificial Sequence
  Synthetic
gccaagcatttaggtgacactatagccatcctccaataaagtgtggtttcagagctatgctggaaacagc

SEQ ID NO: 54081 - DNA, 70 bp, Artificial Sequence
  Synthetic
gccaagcatttaggtgacactatagatgtcctaggaatttggtatgtttcagagctatgctggaaacagc

SEQ ID NO: 54082 - DNA, 70 bp, Artificial Sequence
  Synthetic
gccaagcatttaggtgacactatagtgctttgatccacttatctagtttcagagctatgctggaaacagc

SEQ ID NO: 54083 - DNA, 70 bp, Artificial Sequence
  Synthetic
gccaagcatttaggtgacactatagaggtcgctacagaagatgttgtttcagagctatgctggaaacagc

SEQ ID NO: 54084 - DNA, 70 bp, Artificial Sequence
  Synthetic
gccaagcatttaggtgacactatagcggataccatggtcctagaggtttcagagctatgctggaaacagc

SEQ ID NO: 54085 - DNA, 70 bp, Artificial Sequence
  Synthetic
gccaagcatttaggtgacactatagccgggctgacgagaatgatggtttcagagctatgctggaaacagc

SEQ ID NO: 54086 - DNA, 70 bp, Artificial Sequence
  Synthetic
gccaagcatttaggtgacactataggtccacagcagtcactctccgtttcagagctatgctggaaacagc

SEQ ID NO: 54087 - DNA, 70 bp, Artificial Sequence
  Synthetic
gccaagcatttaggtgacactataggccagaggccgacggtcagagtttcagagctatgctggaaacagc

SEQ ID NO: 54088 - DNA, 70 bp, Artificial Sequence
  Synthetic
gccaagcatttaggtgacactatagactcagaagataccactgcggtttcagagctatgctggaaacagc

SEQ ID NO: 54089 - DNA, 70 bp, Artificial Sequence
  Synthetic
gccaagcatttaggtgacactatagttttggaaagagaagatgctgtttcagagctatgctggaaacagc

SEQ ID NO: 54090 - DNA, 70 bp, Artificial Sequence
  Synthetic
gccaagcatttaggtgacactatagggcttggttcatttgccatagtttcagagctatgctggaaacagc

SEQ ID NO: 54091 - DNA, 70 bp, Artificial Sequence
  Synthetic
gccaagcatttaggtgacactatagtcctgtcatgcaggacacctgtttcagagctatgctggaaacagc

SEQ ID NO: 54092 - DNA, 70 bp, Artificial Sequence
  Synthetic
gccaagcatttaggtgacactatagttacaaagaactttggaggggtttcagagctatgctggaaacagc

SEQ ID NO: 54093 - DNA, 70 bp, Artificial Sequence
  Synthetic
gccaagcatttaggtgacactatagcttgtcatgtgctcattagagtttcagagctatgctggaaacagc

SEQ ID NO: 54094 - DNA, 70 bp, Artificial Sequence
  Synthetic
gccaagcatttaggtgacactatagggagaagatgcaggaacactgtttcagagctatgctggaaacagc

SEQ ID NO: 54095 - DNA, 70 bp, Artificial Sequence
  Synthetic
gccaagcatttaggtgacactatagcttgacccgctcttagatgagtttcagagctatgctggaaacagc

SEQ ID NO: 54096 - DNA, 70 bp, Artificial Sequence
  Synthetic
gccaagcatttaggtgacactataggaagacagaggcatgagcaggtttcagagctatgctggaaacagc

SEQ ID NO: 54097 - DNA, 70 bp, Artificial Sequence
  Synthetic
gccaagcatttaggtgacactatagcatgcctctgtcttcataaagtttcagagctatgctggaaacagc

SEQ ID NO: 54098 - DNA, 70 bp, Artificial Sequence
  Synthetic
gccaagcatttaggtgacactatagtcagatctgaatttgagctcgtttcagagctatgctggaaacagc

SEQ ID NO: 54099 - DNA, 70 bp, Artificial Sequence
  Synthetic
gccaagcatttaggtgacactataggggcttggctgccgagaagagtttcagagctatgctggaaacagc

SEQ ID NO: 54100 - DNA, 70 bp, Artificial Sequence
  Synthetic
gccaagcatttaggtgacactatagtgccattcttttgctgggctgtttcagagctatgctggaaacagc

SEQ ID NO: 54101 - DNA, 70 bp, Artificial Sequence
  Synthetic
gccaagcatttaggtgacactatagtgccattgttgtgctgggctgtttcagagctatgctggaaacagc

SEQ ID NO: 54102 - DNA, 70 bp, Artificial Sequence
  Synthetic
gccaagcatttaggtgacactatagtgccattcttgtgctgggctgtttcagagctatgctggaaacagc

SEQ ID NO: 54103 - DNA, 70 bp, Artificial Sequence
  Synthetic
gccaagcatttaggtgacactatagtgccattattttgttgggctgtttcagagctatgctggaaacagc

SEQ ID NO: 54104 - DNA, 70 bp, Artificial Sequence
  Synthetic
gccaagcatttaggtgacactatagctgctcattctgtgttttacgtttcagagctatgctggaaacagc

SEQ ID NO: 54105 - DNA, 70 bp, Artificial Sequence
  Synthetic
gccaagcatttaggtgacactatagatcgaagagctgaaatgtaggtttcagagctatgctggaaacagc

SEQ ID NO: 54106 - DNA, 70 bp, Artificial Sequence
  Synthetic
gccaagcatttaggtgacactatagtacttgatcagcgtgaaaaggtttcagagctatgctggaaacagc

SEQ ID NO: 54107 - DNA, 70 bp, Artificial Sequence
  Synthetic
gccaagcatttaggtgacactatagtcaccccgagcagagttactgtttcagagctatgctggaaacagc

SEQ ID NO: 54108 - DNA, 70 bp, Artificial Sequence
  Synthetic
gccaagcatttaggtgacactatagagaaatgatctgggctgtgcgtttcagagctatgctggaaacagc

SEQ ID NO: 54109 - DNA, 70 bp, Artificial Sequence
  Synthetic
gccaagcatttaggtgacactatagacttcaaggcactagctcgagtttcagagctatgctggaaacagc

SEQ ID NO: 54110 - DNA, 70 bp, Artificial Sequence
  Synthetic
gccaagcatttaggtgacactatagagttggagaaagcaacaatagtttcagagctatgctggaaacagc

SEQ ID NO: 54111 - DNA, 70 bp, Artificial Sequence
  Synthetic
gccaagcatttaggtgacactatagcctgcttgcttgctgcactagtttcagagctatgctggaaacagc

SEQ ID NO: 54112 - DNA, 70 bp, Artificial Sequence
  Synthetic
gccaagcatttaggtgacactatagccttctgtctgaagaggagcgtttcagagctatgctggaaacagc

SEQ ID NO: 54113 - DNA, 70 bp, Artificial Sequence
  Synthetic
gccaagcatttaggtgacactatagtcgatggaccatctgcaaaagtttcagagctatgctggaaacagc

SEQ ID NO: 54114 - DNA, 70 bp, Artificial Sequence
  Synthetic
gccaagcatttaggtgacactatagagtgaaactccgctagatgagtttcagagctatgctggaaacagc

SEQ ID NO: 54115 - DNA, 70 bp, Artificial Sequence
  Synthetic
gccaagcatttaggtgacactatagaagaataccagaacttcatggtttcagagctatgctggaaacagc

SEQ ID NO: 54116 - DNA, 70 bp, Artificial Sequence
  Synthetic
gccaagcatttaggtgacactatagtattcatacgctcggtgagtgtttcagagctatgctggaaacagc

SEQ ID NO: 54117 - DNA, 70 bp, Artificial Sequence
  Synthetic
gccaagcatttaggtgacactatagcagcccagggtgttattctggtttcagagctatgctggaaacagc

SEQ ID NO: 54118 - DNA, 70 bp, Artificial Sequence
  Synthetic
gccaagcatttaggtgacactatagttaaggtgactcagaagcatgtttcagagctatgctggaaacagc

SEQ ID NO: 54119 - DNA, 70 bp, Artificial Sequence
  Synthetic
gccaagcatttaggtgacactatagccctgaagatgtcccatcaagtttcagagctatgctggaaacagc

SEQ ID NO: 54120 - DNA, 70 bp, Artificial Sequence
  Synthetic
gccaagcatttaggtgacactatagactttggaggaaggtctgcagtttcagagctatgctggaaacagc

SEQ ID NO: 54121 - DNA, 70 bp, Artificial Sequence
  Synthetic
gccaagcatttaggtgacactatagagttactaaactgttggatggtttcagagctatgctggaaacagc

SEQ ID NO: 54122 - DNA, 70 bp, Artificial Sequence
  Synthetic
gccaagcatttaggtgacactataggagcgtggctggctcatgtcgtttcagagctatgctggaaacagc

SEQ ID NO: 54123 - DNA, 70 bp, Artificial Sequence
  Synthetic
gccaagcatttaggtgacactatagtcaggcttggatttgaactcgtttcagagctatgctggaaacagc

SEQ ID NO: 54124 - DNA, 70 bp, Artificial Sequence
  Synthetic
gccaagcatttaggtgacactataggacgggtggtgtttcttcacgtttcagagctatgctggaaacagc

SEQ ID NO: 54125 - DNA, 70 bp, Artificial Sequence
  Synthetic
gccaagcatttaggtgacactatagctcagagatgtgtcttccaagtttcagagctatgctggaaacagc

SEQ ID NO: 54126 - DNA, 70 bp, Artificial Sequence
  Synthetic
gccaagcatttaggtgacactatagctcgcaccagggacattactgtttcagagctatgctggaaacagc

SEQ ID NO: 54127 - DNA, 70 bp, Artificial Sequence
  Synthetic
gccaagcatttaggtgacactatagcccaaacctcccaccctcaggtttcagagctatgctggaaacagc

SEQ ID NO: 54128 - DNA, 70 bp, Artificial Sequence
  Synthetic
gccaagcatttaggtgacactataggccggaaccgacgagtcctggtttcagagctatgctggaaacagc

SEQ ID NO: 54129 - DNA, 70 bp, Artificial Sequence
  Synthetic
gccaagcatttaggtgacactataggctctcagaacagccaagccgtttcagagctatgctggaaacagc

SEQ ID NO: 54130 - DNA, 70 bp, Artificial Sequence
  Synthetic
gccaagcatttaggtgacactatagttttcccattggtttacccagtttcagagctatgctggaaacagc

SEQ ID NO: 54131 - DNA, 70 bp, Artificial Sequence
  Synthetic
gccaagcatttaggtgacactatagcaacgtgctatgatcaaatcgtttcagagctatgctggaaacagc

SEQ ID NO: 54132 - DNA, 70 bp, Artificial Sequence
  Synthetic
gccaagcatttaggtgacactatagctgggggcctggctcaatccgtttcagagctatgctggaaacagc

SEQ ID NO: 54133 - DNA, 70 bp, Artificial Sequence
  Synthetic
gccaagcatttaggtgacactatagctctgctgctggcctgtcacgtttcagagctatgctggaaacagc

SEQ ID NO: 54134 - DNA, 70 bp, Artificial Sequence
  Synthetic
gccaagcatttaggtgacactatagttttctggaatgtgctcttcgtttcagagctatgctggaaacagc

SEQ ID NO: 54135 - DNA, 70 bp, Artificial Sequence
  Synthetic
gccaagcatttaggtgacactatagaccagattttcacacggcaagtttcagagctatgctggaaacagc

SEQ ID NO: 54136 - DNA, 70 bp, Artificial Sequence
  Synthetic
gccaagcatttaggtgacactatagtctgagttttgtggtgctgtgtttcagagctatgctggaaacagc

SEQ ID NO: 54137 - DNA, 70 bp, Artificial Sequence
  Synthetic
gccaagcatttaggtgacactatagtttaccaaagtcagaactcggtttcagagctatgctggaaacagc

SEQ ID NO: 54138 - DNA, 70 bp, Artificial Sequence
  Synthetic
gccaagcatttaggtgacactatagctggaccttcagagacctaggtttcagagctatgctggaaacagc

SEQ ID NO: 54139 - DNA, 70 bp, Artificial Sequence
  Synthetic
gccaagcatttaggtgacactatagtctagctacaaatgaactgcgtttcagagctatgctggaaacagc

SEQ ID NO: 54140 - DNA, 70 bp, Artificial Sequence
  Synthetic
gccaagcatttaggtgacactatagcaatggatctctcagctaaggtttcagagctatgctggaaacagc

SEQ ID NO: 54141 - DNA, 70 bp, Artificial Sequence
  Synthetic
gccaagcatttaggtgacactataggctggaggcaggctcaggaggtttcagagctatgctggaaacagc

SEQ ID NO: 54142 - DNA, 70 bp, Artificial Sequence
  Synthetic
gccaagcatttaggtgacactatagtgaaaagtcttccactaagagtttcagagctatgctggaaacagc

SEQ ID NO: 54143 - DNA, 70 bp, Artificial Sequence
  Synthetic
gccaagcatttaggtgacactatagtagtcatgatctgcagaagtgtttcagagctatgctggaaacagc

SEQ ID NO: 54144 - DNA, 70 bp, Artificial Sequence
  Synthetic
gccaagcatttaggtgacactatagggtttataggggaatctcacgtttcagagctatgctggaaacagc

SEQ ID NO: 54145 - DNA, 70 bp, Artificial Sequence
  Synthetic
gccaagcatttaggtgacactatagtcttctttgcttttcttagggtttcagagctatgctggaaacagc

SEQ ID NO: 54146 - DNA, 70 bp, Artificial Sequence
  Synthetic
gccaagcatttaggtgacactatagcatgtccattgctggatgaagtttcagagctatgctggaaacagc

SEQ ID NO: 54147 - DNA, 70 bp, Artificial Sequence
  Synthetic
gccaagcatttaggtgacactatagcctgctctctagctgtatccgtttcagagctatgctggaaacagc

SEQ ID NO: 54148 - DNA, 70 bp, Artificial Sequence
  Synthetic
gccaagcatttaggtgacactataggctcaaagaggtgagttctggtttcagagctatgctggaaacagc

SEQ ID NO: 54149 - DNA, 70 bp, Artificial Sequence
  Synthetic
gccaagcatttaggtgacactatagggagtgactcatggagaatagtttcagagctatgctggaaacagc

SEQ ID NO: 54150 - DNA, 70 bp, Artificial Sequence
  Synthetic
gccaagcatttaggtgacactatagtgcagctaattcctctttgtgtttcagagctatgctggaaacagc

SEQ ID NO: 54151 - DNA, 70 bp, Artificial Sequence
  Synthetic
gccaagcatttaggtgacactatagtgcagtcttgttcatcacacgtttcagagctatgctggaaacagc

SEQ ID NO: 54152 - DNA, 70 bp, Artificial Sequence
  Synthetic
gccaagcatttaggtgacactatagttgagcatgtaccgtgtgccgtttcagagctatgctggaaacagc

SEQ ID NO: 54153 - DNA, 70 bp, Artificial Sequence
  Synthetic
gccaagcatttaggtgacactatagccctcattgcctgactgaccgtttcagagctatgctggaaacagc

SEQ ID NO: 54154 - DNA, 70 bp, Artificial Sequence
  Synthetic
gccaagcatttaggtgacactataggagagcagagcatgcagtgagtttcagagctatgctggaaacagc

SEQ ID NO: 54155 - DNA, 70 bp, Artificial Sequence
  Synthetic
gccaagcatttaggtgacactatagcccagccatggcacgtgagtgtttcagagctatgctggaaacagc

SEQ ID NO: 54156 - DNA, 70 bp, Artificial Sequence
  Synthetic
gccaagcatttaggtgacactatagtcgacctggacttgaactaagtttcagagctatgctggaaacagc

SEQ ID NO: 54157 - DNA, 70 bp, Artificial Sequence
  Synthetic
gccaagcatttaggtgacactatagcagatgacgacgatgtgtgagtttcagagctatgctggaaacagc

SEQ ID NO: 54158 - DNA, 70 bp, Artificial Sequence
  Synthetic
gccaagcatttaggtgacactatagagatgacgatgcctggaagtgtttcagagctatgctggaaacagc

SEQ ID NO: 54159 - DNA, 70 bp, Artificial Sequence
  Synthetic
gccaagcatttaggtgacactatagcttggggcagttaccgccacgtttcagagctatgctggaaacagc

SEQ ID NO: 54160 - DNA, 70 bp, Artificial Sequence
  Synthetic
gccaagcatttaggtgacactatagctgcttggacctcgataacggtttcagagctatgctggaaacagc

SEQ ID NO: 54161 - DNA, 70 bp, Artificial Sequence
  Synthetic
gccaagcatttaggtgacactatagcaccaggcagtcagtgcaccgtttcagagctatgctggaaacagc

SEQ ID NO: 54162 - DNA, 70 bp, Artificial Sequence
  Synthetic
gccaagcatttaggtgacactatagtcctggttatgcagagagaggtttcagagctatgctggaaacagc

SEQ ID NO: 54163 - DNA, 70 bp, Artificial Sequence
  Synthetic
gccaagcatttaggtgacactatagagagttcagttaccaaatccgtttcagagctatgctggaaacagc

SEQ ID NO: 54164 - DNA, 70 bp, Artificial Sequence
  Synthetic
gccaagcatttaggtgacactatagtgcacagtctctgcagtgccgtttcagagctatgctggaaacagc

SEQ ID NO: 54165 - DNA, 70 bp, Artificial Sequence
  Synthetic
gccaagcatttaggtgacactatagtgccaacggcattgataacggtttcagagctatgctggaaacagc

SEQ ID NO: 54166 - DNA, 70 bp, Artificial Sequence
  Synthetic
gccaagcatttaggtgacactatagcatccagaacatatgtgagtgtttcagagctatgctggaaacagc

SEQ ID NO: 54167 - DNA, 70 bp, Artificial Sequence
  Synthetic
gccaagcatttaggtgacactatagcactttatgtatgctctggagtttcagagctatgctggaaacagc

SEQ ID NO: 54168 - DNA, 70 bp, Artificial Sequence
  Synthetic
gccaagcatttaggtgacactatagccagtggaccgtagttgtgggtttcagagctatgctggaaacagc

SEQ ID NO: 54169 - DNA, 70 bp, Artificial Sequence
  Synthetic
gccaagcatttaggtgacactatagtgcggccaaggctgtctacagtttcagagctatgctggaaacagc

SEQ ID NO: 54170 - DNA, 70 bp, Artificial Sequence
  Synthetic
gccaagcatttaggtgacactatagggatgggctagtagcgagaggtttcagagctatgctggaaacagc

SEQ ID NO: 54171 - DNA, 70 bp, Artificial Sequence
  Synthetic
gccaagcatttaggtgacactataggagcagctagcggcctcagagtttcagagctatgctggaaacagc

SEQ ID NO: 54172 - DNA, 70 bp, Artificial Sequence
  Synthetic
gccaagcatttaggtgacactatagtggtcattggacggctatgagtttcagagctatgctggaaacagc

SEQ ID NO: 54173 - DNA, 70 bp, Artificial Sequence
  Synthetic
gccaagcatttaggtgacactataggcagatgagcacgagtttatgtttcagagctatgctggaaacagc

SEQ ID NO: 54174 - DNA, 70 bp, Artificial Sequence
  Synthetic
gccaagcatttaggtgacactatagccatcaccaagacggtggaggtttcagagctatgctggaaacagc

SEQ ID NO: 54175 - DNA, 70 bp, Artificial Sequence
  Synthetic
gccaagcatttaggtgacactatagggccgtgggtcagggtctccgtttcagagctatgctggaaacagc

SEQ ID NO: 54176 - DNA, 70 bp, Artificial Sequence
  Synthetic
gccaagcatttaggtgacactatagcagtcatcatctgtgtcactgtttcagagctatgctggaaacagc

SEQ ID NO: 54177 - DNA, 70 bp, Artificial Sequence
  Synthetic
gccaagcatttaggtgacactataggaaatcttcaatctgagccagtttcagagctatgctggaaacagc

SEQ ID NO: 54178 - DNA, 70 bp, Artificial Sequence
  Synthetic
gccaagcatttaggtgacactataggtatgcattgagccgctcttgtttcagagctatgctggaaacagc

SEQ ID NO: 54179 - DNA, 70 bp, Artificial Sequence
  Synthetic
gccaagcatttaggtgacactataggttgttcttttgaccgagacgtttcagagctatgctggaaacagc

SEQ ID NO: 54180 - DNA, 70 bp, Artificial Sequence
  Synthetic
gccaagcatttaggtgacactatagtagccatcatgtagatcagcgtttcagagctatgctggaaacagc

SEQ ID NO: 54181 - DNA, 70 bp, Artificial Sequence
  Synthetic
gccaagcatttaggtgacactatagaagaatcgatggcacaatacgtttcagagctatgctggaaacagc

SEQ ID NO: 54182 - DNA, 70 bp, Artificial Sequence
  Synthetic
gccaagcatttaggtgacactatagaccttgttgctacagctgcagtttcagagctatgctggaaacagc

SEQ ID NO: 54183 - DNA, 70 bp, Artificial Sequence
  Synthetic
gccaagcatttaggtgacactatagagtaaactcttcattcatccgtttcagagctatgctggaaacagc

SEQ ID NO: 54184 - DNA, 70 bp, Artificial Sequence
  Synthetic
gccaagcatttaggtgacactatagtgagtagcggatccttttccgtttcagagctatgctggaaacagc

SEQ ID NO: 54185 - DNA, 70 bp, Artificial Sequence
  Synthetic
gccaagcatttaggtgacactatagtaacttattgagctgtttccgtttcagagctatgctggaaacagc

SEQ ID NO: 54186 - DNA, 70 bp, Artificial Sequence
  Synthetic
gccaagcatttaggtgacactatagaggaaaagtagcagaatcgtgtttcagagctatgctggaaacagc

SEQ ID NO: 54187 - DNA, 70 bp, Artificial Sequence
  Synthetic
gccaagcatttaggtgacactatagggaagaagaagacttggaaagtttcagagctatgctggaaacagc

SEQ ID NO: 54188 - DNA, 70 bp, Artificial Sequence
  Synthetic
gccaagcatttaggtgacactatagtcagggtcggctctgtcacagtttcagagctatgctggaaacagc

SEQ ID NO: 54189 - DNA, 70 bp, Artificial Sequence
  Synthetic
gccaagcatttaggtgacactatagcaacaaaacagccagcgggcgtttcagagctatgctggaaacagc

SEQ ID NO: 54190 - DNA, 70 bp, Artificial Sequence
  Synthetic
gccaagcatttaggtgacactatagtcagagtttgatggctaagagtttcagagctatgctggaaacagc

SEQ ID NO: 54191 - DNA, 70 bp, Artificial Sequence
  Synthetic
gccaagcatttaggtgacactataggcaagggtgctacacatcacgtttcagagctatgctggaaacagc

SEQ ID NO: 54192 - DNA, 70 bp, Artificial Sequence
  Synthetic
gccaagcatttaggtgacactatagtgccacacagtgggctcagcgtttcagagctatgctggaaacagc

SEQ ID NO: 54193 - DNA, 70 bp, Artificial Sequence
  Synthetic
gccaagcatttaggtgacactatagggggataccagcctctaagagtttcagagctatgctggaaacagc

SEQ ID NO: 54194 - DNA, 70 bp, Artificial Sequence
  Synthetic
gccaagcatttaggtgacactatagcttgtgccgtccccctaggagtttcagagctatgctggaaacagc

SEQ ID NO: 54195 - DNA, 70 bp, Artificial Sequence
  Synthetic
gccaagcatttaggtgacactatagtggtgccatcgggcgtgagcgtttcagagctatgctggaaacagc

SEQ ID NO: 54196 - DNA, 70 bp, Artificial Sequence
  Synthetic
gccaagcatttaggtgacactatagagggagggggatcacgtctggtttcagagctatgctggaaacagc

SEQ ID NO: 54197 - DNA, 70 bp, Artificial Sequence
  Synthetic
gccaagcatttaggtgacactatagctgttaactgatgctacccagtttcagagctatgctggaaacagc

SEQ ID NO: 54198 - DNA, 70 bp, Artificial Sequence
  Synthetic
gccaagcatttaggtgacactatagtggtgatgctgtcagttttggtttcagagctatgctggaaacagc

SEQ ID NO: 54199 - DNA, 70 bp, Artificial Sequence
  Synthetic
gccaagcatttaggtgacactatagtgccacacctatggaatcacgtttcagagctatgctggaaacagc

SEQ ID NO: 54200 - DNA, 70 bp, Artificial Sequence
  Synthetic
gccaagcatttaggtgacactatagatactgtagtttgtggctaagtttcagagctatgctggaaacagc

SEQ ID NO: 54201 - DNA, 70 bp, Artificial Sequence
  Synthetic
gccaagcatttaggtgacactataggcctccgggactccccacaggtttcagagctatgctggaaacagc

SEQ ID NO: 54202 - DNA, 70 bp, Artificial Sequence
  Synthetic
gccaagcatttaggtgacactatagacccatggagacctatgaaggtttcagagctatgctggaaacagc

SEQ ID NO: 54203 - DNA, 70 bp, Artificial Sequence
  Synthetic
gccaagcatttaggtgacactataggcagcaggtgctggcgtagggtttcagagctatgctggaaacagc

SEQ ID NO: 54204 - DNA, 70 bp, Artificial Sequence
  Synthetic
gccaagcatttaggtgacactataggactcaagaactctaggaaagtttcagagctatgctggaaacagc

SEQ ID NO: 54205 - DNA, 70 bp, Artificial Sequence
  Synthetic
gccaagcatttaggtgacactatagagaaagcaagggtagttagtgtttcagagctatgctggaaacagc

SEQ ID NO: 54206 - DNA, 70 bp, Artificial Sequence
  Synthetic
gccaagcatttaggtgacactataggaggtctgtgtcactctaaagtttcagagctatgctggaaacagc

SEQ ID NO: 54207 - DNA, 70 bp, Artificial Sequence
  Synthetic
gccaagcatttaggtgacactatagctgaccaccaagcacctagagtttcagagctatgctggaaacagc

SEQ ID NO: 54208 - DNA, 70 bp, Artificial Sequence
  Synthetic
gccaagcatttaggtgacactataggaagatcaagagacaggggagtttcagagctatgctggaaacagc

SEQ ID NO: 54209 - DNA, 70 bp, Artificial Sequence
  Synthetic
gccaagcatttaggtgacactatagcgggcgcaggccccacgtgagtttcagagctatgctggaaacagc

SEQ ID NO: 54210 - DNA, 70 bp, Artificial Sequence
  Synthetic
gccaagcatttaggtgacactatagctcgctgggctccgcgtcctgtttcagagctatgctggaaacagc

SEQ ID NO: 54211 - DNA, 70 bp, Artificial Sequence
  Synthetic
gccaagcatttaggtgacactatagccctgcataatttaggtcttgtttcagagctatgctggaaacagc

SEQ ID NO: 54212 - DNA, 70 bp, Artificial Sequence
  Synthetic
gccaagcatttaggtgacactatagtgttgcttttcacaccagcggtttcagagctatgctggaaacagc

SEQ ID NO: 54213 - DNA, 70 bp, Artificial Sequence
  Synthetic
gccaagcatttaggtgacactatagcaggtgcttggaagttccccgtttcagagctatgctggaaacagc

SEQ ID NO: 54214 - DNA, 70 bp, Artificial Sequence
  Synthetic
gccaagcatttaggtgacactataggcctaggaaagaagagatctgtttcagagctatgctggaaacagc

SEQ ID NO: 54215 - DNA, 70 bp, Artificial Sequence
  Synthetic
gccaagcatttaggtgacactatagctttggatccatttgtcaacgtttcagagctatgctggaaacagc

SEQ ID NO: 54216 - DNA, 70 bp, Artificial Sequence
  Synthetic
gccaagcatttaggtgacactatagtagctgccgagcagagatgagtttcagagctatgctggaaacagc

SEQ ID NO: 54217 - DNA, 70 bp, Artificial Sequence
  Synthetic
gccaagcatttaggtgacactataggcaggcctgcttgggctcacgtttcagagctatgctggaaacagc

SEQ ID NO: 54218 - DNA, 70 bp, Artificial Sequence
  Synthetic
gccaagcatttaggtgacactataggccaagtcagagctgtgagcgtttcagagctatgctggaaacagc

SEQ ID NO: 54219 - DNA, 70 bp, Artificial Sequence
  Synthetic
gccaagcatttaggtgacactatagtgcctcacctaaagagaccagtttcagagctatgctggaaacagc

SEQ ID NO: 54220 - DNA, 70 bp, Artificial Sequence
  Synthetic
gccaagcatttaggtgacactatagcctgcttcacatgacacagtgtttcagagctatgctggaaacagc

SEQ ID NO: 54221 - DNA, 70 bp, Artificial Sequence
  Synthetic
gccaagcatttaggtgacactatagttagcataattcaggtgtcagtttcagagctatgctggaaacagc

SEQ ID NO: 54222 - DNA, 70 bp, Artificial Sequence
  Synthetic
gccaagcatttaggtgacactatagccaaaggtggattcctagcagtttcagagctatgctggaaacagc

SEQ ID NO: 54223 - DNA, 70 bp, Artificial Sequence
  Synthetic
gccaagcatttaggtgacactatagcactgtctatccttgggattgtttcagagctatgctggaaacagc

SEQ ID NO: 54224 - DNA, 70 bp, Artificial Sequence
  Synthetic
gccaagcatttaggtgacactataggtttccgatctggtagtctagtttcagagctatgctggaaacagc

SEQ ID NO: 54225 - DNA, 70 bp, Artificial Sequence
  Synthetic
gccaagcatttaggtgacactatagctaccactgaccatatcatcgtttcagagctatgctggaaacagc

SEQ ID NO: 54226 - DNA, 70 bp, Artificial Sequence
  Synthetic
gccaagcatttaggtgacactatagagtctggcctctacctcagcgtttcagagctatgctggaaacagc

SEQ ID NO: 54227 - DNA, 70 bp, Artificial Sequence
  Synthetic
gccaagcatttaggtgacactatagtcactttccatttgaagactgtttcagagctatgctggaaacagc

SEQ ID NO: 54228 - DNA, 70 bp, Artificial Sequence
  Synthetic
gccaagcatttaggtgacactatagccaaggaaaaaaagcttgctgtttcagagctatgctggaaacagc

SEQ ID NO: 54229 - DNA, 70 bp, Artificial Sequence
  Synthetic
gccaagcatttaggtgacactataggagccctgctgactaagcctgtttcagagctatgctggaaacagc

SEQ ID NO: 54230 - DNA, 70 bp, Artificial Sequence
  Synthetic
gccaagcatttaggtgacactatagaatggatgtcatatctgaaggtttcagagctatgctggaaacagc

SEQ ID NO: 54231 - DNA, 70 bp, Artificial Sequence
  Synthetic
gccaagcatttaggtgacactatagctctagtctgtgacaacctggtttcagagctatgctggaaacagc

SEQ ID NO: 54232 - DNA, 70 bp, Artificial Sequence
  Synthetic
gccaagcatttaggtgacactatagagcggcccggggcagctaccgtttcagagctatgctggaaacagc

SEQ ID NO: 54233 - DNA, 70 bp, Artificial Sequence
  Synthetic
gccaagcatttaggtgacactatagttctgccggtgtctgagtgagtttcagagctatgctggaaacagc
